United States Patent 11,369,692 (MATERIALS AND METHODS FOR TREATMENT OF DUCHENNE MUSCULAR DYSTROPHY) - sequence listing, part 36

SEQ ID NO: 1191112 - DNA, 22 bp, Artificial Sequence
  chemically synthesized
tgaaatgtgagaacaatatgag

SEQ ID NO: 1191113 - DNA, 22 bp, Artificial Sequence
  chemically synthesized
gaaatgtgagaacaatatgaga

SEQ ID NO: 1191114 - DNA, 22 bp, Artificial Sequence
  chemically synthesized
aaatgtgagaacaatatgagat

SEQ ID NO: 1191115 - DNA, 22 bp, Artificial Sequence
  chemically synthesized
ccccaacccctcccaaatctca

SEQ ID NO: 1191116 - DNA, 22 bp, Artificial Sequence
  chemically synthesized
tgccccaacccctcccaaatct

SEQ ID NO: 1191117 - DNA, 22 bp, Artificial Sequence
  chemically synthesized
tatcgttctgccccaacccctc

SEQ ID NO: 1191118 - DNA, 22 bp, Artificial Sequence
  chemically synthesized
gggaggggttggggcagaacga

SEQ ID NO: 1191119 - DNA, 22 bp, Artificial Sequence
  chemically synthesized
ggaggggttggggcagaacgat

SEQ ID NO: 1191120 - DNA, 22 bp, Artificial Sequence
  chemically synthesized
gggcagaacgatatagtttggc

SEQ ID NO: 1191121 - DNA, 22 bp, Artificial Sequence
  chemically synthesized
ggcagggacacagtgccaaact

SEQ ID NO: 1191122 - DNA, 22 bp, Artificial Sequence
  chemically synthesized
gggcagggacacagtgccaaac

SEQ ID NO: 1191123 - DNA, 22 bp, Artificial Sequence
  chemically synthesized
ggcactgtgtccctgcccaaat

SEQ ID NO: 1191124 - DNA, 22 bp, Artificial Sequence
  chemically synthesized
gcactgtgtccctgcccaaatc

SEQ ID NO: 1191125 - DNA, 22 bp, Artificial Sequence
  chemically synthesized
tgtccctgcccaaatctcatgt

SEQ ID NO: 1191126 - DNA, 22 bp, Artificial Sequence
  chemically synthesized
gggatcacaatacaacatgaga

SEQ ID NO: 1191127 - DNA, 22 bp, Artificial Sequence
  chemically synthesized
cccaaatctcatgttgtattgt

SEQ ID NO: 1191128 - DNA, 22 bp, Artificial Sequence
  chemically synthesized
aatattggggatcacaatacaa

SEQ ID NO: 1191129 - DNA, 22 bp, Artificial Sequence
  chemically synthesized
attcaatattggggatcacaat

SEQ ID NO: 1191130 - DNA, 22 bp, Artificial Sequence
  chemically synthesized
atgttgtattgtgatccccaat

SEQ ID NO: 1191131 - DNA, 22 bp, Artificial Sequence
  chemically synthesized
tattgtgatccccaatattgaa

SEQ ID NO: 1191132 - DNA, 22 bp, Artificial Sequence
  chemically synthesized
ccaccaggcgcctcattcaata

SEQ ID NO: 1191133 - DNA, 22 bp, Artificial Sequence
  chemically synthesized
tgatccccaatattgaatgagg

SEQ ID NO: 1191134 - DNA, 22 bp, Artificial Sequence
  chemically synthesized
agtcacctcccaccaggcgcct

SEQ ID NO: 1191135 - DNA, 22 bp, Artificial Sequence
  chemically synthesized
tgattcagtcacctcccaccag

SEQ ID NO: 1191136 - DNA, 22 bp, Artificial Sequence
  chemically synthesized
aatgaggcgcctggtgggaggt

SEQ ID NO: 1191137 - DNA, 22 bp, Artificial Sequence
  chemically synthesized
cccctatgattcagtcacctcc

SEQ ID NO: 1191138 - DNA, 22 bp, Artificial Sequence
  chemically synthesized
gtgggaggtgactgaatcatag

SEQ ID NO: 1191139 - DNA, 22 bp, Artificial Sequence
  chemically synthesized
gaacagtaagagggaaatctgc

SEQ ID NO: 1191140 - DNA, 22 bp, Artificial Sequence
  chemically synthesized
aatcataggggcagatttccct

SEQ ID NO: 1191141 - DNA, 22 bp, Artificial Sequence
  chemically synthesized
tcattggaacagtaagagggaa

SEQ ID NO: 1191142 - DNA, 22 bp, Artificial Sequence
  chemically synthesized
actatcattggaacagtaagag

SEQ ID NO: 1191143 - DNA, 22 bp, Artificial Sequence
  chemically synthesized
ccctcttactgttccaatgata

SEQ ID NO: 1191144 - DNA, 22 bp, Artificial Sequence
  chemically synthesized
cctcttactgttccaatgatag

SEQ ID NO: 1191145 - DNA, 22 bp, Artificial Sequence
  chemically synthesized
ttactgttccaatgatagtgag

SEQ ID NO: 1191146 - DNA, 22 bp, Artificial Sequence
  chemically synthesized
actgttccaatgatagtgagtt

SEQ ID NO: 1191147 - DNA, 22 bp, Artificial Sequence
  chemically synthesized
ctgttccaatgatagtgagttc

SEQ ID NO: 1191148 - DNA, 22 bp, Artificial Sequence
  chemically synthesized
ttccaatgatagtgagttctca

SEQ ID NO: 1191149 - DNA, 22 bp, Artificial Sequence
  chemically synthesized
caatgatagtgagttctcatga

SEQ ID NO: 1191150 - DNA, 22 bp, Artificial Sequence
  chemically synthesized
acacaaccagatatcatgagaa

SEQ ID NO: 1191151 - DNA, 22 bp, Artificial Sequence
  chemically synthesized
cacacaaccagatatcatgaga

SEQ ID NO: 1191152 - DNA, 22 bp, Artificial Sequence
  chemically synthesized
tcacacaaccagatatcatgag

SEQ ID NO: 1191153 - DNA, 22 bp, Artificial Sequence
  chemically synthesized
cacgctttcacacaaccagata

SEQ ID NO: 1191154 - DNA, 22 bp, Artificial Sequence
  chemically synthesized
tcatgatatctggttgtgtgaa

SEQ ID NO: 1191155 - DNA, 22 bp, Artificial Sequence
  chemically synthesized
atgatatctggttgtgtgaaag

SEQ ID NO: 1191156 - DNA, 22 bp, Artificial Sequence
  chemically synthesized
gttgtgtgaaagcgtgtagcat

SEQ ID NO: 1191157 - DNA, 22 bp, Artificial Sequence
  chemically synthesized
tgtgaaagcgtgtagcatctct

SEQ ID NO: 1191158 - DNA, 22 bp, Artificial Sequence
  chemically synthesized
catggccagagaaggaggaaga

SEQ ID NO: 1191159 - DNA, 22 bp, Artificial Sequence
  chemically synthesized
tgcctgctctctcttcctcctt

SEQ ID NO: 1191160 - DNA, 22 bp, Artificial Sequence
  chemically synthesized
acatggccagagaaggaggaag

SEQ ID NO: 1191161 - DNA, 22 bp, Artificial Sequence
  chemically synthesized
cctgctctctcttcctccttct

SEQ ID NO: 1191162 - DNA, 22 bp, Artificial Sequence
  chemically synthesized
ctctctcttcctccttctctgg

SEQ ID NO: 1191163 - DNA, 22 bp, Artificial Sequence
  chemically synthesized
tctcttcctccttctctggcca

SEQ ID NO: 1191164 - DNA, 22 bp, Artificial Sequence
  chemically synthesized
tcttcctccttctctggccatg

SEQ ID NO: 1191165 - DNA, 22 bp, Artificial Sequence
  chemically synthesized
ttcctccttctctggccatgta

SEQ ID NO: 1191166 - DNA, 22 bp, Artificial Sequence
  chemically synthesized
cctccttctctggccatgtaag

SEQ ID NO: 1191167 - DNA, 22 bp, Artificial Sequence
  chemically synthesized
ctccttctctggccatgtaagc

SEQ ID NO: 1191168 - DNA, 22 bp, Artificial Sequence
  chemically synthesized
cttctctggccatgtaagccgt

SEQ ID NO: 1191169 - DNA, 22 bp, Artificial Sequence
  chemically synthesized
ctctggccatgtaagccgtgcc

SEQ ID NO: 1191170 - DNA, 22 bp, Artificial Sequence
  chemically synthesized
tctggccatgtaagccgtgcct

SEQ ID NO: 1191171 - DNA, 22 bp, Artificial Sequence
  chemically synthesized
tggccatgtaagccgtgcctac

SEQ ID NO: 1191172 - DNA, 22 bp, Artificial Sequence
  chemically synthesized
gccatgtaagccgtgcctactt

SEQ ID NO: 1191173 - DNA, 22 bp, Artificial Sequence
  chemically synthesized
tggaaggtgaaggggaagtagg

SEQ ID NO: 1191174 - DNA, 22 bp, Artificial Sequence
  chemically synthesized
aggaaatcactgtggaaggtga

SEQ ID NO: 1191175 - DNA, 22 bp, Artificial Sequence
  chemically synthesized
cttccccttcaccttccacagt

SEQ ID NO: 1191176 - DNA, 22 bp, Artificial Sequence
  chemically synthesized
ccccttcaccttccacagtgat

SEQ ID NO: 1191177 - DNA, 22 bp, Artificial Sequence
  chemically synthesized
cccttcaccttccacagtgatt

SEQ ID NO: 1191178 - DNA, 22 bp, Artificial Sequence
  chemically synthesized
gggaggtctcaggaaatcactg

SEQ ID NO: 1191179 - DNA, 22 bp, Artificial Sequence
  chemically synthesized
caccttccacagtgatttcctg

SEQ ID NO: 1191180 - DNA, 22 bp, Artificial Sequence
  chemically synthesized
accttccacagtgatttcctga

SEQ ID NO: 1191181 - DNA, 22 bp, Artificial Sequence
  chemically synthesized
ccacagtgatttcctgagacct

SEQ ID NO: 1191182 - DNA, 22 bp, Artificial Sequence
  chemically synthesized
cacagtgatttcctgagacctc

SEQ ID NO: 1191183 - DNA, 22 bp, Artificial Sequence
  chemically synthesized
tatgggaagcatggctggggag

SEQ ID NO: 1191184 - DNA, 22 bp, Artificial Sequence
  chemically synthesized
cctgagacctccccagccatgc

SEQ ID NO: 1191185 - DNA, 22 bp, Artificial Sequence
  chemically synthesized
ctgagacctccccagccatgct

SEQ ID NO: 1191186 - DNA, 22 bp, Artificial Sequence
  chemically synthesized
agacctccccagccatgcttcc

SEQ ID NO: 1191187 - DNA, 22 bp, Artificial Sequence
  chemically synthesized
cacaggctgtatgggaagcatg

SEQ ID NO: 1191188 - DNA, 22 bp, Artificial Sequence
  chemically synthesized
cccagccatgcttcccatacag

SEQ ID NO: 1191189 - DNA, 22 bp, Artificial Sequence
  chemically synthesized
cagttccacaggctgtatggga

SEQ ID NO: 1191190 - DNA, 22 bp, Artificial Sequence
  chemically synthesized
gcagttccacaggctgtatggg

SEQ ID NO: 1191191 - DNA, 22 bp, Artificial Sequence
  chemically synthesized
acttgcagttccacaggctgta

SEQ ID NO: 1191192 - DNA, 22 bp, Artificial Sequence
  chemically synthesized
attgacttgcagttccacaggc

SEQ ID NO: 1191193 - DNA, 22 bp, Artificial Sequence
  chemically synthesized
aattgacttgcagttccacagg

SEQ ID NO: 1191194 - DNA, 22 bp, Artificial Sequence
  chemically synthesized
cccatacagcctgtggaactgc

SEQ ID NO: 1191195 - DNA, 22 bp, Artificial Sequence
  chemically synthesized
ccatacagcctgtggaactgca

SEQ ID NO: 1191196 - DNA, 22 bp, Artificial Sequence
  chemically synthesized
tggaactgcaagtcaattaagc

SEQ ID NO: 1191197 - DNA, 22 bp, Artificial Sequence
  chemically synthesized
taaagaaaagaggcttaattga

SEQ ID NO: 1191198 - DNA, 22 bp, Artificial Sequence
  chemically synthesized
ataaagaaaagaggcttaattg

SEQ ID NO: 1191199 - DNA, 22 bp, Artificial Sequence
  chemically synthesized
caagtcaattaagcctcttttc

SEQ ID NO: 1191200 - DNA, 22 bp, Artificial Sequence
  chemically synthesized
ggtaatttataaagaaaagagg

SEQ ID NO: 1191201 - DNA, 22 bp, Artificial Sequence
  chemically synthesized
tgactgggtaatttataaagaa

SEQ ID NO: 1191202 - DNA, 22 bp, Artificial Sequence
  chemically synthesized
agcctcttttctttataaatta

SEQ ID NO: 1191203 - DNA, 22 bp, Artificial Sequence
  chemically synthesized
cctgtgactgggtaatttataa

SEQ ID NO: 1191204 - DNA, 22 bp, Artificial Sequence
  chemically synthesized
ttttctttataaattacccagt

SEQ ID NO: 1191205 - DNA, 22 bp, Artificial Sequence
  chemically synthesized
ttctttataaattacccagtca

SEQ ID NO: 1191206 - DNA, 22 bp, Artificial Sequence
  chemically synthesized
tctttataaattacccagtcac

SEQ ID NO: 1191207 - DNA, 22 bp, Artificial Sequence
  chemically synthesized
ctttataaattacccagtcaca

SEQ ID NO: 1191208 - DNA, 22 bp, Artificial Sequence
  chemically synthesized
taaacaactacctgtgactggg

SEQ ID NO: 1191209 - DNA, 22 bp, Artificial Sequence
  chemically synthesized
tttataaattacccagtcacag

SEQ ID NO: 1191210 - DNA, 22 bp, Artificial Sequence
  chemically synthesized
tataaattacccagtcacaggt

SEQ ID NO: 1191211 - DNA, 22 bp, Artificial Sequence
  chemically synthesized
ctataaacaactacctgtgact

SEQ ID NO: 1191212 - DNA, 22 bp, Artificial Sequence
  chemically synthesized
ataaattacccagtcacaggta

SEQ ID NO: 1191213 - DNA, 22 bp, Artificial Sequence
  chemically synthesized
taaattacccagtcacaggtag

SEQ ID NO: 1191214 - DNA, 22 bp, Artificial Sequence
  chemically synthesized
acattgctataaacaactacct

SEQ ID NO: 1191215 - DNA, 22 bp, Artificial Sequence
  chemically synthesized
tcacattgctataaacaactac

SEQ ID NO: 1191216 - DNA, 22 bp, Artificial Sequence
  chemically synthesized
cccagtcacaggtagttgttta

SEQ ID NO: 1191217 - DNA, 22 bp, Artificial Sequence
  chemically synthesized
gtccgttctcacattgctataa

SEQ ID NO: 1191218 - DNA, 22 bp, Artificial Sequence
  chemically synthesized
tttatagcaatgtgagaacgga

SEQ ID NO: 1191219 - DNA, 22 bp, Artificial Sequence
  chemically synthesized
atatgtgtattagtccgttctc

SEQ ID NO: 1191220 - DNA, 22 bp, Artificial Sequence
  chemically synthesized
gatatgtgtattagtccgttct

SEQ ID NO: 1191221 - DNA, 22 bp, Artificial Sequence
  chemically synthesized
atagcaatgtgagaacggacta

SEQ ID NO: 1191222 - DNA, 22 bp, Artificial Sequence
  chemically synthesized
tagcaatgtgagaacggactaa

SEQ ID NO: 1191223 - DNA, 22 bp, Artificial Sequence
  chemically synthesized
tcttgatatgtgtattagtccg

SEQ ID NO: 1191224 - DNA, 22 bp, Artificial Sequence
  chemically synthesized
atcttgatatgtgtattagtcc

SEQ ID NO: 1191225 - DNA, 22 bp, Artificial Sequence
  chemically synthesized
ggaataaatgtccttatcttga

SEQ ID NO: 1191226 - DNA, 22 bp, Artificial Sequence
  chemically synthesized
atacacatatcaagataaggac

SEQ ID NO: 1191227 - DNA, 22 bp, Artificial Sequence
  chemically synthesized
atctgggaataaatgtccttat

SEQ ID NO: 1191228 - DNA, 22 bp, Artificial Sequence
  chemically synthesized
ctaatctgggaataaatgtcct

SEQ ID NO: 1191229 - DNA, 22 bp, Artificial Sequence
  chemically synthesized
actaatctgggaataaatgtcc

SEQ ID NO: 1191230 - DNA, 22 bp, Artificial Sequence
  chemically synthesized
ttactaatctgggaataaatgt

SEQ ID NO: 1191231 - DNA, 22 bp, Artificial Sequence
  chemically synthesized
agaaaggttcttactaatctgg

SEQ ID NO: 1191232 - DNA, 22 bp, Artificial Sequence
  chemically synthesized
attcccagattagtaagaacct

SEQ ID NO: 1191233 - DNA, 22 bp, Artificial Sequence
  chemically synthesized
ttcccagattagtaagaacctt

SEQ ID NO: 1191234 - DNA, 22 bp, Artificial Sequence
  chemically synthesized
ccaagtcctgagaaaggttctt

SEQ ID NO: 1191235 - DNA, 22 bp, Artificial Sequence
  chemically synthesized
ccagattagtaagaacctttct

SEQ ID NO: 1191236 - DNA, 22 bp, Artificial Sequence
  chemically synthesized
aatacattaccaagtcctgaga

SEQ ID NO: 1191237 - DNA, 22 bp, Artificial Sequence
  chemically synthesized
gtaagaacctttctcaggactt

SEQ ID NO: 1191238 - DNA, 22 bp, Artificial Sequence
  chemically synthesized
aaatacattaccaagtcctgag

SEQ ID NO: 1191239 - DNA, 22 bp, Artificial Sequence
  chemically synthesized
cttaaatacattaccaagtcct

SEQ ID NO: 1191240 - DNA, 22 bp, Artificial Sequence
  chemically synthesized
gcttaaatacattaccaagtcc

SEQ ID NO: 1191241 - DNA, 22 bp, Artificial Sequence
  chemically synthesized
tctcaggacttggtaatgtatt

SEQ ID NO: 1191242 - DNA, 22 bp, Artificial Sequence
  chemically synthesized
ctcaggacttggtaatgtattt

SEQ ID NO: 1191243 - DNA, 22 bp, Artificial Sequence
  chemically synthesized
tcaggacttggtaatgtattta

SEQ ID NO: 1191244 - DNA, 22 bp, Artificial Sequence
  chemically synthesized
aggacttggtaatgtatttaag

SEQ ID NO: 1191245 - DNA, 22 bp, Artificial Sequence
  chemically synthesized
ggtaatgtatttaagcaaatgt

SEQ ID NO: 1191246 - DNA, 22 bp, Artificial Sequence
  chemically synthesized
gtaatgtatttaagcaaatgtc

SEQ ID NO: 1191247 - DNA, 22 bp, Artificial Sequence
  chemically synthesized
aagcaaatgtcattggatatat

SEQ ID NO: 1191248 - DNA, 22 bp, Artificial Sequence
  chemically synthesized
agcaaatgtcattggatatatt

SEQ ID NO: 1191249 - DNA, 22 bp, Artificial Sequence
  chemically synthesized
tcagtaaaagcaaaagtaatat

SEQ ID NO: 1191250 - DNA, 22 bp, Artificial Sequence
  chemically synthesized
gatatattacttttgcttttac

SEQ ID NO: 1191251 - DNA, 22 bp, Artificial Sequence
  chemically synthesized
gtcagtcctatcagtaaaagca

SEQ ID NO: 1191252 - DNA, 22 bp, Artificial Sequence
  chemically synthesized
cttttgcttttactgataggac

SEQ ID NO: 1191253 - DNA, 22 bp, Artificial Sequence
  chemically synthesized
ttgcttttactgataggactga

SEQ ID NO: 1191254 - DNA, 22 bp, Artificial Sequence
  chemically synthesized
tgcttttactgataggactgac

SEQ ID NO: 1191255 - DNA, 22 bp, Artificial Sequence
  chemically synthesized
gcttttactgataggactgact

SEQ ID NO: 1191256 - DNA, 22 bp, Artificial Sequence
  chemically synthesized
cttttactgataggactgacta

SEQ ID NO: 1191257 - DNA, 22 bp, Artificial Sequence
  chemically synthesized
ttactgataggactgactagtt

SEQ ID NO: 1191258 - DNA, 22 bp, Artificial Sequence
  chemically synthesized
tactgataggactgactagttc

SEQ ID NO: 1191259 - DNA, 22 bp, Artificial Sequence
  chemically synthesized
actgataggactgactagttct

SEQ ID NO: 1191260 - DNA, 22 bp, Artificial Sequence
  chemically synthesized
ctgataggactgactagttctg

SEQ ID NO: 1191261 - DNA, 22 bp, Artificial Sequence
  chemically synthesized
aagtcaggaagccagaactagt

SEQ ID NO: 1191262 - DNA, 22 bp, Artificial Sequence
  chemically synthesized
aaagtcaggaagccagaactag

SEQ ID NO: 1191263 - DNA, 22 bp, Artificial Sequence
  chemically synthesized
ataggactgactagttctggct

SEQ ID NO: 1191264 - DNA, 22 bp, Artificial Sequence
  chemically synthesized
ttaaagtcaggaagccagaact

SEQ ID NO: 1191265 - DNA, 22 bp, Artificial Sequence
  chemically synthesized
cttaaagtcaggaagccagaac

SEQ ID NO: 1191266 - DNA, 22 bp, Artificial Sequence
  chemically synthesized
tcttaaagtcaggaagccagaa

SEQ ID NO: 1191267 - DNA, 22 bp, Artificial Sequence
  chemically synthesized
ttcttaaagtcaggaagccaga

SEQ ID NO: 1191268 - DNA, 22 bp, Artificial Sequence
  chemically synthesized
cttttcttaaagtcaggaagcc

SEQ ID NO: 1191269 - DNA, 22 bp, Artificial Sequence
  chemically synthesized
ccttttcttaaagtcaggaagc

SEQ ID NO: 1191270 - DNA, 22 bp, Artificial Sequence
  chemically synthesized
actagttctggcttcctgactt

SEQ ID NO: 1191271 - DNA, 22 bp, Artificial Sequence
  chemically synthesized
ttccttttcttaaagtcaggaa

SEQ ID NO: 1191272 - DNA, 22 bp, Artificial Sequence
  chemically synthesized
ttcttccttttcttaaagtcag

SEQ ID NO: 1191273 - DNA, 22 bp, Artificial Sequence
  chemically synthesized
gttctggcttcctgactttaag

SEQ ID NO: 1191274 - DNA, 22 bp, Artificial Sequence
  chemically synthesized
gttcttccttttcttaaagtca

SEQ ID NO: 1191275 - DNA, 22 bp, Artificial Sequence
  chemically synthesized
tgttcttccttttcttaaagtc

SEQ ID NO: 1191276 - DNA, 22 bp, Artificial Sequence
  chemically synthesized
tggcttcctgactttaagaaaa

SEQ ID NO: 1191277 - DNA, 22 bp, Artificial Sequence
  chemically synthesized
gcttcctgactttaagaaaagg

SEQ ID NO: 1191278 - DNA, 22 bp, Artificial Sequence
  chemically synthesized
atctttgttcttccttttctta

SEQ ID NO: 1191279 - DNA, 22 bp, Artificial Sequence
  chemically synthesized
aatctttgttcttccttttctt

SEQ ID NO: 1191280 - DNA, 22 bp, Artificial Sequence
  chemically synthesized
cctgactttaagaaaaggaaga

SEQ ID NO: 1191281 - DNA, 22 bp, Artificial Sequence
  chemically synthesized
ctgactttaagaaaaggaagaa

SEQ ID NO: 1191282 - DNA, 22 bp, Artificial Sequence
  chemically synthesized
actttaagaaaaggaagaacaa

SEQ ID NO: 1191283 - DNA, 22 bp, Artificial Sequence
  chemically synthesized
taagaaaaggaagaacaaagat

SEQ ID NO: 1191284 - DNA, 22 bp, Artificial Sequence
  chemically synthesized
aagaaaaggaagaacaaagatt

SEQ ID NO: 1191285 - DNA, 22 bp, Artificial Sequence
  chemically synthesized
agaaaaggaagaacaaagatta

SEQ ID NO: 1191286 - DNA, 22 bp, Artificial Sequence
  chemically synthesized
aatattacctgttcactgtttt

SEQ ID NO: 1191287 - DNA, 22 bp, Artificial Sequence
  chemically synthesized
ataataaaatgcaaaacagtga

SEQ ID NO: 1191288 - DNA, 22 bp, Artificial Sequence
  chemically synthesized
tattaataataaaatgcaaaac

SEQ ID NO: 1191289 - DNA, 22 bp, Artificial Sequence
  chemically synthesized
atattaataataaaatgcaaaa

SEQ ID NO: 1191290 - DNA, 22 bp, Artificial Sequence
  chemically synthesized
cctgttcactgttttgcatttt

SEQ ID NO: 1191291 - DNA, 22 bp, Artificial Sequence
  chemically synthesized
ttcactgttttgcattttatta

SEQ ID NO: 1191292 - DNA, 22 bp, Artificial Sequence
  chemically synthesized
actgttttgcattttattatta

SEQ ID NO: 1191293 - DNA, 22 bp, Artificial Sequence
  chemically synthesized
ttttgcattttattattaatat

SEQ ID NO: 1191294 - DNA, 22 bp, Artificial Sequence
  chemically synthesized
tgtgacatatttatattaataa

SEQ ID NO: 1191295 - DNA, 22 bp, Artificial Sequence
  chemically synthesized
atgtgacatatttatattaata

SEQ ID NO: 1191296 - DNA, 22 bp, Artificial Sequence
  chemically synthesized
tatgtgacatatttatattaat

SEQ ID NO: 1191297 - DNA, 22 bp, Artificial Sequence
  chemically synthesized
tgcattttattattaatataaa

SEQ ID NO: 1191298 - DNA, 22 bp, Artificial Sequence
  chemically synthesized
ttatgtgacatatttatattaa

SEQ ID NO: 1191299 - DNA, 22 bp, Artificial Sequence
  chemically synthesized
gcattttattattaatataaat

SEQ ID NO: 1191300 - DNA, 22 bp, Artificial Sequence
  chemically synthesized
cattttattattaatataaata

SEQ ID NO: 1191301 - DNA, 22 bp, Artificial Sequence
  chemically synthesized
atgtttttatgtgacatattta

SEQ ID NO: 1191302 - DNA, 22 bp, Artificial Sequence
  chemically synthesized
tattattaatataaatatgtca

SEQ ID NO: 1191303 - DNA, 22 bp, Artificial Sequence
  chemically synthesized
attattaatataaatatgtcac

SEQ ID NO: 1191304 - DNA, 22 bp, Artificial Sequence
  chemically synthesized
ttattaatataaatatgtcaca

SEQ ID NO: 1191305 - DNA, 22 bp, Artificial Sequence
  chemically synthesized
attgatgtttttatgtgacata

SEQ ID NO: 1191306 - DNA, 22 bp, Artificial Sequence
  chemically synthesized
aattgatgtttttatgtgacat

SEQ ID NO: 1191307 - DNA, 22 bp, Artificial Sequence
  chemically synthesized
ttaatataaatatgtcacataa

SEQ ID NO: 1191308 - DNA, 22 bp, Artificial Sequence
  chemically synthesized
atataaatatgtcacataaaaa

SEQ ID NO: 1191309 - DNA, 22 bp, Artificial Sequence
  chemically synthesized
atttaattgatgtttttatgtg

SEQ ID NO: 1191310 - DNA, 22 bp, Artificial Sequence
  chemically synthesized
catttaattgatgtttttatgt

SEQ ID NO: 1191311 - DNA, 22 bp, Artificial Sequence
  chemically synthesized
tcatttaattgatgtttttatg

SEQ ID NO: 1191312 - DNA, 22 bp, Artificial Sequence
  chemically synthesized
agggctttcatttaattgatgt

SEQ ID NO: 1191313 - DNA, 22 bp, Artificial Sequence
  chemically synthesized
aagtgatgaaattcagggcttt

SEQ ID NO: 1191314 - DNA, 22 bp, Artificial Sequence
  chemically synthesized
aaagtgatgaaattcagggctt

SEQ ID NO: 1191315 - DNA, 22 bp, Artificial Sequence
  chemically synthesized
taaagtgatgaaattcagggct

SEQ ID NO: 1191316 - DNA, 22 bp, Artificial Sequence
  chemically synthesized
ttaaagtgatgaaattcagggc

SEQ ID NO: 1191317 - DNA, 22 bp, Artificial Sequence
  chemically synthesized
aatgaaagccctgaatttcatc

SEQ ID NO: 1191318 - DNA, 22 bp, Artificial Sequence
  chemically synthesized
aatttcatcactttaaaagact

SEQ ID NO: 1191319 - DNA, 22 bp, Artificial Sequence
  chemically synthesized
aagagcaataaggaaagtcttt

SEQ ID NO: 1191320 - DNA, 22 bp, Artificial Sequence
  chemically synthesized
aaagagcaataaggaaagtctt

SEQ ID NO: 1191321 - DNA, 22 bp, Artificial Sequence
  chemically synthesized
catcactttaaaagactttcct

SEQ ID NO: 1191322 - DNA, 22 bp, Artificial Sequence
  chemically synthesized
taaagagcaataaggaaagtct

SEQ ID NO: 1191323 - DNA, 22 bp, Artificial Sequence
  chemically synthesized
atcactttaaaagactttcctt

SEQ ID NO: 1191324 - DNA, 22 bp, Artificial Sequence
  chemically synthesized
taaaagactttccttattgctc

SEQ ID NO: 1191325 - DNA, 22 bp, Artificial Sequence
  chemically synthesized
aaaagactttccttattgctct

SEQ ID NO: 1191326 - DNA, 22 bp, Artificial Sequence
  chemically synthesized
aaagactttccttattgctctt

SEQ ID NO: 1191327 - DNA, 22 bp, Artificial Sequence
  chemically synthesized
ccatatattttaaagagcaata

SEQ ID NO: 1191328 - DNA, 22 bp, Artificial Sequence
  chemically synthesized
gccatatattttaaagagcaat

SEQ ID NO: 1191329 - DNA, 22 bp, Artificial Sequence
  chemically synthesized
tccttattgctctttaaaatat

SEQ ID NO: 1191330 - DNA, 22 bp, Artificial Sequence
  chemically synthesized
ccttattgctctttaaaatata

SEQ ID NO: 1191331 - DNA, 22 bp, Artificial Sequence
  chemically synthesized
cttattgctctttaaaatatat

SEQ ID NO: 1191332 - DNA, 22 bp, Artificial Sequence
  chemically synthesized
catccacatttgccatatattt

SEQ ID NO: 1191333 - DNA, 22 bp, Artificial Sequence
  chemically synthesized
attgctctttaaaatatatggc

SEQ ID NO: 1191334 - DNA, 22 bp, Artificial Sequence
  chemically synthesized
ccatccacatttgccatatatt

SEQ ID NO: 1191335 - DNA, 22 bp, Artificial Sequence
  chemically synthesized
ttgctctttaaaatatatggca

SEQ ID NO: 1191336 - DNA, 22 bp, Artificial Sequence
  chemically synthesized
ctctttaaaatatatggcaaat

SEQ ID NO: 1191337 - DNA, 22 bp, Artificial Sequence
  chemically synthesized
tttaaaatatatggcaaatgtg

SEQ ID NO: 1191338 - DNA, 22 bp, Artificial Sequence
  chemically synthesized
taaaatatatggcaaatgtgga

SEQ ID NO: 1191339 - DNA, 22 bp, Artificial Sequence
  chemically synthesized
aaaatatatggcaaatgtggat

SEQ ID NO: 1191340 - DNA, 22 bp, Artificial Sequence
  chemically synthesized
aaatatatggcaaatgtggatg

SEQ ID NO: 1191341 - DNA, 22 bp, Artificial Sequence
  chemically synthesized
agtgtgtacttccatccacatt

SEQ ID NO: 1191342 - DNA, 22 bp, Artificial Sequence
  chemically synthesized
ctaagtgtgtacttccatccac

SEQ ID NO: 1191343 - DNA, 22 bp, Artificial Sequence
  chemically synthesized
gctaagtgtgtacttccatcca

SEQ ID NO: 1191344 - DNA, 22 bp, Artificial Sequence
  chemically synthesized
tttgctaagtgtgtacttccat

SEQ ID NO: 1191345 - DNA, 22 bp, Artificial Sequence
  chemically synthesized
acaaaattatttgctaagtgtg

SEQ ID NO: 1191346 - DNA, 22 bp, Artificial Sequence
  chemically synthesized
gctgacaaaattatttgctaag

SEQ ID NO: 1191347 - DNA, 22 bp, Artificial Sequence
  chemically synthesized
agctgacaaaattatttgctaa

SEQ ID NO: 1191348 - DNA, 22 bp, Artificial Sequence
  chemically synthesized
tagctgacaaaattatttgcta

SEQ ID NO: 1191349 - DNA, 22 bp, Artificial Sequence
  chemically synthesized
agcaaataattttgtcagctaa

SEQ ID NO: 1191350 - DNA, 22 bp, Artificial Sequence
  chemically synthesized
gaataaaaagttttagctgaca

SEQ ID NO: 1191351 - DNA, 22 bp, Artificial Sequence
  chemically synthesized
gcaaataattttgtcagctaaa

SEQ ID NO: 1191352 - DNA, 22 bp, Artificial Sequence
  chemically synthesized
agtcaacattggaataaaaagt

SEQ ID NO: 1191353 - DNA, 22 bp, Artificial Sequence
  chemically synthesized
tgtcagctaaaactttttattc

SEQ ID NO: 1191354 - DNA, 22 bp, Artificial Sequence
  chemically synthesized
gagtcaacattggaataaaaag

SEQ ID NO: 1191355 - DNA, 22 bp, Artificial Sequence
  chemically synthesized
gtcagctaaaactttttattcc

SEQ ID NO: 1191356 - DNA, 22 bp, Artificial Sequence
  chemically synthesized
tcagctaaaactttttattcca

SEQ ID NO: 1191357 - DNA, 22 bp, Artificial Sequence
  chemically synthesized
cacttgagtcaacattggaata

SEQ ID NO: 1191358 - DNA, 22 bp, Artificial Sequence
  chemically synthesized
acacttgagtcaacattggaat

SEQ ID NO: 1191359 - DNA, 22 bp, Artificial Sequence
  chemically synthesized
aaactttttattccaatgttga

SEQ ID NO: 1191360 - DNA, 22 bp, Artificial Sequence
  chemically synthesized
tttacacttgagtcaacattgg

SEQ ID NO: 1191361 - DNA, 22 bp, Artificial Sequence
  chemically synthesized
actatttacacttgagtcaaca

SEQ ID NO: 1191362 - DNA, 22 bp, Artificial Sequence
  chemically synthesized
tttattccaatgttgactcaag

SEQ ID NO: 1191363 - DNA, 22 bp, Artificial Sequence
  chemically synthesized
ttattccaatgttgactcaagt

SEQ ID NO: 1191364 - DNA, 22 bp, Artificial Sequence
  chemically synthesized
ttaactatttacacttgagtca

SEQ ID NO: 1191365 - DNA, 22 bp, Artificial Sequence
  chemically synthesized
tattccaatgttgactcaagtg

SEQ ID NO: 1191366 - DNA, 22 bp, Artificial Sequence
  chemically synthesized
attccaatgttgactcaagtgt

SEQ ID NO: 1191367 - DNA, 22 bp, Artificial Sequence
  chemically synthesized
ttccaatgttgactcaagtgta

SEQ ID NO: 1191368 - DNA, 22 bp, Artificial Sequence
  chemically synthesized
caatgttgactcaagtgtaaat

SEQ ID NO: 1191369 - DNA, 22 bp, Artificial Sequence
  chemically synthesized
actcaagtgtaaatagttaata

SEQ ID NO: 1191370 - DNA, 22 bp, Artificial Sequence
  chemically synthesized
aatatggaaggttattaactat

SEQ ID NO: 1191371 - DNA, 22 bp, Artificial Sequence
  chemically synthesized
aaatatggaaggttattaacta

SEQ ID NO: 1191372 - DNA, 22 bp, Artificial Sequence
  chemically synthesized
taaatatggaaggttattaact

SEQ ID NO: 1191373 - DNA, 22 bp, Artificial Sequence
  chemically synthesized
aagtgtaaatagttaataacct

SEQ ID NO: 1191374 - DNA, 22 bp, Artificial Sequence
  chemically synthesized
atggagcattttaaatatggaa

SEQ ID NO: 1191375 - DNA, 22 bp, Artificial Sequence
  chemically synthesized
cctaatggagcattttaaatat

SEQ ID NO: 1191376 - DNA, 22 bp, Artificial Sequence
  chemically synthesized
acctaatggagcattttaaata

SEQ ID NO: 1191377 - DNA, 22 bp, Artificial Sequence
  chemically synthesized
ataaccttccatatttaaaatg

SEQ ID NO: 1191378 - DNA, 22 bp, Artificial Sequence
  chemically synthesized
tttacctaatggagcattttaa

SEQ ID NO: 1191379 - DNA, 22 bp, Artificial Sequence
  chemically synthesized
ccatatttaaaatgctccatta

SEQ ID NO: 1191380 - DNA, 22 bp, Artificial Sequence
  chemically synthesized
catatttaaaatgctccattag

SEQ ID NO: 1191381 - DNA, 22 bp, Artificial Sequence
  chemically synthesized
cagattatttacctaatggagc

SEQ ID NO: 1191382 - DNA, 22 bp, Artificial Sequence
  chemically synthesized
aaaatgctccattaggtaaata

SEQ ID NO: 1191383 - DNA, 22 bp, Artificial Sequence
  chemically synthesized
aaatgctccattaggtaaataa

SEQ ID NO: 1191384 - DNA, 22 bp, Artificial Sequence
  chemically synthesized
cattaggtaaataatctgtaat

SEQ ID NO: 1191385 - DNA, 22 bp, Artificial Sequence
  chemically synthesized
ggtaaataatctgtaattggtg

SEQ ID NO: 1191386 - DNA, 22 bp, Artificial Sequence
  chemically synthesized
cccgatataaagaggcaccaat

SEQ ID NO: 1191387 - DNA, 22 bp, Artificial Sequence
  chemically synthesized
ccccgatataaagaggcaccaa

SEQ ID NO: 1191388 - DNA, 22 bp, Artificial Sequence
  chemically synthesized
ttccccgatataaagaggcacc

SEQ ID NO: 1191389 - DNA, 22 bp, Artificial Sequence
  chemically synthesized
taattggtgcctctttatatcg

SEQ ID NO: 1191390 - DNA, 22 bp, Artificial Sequence
  chemically synthesized
gtgcctctttatatcggggaag

SEQ ID NO: 1191391 - DNA, 22 bp, Artificial Sequence
  chemically synthesized
ccaagaatatagcctcttcccc

SEQ ID NO: 1191392 - DNA, 22 bp, Artificial Sequence
  chemically synthesized
ctaccaagaatatagcctcttc

SEQ ID NO: 1191393 - DNA, 22 bp, Artificial Sequence
  chemically synthesized
tttatatcggggaagaggctat

SEQ ID NO: 1191394 - DNA, 22 bp, Artificial Sequence
  chemically synthesized
gctaccaagaatatagcctctt

SEQ ID NO: 1191395 - DNA, 22 bp, Artificial Sequence
  chemically synthesized
tgctaccaagaatatagcctct

SEQ ID NO: 1191396 - DNA, 22 bp, Artificial Sequence
  chemically synthesized
tatatcggggaagaggctatat

SEQ ID NO: 1191397 - DNA, 22 bp, Artificial Sequence
  chemically synthesized
atatcggggaagaggctatatt

SEQ ID NO: 1191398 - DNA, 22 bp, Artificial Sequence
  chemically synthesized
tatcggggaagaggctatattc

SEQ ID NO: 1191399 - DNA, 22 bp, Artificial Sequence
  chemically synthesized
ttttgctaccaagaatatagcc

SEQ ID NO: 1191400 - DNA, 22 bp, Artificial Sequence
  chemically synthesized
aatcagactattttgctaccaa

SEQ ID NO: 1191401 - DNA, 22 bp, Artificial Sequence
  chemically synthesized
tattcttggtagcaaaatagtc

SEQ ID NO: 1191402 - DNA, 22 bp, Artificial Sequence
  chemically synthesized
ttggtagcaaaatagtctgatt

SEQ ID NO: 1191403 - DNA, 22 bp, Artificial Sequence
  chemically synthesized
ggtagcaaaatagtctgattca

SEQ ID NO: 1191404 - DNA, 22 bp, Artificial Sequence
  chemically synthesized
gtagcaaaatagtctgattcaa

SEQ ID NO: 1191405 - DNA, 22 bp, Artificial Sequence
  chemically synthesized
tatatgtaggtaattgaatcag

SEQ ID NO: 1191406 - DNA, 22 bp, Artificial Sequence
  chemically synthesized
agtaactatatatgtaggtaat

SEQ ID NO: 1191407 - DNA, 22 bp, Artificial Sequence
  chemically synthesized
gttgagtaactatatatgtagg

SEQ ID NO: 1191408 - DNA, 22 bp, Artificial Sequence
  chemically synthesized
tagttgagtaactatatatgta

SEQ ID NO: 1191409 - DNA, 22 bp, Artificial Sequence
  chemically synthesized
attcaattacctacatatatag

SEQ ID NO: 1191410 - DNA, 22 bp, Artificial Sequence
  chemically synthesized
tctagttgagtaactatatatg

SEQ ID NO: 1191411 - DNA, 22 bp, Artificial Sequence
  chemically synthesized
ctctagttgagtaactatatat

SEQ ID NO: 1191412 - DNA, 22 bp, Artificial Sequence
  chemically synthesized
aattacctacatatatagttac

SEQ ID NO: 1191413 - DNA, 22 bp, Artificial Sequence
  chemically synthesized
ccttctctagttgagtaactat

SEQ ID NO: 1191414 - DNA, 22 bp, Artificial Sequence
  chemically synthesized
cctacatatatagttactcaac

SEQ ID NO: 1191415 - DNA, 22 bp, Artificial Sequence
  chemically synthesized
cctaccttctctagttgagtaa

SEQ ID NO: 1191416 - DNA, 22 bp, Artificial Sequence
  chemically synthesized
gcctaccttctctagttgagta

SEQ ID NO: 1191417 - DNA, 22 bp, Artificial Sequence
  chemically synthesized
catatatagttactcaactaga

SEQ ID NO: 1191418 - DNA, 22 bp, Artificial Sequence
  chemically synthesized
tttgcctaccttctctagttga

SEQ ID NO: 1191419 - DNA, 22 bp, Artificial Sequence
  chemically synthesized
ctcaactagagaaggtaggcaa

SEQ ID NO: 1191420 - DNA, 22 bp, Artificial Sequence
  chemically synthesized
tgaatcacctatttgcctacct

SEQ ID NO: 1191421 - DNA, 22 bp, Artificial Sequence
  chemically synthesized
gtgaatcacctatttgcctacc

SEQ ID NO: 1191422 - DNA, 22 bp, Artificial Sequence
  chemically synthesized
aactagagaaggtaggcaaata

SEQ ID NO: 1191423 - DNA, 22 bp, Artificial Sequence
  chemically synthesized
gtgtttgtgaatcacctatttg

SEQ ID NO: 1191424 - DNA, 22 bp, Artificial Sequence
  chemically synthesized
gagaaggtaggcaaataggtga

SEQ ID NO: 1191425 - DNA, 22 bp, Artificial Sequence
  chemically synthesized
agtgtttgtgaatcacctattt

SEQ ID NO: 1191426 - DNA, 22 bp, Artificial Sequence
  chemically synthesized
tgtttagtgtttgtgaatcacc

SEQ ID NO: 1191427 - DNA, 22 bp, Artificial Sequence
  chemically synthesized
tgtccagttatgtttagtgttt

SEQ ID NO: 1191428 - DNA, 22 bp, Artificial Sequence
  chemically synthesized
caactatgtccagttatgttta

SEQ ID NO: 1191429 - DNA, 22 bp, Artificial Sequence
  chemically synthesized
ccaactatgtccagttatgttt

SEQ ID NO: 1191430 - DNA, 22 bp, Artificial Sequence
  chemically synthesized
acaaacactaaacataactgga

SEQ ID NO: 1191431 - DNA, 22 bp, Artificial Sequence
  chemically synthesized
atagtatttccaactatgtcca

SEQ ID NO: 1191432 - DNA, 22 bp, Artificial Sequence
  chemically synthesized
aacataactggacatagttgga

SEQ ID NO: 1191433 - DNA, 22 bp, Artificial Sequence
  chemically synthesized
gacatagttggaaatactatga

SEQ ID NO: 1191434 - DNA, 22 bp, Artificial Sequence
  chemically synthesized
gaaatactatgaatcacccatg

SEQ ID NO: 1191435 - DNA, 22 bp, Artificial Sequence
  chemically synthesized
tgaatcacccatgcatcctcta

SEQ ID NO: 1191436 - DNA, 22 bp, Artificial Sequence
  chemically synthesized
tgataatcatgatagaggatgc

SEQ ID NO: 1191437 - DNA, 22 bp, Artificial Sequence
  chemically synthesized
ctatgataatcatgatagagga

SEQ ID NO: 1191438 - DNA, 22 bp, Artificial Sequence
  chemically synthesized
aggaacactgctatgataatca

SEQ ID NO: 1191439 - DNA, 22 bp, Artificial Sequence
  chemically synthesized
gaggaacactgctatgataatc

SEQ ID NO: 1191440 - DNA, 22 bp, Artificial Sequence
  chemically synthesized
tgaggaacactgctatgataat

SEQ ID NO: 1191441 - DNA, 22 bp, Artificial Sequence
  chemically synthesized
tatcatgattatcatagcagtg

SEQ ID NO: 1191442 - DNA, 22 bp, Artificial Sequence
  chemically synthesized
tcatgattatcatagcagtgtt

SEQ ID NO: 1191443 - DNA, 22 bp, Artificial Sequence
  chemically synthesized
agatatactttgaggaacactg

SEQ ID NO: 1191444 - DNA, 22 bp, Artificial Sequence
  chemically synthesized
tcatagcagtgttcctcaaagt

SEQ ID NO: 1191445 - DNA, 22 bp, Artificial Sequence
  chemically synthesized
ataagttgagatatactttgag

SEQ ID NO: 1191446 - DNA, 22 bp, Artificial Sequence
  chemically synthesized
ctcaaagtatatctcaacttat

SEQ ID NO: 1191447 - DNA, 22 bp, Artificial Sequence
  chemically synthesized
aaagtatatctcaacttatcag

SEQ ID NO: 1191448 - DNA, 22 bp, Artificial Sequence
  chemically synthesized
tgtggatgcaatggctgataag

SEQ ID NO: 1191449 - DNA, 22 bp, Artificial Sequence
  chemically synthesized
atcagattatgtggatgcaatg

SEQ ID NO: 1191450 - DNA, 22 bp, Artificial Sequence
  chemically synthesized
aacttatcagccattgcatcca

SEQ ID NO: 1191451 - DNA, 22 bp, Artificial Sequence
  chemically synthesized
aattcatcagattatgtggatg

SEQ ID NO: 1191452 - DNA, 22 bp, Artificial Sequence
  chemically synthesized
atcagccattgcatccacataa

SEQ ID NO: 1191453 - DNA, 22 bp, Artificial Sequence
  chemically synthesized
caattcatcagattatgtggat

SEQ ID NO: 1191454 - DNA, 22 bp, Artificial Sequence
  chemically synthesized
tcagccattgcatccacataat

SEQ ID NO: 1191455 - DNA, 22 bp, Artificial Sequence
  chemically synthesized
tcaattcatcagattatgtgga

SEQ ID NO: 1191456 - DNA, 22 bp, Artificial Sequence
  chemically synthesized
ttttcaattcatcagattatgt

SEQ ID NO: 1191457 - DNA, 22 bp, Artificial Sequence
  chemically synthesized
ttattttcaattcatcagatta

SEQ ID NO: 1191458 - DNA, 22 bp, Artificial Sequence
  chemically synthesized
catccacataatctgatgaatt

SEQ ID NO: 1191459 - DNA, 22 bp, Artificial Sequence
  chemically synthesized
attattattttcaattcatcag

SEQ ID NO: 1191460 - DNA, 22 bp, Artificial Sequence
  chemically synthesized
tattaattattattttcaattc

SEQ ID NO: 1191461 - DNA, 22 bp, Artificial Sequence
  chemically synthesized
atattaattattattttcaatt

SEQ ID NO: 1191462 - DNA, 22 bp, Artificial Sequence
  chemically synthesized
tcttatattaattattattttc

SEQ ID NO: 1191463 - DNA, 22 bp, Artificial Sequence
  chemically synthesized
atgaattgaaaataataattaa

SEQ ID NO: 1191464 - DNA, 22 bp, Artificial Sequence
  chemically synthesized
caaccagtctatcttatattaa

SEQ ID NO: 1191465 - DNA, 22 bp, Artificial Sequence
  chemically synthesized
ccaaccagtctatcttatatta

SEQ ID NO: 1191466 - DNA, 22 bp, Artificial Sequence
  chemically synthesized
aaaataataattaatataagat

SEQ ID NO: 1191467 - DNA, 22 bp, Artificial Sequence
  chemically synthesized
cttccaaccagtctatcttata

SEQ ID NO: 1191468 - DNA, 22 bp, Artificial Sequence
  chemically synthesized
gcttccaaccagtctatcttat

SEQ ID NO: 1191469 - DNA, 22 bp, Artificial Sequence
  chemically synthesized
tttgcttccaaccagtctatct

SEQ ID NO: 1191470 - DNA, 22 bp, Artificial Sequence
  chemically synthesized
aagctatttgcttccaaccagt

SEQ ID NO: 1191471 - DNA, 22 bp, Artificial Sequence
  chemically synthesized
atataagatagactggttggaa

SEQ ID NO: 1191472 - DNA, 22 bp, Artificial Sequence
  chemically synthesized
gaagctatttgcttccaaccag

SEQ ID NO: 1191473 - DNA, 22 bp, Artificial Sequence
  chemically synthesized
tttgaagctatttgcttccaac

SEQ ID NO: 1191474 - DNA, 22 bp, Artificial Sequence
  chemically synthesized
tatttgaagctatttgcttcca

SEQ ID NO: 1191475 - DNA, 22 bp, Artificial Sequence
  chemically synthesized
ctatttgaagctatttgcttcc

SEQ ID NO: 1191476 - DNA, 22 bp, Artificial Sequence
  chemically synthesized
tctatttgaagctatttgcttc

SEQ ID NO: 1191477 - DNA, 22 bp, Artificial Sequence
  chemically synthesized
gttggaagcaaatagcttcaaa

SEQ ID NO: 1191478 - DNA, 22 bp, Artificial Sequence
  chemically synthesized
taatactttctatttgaagcta

SEQ ID NO: 1191479 - DNA, 22 bp, Artificial Sequence
  chemically synthesized
gtaatactttctatttgaagct

SEQ ID NO: 1191480 - DNA, 22 bp, Artificial Sequence
  chemically synthesized
tgtaatactttctatttgaagc

SEQ ID NO: 1191481 - DNA, 22 bp, Artificial Sequence
  chemically synthesized
gaagcaaatagcttcaaataga

SEQ ID NO: 1191482 - DNA, 22 bp, Artificial Sequence
  chemically synthesized
aacctttgtaatactttctatt

SEQ ID NO: 1191483 - DNA, 22 bp, Artificial Sequence
  chemically synthesized
tctgaacctttgtaatactttc

SEQ ID NO: 1191484 - DNA, 22 bp, Artificial Sequence
  chemically synthesized
caaatagaaagtattacaaagg

SEQ ID NO: 1191485 - DNA, 22 bp, Artificial Sequence
  chemically synthesized
agattatctgaacctttgtaat

SEQ ID NO: 1191486 - DNA, 22 bp, Artificial Sequence
  chemically synthesized
aaatagaaagtattacaaaggt

SEQ ID NO: 1191487 - DNA, 22 bp, Artificial Sequence
  chemically synthesized
ttaagattatctgaacctttgt

SEQ ID NO: 1191488 - DNA, 22 bp, Artificial Sequence
  chemically synthesized
tattaagattatctgaaccttt

SEQ ID NO: 1191489 - DNA, 22 bp, Artificial Sequence
  chemically synthesized
gctctattaagattatctgaac

SEQ ID NO: 1191490 - DNA, 22 bp, Artificial Sequence
  chemically synthesized
agctctattaagattatctgaa

SEQ ID NO: 1191491 - DNA, 22 bp, Artificial Sequence
  chemically synthesized
caaaggttcagataatcttaat

SEQ ID NO: 1191492 - DNA, 22 bp, Artificial Sequence
  chemically synthesized
gaagcttagctctattaagatt

SEQ ID NO: 1191493 - DNA, 22 bp, Artificial Sequence
  chemically synthesized
tagaagcttagctctattaaga

SEQ ID NO: 1191494 - DNA, 22 bp, Artificial Sequence
  chemically synthesized
agataatcttaatagagctaag

SEQ ID NO: 1191495 - DNA, 22 bp, Artificial Sequence
  chemically synthesized
atgtaaacctctagaagcttag

SEQ ID NO: 1191496 - DNA, 22 bp, Artificial Sequence
  chemically synthesized
gttcatgtaaacctctagaagc

SEQ ID NO: 1191497 - DNA, 22 bp, Artificial Sequence
  chemically synthesized
aatagagctaagcttctagagg

SEQ ID NO: 1191498 - DNA, 22 bp, Artificial Sequence
  chemically synthesized
ggttcatgtaaacctctagaag

SEQ ID NO: 1191499 - DNA, 22 bp, Artificial Sequence
  chemically synthesized
atagagctaagcttctagaggt

SEQ ID NO: 1191500 - DNA, 22 bp, Artificial Sequence
  chemically synthesized
tttggttcatgtaaacctctag

SEQ ID NO: 1191501 - DNA, 22 bp, Artificial Sequence
  chemically synthesized
atttggttcatgtaaacctcta

SEQ ID NO: 1191502 - DNA, 22 bp, Artificial Sequence
  chemically synthesized
tatttggttcatgtaaacctct

SEQ ID NO: 1191503 - DNA, 22 bp, Artificial Sequence
  chemically synthesized
ttatttggttcatgtaaacctc

SEQ ID NO: 1191504 - DNA, 22 bp, Artificial Sequence
  chemically synthesized
agcttctagaggtttacatgaa

SEQ ID NO: 1191505 - DNA, 22 bp, Artificial Sequence
  chemically synthesized
atttttatttggttcatgtaaa

SEQ ID NO: 1191506 - DNA, 22 bp, Artificial Sequence
  chemically synthesized
ctagaggtttacatgaaccaaa

SEQ ID NO: 1191507 - DNA, 22 bp, Artificial Sequence
  chemically synthesized
tagaggtttacatgaaccaaat

SEQ ID NO: 1191508 - DNA, 22 bp, Artificial Sequence
  chemically synthesized
agtgctgatttttatttggttc

SEQ ID NO: 1191509 - DNA, 22 bp, Artificial Sequence
  chemically synthesized
gaggtttacatgaaccaaataa

SEQ ID NO: 1191510 - DNA, 22 bp, Artificial Sequence
  chemically synthesized
acatgaaccaaataaaaatcag

SEQ ID NO: 1191511 - DNA, 22 bp, Artificial Sequence
  chemically synthesized
catgaaccaaataaaaatcagc

SEQ ID NO: 1191512 - DNA, 22 bp, Artificial Sequence
  chemically synthesized
aaaaggaatatgaaagctcagt

SEQ ID NO: 1191513 - DNA, 22 bp, Artificial Sequence
  chemically synthesized
ataatgagaaattgaaaaggaa

SEQ ID NO: 1191514 - DNA, 22 bp, Artificial Sequence
  chemically synthesized
agctttcatattccttttcaat

SEQ ID NO: 1191515 - DNA, 22 bp, Artificial Sequence
  chemically synthesized
tcatattccttttcaatttctc

SEQ ID NO: 1191516 - DNA, 22 bp, Artificial Sequence
  chemically synthesized
catattccttttcaatttctca

SEQ ID NO: 1191517 - DNA, 22 bp, Artificial Sequence
  chemically synthesized
atattccttttcaatttctcat

SEQ ID NO: 1191518 - DNA, 22 bp, Artificial Sequence
  chemically synthesized
cttttcaatttctcattatcaa

SEQ ID NO: 1191519 - DNA, 22 bp, Artificial Sequence
  chemically synthesized
ttcaatttctcattatcaattt

SEQ ID NO: 1191520 - DNA, 22 bp, Artificial Sequence
  chemically synthesized
acacagagaaacaaattgataa

SEQ ID NO: 1191521 - DNA, 22 bp, Artificial Sequence
  chemically synthesized
tcaatttctcattatcaatttg

SEQ ID NO: 1191522 - DNA, 22 bp, Artificial Sequence
  chemically synthesized
caatttctcattatcaatttgt

SEQ ID NO: 1191523 - DNA, 22 bp, Artificial Sequence
  chemically synthesized
aatttctcattatcaatttgtt

SEQ ID NO: 1191524 - DNA, 22 bp, Artificial Sequence
  chemically synthesized
cactcacacagagaaacaaatt

SEQ ID NO: 1191525 - DNA, 22 bp, Artificial Sequence
  chemically synthesized
ctcattatcaatttgtttctct

SEQ ID NO: 1191526 - DNA, 22 bp, Artificial Sequence
  chemically synthesized
tcattatcaatttgtttctctg

SEQ ID NO: 1191527 - DNA, 22 bp, Artificial Sequence
  chemically synthesized
attatcaatttgtttctctgtg

SEQ ID NO: 1191528 - DNA, 22 bp, Artificial Sequence
  chemically synthesized
atcaccctacactcacacagag

SEQ ID NO: 1191529 - DNA, 22 bp, Artificial Sequence
  chemically synthesized
tcaatttgtttctctgtgtgag

SEQ ID NO: 1191530 - DNA, 22 bp, Artificial Sequence
  chemically synthesized
catcaccctacactcacacaga

SEQ ID NO: 1191531 - DNA, 22 bp, Artificial Sequence
  chemically synthesized
ttcatcaccctacactcacaca

SEQ ID NO: 1191532 - DNA, 22 bp, Artificial Sequence
  chemically synthesized
attcttcatcaccctacactca

SEQ ID NO: 1191533 - DNA, 22 bp, Artificial Sequence
  chemically synthesized
gtttctctgtgtgagtgtaggg

SEQ ID NO: 1191534 - DNA, 22 bp, Artificial Sequence
  chemically synthesized
cattcttcatcaccctacactc

SEQ ID NO: 1191535 - DNA, 22 bp, Artificial Sequence
  chemically synthesized
tttctctgtgtgagtgtagggt

SEQ ID NO: 1191536 - DNA, 22 bp, Artificial Sequence
  chemically synthesized
cttcattcttcatcaccctaca

SEQ ID NO: 1191537 - DNA, 22 bp, Artificial Sequence
  chemically synthesized
ctctgtgtgagtgtagggtgat

SEQ ID NO: 1191538 - DNA, 22 bp, Artificial Sequence
  chemically synthesized
tctgtgtgagtgtagggtgatg

SEQ ID NO: 1191539 - DNA, 22 bp, Artificial Sequence
  chemically synthesized
tgtgtgagtgtagggtgatgaa

SEQ ID NO: 1191540 - DNA, 22 bp, Artificial Sequence
  chemically synthesized
atctacttcattcttcatcacc

SEQ ID NO: 1191541 - DNA, 22 bp, Artificial Sequence
  chemically synthesized
tgtgagtgtagggtgatgaaga

SEQ ID NO: 1191542 - DNA, 22 bp, Artificial Sequence
  chemically synthesized
catctacttcattcttcatcac

SEQ ID NO: 1191543 - DNA, 22 bp, Artificial Sequence
  chemically synthesized
aaaatttcatctacttcattct

SEQ ID NO: 1191544 - DNA, 22 bp, Artificial Sequence
  chemically synthesized
ctgaaaatttcatctacttcat

SEQ ID NO: 1191545 - DNA, 22 bp, Artificial Sequence
  chemically synthesized
actgaaaatttcatctacttca

SEQ ID NO: 1191546 - DNA, 22 bp, Artificial Sequence
  chemically synthesized
tactgaaaatttcatctacttc

SEQ ID NO: 1191547 - DNA, 22 bp, Artificial Sequence
  chemically synthesized
gcaacatatgtatactttactg

SEQ ID NO: 1191548 - DNA, 22 bp, Artificial Sequence
  chemically synthesized
ggcaacatatgtatactttact

SEQ ID NO: 1191549 - DNA, 22 bp, Artificial Sequence
  chemically synthesized
ttggcaacatatgtatacttta

SEQ ID NO: 1191550 - DNA, 22 bp, Artificial Sequence
  chemically synthesized
cttggcaacatatgtatacttt

SEQ ID NO: 1191551 - DNA, 22 bp, Artificial Sequence
  chemically synthesized
atttcttggcaacatatgtata

SEQ ID NO: 1191552 - DNA, 22 bp, Artificial Sequence
  chemically synthesized
tgatttcttggcaacatatgta

SEQ ID NO: 1191553 - DNA, 22 bp, Artificial Sequence
  chemically synthesized
tcagtaaagtatacatatgttg

SEQ ID NO: 1191554 - DNA, 22 bp, Artificial Sequence
  chemically synthesized
cagtaaagtatacatatgttgc

SEQ ID NO: 1191555 - DNA, 22 bp, Artificial Sequence
  chemically synthesized
agtaaagtatacatatgttgcc

SEQ ID NO: 1191556 - DNA, 22 bp, Artificial Sequence
  chemically synthesized
cctctgatttcttggcaacata

SEQ ID NO: 1191557 - DNA, 22 bp, Artificial Sequence
  chemically synthesized
gcctctgatttcttggcaacat

SEQ ID NO: 1191558 - DNA, 22 bp, Artificial Sequence
  chemically synthesized
tttgcctctgatttcttggcaa

SEQ ID NO: 1191559 - DNA, 22 bp, Artificial Sequence
  chemically synthesized
tagaattatttgcctctgattt

SEQ ID NO: 1191560 - DNA, 22 bp, Artificial Sequence
  chemically synthesized
ccaagaaatcagaggcaaataa

SEQ ID NO: 1191561 - DNA, 22 bp, Artificial Sequence
  chemically synthesized
gtacaatgacccaaagttatag

SEQ ID NO: 1191562 - DNA, 22 bp, Artificial Sequence
  chemically synthesized
agtacaatgacccaaagttata

SEQ ID NO: 1191563 - DNA, 22 bp, Artificial Sequence
  chemically synthesized
tttagtacaatgacccaaagtt

SEQ ID NO: 1191564 - DNA, 22 bp, Artificial Sequence
  chemically synthesized
atttagtacaatgacccaaagt

SEQ ID NO: 1191565 - DNA, 22 bp, Artificial Sequence
  chemically synthesized
tatttagtacaatgacccaaag

SEQ ID NO: 1191566 - DNA, 22 bp, Artificial Sequence
  chemically synthesized
ttatttagtacaatgacccaaa

SEQ ID NO: 1191567 - DNA, 22 bp, Artificial Sequence
  chemically synthesized
ttttatttagtacaatgaccca

SEQ ID NO: 1191568 - DNA, 22 bp, Artificial Sequence
  chemically synthesized
tcttttatttagtacaatgacc

SEQ ID NO: 1191569 - DNA, 22 bp, Artificial Sequence
  chemically synthesized
ctcttttatttagtacaatgac

SEQ ID NO: 1191570 - DNA, 22 bp, Artificial Sequence
  chemically synthesized
tataactttgggtcattgtact

SEQ ID NO: 1191571 - DNA, 22 bp, Artificial Sequence
  chemically synthesized
taactttgggtcattgtactaa

SEQ ID NO: 1191572 - DNA, 22 bp, Artificial Sequence
  chemically synthesized
aggtttctcttttatttagtac

SEQ ID NO: 1191573 - DNA, 22 bp, Artificial Sequence
  chemically synthesized
tgggtcattgtactaaataaaa

SEQ ID NO: 1191574 - DNA, 22 bp, Artificial Sequence
  chemically synthesized
gggtcattgtactaaataaaag

SEQ ID NO: 1191575 - DNA, 22 bp, Artificial Sequence
  chemically synthesized
ggtcattgtactaaataaaaga

SEQ ID NO: 1191576 - DNA, 22 bp, Artificial Sequence
  chemically synthesized
caatactaaggtttctctttta

SEQ ID NO: 1191577 - DNA, 22 bp, Artificial Sequence
  chemically synthesized
gcaatactaaggtttctctttt

SEQ ID NO: 1191578 - DNA, 22 bp, Artificial Sequence
  chemically synthesized
tgcaatactaaggtttctcttt

SEQ ID NO: 1191579 - DNA, 22 bp, Artificial Sequence
  chemically synthesized
tactaaataaaagagaaacctt

SEQ ID NO: 1191580 - DNA, 22 bp, Artificial Sequence
  chemically synthesized
aactttgcaatactaaggtttc

SEQ ID NO: 1191581 - DNA, 22 bp, Artificial Sequence
  chemically synthesized
aaactttgcaatactaaggttt

SEQ ID NO: 1191582 - DNA, 22 bp, Artificial Sequence
  chemically synthesized
aataaaagagaaaccttagtat

SEQ ID NO: 1191583 - DNA, 22 bp, Artificial Sequence
  chemically synthesized
acataatcagtttaaactttgc

SEQ ID NO: 1191584 - DNA, 22 bp, Artificial Sequence
  chemically synthesized
agtattgcaaagtttaaactga

SEQ ID NO: 1191585 - DNA, 22 bp, Artificial Sequence
  chemically synthesized
gtattgcaaagtttaaactgat

SEQ ID NO: 1191586 - DNA, 22 bp, Artificial Sequence
  chemically synthesized
caaagtttaaactgattatgtt

SEQ ID NO: 1191587 - DNA, 22 bp, Artificial Sequence
  chemically synthesized
gaggcaaatgcatattaacata

SEQ ID NO: 1191588 - DNA, 22 bp, Artificial Sequence
  chemically synthesized
ggaggcaaatgcatattaacat

SEQ ID NO: 1191589 - DNA, 22 bp, Artificial Sequence
  chemically synthesized
aaactgattatgttaatatgca

SEQ ID NO: 1191590 - DNA, 22 bp, Artificial Sequence
  chemically synthesized
aactgattatgttaatatgcat

SEQ ID NO: 1191591 - DNA, 22 bp, Artificial Sequence
  chemically synthesized
taatatttggaggcaaatgcat

SEQ ID NO: 1191592 - DNA, 22 bp, Artificial Sequence
  chemically synthesized
attatgttaatatgcatttgcc

SEQ ID NO: 1191593 - DNA, 22 bp, Artificial Sequence
  chemically synthesized
ctataatatttggaggcaaatg

SEQ ID NO: 1191594 - DNA, 22 bp, Artificial Sequence
  chemically synthesized
actataatatttggaggcaaat

SEQ ID NO: 1191595 - DNA, 22 bp, Artificial Sequence
  chemically synthesized
tgttaatatgcatttgcctcca

SEQ ID NO: 1191596 - DNA, 22 bp, Artificial Sequence
  chemically synthesized
tactataatatttggaggcaaa

SEQ ID NO: 1191597 - DNA, 22 bp, Artificial Sequence
  chemically synthesized
ttttactataatatttggaggc

SEQ ID NO: 1191598 - DNA, 22 bp, Artificial Sequence
  chemically synthesized
atatgcatttgcctccaaatat

SEQ ID NO: 1191599 - DNA, 22 bp, Artificial Sequence
  chemically synthesized
cattattttactataatatttg

SEQ ID NO: 1191600 - DNA, 22 bp, Artificial Sequence
  chemically synthesized
ttccattattttactataatat

SEQ ID NO: 1191601 - DNA, 22 bp, Artificial Sequence
  chemically synthesized
ttattccattattttactataa

SEQ ID NO: 1191602 - DNA, 22 bp, Artificial Sequence
  chemically synthesized
gcctccaaatattatagtaaaa

SEQ ID NO: 1191603 - DNA, 22 bp, Artificial Sequence
  chemically synthesized
gttattccattattttactata

SEQ ID NO: 1191604 - DNA, 22 bp, Artificial Sequence
  chemically synthesized
cctccaaatattatagtaaaat

SEQ ID NO: 1191605 - DNA, 22 bp, Artificial Sequence
  chemically synthesized
tgttattccattattttactat

SEQ ID NO: 1191606 - DNA, 22 bp, Artificial Sequence
  chemically synthesized
caaatattatagtaaaataatg

SEQ ID NO: 1191607 - DNA, 22 bp, Artificial Sequence
  chemically synthesized
aattttgttattccattatttt

SEQ ID NO: 1191608 - DNA, 22 bp, Artificial Sequence
  chemically synthesized
tagtaaaataatggaataacaa

SEQ ID NO: 1191609 - DNA, 22 bp, Artificial Sequence
  chemically synthesized
caccagaattaaattttgttat

SEQ ID NO: 1191610 - DNA, 22 bp, Artificial Sequence
  chemically synthesized
ccaccagaattaaattttgtta

SEQ ID NO: 1191611 - DNA, 22 bp, Artificial Sequence
  chemically synthesized
tacaatatccaaaatatttcca

SEQ ID NO: 1191612 - DNA, 22 bp, Artificial Sequence
  chemically synthesized
aattctggtggaaatattttgg

SEQ ID NO: 1191613 - DNA, 22 bp, Artificial Sequence
  chemically synthesized
attctggtggaaatattttgga

SEQ ID NO: 1191614 - DNA, 22 bp, Artificial Sequence
  chemically synthesized
tggtggaaatattttggatatt

SEQ ID NO: 1191615 - DNA, 22 bp, Artificial Sequence
  chemically synthesized
gtggaaatattttggatattgt

SEQ ID NO: 1191616 - DNA, 22 bp, Artificial Sequence
  chemically synthesized
aaagcatcatgtgcatctgtac

SEQ ID NO: 1191617 - DNA, 22 bp, Artificial Sequence
  chemically synthesized
tggatattgtacagatgcacat

SEQ ID NO: 1191618 - DNA, 22 bp, Artificial Sequence
  chemically synthesized
ggatattgtacagatgcacatg

SEQ ID NO: 1191619 - DNA, 22 bp, Artificial Sequence
  chemically synthesized
gatattgtacagatgcacatga

SEQ ID NO: 1191620 - DNA, 22 bp, Artificial Sequence
  chemically synthesized
atatgctcaaagcatcatgtgc

SEQ ID NO: 1191621 - DNA, 22 bp, Artificial Sequence
  chemically synthesized
aatatgctcaaagcatcatgtg

SEQ ID NO: 1191622 - DNA, 22 bp, Artificial Sequence
  chemically synthesized
tacagatgcacatgatgctttg

SEQ ID NO: 1191623 - DNA, 22 bp, Artificial Sequence
  chemically synthesized
catttaatatgctcaaagcatc

SEQ ID NO: 1191624 - DNA, 22 bp, Artificial Sequence
  chemically synthesized
tgagcatattaaatgtagactt

SEQ ID NO: 1191625 - DNA, 22 bp, Artificial Sequence
  chemically synthesized
gagcatattaaatgtagactta

SEQ ID NO: 1191626 - DNA, 22 bp, Artificial Sequence
  chemically synthesized
agcatattaaatgtagacttac

SEQ ID NO: 1191627 - DNA, 22 bp, Artificial Sequence
  chemically synthesized
aataagaacacaaaagtaagtc

SEQ ID NO: 1191628 - DNA, 22 bp, Artificial Sequence
  chemically synthesized
aaataagaacacaaaagtaagt

SEQ ID NO: 1191629 - DNA, 22 bp, Artificial Sequence
  chemically synthesized
aatgtagacttacttttgtgtt

SEQ ID NO: 1191630 - DNA, 22 bp, Artificial Sequence
  chemically synthesized
acttttgtgttcttatttaagt

SEQ ID NO: 1191631 - DNA, 22 bp, Artificial Sequence
  chemically synthesized
cttttgtgttcttatttaagtt

SEQ ID NO: 1191632 - DNA, 22 bp, Artificial Sequence
  chemically synthesized
caagcagtgaaaataacttaaa

SEQ ID NO: 1191633 - DNA, 22 bp, Artificial Sequence
  chemically synthesized
ttgtgttcttatttaagttatt

SEQ ID NO: 1191634 - DNA, 22 bp, Artificial Sequence
  chemically synthesized
tgtgttcttatttaagttattt

SEQ ID NO: 1191635 - DNA, 22 bp, Artificial Sequence
  chemically synthesized
gtgttcttatttaagttatttt

SEQ ID NO: 1191636 - DNA, 22 bp, Artificial Sequence
  chemically synthesized
tgttcttatttaagttattttc

SEQ ID NO: 1191637 - DNA, 22 bp, Artificial Sequence
  chemically synthesized
ttatttaagttattttcactgc

SEQ ID NO: 1191638 - DNA, 22 bp, Artificial Sequence
  chemically synthesized
atttaagttattttcactgctt

SEQ ID NO: 1191639 - DNA, 22 bp, Artificial Sequence
  chemically synthesized
tttaagttattttcactgcttg

SEQ ID NO: 1191640 - DNA, 22 bp, Artificial Sequence
  chemically synthesized
aagttattttcactgcttggaa

SEQ ID NO: 1191641 - DNA, 22 bp, Artificial Sequence
  chemically synthesized
agttattttcactgcttggaat

SEQ ID NO: 1191642 - DNA, 22 bp, Artificial Sequence
  chemically synthesized
ttttcactgcttggaatgcctg

SEQ ID NO: 1191643 - DNA, 22 bp, Artificial Sequence
  chemically synthesized
tcactgcttggaatgcctgata

SEQ ID NO: 1191644 - DNA, 22 bp, Artificial Sequence
  chemically synthesized
cactgcttggaatgcctgatac

SEQ ID NO: 1191645 - DNA, 22 bp, Artificial Sequence
  chemically synthesized
actgcttggaatgcctgatact

SEQ ID NO: 1191646 - DNA, 22 bp, Artificial Sequence
  chemically synthesized
cttggaatgcctgatacttttt

SEQ ID NO: 1191647 - DNA, 22 bp, Artificial Sequence
  chemically synthesized
aataaatgaaaaaaaaagtatc

SEQ ID NO: 1191648 - DNA, 22 bp, Artificial Sequence
  chemically synthesized
ggaatgcctgatactttttttt

SEQ ID NO: 1191649 - DNA, 22 bp, Artificial Sequence
  chemically synthesized
gaatgcctgatacttttttttt

SEQ ID NO: 1191650 - DNA, 22 bp, Artificial Sequence
  chemically synthesized
agctaaataaatgaaaaaaaaa

SEQ ID NO: 1191651 - DNA, 22 bp, Artificial Sequence
  chemically synthesized
ttcagctaaataaatgaaaaaa

SEQ ID NO: 1191652 - DNA, 22 bp, Artificial Sequence
  chemically synthesized
attcagctaaataaatgaaaaa

SEQ ID NO: 1191653 - DNA, 22 bp, Artificial Sequence
  chemically synthesized
atactttttttttcatttattt

SEQ ID NO: 1191654 - DNA, 22 bp, Artificial Sequence
  chemically synthesized
tttttttcatttatttagctga

SEQ ID NO: 1191655 - DNA, 22 bp, Artificial Sequence
  chemically synthesized
ttttttcatttatttagctgaa

SEQ ID NO: 1191656 - DNA, 22 bp, Artificial Sequence
  chemically synthesized
tttttcatttatttagctgaat

SEQ ID NO: 1191657 - DNA, 22 bp, Artificial Sequence
  chemically synthesized
ttttcatttatttagctgaata

SEQ ID NO: 1191658 - DNA, 22 bp, Artificial Sequence
  chemically synthesized
tttcatttatttagctgaataa

SEQ ID NO: 1191659 - DNA, 22 bp, Artificial Sequence
  chemically synthesized
ttcatttatttagctgaataaa

SEQ ID NO: 1191660 - DNA, 22 bp, Artificial Sequence
  chemically synthesized
tcatttatttagctgaataaat

SEQ ID NO: 1191661 - DNA, 22 bp, Artificial Sequence
  chemically synthesized
catttatttagctgaataaatg

SEQ ID NO: 1191662 - DNA, 22 bp, Artificial Sequence
  chemically synthesized
atttatttagctgaataaatgt

SEQ ID NO: 1191663 - DNA, 22 bp, Artificial Sequence
  chemically synthesized
ataacagtaaatgtacatttat

SEQ ID NO: 1191664 - DNA, 22 bp, Artificial Sequence
  chemically synthesized
atttagctgaataaatgtacat

SEQ ID NO: 1191665 - DNA, 22 bp, Artificial Sequence
  chemically synthesized
tttagctgaataaatgtacatt

SEQ ID NO: 1191666 - DNA, 22 bp, Artificial Sequence
  chemically synthesized
actgataacagtaaatgtacat

SEQ ID NO: 1191667 - DNA, 22 bp, Artificial Sequence
  chemically synthesized
agctgaataaatgtacatttac

SEQ ID NO: 1191668 - DNA, 22 bp, Artificial Sequence
  chemically synthesized
gctgaataaatgtacatttact

SEQ ID NO: 1191669 - DNA, 22 bp, Artificial Sequence
  chemically synthesized
actgactgataacagtaaatgt

SEQ ID NO: 1191670 - DNA, 22 bp, Artificial Sequence
  chemically synthesized
aataaatgtacatttactgtta

SEQ ID NO: 1191671 - DNA, 22 bp, Artificial Sequence
  chemically synthesized
gatattgactgactgataacag

SEQ ID NO: 1191672 - DNA, 22 bp, Artificial Sequence
  chemically synthesized
ggatattgactgactgataaca

SEQ ID NO: 1191673 - DNA, 22 bp, Artificial Sequence
  chemically synthesized
actgttatcagtcagtcaatat

SEQ ID NO: 1191674 - DNA, 22 bp, Artificial Sequence
  chemically synthesized
ctgttatcagtcagtcaatatc

SEQ ID NO: 1191675 - DNA, 22 bp, Artificial Sequence
  chemically synthesized
ttatcagtcagtcaatatccaa

SEQ ID NO: 1191676 - DNA, 22 bp, Artificial Sequence
  chemically synthesized
cacaccaagcatttggatattg

SEQ ID NO: 1191677 - DNA, 22 bp, Artificial Sequence
  chemically synthesized
tcagtcagtcaatatccaaatg

SEQ ID NO: 1191678 - DNA, 22 bp, Artificial Sequence
  chemically synthesized
ggaaataactgcacaccaagca

SEQ ID NO: 1191679 - DNA, 22 bp, Artificial Sequence
  chemically synthesized
tgggaaataactgcacaccaag

SEQ ID NO: 1191680 - DNA, 22 bp, Artificial Sequence
  chemically synthesized
aggtattctgggaaataactgc

SEQ ID NO: 1191681 - DNA, 22 bp, Artificial Sequence
  chemically synthesized
gaggtattctgggaaataactg

SEQ ID NO: 1191682 - DNA, 22 bp, Artificial Sequence
  chemically synthesized
ttgaggtattctgggaaataac

SEQ ID NO: 1191683 - DNA, 22 bp, Artificial Sequence
  chemically synthesized
ggtgtgcagttatttcccagaa

SEQ ID NO: 1191684 - DNA, 22 bp, Artificial Sequence
  chemically synthesized
gtgtgcagttatttcccagaat

SEQ ID NO: 1191685 - DNA, 22 bp, Artificial Sequence
  chemically synthesized
tgtaccaagctcttgaggtatt

SEQ ID NO: 1191686 - DNA, 22 bp, Artificial Sequence
  chemically synthesized
tttcccagaatacctcaagagc

SEQ ID NO: 1191687 - DNA, 22 bp, Artificial Sequence
  chemically synthesized
cccagaatacctcaagagcttg

SEQ ID NO: 1191688 - DNA, 22 bp, Artificial Sequence
  chemically synthesized
ccagaatacctcaagagcttgg

SEQ ID NO: 1191689 - DNA, 22 bp, Artificial Sequence
  chemically synthesized
gaaaagggcattgtgtaccaag

SEQ ID NO: 1191690 - DNA, 22 bp, Artificial Sequence
  chemically synthesized
aagagcttggtacacaatgccc

SEQ ID NO: 1191691 - DNA, 22 bp, Artificial Sequence
  chemically synthesized
agaggttggaaaagggcattgt

SEQ ID NO: 1191692 - DNA, 22 bp, Artificial Sequence
  chemically synthesized
ggtacacaatgcccttttccaa

SEQ ID NO: 1191693 - DNA, 22 bp, Artificial Sequence
  chemically synthesized
gtacacaatgcccttttccaac

SEQ ID NO: 1191694 - DNA, 22 bp, Artificial Sequence
  chemically synthesized
gtgataaacgttcagaggttgg

SEQ ID NO: 1191695 - DNA, 22 bp, Artificial Sequence
  chemically synthesized
tctggtgataaacgttcagagg

SEQ ID NO: 1191696 - DNA, 22 bp, Artificial Sequence
  chemically synthesized
ttccaacctctgaacgtttatc

SEQ ID NO: 1191697 - DNA, 22 bp, Artificial Sequence
  chemically synthesized
tccaacctctgaacgtttatca

SEQ ID NO: 1191698 - DNA, 22 bp, Artificial Sequence
  chemically synthesized
ccaacctctgaacgtttatcac

SEQ ID NO: 1191699 - DNA, 22 bp, Artificial Sequence
  chemically synthesized
caacctctgaacgtttatcacc

SEQ ID NO: 1191700 - DNA, 22 bp, Artificial Sequence
  chemically synthesized
tatgatagagtctatctggtga

SEQ ID NO: 1191701 - DNA, 22 bp, Artificial Sequence
  chemically synthesized
tgaacgtttatcaccagataga

SEQ ID NO: 1191702 - DNA, 22 bp, Artificial Sequence
  chemically synthesized
aacgtttatcaccagatagact

SEQ ID NO: 1191703 - DNA, 22 bp, Artificial Sequence
  chemically synthesized
atcaccagatagactctatcat

SEQ ID NO: 1191704 - DNA, 22 bp, Artificial Sequence
  chemically synthesized
tcaccagatagactctatcata

SEQ ID NO: 1191705 - DNA, 22 bp, Artificial Sequence
  chemically synthesized
ggataacaacgtattatatgat

SEQ ID NO: 1191706 - DNA, 22 bp, Artificial Sequence
  chemically synthesized
tatcatataatacgttgttatc

SEQ ID NO: 1191707 - DNA, 22 bp, Artificial Sequence
  chemically synthesized
tcatataatacgttgttatccc

SEQ ID NO: 1191708 - DNA, 22 bp, Artificial Sequence
  chemically synthesized
ttatcccagcttgcatgtgcac

SEQ ID NO: 1191709 - DNA, 22 bp, Artificial Sequence
  chemically synthesized
tcccagcttgcatgtgcacacg

SEQ ID NO: 1191710 - DNA, 22 bp, Artificial Sequence
  chemically synthesized
gcatgtgcacacgtgcacacac

SEQ ID NO: 1191711 - DNA, 22 bp, Artificial Sequence
  chemically synthesized
catgtgcacacgtgcacacaca

SEQ ID NO: 1191712 - DNA, 22 bp, Artificial Sequence
  chemically synthesized
atgggtcaggtcatatagtatg

SEQ ID NO: 1191713 - DNA, 22 bp, Artificial Sequence
  chemically synthesized
taatgggtcaggtcatatagta

SEQ ID NO: 1191714 - DNA, 22 bp, Artificial Sequence
  chemically synthesized
tatgacctgacccattagaatt

SEQ ID NO: 1191715 - DNA, 22 bp, Artificial Sequence
  chemically synthesized
acccattagaattcattcattc

SEQ ID NO: 1191716 - DNA, 22 bp, Artificial Sequence
  chemically synthesized
gaattcattcattcatatatat

SEQ ID NO: 1191717 - DNA, 22 bp, Artificial Sequence
  chemically synthesized
attcattcatatatatatatat

SEQ ID NO: 1191718 - DNA, 22 bp, Artificial Sequence
  chemically synthesized
attcatatatatatatatatat

SEQ ID NO: 1191719 - DNA, 22 bp, Artificial Sequence
  chemically synthesized
atatatatatatatatatacac

SEQ ID NO: 1191720 - DNA, 22 bp, Artificial Sequence
  chemically synthesized
aaacgtgtgtgtgtgtatatat

SEQ ID NO: 1191721 - DNA, 22 bp, Artificial Sequence
  chemically synthesized
atattaaaacgtgtgtgtgtgt

SEQ ID NO: 1191722 - DNA, 22 bp, Artificial Sequence
  chemically synthesized
aatattaaaacgtgtgtgtgtg

SEQ ID NO: 1191723 - DNA, 22 bp, Artificial Sequence
  chemically synthesized
taatattaaaacgtgtgtgtgt

SEQ ID NO: 1191724 - DNA, 22 bp, Artificial Sequence
  chemically synthesized
ctttaatattaaaacgtgtgtg

SEQ ID NO: 1191725 - DNA, 22 bp, Artificial Sequence
  chemically synthesized
actttaatattaaaacgtgtgt

SEQ ID NO: 1191726 - DNA, 22 bp, Artificial Sequence
  chemically synthesized
atttactttaatattaaaacgt

SEQ ID NO: 1191727 - DNA, 22 bp, Artificial Sequence
  chemically synthesized
aatttactttaatattaaaacg

SEQ ID NO: 1191728 - DNA, 22 bp, Artificial Sequence
  chemically synthesized
atatatttaatttactttaata

SEQ ID NO: 1191729 - DNA, 22 bp, Artificial Sequence
  chemically synthesized
aatatatttaatttactttaat

SEQ ID NO: 1191730 - DNA, 22 bp, Artificial Sequence
  chemically synthesized
cttaatatatttaatttacttt

SEQ ID NO: 1191731 - DNA, 22 bp, Artificial Sequence
  chemically synthesized
acttaatatatttaatttactt

SEQ ID NO: 1191732 - DNA, 22 bp, Artificial Sequence
  chemically synthesized
tttacttaatatatttaattta

SEQ ID NO: 1191733 - DNA, 22 bp, Artificial Sequence
  chemically synthesized
taatattaaagtaaattaaata

SEQ ID NO: 1191734 - DNA, 22 bp, Artificial Sequence
  chemically synthesized
atttacttaatatatttaattt

SEQ ID NO: 1191735 - DNA, 22 bp, Artificial Sequence
  chemically synthesized
aatattaaagtaaattaaatat

SEQ ID NO: 1191736 - DNA, 22 bp, Artificial Sequence
  chemically synthesized
tatttacttaatatatttaatt

SEQ ID NO: 1191737 - DNA, 22 bp, Artificial Sequence
  chemically synthesized
atattaaagtaaattaaatata

SEQ ID NO: 1191738 - DNA, 22 bp, Artificial Sequence
  chemically synthesized
aagtaaattaaatatattaagt

SEQ ID NO: 1191739 - DNA, 22 bp, Artificial Sequence
  chemically synthesized
tgtattttatttacttaatata

SEQ ID NO: 1191740 - DNA, 22 bp, Artificial Sequence
  chemically synthesized
gtgtattttatttacttaatat

SEQ ID NO: 1191741 - DNA, 22 bp, Artificial Sequence
  chemically synthesized
aatatattaagtaaataaaata

SEQ ID NO: 1191742 - DNA, 22 bp, Artificial Sequence
  chemically synthesized
taagtatcttgtgtattttatt

SEQ ID NO: 1191743 - DNA, 22 bp, Artificial Sequence
  chemically synthesized
gtaagtatcttgtgtattttat

SEQ ID NO: 1191744 - DNA, 22 bp, Artificial Sequence
  chemically synthesized
cttgtaagtatcttgtgtattt

SEQ ID NO: 1191745 - DNA, 22 bp, Artificial Sequence
  chemically synthesized
acttgtaagtatcttgtgtatt

SEQ ID NO: 1191746 - DNA, 22 bp, Artificial Sequence
  chemically synthesized
tacttgtaagtatcttgtgtat

SEQ ID NO: 1191747 - DNA, 22 bp, Artificial Sequence
  chemically synthesized
agtaaataaaatacacaagata

SEQ ID NO: 1191748 - DNA, 22 bp, Artificial Sequence
  chemically synthesized
ctttacttgtaagtatcttgtg

SEQ ID NO: 1191749 - DNA, 22 bp, Artificial Sequence
  chemically synthesized
gctttacttgtaagtatcttgt

SEQ ID NO: 1191750 - DNA, 22 bp, Artificial Sequence
  chemically synthesized
tttgctttacttgtaagtatct

SEQ ID NO: 1191751 - DNA, 22 bp, Artificial Sequence
  chemically synthesized
gtttgctttacttgtaagtatc

SEQ ID NO: 1191752 - DNA, 22 bp, Artificial Sequence
  chemically synthesized
tcttgtttgctttacttgtaag

SEQ ID NO: 1191753 - DNA, 22 bp, Artificial Sequence
  chemically synthesized
gtaatgttgtcttgtttgcttt

SEQ ID NO: 1191754 - DNA, 22 bp, Artificial Sequence
  chemically synthesized
acaagtaaagcaaacaagacaa

SEQ ID NO: 1191755 - DNA, 22 bp, Artificial Sequence
  chemically synthesized
caagtaaagcaaacaagacaac

SEQ ID NO: 1191756 - DNA, 22 bp, Artificial Sequence
  chemically synthesized
tcagatagaaacagtcaaagaa

SEQ ID NO: 1191757 - DNA, 22 bp, Artificial Sequence
  chemically synthesized
tgtcagatagaaacagtcaaag

SEQ ID NO: 1191758 - DNA, 22 bp, Artificial Sequence
  chemically synthesized
ctagcatttctttgactgtttc

SEQ ID NO: 1191759 - DNA, 22 bp, Artificial Sequence
  chemically synthesized
gcatttctttgactgtttctat

SEQ ID NO: 1191760 - DNA, 22 bp, Artificial Sequence
  chemically synthesized
agtggctctgtcagatagaaac

SEQ ID NO: 1191761 - DNA, 22 bp, Artificial Sequence
  chemically synthesized
ctttgactgtttctatctgaca

SEQ ID NO: 1191762 - DNA, 22 bp, Artificial Sequence
  chemically synthesized
tttgactgtttctatctgacag

SEQ ID NO: 1191763 - DNA, 22 bp, Artificial Sequence
  chemically synthesized
tgactgtttctatctgacagag

SEQ ID NO: 1191764 - DNA, 22 bp, Artificial Sequence
  chemically synthesized
gactgtttctatctgacagagc

SEQ ID NO: 1191765 - DNA, 22 bp, Artificial Sequence
  chemically synthesized
actgtttctatctgacagagcc

SEQ ID NO: 1191766 - DNA, 22 bp, Artificial Sequence
  chemically synthesized
cgagtgttgagtggctctgtca

SEQ ID NO: 1191767 - DNA, 22 bp, Artificial Sequence
  chemically synthesized
tttctatctgacagagccactc

SEQ ID NO: 1191768 - DNA, 22 bp, Artificial Sequence
  chemically synthesized
ctatctgacagagccactcaac

SEQ ID NO: 1191769 - DNA, 22 bp, Artificial Sequence
  chemically synthesized
tatctgacagagccactcaaca

SEQ ID NO: 1191770 - DNA, 22 bp, Artificial Sequence
  chemically synthesized
tctgacagagccactcaacact

SEQ ID NO: 1191771 - DNA, 22 bp, Artificial Sequence
  chemically synthesized
acagagccactcaacactcgta

SEQ ID NO: 1191772 - DNA, 22 bp, Artificial Sequence
  chemically synthesized
gtataataggtgttacgagtgt

SEQ ID NO: 1191773 - DNA, 22 bp, Artificial Sequence
  chemically synthesized
actcgtataataggtgttacga

SEQ ID NO: 1191774 - DNA, 22 bp, Artificial Sequence
  chemically synthesized
gactcgtataataggtgttacg

SEQ ID NO: 1191775 - DNA, 22 bp, Artificial Sequence
  chemically synthesized
aacactcgtaacacctattata

SEQ ID NO: 1191776 - DNA, 22 bp, Artificial Sequence
  chemically synthesized
gtaacacctattatacgagtca

SEQ ID NO: 1191777 - DNA, 22 bp, Artificial Sequence
  chemically synthesized
taaggtatgatttgactcgtat

SEQ ID NO: 1191778 - DNA, 22 bp, Artificial Sequence
  chemically synthesized
gtaaggtatgatttgactcgta

SEQ ID NO: 1191779 - DNA, 22 bp, Artificial Sequence
  chemically synthesized
tgtaaggtatgatttgactcgt

SEQ ID NO: 1191780 - DNA, 22 bp, Artificial Sequence
  chemically synthesized
ttgtaaggtatgatttgactcg

SEQ ID NO: 1191781 - DNA, 22 bp, Artificial Sequence
  chemically synthesized
ttttgtaaggtatgatttgact

SEQ ID NO: 1191782 - DNA, 22 bp, Artificial Sequence
  chemically synthesized
ttatacgagtcaaatcatacct

SEQ ID NO: 1191783 - DNA, 22 bp, Artificial Sequence
  chemically synthesized
tacgagtcaaatcataccttac

SEQ ID NO: 1191784 - DNA, 22 bp, Artificial Sequence
  chemically synthesized
tggtagacaaaaactcttttgt

SEQ ID NO: 1191785 - DNA, 22 bp, Artificial Sequence
  chemically synthesized
acaaaagagtttttgtctacca

SEQ ID NO: 1191786 - DNA, 22 bp, Artificial Sequence
  chemically synthesized
caaaagagtttttgtctaccac

SEQ ID NO: 1191787 - DNA, 22 bp, Artificial Sequence
  chemically synthesized
ttgtctaccacaattctttatt

SEQ ID NO: 1191788 - DNA, 22 bp, Artificial Sequence
  chemically synthesized
tgtctaccacaattctttattg

SEQ ID NO: 1191789 - DNA, 22 bp, Artificial Sequence
  chemically synthesized
gtctaccacaattctttattgt

SEQ ID NO: 1191790 - DNA, 22 bp, Artificial Sequence
  chemically synthesized
gaaaaggtaacaacaataaaga

SEQ ID NO: 1191791 - DNA, 22 bp, Artificial Sequence
  chemically synthesized
tctaccacaattctttattgtt

SEQ ID NO: 1191792 - DNA, 22 bp, Artificial Sequence
  chemically synthesized
ccacaattctttattgttgtta

SEQ ID NO: 1191793 - DNA, 22 bp, Artificial Sequence
  chemically synthesized
aaaaaaattagaaaaggtaaca

SEQ ID NO: 1191794 - DNA, 22 bp, Artificial Sequence
  chemically synthesized
tgaaaaaaattagaaaaggtaa

SEQ ID NO: 1191795 - DNA, 22 bp, Artificial Sequence
  chemically synthesized
tttattgttgttaccttttcta

SEQ ID NO: 1191796 - DNA, 22 bp, Artificial Sequence
  chemically synthesized
tattgttgttaccttttctaat

SEQ ID NO: 1191797 - DNA, 22 bp, Artificial Sequence
  chemically synthesized
attgttgttaccttttctaatt

SEQ ID NO: 1191798 - DNA, 22 bp, Artificial Sequence
  chemically synthesized
ttgttgttaccttttctaattt

SEQ ID NO: 1191799 - DNA, 22 bp, Artificial Sequence
  chemically synthesized
ccattctgaaaaaaattagaaa

SEQ ID NO: 1191800 - DNA, 22 bp, Artificial Sequence
  chemically synthesized
ttgttaccttttctaatttttt

SEQ ID NO: 1191801 - DNA, 22 bp, Artificial Sequence
  chemically synthesized
ccctcccattctgaaaaaaatt

SEQ ID NO: 1191802 - DNA, 22 bp, Artificial Sequence
  chemically synthesized
ttaccttttctaatttttttca

SEQ ID NO: 1191803 - DNA, 22 bp, Artificial Sequence
  chemically synthesized
cccctcccattctgaaaaaaat

SEQ ID NO: 1191804 - DNA, 22 bp, Artificial Sequence
  chemically synthesized
ccttttctaatttttttcagaa

SEQ ID NO: 1191805 - DNA, 22 bp, Artificial Sequence
  chemically synthesized
tttcccctcccattctgaaaaa

SEQ ID NO: 1191806 - DNA, 22 bp, Artificial Sequence
  chemically synthesized
ttctaatttttttcagaatggg

SEQ ID NO: 1191807 - DNA, 22 bp, Artificial Sequence
  chemically synthesized
tctaatttttttcagaatggga

SEQ ID NO: 1191808 - DNA, 22 bp, Artificial Sequence
  chemically synthesized
ctaatttttttcagaatgggag

SEQ ID NO: 1191809 - DNA, 22 bp, Artificial Sequence
  chemically synthesized
atattgtttcccctcccattct

SEQ ID NO: 1191810 - DNA, 22 bp, Artificial Sequence
  chemically synthesized
taatttttttcagaatgggagg

SEQ ID NO: 1191811 - DNA, 22 bp, Artificial Sequence
  chemically synthesized
atttttttcagaatgggagggg

SEQ ID NO: 1191812 - DNA, 22 bp, Artificial Sequence
  chemically synthesized
ttttcagaatgggaggggaaac

SEQ ID NO: 1191813 - DNA, 22 bp, Artificial Sequence
  chemically synthesized
ggagttcatattgtttcccctc

SEQ ID NO: 1191814 - DNA, 22 bp, Artificial Sequence
  chemically synthesized
tttcagaatgggaggggaaaca

SEQ ID NO: 1191815 - DNA, 22 bp, Artificial Sequence
  chemically synthesized
ttcagaatgggaggggaaacaa

SEQ ID NO: 1191816 - DNA, 22 bp, Artificial Sequence
  chemically synthesized
taggagttcatattgtttcccc

SEQ ID NO: 1191817 - DNA, 22 bp, Artificial Sequence
  chemically synthesized
tcagaatgggaggggaaacaat

SEQ ID NO: 1191818 - DNA, 22 bp, Artificial Sequence
  chemically synthesized
ctaggagttcatattgtttccc

SEQ ID NO: 1191819 - DNA, 22 bp, Artificial Sequence
  chemically synthesized
cagaatgggaggggaaacaata

SEQ ID NO: 1191820 - DNA, 22 bp, Artificial Sequence
  chemically synthesized
agaatgggaggggaaacaatat

SEQ ID NO: 1191821 - DNA, 22 bp, Artificial Sequence
  chemically synthesized
tcttctaggagttcatattgtt

SEQ ID NO: 1191822 - DNA, 22 bp, Artificial Sequence
  chemically synthesized
aaatgcattgtcttctaggagt

SEQ ID NO: 1191823 - DNA, 22 bp, Artificial Sequence
  chemically synthesized
gaccgttaaaatgcattgtctt

SEQ ID NO: 1191824 - DNA, 22 bp, Artificial Sequence
  chemically synthesized
gtattagaccgttaaaatgcat

SEQ ID NO: 1191825 - DNA, 22 bp, Artificial Sequence
  chemically synthesized
ggtattagaccgttaaaatgca

SEQ ID NO: 1191826 - DNA, 22 bp, Artificial Sequence
  chemically synthesized
ctagaagacaatgcattttaac

SEQ ID NO: 1191827 - DNA, 22 bp, Artificial Sequence
  chemically synthesized
gaagacaatgcattttaacggt

SEQ ID NO: 1191828 - DNA, 22 bp, Artificial Sequence
  chemically synthesized
taacggtctaataccaagactg

SEQ ID NO: 1191829 - DNA, 22 bp, Artificial Sequence
  chemically synthesized
aacggtctaataccaagactgg

SEQ ID NO: 1191830 - DNA, 22 bp, Artificial Sequence
  chemically synthesized
acggtctaataccaagactggc

SEQ ID NO: 1191831 - DNA, 22 bp, Artificial Sequence
  chemically synthesized
atgggtgcaaaatgagccagtc

SEQ ID NO: 1191832 - DNA, 22 bp, Artificial Sequence
  chemically synthesized
aatgggtgcaaaatgagccagt

SEQ ID NO: 1191833 - DNA, 22 bp, Artificial Sequence
  chemically synthesized
ataccaagactggctcattttg

SEQ ID NO: 1191834 - DNA, 22 bp, Artificial Sequence
  chemically synthesized
acaggcatttaatgggtgcaaa

SEQ ID NO: 1191835 - DNA, 22 bp, Artificial Sequence
  chemically synthesized
cacaggcatttaatgggtgcaa

SEQ ID NO: 1191836 - DNA, 22 bp, Artificial Sequence
  chemically synthesized
tcacaggcatttaatgggtgca

SEQ ID NO: 1191837 - DNA, 22 bp, Artificial Sequence
  chemically synthesized
ttcacaggcatttaatgggtgc

SEQ ID NO: 1191838 - DNA, 22 bp, Artificial Sequence
  chemically synthesized
tttcacaggcatttaatgggtg

SEQ ID NO: 1191839 - DNA, 22 bp, Artificial Sequence
  chemically synthesized
gctcattttgcacccattaaat

SEQ ID NO: 1191840 - DNA, 22 bp, Artificial Sequence
  chemically synthesized
attttgcacccattaaatgcct

SEQ ID NO: 1191841 - DNA, 22 bp, Artificial Sequence
  chemically synthesized
gtcaattttttcacaggcattt

SEQ ID NO: 1191842 - DNA, 22 bp, Artificial Sequence
  chemically synthesized
ggtcaattttttcacaggcatt

SEQ ID NO: 1191843 - DNA, 22 bp, Artificial Sequence
  chemically synthesized
tgcacccattaaatgcctgtga

SEQ ID NO: 1191844 - DNA, 22 bp, Artificial Sequence
  chemically synthesized
tggtcaattttttcacaggcat

SEQ ID NO: 1191845 - DNA, 22 bp, Artificial Sequence
  chemically synthesized
gcacccattaaatgcctgtgaa

SEQ ID NO: 1191846 - DNA, 22 bp, Artificial Sequence
  chemically synthesized
cacccattaaatgcctgtgaaa

SEQ ID NO: 1191847 - DNA, 22 bp, Artificial Sequence
  chemically synthesized
tgaccaattttggtcaattttt

SEQ ID NO: 1191848 - DNA, 22 bp, Artificial Sequence
  chemically synthesized
aatgcctgtgaaaaaattgacc

SEQ ID NO: 1191849 - DNA, 22 bp, Artificial Sequence
  chemically synthesized
catctgtgaccaattttggtca

SEQ ID NO: 1191850 - DNA, 22 bp, Artificial Sequence
  chemically synthesized
tgaaaaaattgaccaaaattgg

SEQ ID NO: 1191851 - DNA, 22 bp, Artificial Sequence
  chemically synthesized
accaaaattggtcacagatgga

SEQ ID NO: 1191852 - DNA, 22 bp, Artificial Sequence
  chemically synthesized
agaagagcaatgagatgtgttc

SEQ ID NO: 1191853 - DNA, 22 bp, Artificial Sequence
  chemically synthesized
gtcacagatggaacacatctca

SEQ ID NO: 1191854 - DNA, 22 bp, Artificial Sequence
  chemically synthesized
tctaagaagagcaatgagatgt

SEQ ID NO: 1191855 - DNA, 22 bp, Artificial Sequence
  chemically synthesized
attgctcttcttagataatttc

SEQ ID NO: 1191856 - DNA, 22 bp, Artificial Sequence
  chemically synthesized
ctcttcttagataatttctatt

SEQ ID NO: 1191857 - DNA, 22 bp, Artificial Sequence
  chemically synthesized
ttcttagataatttctattact

SEQ ID NO: 1191858 - DNA, 22 bp, Artificial Sequence
  chemically synthesized
cttagataatttctattactta

SEQ ID NO: 1191859 - DNA, 22 bp, Artificial Sequence
  chemically synthesized
taaaagaaaatgtaagtaatag

SEQ ID NO: 1191860 - DNA, 22 bp, Artificial Sequence
  chemically synthesized
ttagataatttctattacttac

SEQ ID NO: 1191861 - DNA, 22 bp, Artificial Sequence
  chemically synthesized
agataatttctattacttacat

SEQ ID NO: 1191862 - DNA, 22 bp, Artificial Sequence
  chemically synthesized
gataatttctattacttacatt

SEQ ID NO: 1191863 - DNA, 22 bp, Artificial Sequence
  chemically synthesized
ctattacttacattttctttta

SEQ ID NO: 1191864 - DNA, 22 bp, Artificial Sequence
  chemically synthesized
tattacttacattttcttttac

SEQ ID NO: 1191865 - DNA, 22 bp, Artificial Sequence
  chemically synthesized
ttacttacattttcttttacaa

SEQ ID NO: 1191866 - DNA, 22 bp, Artificial Sequence
  chemically synthesized
agtaaaaaaacgattgtaaaag

SEQ ID NO: 1191867 - DNA, 22 bp, Artificial Sequence
  chemically synthesized
cttacattttcttttacaatcg

SEQ ID NO: 1191868 - DNA, 22 bp, Artificial Sequence
  chemically synthesized
acattttcttttacaatcgttt

SEQ ID NO: 1191869 - DNA, 22 bp, Artificial Sequence
  chemically synthesized
cattttcttttacaatcgtttt

SEQ ID NO: 1191870 - DNA, 22 bp, Artificial Sequence
  chemically synthesized
tcttttacaatcgtttttttac

SEQ ID NO: 1191871 - DNA, 22 bp, Artificial Sequence
  chemically synthesized
gatgtgagctaagtaaaaaaac

SEQ ID NO: 1191872 - DNA, 22 bp, Artificial Sequence
  chemically synthesized
cttttacaatcgtttttttact

SEQ ID NO: 1191873 - DNA, 22 bp, Artificial Sequence
  chemically synthesized
ggatgtgagctaagtaaaaaaa

SEQ ID NO: 1191874 - DNA, 22 bp, Artificial Sequence
  chemically synthesized
ttttacaatcgtttttttactt

SEQ ID NO: 1191875 - DNA, 22 bp, Artificial Sequence
  chemically synthesized
ttacaatcgtttttttacttag

SEQ ID NO: 1191876 - DNA, 22 bp, Artificial Sequence
  chemically synthesized
tacaatcgtttttttacttagc

SEQ ID NO: 1191877 - DNA, 22 bp, Artificial Sequence
  chemically synthesized
atttggatgtgagctaagtaaa

SEQ ID NO: 1191878 - DNA, 22 bp, Artificial Sequence
  chemically synthesized
acaatcgtttttttacttagct

SEQ ID NO: 1191879 - DNA, 22 bp, Artificial Sequence
  chemically synthesized
caatcgtttttttacttagctc

SEQ ID NO: 1191880 - DNA, 22 bp, Artificial Sequence
  chemically synthesized
ctcatttggatgtgagctaagt

SEQ ID NO: 1191881 - DNA, 22 bp, Artificial Sequence
  chemically synthesized
gctcatttggatgtgagctaag

SEQ ID NO: 1191882 - DNA, 22 bp, Artificial Sequence
  chemically synthesized
ttttacttagctcacatccaaa

SEQ ID NO: 1191883 - DNA, 22 bp, Artificial Sequence
  chemically synthesized
tttacttagctcacatccaaat

SEQ ID NO: 1191884 - DNA, 22 bp, Artificial Sequence
  chemically synthesized
ttacttagctcacatccaaatg

SEQ ID NO: 1191885 - DNA, 22 bp, Artificial Sequence
  chemically synthesized
tacttagctcacatccaaatga

SEQ ID NO: 1191886 - DNA, 22 bp, Artificial Sequence
  chemically synthesized
acttagctcacatccaaatgag

SEQ ID NO: 1191887 - DNA, 22 bp, Artificial Sequence
  chemically synthesized
cttagctcacatccaaatgagc

SEQ ID NO: 1191888 - DNA, 22 bp, Artificial Sequence
  chemically synthesized
agctcacatccaaatgagcaaa

SEQ ID NO: 1191889 - DNA, 22 bp, Artificial Sequence
  chemically synthesized
gctcacatccaaatgagcaaat

SEQ ID NO: 1191890 - DNA, 22 bp, Artificial Sequence
  chemically synthesized
caaatgaatgtaatttgctcat

SEQ ID NO: 1191891 - DNA, 22 bp, Artificial Sequence
  chemically synthesized
ccaaatgaatgtaatttgctca

SEQ ID NO: 1191892 - DNA, 22 bp, Artificial Sequence
  chemically synthesized
acatccaaatgagcaaattaca

SEQ ID NO: 1191893 - DNA, 22 bp, Artificial Sequence
  chemically synthesized
cattcatttggaaatgttattc

SEQ ID NO: 1191894 - DNA, 22 bp, Artificial Sequence
  chemically synthesized
atttggaaatgttattcgattc

SEQ ID NO: 1191895 - DNA, 22 bp, Artificial Sequence
  chemically synthesized
ggaaatgttattcgattcacat

SEQ ID NO: 1191896 - DNA, 22 bp, Artificial Sequence
  chemically synthesized
gaaatgttattcgattcacatt

SEQ ID NO: 1191897 - DNA, 22 bp, Artificial Sequence
  chemically synthesized
ttcgattcacattgtttgcccc

SEQ ID NO: 1191898 - DNA, 22 bp, Artificial Sequence
  chemically synthesized
aaaaaatccccatgggggcaaa

SEQ ID NO: 1191899 - DNA, 22 bp, Artificial Sequence
  chemically synthesized
gattcacattgtttgcccccat

SEQ ID NO: 1191900 - DNA, 22 bp, Artificial Sequence
  chemically synthesized
acattgtttgcccccatgggga

SEQ ID NO: 1191901 - DNA, 22 bp, Artificial Sequence
  chemically synthesized
aaaaggcgttaaaaaaatcccc

SEQ ID NO: 1191902 - DNA, 22 bp, Artificial Sequence
  chemically synthesized
tttgcccccatggggatttttt

SEQ ID NO: 1191903 - DNA, 22 bp, Artificial Sequence
  chemically synthesized
taaaaaggcgttaaaaaaatcc

SEQ ID NO: 1191904 - DNA, 22 bp, Artificial Sequence
  chemically synthesized
ctaaaaaggcgttaaaaaaatc

SEQ ID NO: 1191905 - DNA, 22 bp, Artificial Sequence
  chemically synthesized
gcccccatggggatttttttaa

SEQ ID NO: 1191906 - DNA, 22 bp, Artificial Sequence
  chemically synthesized
cccccatggggatttttttaac

SEQ ID NO: 1191907 - DNA, 22 bp, Artificial Sequence
  chemically synthesized
agtagtttctaaaaaggcgtta

SEQ ID NO: 1191908 - DNA, 22 bp, Artificial Sequence
  chemically synthesized
aagtagtttctaaaaaggcgtt

SEQ ID NO: 1191909 - DNA, 22 bp, Artificial Sequence
  chemically synthesized
tttaagtagtttctaaaaaggc

SEQ ID NO: 1191910 - DNA, 22 bp, Artificial Sequence
  chemically synthesized
ttttaacgcctttttagaaact

SEQ ID NO: 1191911 - DNA, 22 bp, Artificial Sequence
  chemically synthesized
tttaacgcctttttagaaacta

SEQ ID NO: 1191912 - DNA, 22 bp, Artificial Sequence
  chemically synthesized
ttaacgcctttttagaaactac

SEQ ID NO: 1191913 - DNA, 22 bp, Artificial Sequence
  chemically synthesized
ggacctatttaagtagtttcta

SEQ ID NO: 1191914 - DNA, 22 bp, Artificial Sequence
  chemically synthesized
taacgcctttttagaaactact

SEQ ID NO: 1191915 - DNA, 22 bp, Artificial Sequence
  chemically synthesized
aggacctatttaagtagtttct

SEQ ID NO: 1191916 - DNA, 22 bp, Artificial Sequence
  chemically synthesized
aacgcctttttagaaactactt

SEQ ID NO: 1191917 - DNA, 22 bp, Artificial Sequence
  chemically synthesized
acgcctttttagaaactactta

SEQ ID NO: 1191918 - DNA, 22 bp, Artificial Sequence
  chemically synthesized
tttagaaactacttaaataggt

SEQ ID NO: 1191919 - DNA, 22 bp, Artificial Sequence
  chemically synthesized
ttagaaactacttaaataggtc

SEQ ID NO: 1191920 - DNA, 22 bp, Artificial Sequence
  chemically synthesized
tagaaactacttaaataggtcc

SEQ ID NO: 1191921 - DNA, 22 bp, Artificial Sequence
  chemically synthesized
agaaactacttaaataggtcct

SEQ ID NO: 1191922 - DNA, 22 bp, Artificial Sequence
  chemically synthesized
gaaactacttaaataggtccta

SEQ ID NO: 1191923 - DNA, 22 bp, Artificial Sequence
  chemically synthesized
cttaaataggtcctaaatttat

SEQ ID NO: 1191924 - DNA, 22 bp, Artificial Sequence
  chemically synthesized
aaataggtcctaaatttattat

SEQ ID NO: 1191925 - DNA, 22 bp, Artificial Sequence
  chemically synthesized
aataggtcctaaatttattatc

SEQ ID NO: 1191926 - DNA, 22 bp, Artificial Sequence
  chemically synthesized
aacacccatggaccaagataat

SEQ ID NO: 1191927 - DNA, 22 bp, Artificial Sequence
  chemically synthesized
ttcaacacccatggaccaagat

SEQ ID NO: 1191928 - DNA, 22 bp, Artificial Sequence
  chemically synthesized
attcaacacccatggaccaaga

SEQ ID NO: 1191929 - DNA, 22 bp, Artificial Sequence
  chemically synthesized
aatttattatcttggtccatgg

SEQ ID NO: 1191930 - DNA, 22 bp, Artificial Sequence
  chemically synthesized
cttattcaacacccatggacca

SEQ ID NO: 1191931 - DNA, 22 bp, Artificial Sequence
  chemically synthesized
gcttattcaacacccatggacc

SEQ ID NO: 1191932 - DNA, 22 bp, Artificial Sequence
  chemically synthesized
attatcttggtccatgggtgtt

SEQ ID NO: 1191933 - DNA, 22 bp, Artificial Sequence
  chemically synthesized
ttatcttggtccatgggtgttg

SEQ ID NO: 1191934 - DNA, 22 bp, Artificial Sequence
  chemically synthesized
agtttgcttattcaacacccat

SEQ ID NO: 1191935 - DNA, 22 bp, Artificial Sequence
  chemically synthesized
tcagtttgcttattcaacaccc

SEQ ID NO: 1191936 - DNA, 22 bp, Artificial Sequence
  chemically synthesized
tcttggtccatgggtgttgaat

SEQ ID NO: 1191937 - DNA, 22 bp, Artificial Sequence
  chemically synthesized
ctcagtttgcttattcaacacc

SEQ ID NO: 1191938 - DNA, 22 bp, Artificial Sequence
  chemically synthesized
tctcagtttgcttattcaacac

SEQ ID NO: 1191939 - DNA, 22 bp, Artificial Sequence
  chemically synthesized
ggtccatgggtgttgaataagc

SEQ ID NO: 1191940 - DNA, 22 bp, Artificial Sequence
  chemically synthesized
gtccatgggtgttgaataagca

SEQ ID NO: 1191941 - DNA, 22 bp, Artificial Sequence
  chemically synthesized
taacaatgattttctcagtttg

SEQ ID NO: 1191942 - DNA, 22 bp, Artificial Sequence
  chemically synthesized
aataagcaaactgagaaaatca

SEQ ID NO: 1191943 - DNA, 22 bp, Artificial Sequence
  chemically synthesized
acagttgtaacaatgattttct

SEQ ID NO: 1191944 - DNA, 22 bp, Artificial Sequence
  chemically synthesized
atgtagaattgacagttgtaac

SEQ ID NO: 1191945 - DNA, 22 bp, Artificial Sequence
  chemically synthesized
agaaaatcattgttacaactgt

SEQ ID NO: 1191946 - DNA, 22 bp, Artificial Sequence
  chemically synthesized
aatgtagaattgacagttgtaa

SEQ ID NO: 1191947 - DNA, 22 bp, Artificial Sequence
  chemically synthesized
taatgtagaattgacagttgta

SEQ ID NO: 1191948 - DNA, 22 bp, Artificial Sequence
  chemically synthesized
ttaatgtagaattgacagttgt

SEQ ID NO: 1191949 - DNA, 22 bp, Artificial Sequence
  chemically synthesized
acatcatttttaatgtagaatt

SEQ ID NO: 1191950 - DNA, 22 bp, Artificial Sequence
  chemically synthesized
ttacaactgtcaattctacatt

SEQ ID NO: 1191951 - DNA, 22 bp, Artificial Sequence
  chemically synthesized
aacatcatttttaatgtagaat

SEQ ID NO: 1191952 - DNA, 22 bp, Artificial Sequence
  chemically synthesized
taacatcatttttaatgtagaa

SEQ ID NO: 1191953 - DNA, 22 bp, Artificial Sequence
  chemically synthesized
caactgtcaattctacattaaa

SEQ ID NO: 1191954 - DNA, 22 bp, Artificial Sequence
  chemically synthesized
tcaattctacattaaaaatgat

SEQ ID NO: 1191955 - DNA, 22 bp, Artificial Sequence
  chemically synthesized
tacattaaaaatgatgttaaaa

SEQ ID NO: 1191956 - DNA, 22 bp, Artificial Sequence
  chemically synthesized
cattaaaaatgatgttaaaatc

SEQ ID NO: 1191957 - DNA, 22 bp, Artificial Sequence
  chemically synthesized
aaaatgatgttaaaatctggtc

SEQ ID NO: 1191958 - DNA, 22 bp, Artificial Sequence
  chemically synthesized
aaatctggtcatacatctctgg

SEQ ID NO: 1191959 - DNA, 22 bp, Artificial Sequence
  chemically synthesized
aaatatgtcagatccagagatg

SEQ ID NO: 1191960 - DNA, 22 bp, Artificial Sequence
  chemically synthesized
tctaaaatatgtcagatccaga

SEQ ID NO: 1191961 - DNA, 22 bp, Artificial Sequence
  chemically synthesized
atctaaaatatgtcagatccag

SEQ ID NO: 1191962 - DNA, 22 bp, Artificial Sequence
  chemically synthesized
gtcatacatctctggatctgac

SEQ ID NO: 1191963 - DNA, 22 bp, Artificial Sequence
  chemically synthesized
atatttatctaaaatatgtcag

SEQ ID NO: 1191964 - DNA, 22 bp, Artificial Sequence
  chemically synthesized
taatatttatctaaaatatgtc

SEQ ID NO: 1191965 - DNA, 22 bp, Artificial Sequence
  chemically synthesized
ctaatatttatctaaaatatgt

SEQ ID NO: 1191966 - DNA, 22 bp, Artificial Sequence
  chemically synthesized
tctaatatttatctaaaatatg

SEQ ID NO: 1191967 - DNA, 22 bp, Artificial Sequence
  chemically synthesized
tggatctgacatattttagata

SEQ ID NO: 1191968 - DNA, 22 bp, Artificial Sequence
  chemically synthesized
gatctgacatattttagataaa

SEQ ID NO: 1191969 - DNA, 22 bp, Artificial Sequence
  chemically synthesized
accctttctaatatttatctaa

SEQ ID NO: 1191970 - DNA, 22 bp, Artificial Sequence
  chemically synthesized
aaccctttctaatatttatcta

SEQ ID NO: 1191971 - DNA, 22 bp, Artificial Sequence
  chemically synthesized
cttaaccctttctaatatttat

SEQ ID NO: 1191972 - DNA, 22 bp, Artificial Sequence
  chemically synthesized
acatattttagataaatattag

SEQ ID NO: 1191973 - DNA, 22 bp, Artificial Sequence
  chemically synthesized
agctacttaaccctttctaata

SEQ ID NO: 1191974 - DNA, 22 bp, Artificial Sequence
  chemically synthesized
tagataaatattagaaagggtt

SEQ ID NO: 1191975 - DNA, 22 bp, Artificial Sequence
  chemically synthesized
agataaatattagaaagggtta

SEQ ID NO: 1191976 - DNA, 22 bp, Artificial Sequence
  chemically synthesized
gataaatattagaaagggttaa

SEQ ID NO: 1191977 - DNA, 22 bp, Artificial Sequence
  chemically synthesized
tcgcctcagctacttaaccctt

SEQ ID NO: 1191978 - DNA, 22 bp, Artificial Sequence
  chemically synthesized
aaatgtctatcgcctcagctac

SEQ ID NO: 1191979 - DNA, 22 bp, Artificial Sequence
  chemically synthesized
gaaagggttaagtagctgaggc

SEQ ID NO: 1191980 - DNA, 22 bp, Artificial Sequence
  chemically synthesized
gttaaaatgtctatcgcctcag

SEQ ID NO: 1191981 - DNA, 22 bp, Artificial Sequence
  chemically synthesized
gctagttaaaatgtctatcgcc

SEQ ID NO: 1191982 - DNA, 22 bp, Artificial Sequence
  chemically synthesized
agtagctgaggcgatagacatt

SEQ ID NO: 1191983 - DNA, 22 bp, Artificial Sequence
  chemically synthesized
atctagctagttaaaatgtcta

SEQ ID NO: 1191984 - DNA, 22 bp, Artificial Sequence
  chemically synthesized
gatctagctagttaaaatgtct

SEQ ID NO: 1191985 - DNA, 22 bp, Artificial Sequence
  chemically synthesized
aggcgatagacattttaactag

SEQ ID NO: 1191986 - DNA, 22 bp, Artificial Sequence
  chemically synthesized
tgagaaagatttgatctagcta

SEQ ID NO: 1191987 - DNA, 22 bp, Artificial Sequence
  chemically synthesized
taactagctagatcaaatcttt

SEQ ID NO: 1191988 - DNA, 22 bp, Artificial Sequence
  chemically synthesized
aactagctagatcaaatctttc

SEQ ID NO: 1191989 - DNA, 22 bp, Artificial Sequence
  chemically synthesized
actagctagatcaaatctttct

SEQ ID NO: 1191990 - DNA, 22 bp, Artificial Sequence
  chemically synthesized
tgcatacattatgagaaagatt

SEQ ID NO: 1191991 - DNA, 22 bp, Artificial Sequence
  chemically synthesized
gctagatcaaatctttctcata

SEQ ID NO: 1191992 - DNA, 22 bp, Artificial Sequence
  chemically synthesized
atctatgcatacattatgagaa

SEQ ID NO: 1191993 - DNA, 22 bp, Artificial Sequence
  chemically synthesized
gatctatgcatacattatgaga

SEQ ID NO: 1191994 - DNA, 22 bp, Artificial Sequence
  chemically synthesized
gatcaaatctttctcataatgt

SEQ ID NO: 1191995 - DNA, 22 bp, Artificial Sequence
  chemically synthesized
tgatctatgcatacattatgag

SEQ ID NO: 1191996 - DNA, 22 bp, Artificial Sequence
  chemically synthesized
tctcataatgtatgcatagatc

SEQ ID NO: 1191997 - DNA, 22 bp, Artificial Sequence
  chemically synthesized
ctcataatgtatgcatagatca

SEQ ID NO: 1191998 - DNA, 22 bp, Artificial Sequence
  chemically synthesized
tcataatgtatgcatagatcaa

SEQ ID NO: 1191999 - DNA, 22 bp, Artificial Sequence
  chemically synthesized
ataatgtatgcatagatcaaaa

SEQ ID NO: 1192000 - DNA, 22 bp, Artificial Sequence
  chemically synthesized
cattttaccccattattatctg

SEQ ID NO: 1192001 - DNA, 22 bp, Artificial Sequence
  chemically synthesized
aaaaaatataaaagcagataat

SEQ ID NO: 1192002 - DNA, 22 bp, Artificial Sequence
  chemically synthesized
aaaaaaatataaaagcagataa

SEQ ID NO: 1192003 - DNA, 22 bp, Artificial Sequence
  chemically synthesized
taaaaaaatataaaagcagata

SEQ ID NO: 1192004 - DNA, 22 bp, Artificial Sequence
  chemically synthesized
taccccattattatctgctttt

SEQ ID NO: 1192005 - DNA, 22 bp, Artificial Sequence
  chemically synthesized
ttaaaaaaatataaaagcagat

SEQ ID NO: 1192006 - DNA, 22 bp, Artificial Sequence
  chemically synthesized
accccattattatctgctttta

SEQ ID NO: 1192007 - DNA, 22 bp, Artificial Sequence
  chemically synthesized
tttaaaaaaatataaaagcaga

SEQ ID NO: 1192008 - DNA, 22 bp, Artificial Sequence
  chemically synthesized
ccccattattatctgcttttat

SEQ ID NO: 1192009 - DNA, 22 bp, Artificial Sequence
  chemically synthesized
ttttaaaaaaatataaaagcag

SEQ ID NO: 1192010 - DNA, 22 bp, Artificial Sequence
  chemically synthesized
acccttttttaaaaaaatataa

SEQ ID NO: 1192011 - DNA, 22 bp, Artificial Sequence
  chemically synthesized
ttatctgcttttatattttttt

SEQ ID NO: 1192012 - DNA, 22 bp, Artificial Sequence
  chemically synthesized
tctgcttttatatttttttaaa

SEQ ID NO: 1192013 - DNA, 22 bp, Artificial Sequence
  chemically synthesized
cttttatatttttttaaaaaag

SEQ ID NO: 1192014 - DNA, 22 bp, Artificial Sequence
  chemically synthesized
ttatatttttttaaaaaagggt

SEQ ID NO: 1192015 - DNA, 22 bp, Artificial Sequence
  chemically synthesized
gatatacagctaaccctttttt

SEQ ID NO: 1192016 - DNA, 22 bp, Artificial Sequence
  chemically synthesized
tatatttttttaaaaaagggtt

SEQ ID NO: 1192017 - DNA, 22 bp, Artificial Sequence
  chemically synthesized
cgatatacagctaacccttttt

SEQ ID NO: 1192018 - DNA, 22 bp, Artificial Sequence
  chemically synthesized
atatttttttaaaaaagggtta

SEQ ID NO: 1192019 - DNA, 22 bp, Artificial Sequence
  chemically synthesized
tatttttttaaaaaagggttag

SEQ ID NO: 1192020 - DNA, 22 bp, Artificial Sequence
  chemically synthesized
gagtttcgatatacagctaacc

SEQ ID NO: 1192021 - DNA, 22 bp, Artificial Sequence
  chemically synthesized
ttttaaaaaagggttagctgta

SEQ ID NO: 1192022 - DNA, 22 bp, Artificial Sequence
  chemically synthesized
agagtttcgatatacagctaac

SEQ ID NO: 1192023 - DNA, 22 bp, Artificial Sequence
  chemically synthesized
tttaaaaaagggttagctgtat

SEQ ID NO: 1192024 - DNA, 22 bp, Artificial Sequence
  chemically synthesized
ttaaaaaagggttagctgtata

SEQ ID NO: 1192025 - DNA, 22 bp, Artificial Sequence
  chemically synthesized
taaaaaagggttagctgtatat

SEQ ID NO: 1192026 - DNA, 22 bp, Artificial Sequence
  chemically synthesized
aaaaaagggttagctgtatatc

SEQ ID NO: 1192027 - DNA, 22 bp, Artificial Sequence
  chemically synthesized
aaaaagggttagctgtatatcg

SEQ ID NO: 1192028 - DNA, 22 bp, Artificial Sequence
  chemically synthesized
gctgtatatcgaaactctaaat

SEQ ID NO: 1192029 - DNA, 22 bp, Artificial Sequence
  chemically synthesized
tgtgggataaataaatttagag

SEQ ID NO: 1192030 - DNA, 22 bp, Artificial Sequence
  chemically synthesized
tatatcgaaactctaaatttat

SEQ ID NO: 1192031 - DNA, 22 bp, Artificial Sequence
  chemically synthesized
cagttatgtgggataaataaat

SEQ ID NO: 1192032 - DNA, 22 bp, Artificial Sequence
  chemically synthesized
gcagttatgtgggataaataaa

SEQ ID NO: 1192033 - DNA, 22 bp, Artificial Sequence
  chemically synthesized
taaatttatttatcccacataa

SEQ ID NO: 1192034 - DNA, 22 bp, Artificial Sequence
  chemically synthesized
aatttatttatcccacataact

SEQ ID NO: 1192035 - DNA, 22 bp, Artificial Sequence
  chemically synthesized
atttatcccacataactgcaag

SEQ ID NO: 1192036 - DNA, 22 bp, Artificial Sequence
  chemically synthesized
tttatcccacataactgcaagt

SEQ ID NO: 1192037 - DNA, 22 bp, Artificial Sequence
  chemically synthesized
atcccacataactgcaagtttc

SEQ ID NO: 1192038 - DNA, 22 bp, Artificial Sequence
  chemically synthesized
tcccacataactgcaagtttcc

SEQ ID NO: 1192039 - DNA, 22 bp, Artificial Sequence
  chemically synthesized
caagtttccatgtacacattga

SEQ ID NO: 1192040 - DNA, 22 bp, Artificial Sequence
  chemically synthesized
ccatgtacacattgacttattt

SEQ ID NO: 1192041 - DNA, 22 bp, Artificial Sequence
  chemically synthesized
catgtacacattgacttatttc

SEQ ID NO: 1192042 - DNA, 22 bp, Artificial Sequence
  chemically synthesized
ccaggagtagtgagggtgagga

SEQ ID NO: 1192043 - DNA, 22 bp, Artificial Sequence
  chemically synthesized
acttatttcctcaccctcacta

SEQ ID NO: 1192044 - DNA, 22 bp, Artificial Sequence
  chemically synthesized
atttcctcaccctcactactcc

SEQ ID NO: 1192045 - DNA, 22 bp, Artificial Sequence
  chemically synthesized
tttcctcaccctcactactcct

SEQ ID NO: 1192046 - DNA, 22 bp, Artificial Sequence
  chemically synthesized
cctcaccctcactactcctggt

SEQ ID NO: 1192047 - DNA, 22 bp, Artificial Sequence
  chemically synthesized
ctcaccctcactactcctggta

SEQ ID NO: 1192048 - DNA, 22 bp, Artificial Sequence
  chemically synthesized
accctcactactcctggtaatc

SEQ ID NO: 1192049 - DNA, 22 bp, Artificial Sequence
  chemically synthesized
actactcctggtaatcaccatt

SEQ ID NO: 1192050 - DNA, 22 bp, Artificial Sequence
  chemically synthesized
ctcctggtaatcaccattctac

SEQ ID NO: 1192051 - DNA, 22 bp, Artificial Sequence
  chemically synthesized
aatacatagacagtagaatggt

SEQ ID NO: 1192052 - DNA, 22 bp, Artificial Sequence
  chemically synthesized
ctggtaatcaccattctactgt

SEQ ID NO: 1192053 - DNA, 22 bp, Artificial Sequence
  chemically synthesized
gtaatcaccattctactgtcta

SEQ ID NO: 1192054 - DNA, 22 bp, Artificial Sequence
  chemically synthesized
aagaaaatgtataagttgaata

SEQ ID NO: 1192055 - DNA, 22 bp, Artificial Sequence
  chemically synthesized
tactgtctatgtattcaactta

SEQ ID NO: 1192056 - DNA, 22 bp, Artificial Sequence
  chemically synthesized
ctgtctatgtattcaacttata

SEQ ID NO: 1192057 - DNA, 22 bp, Artificial Sequence
  chemically synthesized
tctatgtattcaacttatacat

SEQ ID NO: 1192058 - DNA, 22 bp, Artificial Sequence
  chemically synthesized
aaatctgaagaaaatgtataag

SEQ ID NO: 1192059 - DNA, 22 bp, Artificial Sequence
  chemically synthesized
tgtattcaacttatacattttc

SEQ ID NO: 1192060 - DNA, 22 bp, Artificial Sequence
  chemically synthesized
acatctgaaatctgaagaaaat

SEQ ID NO: 1192061 - DNA, 22 bp, Artificial Sequence
  chemically synthesized
aacttatacattttcttcagat

SEQ ID NO: 1192062 - DNA, 22 bp, Artificial Sequence
  chemically synthesized
tctaacatctgaaatctgaaga

SEQ ID NO: 1192063 - DNA, 22 bp, Artificial Sequence
  chemically synthesized
atacattttcttcagatttcag

SEQ ID NO: 1192064 - DNA, 22 bp, Artificial Sequence
  chemically synthesized
tacattttcttcagatttcaga

SEQ ID NO: 1192065 - DNA, 22 bp, Artificial Sequence
  chemically synthesized
cgttatctaacatctgaaatct

SEQ ID NO: 1192066 - DNA, 22 bp, Artificial Sequence
  chemically synthesized
tcttcagatttcagatgttaga

SEQ ID NO: 1192067 - DNA, 22 bp, Artificial Sequence
  chemically synthesized
cttcagatttcagatgttagat

SEQ ID NO: 1192068 - DNA, 22 bp, Artificial Sequence
  chemically synthesized
ttcagatttcagatgttagata

SEQ ID NO: 1192069 - DNA, 22 bp, Artificial Sequence
  chemically synthesized
cagatttcagatgttagataac

SEQ ID NO: 1192070 - DNA, 22 bp, Artificial Sequence
  chemically synthesized
agatttcagatgttagataacg

SEQ ID NO: 1192071 - DNA, 22 bp, Artificial Sequence
  chemically synthesized
cagatgttagataacgtagcat

SEQ ID NO: 1192072 - DNA, 22 bp, Artificial Sequence
  chemically synthesized
agatgttagataacgtagcata

SEQ ID NO: 1192073 - DNA, 22 bp, Artificial Sequence
  chemically synthesized
gataacgtagcatatttttttc

SEQ ID NO: 1192074 - DNA, 22 bp, Artificial Sequence
  chemically synthesized
agtgaaataagcaagacacaga

SEQ ID NO: 1192075 - DNA, 22 bp, Artificial Sequence
  chemically synthesized
cactaagtgaaataagcaagac

SEQ ID NO: 1192076 - DNA, 22 bp, Artificial Sequence
  chemically synthesized
ttttctgtgtcttgcttatttc

SEQ ID NO: 1192077 - DNA, 22 bp, Artificial Sequence
  chemically synthesized
tttctgtgtcttgcttatttca

SEQ ID NO: 1192078 - DNA, 22 bp, Artificial Sequence
  chemically synthesized
ttctgtgtcttgcttatttcac

SEQ ID NO: 1192079 - DNA, 22 bp, Artificial Sequence
  chemically synthesized
tctgtgtcttgcttatttcact

SEQ ID NO: 1192080 - DNA, 22 bp, Artificial Sequence
  chemically synthesized
ctgtgtcttgcttatttcactt

SEQ ID NO: 1192081 - DNA, 22 bp, Artificial Sequence
  chemically synthesized
tgtgtcttgcttatttcactta

SEQ ID NO: 1192082 - DNA, 22 bp, Artificial Sequence
  chemically synthesized
aaggaaattacactaagtgaaa

SEQ ID NO: 1192083 - DNA, 22 bp, Artificial Sequence
  chemically synthesized
tgtcttgcttatttcacttagt

SEQ ID NO: 1192084 - DNA, 22 bp, Artificial Sequence
  chemically synthesized
gcttatttcacttagtgtaatt

SEQ ID NO: 1192085 - DNA, 22 bp, Artificial Sequence
  chemically synthesized
cttatttcacttagtgtaattt

SEQ ID NO: 1192086 - DNA, 22 bp, Artificial Sequence
  chemically synthesized
atttcacttagtgtaatttcct

SEQ ID NO: 1192087 - DNA, 22 bp, Artificial Sequence
  chemically synthesized
tttcacttagtgtaatttcctt

SEQ ID NO: 1192088 - DNA, 22 bp, Artificial Sequence
  chemically synthesized
cacttagtgtaatttccttcag

SEQ ID NO: 1192089 - DNA, 22 bp, Artificial Sequence
  chemically synthesized
acttagtgtaatttccttcagg

SEQ ID NO: 1192090 - DNA, 22 bp, Artificial Sequence
  chemically synthesized
agtgtaatttccttcaggctca

SEQ ID NO: 1192091 - DNA, 22 bp, Artificial Sequence
  chemically synthesized
taacaacataggtgagcctgaa

SEQ ID NO: 1192092 - DNA, 22 bp, Artificial Sequence
  chemically synthesized
gtgtaatttccttcaggctcac

SEQ ID NO: 1192093 - DNA, 22 bp, Artificial Sequence
  chemically synthesized
gtaacaacataggtgagcctga

SEQ ID NO: 1192094 - DNA, 22 bp, Artificial Sequence
  chemically synthesized
ccttcaggctcacctatgttgt

SEQ ID NO: 1192095 - DNA, 22 bp, Artificial Sequence
  chemically synthesized
cttcaggctcacctatgttgtt

SEQ ID NO: 1192096 - DNA, 22 bp, Artificial Sequence
  chemically synthesized
caggctcacctatgttgttaca

SEQ ID NO: 1192097 - DNA, 22 bp, Artificial Sequence
  chemically synthesized
aggctcacctatgttgttacaa

SEQ ID NO: 1192098 - DNA, 22 bp, Artificial Sequence
  chemically synthesized
acaaaagatagtgccatttgta

SEQ ID NO: 1192099 - DNA, 22 bp, Artificial Sequence
  chemically synthesized
acctatgttgttacaaatggca

SEQ ID NO: 1192100 - DNA, 22 bp, Artificial Sequence
  chemically synthesized
tgttgttacaaatggcactatc

SEQ ID NO: 1192101 - DNA, 22 bp, Artificial Sequence
  chemically synthesized
agcctcacaaaagatagtgcca

SEQ ID NO: 1192102 - DNA, 22 bp, Artificial Sequence
  chemically synthesized
ttacaaatggcactatcttttg

SEQ ID NO: 1192103 - DNA, 22 bp, Artificial Sequence
  chemically synthesized
caaatggcactatcttttgtga

SEQ ID NO: 1192104 - DNA, 22 bp, Artificial Sequence
  chemically synthesized
tcttttgtgaggctgaatattt

SEQ ID NO: 1192105 - DNA, 22 bp, Artificial Sequence
  chemically synthesized
ttgtgaggctgaatatttgtgt

SEQ ID NO: 1192106 - DNA, 22 bp, Artificial Sequence
  chemically synthesized
tgtgaggctgaatatttgtgtg

SEQ ID NO: 1192107 - DNA, 22 bp, Artificial Sequence
  chemically synthesized
gtgaggctgaatatttgtgtgt

SEQ ID NO: 1192108 - DNA, 22 bp, Artificial Sequence
  chemically synthesized
tgaggctgaatatttgtgtgtg

SEQ ID NO: 1192109 - DNA, 22 bp, Artificial Sequence
  chemically synthesized
tgacacacacacacacacacac

SEQ ID NO: 1192110 - DNA, 22 bp, Artificial Sequence
  chemically synthesized
aatatttgtgtgtgtgtgtgtg

SEQ ID NO: 1192111 - DNA, 22 bp, Artificial Sequence
  chemically synthesized
gtgtgtgtgtgtgtgtgtgtca

SEQ ID NO: 1192112 - DNA, 22 bp, Artificial Sequence
  chemically synthesized
tgtgtgtgtgtgtgtgtgtcac

SEQ ID NO: 1192113 - DNA, 22 bp, Artificial Sequence
  chemically synthesized
acagataaagaaattgtgacac

SEQ ID NO: 1192114 - DNA, 22 bp, Artificial Sequence
  chemically synthesized
agtgtccactgacagataaaga

SEQ ID NO: 1192115 - DNA, 22 bp, Artificial Sequence
  chemically synthesized
ctttatctgtcagtggacactc

SEQ ID NO: 1192116 - DNA, 22 bp, Artificial Sequence
  chemically synthesized
tttatctgtcagtggacactca

SEQ ID NO: 1192117 - DNA, 22 bp, Artificial Sequence
  chemically synthesized
tatctgtcagtggacactcagg

SEQ ID NO: 1192118 - DNA, 22 bp, Artificial Sequence
  chemically synthesized
atctgtcagtggacactcaggt

SEQ ID NO: 1192119 - DNA, 22 bp, Artificial Sequence
  chemically synthesized
tctgtcagtggacactcaggtt

SEQ ID NO: 1192120 - DNA, 22 bp, Artificial Sequence
  chemically synthesized
tcagtggacactcaggttattt

SEQ ID NO: 1192121 - DNA, 22 bp, Artificial Sequence
  chemically synthesized
ataatagccaagatatgaaaat

SEQ ID NO: 1192122 - DNA, 22 bp, Artificial Sequence
  chemically synthesized
tgattcataatagccaagatat

SEQ ID NO: 1192123 - DNA, 22 bp, Artificial Sequence
  chemically synthesized
aggttattttcatatcttggct

SEQ ID NO: 1192124 - DNA, 22 bp, Artificial Sequence
  chemically synthesized
cgttatgattcataatagccaa

SEQ ID NO: 1192125 - DNA, 22 bp, Artificial Sequence
  chemically synthesized
ttttcatatcttggctattatg

SEQ ID NO: 1192126 - DNA, 22 bp, Artificial Sequence
  chemically synthesized
attgcgttatgattcataatag

SEQ ID NO: 1192127 - DNA, 22 bp, Artificial Sequence
  chemically synthesized
tcatatcttggctattatgaat

SEQ ID NO: 1192128 - DNA, 22 bp, Artificial Sequence
  chemically synthesized
catatcttggctattatgaatc

SEQ ID NO: 1192129 - DNA, 22 bp, Artificial Sequence
  chemically synthesized
atatcttggctattatgaatca

SEQ ID NO: 1192130 - DNA, 22 bp, Artificial Sequence
  chemically synthesized
atgttcattgcgttatgattca

SEQ ID NO: 1192131 - DNA, 22 bp, Artificial Sequence
  chemically synthesized
tcatgttcattgcgttatgatt

SEQ ID NO: 1192132 - DNA, 22 bp, Artificial Sequence
  chemically synthesized
ggctattatgaatcataacgca

SEQ ID NO: 1192133 - DNA, 22 bp, Artificial Sequence
  chemically synthesized
gctattatgaatcataacgcaa

SEQ ID NO: 1192134 - DNA, 22 bp, Artificial Sequence
  chemically synthesized
ctctcatgttcattgcgttatg

SEQ ID NO: 1192135 - DNA, 22 bp, Artificial Sequence
  chemically synthesized
actctcatgttcattgcgttat

SEQ ID NO: 1192136 - DNA, 22 bp, Artificial Sequence
  chemically synthesized
ttatgaatcataacgcaatgaa

SEQ ID NO: 1192137 - DNA, 22 bp, Artificial Sequence
  chemically synthesized
tgaatcataacgcaatgaacat

SEQ ID NO: 1192138 - DNA, 22 bp, Artificial Sequence
  chemically synthesized
tggagatagccttactctcatg

SEQ ID NO: 1192139 - DNA, 22 bp, Artificial Sequence
  chemically synthesized
gtggagatagccttactctcat

SEQ ID NO: 1192140 - DNA, 22 bp, Artificial Sequence
  chemically synthesized
tctccacaaggttctgatttca

SEQ ID NO: 1192141 - DNA, 22 bp, Artificial Sequence
  chemically synthesized
cacaaggttctgatttcatttt

SEQ ID NO: 1192142 - DNA, 22 bp, Artificial Sequence
  chemically synthesized
ggtatagacccacagaaaatga

SEQ ID NO: 1192143 - DNA, 22 bp, Artificial Sequence
  chemically synthesized
ctgggtatagacccacagaaaa

SEQ ID NO: 1192144 - DNA, 22 bp, Artificial Sequence
  chemically synthesized
tgatttcattttctgtgggtct

SEQ ID NO: 1192145 - DNA, 22 bp, Artificial Sequence
  chemically synthesized
atttcattttctgtgggtctat

SEQ ID NO: 1192146 - DNA, 22 bp, Artificial Sequence
  chemically synthesized
cattttctgtgggtctataccc

SEQ ID NO: 1192147 - DNA, 22 bp, Artificial Sequence
  chemically synthesized
attttctgtgggtctataccca

SEQ ID NO: 1192148 - DNA, 22 bp, Artificial Sequence
  chemically synthesized
tctgtgggtctatacccaggag

SEQ ID NO: 1192149 - DNA, 22 bp, Artificial Sequence
  chemically synthesized
ctgtgggtctatacccaggagt

SEQ ID NO: 1192150 - DNA, 22 bp, Artificial Sequence
  chemically synthesized
tgtgggtctatacccaggagtg

SEQ ID NO: 1192151 - DNA, 22 bp, Artificial Sequence
  chemically synthesized
tgggtctatacccaggagtggg

SEQ ID NO: 1192152 - DNA, 22 bp, Artificial Sequence
  chemically synthesized
ccatatgacccaacaatcccac

SEQ ID NO: 1192153 - DNA, 22 bp, Artificial Sequence
  chemically synthesized
tacccaggagtgggattgttgg

SEQ ID NO: 1192154 - DNA, 22 bp, Artificial Sequence
  chemically synthesized
aaaatagaactaccatatgacc

SEQ ID NO: 1192155 - DNA, 22 bp, Artificial Sequence
  chemically synthesized
ttgggtcatatggtagttctat

SEQ ID NO: 1192156 - DNA, 22 bp, Artificial Sequence
  chemically synthesized
aaaaagttaaaaatagaactac

SEQ ID NO: 1192157 - DNA, 22 bp, Artificial Sequence
  chemically synthesized
ggtcatatggtagttctatttt

SEQ ID NO: 1192158 - DNA, 22 bp, Artificial Sequence
  chemically synthesized
ctcaaaaagttaaaaatagaac

SEQ ID NO: 1192159 - DNA, 22 bp, Artificial Sequence
  chemically synthesized
cctcaaaaagttaaaaatagaa

SEQ ID NO: 1192160 - DNA, 22 bp, Artificial Sequence
  chemically synthesized
ggagtgtttcctcaaaaagtta

SEQ ID NO: 1192161 - DNA, 22 bp, Artificial Sequence
  chemically synthesized
tctgggagtgtttcctcaaaaa

SEQ ID NO: 1192162 - DNA, 22 bp, Artificial Sequence
  chemically synthesized
tatttttaactttttgaggaaa

SEQ ID NO: 1192163 - DNA, 22 bp, Artificial Sequence
  chemically synthesized
tttttaactttttgaggaaaca

SEQ ID NO: 1192164 - DNA, 22 bp, Artificial Sequence
  chemically synthesized
ttaactttttgaggaaacactc

SEQ ID NO: 1192165 - DNA, 22 bp, Artificial Sequence
  chemically synthesized
taactttttgaggaaacactcc

SEQ ID NO: 1192166 - DNA, 22 bp, Artificial Sequence
  chemically synthesized
aactttttgaggaaacactccc

SEQ ID NO: 1192167 - DNA, 22 bp, Artificial Sequence
  chemically synthesized
actttttgaggaaacactccca

SEQ ID NO: 1192168 - DNA, 22 bp, Artificial Sequence
  chemically synthesized
tggaaaattgtctgggagtgtt

SEQ ID NO: 1192169 - DNA, 22 bp, Artificial Sequence
  chemically synthesized
tttgaggaaacactcccagaca

SEQ ID NO: 1192170 - DNA, 22 bp, Artificial Sequence
  chemically synthesized
ttgaggaaacactcccagacaa

SEQ ID NO: 1192171 - DNA, 22 bp, Artificial Sequence
  chemically synthesized
tgaggaaacactcccagacaat

SEQ ID NO: 1192172 - DNA, 22 bp, Artificial Sequence
  chemically synthesized
gaggaaacactcccagacaatt

SEQ ID NO: 1192173 - DNA, 22 bp, Artificial Sequence
  chemically synthesized
aggaaacactcccagacaattt

SEQ ID NO: 1192174 - DNA, 22 bp, Artificial Sequence
  chemically synthesized
gagcagacattatggaaaattg

SEQ ID NO: 1192175 - DNA, 22 bp, Artificial Sequence
  chemically synthesized
ccagacaattttccataatgtc

SEQ ID NO: 1192176 - DNA, 22 bp, Artificial Sequence
  chemically synthesized
gtgtcggtgtaaattagagcag

SEQ ID NO: 1192177 - DNA, 22 bp, Artificial Sequence
  chemically synthesized
tccataatgtctgctctaattt

SEQ ID NO: 1192178 - DNA, 22 bp, Artificial Sequence
  chemically synthesized
ccataatgtctgctctaattta

SEQ ID NO: 1192179 - DNA, 22 bp, Artificial Sequence
  chemically synthesized
ctggtgtcggtgtaaattagag

SEQ ID NO: 1192180 - DNA, 22 bp, Artificial Sequence
  chemically synthesized
cataatgtctgctctaatttac

SEQ ID NO: 1192181 - DNA, 22 bp, Artificial Sequence
  chemically synthesized
acatactgctggtgtcggtgta

SEQ ID NO: 1192182 - DNA, 22 bp, Artificial Sequence
  chemically synthesized
ctctaatttacaccgacaccag

SEQ ID NO: 1192183 - DNA, 22 bp, Artificial Sequence
  chemically synthesized
taatttacaccgacaccagcag

SEQ ID NO: 1192184 - DNA, 22 bp, Artificial Sequence
  chemically synthesized
atttacaccgacaccagcagta

SEQ ID NO: 1192185 - DNA, 22 bp, Artificial Sequence
  chemically synthesized
acaccgacaccagcagtatgtc

SEQ ID NO: 1192186 - DNA, 22 bp, Artificial Sequence
  chemically synthesized
caccgacaccagcagtatgtca

SEQ ID NO: 1192187 - DNA, 22 bp, Artificial Sequence
  chemically synthesized
cctttcctccttgcctttactg

SEQ ID NO: 1192188 - DNA, 22 bp, Artificial Sequence
  chemically synthesized
tcctccttgcctttactggcac

SEQ ID NO: 1192189 - DNA, 22 bp, Artificial Sequence
  chemically synthesized
cctccttgcctttactggcact

SEQ ID NO: 1192190 - DNA, 22 bp, Artificial Sequence
  chemically synthesized
ctccttgcctttactggcactt

SEQ ID NO: 1192191 - DNA, 22 bp, Artificial Sequence
  chemically synthesized
aaagatgagataacaagtgcca

SEQ ID NO: 1192192 - DNA, 22 bp, Artificial Sequence
  chemically synthesized
cttgcctttactggcacttgtt

SEQ ID NO: 1192193 - DNA, 22 bp, Artificial Sequence
  chemically synthesized
gcctttactggcacttgttatc

SEQ ID NO: 1192194 - DNA, 22 bp, Artificial Sequence
  chemically synthesized
tctaaaagatgagataacaagt

SEQ ID NO: 1192195 - DNA, 22 bp, Artificial Sequence
  chemically synthesized
cctttactggcacttgttatct

SEQ ID NO: 1192196 - DNA, 22 bp, Artificial Sequence
  chemically synthesized
tactggcacttgttatctcatc

SEQ ID NO: 1192197 - DNA, 22 bp, Artificial Sequence
  chemically synthesized
actggcacttgttatctcatct

SEQ ID NO: 1192198 - DNA, 22 bp, Artificial Sequence
  chemically synthesized
ctggcacttgttatctcatctt

SEQ ID NO: 1192199 - DNA, 22 bp, Artificial Sequence
  chemically synthesized
gcacttgttatctcatctttta

SEQ ID NO: 1192200 - DNA, 22 bp, Artificial Sequence
  chemically synthesized
ggatgagtattatctaaaagat

SEQ ID NO: 1192201 - DNA, 22 bp, Artificial Sequence
  chemically synthesized
ttaggatgagtattatctaaaa

SEQ ID NO: 1192202 - DNA, 22 bp, Artificial Sequence
  chemically synthesized
gttatctcatcttttagataat

SEQ ID NO: 1192203 - DNA, 22 bp, Artificial Sequence
  chemically synthesized
ttatctcatcttttagataata

SEQ ID NO: 1192204 - DNA, 22 bp, Artificial Sequence
  chemically synthesized
tctcatcttttagataatactc

SEQ ID NO: 1192205 - DNA, 22 bp, Artificial Sequence
  chemically synthesized
atacctgttaggatgagtatta

SEQ ID NO: 1192206 - DNA, 22 bp, Artificial Sequence
  chemically synthesized
catacctgttaggatgagtatt

SEQ ID NO: 1192207 - DNA, 22 bp, Artificial Sequence
  chemically synthesized
atcttttagataatactcatcc

SEQ ID NO: 1192208 - DNA, 22 bp, Artificial Sequence
  chemically synthesized
cttcatacctgttaggatgagt

SEQ ID NO: 1192209 - DNA, 22 bp, Artificial Sequence
  chemically synthesized
ttagataatactcatcctaaca

SEQ ID NO: 1192210 - DNA, 22 bp, Artificial Sequence
  chemically synthesized
tagataatactcatcctaacag

SEQ ID NO: 1192211 - DNA, 22 bp, Artificial Sequence
  chemically synthesized
agataatactcatcctaacagg

SEQ ID NO: 1192212 - DNA, 22 bp, Artificial Sequence
  chemically synthesized
gataatactcatcctaacaggt

SEQ ID NO: 1192213 - DNA, 22 bp, Artificial Sequence
  chemically synthesized
atcctaacaggtatgaagtaat

SEQ ID NO: 1192214 - DNA, 22 bp, Artificial Sequence
  chemically synthesized
acaggtatgaagtaatacctta

SEQ ID NO: 1192215 - DNA, 22 bp, Artificial Sequence
  chemically synthesized
gggaaatgcaaatcaaaatcat

SEQ ID NO: 1192216 - DNA, 22 bp, Artificial Sequence
  chemically synthesized
ttagggaaatgcaaatcaaaat

SEQ ID NO: 1192217 - DNA, 22 bp, Artificial Sequence
  chemically synthesized
attatgattttgatttgcattt

SEQ ID NO: 1192218 - DNA, 22 bp, Artificial Sequence
  chemically synthesized
ttatgattttgatttgcatttc

SEQ ID NO: 1192219 - DNA, 22 bp, Artificial Sequence
  chemically synthesized
tgattttgatttgcatttccct

SEQ ID NO: 1192220 - DNA, 22 bp, Artificial Sequence
  chemically synthesized
aatatcactattagggaaatgc

SEQ ID NO: 1192221 - DNA, 22 bp, Artificial Sequence
  chemically synthesized
tgatttgcatttccctaatagt

SEQ ID NO: 1192222 - DNA, 22 bp, Artificial Sequence
  chemically synthesized
gatttgcatttccctaatagtg

SEQ ID NO: 1192223 - DNA, 22 bp, Artificial Sequence
  chemically synthesized
atttgcatttccctaatagtga

SEQ ID NO: 1192224 - DNA, 22 bp, Artificial Sequence
  chemically synthesized
aaacgtgctcaatatcactatt

SEQ ID NO: 1192225 - DNA, 22 bp, Artificial Sequence
  chemically synthesized
gcatttccctaatagtgatatt

SEQ ID NO: 1192226 - DNA, 22 bp, Artificial Sequence
  chemically synthesized
catttccctaatagtgatattg

SEQ ID NO: 1192227 - DNA, 22 bp, Artificial Sequence
  chemically synthesized
ccctaatagtgatattgagcac

SEQ ID NO: 1192228 - DNA, 22 bp, Artificial Sequence
  chemically synthesized
cctaatagtgatattgagcacg

SEQ ID NO: 1192229 - DNA, 22 bp, Artificial Sequence
  chemically synthesized
atagtgatattgagcacgtttt

SEQ ID NO: 1192230 - DNA, 22 bp, Artificial Sequence
  chemically synthesized
agcacgttttaatttccctgtt

SEQ ID NO: 1192231 - DNA, 22 bp, Artificial Sequence
  chemically synthesized
taatttccctgttggccgtttg

SEQ ID NO: 1192232 - DNA, 22 bp, Artificial Sequence
  chemically synthesized
aaagaagatgtgcaaacggcca

SEQ ID NO: 1192233 - DNA, 22 bp, Artificial Sequence
  chemically synthesized
aatttccctgttggccgtttgc

SEQ ID NO: 1192234 - DNA, 22 bp, Artificial Sequence
  chemically synthesized
caaagaagatgtgcaaacggcc

SEQ ID NO: 1192235 - DNA, 22 bp, Artificial Sequence
  chemically synthesized
atttccctgttggccgtttgca

SEQ ID NO: 1192236 - DNA, 22 bp, Artificial Sequence
  chemically synthesized
tcaaagaagatgtgcaaacggc

SEQ ID NO: 1192237 - DNA, 22 bp, Artificial Sequence
  chemically synthesized
ttcaaagaagatgtgcaaacgg

SEQ ID NO: 1192238 - DNA, 22 bp, Artificial Sequence
  chemically synthesized
tttcaaagaagatgtgcaaacg

SEQ ID NO: 1192239 - DNA, 22 bp, Artificial Sequence
  chemically synthesized
ttttcaaagaagatgtgcaaac

SEQ ID NO: 1192240 - DNA, 22 bp, Artificial Sequence
  chemically synthesized
ccctgttggccgtttgcacatc

SEQ ID NO: 1192241 - DNA, 22 bp, Artificial Sequence
  chemically synthesized
tttttcaaagaagatgtgcaaa

SEQ ID NO: 1192242 - DNA, 22 bp, Artificial Sequence
  chemically synthesized
cctgttggccgtttgcacatct

SEQ ID NO: 1192243 - DNA, 22 bp, Artificial Sequence
  chemically synthesized
ttttttcaaagaagatgtgcaa

SEQ ID NO: 1192244 - DNA, 22 bp, Artificial Sequence
  chemically synthesized
tttttttcaaagaagatgtgca

SEQ ID NO: 1192245 - DNA, 22 bp, Artificial Sequence
  chemically synthesized
ttggccgtttgcacatcttctt

SEQ ID NO: 1192246 - DNA, 22 bp, Artificial Sequence
  chemically synthesized
gccgtttgcacatcttctttga

SEQ ID NO: 1192247 - DNA, 22 bp, Artificial Sequence
  chemically synthesized
aacattttttttttcaaagaag

SEQ ID NO: 1192248 - DNA, 22 bp, Artificial Sequence
  chemically synthesized
gaacattttttttttcaaagaa

SEQ ID NO: 1192249 - DNA, 22 bp, Artificial Sequence
  chemically synthesized
gcacatcttctttgaaaaaaaa

SEQ ID NO: 1192250 - DNA, 22 bp, Artificial Sequence
  chemically synthesized
cacatcttctttgaaaaaaaaa

SEQ ID NO: 1192251 - DNA, 22 bp, Artificial Sequence
  chemically synthesized
ggaaagaacttgaacatttttt

SEQ ID NO: 1192252 - DNA, 22 bp, Artificial Sequence
  chemically synthesized
ctttgaaaaaaaaaatgttcaa

SEQ ID NO: 1192253 - DNA, 22 bp, Artificial Sequence
  chemically synthesized
tttgaaaaaaaaaatgttcaag

SEQ ID NO: 1192254 - DNA, 22 bp, Artificial Sequence
  chemically synthesized
tgaaaaaaaaaatgttcaagtt

SEQ ID NO: 1192255 - DNA, 22 bp, Artificial Sequence
  chemically synthesized
gaaaaaaaaaatgttcaagttc

SEQ ID NO: 1192256 - DNA, 22 bp, Artificial Sequence
  chemically synthesized
aaaaaaaaaatgttcaagttct

SEQ ID NO: 1192257 - DNA, 22 bp, Artificial Sequence
  chemically synthesized
aaaaattgggaaagaacttgaa

SEQ ID NO: 1192258 - DNA, 22 bp, Artificial Sequence
  chemically synthesized
aataacccaattaaaaaattgg

SEQ ID NO: 1192259 - DNA, 22 bp, Artificial Sequence
  chemically synthesized
aagttctttcccaattttttaa

SEQ ID NO: 1192260 - DNA, 22 bp, Artificial Sequence
  chemically synthesized
tttcccaattttttaattgggt

SEQ ID NO: 1192261 - DNA, 22 bp, Artificial Sequence
  chemically synthesized
tcccaattttttaattgggtta

SEQ ID NO: 1192262 - DNA, 22 bp, Artificial Sequence
  chemically synthesized
cccaattttttaattgggttat

SEQ ID NO: 1192263 - DNA, 22 bp, Artificial Sequence
  chemically synthesized
ccaattttttaattgggttatt

SEQ ID NO: 1192264 - DNA, 22 bp, Artificial Sequence
  chemically synthesized
catagtgacaaactaaataacc

SEQ ID NO: 1192265 - DNA, 22 bp, Artificial Sequence
  chemically synthesized
tttaattgggttatttagtttg

SEQ ID NO: 1192266 - DNA, 22 bp, Artificial Sequence
  chemically synthesized
ttaattgggttatttagtttgt

SEQ ID NO: 1192267 - DNA, 22 bp, Artificial Sequence
  chemically synthesized
taattgggttatttagtttgtc

SEQ ID NO: 1192268 - DNA, 22 bp, Artificial Sequence
  chemically synthesized
aattgggttatttagtttgtca

SEQ ID NO: 1192269 - DNA, 22 bp, Artificial Sequence
  chemically synthesized
attgggttatttagtttgtcac

SEQ ID NO: 1192270 - DNA, 22 bp, Artificial Sequence
  chemically synthesized
cacaattccatagtgacaaact

SEQ ID NO: 1192271 - DNA, 22 bp, Artificial Sequence
  chemically synthesized
gcacaattccatagtgacaaac

SEQ ID NO: 1192272 - DNA, 22 bp, Artificial Sequence
  chemically synthesized
ggttatttagtttgtcactatg

SEQ ID NO: 1192273 - DNA, 22 bp, Artificial Sequence
  chemically synthesized
tttagtttgtcactatggaatt

SEQ ID NO: 1192274 - DNA, 22 bp, Artificial Sequence
  chemically synthesized
agtttgtcactatggaattgtg

SEQ ID NO: 1192275 - DNA, 22 bp, Artificial Sequence
  chemically synthesized
gtttgtcactatggaattgtgc

SEQ ID NO: 1192276 - DNA, 22 bp, Artificial Sequence
  chemically synthesized
gtcactatggaattgtgcaagt

SEQ ID NO: 1192277 - DNA, 22 bp, Artificial Sequence
  chemically synthesized
tcactatggaattgtgcaagtt

SEQ ID NO: 1192278 - DNA, 22 bp, Artificial Sequence
  chemically synthesized
tggaattgtgcaagttccttat

SEQ ID NO: 1192279 - DNA, 22 bp, Artificial Sequence
  chemically synthesized
atatccaaaatatataaggaac

SEQ ID NO: 1192280 - DNA, 22 bp, Artificial Sequence
  chemically synthesized
aatatccaaaatatataaggaa

SEQ ID NO: 1192281 - DNA, 22 bp, Artificial Sequence
  chemically synthesized
tgcaagttccttatatattttg

SEQ ID NO: 1192282 - DNA, 22 bp, Artificial Sequence
  chemically synthesized
ataagggtttaatatccaaaat

SEQ ID NO: 1192283 - DNA, 22 bp, Artificial Sequence
  chemically synthesized
cttatatattttggatattaaa

SEQ ID NO: 1192284 - DNA, 22 bp, Artificial Sequence
  chemically synthesized
atatattttggatattaaaccc

SEQ ID NO: 1192285 - DNA, 22 bp, Artificial Sequence
  chemically synthesized
tatattttggatattaaaccct

SEQ ID NO: 1192286 - DNA, 22 bp, Artificial Sequence
  chemically synthesized
caaaacatatatctgataaggg

SEQ ID NO: 1192287 - DNA, 22 bp, Artificial Sequence
  chemically synthesized
tggatattaaacccttatcaga

SEQ ID NO: 1192288 - DNA, 22 bp, Artificial Sequence
  chemically synthesized
gcaaaacatatatctgataagg

SEQ ID NO: 1192289 - DNA, 22 bp, Artificial Sequence
  chemically synthesized
ggatattaaacccttatcagat

SEQ ID NO: 1192290 - DNA, 22 bp, Artificial Sequence
  chemically synthesized
gatattaaacccttatcagata

SEQ ID NO: 1192291 - DNA, 22 bp, Artificial Sequence
  chemically synthesized
aacccttatcagatatatgttt

SEQ ID NO: 1192292 - DNA, 22 bp, Artificial Sequence
  chemically synthesized
tgagtagatatttgcaaaacat

SEQ ID NO: 1192293 - DNA, 22 bp, Artificial Sequence
  chemically synthesized
atcagatatatgttttgcaaat

SEQ ID NO: 1192294 - DNA, 22 bp, Artificial Sequence
  chemically synthesized
tcagatatatgttttgcaaata

SEQ ID NO: 1192295 - DNA, 22 bp, Artificial Sequence
  chemically synthesized
cagattatgagtagatatttgc

SEQ ID NO: 1192296 - DNA, 22 bp, Artificial Sequence
  chemically synthesized
tgcaaatatctactcataatct

SEQ ID NO: 1192297 - DNA, 22 bp, Artificial Sequence
  chemically synthesized
gcaaatatctactcataatctg

SEQ ID NO: 1192298 - DNA, 22 bp, Artificial Sequence
  chemically synthesized
caaatatctactcataatctgt

SEQ ID NO: 1192299 - DNA, 22 bp, Artificial Sequence
  chemically synthesized
ctcataatctgtaggctgtgtt

SEQ ID NO: 1192300 - DNA, 22 bp, Artificial Sequence
  chemically synthesized
gaaagcaaaagaaaaacacagc

SEQ ID NO: 1192301 - DNA, 22 bp, Artificial Sequence
  chemically synthesized
ataatctgtaggctgtgttttt

SEQ ID NO: 1192302 - DNA, 22 bp, Artificial Sequence
  chemically synthesized
tggaaagcaaaagaaaaacaca

SEQ ID NO: 1192303 - DNA, 22 bp, Artificial Sequence
  chemically synthesized
ctggaaagcaaaagaaaaacac

SEQ ID NO: 1192304 - DNA, 22 bp, Artificial Sequence
  chemically synthesized
taggctgtgtttttcttttgct

SEQ ID NO: 1192305 - DNA, 22 bp, Artificial Sequence
  chemically synthesized
aaaagcttctggaaagcaaaag

SEQ ID NO: 1192306 - DNA, 22 bp, Artificial Sequence
  chemically synthesized
tgtttttcttttgctttccaga

SEQ ID NO: 1192307 - DNA, 22 bp, Artificial Sequence
  chemically synthesized
atctaaaaagcttctggaaagc

SEQ ID NO: 1192308 - DNA, 22 bp, Artificial Sequence
  chemically synthesized
ttcttttgctttccagaagctt

SEQ ID NO: 1192309 - DNA, 22 bp, Artificial Sequence
  chemically synthesized
cattaatctaaaaagcttctgg

SEQ ID NO: 1192310 - DNA, 22 bp, Artificial Sequence
  chemically synthesized
tcttttgctttccagaagcttt

SEQ ID NO: 1192311 - DNA, 22 bp, Artificial Sequence
  chemically synthesized
cttttgctttccagaagctttt

SEQ ID NO: 1192312 - DNA, 22 bp, Artificial Sequence
  chemically synthesized
ttttgctttccagaagcttttt

SEQ ID NO: 1192313 - DNA, 22 bp, Artificial Sequence
  chemically synthesized
ttgctttccagaagctttttag

SEQ ID NO: 1192314 - DNA, 22 bp, Artificial Sequence
  chemically synthesized
tgctttccagaagctttttaga

SEQ ID NO: 1192315 - DNA, 22 bp, Artificial Sequence
  chemically synthesized
gctttccagaagctttttagat

SEQ ID NO: 1192316 - DNA, 22 bp, Artificial Sequence
  chemically synthesized
ctttccagaagctttttagatt

SEQ ID NO: 1192317 - DNA, 22 bp, Artificial Sequence
  chemically synthesized
gtggaactacattaatctaaaa

SEQ ID NO: 1192318 - DNA, 22 bp, Artificial Sequence
  chemically synthesized
tccagaagctttttagattaat

SEQ ID NO: 1192319 - DNA, 22 bp, Artificial Sequence
  chemically synthesized
ccagaagctttttagattaatg

SEQ ID NO: 1192320 - DNA, 22 bp, Artificial Sequence
  chemically synthesized
cagaagctttttagattaatgt

SEQ ID NO: 1192321 - DNA, 22 bp, Artificial Sequence
  chemically synthesized
tttagattaatgtagttccact

SEQ ID NO: 1192322 - DNA, 22 bp, Artificial Sequence
  chemically synthesized
ttagattaatgtagttccacta

SEQ ID NO: 1192323 - DNA, 22 bp, Artificial Sequence
  chemically synthesized
tagattaatgtagttccactag

SEQ ID NO: 1192324 - DNA, 22 bp, Artificial Sequence
  chemically synthesized
agattaatgtagttccactagt

SEQ ID NO: 1192325 - DNA, 22 bp, Artificial Sequence
  chemically synthesized
gattaatgtagttccactagtt

SEQ ID NO: 1192326 - DNA, 22 bp, Artificial Sequence
  chemically synthesized
atgtagttccactagtttattt

SEQ ID NO: 1192327 - DNA, 22 bp, Artificial Sequence
  chemically synthesized
aggcaagaaaacaaaaataaac

SEQ ID NO: 1192328 - DNA, 22 bp, Artificial Sequence
  chemically synthesized
caggcaagaaaacaaaaataaa

SEQ ID NO: 1192329 - DNA, 22 bp, Artificial Sequence
  chemically synthesized
cactagtttatttttgttttct

SEQ ID NO: 1192330 - DNA, 22 bp, Artificial Sequence
  chemically synthesized
gtttatttttgttttcttgcct

SEQ ID NO: 1192331 - DNA, 22 bp, Artificial Sequence
  chemically synthesized
atttttgttttcttgcctgaaa

SEQ ID NO: 1192332 - DNA, 22 bp, Artificial Sequence
  chemically synthesized
tttttgttttcttgcctgaaat

SEQ ID NO: 1192333 - DNA, 22 bp, Artificial Sequence
  chemically synthesized
aatatcacatcaaaatttcagg

SEQ ID NO: 1192334 - DNA, 22 bp, Artificial Sequence
  chemically synthesized
ttgttttcttgcctgaaatttt

SEQ ID NO: 1192335 - DNA, 22 bp, Artificial Sequence
  chemically synthesized
gaatatcacatcaaaatttcag

SEQ ID NO: 1192336 - DNA, 22 bp, Artificial Sequence
  chemically synthesized
tgttttcttgcctgaaattttg

SEQ ID NO: 1192337 - DNA, 22 bp, Artificial Sequence
  chemically synthesized
tgaatatcacatcaaaatttca

SEQ ID NO: 1192338 - DNA, 22 bp, Artificial Sequence
  chemically synthesized
gttttcttgcctgaaattttga

SEQ ID NO: 1192339 - DNA, 22 bp, Artificial Sequence
  chemically synthesized
ttgaatatcacatcaaaatttc

SEQ ID NO: 1192340 - DNA, 22 bp, Artificial Sequence
  chemically synthesized
ttttcttgcctgaaattttgat

SEQ ID NO: 1192341 - DNA, 22 bp, Artificial Sequence
  chemically synthesized
tttgaatatcacatcaaaattt

SEQ ID NO: 1192342 - DNA, 22 bp, Artificial Sequence
  chemically synthesized
tcttgcctgaaattttgatgtg

SEQ ID NO: 1192343 - DNA, 22 bp, Artificial Sequence
  chemically synthesized
cttgcctgaaattttgatgtga

SEQ ID NO: 1192344 - DNA, 22 bp, Artificial Sequence
  chemically synthesized
ttgcctgaaattttgatgtgat

SEQ ID NO: 1192345 - DNA, 22 bp, Artificial Sequence
  chemically synthesized
gcctgaaattttgatgtgatat

SEQ ID NO: 1192346 - DNA, 22 bp, Artificial Sequence
  chemically synthesized
cctgaaattttgatgtgatatt

SEQ ID NO: 1192347 - DNA, 22 bp, Artificial Sequence
  chemically synthesized
caaggattttttgaatatcaca

SEQ ID NO: 1192348 - DNA, 22 bp, Artificial Sequence
  chemically synthesized
gcaaggattttttgaatatcac

SEQ ID NO: 1192349 - DNA, 22 bp, Artificial Sequence
  chemically synthesized
tgcaaggattttttgaatatca

SEQ ID NO: 1192350 - DNA, 22 bp, Artificial Sequence
  chemically synthesized
aaattttgatgtgatattcaaa

SEQ ID NO: 1192351 - DNA, 22 bp, Artificial Sequence
  chemically synthesized
tgatgtgatattcaaaaaatcc

SEQ ID NO: 1192352 - DNA, 22 bp, Artificial Sequence
  chemically synthesized
gatgtgatattcaaaaaatcct

SEQ ID NO: 1192353 - DNA, 22 bp, Artificial Sequence
  chemically synthesized
atgtgatattcaaaaaatcctt

SEQ ID NO: 1192354 - DNA, 22 bp, Artificial Sequence
  chemically synthesized
acagtcgcctttgcaaggattt

SEQ ID NO: 1192355 - DNA, 22 bp, Artificial Sequence
  chemically synthesized
tgacagtcgcctttgcaaggat

SEQ ID NO: 1192356 - DNA, 22 bp, Artificial Sequence
  chemically synthesized
tctgacagtcgcctttgcaagg

SEQ ID NO: 1192357 - DNA, 22 bp, Artificial Sequence
  chemically synthesized
aaaaaatccttgcaaaggcgac

SEQ ID NO: 1192358 - DNA, 22 bp, Artificial Sequence
  chemically synthesized
gcaaaggcgactgtcagagagc

SEQ ID NO: 1192359 - DNA, 22 bp, Artificial Sequence
  chemically synthesized
caaaggcgactgtcagagagct

SEQ ID NO: 1192360 - DNA, 22 bp, Artificial Sequence
  chemically synthesized
gaagaaaacagagaggaaaaag

SEQ ID NO: 1192361 - DNA, 22 bp, Artificial Sequence
  chemically synthesized
ctagaagaaaacagagaggaaa

SEQ ID NO: 1192362 - DNA, 22 bp, Artificial Sequence
  chemically synthesized
tcagagagctttttcctctctg

SEQ ID NO: 1192363 - DNA, 22 bp, Artificial Sequence
  chemically synthesized
tttcctctctgttttcttctag

SEQ ID NO: 1192364 - DNA, 22 bp, Artificial Sequence
  chemically synthesized
ttcctctctgttttcttctagg

SEQ ID NO: 1192365 - DNA, 22 bp, Artificial Sequence
  chemically synthesized
tcctctctgttttcttctagga

SEQ ID NO: 1192366 - DNA, 22 bp, Artificial Sequence
  chemically synthesized
aaatcataagactcctagaaga

SEQ ID NO: 1192367 - DNA, 22 bp, Artificial Sequence
  chemically synthesized
cctctctgttttcttctaggag

SEQ ID NO: 1192368 - DNA, 22 bp, Artificial Sequence
  chemically synthesized
ctctctgttttcttctaggagt

SEQ ID NO: 1192369 - DNA, 22 bp, Artificial Sequence
  chemically synthesized
tctgttttcttctaggagtctt

SEQ ID NO: 1192370 - DNA, 22 bp, Artificial Sequence
  chemically synthesized
tgttttcttctaggagtcttat

SEQ ID NO: 1192371 - DNA, 22 bp, Artificial Sequence
  chemically synthesized
ttttcttctaggagtcttatga

SEQ ID NO: 1192372 - DNA, 22 bp, Artificial Sequence
  chemically synthesized
tcttctaggagtcttatgattt

SEQ ID NO: 1192373 - DNA, 22 bp, Artificial Sequence
  chemically synthesized
cttctaggagtcttatgatttt

SEQ ID NO: 1192374 - DNA, 22 bp, Artificial Sequence
  chemically synthesized
aatataagacctaaaatcataa

SEQ ID NO: 1192375 - DNA, 22 bp, Artificial Sequence
  chemically synthesized
ttctaggagtcttatgatttta

SEQ ID NO: 1192376 - DNA, 22 bp, Artificial Sequence
  chemically synthesized
aaatataagacctaaaatcata

SEQ ID NO: 1192377 - DNA, 22 bp, Artificial Sequence
  chemically synthesized
ctaggagtcttatgattttagg

SEQ ID NO: 1192378 - DNA, 22 bp, Artificial Sequence
  chemically synthesized
taggagtcttatgattttaggt

SEQ ID NO: 1192379 - DNA, 22 bp, Artificial Sequence
  chemically synthesized
ggagtcttatgattttaggtct

SEQ ID NO: 1192380 - DNA, 22 bp, Artificial Sequence
  chemically synthesized
aagacttaaatataagacctaa

SEQ ID NO: 1192381 - DNA, 22 bp, Artificial Sequence
  chemically synthesized
atgattttaggtcttatattta

SEQ ID NO: 1192382 - DNA, 22 bp, Artificial Sequence
  chemically synthesized
tgattttaggtcttatatttaa

SEQ ID NO: 1192383 - DNA, 22 bp, Artificial Sequence
  chemically synthesized
taggtcttatatttaagtcttt

SEQ ID NO: 1192384 - DNA, 22 bp, Artificial Sequence
  chemically synthesized
aggtcttatatttaagtcttta

SEQ ID NO: 1192385 - DNA, 22 bp, Artificial Sequence
  chemically synthesized
ggtcttatatttaagtctttag

SEQ ID NO: 1192386 - DNA, 22 bp, Artificial Sequence
  chemically synthesized
agtgaaaatggactaaagactt

SEQ ID NO: 1192387 - DNA, 22 bp, Artificial Sequence
  chemically synthesized
atatttaagtctttagtccatt

SEQ ID NO: 1192388 - DNA, 22 bp, Artificial Sequence
  chemically synthesized
tatttaagtctttagtccattt

SEQ ID NO: 1192389 - DNA, 22 bp, Artificial Sequence
  chemically synthesized
aagtctttagtccattttcact

SEQ ID NO: 1192390 - DNA, 22 bp, Artificial Sequence
  chemically synthesized
agtctttagtccattttcactt

SEQ ID NO: 1192391 - DNA, 22 bp, Artificial Sequence
  chemically synthesized
tacacaaaaattaagtgaaaat

SEQ ID NO: 1192392 - DNA, 22 bp, Artificial Sequence
  chemically synthesized
tactgtacacaaaaattaagtg

SEQ ID NO: 1192393 - DNA, 22 bp, Artificial Sequence
  chemically synthesized
tagtccattttcacttaatttt

SEQ ID NO: 1192394 - DNA, 22 bp, Artificial Sequence
  chemically synthesized
atactgtacacaaaaattaagt

SEQ ID NO: 1192395 - DNA, 22 bp, Artificial Sequence
  chemically synthesized
agtccattttcacttaattttt

SEQ ID NO: 1192396 - DNA, 22 bp, Artificial Sequence
  chemically synthesized
gtccattttcacttaatttttg

SEQ ID NO: 1192397 - DNA, 22 bp, Artificial Sequence
  chemically synthesized
tcttatactgtacacaaaaatt

SEQ ID NO: 1192398 - DNA, 22 bp, Artificial Sequence
  chemically synthesized
gtcttatactgtacacaaaaat

SEQ ID NO: 1192399 - DNA, 22 bp, Artificial Sequence
  chemically synthesized
tcacttaatttttgtgtacagt

SEQ ID NO: 1192400 - DNA, 22 bp, Artificial Sequence
  chemically synthesized
cacttaatttttgtgtacagta

SEQ ID NO: 1192401 - DNA, 22 bp, Artificial Sequence
  chemically synthesized
acttaatttttgtgtacagtat

SEQ ID NO: 1192402 - DNA, 22 bp, Artificial Sequence
  chemically synthesized
tacccttgtcttatactgtaca

SEQ ID NO: 1192403 - DNA, 22 bp, Artificial Sequence
  chemically synthesized
aatttttgtgtacagtataaga

SEQ ID NO: 1192404 - DNA, 22 bp, Artificial Sequence
  chemically synthesized
atttttgtgtacagtataagac

SEQ ID NO: 1192405 - DNA, 22 bp, Artificial Sequence
  chemically synthesized
taaattgtacccttgtcttata

SEQ ID NO: 1192406 - DNA, 22 bp, Artificial Sequence
  chemically synthesized
ttgtgtacagtataagacaagg

SEQ ID NO: 1192407 - DNA, 22 bp, Artificial Sequence
  chemically synthesized
tgtgtacagtataagacaaggg

SEQ ID NO: 1192408 - DNA, 22 bp, Artificial Sequence
  chemically synthesized
gtgtacagtataagacaagggt

SEQ ID NO: 1192409 - DNA, 22 bp, Artificial Sequence
  chemically synthesized
tgtacagtataagacaagggta

SEQ ID NO: 1192410 - DNA, 22 bp, Artificial Sequence
  chemically synthesized
aataaatggtgttgtaaattgt

SEQ ID NO: 1192411 - DNA, 22 bp, Artificial Sequence
  chemically synthesized
caataaatggtgttgtaaattg

SEQ ID NO: 1192412 - DNA, 22 bp, Artificial Sequence
  chemically synthesized
ttcaataaatggtgttgtaaat

SEQ ID NO: 1192413 - DNA, 22 bp, Artificial Sequence
  chemically synthesized
acaacaccatttattgaagaga

SEQ ID NO: 1192414 - DNA, 22 bp, Artificial Sequence
  chemically synthesized
caacaccatttattgaagagac

SEQ ID NO: 1192415 - DNA, 22 bp, Artificial Sequence
  chemically synthesized
attgaagagactgtcctttccc

SEQ ID NO: 1192416 - DNA, 22 bp, Artificial Sequence
  chemically synthesized
ttgaagagactgtcctttcccc

SEQ ID NO: 1192417 - DNA, 22 bp, Artificial Sequence
  chemically synthesized
aagagactgtcctttccccaca

SEQ ID NO: 1192418 - DNA, 22 bp, Artificial Sequence
  chemically synthesized
tcctttccccacatatcttctt

SEQ ID NO: 1192419 - DNA, 22 bp, Artificial Sequence
  chemically synthesized
gacaggaccaccaagaagatat

SEQ ID NO: 1192420 - DNA, 22 bp, Artificial Sequence
  chemically synthesized
ggacaggaccaccaagaagata

SEQ ID NO: 1192421 - DNA, 22 bp, Artificial Sequence
  chemically synthesized
tggacaggaccaccaagaagat

SEQ ID NO: 1192422 - DNA, 22 bp, Artificial Sequence
  chemically synthesized
tccccacatatcttcttggtgg

SEQ ID NO: 1192423 - DNA, 22 bp, Artificial Sequence
  chemically synthesized
ccccacatatcttcttggtggt

SEQ ID NO: 1192424 - DNA, 22 bp, Artificial Sequence
  chemically synthesized
attttggacaggaccaccaaga

SEQ ID NO: 1192425 - DNA, 22 bp, Artificial Sequence
  chemically synthesized
cccacatatcttcttggtggtc

SEQ ID NO: 1192426 - DNA, 22 bp, Artificial Sequence
  chemically synthesized
tataatcaactaattttggaca

SEQ ID NO: 1192427 - DNA, 22 bp, Artificial Sequence
  chemically synthesized
cttggtggtcctgtccaaaatt

SEQ ID NO: 1192428 - DNA, 22 bp, Artificial Sequence
  chemically synthesized
ttggtggtcctgtccaaaatta

SEQ ID NO: 1192429 - DNA, 22 bp, Artificial Sequence
  chemically synthesized
ggtggtcctgtccaaaattagt

SEQ ID NO: 1192430 - DNA, 22 bp, Artificial Sequence
  chemically synthesized
gtggtcctgtccaaaattagtt

SEQ ID NO: 1192431 - DNA, 22 bp, Artificial Sequence
  chemically synthesized
agcctatataatcaactaattt

SEQ ID NO: 1192432 - DNA, 22 bp, Artificial Sequence
  chemically synthesized
tccaaaattagttgattatata

SEQ ID NO: 1192433 - DNA, 22 bp, Artificial Sequence
  chemically synthesized
acaaataaacctaagcctatat

SEQ ID NO: 1192434 - DNA, 22 bp, Artificial Sequence
  chemically synthesized
gttgattatataggcttaggtt

SEQ ID NO: 1192435 - DNA, 22 bp, Artificial Sequence
  chemically synthesized
attatataggcttaggtttatt

SEQ ID NO: 1192436 - DNA, 22 bp, Artificial Sequence
  chemically synthesized
tataggcttaggtttatttgtg

SEQ ID NO: 1192437 - DNA, 22 bp, Artificial Sequence
  chemically synthesized
atggaacagaatagagatctca

SEQ ID NO: 1192438 - DNA, 22 bp, Artificial Sequence
  chemically synthesized
aggtttatttgtgagatctcta

SEQ ID NO: 1192439 - DNA, 22 bp, Artificial Sequence
  chemically synthesized
ggtttatttgtgagatctctat

SEQ ID NO: 1192440 - DNA, 22 bp, Artificial Sequence
  chemically synthesized
atttgtgagatctctattctgt

SEQ ID NO: 1192441 - DNA, 22 bp, Artificial Sequence
  chemically synthesized
tttgtgagatctctattctgtt

SEQ ID NO: 1192442 - DNA, 22 bp, Artificial Sequence
  chemically synthesized
gtgagatctctattctgttcca

SEQ ID NO: 1192443 - DNA, 22 bp, Artificial Sequence
  chemically synthesized
tgagatctctattctgttccat

SEQ ID NO: 1192444 - DNA, 22 bp, Artificial Sequence
  chemically synthesized
tattctgttccatcagtttatg

SEQ ID NO: 1192445 - DNA, 22 bp, Artificial Sequence
  chemically synthesized
ttctgttccatcagtttatgtg

SEQ ID NO: 1192446 - DNA, 22 bp, Artificial Sequence
  chemically synthesized
tgttccatcagtttatgtgtct

SEQ ID NO: 1192447 - DNA, 22 bp, Artificial Sequence
  chemically synthesized
ttccatcagtttatgtgtctgt

SEQ ID NO: 1192448 - DNA, 22 bp, Artificial Sequence
  chemically synthesized
taatgccataaaaacagacaca

SEQ ID NO: 1192449 - DNA, 22 bp, Artificial Sequence
  chemically synthesized
catcagtttatgtgtctgtttt

SEQ ID NO: 1192450 - DNA, 22 bp, Artificial Sequence
  chemically synthesized
atgtgtctgtttttatggcatt

SEQ ID NO: 1192451 - DNA, 22 bp, Artificial Sequence
  chemically synthesized
tgtgtctgtttttatggcatta

SEQ ID NO: 1192452 - DNA, 22 bp, Artificial Sequence
  chemically synthesized
aaaagagtattgtaatgccata

SEQ ID NO: 1192453 - DNA, 22 bp, Artificial Sequence
  chemically synthesized
tttttatggcattacaatactc

SEQ ID NO: 1192454 - DNA, 22 bp, Artificial Sequence
  chemically synthesized
cagtattaaaaagagtattgta

SEQ ID NO: 1192455 - DNA, 22 bp, Artificial Sequence
  chemically synthesized
ttatggcattacaatactcttt

SEQ ID NO: 1192456 - DNA, 22 bp, Artificial Sequence
  chemically synthesized
tatggcattacaatactctttt

SEQ ID NO: 1192457 - DNA, 22 bp, Artificial Sequence
  chemically synthesized
atggcattacaatactcttttt

SEQ ID NO: 1192458 - DNA, 22 bp, Artificial Sequence
  chemically synthesized
tggcattacaatactcttttta

SEQ ID NO: 1192459 - DNA, 22 bp, Artificial Sequence
  chemically synthesized
tatcataaatctacagtattaa

SEQ ID NO: 1192460 - DNA, 22 bp, Artificial Sequence
  chemically synthesized
caatactctttttaatactgta

SEQ ID NO: 1192461 - DNA, 22 bp, Artificial Sequence
  chemically synthesized
aaattatatcataaatctacag

SEQ ID NO: 1192462 - DNA, 22 bp, Artificial Sequence
  chemically synthesized
gaaattatatcataaatctaca

SEQ ID NO: 1192463 - DNA, 22 bp, Artificial Sequence
  chemically synthesized
tttttaatactgtagatttatg

SEQ ID NO: 1192464 - DNA, 22 bp, Artificial Sequence
  chemically synthesized
tttaatactgtagatttatgat

SEQ ID NO: 1192465 - DNA, 22 bp, Artificial Sequence
  chemically synthesized
ttaatactgtagatttatgata

SEQ ID NO: 1192466 - DNA, 22 bp, Artificial Sequence
  chemically synthesized
gatttgaaattatatcataaat

SEQ ID NO: 1192467 - DNA, 22 bp, Artificial Sequence
  chemically synthesized
taatactgtagatttatgatat

SEQ ID NO: 1192468 - DNA, 22 bp, Artificial Sequence
  chemically synthesized
ggatttgaaattatatcataaa

SEQ ID NO: 1192469 - DNA, 22 bp, Artificial Sequence
  chemically synthesized
aatactgtagatttatgatata

SEQ ID NO: 1192470 - DNA, 22 bp, Artificial Sequence
  chemically synthesized
tggatttgaaattatatcataa

SEQ ID NO: 1192471 - DNA, 22 bp, Artificial Sequence
  chemically synthesized
atactgtagatttatgatataa

SEQ ID NO: 1192472 - DNA, 22 bp, Artificial Sequence
  chemically synthesized
tttggatttgaaattatatcat

SEQ ID NO: 1192473 - DNA, 22 bp, Artificial Sequence
  chemically synthesized
ctctttggatttgaaattatat

SEQ ID NO: 1192474 - DNA, 22 bp, Artificial Sequence
  chemically synthesized
tagatttatgatataatttcaa

SEQ ID NO: 1192475 - DNA, 22 bp, Artificial Sequence
  chemically synthesized
atgatataatttcaaatccaaa

SEQ ID NO: 1192476 - DNA, 22 bp, Artificial Sequence
  chemically synthesized
gaaatactgctctttggatttg

SEQ ID NO: 1192477 - DNA, 22 bp, Artificial Sequence
  chemically synthesized
tgatataatttcaaatccaaag

SEQ ID NO: 1192478 - DNA, 22 bp, Artificial Sequence
  chemically synthesized
caaatccaaagagcagtatttc

SEQ ID NO: 1192479 - DNA, 22 bp, Artificial Sequence
  chemically synthesized
aaatccaaagagcagtatttcc

SEQ ID NO: 1192480 - DNA, 22 bp, Artificial Sequence
  chemically synthesized
aggaaaaaaaagttggaaatac

SEQ ID NO: 1192481 - DNA, 22 bp, Artificial Sequence
  chemically synthesized
gaggaaaaaaaagttggaaata

SEQ ID NO: 1192482 - DNA, 22 bp, Artificial Sequence
  chemically synthesized
ccaacttttttttcctcaagat

SEQ ID NO: 1192483 - DNA, 22 bp, Artificial Sequence
  chemically synthesized
caacttttttttcctcaagatt

SEQ ID NO: 1192484 - DNA, 22 bp, Artificial Sequence
  chemically synthesized
ttttttcctcaagattgttctg

SEQ ID NO: 1192485 - DNA, 22 bp, Artificial Sequence
  chemically synthesized
tttttcctcaagattgttctgg

SEQ ID NO: 1192486 - DNA, 22 bp, Artificial Sequence
  chemically synthesized
ttttcctcaagattgttctggc

SEQ ID NO: 1192487 - DNA, 22 bp, Artificial Sequence
  chemically synthesized
tttcctcaagattgttctggct

SEQ ID NO: 1192488 - DNA, 22 bp, Artificial Sequence
  chemically synthesized
ttcctcaagattgttctggcta

SEQ ID NO: 1192489 - DNA, 22 bp, Artificial Sequence
  chemically synthesized
tcctcaagattgttctggctat

SEQ ID NO: 1192490 - DNA, 22 bp, Artificial Sequence
  chemically synthesized
cctcaagattgttctggctatt

SEQ ID NO: 1192491 - DNA, 22 bp, Artificial Sequence
  chemically synthesized
catgaaatcccaaatagccaga

SEQ ID NO: 1192492 - DNA, 22 bp, Artificial Sequence
  chemically synthesized
ctcaagattgttctggctattt

SEQ ID NO: 1192493 - DNA, 22 bp, Artificial Sequence
  chemically synthesized
acatgaaatcccaaatagccag

SEQ ID NO: 1192494 - DNA, 22 bp, Artificial Sequence
  chemically synthesized
aagattgttctggctatttggg

SEQ ID NO: 1192495 - DNA, 22 bp, Artificial Sequence
  chemically synthesized
taaaacttacatgaaatcccaa

SEQ ID NO: 1192496 - DNA, 22 bp, Artificial Sequence
  chemically synthesized
ttctggctatttgggatttcat

SEQ ID NO: 1192497 - DNA, 22 bp, Artificial Sequence
  chemically synthesized
tggctatttgggatttcatgta

SEQ ID NO: 1192498 - DNA, 22 bp, Artificial Sequence
  chemically synthesized
gctatttgggatttcatgtaag

SEQ ID NO: 1192499 - DNA, 22 bp, Artificial Sequence
  chemically synthesized
tttgggatttcatgtaagtttt

SEQ ID NO: 1192500 - DNA, 22 bp, Artificial Sequence
  chemically synthesized
gggatttcatgtaagttttata

SEQ ID NO: 1192501 - DNA, 22 bp, Artificial Sequence
  chemically synthesized
ggatttcatgtaagttttataa

SEQ ID NO: 1192502 - DNA, 22 bp, Artificial Sequence
  chemically synthesized
acagaaataaaagagcattata

SEQ ID NO: 1192503 - DNA, 22 bp, Artificial Sequence
  chemically synthesized
catgtaagttttataatgctct

SEQ ID NO: 1192504 - DNA, 22 bp, Artificial Sequence
  chemically synthesized
cacagaaataaaagagcattat

SEQ ID NO: 1192505 - DNA, 22 bp, Artificial Sequence
  chemically synthesized
atgtaagttttataatgctctt

SEQ ID NO: 1192506 - DNA, 22 bp, Artificial Sequence
  chemically synthesized
tcacagaaataaaagagcatta

SEQ ID NO: 1192507 - DNA, 22 bp, Artificial Sequence
  chemically synthesized
ttcacagaaataaaagagcatt

SEQ ID NO: 1192508 - DNA, 22 bp, Artificial Sequence
  chemically synthesized
tttcacagaaataaaagagcat

SEQ ID NO: 1192509 - DNA, 22 bp, Artificial Sequence
  chemically synthesized
ttttcacagaaataaaagagca

SEQ ID NO: 1192510 - DNA, 22 bp, Artificial Sequence
  chemically synthesized
tttttcacagaaataaaagagc

SEQ ID NO: 1192511 - DNA, 22 bp, Artificial Sequence
  chemically synthesized
tataatgctcttttatttctgt

SEQ ID NO: 1192512 - DNA, 22 bp, Artificial Sequence
  chemically synthesized
ataatgctcttttatttctgtg

SEQ ID NO: 1192513 - DNA, 22 bp, Artificial Sequence
  chemically synthesized
taatgctcttttatttctgtga

SEQ ID NO: 1192514 - DNA, 22 bp, Artificial Sequence
  chemically synthesized
aatggcattttttttcacagaa

SEQ ID NO: 1192515 - DNA, 22 bp, Artificial Sequence
  chemically synthesized
ttttatttctgtgaaaaaaaat

SEQ ID NO: 1192516 - DNA, 22 bp, Artificial Sequence
  chemically synthesized
ttatttctgtgaaaaaaaatgc

SEQ ID NO: 1192517 - DNA, 22 bp, Artificial Sequence
  chemically synthesized
tatttctgtgaaaaaaaatgcc

SEQ ID NO: 1192518 - DNA, 22 bp, Artificial Sequence
  chemically synthesized
atttctgtgaaaaaaaatgcca

SEQ ID NO: 1192519 - DNA, 22 bp, Artificial Sequence
  chemically synthesized
tgaaaatctaaatggcattttt

SEQ ID NO: 1192520 - DNA, 22 bp, Artificial Sequence
  chemically synthesized
tttctgtgaaaaaaaatgccat

SEQ ID NO: 1192521 - DNA, 22 bp, Artificial Sequence
  chemically synthesized
ctgtgaaaaaaaatgccattta

SEQ ID NO: 1192522 - DNA, 22 bp, Artificial Sequence
  chemically synthesized
tgtgaaaaaaaatgccatttag

SEQ ID NO: 1192523 - DNA, 22 bp, Artificial Sequence
  chemically synthesized
tgaaaaaaaatgccatttagat

SEQ ID NO: 1192524 - DNA, 22 bp, Artificial Sequence
  chemically synthesized
atgtaatccctgtgaaaatcta

SEQ ID NO: 1192525 - DNA, 22 bp, Artificial Sequence
  chemically synthesized
aatgtaatccctgtgaaaatct

SEQ ID NO: 1192526 - DNA, 22 bp, Artificial Sequence
  chemically synthesized
tacaaatttaatgtaatccctg

SEQ ID NO: 1192527 - DNA, 22 bp, Artificial Sequence
  chemically synthesized
agattttcacagggattacatt

SEQ ID NO: 1192528 - DNA, 22 bp, Artificial Sequence
  chemically synthesized
gattttcacagggattacatta

SEQ ID NO: 1192529 - DNA, 22 bp, Artificial Sequence
  chemically synthesized
actgtacaaatttaatgtaatc

SEQ ID NO: 1192530 - DNA, 22 bp, Artificial Sequence
  chemically synthesized
tcacagggattacattaaattt

SEQ ID NO: 1192531 - DNA, 22 bp, Artificial Sequence
  chemically synthesized
cacagggattacattaaatttg

SEQ ID NO: 1192532 - DNA, 22 bp, Artificial Sequence
  chemically synthesized
acagggattacattaaatttgt

SEQ ID NO: 1192533 - DNA, 22 bp, Artificial Sequence
  chemically synthesized
cattaaatttgtacagtcaacc

SEQ ID NO: 1192534 - DNA, 22 bp, Artificial Sequence
  chemically synthesized
aatttgtacagtcaaccttcta

SEQ ID NO: 1192535 - DNA, 22 bp, Artificial Sequence
  chemically synthesized
catccgtggaaatagaaggttg

SEQ ID NO: 1192536 - DNA, 22 bp, Artificial Sequence
  chemically synthesized
gtacagtcaaccttctatttcc

SEQ ID NO: 1192537 - DNA, 22 bp, Artificial Sequence
  chemically synthesized
tacagtcaaccttctatttcca

SEQ ID NO: 1192538 - DNA, 22 bp, Artificial Sequence
  chemically synthesized
cagttgcatccgtggaaataga

SEQ ID NO: 1192539 - DNA, 22 bp, Artificial Sequence
  chemically synthesized
gtctacagttgcatccgtggaa

SEQ ID NO: 1192540 - DNA, 22 bp, Artificial Sequence
  chemically synthesized
tggtctacagttgcatccgtgg

SEQ ID NO: 1192541 - DNA, 22 bp, Artificial Sequence
  chemically synthesized
ctggtctacagttgcatccgtg

SEQ ID NO: 1192542 - DNA, 22 bp, Artificial Sequence
  chemically synthesized
tttctggtctacagttgcatcc

SEQ ID NO: 1192543 - DNA, 22 bp, Artificial Sequence
  chemically synthesized
ctatttccacggatgcaactgt

SEQ ID NO: 1192544 - DNA, 22 bp, Artificial Sequence
  chemically synthesized
tatttccacggatgcaactgta

SEQ ID NO: 1192545 - DNA, 22 bp, Artificial Sequence
  chemically synthesized
attatttctggtctacagttgc

SEQ ID NO: 1192546 - DNA, 22 bp, Artificial Sequence
  chemically synthesized
tttccacggatgcaactgtaga

SEQ ID NO: 1192547 - DNA, 22 bp, Artificial Sequence
  chemically synthesized
gattatttctggtctacagttg

SEQ ID NO: 1192548 - DNA, 22 bp, Artificial Sequence
  chemically synthesized
tgattatttctggtctacagtt

SEQ ID NO: 1192549 - DNA, 22 bp, Artificial Sequence
  chemically synthesized
ttgattatttctggtctacagt

SEQ ID NO: 1192550 - DNA, 22 bp, Artificial Sequence
  chemically synthesized
ccacggatgcaactgtagacca

SEQ ID NO: 1192551 - DNA, 22 bp, Artificial Sequence
  chemically synthesized
cacggatgcaactgtagaccag

SEQ ID NO: 1192552 - DNA, 22 bp, Artificial Sequence
  chemically synthesized
tttttgattatttctggtctac

SEQ ID NO: 1192553 - DNA, 22 bp, Artificial Sequence
  chemically synthesized
tatttttgattatttctggtct

SEQ ID NO: 1192554 - DNA, 22 bp, Artificial Sequence
  chemically synthesized
ttctatttttgattatttctgg

SEQ ID NO: 1192555 - DNA, 22 bp, Artificial Sequence
  chemically synthesized
gttctatttttgattatttctg

SEQ ID NO: 1192556 - DNA, 22 bp, Artificial Sequence
  chemically synthesized
tgttctatttttgattatttct

SEQ ID NO: 1192557 - DNA, 22 bp, Artificial Sequence
  chemically synthesized
ttgttctatttttgattatttc

SEQ ID NO: 1192558 - DNA, 22 bp, Artificial Sequence
  chemically synthesized
tttgttctatttttgattattt

SEQ ID NO: 1192559 - DNA, 22 bp, Artificial Sequence
  chemically synthesized
tagaccagaaataatcaaaaat

SEQ ID NO: 1192560 - DNA, 22 bp, Artificial Sequence
  chemically synthesized
agttttttgttctatttttgat

SEQ ID NO: 1192561 - DNA, 22 bp, Artificial Sequence
  chemically synthesized
tattgagttttttgttctattt

SEQ ID NO: 1192562 - DNA, 22 bp, Artificial Sequence
  chemically synthesized
ttgtattgagttttttgttcta

SEQ ID NO: 1192563 - DNA, 22 bp, Artificial Sequence
  chemically synthesized
ttgttgtattgagttttttgtt

SEQ ID NO: 1192564 - DNA, 22 bp, Artificial Sequence
  chemically synthesized
gttgttgtattgagttttttgt

SEQ ID NO: 1192565 - DNA, 22 bp, Artificial Sequence
  chemically synthesized
tgttgttgtattgagttttttg

SEQ ID NO: 1192566 - DNA, 22 bp, Artificial Sequence
  chemically synthesized
ttgttgttgtattgagtttttt

SEQ ID NO: 1192567 - DNA, 22 bp, Artificial Sequence
  chemically synthesized
tttgttgttgtattgagttttt

SEQ ID NO: 1192568 - DNA, 22 bp, Artificial Sequence
  chemically synthesized
atattttttgttgttgtattga

SEQ ID NO: 1192569 - DNA, 22 bp, Artificial Sequence
  chemically synthesized
tattaatattttttgttgttgt

SEQ ID NO: 1192570 - DNA, 22 bp, Artificial Sequence
  chemically synthesized
gtattaatattttttgttgttg

SEQ ID NO: 1192571 - DNA, 22 bp, Artificial Sequence
  chemically synthesized
cttgtattaatattttttgttg

SEQ ID NO: 1192572 - DNA, 22 bp, Artificial Sequence
  chemically synthesized
acttgtattaatattttttgtt

SEQ ID NO: 1192573 - DNA, 22 bp, Artificial Sequence
  chemically synthesized
tacttgtattaatattttttgt

SEQ ID NO: 1192574 - DNA, 22 bp, Artificial Sequence
  chemically synthesized
ttacttgtattaatattttttg

SEQ ID NO: 1192575 - DNA, 22 bp, Artificial Sequence
  chemically synthesized
aatacaacaacaaaaaatatta

SEQ ID NO: 1192576 - DNA, 22 bp, Artificial Sequence
  chemically synthesized
tttttacttgtattaatatttt

SEQ ID NO: 1192577 - DNA, 22 bp, Artificial Sequence
  chemically synthesized
ccatatattatttttacttgta

SEQ ID NO: 1192578 - DNA, 22 bp, Artificial Sequence
  chemically synthesized
ttaccatatattatttttactt

SEQ ID NO: 1192579 - DNA, 22 bp, Artificial Sequence
  chemically synthesized
atacaagtaaaaataatatatg

SEQ ID NO: 1192580 - DNA, 22 bp, Artificial Sequence
  chemically synthesized
tagaaatagttgttaccatata

SEQ ID NO: 1192581 - DNA, 22 bp, Artificial Sequence
  chemically synthesized
atacaatgtaaatgctatagaa

SEQ ID NO: 1192582 - DNA, 22 bp, Artificial Sequence
  chemically synthesized
cacctaatacaatgtaaatgct

SEQ ID NO: 1192583 - DNA, 22 bp, Artificial Sequence
  chemically synthesized
ttacacctaatacaatgtaaat

SEQ ID NO: 1192584 - DNA, 22 bp, Artificial Sequence
  chemically synthesized
tttctatagcatttacattgta

SEQ ID NO: 1192585 - DNA, 22 bp, Artificial Sequence
  chemically synthesized
ttattacacctaatacaatgta

SEQ ID NO: 1192586 - DNA, 22 bp, Artificial Sequence
  chemically synthesized
gttattacacctaatacaatgt

SEQ ID NO: 1192587 - DNA, 22 bp, Artificial Sequence
  chemically synthesized
ctatagcatttacattgtatta

SEQ ID NO: 1192588 - DNA, 22 bp, Artificial Sequence
  chemically synthesized
tatagcatttacattgtattag

SEQ ID NO: 1192589 - DNA, 22 bp, Artificial Sequence
  chemically synthesized
tttgttattacacctaatacaa

SEQ ID NO: 1192590 - DNA, 22 bp, Artificial Sequence
  chemically synthesized
tagcatttacattgtattaggt

SEQ ID NO: 1192591 - DNA, 22 bp, Artificial Sequence
  chemically synthesized
tcgattatttgttattacacct

SEQ ID NO: 1192592 - DNA, 22 bp, Artificial Sequence
  chemically synthesized
acattgtattaggtgtaataac

SEQ ID NO: 1192593 - DNA, 22 bp, Artificial Sequence
  chemically synthesized
cattgtattaggtgtaataaca

SEQ ID NO: 1192594 - DNA, 22 bp, Artificial Sequence
  chemically synthesized
tattaggtgtaataacaaataa

SEQ ID NO: 1192595 - DNA, 22 bp, Artificial Sequence
  chemically synthesized
aaacatctatcgattatttgtt

SEQ ID NO: 1192596 - DNA, 22 bp, Artificial Sequence
  chemically synthesized
aaaacatctatcgattatttgt

SEQ ID NO: 1192597 - DNA, 22 bp, Artificial Sequence
  chemically synthesized
taaaacatctatcgattatttg

SEQ ID NO: 1192598 - DNA, 22 bp, Artificial Sequence
  chemically synthesized
ggtgtaataacaaataatcgat

SEQ ID NO: 1192599 - DNA, 22 bp, Artificial Sequence
  chemically synthesized
tatactttaaaacatctatcga

SEQ ID NO: 1192600 - DNA, 22 bp, Artificial Sequence
  chemically synthesized
tgcacacccccctatatacttt

SEQ ID NO: 1192601 - DNA, 22 bp, Artificial Sequence
  chemically synthesized
catatacctatgcacacccccc

SEQ ID NO: 1192602 - DNA, 22 bp, Artificial Sequence
  chemically synthesized
taaagtatataggggggtgtgc

SEQ ID NO: 1192603 - DNA, 22 bp, Artificial Sequence
  chemically synthesized
gcatatacctatgcacaccccc

SEQ ID NO: 1192604 - DNA, 22 bp, Artificial Sequence
  chemically synthesized
aaagtatataggggggtgtgca

SEQ ID NO: 1192605 - DNA, 22 bp, Artificial Sequence
  chemically synthesized
aagtatataggggggtgtgcat

SEQ ID NO: 1192606 - DNA, 22 bp, Artificial Sequence
  chemically synthesized
tacaaaatggcatagtatttgc

SEQ ID NO: 1192607 - DNA, 22 bp, Artificial Sequence
  chemically synthesized
atacaaaatggcatagtatttg

SEQ ID NO: 1192608 - DNA, 22 bp, Artificial Sequence
  chemically synthesized
aatcccttatacaaaatggcat

SEQ ID NO: 1192609 - DNA, 22 bp, Artificial Sequence
  chemically synthesized
aaatcccttatacaaaatggca

SEQ ID NO: 1192610 - DNA, 22 bp, Artificial Sequence
  chemically synthesized
tgccattttgtataagggattt

SEQ ID NO: 1192611 - DNA, 22 bp, Artificial Sequence
  chemically synthesized
tgtataagggatttaagcatct

SEQ ID NO: 1192612 - DNA, 22 bp, Artificial Sequence
  chemically synthesized
gtataagggatttaagcatctt

SEQ ID NO: 1192613 - DNA, 22 bp, Artificial Sequence
  chemically synthesized
tataagggatttaagcatcttt

SEQ ID NO: 1192614 - DNA, 22 bp, Artificial Sequence
  chemically synthesized
aagcatctttggattttggtat

SEQ ID NO: 1192615 - DNA, 22 bp, Artificial Sequence
  chemically synthesized
agcatctttggattttggtatc

SEQ ID NO: 1192616 - DNA, 22 bp, Artificial Sequence
  chemically synthesized
caggatgccagtggataccaaa

SEQ ID NO: 1192617 - DNA, 22 bp, Artificial Sequence
  chemically synthesized
tggattttggtatccactggca

SEQ ID NO: 1192618 - DNA, 22 bp, Artificial Sequence
  chemically synthesized
ggattttggtatccactggcat

SEQ ID NO: 1192619 - DNA, 22 bp, Artificial Sequence
  chemically synthesized
gattttggtatccactggcatc

SEQ ID NO: 1192620 - DNA, 22 bp, Artificial Sequence
  chemically synthesized
tggtatccactggcatcctgga

SEQ ID NO: 1192621 - DNA, 22 bp, Artificial Sequence
  chemically synthesized
ggtatccactggcatcctggaa

SEQ ID NO: 1192622 - DNA, 22 bp, Artificial Sequence
  chemically synthesized
gtatccactggcatcctggaac

SEQ ID NO: 1192623 - DNA, 22 bp, Artificial Sequence
  chemically synthesized
gtatccacgggacatgggttcc

SEQ ID NO: 1192624 - DNA, 22 bp, Artificial Sequence
  chemically synthesized
ggtatccacgggacatgggttc

SEQ ID NO: 1192625 - DNA, 22 bp, Artificial Sequence
  chemically synthesized
gcatcctggaacccatgtcccg

SEQ ID NO: 1192626 - DNA, 22 bp, Artificial Sequence
  chemically synthesized
tcccttggtatccacgggacat

SEQ ID NO: 1192627 - DNA, 22 bp, Artificial Sequence
  chemically synthesized
gaacccatgtcccgtggatacc

SEQ ID NO: 1192628 - DNA, 22 bp, Artificial Sequence
  chemically synthesized
cccaaatggatatatagctgtc

SEQ ID NO: 1192629 - DNA, 22 bp, Artificial Sequence
  chemically synthesized
catactacccaaatggatatat

SEQ ID NO: 1192630 - DNA, 22 bp, Artificial Sequence
  chemically synthesized
ccatactacccaaatggatata

SEQ ID NO: 1192631 - DNA, 22 bp, Artificial Sequence
  chemically synthesized
aaatttccatactacccaaatg

SEQ ID NO: 1192632 - DNA, 22 bp, Artificial Sequence
  chemically synthesized
ttaaaatttccatactacccaa

SEQ ID NO: 1192633 - DNA, 22 bp, Artificial Sequence
  chemically synthesized
tatatccatttgggtagtatgg

SEQ ID NO: 1192634 - DNA, 22 bp, Artificial Sequence
  chemically synthesized
gggtagtatggaaattttaaca

SEQ ID NO: 1192635 - DNA, 22 bp, Artificial Sequence
  chemically synthesized
ggtagtatggaaattttaacaa

SEQ ID NO: 1192636 - DNA, 22 bp, Artificial Sequence
  chemically synthesized
gaagaagtaatattgttaaaat

SEQ ID NO: 1192637 - DNA, 22 bp, Artificial Sequence
  chemically synthesized
tagactggaagaagtaatattg

SEQ ID NO: 1192638 - DNA, 22 bp, Artificial Sequence
  chemically synthesized
gtagactggaagaagtaatatt

SEQ ID NO: 1192639 - DNA, 22 bp, Artificial Sequence
  chemically synthesized
taacaatattacttcttccagt

SEQ ID NO: 1192640 - DNA, 22 bp, Artificial Sequence
  chemically synthesized
aacaatattacttcttccagtc

SEQ ID NO: 1192641 - DNA, 22 bp, Artificial Sequence
  chemically synthesized
acaatattacttcttccagtct

SEQ ID NO: 1192642 - DNA, 22 bp, Artificial Sequence
  chemically synthesized
cttcttccagtctacaaacatg

SEQ ID NO: 1192643 - DNA, 22 bp, Artificial Sequence
  chemically synthesized
cttccagtctacaaacatggga

SEQ ID NO: 1192644 - DNA, 22 bp, Artificial Sequence
  chemically synthesized
ttccagtctacaaacatgggat

SEQ ID NO: 1192645 - DNA, 22 bp, Artificial Sequence
  chemically synthesized
ccagtctacaaacatgggatat

SEQ ID NO: 1192646 - DNA, 22 bp, Artificial Sequence
  chemically synthesized
cagtctacaaacatgggatatt

SEQ ID NO: 1192647 - DNA, 22 bp, Artificial Sequence
  chemically synthesized
caaacatgggatattttcccat

SEQ ID NO: 1192648 - DNA, 22 bp, Artificial Sequence
  chemically synthesized
aaaggtaaatatatgggaaaat

SEQ ID NO: 1192649 - DNA, 22 bp, Artificial Sequence
  chemically synthesized
aggaacaaattaaaaggtaaat

SEQ ID NO: 1192650 - DNA, 22 bp, Artificial Sequence
  chemically synthesized
tcccatatatttaccttttaat

SEQ ID NO: 1192651 - DNA, 22 bp, Artificial Sequence
  chemically synthesized
cccatatatttaccttttaatt

SEQ ID NO: 1192652 - DNA, 22 bp, Artificial Sequence
  chemically synthesized
ccatatatttaccttttaattt

SEQ ID NO: 1192653 - DNA, 22 bp, Artificial Sequence
  chemically synthesized
taaaacattgaggaacaaatta

SEQ ID NO: 1192654 - DNA, 22 bp, Artificial Sequence
  chemically synthesized
accttttaatttgttcctcaat

SEQ ID NO: 1192655 - DNA, 22 bp, Artificial Sequence
  chemically synthesized
ccttttaatttgttcctcaatg

SEQ ID NO: 1192656 - DNA, 22 bp, Artificial Sequence
  chemically synthesized
ttaatttgttcctcaatgtttt

SEQ ID NO: 1192657 - DNA, 22 bp, Artificial Sequence
  chemically synthesized
taatttgttcctcaatgtttta

SEQ ID NO: 1192658 - DNA, 22 bp, Artificial Sequence
  chemically synthesized
aatttgttcctcaatgttttat

SEQ ID NO: 1192659 - DNA, 22 bp, Artificial Sequence
  chemically synthesized
atttgttcctcaatgttttata

SEQ ID NO: 1192660 - DNA, 22 bp, Artificial Sequence
  chemically synthesized
gttcctcaatgttttatagttt

SEQ ID NO: 1192661 - DNA, 22 bp, Artificial Sequence
  chemically synthesized
ttcctcaatgttttatagtttt

SEQ ID NO: 1192662 - DNA, 22 bp, Artificial Sequence
  chemically synthesized
ctcaatgttttatagttttggt

SEQ ID NO: 1192663 - DNA, 22 bp, Artificial Sequence
  chemically synthesized
aatgttttatagttttggttgt

SEQ ID NO: 1192664 - DNA, 22 bp, Artificial Sequence
  chemically synthesized
tatagttttggttgtacgtatt

SEQ ID NO: 1192665 - DNA, 22 bp, Artificial Sequence
  chemically synthesized
atagttttggttgtacgtattt

SEQ ID NO: 1192666 - DNA, 22 bp, Artificial Sequence
  chemically synthesized
tagttttggttgtacgtatttt

SEQ ID NO: 1192667 - DNA, 22 bp, Artificial Sequence
  chemically synthesized
aagaagaaagtgaaaaatacgt

SEQ ID NO: 1192668 - DNA, 22 bp, Artificial Sequence
  chemically synthesized
aaagaagaaagtgaaaaatacg

SEQ ID NO: 1192669 - DNA, 22 bp, Artificial Sequence
  chemically synthesized
tggttgtacgtatttttcactt

SEQ ID NO: 1192670 - DNA, 22 bp, Artificial Sequence
  chemically synthesized
ggttgtacgtatttttcacttt

SEQ ID NO: 1192671 - DNA, 22 bp, Artificial Sequence
  chemically synthesized
gttgtacgtatttttcactttc

SEQ ID NO: 1192672 - DNA, 22 bp, Artificial Sequence
  chemically synthesized
tacgtatttttcactttcttct

SEQ ID NO: 1192673 - DNA, 22 bp, Artificial Sequence
  chemically synthesized
agacccaatttaaagaagaaag

SEQ ID NO: 1192674 - DNA, 22 bp, Artificial Sequence
  chemically synthesized
aagacccaatttaaagaagaaa

SEQ ID NO: 1192675 - DNA, 22 bp, Artificial Sequence
  chemically synthesized
ttcactttcttctttaaattgg

SEQ ID NO: 1192676 - DNA, 22 bp, Artificial Sequence
  chemically synthesized
tcactttcttctttaaattggg

SEQ ID NO: 1192677 - DNA, 22 bp, Artificial Sequence
  chemically synthesized
cactttcttctttaaattgggt

SEQ ID NO: 1192678 - DNA, 22 bp, Artificial Sequence
  chemically synthesized
actttcttctttaaattgggtc

SEQ ID NO: 1192679 - DNA, 22 bp, Artificial Sequence
  chemically synthesized
tcttctttaaattgggtcttaa

SEQ ID NO: 1192680 - DNA, 22 bp, Artificial Sequence
  chemically synthesized
cttctttaaattgggtcttaaa

SEQ ID NO: 1192681 - DNA, 22 bp, Artificial Sequence
  chemically synthesized
ttctttaaattgggtcttaaat

SEQ ID NO: 1192682 - DNA, 22 bp, Artificial Sequence
  chemically synthesized
ctttaaattgggtcttaaatat

SEQ ID NO: 1192683 - DNA, 22 bp, Artificial Sequence
  chemically synthesized
tttaaattgggtcttaaatatt

SEQ ID NO: 1192684 - DNA, 22 bp, Artificial Sequence
  chemically synthesized
taaattgggtcttaaatatttt

SEQ ID NO: 1192685 - DNA, 22 bp, Artificial Sequence
  chemically synthesized
aaattgggtcttaaatatttta

SEQ ID NO: 1192686 - DNA, 22 bp, Artificial Sequence
  chemically synthesized
aattgggtcttaaatattttat

SEQ ID NO: 1192687 - DNA, 22 bp, Artificial Sequence
  chemically synthesized
tgataacatagaataaaatatt

SEQ ID NO: 1192688 - DNA, 22 bp, Artificial Sequence
  chemically synthesized
atgataacatagaataaaatat

SEQ ID NO: 1192689 - DNA, 22 bp, Artificial Sequence
  chemically synthesized
tttatgataacatagaataaaa

SEQ ID NO: 1192690 - DNA, 22 bp, Artificial Sequence
  chemically synthesized
ggtcttaaatattttattctat

SEQ ID NO: 1192691 - DNA, 22 bp, Artificial Sequence
  chemically synthesized
tatttatgataacatagaataa

SEQ ID NO: 1192692 - DNA, 22 bp, Artificial Sequence
  chemically synthesized
aaatattttattctatgttatc

SEQ ID NO: 1192693 - DNA, 22 bp, Artificial Sequence
  chemically synthesized
aatattttattctatgttatca

SEQ ID NO: 1192694 - DNA, 22 bp, Artificial Sequence
  chemically synthesized
aaaaattctatttatgataaca

SEQ ID NO: 1192695 - DNA, 22 bp, Artificial Sequence
  chemically synthesized
aaaaaattctatttatgataac

SEQ ID NO: 1192696 - DNA, 22 bp, Artificial Sequence
  chemically synthesized
taaaaaattctatttatgataa

SEQ ID NO: 1192697 - DNA, 22 bp, Artificial Sequence
  chemically synthesized
tattctatgttatcataaatag

SEQ ID NO: 1192698 - DNA, 22 bp, Artificial Sequence
  chemically synthesized
attctatgttatcataaataga

SEQ ID NO: 1192699 - DNA, 22 bp, Artificial Sequence
  chemically synthesized
ttctatgttatcataaatagaa

SEQ ID NO: 1192700 - DNA, 22 bp, Artificial Sequence
  chemically synthesized
tatgttatcataaatagaattt

SEQ ID NO: 1192701 - DNA, 22 bp, Artificial Sequence
  chemically synthesized
tgttatcataaatagaattttt

SEQ ID NO: 1192702 - DNA, 22 bp, Artificial Sequence
  chemically synthesized
tcataaatagaattttttaaaa

SEQ ID NO: 1192703 - DNA, 22 bp, Artificial Sequence
  chemically synthesized
tgcaaaagatatccaaaaaatt

SEQ ID NO: 1192704 - DNA, 22 bp, Artificial Sequence
  chemically synthesized
atgcaaaagatatccaaaaaat

SEQ ID NO: 1192705 - DNA, 22 bp, Artificial Sequence
  chemically synthesized
tatgcaaaagatatccaaaaaa

SEQ ID NO: 1192706 - DNA, 22 bp, Artificial Sequence
  chemically synthesized
ttatgcaaaagatatccaaaaa

SEQ ID NO: 1192707 - DNA, 22 bp, Artificial Sequence
  chemically synthesized
tttaaaattttttggatatctt

SEQ ID NO: 1192708 - DNA, 22 bp, Artificial Sequence
  chemically synthesized
ttaaaattttttggatatcttt

SEQ ID NO: 1192709 - DNA, 22 bp, Artificial Sequence
  chemically synthesized
catttttatgcaaaagatatcc

SEQ ID NO: 1192710 - DNA, 22 bp, Artificial Sequence
  chemically synthesized
taaaattttttggatatctttt

SEQ ID NO: 1192711 - DNA, 22 bp, Artificial Sequence
  chemically synthesized
aaaattttttggatatcttttg

SEQ ID NO: 1192712 - DNA, 22 bp, Artificial Sequence
  chemically synthesized
aaattttttggatatcttttgc

SEQ ID NO: 1192713 - DNA, 22 bp, Artificial Sequence
  chemically synthesized
gttgcatttttatgcaaaagat

SEQ ID NO: 1192714 - DNA, 22 bp, Artificial Sequence
  chemically synthesized
tttggatatcttttgcataaaa

SEQ ID NO: 1192715 - DNA, 22 bp, Artificial Sequence
  chemically synthesized
ttggatatcttttgcataaaaa

SEQ ID NO: 1192716 - DNA, 22 bp, Artificial Sequence
  chemically synthesized
tggatatcttttgcataaaaat

SEQ ID NO: 1192717 - DNA, 22 bp, Artificial Sequence
  chemically synthesized
ggatatcttttgcataaaaatg

SEQ ID NO: 1192718 - DNA, 22 bp, Artificial Sequence
  chemically synthesized
gatatcttttgcataaaaatgc

SEQ ID NO: 1192719 - DNA, 22 bp, Artificial Sequence
  chemically synthesized
ttgcataaaaatgcaactaatt

SEQ ID NO: 1192720 - DNA, 22 bp, Artificial Sequence
  chemically synthesized
tgcataaaaatgcaactaattt

SEQ ID NO: 1192721 - DNA, 22 bp, Artificial Sequence
  chemically synthesized
gcataaaaatgcaactaatttt

SEQ ID NO: 1192722 - DNA, 22 bp, Artificial Sequence
  chemically synthesized
cataaaaatgcaactaatttta

SEQ ID NO: 1192723 - DNA, 22 bp, Artificial Sequence
  chemically synthesized
agtaagtagtggaatacaaaat

SEQ ID NO: 1192724 - DNA, 22 bp, Artificial Sequence
  chemically synthesized
attttatgttgattttgtattc

SEQ ID NO: 1192725 - DNA, 22 bp, Artificial Sequence
  chemically synthesized
tatgttgattttgtattccact

SEQ ID NO: 1192726 - DNA, 22 bp, Artificial Sequence
  chemically synthesized
atgttgattttgtattccacta

SEQ ID NO: 1192727 - DNA, 22 bp, Artificial Sequence
  chemically synthesized
tgttgattttgtattccactac

SEQ ID NO: 1192728 - DNA, 22 bp, Artificial Sequence
  chemically synthesized
attttgtattccactacttact

SEQ ID NO: 1192729 - DNA, 22 bp, Artificial Sequence
  chemically synthesized
ataaatgagttcagtaagtagt

SEQ ID NO: 1192730 - DNA, 22 bp, Artificial Sequence
  chemically synthesized
tgtattccactacttactgaac

SEQ ID NO: 1192731 - DNA, 22 bp, Artificial Sequence
  chemically synthesized
gtattccactacttactgaact

SEQ ID NO: 1192732 - DNA, 22 bp, Artificial Sequence
  chemically synthesized
tattccactacttactgaactc

SEQ ID NO: 1192733 - DNA, 22 bp, Artificial Sequence
  chemically synthesized
gaactaataaatgagttcagta

SEQ ID NO: 1192734 - DNA, 22 bp, Artificial Sequence
  chemically synthesized
cactacttactgaactcattta

SEQ ID NO: 1192735 - DNA, 22 bp, Artificial Sequence
  chemically synthesized
cttactgaactcatttattagt

SEQ ID NO: 1192736 - DNA, 22 bp, Artificial Sequence
  chemically synthesized
actgaactcatttattagttct

SEQ ID NO: 1192737 - DNA, 22 bp, Artificial Sequence
  chemically synthesized
ctgaactcatttattagttcta

SEQ ID NO: 1192738 - DNA, 22 bp, Artificial Sequence
  chemically synthesized
cacaagaaaaatgttagaacta

SEQ ID NO: 1192739 - DNA, 22 bp, Artificial Sequence
  chemically synthesized
aactcatttattagttctaaca

SEQ ID NO: 1192740 - DNA, 22 bp, Artificial Sequence
  chemically synthesized
atttattagttctaacattttt

SEQ ID NO: 1192741 - DNA, 22 bp, Artificial Sequence
  chemically synthesized
aggactccacaagaaaaatgtt

SEQ ID NO: 1192742 - DNA, 22 bp, Artificial Sequence
  chemically synthesized
attagttctaacatttttcttg

SEQ ID NO: 1192743 - DNA, 22 bp, Artificial Sequence
  chemically synthesized
ttagttctaacatttttcttgt

SEQ ID NO: 1192744 - DNA, 22 bp, Artificial Sequence
  chemically synthesized
gttctaacatttttcttgtgga

SEQ ID NO: 1192745 - DNA, 22 bp, Artificial Sequence
  chemically synthesized
taacatttttcttgtggagtcc

SEQ ID NO: 1192746 - DNA, 22 bp, Artificial Sequence
  chemically synthesized
acatttttcttgtggagtcctt

SEQ ID NO: 1192747 - DNA, 22 bp, Artificial Sequence
  chemically synthesized
ttcttgtggagtccttaggggt

SEQ ID NO: 1192748 - DNA, 22 bp, Artificial Sequence
  chemically synthesized
tcttgtggagtccttaggggtt

SEQ ID NO: 1192749 - DNA, 22 bp, Artificial Sequence
  chemically synthesized
cttgtggagtccttaggggttt

SEQ ID NO: 1192750 - DNA, 22 bp, Artificial Sequence
  chemically synthesized
ttgtggagtccttaggggtttc

SEQ ID NO: 1192751 - DNA, 22 bp, Artificial Sequence
  chemically synthesized
gtggagtccttaggggtttcta

SEQ ID NO: 1192752 - DNA, 22 bp, Artificial Sequence
  chemically synthesized
tggagtccttaggggtttctac

SEQ ID NO: 1192753 - DNA, 22 bp, Artificial Sequence
  chemically synthesized
caaatggtatgatcgtatatgt

SEQ ID NO: 1192754 - DNA, 22 bp, Artificial Sequence
  chemically synthesized
gcaaatggtatgatcgtatatg

SEQ ID NO: 1192755 - DNA, 22 bp, Artificial Sequence
  chemically synthesized
aggggtttctacatatacgatc

SEQ ID NO: 1192756 - DNA, 22 bp, Artificial Sequence
  chemically synthesized
ggggtttctacatatacgatca

SEQ ID NO: 1192757 - DNA, 22 bp, Artificial Sequence
  chemically synthesized
tttgcaaatggtatgatcgtat

SEQ ID NO: 1192758 - DNA, 22 bp, Artificial Sequence
  chemically synthesized
tgtttgcaaatggtatgatcgt

SEQ ID NO: 1192759 - DNA, 22 bp, Artificial Sequence
  chemically synthesized
ctgtttgcaaatggtatgatcg

SEQ ID NO: 1192760 - DNA, 22 bp, Artificial Sequence
  chemically synthesized
ctacatatacgatcataccatt

SEQ ID NO: 1192761 - DNA, 22 bp, Artificial Sequence
  chemically synthesized
tttctgtttgcaaatggtatga

SEQ ID NO: 1192762 - DNA, 22 bp, Artificial Sequence
  chemically synthesized
tacatatacgatcataccattt

SEQ ID NO: 1192763 - DNA, 22 bp, Artificial Sequence
  chemically synthesized
catatacgatcataccatttgc

SEQ ID NO: 1192764 - DNA, 22 bp, Artificial Sequence
  chemically synthesized
aaaggaagaagtaatattattt

SEQ ID NO: 1192765 - DNA, 22 bp, Artificial Sequence
  chemically synthesized
gcaaacagaaataatattactt

SEQ ID NO: 1192766 - DNA, 22 bp, Artificial Sequence
  chemically synthesized
caaacagaaataatattacttc

SEQ ID NO: 1192767 - DNA, 22 bp, Artificial Sequence
  chemically synthesized
acatctgaaaggaagaagtaat

SEQ ID NO: 1192768 - DNA, 22 bp, Artificial Sequence
  chemically synthesized
cacatctgaaaggaagaagtaa

SEQ ID NO: 1192769 - DNA, 22 bp, Artificial Sequence
  chemically synthesized
tcacatctgaaaggaagaagta

SEQ ID NO: 1192770 - DNA, 22 bp, Artificial Sequence
  chemically synthesized
ataaaaggctttcacatctgaa

SEQ ID NO: 1192771 - DNA, 22 bp, Artificial Sequence
  chemically synthesized
cttcttcctttcagatgtgaaa

SEQ ID NO: 1192772 - DNA, 22 bp, Artificial Sequence
  chemically synthesized
cttcctttcagatgtgaaagcc

SEQ ID NO: 1192773 - DNA, 22 bp, Artificial Sequence
  chemically synthesized
ttcctttcagatgtgaaagcct

SEQ ID NO: 1192774 - DNA, 22 bp, Artificial Sequence
  chemically synthesized
cctttcagatgtgaaagccttt

SEQ ID NO: 1192775 - DNA, 22 bp, Artificial Sequence
  chemically synthesized
ctttcagatgtgaaagcctttt

SEQ ID NO: 1192776 - DNA, 22 bp, Artificial Sequence
  chemically synthesized
tcagatgtgaaagccttttatt

SEQ ID NO: 1192777 - DNA, 22 bp, Artificial Sequence
  chemically synthesized
cagatgtgaaagccttttatta

SEQ ID NO: 1192778 - DNA, 22 bp, Artificial Sequence
  chemically synthesized
agatgtgaaagccttttattaa

SEQ ID NO: 1192779 - DNA, 22 bp, Artificial Sequence
  chemically synthesized
gcaggagcagtgagacaaaatt

SEQ ID NO: 1192780 - DNA, 22 bp, Artificial Sequence
  chemically synthesized
ttattaattttgtctcactgct

SEQ ID NO: 1192781 - DNA, 22 bp, Artificial Sequence
  chemically synthesized
tattaattttgtctcactgctc

SEQ ID NO: 1192782 - DNA, 22 bp, Artificial Sequence
  chemically synthesized
attaattttgtctcactgctcc

SEQ ID NO: 1192783 - DNA, 22 bp, Artificial Sequence
  chemically synthesized
ttaattttgtctcactgctcct

SEQ ID NO: 1192784 - DNA, 22 bp, Artificial Sequence
  chemically synthesized
attttgtctcactgctcctgct

SEQ ID NO: 1192785 - DNA, 22 bp, Artificial Sequence
  chemically synthesized
tgtctcactgctcctgctagta

SEQ ID NO: 1192786 - DNA, 22 bp, Artificial Sequence
  chemically synthesized
gtctcactgctcctgctagtat

SEQ ID NO: 1192787 - DNA, 22 bp, Artificial Sequence
  chemically synthesized
tctcactgctcctgctagtatt

SEQ ID NO: 1192788 - DNA, 22 bp, Artificial Sequence
  chemically synthesized
tcatagtaccaaaaatactagc

SEQ ID NO: 1192789 - DNA, 22 bp, Artificial Sequence
  chemically synthesized
gtcatagtaccaaaaatactag

SEQ ID NO: 1192790 - DNA, 22 bp, Artificial Sequence
  chemically synthesized
actgctcctgctagtatttttg

SEQ ID NO: 1192791 - DNA, 22 bp, Artificial Sequence
  chemically synthesized
catttgtcatagtaccaaaaat

SEQ ID NO: 1192792 - DNA, 22 bp, Artificial Sequence
  chemically synthesized
ctcctgctagtatttttggtac

SEQ ID NO: 1192793 - DNA, 22 bp, Artificial Sequence
  chemically synthesized
ccatttgtcatagtaccaaaaa

SEQ ID NO: 1192794 - DNA, 22 bp, Artificial Sequence
  chemically synthesized
ctgctagtatttttggtactat

SEQ ID NO: 1192795 - DNA, 22 bp, Artificial Sequence
  chemically synthesized
ctagtatttttggtactatgac

SEQ ID NO: 1192796 - DNA, 22 bp, Artificial Sequence
  chemically synthesized
ccacttccatttgtcatagtac

SEQ ID NO: 1192797 - DNA, 22 bp, Artificial Sequence
  chemically synthesized
accacttccatttgtcatagta

SEQ ID NO: 1192798 - DNA, 22 bp, Artificial Sequence
  chemically synthesized
gtatttttggtactatgacaaa

SEQ ID NO: 1192799 - DNA, 22 bp, Artificial Sequence
  chemically synthesized
ttaccacttccatttgtcatag

SEQ ID NO: 1192800 - DNA, 22 bp, Artificial Sequence
  chemically synthesized
ttggtactatgacaaatggaag

SEQ ID NO: 1192801 - DNA, 22 bp, Artificial Sequence
  chemically synthesized
tggtactatgacaaatggaagt

SEQ ID NO: 1192802 - DNA, 22 bp, Artificial Sequence
  chemically synthesized
ggtactatgacaaatggaagtg

SEQ ID NO: 1192803 - DNA, 22 bp, Artificial Sequence
  chemically synthesized
gtactatgacaaatggaagtgg

SEQ ID NO: 1192804 - DNA, 22 bp, Artificial Sequence
  chemically synthesized
tgacaaatggaagtggtaagag

SEQ ID NO: 1192805 - DNA, 22 bp, Artificial Sequence
  chemically synthesized
aaaagcaaggatgcccactctt

SEQ ID NO: 1192806 - DNA, 22 bp, Artificial Sequence
  chemically synthesized
ctaaaaagcaaggatgcccact

SEQ ID NO: 1192807 - DNA, 22 bp, Artificial Sequence
  chemically synthesized
gctaaaaagcaaggatgcccac

SEQ ID NO: 1192808 - DNA, 22 bp, Artificial Sequence
  chemically synthesized
agatttgctaaaaagcaaggat

SEQ ID NO: 1192809 - DNA, 22 bp, Artificial Sequence
  chemically synthesized
aagatttgctaaaaagcaagga

SEQ ID NO: 1192810 - DNA, 22 bp, Artificial Sequence
  chemically synthesized
cccttaagatttgctaaaaagc

SEQ ID NO: 1192811 - DNA, 22 bp, Artificial Sequence
  chemically synthesized
ccccttaagatttgctaaaaag

SEQ ID NO: 1192812 - DNA, 22 bp, Artificial Sequence
  chemically synthesized
tccccttaagatttgctaaaaa

SEQ ID NO: 1192813 - DNA, 22 bp, Artificial Sequence
  chemically synthesized
aaagctttccccttaagatttg

SEQ ID NO: 1192814 - DNA, 22 bp, Artificial Sequence
  chemically synthesized
gctttttagcaaatcttaaggg

SEQ ID NO: 1192815 - DNA, 22 bp, Artificial Sequence
  chemically synthesized
ctttttagcaaatcttaagggg

SEQ ID NO: 1192816 - DNA, 22 bp, Artificial Sequence
  chemically synthesized
tactgaaagctttccccttaag

SEQ ID NO: 1192817 - DNA, 22 bp, Artificial Sequence
  chemically synthesized
tttagcaaatcttaaggggaaa

SEQ ID NO: 1192818 - DNA, 22 bp, Artificial Sequence
  chemically synthesized
ttagcaaatcttaaggggaaag

SEQ ID NO: 1192819 - DNA, 22 bp, Artificial Sequence
  chemically synthesized
tagcaaatcttaaggggaaagc

SEQ ID NO: 1192820 - DNA, 22 bp, Artificial Sequence
  chemically synthesized
agcaaatcttaaggggaaagct

SEQ ID NO: 1192821 - DNA, 22 bp, Artificial Sequence
  chemically synthesized
gcaaatcttaaggggaaagctt

SEQ ID NO: 1192822 - DNA, 22 bp, Artificial Sequence
  chemically synthesized
tggggtggttgtactgaaagct

SEQ ID NO: 1192823 - DNA, 22 bp, Artificial Sequence
  chemically synthesized
aaggggaaagctttcagtacaa

SEQ ID NO: 1192824 - DNA, 22 bp, Artificial Sequence
  chemically synthesized
aggggaaagctttcagtacaac

SEQ ID NO: 1192825 - DNA, 22 bp, Artificial Sequence
  chemically synthesized
tcagtacaaccaccccacaacc

SEQ ID NO: 1192826 - DNA, 22 bp, Artificial Sequence
  chemically synthesized
cagtacaaccaccccacaacca

SEQ ID NO: 1192827 - DNA, 22 bp, Artificial Sequence
  chemically synthesized
agtacaaccaccccacaaccac

SEQ ID NO: 1192828 - DNA, 22 bp, Artificial Sequence
  chemically synthesized
atatgatcaacggtggttgtgg

SEQ ID NO: 1192829 - DNA, 22 bp, Artificial Sequence
  chemically synthesized
tagctaatatgatcaacggtgg

SEQ ID NO: 1192830 - DNA, 22 bp, Artificial Sequence
  chemically synthesized
tgaaaagcctatagctaatatg

SEQ ID NO: 1192831 - DNA, 22 bp, Artificial Sequence
  chemically synthesized
atgaaaagcctatagctaatat

SEQ ID NO: 1192832 - DNA, 22 bp, Artificial Sequence
  chemically synthesized
tttatgaaaagcctatagctaa

SEQ ID NO: 1192833 - DNA, 22 bp, Artificial Sequence
  chemically synthesized
atcatattagctataggctttt

SEQ ID NO: 1192834 - DNA, 22 bp, Artificial Sequence
  chemically synthesized
aacatcaaggctatttatgaaa

SEQ ID NO: 1192835 - DNA, 22 bp, Artificial Sequence
  chemically synthesized
gctataggcttttcataaatag

SEQ ID NO: 1192836 - DNA, 22 bp, Artificial Sequence
  chemically synthesized
ctcaacatcaaggctatttatg

SEQ ID NO: 1192837 - DNA, 22 bp, Artificial Sequence
  chemically synthesized
cctcaacatcaaggctatttat

SEQ ID NO: 1192838 - DNA, 22 bp, Artificial Sequence
  chemically synthesized
taggcttttcataaatagcctt

SEQ ID NO: 1192839 - DNA, 22 bp, Artificial Sequence
  chemically synthesized
ttcataaatagccttgatgttg

SEQ ID NO: 1192840 - DNA, 22 bp, Artificial Sequence
  chemically synthesized
tcataaatagccttgatgttga

SEQ ID NO: 1192841 - DNA, 22 bp, Artificial Sequence
  chemically synthesized
cataaatagccttgatgttgag

SEQ ID NO: 1192842 - DNA, 22 bp, Artificial Sequence
  chemically synthesized
ataaatagccttgatgttgagg

SEQ ID NO: 1192843 - DNA, 22 bp, Artificial Sequence
  chemically synthesized
gatgttgaggaaatttccttcc

SEQ ID NO: 1192844 - DNA, 22 bp, Artificial Sequence
  chemically synthesized
atgttgaggaaatttccttcca

SEQ ID NO: 1192845 - DNA, 22 bp, Artificial Sequence
  chemically synthesized
gcaaaatatgtatggaaggaaa

SEQ ID NO: 1192846 - DNA, 22 bp, Artificial Sequence
  chemically synthesized
cgcaaaatatgtatggaaggaa

SEQ ID NO: 1192847 - DNA, 22 bp, Artificial Sequence
  chemically synthesized
ttcgcaaaatatgtatggaagg

SEQ ID NO: 1192848 - DNA, 22 bp, Artificial Sequence
  chemically synthesized
aggaaatttccttccatacata

SEQ ID NO: 1192849 - DNA, 22 bp, Artificial Sequence
  chemically synthesized
taactcttcgcaaaatatgtat

SEQ ID NO: 1192850 - DNA, 22 bp, Artificial Sequence
  chemically synthesized
ttataactcttcgcaaaatatg

SEQ ID NO: 1192851 - DNA, 22 bp, Artificial Sequence
  chemically synthesized
ccttccatacatattttgcgaa

SEQ ID NO: 1192852 - DNA, 22 bp, Artificial Sequence
  chemically synthesized
ttattataactcttcgcaaaat

SEQ ID NO: 1192853 - DNA, 22 bp, Artificial Sequence
  chemically synthesized
cttccatacatattttgcgaag

SEQ ID NO: 1192854 - DNA, 22 bp, Artificial Sequence
  chemically synthesized
attattataactcttcgcaaaa

SEQ ID NO: 1192855 - DNA, 22 bp, Artificial Sequence
  chemically synthesized
tattattataactcttcgcaaa

SEQ ID NO: 1192856 - DNA, 22 bp, Artificial Sequence
  chemically synthesized
ttattattataactcttcgcaa

SEQ ID NO: 1192857 - DNA, 22 bp, Artificial Sequence
  chemically synthesized
ccatacatattttgcgaagagt

SEQ ID NO: 1192858 - DNA, 22 bp, Artificial Sequence
  chemically synthesized
catacatattttgcgaagagtt

SEQ ID NO: 1192859 - DNA, 22 bp, Artificial Sequence
  chemically synthesized
aacatccttttattattataac

SEQ ID NO: 1192860 - DNA, 22 bp, Artificial Sequence
  chemically synthesized
tgcgaagagttataataataaa

SEQ ID NO: 1192861 - DNA, 22 bp, Artificial Sequence
  chemically synthesized
gcgaagagttataataataaaa

SEQ ID NO: 1192862 - DNA, 22 bp, Artificial Sequence
  chemically synthesized
cgaagagttataataataaaag

SEQ ID NO: 1192863 - DNA, 22 bp, Artificial Sequence
  chemically synthesized
ataaagctaaacatccttttat

SEQ ID NO: 1192864 - DNA, 22 bp, Artificial Sequence
  chemically synthesized
gataaagctaaacatcctttta

SEQ ID NO: 1192865 - DNA, 22 bp, Artificial Sequence
  chemically synthesized
taataataaaaggatgtttagc

SEQ ID NO: 1192866 - DNA, 22 bp, Artificial Sequence
  chemically synthesized
aatacatgcagaaaaagcattt

SEQ ID NO: 1192867 - DNA, 22 bp, Artificial Sequence
  chemically synthesized
agctttatcaaatgctttttct

SEQ ID NO: 1192868 - DNA, 22 bp, Artificial Sequence
  chemically synthesized
gctttatcaaatgctttttctg

SEQ ID NO: 1192869 - DNA, 22 bp, Artificial Sequence
  chemically synthesized
tctcaatacatgcagaaaaagc

SEQ ID NO: 1192870 - DNA, 22 bp, Artificial Sequence
  chemically synthesized
tatcaaatgctttttctgcatg

SEQ ID NO: 1192871 - DNA, 22 bp, Artificial Sequence
  chemically synthesized
atcaaatgctttttctgcatgt

SEQ ID NO: 1192872 - DNA, 22 bp, Artificial Sequence
  chemically synthesized
tcaaatgctttttctgcatgta

SEQ ID NO: 1192873 - DNA, 22 bp, Artificial Sequence
  chemically synthesized
tttctgcatgtattgagataat

SEQ ID NO: 1192874 - DNA, 22 bp, Artificial Sequence
  chemically synthesized
ttctgcatgtattgagataatc

SEQ ID NO: 1192875 - DNA, 22 bp, Artificial Sequence
  chemically synthesized
tctgcatgtattgagataatca

SEQ ID NO: 1192876 - DNA, 22 bp, Artificial Sequence
  chemically synthesized
ctgcatgtattgagataatcat

SEQ ID NO: 1192877 - DNA, 22 bp, Artificial Sequence
  chemically synthesized
tgcatgtattgagataatcatg

SEQ ID NO: 1192878 - DNA, 22 bp, Artificial Sequence
  chemically synthesized
catgtattgagataatcatgtg

SEQ ID NO: 1192879 - DNA, 22 bp, Artificial Sequence
  chemically synthesized
acagaaagatgaaaaaccacat

SEQ ID NO: 1192880 - DNA, 22 bp, Artificial Sequence
  chemically synthesized
agataatcatgtggtttttcat

SEQ ID NO: 1192881 - DNA, 22 bp, Artificial Sequence
  chemically synthesized
cattaacagaaagatgaaaaac

SEQ ID NO: 1192882 - DNA, 22 bp, Artificial Sequence
  chemically synthesized
ttcatctttctgttaatgtagt

SEQ ID NO: 1192883 - DNA, 22 bp, Artificial Sequence
  chemically synthesized
tcatctttctgttaatgtagta

SEQ ID NO: 1192884 - DNA, 22 bp, Artificial Sequence
  chemically synthesized
catctttctgttaatgtagtat

SEQ ID NO: 1192885 - DNA, 22 bp, Artificial Sequence
  chemically synthesized
atctttctgttaatgtagtatg

SEQ ID NO: 1192886 - DNA, 22 bp, Artificial Sequence
  chemically synthesized
tctgttaatgtagtatgtcgca

SEQ ID NO: 1192887 - DNA, 22 bp, Artificial Sequence
  chemically synthesized
ctgttaatgtagtatgtcgcat

SEQ ID NO: 1192888 - DNA, 22 bp, Artificial Sequence
  chemically synthesized
tgttaatgtagtatgtcgcatt

SEQ ID NO: 1192889 - DNA, 22 bp, Artificial Sequence
  chemically synthesized
ttaatgtagtatgtcgcattga

SEQ ID NO: 1192890 - DNA, 22 bp, Artificial Sequence
  chemically synthesized
atgtagtatgtcgcattgattg

SEQ ID NO: 1192891 - DNA, 22 bp, Artificial Sequence
  chemically synthesized
acatacacaaatcaatcaatgc

SEQ ID NO: 1192892 - DNA, 22 bp, Artificial Sequence
  chemically synthesized
aacatacacaaatcaatcaatg

SEQ ID NO: 1192893 - DNA, 22 bp, Artificial Sequence
  chemically synthesized
gtttaacatacacaaatcaatc

SEQ ID NO: 1192894 - DNA, 22 bp, Artificial Sequence
  chemically synthesized
attgatttgtgtatgttaaacc

SEQ ID NO: 1192895 - DNA, 22 bp, Artificial Sequence
  chemically synthesized
ggacacaaggttggtttaacat

SEQ ID NO: 1192896 - DNA, 22 bp, Artificial Sequence
  chemically synthesized
atttgtgtatgttaaaccaacc

SEQ ID NO: 1192897 - DNA, 22 bp, Artificial Sequence
  chemically synthesized
gccctaggacacaaggttggtt

SEQ ID NO: 1192898 - DNA, 22 bp, Artificial Sequence
  chemically synthesized
agccctaggacacaaggttggt

SEQ ID NO: 1192899 - DNA, 22 bp, Artificial Sequence
  chemically synthesized
gtgtatgttaaaccaaccttgt

SEQ ID NO: 1192900 - DNA, 22 bp, Artificial Sequence
  chemically synthesized
tgtatgttaaaccaaccttgtg

SEQ ID NO: 1192901 - DNA, 22 bp, Artificial Sequence
  chemically synthesized
aaccaaccttgtgtcctagggc

SEQ ID NO: 1192902 - DNA, 22 bp, Artificial Sequence
  chemically synthesized
gtgtcctagggctaaacccacc

SEQ ID NO: 1192903 - DNA, 22 bp, Artificial Sequence
  chemically synthesized
tgtcctagggctaaacccacct

SEQ ID NO: 1192904 - DNA, 22 bp, Artificial Sequence
  chemically synthesized
taaaccgtgaccaggtgggttt

SEQ ID NO: 1192905 - DNA, 22 bp, Artificial Sequence
  chemically synthesized
gattataaaccgtgaccaggtg

SEQ ID NO: 1192906 - DNA, 22 bp, Artificial Sequence
  chemically synthesized
gggctaaacccacctggtcacg

SEQ ID NO: 1192907 - DNA, 22 bp, Artificial Sequence
  chemically synthesized
aacccacctggtcacggtttat

SEQ ID NO: 1192908 - DNA, 22 bp, Artificial Sequence
  chemically synthesized
gtcacggtttataatccaatgt

SEQ ID NO: 1192909 - DNA, 22 bp, Artificial Sequence
  chemically synthesized
gcaagacaaataacacattgga

SEQ ID NO: 1192910 - DNA, 22 bp, Artificial Sequence
  chemically synthesized
ataatccaatgtgttatttgtc

SEQ ID NO: 1192911 - DNA, 22 bp, Artificial Sequence
  chemically synthesized
taatccaatgtgttatttgtct

SEQ ID NO: 1192912 - DNA, 22 bp, Artificial Sequence
  chemically synthesized
aataaagtattagcaagacaaa

SEQ ID NO: 1192913 - DNA, 22 bp, Artificial Sequence
  chemically synthesized
tttgtcttgctaatactttatt

SEQ ID NO: 1192914 - DNA, 22 bp, Artificial Sequence
  chemically synthesized
gtcttgctaatactttattgag

SEQ ID NO: 1192915 - DNA, 22 bp, Artificial Sequence
  chemically synthesized
tcttgctaatactttattgagg

SEQ ID NO: 1192916 - DNA, 22 bp, Artificial Sequence
  chemically synthesized
gctaatactttattgaggactt

SEQ ID NO: 1192917 - DNA, 22 bp, Artificial Sequence
  chemically synthesized
ctaatactttattgaggacttt

SEQ ID NO: 1192918 - DNA, 22 bp, Artificial Sequence
  chemically synthesized
atactttattgaggactttcac

SEQ ID NO: 1192919 - DNA, 22 bp, Artificial Sequence
  chemically synthesized
ggaggaatatagatgtgaaagt

SEQ ID NO: 1192920 - DNA, 22 bp, Artificial Sequence
  chemically synthesized
tattgaggactttcacatctat

SEQ ID NO: 1192921 - DNA, 22 bp, Artificial Sequence
  chemically synthesized
attgaggactttcacatctata

SEQ ID NO: 1192922 - DNA, 22 bp, Artificial Sequence
  chemically synthesized
ttgaggactttcacatctatat

SEQ ID NO: 1192923 - DNA, 22 bp, Artificial Sequence
  chemically synthesized
aggactttcacatctatattcc

SEQ ID NO: 1192924 - DNA, 22 bp, Artificial Sequence
  chemically synthesized
tcacatctatattcctcctaga

SEQ ID NO: 1192925 - DNA, 22 bp, Artificial Sequence
  chemically synthesized
cacatctatattcctcctagat

SEQ ID NO: 1192926 - DNA, 22 bp, Artificial Sequence
  chemically synthesized
acatctatattcctcctagata

SEQ ID NO: 1192927 - DNA, 22 bp, Artificial Sequence
  chemically synthesized
tattcctcctagatattggcat

SEQ ID NO: 1192928 - DNA, 22 bp, Artificial Sequence
  chemically synthesized
ctcctagatattggcatatata

SEQ ID NO: 1192929 - DNA, 22 bp, Artificial Sequence
  chemically synthesized
ctagatattggcatatatatat

SEQ ID NO: 1192930 - DNA, 22 bp, Artificial Sequence
  chemically synthesized
gatattggcatatatatatttt

SEQ ID NO: 1192931 - DNA, 22 bp, Artificial Sequence
  chemically synthesized
gcatatatatattttcttctct

SEQ ID NO: 1192932 - DNA, 22 bp, Artificial Sequence
  chemically synthesized
tcttctcttgcggtgtctgttt

SEQ ID NO: 1192933 - DNA, 22 bp, Artificial Sequence
  chemically synthesized
aatacgaaagtcaaacagacac

SEQ ID NO: 1192934 - DNA, 22 bp, Artificial Sequence
  chemically synthesized
cttctcttgcggtgtctgtttg

SEQ ID NO: 1192935 - DNA, 22 bp, Artificial Sequence
  chemically synthesized
ttctcttgcggtgtctgtttga

SEQ ID NO: 1192936 - DNA, 22 bp, Artificial Sequence
  chemically synthesized
ctcttgcggtgtctgtttgact

SEQ ID NO: 1192937 - DNA, 22 bp, Artificial Sequence
  chemically synthesized
tcttgcggtgtctgtttgactt

SEQ ID NO: 1192938 - DNA, 22 bp, Artificial Sequence
  chemically synthesized
ttgcggtgtctgtttgactttc

SEQ ID NO: 1192939 - DNA, 22 bp, Artificial Sequence
  chemically synthesized
gcggtgtctgtttgactttcgt

SEQ ID NO: 1192940 - DNA, 22 bp, Artificial Sequence
  chemically synthesized
cggtgtctgtttgactttcgta

SEQ ID NO: 1192941 - DNA, 22 bp, Artificial Sequence
  chemically synthesized
agcatcaccctaaatacgaaag

SEQ ID NO: 1192942 - DNA, 22 bp, Artificial Sequence
  chemically synthesized
cagcatcaccctaaatacgaaa

SEQ ID NO: 1192943 - DNA, 22 bp, Artificial Sequence
  chemically synthesized
tttgactttcgtatttagggtg

SEQ ID NO: 1192944 - DNA, 22 bp, Artificial Sequence
  chemically synthesized
tgacttcagcatcaccctaaat

SEQ ID NO: 1192945 - DNA, 22 bp, Artificial Sequence
  chemically synthesized
atgacttcagcatcaccctaaa

SEQ ID NO: 1192946 - DNA, 22 bp, Artificial Sequence
  chemically synthesized
gactttcgtatttagggtgatg

SEQ ID NO: 1192947 - DNA, 22 bp, Artificial Sequence
  chemically synthesized
actttcgtatttagggtgatgc

SEQ ID NO: 1192948 - DNA, 22 bp, Artificial Sequence
  chemically synthesized
tcgtatttagggtgatgctgaa

SEQ ID NO: 1192949 - DNA, 22 bp, Artificial Sequence
  chemically synthesized
cgtatttagggtgatgctgaag

SEQ ID NO: 1192950 - DNA, 22 bp, Artificial Sequence
  chemically synthesized
gtatttagggtgatgctgaagt

SEQ ID NO: 1192951 - DNA, 22 bp, Artificial Sequence
  chemically synthesized
caaagccatttatgacttcagc

SEQ ID NO: 1192952 - DNA, 22 bp, Artificial Sequence
  chemically synthesized
agggtgatgctgaagtcataaa

SEQ ID NO: 1192953 - DNA, 22 bp, Artificial Sequence
  chemically synthesized
gggtgatgctgaagtcataaat

SEQ ID NO: 1192954 - DNA, 22 bp, Artificial Sequence
  chemically synthesized
aagtcataaatggctttggagg

SEQ ID NO: 1192955 - DNA, 22 bp, Artificial Sequence
  chemically synthesized
aataatagaagaggaaatacct

SEQ ID NO: 1192956 - DNA, 22 bp, Artificial Sequence
  chemically synthesized
taaataatagaagaggaaatac

SEQ ID NO: 1192957 - DNA, 22 bp, Artificial Sequence
  chemically synthesized
ctaaataatagaagaggaaata

SEQ ID NO: 1192958 - DNA, 22 bp, Artificial Sequence
  chemically synthesized
tggaggtatttcctcttctatt

SEQ ID NO: 1192959 - DNA, 22 bp, Artificial Sequence
  chemically synthesized
ggaggtatttcctcttctatta

SEQ ID NO: 1192960 - DNA, 22 bp, Artificial Sequence
  chemically synthesized
aaatcttctaaataatagaaga

SEQ ID NO: 1192961 - DNA, 22 bp, Artificial Sequence
  chemically synthesized
gaggtatttcctcttctattat

SEQ ID NO: 1192962 - DNA, 22 bp, Artificial Sequence
  chemically synthesized
aaaatcttctaaataatagaag

SEQ ID NO: 1192963 - DNA, 22 bp, Artificial Sequence
  chemically synthesized
ttaaaatcttctaaataataga

SEQ ID NO: 1192964 - DNA, 22 bp, Artificial Sequence
  chemically synthesized
ttcttaaaatcttctaaataat

SEQ ID NO: 1192965 - DNA, 22 bp, Artificial Sequence
  chemically synthesized
gttcttaaaatcttctaaataa

SEQ ID NO: 1192966 - DNA, 22 bp, Artificial Sequence
  chemically synthesized
cctcttctattatttagaagat

SEQ ID NO: 1192967 - DNA, 22 bp, Artificial Sequence
  chemically synthesized
ctcttctattatttagaagatt

SEQ ID NO: 1192968 - DNA, 22 bp, Artificial Sequence
  chemically synthesized
ttctattatttagaagatttta

SEQ ID NO: 1192969 - DNA, 22 bp, Artificial Sequence
  chemically synthesized
taccatttgttcttaaaatctt

SEQ ID NO: 1192970 - DNA, 22 bp, Artificial Sequence
  chemically synthesized
ctattatttagaagattttaag

SEQ ID NO: 1192971 - DNA, 22 bp, Artificial Sequence
  chemically synthesized
ataccatttgttcttaaaatct

SEQ ID NO: 1192972 - DNA, 22 bp, Artificial Sequence
  chemically synthesized
tattatttagaagattttaaga

SEQ ID NO: 1192973 - DNA, 22 bp, Artificial Sequence
  chemically synthesized
ttatttagaagattttaagaac

SEQ ID NO: 1192974 - DNA, 22 bp, Artificial Sequence
  chemically synthesized
tttagaagattttaagaacaaa

SEQ ID NO: 1192975 - DNA, 22 bp, Artificial Sequence
  chemically synthesized
agaagattttaagaacaaatgg

SEQ ID NO: 1192976 - DNA, 22 bp, Artificial Sequence
  chemically synthesized
gaagattttaagaacaaatggt

SEQ ID NO: 1192977 - DNA, 22 bp, Artificial Sequence
  chemically synthesized
aagagtaatttataccatttgt

SEQ ID NO: 1192978 - DNA, 22 bp, Artificial Sequence
  chemically synthesized
aaagagtaatttataccatttg

SEQ ID NO: 1192979 - DNA, 22 bp, Artificial Sequence
  chemically synthesized
taagaacaaatggtataaatta

SEQ ID NO: 1192980 - DNA, 22 bp, Artificial Sequence
  chemically synthesized
aagaacaaatggtataaattac

SEQ ID NO: 1192981 - DNA, 22 bp, Artificial Sequence
  chemically synthesized
agaacaaatggtataaattact

SEQ ID NO: 1192982 - DNA, 22 bp, Artificial Sequence
  chemically synthesized
caaacatttaaagagtaattta

SEQ ID NO: 1192983 - DNA, 22 bp, Artificial Sequence
  chemically synthesized
ccaaacatttaaagagtaattt

SEQ ID NO: 1192984 - DNA, 22 bp, Artificial Sequence
  chemically synthesized
ttccaaacatttaaagagtaat

SEQ ID NO: 1192985 - DNA, 22 bp, Artificial Sequence
  chemically synthesized
cttccaaacatttaaagagtaa

SEQ ID NO: 1192986 - DNA, 22 bp, Artificial Sequence
  chemically synthesized
atttcttccaaacatttaaaga

SEQ ID NO: 1192987 - DNA, 22 bp, Artificial Sequence
  chemically synthesized
ctcatttcttccaaacatttaa

SEQ ID NO: 1192988 - DNA, 22 bp, Artificial Sequence
  chemically synthesized
tcctcatttcttccaaacattt

SEQ ID NO: 1192989 - DNA, 22 bp, Artificial Sequence
  chemically synthesized
ctcctcatttcttccaaacatt

SEQ ID NO: 1192990 - DNA, 22 bp, Artificial Sequence
  chemically synthesized
cttctcctcatttcttccaaac

SEQ ID NO: 1192991 - DNA, 22 bp, Artificial Sequence
  chemically synthesized
ctctttaaatgtttggaagaaa

SEQ ID NO: 1192992 - DNA, 22 bp, Artificial Sequence
  chemically synthesized
tttaaatgtttggaagaaatga

SEQ ID NO: 1192993 - DNA, 22 bp, Artificial Sequence
  chemically synthesized
acctacttctcctcatttcttc

SEQ ID NO: 1192994 - DNA, 22 bp, Artificial Sequence
  chemically synthesized
gacctacttctcctcatttctt

SEQ ID NO: 1192995 - DNA, 22 bp, Artificial Sequence
  chemically synthesized
taaatgtttggaagaaatgagg

SEQ ID NO: 1192996 - DNA, 22 bp, Artificial Sequence
  chemically synthesized
tgacctacttctcctcatttct

SEQ ID NO: 1192997 - DNA, 22 bp, Artificial Sequence
  chemically synthesized
aaatgtttggaagaaatgagga

SEQ ID NO: 1192998 - DNA, 22 bp, Artificial Sequence
  chemically synthesized
aatgtttggaagaaatgaggag

SEQ ID NO: 1192999 - DNA, 22 bp, Artificial Sequence
  chemically synthesized
tgtcctttgacctacttctcct

SEQ ID NO: 1193000 - DNA, 22 bp, Artificial Sequence
  chemically synthesized
gtgtcctttgacctacttctcc

SEQ ID NO: 1193001 - DNA, 22 bp, Artificial Sequence
  chemically synthesized
ggaagaaatgaggagaagtagg

SEQ ID NO: 1193002 - DNA, 22 bp, Artificial Sequence
  chemically synthesized
gaagaaatgaggagaagtaggt

SEQ ID NO: 1193003 - DNA, 22 bp, Artificial Sequence
  chemically synthesized
aagtttgtgtcctttgacctac

SEQ ID NO: 1193004 - DNA, 22 bp, Artificial Sequence
  chemically synthesized
caagtttgtgtcctttgaccta

SEQ ID NO: 1193005 - DNA, 22 bp, Artificial Sequence
  chemically synthesized
tccaatataacttcaagtttgt

SEQ ID NO: 1193006 - DNA, 22 bp, Artificial Sequence
  chemically synthesized
atccaatataacttcaagtttg

SEQ ID NO: 1193007 - DNA, 22 bp, Artificial Sequence
  chemically synthesized
tttatccaatataacttcaagt

SEQ ID NO: 1193008 - DNA, 22 bp, Artificial Sequence
  chemically synthesized
atttatccaatataacttcaag

SEQ ID NO: 1193009 - DNA, 22 bp, Artificial Sequence
  chemically synthesized
tcgagatttatttatccaatat

SEQ ID NO: 1193010 - DNA, 22 bp, Artificial Sequence
  chemically synthesized
gaagttatattggataaataaa

SEQ ID NO: 1193011 - DNA, 22 bp, Artificial Sequence
  chemically synthesized
aagttatattggataaataaat

SEQ ID NO: 1193012 - DNA, 22 bp, Artificial Sequence
  chemically synthesized
agcagttatcgagatttattta

SEQ ID NO: 1193013 - DNA, 22 bp, Artificial Sequence
  chemically synthesized
tattggataaataaatctcgat

SEQ ID NO: 1193014 - DNA, 22 bp, Artificial Sequence
  chemically synthesized
gataaataaatctcgataactg

SEQ ID NO: 1193015 - DNA, 22 bp, Artificial Sequence
  chemically synthesized
tagtcatcatactaagcagtta

SEQ ID NO: 1193016 - DNA, 22 bp, Artificial Sequence
  chemically synthesized
actgtagtcatcatactaagca

SEQ ID NO: 1193017 - DNA, 22 bp, Artificial Sequence
  chemically synthesized
gataactgcttagtatgatgac

SEQ ID NO: 1193018 - DNA, 22 bp, Artificial Sequence
  chemically synthesized
cttagtatgatgactacagtta

SEQ ID NO: 1193019 - DNA, 22 bp, Artificial Sequence
  chemically synthesized
agtatgatgactacagttaatg

SEQ ID NO: 1193020 - DNA, 22 bp, Artificial Sequence
  chemically synthesized
gtatgatgactacagttaatgg

SEQ ID NO: 1193021 - DNA, 22 bp, Artificial Sequence
  chemically synthesized
agtgtacaatacaatgccatta

SEQ ID NO: 1193022 - DNA, 22 bp, Artificial Sequence
  chemically synthesized
atgttcagtgtacaatacaatg

SEQ ID NO: 1193023 - DNA, 22 bp, Artificial Sequence
  chemically synthesized
cagttaatggcattgtattgta

SEQ ID NO: 1193024 - DNA, 22 bp, Artificial Sequence
  chemically synthesized
gctaatgttcagtgtacaatac

SEQ ID NO: 1193025 - DNA, 22 bp, Artificial Sequence
  chemically synthesized
agctaatgttcagtgtacaata

SEQ ID NO: 1193026 - DNA, 22 bp, Artificial Sequence
  chemically synthesized
ttagctaatgttcagtgtacaa

SEQ ID NO: 1193027 - DNA, 22 bp, Artificial Sequence
  chemically synthesized
atggcattgtattgtacactga

SEQ ID NO: 1193028 - DNA, 22 bp, Artificial Sequence
  chemically synthesized
cttagctaatgttcagtgtaca

SEQ ID NO: 1193029 - DNA, 22 bp, Artificial Sequence
  chemically synthesized
tcttagctaatgttcagtgtac

SEQ ID NO: 1193030 - DNA, 22 bp, Artificial Sequence
  chemically synthesized
ttcttagctaatgttcagtgta

SEQ ID NO: 1193031 - DNA, 22 bp, Artificial Sequence
  chemically synthesized
ttttcttagctaatgttcagtg

SEQ ID NO: 1193032 - DNA, 22 bp, Artificial Sequence
  chemically synthesized
tattgtacactgaacattagct

SEQ ID NO: 1193033 - DNA, 22 bp, Artificial Sequence
  chemically synthesized
aagtctcttttcttagctaatg

SEQ ID NO: 1193034 - DNA, 22 bp, Artificial Sequence
  chemically synthesized
tacactgaacattagctaagaa

SEQ ID NO: 1193035 - DNA, 22 bp, Artificial Sequence
  chemically synthesized
aacattagctaagaaaagagac

SEQ ID NO: 1193036 - DNA, 22 bp, Artificial Sequence
  chemically synthesized
gctaagaaaagagactttaggt

SEQ ID NO: 1193037 - DNA, 22 bp, Artificial Sequence
  chemically synthesized
gtatggtaagaatacctaaagt

SEQ ID NO: 1193038 - DNA, 22 bp, Artificial Sequence
  chemically synthesized
ggtatggtaagaatacctaaag

SEQ ID NO: 1193039 - DNA, 22 bp, Artificial Sequence
  chemically synthesized
tggtatggtaagaatacctaaa

SEQ ID NO: 1193040 - DNA, 22 bp, Artificial Sequence
  chemically synthesized
agaaaagagactttaggtattc

SEQ ID NO: 1193041 - DNA, 22 bp, Artificial Sequence
  chemically synthesized
ttttggtatggtaagaatacct

SEQ ID NO: 1193042 - DNA, 22 bp, Artificial Sequence
  chemically synthesized
taggtattcttaccataccaaa

SEQ ID NO: 1193043 - DNA, 22 bp, Artificial Sequence
  chemically synthesized
cataataactgttttggtatgg

SEQ ID NO: 1193044 - DNA, 22 bp, Artificial Sequence
  chemically synthesized
aggtattcttaccataccaaaa

SEQ ID NO: 1193045 - DNA, 22 bp, Artificial Sequence
  chemically synthesized
ccataataactgttttggtatg

SEQ ID NO: 1193046 - DNA, 22 bp, Artificial Sequence
  chemically synthesized
ggtattcttaccataccaaaac

SEQ ID NO: 1193047 - DNA, 22 bp, Artificial Sequence
  chemically synthesized
tcttccataataactgttttgg

SEQ ID NO: 1193048 - DNA, 22 bp, Artificial Sequence
  chemically synthesized
ttaccataccaaaacagttatt

SEQ ID NO: 1193049 - DNA, 22 bp, Artificial Sequence
  chemically synthesized
accataccaaaacagttattat

SEQ ID NO: 1193050 - DNA, 22 bp, Artificial Sequence
  chemically synthesized
ccataccaaaacagttattatg

SEQ ID NO: 1193051 - DNA, 22 bp, Artificial Sequence
  chemically synthesized
tccattatcttccataataact

SEQ ID NO: 1193052 - DNA, 22 bp, Artificial Sequence
  chemically synthesized
tcctatccattatcttccataa

SEQ ID NO: 1193053 - DNA, 22 bp, Artificial Sequence
  chemically synthesized
aaccaaattatcctatccatta

SEQ ID NO: 1193054 - DNA, 22 bp, Artificial Sequence
  chemically synthesized
ttatggaagataatggatagga

SEQ ID NO: 1193055 - DNA, 22 bp, Artificial Sequence
  chemically synthesized
tggaagataatggataggataa

SEQ ID NO: 1193056 - DNA, 22 bp, Artificial Sequence
  chemically synthesized
aattcaaccaaattatcctatc

SEQ ID NO: 1193057 - DNA, 22 bp, Artificial Sequence
  chemically synthesized
ctgaattcaaccaaattatcct

SEQ ID NO: 1193058 - DNA, 22 bp, Artificial Sequence
  chemically synthesized
ggttgaattcagtaatcatttc

SEQ ID NO: 1193059 - DNA, 22 bp, Artificial Sequence
  chemically synthesized
gttgaattcagtaatcatttca

SEQ ID NO: 1193060 - DNA, 22 bp, Artificial Sequence
  chemically synthesized
aattcagtaatcatttcattat

SEQ ID NO: 1193061 - DNA, 22 bp, Artificial Sequence
  chemically synthesized
cgatatacatagacataatgaa

SEQ ID NO: 1193062 - DNA, 22 bp, Artificial Sequence
  chemically synthesized
agtaatcatttcattatgtcta

SEQ ID NO: 1193063 - DNA, 22 bp, Artificial Sequence
  chemically synthesized
cattatgtctatgtatatcgta

SEQ ID NO: 1193064 - DNA, 22 bp, Artificial Sequence
  chemically synthesized
attatgtctatgtatatcgtaa

SEQ ID NO: 1193065 - DNA, 22 bp, Artificial Sequence
  chemically synthesized
aggggtacaagatgttacgata

SEQ ID NO: 1193066 - DNA, 22 bp, Artificial Sequence
  chemically synthesized
aaggggtacaagatgttacgat

SEQ ID NO: 1193067 - DNA, 22 bp, Artificial Sequence
  chemically synthesized
tgtctatgtatatcgtaacatc

SEQ ID NO: 1193068 - DNA, 22 bp, Artificial Sequence
  chemically synthesized
atttaaggggtacaagatgtta

SEQ ID NO: 1193069 - DNA, 22 bp, Artificial Sequence
  chemically synthesized
tgtatatcgtaacatcttgtac

SEQ ID NO: 1193070 - DNA, 22 bp, Artificial Sequence
  chemically synthesized
catacccctgatttaaggggta

SEQ ID NO: 1193071 - DNA, 22 bp, Artificial Sequence
  chemically synthesized
gtaccccttaaatcaggggtat

SEQ ID NO: 1193072 - DNA, 22 bp, Artificial Sequence
  chemically synthesized
taccccttaaatcaggggtatg

SEQ ID NO: 1193073 - DNA, 22 bp, Artificial Sequence
  chemically synthesized
aggaagccaaaagattacatac

SEQ ID NO: 1193074 - DNA, 22 bp, Artificial Sequence
  chemically synthesized
aaatcaggggtatgtaatcttt

SEQ ID NO: 1193075 - DNA, 22 bp, Artificial Sequence
  chemically synthesized
aatcaggggtatgtaatctttt

SEQ ID NO: 1193076 - DNA, 22 bp, Artificial Sequence
  chemically synthesized
aaatggagcctaaggaagccaa

SEQ ID NO: 1193077 - DNA, 22 bp, Artificial Sequence
  chemically synthesized
caaatggagcctaaggaagcca

SEQ ID NO: 1193078 - DNA, 22 bp, Artificial Sequence
  chemically synthesized
ttcaaatggagcctaaggaagc

SEQ ID NO: 1193079 - DNA, 22 bp, Artificial Sequence
  chemically synthesized
ttcttcaaatggagcctaagga

SEQ ID NO: 1193080 - DNA, 22 bp, Artificial Sequence
  chemically synthesized
ttggcttccttaggctccattt

SEQ ID NO: 1193081 - DNA, 22 bp, Artificial Sequence
  chemically synthesized
tggcttccttaggctccatttg

SEQ ID NO: 1193082 - DNA, 22 bp, Artificial Sequence
  chemically synthesized
ggcttccttaggctccatttga

SEQ ID NO: 1193083 - DNA, 22 bp, Artificial Sequence
  chemically synthesized
gcttccttaggctccatttgaa

SEQ ID NO: 1193084 - DNA, 22 bp, Artificial Sequence
  chemically synthesized
agataattattcttcaaatgga

SEQ ID NO: 1193085 - DNA, 22 bp, Artificial Sequence
  chemically synthesized
ccttaggctccatttgaagaat

SEQ ID NO: 1193086 - DNA, 22 bp, Artificial Sequence
  chemically synthesized
cttaggctccatttgaagaata

SEQ ID NO: 1193087 - DNA, 22 bp, Artificial Sequence
  chemically synthesized
aggctccatttgaagaataatt

SEQ ID NO: 1193088 - DNA, 22 bp, Artificial Sequence
  chemically synthesized
ggctccatttgaagaataatta

SEQ ID NO: 1193089 - DNA, 22 bp, Artificial Sequence
  chemically synthesized
ggtgtggcctaagataattatt

SEQ ID NO: 1193090 - DNA, 22 bp, Artificial Sequence
  chemically synthesized
aggtgtggcctaagataattat

SEQ ID NO: 1193091 - DNA, 22 bp, Artificial Sequence
  chemically synthesized
taggtgtggcctaagataatta

SEQ ID NO: 1193092 - DNA, 22 bp, Artificial Sequence
  chemically synthesized
catttgaagaataattatctta

SEQ ID NO: 1193093 - DNA, 22 bp, Artificial Sequence
  chemically synthesized
gaagaataattatcttaggcca

SEQ ID NO: 1193094 - DNA, 22 bp, Artificial Sequence
  chemically synthesized
aagaataattatcttaggccac

SEQ ID NO: 1193095 - DNA, 22 bp, Artificial Sequence
  chemically synthesized
gtgtattttaggtgtggcctaa

SEQ ID NO: 1193096 - DNA, 22 bp, Artificial Sequence
  chemically synthesized
gtgttagtgtattttaggtgtg

SEQ ID NO: 1193097 - DNA, 22 bp, Artificial Sequence
  chemically synthesized
ttagtgttagtgtattttaggt

SEQ ID NO: 1193098 - DNA, 22 bp, Artificial Sequence
  chemically synthesized
tcttaggccacacctaaaatac

SEQ ID NO: 1193099 - DNA, 22 bp, Artificial Sequence
  chemically synthesized
ttgttagtgttagtgtatttta

SEQ ID NO: 1193100 - DNA, 22 bp, Artificial Sequence
  chemically synthesized
aggccacacctaaaatacacta

SEQ ID NO: 1193101 - DNA, 22 bp, Artificial Sequence
  chemically synthesized
ggccacacctaaaatacactaa

SEQ ID NO: 1193102 - DNA, 22 bp, Artificial Sequence
  chemically synthesized
gctattgttagtgttagtgtat

SEQ ID NO: 1193103 - DNA, 22 bp, Artificial Sequence
  chemically synthesized
attagctattgttagtgttagt

SEQ ID NO: 1193104 - DNA, 22 bp, Artificial Sequence
  chemically synthesized
gttgattagctattgttagtgt

SEQ ID NO: 1193105 - DNA, 22 bp, Artificial Sequence
  chemically synthesized
agttgattagctattgttagtg

SEQ ID NO: 1193106 - DNA, 22 bp, Artificial Sequence
  chemically synthesized
aaatacactaacactaacaata

SEQ ID NO: 1193107 - DNA, 22 bp, Artificial Sequence
  chemically synthesized
tagttgattagctattgttagt

SEQ ID NO: 1193108 - DNA, 22 bp, Artificial Sequence
  chemically synthesized
ttagttgattagctattgttag

SEQ ID NO: 1193109 - DNA, 22 bp, Artificial Sequence
  chemically synthesized
tttagttgattagctattgtta

SEQ ID NO: 1193110 - DNA, 22 bp, Artificial Sequence
  chemically synthesized
ttttagttgattagctattgtt

SEQ ID NO: 1193111 - DNA, 22 bp, Artificial Sequence
  chemically synthesized
tttttagttgattagctattgt

SEQ ID NO: 1193112 - DNA, 22 bp, Artificial Sequence
  chemically synthesized
ttttttagttgattagctattg

SEQ ID NO: 1193113 - DNA, 22 bp, Artificial Sequence
  chemically synthesized
tttttttagttgattagctatt

SEQ ID NO: 1193114 - DNA, 22 bp, Artificial Sequence
  chemically synthesized
ttttttttagttgattagctat

SEQ ID NO: 1193115 - DNA, 22 bp, Artificial Sequence
  chemically synthesized
acactaacaatagctaatcaac

SEQ ID NO: 1193116 - DNA, 22 bp, Artificial Sequence
  chemically synthesized
caggtttttttttttagttgat

SEQ ID NO: 1193117 - DNA, 22 bp, Artificial Sequence
  chemically synthesized
gcaggtttttttttttagttga

SEQ ID NO: 1193118 - DNA, 22 bp, Artificial Sequence
  chemically synthesized
acaatagctaatcaactaaaaa

SEQ ID NO: 1193119 - DNA, 22 bp, Artificial Sequence
  chemically synthesized
tgcaggtttttttttttagttg

SEQ ID NO: 1193120 - DNA, 22 bp, Artificial Sequence
  chemically synthesized
ttgcaggtttttttttttagtt

SEQ ID NO: 1193121 - DNA, 22 bp, Artificial Sequence
  chemically synthesized
tttgcaggtttttttttttagt

SEQ ID NO: 1193122 - DNA, 22 bp, Artificial Sequence
  chemically synthesized
ttttgcaggtttttttttttag

SEQ ID NO: 1193123 - DNA, 22 bp, Artificial Sequence
  chemically synthesized
atcaactaaaaaaaaaaacctg

SEQ ID NO: 1193124 - DNA, 22 bp, Artificial Sequence
  chemically synthesized
tgagatttttttgcaggttttt

SEQ ID NO: 1193125 - DNA, 22 bp, Artificial Sequence
  chemically synthesized
aaaaaaaaaacctgcaaaaaaa

SEQ ID NO: 1193126 - DNA, 22 bp, Artificial Sequence
  chemically synthesized
aaacattatgagatttttttgc

SEQ ID NO: 1193127 - DNA, 22 bp, Artificial Sequence
  chemically synthesized
aaaacattatgagatttttttg

SEQ ID NO: 1193128 - DNA, 22 bp, Artificial Sequence
  chemically synthesized
ttaaaacattatgagatttttt

SEQ ID NO: 1193129 - DNA, 22 bp, Artificial Sequence
  chemically synthesized
cttaaaacattatgagattttt

SEQ ID NO: 1193130 - DNA, 22 bp, Artificial Sequence
  chemically synthesized
tcttaaaacattatgagatttt

SEQ ID NO: 1193131 - DNA, 22 bp, Artificial Sequence
  chemically synthesized
caaaaaaatctcataatgtttt

SEQ ID NO: 1193132 - DNA, 22 bp, Artificial Sequence
  chemically synthesized
acccactttcttaaaacattat

SEQ ID NO: 1193133 - DNA, 22 bp, Artificial Sequence
  chemically synthesized
taattcacccactttcttaaaa

SEQ ID NO: 1193134 - DNA, 22 bp, Artificial Sequence
  chemically synthesized
actgtaattcacccactttctt

SEQ ID NO: 1193135 - DNA, 22 bp, Artificial Sequence
  chemically synthesized
ataatgttttaagaaagtgggt

SEQ ID NO: 1193136 - DNA, 22 bp, Artificial Sequence
  chemically synthesized
taagaaagtgggtgaattacag

SEQ ID NO: 1193137 - DNA, 22 bp, Artificial Sequence
  chemically synthesized
aatgcagcctaactgtaattca

SEQ ID NO: 1193138 - DNA, 22 bp, Artificial Sequence
  chemically synthesized
aagaaagtgggtgaattacagt

SEQ ID NO: 1193139 - DNA, 22 bp, Artificial Sequence
  chemically synthesized
gaatgcagcctaactgtaattc

SEQ ID NO: 1193140 - DNA, 22 bp, Artificial Sequence
  chemically synthesized
agaaagtgggtgaattacagtt

SEQ ID NO: 1193141 - DNA, 22 bp, Artificial Sequence
  chemically synthesized
tgaatgcagcctaactgtaatt

SEQ ID NO: 1193142 - DNA, 22 bp, Artificial Sequence
  chemically synthesized
cagttaggctgcattcaaagct

SEQ ID NO: 1193143 - DNA, 22 bp, Artificial Sequence
  chemically synthesized
catgtggcccaggacagctttg

SEQ ID NO: 1193144 - DNA, 22 bp, Artificial Sequence
  chemically synthesized
ggctgcattcaaagctgtcctg

SEQ ID NO: 1193145 - DNA, 22 bp, Artificial Sequence
  chemically synthesized
cattcaaagctgtcctgggcca

SEQ ID NO: 1193146 - DNA, 22 bp, Artificial Sequence
  chemically synthesized
aaagctgtcctgggccacatgt

SEQ ID NO: 1193147 - DNA, 22 bp, Artificial Sequence
  chemically synthesized
acagcccatgggctacatgtgg

SEQ ID NO: 1193148 - DNA, 22 bp, Artificial Sequence
  chemically synthesized
tcctgggccacatgtagcccat

SEQ ID NO: 1193149 - DNA, 22 bp, Artificial Sequence
  chemically synthesized
tccaactcacagcccatgggct

SEQ ID NO: 1193150 - DNA, 22 bp, Artificial Sequence
  chemically synthesized
gtccaactcacagcccatgggc

SEQ ID NO: 1193151 - DNA, 22 bp, Artificial Sequence
  chemically synthesized
ggccacatgtagcccatgggct

SEQ ID NO: 1193152 - DNA, 22 bp, Artificial Sequence
  chemically synthesized
aggcaaccttgtccaactcaca

SEQ ID NO: 1193153 - DNA, 22 bp, Artificial Sequence
  chemically synthesized
aaggcaaccttgtccaactcac

SEQ ID NO: 1193154 - DNA, 22 bp, Artificial Sequence
  chemically synthesized
gatgtacttaaggcaaccttgt

SEQ ID NO: 1193155 - DNA, 22 bp, Artificial Sequence
  chemically synthesized
ctggatgtacttaaggcaacct

SEQ ID NO: 1193156 - DNA, 22 bp, Artificial Sequence
  chemically synthesized
tgagttggacaaggttgcctta

SEQ ID NO: 1193157 - DNA, 22 bp, Artificial Sequence
  chemically synthesized
actggatgtacttaaggcaacc

SEQ ID NO: 1193158 - DNA, 22 bp, Artificial Sequence
  chemically synthesized
tactggatgtacttaaggcaac

SEQ ID NO: 1193159 - DNA, 22 bp, Artificial Sequence
  chemically synthesized
ttactggatgtacttaaggcaa

SEQ ID NO: 1193160 - DNA, 22 bp, Artificial Sequence
  chemically synthesized
ttttactggatgtacttaaggc

SEQ ID NO: 1193161 - DNA, 22 bp, Artificial Sequence
  chemically synthesized
gacaaggttgccttaagtacat

SEQ ID NO: 1193162 - DNA, 22 bp, Artificial Sequence
  chemically synthesized
ttcttttactggatgtacttaa

SEQ ID NO: 1193163 - DNA, 22 bp, Artificial Sequence
  chemically synthesized
attcttttactggatgtactta

SEQ ID NO: 1193164 - DNA, 22 bp, Artificial Sequence
  chemically synthesized
tattcttttactggatgtactt

SEQ ID NO: 1193165 - DNA, 22 bp, Artificial Sequence
  chemically synthesized
ttattcttttactggatgtact

SEQ ID NO: 1193166 - DNA, 22 bp, Artificial Sequence
  chemically synthesized
gtttttattcttttactggatg

SEQ ID NO: 1193167 - DNA, 22 bp, Artificial Sequence
  chemically synthesized
agtttttattcttttactggat

SEQ ID NO: 1193168 - DNA, 22 bp, Artificial Sequence
  chemically synthesized
tagtttttattcttttactgga

SEQ ID NO: 1193169 - DNA, 22 bp, Artificial Sequence
  chemically synthesized
ccttaagtacatccagtaaaag

SEQ ID NO: 1193170 - DNA, 22 bp, Artificial Sequence
  chemically synthesized
gttttagtttttattcttttac

SEQ ID NO: 1193171 - DNA, 22 bp, Artificial Sequence
  chemically synthesized
aagtacatccagtaaaagaata

SEQ ID NO: 1193172 - DNA, 22 bp, Artificial Sequence
  chemically synthesized
agttttagtttttattctttta

SEQ ID NO: 1193173 - DNA, 22 bp, Artificial Sequence
  chemically synthesized
agtacatccagtaaaagaataa

SEQ ID NO: 1193174 - DNA, 22 bp, Artificial Sequence
  chemically synthesized
tagttttagtttttattctttt

SEQ ID NO: 1193175 - DNA, 22 bp, Artificial Sequence
  chemically synthesized
ttttagttttagtttttattct

SEQ ID NO: 1193176 - DNA, 22 bp, Artificial Sequence
  chemically synthesized
attattttagttttagttttta

SEQ ID NO: 1193177 - DNA, 22 bp, Artificial Sequence
  chemically synthesized
aaatacaacaatatgtgctaat

SEQ ID NO: 1193178 - DNA, 22 bp, Artificial Sequence
  chemically synthesized
aaactaaaataattagcacata

SEQ ID NO: 1193179 - DNA, 22 bp, Artificial Sequence
  chemically synthesized
gaaatacaacaatatgtgctaa

SEQ ID NO: 1193180 - DNA, 22 bp, Artificial Sequence
  chemically synthesized
aaataattagcacatattgttg

SEQ ID NO: 1193181 - DNA, 22 bp, Artificial Sequence
  chemically synthesized
tcatcatttgaaatacaacaat

SEQ ID NO: 1193182 - DNA, 22 bp, Artificial Sequence
  chemically synthesized
attgtcatcatttgaaatacaa

SEQ ID NO: 1193183 - DNA, 22 bp, Artificial Sequence
  chemically synthesized
gcacatattgttgtatttcaaa

SEQ ID NO: 1193184 - DNA, 22 bp, Artificial Sequence
  chemically synthesized
tcgaatctaattgtcatcattt

SEQ ID NO: 1193185 - DNA, 22 bp, Artificial Sequence
  chemically synthesized
ttgtatttcaaatgatgacaat

SEQ ID NO: 1193186 - DNA, 22 bp, Artificial Sequence
  chemically synthesized
tatttcaaatgatgacaattag

SEQ ID NO: 1193187 - DNA, 22 bp, Artificial Sequence
  chemically synthesized
tcaactgtcgaatctaattgtc

SEQ ID NO: 1193188 - DNA, 22 bp, Artificial Sequence
  chemically synthesized
gtcaactgtcgaatctaattgt

SEQ ID NO: 1193189 - DNA, 22 bp, Artificial Sequence
  chemically synthesized
caaatgatgacaattagattcg

SEQ ID NO: 1193190 - DNA, 22 bp, Artificial Sequence
  chemically synthesized
aaatgatgacaattagattcga

SEQ ID NO: 1193191 - DNA, 22 bp, Artificial Sequence
  chemically synthesized
acttgtcaactgtcgaatctaa

SEQ ID NO: 1193192 - DNA, 22 bp, Artificial Sequence
  chemically synthesized
gacttgtcaactgtcgaatcta

SEQ ID NO: 1193193 - DNA, 22 bp, Artificial Sequence
  chemically synthesized
tatttgacttgtcaactgtcga

SEQ ID NO: 1193194 - DNA, 22 bp, Artificial Sequence
  chemically synthesized
gattcgacagttgacaagtcaa

SEQ ID NO: 1193195 - DNA, 22 bp, Artificial Sequence
  chemically synthesized
aatgtattatatttgacttgtc

SEQ ID NO: 1193196 - DNA, 22 bp, Artificial Sequence
  chemically synthesized
aaatgtattatatttgacttgt

SEQ ID NO: 1193197 - DNA, 22 bp, Artificial Sequence
  chemically synthesized
gacagttgacaagtcaaatata

SEQ ID NO: 1193198 - DNA, 22 bp, Artificial Sequence
  chemically synthesized
caccatttaaatgtattatatt

SEQ ID NO: 1193199 - DNA, 22 bp, Artificial Sequence
  chemically synthesized
acaagtcaaatataatacattt

SEQ ID NO: 1193200 - DNA, 22 bp, Artificial Sequence
  chemically synthesized
aagaagtagaattgcaccattt

SEQ ID NO: 1193201 - DNA, 22 bp, Artificial Sequence
  chemically synthesized
ctcaagaagtagaattgcacca

SEQ ID NO: 1193202 - DNA, 22 bp, Artificial Sequence
  chemically synthesized
cctcaagaagtagaattgcacc

SEQ ID NO: 1193203 - DNA, 22 bp, Artificial Sequence
  chemically synthesized
aaatggtgcaattctacttctt

SEQ ID NO: 1193204 - DNA, 22 bp, Artificial Sequence
  chemically synthesized
aatggtgcaattctacttcttg

SEQ ID NO: 1193205 - DNA, 22 bp, Artificial Sequence
  chemically synthesized
aaaggatttcctcaagaagtag

SEQ ID NO: 1193206 - DNA, 22 bp, Artificial Sequence
  chemically synthesized
gaaaggatttcctcaagaagta

SEQ ID NO: 1193207 - DNA, 22 bp, Artificial Sequence
  chemically synthesized
tgaaaggatttcctcaagaagt

SEQ ID NO: 1193208 - DNA, 22 bp, Artificial Sequence
  chemically synthesized
ttgaaaggatttcctcaagaag

SEQ ID NO: 1193209 - DNA, 22 bp, Artificial Sequence
  chemically synthesized
tttgaaaggatttcctcaagaa

SEQ ID NO: 1193210 - DNA, 22 bp, Artificial Sequence
  chemically synthesized
tacttcttgaggaaatcctttc

SEQ ID NO: 1193211 - DNA, 22 bp, Artificial Sequence
  chemically synthesized
gaccaattttttgaaaggattt

SEQ ID NO: 1193212 - DNA, 22 bp, Artificial Sequence
  chemically synthesized
cttcttgaggaaatcctttcaa

SEQ ID NO: 1193213 - DNA, 22 bp, Artificial Sequence
  chemically synthesized
cttgaggaaatcctttcaaaaa

SEQ ID NO: 1193214 - DNA, 22 bp, Artificial Sequence
  chemically synthesized
ttgaggaaatcctttcaaaaaa

SEQ ID NO: 1193215 - DNA, 22 bp, Artificial Sequence
  chemically synthesized
cagttggaccaattttttgaaa

SEQ ID NO: 1193216 - DNA, 22 bp, Artificial Sequence
  chemically synthesized
gaggaaatcctttcaaaaaatt

SEQ ID NO: 1193217 - DNA, 22 bp, Artificial Sequence
  chemically synthesized
aggaaatcctttcaaaaaattg

SEQ ID NO: 1193218 - DNA, 22 bp, Artificial Sequence
  chemically synthesized
tacattccagttggaccaattt

SEQ ID NO: 1193219 - DNA, 22 bp, Artificial Sequence
  chemically synthesized
atacattccagttggaccaatt

SEQ ID NO: 1193220 - DNA, 22 bp, Artificial Sequence
  chemically synthesized
tcaaaaaattggtccaactgga

SEQ ID NO: 1193221 - DNA, 22 bp, Artificial Sequence
  chemically synthesized
caaaaaattggtccaactggaa

SEQ ID NO: 1193222 - DNA, 22 bp, Artificial Sequence
  chemically synthesized
tatatttatacattccagttgg

SEQ ID NO: 1193223 - DNA, 22 bp, Artificial Sequence
  chemically synthesized
aaaaaattggtccaactggaat

SEQ ID NO: 1193224 - DNA, 22 bp, Artificial Sequence
  chemically synthesized
attgtatatttatacattccag

SEQ ID NO: 1193225 - DNA, 22 bp, Artificial Sequence
  chemically synthesized
aattgtatatttatacattcca

SEQ ID NO: 1193226 - DNA, 22 bp, Artificial Sequence
  chemically synthesized
ttaattgtatatttatacattc

SEQ ID NO: 1193227 - DNA, 22 bp, Artificial Sequence
  chemically synthesized
gtccaactggaatgtataaata

SEQ ID NO: 1193228 - DNA, 22 bp, Artificial Sequence
  chemically synthesized
gaatgtataaatatacaattaa

SEQ ID NO: 1193229 - DNA, 22 bp, Artificial Sequence
  chemically synthesized
aatgcacaattcttaattgtat

SEQ ID NO: 1193230 - DNA, 22 bp, Artificial Sequence
  chemically synthesized
aaatgcacaattcttaattgta

SEQ ID NO: 1193231 - DNA, 22 bp, Artificial Sequence
  chemically synthesized
taaatgcacaattcttaattgt

SEQ ID NO: 1193232 - DNA, 22 bp, Artificial Sequence
  chemically synthesized
attttaaatgcacaattcttaa

SEQ ID NO: 1193233 - DNA, 22 bp, Artificial Sequence
  chemically synthesized
gattttaaatgcacaattctta

SEQ ID NO: 1193234 - DNA, 22 bp, Artificial Sequence
  chemically synthesized
tgattttaaatgcacaattctt

SEQ ID NO: 1193235 - DNA, 22 bp, Artificial Sequence
  chemically synthesized
ttgattttaaatgcacaattct

SEQ ID NO: 1193236 - DNA, 22 bp, Artificial Sequence
  chemically synthesized
cttttgattttaaatgcacaat

SEQ ID NO: 1193237 - DNA, 22 bp, Artificial Sequence
  chemically synthesized
ttacttttgattttaaatgcac

SEQ ID NO: 1193238 - DNA, 22 bp, Artificial Sequence
  chemically synthesized
ttattacttttgattttaaatg

SEQ ID NO: 1193239 - DNA, 22 bp, Artificial Sequence
  chemically synthesized
attattacttttgattttaaat

SEQ ID NO: 1193240 - DNA, 22 bp, Artificial Sequence
  chemically synthesized
agaattgtgcatttaaaatcaa

SEQ ID NO: 1193241 - DNA, 22 bp, Artificial Sequence
  chemically synthesized
gagtttattattacttttgatt

SEQ ID NO: 1193242 - DNA, 22 bp, Artificial Sequence
  chemically synthesized
agagtttattattacttttgat

SEQ ID NO: 1193243 - DNA, 22 bp, Artificial Sequence
  chemically synthesized
tgcatttaaaatcaaaagtaat

SEQ ID NO: 1193244 - DNA, 22 bp, Artificial Sequence
  chemically synthesized
atttagagtttattattacttt

SEQ ID NO: 1193245 - DNA, 22 bp, Artificial Sequence
  chemically synthesized
aatttagagtttattattactt

SEQ ID NO: 1193246 - DNA, 22 bp, Artificial Sequence
  chemically synthesized
aaaatcaaaagtaataataaac

SEQ ID NO: 1193247 - DNA, 22 bp, Artificial Sequence
  chemically synthesized
atttaatttagagtttattatt

SEQ ID NO: 1193248 - DNA, 22 bp, Artificial Sequence
  chemically synthesized
aaatcaaaagtaataataaact

SEQ ID NO: 1193249 - DNA, 22 bp, Artificial Sequence
  chemically synthesized
agcaaaaaagtctgatttaatt

SEQ ID NO: 1193250 - DNA, 22 bp, Artificial Sequence
  chemically synthesized
cagcaaaaaagtctgatttaat

SEQ ID NO: 1193251 - DNA, 22 bp, Artificial Sequence
  chemically synthesized
gtttcagcaaaaaagtctgatt

SEQ ID NO: 1193252 - DNA, 22 bp, Artificial Sequence
  chemically synthesized
agtttcagcaaaaaagtctgat

SEQ ID NO: 1193253 - DNA, 22 bp, Artificial Sequence
  chemically synthesized
taaattaaatcagacttttttg

SEQ ID NO: 1193254 - DNA, 22 bp, Artificial Sequence
  chemically synthesized
gtttagtttcagcaaaaaagtc

SEQ ID NO: 1193255 - DNA, 22 bp, Artificial Sequence
  chemically synthesized
aattaaatcagacttttttgct

SEQ ID NO: 1193256 - DNA, 22 bp, Artificial Sequence
  chemically synthesized
acctcgtttagtttcagcaaaa

SEQ ID NO: 1193257 - DNA, 22 bp, Artificial Sequence
  chemically synthesized
aatcagacttttttgctgaaac

SEQ ID NO: 1193258 - DNA, 22 bp, Artificial Sequence
  chemically synthesized
ttcacctcgtttagtttcagca

SEQ ID NO: 1193259 - DNA, 22 bp, Artificial Sequence
  chemically synthesized
attcacctcgtttagtttcagc

SEQ ID NO: 1193260 - DNA, 22 bp, Artificial Sequence
  chemically synthesized
tattcacctcgtttagtttcag

SEQ ID NO: 1193261 - DNA, 22 bp, Artificial Sequence
  chemically synthesized
ttttattcacctcgtttagttt

SEQ ID NO: 1193262 - DNA, 22 bp, Artificial Sequence
  chemically synthesized
ttttgctgaaactaaacgaggt

SEQ ID NO: 1193263 - DNA, 22 bp, Artificial Sequence
  chemically synthesized
tttgctgaaactaaacgaggtg

SEQ ID NO: 1193264 - DNA, 22 bp, Artificial Sequence
  chemically synthesized
acctattttattcacctcgttt

SEQ ID NO: 1193265 - DNA, 22 bp, Artificial Sequence
  chemically synthesized
ttgctgaaactaaacgaggtga

SEQ ID NO: 1193266 - DNA, 22 bp, Artificial Sequence
  chemically synthesized
cacctattttattcacctcgtt

SEQ ID NO: 1193267 - DNA, 22 bp, Artificial Sequence
  chemically synthesized
tgctgaaactaaacgaggtgaa

SEQ ID NO: 1193268 - DNA, 22 bp, Artificial Sequence
  chemically synthesized
gctgaaactaaacgaggtgaat

SEQ ID NO: 1193269 - DNA, 22 bp, Artificial Sequence
  chemically synthesized
ctgaaactaaacgaggtgaata

SEQ ID NO: 1193270 - DNA, 22 bp, Artificial Sequence
  chemically synthesized
acttcacctattttattcacct

SEQ ID NO: 1193271 - DNA, 22 bp, Artificial Sequence
  chemically synthesized
aaactaaacgaggtgaataaaa

SEQ ID NO: 1193272 - DNA, 22 bp, Artificial Sequence
  chemically synthesized
ggttcacttcacctattttatt

SEQ ID NO: 1193273 - DNA, 22 bp, Artificial Sequence
  chemically synthesized
aacgaggtgaataaaataggtg

SEQ ID NO: 1193274 - DNA, 22 bp, Artificial Sequence
  chemically synthesized
taaattaggttcacttcaccta

SEQ ID NO: 1193275 - DNA, 22 bp, Artificial Sequence
  chemically synthesized
ataaattaggttcacttcacct

SEQ ID NO: 1193276 - DNA, 22 bp, Artificial Sequence
  chemically synthesized
agccataacagccttataaatt

SEQ ID NO: 1193277 - DNA, 22 bp, Artificial Sequence
  chemically synthesized
gagccataacagccttataaat

SEQ ID NO: 1193278 - DNA, 22 bp, Artificial Sequence
  chemically synthesized
aagaatttgagccataacagcc

SEQ ID NO: 1193279 - DNA, 22 bp, Artificial Sequence
  chemically synthesized
gaagaatttgagccataacagc

SEQ ID NO: 1193280 - DNA, 22 bp, Artificial Sequence
  chemically synthesized
atttataaggctgttatggctc

SEQ ID NO: 1193281 - DNA, 22 bp, Artificial Sequence
  chemically synthesized
tttgaagaatttgagccataac

SEQ ID NO: 1193282 - DNA, 22 bp, Artificial Sequence
  chemically synthesized
atttgaagaatttgagccataa

SEQ ID NO: 1193283 - DNA, 22 bp, Artificial Sequence
  chemically synthesized
ataaggctgttatggctcaaat

SEQ ID NO: 1193284 - DNA, 22 bp, Artificial Sequence
  chemically synthesized
taaggctgttatggctcaaatt

SEQ ID NO: 1193285 - DNA, 22 bp, Artificial Sequence
  chemically synthesized
aacagaaatttatttgaagaat

SEQ ID NO: 1193286 - DNA, 22 bp, Artificial Sequence
  chemically synthesized
ttatggctcaaattcttcaaat

SEQ ID NO: 1193287 - DNA, 22 bp, Artificial Sequence
  chemically synthesized
tggctcaaattcttcaaataaa

SEQ ID NO: 1193288 - DNA, 22 bp, Artificial Sequence
  chemically synthesized
aaattcttcaaataaatttctg

SEQ ID NO: 1193289 - DNA, 22 bp, Artificial Sequence
  chemically synthesized
ttcaaataaatttctgttcagt

SEQ ID NO: 1193290 - DNA, 22 bp, Artificial Sequence
  chemically synthesized
caaataaatttctgttcagttc

SEQ ID NO: 1193291 - DNA, 22 bp, Artificial Sequence
  chemically synthesized
tgaaaatgataagaactgaaca

SEQ ID NO: 1193292 - DNA, 22 bp, Artificial Sequence
  chemically synthesized
aaataaatttctgttcagttct

SEQ ID NO: 1193293 - DNA, 22 bp, Artificial Sequence
  chemically synthesized
atgaaaatgataagaactgaac

SEQ ID NO: 1193294 - DNA, 22 bp, Artificial Sequence
  chemically synthesized
tatgaaaatgataagaactgaa

SEQ ID NO: 1193295 - DNA, 22 bp, Artificial Sequence
  chemically synthesized
ctgttcagttcttatcattttc

SEQ ID NO: 1193296 - DNA, 22 bp, Artificial Sequence
  chemically synthesized
tgttcagttcttatcattttca

SEQ ID NO: 1193297 - DNA, 22 bp, Artificial Sequence
  chemically synthesized
ttcagttcttatcattttcata

SEQ ID NO: 1193298 - DNA, 22 bp, Artificial Sequence
  chemically synthesized
ataaatcaactttatgaaaatg

SEQ ID NO: 1193299 - DNA, 22 bp, Artificial Sequence
  chemically synthesized
agttcttatcattttcataaag

SEQ ID NO: 1193300 - DNA, 22 bp, Artificial Sequence
  chemically synthesized
ctcataaatcaactttatgaaa

SEQ ID NO: 1193301 - DNA, 22 bp, Artificial Sequence
  chemically synthesized
ttatcattttcataaagttgat

SEQ ID NO: 1193302 - DNA, 22 bp, Artificial Sequence
  chemically synthesized
atcattttcataaagttgattt

SEQ ID NO: 1193303 - DNA, 22 bp, Artificial Sequence
  chemically synthesized
tcattttcataaagttgattta

SEQ ID NO: 1193304 - DNA, 22 bp, Artificial Sequence
  chemically synthesized
catagttcctcataaatcaact

SEQ ID NO: 1193305 - DNA, 22 bp, Artificial Sequence
  chemically synthesized
gcatagttcctcataaatcaac

SEQ ID NO: 1193306 - DNA, 22 bp, Artificial Sequence
  chemically synthesized
tcataaagttgatttatgagga

SEQ ID NO: 1193307 - DNA, 22 bp, Artificial Sequence
  chemically synthesized
gatttgcatagttcctcataaa

SEQ ID NO: 1193308 - DNA, 22 bp, Artificial Sequence
  chemically synthesized
cataaagttgatttatgaggaa

SEQ ID NO: 1193309 - DNA, 22 bp, Artificial Sequence
  chemically synthesized
ataaagttgatttatgaggaac

SEQ ID NO: 1193310 - DNA, 22 bp, Artificial Sequence
  chemically synthesized
tagatttgcatagttcctcata

SEQ ID NO: 1193311 - DNA, 22 bp, Artificial Sequence
  chemically synthesized
ctctagatttgcatagttcctc

SEQ ID NO: 1193312 - DNA, 22 bp, Artificial Sequence
  chemically synthesized
atttatgaggaactatgcaaat

SEQ ID NO: 1193313 - DNA, 22 bp, Artificial Sequence
  chemically synthesized
gtagactactctagatttgcat

SEQ ID NO: 1193314 - DNA, 22 bp, Artificial Sequence
  chemically synthesized
agtagactactctagatttgca

SEQ ID NO: 1193315 - DNA, 22 bp, Artificial Sequence
  chemically synthesized
atgaggaactatgcaaatctag

SEQ ID NO: 1193316 - DNA, 22 bp, Artificial Sequence
  chemically synthesized
tagtagactactctagatttgc

SEQ ID NO: 1193317 - DNA, 22 bp, Artificial Sequence
  chemically synthesized
tgaggaactatgcaaatctaga

SEQ ID NO: 1193318 - DNA, 22 bp, Artificial Sequence
  chemically synthesized
tgcaaatctagagtagtctact

SEQ ID NO: 1193319 - DNA, 22 bp, Artificial Sequence
  chemically synthesized
gagtagtctactaaagtctgct

SEQ ID NO: 1193320 - DNA, 22 bp, Artificial Sequence
  chemically synthesized
tgtgaaataagcatataaaaag

SEQ ID NO: 1193321 - DNA, 22 bp, Artificial Sequence
  chemically synthesized
gtgtgaaataagcatataaaaa

SEQ ID NO: 1193322 - DNA, 22 bp, Artificial Sequence
  chemically synthesized
ctaaagtctgctttttatatgc

SEQ ID NO: 1193323 - DNA, 22 bp, Artificial Sequence
  chemically synthesized
tgtgtgaaataagcatataaaa

SEQ ID NO: 1193324 - DNA, 22 bp, Artificial Sequence
  chemically synthesized
aagtctgctttttatatgctta

SEQ ID NO: 1193325 - DNA, 22 bp, Artificial Sequence
  chemically synthesized
ctttttatatgcttatttcaca

SEQ ID NO: 1193326 - DNA, 22 bp, Artificial Sequence
  chemically synthesized
tttatatgcttatttcacacaa

SEQ ID NO: 1193327 - DNA, 22 bp, Artificial Sequence
  chemically synthesized
ttatatgcttatttcacacaaa

SEQ ID NO: 1193328 - DNA, 22 bp, Artificial Sequence
  chemically synthesized
tatatgcttatttcacacaaaa

SEQ ID NO: 1193329 - DNA, 22 bp, Artificial Sequence
  chemically synthesized
atatgcttatttcacacaaaat

SEQ ID NO: 1193330 - DNA, 22 bp, Artificial Sequence
  chemically synthesized
tatgcttatttcacacaaaatg

SEQ ID NO: 1193331 - DNA, 22 bp, Artificial Sequence
  chemically synthesized
atttcacacaaaatggttattg

SEQ ID NO: 1193332 - DNA, 22 bp, Artificial Sequence
  chemically synthesized
tttcacacaaaatggttattga

SEQ ID NO: 1193333 - DNA, 22 bp, Artificial Sequence
  chemically synthesized
cacacaaaatggttattgacca

SEQ ID NO: 1193334 - DNA, 22 bp, Artificial Sequence
  chemically synthesized
acacaaaatggttattgaccat

SEQ ID NO: 1193335 - DNA, 22 bp, Artificial Sequence
  chemically synthesized
gacaaaatacatatggtcaata

SEQ ID NO: 1193336 - DNA, 22 bp, Artificial Sequence
  chemically synthesized
gtaagggcctagacaaaataca

SEQ ID NO: 1193337 - DNA, 22 bp, Artificial Sequence
  chemically synthesized
ggtaagggcctagacaaaatac

SEQ ID NO: 1193338 - DNA, 22 bp, Artificial Sequence
  chemically synthesized
ttgaccatatgtattttgtcta

SEQ ID NO: 1193339 - DNA, 22 bp, Artificial Sequence
  chemically synthesized
ttggtaagggcctagacaaaat

SEQ ID NO: 1193340 - DNA, 22 bp, Artificial Sequence
  chemically synthesized
accatatgtattttgtctaggc

SEQ ID NO: 1193341 - DNA, 22 bp, Artificial Sequence
  chemically synthesized
ctcttggtaagggcctagacaa

SEQ ID NO: 1193342 - DNA, 22 bp, Artificial Sequence
  chemically synthesized
acagctcctcttggtaagggcc

SEQ ID NO: 1193343 - DNA, 22 bp, Artificial Sequence
  chemically synthesized
tgttaacagctcctcttggtaa

SEQ ID NO: 1193344 - DNA, 22 bp, Artificial Sequence
  chemically synthesized
tgtctaggcccttaccaagagg

SEQ ID NO: 1193345 - DNA, 22 bp, Artificial Sequence
  chemically synthesized
gtctaggcccttaccaagagga

SEQ ID NO: 1193346 - DNA, 22 bp, Artificial Sequence
  chemically synthesized
tctaggcccttaccaagaggag

SEQ ID NO: 1193347 - DNA, 22 bp, Artificial Sequence
  chemically synthesized
ggcccttaccaagaggagctgt

SEQ ID NO: 1193348 - DNA, 22 bp, Artificial Sequence
  chemically synthesized
taaatcaattatgttaacagct

SEQ ID NO: 1193349 - DNA, 22 bp, Artificial Sequence
  chemically synthesized
accaagaggagctgttaacata

SEQ ID NO: 1193350 - DNA, 22 bp, Artificial Sequence
  chemically synthesized
ccaagaggagctgttaacataa

SEQ ID NO: 1193351 - DNA, 22 bp, Artificial Sequence
  chemically synthesized
aattgtaaatcaattatgttaa

SEQ ID NO: 1193352 - DNA, 22 bp, Artificial Sequence
  chemically synthesized
actgaattgtaaatcaattatg

SEQ ID NO: 1193353 - DNA, 22 bp, Artificial Sequence
  chemically synthesized
ctaactgaattgtaaatcaatt

SEQ ID NO: 1193354 - DNA, 22 bp, Artificial Sequence
  chemically synthesized
cctaactgaattgtaaatcaat

SEQ ID NO: 1193355 - DNA, 22 bp, Artificial Sequence
  chemically synthesized
ttcctaactgaattgtaaatca

SEQ ID NO: 1193356 - DNA, 22 bp, Artificial Sequence
  chemically synthesized
cttcctaactgaattgtaaatc

SEQ ID NO: 1193357 - DNA, 22 bp, Artificial Sequence
  chemically synthesized
ttaacataattgatttacaatt

SEQ ID NO: 1193358 - DNA, 22 bp, Artificial Sequence
  chemically synthesized
tcttcctaactgaattgtaaat

SEQ ID NO: 1193359 - DNA, 22 bp, Artificial Sequence
  chemically synthesized
acataattgatttacaattcag

SEQ ID NO: 1193360 - DNA, 22 bp, Artificial Sequence
  chemically synthesized
acatgttttcttcctaactgaa

SEQ ID NO: 1193361 - DNA, 22 bp, Artificial Sequence
  chemically synthesized
aacatgttttcttcctaactga

SEQ ID NO: 1193362 - DNA, 22 bp, Artificial Sequence
  chemically synthesized
taacatgttttcttcctaactg

SEQ ID NO: 1193363 - DNA, 22 bp, Artificial Sequence
  chemically synthesized
atttacaattcagttaggaaga

SEQ ID NO: 1193364 - DNA, 22 bp, Artificial Sequence
  chemically synthesized
gctttaacatgttttcttccta

SEQ ID NO: 1193365 - DNA, 22 bp, Artificial Sequence
  chemically synthesized
acaattcagttaggaagaaaac

SEQ ID NO: 1193366 - DNA, 22 bp, Artificial Sequence
  chemically synthesized
caattcagttaggaagaaaaca

SEQ ID NO: 1193367 - DNA, 22 bp, Artificial Sequence
  chemically synthesized
agttaggaagaaaacatgttaa

SEQ ID NO: 1193368 - DNA, 22 bp, Artificial Sequence
  chemically synthesized
agagtaaaattagctttaacat

SEQ ID NO: 1193369 - DNA, 22 bp, Artificial Sequence
  chemically synthesized
cagagtaaaattagctttaaca

SEQ ID NO: 1193370 - DNA, 22 bp, Artificial Sequence
  chemically synthesized
ggaagaaaacatgttaaagcta

SEQ ID NO: 1193371 - DNA, 22 bp, Artificial Sequence
  chemically synthesized
tttcagagtaaaattagcttta

SEQ ID NO: 1193372 - DNA, 22 bp, Artificial Sequence
  chemically synthesized
ttgtttcagagtaaaattagct

SEQ ID NO: 1193373 - DNA, 22 bp, Artificial Sequence
  chemically synthesized
attgtttcagagtaaaattagc

SEQ ID NO: 1193374 - DNA, 22 bp, Artificial Sequence
  chemically synthesized
atttattgtttcagagtaaaat

SEQ ID NO: 1193375 - DNA, 22 bp, Artificial Sequence
  chemically synthesized
ggttgatttattgtttcagagt

SEQ ID NO: 1193376 - DNA, 22 bp, Artificial Sequence
  chemically synthesized
aagctaattttactctgaaaca

SEQ ID NO: 1193377 - DNA, 22 bp, Artificial Sequence
  chemically synthesized
acattgggttgatttattgttt

SEQ ID NO: 1193378 - DNA, 22 bp, Artificial Sequence
  chemically synthesized
attttactctgaaacaataaat

SEQ ID NO: 1193379 - DNA, 22 bp, Artificial Sequence
  chemically synthesized
cacattgggttgatttattgtt

SEQ ID NO: 1193380 - DNA, 22 bp, Artificial Sequence
  chemically synthesized
tactctgaaacaataaatcaac

SEQ ID NO: 1193381 - DNA, 22 bp, Artificial Sequence
  chemically synthesized
actctgaaacaataaatcaacc

SEQ ID NO: 1193382 - DNA, 22 bp, Artificial Sequence
  chemically synthesized
ctctgaaacaataaatcaaccc

SEQ ID NO: 1193383 - DNA, 22 bp, Artificial Sequence
  chemically synthesized
tgaaacaataaatcaacccaat

SEQ ID NO: 1193384 - DNA, 22 bp, Artificial Sequence
  chemically synthesized
tgatatacttcacattgggttg

SEQ ID NO: 1193385 - DNA, 22 bp, Artificial Sequence
  chemically synthesized
aaacaataaatcaacccaatgt

SEQ ID NO: 1193386 - DNA, 22 bp, Artificial Sequence
  chemically synthesized
tgggctgtgatatacttcacat

SEQ ID NO: 1193387 - DNA, 22 bp, Artificial Sequence
  chemically synthesized
atgggctgtgatatacttcaca

SEQ ID NO: 1193388 - DNA, 22 bp, Artificial Sequence
  chemically synthesized
tatgggctgtgatatacttcac

SEQ ID NO: 1193389 - DNA, 22 bp, Artificial Sequence
  chemically synthesized
attttatgggctgtgatatact

SEQ ID NO: 1193390 - DNA, 22 bp, Artificial Sequence
  chemically synthesized
ttcattttatgggctgtgatat

SEQ ID NO: 1193391 - DNA, 22 bp, Artificial Sequence
  chemically synthesized
gatcactgttcattttatgggc

SEQ ID NO: 1193392 - DNA, 22 bp, Artificial Sequence
  chemically synthesized
tacaattggatcactgttcatt

SEQ ID NO: 1193393 - DNA, 22 bp, Artificial Sequence
  chemically synthesized
aactgtacaattggatcactgt

SEQ ID NO: 1193394 - DNA, 22 bp, Artificial Sequence
  chemically synthesized
catggttcaactgtacaattgg

SEQ ID NO: 1193395 - DNA, 22 bp, Artificial Sequence
  chemically synthesized
tacagttgaaccatgtagctca

SEQ ID NO: 1193396 - DNA, 22 bp, Artificial Sequence
  chemically synthesized
agtgccatgggatatgtgagct

SEQ ID NO: 1193397 - DNA, 22 bp, Artificial Sequence
  chemically synthesized
aagtgccatgggatatgtgagc

SEQ ID NO: 1193398 - DNA, 22 bp, Artificial Sequence
  chemically synthesized
taagtgccatgggatatgtgag

SEQ ID NO: 1193399 - DNA, 22 bp, Artificial Sequence
  chemically synthesized
aaccatgtagctcacatatccc

SEQ ID NO: 1193400 - DNA, 22 bp, Artificial Sequence
  chemically synthesized
gatgaagattttaagtgccatg

SEQ ID NO: 1193401 - DNA, 22 bp, Artificial Sequence
  chemically synthesized
acatatcccatggcacttaaaa

SEQ ID NO: 1193402 - DNA, 22 bp, Artificial Sequence
  chemically synthesized
atgactggatgaagattttaag

SEQ ID NO: 1193403 - DNA, 22 bp, Artificial Sequence
  chemically synthesized
aatgactggatgaagattttaa

SEQ ID NO: 1193404 - DNA, 22 bp, Artificial Sequence
  chemically synthesized
tttaatgactggatgaagattt

SEQ ID NO: 1193405 - DNA, 22 bp, Artificial Sequence
  chemically synthesized
atttaatgactggatgaagatt

SEQ ID NO: 1193406 - DNA, 22 bp, Artificial Sequence
  chemically synthesized
agacttatttaatgactggatg

SEQ ID NO: 1193407 - DNA, 22 bp, Artificial Sequence
  chemically synthesized
gagacttatttaatgactggat

SEQ ID NO: 1193408 - DNA, 22 bp, Artificial Sequence
  chemically synthesized
aaaatcttcatccagtcattaa

SEQ ID NO: 1193409 - DNA, 22 bp, Artificial Sequence
  chemically synthesized
aaatcttcatccagtcattaaa

SEQ ID NO: 1193410 - DNA, 22 bp, Artificial Sequence
  chemically synthesized
gatcttgagacttatttaatga

SEQ ID NO: 1193411 - DNA, 22 bp, Artificial Sequence
  chemically synthesized
ggatcttgagacttatttaatg

SEQ ID NO: 1193412 - DNA, 22 bp, Artificial Sequence
  chemically synthesized
tggatcttgagacttatttaat

SEQ ID NO: 1193413 - DNA, 22 bp, Artificial Sequence
  chemically synthesized
ttggatcttgagacttatttaa

SEQ ID NO: 1193414 - DNA, 22 bp, Artificial Sequence
  chemically synthesized
catccagtcattaaataagtct

SEQ ID NO: 1193415 - DNA, 22 bp, Artificial Sequence
  chemically synthesized
atccagtcattaaataagtctc

SEQ ID NO: 1193416 - DNA, 22 bp, Artificial Sequence
  chemically synthesized
tgtaaatcttttggatcttgag

SEQ ID NO: 1193417 - DNA, 22 bp, Artificial Sequence
  chemically synthesized
atgtaaatcttttggatcttga

SEQ ID NO: 1193418 - DNA, 22 bp, Artificial Sequence
  chemically synthesized
aataagtctcaagatccaaaag

SEQ ID NO: 1193419 - DNA, 22 bp, Artificial Sequence
  chemically synthesized
tgcttatgtaaatcttttggat

SEQ ID NO: 1193420 - DNA, 22 bp, Artificial Sequence
  chemically synthesized
agttgtgcttatgtaaatcttt

SEQ ID NO: 1193421 - DNA, 22 bp, Artificial Sequence
  chemically synthesized
ttcagttgtgcttatgtaaatc

SEQ ID NO: 1193422 - DNA, 22 bp, Artificial Sequence
  chemically synthesized
aagatccaaaagatttacataa

SEQ ID NO: 1193423 - DNA, 22 bp, Artificial Sequence
  chemically synthesized
ataaagttattcagttgtgctt

SEQ ID NO: 1193424 - DNA, 22 bp, Artificial Sequence
  chemically synthesized
acataagcacaactgaataact

SEQ ID NO: 1193425 - DNA, 22 bp, Artificial Sequence
  chemically synthesized
cataagcacaactgaataactt

SEQ ID NO: 1193426 - DNA, 22 bp, Artificial Sequence
  chemically synthesized
taaacccagaagagaagagcta

SEQ ID NO: 1193427 - DNA, 22 bp, Artificial Sequence
  chemically synthesized
aataactttattagctcttctc

SEQ ID NO: 1193428 - DNA, 22 bp, Artificial Sequence
  chemically synthesized
atcattataaacccagaagaga

SEQ ID NO: 1193429 - DNA, 22 bp, Artificial Sequence
  chemically synthesized
tattagctcttctcttctgggt

SEQ ID NO: 1193430 - DNA, 22 bp, Artificial Sequence
  chemically synthesized
attagctcttctcttctgggtt

SEQ ID NO: 1193431 - DNA, 22 bp, Artificial Sequence
  chemically synthesized
ttagctcttctcttctgggttt

SEQ ID NO: 1193432 - DNA, 22 bp, Artificial Sequence
  chemically synthesized
gttcatcattataaacccagaa

SEQ ID NO: 1193433 - DNA, 22 bp, Artificial Sequence
  chemically synthesized
agttcatcattataaacccaga

SEQ ID NO: 1193434 - DNA, 22 bp, Artificial Sequence
  chemically synthesized
tagttcatcattataaacccag

SEQ ID NO: 1193435 - DNA, 22 bp, Artificial Sequence
  chemically synthesized
gctcttctcttctgggtttata

SEQ ID NO: 1193436 - DNA, 22 bp, Artificial Sequence
  chemically synthesized
ttagttcatcattataaaccca

SEQ ID NO: 1193437 - DNA, 22 bp, Artificial Sequence
  chemically synthesized
ttctcttctgggtttataatga

SEQ ID NO: 1193438 - DNA, 22 bp, Artificial Sequence
  chemically synthesized
ctcttctgggtttataatgatg

SEQ ID NO: 1193439 - DNA, 22 bp, Artificial Sequence
  chemically synthesized
gtatttttagttcatcattata

SEQ ID NO: 1193440 - DNA, 22 bp, Artificial Sequence
  chemically synthesized
tcttctgggtttataatgatga

SEQ ID NO: 1193441 - DNA, 22 bp, Artificial Sequence
  chemically synthesized
ttctgggtttataatgatgaac

SEQ ID NO: 1193442 - DNA, 22 bp, Artificial Sequence
  chemically synthesized
ctgggtttataatgatgaacta

SEQ ID NO: 1193443 - DNA, 22 bp, Artificial Sequence
  chemically synthesized
tgggtttataatgatgaactaa

SEQ ID NO: 1193444 - DNA, 22 bp, Artificial Sequence
  chemically synthesized
ggtttataatgatgaactaaaa

SEQ ID NO: 1193445 - DNA, 22 bp, Artificial Sequence
  chemically synthesized
taacaggttagtatttttagtt

SEQ ID NO: 1193446 - DNA, 22 bp, Artificial Sequence
  chemically synthesized
ataacaggttagtatttttagt

SEQ ID NO: 1193447 - DNA, 22 bp, Artificial Sequence
  chemically synthesized
ataatgatgaactaaaaatact

SEQ ID NO: 1193448 - DNA, 22 bp, Artificial Sequence
  chemically synthesized
taatgatgaactaaaaatacta

SEQ ID NO: 1193449 - DNA, 22 bp, Artificial Sequence
  chemically synthesized
atgtaatttataacaggttagt

SEQ ID NO: 1193450 - DNA, 22 bp, Artificial Sequence
  chemically synthesized
ctgatgtaatttataacaggtt

SEQ ID NO: 1193451 - DNA, 22 bp, Artificial Sequence
  chemically synthesized
aaaatactaacctgttataaat

SEQ ID NO: 1193452 - DNA, 22 bp, Artificial Sequence
  chemically synthesized
aaagattactgatgtaatttat

SEQ ID NO: 1193453 - DNA, 22 bp, Artificial Sequence
  chemically synthesized
acctgttataaattacatcagt

SEQ ID NO: 1193454 - DNA, 22 bp, Artificial Sequence
  chemically synthesized
ttataaattacatcagtaatct

SEQ ID NO: 1193455 - DNA, 22 bp, Artificial Sequence
  chemically synthesized
taaattacatcagtaatctttc

SEQ ID NO: 1193456 - DNA, 22 bp, Artificial Sequence
  chemically synthesized
catcagtaatctttcagctctt

SEQ ID NO: 1193457 - DNA, 22 bp, Artificial Sequence
  chemically synthesized
taatatgatgagaaaaagagct

SEQ ID NO: 1193458 - DNA, 22 bp, Artificial Sequence
  chemically synthesized
ataatatgatgagaaaaagagc

SEQ ID NO: 1193459 - DNA, 22 bp, Artificial Sequence
  chemically synthesized
taaatttataatatgatgagaa

SEQ ID NO: 1193460 - DNA, 22 bp, Artificial Sequence
  chemically synthesized
tcagctctttttctcatcatat

SEQ ID NO: 1193461 - DNA, 22 bp, Artificial Sequence
  chemically synthesized
cagctctttttctcatcatatt

SEQ ID NO: 1193462 - DNA, 22 bp, Artificial Sequence
  chemically synthesized
agctctttttctcatcatatta

SEQ ID NO: 1193463 - DNA, 22 bp, Artificial Sequence
  chemically synthesized
tttttctcatcatattataaat

SEQ ID NO: 1193464 - DNA, 22 bp, Artificial Sequence
  chemically synthesized
agtaacattgtaaatttataat

SEQ ID NO: 1193465 - DNA, 22 bp, Artificial Sequence
  chemically synthesized
tttctcatcatattataaattt

SEQ ID NO: 1193466 - DNA, 22 bp, Artificial Sequence
  chemically synthesized
ttctcatcatattataaattta

SEQ ID NO: 1193467 - DNA, 22 bp, Artificial Sequence
  chemically synthesized
tctcatcatattataaatttac

SEQ ID NO: 1193468 - DNA, 22 bp, Artificial Sequence
  chemically synthesized
ctcatcatattataaatttaca

SEQ ID NO: 1193469 - DNA, 22 bp, Artificial Sequence
  chemically synthesized
tcatcatattataaatttacaa

SEQ ID NO: 1193470 - DNA, 22 bp, Artificial Sequence
  chemically synthesized
atctcagtaacattgtaaattt

SEQ ID NO: 1193471 - DNA, 22 bp, Artificial Sequence
  chemically synthesized
aatctcagtaacattgtaaatt

SEQ ID NO: 1193472 - DNA, 22 bp, Artificial Sequence
  chemically synthesized
atcatattataaatttacaatg

SEQ ID NO: 1193473 - DNA, 22 bp, Artificial Sequence
  chemically synthesized
taatctcagtaacattgtaaat

SEQ ID NO: 1193474 - DNA, 22 bp, Artificial Sequence
  chemically synthesized
ttaatctcagtaacattgtaaa

SEQ ID NO: 1193475 - DNA, 22 bp, Artificial Sequence
  chemically synthesized
tttaatctcagtaacattgtaa

SEQ ID NO: 1193476 - DNA, 22 bp, Artificial Sequence
  chemically synthesized
taaatttacaatgttactgaga

SEQ ID NO: 1193477 - DNA, 22 bp, Artificial Sequence
  chemically synthesized
acaatgttactgagattaaaaa

SEQ ID NO: 1193478 - DNA, 22 bp, Artificial Sequence
  chemically synthesized
caatgttactgagattaaaaaa

SEQ ID NO: 1193479 - DNA, 22 bp, Artificial Sequence
  chemically synthesized
acatatgataaacattttttaa

SEQ ID NO: 1193480 - DNA, 22 bp, Artificial Sequence
  chemically synthesized
ctgagattaaaaaatgtttatc

SEQ ID NO: 1193481 - DNA, 22 bp, Artificial Sequence
  chemically synthesized
agattaaaaaatgtttatcata

SEQ ID NO: 1193482 - DNA, 22 bp, Artificial Sequence
  chemically synthesized
aaaaatgtttatcatatgttaa

SEQ ID NO: 1193483 - DNA, 22 bp, Artificial Sequence
  chemically synthesized
aagatcatgcaaataattaaca

SEQ ID NO: 1193484 - DNA, 22 bp, Artificial Sequence
  chemically synthesized
atcatatgttaattatttgcat

SEQ ID NO: 1193485 - DNA, 22 bp, Artificial Sequence
  chemically synthesized
tcatatgttaattatttgcatg

SEQ ID NO: 1193486 - DNA, 22 bp, Artificial Sequence
  chemically synthesized
aaaatgctaaagatcatgcaaa

SEQ ID NO: 1193487 - DNA, 22 bp, Artificial Sequence
  chemically synthesized
aaaaatgctaaagatcatgcaa

SEQ ID NO: 1193488 - DNA, 22 bp, Artificial Sequence
  chemically synthesized
tttaaaaatgctaaagatcatg

SEQ ID NO: 1193489 - DNA, 22 bp, Artificial Sequence
  chemically synthesized
attatttgcatgatctttagca

SEQ ID NO: 1193490 - DNA, 22 bp, Artificial Sequence
  chemically synthesized
cattgtttaaaaatgctaaaga

SEQ ID NO: 1193491 - DNA, 22 bp, Artificial Sequence
  chemically synthesized
ccattgtttaaaaatgctaaag

SEQ ID NO: 1193492 - DNA, 22 bp, Artificial Sequence
  chemically synthesized
tccattgtttaaaaatgctaaa

SEQ ID NO: 1193493 - DNA, 22 bp, Artificial Sequence
  chemically synthesized
tttgcatgatctttagcatttt

SEQ ID NO: 1193494 - DNA, 22 bp, Artificial Sequence
  chemically synthesized
ttccattgtttaaaaatgctaa

SEQ ID NO: 1193495 - DNA, 22 bp, Artificial Sequence
  chemically synthesized
tttccattgtttaaaaatgcta

SEQ ID NO: 1193496 - DNA, 22 bp, Artificial Sequence
  chemically synthesized
ttttccattgtttaaaaatgct

SEQ ID NO: 1193497 - DNA, 22 bp, Artificial Sequence
  chemically synthesized
gcatgatctttagcatttttaa

SEQ ID NO: 1193498 - DNA, 22 bp, Artificial Sequence
  chemically synthesized
catgatctttagcatttttaaa

SEQ ID NO: 1193499 - DNA, 22 bp, Artificial Sequence
  chemically synthesized
ttttttccattgtttaaaaatg

SEQ ID NO: 1193500 - DNA, 22 bp, Artificial Sequence
  chemically synthesized
tcttttttccattgtttaaaaa

SEQ ID NO: 1193501 - DNA, 22 bp, Artificial Sequence
  chemically synthesized
tagcatttttaaacaatggaaa

SEQ ID NO: 1193502 - DNA, 22 bp, Artificial Sequence
  chemically synthesized
gtagctctcttttttccattgt

SEQ ID NO: 1193503 - DNA, 22 bp, Artificial Sequence
  chemically synthesized
agcatttttaaacaatggaaaa

SEQ ID NO: 1193504 - DNA, 22 bp, Artificial Sequence
  chemically synthesized
ggtagctctcttttttccattg

SEQ ID NO: 1193505 - DNA, 22 bp, Artificial Sequence
  chemically synthesized
gcatttttaaacaatggaaaaa

SEQ ID NO: 1193506 - DNA, 22 bp, Artificial Sequence
  chemically synthesized
tggtagctctcttttttccatt

SEQ ID NO: 1193507 - DNA, 22 bp, Artificial Sequence
  chemically synthesized
gttttggtagctctcttttttc

SEQ ID NO: 1193508 - DNA, 22 bp, Artificial Sequence
  chemically synthesized
ttaaacaatggaaaaaagagag

SEQ ID NO: 1193509 - DNA, 22 bp, Artificial Sequence
  chemically synthesized
tggttttggtagctctcttttt

SEQ ID NO: 1193510 - DNA, 22 bp, Artificial Sequence
  chemically synthesized
taaacaatggaaaaaagagagc

SEQ ID NO: 1193511 - DNA, 22 bp, Artificial Sequence
  chemically synthesized
aaacaatggaaaaaagagagct

SEQ ID NO: 1193512 - DNA, 22 bp, Artificial Sequence
  chemically synthesized
aacaatggaaaaaagagagcta

SEQ ID NO: 1193513 - DNA, 22 bp, Artificial Sequence
  chemically synthesized
atgccaagaacacaactctggt

SEQ ID NO: 1193514 - DNA, 22 bp, Artificial Sequence
  chemically synthesized
tgatgccaagaacacaactctg

SEQ ID NO: 1193515 - DNA, 22 bp, Artificial Sequence
  chemically synthesized
ctgatgccaagaacacaactct

SEQ ID NO: 1193516 - DNA, 22 bp, Artificial Sequence
  chemically synthesized
tctgatgccaagaacacaactc

SEQ ID NO: 1193517 - DNA, 22 bp, Artificial Sequence
  chemically synthesized
ccaaaaccagagttgtgttctt

SEQ ID NO: 1193518 - DNA, 22 bp, Artificial Sequence
  chemically synthesized
gagctttctgatgccaagaaca

SEQ ID NO: 1193519 - DNA, 22 bp, Artificial Sequence
  chemically synthesized
ctagagctttctgatgccaaga

SEQ ID NO: 1193520 - DNA, 22 bp, Artificial Sequence
  chemically synthesized
actagagctttctgatgccaag

SEQ ID NO: 1193521 - DNA, 22 bp, Artificial Sequence
  chemically synthesized
atgtttactagagctttctgat

SEQ ID NO: 1193522 - DNA, 22 bp, Artificial Sequence
  chemically synthesized
gatgtttactagagctttctga

SEQ ID NO: 1193523 - DNA, 22 bp, Artificial Sequence
  chemically synthesized
tgttcttggcatcagaaagctc

SEQ ID NO: 1193524 - DNA, 22 bp, Artificial Sequence
  chemically synthesized
tttgatgtttactagagctttc

SEQ ID NO: 1193525 - DNA, 22 bp, Artificial Sequence
  chemically synthesized
atttgatgtttactagagcttt

SEQ ID NO: 1193526 - DNA, 22 bp, Artificial Sequence
  chemically synthesized
ttggcatcagaaagctctagta

SEQ ID NO: 1193527 - DNA, 22 bp, Artificial Sequence
  chemically synthesized
ggcatcagaaagctctagtaaa

SEQ ID NO: 1193528 - DNA, 22 bp, Artificial Sequence
  chemically synthesized
gcatcagaaagctctagtaaac

SEQ ID NO: 1193529 - DNA, 22 bp, Artificial Sequence
  chemically synthesized
aagtttatttgatgtttactag

SEQ ID NO: 1193530 - DNA, 22 bp, Artificial Sequence
  chemically synthesized
ttaaagtttatttgatgtttac

SEQ ID NO: 1193531 - DNA, 22 bp, Artificial Sequence
  chemically synthesized
agctgttaaagtttatttgatg

SEQ ID NO: 1193532 - DNA, 22 bp, Artificial Sequence
  chemically synthesized
tagtaaacatcaaataaacttt

SEQ ID NO: 1193533 - DNA, 22 bp, Artificial Sequence
  chemically synthesized
gtaaacatcaaataaactttaa

SEQ ID NO: 1193534 - DNA, 22 bp, Artificial Sequence
  chemically synthesized
cgcactaagctgttaaagttta

SEQ ID NO: 1193535 - DNA, 22 bp, Artificial Sequence
  chemically synthesized
acgcactaagctgttaaagttt

SEQ ID NO: 1193536 - DNA, 22 bp, Artificial Sequence
  chemically synthesized
tttacgcactaagctgttaaag

SEQ ID NO: 1193537 - DNA, 22 bp, Artificial Sequence
  chemically synthesized
tgttatttacgcactaagctgt

SEQ ID NO: 1193538 - DNA, 22 bp, Artificial Sequence
  chemically synthesized
aggctgtgttatttacgcacta

SEQ ID NO: 1193539 - DNA, 22 bp, Artificial Sequence
  chemically synthesized
gaggctgtgttatttacgcact

SEQ ID NO: 1193540 - DNA, 22 bp, Artificial Sequence
  chemically synthesized
taacagcttagtgcgtaaataa

SEQ ID NO: 1193541 - DNA, 22 bp, Artificial Sequence
  chemically synthesized
aacagcttagtgcgtaaataac

SEQ ID NO: 1193542 - DNA, 22 bp, Artificial Sequence
  chemically synthesized
acagcttagtgcgtaaataaca

SEQ ID NO: 1193543 - DNA, 22 bp, Artificial Sequence
  chemically synthesized
tacttgaggctgtgttatttac

SEQ ID NO: 1193544 - DNA, 22 bp, Artificial Sequence
  chemically synthesized
agtgcgtaaataacacagcctc

SEQ ID NO: 1193545 - DNA, 22 bp, Artificial Sequence
  chemically synthesized
gtgcgtaaataacacagcctca

SEQ ID NO: 1193546 - DNA, 22 bp, Artificial Sequence
  chemically synthesized
aggtgttgtacttgaggctgtg

SEQ ID NO: 1193547 - DNA, 22 bp, Artificial Sequence
  chemically synthesized
tggctaaggtgttgtacttgag

SEQ ID NO: 1193548 - DNA, 22 bp, Artificial Sequence
  chemically synthesized
tctgtggctaaggtgttgtact

SEQ ID NO: 1193549 - DNA, 22 bp, Artificial Sequence
  chemically synthesized
agtactatctgtggctaaggtg

SEQ ID NO: 1193550 - DNA, 22 bp, Artificial Sequence
  chemically synthesized
ttaagtactatctgtggctaag

SEQ ID NO: 1193551 - DNA, 22 bp, Artificial Sequence
  chemically synthesized
aagtacaacaccttagccacag

SEQ ID NO: 1193552 - DNA, 22 bp, Artificial Sequence
  chemically synthesized
attaagtactatctgtggctaa

SEQ ID NO: 1193553 - DNA, 22 bp, Artificial Sequence
  chemically synthesized
tttattaagtactatctgtggc

SEQ ID NO: 1193554 - DNA, 22 bp, Artificial Sequence
  chemically synthesized
agccacagatagtacttaataa

SEQ ID NO: 1193555 - DNA, 22 bp, Artificial Sequence
  chemically synthesized
gccacagatagtacttaataaa

SEQ ID NO: 1193556 - DNA, 22 bp, Artificial Sequence
  chemically synthesized
cacagatacaaccaaacaatga

SEQ ID NO: 1193557 - DNA, 22 bp, Artificial Sequence
  chemically synthesized
aataaatagtcattgtttggtt

SEQ ID NO: 1193558 - DNA, 22 bp, Artificial Sequence
  chemically synthesized
ataaatagtcattgtttggttg

SEQ ID NO: 1193559 - DNA, 22 bp, Artificial Sequence
  chemically synthesized
tgttacacagatacaaccaaac

SEQ ID NO: 1193560 - DNA, 22 bp, Artificial Sequence
  chemically synthesized
ttgtgttacacagatacaacca

SEQ ID NO: 1193561 - DNA, 22 bp, Artificial Sequence
  chemically synthesized
tgttgtgttacacagatacaac

SEQ ID NO: 1193562 - DNA, 22 bp, Artificial Sequence
  chemically synthesized
ctgttgtgttacacagatacaa

SEQ ID NO: 1193563 - DNA, 22 bp, Artificial Sequence
  chemically synthesized
ttctgttgtgttacacagatac

SEQ ID NO: 1193564 - DNA, 22 bp, Artificial Sequence
  chemically synthesized
cttctgttgtgttacacagata

SEQ ID NO: 1193565 - DNA, 22 bp, Artificial Sequence
  chemically synthesized
tcttctgttgtgttacacagat

SEQ ID NO: 1193566 - DNA, 22 bp, Artificial Sequence
  chemically synthesized
tttggttgtatctgtgtaacac

SEQ ID NO: 1193567 - DNA, 22 bp, Artificial Sequence
  chemically synthesized
ggttgtatctgtgtaacacaac

SEQ ID NO: 1193568 - DNA, 22 bp, Artificial Sequence
  chemically synthesized
gttgtatctgtgtaacacaaca

SEQ ID NO: 1193569 - DNA, 22 bp, Artificial Sequence
  chemically synthesized
tatactttcttctgttgtgtta

SEQ ID NO: 1193570 - DNA, 22 bp, Artificial Sequence
  chemically synthesized
tatctgtgtaacacaacagaag

SEQ ID NO: 1193571 - DNA, 22 bp, Artificial Sequence
  chemically synthesized
ggattgtatactttcttctgtt

SEQ ID NO: 1193572 - DNA, 22 bp, Artificial Sequence
  chemically synthesized
tgtaacacaacagaagaaagta

SEQ ID NO: 1193573 - DNA, 22 bp, Artificial Sequence
  chemically synthesized
aagcaaggattaggattgtata

SEQ ID NO: 1193574 - DNA, 22 bp, Artificial Sequence
  chemically synthesized
taaagcaaggattaggattgta

SEQ ID NO: 1193575 - DNA, 22 bp, Artificial Sequence
  chemically synthesized
gattctaaagcaaggattagga

SEQ ID NO: 1193576 - DNA, 22 bp, Artificial Sequence
  chemically synthesized
agaaaacaatgtctagattcta

SEQ ID NO: 1193577 - DNA, 22 bp, Artificial Sequence
  chemically synthesized
atccttgctttagaatctagac

SEQ ID NO: 1193578 - DNA, 22 bp, Artificial Sequence
  chemically synthesized
gctttagaatctagacattgtt

SEQ ID NO: 1193579 - DNA, 22 bp, Artificial Sequence
  chemically synthesized
ctttagaatctagacattgttt

SEQ ID NO: 1193580 - DNA, 22 bp, Artificial Sequence
  chemically synthesized
tagaatctagacattgttttct

SEQ ID NO: 1193581 - DNA, 22 bp, Artificial Sequence
  chemically synthesized
cagaaatggctaagaaaacaat

SEQ ID NO: 1193582 - DNA, 22 bp, Artificial Sequence
  chemically synthesized
agaatctagacattgttttctt

SEQ ID NO: 1193583 - DNA, 22 bp, Artificial Sequence
  chemically synthesized
gaatctagacattgttttctta

SEQ ID NO: 1193584 - DNA, 22 bp, Artificial Sequence
  chemically synthesized
ttgcagaaatggctaagaaaac

SEQ ID NO: 1193585 - DNA, 22 bp, Artificial Sequence
  chemically synthesized
ttattgcagaaatggctaagaa

SEQ ID NO: 1193586 - DNA, 22 bp, Artificial Sequence
  chemically synthesized
gacattgttttcttagccattt

SEQ ID NO: 1193587 - DNA, 22 bp, Artificial Sequence
  chemically synthesized
actgttattgcagaaatggcta

SEQ ID NO: 1193588 - DNA, 22 bp, Artificial Sequence
  chemically synthesized
aactgttattgcagaaatggct

SEQ ID NO: 1193589 - DNA, 22 bp, Artificial Sequence
  chemically synthesized
taactgttattgcagaaatggc

SEQ ID NO: 1193590 - DNA, 22 bp, Artificial Sequence
  chemically synthesized
ttttaactgttattgcagaaat

SEQ ID NO: 1193591 - DNA, 22 bp, Artificial Sequence
  chemically synthesized
ttttcttagccatttctgcaat

SEQ ID NO: 1193592 - DNA, 22 bp, Artificial Sequence
  chemically synthesized
attttaactgttattgcagaaa

SEQ ID NO: 1193593 - DNA, 22 bp, Artificial Sequence
  chemically synthesized
tcttagccatttctgcaataac

SEQ ID NO: 1193594 - DNA, 22 bp, Artificial Sequence
  chemically synthesized
cttagccatttctgcaataaca

SEQ ID NO: 1193595 - DNA, 22 bp, Artificial Sequence
  chemically synthesized
ttagccatttctgcaataacag

SEQ ID NO: 1193596 - DNA, 22 bp, Artificial Sequence
  chemically synthesized
agccatttctgcaataacagtt

SEQ ID NO: 1193597 - DNA, 22 bp, Artificial Sequence
  chemically synthesized
gccatttctgcaataacagtta

SEQ ID NO: 1193598 - DNA, 22 bp, Artificial Sequence
  chemically synthesized
gtacgtttattttaactgttat

SEQ ID NO: 1193599 - DNA, 22 bp, Artificial Sequence
  chemically synthesized
ctgcaataacagttaaaataaa

SEQ ID NO: 1193600 - DNA, 22 bp, Artificial Sequence
  chemically synthesized
tgcaataacagttaaaataaac

SEQ ID NO: 1193601 - DNA, 22 bp, Artificial Sequence
  chemically synthesized
caataacagttaaaataaacgt

SEQ ID NO: 1193602 - DNA, 22 bp, Artificial Sequence
  chemically synthesized
ccagaaatgctggtacgtttat

SEQ ID NO: 1193603 - DNA, 22 bp, Artificial Sequence
  chemically synthesized
accagaaatgctggtacgttta

SEQ ID NO: 1193604 - DNA, 22 bp, Artificial Sequence
  chemically synthesized
taccagaaatgctggtacgttt

SEQ ID NO: 1193605 - DNA, 22 bp, Artificial Sequence
  chemically synthesized
gagtctttaccagaaatgctgg

SEQ ID NO: 1193606 - DNA, 22 bp, Artificial Sequence
  chemically synthesized
aaataaacgtaccagcatttct

SEQ ID NO: 1193607 - DNA, 22 bp, Artificial Sequence
  chemically synthesized
tatattagagtctttaccagaa

SEQ ID NO: 1193608 - DNA, 22 bp, Artificial Sequence
  chemically synthesized
atatattagagtctttaccaga

SEQ ID NO: 1193609 - DNA, 22 bp, Artificial Sequence
  chemically synthesized
gaacacccttatatattagagt

SEQ ID NO: 1193610 - DNA, 22 bp, Artificial Sequence
  chemically synthesized
tggaacacccttatatattaga

SEQ ID NO: 1193611 - DNA, 22 bp, Artificial Sequence
  chemically synthesized
ctggtaaagactctaatatata

SEQ ID NO: 1193612 - DNA, 22 bp, Artificial Sequence
  chemically synthesized
ctggaacacccttatatattag

SEQ ID NO: 1193613 - DNA, 22 bp, Artificial Sequence
  chemically synthesized
tggtaaagactctaatatataa

SEQ ID NO: 1193614 - DNA, 22 bp, Artificial Sequence
  chemically synthesized
gtaaagactctaatatataagg

SEQ ID NO: 1193615 - DNA, 22 bp, Artificial Sequence
  chemically synthesized
aaatttctggaacacccttata

SEQ ID NO: 1193616 - DNA, 22 bp, Artificial Sequence
  chemically synthesized
taatatataagggtgttccaga

SEQ ID NO: 1193617 - DNA, 22 bp, Artificial Sequence
  chemically synthesized
gtatattgaaatttctggaaca

SEQ ID NO: 1193618 - DNA, 22 bp, Artificial Sequence
  chemically synthesized
atatataagggtgttccagaaa

SEQ ID NO: 1193619 - DNA, 22 bp, Artificial Sequence
  chemically synthesized
tcaaatctagtatattgaaatt

SEQ ID NO: 1193620 - DNA, 22 bp, Artificial Sequence
  chemically synthesized
cagaaatttcaatatactagat

SEQ ID NO: 1193621 - DNA, 22 bp, Artificial Sequence
  chemically synthesized
aagccatactgtcaaatctagt

SEQ ID NO: 1193622 - DNA, 22 bp, Artificial Sequence
  chemically synthesized
tcaagccatactgtcaaatcta

SEQ ID NO: 1193623 - DNA, 22 bp, Artificial Sequence
  chemically synthesized
tctcaagccatactgtcaaatc

SEQ ID NO: 1193624 - DNA, 22 bp, Artificial Sequence
  chemically synthesized
caatatactagatttgacagta

SEQ ID NO: 1193625 - DNA, 22 bp, Artificial Sequence
  chemically synthesized
aatatactagatttgacagtat

SEQ ID NO: 1193626 - DNA, 22 bp, Artificial Sequence
  chemically synthesized
gatttgacagtatggcttgaga

SEQ ID NO: 1193627 - DNA, 22 bp, Artificial Sequence
  chemically synthesized
agcagtgggatccctctctcaa

SEQ ID NO: 1193628 - DNA, 22 bp, Artificial Sequence
  chemically synthesized
gacagtatggcttgagagaggg

SEQ ID NO: 1193629 - DNA, 22 bp, Artificial Sequence
  chemically synthesized
acagtatggcttgagagaggga

SEQ ID NO: 1193630 - DNA, 22 bp, Artificial Sequence
  chemically synthesized
gagagagggatcccactgctga

SEQ ID NO: 1193631 - DNA, 22 bp, Artificial Sequence
  chemically synthesized
agagagggatcccactgctgag

SEQ ID NO: 1193632 - DNA, 22 bp, Artificial Sequence
  chemically synthesized
tgatccatgatatgagaggcag

SEQ ID NO: 1193633 - DNA, 22 bp, Artificial Sequence
  chemically synthesized
ctgagcattctctgcctctcat

SEQ ID NO: 1193634 - DNA, 22 bp, Artificial Sequence
  chemically synthesized
agcattctctgcctctcatatc

SEQ ID NO: 1193635 - DNA, 22 bp, Artificial Sequence
  chemically synthesized
tctgcctctcatatcatggatc

SEQ ID NO: 1193636 - DNA, 22 bp, Artificial Sequence
  chemically synthesized
ataagtgactatgatccatgat

SEQ ID NO: 1193637 - DNA, 22 bp, Artificial Sequence
  chemically synthesized
cataagtgactatgatccatga

SEQ ID NO: 1193638 - DNA, 22 bp, Artificial Sequence
  chemically synthesized
tgcctctcatatcatggatcat

SEQ ID NO: 1193639 - DNA, 22 bp, Artificial Sequence
  chemically synthesized
cctctcatatcatggatcatag

SEQ ID NO: 1193640 - DNA, 22 bp, Artificial Sequence
  chemically synthesized
tcatatcatggatcatagtcac

SEQ ID NO: 1193641 - DNA, 22 bp, Artificial Sequence
  chemically synthesized
atatcatggatcatagtcactt

SEQ ID NO: 1193642 - DNA, 22 bp, Artificial Sequence
  chemically synthesized
tagataaaatttcataagtgac

SEQ ID NO: 1193643 - DNA, 22 bp, Artificial Sequence
  chemically synthesized
caatattatagataaaatttca

SEQ ID NO: 1193644 - DNA, 22 bp, Artificial Sequence
  chemically synthesized
tggactacaatattatagataa

SEQ ID NO: 1193645 - DNA, 22 bp, Artificial Sequence
  chemically synthesized
atgaaattttatctataatatt

SEQ ID NO: 1193646 - DNA, 22 bp, Artificial Sequence
  chemically synthesized
tgaaattttatctataatattg

SEQ ID NO: 1193647 - DNA, 22 bp, Artificial Sequence
  chemically synthesized
tatctataatattgtagtccat

SEQ ID NO: 1193648 - DNA, 22 bp, Artificial Sequence
  chemically synthesized
atctataatattgtagtccata

SEQ ID NO: 1193649 - DNA, 22 bp, Artificial Sequence
  chemically synthesized
tctataatattgtagtccatag

SEQ ID NO: 1193650 - DNA, 22 bp, Artificial Sequence
  chemically synthesized
taatattgtagtccataggtat

SEQ ID NO: 1193651 - DNA, 22 bp, Artificial Sequence
  chemically synthesized
tagtccataggtatatatatgt

SEQ ID NO: 1193652 - DNA, 22 bp, Artificial Sequence
  chemically synthesized
tagaatcatagcatgtatataa

SEQ ID NO: 1193653 - DNA, 22 bp, Artificial Sequence
  chemically synthesized
gtagaatcatagcatgtatata

SEQ ID NO: 1193654 - DNA, 22 bp, Artificial Sequence
  chemically synthesized
tgtagaatcatagcatgtatat

SEQ ID NO: 1193655 - DNA, 22 bp, Artificial Sequence
  chemically synthesized
atatacatgctatgattctaca

SEQ ID NO: 1193656 - DNA, 22 bp, Artificial Sequence
  chemically synthesized
tatacatgctatgattctacaa

SEQ ID NO: 1193657 - DNA, 22 bp, Artificial Sequence
  chemically synthesized
aagatgtcaagtattttgtaga

SEQ ID NO: 1193658 - DNA, 22 bp, Artificial Sequence
  chemically synthesized
tgattctacaaaatacttgaca

SEQ ID NO: 1193659 - DNA, 22 bp, Artificial Sequence
  chemically synthesized
taggcggtcattaaagatgtca

SEQ ID NO: 1193660 - DNA, 22 bp, Artificial Sequence
  chemically synthesized
tacaaaatacttgacatcttta

SEQ ID NO: 1193661 - DNA, 22 bp, Artificial Sequence
  chemically synthesized
ataggcggtcattaaagatgtc

SEQ ID NO: 1193662 - DNA, 22 bp, Artificial Sequence
  chemically synthesized
tataggcggtcattaaagatgt

SEQ ID NO: 1193663 - DNA, 22 bp, Artificial Sequence
  chemically synthesized
caaaatacttgacatctttaat

SEQ ID NO: 1193664 - DNA, 22 bp, Artificial Sequence
  chemically synthesized
gacatctttaatgaccgcctat

SEQ ID NO: 1193665 - DNA, 22 bp, Artificial Sequence
  chemically synthesized
acatctttaatgaccgcctata

SEQ ID NO: 1193666 - DNA, 22 bp, Artificial Sequence
  chemically synthesized
agcccatgtgtatctttatagg

SEQ ID NO: 1193667 - DNA, 22 bp, Artificial Sequence
  chemically synthesized
cagcccatgtgtatctttatag

SEQ ID NO: 1193668 - DNA, 22 bp, Artificial Sequence
  chemically synthesized
tcagcccatgtgtatctttata

SEQ ID NO: 1193669 - DNA, 22 bp, Artificial Sequence
  chemically synthesized
taatgaccgcctataaagatac

SEQ ID NO: 1193670 - DNA, 22 bp, Artificial Sequence
  chemically synthesized
aatgaccgcctataaagataca

SEQ ID NO: 1193671 - DNA, 22 bp, Artificial Sequence
  chemically synthesized
atgaccgcctataaagatacac

SEQ ID NO: 1193672 - DNA, 22 bp, Artificial Sequence
  chemically synthesized
atccattttcagcccatgtgta

SEQ ID NO: 1193673 - DNA, 22 bp, Artificial Sequence
  chemically synthesized
catccattttcagcccatgtgt

SEQ ID NO: 1193674 - DNA, 22 bp, Artificial Sequence
  chemically synthesized
tcatccattttcagcccatgtg

SEQ ID NO: 1193675 - DNA, 22 bp, Artificial Sequence
  chemically synthesized
ttcatccattttcagcccatgt

SEQ ID NO: 1193676 - DNA, 22 bp, Artificial Sequence
  chemically synthesized
tttcatccattttcagcccatg

SEQ ID NO: 1193677 - DNA, 22 bp, Artificial Sequence
  chemically synthesized
ttttcatccattttcagcccat

SEQ ID NO: 1193678 - DNA, 22 bp, Artificial Sequence
  chemically synthesized
taaagatacacatgggctgaaa

SEQ ID NO: 1193679 - DNA, 22 bp, Artificial Sequence
  chemically synthesized
gcatggaatatcttttttcatc

SEQ ID NO: 1193680 - DNA, 22 bp, Artificial Sequence
  chemically synthesized
cattggcatggaatatcttttt

SEQ ID NO: 1193681 - DNA, 22 bp, Artificial Sequence
  chemically synthesized
aaaatggatgaaaaaagatatt

SEQ ID NO: 1193682 - DNA, 22 bp, Artificial Sequence
  chemically synthesized
ccattggcatggaatatctttt

SEQ ID NO: 1193683 - DNA, 22 bp, Artificial Sequence
  chemically synthesized
gtttccattggcatggaatatc

SEQ ID NO: 1193684 - DNA, 22 bp, Artificial Sequence
  chemically synthesized
ggtttccattggcatggaatat

SEQ ID NO: 1193685 - DNA, 22 bp, Artificial Sequence
  chemically synthesized
tggtttccattggcatggaata

SEQ ID NO: 1193686 - DNA, 22 bp, Artificial Sequence
  chemically synthesized
ttggtttccattggcatggaat

SEQ ID NO: 1193687 - DNA, 22 bp, Artificial Sequence
  chemically synthesized
tttggtttccattggcatggaa

SEQ ID NO: 1193688 - DNA, 22 bp, Artificial Sequence
  chemically synthesized
ttttttggtttccattggcatg

SEQ ID NO: 1193689 - DNA, 22 bp, Artificial Sequence
  chemically synthesized
ctgttttttggtttccattggc

SEQ ID NO: 1193690 - DNA, 22 bp, Artificial Sequence
  chemically synthesized
ctgctgttttttggtttccatt

SEQ ID NO: 1193691 - DNA, 22 bp, Artificial Sequence
  chemically synthesized
catgccaatggaaaccaaaaaa

SEQ ID NO: 1193692 - DNA, 22 bp, Artificial Sequence
  chemically synthesized
aaaaaagtacagccactcctgc

SEQ ID NO: 1193693 - DNA, 22 bp, Artificial Sequence
  chemically synthesized
tctgaaaaaagtacagccactc

SEQ ID NO: 1193694 - DNA, 22 bp, Artificial Sequence
  chemically synthesized
tgtctgaaaaaagtacagccac

SEQ ID NO: 1193695 - DNA, 22 bp, Artificial Sequence
  chemically synthesized
ttctgtctgaaaaaagtacagc

SEQ ID NO: 1193696 - DNA, 22 bp, Artificial Sequence
  chemically synthesized
aaatctgttctgtctgaaaaaa

SEQ ID NO: 1193697 - DNA, 22 bp, Artificial Sequence
  chemically synthesized
gaaatctgttctgtctgaaaaa

SEQ ID NO: 1193698 - DNA, 22 bp, Artificial Sequence
  chemically synthesized
tcttgaaatctgttctgtctga

SEQ ID NO: 1193699 - DNA, 22 bp, Artificial Sequence
  chemically synthesized
gtcttgaaatctgttctgtctg

SEQ ID NO: 1193700 - DNA, 22 bp, Artificial Sequence
  chemically synthesized
tgtcttgaaatctgttctgtct

SEQ ID NO: 1193701 - DNA, 22 bp, Artificial Sequence
  chemically synthesized
ttgtcttgaaatctgttctgtc

SEQ ID NO: 1193702 - DNA, 22 bp, Artificial Sequence
  chemically synthesized
tacttttttcagacagaacaga

SEQ ID NO: 1193703 - DNA, 22 bp, Artificial Sequence
  chemically synthesized
tttttgtcttgaaatctgttct

SEQ ID NO: 1193704 - DNA, 22 bp, Artificial Sequence
  chemically synthesized
gtttttgtcttgaaatctgttc

SEQ ID NO: 1193705 - DNA, 22 bp, Artificial Sequence
  chemically synthesized
tgtttttgtcttgaaatctgtt

SEQ ID NO: 1193706 - DNA, 22 bp, Artificial Sequence
  chemically synthesized
ttttcagacagaacagatttca

SEQ ID NO: 1193707 - DNA, 22 bp, Artificial Sequence
  chemically synthesized
tttcagacagaacagatttcaa

SEQ ID NO: 1193708 - DNA, 22 bp, Artificial Sequence
  chemically synthesized
tttgtttttgtcttgaaatctg

SEQ ID NO: 1193709 - DNA, 22 bp, Artificial Sequence
  chemically synthesized
ttcagacagaacagatttcaag

SEQ ID NO: 1193710 - DNA, 22 bp, Artificial Sequence
  chemically synthesized
tcagacagaacagatttcaaga

SEQ ID NO: 1193711 - DNA, 22 bp, Artificial Sequence
  chemically synthesized
cagacagaacagatttcaagac

SEQ ID NO: 1193712 - DNA, 22 bp, Artificial Sequence
  chemically synthesized
agacagaacagatttcaagaca

SEQ ID NO: 1193713 - DNA, 22 bp, Artificial Sequence
  chemically synthesized
actctttgtttttgtcttgaaa

SEQ ID NO: 1193714 - DNA, 22 bp, Artificial Sequence
  chemically synthesized
gactctttgtttttgtcttgaa

SEQ ID NO: 1193715 - DNA, 22 bp, Artificial Sequence
  chemically synthesized
tgactctttgtttttgtcttga

SEQ ID NO: 1193716 - DNA, 22 bp, Artificial Sequence
  chemically synthesized
ttgactctttgtttttgtcttg

SEQ ID NO: 1193717 - DNA, 22 bp, Artificial Sequence
  chemically synthesized
tttgactctttgtttttgtctt

SEQ ID NO: 1193718 - DNA, 22 bp, Artificial Sequence
  chemically synthesized
ttttgactctttgtttttgtct

SEQ ID NO: 1193719 - DNA, 22 bp, Artificial Sequence
  chemically synthesized
caagacaaaaacaaagagtcaa

SEQ ID NO: 1193720 - DNA, 22 bp, Artificial Sequence
  chemically synthesized
aagacaaaaacaaagagtcaaa

SEQ ID NO: 1193721 - DNA, 22 bp, Artificial Sequence
  chemically synthesized
tataatgaccttttttgactct

SEQ ID NO: 1193722 - DNA, 22 bp, Artificial Sequence
  chemically synthesized
attatataatgaccttttttga

SEQ ID NO: 1193723 - DNA, 22 bp, Artificial Sequence
  chemically synthesized
tcattatataatgacctttttt

SEQ ID NO: 1193724 - DNA, 22 bp, Artificial Sequence
  chemically synthesized
ctcattatataatgaccttttt

SEQ ID NO: 1193725 - DNA, 22 bp, Artificial Sequence
  chemically synthesized
tctcattatataatgacctttt

SEQ ID NO: 1193726 - DNA, 22 bp, Artificial Sequence
  chemically synthesized
acccctttctcattatataatg

SEQ ID NO: 1193727 - DNA, 22 bp, Artificial Sequence
  chemically synthesized
aattgacccctttctcattata

SEQ ID NO: 1193728 - DNA, 22 bp, Artificial Sequence
  chemically synthesized
ctgaattgacccctttctcatt

SEQ ID NO: 1193729 - DNA, 22 bp, Artificial Sequence
  chemically synthesized
gctgaattgacccctttctcat

SEQ ID NO: 1193730 - DNA, 22 bp, Artificial Sequence
  chemically synthesized
tgctgaattgacccctttctca

SEQ ID NO: 1193731 - DNA, 22 bp, Artificial Sequence
  chemically synthesized
ttgctgaattgacccctttctc

SEQ ID NO: 1193732 - DNA, 22 bp, Artificial Sequence
  chemically synthesized
tataatgagaaaggggtcaatt

SEQ ID NO: 1193733 - DNA, 22 bp, Artificial Sequence
  chemically synthesized
tatccttttgctgaattgaccc

SEQ ID NO: 1193734 - DNA, 22 bp, Artificial Sequence
  chemically synthesized
ttgtatccttttgctgaattga

SEQ ID NO: 1193735 - DNA, 22 bp, Artificial Sequence
  chemically synthesized
caattgttgtatccttttgctg

SEQ ID NO: 1193736 - DNA, 22 bp, Artificial Sequence
  chemically synthesized
gcaattgttgtatccttttgct

SEQ ID NO: 1193737 - DNA, 22 bp, Artificial Sequence
  chemically synthesized
aatatttgcaattgttgtatcc

SEQ ID NO: 1193738 - DNA, 22 bp, Artificial Sequence
  chemically synthesized
agcaaaaggatacaacaattgc

SEQ ID NO: 1193739 - DNA, 22 bp, Artificial Sequence
  chemically synthesized
ggtgcctaaatatttgcaattg

SEQ ID NO: 1193740 - DNA, 22 bp, Artificial Sequence
  chemically synthesized
cagtgttgggtgcctaaatatt

SEQ ID NO: 1193741 - DNA, 22 bp, Artificial Sequence
  chemically synthesized
ggtgctccagtgttgggtgcct

SEQ ID NO: 1193742 - DNA, 22 bp, Artificial Sequence
  chemically synthesized
caaatatttaggcacccaacac

SEQ ID NO: 1193743 - DNA, 22 bp, Artificial Sequence
  chemically synthesized
tctgggtgctccagtgttgggt

SEQ ID NO: 1193744 - DNA, 22 bp, Artificial Sequence
  chemically synthesized
atctgggtgctccagtgttggg

SEQ ID NO: 1193745 - DNA, 22 bp, Artificial Sequence
  chemically synthesized
tttatctgggtgctccagtgtt

SEQ ID NO: 1193746 - DNA, 22 bp, Artificial Sequence
  chemically synthesized
atttatctgggtgctccagtgt

SEQ ID NO: 1193747 - DNA, 22 bp, Artificial Sequence
  chemically synthesized
tatttatctgggtgctccagtg

SEQ ID NO: 1193748 - DNA, 22 bp, Artificial Sequence
  chemically synthesized
aggcacccaacactggagcacc

SEQ ID NO: 1193749 - DNA, 22 bp, Artificial Sequence
  chemically synthesized
ggcacccaacactggagcaccc

SEQ ID NO: 1193750 - DNA, 22 bp, Artificial Sequence
  chemically synthesized
ctttatttatctgggtgctcca

SEQ ID NO: 1193751 - DNA, 22 bp, Artificial Sequence
  chemically synthesized
gctttatttatctgggtgctcc

SEQ ID NO: 1193752 - DNA, 22 bp, Artificial Sequence
  chemically synthesized
ataatatttgctttatttatct

SEQ ID NO: 1193753 - DNA, 22 bp, Artificial Sequence
  chemically synthesized
taataatatttgctttatttat

SEQ ID NO: 1193754 - DNA, 22 bp, Artificial Sequence
  chemically synthesized
gagcacccagataaataaagca

SEQ ID NO: 1193755 - DNA, 22 bp, Artificial Sequence
  chemically synthesized
gctctaataatatttgctttat

SEQ ID NO: 1193756 - DNA, 22 bp, Artificial Sequence
  chemically synthesized
agctctaataatatttgcttta

SEQ ID NO: 1193757 - DNA, 22 bp, Artificial Sequence
  chemically synthesized
tagctctaataatatttgcttt

SEQ ID NO: 1193758 - DNA, 22 bp, Artificial Sequence
  chemically synthesized
tttagctctaataatatttgct

SEQ ID NO: 1193759 - DNA, 22 bp, Artificial Sequence
  chemically synthesized
tctttagctctaataatatttg

SEQ ID NO: 1193760 - DNA, 22 bp, Artificial Sequence
  chemically synthesized
tctctttagctctaataatatt

SEQ ID NO: 1193761 - DNA, 22 bp, Artificial Sequence
  chemically synthesized
tctctctttagctctaataata

SEQ ID NO: 1193762 - DNA, 22 bp, Artificial Sequence
  chemically synthesized
tctctctctttagctctaataa

SEQ ID NO: 1193763 - DNA, 22 bp, Artificial Sequence
  chemically synthesized
agatctctctctctctttagct

SEQ ID NO: 1193764 - DNA, 22 bp, Artificial Sequence
  chemically synthesized
agttgagatctctctctctctt

SEQ ID NO: 1193765 - DNA, 22 bp, Artificial Sequence
  chemically synthesized
gagttgagatctctctctctct

SEQ ID NO: 1193766 - DNA, 22 bp, Artificial Sequence
  chemically synthesized
tgagttgagatctctctctctc

SEQ ID NO: 1193767 - DNA, 22 bp, Artificial Sequence
  chemically synthesized
ttagagctaaagagagagagag

SEQ ID NO: 1193768 - DNA, 22 bp, Artificial Sequence
  chemically synthesized
gagctaaagagagagagagatc

SEQ ID NO: 1193769 - DNA, 22 bp, Artificial Sequence
  chemically synthesized
agcctttgagttgagatctctc

SEQ ID NO: 1193770 - DNA, 22 bp, Artificial Sequence
  chemically synthesized
ctcagcctttgagttgagatct

SEQ ID NO: 1193771 - DNA, 22 bp, Artificial Sequence
  chemically synthesized
aagagagagagagatctcaact

SEQ ID NO: 1193772 - DNA, 22 bp, Artificial Sequence
  chemically synthesized
gtaccctactcagcctttgagt

SEQ ID NO: 1193773 - DNA, 22 bp, Artificial Sequence
  chemically synthesized
caccccctagtaccctactcag

SEQ ID NO: 1193774 - DNA, 22 bp, Artificial Sequence
  chemically synthesized
aactcaaaggctgagtagggta

SEQ ID NO: 1193775 - DNA, 22 bp, Artificial Sequence
  chemically synthesized
cctccaccccctagtaccctac

SEQ ID NO: 1193776 - DNA, 22 bp, Artificial Sequence
  chemically synthesized
acctccaccccctagtacccta

SEQ ID NO: 1193777 - DNA, 22 bp, Artificial Sequence
  chemically synthesized
aaaggctgagtagggtactagg

SEQ ID NO: 1193778 - DNA, 22 bp, Artificial Sequence
  chemically synthesized
agtagggtactagggggtggag

SEQ ID NO: 1193779 - DNA, 22 bp, Artificial Sequence
  chemically synthesized
accaaccccagcttacctccac

SEQ ID NO: 1193780 - DNA, 22 bp, Artificial Sequence
  chemically synthesized
gggggtggaggtaagctggggt

SEQ ID NO: 1193781 - DNA, 22 bp, Artificial Sequence
  chemically synthesized
tacccattaaccaaccccagct

SEQ ID NO: 1193782 - DNA, 22 bp, Artificial Sequence
  chemically synthesized
gtacccattaaccaaccccagc

SEQ ID NO: 1193783 - DNA, 22 bp, Artificial Sequence
  chemically synthesized
tgtacccattaaccaaccccag

SEQ ID NO: 1193784 - DNA, 22 bp, Artificial Sequence
  chemically synthesized
ttgtacccattaaccaacccca

SEQ ID NO: 1193785 - DNA, 22 bp, Artificial Sequence
  chemically synthesized
aggaatttttgtacccattaac

SEQ ID NO: 1193786 - DNA, 22 bp, Artificial Sequence
  chemically synthesized
taaggaatttttgtacccatta

SEQ ID NO: 1193787 - DNA, 22 bp, Artificial Sequence
  chemically synthesized
ctaaggaatttttgtacccatt

SEQ ID NO: 1193788 - DNA, 22 bp, Artificial Sequence
  chemically synthesized
tctaaggaatttttgtacccat

SEQ ID NO: 1193789 - DNA, 22 bp, Artificial Sequence
  chemically synthesized
gggttggttaatgggtacaaaa

SEQ ID NO: 1193790 - DNA, 22 bp, Artificial Sequence
  chemically synthesized
tttctaaggaatttttgtaccc

SEQ ID NO: 1193791 - DNA, 22 bp, Artificial Sequence
  chemically synthesized
ttctttctaaggaatttttgta

SEQ ID NO: 1193792 - DNA, 22 bp, Artificial Sequence
  chemically synthesized
attctttctaaggaatttttgt

SEQ ID NO: 1193793 - DNA, 22 bp, Artificial Sequence
  chemically synthesized
tattctttctaaggaatttttg

SEQ ID NO: 1193794 - DNA, 22 bp, Artificial Sequence
  chemically synthesized
gttaatgggtacaaaaattcct

SEQ ID NO: 1193795 - DNA, 22 bp, Artificial Sequence
  chemically synthesized
atgggtacaaaaattccttaga

SEQ ID NO: 1193796 - DNA, 22 bp, Artificial Sequence
  chemically synthesized
tgttttattctttctaaggaat

SEQ ID NO: 1193797 - DNA, 22 bp, Artificial Sequence
  chemically synthesized
gcaaatactatgttttattctt

SEQ ID NO: 1193798 - DNA, 22 bp, Artificial Sequence
  chemically synthesized
tgctcgcaaatactatgtttta

SEQ ID NO: 1193799 - DNA, 22 bp, Artificial Sequence
  chemically synthesized
cttagaaagaataaaacatagt

SEQ ID NO: 1193800 - DNA, 22 bp, Artificial Sequence
  chemically synthesized
ctgtgctcgcaaatactatgtt

SEQ ID NO: 1193801 - DNA, 22 bp, Artificial Sequence
  chemically synthesized
agaaagaataaaacatagtatt

SEQ ID NO: 1193802 - DNA, 22 bp, Artificial Sequence
  chemically synthesized
gctgtgctcgcaaatactatgt

SEQ ID NO: 1193803 - DNA, 22 bp, Artificial Sequence
  chemically synthesized
gaaagaataaaacatagtattt

SEQ ID NO: 1193804 - DNA, 22 bp, Artificial Sequence
  chemically synthesized
agtatagtcaccttgctgtgct

SEQ ID NO: 1193805 - DNA, 22 bp, Artificial Sequence
  chemically synthesized
ttgagtatagtcaccttgctgt

SEQ ID NO: 1193806 - DNA, 22 bp, Artificial Sequence
  chemically synthesized
aattattgagtatagtcacctt

SEQ ID NO: 1193807 - DNA, 22 bp, Artificial Sequence
  chemically synthesized
gcgagcacagcaaggtgactat

SEQ ID NO: 1193808 - DNA, 22 bp, Artificial Sequence
  chemically synthesized
cgagcacagcaaggtgactata

SEQ ID NO: 1193809 - DNA, 22 bp, Artificial Sequence
  chemically synthesized
taaaatgtacagttaaattatt

SEQ ID NO: 1193810 - DNA, 22 bp, Artificial Sequence
  chemically synthesized
ttataaaatgtacagttaaatt

SEQ ID NO: 1193811 - DNA, 22 bp, Artificial Sequence
  chemically synthesized
tactcaataatttaactgtaca

SEQ ID NO: 1193812 - DNA, 22 bp, Artificial Sequence
  chemically synthesized
agttattataaaatgtacagtt

SEQ ID NO: 1193813 - DNA, 22 bp, Artificial Sequence
  chemically synthesized
aataatttaactgtacatttta

SEQ ID NO: 1193814 - DNA, 22 bp, Artificial Sequence
  chemically synthesized
aactgtacattttataataact

SEQ ID NO: 1193815 - DNA, 22 bp, Artificial Sequence
  chemically synthesized
actgtacattttataataactc

SEQ ID NO: 1193816 - DNA, 22 bp, Artificial Sequence
  chemically synthesized
tacattttataataactcagta

SEQ ID NO: 1193817 - DNA, 22 bp, Artificial Sequence
  chemically synthesized
taaacaatccaatgatactgag

SEQ ID NO: 1193818 - DNA, 22 bp, Artificial Sequence
  chemically synthesized
tataataactcagtatcattgg

SEQ ID NO: 1193819 - DNA, 22 bp, Artificial Sequence
  chemically synthesized
ataataactcagtatcattgga

SEQ ID NO: 1193820 - DNA, 22 bp, Artificial Sequence
  chemically synthesized
tgttataaacaatccaatgata

SEQ ID NO: 1193821 - DNA, 22 bp, Artificial Sequence
  chemically synthesized
taataactcagtatcattggat

SEQ ID NO: 1193822 - DNA, 22 bp, Artificial Sequence
  chemically synthesized
gtgttataaacaatccaatgat

SEQ ID NO: 1193823 - DNA, 22 bp, Artificial Sequence
  chemically synthesized
tgtgttataaacaatccaatga

SEQ ID NO: 1193824 - DNA, 22 bp, Artificial Sequence
  chemically synthesized
tcctttgtgttataaacaatcc

SEQ ID NO: 1193825 - DNA, 22 bp, Artificial Sequence
  chemically synthesized
atcctttgtgttataaacaatc

SEQ ID NO: 1193826 - DNA, 22 bp, Artificial Sequence
  chemically synthesized
agtatcattggattgtttataa

SEQ ID NO: 1193827 - DNA, 22 bp, Artificial Sequence
  chemically synthesized
aagcatttatcctttgtgttat

SEQ ID NO: 1193828 - DNA, 22 bp, Artificial Sequence
  chemically synthesized
gattgtttataacacaaaggat

SEQ ID NO: 1193829 - DNA, 22 bp, Artificial Sequence
  chemically synthesized
tttataacacaaaggataaatg

SEQ ID NO: 1193830 - DNA, 22 bp, Artificial Sequence
  chemically synthesized
ataacacaaaggataaatgctt

SEQ ID NO: 1193831 - DNA, 22 bp, Artificial Sequence
  chemically synthesized
taacacaaaggataaatgcttg

SEQ ID NO: 1193832 - DNA, 22 bp, Artificial Sequence
  chemically synthesized
gagtggatggataccccattct

SEQ ID NO: 1193833 - DNA, 22 bp, Artificial Sequence
  chemically synthesized
agtggatggataccccattctc

SEQ ID NO: 1193834 - DNA, 22 bp, Artificial Sequence
  chemically synthesized
ataaaggcatgcagtaaataat

SEQ ID NO: 1193835 - DNA, 22 bp, Artificial Sequence
  chemically synthesized
tccatgtgattattatttactg

SEQ ID NO: 1193836 - DNA, 22 bp, Artificial Sequence
  chemically synthesized
gataaaggcatgcagtaaataa

SEQ ID NO: 1193837 - DNA, 22 bp, Artificial Sequence
  chemically synthesized
tgataaaggcatgcagtaaata

SEQ ID NO: 1193838 - DNA, 22 bp, Artificial Sequence
  chemically synthesized
catgtgattattatttactgca

SEQ ID NO: 1193839 - DNA, 22 bp, Artificial Sequence
  chemically synthesized
ttatttactgcatgcctttatc

SEQ ID NO: 1193840 - DNA, 22 bp, Artificial Sequence
  chemically synthesized
tttactgcatgcctttatcaaa

SEQ ID NO: 1193841 - DNA, 22 bp, Artificial Sequence
  chemically synthesized
actgcatgcctttatcaaagta

SEQ ID NO: 1193842 - DNA, 22 bp, Artificial Sequence
  chemically synthesized
ctgcatgcctttatcaaagtat

SEQ ID NO: 1193843 - DNA, 22 bp, Artificial Sequence
  chemically synthesized
catgcctttatcaaagtatctc

SEQ ID NO: 1193844 - DNA, 22 bp, Artificial Sequence
  chemically synthesized
tatcaaagtatctcatgtactg

SEQ ID NO: 1193845 - DNA, 22 bp, Artificial Sequence
  chemically synthesized
atcaaagtatctcatgtactgt

SEQ ID NO: 1193846 - DNA, 22 bp, Artificial Sequence
  chemically synthesized
tcaaagtatctcatgtactgtc

SEQ ID NO: 1193847 - DNA, 22 bp, Artificial Sequence
  chemically synthesized
atgtactgtctctctctttcta

SEQ ID NO: 1193848 - DNA, 22 bp, Artificial Sequence
  chemically synthesized
tatgtgtatatatgtatagaaa

SEQ ID NO: 1193849 - DNA, 22 bp, Artificial Sequence
  chemically synthesized
gtatgtgtatatatgtatagaa

SEQ ID NO: 1193850 - DNA, 22 bp, Artificial Sequence
  chemically synthesized
tctctctctttctatacatata

SEQ ID NO: 1193851 - DNA, 22 bp, Artificial Sequence
  chemically synthesized
tctctttctatacatatataca

SEQ ID NO: 1193852 - DNA, 22 bp, Artificial Sequence
  chemically synthesized
tctttctatacatatatacaca

SEQ ID NO: 1193853 - DNA, 22 bp, Artificial Sequence
  chemically synthesized
tttctatacatatatacacata

SEQ ID NO: 1193854 - DNA, 22 bp, Artificial Sequence
  chemically synthesized
tctatacatatatacacataca

SEQ ID NO: 1193855 - DNA, 22 bp, Artificial Sequence
  chemically synthesized
ctatacatatatacacatacaa

SEQ ID NO: 1193856 - DNA, 22 bp, Artificial Sequence
  chemically synthesized
tgggtacatagtttgtatgtgt

SEQ ID NO: 1193857 - DNA, 22 bp, Artificial Sequence
  chemically synthesized
tatacatatatacacatacaaa

SEQ ID NO: 1193858 - DNA, 22 bp, Artificial Sequence
  chemically synthesized
gtgggtacatagtttgtatgtg

SEQ ID NO: 1193859 - DNA, 22 bp, Artificial Sequence
  chemically synthesized
tgtgggtacatagtttgtatgt

SEQ ID NO: 1193860 - DNA, 22 bp, Artificial Sequence
  chemically synthesized
tacatatatacacatacaaact

SEQ ID NO: 1193861 - DNA, 22 bp, Artificial Sequence
  chemically synthesized
ttgtgggtacatagtttgtatg

SEQ ID NO: 1193862 - DNA, 22 bp, Artificial Sequence
  chemically synthesized
aatttttgtgggtacatagttt

SEQ ID NO: 1193863 - DNA, 22 bp, Artificial Sequence
  chemically synthesized
aaatttttgtgggtacatagtt

SEQ ID NO: 1193864 - DNA, 22 bp, Artificial Sequence
  chemically synthesized
taaatttttgtgggtacatagt

SEQ ID NO: 1193865 - DNA, 22 bp, Artificial Sequence
  chemically synthesized
ttaaatttttgtgggtacatag

SEQ ID NO: 1193866 - DNA, 22 bp, Artificial Sequence
  chemically synthesized
tttaaatttttgtgggtacata

SEQ ID NO: 1193867 - DNA, 22 bp, Artificial Sequence
  chemically synthesized
caggggaattttttaaattttt

SEQ ID NO: 1193868 - DNA, 22 bp, Artificial Sequence
  chemically synthesized
tgtacccacaaaaatttaaaaa

SEQ ID NO: 1193869 - DNA, 22 bp, Artificial Sequence
  chemically synthesized
catatattccaggggaattttt

SEQ ID NO: 1193870 - DNA, 22 bp, Artificial Sequence
  chemically synthesized
gaaattgcatatattccagggg

SEQ ID NO: 1193871 - DNA, 22 bp, Artificial Sequence
  chemically synthesized
ttagaaattgcatatattccag

SEQ ID NO: 1193872 - DNA, 22 bp, Artificial Sequence
  chemically synthesized
aaaaaattcccctggaatatat

SEQ ID NO: 1193873 - DNA, 22 bp, Artificial Sequence
  chemically synthesized
aaaaattcccctggaatatatg

SEQ ID NO: 1193874 - DNA, 22 bp, Artificial Sequence
  chemically synthesized
ccctggaatatatgcaatttct

SEQ ID NO: 1193875 - DNA, 22 bp, Artificial Sequence
  chemically synthesized
agagatatacctattagaaatt

SEQ ID NO: 1193876 - DNA, 22 bp, Artificial Sequence
  chemically synthesized
gaatatatgcaatttctaatag

SEQ ID NO: 1193877 - DNA, 22 bp, Artificial Sequence
  chemically synthesized
gattaagagatatacctattag

SEQ ID NO: 1193878 - DNA, 22 bp, Artificial Sequence
  chemically synthesized
agattaagagatatacctatta

SEQ ID NO: 1193879 - DNA, 22 bp, Artificial Sequence
  chemically synthesized
tttagattaagagatataccta

SEQ ID NO: 1193880 - DNA, 22 bp, Artificial Sequence
  chemically synthesized
ctaataggtatatctcttaatc

SEQ ID NO: 1193881 - DNA, 22 bp, Artificial Sequence
  chemically synthesized
taataggtatatctcttaatct

SEQ ID NO: 1193882 - DNA, 22 bp, Artificial Sequence
  chemically synthesized
aaaacattatttagattaagag

SEQ ID NO: 1193883 - DNA, 22 bp, Artificial Sequence
  chemically synthesized
ataggtatatctcttaatctaa

SEQ ID NO: 1193884 - DNA, 22 bp, Artificial Sequence
  chemically synthesized
ttaatctaaataatgttttgaa

SEQ ID NO: 1193885 - DNA, 22 bp, Artificial Sequence
  chemically synthesized
aatctaaataatgttttgaaca

SEQ ID NO: 1193886 - DNA, 22 bp, Artificial Sequence
  chemically synthesized
atctaaataatgttttgaacat

SEQ ID NO: 1193887 - DNA, 22 bp, Artificial Sequence
  chemically synthesized
aataatgttttgaacattctca

SEQ ID NO: 1193888 - DNA, 22 bp, Artificial Sequence
  chemically synthesized
gataaaagtatatgagaatgtt

SEQ ID NO: 1193889 - DNA, 22 bp, Artificial Sequence
  chemically synthesized
tgaacattctcatatactttta

SEQ ID NO: 1193890 - DNA, 22 bp, Artificial Sequence
  chemically synthesized
gaacattctcatatacttttat

SEQ ID NO: 1193891 - DNA, 22 bp, Artificial Sequence
  chemically synthesized
aacattctcatatacttttatc

SEQ ID NO: 1193892 - DNA, 22 bp, Artificial Sequence
  chemically synthesized
taacatatatattggataaaag

SEQ ID NO: 1193893 - DNA, 22 bp, Artificial Sequence
  chemically synthesized
gtaacatatatattggataaaa

SEQ ID NO: 1193894 - DNA, 22 bp, Artificial Sequence
  chemically synthesized
tcatatacttttatccaatata

SEQ ID NO: 1193895 - DNA, 22 bp, Artificial Sequence
  chemically synthesized
atatacttttatccaatatata

SEQ ID NO: 1193896 - DNA, 22 bp, Artificial Sequence
  chemically synthesized
taataaatttgtaacatatata

SEQ ID NO: 1193897 - DNA, 22 bp, Artificial Sequence
  chemically synthesized
ttatccaatatatatgttacaa

SEQ ID NO: 1193898 - DNA, 22 bp, Artificial Sequence
  chemically synthesized
tatccaatatatatgttacaaa

SEQ ID NO: 1193899 - DNA, 22 bp, Artificial Sequence
  chemically synthesized
agctgtaataaatttgtaacat

SEQ ID NO: 1193900 - DNA, 22 bp, Artificial Sequence
  chemically synthesized
atccaatatatatgttacaaat

SEQ ID NO: 1193901 - DNA, 22 bp, Artificial Sequence
  chemically synthesized
cagctgtaataaatttgtaaca

SEQ ID NO: 1193902 - DNA, 22 bp, Artificial Sequence
  chemically synthesized
tccaatatatatgttacaaatt

SEQ ID NO: 1193903 - DNA, 22 bp, Artificial Sequence
  chemically synthesized
ttcagctgtaataaatttgtaa

SEQ ID NO: 1193904 - DNA, 22 bp, Artificial Sequence
  chemically synthesized
cgtagattcttcagctgtaata

SEQ ID NO: 1193905 - DNA, 22 bp, Artificial Sequence
  chemically synthesized
caaatttattacagctgaagaa

SEQ ID NO: 1193906 - DNA, 22 bp, Artificial Sequence
  chemically synthesized
agattgcgtagattcttcagct

SEQ ID NO: 1193907 - DNA, 22 bp, Artificial Sequence
  chemically synthesized
attacagctgaagaatctacgc

SEQ ID NO: 1193908 - DNA, 22 bp, Artificial Sequence
  chemically synthesized
ttacagctgaagaatctacgca

SEQ ID NO: 1193909 - DNA, 22 bp, Artificial Sequence
  chemically synthesized
cagctgaagaatctacgcaatc

SEQ ID NO: 1193910 - DNA, 22 bp, Artificial Sequence
  chemically synthesized
catagaaagttaagattgcgta

SEQ ID NO: 1193911 - DNA, 22 bp, Artificial Sequence
  chemically synthesized
cctccatagaaagttaagattg

SEQ ID NO: 1193912 - DNA, 22 bp, Artificial Sequence
  chemically synthesized
aagaatctacgcaatcttaact

SEQ ID NO: 1193913 - DNA, 22 bp, Artificial Sequence
  chemically synthesized
cgcaatcttaactttctatgga

SEQ ID NO: 1193914 - DNA, 22 bp, Artificial Sequence
  chemically synthesized
tagtagtgtcattgcctccata

SEQ ID NO: 1193915 - DNA, 22 bp, Artificial Sequence
  chemically synthesized
atagtagtgtcattgcctccat

SEQ ID NO: 1193916 - DNA, 22 bp, Artificial Sequence
  chemically synthesized
aactttctatggaggcaatgac

SEQ ID NO: 1193917 - DNA, 22 bp, Artificial Sequence
  chemically synthesized
actttctatggaggcaatgaca

SEQ ID NO: 1193918 - DNA, 22 bp, Artificial Sequence
  chemically synthesized
tctatggaggcaatgacactac

SEQ ID NO: 1193919 - DNA, 22 bp, Artificial Sequence
  chemically synthesized
ctatggaggcaatgacactact

SEQ ID NO: 1193920 - DNA, 22 bp, Artificial Sequence
  chemically synthesized
tatggaggcaatgacactacta

SEQ ID NO: 1193921 - DNA, 22 bp, Artificial Sequence
  chemically synthesized
tggaggcaatgacactactata

SEQ ID NO: 1193922 - DNA, 22 bp, Artificial Sequence
  chemically synthesized
accccgcagtgtcataaatagt

SEQ ID NO: 1193923 - DNA, 22 bp, Artificial Sequence
  chemically synthesized
ctaaccccgcagtgtcataaat

SEQ ID NO: 1193924 - DNA, 22 bp, Artificial Sequence
  chemically synthesized
gctaaccccgcagtgtcataaa

SEQ ID NO: 1193925 - DNA, 22 bp, Artificial Sequence
  chemically synthesized
ctataaactatttatgacactg

SEQ ID NO: 1193926 - DNA, 22 bp, Artificial Sequence
  chemically synthesized
atttgctaaccccgcagtgtca

SEQ ID NO: 1193927 - DNA, 22 bp, Artificial Sequence
  chemically synthesized
taaactatttatgacactgcgg

SEQ ID NO: 1193928 - DNA, 22 bp, Artificial Sequence
  chemically synthesized
tttatgacactgcggggttagc

SEQ ID NO: 1193929 - DNA, 22 bp, Artificial Sequence
  chemically synthesized
atgggttgatttgctaaccccg

SEQ ID NO: 1193930 - DNA, 22 bp, Artificial Sequence
  chemically synthesized
atgacactgcggggttagcaaa

SEQ ID NO: 1193931 - DNA, 22 bp, Artificial Sequence
  chemically synthesized
ttcatgggttgatttgctaacc

SEQ ID NO: 1193932 - DNA, 22 bp, Artificial Sequence
  chemically synthesized
tgacactgcggggttagcaaat

SEQ ID NO: 1193933 - DNA, 22 bp, Artificial Sequence
  chemically synthesized
gttcatgggttgatttgctaac

SEQ ID NO: 1193934 - DNA, 22 bp, Artificial Sequence
  chemically synthesized
cggggttagcaaatcaacccat

SEQ ID NO: 1193935 - DNA, 22 bp, Artificial Sequence
  chemically synthesized
gcaaatcaacccatgaacaaat

SEQ ID NO: 1193936 - DNA, 22 bp, Artificial Sequence
  chemically synthesized
ataatatgatcaaaagagaaaa

SEQ ID NO: 1193937 - DNA, 22 bp, Artificial Sequence
  chemically synthesized
tcgaactaataatatgatcaaa

SEQ ID NO: 1193938 - DNA, 22 bp, Artificial Sequence
  chemically synthesized
tctatcgaactaataatatgat

SEQ ID NO: 1193939 - DNA, 22 bp, Artificial Sequence
  chemically synthesized
atctatcgaactaataatatga

SEQ ID NO: 1193940 - DNA, 22 bp, Artificial Sequence
  chemically synthesized
tctcttttgatcatattattag

SEQ ID NO: 1193941 - DNA, 22 bp, Artificial Sequence
  chemically synthesized
ctcttttgatcatattattagt

SEQ ID NO: 1193942 - DNA, 22 bp, Artificial Sequence
  chemically synthesized
tcttttgatcatattattagtt

SEQ ID NO: 1193943 - DNA, 22 bp, Artificial Sequence
  chemically synthesized
ttttgatcatattattagttcg

SEQ ID NO: 1193944 - DNA, 22 bp, Artificial Sequence
  chemically synthesized
ttgatcatattattagttcgat

SEQ ID NO: 1193945 - DNA, 22 bp, Artificial Sequence
  chemically synthesized
tgatcatattattagttcgata

SEQ ID NO: 1193946 - DNA, 22 bp, Artificial Sequence
  chemically synthesized
gatcatattattagttcgatag

SEQ ID NO: 1193947 - DNA, 22 bp, Artificial Sequence
  chemically synthesized
atcatattattagttcgataga

SEQ ID NO: 1193948 - DNA, 22 bp, Artificial Sequence
  chemically synthesized
tgaatatgaccttatctatcga

SEQ ID NO: 1193949 - DNA, 22 bp, Artificial Sequence
  chemically synthesized
cattgtgaatatgaccttatct

SEQ ID NO: 1193950 - DNA, 22 bp, Artificial Sequence
  chemically synthesized
ttagttcgatagataaggtcat

SEQ ID NO: 1193951 - DNA, 22 bp, Artificial Sequence
  chemically synthesized
gttcgatagataaggtcatatt

SEQ ID NO: 1193952 - DNA, 22 bp, Artificial Sequence
  chemically synthesized
ataagctacattgtgaatatga

SEQ ID NO: 1193953 - DNA, 22 bp, Artificial Sequence
  chemically synthesized
gatagataaggtcatattcaca

SEQ ID NO: 1193954 - DNA, 22 bp, Artificial Sequence
  chemically synthesized
tgggagacattgataagctaca

SEQ ID NO: 1193955 - DNA, 22 bp, Artificial Sequence
  chemically synthesized
ttatgggagacattgataagct

SEQ ID NO: 1193956 - DNA, 22 bp, Artificial Sequence
  chemically synthesized
attatgggagacattgataagc

SEQ ID NO: 1193957 - DNA, 22 bp, Artificial Sequence
  chemically synthesized
acaatgtagcttatcaatgtct

SEQ ID NO: 1193958 - DNA, 22 bp, Artificial Sequence
  chemically synthesized
tgaatttattatgggagacatt

SEQ ID NO: 1193959 - DNA, 22 bp, Artificial Sequence
  chemically synthesized
tctgtgaatttattatgggaga

SEQ ID NO: 1193960 - DNA, 22 bp, Artificial Sequence
  chemically synthesized
gtctgtgaatttattatgggag

SEQ ID NO: 1193961 - DNA, 22 bp, Artificial Sequence
  chemically synthesized
tgtctgtgaatttattatggga

SEQ ID NO: 1193962 - DNA, 22 bp, Artificial Sequence
  chemically synthesized
atcaatgtctcccataataaat

SEQ ID NO: 1193963 - DNA, 22 bp, Artificial Sequence
  chemically synthesized
tcaatgtctcccataataaatt

SEQ ID NO: 1193964 - DNA, 22 bp, Artificial Sequence
  chemically synthesized
aaaattttgtctgtgaatttat

SEQ ID NO: 1193965 - DNA, 22 bp, Artificial Sequence
  chemically synthesized
ccataataaattcacagacaaa

SEQ ID NO: 1193966 - DNA, 22 bp, Artificial Sequence
  chemically synthesized
gtacagattcaaaattttgtct

SEQ ID NO: 1193967 - DNA, 22 bp, Artificial Sequence
  chemically synthesized
agtacagattcaaaattttgtc

SEQ ID NO: 1193968 - DNA, 22 bp, Artificial Sequence
  chemically synthesized
tagtacagattcaaaattttgt

SEQ ID NO: 1193969 - DNA, 22 bp, Artificial Sequence
  chemically synthesized
tattttagtacagattcaaaat

SEQ ID NO: 1193970 - DNA, 22 bp, Artificial Sequence
  chemically synthesized
acagacaaaattttgaatctgt

SEQ ID NO: 1193971 - DNA, 22 bp, Artificial Sequence
  chemically synthesized
aaatactatattttagtacaga

SEQ ID NO: 1193972 - DNA, 22 bp, Artificial Sequence
  chemically synthesized
aaaatactatattttagtacag

SEQ ID NO: 1193973 - DNA, 22 bp, Artificial Sequence
  chemically synthesized
taaaatactatattttagtaca

SEQ ID NO: 1193974 - DNA, 22 bp, Artificial Sequence
  chemically synthesized
ttaaaatactatattttagtac

SEQ ID NO: 1193975 - DNA, 22 bp, Artificial Sequence
  chemically synthesized
tgaatctgtactaaaatatagt

SEQ ID NO: 1193976 - DNA, 22 bp, Artificial Sequence
  chemically synthesized
gaatctgtactaaaatatagta

SEQ ID NO: 1193977 - DNA, 22 bp, Artificial Sequence
  chemically synthesized
aatctgtactaaaatatagtat

SEQ ID NO: 1193978 - DNA, 22 bp, Artificial Sequence
  chemically synthesized
tactaaaatatagtattttaaa

SEQ ID NO: 1193979 - DNA, 22 bp, Artificial Sequence
  chemically synthesized
ccacatgtgtgtttttaaaata

SEQ ID NO: 1193980 - DNA, 22 bp, Artificial Sequence
  chemically synthesized
aaatatagtattttaaaaacac

SEQ ID NO: 1193981 - DNA, 22 bp, Artificial Sequence
  chemically synthesized
gatagggtgtgctgccacatgt

SEQ ID NO: 1193982 - DNA, 22 bp, Artificial Sequence
  chemically synthesized
ggatagggtgtgctgccacatg

SEQ ID NO: 1193983 - DNA, 22 bp, Artificial Sequence
  chemically synthesized
tggatagggtgtgctgccacat

SEQ ID NO: 1193984 - DNA, 22 bp, Artificial Sequence
  chemically synthesized
taaaaacacacatgtggcagca

SEQ ID NO: 1193985 - DNA, 22 bp, Artificial Sequence
  chemically synthesized
ttggatagggtgtgctgccaca

SEQ ID NO: 1193986 - DNA, 22 bp, Artificial Sequence
  chemically synthesized
aaaaacacacatgtggcagcac

SEQ ID NO: 1193987 - DNA, 22 bp, Artificial Sequence
  chemically synthesized
tttggatagggtgtgctgccac

SEQ ID NO: 1193988 - DNA, 22 bp, Artificial Sequence
  chemically synthesized
aaaacacacatgtggcagcaca

SEQ ID NO: 1193989 - DNA, 22 bp, Artificial Sequence
  chemically synthesized
ccatcactttttggatagggtg

SEQ ID NO: 1193990 - DNA, 22 bp, Artificial Sequence
  chemically synthesized
gccatcactttttggatagggt

SEQ ID NO: 1193991 - DNA, 22 bp, Artificial Sequence
  chemically synthesized
acacaaggccatttgccatcac

SEQ ID NO: 1193992 - DNA, 22 bp, Artificial Sequence
  chemically synthesized
tccaaaaagtgatggcaaatgg

SEQ ID NO: 1193993 - DNA, 22 bp, Artificial Sequence
  chemically synthesized
aactgacacaaggccatttgcc

SEQ ID NO: 1193994 - DNA, 22 bp, Artificial Sequence
  chemically synthesized
aaactgacacaaggccatttgc

SEQ ID NO: 1193995 - DNA, 22 bp, Artificial Sequence
  chemically synthesized
taaactgacacaaggccatttg

SEQ ID NO: 1193996 - DNA, 22 bp, Artificial Sequence
  chemically synthesized
gtgtcagtttaaagttatatct

SEQ ID NO: 1193997 - DNA, 22 bp, Artificial Sequence
  chemically synthesized
tgtcagtttaaagttatatcta

SEQ ID NO: 1193998 - DNA, 22 bp, Artificial Sequence
  chemically synthesized
aaagttatatctacttgatggt

SEQ ID NO: 1193999 - DNA, 22 bp, Artificial Sequence
  chemically synthesized
aagttatatctacttgatggtc

SEQ ID NO: 1194000 - DNA, 22 bp, Artificial Sequence
  chemically synthesized
tatctacttgatggtcatgtga

SEQ ID NO: 1194001 - DNA, 22 bp, Artificial Sequence
  chemically synthesized
cttgatggtcatgtgactctca

SEQ ID NO: 1194002 - DNA, 22 bp, Artificial Sequence
  chemically synthesized
gatggtcatgtgactctcattt

SEQ ID NO: 1194003 - DNA, 22 bp, Artificial Sequence
  chemically synthesized
atggtcatgtgactctcatttg

SEQ ID NO: 1194004 - DNA, 22 bp, Artificial Sequence
  chemically synthesized
gtggaagcagtccaaatgagag

SEQ ID NO: 1194005 - DNA, 22 bp, Artificial Sequence
  chemically synthesized
ggtggaagcagtccaaatgaga

SEQ ID NO: 1194006 - DNA, 22 bp, Artificial Sequence
  chemically synthesized
gcaaggtatatttggtggaagc

SEQ ID NO: 1194007 - DNA, 22 bp, Artificial Sequence
  chemically synthesized
tcatttggactgcttccaccaa

SEQ ID NO: 1194008 - DNA, 22 bp, Artificial Sequence
  chemically synthesized
atttggactgcttccaccaaat

SEQ ID NO: 1194009 - DNA, 22 bp, Artificial Sequence
  chemically synthesized
ggactgcttccaccaaatatac

SEQ ID NO: 1194010 - DNA, 22 bp, Artificial Sequence
  chemically synthesized
gactgcttccaccaaatatacc

SEQ ID NO: 1194011 - DNA, 22 bp, Artificial Sequence
  chemically synthesized
cttccaccaaatataccttgcc

SEQ ID NO: 1194012 - DNA, 22 bp, Artificial Sequence
  chemically synthesized
ccaccaaatataccttgccaat

SEQ ID NO: 1194013 - DNA, 22 bp, Artificial Sequence
  chemically synthesized
agatccaagatcattggcaagg

SEQ ID NO: 1194014 - DNA, 22 bp, Artificial Sequence
  chemically synthesized
caccaaatataccttgccaatg

SEQ ID NO: 1194015 - DNA, 22 bp, Artificial Sequence
  chemically synthesized
aagatccaagatcattggcaag

SEQ ID NO: 1194016 - DNA, 22 bp, Artificial Sequence
  chemically synthesized
tgccttaagatccaagatcatt

SEQ ID NO: 1194017 - DNA, 22 bp, Artificial Sequence
  chemically synthesized
atgccttaagatccaagatcat

SEQ ID NO: 1194018 - DNA, 22 bp, Artificial Sequence
  chemically synthesized
tatgccttaagatccaagatca

SEQ ID NO: 1194019 - DNA, 22 bp, Artificial Sequence
  chemically synthesized
ttatgccttaagatccaagatc

SEQ ID NO: 1194020 - DNA, 22 bp, Artificial Sequence
  chemically synthesized
tatttttatgccttaagatcca

SEQ ID NO: 1194021 - DNA, 22 bp, Artificial Sequence
  chemically synthesized
gccaatgatcttggatcttaag

SEQ ID NO: 1194022 - DNA, 22 bp, Artificial Sequence
  chemically synthesized
ccaatgatcttggatcttaagg

SEQ ID NO: 1194023 - DNA, 22 bp, Artificial Sequence
  chemically synthesized
taatagctgtatttttatgcct

SEQ ID NO: 1194024 - DNA, 22 bp, Artificial Sequence
  chemically synthesized
ttataatagctgtatttttatg

SEQ ID NO: 1194025 - DNA, 22 bp, Artificial Sequence
  chemically synthesized
ggatcttaaggcataaaaatac

SEQ ID NO: 1194026 - DNA, 22 bp, Artificial Sequence
  chemically synthesized
attataatagctgtatttttat

SEQ ID NO: 1194027 - DNA, 22 bp, Artificial Sequence
  chemically synthesized
gatcttaaggcataaaaataca

SEQ ID NO: 1194028 - DNA, 22 bp, Artificial Sequence
  chemically synthesized
tattataatagctgtattttta

SEQ ID NO: 1194029 - DNA, 22 bp, Artificial Sequence
  chemically synthesized
aaggcataaaaatacagctatt

SEQ ID NO: 1194030 - DNA, 22 bp, Artificial Sequence
  chemically synthesized
aggcataaaaatacagctatta

SEQ ID NO: 1194031 - DNA, 22 bp, Artificial Sequence
  chemically synthesized
caggagagtaaaatattttatt

SEQ ID NO: 1194032 - DNA, 22 bp, Artificial Sequence
  chemically synthesized
ccaggagagtaaaatattttat

SEQ ID NO: 1194033 - DNA, 22 bp, Artificial Sequence
  chemically synthesized
tccaggagagtaaaatatttta

SEQ ID NO: 1194034 - DNA, 22 bp, Artificial Sequence
  chemically synthesized
ccctttccaggagagtaaaata

SEQ ID NO: 1194035 - DNA, 22 bp, Artificial Sequence
  chemically synthesized
ttataataaaatattttactct

SEQ ID NO: 1194036 - DNA, 22 bp, Artificial Sequence
  chemically synthesized
taataaaatattttactctcct

SEQ ID NO: 1194037 - DNA, 22 bp, Artificial Sequence
  chemically synthesized
caaagagtaaaagctacccttt

SEQ ID NO: 1194038 - DNA, 22 bp, Artificial Sequence
  chemically synthesized
tactctcctggaaagggtagct

SEQ ID NO: 1194039 - DNA, 22 bp, Artificial Sequence
  chemically synthesized
actctcctggaaagggtagctt

SEQ ID NO: 1194040 - DNA, 22 bp, Artificial Sequence
  chemically synthesized
ctctcctggaaagggtagcttt

SEQ ID NO: 1194041 - DNA, 22 bp, Artificial Sequence
  chemically synthesized
ttacaaagagtaaaagctaccc

SEQ ID NO: 1194042 - DNA, 22 bp, Artificial Sequence
  chemically synthesized
attacaaagagtaaaagctacc

SEQ ID NO: 1194043 - DNA, 22 bp, Artificial Sequence
  chemically synthesized
tattacaaagagtaaaagctac

SEQ ID NO: 1194044 - DNA, 22 bp, Artificial Sequence
  chemically synthesized
tcctggaaagggtagcttttac

SEQ ID NO: 1194045 - DNA, 22 bp, Artificial Sequence
  chemically synthesized
ctggaaagggtagcttttactc

SEQ ID NO: 1194046 - DNA, 22 bp, Artificial Sequence
  chemically synthesized
aattttattacaaagagtaaaa

SEQ ID NO: 1194047 - DNA, 22 bp, Artificial Sequence
  chemically synthesized
gaaagggtagcttttactcttt

SEQ ID NO: 1194048 - DNA, 22 bp, Artificial Sequence
  chemically synthesized
ttactctttgtaataaaattca

SEQ ID NO: 1194049 - DNA, 22 bp, Artificial Sequence
  chemically synthesized
tactctttgtaataaaattcag

SEQ ID NO: 1194050 - DNA, 22 bp, Artificial Sequence
  chemically synthesized
agacatccatagctgaatttta

SEQ ID NO: 1194051 - DNA, 22 bp, Artificial Sequence
  chemically synthesized
actctttgtaataaaattcagc

SEQ ID NO: 1194052 - DNA, 22 bp, Artificial Sequence
  chemically synthesized
ctctttgtaataaaattcagct

SEQ ID NO: 1194053 - DNA, 22 bp, Artificial Sequence
  chemically synthesized
tttgtaataaaattcagctatg

SEQ ID NO: 1194054 - DNA, 22 bp, Artificial Sequence
  chemically synthesized
tagctaagacatccatagctga

SEQ ID NO: 1194055 - DNA, 22 bp, Artificial Sequence
  chemically synthesized
tgtaataaaattcagctatgga

SEQ ID NO: 1194056 - DNA, 22 bp, Artificial Sequence
  chemically synthesized
gtaataaaattcagctatggat

SEQ ID NO: 1194057 - DNA, 22 bp, Artificial Sequence
  chemically synthesized
taataaaattcagctatggatg

SEQ ID NO: 1194058 - DNA, 22 bp, Artificial Sequence
  chemically synthesized
ttatagctaagacatccatagc

SEQ ID NO: 1194059 - DNA, 22 bp, Artificial Sequence
  chemically synthesized
gatattattatagctaagacat

SEQ ID NO: 1194060 - DNA, 22 bp, Artificial Sequence
  chemically synthesized
cgatattattatagctaagaca

SEQ ID NO: 1194061 - DNA, 22 bp, Artificial Sequence
  chemically synthesized
agctatggatgtcttagctata

SEQ ID NO: 1194062 - DNA, 22 bp, Artificial Sequence
  chemically synthesized
gtttcgatattattatagctaa

SEQ ID NO: 1194063 - DNA, 22 bp, Artificial Sequence
  chemically synthesized
ctggtttcgatattattatagc

SEQ ID NO: 1194064 - DNA, 22 bp, Artificial Sequence
  chemically synthesized
tggatgtcttagctataataat

SEQ ID NO: 1194065 - DNA, 22 bp, Artificial Sequence
  chemically synthesized
actggtttcgatattattatag

SEQ ID NO: 1194066 - DNA, 22 bp, Artificial Sequence
  chemically synthesized
tcttactggtttcgatattatt

SEQ ID NO: 1194067 - DNA, 22 bp, Artificial Sequence
  chemically synthesized
atcttactggtttcgatattat

SEQ ID NO: 1194068 - DNA, 22 bp, Artificial Sequence
  chemically synthesized
tatcttactggtttcgatatta

SEQ ID NO: 1194069 - DNA, 22 bp, Artificial Sequence
  chemically synthesized
agctataataatatcgaaacca

SEQ ID NO: 1194070 - DNA, 22 bp, Artificial Sequence
  chemically synthesized
gctataataatatcgaaaccag

SEQ ID NO: 1194071 - DNA, 22 bp, Artificial Sequence
  chemically synthesized
aattttatcttactggtttcga

SEQ ID NO: 1194072 - DNA, 22 bp, Artificial Sequence
  chemically synthesized
ttaaattttatcttactggttt

SEQ ID NO: 1194073 - DNA, 22 bp, Artificial Sequence
  chemically synthesized
taataatatcgaaaccagtaag

SEQ ID NO: 1194074 - DNA, 22 bp, Artificial Sequence
  chemically synthesized
aaggtgatctgttaaattttat

SEQ ID NO: 1194075 - DNA, 22 bp, Artificial Sequence
  chemically synthesized
aaaggtgatctgttaaatttta

SEQ ID NO: 1194076 - DNA, 22 bp, Artificial Sequence
  chemically synthesized
agacttaaaggtgatctgttaa

SEQ ID NO: 1194077 - DNA, 22 bp, Artificial Sequence
  chemically synthesized
cagacttaaaggtgatctgtta

SEQ ID NO: 1194078 - DNA, 22 bp, Artificial Sequence
  chemically synthesized
atttcagacttaaaggtgatct

SEQ ID NO: 1194079 - DNA, 22 bp, Artificial Sequence
  chemically synthesized
caatattaatttcagacttaaa

SEQ ID NO: 1194080 - DNA, 22 bp, Artificial Sequence
  chemically synthesized
aacagatcacctttaagtctga

SEQ ID NO: 1194081 - DNA, 22 bp, Artificial Sequence
  chemically synthesized
ccaatattaatttcagacttaa

SEQ ID NO: 1194082 - DNA, 22 bp, Artificial Sequence
  chemically synthesized
acagatcacctttaagtctgaa

SEQ ID NO: 1194083 - DNA, 22 bp, Artificial Sequence
  chemically synthesized
tccaatattaatttcagactta

SEQ ID NO: 1194084 - DNA, 22 bp, Artificial Sequence
  chemically synthesized
tttccaatattaatttcagact

SEQ ID NO: 1194085 - DNA, 22 bp, Artificial Sequence
  chemically synthesized
ctctttccaatattaatttcag

SEQ ID NO: 1194086 - DNA, 22 bp, Artificial Sequence
  chemically synthesized
taactgctctttccaatattaa

SEQ ID NO: 1194087 - DNA, 22 bp, Artificial Sequence
  chemically synthesized
taagtctgaaattaatattgga

SEQ ID NO: 1194088 - DNA, 22 bp, Artificial Sequence
  chemically synthesized
ataactgctctttccaatatta

SEQ ID NO: 1194089 - DNA, 22 bp, Artificial Sequence
  chemically synthesized
aagtctgaaattaatattggaa

SEQ ID NO: 1194090 - DNA, 22 bp, Artificial Sequence
  chemically synthesized
agtctgaaattaatattggaaa

SEQ ID NO: 1194091 - DNA, 22 bp, Artificial Sequence
  chemically synthesized
aaattaatattggaaagagcag

SEQ ID NO: 1194092 - DNA, 22 bp, Artificial Sequence
  chemically synthesized
atattggaaagagcagttataa

SEQ ID NO: 1194093 - DNA, 22 bp, Artificial Sequence
  chemically synthesized
taaacccatgcagtccttataa

SEQ ID NO: 1194094 - DNA, 22 bp, Artificial Sequence
  chemically synthesized
ataaacccatgcagtccttata

SEQ ID NO: 1194095 - DNA, 22 bp, Artificial Sequence
  chemically synthesized
gaaagagcagttataaggactg

SEQ ID NO: 1194096 - DNA, 22 bp, Artificial Sequence
  chemically synthesized
ccacaaataatttataaaccca

SEQ ID NO: 1194097 - DNA, 22 bp, Artificial Sequence
  chemically synthesized
taaggactgcatgggtttataa

SEQ ID NO: 1194098 - DNA, 22 bp, Artificial Sequence
  chemically synthesized
cccacaaataatttataaaccc

SEQ ID NO: 1194099 - DNA, 22 bp, Artificial Sequence
  chemically synthesized
catgggtttataaattatttgt

SEQ ID NO: 1194100 - DNA, 22 bp, Artificial Sequence
  chemically synthesized
ataaattatttgtgggaagttt

SEQ ID NO: 1194101 - DNA, 22 bp, Artificial Sequence
  chemically synthesized
taaattatttgtgggaagtttt

SEQ ID NO: 1194102 - DNA, 22 bp, Artificial Sequence
  chemically synthesized
tttgtgggaagttttttttatt

SEQ ID NO: 1194103 - DNA, 22 bp, Artificial Sequence
  chemically synthesized
gtgggaagttttttttattatt

SEQ ID NO: 1194104 - DNA, 22 bp, Artificial Sequence
  chemically synthesized
tgggaagttttttttattattt

SEQ ID NO: 1194105 - DNA, 22 bp, Artificial Sequence
  chemically synthesized
tcatgtcagtcataaataataa

SEQ ID NO: 1194106 - DNA, 22 bp, Artificial Sequence
  chemically synthesized
tttttattatttatgactgaca

SEQ ID NO: 1194107 - DNA, 22 bp, Artificial Sequence
  chemically synthesized
ttttattatttatgactgacat

SEQ ID NO: 1194108 - DNA, 22 bp, Artificial Sequence
  chemically synthesized
tttattatttatgactgacatg

SEQ ID NO: 1194109 - DNA, 22 bp, Artificial Sequence
  chemically synthesized
ttattatttatgactgacatga

SEQ ID NO: 1194110 - DNA, 22 bp, Artificial Sequence
  chemically synthesized
tattatttatgactgacatgat

SEQ ID NO: 1194111 - DNA, 22 bp, Artificial Sequence
  chemically synthesized
attatttatgactgacatgata

SEQ ID NO: 1194112 - DNA, 22 bp, Artificial Sequence
  chemically synthesized
ttatttatgactgacatgataa

SEQ ID NO: 1194113 - DNA, 22 bp, Artificial Sequence
  chemically synthesized
tttatgactgacatgataatta

SEQ ID NO: 1194114 - DNA, 22 bp, Artificial Sequence
  chemically synthesized
atgactgacatgataattatac

SEQ ID NO: 1194115 - DNA, 22 bp, Artificial Sequence
  chemically synthesized
tgactgacatgataattataca

SEQ ID NO: 1194116 - DNA, 22 bp, Artificial Sequence
  chemically synthesized
gaccccataaatatgtataatt

SEQ ID NO: 1194117 - DNA, 22 bp, Artificial Sequence
  chemically synthesized
acatgataattatacatattta

SEQ ID NO: 1194118 - DNA, 22 bp, Artificial Sequence
  chemically synthesized
tgttggaccccataaatatgta

SEQ ID NO: 1194119 - DNA, 22 bp, Artificial Sequence
  chemically synthesized
tacatatttatggggtccaaca

SEQ ID NO: 1194120 - DNA, 22 bp, Artificial Sequence
  chemically synthesized
tgtgtagaaacattgtgttgga

SEQ ID NO: 1194121 - DNA, 22 bp, Artificial Sequence
  chemically synthesized
atggggtccaacacaatgtttc

SEQ ID NO: 1194122 - DNA, 22 bp, Artificial Sequence
  chemically synthesized
tggggtccaacacaatgtttct

SEQ ID NO: 1194123 - DNA, 22 bp, Artificial Sequence
  chemically synthesized
gcacatccaatgtctgtgtgta

SEQ ID NO: 1194124 - DNA, 22 bp, Artificial Sequence
  chemically synthesized
agggtaattagcacatccaatg

SEQ ID NO: 1194125 - DNA, 22 bp, Artificial Sequence
  chemically synthesized
ctacacacagacattggatgtg

SEQ ID NO: 1194126 - DNA, 22 bp, Artificial Sequence
  chemically synthesized
tacacacagacattggatgtgc

SEQ ID NO: 1194127 - DNA, 22 bp, Artificial Sequence
  chemically synthesized
cacacagacattggatgtgcta

SEQ ID NO: 1194128 - DNA, 22 bp, Artificial Sequence
  chemically synthesized
attcagggtaattagcacatcc

SEQ ID NO: 1194129 - DNA, 22 bp, Artificial Sequence
  chemically synthesized
gatgtgctaattaccctgaatt

SEQ ID NO: 1194130 - DNA, 22 bp, Artificial Sequence
  chemically synthesized
aatatgtgataattaattcagg

SEQ ID NO: 1194131 - DNA, 22 bp, Artificial Sequence
  chemically synthesized
gaatatgtgataattaattcag

SEQ ID NO: 1194132 - DNA, 22 bp, Artificial Sequence
  chemically synthesized
tgaatatgtgataattaattca

SEQ ID NO: 1194133 - DNA, 22 bp, Artificial Sequence
  chemically synthesized
tttgaatatgtgataattaatt

SEQ ID NO: 1194134 - DNA, 22 bp, Artificial Sequence
  chemically synthesized
ctttgaatatgtgataattaat

SEQ ID NO: 1194135 - DNA, 22 bp, Artificial Sequence
  chemically synthesized
attaccctgaattaattatcac

SEQ ID NO: 1194136 - DNA, 22 bp, Artificial Sequence
  chemically synthesized
ccctgaattaattatcacatat

SEQ ID NO: 1194137 - DNA, 22 bp, Artificial Sequence
  chemically synthesized
taatttctttgaatatgtgata

SEQ ID NO: 1194138 - DNA, 22 bp, Artificial Sequence
  chemically synthesized
ataatttctttgaatatgtgat

SEQ ID NO: 1194139 - DNA, 22 bp, Artificial Sequence
  chemically synthesized
aattaattatcacatattcaaa

SEQ ID NO: 1194140 - DNA, 22 bp, Artificial Sequence
  chemically synthesized
tatatttataatttctttgaat

SEQ ID NO: 1194141 - DNA, 22 bp, Artificial Sequence
  chemically synthesized
atatatttataatttctttgaa

SEQ ID NO: 1194142 - DNA, 22 bp, Artificial Sequence
  chemically synthesized
attatcacatattcaaagaaat

SEQ ID NO: 1194143 - DNA, 22 bp, Artificial Sequence
  chemically synthesized
tcacatattcaaagaaattata

SEQ ID NO: 1194144 - DNA, 22 bp, Artificial Sequence
  chemically synthesized
aatccatcatcttatatattta

SEQ ID NO: 1194145 - DNA, 22 bp, Artificial Sequence
  chemically synthesized
aaagaaattataaatatataag

SEQ ID NO: 1194146 - DNA, 22 bp, Artificial Sequence
  chemically synthesized
taaatatataagatgatggatt

SEQ ID NO: 1194147 - DNA, 22 bp, Artificial Sequence
  chemically synthesized
aaataatatctgaatccatcat

SEQ ID NO: 1194148 - DNA, 22 bp, Artificial Sequence
  chemically synthesized
tcaaataatatctgaatccatc

SEQ ID NO: 1194149 - DNA, 22 bp, Artificial Sequence
  chemically synthesized
attctcaaataatatctgaatc

SEQ ID NO: 1194150 - DNA, 22 bp, Artificial Sequence
  chemically synthesized
gattctcaaataatatctgaat

SEQ ID NO: 1194151 - DNA, 22 bp, Artificial Sequence
  chemically synthesized
ccttgattctcaaataatatct

SEQ ID NO: 1194152 - DNA, 22 bp, Artificial Sequence
  chemically synthesized
aattgccttgattctcaaataa

SEQ ID NO: 1194153 - DNA, 22 bp, Artificial Sequence
  chemically synthesized
gaattgccttgattctcaaata

SEQ ID NO: 1194154 - DNA, 22 bp, Artificial Sequence
  chemically synthesized
agatattatttgagaatcaagg

SEQ ID NO: 1194155 - DNA, 22 bp, Artificial Sequence
  chemically synthesized
gaatttgaattgccttgattct

SEQ ID NO: 1194156 - DNA, 22 bp, Artificial Sequence
  chemically synthesized
ggcctagaatttgaattgcctt

SEQ ID NO: 1194157 - DNA, 22 bp, Artificial Sequence
  chemically synthesized
tttgagaatcaaggcaattcaa

SEQ ID NO: 1194158 - DNA, 22 bp, Artificial Sequence
  chemically synthesized
gagaatcaaggcaattcaaatt

SEQ ID NO: 1194159 - DNA, 22 bp, Artificial Sequence
  chemically synthesized
agaatcaaggcaattcaaattc

SEQ ID NO: 1194160 - DNA, 22 bp, Artificial Sequence
  chemically synthesized
gtaaacgttaggcctagaattt

SEQ ID NO: 1194161 - DNA, 22 bp, Artificial Sequence
  chemically synthesized
catctagtaaacgttaggccta

SEQ ID NO: 1194162 - DNA, 22 bp, Artificial Sequence
  chemically synthesized
ctacatctagtaaacgttaggc

SEQ ID NO: 1194163 - DNA, 22 bp, Artificial Sequence
  chemically synthesized
aaattctaggcctaacgtttac

SEQ ID NO: 1194164 - DNA, 22 bp, Artificial Sequence
  chemically synthesized
taggcctaacgtttactagatg

SEQ ID NO: 1194165 - DNA, 22 bp, Artificial Sequence
  chemically synthesized
ggcctaacgtttactagatgta

SEQ ID NO: 1194166 - DNA, 22 bp, Artificial Sequence
  chemically synthesized
acgtttactagatgtaggagct

SEQ ID NO: 1194167 - DNA, 22 bp, Artificial Sequence
  chemically synthesized
tcgtcatggtagtcatagctcc

SEQ ID NO: 1194168 - DNA, 22 bp, Artificial Sequence
  chemically synthesized
atcgtcatggtagtcatagctc

SEQ ID NO: 1194169 - DNA, 22 bp, Artificial Sequence
  chemically synthesized
actagatgtaggagctatgact

SEQ ID NO: 1194170 - DNA, 22 bp, Artificial Sequence
  chemically synthesized
tatcgtcatggtagtcatagct

SEQ ID NO: 1194171 - DNA, 22 bp, Artificial Sequence
  chemically synthesized
ctagatgtaggagctatgacta

SEQ ID NO: 1194172 - DNA, 22 bp, Artificial Sequence
  chemically synthesized
gatgtaggagctatgactacca

SEQ ID NO: 1194173 - DNA, 22 bp, Artificial Sequence
  chemically synthesized
gtgtcctttatcgtcatggtag

SEQ ID NO: 1194174 - DNA, 22 bp, Artificial Sequence
  chemically synthesized
ggtgtcctttatcgtcatggta

SEQ ID NO: 1194175 - DNA, 22 bp, Artificial Sequence
  chemically synthesized
tggtgtcctttatcgtcatggt

SEQ ID NO: 1194176 - DNA, 22 bp, Artificial Sequence
  chemically synthesized
ttggtgtcctttatcgtcatgg

SEQ ID NO: 1194177 - DNA, 22 bp, Artificial Sequence
  chemically synthesized
acttttggtgtcctttatcgtc

SEQ ID NO: 1194178 - DNA, 22 bp, Artificial Sequence
  chemically synthesized
tgactaccatgacgataaagga

SEQ ID NO: 1194179 - DNA, 22 bp, Artificial Sequence
  chemically synthesized
ggctcacttttggtgtccttta

SEQ ID NO: 1194180 - DNA, 22 bp, Artificial Sequence
  chemically synthesized
ccatgacgataaaggacaccaa

SEQ ID NO: 1194181 - DNA, 22 bp, Artificial Sequence
  chemically synthesized
ttgggctcacttttggtgtcct

SEQ ID NO: 1194182 - DNA, 22 bp, Artificial Sequence
  chemically synthesized
ttattgggctcacttttggtgt

SEQ ID NO: 1194183 - DNA, 22 bp, Artificial Sequence
  chemically synthesized
attattgggctcacttttggtg

SEQ ID NO: 1194184 - DNA, 22 bp, Artificial Sequence
  chemically synthesized
tattattgggctcacttttggt

SEQ ID NO: 1194185 - DNA, 22 bp, Artificial Sequence
  chemically synthesized
caagatgaatacccacagcctt

SEQ ID NO: 1194186 - DNA, 22 bp, Artificial Sequence
  chemically synthesized
ccatctccaagatgaataccca

SEQ ID NO: 1194187 - DNA, 22 bp, Artificial Sequence
  chemically synthesized
tgaatctaccatctccaagatg

SEQ ID NO: 1194188 - DNA, 22 bp, Artificial Sequence
  chemically synthesized
atgaatctaccatctccaagat

SEQ ID NO: 1194189 - DNA, 22 bp, Artificial Sequence
  chemically synthesized
tatgaatctaccatctccaaga

SEQ ID NO: 1194190 - DNA, 22 bp, Artificial Sequence
  chemically synthesized
tgggtattcatcttggagatgg

SEQ ID NO: 1194191 - DNA, 22 bp, Artificial Sequence
  chemically synthesized
aaaaggtctttatgaatctacc

SEQ ID NO: 1194192 - DNA, 22 bp, Artificial Sequence
  chemically synthesized
atcttggagatggtagattcat

SEQ ID NO: 1194193 - DNA, 22 bp, Artificial Sequence
  chemically synthesized
gaaaaggtctttatgaatctac

SEQ ID NO: 1194194 - DNA, 22 bp, Artificial Sequence
  chemically synthesized
ggagatggtagattcataaaga

SEQ ID NO: 1194195 - DNA, 22 bp, Artificial Sequence
  chemically synthesized
gagatggtagattcataaagac

SEQ ID NO: 1194196 - DNA, 22 bp, Artificial Sequence
  chemically synthesized
accatttgaaaaggtctttatg

SEQ ID NO: 1194197 - DNA, 22 bp, Artificial Sequence
  chemically synthesized
aaccatttgaaaaggtctttat

SEQ ID NO: 1194198 - DNA, 22 bp, Artificial Sequence
  chemically synthesized
taaccatttgaaaaggtcttta

SEQ ID NO: 1194199 - DNA, 22 bp, Artificial Sequence
  chemically synthesized
cctttaaccatttgaaaaggtc

SEQ ID NO: 1194200 - DNA, 22 bp, Artificial Sequence
  chemically synthesized
ataaagaccttttcaaatggtt

SEQ ID NO: 1194201 - DNA, 22 bp, Artificial Sequence
  chemically synthesized
gaggaaccatgactgcctttaa

SEQ ID NO: 1194202 - DNA, 22 bp, Artificial Sequence
  chemically synthesized
ttcaaatggttaaaggcagtca

SEQ ID NO: 1194203 - DNA, 22 bp, Artificial Sequence
  chemically synthesized
tcaaatggttaaaggcagtcat

SEQ ID NO: 1194204 - DNA, 22 bp, Artificial Sequence
  chemically synthesized
caaatggttaaaggcagtcatg

SEQ ID NO: 1194205 - DNA, 22 bp, Artificial Sequence
  chemically synthesized
aaatggttaaaggcagtcatgg

SEQ ID NO: 1194206 - DNA, 22 bp, Artificial Sequence
  chemically synthesized
aacctagaggaaccatgactgc

SEQ ID NO: 1194207 - DNA, 22 bp, Artificial Sequence
  chemically synthesized
caacctagaggaaccatgactg

SEQ ID NO: 1194208 - DNA, 22 bp, Artificial Sequence
  chemically synthesized
cttcaacctagaggaaccatga

SEQ ID NO: 1194209 - DNA, 22 bp, Artificial Sequence
  chemically synthesized
acttcaacctagaggaaccatg

SEQ ID NO: 1194210 - DNA, 22 bp, Artificial Sequence
  chemically synthesized
tacttcaacctagaggaaccat

SEQ ID NO: 1194211 - DNA, 22 bp, Artificial Sequence
  chemically synthesized
aaggcagtcatggttcctctag

SEQ ID NO: 1194212 - DNA, 22 bp, Artificial Sequence
  chemically synthesized
attttacttcaacctagaggaa

SEQ ID NO: 1194213 - DNA, 22 bp, Artificial Sequence
  chemically synthesized
acacattgattttacttcaacc

SEQ ID NO: 1194214 - DNA, 22 bp, Artificial Sequence
  chemically synthesized
ctctaggttgaagtaaaatcaa

SEQ ID NO: 1194215 - DNA, 22 bp, Artificial Sequence
  chemically synthesized
taacattcacacattgatttta

SEQ ID NO: 1194216 - DNA, 22 bp, Artificial Sequence
  chemically synthesized
gtaacattcacacattgatttt

SEQ ID NO: 1194217 - DNA, 22 bp, Artificial Sequence
  chemically synthesized
taggttgaagtaaaatcaatgt

SEQ ID NO: 1194218 - DNA, 22 bp, Artificial Sequence
  chemically synthesized
tgtaacattcacacattgattt

SEQ ID NO: 1194219 - DNA, 22 bp, Artificial Sequence
  chemically synthesized
ggttgaagtaaaatcaatgtgt

SEQ ID NO: 1194220 - DNA, 22 bp, Artificial Sequence
  chemically synthesized
aagtaaaatcaatgtgtgaatg

SEQ ID NO: 1194221 - DNA, 22 bp, Artificial Sequence
  chemically synthesized
aagaagcatcagtatctttgta

SEQ ID NO: 1194222 - DNA, 22 bp, Artificial Sequence
  chemically synthesized
tcacattaaagaagcatcagta

SEQ ID NO: 1194223 - DNA, 22 bp, Artificial Sequence
  chemically synthesized
gtcacattaaagaagcatcagt

SEQ ID NO: 1194224 - DNA, 22 bp, Artificial Sequence
  chemically synthesized
caaagatactgatgcttcttta

SEQ ID NO: 1194225 - DNA, 22 bp, Artificial Sequence
  chemically synthesized
aaatttgtcacattaaagaagc

SEQ ID NO: 1194226 - DNA, 22 bp, Artificial Sequence
  chemically synthesized
atgcttctttaatgtgacaaat

SEQ ID NO: 1194227 - DNA, 22 bp, Artificial Sequence
  chemically synthesized
ctttaatgtgacaaattttagg

SEQ ID NO: 1194228 - DNA, 22 bp, Artificial Sequence
  chemically synthesized
tttaatgtgacaaattttaggc

SEQ ID NO: 1194229 - DNA, 22 bp, Artificial Sequence
  chemically synthesized
aagatgatatcatgcctaaaat

SEQ ID NO: 1194230 - DNA, 22 bp, Artificial Sequence
  chemically synthesized
taatgtgacaaattttaggcat

SEQ ID NO: 1194231 - DNA, 22 bp, Artificial Sequence
  chemically synthesized
aatgtgacaaattttaggcatg

SEQ ID NO: 1194232 - DNA, 22 bp, Artificial Sequence
  chemically synthesized
atgtgacaaattttaggcatga

SEQ ID NO: 1194233 - DNA, 22 bp, Artificial Sequence
  chemically synthesized
ttaaagatgatatcatgcctaa

SEQ ID NO: 1194234 - DNA, 22 bp, Artificial Sequence
  chemically synthesized
taattattaaagatgatatcat

SEQ ID NO: 1194235 - DNA, 22 bp, Artificial Sequence
  chemically synthesized
ttataattattaaagatgatat

SEQ ID NO: 1194236 - DNA, 22 bp, Artificial Sequence
  chemically synthesized
taggcatgatatcatctttaat

SEQ ID NO: 1194237 - DNA, 22 bp, Artificial Sequence
  chemically synthesized
aggcatgatatcatctttaata

SEQ ID NO: 1194238 - DNA, 22 bp, Artificial Sequence
  chemically synthesized
gtctattataattattaaagat

SEQ ID NO: 1194239 - DNA, 22 bp, Artificial Sequence
  chemically synthesized
ggcatgatatcatctttaataa

SEQ ID NO: 1194240 - DNA, 22 bp, Artificial Sequence
  chemically synthesized
ctagtctattataattattaaa

SEQ ID NO: 1194241 - DNA, 22 bp, Artificial Sequence
  chemically synthesized
gctagtctattataattattaa

SEQ ID NO: 1194242 - DNA, 22 bp, Artificial Sequence
  chemically synthesized
tgctagtctattataattatta

SEQ ID NO: 1194243 - DNA, 22 bp, Artificial Sequence
  chemically synthesized
ttgctagtctattataattatt

SEQ ID NO: 1194244 - DNA, 22 bp, Artificial Sequence
  chemically synthesized
tttgctagtctattataattat

SEQ ID NO: 1194245 - DNA, 22 bp, Artificial Sequence
  chemically synthesized
ttttgctagtctattataatta

SEQ ID NO: 1194246 - DNA, 22 bp, Artificial Sequence
  chemically synthesized
tttttgctagtctattataatt

SEQ ID NO: 1194247 - DNA, 22 bp, Artificial Sequence
  chemically synthesized
ttttttgctagtctattataat

SEQ ID NO: 1194248 - DNA, 22 bp, Artificial Sequence
  chemically synthesized
taataattataatagactagca

SEQ ID NO: 1194249 - DNA, 22 bp, Artificial Sequence
  chemically synthesized
aataattataatagactagcaa

SEQ ID NO: 1194250 - DNA, 22 bp, Artificial Sequence
  chemically synthesized
ataattataatagactagcaaa

SEQ ID NO: 1194251 - DNA, 22 bp, Artificial Sequence
  chemically synthesized
aagcagatcttttttttgctag

SEQ ID NO: 1194252 - DNA, 22 bp, Artificial Sequence
  chemically synthesized
tgaagcagatcttttttttgct

SEQ ID NO: 1194253 - DNA, 22 bp, Artificial Sequence
  chemically synthesized
ctgaagcagatcttttttttgc

SEQ ID NO: 1194254 - DNA, 22 bp, Artificial Sequence
  chemically synthesized
taatagactagcaaaaaaaaga

SEQ ID NO: 1194255 - DNA, 22 bp, Artificial Sequence
  chemically synthesized
gaagtgtttctgaagcagatct

SEQ ID NO: 1194256 - DNA, 22 bp, Artificial Sequence
  chemically synthesized
gcaaaaaaaagatctgcttcag

SEQ ID NO: 1194257 - DNA, 22 bp, Artificial Sequence
  chemically synthesized
taccagttggaagtgtttctga

SEQ ID NO: 1194258 - DNA, 22 bp, Artificial Sequence
  chemically synthesized
gtaccagttggaagtgtttctg

SEQ ID NO: 1194259 - DNA, 22 bp, Artificial Sequence
  chemically synthesized
tgtaccagttggaagtgtttct

SEQ ID NO: 1194260 - DNA, 22 bp, Artificial Sequence
  chemically synthesized
ttgtaccagttggaagtgtttc

SEQ ID NO: 1194261 - DNA, 22 bp, Artificial Sequence
  chemically synthesized
aatttttgtaccagttggaagt

SEQ ID NO: 1194262 - DNA, 22 bp, Artificial Sequence
  chemically synthesized
cttcagaaacacttccaactgg

SEQ ID NO: 1194263 - DNA, 22 bp, Artificial Sequence
  chemically synthesized
actgaatttttgtaccagttgg

SEQ ID NO: 1194264 - DNA, 22 bp, Artificial Sequence
  chemically synthesized
cagaaacacttccaactggtac

SEQ ID NO: 1194265 - DNA, 22 bp, Artificial Sequence
  chemically synthesized
agaaacacttccaactggtaca

SEQ ID NO: 1194266 - DNA, 22 bp, Artificial Sequence
  chemically synthesized
actaactgaatttttgtaccag

SEQ ID NO: 1194267 - DNA, 22 bp, Artificial Sequence
  chemically synthesized
tgcattcactaactgaattttt

SEQ ID NO: 1194268 - DNA, 22 bp, Artificial Sequence
  chemically synthesized
ccaactggtacaaaaattcagt

SEQ ID NO: 1194269 - DNA, 22 bp, Artificial Sequence
  chemically synthesized
caactggtacaaaaattcagtt

SEQ ID NO: 1194270 - DNA, 22 bp, Artificial Sequence
  chemically synthesized
gtacaaaaattcagttagtgaa

SEQ ID NO: 1194271 - DNA, 22 bp, Artificial Sequence
  chemically synthesized
gagatatctatgcattcactaa

SEQ ID NO: 1194272 - DNA, 22 bp, Artificial Sequence
  chemically synthesized
agttagtgaatgcatagatatc

SEQ ID NO: 1194273 - DNA, 22 bp, Artificial Sequence
  chemically synthesized
gtgcagattagagatatctatg

SEQ ID NO: 1194274 - DNA, 22 bp, Artificial Sequence
  chemically synthesized
tagtgcagattagagatatcta

SEQ ID NO: 1194275 - DNA, 22 bp, Artificial Sequence
  chemically synthesized
tctagtgcagattagagatatc

SEQ ID NO: 1194276 - DNA, 22 bp, Artificial Sequence
  chemically synthesized
gtgaatgcatagatatctctaa

SEQ ID NO: 1194277 - DNA, 22 bp, Artificial Sequence
  chemically synthesized
ctctagtgcagattagagatat

SEQ ID NO: 1194278 - DNA, 22 bp, Artificial Sequence
  chemically synthesized
ccttctctagtgcagattagag

SEQ ID NO: 1194279 - DNA, 22 bp, Artificial Sequence
  chemically synthesized
ggcagattaccttctctagtgc

SEQ ID NO: 1194280 - DNA, 22 bp, Artificial Sequence
  chemically synthesized
taatctgcactagagaaggtaa

SEQ ID NO: 1194281 - DNA, 22 bp, Artificial Sequence
  chemically synthesized
atctgcactagagaaggtaatc

SEQ ID NO: 1194282 - DNA, 22 bp, Artificial Sequence
  chemically synthesized
agccaatctgggcagattacct

SEQ ID NO: 1194283 - DNA, 22 bp, Artificial Sequence
  chemically synthesized
cactagagaaggtaatctgccc

SEQ ID NO: 1194284 - DNA, 22 bp, Artificial Sequence
  chemically synthesized
gagaaggtaatctgcccagatt

SEQ ID NO: 1194285 - DNA, 22 bp, Artificial Sequence
  chemically synthesized
cccagattggcttagattacac

SEQ ID NO: 1194286 - DNA, 22 bp, Artificial Sequence
  chemically synthesized
gcttagattacacattgtgtct

SEQ ID NO: 1194287 - DNA, 22 bp, Artificial Sequence
  chemically synthesized
agattacacattgtgtcttatg

SEQ ID NO: 1194288 - DNA, 22 bp, Artificial Sequence
  chemically synthesized
gattacacattgtgtcttatgt

SEQ ID NO: 1194289 - DNA, 22 bp, Artificial Sequence
  chemically synthesized
cacattgtgtcttatgttcgca

SEQ ID NO: 1194290 - DNA, 22 bp, Artificial Sequence
  chemically synthesized
tgtcttatgttcgcacacatta

SEQ ID NO: 1194291 - DNA, 22 bp, Artificial Sequence
  chemically synthesized
aggagcaaatgagataatgtgt

SEQ ID NO: 1194292 - DNA, 22 bp, Artificial Sequence
  chemically synthesized
gaggagcaaatgagataatgtg

SEQ ID NO: 1194293 - DNA, 22 bp, Artificial Sequence
  chemically synthesized
tgaggagcaaatgagataatgt

SEQ ID NO: 1194294 - DNA, 22 bp, Artificial Sequence
  chemically synthesized
ttgaggagcaaatgagataatg

SEQ ID NO: 1194295 - DNA, 22 bp, Artificial Sequence
  chemically synthesized
atgttcgcacacattatctcat

SEQ ID NO: 1194296 - DNA, 22 bp, Artificial Sequence
  chemically synthesized
tttgaggagcaaatgagataat

SEQ ID NO: 1194297 - DNA, 22 bp, Artificial Sequence
  chemically synthesized
tgttcgcacacattatctcatt

SEQ ID NO: 1194298 - DNA, 22 bp, Artificial Sequence
  chemically synthesized
gcacacattatctcatttgctc

SEQ ID NO: 1194299 - DNA, 22 bp, Artificial Sequence
  chemically synthesized
gtattttttgaggagcaaatga

SEQ ID NO: 1194300 - DNA, 22 bp, Artificial Sequence
  chemically synthesized
agtattttttgaggagcaaatg

SEQ ID NO: 1194301 - DNA, 22 bp, Artificial Sequence
  chemically synthesized
tagtattttttgaggagcaaat

SEQ ID NO: 1194302 - DNA, 22 bp, Artificial Sequence
  chemically synthesized
ctttagtattttttgaggagca

SEQ ID NO: 1194303 - DNA, 22 bp, Artificial Sequence
  chemically synthesized
tctcatttgctcctcaaaaaat

SEQ ID NO: 1194304 - DNA, 22 bp, Artificial Sequence
  chemically synthesized
cacctactttagtattttttga

SEQ ID NO: 1194305 - DNA, 22 bp, Artificial Sequence
  chemically synthesized
atttgctcctcaaaaaatacta

SEQ ID NO: 1194306 - DNA, 22 bp, Artificial Sequence
  chemically synthesized
ttccacctactttagtattttt

SEQ ID NO: 1194307 - DNA, 22 bp, Artificial Sequence
  chemically synthesized
gttccacctactttagtatttt

SEQ ID NO: 1194308 - DNA, 22 bp, Artificial Sequence
  chemically synthesized
ttgttccacctactttagtatt

SEQ ID NO: 1194309 - DNA, 22 bp, Artificial Sequence
  chemically synthesized
gctcctcaaaaaatactaaagt

SEQ ID NO: 1194310 - DNA, 22 bp, Artificial Sequence
  chemically synthesized
ctcctcaaaaaatactaaagta

SEQ ID NO: 1194311 - DNA, 22 bp, Artificial Sequence
  chemically synthesized
ctcaaaaaatactaaagtaggt

SEQ ID NO: 1194312 - DNA, 22 bp, Artificial Sequence
  chemically synthesized
aaaaaatactaaagtaggtgga

SEQ ID NO: 1194313 - DNA, 22 bp, Artificial Sequence
  chemically synthesized
tatagttcttgttccacctact

SEQ ID NO: 1194314 - DNA, 22 bp, Artificial Sequence
  chemically synthesized
tatatagttcttgttccaccta

SEQ ID NO: 1194315 - DNA, 22 bp, Artificial Sequence
  chemically synthesized
atctctatatagttcttgttcc

SEQ ID NO: 1194316 - DNA, 22 bp, Artificial Sequence
  chemically synthesized
aagtaggtggaacaagaactat

SEQ ID NO: 1194317 - DNA, 22 bp, Artificial Sequence
  chemically synthesized
aatgaattcatctctatatagt

SEQ ID NO: 1194318 - DNA, 22 bp, Artificial Sequence
  chemically synthesized
tacaagtctcaatgaattcatc

SEQ ID NO: 1194319 - DNA, 22 bp, Artificial Sequence
  chemically synthesized
atacaagtctcaatgaattcat

SEQ ID NO: 1194320 - DNA, 22 bp, Artificial Sequence
  chemically synthesized
tatacaagtctcaatgaattca

SEQ ID NO: 1194321 - DNA, 22 bp, Artificial Sequence
  chemically synthesized
ttatacaagtctcaatgaattc

SEQ ID NO: 1194322 - DNA, 22 bp, Artificial Sequence
  chemically synthesized
tatagagatgaattcattgaga

SEQ ID NO: 1194323 - DNA, 22 bp, Artificial Sequence
  chemically synthesized
gtgaaaccatttttatacaagt

SEQ ID NO: 1194324 - DNA, 22 bp, Artificial Sequence
  chemically synthesized
attgagacttgtataaaaatgg

SEQ ID NO: 1194325 - DNA, 22 bp, Artificial Sequence
  chemically synthesized
aatggtctcgtgaaaccatttt

SEQ ID NO: 1194326 - DNA, 22 bp, Artificial Sequence
  chemically synthesized
agacttgtataaaaatggtttc

SEQ ID NO: 1194327 - DNA, 22 bp, Artificial Sequence
  chemically synthesized
gtataaaaatggtttcacgaga

SEQ ID NO: 1194328 - DNA, 22 bp, Artificial Sequence
  chemically synthesized
taaactcaatggtctcgtgaaa

SEQ ID NO: 1194329 - DNA, 22 bp, Artificial Sequence
  chemically synthesized
tataaaaatggtttcacgagac

SEQ ID NO: 1194330 - DNA, 22 bp, Artificial Sequence
  chemically synthesized
ttataaactcaatggtctcgtg

SEQ ID NO: 1194331 - DNA, 22 bp, Artificial Sequence
  chemically synthesized
tgttataaactcaatggtctcg

SEQ ID NO: 1194332 - DNA, 22 bp, Artificial Sequence
  chemically synthesized
ctctgttataaactcaatggtc

SEQ ID NO: 1194333 - DNA, 22 bp, Artificial Sequence
  chemically synthesized
tgctctgttataaactcaatgg

SEQ ID NO: 1194334 - DNA, 22 bp, Artificial Sequence
  chemically synthesized
cacgagaccattgagtttataa

SEQ ID NO: 1194335 - DNA, 22 bp, Artificial Sequence
  chemically synthesized
acgagaccattgagtttataac

SEQ ID NO: 1194336 - DNA, 22 bp, Artificial Sequence
  chemically synthesized
gagttctgctctgttataaact

SEQ ID NO: 1194337 - DNA, 22 bp, Artificial Sequence
  chemically synthesized
agagttctgctctgttataaac

SEQ ID NO: 1194338 - DNA, 22 bp, Artificial Sequence
  chemically synthesized
atcagaatttagagttctgctc

SEQ ID NO: 1194339 - DNA, 22 bp, Artificial Sequence
  chemically synthesized
agtttataacagagcagaactc

SEQ ID NO: 1194340 - DNA, 22 bp, Artificial Sequence
  chemically synthesized
ataacagagcagaactctaaat

SEQ ID NO: 1194341 - DNA, 22 bp, Artificial Sequence
  chemically synthesized
taacagagcagaactctaaatt

SEQ ID NO: 1194342 - DNA, 22 bp, Artificial Sequence
  chemically synthesized
aacattaatcagaatttagagt

SEQ ID NO: 1194343 - DNA, 22 bp, Artificial Sequence
  chemically synthesized
gaacattaatcagaatttagag

SEQ ID NO: 1194344 - DNA, 22 bp, Artificial Sequence
  chemically synthesized
cttgaacattaatcagaattta

SEQ ID NO: 1194345 - DNA, 22 bp, Artificial Sequence
  chemically synthesized
gtcagttgcttgaacattaatc

SEQ ID NO: 1194346 - DNA, 22 bp, Artificial Sequence
  chemically synthesized
taaattctgattaatgttcaag

SEQ ID NO: 1194347 - DNA, 22 bp, Artificial Sequence
  chemically synthesized
aattctgattaatgttcaagca

SEQ ID NO: 1194348 - DNA, 22 bp, Artificial Sequence
  chemically synthesized
tgattaatgttcaagcaactga

SEQ ID NO: 1194349 - DNA, 22 bp, Artificial Sequence
  chemically synthesized
gaaggtggtctagtcagttgct

SEQ ID NO: 1194350 - DNA, 22 bp, Artificial Sequence
  chemically synthesized
attaatgttcaagcaactgact

SEQ ID NO: 1194351 - DNA, 22 bp, Artificial Sequence
  chemically synthesized
agaaggtggtctagtcagttgc

SEQ ID NO: 1194352 - DNA, 22 bp, Artificial Sequence
  chemically synthesized
atgttcaagcaactgactagac

SEQ ID NO: 1194353 - DNA, 22 bp, Artificial Sequence
  chemically synthesized
aagcaactgactagaccacctt

SEQ ID NO: 1194354 - DNA, 22 bp, Artificial Sequence
  chemically synthesized
gtaaatgaatttagaaggtggt

SEQ ID NO: 1194355 - DNA, 22 bp, Artificial Sequence
  chemically synthesized
tagtaaatgaatttagaaggtg

SEQ ID NO: 1194356 - DNA, 22 bp, Artificial Sequence
  chemically synthesized
actagaccaccttctaaattca

SEQ ID NO: 1194357 - DNA, 22 bp, Artificial Sequence
  chemically synthesized
gaccaccttctaaattcattta

SEQ ID NO: 1194358 - DNA, 22 bp, Artificial Sequence
  chemically synthesized
ctaaattcatttactagagtcc

SEQ ID NO: 1194359 - DNA, 22 bp, Artificial Sequence
  chemically synthesized
taaattcatttactagagtcct

SEQ ID NO: 1194360 - DNA, 22 bp, Artificial Sequence
  chemically synthesized
tagaggtgtaagcaggactcta

SEQ ID NO: 1194361 - DNA, 22 bp, Artificial Sequence
  chemically synthesized
aattcatttactagagtcctgc

SEQ ID NO: 1194362 - DNA, 22 bp, Artificial Sequence
  chemically synthesized
atttactagagtcctgcttaca

SEQ ID NO: 1194363 - DNA, 22 bp, Artificial Sequence
  chemically synthesized
aggtgattatagaggtgtaagc

SEQ ID NO: 1194364 - DNA, 22 bp, Artificial Sequence
  chemically synthesized
actagagtcctgcttacacctc

SEQ ID NO: 1194365 - DNA, 22 bp, Artificial Sequence
  chemically synthesized
ctagagtcctgcttacacctct

SEQ ID NO: 1194366 - DNA, 22 bp, Artificial Sequence
  chemically synthesized
attaaggtgattatagaggtgt

SEQ ID NO: 1194367 - DNA, 22 bp, Artificial Sequence
  chemically synthesized
gagtcctgcttacacctctata

SEQ ID NO: 1194368 - DNA, 22 bp, Artificial Sequence
  chemically synthesized
cttacacctctataatcacctt

SEQ ID NO: 1194369 - DNA, 22 bp, Artificial Sequence
  chemically synthesized
acacctctataatcaccttaat

SEQ ID NO: 1194370 - DNA, 22 bp, Artificial Sequence
  chemically synthesized
cacctctataatcaccttaatt

SEQ ID NO: 1194371 - DNA, 22 bp, Artificial Sequence
  chemically synthesized
atatagaaaaattaattaaggt

SEQ ID NO: 1194372 - DNA, 22 bp, Artificial Sequence
  chemically synthesized
tataatcaccttaattaatttt

SEQ ID NO: 1194373 - DNA, 22 bp, Artificial Sequence
  chemically synthesized
taatcaccttaattaatttttc

SEQ ID NO: 1194374 - DNA, 22 bp, Artificial Sequence
  chemically synthesized
aattaatttttctatatcaggc

SEQ ID NO: 1194375 - DNA, 22 bp, Artificial Sequence
  chemically synthesized
attaatttttctatatcaggcc

SEQ ID NO: 1194376 - DNA, 22 bp, Artificial Sequence
  chemically synthesized
atttttctatatcaggcctctg

SEQ ID NO: 1194377 - DNA, 22 bp, Artificial Sequence
  chemically synthesized
ttctatatcaggcctctgcttg

SEQ ID NO: 1194378 - DNA, 22 bp, Artificial Sequence
  chemically synthesized
tctatatcaggcctctgcttgc

SEQ ID NO: 1194379 - DNA, 22 bp, Artificial Sequence
  chemically synthesized
ctatatcaggcctctgcttgca

SEQ ID NO: 1194380 - DNA, 22 bp, Artificial Sequence
  chemically synthesized
tatatcaggcctctgcttgcat

SEQ ID NO: 1194381 - DNA, 22 bp, Artificial Sequence
  chemically synthesized
tatcaggcctctgcttgcattg

SEQ ID NO: 1194382 - DNA, 22 bp, Artificial Sequence
  chemically synthesized
aagggaccaataatatcaatgc

SEQ ID NO: 1194383 - DNA, 22 bp, Artificial Sequence
  chemically synthesized
actgaagggaccaataatatca

SEQ ID NO: 1194384 - DNA, 22 bp, Artificial Sequence
  chemically synthesized
tgcttgcattgatattattggt

SEQ ID NO: 1194385 - DNA, 22 bp, Artificial Sequence
  chemically synthesized
ttcactgaagggaccaataata

SEQ ID NO: 1194386 - DNA, 22 bp, Artificial Sequence
  chemically synthesized
cttgcattgatattattggtcc

SEQ ID NO: 1194387 - DNA, 22 bp, Artificial Sequence
  chemically synthesized
ttattcactgaagggaccaata

SEQ ID NO: 1194388 - DNA, 22 bp, Artificial Sequence
  chemically synthesized
attattcactgaagggaccaat

SEQ ID NO: 1194389 - DNA, 22 bp, Artificial Sequence
  chemically synthesized
gcattgatattattggtccctt

SEQ ID NO: 1194390 - DNA, 22 bp, Artificial Sequence
  chemically synthesized
tattattcactgaagggaccaa

SEQ ID NO: 1194391 - DNA, 22 bp, Artificial Sequence
  chemically synthesized
cattgatattattggtcccttc

SEQ ID NO: 1194392 - DNA, 22 bp, Artificial Sequence
  chemically synthesized
atattattggtcccttcagtga

SEQ ID NO: 1194393 - DNA, 22 bp, Artificial Sequence
  chemically synthesized
ttggtcccttcagtgaataata

SEQ ID NO: 1194394 - DNA, 22 bp, Artificial Sequence
  chemically synthesized
gtcccttcagtgaataataaaa

SEQ ID NO: 1194395 - DNA, 22 bp, Artificial Sequence
  chemically synthesized
cagtgaataataaaatacttga

SEQ ID NO: 1194396 - DNA, 22 bp, Artificial Sequence
  chemically synthesized
agcataggaacgtcaagtattt

SEQ ID NO: 1194397 - DNA, 22 bp, Artificial Sequence
  chemically synthesized
agtgaataataaaatacttgac

SEQ ID NO: 1194398 - DNA, 22 bp, Artificial Sequence
  chemically synthesized
aaaattcagcataggaacgtca

SEQ ID NO: 1194399 - DNA, 22 bp, Artificial Sequence
  chemically synthesized
taaaaattcagcataggaacgt

SEQ ID NO: 1194400 - DNA, 22 bp, Artificial Sequence
  chemically synthesized
gttctaaaaattcagcatagga

SEQ ID NO: 1194401 - DNA, 22 bp, Artificial Sequence
  chemically synthesized
gacgttcctatgctgaattttt

SEQ ID NO: 1194402 - DNA, 22 bp, Artificial Sequence
  chemically synthesized
acgttcctatgctgaattttta

SEQ ID NO: 1194403 - DNA, 22 bp, Artificial Sequence
  chemically synthesized
aggaaatattggttctaaaaat

SEQ ID NO: 1194404 - DNA, 22 bp, Artificial Sequence
  chemically synthesized
ctatgctgaatttttagaacca

SEQ ID NO: 1194405 - DNA, 22 bp, Artificial Sequence
  chemically synthesized
ctaaggaaatattggttctaaa

SEQ ID NO: 1194406 - DNA, 22 bp, Artificial Sequence
  chemically synthesized
cctaaggaaatattggttctaa

SEQ ID NO: 1194407 - DNA, 22 bp, Artificial Sequence
  chemically synthesized
tcctaaggaaatattggttcta

SEQ ID NO: 1194408 - DNA, 22 bp, Artificial Sequence
  chemically synthesized
tgctgaatttttagaaccaata

SEQ ID NO: 1194409 - DNA, 22 bp, Artificial Sequence
  chemically synthesized
aatttttagaaccaatatttcc

SEQ ID NO: 1194410 - DNA, 22 bp, Artificial Sequence
  chemically synthesized
cggatattttcctaaggaaata

SEQ ID NO: 1194411 - DNA, 22 bp, Artificial Sequence
  chemically synthesized
ccggatattttcctaaggaaat

SEQ ID NO: 1194412 - DNA, 22 bp, Artificial Sequence
  chemically synthesized
ttagaaccaatatttccttagg

SEQ ID NO: 1194413 - DNA, 22 bp, Artificial Sequence
  chemically synthesized
tagaaccaatatttccttagga

SEQ ID NO: 1194414 - DNA, 22 bp, Artificial Sequence
  chemically synthesized
agaaccaatatttccttaggaa

SEQ ID NO: 1194415 - DNA, 22 bp, Artificial Sequence
  chemically synthesized
gaaccaatatttccttaggaaa

SEQ ID NO: 1194416 - DNA, 22 bp, Artificial Sequence
  chemically synthesized
ggaaagtcatgtttccggatat

SEQ ID NO: 1194417 - DNA, 22 bp, Artificial Sequence
  chemically synthesized
ccttaggaaaatatccggaaac

SEQ ID NO: 1194418 - DNA, 22 bp, Artificial Sequence
  chemically synthesized
cttaggaaaatatccggaaaca

SEQ ID NO: 1194419 - DNA, 22 bp, Artificial Sequence
  chemically synthesized
aattaggaaagtcatgtttccg

SEQ ID NO: 1194420 - DNA, 22 bp, Artificial Sequence
  chemically synthesized
aggaaaatatccggaaacatga

SEQ ID NO: 1194421 - DNA, 22 bp, Artificial Sequence
  chemically synthesized
ggaaaatatccggaaacatgac

SEQ ID NO: 1194422 - DNA, 22 bp, Artificial Sequence
  chemically synthesized
tgacgcagtaacatgtatccta

SEQ ID NO: 1194423 - DNA, 22 bp, Artificial Sequence
  chemically synthesized
ttatgacgcagtaacatgtatc

SEQ ID NO: 1194424 - DNA, 22 bp, Artificial Sequence
  chemically synthesized
tcctaatttaggatacatgtta

SEQ ID NO: 1194425 - DNA, 22 bp, Artificial Sequence
  chemically synthesized
cctaatttaggatacatgttac

SEQ ID NO: 1194426 - DNA, 22 bp, Artificial Sequence
  chemically synthesized
ctaatttaggatacatgttact

SEQ ID NO: 1194427 - DNA, 22 bp, Artificial Sequence
  chemically synthesized
ttgttatgacgcagtaacatgt

SEQ ID NO: 1194428 - DNA, 22 bp, Artificial Sequence
  chemically synthesized
gttgttatgacgcagtaacatg

SEQ ID NO: 1194429 - DNA, 22 bp, Artificial Sequence
  chemically synthesized
atttaggatacatgttactgcg

SEQ ID NO: 1194430 - DNA, 22 bp, Artificial Sequence
  chemically synthesized
aggatacatgttactgcgtcat

SEQ ID NO: 1194431 - DNA, 22 bp, Artificial Sequence
  chemically synthesized
ggatacatgttactgcgtcata

SEQ ID NO: 1194432 - DNA, 22 bp, Artificial Sequence
  chemically synthesized
acacatttgttgttatgacgca

SEQ ID NO: 1194433 - DNA, 22 bp, Artificial Sequence
  chemically synthesized
aacacatttgttgttatgacgc

SEQ ID NO: 1194434 - DNA, 22 bp, Artificial Sequence
  chemically synthesized
taacacatttgttgttatgacg

SEQ ID NO: 1194435 - DNA, 22 bp, Artificial Sequence
  chemically synthesized
ttaacacatttgttgttatgac

SEQ ID NO: 1194436 - DNA, 22 bp, Artificial Sequence
  chemically synthesized
ctgcgtcataacaacaaatgtg

SEQ ID NO: 1194437 - DNA, 22 bp, Artificial Sequence
  chemically synthesized
cgtcataacaacaaatgtgtta

SEQ ID NO: 1194438 - DNA, 22 bp, Artificial Sequence
  chemically synthesized
agagaaaatcatcaacaaatac

SEQ ID NO: 1194439 - DNA, 22 bp, Artificial Sequence
  chemically synthesized
aagagaaaatcatcaacaaata

SEQ ID NO: 1194440 - DNA, 22 bp, Artificial Sequence
  chemically synthesized
tatttaagagaaaatcatcaac

SEQ ID NO: 1194441 - DNA, 22 bp, Artificial Sequence
  chemically synthesized
atatttaagagaaaatcatcaa

SEQ ID NO: 1194442 - DNA, 22 bp, Artificial Sequence
  chemically synthesized
tatatttaagagaaaatcatca

SEQ ID NO: 1194443 - DNA, 22 bp, Artificial Sequence
  chemically synthesized
aaagtatttgttgatgattttc

SEQ ID NO: 1194444 - DNA, 22 bp, Artificial Sequence
  chemically synthesized
gttgatgattttctcttaaata

SEQ ID NO: 1194445 - DNA, 22 bp, Artificial Sequence
  chemically synthesized
ttgatgattttctcttaaatat

SEQ ID NO: 1194446 - DNA, 22 bp, Artificial Sequence
  chemically synthesized
atgattttctcttaaatataaa

SEQ ID NO: 1194447 - DNA, 22 bp, Artificial Sequence
  chemically synthesized
tctcttaaatataaaggtttct

SEQ ID NO: 1194448 - DNA, 22 bp, Artificial Sequence
  chemically synthesized
ctcttaaatataaaggtttcta

SEQ ID NO: 1194449 - DNA, 22 bp, Artificial Sequence
  chemically synthesized
tcttaaatataaaggtttctat

SEQ ID NO: 1194450 - DNA, 22 bp, Artificial Sequence
  chemically synthesized
ttaaatataaaggtttctatga

SEQ ID NO: 1194451 - DNA, 22 bp, Artificial Sequence
  chemically synthesized
aaatataaaggtttctatgatg

SEQ ID NO: 1194452 - DNA, 22 bp, Artificial Sequence
  chemically synthesized
aatataaaggtttctatgatgt

SEQ ID NO: 1194453 - DNA, 22 bp, Artificial Sequence
  chemically synthesized
ctatgatgtatatatacacaca

SEQ ID NO: 1194454 - DNA, 22 bp, Artificial Sequence
  chemically synthesized
tatgatgtatatatacacacat

SEQ ID NO: 1194455 - DNA, 22 bp, Artificial Sequence
  chemically synthesized
tgatgtatatatacacacatat

SEQ ID NO: 1194456 - DNA, 22 bp, Artificial Sequence
  chemically synthesized
atatgtatatgtgtgtatgtgt

SEQ ID NO: 1194457 - DNA, 22 bp, Artificial Sequence
  chemically synthesized
aaggctaatatgtatatgtgtg

SEQ ID NO: 1194458 - DNA, 22 bp, Artificial Sequence
  chemically synthesized
aaaggctaatatgtatatgtgt

SEQ ID NO: 1194459 - DNA, 22 bp, Artificial Sequence
  chemically synthesized
taaaggctaatatgtatatgtg

SEQ ID NO: 1194460 - DNA, 22 bp, Artificial Sequence
  chemically synthesized
gaatatattttaaaggctaata

SEQ ID NO: 1194461 - DNA, 22 bp, Artificial Sequence
  chemically synthesized
gcctttaaaatatattccaatt

SEQ ID NO: 1194462 - DNA, 22 bp, Artificial Sequence
  chemically synthesized
gtaaataaaagtgaattggaat

SEQ ID NO: 1194463 - DNA, 22 bp, Artificial Sequence
  chemically synthesized
ggtaaataaaagtgaattggaa

SEQ ID NO: 1194464 - DNA, 22 bp, Artificial Sequence
  chemically synthesized
taaaatatattccaattcactt

SEQ ID NO: 1194465 - DNA, 22 bp, Artificial Sequence
  chemically synthesized
aaaatatattccaattcacttt

SEQ ID NO: 1194466 - DNA, 22 bp, Artificial Sequence
  chemically synthesized
atttggtaaataaaagtgaatt

SEQ ID NO: 1194467 - DNA, 22 bp, Artificial Sequence
  chemically synthesized
aaatatattccaattcactttt

SEQ ID NO: 1194468 - DNA, 22 bp, Artificial Sequence
  chemically synthesized
cagcagtctaatttggtaaata

SEQ ID NO: 1194469 - DNA, 22 bp, Artificial Sequence
  chemically synthesized
caattcacttttatttaccaaa

SEQ ID NO: 1194470 - DNA, 22 bp, Artificial Sequence
  chemically synthesized
acagcagtctaatttggtaaat

SEQ ID NO: 1194471 - DNA, 22 bp, Artificial Sequence
  chemically synthesized
tacagcagtctaatttggtaaa

SEQ ID NO: 1194472 - DNA, 22 bp, Artificial Sequence
  chemically synthesized
acttttatttaccaaattagac

SEQ ID NO: 1194473 - DNA, 22 bp, Artificial Sequence
  chemically synthesized
ttatttaccaaattagactgct

SEQ ID NO: 1194474 - DNA, 22 bp, Artificial Sequence
  chemically synthesized
tatttaccaaattagactgctg

SEQ ID NO: 1194475 - DNA, 22 bp, Artificial Sequence
  chemically synthesized
atttaccaaattagactgctgt

SEQ ID NO: 1194476 - DNA, 22 bp, Artificial Sequence
  chemically synthesized
tttaccaaattagactgctgta

SEQ ID NO: 1194477 - DNA, 22 bp, Artificial Sequence
  chemically synthesized
gtaatcatgttttacagcagtc

SEQ ID NO: 1194478 - DNA, 22 bp, Artificial Sequence
  chemically synthesized
tagtaatcatgttttacagcag

SEQ ID NO: 1194479 - DNA, 22 bp, Artificial Sequence
  chemically synthesized
accaaattagactgctgtaaaa

SEQ ID NO: 1194480 - DNA, 22 bp, Artificial Sequence
  chemically synthesized
ctagtaatcatgttttacagca

SEQ ID NO: 1194481 - DNA, 22 bp, Artificial Sequence
  chemically synthesized
ccaaattagactgctgtaaaac

SEQ ID NO: 1194482 - DNA, 22 bp, Artificial Sequence
  chemically synthesized
tctagtaatcatgttttacagc

SEQ ID NO: 1194483 - DNA, 22 bp, Artificial Sequence
  chemically synthesized
gactgctgtaaaacatgattac

SEQ ID NO: 1194484 - DNA, 22 bp, Artificial Sequence
  chemically synthesized
tgtggtacattttctagtaatc

SEQ ID NO: 1194485 - DNA, 22 bp, Artificial Sequence
  chemically synthesized
ctgtaaaacatgattactagaa

SEQ ID NO: 1194486 - DNA, 22 bp, Artificial Sequence
  chemically synthesized
gtgtggtacattttctagtaat

SEQ ID NO: 1194487 - DNA, 22 bp, Artificial Sequence
  chemically synthesized
tgtgtggtacattttctagtaa

SEQ ID NO: 1194488 - DNA, 22 bp, Artificial Sequence
  chemically synthesized
taaaacatgattactagaaaat

SEQ ID NO: 1194489 - DNA, 22 bp, Artificial Sequence
  chemically synthesized
ctagaaaatgtaccacacaaaa

SEQ ID NO: 1194490 - DNA, 22 bp, Artificial Sequence
  chemically synthesized
gaaaatgtaccacacaaaactc

SEQ ID NO: 1194491 - DNA, 22 bp, Artificial Sequence
  chemically synthesized
aaaacaaaagtatgatcagagt

SEQ ID NO: 1194492 - DNA, 22 bp, Artificial Sequence
  chemically synthesized
aattaaaaacaaaagtatgatc

SEQ ID NO: 1194493 - DNA, 22 bp, Artificial Sequence
  chemically synthesized
tgatcactctgatcatactttt

SEQ ID NO: 1194494 - DNA, 22 bp, Artificial Sequence
  chemically synthesized
atcactctgatcatacttttgt

SEQ ID NO: 1194495 - DNA, 22 bp, Artificial Sequence
  chemically synthesized
tgatcatacttttgtttttaat

SEQ ID NO: 1194496 - DNA, 22 bp, Artificial Sequence
  chemically synthesized
caaaaaaagttaaattaaaaac

SEQ ID NO: 1194497 - DNA, 22 bp, Artificial Sequence
  chemically synthesized
atcatacttttgtttttaattt

SEQ ID NO: 1194498 - DNA, 22 bp, Artificial Sequence
  chemically synthesized
aattacaaaaaaagttaaatta

SEQ ID NO: 1194499 - DNA, 22 bp, Artificial Sequence
  chemically synthesized
ttgtttttaatttaactttttt

SEQ ID NO: 1194500 - DNA, 22 bp, Artificial Sequence
  chemically synthesized
tgtttttaatttaacttttttt

SEQ ID NO: 1194501 - DNA, 22 bp, Artificial Sequence
  chemically synthesized
gtttttaatttaactttttttg

SEQ ID NO: 1194502 - DNA, 22 bp, Artificial Sequence
  chemically synthesized
tttttaatttaactttttttgt

SEQ ID NO: 1194503 - DNA, 22 bp, Artificial Sequence
  chemically synthesized
tggagattaaattacaaaaaaa

SEQ ID NO: 1194504 - DNA, 22 bp, Artificial Sequence
  chemically synthesized
ttaatttaactttttttgtaat

SEQ ID NO: 1194505 - DNA, 22 bp, Artificial Sequence
  chemically synthesized
taatttaactttttttgtaatt

SEQ ID NO: 1194506 - DNA, 22 bp, Artificial Sequence
  chemically synthesized
aatttaactttttttgtaattt

SEQ ID NO: 1194507 - DNA, 22 bp, Artificial Sequence
  chemically synthesized
atttaactttttttgtaattta

SEQ ID NO: 1194508 - DNA, 22 bp, Artificial Sequence
  chemically synthesized
taaactatggagattaaattac

SEQ ID NO: 1194509 - DNA, 22 bp, Artificial Sequence
  chemically synthesized
ataaactatggagattaaatta

SEQ ID NO: 1194510 - DNA, 22 bp, Artificial Sequence
  chemically synthesized
aactttttttgtaatttaatct

SEQ ID NO: 1194511 - DNA, 22 bp, Artificial Sequence
  chemically synthesized
tataaactatggagattaaatt

SEQ ID NO: 1194512 - DNA, 22 bp, Artificial Sequence
  chemically synthesized
actttttttgtaatttaatctc

SEQ ID NO: 1194513 - DNA, 22 bp, Artificial Sequence
  chemically synthesized
tttttgtaatttaatctccata

SEQ ID NO: 1194514 - DNA, 22 bp, Artificial Sequence
  chemically synthesized
ttttgtaatttaatctccatag

SEQ ID NO: 1194515 - DNA, 22 bp, Artificial Sequence
  chemically synthesized
tttgtaatttaatctccatagt

SEQ ID NO: 1194516 - DNA, 22 bp, Artificial Sequence
  chemically synthesized
ttgtaatttaatctccatagtt

SEQ ID NO: 1194517 - DNA, 22 bp, Artificial Sequence
  chemically synthesized
tgtaatttaatctccatagttt

SEQ ID NO: 1194518 - DNA, 22 bp, Artificial Sequence
  chemically synthesized
gtaatttaatctccatagttta

SEQ ID NO: 1194519 - DNA, 22 bp, Artificial Sequence
  chemically synthesized
taatttaatctccatagtttat

SEQ ID NO: 1194520 - DNA, 22 bp, Artificial Sequence
  chemically synthesized
aatctccatagtttataaaggg

SEQ ID NO: 1194521 - DNA, 22 bp, Artificial Sequence
  chemically synthesized
atctccatagtttataaagggc

SEQ ID NO: 1194522 - DNA, 22 bp, Artificial Sequence
  chemically synthesized
acaagcagtaatgccctttata

SEQ ID NO: 1194523 - DNA, 22 bp, Artificial Sequence
  chemically synthesized
ctgacaagcagtaatgcccttt

SEQ ID NO: 1194524 - DNA, 22 bp, Artificial Sequence
  chemically synthesized
cctgacaagcagtaatgccctt

SEQ ID NO: 1194525 - DNA, 22 bp, Artificial Sequence
  chemically synthesized
catagtttataaagggcattac

SEQ ID NO: 1194526 - DNA, 22 bp, Artificial Sequence
  chemically synthesized
tcctgacaagcagtaatgccct

SEQ ID NO: 1194527 - DNA, 22 bp, Artificial Sequence
  chemically synthesized
ttcctgacaagcagtaatgccc

SEQ ID NO: 1194528 - DNA, 22 bp, Artificial Sequence
  chemically synthesized
tttcctgacaagcagtaatgcc

SEQ ID NO: 1194529 - DNA, 22 bp, Artificial Sequence
  chemically synthesized
attttttcctgacaagcagtaa

SEQ ID NO: 1194530 - DNA, 22 bp, Artificial Sequence
  chemically synthesized
ataaagggcattactgcttgtc

SEQ ID NO: 1194531 - DNA, 22 bp, Artificial Sequence
  chemically synthesized
taaagggcattactgcttgtca

SEQ ID NO: 1194532 - DNA, 22 bp, Artificial Sequence
  chemically synthesized
agaaatacaagctcattttttc

SEQ ID NO: 1194533 - DNA, 22 bp, Artificial Sequence
  chemically synthesized
ctgcttgtcaggaaaaaatgag

SEQ ID NO: 1194534 - DNA, 22 bp, Artificial Sequence
  chemically synthesized
cttgtcaggaaaaaatgagctt

SEQ ID NO: 1194535 - DNA, 22 bp, Artificial Sequence
  chemically synthesized
gtcaggaaaaaatgagcttgta

SEQ ID NO: 1194536 - DNA, 22 bp, Artificial Sequence
  chemically synthesized
tcaggaaaaaatgagcttgtat

SEQ ID NO: 1194537 - DNA, 22 bp, Artificial Sequence
  chemically synthesized
cacacagctgagaaatacaagc

SEQ ID NO: 1194538 - DNA, 22 bp, Artificial Sequence
  chemically synthesized
acacacagctgagaaatacaag

SEQ ID NO: 1194539 - DNA, 22 bp, Artificial Sequence
  chemically synthesized
gtatttctcagctgtgtgtaaa

SEQ ID NO: 1194540 - DNA, 22 bp, Artificial Sequence
  chemically synthesized
tatttctcagctgtgtgtaaat

SEQ ID NO: 1194541 - DNA, 22 bp, Artificial Sequence
  chemically synthesized
ctcagctgtgtgtaaattacat

SEQ ID NO: 1194542 - DNA, 22 bp, Artificial Sequence
  chemically synthesized
tcagctgtgtgtaaattacatg

SEQ ID NO: 1194543 - DNA, 22 bp, Artificial Sequence
  chemically synthesized
agctgtgtgtaaattacatgca

SEQ ID NO: 1194544 - DNA, 22 bp, Artificial Sequence
  chemically synthesized
aaaaatataaaatgcatgtaat

SEQ ID NO: 1194545 - DNA, 22 bp, Artificial Sequence
  chemically synthesized
cctaaaaaatataaaatgcatg

SEQ ID NO: 1194546 - DNA, 22 bp, Artificial Sequence
  chemically synthesized
tgtgtaaattacatgcatttta

SEQ ID NO: 1194547 - DNA, 22 bp, Artificial Sequence
  chemically synthesized
gcctaaaaaatataaaatgcat

SEQ ID NO: 1194548 - DNA, 22 bp, Artificial Sequence
  chemically synthesized
catgcattttatattttttagg

SEQ ID NO: 1194549 - DNA, 22 bp, Artificial Sequence
  chemically synthesized
atagaggccttgcctaaaaaat

SEQ ID NO: 1194550 - DNA, 22 bp, Artificial Sequence
  chemically synthesized
attgatagaggccttgcctaaa

SEQ ID NO: 1194551 - DNA, 22 bp, Artificial Sequence
  chemically synthesized
tatattttttaggcaaggcctc

SEQ ID NO: 1194552 - DNA, 22 bp, Artificial Sequence
  chemically synthesized
atattttttaggcaaggcctct

SEQ ID NO: 1194553 - DNA, 22 bp, Artificial Sequence
  chemically synthesized
tattttttaggcaaggcctcta

SEQ ID NO: 1194554 - DNA, 22 bp, Artificial Sequence
  chemically synthesized
aaaatattgattgatagaggcc

SEQ ID NO: 1194555 - DNA, 22 bp, Artificial Sequence
  chemically synthesized
tgaaaatattgattgatagagg

SEQ ID NO: 1194556 - DNA, 22 bp, Artificial Sequence
  chemically synthesized
tttaggcaaggcctctatcaat

SEQ ID NO: 1194557 - DNA, 22 bp, Artificial Sequence
  chemically synthesized
ctgaaaatattgattgatagag

SEQ ID NO: 1194558 - DNA, 22 bp, Artificial Sequence
  chemically synthesized
ttaggcaaggcctctatcaatc

SEQ ID NO: 1194559 - DNA, 22 bp, Artificial Sequence
  chemically synthesized
tctgaaaatattgattgataga

SEQ ID NO: 1194560 - DNA, 22 bp, Artificial Sequence
  chemically synthesized
taggcaaggcctctatcaatca

SEQ ID NO: 1194561 - DNA, 22 bp, Artificial Sequence
  chemically synthesized
aggcaaggcctctatcaatcaa

SEQ ID NO: 1194562 - DNA, 22 bp, Artificial Sequence
  chemically synthesized
ggcaaggcctctatcaatcaat

SEQ ID NO: 1194563 - DNA, 22 bp, Artificial Sequence
  chemically synthesized
aggagtgtcattttctgaaaat

SEQ ID NO: 1194564 - DNA, 22 bp, Artificial Sequence
  chemically synthesized
tatcaatcaatattttcagaaa

SEQ ID NO: 1194565 - DNA, 22 bp, Artificial Sequence
  chemically synthesized
tcaatcaatattttcagaaaat

SEQ ID NO: 1194566 - DNA, 22 bp, Artificial Sequence
  chemically synthesized
actgaggagtgtcattttctga

SEQ ID NO: 1194567 - DNA, 22 bp, Artificial Sequence
  chemically synthesized
cctaactgaggagtgtcatttt

SEQ ID NO: 1194568 - DNA, 22 bp, Artificial Sequence
  chemically synthesized
tcagaaaatgacactcctcagt

SEQ ID NO: 1194569 - DNA, 22 bp, Artificial Sequence
  chemically synthesized
cagaaaatgacactcctcagtt

SEQ ID NO: 1194570 - DNA, 22 bp, Artificial Sequence
  chemically synthesized
agaaaatgacactcctcagtta

SEQ ID NO: 1194571 - DNA, 22 bp, Artificial Sequence
  chemically synthesized
agtaacaatccctgcctaactg

SEQ ID NO: 1194572 - DNA, 22 bp, Artificial Sequence
  chemically synthesized
cagtaacaatccctgcctaact

SEQ ID NO: 1194573 - DNA, 22 bp, Artificial Sequence
  chemically synthesized
tcagcttcagtaacaatccctg

SEQ ID NO: 1194574 - DNA, 22 bp, Artificial Sequence
  chemically synthesized
atcagcttcagtaacaatccct

SEQ ID NO: 1194575 - DNA, 22 bp, Artificial Sequence
  chemically synthesized
ctcagttaggcagggattgtta

SEQ ID NO: 1194576 - DNA, 22 bp, Artificial Sequence
  chemically synthesized
agttaggcagggattgttactg

SEQ ID NO: 1194577 - DNA, 22 bp, Artificial Sequence
  chemically synthesized
ggcagggattgttactgaagct

SEQ ID NO: 1194578 - DNA, 22 bp, Artificial Sequence
  chemically synthesized
caatgaagagtaaacatttatc

SEQ ID NO: 1194579 - DNA, 22 bp, Artificial Sequence
  chemically synthesized
ttactgaagctgataaatgttt

SEQ ID NO: 1194580 - DNA, 22 bp, Artificial Sequence
  chemically synthesized
ctgaagctgataaatgtttact

SEQ ID NO: 1194581 - DNA, 22 bp, Artificial Sequence
  chemically synthesized
aagctgataaatgtttactctt

SEQ ID NO: 1194582 - DNA, 22 bp, Artificial Sequence
  chemically synthesized
tcagtctccaatgaagagtaaa

SEQ ID NO: 1194583 - DNA, 22 bp, Artificial Sequence
  chemically synthesized
gtcagtctccaatgaagagtaa

SEQ ID NO: 1194584 - DNA, 22 bp, Artificial Sequence
  chemically synthesized
tttgtcagtctccaatgaagag

SEQ ID NO: 1194585 - DNA, 22 bp, Artificial Sequence
  chemically synthesized
ataaatgtttactcttcattgg

SEQ ID NO: 1194586 - DNA, 22 bp, Artificial Sequence
  chemically synthesized
actcttcattggagactgacaa

SEQ ID NO: 1194587 - DNA, 22 bp, Artificial Sequence
  chemically synthesized
ctcttcattggagactgacaaa

SEQ ID NO: 1194588 - DNA, 22 bp, Artificial Sequence
  chemically synthesized
tgtcatatgctatttgtcagtc

SEQ ID NO: 1194589 - DNA, 22 bp, Artificial Sequence
  chemically synthesized
ttcattggagactgacaaatag

SEQ ID NO: 1194590 - DNA, 22 bp, Artificial Sequence
  chemically synthesized
cattggagactgacaaatagca

SEQ ID NO: 1194591 - DNA, 22 bp, Artificial Sequence
  chemically synthesized
attggagactgacaaatagcat

SEQ ID NO: 1194592 - DNA, 22 bp, Artificial Sequence
  chemically synthesized
gagactgacaaatagcatatga

SEQ ID NO: 1194593 - DNA, 22 bp, Artificial Sequence
  chemically synthesized
acaaatagcatatgacatagac

SEQ ID NO: 1194594 - DNA, 22 bp, Artificial Sequence
  chemically synthesized
gtacaagcagtgtaagagcata

SEQ ID NO: 1194595 - DNA, 22 bp, Artificial Sequence
  chemically synthesized
agtacaagcagtgtaagagcat

SEQ ID NO: 1194596 - DNA, 22 bp, Artificial Sequence
  chemically synthesized
tagtacaagcagtgtaagagca

SEQ ID NO: 1194597 - DNA, 22 bp, Artificial Sequence
  chemically synthesized
ctcttatgctcttacactgctt

SEQ ID NO: 1194598 - DNA, 22 bp, Artificial Sequence
  chemically synthesized
ttatgctcttacactgcttgta

SEQ ID NO: 1194599 - DNA, 22 bp, Artificial Sequence
  chemically synthesized
gacaagttttagtacaagcagt

SEQ ID NO: 1194600 - DNA, 22 bp, Artificial Sequence
  chemically synthesized
atgctcttacactgcttgtact

SEQ ID NO: 1194601 - DNA, 22 bp, Artificial Sequence
  chemically synthesized
tagacaagttttagtacaagca

SEQ ID NO: 1194602 - DNA, 22 bp, Artificial Sequence
  chemically synthesized
tgctcttacactgcttgtacta

SEQ ID NO: 1194603 - DNA, 22 bp, Artificial Sequence
  chemically synthesized
ctagacaagttttagtacaagc

SEQ ID NO: 1194604 - DNA, 22 bp, Artificial Sequence
  chemically synthesized
ttacactgcttgtactaaaact

SEQ ID NO: 1194605 - DNA, 22 bp, Artificial Sequence
  chemically synthesized
tatttctagacaagttttagta

SEQ ID NO: 1194606 - DNA, 22 bp, Artificial Sequence
  chemically synthesized
atatttctagacaagttttagt

SEQ ID NO: 1194607 - DNA, 22 bp, Artificial Sequence
  chemically synthesized
acactgcttgtactaaaacttg

SEQ ID NO: 1194608 - DNA, 22 bp, Artificial Sequence
  chemically synthesized
tatatttctagacaagttttag

SEQ ID NO: 1194609 - DNA, 22 bp, Artificial Sequence
  chemically synthesized
cactgcttgtactaaaacttgt

SEQ ID NO: 1194610 - DNA, 22 bp, Artificial Sequence
  chemically synthesized
aattttatatttctagacaagt

SEQ ID NO: 1194611 - DNA, 22 bp, Artificial Sequence
  chemically synthesized
cttgtactaaaacttgtctaga

SEQ ID NO: 1194612 - DNA, 22 bp, Artificial Sequence
  chemically synthesized
gaattttatatttctagacaag

SEQ ID NO: 1194613 - DNA, 22 bp, Artificial Sequence
  chemically synthesized
tgaattttatatttctagacaa

SEQ ID NO: 1194614 - DNA, 22 bp, Artificial Sequence
  chemically synthesized
ttgaattttatatttctagaca

SEQ ID NO: 1194615 - DNA, 22 bp, Artificial Sequence
  chemically synthesized
gtactaaaacttgtctagaaat

SEQ ID NO: 1194616 - DNA, 22 bp, Artificial Sequence
  chemically synthesized
tactaaaacttgtctagaaata

SEQ ID NO: 1194617 - DNA, 22 bp, Artificial Sequence
  chemically synthesized
aaacttgtctagaaatataaaa

SEQ ID NO: 1194618 - DNA, 22 bp, Artificial Sequence
  chemically synthesized
gtctagaaatataaaattcaaa

SEQ ID NO: 1194619 - DNA, 22 bp, Artificial Sequence
  chemically synthesized
tctagaaatataaaattcaaaa

SEQ ID NO: 1194620 - DNA, 22 bp, Artificial Sequence
  chemically synthesized
catgaaaatcacatttttgaat

SEQ ID NO: 1194621 - DNA, 22 bp, Artificial Sequence
  chemically synthesized
acatgaaaatcacatttttgaa

SEQ ID NO: 1194622 - DNA, 22 bp, Artificial Sequence
  chemically synthesized
gaaatataaaattcaaaaatgt

SEQ ID NO: 1194623 - DNA, 22 bp, Artificial Sequence
  chemically synthesized
tacatgaaaatcacatttttga

SEQ ID NO: 1194624 - DNA, 22 bp, Artificial Sequence
  chemically synthesized
aaagcagttttacatgaaaatc

SEQ ID NO: 1194625 - DNA, 22 bp, Artificial Sequence
  chemically synthesized
gaaagcagttttacatgaaaat

SEQ ID NO: 1194626 - DNA, 22 bp, Artificial Sequence
  chemically synthesized
aaaaatgtgattttcatgtaaa

SEQ ID NO: 1194627 - DNA, 22 bp, Artificial Sequence
  chemically synthesized
acaagaaatttgaaagcagttt

SEQ ID NO: 1194628 - DNA, 22 bp, Artificial Sequence
  chemically synthesized
ctaacaagaaatttgaaagcag

SEQ ID NO: 1194629 - DNA, 22 bp, Artificial Sequence
  chemically synthesized
cctaacaagaaatttgaaagca

SEQ ID NO: 1194630 - DNA, 22 bp, Artificial Sequence
  chemically synthesized
tcatgtaaaactgctttcaaat

SEQ ID NO: 1194631 - DNA, 22 bp, Artificial Sequence
  chemically synthesized
catgtaaaactgctttcaaatt

SEQ ID NO: 1194632 - DNA, 22 bp, Artificial Sequence
  chemically synthesized
atgtaaaactgctttcaaattt

SEQ ID NO: 1194633 - DNA, 22 bp, Artificial Sequence
  chemically synthesized
gcaagcttcctaacaagaaatt

SEQ ID NO: 1194634 - DNA, 22 bp, Artificial Sequence
  chemically synthesized
ctttcaaatttcttgttaggaa

SEQ ID NO: 1194635 - DNA, 22 bp, Artificial Sequence
  chemically synthesized
tcaaatttcttgttaggaagct

SEQ ID NO: 1194636 - DNA, 22 bp, Artificial Sequence
  chemically synthesized
gagtgtctggcaagcttcctaa

SEQ ID NO: 1194637 - DNA, 22 bp, Artificial Sequence
  chemically synthesized
caaatttcttgttaggaagctt

SEQ ID NO: 1194638 - DNA, 22 bp, Artificial Sequence
  chemically synthesized
aaatttcttgttaggaagcttg

SEQ ID NO: 1194639 - DNA, 22 bp, Artificial Sequence
  chemically synthesized
tggagtgtctggcaagcttcct

SEQ ID NO: 1194640 - DNA, 22 bp, Artificial Sequence
  chemically synthesized
ctctggagtgtctggcaagctt

SEQ ID NO: 1194641 - DNA, 22 bp, Artificial Sequence
  chemically synthesized
cttgttaggaagcttgccagac

SEQ ID NO: 1194642 - DNA, 22 bp, Artificial Sequence
  chemically synthesized
ttgttaggaagcttgccagaca

SEQ ID NO: 1194643 - DNA, 22 bp, Artificial Sequence
  chemically synthesized
gttaggaagcttgccagacact

SEQ ID NO: 1194644 - DNA, 22 bp, Artificial Sequence
  chemically synthesized
ttaggaagcttgccagacactc

SEQ ID NO: 1194645 - DNA, 22 bp, Artificial Sequence
  chemically synthesized
ggaagcttgccagacactccag

SEQ ID NO: 1194646 - DNA, 22 bp, Artificial Sequence
  chemically synthesized
acaaaatgttactctggagtgt

SEQ ID NO: 1194647 - DNA, 22 bp, Artificial Sequence
  chemically synthesized
cacaaaatgttactctggagtg

SEQ ID NO: 1194648 - DNA, 22 bp, Artificial Sequence
  chemically synthesized
cttcacaaaatgttactctgga

SEQ ID NO: 1194649 - DNA, 22 bp, Artificial Sequence
  chemically synthesized
gcttcacaaaatgttactctgg

SEQ ID NO: 1194650 - DNA, 22 bp, Artificial Sequence
  chemically synthesized
gccagacactccagagtaacat

SEQ ID NO: 1194651 - DNA, 22 bp, Artificial Sequence
  chemically synthesized
ccagacactccagagtaacatt

SEQ ID NO: 1194652 - DNA, 22 bp, Artificial Sequence
  chemically synthesized
acttgcttcacaaaatgttact

SEQ ID NO: 1194653 - DNA, 22 bp, Artificial Sequence
  chemically synthesized
cagagtaacattttgtgaagca

SEQ ID NO: 1194654 - DNA, 22 bp, Artificial Sequence
  chemically synthesized
tgcgtgtaatactgacttgctt

SEQ ID NO: 1194655 - DNA, 22 bp, Artificial Sequence
  chemically synthesized
atgcgtgtaatactgacttgct

SEQ ID NO: 1194656 - DNA, 22 bp, Artificial Sequence
  chemically synthesized
cttatgcgtgtaatactgactt

SEQ ID NO: 1194657 - DNA, 22 bp, Artificial Sequence
  chemically synthesized
acttatgcgtgtaatactgact

SEQ ID NO: 1194658 - DNA, 22 bp, Artificial Sequence
  chemically synthesized
tgtgaagcaagtcagtattaca

SEQ ID NO: 1194659 - DNA, 22 bp, Artificial Sequence
  chemically synthesized
gtgaagcaagtcagtattacac

SEQ ID NO: 1194660 - DNA, 22 bp, Artificial Sequence
  chemically synthesized
atttacttatgcgtgtaatact

SEQ ID NO: 1194661 - DNA, 22 bp, Artificial Sequence
  chemically synthesized
tgaagcaagtcagtattacacg

SEQ ID NO: 1194662 - DNA, 22 bp, Artificial Sequence
  chemically synthesized
catttacttatgcgtgtaatac

SEQ ID NO: 1194663 - DNA, 22 bp, Artificial Sequence
  chemically synthesized
cttcatttacttatgcgtgtaa

SEQ ID NO: 1194664 - DNA, 22 bp, Artificial Sequence
  chemically synthesized
tacttcatttacttatgcgtgt

SEQ ID NO: 1194665 - DNA, 22 bp, Artificial Sequence
  chemically synthesized
aatctctacttcatttacttat

SEQ ID NO: 1194666 - DNA, 22 bp, Artificial Sequence
  chemically synthesized
aaatctctacttcatttactta

SEQ ID NO: 1194667 - DNA, 22 bp, Artificial Sequence
  chemically synthesized
tttaaatctctacttcatttac

SEQ ID NO: 1194668 - DNA, 22 bp, Artificial Sequence
  chemically synthesized
gtttaaatctctacttcattta

SEQ ID NO: 1194669 - DNA, 22 bp, Artificial Sequence
  chemically synthesized
tgtttaaatctctacttcattt

SEQ ID NO: 1194670 - DNA, 22 bp, Artificial Sequence
  chemically synthesized
cacgcataagtaaatgaagtag

SEQ ID NO: 1194671 - DNA, 22 bp, Artificial Sequence
  chemically synthesized
ttgtttaaatctctacttcatt

SEQ ID NO: 1194672 - DNA, 22 bp, Artificial Sequence
  chemically synthesized
tatttttgtttaaatctctact

SEQ ID NO: 1194673 - DNA, 22 bp, Artificial Sequence
  chemically synthesized
ggttgtatttttgtttaaatct

SEQ ID NO: 1194674 - DNA, 22 bp, Artificial Sequence
  chemically synthesized
caacattgggttgtatttttgt

SEQ ID NO: 1194675 - DNA, 22 bp, Artificial Sequence
  chemically synthesized
tattacaacattgggttgtatt

SEQ ID NO: 1194676 - DNA, 22 bp, Artificial Sequence
  chemically synthesized
cctgtattacaacattgggttg

SEQ ID NO: 1194677 - DNA, 22 bp, Artificial Sequence
  chemically synthesized
aaacaaaaatacaacccaatgt

SEQ ID NO: 1194678 - DNA, 22 bp, Artificial Sequence
  chemically synthesized
gcctgtattacaacattgggtt

SEQ ID NO: 1194679 - DNA, 22 bp, Artificial Sequence
  chemically synthesized
aacaaaaatacaacccaatgtt

SEQ ID NO: 1194680 - DNA, 22 bp, Artificial Sequence
  chemically synthesized
tgcctgtattacaacattgggt

SEQ ID NO: 1194681 - DNA, 22 bp, Artificial Sequence
  chemically synthesized
tattttgcctgtattacaacat

SEQ ID NO: 1194682 - DNA, 22 bp, Artificial Sequence
  chemically synthesized
aaaatattatattttgcctgta

SEQ ID NO: 1194683 - DNA, 22 bp, Artificial Sequence
  chemically synthesized
aaaaatattatattttgcctgt

SEQ ID NO: 1194684 - DNA, 22 bp, Artificial Sequence
  chemically synthesized
taatacaggcaaaatataatat

SEQ ID NO: 1194685 - DNA, 22 bp, Artificial Sequence
  chemically synthesized
acatggtgatcatttaaaaata

SEQ ID NO: 1194686 - DNA, 22 bp, Artificial Sequence
  chemically synthesized
aatatagacctcacatggtgat

SEQ ID NO: 1194687 - DNA, 22 bp, Artificial Sequence
  chemically synthesized
gaatatagacctcacatggtga

SEQ ID NO: 1194688 - DNA, 22 bp, Artificial Sequence
  chemically synthesized
ttaaatgatcaccatgtgaggt

SEQ ID NO: 1194689 - DNA, 22 bp, Artificial Sequence
  chemically synthesized
taaatgatcaccatgtgaggtc

SEQ ID NO: 1194690 - DNA, 22 bp, Artificial Sequence
  chemically synthesized
aaatgatcaccatgtgaggtct

SEQ ID NO: 1194691 - DNA, 22 bp, Artificial Sequence
  chemically synthesized
aatgatcaccatgtgaggtcta

SEQ ID NO: 1194692 - DNA, 22 bp, Artificial Sequence
  chemically synthesized
tgaaaagacatttgaatataga

SEQ ID NO: 1194693 - DNA, 22 bp, Artificial Sequence
  chemically synthesized
atgaaaagacatttgaatatag

SEQ ID NO: 1194694 - DNA, 22 bp, Artificial Sequence
  chemically synthesized
catttatgaaaagacatttgaa

SEQ ID NO: 1194695 - DNA, 22 bp, Artificial Sequence
  chemically synthesized
gactccatttatgaaaagacat

SEQ ID NO: 1194696 - DNA, 22 bp, Artificial Sequence
  chemically synthesized
tattcaaatgtcttttcataaa

SEQ ID NO: 1194697 - DNA, 22 bp, Artificial Sequence
  chemically synthesized
aaatgtcttttcataaatggag

SEQ ID NO: 1194698 - DNA, 22 bp, Artificial Sequence
  chemically synthesized
caaagagtgcctggactccatt

SEQ ID NO: 1194699 - DNA, 22 bp, Artificial Sequence
  chemically synthesized
ttcataaatggagtccaggcac

SEQ ID NO: 1194700 - DNA, 22 bp, Artificial Sequence
  chemically synthesized
tcataaatggagtccaggcact

SEQ ID NO: 1194701 - DNA, 22 bp, Artificial Sequence
  chemically synthesized
cataaatggagtccaggcactc

SEQ ID NO: 1194702 - DNA, 22 bp, Artificial Sequence
  chemically synthesized
ataaactacaaagagtgcctgg

SEQ ID NO: 1194703 - DNA, 22 bp, Artificial Sequence
  chemically synthesized
ataaatggagtccaggcactct

SEQ ID NO: 1194704 - DNA, 22 bp, Artificial Sequence
  chemically synthesized
gataaactacaaagagtgcctg

SEQ ID NO: 1194705 - DNA, 22 bp, Artificial Sequence
  chemically synthesized
ttgataaactacaaagagtgcc

SEQ ID NO: 1194706 - DNA, 22 bp, Artificial Sequence
  chemically synthesized
ctcttgataaactacaaagagt

SEQ ID NO: 1194707 - DNA, 22 bp, Artificial Sequence
  chemically synthesized
aacctgctcttgataaactaca

SEQ ID NO: 1194708 - DNA, 22 bp, Artificial Sequence
  chemically synthesized
ttaaacctgctcttgataaact

SEQ ID NO: 1194709 - DNA, 22 bp, Artificial Sequence
  chemically synthesized
ctgttaaacctgctcttgataa

SEQ ID NO: 1194710 - DNA, 22 bp, Artificial Sequence
  chemically synthesized
ctgctgttaaacctgctcttga

SEQ ID NO: 1194711 - DNA, 22 bp, Artificial Sequence
  chemically synthesized
tttgtagtttatcaagagcagg

SEQ ID NO: 1194712 - DNA, 22 bp, Artificial Sequence
  chemically synthesized
tgtagtttatcaagagcaggtt

SEQ ID NO: 1194713 - DNA, 22 bp, Artificial Sequence
  chemically synthesized
gtagtttatcaagagcaggttt

SEQ ID NO: 1194714 - DNA, 22 bp, Artificial Sequence
  chemically synthesized
tagtttatcaagagcaggttta

SEQ ID NO: 1194715 - DNA, 22 bp, Artificial Sequence
  chemically synthesized
tggaaactactgctgttaaacc

SEQ ID NO: 1194716 - DNA, 22 bp, Artificial Sequence
  chemically synthesized
gtggaaactactgctgttaaac

SEQ ID NO: 1194717 - DNA, 22 bp, Artificial Sequence
  chemically synthesized
atcaagagcaggtttaacagca

SEQ ID NO: 1194718 - DNA, 22 bp, Artificial Sequence
  chemically synthesized
tgtggaaactactgctgttaaa

SEQ ID NO: 1194719 - DNA, 22 bp, Artificial Sequence
  chemically synthesized
tcaagagcaggtttaacagcag

SEQ ID NO: 1194720 - DNA, 22 bp, Artificial Sequence
  chemically synthesized
ctttgtggaaactactgctgtt

SEQ ID NO: 1194721 - DNA, 22 bp, Artificial Sequence
  chemically synthesized
agcctgctttgtggaaactact

SEQ ID NO: 1194722 - DNA, 22 bp, Artificial Sequence
  chemically synthesized
cagcctgctttgtggaaactac

SEQ ID NO: 1194723 - DNA, 22 bp, Artificial Sequence
  chemically synthesized
aacagcagtagtttccacaaag

SEQ ID NO: 1194724 - DNA, 22 bp, Artificial Sequence
  chemically synthesized
acagcagtagtttccacaaagc

SEQ ID NO: 1194725 - DNA, 22 bp, Artificial Sequence
  chemically synthesized
aatgacttcagcctgctttgtg

SEQ ID NO: 1194726 - DNA, 22 bp, Artificial Sequence
  chemically synthesized
ccacaaagcaggctgaagtcat

SEQ ID NO: 1194727 - DNA, 22 bp, Artificial Sequence
  chemically synthesized
cacaaagcaggctgaagtcatt

SEQ ID NO: 1194728 - DNA, 22 bp, Artificial Sequence
  chemically synthesized
cgtataaaaagcagccatggat

SEQ ID NO: 1194729 - DNA, 22 bp, Artificial Sequence
  chemically synthesized
aagtcatttaatccatggctgc

SEQ ID NO: 1194730 - DNA, 22 bp, Artificial Sequence
  chemically synthesized
aatccatggctgctttttatac

SEQ ID NO: 1194731 - DNA, 22 bp, Artificial Sequence
  chemically synthesized
atccatggctgctttttatacg

SEQ ID NO: 1194732 - DNA, 22 bp, Artificial Sequence
  chemically synthesized
aaataaagcagctgcgtataaa

SEQ ID NO: 1194733 - DNA, 22 bp, Artificial Sequence
  chemically synthesized
agctcaaataaagcagctgcgt

SEQ ID NO: 1194734 - DNA, 22 bp, Artificial Sequence
  chemically synthesized
taagctcaaataaagcagctgc

SEQ ID NO: 1194735 - DNA, 22 bp, Artificial Sequence
  chemically synthesized
ctttttatacgcagctgcttta

SEQ ID NO: 1194736 - DNA, 22 bp, Artificial Sequence
  chemically synthesized
tctaagctcaaataaagcagct

SEQ ID NO: 1194737 - DNA, 22 bp, Artificial Sequence
  chemically synthesized
tttatacgcagctgctttattt

SEQ ID NO: 1194738 - DNA, 22 bp, Artificial Sequence
  chemically synthesized
ctctctaagctcaaataaagca

SEQ ID NO: 1194739 - DNA, 22 bp, Artificial Sequence
  chemically synthesized
ttatacgcagctgctttatttg

SEQ ID NO: 1194740 - DNA, 22 bp, Artificial Sequence
  chemically synthesized
tatacgcagctgctttatttga

SEQ ID NO: 1194741 - DNA, 22 bp, Artificial Sequence
  chemically synthesized
atacgcagctgctttatttgag

SEQ ID NO: 1194742 - DNA, 22 bp, Artificial Sequence
  chemically synthesized
ctcctctctaagctcaaataaa

SEQ ID NO: 1194743 - DNA, 22 bp, Artificial Sequence
  chemically synthesized
tacgcagctgctttatttgagc

SEQ ID NO: 1194744 - DNA, 22 bp, Artificial Sequence
  chemically synthesized
tgtggtctactcctctctaagc

SEQ ID NO: 1194745 - DNA, 22 bp, Artificial Sequence
  chemically synthesized
atgtggtctactcctctctaag

SEQ ID NO: 1194746 - DNA, 22 bp, Artificial Sequence
  chemically synthesized
ctttatttgagcttagagagga

SEQ ID NO: 1194747 - DNA, 22 bp, Artificial Sequence
  chemically synthesized
tatttgagcttagagaggagta

SEQ ID NO: 1194748 - DNA, 22 bp, Artificial Sequence
  chemically synthesized
atttgagcttagagaggagtag

SEQ ID NO: 1194749 - DNA, 22 bp, Artificial Sequence
  chemically synthesized
tttgagcttagagaggagtaga

SEQ ID NO: 1194750 - DNA, 22 bp, Artificial Sequence
  chemically synthesized
gagcttagagaggagtagacca

SEQ ID NO: 1194751 - DNA, 22 bp, Artificial Sequence
  chemically synthesized
agcttagagaggagtagaccac

SEQ ID NO: 1194752 - DNA, 22 bp, Artificial Sequence
  chemically synthesized
acatgacatttatgtggtctac

SEQ ID NO: 1194753 - DNA, 22 bp, Artificial Sequence
  chemically synthesized
agagaggagtagaccacataaa

SEQ ID NO: 1194754 - DNA, 22 bp, Artificial Sequence
  chemically synthesized
gagaggagtagaccacataaat

SEQ ID NO: 1194755 - DNA, 22 bp, Artificial Sequence
  chemically synthesized
gaatattaacatgacatttatg

SEQ ID NO: 1194756 - DNA, 22 bp, Artificial Sequence
  chemically synthesized
agaatattaacatgacatttat

SEQ ID NO: 1194757 - DNA, 22 bp, Artificial Sequence
  chemically synthesized
tagaatattaacatgacattta

SEQ ID NO: 1194758 - DNA, 22 bp, Artificial Sequence
  chemically synthesized
actttagaatattaacatgaca

SEQ ID NO: 1194759 - DNA, 22 bp, Artificial Sequence
  chemically synthesized
actcactttagaatattaacat

SEQ ID NO: 1194760 - DNA, 22 bp, Artificial Sequence
  chemically synthesized
aactcactttagaatattaaca

SEQ ID NO: 1194761 - DNA, 22 bp, Artificial Sequence
  chemically synthesized
acacaatttaactcactttaga

SEQ ID NO: 1194762 - DNA, 22 bp, Artificial Sequence
  chemically synthesized
ctaacacaatttaactcacttt

SEQ ID NO: 1194763 - DNA, 22 bp, Artificial Sequence
  chemically synthesized
ttgctaacacaatttaactcac

SEQ ID NO: 1194764 - DNA, 22 bp, Artificial Sequence
  chemically synthesized
gttgctaacacaatttaactca

SEQ ID NO: 1194765 - DNA, 22 bp, Artificial Sequence
  chemically synthesized
atattctaaagtgagttaaatt

SEQ ID NO: 1194766 - DNA, 22 bp, Artificial Sequence
  chemically synthesized
tgttgctaacacaatttaactc

SEQ ID NO: 1194767 - DNA, 22 bp, Artificial Sequence
  chemically synthesized
taaagtgagttaaattgtgtta

SEQ ID NO: 1194768 - DNA, 22 bp, Artificial Sequence
  chemically synthesized
aagtgagttaaattgtgttagc

SEQ ID NO: 1194769 - DNA, 22 bp, Artificial Sequence
  chemically synthesized
ataagacaagctttgttgctaa

SEQ ID NO: 1194770 - DNA, 22 bp, Artificial Sequence
  chemically synthesized
aattgtgttagcaacaaagctt

SEQ ID NO: 1194771 - DNA, 22 bp, Artificial Sequence
  chemically synthesized
tgttagcaacaaagcttgtctt

SEQ ID NO: 1194772 - DNA, 22 bp, Artificial Sequence
  chemically synthesized
gcaacaaagcttgtcttatcag

SEQ ID NO: 1194773 - DNA, 22 bp, Artificial Sequence
  chemically synthesized
ataggccaaggtgaaatgtctg

SEQ ID NO: 1194774 - DNA, 22 bp, Artificial Sequence
  chemically synthesized
tcataggccaaggtgaaatgtc

SEQ ID NO: 1194775 - DNA, 22 bp, Artificial Sequence
  chemically synthesized
ctcataggccaaggtgaaatgt

SEQ ID NO: 1194776 - DNA, 22 bp, Artificial Sequence
  chemically synthesized
tctcataggccaaggtgaaatg

SEQ ID NO: 1194777 - DNA, 22 bp, Artificial Sequence
  chemically synthesized
gtcttatcagacatttcacctt

SEQ ID NO: 1194778 - DNA, 22 bp, Artificial Sequence
  chemically synthesized
tcttatcagacatttcaccttg

SEQ ID NO: 1194779 - DNA, 22 bp, Artificial Sequence
  chemically synthesized
atcagacatttcaccttggcct

SEQ ID NO: 1194780 - DNA, 22 bp, Artificial Sequence
  chemically synthesized
tcagacatttcaccttggccta

SEQ ID NO: 1194781 - DNA, 22 bp, Artificial Sequence
  chemically synthesized
tcacattttctcataggccaag

SEQ ID NO: 1194782 - DNA, 22 bp, Artificial Sequence
  chemically synthesized
caccttggcctatgagaaaatg

SEQ ID NO: 1194783 - DNA, 22 bp, Artificial Sequence
  chemically synthesized
accttggcctatgagaaaatgt

SEQ ID NO: 1194784 - DNA, 22 bp, Artificial Sequence
  chemically synthesized
ataccataactatcacattttc

SEQ ID NO: 1194785 - DNA, 22 bp, Artificial Sequence
  chemically synthesized
ggcctatgagaaaatgtgatag

SEQ ID NO: 1194786 - DNA, 22 bp, Artificial Sequence
  chemically synthesized
gcctatgagaaaatgtgatagt

SEQ ID NO: 1194787 - DNA, 22 bp, Artificial Sequence
  chemically synthesized
tgagaaaatgtgatagttatgg

SEQ ID NO: 1194788 - DNA, 22 bp, Artificial Sequence
  chemically synthesized
atatcaattaataccataacta

SEQ ID NO: 1194789 - DNA, 22 bp, Artificial Sequence
  chemically synthesized
attaatatcaattaataccata

SEQ ID NO: 1194790 - DNA, 22 bp, Artificial Sequence
  chemically synthesized
ctgattaatatcaattaatacc

SEQ ID NO: 1194791 - DNA, 22 bp, Artificial Sequence
  chemically synthesized
actgattaatatcaattaatac

SEQ ID NO: 1194792 - DNA, 22 bp, Artificial Sequence
  chemically synthesized
ccttactgattaatatcaatta

SEQ ID NO: 1194793 - DNA, 22 bp, Artificial Sequence
  chemically synthesized
tggtattaattgatattaatca

SEQ ID NO: 1194794 - DNA, 22 bp, Artificial Sequence
  chemically synthesized
ccaaagatatctgccttactga

SEQ ID NO: 1194795 - DNA, 22 bp, Artificial Sequence
  chemically synthesized
attgatattaatcagtaaggca

SEQ ID NO: 1194796 - DNA, 22 bp, Artificial Sequence
  chemically synthesized
atattaatcagtaaggcagata

SEQ ID NO: 1194797 - DNA, 22 bp, Artificial Sequence
  chemically synthesized
tattcccaaagatatctgcctt

SEQ ID NO: 1194798 - DNA, 22 bp, Artificial Sequence
  chemically synthesized
atcagtaaggcagatatctttg

SEQ ID NO: 1194799 - DNA, 22 bp, Artificial Sequence
  chemically synthesized
tgcattatattcccaaagatat

SEQ ID NO: 1194800 - DNA, 22 bp, Artificial Sequence
  chemically synthesized
tatgcattatattcccaaagat

SEQ ID NO: 1194801 - DNA, 22 bp, Artificial Sequence
  chemically synthesized
ctatgcattatattcccaaaga

SEQ ID NO: 1194802 - DNA, 22 bp, Artificial Sequence
  chemically synthesized
tctatgcattatattcccaaag

SEQ ID NO: 1194803 - DNA, 22 bp, Artificial Sequence
  chemically synthesized
ttttctatgcattatattccca

SEQ ID NO: 1194804 - DNA, 22 bp, Artificial Sequence
  chemically synthesized
tgggaatataatgcatagaaaa

SEQ ID NO: 1194805 - DNA, 22 bp, Artificial Sequence
  chemically synthesized
gggaatataatgcatagaaaat

SEQ ID NO: 1194806 - DNA, 22 bp, Artificial Sequence
  chemically synthesized
ggaatataatgcatagaaaata

SEQ ID NO: 1194807 - DNA, 22 bp, Artificial Sequence
  chemically synthesized
aaaaaaatacaggaagaagaag

SEQ ID NO: 1194808 - DNA, 22 bp, Artificial Sequence
  chemically synthesized
tcttcctcttcttcttcctgta

SEQ ID NO: 1194809 - DNA, 22 bp, Artificial Sequence
  chemically synthesized
cttcctcttcttcttcctgtat

SEQ ID NO: 1194810 - DNA, 22 bp, Artificial Sequence
  chemically synthesized
ttcctcttcttcttcctgtatt

SEQ ID NO: 1194811 - DNA, 22 bp, Artificial Sequence
  chemically synthesized
cctcttcttcttcctgtatttt

SEQ ID NO: 1194812 - DNA, 22 bp, Artificial Sequence
  chemically synthesized
ctcttcttcttcctgtattttt

SEQ ID NO: 1194813 - DNA, 22 bp, Artificial Sequence
  chemically synthesized
ttcttcttcctgtatttttttg

SEQ ID NO: 1194814 - DNA, 22 bp, Artificial Sequence
  chemically synthesized
aagccaagagattcaaaaaaat

SEQ ID NO: 1194815 - DNA, 22 bp, Artificial Sequence
  chemically synthesized
cttcttcctgtatttttttgaa

SEQ ID NO: 1194816 - DNA, 22 bp, Artificial Sequence
  chemically synthesized
ttcttcctgtatttttttgaat

SEQ ID NO: 1194817 - DNA, 22 bp, Artificial Sequence
  chemically synthesized
cttcctgtatttttttgaatct

SEQ ID NO: 1194818 - DNA, 22 bp, Artificial Sequence
  chemically synthesized
actgaagccaagagattcaaaa

SEQ ID NO: 1194819 - DNA, 22 bp, Artificial Sequence
  chemically synthesized
ttcctgtatttttttgaatctc

SEQ ID NO: 1194820 - DNA, 22 bp, Artificial Sequence
  chemically synthesized
tcactgaagccaagagattcaa

SEQ ID NO: 1194821 - DNA, 22 bp, Artificial Sequence
  chemically synthesized
cctgtatttttttgaatctctt

SEQ ID NO: 1194822 - DNA, 22 bp, Artificial Sequence
  chemically synthesized
ctgtatttttttgaatctcttg

SEQ ID NO: 1194823 - DNA, 22 bp, Artificial Sequence
  chemically synthesized
tatttttttgaatctcttggct

SEQ ID NO: 1194824 - DNA, 22 bp, Artificial Sequence
  chemically synthesized
ttttgaatctcttggcttcagt

SEQ ID NO: 1194825 - DNA, 22 bp, Artificial Sequence
  chemically synthesized
tttgaatctcttggcttcagtg

SEQ ID NO: 1194826 - DNA, 22 bp, Artificial Sequence
  chemically synthesized
ttgaatctcttggcttcagtga

SEQ ID NO: 1194827 - DNA, 22 bp, Artificial Sequence
  chemically synthesized
tgaatctcttggcttcagtgag

SEQ ID NO: 1194828 - DNA, 22 bp, Artificial Sequence
  chemically synthesized
gaatctcttggcttcagtgaga

SEQ ID NO: 1194829 - DNA, 22 bp, Artificial Sequence
  chemically synthesized
aatctcttggcttcagtgagaa

SEQ ID NO: 1194830 - DNA, 22 bp, Artificial Sequence
  chemically synthesized
ttggcttcagtgagaacttcct

SEQ ID NO: 1194831 - DNA, 22 bp, Artificial Sequence
  chemically synthesized
ggcttcagtgagaacttcctgt

SEQ ID NO: 1194832 - DNA, 22 bp, Artificial Sequence
  chemically synthesized
gcttcagtgagaacttcctgtt

SEQ ID NO: 1194833 - DNA, 22 bp, Artificial Sequence
  chemically synthesized
cagtgagaacttcctgttggat

SEQ ID NO: 1194834 - DNA, 22 bp, Artificial Sequence
  chemically synthesized
agtgagaacttcctgttggatt

SEQ ID NO: 1194835 - DNA, 22 bp, Artificial Sequence
  chemically synthesized
aggaaagataagaataaatcca

SEQ ID NO: 1194836 - DNA, 22 bp, Artificial Sequence
  chemically synthesized
cctgttggatttattcttatct

SEQ ID NO: 1194837 - DNA, 22 bp, Artificial Sequence
  chemically synthesized
ctgttggatttattcttatctt

SEQ ID NO: 1194838 - DNA, 22 bp, Artificial Sequence
  chemically synthesized
aacaattaaggaaagataagaa

SEQ ID NO: 1194839 - DNA, 22 bp, Artificial Sequence
  chemically synthesized
ttggatttattcttatctttcc

SEQ ID NO: 1194840 - DNA, 22 bp, Artificial Sequence
  chemically synthesized
gatttattcttatctttcctta

SEQ ID NO: 1194841 - DNA, 22 bp, Artificial Sequence
  chemically synthesized
attcttatctttccttaattgt

SEQ ID NO: 1194842 - DNA, 22 bp, Artificial Sequence
  chemically synthesized
ttcttatctttccttaattgtt

SEQ ID NO: 1194843 - DNA, 22 bp, Artificial Sequence
  chemically synthesized
ttatctttccttaattgtttaa

SEQ ID NO: 1194844 - DNA, 22 bp, Artificial Sequence
  chemically synthesized
atctttccttaattgtttaatt

SEQ ID NO: 1194845 - DNA, 22 bp, Artificial Sequence
  chemically synthesized
tggaaagaagaaaattaaacaa

SEQ ID NO: 1194846 - DNA, 22 bp, Artificial Sequence
  chemically synthesized
tctttccttaattgtttaattt

SEQ ID NO: 1194847 - DNA, 22 bp, Artificial Sequence
  chemically synthesized
tccttaattgtttaattttctt

SEQ ID NO: 1194848 - DNA, 22 bp, Artificial Sequence
  chemically synthesized
ccttaattgtttaattttcttc

SEQ ID NO: 1194849 - DNA, 22 bp, Artificial Sequence
  chemically synthesized
cttaattgtttaattttcttct

SEQ ID NO: 1194850 - DNA, 22 bp, Artificial Sequence
  chemically synthesized
agaactgtggaaagaagaaaat

SEQ ID NO: 1194851 - DNA, 22 bp, Artificial Sequence
  chemically synthesized
aagaactgtggaaagaagaaaa

SEQ ID NO: 1194852 - DNA, 22 bp, Artificial Sequence
  chemically synthesized
aattgtttaattttcttctttc

SEQ ID NO: 1194853 - DNA, 22 bp, Artificial Sequence
  chemically synthesized
attgtttaattttcttctttcc

SEQ ID NO: 1194854 - DNA, 22 bp, Artificial Sequence
  chemically synthesized
agtttaagaactgtggaaagaa

SEQ ID NO: 1194855 - DNA, 22 bp, Artificial Sequence
  chemically synthesized
cagtttaagaactgtggaaaga

SEQ ID NO: 1194856 - DNA, 22 bp, Artificial Sequence
  chemically synthesized
tttaattttcttctttccacag

SEQ ID NO: 1194857 - DNA, 22 bp, Artificial Sequence
  chemically synthesized
ttcagtttaagaactgtggaaa

SEQ ID NO: 1194858 - DNA, 22 bp, Artificial Sequence
  chemically synthesized
cttcagtttaagaactgtggaa

SEQ ID NO: 1194859 - DNA, 22 bp, Artificial Sequence
  chemically synthesized
aattttcttctttccacagttc

SEQ ID NO: 1194860 - DNA, 22 bp, Artificial Sequence
  chemically synthesized
attttcttctttccacagttct

SEQ ID NO: 1194861 - DNA, 22 bp, Artificial Sequence
  chemically synthesized
tcttctttccacagttcttaaa

SEQ ID NO: 1194862 - DNA, 22 bp, Artificial Sequence
  chemically synthesized
cttctttccacagttcttaaac

SEQ ID NO: 1194863 - DNA, 22 bp, Artificial Sequence
  chemically synthesized
ttctttccacagttcttaaact

SEQ ID NO: 1194864 - DNA, 22 bp, Artificial Sequence
  chemically synthesized
ctttccacagttcttaaactga

SEQ ID NO: 1194865 - DNA, 22 bp, Artificial Sequence
  chemically synthesized
tttccacagttcttaaactgaa

SEQ ID NO: 1194866 - DNA, 22 bp, Artificial Sequence
  chemically synthesized
tccacagttcttaaactgaaga

SEQ ID NO: 1194867 - DNA, 22 bp, Artificial Sequence
  chemically synthesized
ccacagttcttaaactgaagaa

SEQ ID NO: 1194868 - DNA, 22 bp, Artificial Sequence
  chemically synthesized
cacagttcttaaactgaagaag

SEQ ID NO: 1194869 - DNA, 22 bp, Artificial Sequence
  chemically synthesized
tggccaacgtcaggccttcttc

SEQ ID NO: 1194870 - DNA, 22 bp, Artificial Sequence
  chemically synthesized
ttaaactgaagaaggcctgacg

SEQ ID NO: 1194871 - DNA, 22 bp, Artificial Sequence
  chemically synthesized
aaactgaagaaggcctgacgtt

SEQ ID NO: 1194872 - DNA, 22 bp, Artificial Sequence
  chemically synthesized
aactgaagaaggcctgacgttg

SEQ ID NO: 1194873 - DNA, 22 bp, Artificial Sequence
  chemically synthesized
agtggctatggccaacgtcagg

SEQ ID NO: 1194874 - DNA, 22 bp, Artificial Sequence
  chemically synthesized
aagtggctatggccaacgtcag

SEQ ID NO: 1194875 - DNA, 22 bp, Artificial Sequence
  chemically synthesized
aagaaggcctgacgttggccat

SEQ ID NO: 1194876 - DNA, 22 bp, Artificial Sequence
  chemically synthesized
acagtgtttaagtggctatggc

SEQ ID NO: 1194877 - DNA, 22 bp, Artificial Sequence
  chemically synthesized
acgttggccatagccacttaaa

SEQ ID NO: 1194878 - DNA, 22 bp, Artificial Sequence
  chemically synthesized
gccatagccacttaaacactgt

SEQ ID NO: 1194879 - DNA, 22 bp, Artificial Sequence
  chemically synthesized
gcatggcaagatggaaagacta

SEQ ID NO: 1194880 - DNA, 22 bp, Artificial Sequence
  chemically synthesized
ggcatggcaagatggaaagact

SEQ ID NO: 1194881 - DNA, 22 bp, Artificial Sequence
  chemically synthesized
aaacactgttagtctttccatc

SEQ ID NO: 1194882 - DNA, 22 bp, Artificial Sequence
  chemically synthesized
aacactgttagtctttccatct

SEQ ID NO: 1194883 - DNA, 22 bp, Artificial Sequence
  chemically synthesized
agtttggcatggcaagatggaa

SEQ ID NO: 1194884 - DNA, 22 bp, Artificial Sequence
  chemically synthesized
cagtttggcatggcaagatgga

SEQ ID NO: 1194885 - DNA, 22 bp, Artificial Sequence
  chemically synthesized
ttagtctttccatcttgccatg

SEQ ID NO: 1194886 - DNA, 22 bp, Artificial Sequence
  chemically synthesized
gtctttccatcttgccatgcca

SEQ ID NO: 1194887 - DNA, 22 bp, Artificial Sequence
  chemically synthesized
tccatcttgccatgccaaactg

SEQ ID NO: 1194888 - DNA, 22 bp, Artificial Sequence
  chemically synthesized
ccatcttgccatgccaaactga

SEQ ID NO: 1194889 - DNA, 22 bp, Artificial Sequence
  chemically synthesized
catcttgccatgccaaactgaa

SEQ ID NO: 1194890 - DNA, 22 bp, Artificial Sequence
  chemically synthesized
gccatgccaaactgaaatactt

SEQ ID NO: 1194891 - DNA, 22 bp, Artificial Sequence
  chemically synthesized
ccatgccaaactgaaatacttt

SEQ ID NO: 1194892 - DNA, 22 bp, Artificial Sequence
  chemically synthesized
aatgagtggataggtaaaagta

SEQ ID NO: 1194893 - DNA, 22 bp, Artificial Sequence
  chemically synthesized
ctaaatgagtggataggtaaaa

SEQ ID NO: 1194894 - DNA, 22 bp, Artificial Sequence
  chemically synthesized
actaaatgagtggataggtaaa

SEQ ID NO: 1194895 - DNA, 22 bp, Artificial Sequence
  chemically synthesized
aaatacttttacctatccactc

SEQ ID NO: 1194896 - DNA, 22 bp, Artificial Sequence
  chemically synthesized
agtaaatatttactaaatgagt

SEQ ID NO: 1194897 - DNA, 22 bp, Artificial Sequence
  chemically synthesized
ttacctatccactcatttagta

SEQ ID NO: 1194898 - DNA, 22 bp, Artificial Sequence
  chemically synthesized
tacctatccactcatttagtaa

SEQ ID NO: 1194899 - DNA, 22 bp, Artificial Sequence
  chemically synthesized
acctatccactcatttagtaaa

SEQ ID NO: 1194900 - DNA, 22 bp, Artificial Sequence
  chemically synthesized
cctatccactcatttagtaaat

SEQ ID NO: 1194901 - DNA, 22 bp, Artificial Sequence
  chemically synthesized
tccactcatttagtaaatattt

SEQ ID NO: 1194902 - DNA, 22 bp, Artificial Sequence
  chemically synthesized
atttagtaaatatttactcagt

SEQ ID NO: 1194903 - DNA, 22 bp, Artificial Sequence
  chemically synthesized
gaaaatggtagacactgagtaa

SEQ ID NO: 1194904 - DNA, 22 bp, Artificial Sequence
  chemically synthesized
agtaaatatttactcagtgtct

SEQ ID NO: 1194905 - DNA, 22 bp, Artificial Sequence
  chemically synthesized
gtaaatatttactcagtgtcta

SEQ ID NO: 1194906 - DNA, 22 bp, Artificial Sequence
  chemically synthesized
tggtagttggaaaatggtagac

SEQ ID NO: 1194907 - DNA, 22 bp, Artificial Sequence
  chemically synthesized
gtggtagttggaaaatggtaga

SEQ ID NO: 1194908 - DNA, 22 bp, Artificial Sequence
  chemically synthesized
tgtggtagttggaaaatggtag

SEQ ID NO: 1194909 - DNA, 22 bp, Artificial Sequence
  chemically synthesized
ttgtggtagttggaaaatggta

SEQ ID NO: 1194910 - DNA, 22 bp, Artificial Sequence
  chemically synthesized
actcagtgtctaccattttcca

SEQ ID NO: 1194911 - DNA, 22 bp, Artificial Sequence
  chemically synthesized
ctcagtgtctaccattttccaa

SEQ ID NO: 1194912 - DNA, 22 bp, Artificial Sequence
  chemically synthesized
agtgtctaccattttccaacta

SEQ ID NO: 1194913 - DNA, 22 bp, Artificial Sequence
  chemically synthesized
gcaccttttgtggtagttggaa

SEQ ID NO: 1194914 - DNA, 22 bp, Artificial Sequence
  chemically synthesized
ccattttccaactaccacaaaa

SEQ ID NO: 1194915 - DNA, 22 bp, Artificial Sequence
  chemically synthesized
cgccctagcaccttttgtggta

SEQ ID NO: 1194916 - DNA, 22 bp, Artificial Sequence
  chemically synthesized
tccaactaccacaaaaggtgct

SEQ ID NO: 1194917 - DNA, 22 bp, Artificial Sequence
  chemically synthesized
ccaactaccacaaaaggtgcta

SEQ ID NO: 1194918 - DNA, 22 bp, Artificial Sequence
  chemically synthesized
ataattgcgccctagcaccttt

SEQ ID NO: 1194919 - DNA, 22 bp, Artificial Sequence
  chemically synthesized
caactaccacaaaaggtgctag

SEQ ID NO: 1194920 - DNA, 22 bp, Artificial Sequence
  chemically synthesized
ttcataattgcgccctagcacc

SEQ ID NO: 1194921 - DNA, 22 bp, Artificial Sequence
  chemically synthesized
gttcataattgcgccctagcac

SEQ ID NO: 1194922 - DNA, 22 bp, Artificial Sequence
  chemically synthesized
tgttcataattgcgccctagca

SEQ ID NO: 1194923 - DNA, 22 bp, Artificial Sequence
  chemically synthesized
ccacaaaaggtgctagggcgca

SEQ ID NO: 1194924 - DNA, 22 bp, Artificial Sequence
  chemically synthesized
tttgttcataattgcgccctag

SEQ ID NO: 1194925 - DNA, 22 bp, Artificial Sequence
  chemically synthesized
ctttgttcataattgcgcccta

SEQ ID NO: 1194926 - DNA, 22 bp, Artificial Sequence
  chemically synthesized
acttctttgttcataattgcgc

SEQ ID NO: 1194927 - DNA, 22 bp, Artificial Sequence
  chemically synthesized
ctgacttctttgttcataattg

SEQ ID NO: 1194928 - DNA, 22 bp, Artificial Sequence
  chemically synthesized
gggcgcaattatgaacaaagaa

SEQ ID NO: 1194929 - DNA, 22 bp, Artificial Sequence
  chemically synthesized
tgaaaaaagtatctgctgactt

SEQ ID NO: 1194930 - DNA, 22 bp, Artificial Sequence
  chemically synthesized
tgtgaaaaaagtatctgctgac

SEQ ID NO: 1194931 - DNA, 22 bp, Artificial Sequence
  chemically synthesized
tgaacaaagaagtcagcagata

SEQ ID NO: 1194932 - DNA, 22 bp, Artificial Sequence
  chemically synthesized
taagctctgtgaaaaaagtatc

SEQ ID NO: 1194933 - DNA, 22 bp, Artificial Sequence
  chemically synthesized
tactgtaagctctgtgaaaaaa

SEQ ID NO: 1194934 - DNA, 22 bp, Artificial Sequence
  chemically synthesized
ctgtactgtaagctctgtgaaa

SEQ ID NO: 1194935 - DNA, 22 bp, Artificial Sequence
  chemically synthesized
gctgtactgtaagctctgtgaa

SEQ ID NO: 1194936 - DNA, 22 bp, Artificial Sequence
  chemically synthesized
cccgtttgctgtactgtaagct

SEQ ID NO: 1194937 - DNA, 22 bp, Artificial Sequence
  chemically synthesized
ttttcacagagcttacagtaca

SEQ ID NO: 1194938 - DNA, 22 bp, Artificial Sequence
  chemically synthesized
tttcacagagcttacagtacag

SEQ ID NO: 1194939 - DNA, 22 bp, Artificial Sequence
  chemically synthesized
ttcacagagcttacagtacagc

SEQ ID NO: 1194940 - DNA, 22 bp, Artificial Sequence
  chemically synthesized
tcacagagcttacagtacagca

SEQ ID NO: 1194941 - DNA, 22 bp, Artificial Sequence
  chemically synthesized
cacagagcttacagtacagcaa

SEQ ID NO: 1194942 - DNA, 22 bp, Artificial Sequence
  chemically synthesized
acagagcttacagtacagcaaa

SEQ ID NO: 1194943 - DNA, 22 bp, Artificial Sequence
  chemically synthesized
cacgtgttgcccgtttgctgta

SEQ ID NO: 1194944 - DNA, 22 bp, Artificial Sequence
  chemically synthesized
acacgtgttgcccgtttgctgt

SEQ ID NO: 1194945 - DNA, 22 bp, Artificial Sequence
  chemically synthesized
cttacacgtgttgcccgtttgc

SEQ ID NO: 1194946 - DNA, 22 bp, Artificial Sequence
  chemically synthesized
gcttacacgtgttgcccgtttg

SEQ ID NO: 1194947 - DNA, 22 bp, Artificial Sequence
  chemically synthesized
acagtacagcaaacgggcaaca

SEQ ID NO: 1194948 - DNA, 22 bp, Artificial Sequence
  chemically synthesized
cttgcttacacgtgttgcccgt

SEQ ID NO: 1194949 - DNA, 22 bp, Artificial Sequence
  chemically synthesized
cagtacagcaaacgggcaacac

SEQ ID NO: 1194950 - DNA, 22 bp, Artificial Sequence
  chemically synthesized
acttgcttacacgtgttgcccg

SEQ ID NO: 1194951 - DNA, 22 bp, Artificial Sequence
  chemically synthesized
aacttacttgcttacacgtgtt

SEQ ID NO: 1194952 - DNA, 22 bp, Artificial Sequence
  chemically synthesized
tattgaacttacttgcttacac

SEQ ID NO: 1194953 - DNA, 22 bp, Artificial Sequence
  chemically synthesized
aacctgtattgaacttacttgc

SEQ ID NO: 1194954 - DNA, 22 bp, Artificial Sequence
  chemically synthesized
gggatgttcaacctgtattgaa

SEQ ID NO: 1194955 - DNA, 22 bp, Artificial Sequence
  chemically synthesized
ttagggatgttcaacctgtatt

SEQ ID NO: 1194956 - DNA, 22 bp, Artificial Sequence
  chemically synthesized
ctattagggatgttcaacctgt

SEQ ID NO: 1194957 - DNA, 22 bp, Artificial Sequence
  chemically synthesized
cctattagggatgttcaacctg

SEQ ID NO: 1194958 - DNA, 22 bp, Artificial Sequence
  chemically synthesized
tcctattagggatgttcaacct

SEQ ID NO: 1194959 - DNA, 22 bp, Artificial Sequence
  chemically synthesized
aaattttcctattagggatgtt

SEQ ID NO: 1194960 - DNA, 22 bp, Artificial Sequence
  chemically synthesized
aatacaggttgaacatccctaa

SEQ ID NO: 1194961 - DNA, 22 bp, Artificial Sequence
  chemically synthesized
caaattttcctattagggatgt

SEQ ID NO: 1194962 - DNA, 22 bp, Artificial Sequence
  chemically synthesized
agatttcaaattttcctattag

SEQ ID NO: 1194963 - DNA, 22 bp, Artificial Sequence
  chemically synthesized
cagatttcaaattttcctatta

SEQ ID NO: 1194964 - DNA, 22 bp, Artificial Sequence
  chemically synthesized
aacatccctaataggaaaattt

SEQ ID NO: 1194965 - DNA, 22 bp, Artificial Sequence
  chemically synthesized
tagcatttcagatttcaaattt

SEQ ID NO: 1194966 - DNA, 22 bp, Artificial Sequence
  chemically synthesized
gtagcatttcagatttcaaatt

SEQ ID NO: 1194967 - DNA, 22 bp, Artificial Sequence
  chemically synthesized
tgtagcatttcagatttcaaat

SEQ ID NO: 1194968 - DNA, 22 bp, Artificial Sequence
  chemically synthesized
ataggaaaatttgaaatctgaa

SEQ ID NO: 1194969 - DNA, 22 bp, Artificial Sequence
  chemically synthesized
cagattttgtagcatttcagat

SEQ ID NO: 1194970 - DNA, 22 bp, Artificial Sequence
  chemically synthesized
gaaatctgaaatgctacaaaat

SEQ ID NO: 1194971 - DNA, 22 bp, Artificial Sequence
  chemically synthesized
aaaaaattacagattttgtagc

SEQ ID NO: 1194972 - DNA, 22 bp, Artificial Sequence
  chemically synthesized
aaatctgaaatgctacaaaatc

SEQ ID NO: 1194973 - DNA, 22 bp, Artificial Sequence
  chemically synthesized
ctcaaaaaattacagattttgt

SEQ ID NO: 1194974 - DNA, 22 bp, Artificial Sequence
  chemically synthesized
aaatgctacaaaatctgtaatt

SEQ ID NO: 1194975 - DNA, 22 bp, Artificial Sequence
  chemically synthesized
caaaatctgtaattttttgagt

SEQ ID NO: 1194976 - DNA, 22 bp, Artificial Sequence
  chemically synthesized
aaaatgatcgtgtagttactca

SEQ ID NO: 1194977 - DNA, 22 bp, Artificial Sequence
  chemically synthesized
aaaaatgatcgtgtagttactc

SEQ ID NO: 1194978 - DNA, 22 bp, Artificial Sequence
  chemically synthesized
taattttttgagtaactacacg

SEQ ID NO: 1194979 - DNA, 22 bp, Artificial Sequence
  chemically synthesized
ccttaaaaatgatcgtgtagtt

SEQ ID NO: 1194980 - DNA, 22 bp, Artificial Sequence
  chemically synthesized
cccttaaaaatgatcgtgtagt

SEQ ID NO: 1194981 - DNA, 22 bp, Artificial Sequence
  chemically synthesized
tttgagtaactacacgatcatt

SEQ ID NO: 1194982 - DNA, 22 bp, Artificial Sequence
  chemically synthesized
ttgagtaactacacgatcattt

SEQ ID NO: 1194983 - DNA, 22 bp, Artificial Sequence
  chemically synthesized
tgagtaactacacgatcatttt

SEQ ID NO: 1194984 - DNA, 22 bp, Artificial Sequence
  chemically synthesized
gagtaactacacgatcattttt

SEQ ID NO: 1194985 - DNA, 22 bp, Artificial Sequence
  chemically synthesized
agtaactacacgatcattttta

SEQ ID NO: 1194986 - DNA, 22 bp, Artificial Sequence
  chemically synthesized
aataaggatttcccttaaaaat

SEQ ID NO: 1194987 - DNA, 22 bp, Artificial Sequence
  chemically synthesized
cacgatcatttttaagggaaat

SEQ ID NO: 1194988 - DNA, 22 bp, Artificial Sequence
  chemically synthesized
ttaagggaaatccttattgaat

SEQ ID NO: 1194989 - DNA, 22 bp, Artificial Sequence
  chemically synthesized
aaatccgaaatgattcaataag

SEQ ID NO: 1194990 - DNA, 22 bp, Artificial Sequence
  chemically synthesized
taagggaaatccttattgaatc

SEQ ID NO: 1194991 - DNA, 22 bp, Artificial Sequence
  chemically synthesized
aagggaaatccttattgaatca

SEQ ID NO: 1194992 - DNA, 22 bp, Artificial Sequence
  chemically synthesized
agggaaatccttattgaatcat

SEQ ID NO: 1194993 - DNA, 22 bp, Artificial Sequence
  chemically synthesized
aaaatctgaaatccgaaatgat

SEQ ID NO: 1194994 - DNA, 22 bp, Artificial Sequence
  chemically synthesized
attgaatcatttcggatttcag

SEQ ID NO: 1194995 - DNA, 22 bp, Artificial Sequence
  chemically synthesized
ttgaatcatttcggatttcaga

SEQ ID NO: 1194996 - DNA, 22 bp, Artificial Sequence
  chemically synthesized
aatcatttcggatttcagattt

SEQ ID NO: 1194997 - DNA, 22 bp, Artificial Sequence
  chemically synthesized
agcatccataatctgaaaatct

SEQ ID NO: 1194998 - DNA, 22 bp, Artificial Sequence
  chemically synthesized
cggatttcagattttcagatta

SEQ ID NO: 1194999 - DNA, 22 bp, Artificial Sequence
  chemically synthesized
ggatttcagattttcagattat

SEQ ID NO: 1195000 - DNA, 22 bp, Artificial Sequence
  chemically synthesized
cagattttcagattatggatgc

SEQ ID NO: 1195001 - DNA, 22 bp, Artificial Sequence
  chemically synthesized
agattttcagattatggatgct

SEQ ID NO: 1195002 - DNA, 22 bp, Artificial Sequence
  chemically synthesized
tacatacgagttgagcatccat

SEQ ID NO: 1195003 - DNA, 22 bp, Artificial Sequence
  chemically synthesized
ttatacatacgagttgagcatc

SEQ ID NO: 1195004 - DNA, 22 bp, Artificial Sequence
  chemically synthesized
attatacatacgagttgagcat

SEQ ID NO: 1195005 - DNA, 22 bp, Artificial Sequence
  chemically synthesized
tcagattatggatgctcaactc

SEQ ID NO: 1195006 - DNA, 22 bp, Artificial Sequence
  chemically synthesized
tattatacatacgagttgagca

SEQ ID NO: 1195007 - DNA, 22 bp, Artificial Sequence
  chemically synthesized
cagattatggatgctcaactcg

SEQ ID NO: 1195008 - DNA, 22 bp, Artificial Sequence
  chemically synthesized
agattatggatgctcaactcgt

SEQ ID NO: 1195009 - DNA, 22 bp, Artificial Sequence
  chemically synthesized
tggatgctcaactcgtatgtat

SEQ ID NO: 1195010 - DNA, 22 bp, Artificial Sequence
  chemically synthesized
gaatatctttattatacatacg

SEQ ID NO: 1195011 - DNA, 22 bp, Artificial Sequence
  chemically synthesized
ggaatatctttattatacatac

SEQ ID NO: 1195012 - DNA, 22 bp, Artificial Sequence
  chemically synthesized
agtttggaatatctttattata

SEQ ID NO: 1195013 - DNA, 22 bp, Artificial Sequence
  chemically synthesized
cagtttggaatatctttattat

SEQ ID NO: 1195014 - DNA, 22 bp, Artificial Sequence
  chemically synthesized
aactcgtatgtataataaagat

SEQ ID NO: 1195015 - DNA, 22 bp, Artificial Sequence
  chemically synthesized
tcagtttggaatatctttatta

SEQ ID NO: 1195016 - DNA, 22 bp, Artificial Sequence
  chemically synthesized
gtatgtataataaagatattcc

SEQ ID NO: 1195017 - DNA, 22 bp, Artificial Sequence
  chemically synthesized
gatattttcagtttggaatatc

SEQ ID NO: 1195018 - DNA, 22 bp, Artificial Sequence
  chemically synthesized
ggatattttcagtttggaatat

SEQ ID NO: 1195019 - DNA, 22 bp, Artificial Sequence
  chemically synthesized
tggatattttcagtttggaata

SEQ ID NO: 1195020 - DNA, 22 bp, Artificial Sequence
  chemically synthesized
gattttggatattttcagtttg

SEQ ID NO: 1195021 - DNA, 22 bp, Artificial Sequence
  chemically synthesized
ggattttggatattttcagttt

SEQ ID NO: 1195022 - DNA, 22 bp, Artificial Sequence
  chemically synthesized
tggattttggatattttcagtt

SEQ ID NO: 1195023 - DNA, 22 bp, Artificial Sequence
  chemically synthesized
caaactgaaaatatccaaaatc

SEQ ID NO: 1195024 - DNA, 22 bp, Artificial Sequence
  chemically synthesized
ggaccagaagtgttttggattt

SEQ ID NO: 1195025 - DNA, 22 bp, Artificial Sequence
  chemically synthesized
gggaccagaagtgttttggatt

SEQ ID NO: 1195026 - DNA, 22 bp, Artificial Sequence
  chemically synthesized
aaaatatccaaaatccaaaaca

SEQ ID NO: 1195027 - DNA, 22 bp, Artificial Sequence
  chemically synthesized
tccaaaatgcttgggaccagaa

SEQ ID NO: 1195028 - DNA, 22 bp, Artificial Sequence
  chemically synthesized
atccaaaatgcttgggaccaga

SEQ ID NO: 1195029 - DNA, 22 bp, Artificial Sequence
  chemically synthesized
agtatcccttatccaaaatgct

SEQ ID NO: 1195030 - DNA, 22 bp, Artificial Sequence
  chemically synthesized
ctggtcccaagcattttggata

SEQ ID NO: 1195031 - DNA, 22 bp, Artificial Sequence
  chemically synthesized
tggtcccaagcattttggataa

SEQ ID NO: 1195032 - DNA, 22 bp, Artificial Sequence
  chemically synthesized
gtcccaagcattttggataagg

SEQ ID NO: 1195033 - DNA, 22 bp, Artificial Sequence
  chemically synthesized
ccccaaaatatatgttgagtat

SEQ ID NO: 1195034 - DNA, 22 bp, Artificial Sequence
  chemically synthesized
gccccaaaatatatgttgagta

SEQ ID NO: 1195035 - DNA, 22 bp, Artificial Sequence
  chemically synthesized
tggataagggatactcaacata

SEQ ID NO: 1195036 - DNA, 22 bp, Artificial Sequence
  chemically synthesized
ggataagggatactcaacatat

SEQ ID NO: 1195037 - DNA, 22 bp, Artificial Sequence
  chemically synthesized
gataagggatactcaacatata

SEQ ID NO: 1195038 - DNA, 22 bp, Artificial Sequence
  chemically synthesized
taataaaacttgccccaaaata

SEQ ID NO: 1195039 - DNA, 22 bp, Artificial Sequence
  chemically synthesized
cctataataaaacttgccccaa

SEQ ID NO: 1195040 - DNA, 22 bp, Artificial Sequence
  chemically synthesized
ccctataataaaacttgcccca

SEQ ID NO: 1195041 - DNA, 22 bp, Artificial Sequence
  chemically synthesized
aacatatattttggggcaagtt

SEQ ID NO: 1195042 - DNA, 22 bp, Artificial Sequence
  chemically synthesized
tccctataataaaacttgcccc

SEQ ID NO: 1195043 - DNA, 22 bp, Artificial Sequence
  chemically synthesized
gctttccctataataaaacttg

SEQ ID NO: 1195044 - DNA, 22 bp, Artificial Sequence
  chemically synthesized
tggggcaagttttattataggg

SEQ ID NO: 1195045 - DNA, 22 bp, Artificial Sequence
  chemically synthesized
ggggcaagttttattataggga

SEQ ID NO: 1195046 - DNA, 22 bp, Artificial Sequence
  chemically synthesized
gggcaagttttattatagggaa

SEQ ID NO: 1195047 - DNA, 22 bp, Artificial Sequence
  chemically synthesized
ggcaatgttagctttccctata

SEQ ID NO: 1195048 - DNA, 22 bp, Artificial Sequence
  chemically synthesized
aatattgggcaatgttagcttt

SEQ ID NO: 1195049 - DNA, 22 bp, Artificial Sequence
  chemically synthesized
tattatagggaaagctaacatt

SEQ ID NO: 1195050 - DNA, 22 bp, Artificial Sequence
  chemically synthesized
attatagggaaagctaacattg

SEQ ID NO: 1195051 - DNA, 22 bp, Artificial Sequence
  chemically synthesized
ttatagggaaagctaacattgc

SEQ ID NO: 1195052 - DNA, 22 bp, Artificial Sequence
  chemically synthesized
tagggaaagctaacattgccca

SEQ ID NO: 1195053 - DNA, 22 bp, Artificial Sequence
  chemically synthesized
aagactaaatattgggcaatgt

SEQ ID NO: 1195054 - DNA, 22 bp, Artificial Sequence
  chemically synthesized
tgcctcaagactaaatattggg

SEQ ID NO: 1195055 - DNA, 22 bp, Artificial Sequence
  chemically synthesized
gtgcctcaagactaaatattgg

SEQ ID NO: 1195056 - DNA, 22 bp, Artificial Sequence
  chemically synthesized
tgtgcctcaagactaaatattg

SEQ ID NO: 1195057 - DNA, 22 bp, Artificial Sequence
  chemically synthesized
acattgcccaatatttagtctt

SEQ ID NO: 1195058 - DNA, 22 bp, Artificial Sequence
  chemically synthesized
actttgtgcctcaagactaaat

SEQ ID NO: 1195059 - DNA, 22 bp, Artificial Sequence
  chemically synthesized
cccaatatttagtcttgaggca

SEQ ID NO: 1195060 - DNA, 22 bp, Artificial Sequence
  chemically synthesized
atggttgactttgtgcctcaag

SEQ ID NO: 1195061 - DNA, 22 bp, Artificial Sequence
  chemically synthesized
cattaatggttgactttgtgcc

SEQ ID NO: 1195062 - DNA, 22 bp, Artificial Sequence
  chemically synthesized
agtcttgaggcacaaagtcaac

SEQ ID NO: 1195063 - DNA, 22 bp, Artificial Sequence
  chemically synthesized
gtcttgaggcacaaagtcaacc

SEQ ID NO: 1195064 - DNA, 22 bp, Artificial Sequence
  chemically synthesized
aagtgctacattaatggttgac

SEQ ID NO: 1195065 - DNA, 22 bp, Artificial Sequence
  chemically synthesized
gaggcacaaagtcaaccattaa

SEQ ID NO: 1195066 - DNA, 22 bp, Artificial Sequence
  chemically synthesized
aggcacaaagtcaaccattaat

SEQ ID NO: 1195067 - DNA, 22 bp, Artificial Sequence
  chemically synthesized
caaagctgaagtgctacattaa

SEQ ID NO: 1195068 - DNA, 22 bp, Artificial Sequence
  chemically synthesized
ccaaagctgaagtgctacatta

SEQ ID NO: 1195069 - DNA, 22 bp, Artificial Sequence
  chemically synthesized
acatgaaatgtttccaaagctg

SEQ ID NO: 1195070 - DNA, 22 bp, Artificial Sequence
  chemically synthesized
atgtagcacttcagctttggaa

SEQ ID NO: 1195071 - DNA, 22 bp, Artificial Sequence
  chemically synthesized
attaacatgaaatgtttccaaa

SEQ ID NO: 1195072 - DNA, 22 bp, Artificial Sequence
  chemically synthesized
cagctttggaaacatttcatgt

SEQ ID NO: 1195073 - DNA, 22 bp, Artificial Sequence
  chemically synthesized
agctttggaaacatttcatgtt

SEQ ID NO: 1195074 - DNA, 22 bp, Artificial Sequence
  chemically synthesized
tggaaacatttcatgttaatga

SEQ ID NO: 1195075 - DNA, 22 bp, Artificial Sequence
  chemically synthesized
ggaaacatttcatgttaatgaa

SEQ ID NO: 1195076 - DNA, 22 bp, Artificial Sequence
  chemically synthesized
gaaacatttcatgttaatgaat

SEQ ID NO: 1195077 - DNA, 22 bp, Artificial Sequence
  chemically synthesized
catgttaatgaatattttggct

SEQ ID NO: 1195078 - DNA, 22 bp, Artificial Sequence
  chemically synthesized
atgttaatgaatattttggctg

SEQ ID NO: 1195079 - DNA, 22 bp, Artificial Sequence
  chemically synthesized
atgaatattttggctgattttt

SEQ ID NO: 1195080 - DNA, 22 bp, Artificial Sequence
  chemically synthesized
tggctgatttttctatgtatgt

SEQ ID NO: 1195081 - DNA, 22 bp, Artificial Sequence
  chemically synthesized
ggctgatttttctatgtatgta

SEQ ID NO: 1195082 - DNA, 22 bp, Artificial Sequence
  chemically synthesized
gctgatttttctatgtatgtat

SEQ ID NO: 1195083 - DNA, 22 bp, Artificial Sequence
  chemically synthesized
aaaagaggcagaagatacatac

SEQ ID NO: 1195084 - DNA, 22 bp, Artificial Sequence
  chemically synthesized
gaaaagaggcagaagatacata

SEQ ID NO: 1195085 - DNA, 22 bp, Artificial Sequence
  chemically synthesized
atttttctatgtatgtatcttc

SEQ ID NO: 1195086 - DNA, 22 bp, Artificial Sequence
  chemically synthesized
ttctatgtatgtatcttctgcc

SEQ ID NO: 1195087 - DNA, 22 bp, Artificial Sequence
  chemically synthesized
tctatgtatgtatcttctgcct

SEQ ID NO: 1195088 - DNA, 22 bp, Artificial Sequence
  chemically synthesized
ctatgtatgtatcttctgcctc

SEQ ID NO: 1195089 - DNA, 22 bp, Artificial Sequence
  chemically synthesized
tatgtatgtatcttctgcctct

SEQ ID NO: 1195090 - DNA, 22 bp, Artificial Sequence
  chemically synthesized
tgtatgtatcttctgcctcttt

SEQ ID NO: 1195091 - DNA, 22 bp, Artificial Sequence
  chemically synthesized
ccatgaatcagtgtttgaaaag

SEQ ID NO: 1195092 - DNA, 22 bp, Artificial Sequence
  chemically synthesized
ctgcctcttttcaaacactgat

SEQ ID NO: 1195093 - DNA, 22 bp, Artificial Sequence
  chemically synthesized
tgcctcttttcaaacactgatt

SEQ ID NO: 1195094 - DNA, 22 bp, Artificial Sequence
  chemically synthesized
ccaagctaccatgaatcagtgt

SEQ ID NO: 1195095 - DNA, 22 bp, Artificial Sequence
  chemically synthesized
cctcttttcaaacactgattca

SEQ ID NO: 1195096 - DNA, 22 bp, Artificial Sequence
  chemically synthesized
gccaagctaccatgaatcagtg

SEQ ID NO: 1195097 - DNA, 22 bp, Artificial Sequence
  chemically synthesized
ttttcaaacactgattcatggt

SEQ ID NO: 1195098 - DNA, 22 bp, Artificial Sequence
  chemically synthesized
agcttgccaagctaccatgaat

SEQ ID NO: 1195099 - DNA, 22 bp, Artificial Sequence
  chemically synthesized
ttcaaacactgattcatggtag

SEQ ID NO: 1195100 - DNA, 22 bp, Artificial Sequence
  chemically synthesized
tcaaacactgattcatggtagc

SEQ ID NO: 1195101 - DNA, 22 bp, Artificial Sequence
  chemically synthesized
caaacactgattcatggtagct

SEQ ID NO: 1195102 - DNA, 22 bp, Artificial Sequence
  chemically synthesized
aaacactgattcatggtagctt

SEQ ID NO: 1195103 - DNA, 22 bp, Artificial Sequence
  chemically synthesized
gagaatcattcagcttgccaag

SEQ ID NO: 1195104 - DNA, 22 bp, Artificial Sequence
  chemically synthesized
attcatggtagcttggcaagct

SEQ ID NO: 1195105 - DNA, 22 bp, Artificial Sequence
  chemically synthesized
ggagaatcattcagcttgccaa

SEQ ID NO: 1195106 - DNA, 22 bp, Artificial Sequence
  chemically synthesized
ttggagaatcattcagcttgcc

SEQ ID NO: 1195107 - DNA, 22 bp, Artificial Sequence
  chemically synthesized
atggtagcttggcaagctgaat

SEQ ID NO: 1195108 - DNA, 22 bp, Artificial Sequence
  chemically synthesized
ctcttggagaatcattcagctt

SEQ ID NO: 1195109 - DNA, 22 bp, Artificial Sequence
  chemically synthesized
ggcaagctgaatgattctccaa

SEQ ID NO: 1195110 - DNA, 22 bp, Artificial Sequence
  chemically synthesized
gcaagctgaatgattctccaag

SEQ ID NO: 1195111 - DNA, 22 bp, Artificial Sequence
  chemically synthesized
aagcatataatactcctcttgg

SEQ ID NO: 1195112 - DNA, 22 bp, Artificial Sequence
  chemically synthesized
aatgattctccaagaggagtat

SEQ ID NO: 1195113 - DNA, 22 bp, Artificial Sequence
  chemically synthesized
tccaagaggagtattatatgct

SEQ ID NO: 1195114 - DNA, 22 bp, Artificial Sequence
  chemically synthesized
caagaggagtattatatgcttc

SEQ ID NO: 1195115 - DNA, 22 bp, Artificial Sequence
  chemically synthesized
agataagacattgaagcatata

SEQ ID NO: 1195116 - DNA, 22 bp, Artificial Sequence
  chemically synthesized
ggggggtggttaagataagaca

SEQ ID NO: 1195117 - DNA, 22 bp, Artificial Sequence
  chemically synthesized
tatgcttcaatgtcttatctta

SEQ ID NO: 1195118 - DNA, 22 bp, Artificial Sequence
  chemically synthesized
caatgtcttatcttaaccaccc

SEQ ID NO: 1195119 - DNA, 22 bp, Artificial Sequence
  chemically synthesized
aatgtcttatcttaaccacccc

SEQ ID NO: 1195120 - DNA, 22 bp, Artificial Sequence
  chemically synthesized
aagatagattgggggggtggtt

SEQ ID NO: 1195121 - DNA, 22 bp, Artificial Sequence
  chemically synthesized
atcttaaccacccccccaatct

SEQ ID NO: 1195122 - DNA, 22 bp, Artificial Sequence
  chemically synthesized
tcttaaccacccccccaatcta

SEQ ID NO: 1195123 - DNA, 22 bp, Artificial Sequence
  chemically synthesized
aaccacccccccaatctatctt

SEQ ID NO: 1195124 - DNA, 22 bp, Artificial Sequence
  chemically synthesized
accacccccccaatctatcttt

SEQ ID NO: 1195125 - DNA, 22 bp, Artificial Sequence
  chemically synthesized
agatgatatatgaaatgtggaa

SEQ ID NO: 1195126 - DNA, 22 bp, Artificial Sequence
  chemically synthesized
tctttaacatttccacatttca

SEQ ID NO: 1195127 - DNA, 22 bp, Artificial Sequence
  chemically synthesized
ctgagatgatatatgaaatgtg

SEQ ID NO: 1195128 - DNA, 22 bp, Artificial Sequence
  chemically synthesized
taacatttccacatttcatata

SEQ ID NO: 1195129 - DNA, 22 bp, Artificial Sequence
  chemically synthesized
aacatttccacatttcatatat

SEQ ID NO: 1195130 - DNA, 22 bp, Artificial Sequence
  chemically synthesized
acatttccacatttcatatatc

SEQ ID NO: 1195131 - DNA, 22 bp, Artificial Sequence
  chemically synthesized
ccacatttcatatatcatctca

SEQ ID NO: 1195132 - DNA, 22 bp, Artificial Sequence
  chemically synthesized
cacatttcatatatcatctcag

SEQ ID NO: 1195133 - DNA, 22 bp, Artificial Sequence
  chemically synthesized
caagggtagaaatctgctgaga

SEQ ID NO: 1195134 - DNA, 22 bp, Artificial Sequence
  chemically synthesized
acaagggtagaaatctgctgag

SEQ ID NO: 1195135 - DNA, 22 bp, Artificial Sequence
  chemically synthesized
catatatcatctcagcagattt

SEQ ID NO: 1195136 - DNA, 22 bp, Artificial Sequence
  chemically synthesized
atatatcatctcagcagatttc

SEQ ID NO: 1195137 - DNA, 22 bp, Artificial Sequence
  chemically synthesized
acaaaaacttacaagggtagaa

SEQ ID NO: 1195138 - DNA, 22 bp, Artificial Sequence
  chemically synthesized
aacaaaaacttacaagggtaga

SEQ ID NO: 1195139 - DNA, 22 bp, Artificial Sequence
  chemically synthesized
taacaaaaacttacaagggtag

SEQ ID NO: 1195140 - DNA, 22 bp, Artificial Sequence
  chemically synthesized
ttaacaaaaacttacaagggta

SEQ ID NO: 1195141 - DNA, 22 bp, Artificial Sequence
  chemically synthesized
tttaacaaaaacttacaagggt

SEQ ID NO: 1195142 - DNA, 22 bp, Artificial Sequence
  chemically synthesized
agcagatttctacccttgtaag

SEQ ID NO: 1195143 - DNA, 22 bp, Artificial Sequence
  chemically synthesized
tttttaacaaaaacttacaagg

SEQ ID NO: 1195144 - DNA, 22 bp, Artificial Sequence
  chemically synthesized
ctttttaacaaaaacttacaag

SEQ ID NO: 1195145 - DNA, 22 bp, Artificial Sequence
  chemically synthesized
ctacccttgtaagtttttgtta

SEQ ID NO: 1195146 - DNA, 22 bp, Artificial Sequence
  chemically synthesized
tacccttgtaagtttttgttaa

SEQ ID NO: 1195147 - DNA, 22 bp, Artificial Sequence
  chemically synthesized
gcatatttctttttaacaaaaa

SEQ ID NO: 1195148 - DNA, 22 bp, Artificial Sequence
  chemically synthesized
ggcatatttctttttaacaaaa

SEQ ID NO: 1195149 - DNA, 22 bp, Artificial Sequence
  chemically synthesized
cccttgtaagtttttgttaaaa

SEQ ID NO: 1195150 - DNA, 22 bp, Artificial Sequence
  chemically synthesized
aatttggcatatttctttttaa

SEQ ID NO: 1195151 - DNA, 22 bp, Artificial Sequence
  chemically synthesized
gtaagtttttgttaaaaagaaa

SEQ ID NO: 1195152 - DNA, 22 bp, Artificial Sequence
  chemically synthesized
taagtttttgttaaaaagaaat

SEQ ID NO: 1195153 - DNA, 22 bp, Artificial Sequence
  chemically synthesized
ttaaatttggcatatttctttt

SEQ ID NO: 1195154 - DNA, 22 bp, Artificial Sequence
  chemically synthesized
tattaaatttggcatatttctt

SEQ ID NO: 1195155 - DNA, 22 bp, Artificial Sequence
  chemically synthesized
ttgttaaaaagaaatatgccaa

SEQ ID NO: 1195156 - DNA, 22 bp, Artificial Sequence
  chemically synthesized
tgttaaaaagaaatatgccaaa

SEQ ID NO: 1195157 - DNA, 22 bp, Artificial Sequence
  chemically synthesized
gttaaaaagaaatatgccaaat

SEQ ID NO: 1195158 - DNA, 22 bp, Artificial Sequence
  chemically synthesized
ttaaaaagaaatatgccaaatt

SEQ ID NO: 1195159 - DNA, 22 bp, Artificial Sequence
  chemically synthesized
tgatactctattaaatttggca

SEQ ID NO: 1195160 - DNA, 22 bp, Artificial Sequence
  chemically synthesized
aaaagaaatatgccaaatttaa

SEQ ID NO: 1195161 - DNA, 22 bp, Artificial Sequence
  chemically synthesized
atctatgatactctattaaatt

SEQ ID NO: 1195162 - DNA, 22 bp, Artificial Sequence
  chemically synthesized
catctatgatactctattaaat

SEQ ID NO: 1195163 - DNA, 22 bp, Artificial Sequence
  chemically synthesized
ttcatctatgatactctattaa

SEQ ID NO: 1195164 - DNA, 22 bp, Artificial Sequence
  chemically synthesized
cttcatctatgatactctatta

SEQ ID NO: 1195165 - DNA, 22 bp, Artificial Sequence
  chemically synthesized
aatagagtatcatagatgaaga

SEQ ID NO: 1195166 - DNA, 22 bp, Artificial Sequence
  chemically synthesized
atagagtatcatagatgaagaa

SEQ ID NO: 1195167 - DNA, 22 bp, Artificial Sequence
  chemically synthesized
agagacataagtatacaaatat

SEQ ID NO: 1195168 - DNA, 22 bp, Artificial Sequence
  chemically synthesized
aagagacataagtatacaaata

SEQ ID NO: 1195169 - DNA, 22 bp, Artificial Sequence
  chemically synthesized
cttaagagacataagtatacaa

SEQ ID NO: 1195170 - DNA, 22 bp, Artificial Sequence
  chemically synthesized
gtataaaaagctccttaagaga

SEQ ID NO: 1195171 - DNA, 22 bp, Artificial Sequence
  chemically synthesized
gtatacttatgtctcttaagga

SEQ ID NO: 1195172 - DNA, 22 bp, Artificial Sequence
  chemically synthesized
agtataaaaagctccttaagag

SEQ ID NO: 1195173 - DNA, 22 bp, Artificial Sequence
  chemically synthesized
tatacttatgtctcttaaggag

SEQ ID NO: 1195174 - DNA, 22 bp, Artificial Sequence
  chemically synthesized
ttagtataaaaagctccttaag

SEQ ID NO: 1195175 - DNA, 22 bp, Artificial Sequence
  chemically synthesized
cttagtataaaaagctccttaa

SEQ ID NO: 1195176 - DNA, 22 bp, Artificial Sequence
  chemically synthesized
atgtctcttaaggagcttttta

SEQ ID NO: 1195177 - DNA, 22 bp, Artificial Sequence
  chemically synthesized
aatttcttagtataaaaagctc

SEQ ID NO: 1195178 - DNA, 22 bp, Artificial Sequence
  chemically synthesized
tgtctcttaaggagctttttat

SEQ ID NO: 1195179 - DNA, 22 bp, Artificial Sequence
  chemically synthesized
tgaatttcttagtataaaaagc

SEQ ID NO: 1195180 - DNA, 22 bp, Artificial Sequence
  chemically synthesized
ctgaatttcttagtataaaaag

SEQ ID NO: 1195181 - DNA, 22 bp, Artificial Sequence
  chemically synthesized
tctgaatttcttagtataaaaa

SEQ ID NO: 1195182 - DNA, 22 bp, Artificial Sequence
  chemically synthesized
ttaaggagctttttatactaag

SEQ ID NO: 1195183 - DNA, 22 bp, Artificial Sequence
  chemically synthesized
aaggagctttttatactaagaa

SEQ ID NO: 1195184 - DNA, 22 bp, Artificial Sequence
  chemically synthesized
aggagctttttatactaagaaa

SEQ ID NO: 1195185 - DNA, 22 bp, Artificial Sequence
  chemically synthesized
tttatactaagaaattcagaaa

SEQ ID NO: 1195186 - DNA, 22 bp, Artificial Sequence
  chemically synthesized
ttatactaagaaattcagaaaa

SEQ ID NO: 1195187 - DNA, 22 bp, Artificial Sequence
  chemically synthesized
tatactaagaaattcagaaaac

SEQ ID NO: 1195188 - DNA, 22 bp, Artificial Sequence
  chemically synthesized
atactaagaaattcagaaaact

SEQ ID NO: 1195189 - DNA, 22 bp, Artificial Sequence
  chemically synthesized
tactaagaaattcagaaaacta

SEQ ID NO: 1195190 - DNA, 22 bp, Artificial Sequence
  chemically synthesized
aagaaccagaacatgtagtttt

SEQ ID NO: 1195191 - DNA, 22 bp, Artificial Sequence
  chemically synthesized
agaaattcagaaaactacatgt

SEQ ID NO: 1195192 - DNA, 22 bp, Artificial Sequence
  chemically synthesized
ttaaagaaccagaacatgtagt

SEQ ID NO: 1195193 - DNA, 22 bp, Artificial Sequence
  chemically synthesized
attattaaagaaccagaacatg

SEQ ID NO: 1195194 - DNA, 22 bp, Artificial Sequence
  chemically synthesized
aattattaaagaaccagaacat

SEQ ID NO: 1195195 - DNA, 22 bp, Artificial Sequence
  chemically synthesized
agaaaactacatgttctggttc

SEQ ID NO: 1195196 - DNA, 22 bp, Artificial Sequence
  chemically synthesized
catgttctggttctttaataat

SEQ ID NO: 1195197 - DNA, 22 bp, Artificial Sequence
  chemically synthesized
tggttctttaataattaaatat

SEQ ID NO: 1195198 - DNA, 22 bp, Artificial Sequence
  chemically synthesized
gttctttaataattaaatatgt

SEQ ID NO: 1195199 - DNA, 22 bp, Artificial Sequence
  chemically synthesized
tttaataattaaatatgtgtgt

SEQ ID NO: 1195200 - DNA, 22 bp, Artificial Sequence
  chemically synthesized
taataattaaatatgtgtgtta

SEQ ID NO: 1195201 - DNA, 22 bp, Artificial Sequence
  chemically synthesized
aataattaaatatgtgtgttat

SEQ ID NO: 1195202 - DNA, 22 bp, Artificial Sequence
  chemically synthesized
ataattaaatatgtgtgttatt

SEQ ID NO: 1195203 - DNA, 22 bp, Artificial Sequence
  chemically synthesized
ataggaaagtcaaaagaataac

SEQ ID NO: 1195204 - DNA, 22 bp, Artificial Sequence
  chemically synthesized
gataggaaagtcaaaagaataa

SEQ ID NO: 1195205 - DNA, 22 bp, Artificial Sequence
  chemically synthesized
tgataggaaagtcaaaagaata

SEQ ID NO: 1195206 - DNA, 22 bp, Artificial Sequence
  chemically synthesized
aatatgtgtgttattcttttga

SEQ ID NO: 1195207 - DNA, 22 bp, Artificial Sequence
  chemically synthesized
ctttgataggaaagtcaaaaga

SEQ ID NO: 1195208 - DNA, 22 bp, Artificial Sequence
  chemically synthesized
actttgataggaaagtcaaaag

SEQ ID NO: 1195209 - DNA, 22 bp, Artificial Sequence
  chemically synthesized
tactttgataggaaagtcaaaa

SEQ ID NO: 1195210 - DNA, 22 bp, Artificial Sequence
  chemically synthesized
ttactttgataggaaagtcaaa

SEQ ID NO: 1195211 - DNA, 22 bp, Artificial Sequence
  chemically synthesized
ttcttttgactttcctatcaaa

SEQ ID NO: 1195212 - DNA, 22 bp, Artificial Sequence
  chemically synthesized
ttttgactttcctatcaaagta

SEQ ID NO: 1195213 - DNA, 22 bp, Artificial Sequence
  chemically synthesized
agacaacgtttttactttgata

SEQ ID NO: 1195214 - DNA, 22 bp, Artificial Sequence
  chemically synthesized
ttgactttcctatcaaagtaaa

SEQ ID NO: 1195215 - DNA, 22 bp, Artificial Sequence
  chemically synthesized
tgactttcctatcaaagtaaaa

SEQ ID NO: 1195216 - DNA, 22 bp, Artificial Sequence
  chemically synthesized
ctgagacaacgtttttactttg

SEQ ID NO: 1195217 - DNA, 22 bp, Artificial Sequence
  chemically synthesized
gactttcctatcaaagtaaaaa

SEQ ID NO: 1195218 - DNA, 22 bp, Artificial Sequence
  chemically synthesized
actttcctatcaaagtaaaaac

SEQ ID NO: 1195219 - DNA, 22 bp, Artificial Sequence
  chemically synthesized
tcctatcaaagtaaaaacgttg

SEQ ID NO: 1195220 - DNA, 22 bp, Artificial Sequence
  chemically synthesized
cctatcaaagtaaaaacgttgt

SEQ ID NO: 1195221 - DNA, 22 bp, Artificial Sequence
  chemically synthesized
ctatcaaagtaaaaacgttgtc

SEQ ID NO: 1195222 - DNA, 22 bp, Artificial Sequence
  chemically synthesized
aatgccctgctgagacaacgtt

SEQ ID NO: 1195223 - DNA, 22 bp, Artificial Sequence
  chemically synthesized
tcaaagtaaaaacgttgtctca

SEQ ID NO: 1195224 - DNA, 22 bp, Artificial Sequence
  chemically synthesized
agatatgttgaatgccctgctg

SEQ ID NO: 1195225 - DNA, 22 bp, Artificial Sequence
  chemically synthesized
tctcagcagggcattcaacata

SEQ ID NO: 1195226 - DNA, 22 bp, Artificial Sequence
  chemically synthesized
agcagggcattcaacatatctt

SEQ ID NO: 1195227 - DNA, 22 bp, Artificial Sequence
  chemically synthesized
tggtgaatggttaagatatgtt

SEQ ID NO: 1195228 - DNA, 22 bp, Artificial Sequence
  chemically synthesized
aacatatcttaaccattcacca

SEQ ID NO: 1195229 - DNA, 22 bp, Artificial Sequence
  chemically synthesized
catagtcagtactatggtgaat

SEQ ID NO: 1195230 - DNA, 22 bp, Artificial Sequence
  chemically synthesized
ttacatagtcagtactatggtg

SEQ ID NO: 1195231 - DNA, 22 bp, Artificial Sequence
  chemically synthesized
attacatagtcagtactatggt

SEQ ID NO: 1195232 - DNA, 22 bp, Artificial Sequence
  chemically synthesized
tttattacatagtcagtactat

SEQ ID NO: 1195233 - DNA, 22 bp, Artificial Sequence
  chemically synthesized
aaccattcaccatagtactgac

SEQ ID NO: 1195234 - DNA, 22 bp, Artificial Sequence
  chemically synthesized
accattcaccatagtactgact

SEQ ID NO: 1195235 - DNA, 22 bp, Artificial Sequence
  chemically synthesized
gaaaattgtttattacatagtc

SEQ ID NO: 1195236 - DNA, 22 bp, Artificial Sequence
  chemically synthesized
accatagtactgactatgtaat

SEQ ID NO: 1195237 - DNA, 22 bp, Artificial Sequence
  chemically synthesized
agaaaattgtttattacatagt

SEQ ID NO: 1195238 - DNA, 22 bp, Artificial Sequence
  chemically synthesized
gtacatttagaaaattgtttat

SEQ ID NO: 1195239 - DNA, 22 bp, Artificial Sequence
  chemically synthesized
ctagtacatttagaaaattgtt

SEQ ID NO: 1195240 - DNA, 22 bp, Artificial Sequence
  chemically synthesized
actatgtaataaacaattttct

SEQ ID NO: 1195241 - DNA, 22 bp, Artificial Sequence
  chemically synthesized
gctagtacatttagaaaattgt

SEQ ID NO: 1195242 - DNA, 22 bp, Artificial Sequence
  chemically synthesized
tgctagtacatttagaaaattg

SEQ ID NO: 1195243 - DNA, 22 bp, Artificial Sequence
  chemically synthesized
tgtaataaacaattttctaaat

SEQ ID NO: 1195244 - DNA, 22 bp, Artificial Sequence
  chemically synthesized
gttttgctagtacatttagaaa

SEQ ID NO: 1195245 - DNA, 22 bp, Artificial Sequence
  chemically synthesized
agttttgctagtacatttagaa

SEQ ID NO: 1195246 - DNA, 22 bp, Artificial Sequence
  chemically synthesized
tagttttgctagtacatttaga

SEQ ID NO: 1195247 - DNA, 22 bp, Artificial Sequence
  chemically synthesized
tatatgctttagttttgctagt

SEQ ID NO: 1195248 - DNA, 22 bp, Artificial Sequence
  chemically synthesized
tctaaatgtactagcaaaacta

SEQ ID NO: 1195249 - DNA, 22 bp, Artificial Sequence
  chemically synthesized
ctatatatgctttagttttgct

SEQ ID NO: 1195250 - DNA, 22 bp, Artificial Sequence
  chemically synthesized
ctaaatgtactagcaaaactaa

SEQ ID NO: 1195251 - DNA, 22 bp, Artificial Sequence
  chemically synthesized
taaatgtactagcaaaactaaa

SEQ ID NO: 1195252 - DNA, 22 bp, Artificial Sequence
  chemically synthesized
aatgtactagcaaaactaaagc

SEQ ID NO: 1195253 - DNA, 22 bp, Artificial Sequence
  chemically synthesized
tgctactatatatgctttagtt

SEQ ID NO: 1195254 - DNA, 22 bp, Artificial Sequence
  chemically synthesized
gcaaaactaaagcatatatagt

SEQ ID NO: 1195255 - DNA, 22 bp, Artificial Sequence
  chemically synthesized
aagcatatatagtagcacagcc

SEQ ID NO: 1195256 - DNA, 22 bp, Artificial Sequence
  chemically synthesized
gaccatggtcatatagagcaga

SEQ ID NO: 1195257 - DNA, 22 bp, Artificial Sequence
  chemically synthesized
ctggaccatggtcatatagagc

SEQ ID NO: 1195258 - DNA, 22 bp, Artificial Sequence
  chemically synthesized
agtatacctcctggaccatggt

SEQ ID NO: 1195259 - DNA, 22 bp, Artificial Sequence
  chemically synthesized
tgctctatatgaccatggtcca

SEQ ID NO: 1195260 - DNA, 22 bp, Artificial Sequence
  chemically synthesized
aagtatacctcctggaccatgg

SEQ ID NO: 1195261 - DNA, 22 bp, Artificial Sequence
  chemically synthesized
ctctatatgaccatggtccagg

SEQ ID NO: 1195262 - DNA, 22 bp, Artificial Sequence
  chemically synthesized
ttaagtatacctcctggaccat

SEQ ID NO: 1195263 - DNA, 22 bp, Artificial Sequence
  chemically synthesized
tatatgaccatggtccaggagg

SEQ ID NO: 1195264 - DNA, 22 bp, Artificial Sequence
  chemically synthesized
tatgaccatggtccaggaggta

SEQ ID NO: 1195265 - DNA, 22 bp, Artificial Sequence
  chemically synthesized
accaactcttaagtatacctcc

SEQ ID NO: 1195266 - DNA, 22 bp, Artificial Sequence
  chemically synthesized
aaccaactcttaagtatacctc

SEQ ID NO: 1195267 - DNA, 22 bp, Artificial Sequence
  chemically synthesized
taaatatttaaccaactcttaa

SEQ ID NO: 1195268 - DNA, 22 bp, Artificial Sequence
  chemically synthesized
agctataaatatttaaccaact

SEQ ID NO: 1195269 - DNA, 22 bp, Artificial Sequence
  chemically synthesized
actcagctataaatatttaacc

SEQ ID NO: 1195270 - DNA, 22 bp, Artificial Sequence
  chemically synthesized
aagagttggttaaatatttata

SEQ ID NO: 1195271 - DNA, 22 bp, Artificial Sequence
  chemically synthesized
agagttggttaaatatttatag

SEQ ID NO: 1195272 - DNA, 22 bp, Artificial Sequence
  chemically synthesized
gttaaatatttatagctgagtt

SEQ ID NO: 1195273 - DNA, 22 bp, Artificial Sequence
  chemically synthesized
aatatttatagctgagttagtc

SEQ ID NO: 1195274 - DNA, 22 bp, Artificial Sequence
  chemically synthesized
ccaaagccaaaaacatgactaa

SEQ ID NO: 1195275 - DNA, 22 bp, Artificial Sequence
  chemically synthesized
cccaaagccaaaaacatgacta

SEQ ID NO: 1195276 - DNA, 22 bp, Artificial Sequence
  chemically synthesized
atagctgagttagtcatgtttt

SEQ ID NO: 1195277 - DNA, 22 bp, Artificial Sequence
  chemically synthesized
tagctgagttagtcatgttttt

SEQ ID NO: 1195278 - DNA, 22 bp, Artificial Sequence
  chemically synthesized
cagtttcccaaagccaaaaaca

SEQ ID NO: 1195279 - DNA, 22 bp, Artificial Sequence
  chemically synthesized
agttagtcatgtttttggcttt

SEQ ID NO: 1195280 - DNA, 22 bp, Artificial Sequence
  chemically synthesized
aacactgcagtttcccaaagcc

SEQ ID NO: 1195281 - DNA, 22 bp, Artificial Sequence
  chemically synthesized
gtcatgtttttggctttgggaa

SEQ ID NO: 1195282 - DNA, 22 bp, Artificial Sequence
  chemically synthesized
ttggctttgggaaactgcagtg

SEQ ID NO: 1195283 - DNA, 22 bp, Artificial Sequence
  chemically synthesized
tggctttgggaaactgcagtgt

SEQ ID NO: 1195284 - DNA, 22 bp, Artificial Sequence
  chemically synthesized
ggctttgggaaactgcagtgtt

SEQ ID NO: 1195285 - DNA, 22 bp, Artificial Sequence
  chemically synthesized
gctttgggaaactgcagtgttc

SEQ ID NO: 1195286 - DNA, 22 bp, Artificial Sequence
  chemically synthesized
acagtggggatctgaacactgc

SEQ ID NO: 1195287 - DNA, 22 bp, Artificial Sequence
  chemically synthesized
aacagtggggatctgaacactg

SEQ ID NO: 1195288 - DNA, 22 bp, Artificial Sequence
  chemically synthesized
taacagtggggatctgaacact

SEQ ID NO: 1195289 - DNA, 22 bp, Artificial Sequence
  chemically synthesized
tgggaaactgcagtgttcagat

SEQ ID NO: 1195290 - DNA, 22 bp, Artificial Sequence
  chemically synthesized
gggaaactgcagtgttcagatc

SEQ ID NO: 1195291 - DNA, 22 bp, Artificial Sequence
  chemically synthesized
ggaaactgcagtgttcagatcc

SEQ ID NO: 1195292 - DNA, 22 bp, Artificial Sequence
  chemically synthesized
cattttaacagtggggatctga

SEQ ID NO: 1195293 - DNA, 22 bp, Artificial Sequence
  chemically synthesized
cagtgttcagatccccactgtt

SEQ ID NO: 1195294 - DNA, 22 bp, Artificial Sequence
  chemically synthesized
gcccacgttacattttaacagt

SEQ ID NO: 1195295 - DNA, 22 bp, Artificial Sequence
  chemically synthesized
agatccccactgttaaaatgta

SEQ ID NO: 1195296 - DNA, 22 bp, Artificial Sequence
  chemically synthesized
tgcctggcccacgttacatttt

SEQ ID NO: 1195297 - DNA, 22 bp, Artificial Sequence
  chemically synthesized
ttaaaatgtaacgtgggccagg

SEQ ID NO: 1195298 - DNA, 22 bp, Artificial Sequence
  chemically synthesized
aaatgtaacgtgggccaggcac

SEQ ID NO: 1195299 - DNA, 22 bp, Artificial Sequence
  chemically synthesized
ggaatgtgaaccattgtgcctg

SEQ ID NO: 1195300 - DNA, 22 bp, Artificial Sequence
  chemically synthesized
agattaggaatgtgaaccattg

SEQ ID NO: 1195301 - DNA, 22 bp, Artificial Sequence
  chemically synthesized
cgaaaatgctgagattaggaat

SEQ ID NO: 1195302 - DNA, 22 bp, Artificial Sequence
  chemically synthesized
agcctccgaaaatgctgagatt

SEQ ID NO: 1195303 - DNA, 22 bp, Artificial Sequence
  chemically synthesized
acattcctaatctcagcatttt

SEQ ID NO: 1195304 - DNA, 22 bp, Artificial Sequence
  chemically synthesized
cctcagcctccgaaaatgctga

SEQ ID NO: 1195305 - DNA, 22 bp, Artificial Sequence
  chemically synthesized
ctgcctcagcctccgaaaatgc

SEQ ID NO: 1195306 - DNA, 22 bp, Artificial Sequence
  chemically synthesized
ctaatctcagcattttcggagg

SEQ ID NO: 1195307 - DNA, 22 bp, Artificial Sequence
  chemically synthesized
atctcagcattttcggaggctg

SEQ ID NO: 1195308 - DNA, 22 bp, Artificial Sequence
  chemically synthesized
agcattttcggaggctgaggca

SEQ ID NO: 1195309 - DNA, 22 bp, Artificial Sequence
  chemically synthesized
aagcgatcctcctgcctcagcc

SEQ ID NO: 1195310 - DNA, 22 bp, Artificial Sequence
  chemically synthesized
gcctcaagcgatcctcctgcct

SEQ ID NO: 1195311 - DNA, 22 bp, Artificial Sequence
  chemically synthesized
tcggaggctgaggcaggaggat

SEQ ID NO: 1195312 - DNA, 22 bp, Artificial Sequence
  chemically synthesized
cggaggctgaggcaggaggatc

SEQ ID NO: 1195313 - DNA, 22 bp, Artificial Sequence
  chemically synthesized
ctggcctcaagcgatcctcctg

SEQ ID NO: 1195314 - DNA, 22 bp, Artificial Sequence
  chemically synthesized
ggaggctgaggcaggaggatcg

SEQ ID NO: 1195315 - DNA, 22 bp, Artificial Sequence
  chemically synthesized
aaactcctggcctcaagcgatc

SEQ ID NO: 1195316 - DNA, 22 bp, Artificial Sequence
  chemically synthesized
aggcaggaggatcgcttgaggc

SEQ ID NO: 1195317 - DNA, 22 bp, Artificial Sequence
  chemically synthesized
gtctcaaactcctggcctcaag

SEQ ID NO: 1195318 - DNA, 22 bp, Artificial Sequence
  chemically synthesized
ccccggttggtctcaaactcct

SEQ ID NO: 1195319 - DNA, 22 bp, Artificial Sequence
  chemically synthesized
attgccccggttggtctcaaac

SEQ ID NO: 1195320 - DNA, 22 bp, Artificial Sequence
  chemically synthesized
cattgccccggttggtctcaaa

SEQ ID NO: 1195321 - DNA, 22 bp, Artificial Sequence
  chemically synthesized
gaggccaggagtttgagaccaa

SEQ ID NO: 1195322 - DNA, 22 bp, Artificial Sequence
  chemically synthesized
aggccaggagtttgagaccaac

SEQ ID NO: 1195323 - DNA, 22 bp, Artificial Sequence
  chemically synthesized
cttcattgccccggttggtctc

SEQ ID NO: 1195324 - DNA, 22 bp, Artificial Sequence
  chemically synthesized
gcttcattgccccggttggtct

SEQ ID NO: 1195325 - DNA, 22 bp, Artificial Sequence
  chemically synthesized
gagaccaaccggggcaatgaag

SEQ ID NO: 1195326 - DNA, 22 bp, Artificial Sequence
  chemically synthesized
agaccaaccggggcaatgaagc

SEQ ID NO: 1195327 - DNA, 22 bp, Artificial Sequence
  chemically synthesized
tagagacagggtcttgcttcat

SEQ ID NO: 1195328 - DNA, 22 bp, Artificial Sequence
  chemically synthesized
gtagagacagggtcttgcttca

SEQ ID NO: 1195329 - DNA, 22 bp, Artificial Sequence
  chemically synthesized
tgtagagacagggtcttgcttc

SEQ ID NO: 1195330 - DNA, 22 bp, Artificial Sequence
  chemically synthesized
ttttgtagagacagggtcttgc

SEQ ID NO: 1195331 - DNA, 22 bp, Artificial Sequence
  chemically synthesized
ttattttgtagagacagggtct

SEQ ID NO: 1195332 - DNA, 22 bp, Artificial Sequence
  chemically synthesized
ttgttattttgtagagacaggg

SEQ ID NO: 1195333 - DNA, 22 bp, Artificial Sequence
  chemically synthesized
attgttattttgtagagacagg

SEQ ID NO: 1195334 - DNA, 22 bp, Artificial Sequence
  chemically synthesized
tattgttattttgtagagacag

SEQ ID NO: 1195335 - DNA, 22 bp, Artificial Sequence
  chemically synthesized
ttattgttattttgtagagaca

SEQ ID NO: 1195336 - DNA, 22 bp, Artificial Sequence
  chemically synthesized
tttattgttattttgtagagac

SEQ ID NO: 1195337 - DNA, 22 bp, Artificial Sequence
  chemically synthesized
aacaattttttattgttatttt

SEQ ID NO: 1195338 - DNA, 22 bp, Artificial Sequence
  chemically synthesized
aaacaattttttattgttattt

SEQ ID NO: 1195339 - DNA, 22 bp, Artificial Sequence
  chemically synthesized
tctctacaaaataacaataaaa

SEQ ID NO: 1195340 - DNA, 22 bp, Artificial Sequence
  chemically synthesized
tacaaaataacaataaaaaatt

SEQ ID NO: 1195341 - DNA, 22 bp, Artificial Sequence
  chemically synthesized
caaaataacaataaaaaattgt

SEQ ID NO: 1195342 - DNA, 22 bp, Artificial Sequence
  chemically synthesized
tttaaatgtacctctgcattgt

SEQ ID NO: 1195343 - DNA, 22 bp, Artificial Sequence
  chemically synthesized
caggtgtacaacacaatgcaga

SEQ ID NO: 1195344 - DNA, 22 bp, Artificial Sequence
  chemically synthesized
aaatgtacctctgcattgtgtt

SEQ ID NO: 1195345 - DNA, 22 bp, Artificial Sequence
  chemically synthesized
aatgtacctctgcattgtgttg

SEQ ID NO: 1195346 - DNA, 22 bp, Artificial Sequence
  chemically synthesized
gaattgcaggtgtacaacacaa

SEQ ID NO: 1195347 - DNA, 22 bp, Artificial Sequence
  chemically synthesized
tgcattgtgttgtacacctgca

SEQ ID NO: 1195348 - DNA, 22 bp, Artificial Sequence
  chemically synthesized
agtaactagaattgcaggtgta

SEQ ID NO: 1195349 - DNA, 22 bp, Artificial Sequence
  chemically synthesized
cattgtgttgtacacctgcaat

SEQ ID NO: 1195350 - DNA, 22 bp, Artificial Sequence
  chemically synthesized
ctgagtaactagaattgcaggt

SEQ ID NO: 1195351 - DNA, 22 bp, Artificial Sequence
  chemically synthesized
tgttgtacacctgcaattctag

SEQ ID NO: 1195352 - DNA, 22 bp, Artificial Sequence
  chemically synthesized
agcctcctgagtaactagaatt

SEQ ID NO: 1195353 - DNA, 22 bp, Artificial Sequence
  chemically synthesized
tacacctgcaattctagttact

SEQ ID NO: 1195354 - DNA, 22 bp, Artificial Sequence
  chemically synthesized
gctcagcctcctgagtaactag

SEQ ID NO: 1195355 - DNA, 22 bp, Artificial Sequence
  chemically synthesized
tagctcagcctcctgagtaact

SEQ ID NO: 1195356 - DNA, 22 bp, Artificial Sequence
  chemically synthesized
ctagctcagcctcctgagtaac

SEQ ID NO: 1195357 - DNA, 22 bp, Artificial Sequence
  chemically synthesized
caattctagttactcaggaggc

SEQ ID NO: 1195358 - DNA, 22 bp, Artificial Sequence
  chemically synthesized
tagttactcaggaggctgagct

SEQ ID NO: 1195359 - DNA, 22 bp, Artificial Sequence
  chemically synthesized
gttactcaggaggctgagctag

SEQ ID NO: 1195360 - DNA, 22 bp, Artificial Sequence
  chemically synthesized
agtcaagtgatccttctagctc

SEQ ID NO: 1195361 - DNA, 22 bp, Artificial Sequence
  chemically synthesized
ctcaggaggctgagctagaagg

SEQ ID NO: 1195362 - DNA, 22 bp, Artificial Sequence
  chemically synthesized
ctgagtcaagtgatccttctag

SEQ ID NO: 1195363 - DNA, 22 bp, Artificial Sequence
  chemically synthesized
aggaggctgagctagaaggatc

SEQ ID NO: 1195364 - DNA, 22 bp, Artificial Sequence
  chemically synthesized
caactcctgagtcaagtgatcc

SEQ ID NO: 1195365 - DNA, 22 bp, Artificial Sequence
  chemically synthesized
agctagaaggatcacttgactc

SEQ ID NO: 1195366 - DNA, 22 bp, Artificial Sequence
  chemically synthesized
gaaggatcacttgactcaggag

SEQ ID NO: 1195367 - DNA, 22 bp, Artificial Sequence
  chemically synthesized
ccacaggcctccaactcctgag

SEQ ID NO: 1195368 - DNA, 22 bp, Artificial Sequence
  chemically synthesized
accacaggcctccaactcctga

SEQ ID NO: 1195369 - DNA, 22 bp, Artificial Sequence
  chemically synthesized
gactcaggagttggaggcctgt

SEQ ID NO: 1195370 - DNA, 22 bp, Artificial Sequence
  chemically synthesized
actcaggagttggaggcctgtg

SEQ ID NO: 1195371 - DNA, 22 bp, Artificial Sequence
  chemically synthesized
aggagttggaggcctgtggtaa

SEQ ID NO: 1195372 - DNA, 22 bp, Artificial Sequence
  chemically synthesized
gcacagtcgtagcttaccacag

SEQ ID NO: 1195373 - DNA, 22 bp, Artificial Sequence
  chemically synthesized
gaggcctgtggtaagctacgac

SEQ ID NO: 1195374 - DNA, 22 bp, Artificial Sequence
  chemically synthesized
gagtgcactagcacagtcgtag

SEQ ID NO: 1195375 - DNA, 22 bp, Artificial Sequence
  chemically synthesized
tggtaagctacgactgtgctag

SEQ ID NO: 1195376 - DNA, 22 bp, Artificial Sequence
  chemically synthesized
cccaggctggagtgcactagca

SEQ ID NO: 1195377 - DNA, 22 bp, Artificial Sequence
  chemically synthesized
gcccaggctggagtgcactagc

SEQ ID NO: 1195378 - DNA, 22 bp, Artificial Sequence
  chemically synthesized
tgcccaggctggagtgcactag

SEQ ID NO: 1195379 - DNA, 22 bp, Artificial Sequence
  chemically synthesized
ttgcccaggctggagtgcacta

SEQ ID NO: 1195380 - DNA, 22 bp, Artificial Sequence
  chemically synthesized
ttttgcccaggctggagtgcac

SEQ ID NO: 1195381 - DNA, 22 bp, Artificial Sequence
  chemically synthesized
cgactgtgctagtgcactccag

SEQ ID NO: 1195382 - DNA, 22 bp, Artificial Sequence
  chemically synthesized
ctcttttgcccaggctggagtg

SEQ ID NO: 1195383 - DNA, 22 bp, Artificial Sequence
  chemically synthesized
tgctagtgcactccagcctggg

SEQ ID NO: 1195384 - DNA, 22 bp, Artificial Sequence
  chemically synthesized
gtgcactccagcctgggcaaaa

SEQ ID NO: 1195385 - DNA, 22 bp, Artificial Sequence
  chemically synthesized
agagacaagatattactctttt

SEQ ID NO: 1195386 - DNA, 22 bp, Artificial Sequence
  chemically synthesized
aagagacaagatattactcttt

SEQ ID NO: 1195387 - DNA, 22 bp, Artificial Sequence
  chemically synthesized
cagcctgggcaaaagagtaata

SEQ ID NO: 1195388 - DNA, 22 bp, Artificial Sequence
  chemically synthesized
taagagacaagatattactctt

SEQ ID NO: 1195389 - DNA, 22 bp, Artificial Sequence
  chemically synthesized
ttttaagagacaagatattact

SEQ ID NO: 1195390 - DNA, 22 bp, Artificial Sequence
  chemically synthesized
attttaagagacaagatattac

SEQ ID NO: 1195391 - DNA, 22 bp, Artificial Sequence
  chemically synthesized
ggcaaaagagtaatatcttgtc

SEQ ID NO: 1195392 - DNA, 22 bp, Artificial Sequence
  chemically synthesized
tttattttaagagacaagatat

SEQ ID NO: 1195393 - DNA, 22 bp, Artificial Sequence
  chemically synthesized
atttattttaagagacaagata

SEQ ID NO: 1195394 - DNA, 22 bp, Artificial Sequence
  chemically synthesized
tatttattttaagagacaagat

SEQ ID NO: 1195395 - DNA, 22 bp, Artificial Sequence
  chemically synthesized
cattttatttattttaagagac

SEQ ID NO: 1195396 - DNA, 22 bp, Artificial Sequence
  chemically synthesized
tggcaccattacattttattta

SEQ ID NO: 1195397 - DNA, 22 bp, Artificial Sequence
  chemically synthesized
gtctcttaaaataaataaaatg

SEQ ID NO: 1195398 - DNA, 22 bp, Artificial Sequence
  chemically synthesized
atggcaccattacattttattt

SEQ ID NO: 1195399 - DNA, 22 bp, Artificial Sequence
  chemically synthesized
tctcttaaaataaataaaatgt

SEQ ID NO: 1195400 - DNA, 22 bp, Artificial Sequence
  chemically synthesized
cttatggcaccattacatttta

SEQ ID NO: 1195401 - DNA, 22 bp, Artificial Sequence
  chemically synthesized
acttatggcaccattacatttt

SEQ ID NO: 1195402 - DNA, 22 bp, Artificial Sequence
  chemically synthesized
ttaaaataaataaaatgtaatg

SEQ ID NO: 1195403 - DNA, 22 bp, Artificial Sequence
  chemically synthesized
aaaataaataaaatgtaatggt

SEQ ID NO: 1195404 - DNA, 22 bp, Artificial Sequence
  chemically synthesized
aaataaataaaatgtaatggtg

SEQ ID NO: 1195405 - DNA, 22 bp, Artificial Sequence
  chemically synthesized
tgcatttacttatggcaccatt

SEQ ID NO: 1195406 - DNA, 22 bp, Artificial Sequence
  chemically synthesized
gatcacatatctatgcatttac

SEQ ID NO: 1195407 - DNA, 22 bp, Artificial Sequence
  chemically synthesized
atggattggatcacatatctat

SEQ ID NO: 1195408 - DNA, 22 bp, Artificial Sequence
  chemically synthesized
aaactcatggattggatcacat

SEQ ID NO: 1195409 - DNA, 22 bp, Artificial Sequence
  chemically synthesized
aaaactcatggattggatcaca

SEQ ID NO: 1195410 - DNA, 22 bp, Artificial Sequence
  chemically synthesized
taaaactcatggattggatcac

SEQ ID NO: 1195411 - DNA, 22 bp, Artificial Sequence
  chemically synthesized
acatattttaaaactcatggat

SEQ ID NO: 1195412 - DNA, 22 bp, Artificial Sequence
  chemically synthesized
cctgacatattttaaaactcat

SEQ ID NO: 1195413 - DNA, 22 bp, Artificial Sequence
  chemically synthesized
gtgttacctgacatattttaaa

SEQ ID NO: 1195414 - DNA, 22 bp, Artificial Sequence
  chemically synthesized
ggtgttacctgacatattttaa

SEQ ID NO: 1195415 - DNA, 22 bp, Artificial Sequence
  chemically synthesized
tggtgttacctgacatatttta

SEQ ID NO: 1195416 - DNA, 22 bp, Artificial Sequence
  chemically synthesized
ctttggtgttacctgacatatt

SEQ ID NO: 1195417 - DNA, 22 bp, Artificial Sequence
  chemically synthesized
tgtcctactttggtgttacctg

SEQ ID NO: 1195418 - DNA, 22 bp, Artificial Sequence
  chemically synthesized
gtgtcctactttggtgttacct

SEQ ID NO: 1195419 - DNA, 22 bp, Artificial Sequence
  chemically synthesized
taaaatatgtcaggtaacacca

SEQ ID NO: 1195420 - DNA, 22 bp, Artificial Sequence
  chemically synthesized
tgtgtcctactttggtgttacc

SEQ ID NO: 1195421 - DNA, 22 bp, Artificial Sequence
  chemically synthesized
aaaatatgtcaggtaacaccaa

SEQ ID NO: 1195422 - DNA, 22 bp, Artificial Sequence
  chemically synthesized
ttgtgtcctactttggtgttac

SEQ ID NO: 1195423 - DNA, 22 bp, Artificial Sequence
  chemically synthesized
aaatatgtcaggtaacaccaaa

SEQ ID NO: 1195424 - DNA, 22 bp, Artificial Sequence
  chemically synthesized
tttttgtgtcctactttggtgt

SEQ ID NO: 1195425 - DNA, 22 bp, Artificial Sequence
  chemically synthesized
aaattgtttttgtgtcctactt

SEQ ID NO: 1195426 - DNA, 22 bp, Artificial Sequence
  chemically synthesized
ataaacattcaaattgtttttg

SEQ ID NO: 1195427 - DNA, 22 bp, Artificial Sequence
  chemically synthesized
cataaacattcaaattgttttt

SEQ ID NO: 1195428 - DNA, 22 bp, Artificial Sequence
  chemically synthesized
tcataaacattcaaattgtttt

SEQ ID NO: 1195429 - DNA, 22 bp, Artificial Sequence
  chemically synthesized
ttcataaacattcaaattgttt

SEQ ID NO: 1195430 - DNA, 22 bp, Artificial Sequence
  chemically synthesized
tttcataaacattcaaattgtt

SEQ ID NO: 1195431 - DNA, 22 bp, Artificial Sequence
  chemically synthesized
tttttcataaacattcaaattg

SEQ ID NO: 1195432 - DNA, 22 bp, Artificial Sequence
  chemically synthesized
aagtactctttttcataaacat

SEQ ID NO: 1195433 - DNA, 22 bp, Artificial Sequence
  chemically synthesized
ttgaagtactctttttcataaa

SEQ ID NO: 1195434 - DNA, 22 bp, Artificial Sequence
  chemically synthesized
ctgttgaagtactctttttcat

SEQ ID NO: 1195435 - DNA, 22 bp, Artificial Sequence
  chemically synthesized
cctgttgaagtactctttttca

SEQ ID NO: 1195436 - DNA, 22 bp, Artificial Sequence
  chemically synthesized
gaatgtttatgaaaaagagtac

SEQ ID NO: 1195437 - DNA, 22 bp, Artificial Sequence
  chemically synthesized
cttcctgttgaagtactctttt

SEQ ID NO: 1195438 - DNA, 22 bp, Artificial Sequence
  chemically synthesized
aatgtttatgaaaaagagtact

SEQ ID NO: 1195439 - DNA, 22 bp, Artificial Sequence
  chemically synthesized
agtctacttcctgttgaagtac

SEQ ID NO: 1195440 - DNA, 22 bp, Artificial Sequence
  chemically synthesized
atgaaaaagagtacttcaacag

SEQ ID NO: 1195441 - DNA, 22 bp, Artificial Sequence
  chemically synthesized
taagtctacttcctgttgaagt

SEQ ID NO: 1195442 - DNA, 22 bp, Artificial Sequence
  chemically synthesized
tgaaaaagagtacttcaacagg

SEQ ID NO: 1195443 - DNA, 22 bp, Artificial Sequence
  chemically synthesized
tctaagtctacttcctgttgaa

SEQ ID NO: 1195444 - DNA, 22 bp, Artificial Sequence
  chemically synthesized
tggctctctaagtctacttcct

SEQ ID NO: 1195445 - DNA, 22 bp, Artificial Sequence
  chemically synthesized
tcctatggctctctaagtctac

SEQ ID NO: 1195446 - DNA, 22 bp, Artificial Sequence
  chemically synthesized
tgtcctatggctctctaagtct

SEQ ID NO: 1195447 - DNA, 22 bp, Artificial Sequence
  chemically synthesized
caacaggaagtagacttagaga

SEQ ID NO: 1195448 - DNA, 22 bp, Artificial Sequence
  chemically synthesized
ctgtcctatggctctctaagtc

SEQ ID NO: 1195449 - DNA, 22 bp, Artificial Sequence
  chemically synthesized
aacaggaagtagacttagagag

SEQ ID NO: 1195450 - DNA, 22 bp, Artificial Sequence
  chemically synthesized
ttctgtcctatggctctctaag

SEQ ID NO: 1195451 - DNA, 22 bp, Artificial Sequence
  chemically synthesized
ggaagacactcttctgtcctat

SEQ ID NO: 1195452 - DNA, 22 bp, Artificial Sequence
  chemically synthesized
agagagccataggacagaagag

SEQ ID NO: 1195453 - DNA, 22 bp, Artificial Sequence
  chemically synthesized
cctaggaagacactcttctgtc

SEQ ID NO: 1195454 - DNA, 22 bp, Artificial Sequence
  chemically synthesized
gagagccataggacagaagagt

SEQ ID NO: 1195455 - DNA, 22 bp, Artificial Sequence
  chemically synthesized
ttgcctaggaagacactcttct

SEQ ID NO: 1195456 - DNA, 22 bp, Artificial Sequence
  chemically synthesized
ctattgcctaggaagacactct

SEQ ID NO: 1195457 - DNA, 22 bp, Artificial Sequence
  chemically synthesized
aacgtcattcctattgcctagg

SEQ ID NO: 1195458 - DNA, 22 bp, Artificial Sequence
  chemically synthesized
cctaggcaataggaatgacgtt

SEQ ID NO: 1195459 - DNA, 22 bp, Artificial Sequence
  chemically synthesized
ctaggcaataggaatgacgttg

SEQ ID NO: 1195460 - DNA, 22 bp, Artificial Sequence
  chemically synthesized
caaaatgtgattcaacgtcatt

SEQ ID NO: 1195461 - DNA, 22 bp, Artificial Sequence
  chemically synthesized
ccaaaatgtgattcaacgtcat

SEQ ID NO: 1195462 - DNA, 22 bp, Artificial Sequence
  chemically synthesized
ggcaataggaatgacgttgaat

SEQ ID NO: 1195463 - DNA, 22 bp, Artificial Sequence
  chemically synthesized
tttccaaaatgtgattcaacgt

SEQ ID NO: 1195464 - DNA, 22 bp, Artificial Sequence
  chemically synthesized
ctatttccaaaatgtgattcaa

SEQ ID NO: 1195465 - DNA, 22 bp, Artificial Sequence
  chemically synthesized
actatttccaaaatgtgattca

SEQ ID NO: 1195466 - DNA, 22 bp, Artificial Sequence
  chemically synthesized
gggcaaacatcttactatttcc

SEQ ID NO: 1195467 - DNA, 22 bp, Artificial Sequence
  chemically synthesized
aatcacattttggaaatagtaa

SEQ ID NO: 1195468 - DNA, 22 bp, Artificial Sequence
  chemically synthesized
ctagggcaaacatcttactatt

SEQ ID NO: 1195469 - DNA, 22 bp, Artificial Sequence
  chemically synthesized
ttcctagggcaaacatcttact

SEQ ID NO: 1195470 - DNA, 22 bp, Artificial Sequence
  chemically synthesized
attcctagggcaaacatcttac

SEQ ID NO: 1195471 - DNA, 22 bp, Artificial Sequence
  chemically synthesized
tggaaatagtaagatgtttgcc

SEQ ID NO: 1195472 - DNA, 22 bp, Artificial Sequence
  chemically synthesized
ggaaatagtaagatgtttgccc

SEQ ID NO: 1195473 - DNA, 22 bp, Artificial Sequence
  chemically synthesized
agcttattcctagggcaaacat

SEQ ID NO: 1195474 - DNA, 22 bp, Artificial Sequence
  chemically synthesized
gaaatagtaagatgtttgccct

SEQ ID NO: 1195475 - DNA, 22 bp, Artificial Sequence
  chemically synthesized
aagcttattcctagggcaaaca

SEQ ID NO: 1195476 - DNA, 22 bp, Artificial Sequence
  chemically synthesized
taagcttattcctagggcaaac

SEQ ID NO: 1195477 - DNA, 22 bp, Artificial Sequence
  chemically synthesized
ctttaagcttattcctagggca

SEQ ID NO: 1195478 - DNA, 22 bp, Artificial Sequence
  chemically synthesized
ctactttaagcttattcctagg

SEQ ID NO: 1195479 - DNA, 22 bp, Artificial Sequence
  chemically synthesized
actactttaagcttattcctag

SEQ ID NO: 1195480 - DNA, 22 bp, Artificial Sequence
  chemically synthesized
ttactactttaagcttattcct

SEQ ID NO: 1195481 - DNA, 22 bp, Artificial Sequence
  chemically synthesized
tctcttactactttaagcttat

SEQ ID NO: 1195482 - DNA, 22 bp, Artificial Sequence
  chemically synthesized
atctcttactactttaagctta

SEQ ID NO: 1195483 - DNA, 22 bp, Artificial Sequence
  chemically synthesized
gccctaggaataagcttaaagt

SEQ ID NO: 1195484 - DNA, 22 bp, Artificial Sequence
  chemically synthesized
ccctaggaataagcttaaagta

SEQ ID NO: 1195485 - DNA, 22 bp, Artificial Sequence
  chemically synthesized
gtcttatctcttactactttaa

SEQ ID NO: 1195486 - DNA, 22 bp, Artificial Sequence
  chemically synthesized
agtcttatctcttactacttta

SEQ ID NO: 1195487 - DNA, 22 bp, Artificial Sequence
  chemically synthesized
tagtcttatctcttactacttt

SEQ ID NO: 1195488 - DNA, 22 bp, Artificial Sequence
  chemically synthesized
ggaataagcttaaagtagtaag

SEQ ID NO: 1195489 - DNA, 22 bp, Artificial Sequence
  chemically synthesized
ttagtcttatctcttactactt

SEQ ID NO: 1195490 - DNA, 22 bp, Artificial Sequence
  chemically synthesized
ttttagtcttatctcttactac

SEQ ID NO: 1195491 - DNA, 22 bp, Artificial Sequence
  chemically synthesized
cttttagtcttatctcttacta

SEQ ID NO: 1195492 - DNA, 22 bp, Artificial Sequence
  chemically synthesized
tcttttagtcttatctcttact

SEQ ID NO: 1195493 - DNA, 22 bp, Artificial Sequence
  chemically synthesized
tcctttcttttagtcttatctc

SEQ ID NO: 1195494 - DNA, 22 bp, Artificial Sequence
  chemically synthesized
aaagtagtaagagataagacta

SEQ ID NO: 1195495 - DNA, 22 bp, Artificial Sequence
  chemically synthesized
aagtagtaagagataagactaa

SEQ ID NO: 1195496 - DNA, 22 bp, Artificial Sequence
  chemically synthesized
gtcctgtcctttcttttagtct

SEQ ID NO: 1195497 - DNA, 22 bp, Artificial Sequence
  chemically synthesized
tagtcctgtcctttcttttagt

SEQ ID NO: 1195498 - DNA, 22 bp, Artificial Sequence
  chemically synthesized
ctagtcctgtcctttcttttag

SEQ ID NO: 1195499 - DNA, 22 bp, Artificial Sequence
  chemically synthesized
tctagtcctgtcctttctttta

SEQ ID NO: 1195500 - DNA, 22 bp, Artificial Sequence
  chemically synthesized
ataggctttctagtcctgtcct

SEQ ID NO: 1195501 - DNA, 22 bp, Artificial Sequence
  chemically synthesized
cataggctttctagtcctgtcc

SEQ ID NO: 1195502 - DNA, 22 bp, Artificial Sequence
  chemically synthesized
tcataggctttctagtcctgtc

SEQ ID NO: 1195503 - DNA, 22 bp, Artificial Sequence
  chemically synthesized
ttcataggctttctagtcctgt

SEQ ID NO: 1195504 - DNA, 22 bp, Artificial Sequence
  chemically synthesized
aaagaaaggacaggactagaaa

SEQ ID NO: 1195505 - DNA, 22 bp, Artificial Sequence
  chemically synthesized
atatttttcataggctttctag

SEQ ID NO: 1195506 - DNA, 22 bp, Artificial Sequence
  chemically synthesized
ctaatatttttcataggctttc

SEQ ID NO: 1195507 - DNA, 22 bp, Artificial Sequence
  chemically synthesized
agtagttactaatatttttcat

SEQ ID NO: 1195508 - DNA, 22 bp, Artificial Sequence
  chemically synthesized
gaaagcctatgaaaaatattag

SEQ ID NO: 1195509 - DNA, 22 bp, Artificial Sequence
  chemically synthesized
caaactcagtagttactaatat

SEQ ID NO: 1195510 - DNA, 22 bp, Artificial Sequence
  chemically synthesized
tgaaaaatattagtaactactg

SEQ ID NO: 1195511 - DNA, 22 bp, Artificial Sequence
  chemically synthesized
aagattccaaactcagtagtta

SEQ ID NO: 1195512 - DNA, 22 bp, Artificial Sequence
  chemically synthesized
tattaaagattccaaactcagt

SEQ ID NO: 1195513 - DNA, 22 bp, Artificial Sequence
  chemically synthesized
cctatattaaagattccaaact

SEQ ID NO: 1195514 - DNA, 22 bp, Artificial Sequence
  chemically synthesized
gtaactactgagtttggaatct

SEQ ID NO: 1195515 - DNA, 22 bp, Artificial Sequence
  chemically synthesized
ccactacctatattaaagattc

SEQ ID NO: 1195516 - DNA, 22 bp, Artificial Sequence
  chemically synthesized
ctgagtttggaatctttaatat

SEQ ID NO: 1195517 - DNA, 22 bp, Artificial Sequence
  chemically synthesized
agtttggaatctttaatatagg

SEQ ID NO: 1195518 - DNA, 22 bp, Artificial Sequence
  chemically synthesized
gtggctcccactacctatatta

SEQ ID NO: 1195519 - DNA, 22 bp, Artificial Sequence
  chemically synthesized
agtggctcccactacctatatt

SEQ ID NO: 1195520 - DNA, 22 bp, Artificial Sequence
  chemically synthesized
ggaatctttaatataggtagtg

SEQ ID NO: 1195521 - DNA, 22 bp, Artificial Sequence
  chemically synthesized
gaatctttaatataggtagtgg

SEQ ID NO: 1195522 - DNA, 22 bp, Artificial Sequence
  chemically synthesized
aaaatatttagtggctcccact

SEQ ID NO: 1195523 - DNA, 22 bp, Artificial Sequence
  chemically synthesized
taatataggtagtgggagccac

SEQ ID NO: 1195524 - DNA, 22 bp, Artificial Sequence
  chemically synthesized
aatataggtagtgggagccact

SEQ ID NO: 1195525 - DNA, 22 bp, Artificial Sequence
  chemically synthesized
ttcaaaatatttagtggctccc

SEQ ID NO: 1195526 - DNA, 22 bp, Artificial Sequence
  chemically synthesized
atataggtagtgggagccacta

SEQ ID NO: 1195527 - DNA, 22 bp, Artificial Sequence
  chemically synthesized
attattcaaaatatttagtggc

SEQ ID NO: 1195528 - DNA, 22 bp, Artificial Sequence
  chemically synthesized
cattattcaaaatatttagtgg

SEQ ID NO: 1195529 - DNA, 22 bp, Artificial Sequence
  chemically synthesized
atcatgtaacttcattattcaa

SEQ ID NO: 1195530 - DNA, 22 bp, Artificial Sequence
  chemically synthesized
catcatgtaacttcattattca

SEQ ID NO: 1195531 - DNA, 22 bp, Artificial Sequence
  chemically synthesized
atttcatcatgtaacttcatta

SEQ ID NO: 1195532 - DNA, 22 bp, Artificial Sequence
  chemically synthesized
aatattttgaataatgaagtta

SEQ ID NO: 1195533 - DNA, 22 bp, Artificial Sequence
  chemically synthesized
tgaataatgaagttacatgatg

SEQ ID NO: 1195534 - DNA, 22 bp, Artificial Sequence
  chemically synthesized
gaataatgaagttacatgatga

SEQ ID NO: 1195535 - DNA, 22 bp, Artificial Sequence
  chemically synthesized
aataatgaagttacatgatgaa

SEQ ID NO: 1195536 - DNA, 22 bp, Artificial Sequence
  chemically synthesized
ataaaatactaatttcatcatg

SEQ ID NO: 1195537 - DNA, 22 bp, Artificial Sequence
  chemically synthesized
aataaaatactaatttcatcat

SEQ ID NO: 1195538 - DNA, 22 bp, Artificial Sequence
  chemically synthesized
ttaataaaatactaatttcatc

SEQ ID NO: 1195539 - DNA, 22 bp, Artificial Sequence
  chemically synthesized
cacactcttaataaaatactaa

SEQ ID NO: 1195540 - DNA, 22 bp, Artificial Sequence
  chemically synthesized
catgatgaaattagtattttat

SEQ ID NO: 1195541 - DNA, 22 bp, Artificial Sequence
  chemically synthesized
aatacatagcctccacactctt

SEQ ID NO: 1195542 - DNA, 22 bp, Artificial Sequence
  chemically synthesized
gtattttattaagagtgtggag

SEQ ID NO: 1195543 - DNA, 22 bp, Artificial Sequence
  chemically synthesized
ttgaatacatagcctccacact

SEQ ID NO: 1195544 - DNA, 22 bp, Artificial Sequence
  chemically synthesized
tattaagagtgtggaggctatg

SEQ ID NO: 1195545 - DNA, 22 bp, Artificial Sequence
  chemically synthesized
attaagagtgtggaggctatgt

SEQ ID NO: 1195546 - DNA, 22 bp, Artificial Sequence
  chemically synthesized
aatctattgaatacatagcctc

SEQ ID NO: 1195547 - DNA, 22 bp, Artificial Sequence
  chemically synthesized
ttaagagtgtggaggctatgta

SEQ ID NO: 1195548 - DNA, 22 bp, Artificial Sequence
  chemically synthesized
gaatctattgaatacatagcct

SEQ ID NO: 1195549 - DNA, 22 bp, Artificial Sequence
  chemically synthesized
agagtgtggaggctatgtattc

SEQ ID NO: 1195550 - DNA, 22 bp, Artificial Sequence
  chemically synthesized
atatttgaatctattgaataca

SEQ ID NO: 1195551 - DNA, 22 bp, Artificial Sequence
  chemically synthesized
catatttgaatctattgaatac

SEQ ID NO: 1195552 - DNA, 22 bp, Artificial Sequence
  chemically synthesized
tcatatttgaatctattgaata

SEQ ID NO: 1195553 - DNA, 22 bp, Artificial Sequence
  chemically synthesized
tttcatatttgaatctattgaa

SEQ ID NO: 1195554 - DNA, 22 bp, Artificial Sequence
  chemically synthesized
ccatctctttcatatttgaatc

SEQ ID NO: 1195555 - DNA, 22 bp, Artificial Sequence
  chemically synthesized
tgtattcaatagattcaaatat

SEQ ID NO: 1195556 - DNA, 22 bp, Artificial Sequence
  chemically synthesized
tatctcccatctctttcatatt

SEQ ID NO: 1195557 - DNA, 22 bp, Artificial Sequence
  chemically synthesized
aatagattcaaatatgaaagag

SEQ ID NO: 1195558 - DNA, 22 bp, Artificial Sequence
  chemically synthesized
tgtatctcccatctctttcata

SEQ ID NO: 1195559 - DNA, 22 bp, Artificial Sequence
  chemically synthesized
ctgtatctcccatctctttcat

SEQ ID NO: 1195560 - DNA, 22 bp, Artificial Sequence
  chemically synthesized
tctgtatctcccatctctttca

SEQ ID NO: 1195561 - DNA, 22 bp, Artificial Sequence
  chemically synthesized
aaatatgaaagagatgggagat

SEQ ID NO: 1195562 - DNA, 22 bp, Artificial Sequence
  chemically synthesized
aaaattttctgtatctcccatc

SEQ ID NO: 1195563 - DNA, 22 bp, Artificial Sequence
  chemically synthesized
atggctgaaaattttctgtatc

SEQ ID NO: 1195564 - DNA, 22 bp, Artificial Sequence
  chemically synthesized
ctcatggctgaaaattttctgt

SEQ ID NO: 1195565 - DNA, 22 bp, Artificial Sequence
  chemically synthesized
tgctcatggctgaaaattttct

SEQ ID NO: 1195566 - DNA, 22 bp, Artificial Sequence
  chemically synthesized
ctgctcatggctgaaaattttc

SEQ ID NO: 1195567 - DNA, 22 bp, Artificial Sequence
  chemically synthesized
tctgctcatggctgaaaatttt

SEQ ID NO: 1195568 - DNA, 22 bp, Artificial Sequence
  chemically synthesized
ttctgctcatggctgaaaattt

SEQ ID NO: 1195569 - DNA, 22 bp, Artificial Sequence
  chemically synthesized
tttctgctcatggctgaaaatt

SEQ ID NO: 1195570 - DNA, 22 bp, Artificial Sequence
  chemically synthesized
tttttctgctcatggctgaaaa

SEQ ID NO: 1195571 - DNA, 22 bp, Artificial Sequence
  chemically synthesized
ctctttttctgctcatggctga

SEQ ID NO: 1195572 - DNA, 22 bp, Artificial Sequence
  chemically synthesized
ctactctttttctgctcatggc

SEQ ID NO: 1195573 - DNA, 22 bp, Artificial Sequence
  chemically synthesized
ttcctactctttttctgctcat

SEQ ID NO: 1195574 - DNA, 22 bp, Artificial Sequence
  chemically synthesized
tattcctactctttttctgctc

SEQ ID NO: 1195575 - DNA, 22 bp, Artificial Sequence
  chemically synthesized
tcagccatgagcagaaaaagag

SEQ ID NO: 1195576 - DNA, 22 bp, Artificial Sequence
  chemically synthesized
cagccatgagcagaaaaagagt

SEQ ID NO: 1195577 - DNA, 22 bp, Artificial Sequence
  chemically synthesized
agccatgagcagaaaaagagta

SEQ ID NO: 1195578 - DNA, 22 bp, Artificial Sequence
  chemically synthesized
gtaggctctattcctactcttt

SEQ ID NO: 1195579 - DNA, 22 bp, Artificial Sequence
  chemically synthesized
ccactggtaggctctattccta

SEQ ID NO: 1195580 - DNA, 22 bp, Artificial Sequence
  chemically synthesized
cccactggtaggctctattcct

SEQ ID NO: 1195581 - DNA, 22 bp, Artificial Sequence
  chemically synthesized
tcccactggtaggctctattcc

SEQ ID NO: 1195582 - DNA, 22 bp, Artificial Sequence
  chemically synthesized
attttcccactggtaggctcta

SEQ ID NO: 1195583 - DNA, 22 bp, Artificial Sequence
  chemically synthesized
aattttcccactggtaggctct

SEQ ID NO: 1195584 - DNA, 22 bp, Artificial Sequence
  chemically synthesized
taattttcccactggtaggctc

SEQ ID NO: 1195585 - DNA, 22 bp, Artificial Sequence
  chemically synthesized
aagttttaattttcccactggt

SEQ ID NO: 1195586 - DNA, 22 bp, Artificial Sequence
  chemically synthesized
caagttttaattttcccactgg

SEQ ID NO: 1195587 - DNA, 22 bp, Artificial Sequence
  chemically synthesized
atccaatatttcaagttttaat

SEQ ID NO: 1195588 - DNA, 22 bp, Artificial Sequence
  chemically synthesized
ccagtgggaaaattaaaacttg

SEQ ID NO: 1195589 - DNA, 22 bp, Artificial Sequence
  chemically synthesized
tgatccaatatttcaagtttta

SEQ ID NO: 1195590 - DNA, 22 bp, Artificial Sequence
  chemically synthesized
ctgatccaatatttcaagtttt

SEQ ID NO: 1195591 - DNA, 22 bp, Artificial Sequence
  chemically synthesized
aaatcagatttctgatccaata

SEQ ID NO: 1195592 - DNA, 22 bp, Artificial Sequence
  chemically synthesized
aaacttgaaatattggatcaga

SEQ ID NO: 1195593 - DNA, 22 bp, Artificial Sequence
  chemically synthesized
tcaaatcagatttctgatccaa

SEQ ID NO: 1195594 - DNA, 22 bp, Artificial Sequence
  chemically synthesized
ctctcaaatcagatttctgatc

SEQ ID NO: 1195595 - DNA, 22 bp, Artificial Sequence
  chemically synthesized
gaaatattggatcagaaatctg

SEQ ID NO: 1195596 - DNA, 22 bp, Artificial Sequence
  chemically synthesized
ctcctctcaaatcagatttctg

SEQ ID NO: 1195597 - DNA, 22 bp, Artificial Sequence
  chemically synthesized
aaatattggatcagaaatctga

SEQ ID NO: 1195598 - DNA, 22 bp, Artificial Sequence
  chemically synthesized
gctcctcctctcaaatcagatt

SEQ ID NO: 1195599 - DNA, 22 bp, Artificial Sequence
  chemically synthesized
ggctcctcctctcaaatcagat

SEQ ID NO: 1195600 - DNA, 22 bp, Artificial Sequence
  chemically synthesized
gatcagaaatctgatttgagag

SEQ ID NO: 1195601 - DNA, 22 bp, Artificial Sequence
  chemically synthesized
ggccatcttggctcctcctctc

SEQ ID NO: 1195602 - DNA, 22 bp, Artificial Sequence
  chemically synthesized
ttcggccatcttggctcctcct

SEQ ID NO: 1195603 - DNA, 22 bp, Artificial Sequence
  chemically synthesized
ctattcggccatcttggctcct

SEQ ID NO: 1195604 - DNA, 22 bp, Artificial Sequence
  chemically synthesized
atttgagaggaggagccaagat

SEQ ID NO: 1195605 - DNA, 22 bp, Artificial Sequence
  chemically synthesized
ttcctattcggccatcttggct

SEQ ID NO: 1195606 - DNA, 22 bp, Artificial Sequence
  chemically synthesized
gagaggaggagccaagatggcc

SEQ ID NO: 1195607 - DNA, 22 bp, Artificial Sequence
  chemically synthesized
agaggaggagccaagatggccg

SEQ ID NO: 1195608 - DNA, 22 bp, Artificial Sequence
  chemically synthesized
tagaccggagctgttcctattc

SEQ ID NO: 1195609 - DNA, 22 bp, Artificial Sequence
  chemically synthesized
ggagctgtagaccggagctgtt

SEQ ID NO: 1195610 - DNA, 22 bp, Artificial Sequence
  chemically synthesized
tgggagctgtagaccggagctg

SEQ ID NO: 1195611 - DNA, 22 bp, Artificial Sequence
  chemically synthesized
actctgggagctgtagaccgga

SEQ ID NO: 1195612 - DNA, 22 bp, Artificial Sequence
  chemically synthesized
cgtcgctcactctgggagctgt

SEQ ID NO: 1195613 - DNA, 22 bp, Artificial Sequence
  chemically synthesized
tgcgtcgctcactctgggagct

SEQ ID NO: 1195614 - DNA, 22 bp, Artificial Sequence
  chemically synthesized
ctgcgtcgctcactctgggagc

SEQ ID NO: 1195615 - DNA, 22 bp, Artificial Sequence
  chemically synthesized
cggtctacagctcccagagtga

SEQ ID NO: 1195616 - DNA, 22 bp, Artificial Sequence
  chemically synthesized
cagctcccagagtgagcgacgc

SEQ ID NO: 1195617 - DNA, 22 bp, Artificial Sequence
  chemically synthesized
ccagagtgagcgacgcagaaga

SEQ ID NO: 1195618 - DNA, 22 bp, Artificial Sequence
  chemically synthesized
agatggaaatgcagaaatcacc

SEQ ID NO: 1195619 - DNA, 22 bp, Artificial Sequence
  chemically synthesized
gtacctcagatggaaatgcaga

SEQ ID NO: 1195620 - DNA, 22 bp, Artificial Sequence
  chemically synthesized
ctgcatttccatctgaggtacc

SEQ ID NO: 1195621 - DNA, 22 bp, Artificial Sequence
  chemically synthesized
tgcatttccatctgaggtacca

SEQ ID NO: 1195622 - DNA, 22 bp, Artificial Sequence
  chemically synthesized
gtgagatgaacctggtacctca

SEQ ID NO: 1195623 - DNA, 22 bp, Artificial Sequence
  chemically synthesized
catttccatctgaggtaccagg

SEQ ID NO: 1195624 - DNA, 22 bp, Artificial Sequence
  chemically synthesized
cctagtgagatgaacctggtac

SEQ ID NO: 1195625 - DNA, 22 bp, Artificial Sequence
  chemically synthesized
ccatctgaggtaccaggttcat

SEQ ID NO: 1195626 - DNA, 22 bp, Artificial Sequence
  chemically synthesized
catctgaggtaccaggttcatc

SEQ ID NO: 1195627 - DNA, 22 bp, Artificial Sequence
  chemically synthesized
gcactccctagtgagatgaacc

SEQ ID NO: 1195628 - DNA, 22 bp, Artificial Sequence
  chemically synthesized
aggtaccaggttcatctcacta

SEQ ID NO: 1195629 - DNA, 22 bp, Artificial Sequence
  chemically synthesized
tctggcactccctagtgagatg

SEQ ID NO: 1195630 - DNA, 22 bp, Artificial Sequence
  chemically synthesized
cgcccactgtctggcactccct

SEQ ID NO: 1195631 - DNA, 22 bp, Artificial Sequence
  chemically synthesized
atctcactagggagtgccagac

SEQ ID NO: 1195632 - DNA, 22 bp, Artificial Sequence
  chemically synthesized
agctgcgcccactgtctggcac

SEQ ID NO: 1195633 - DNA, 22 bp, Artificial Sequence
  chemically synthesized
actagggagtgccagacagtgg

SEQ ID NO: 1195634 - DNA, 22 bp, Artificial Sequence
  chemically synthesized
gggagtgccagacagtgggcgc

SEQ ID NO: 1195635 - DNA, 22 bp, Artificial Sequence
  chemically synthesized
gggtcgcgcacggtgcacgcac

SEQ ID NO: 1195636 - DNA, 22 bp, Artificial Sequence
  chemically synthesized
cgggtcgcgcacggtgcacgca

SEQ ID NO: 1195637 - DNA, 22 bp, Artificial Sequence
  chemically synthesized
cttcgggtcgcgcacggtgcac

SEQ ID NO: 1195638 - DNA, 22 bp, Artificial Sequence
  chemically synthesized
agtgggtgcgtgcaccgtgcgc

SEQ ID NO: 1195639 - DNA, 22 bp, Artificial Sequence
  chemically synthesized
accctgcttcgggtcgcgcacg

SEQ ID NO: 1195640 - DNA, 22 bp, Artificial Sequence
  chemically synthesized
ccgagtgaggcaatgcctcacc

SEQ ID NO: 1195641 - DNA, 22 bp, Artificial Sequence
  chemically synthesized
cccgagtgaggcaatgcctcac

SEQ ID NO: 1195642 - DNA, 22 bp, Artificial Sequence
  chemically synthesized
cacttcccgagtgaggcaatgc

SEQ ID NO: 1195643 - DNA, 22 bp, Artificial Sequence
  chemically synthesized
gcacttcccgagtgaggcaatg

SEQ ID NO: 1195644 - DNA, 22 bp, Artificial Sequence
  chemically synthesized
accccttgcacttcccgagtga

SEQ ID NO: 1195645 - DNA, 22 bp, Artificial Sequence
  chemically synthesized
cctgaccccttgcacttcccga

SEQ ID NO: 1195646 - DNA, 22 bp, Artificial Sequence
  chemically synthesized
cctcactcgggaagtgcaaggg

SEQ ID NO: 1195647 - DNA, 22 bp, Artificial Sequence
  chemically synthesized
actcgggaagtgcaaggggtca

SEQ ID NO: 1195648 - DNA, 22 bp, Artificial Sequence
  chemically synthesized
ggaaagggaactccctgacccc

SEQ ID NO: 1195649 - DNA, 22 bp, Artificial Sequence
  chemically synthesized
gggaagtgcaaggggtcaggga

SEQ ID NO: 1195650 - DNA, 22 bp, Artificial Sequence
  chemically synthesized
actaggaaagggaactccctga

SEQ ID NO: 1195651 - DNA, 22 bp, Artificial Sequence
  chemically synthesized
gactaggaaagggaactccctg

SEQ ID NO: 1195652 - DNA, 22 bp, Artificial Sequence
  chemically synthesized
tgactaggaaagggaactccct

SEQ ID NO: 1195653 - DNA, 22 bp, Artificial Sequence
  chemically synthesized
tttgactaggaaagggaactcc

SEQ ID NO: 1195654 - DNA, 22 bp, Artificial Sequence
  chemically synthesized
ctttgactaggaaagggaactc

SEQ ID NO: 1195655 - DNA, 22 bp, Artificial Sequence
  chemically synthesized
tctttgactaggaaagggaact

SEQ ID NO: 1195656 - DNA, 22 bp, Artificial Sequence
  chemically synthesized
tccgtcacccctttctttgact

SEQ ID NO: 1195657 - DNA, 22 bp, Artificial Sequence
  chemically synthesized
cctttcctagtcaaagaaaggg

SEQ ID NO: 1195658 - DNA, 22 bp, Artificial Sequence
  chemically synthesized
tcctagtcaaagaaaggggtga

SEQ ID NO: 1195659 - DNA, 22 bp, Artificial Sequence
  chemically synthesized
cctagtcaaagaaaggggtgac

SEQ ID NO: 1195660 - DNA, 22 bp, Artificial Sequence
  chemically synthesized
caggtgctgtccgtcacccctt

SEQ ID NO: 1195661 - DNA, 22 bp, Artificial Sequence
  chemically synthesized
ctagtcaaagaaaggggtgacg

SEQ ID NO: 1195662 - DNA, 22 bp, Artificial Sequence
  chemically synthesized
ccaggtgctgtccgtcacccct

SEQ ID NO: 1195663 - DNA, 22 bp, Artificial Sequence
  chemically synthesized
tccaggtgctgtccgtcacccc

SEQ ID NO: 1195664 - DNA, 22 bp, Artificial Sequence
  chemically synthesized
gtcaaagaaaggggtgacggac

SEQ ID NO: 1195665 - DNA, 22 bp, Artificial Sequence
  chemically synthesized
gggtgggtgtgacccgattttc

SEQ ID NO: 1195666 - DNA, 22 bp, Artificial Sequence
  chemically synthesized
gaaaatcgggtcacacccaccc

SEQ ID NO: 1195667 - DNA, 22 bp, Artificial Sequence
  chemically synthesized
agcccgtcggaaacacgcagta

SEQ ID NO: 1195668 - DNA, 22 bp, Artificial Sequence
  chemically synthesized
aagcccgtcggaaacacgcagt

SEQ ID NO: 1195669 - DNA, 22 bp, Artificial Sequence
  chemically synthesized
taagcccgtcggaaacacgcag

SEQ ID NO: 1195670 - DNA, 22 bp, Artificial Sequence
  chemically synthesized
ttaagcccgtcggaaacacgca

SEQ ID NO: 1195671 - DNA, 22 bp, Artificial Sequence
  chemically synthesized
tttaagcccgtcggaaacacgc

SEQ ID NO: 1195672 - DNA, 22 bp, Artificial Sequence
  chemically synthesized
gtgtgccgttttttaagcccgt

SEQ ID NO: 1195673 - DNA, 22 bp, Artificial Sequence
  chemically synthesized
cgtgtttccgacgggcttaaaa

SEQ ID NO: 1195674 - DNA, 22 bp, Artificial Sequence
  chemically synthesized
ctggtgtgccgttttttaagcc

SEQ ID NO: 1195675 - DNA, 22 bp, Artificial Sequence
  chemically synthesized
ccgacgggcttaaaaaacggca

SEQ ID NO: 1195676 - DNA, 22 bp, Artificial Sequence
  chemically synthesized
cgacgggcttaaaaaacggcac

SEQ ID NO: 1195677 - DNA, 22 bp, Artificial Sequence
  chemically synthesized
aaaaaacggcacaccaggagat

SEQ ID NO: 1195678 - DNA, 22 bp, Artificial Sequence
  chemically synthesized
aaaaacggcacaccaggagatt

SEQ ID NO: 1195679 - DNA, 22 bp, Artificial Sequence
  chemically synthesized
cgagccagatgcaggatataat

SEQ ID NO: 1195680 - DNA, 22 bp, Artificial Sequence
  chemically synthesized
gggtaggaccctccgagccaga

SEQ ID NO: 1195681 - DNA, 22 bp, Artificial Sequence
  chemically synthesized
tatcctgcatctggctcggagg

SEQ ID NO: 1195682 - DNA, 22 bp, Artificial Sequence
  chemically synthesized
cgttggggtaggaccctccgag

SEQ ID NO: 1195683 - DNA, 22 bp, Artificial Sequence
  chemically synthesized
catctggctcggagggtcctac

SEQ ID NO: 1195684 - DNA, 22 bp, Artificial Sequence
  chemically synthesized
gctcggagggtcctaccccaac

SEQ ID NO: 1195685 - DNA, 22 bp, Artificial Sequence
  chemically synthesized
ggagggtcctaccccaacggaa

SEQ ID NO: 1195686 - DNA, 22 bp, Artificial Sequence
  chemically synthesized
gcaatcagcgagattccgttgg

SEQ ID NO: 1195687 - DNA, 22 bp, Artificial Sequence
  chemically synthesized
tgctagcaatcagcgagattcc

SEQ ID NO: 1195688 - DNA, 22 bp, Artificial Sequence
  chemically synthesized
ctgtgctagcaatcagcgagat

SEQ ID NO: 1195689 - DNA, 22 bp, Artificial Sequence
  chemically synthesized
ccccaacggaatctcgctgatt

SEQ ID NO: 1195690 - DNA, 22 bp, Artificial Sequence
  chemically synthesized
agactgctgtgctagcaatcag

SEQ ID NO: 1195691 - DNA, 22 bp, Artificial Sequence
  chemically synthesized
atctcagactgctgtgctagca

SEQ ID NO: 1195692 - DNA, 22 bp, Artificial Sequence
  chemically synthesized
gatctcagactgctgtgctagc

SEQ ID NO: 1195693 - DNA, 22 bp, Artificial Sequence
  chemically synthesized
gctgattgctagcacagcagtc

SEQ ID NO: 1195694 - DNA, 22 bp, Artificial Sequence
  chemically synthesized
cagtttgatctcagactgctgt

SEQ ID NO: 1195695 - DNA, 22 bp, Artificial Sequence
  chemically synthesized
gcagtttgatctcagactgctg

SEQ ID NO: 1195696 - DNA, 22 bp, Artificial Sequence
  chemically synthesized
attgctagcacagcagtctgag

SEQ ID NO: 1195697 - DNA, 22 bp, Artificial Sequence
  chemically synthesized
ctagcacagcagtctgagatca

SEQ ID NO: 1195698 - DNA, 22 bp, Artificial Sequence
  chemically synthesized
ccaccttgcagtttgatctcag

SEQ ID NO: 1195699 - DNA, 22 bp, Artificial Sequence
  chemically synthesized
gcacagcagtctgagatcaaac

SEQ ID NO: 1195700 - DNA, 22 bp, Artificial Sequence
  chemically synthesized
ctgccaccttgcagtttgatct

SEQ ID NO: 1195701 - DNA, 22 bp, Artificial Sequence
  chemically synthesized
gctgccaccttgcagtttgatc

SEQ ID NO: 1195702 - DNA, 22 bp, Artificial Sequence
  chemically synthesized
ccccagccttgctgccaccttg

SEQ ID NO: 1195703 - DNA, 22 bp, Artificial Sequence
  chemically synthesized
agatcaaactgcaaggtggcag

SEQ ID NO: 1195704 - DNA, 22 bp, Artificial Sequence
  chemically synthesized
caaggtggcagcaaggctgggg

SEQ ID NO: 1195705 - DNA, 22 bp, Artificial Sequence
  chemically synthesized
ggcaatggcgggtgcccctccc

SEQ ID NO: 1195706 - DNA, 22 bp, Artificial Sequence
  chemically synthesized
atcaagcctaggcaatggcggg

SEQ ID NO: 1195707 - DNA, 22 bp, Artificial Sequence
  chemically synthesized
ggggaggggcacccgccattgc

SEQ ID NO: 1195708 - DNA, 22 bp, Artificial Sequence
  chemically synthesized
cctaatcaagcctaggcaatgg

SEQ ID NO: 1195709 - DNA, 22 bp, Artificial Sequence
  chemically synthesized
acctaatcaagcctaggcaatg

SEQ ID NO: 1195710 - DNA, 22 bp, Artificial Sequence
  chemically synthesized
tttacctaatcaagcctaggca

SEQ ID NO: 1195711 - DNA, 22 bp, Artificial Sequence
  chemically synthesized
gtttacctaatcaagcctaggc

SEQ ID NO: 1195712 - DNA, 22 bp, Artificial Sequence
  chemically synthesized
tgtttacctaatcaagcctagg

SEQ ID NO: 1195713 - DNA, 22 bp, Artificial Sequence
  chemically synthesized
ctttgtttacctaatcaagcct

SEQ ID NO: 1195714 - DNA, 22 bp, Artificial Sequence
  chemically synthesized
ccagctgctttgtttacctaat

SEQ ID NO: 1195715 - DNA, 22 bp, Artificial Sequence
  chemically synthesized
cccagctgctttgtttacctaa

SEQ ID NO: 1195716 - DNA, 22 bp, Artificial Sequence
  chemically synthesized
cctaggcttgattaggtaaaca

SEQ ID NO: 1195717 - DNA, 22 bp, Artificial Sequence
  chemically synthesized
ggcttgattaggtaaacaaagc

SEQ ID NO: 1195718 - DNA, 22 bp, Artificial Sequence
  chemically synthesized
aagcttcccagctgctttgttt

SEQ ID NO: 1195719 - DNA, 22 bp, Artificial Sequence
  chemically synthesized
gattaggtaaacaaagcagctg

SEQ ID NO: 1195720 - DNA, 22 bp, Artificial Sequence
  chemically synthesized
attaggtaaacaaagcagctgg

SEQ ID NO: 1195721 - DNA, 22 bp, Artificial Sequence
  chemically synthesized
ggtaaacaaagcagctgggaag

SEQ ID NO: 1195722 - DNA, 22 bp, Artificial Sequence
  chemically synthesized
cacccagttcaagcttcccagc

SEQ ID NO: 1195723 - DNA, 22 bp, Artificial Sequence
  chemically synthesized
tggtgggctccacccagttcaa

SEQ ID NO: 1195724 - DNA, 22 bp, Artificial Sequence
  chemically synthesized
agttgtggtgggctccacccag

SEQ ID NO: 1195725 - DNA, 22 bp, Artificial Sequence
  chemically synthesized
ggaagcttgaactgggtggagc

SEQ ID NO: 1195726 - DNA, 22 bp, Artificial Sequence
  chemically synthesized
gagttgtggtgggctccaccca

SEQ ID NO: 1195727 - DNA, 22 bp, Artificial Sequence
  chemically synthesized
cttgagttgtggtgggctccac

SEQ ID NO: 1195728 - DNA, 22 bp, Artificial Sequence
  chemically synthesized
gaactgggtggagcccaccaca

SEQ ID NO: 1195729 - DNA, 22 bp, Artificial Sequence
  chemically synthesized
aactgggtggagcccaccacaa

SEQ ID NO: 1195730 - DNA, 22 bp, Artificial Sequence
  chemically synthesized
ggtggagcccaccacaactcaa

SEQ ID NO: 1195731 - DNA, 22 bp, Artificial Sequence
  chemically synthesized
cagaggcaggcaggcctccttg

SEQ ID NO: 1195732 - DNA, 22 bp, Artificial Sequence
  chemically synthesized
aaggaggcctgcctgcctctgt

SEQ ID NO: 1195733 - DNA, 22 bp, Artificial Sequence
  chemically synthesized
agaggtggagcctacagaggca

SEQ ID NO: 1195734 - DNA, 22 bp, Artificial Sequence
  chemically synthesized
ccctcagaggtggagcctacag

SEQ ID NO: 1195735 - DNA, 22 bp, Artificial Sequence
  chemically synthesized
cctgcctctgtaggctccacct

SEQ ID NO: 1195736 - DNA, 22 bp, Artificial Sequence
  chemically synthesized
tgccctgccctcagaggtggag

SEQ ID NO: 1195737 - DNA, 22 bp, Artificial Sequence
  chemically synthesized
cctctgtaggctccacctctga

SEQ ID NO: 1195738 - DNA, 22 bp, Artificial Sequence
  chemically synthesized
tctgtgccctgccctcagaggt

SEQ ID NO: 1195739 - DNA, 22 bp, Artificial Sequence
  chemically synthesized
gtctgtgccctgccctcagagg

SEQ ID NO: 1195740 - DNA, 22 bp, Artificial Sequence
  chemically synthesized
tgtaggctccacctctgagggc

SEQ ID NO: 1195741 - DNA, 22 bp, Artificial Sequence
  chemically synthesized
taggctccacctctgagggcag

SEQ ID NO: 1195742 - DNA, 22 bp, Artificial Sequence
  chemically synthesized
tttgtctgtgccctgccctcag

SEQ ID NO: 1195743 - DNA, 22 bp, Artificial Sequence
  chemically synthesized
gtttgtctgtgccctgccctca

SEQ ID NO: 1195744 - DNA, 22 bp, Artificial Sequence
  chemically synthesized
tgtttgtctgtgccctgccctc

SEQ ID NO: 1195745 - DNA, 22 bp, Artificial Sequence
  chemically synthesized
ttgtttgtctgtgccctgccct

SEQ ID NO: 1195746 - DNA, 22 bp, Artificial Sequence
  chemically synthesized
tttgtttgtctgtgccctgccc

SEQ ID NO: 1195747 - DNA, 22 bp, Artificial Sequence
  chemically synthesized
cacctctgagggcagggcacag

SEQ ID NO: 1195748 - DNA, 22 bp, Artificial Sequence
  chemically synthesized
tctttttgtttgtctgtgccct

SEQ ID NO: 1195749 - DNA, 22 bp, Artificial Sequence
  chemically synthesized
ctgtctttttgtttgtctgtgc

SEQ ID NO: 1195750 - DNA, 22 bp, Artificial Sequence
  chemically synthesized
tgagggcagggcacagacaaac

SEQ ID NO: 1195751 - DNA, 22 bp, Artificial Sequence
  chemically synthesized
ctgctgtctttttgtttgtctg

SEQ ID NO: 1195752 - DNA, 22 bp, Artificial Sequence
  chemically synthesized
agggcagggcacagacaaacaa

SEQ ID NO: 1195753 - DNA, 22 bp, Artificial Sequence
  chemically synthesized
cagaggttactgctgtcttttt

SEQ ID NO: 1195754 - DNA, 22 bp, Artificial Sequence
  chemically synthesized
aatctgcagaggttactgctgt

SEQ ID NO: 1195755 - DNA, 22 bp, Artificial Sequence
  chemically synthesized
aaatctgcagaggttactgctg

SEQ ID NO: 1195756 - DNA, 22 bp, Artificial Sequence
  chemically synthesized
tcagacagggatatttaaatct

SEQ ID NO: 1195757 - DNA, 22 bp, Artificial Sequence
  chemically synthesized
aaagctgtcagacagggatatt

SEQ ID NO: 1195758 - DNA, 22 bp, Artificial Sequence
  chemically synthesized
caaagctgtcagacagggatat

SEQ ID NO: 1195759 - DNA, 22 bp, Artificial Sequence
  chemically synthesized
tgcagatttaaatatccctgtc

SEQ ID NO: 1195760 - DNA, 22 bp, Artificial Sequence
  chemically synthesized
ttcaaagctgtcagacagggat

SEQ ID NO: 1195761 - DNA, 22 bp, Artificial Sequence
  chemically synthesized
cagatttaaatatccctgtctg

SEQ ID NO: 1195762 - DNA, 22 bp, Artificial Sequence
  chemically synthesized
tcttcaaagctgtcagacaggg

SEQ ID NO: 1195763 - DNA, 22 bp, Artificial Sequence
  chemically synthesized
ctctcttcaaagctgtcagaca

SEQ ID NO: 1195764 - DNA, 22 bp, Artificial Sequence
  chemically synthesized
aaatatccctgtctgacagctt

SEQ ID NO: 1195765 - DNA, 22 bp, Artificial Sequence
  chemically synthesized
aatatccctgtctgacagcttt

SEQ ID NO: 1195766 - DNA, 22 bp, Artificial Sequence
  chemically synthesized
ggagaaccactgctctcttcaa

SEQ ID NO: 1195767 - DNA, 22 bp, Artificial Sequence
  chemically synthesized
tctgacagctttgaagagagca

SEQ ID NO: 1195768 - DNA, 22 bp, Artificial Sequence
  chemically synthesized
acagctttgaagagagcagtgg

SEQ ID NO: 1195769 - DNA, 22 bp, Artificial Sequence
  chemically synthesized
cgtactgggagaaccactgctc

SEQ ID NO: 1195770 - DNA, 22 bp, Artificial Sequence
  chemically synthesized
tgaagagagcagtggttctccc

SEQ ID NO: 1195771 - DNA, 22 bp, Artificial Sequence
  chemically synthesized
cagctgcgtactgggagaacca

SEQ ID NO: 1195772 - DNA, 22 bp, Artificial Sequence
  chemically synthesized
gaagagagcagtggttctccca

SEQ ID NO: 1195773 - DNA, 22 bp, Artificial Sequence
  chemically synthesized
aagagagcagtggttctcccag

SEQ ID NO: 1195774 - DNA, 22 bp, Artificial Sequence
  chemically synthesized
agatctccagctgcgtactggg

SEQ ID NO: 1195775 - DNA, 22 bp, Artificial Sequence
  chemically synthesized
tcagatctccagctgcgtactg

SEQ ID NO: 1195776 - DNA, 22 bp, Artificial Sequence
  chemically synthesized
ctcagatctccagctgcgtact

SEQ ID NO: 1195777 - DNA, 22 bp, Artificial Sequence
  chemically synthesized
ccccttctcagatctccagctg

SEQ ID NO: 1195778 - DNA, 22 bp, Artificial Sequence
  chemically synthesized
tcccagtacgcagctggagatc

SEQ ID NO: 1195779 - DNA, 22 bp, Artificial Sequence
  chemically synthesized
ccagtacgcagctggagatctg

SEQ ID NO: 1195780 - DNA, 22 bp, Artificial Sequence
  chemically synthesized
aggaggcagtctgccccttctc

SEQ ID NO: 1195781 - DNA, 22 bp, Artificial Sequence
  chemically synthesized
gaggaggcagtctgccccttct

SEQ ID NO: 1195782 - DNA, 22 bp, Artificial Sequence
  chemically synthesized
gagatctgagaaggggcagact

SEQ ID NO: 1195783 - DNA, 22 bp, Artificial Sequence
  chemically synthesized
agaaggggcagactgcctcctc

SEQ ID NO: 1195784 - DNA, 22 bp, Artificial Sequence
  chemically synthesized
gggggtcaggggtcaggcaccc

SEQ ID NO: 1195785 - DNA, 22 bp, Artificial Sequence
  chemically synthesized
cctcctcaagtgggtgcctgac

SEQ ID NO: 1195786 - DNA, 22 bp, Artificial Sequence
  chemically synthesized
ctcaagtgggtgcctgacccct

SEQ ID NO: 1195787 - DNA, 22 bp, Artificial Sequence
  chemically synthesized
aagtgggtgcctgacccctgac

SEQ ID NO: 1195788 - DNA, 22 bp, Artificial Sequence
  chemically synthesized
gggtgctcgggggtcaggggtc

SEQ ID NO: 1195789 - DNA, 22 bp, Artificial Sequence
  chemically synthesized
ccagttagggtgctcgggggtc

SEQ ID NO: 1195790 - DNA, 22 bp, Artificial Sequence
  chemically synthesized
acccctgacccccgagcaccct

SEQ ID NO: 1195791 - DNA, 22 bp, Artificial Sequence
  chemically synthesized
gggagtgcctcccagttagggt

SEQ ID NO: 1195792 - DNA, 22 bp, Artificial Sequence
  chemically synthesized
ggggagtgcctcccagttaggg

SEQ ID NO: 1195793 - DNA, 22 bp, Artificial Sequence
  chemically synthesized
acccccgagcaccctaactggg

SEQ ID NO: 1195794 - DNA, 22 bp, Artificial Sequence
  chemically synthesized
tggggagtgcctcccagttagg

SEQ ID NO: 1195795 - DNA, 22 bp, Artificial Sequence
  chemically synthesized
ttggggagtgcctcccagttag

SEQ ID NO: 1195796 - DNA, 22 bp, Artificial Sequence
  chemically synthesized
actgggaggcactccccaaaag

SEQ ID NO: 1195797 - DNA, 22 bp, Artificial Sequence
  chemically synthesized
ggaggcactccccaaaaggggc

SEQ ID NO: 1195798 - DNA, 22 bp, Artificial Sequence
  chemically synthesized
ccgtgtgaggtgtcagtatgcc

SEQ ID NO: 1195799 - DNA, 22 bp, Artificial Sequence
  chemically synthesized
cccaaaaggggcatactgacac

SEQ ID NO: 1195800 - DNA, 22 bp, Artificial Sequence
  chemically synthesized
gagtaccctgccgtgtgaggtg

SEQ ID NO: 1195801 - DNA, 22 bp, Artificial Sequence
  chemically synthesized
ttggagtaccctgccgtgtgag

SEQ ID NO: 1195802 - DNA, 22 bp, Artificial Sequence
  chemically synthesized
acacctcacacggcagggtact

SEQ ID NO: 1195803 - DNA, 22 bp, Artificial Sequence
  chemically synthesized
caggtctgttggagtaccctgc

SEQ ID NO: 1195804 - DNA, 22 bp, Artificial Sequence
  chemically synthesized
agctgcaggtctgttggagtac

SEQ ID NO: 1195805 - DNA, 22 bp, Artificial Sequence
  chemically synthesized
acacggcagggtactccaacag

SEQ ID NO: 1195806 - DNA, 22 bp, Artificial Sequence
  chemically synthesized
acagacaggaccctcagctgca

SEQ ID NO: 1195807 - DNA, 22 bp, Artificial Sequence
  chemically synthesized
taacagacaggaccctcagctg

SEQ ID NO: 1195808 - DNA, 22 bp, Artificial Sequence
  chemically synthesized
caacagacctgcagctgagggt

SEQ ID NO: 1195809 - DNA, 22 bp, Artificial Sequence
  chemically synthesized
ctaacagacaggaccctcagct

SEQ ID NO: 1195810 - DNA, 22 bp, Artificial Sequence
  chemically synthesized
cttctaacagacaggaccctca

SEQ ID NO: 1195811 - DNA, 22 bp, Artificial Sequence
  chemically synthesized
ccttctaacagacaggaccctc

SEQ ID NO: 1195812 - DNA, 22 bp, Artificial Sequence
  chemically synthesized
tccttctaacagacaggaccct

SEQ ID NO: 1195813 - DNA, 22 bp, Artificial Sequence
  chemically synthesized
gttttccttctaacagacagga

SEQ ID NO: 1195814 - DNA, 22 bp, Artificial Sequence
  chemically synthesized
cagctgagggtcctgtctgtta

SEQ ID NO: 1195815 - DNA, 22 bp, Artificial Sequence
  chemically synthesized
ttagttttccttctaacagaca

SEQ ID NO: 1195816 - DNA, 22 bp, Artificial Sequence
  chemically synthesized
gttagttttccttctaacagac

SEQ ID NO: 1195817 - DNA, 22 bp, Artificial Sequence
  chemically synthesized
tttgttagttttccttctaaca

SEQ ID NO: 1195818 - DNA, 22 bp, Artificial Sequence
  chemically synthesized
agggtcctgtctgttagaagga

SEQ ID NO: 1195819 - DNA, 22 bp, Artificial Sequence
  chemically synthesized
tgtttgttagttttccttctaa

SEQ ID NO: 1195820 - DNA, 22 bp, Artificial Sequence
  chemically synthesized
ctgtttgttagttttccttcta

SEQ ID NO: 1195821 - DNA, 22 bp, Artificial Sequence
  chemically synthesized
tctgtttgttagttttccttct

SEQ ID NO: 1195822 - DNA, 22 bp, Artificial Sequence
  chemically synthesized
tctgttagaaggaaaactaaca

SEQ ID NO: 1195823 - DNA, 22 bp, Artificial Sequence
  chemically synthesized
ttagaaggaaaactaacaaaca

SEQ ID NO: 1195824 - DNA, 22 bp, Artificial Sequence
  chemically synthesized
gaaggaaaactaacaaacagaa

SEQ ID NO: 1195825 - DNA, 22 bp, Artificial Sequence
  chemically synthesized
tgtggatgtcctttctgtttgt

SEQ ID NO: 1195826 - DNA, 22 bp, Artificial Sequence
  chemically synthesized
gtgtggatgtcctttctgtttg

SEQ ID NO: 1195827 - DNA, 22 bp, Artificial Sequence
  chemically synthesized
tgtgtggatgtcctttctgttt

SEQ ID NO: 1195828 - DNA, 22 bp, Artificial Sequence
  chemically synthesized
ttgtgtggatgtcctttctgtt

SEQ ID NO: 1195829 - DNA, 22 bp, Artificial Sequence
  chemically synthesized
tttgtgtggatgtcctttctgt

SEQ ID NO: 1195830 - DNA, 22 bp, Artificial Sequence
  chemically synthesized
acaaacagaaaggacatccaca

SEQ ID NO: 1195831 - DNA, 22 bp, Artificial Sequence
  chemically synthesized
atgatggtgacgtccagatggg

SEQ ID NO: 1195832 - DNA, 22 bp, Artificial Sequence
  chemically synthesized
gatgatggtgacgtccagatgg

SEQ ID NO: 1195833 - DNA, 22 bp, Artificial Sequence
  chemically synthesized
tgatgatggtgacgtccagatg

SEQ ID NO: 1195834 - DNA, 22 bp, Artificial Sequence
  chemically synthesized
gactttgatgatggtgacgtcc

SEQ ID NO: 1195835 - DNA, 22 bp, Artificial Sequence
  chemically synthesized
ggactttgatgatggtgacgtc

SEQ ID NO: 1195836 - DNA, 22 bp, Artificial Sequence
  chemically synthesized
tggactttgatgatggtgacgt

SEQ ID NO: 1195837 - DNA, 22 bp, Artificial Sequence
  chemically synthesized
ttggactttgatgatggtgacg

SEQ ID NO: 1195838 - DNA, 22 bp, Artificial Sequence
  chemically synthesized
cttttggactttgatgatggtg

SEQ ID NO: 1195839 - DNA, 22 bp, Artificial Sequence
  chemically synthesized
tctacttttggactttgatgat

SEQ ID NO: 1195840 - DNA, 22 bp, Artificial Sequence
  chemically synthesized
atctacttttggactttgatga

SEQ ID NO: 1195841 - DNA, 22 bp, Artificial Sequence
  chemically synthesized
tatctacttttggactttgatg

SEQ ID NO: 1195842 - DNA, 22 bp, Artificial Sequence
  chemically synthesized
gacgtcaccatcatcaaagtcc

SEQ ID NO: 1195843 - DNA, 22 bp, Artificial Sequence
  chemically synthesized
tggttttatctacttttggact

SEQ ID NO: 1195844 - DNA, 22 bp, Artificial Sequence
  chemically synthesized
gtggttttatctacttttggac

SEQ ID NO: 1195845 - DNA, 22 bp, Artificial Sequence
  chemically synthesized
tgtggttttatctacttttgga

SEQ ID NO: 1195846 - DNA, 22 bp, Artificial Sequence
  chemically synthesized
cccatctttgtggttttatcta

SEQ ID NO: 1195847 - DNA, 22 bp, Artificial Sequence
  chemically synthesized
ccccatctttgtggttttatct

SEQ ID NO: 1195848 - DNA, 22 bp, Artificial Sequence
  chemically synthesized
ttccccatctttgtggttttat

SEQ ID NO: 1195849 - DNA, 22 bp, Artificial Sequence
  chemically synthesized
cttccccatctttgtggtttta

SEQ ID NO: 1195850 - DNA, 22 bp, Artificial Sequence
  chemically synthesized
tttcttccccatctttgtggtt

SEQ ID NO: 1195851 - DNA, 22 bp, Artificial Sequence
  chemically synthesized
tgtttcttccccatctttgtgg

SEQ ID NO: 1195852 - DNA, 22 bp, Artificial Sequence
  chemically synthesized
ctctgtttcttccccatctttg

SEQ ID NO: 1195853 - DNA, 22 bp, Artificial Sequence
  chemically synthesized
tgctctgtttcttccccatctt

SEQ ID NO: 1195854 - DNA, 22 bp, Artificial Sequence
  chemically synthesized
ctgctctgtttcttccccatct

SEQ ID NO: 1195855 - DNA, 22 bp, Artificial Sequence
  chemically synthesized
tctgctctgtttcttccccatc

SEQ ID NO: 1195856 - DNA, 22 bp, Artificial Sequence
  chemically synthesized
ttctgctctgtttcttccccat

SEQ ID NO: 1195857 - DNA, 22 bp, Artificial Sequence
  chemically synthesized
cagtttttctgctctgtttctt

SEQ ID NO: 1195858 - DNA, 22 bp, Artificial Sequence
  chemically synthesized
ccagtttttctgctctgtttct

SEQ ID NO: 1195859 - DNA, 22 bp, Artificial Sequence
  chemically synthesized
gagtttccagtttttctgctct

SEQ ID NO: 1195860 - DNA, 22 bp, Artificial Sequence
  chemically synthesized
agagtttccagtttttctgctc

SEQ ID NO: 1195861 - DNA, 22 bp, Artificial Sequence
  chemically synthesized
tagagtttccagtttttctgct

SEQ ID NO: 1195862 - DNA, 22 bp, Artificial Sequence
  chemically synthesized
ttagagtttccagtttttctgc

SEQ ID NO: 1195863 - DNA, 22 bp, Artificial Sequence
  chemically synthesized
tttagagtttccagtttttctg

SEQ ID NO: 1195864 - DNA, 22 bp, Artificial Sequence
  chemically synthesized
ctttttagagtttccagttttt

SEQ ID NO: 1195865 - DNA, 22 bp, Artificial Sequence
  chemically synthesized
tgctttttagagtttccagttt

SEQ ID NO: 1195866 - DNA, 22 bp, Artificial Sequence
  chemically synthesized
gaggaggagaggtgctctgctt

SEQ ID NO: 1195867 - DNA, 22 bp, Artificial Sequence
  chemically synthesized
gaaactctaaaaagcagagcac

SEQ ID NO: 1195868 - DNA, 22 bp, Artificial Sequence
  chemically synthesized
ggaggaggagaggtgctctgct

SEQ ID NO: 1195869 - DNA, 22 bp, Artificial Sequence
  chemically synthesized
tggaggaggagaggtgctctgc

SEQ ID NO: 1195870 - DNA, 22 bp, Artificial Sequence
  chemically synthesized
ctttggaggaggagaggtgctc

SEQ ID NO: 1195871 - DNA, 22 bp, Artificial Sequence
  chemically synthesized
taaaaagcagagcacctctcct

SEQ ID NO: 1195872 - DNA, 22 bp, Artificial Sequence
  chemically synthesized
aaaagcagagcacctctcctcc

SEQ ID NO: 1195873 - DNA, 22 bp, Artificial Sequence
  chemically synthesized
tgttcctttggaggaggagagg

SEQ ID NO: 1195874 - DNA, 22 bp, Artificial Sequence
  chemically synthesized
gtgaggaactgtgttcctttgg

SEQ ID NO: 1195875 - DNA, 22 bp, Artificial Sequence
  chemically synthesized
ctagtgaggaactgtgttcctt

SEQ ID NO: 1195876 - DNA, 22 bp, Artificial Sequence
  chemically synthesized
tcctcctccaaaggaacacagt

SEQ ID NO: 1195877 - DNA, 22 bp, Artificial Sequence
  chemically synthesized
ctcctccaaaggaacacagttc

SEQ ID NO: 1195878 - DNA, 22 bp, Artificial Sequence
  chemically synthesized
cgttgctagtgaggaactgtgt

SEQ ID NO: 1195879 - DNA, 22 bp, Artificial Sequence
  chemically synthesized
ctccaaaggaacacagttcctc

SEQ ID NO: 1195880 - DNA, 22 bp, Artificial Sequence
  chemically synthesized
ttccgttgctagtgaggaactg

SEQ ID NO: 1195881 - DNA, 22 bp, Artificial Sequence
  chemically synthesized
gttccgttgctagtgaggaact

SEQ ID NO: 1195882 - DNA, 22 bp, Artificial Sequence
  chemically synthesized
caaaggaacacagttcctcact

SEQ ID NO: 1195883 - DNA, 22 bp, Artificial Sequence
  chemically synthesized
tgttccgttgctagtgaggaac

SEQ ID NO: 1195884 - DNA, 22 bp, Artificial Sequence
  chemically synthesized
cagctttgttccgttgctagtg

SEQ ID NO: 1195885 - DNA, 22 bp, Artificial Sequence
  chemically synthesized
tccagctttgttccgttgctag

SEQ ID NO: 1195886 - DNA, 22 bp, Artificial Sequence
  chemically synthesized
tctccagctttgttccgttgct

SEQ ID NO: 1195887 - DNA, 22 bp, Artificial Sequence
  chemically synthesized
ctcactagcaacggaacaaagc

SEQ ID NO: 1195888 - DNA, 22 bp, Artificial Sequence
  chemically synthesized
actagcaacggaacaaagctgg

SEQ ID NO: 1195889 - DNA, 22 bp, Artificial Sequence
  chemically synthesized
gcaacggaacaaagctggagag

SEQ ID NO: 1195890 - DNA, 22 bp, Artificial Sequence
  chemically synthesized
gtcaaagtcatcctctctccag

SEQ ID NO: 1195891 - DNA, 22 bp, Artificial Sequence
  chemically synthesized
agctcgtcaaagtcatcctctc

SEQ ID NO: 1195892 - DNA, 22 bp, Artificial Sequence
  chemically synthesized
tcagctcgtcaaagtcatcctc

SEQ ID NO: 1195893 - DNA, 22 bp, Artificial Sequence
  chemically synthesized
tctcagctcgtcaaagtcatcc

SEQ ID NO: 1195894 - DNA, 22 bp, Artificial Sequence
  chemically synthesized
ctctcagctcgtcaaagtcatc

SEQ ID NO: 1195895 - DNA, 22 bp, Artificial Sequence
  chemically synthesized
ttctctcagctcgtcaaagtca

SEQ ID NO: 1195896 - DNA, 22 bp, Artificial Sequence
  chemically synthesized
cttctctcagctcgtcaaagtc

SEQ ID NO: 1195897 - DNA, 22 bp, Artificial Sequence
  chemically synthesized
gagagaggatgactttgacgag

SEQ ID NO: 1195898 - DNA, 22 bp, Artificial Sequence
  chemically synthesized
aagccttcttctctcagctcgt

SEQ ID NO: 1195899 - DNA, 22 bp, Artificial Sequence
  chemically synthesized
atcgtctgaagccttcttctct

SEQ ID NO: 1195900 - DNA, 22 bp, Artificial Sequence
  chemically synthesized
gatcgtctgaagccttcttctc

SEQ ID NO: 1195901 - DNA, 22 bp, Artificial Sequence
  chemically synthesized
tgacgagctgagagaagaaggc

SEQ ID NO: 1195902 - DNA, 22 bp, Artificial Sequence
  chemically synthesized
gacgagctgagagaagaaggct

SEQ ID NO: 1195903 - DNA, 22 bp, Artificial Sequence
  chemically synthesized
acgagctgagagaagaaggctt

SEQ ID NO: 1195904 - DNA, 22 bp, Artificial Sequence
  chemically synthesized
agagtaatttgatcgtctgaag

SEQ ID NO: 1195905 - DNA, 22 bp, Artificial Sequence
  chemically synthesized
agagaagaaggcttcagacgat

SEQ ID NO: 1195906 - DNA, 22 bp, Artificial Sequence
  chemically synthesized
ccgtagctcagagtaatttgat

SEQ ID NO: 1195907 - DNA, 22 bp, Artificial Sequence
  chemically synthesized
cagacgatcaaattactctgag

SEQ ID NO: 1195908 - DNA, 22 bp, Artificial Sequence
  chemically synthesized
agacgatcaaattactctgagc

SEQ ID NO: 1195909 - DNA, 22 bp, Artificial Sequence
  chemically synthesized
aatgtcctcccgtagctcagag

SEQ ID NO: 1195910 - DNA, 22 bp, Artificial Sequence
  chemically synthesized
gaatgtcctcccgtagctcaga

SEQ ID NO: 1195911 - DNA, 22 bp, Artificial Sequence
  chemically synthesized
gtttgaatgtcctcccgtagct

SEQ ID NO: 1195912 - DNA, 22 bp, Artificial Sequence
  chemically synthesized
ggtttgaatgtcctcccgtagc

SEQ ID NO: 1195913 - DNA, 22 bp, Artificial Sequence
  chemically synthesized
tggtttgaatgtcctcccgtag

SEQ ID NO: 1195914 - DNA, 22 bp, Artificial Sequence
  chemically synthesized
cctttggtttgaatgtcctccc

SEQ ID NO: 1195915 - DNA, 22 bp, Artificial Sequence
  chemically synthesized
ctctgagctacgggaggacatt

SEQ ID NO: 1195916 - DNA, 22 bp, Artificial Sequence
  chemically synthesized
gcctttggtttgaatgtcctcc

SEQ ID NO: 1195917 - DNA, 22 bp, Artificial Sequence
  chemically synthesized
tgcctttggtttgaatgtcctc

SEQ ID NO: 1195918 - DNA, 22 bp, Artificial Sequence
  chemically synthesized
tgagctacgggaggacattcaa

SEQ ID NO: 1195919 - DNA, 22 bp, Artificial Sequence
  chemically synthesized
tttgcctttggtttgaatgtcc

SEQ ID NO: 1195920 - DNA, 22 bp, Artificial Sequence
  chemically synthesized
ctttgcctttggtttgaatgtc

SEQ ID NO: 1195921 - DNA, 22 bp, Artificial Sequence
  chemically synthesized
agctacgggaggacattcaaac

SEQ ID NO: 1195922 - DNA, 22 bp, Artificial Sequence
  chemically synthesized
aacttctttgcctttggtttga

SEQ ID NO: 1195923 - DNA, 22 bp, Artificial Sequence
  chemically synthesized
cgggaggacattcaaaccaaag

SEQ ID NO: 1195924 - DNA, 22 bp, Artificial Sequence
  chemically synthesized
caacttctttgcctttggtttg

SEQ ID NO: 1195925 - DNA, 22 bp, Artificial Sequence
  chemically synthesized
tcaacttctttgcctttggttt

SEQ ID NO: 1195926 - DNA, 22 bp, Artificial Sequence
  chemically synthesized
aaagttttcaacttctttgcct

SEQ ID NO: 1195927 - DNA, 22 bp, Artificial Sequence
  chemically synthesized
caaagttttcaacttctttgcc

SEQ ID NO: 1195928 - DNA, 22 bp, Artificial Sequence
  chemically synthesized
tcaaagttttcaacttctttgc

SEQ ID NO: 1195929 - DNA, 22 bp, Artificial Sequence
  chemically synthesized
ttcaaagttttcaacttctttg

SEQ ID NO: 1195930 - DNA, 22 bp, Artificial Sequence
  chemically synthesized
aaaccaaaggcaaagaagttga

SEQ ID NO: 1195931 - DNA, 22 bp, Artificial Sequence
  chemically synthesized
aatgtttttcaaagttttcaac

SEQ ID NO: 1195932 - DNA, 22 bp, Artificial Sequence
  chemically synthesized
taaatgtttttcaaagttttca

SEQ ID NO: 1195933 - DNA, 22 bp, Artificial Sequence
  chemically synthesized
ctaaatgtttttcaaagttttc

SEQ ID NO: 1195934 - DNA, 22 bp, Artificial Sequence
  chemically synthesized
ttctaaatgtttttcaaagttt

SEQ ID NO: 1195935 - DNA, 22 bp, Artificial Sequence
  chemically synthesized
tacattcttctaaatgtttttc

SEQ ID NO: 1195936 - DNA, 22 bp, Artificial Sequence
  chemically synthesized
atacattcttctaaatgttttt

SEQ ID NO: 1195937 - DNA, 22 bp, Artificial Sequence
  chemically synthesized
aaaactttgaaaaacatttaga

SEQ ID NO: 1195938 - DNA, 22 bp, Artificial Sequence
  chemically synthesized
cttatacattcttctaaatgtt

SEQ ID NO: 1195939 - DNA, 22 bp, Artificial Sequence
  chemically synthesized
tacttatacattcttctaaatg

SEQ ID NO: 1195940 - DNA, 22 bp, Artificial Sequence
  chemically synthesized
ttctacttatacattcttctaa

SEQ ID NO: 1195941 - DNA, 22 bp, Artificial Sequence
  chemically synthesized
tgaaaaacatttagaagaatgt

SEQ ID NO: 1195942 - DNA, 22 bp, Artificial Sequence
  chemically synthesized
gaaaaacatttagaagaatgta

SEQ ID NO: 1195943 - DNA, 22 bp, Artificial Sequence
  chemically synthesized
aaaaacatttagaagaatgtat

SEQ ID NO: 1195944 - DNA, 22 bp, Artificial Sequence
  chemically synthesized
taatggttattctacttataca

SEQ ID NO: 1195945 - DNA, 22 bp, Artificial Sequence
  chemically synthesized
tgtaatggttattctacttata

SEQ ID NO: 1195946 - DNA, 22 bp, Artificial Sequence
  chemically synthesized
tctgtaatggttattctactta

SEQ ID NO: 1195947 - DNA, 22 bp, Artificial Sequence
  chemically synthesized
agaagaatgtataagtagaata

SEQ ID NO: 1195948 - DNA, 22 bp, Artificial Sequence
  chemically synthesized
ctctgtaatggttattctactt

SEQ ID NO: 1195949 - DNA, 22 bp, Artificial Sequence
  chemically synthesized
gaagaatgtataagtagaataa

SEQ ID NO: 1195950 - DNA, 22 bp, Artificial Sequence
  chemically synthesized
agcacttctctgtaatggttat

SEQ ID NO: 1195951 - DNA, 22 bp, Artificial Sequence
  chemically synthesized
aagcacttctctgtaatggtta

SEQ ID NO: 1195952 - DNA, 22 bp, Artificial Sequence
  chemically synthesized
taagcacttctctgtaatggtt

SEQ ID NO: 1195953 - DNA, 22 bp, Artificial Sequence
  chemically synthesized
ctttaagcacttctctgtaatg

SEQ ID NO: 1195954 - DNA, 22 bp, Artificial Sequence
  chemically synthesized
catcagctcctttaagcacttc

SEQ ID NO: 1195955 - DNA, 22 bp, Artificial Sequence
  chemically synthesized
agctccatcagctcctttaagc

SEQ ID NO: 1195956 - DNA, 22 bp, Artificial Sequence
  chemically synthesized
cagctccatcagctcctttaag

SEQ ID NO: 1195957 - DNA, 22 bp, Artificial Sequence
  chemically synthesized
tcagctccatcagctcctttaa

SEQ ID NO: 1195958 - DNA, 22 bp, Artificial Sequence
  chemically synthesized
cagagaagtgcttaaaggagct

SEQ ID NO: 1195959 - DNA, 22 bp, Artificial Sequence
  chemically synthesized
gttttcagctccatcagctcct

SEQ ID NO: 1195960 - DNA, 22 bp, Artificial Sequence
  chemically synthesized
ggttttcagctccatcagctcc

SEQ ID NO: 1195961 - DNA, 22 bp, Artificial Sequence
  chemically synthesized
gccttggttttcagctccatca

SEQ ID NO: 1195962 - DNA, 22 bp, Artificial Sequence
  chemically synthesized
tagccttggttttcagctccat

SEQ ID NO: 1195963 - DNA, 22 bp, Artificial Sequence
  chemically synthesized
aaaggagctgatggagctgaaa

SEQ ID NO: 1195964 - DNA, 22 bp, Artificial Sequence
  chemically synthesized
tctagccttggttttcagctcc

SEQ ID NO: 1195965 - DNA, 22 bp, Artificial Sequence
  chemically synthesized
aaggagctgatggagctgaaaa

SEQ ID NO: 1195966 - DNA, 22 bp, Artificial Sequence
  chemically synthesized
ctctagccttggttttcagctc

SEQ ID NO: 1195967 - DNA, 22 bp, Artificial Sequence
  chemically synthesized
acgtacttctctagccttggtt

SEQ ID NO: 1195968 - DNA, 22 bp, Artificial Sequence
  chemically synthesized
atggagctgaaaaccaaggcta

SEQ ID NO: 1195969 - DNA, 22 bp, Artificial Sequence
  chemically synthesized
cacgtacttctctagccttggt

SEQ ID NO: 1195970 - DNA, 22 bp, Artificial Sequence
  chemically synthesized
ttcacgtacttctctagccttg

SEQ ID NO: 1195971 - DNA, 22 bp, Artificial Sequence
  chemically synthesized
cattcttcacgtacttctctag

SEQ ID NO: 1195972 - DNA, 22 bp, Artificial Sequence
  chemically synthesized
aaaaccaaggctagagaagtac

SEQ ID NO: 1195973 - DNA, 22 bp, Artificial Sequence
  chemically synthesized
tgcattcttcacgtacttctct

SEQ ID NO: 1195974 - DNA, 22 bp, Artificial Sequence
  chemically synthesized
ctgcattcttcacgtacttctc

SEQ ID NO: 1195975 - DNA, 22 bp, Artificial Sequence
  chemically synthesized
aggcttctgcattcttcacgta

SEQ ID NO: 1195976 - DNA, 22 bp, Artificial Sequence
  chemically synthesized
ctgaggcttctgcattcttcac

SEQ ID NO: 1195977 - DNA, 22 bp, Artificial Sequence
  chemically synthesized
gagaagtacgtgaagaatgcag

SEQ ID NO: 1195978 - DNA, 22 bp, Artificial Sequence
  chemically synthesized
atcgcatcggctcctgaggctt

SEQ ID NO: 1195979 - DNA, 22 bp, Artificial Sequence
  chemically synthesized
cagttgatcgcatcggctcctg

SEQ ID NO: 1195980 - DNA, 22 bp, Artificial Sequence
  chemically synthesized
ccagttgatcgcatcggctcct

SEQ ID NO: 1195981 - DNA, 22 bp, Artificial Sequence
  chemically synthesized
ttccagttgatcgcatcggctc

SEQ ID NO: 1195982 - DNA, 22 bp, Artificial Sequence
  chemically synthesized
cttccagttgatcgcatcggct

SEQ ID NO: 1195983 - DNA, 22 bp, Artificial Sequence
  chemically synthesized
tcttccagttgatcgcatcggc

SEQ ID NO: 1195984 - DNA, 22 bp, Artificial Sequence
  chemically synthesized
aggagccgatgcgatcaactgg

SEQ ID NO: 1195985 - DNA, 22 bp, Artificial Sequence
  chemically synthesized
ataccctttcttccagttgatc

SEQ ID NO: 1195986 - DNA, 22 bp, Artificial Sequence
  chemically synthesized
catcactgataccctttcttcc

SEQ ID NO: 1195987 - DNA, 22 bp, Artificial Sequence
  chemically synthesized
ccatcactgataccctttcttc

SEQ ID NO: 1195988 - DNA, 22 bp, Artificial Sequence
  chemically synthesized
atcttccatcactgataccctt

SEQ ID NO: 1195989 - DNA, 22 bp, Artificial Sequence
  chemically synthesized
catcttccatcactgataccct

SEQ ID NO: 1195990 - DNA, 22 bp, Artificial Sequence
  chemically synthesized
atttcatcttccatcactgata

SEQ ID NO: 1195991 - DNA, 22 bp, Artificial Sequence
  chemically synthesized
gaagaaagggtatcagtgatgg

SEQ ID NO: 1195992 - DNA, 22 bp, Artificial Sequence
  chemically synthesized
attaatttcatcttccatcact

SEQ ID NO: 1195993 - DNA, 22 bp, Artificial Sequence
  chemically synthesized
cattaatttcatcttccatcac

SEQ ID NO: 1195994 - DNA, 22 bp, Artificial Sequence
  chemically synthesized
atttcattaatttcatcttcca

SEQ ID NO: 1195995 - DNA, 22 bp, Artificial Sequence
  chemically synthesized
ggttcatttcattaatttcatc

SEQ ID NO: 1195996 - DNA, 22 bp, Artificial Sequence
  chemically synthesized
tcggttcatttcattaatttca

SEQ ID NO: 1195997 - DNA, 22 bp, Artificial Sequence
  chemically synthesized
ctcggttcatttcattaatttc

SEQ ID NO: 1195998 - DNA, 22 bp, Artificial Sequence
  chemically synthesized
ccttctcggttcatttcattaa

SEQ ID NO: 1195999 - DNA, 22 bp, Artificial Sequence
  chemically synthesized
cccttctcggttcatttcatta

SEQ ID NO: 1196000 - DNA, 22 bp, Artificial Sequence
  chemically synthesized
aacttcccttctcggttcattt

SEQ ID NO: 1196001 - DNA, 22 bp, Artificial Sequence
  chemically synthesized
taaacttcccttctcggttcat

SEQ ID NO: 1196002 - DNA, 22 bp, Artificial Sequence
  chemically synthesized
ctctaaacttcccttctcggtt

SEQ ID NO: 1196003 - DNA, 22 bp, Artificial Sequence
  chemically synthesized
cctctaaacttcccttctcggt

SEQ ID NO: 1196004 - DNA, 22 bp, Artificial Sequence
  chemically synthesized
tcctctaaacttcccttctcgg

SEQ ID NO: 1196005 - DNA, 22 bp, Artificial Sequence
  chemically synthesized
ttcctctaaacttcccttctcg

SEQ ID NO: 1196006 - DNA, 22 bp, Artificial Sequence
  chemically synthesized
atgaaatgaaccgagaagggaa

SEQ ID NO: 1196007 - DNA, 22 bp, Artificial Sequence
  chemically synthesized
tttcctctaaacttcccttctc

SEQ ID NO: 1196008 - DNA, 22 bp, Artificial Sequence
  chemically synthesized
tttttcctctaaacttcccttc

SEQ ID NO: 1196009 - DNA, 22 bp, Artificial Sequence
  chemically synthesized
ttctttttcctctaaacttccc

SEQ ID NO: 1196010 - DNA, 22 bp, Artificial Sequence
  chemically synthesized
attctttttcctctaaacttcc

SEQ ID NO: 1196011 - DNA, 22 bp, Artificial Sequence
  chemically synthesized
tattctttttcctctaaacttc

SEQ ID NO: 1196012 - DNA, 22 bp, Artificial Sequence
  chemically synthesized
ttattctttttcctctaaactt

SEQ ID NO: 1196013 - DNA, 22 bp, Artificial Sequence
  chemically synthesized
tttattctttttcctctaaact

SEQ ID NO: 1196014 - DNA, 22 bp, Artificial Sequence
  chemically synthesized
tttttattctttttcctctaaa

SEQ ID NO: 1196015 - DNA, 22 bp, Artificial Sequence
  chemically synthesized
ctttttattctttttcctctaa

SEQ ID NO: 1196016 - DNA, 22 bp, Artificial Sequence
  chemically synthesized
atttctttttattctttttcct

SEQ ID NO: 1196017 - DNA, 22 bp, Artificial Sequence
  chemically synthesized
ctcatttctttttattcttttt

SEQ ID NO: 1196018 - DNA, 22 bp, Artificial Sequence
  chemically synthesized
gctcatttctttttattctttt

SEQ ID NO: 1196019 - DNA, 22 bp, Artificial Sequence
  chemically synthesized
tgctcatttctttttattcttt

SEQ ID NO: 1196020 - DNA, 22 bp, Artificial Sequence
  chemically synthesized
agaggaaaaagaataaaaagaa

SEQ ID NO: 1196021 - DNA, 22 bp, Artificial Sequence
  chemically synthesized
gaggaaaaagaataaaaagaaa

SEQ ID NO: 1196022 - DNA, 22 bp, Artificial Sequence
  chemically synthesized
gaggctttgctcatttcttttt

SEQ ID NO: 1196023 - DNA, 22 bp, Artificial Sequence
  chemically synthesized
ggaggctttgctcatttctttt

SEQ ID NO: 1196024 - DNA, 22 bp, Artificial Sequence
  chemically synthesized
ttggaggctttgctcatttctt

SEQ ID NO: 1196025 - DNA, 22 bp, Artificial Sequence
  chemically synthesized
cttggaggctttgctcatttct

SEQ ID NO: 1196026 - DNA, 22 bp, Artificial Sequence
  chemically synthesized
acatagtcccatatttcttgga

SEQ ID NO: 1196027 - DNA, 22 bp, Artificial Sequence
  chemically synthesized
cacatagtcccatatttcttgg

SEQ ID NO: 1196028 - DNA, 22 bp, Artificial Sequence
  chemically synthesized
tcacatagtcccatatttcttg

SEQ ID NO: 1196029 - DNA, 22 bp, Artificial Sequence
  chemically synthesized
ttcacatagtcccatatttctt

SEQ ID NO: 1196030 - DNA, 22 bp, Artificial Sequence
  chemically synthesized
gtcttttcacatagtcccatat

SEQ ID NO: 1196031 - DNA, 22 bp, Artificial Sequence
  chemically synthesized
ggtcttttcacatagtcccata

SEQ ID NO: 1196032 - DNA, 22 bp, Artificial Sequence
  chemically synthesized
caagaaatatgggactatgtga

SEQ ID NO: 1196033 - DNA, 22 bp, Artificial Sequence
  chemically synthesized
tgtgaaaagaccaaatctacgt

SEQ ID NO: 1196034 - DNA, 22 bp, Artificial Sequence
  chemically synthesized
aggtacaccaatcagacgtaga

SEQ ID NO: 1196035 - DNA, 22 bp, Artificial Sequence
  chemically synthesized
caggtacaccaatcagacgtag

SEQ ID NO: 1196036 - DNA, 22 bp, Artificial Sequence
  chemically synthesized
tcaggtacaccaatcagacgta

SEQ ID NO: 1196037 - DNA, 22 bp, Artificial Sequence
  chemically synthesized
cccatcactttcaggtacacca

SEQ ID NO: 1196038 - DNA, 22 bp, Artificial Sequence
  chemically synthesized
tccccatcactttcaggtacac

SEQ ID NO: 1196039 - DNA, 22 bp, Artificial Sequence
  chemically synthesized
cgtctgattggtgtacctgaaa

SEQ ID NO: 1196040 - DNA, 22 bp, Artificial Sequence
  chemically synthesized
cattctccccatcactttcagg

SEQ ID NO: 1196041 - DNA, 22 bp, Artificial Sequence
  chemically synthesized
attggtgtacctgaaagtgatg

SEQ ID NO: 1196042 - DNA, 22 bp, Artificial Sequence
  chemically synthesized
gttccattctccccatcacttt

SEQ ID NO: 1196043 - DNA, 22 bp, Artificial Sequence
  chemically synthesized
gtgtacctgaaagtgatgggga

SEQ ID NO: 1196044 - DNA, 22 bp, Artificial Sequence
  chemically synthesized
caaattggttccattctcccca

SEQ ID NO: 1196045 - DNA, 22 bp, Artificial Sequence
  chemically synthesized
ccaaattggttccattctcccc

SEQ ID NO: 1196046 - DNA, 22 bp, Artificial Sequence
  chemically synthesized
tccaaattggttccattctccc

SEQ ID NO: 1196047 - DNA, 22 bp, Artificial Sequence
  chemically synthesized
aaagtgatggggagaatggaac

SEQ ID NO: 1196048 - DNA, 22 bp, Artificial Sequence
  chemically synthesized
cagagtgttttccaaattggtt

SEQ ID NO: 1196049 - DNA, 22 bp, Artificial Sequence
  chemically synthesized
gataatatcctgcagagtgttt

SEQ ID NO: 1196050 - DNA, 22 bp, Artificial Sequence
  chemically synthesized
ctggataatatcctgcagagtg

SEQ ID NO: 1196051 - DNA, 22 bp, Artificial Sequence
  chemically synthesized
tcctggataatatcctgcagag

SEQ ID NO: 1196052 - DNA, 22 bp, Artificial Sequence
  chemically synthesized
ggaaaacactctgcaggatatt

SEQ ID NO: 1196053 - DNA, 22 bp, Artificial Sequence
  chemically synthesized
gaaaacactctgcaggatatta

SEQ ID NO: 1196054 - DNA, 22 bp, Artificial Sequence
  chemically synthesized
gggaagttctcctggataatat

SEQ ID NO: 1196055 - DNA, 22 bp, Artificial Sequence
  chemically synthesized
gattggggaagttctcctggat

SEQ ID NO: 1196056 - DNA, 22 bp, Artificial Sequence
  chemically synthesized
tgcaggatattatccaggagaa

SEQ ID NO: 1196057 - DNA, 22 bp, Artificial Sequence
  chemically synthesized
caggatattatccaggagaact

SEQ ID NO: 1196058 - DNA, 22 bp, Artificial Sequence
  chemically synthesized
ctagattggggaagttctcctg

SEQ ID NO: 1196059 - DNA, 22 bp, Artificial Sequence
  chemically synthesized
gctagattggggaagttctcct

SEQ ID NO: 1196060 - DNA, 22 bp, Artificial Sequence
  chemically synthesized
ccttgctagattggggaagttc

SEQ ID NO: 1196061 - DNA, 22 bp, Artificial Sequence
  chemically synthesized
tccaggagaacttccccaatct

SEQ ID NO: 1196062 - DNA, 22 bp, Artificial Sequence
  chemically synthesized
gcctgccttgctagattgggga

SEQ ID NO: 1196063 - DNA, 22 bp, Artificial Sequence
  chemically synthesized
aatgttggcctgccttgctaga

SEQ ID NO: 1196064 - DNA, 22 bp, Artificial Sequence
  chemically synthesized
ccccaatctagcaaggcaggcc

SEQ ID NO: 1196065 - DNA, 22 bp, Artificial Sequence
  chemically synthesized
aatctgaatgttggcctgcctt

SEQ ID NO: 1196066 - DNA, 22 bp, Artificial Sequence
  chemically synthesized
cccaatctagcaaggcaggcca

SEQ ID NO: 1196067 - DNA, 22 bp, Artificial Sequence
  chemically synthesized
ctgaatctgaatgttggcctgc

SEQ ID NO: 1196068 - DNA, 22 bp, Artificial Sequence
  chemically synthesized
cctgaatctgaatgttggcctg

SEQ ID NO: 1196069 - DNA, 22 bp, Artificial Sequence
  chemically synthesized
tatttcctgaatctgaatgttg

SEQ ID NO: 1196070 - DNA, 22 bp, Artificial Sequence
  chemically synthesized
gcaaggcaggccaacattcaga

SEQ ID NO: 1196071 - DNA, 22 bp, Artificial Sequence
  chemically synthesized
tgtatttcctgaatctgaatgt

SEQ ID NO: 1196072 - DNA, 22 bp, Artificial Sequence
  chemically synthesized
tctgtatttcctgaatctgaat

SEQ ID NO: 1196073 - DNA, 22 bp, Artificial Sequence
  chemically synthesized
tggcattctctgtatttcctga

SEQ ID NO: 1196074 - DNA, 22 bp, Artificial Sequence
  chemically synthesized
gtggcattctctgtatttcctg

SEQ ID NO: 1196075 - DNA, 22 bp, Artificial Sequence
  chemically synthesized
tgtggcattctctgtatttcct

SEQ ID NO: 1196076 - DNA, 22 bp, Artificial Sequence
  chemically synthesized
agattcaggaaatacagagaat

SEQ ID NO: 1196077 - DNA, 22 bp, Artificial Sequence
  chemically synthesized
aggaaatacagagaatgccaca

SEQ ID NO: 1196078 - DNA, 22 bp, Artificial Sequence
  chemically synthesized
gaggagtatctttgtggcattc

SEQ ID NO: 1196079 - DNA, 22 bp, Artificial Sequence
  chemically synthesized
tcgaggagtatctttgtggcat

SEQ ID NO: 1196080 - DNA, 22 bp, Artificial Sequence
  chemically synthesized
ctcgaggagtatctttgtggca

SEQ ID NO: 1196081 - DNA, 22 bp, Artificial Sequence
  chemically synthesized
ttctcgaggagtatctttgtgg

SEQ ID NO: 1196082 - DNA, 22 bp, Artificial Sequence
  chemically synthesized
ctcttctcgaggagtatctttg

SEQ ID NO: 1196083 - DNA, 22 bp, Artificial Sequence
  chemically synthesized
gagttgctcttctcgaggagta

SEQ ID NO: 1196084 - DNA, 22 bp, Artificial Sequence
  chemically synthesized
ggagttgctcttctcgaggagt

SEQ ID NO: 1196085 - DNA, 22 bp, Artificial Sequence
  chemically synthesized
tgtgtcttggagttgctcttct

SEQ ID NO: 1196086 - DNA, 22 bp, Artificial Sequence
  chemically synthesized
acaattatgtgtcttggagttg

SEQ ID NO: 1196087 - DNA, 22 bp, Artificial Sequence
  chemically synthesized
ctcgagaagagcaactccaaga

SEQ ID NO: 1196088 - DNA, 22 bp, Artificial Sequence
  chemically synthesized
gagaagagcaactccaagacac

SEQ ID NO: 1196089 - DNA, 22 bp, Artificial Sequence
  chemically synthesized
gtgaatctgacaattatgtgtc

SEQ ID NO: 1196090 - DNA, 22 bp, Artificial Sequence
  chemically synthesized
ggtgaatctgacaattatgtgt

SEQ ID NO: 1196091 - DNA, 22 bp, Artificial Sequence
  chemically synthesized
tggtgaatctgacaattatgtg

SEQ ID NO: 1196092 - DNA, 22 bp, Artificial Sequence
  chemically synthesized
aactttggtgaatctgacaatt

SEQ ID NO: 1196093 - DNA, 22 bp, Artificial Sequence
  chemically synthesized
caactttggtgaatctgacaat

SEQ ID NO: 1196094 - DNA, 22 bp, Artificial Sequence
  chemically synthesized
caagacacataattgtcagatt

SEQ ID NO: 1196095 - DNA, 22 bp, Artificial Sequence
  chemically synthesized
atttcaactttggtgaatctga

SEQ ID NO: 1196096 - DNA, 22 bp, Artificial Sequence
  chemically synthesized
catttcaactttggtgaatctg

SEQ ID NO: 1196097 - DNA, 22 bp, Artificial Sequence
  chemically synthesized
cttcatttcaactttggtgaat

SEQ ID NO: 1196098 - DNA, 22 bp, Artificial Sequence
  chemically synthesized
ccttcatttcaactttggtgaa

SEQ ID NO: 1196099 - DNA, 22 bp, Artificial Sequence
  chemically synthesized
tccttcatttcaactttggtga

SEQ ID NO: 1196100 - DNA, 22 bp, Artificial Sequence
  chemically synthesized
ttccttcatttcaactttggtg

SEQ ID NO: 1196101 - DNA, 22 bp, Artificial Sequence
  chemically synthesized
tttccttcatttcaactttggt

SEQ ID NO: 1196102 - DNA, 22 bp, Artificial Sequence
  chemically synthesized
tcagattcaccaaagttgaaat

SEQ ID NO: 1196103 - DNA, 22 bp, Artificial Sequence
  chemically synthesized
acactttttccttcatttcaac

SEQ ID NO: 1196104 - DNA, 22 bp, Artificial Sequence
  chemically synthesized
aacactttttccttcatttcaa

SEQ ID NO: 1196105 - DNA, 22 bp, Artificial Sequence
  chemically synthesized
accaaagttgaaatgaaggaaa

SEQ ID NO: 1196106 - DNA, 22 bp, Artificial Sequence
  chemically synthesized
cccttaacactttttccttcat

SEQ ID NO: 1196107 - DNA, 22 bp, Artificial Sequence
  chemically synthesized
gctgcccttaacactttttcct

SEQ ID NO: 1196108 - DNA, 22 bp, Artificial Sequence
  chemically synthesized
tggctgcccttaacactttttc

SEQ ID NO: 1196109 - DNA, 22 bp, Artificial Sequence
  chemically synthesized
tctggctgcccttaacactttt

SEQ ID NO: 1196110 - DNA, 22 bp, Artificial Sequence
  chemically synthesized
aaatgaaggaaaaagtgttaag

SEQ ID NO: 1196111 - DNA, 22 bp, Artificial Sequence
  chemically synthesized
tctctggctgcccttaacactt

SEQ ID NO: 1196112 - DNA, 22 bp, Artificial Sequence
  chemically synthesized
ctctctggctgcccttaacact

SEQ ID NO: 1196113 - DNA, 22 bp, Artificial Sequence
  chemically synthesized
tctctctggctgcccttaacac

SEQ ID NO: 1196114 - DNA, 22 bp, Artificial Sequence
  chemically synthesized
agggtaacccgacctttctctc

SEQ ID NO: 1196115 - DNA, 22 bp, Artificial Sequence
  chemically synthesized
gagggtaacccgacctttctct

SEQ ID NO: 1196116 - DNA, 22 bp, Artificial Sequence
  chemically synthesized
agggcagccagagagaaaggtc

SEQ ID NO: 1196117 - DNA, 22 bp, Artificial Sequence
  chemically synthesized
tgagggtaacccgacctttctc

SEQ ID NO: 1196118 - DNA, 22 bp, Artificial Sequence
  chemically synthesized
cctttgagggtaacccgacctt

SEQ ID NO: 1196119 - DNA, 22 bp, Artificial Sequence
  chemically synthesized
ccctttgagggtaacccgacct

SEQ ID NO: 1196120 - DNA, 22 bp, Artificial Sequence
  chemically synthesized
gtgtgatgggcttccctttgag

SEQ ID NO: 1196121 - DNA, 22 bp, Artificial Sequence
  chemically synthesized
ttagtgtgatgggcttcccttt

SEQ ID NO: 1196122 - DNA, 22 bp, Artificial Sequence
  chemically synthesized
ccctcaaagggaagcccatcac

SEQ ID NO: 1196123 - DNA, 22 bp, Artificial Sequence
  chemically synthesized
aaagggaagcccatcacactaa

SEQ ID NO: 1196124 - DNA, 22 bp, Artificial Sequence
  chemically synthesized
ccgagagatccgctgttagtgt

SEQ ID NO: 1196125 - DNA, 22 bp, Artificial Sequence
  chemically synthesized
tagggtgtctgccgagagatcc

SEQ ID NO: 1196126 - DNA, 22 bp, Artificial Sequence
  chemically synthesized
gtagggtgtctgccgagagatc

SEQ ID NO: 1196127 - DNA, 22 bp, Artificial Sequence
  chemically synthesized
gcttgtagggtgtctgccgaga

SEQ ID NO: 1196128 - DNA, 22 bp, Artificial Sequence
  chemically synthesized
acagcggatctctcggcagaca

SEQ ID NO: 1196129 - DNA, 22 bp, Artificial Sequence
  chemically synthesized
tggcttgtagggtgtctgccga

SEQ ID NO: 1196130 - DNA, 22 bp, Artificial Sequence
  chemically synthesized
ctggcttgtagggtgtctgccg

SEQ ID NO: 1196131 - DNA, 22 bp, Artificial Sequence
  chemically synthesized
ttctggcttgtagggtgtctgc

SEQ ID NO: 1196132 - DNA, 22 bp, Artificial Sequence
  chemically synthesized
tcttctggcttgtagggtgtct

SEQ ID NO: 1196133 - DNA, 22 bp, Artificial Sequence
  chemically synthesized
tcggcagacaccctacaagcca

SEQ ID NO: 1196134 - DNA, 22 bp, Artificial Sequence
  chemically synthesized
ggcagacaccctacaagccaga

SEQ ID NO: 1196135 - DNA, 22 bp, Artificial Sequence
  chemically synthesized
gcccccactctcttctggcttg

SEQ ID NO: 1196136 - DNA, 22 bp, Artificial Sequence
  chemically synthesized
aatattggcccccactctcttc

SEQ ID NO: 1196137 - DNA, 22 bp, Artificial Sequence
  chemically synthesized
caagccagaagagagtgggggc

SEQ ID NO: 1196138 - DNA, 22 bp, Artificial Sequence
  chemically synthesized
agaatgttgaatattggccccc

SEQ ID NO: 1196139 - DNA, 22 bp, Artificial Sequence
  chemically synthesized
aagaatgttgaatattggcccc

SEQ ID NO: 1196140 - DNA, 22 bp, Artificial Sequence
  chemically synthesized
taagaatgttgaatattggccc

SEQ ID NO: 1196141 - DNA, 22 bp, Artificial Sequence
  chemically synthesized
tttaagaatgttgaatattggc

SEQ ID NO: 1196142 - DNA, 22 bp, Artificial Sequence
  chemically synthesized
ctttaagaatgttgaatattgg

SEQ ID NO: 1196143 - DNA, 22 bp, Artificial Sequence
  chemically synthesized
tctttaagaatgttgaatattg

SEQ ID NO: 1196144 - DNA, 22 bp, Artificial Sequence
  chemically synthesized
ttctttaagaatgttgaatatt

SEQ ID NO: 1196145 - DNA, 22 bp, Artificial Sequence
  chemically synthesized
ttttctttaagaatgttgaata

SEQ ID NO: 1196146 - DNA, 22 bp, Artificial Sequence
  chemically synthesized
aaaattcttttctttaagaatg

SEQ ID NO: 1196147 - DNA, 22 bp, Artificial Sequence
  chemically synthesized
ggttgaaaattcttttctttaa

SEQ ID NO: 1196148 - DNA, 22 bp, Artificial Sequence
  chemically synthesized
tgggttgaaaattcttttcttt

SEQ ID NO: 1196149 - DNA, 22 bp, Artificial Sequence
  chemically synthesized
aacattcttaaagaaaagaatt

SEQ ID NO: 1196150 - DNA, 22 bp, Artificial Sequence
  chemically synthesized
ttaaagaaaagaattttcaacc

SEQ ID NO: 1196151 - DNA, 22 bp, Artificial Sequence
  chemically synthesized
aaagaaaagaattttcaaccca

SEQ ID NO: 1196152 - DNA, 22 bp, Artificial Sequence
  chemically synthesized
gatgtgaaattctgggttgaaa

SEQ ID NO: 1196153 - DNA, 22 bp, Artificial Sequence
  chemically synthesized
aagaaaagaattttcaacccag

SEQ ID NO: 1196154 - DNA, 22 bp, Artificial Sequence
  chemically synthesized
cctggatgtgaaattctgggtt

SEQ ID NO: 1196155 - DNA, 22 bp, Artificial Sequence
  chemically synthesized
gcctggatgtgaaattctgggt

SEQ ID NO: 1196156 - DNA, 22 bp, Artificial Sequence
  chemically synthesized
gtttgcctggatgtgaaattct

SEQ ID NO: 1196157 - DNA, 22 bp, Artificial Sequence
  chemically synthesized
agtttgcctggatgtgaaattc

SEQ ID NO: 1196158 - DNA, 22 bp, Artificial Sequence
  chemically synthesized
tcaacccagaatttcacatcca

SEQ ID NO: 1196159 - DNA, 22 bp, Artificial Sequence
  chemically synthesized
caacccagaatttcacatccag

SEQ ID NO: 1196160 - DNA, 22 bp, Artificial Sequence
  chemically synthesized
aacccagaatttcacatccagg

SEQ ID NO: 1196161 - DNA, 22 bp, Artificial Sequence
  chemically synthesized
tgaagcttagtttgcctggatg

SEQ ID NO: 1196162 - DNA, 22 bp, Artificial Sequence
  chemically synthesized
atgaagcttagtttgcctggat

SEQ ID NO: 1196163 - DNA, 22 bp, Artificial Sequence
  chemically synthesized
cttatgaagcttagtttgcctg

SEQ ID NO: 1196164 - DNA, 22 bp, Artificial Sequence
  chemically synthesized
acttatgaagcttagtttgcct

SEQ ID NO: 1196165 - DNA, 22 bp, Artificial Sequence
  chemically synthesized
tacttatgaagcttagtttgcc

SEQ ID NO: 1196166 - DNA, 22 bp, Artificial Sequence
  chemically synthesized
ctttacttatgaagcttagttt

SEQ ID NO: 1196167 - DNA, 22 bp, Artificial Sequence
  chemically synthesized
cacatccaggcaaactaagctt

SEQ ID NO: 1196168 - DNA, 22 bp, Artificial Sequence
  chemically synthesized
acatccaggcaaactaagcttc

SEQ ID NO: 1196169 - DNA, 22 bp, Artificial Sequence
  chemically synthesized
tcctttacttatgaagcttagt

SEQ ID NO: 1196170 - DNA, 22 bp, Artificial Sequence
  chemically synthesized
ctcctttacttatgaagcttag

SEQ ID NO: 1196171 - DNA, 22 bp, Artificial Sequence
  chemically synthesized
tttctcctttacttatgaagct

SEQ ID NO: 1196172 - DNA, 22 bp, Artificial Sequence
  chemically synthesized
atttctcctttacttatgaagc

SEQ ID NO: 1196173 - DNA, 22 bp, Artificial Sequence
  chemically synthesized
tatttctcctttacttatgaag

SEQ ID NO: 1196174 - DNA, 22 bp, Artificial Sequence
  chemically synthesized
agcttcataagtaaaggagaaa

SEQ ID NO: 1196175 - DNA, 22 bp, Artificial Sequence
  chemically synthesized
tagagtattttatttctccttt

SEQ ID NO: 1196176 - DNA, 22 bp, Artificial Sequence
  chemically synthesized
tctgtagagtattttatttctc

SEQ ID NO: 1196177 - DNA, 22 bp, Artificial Sequence
  chemically synthesized
cataagtaaaggagaaataaaa

SEQ ID NO: 1196178 - DNA, 22 bp, Artificial Sequence
  chemically synthesized
gtctgtagagtattttatttct

SEQ ID NO: 1196179 - DNA, 22 bp, Artificial Sequence
  chemically synthesized
ataagtaaaggagaaataaaat

SEQ ID NO: 1196180 - DNA, 22 bp, Artificial Sequence
  chemically synthesized
cttgtctgtagagtattttatt

SEQ ID NO: 1196181 - DNA, 22 bp, Artificial Sequence
  chemically synthesized
gcttgtctgtagagtattttat

SEQ ID NO: 1196182 - DNA, 22 bp, Artificial Sequence
  chemically synthesized
agcatttgcttgtctgtagagt

SEQ ID NO: 1196183 - DNA, 22 bp, Artificial Sequence
  chemically synthesized
tcagcatttgcttgtctgtaga

SEQ ID NO: 1196184 - DNA, 22 bp, Artificial Sequence
  chemically synthesized
tacagacaagcaaatgctgaga

SEQ ID NO: 1196185 - DNA, 22 bp, Artificial Sequence
  chemically synthesized
cagacaagcaaatgctgagaga

SEQ ID NO: 1196186 - DNA, 22 bp, Artificial Sequence
  chemically synthesized
gtggtgacaaaatctctcagca

SEQ ID NO: 1196187 - DNA, 22 bp, Artificial Sequence
  chemically synthesized
gggcaggcctggtggtgacaaa

SEQ ID NO: 1196188 - DNA, 22 bp, Artificial Sequence
  chemically synthesized
agggcaggcctggtggtgacaa

SEQ ID NO: 1196189 - DNA, 22 bp, Artificial Sequence
  chemically synthesized
tagggcaggcctggtggtgaca

SEQ ID NO: 1196190 - DNA, 22 bp, Artificial Sequence
  chemically synthesized
ttagggcaggcctggtggtgac

SEQ ID NO: 1196191 - DNA, 22 bp, Artificial Sequence
  chemically synthesized
ttttagggcaggcctggtggtg

SEQ ID NO: 1196192 - DNA, 22 bp, Artificial Sequence
  chemically synthesized
agagattttgtcaccaccaggc

SEQ ID NO: 1196193 - DNA, 22 bp, Artificial Sequence
  chemically synthesized
aggagctcttttagggcaggcc

SEQ ID NO: 1196194 - DNA, 22 bp, Artificial Sequence
  chemically synthesized
tgtcaccaccaggcctgcccta

SEQ ID NO: 1196195 - DNA, 22 bp, Artificial Sequence
  chemically synthesized
caggagctcttttagggcaggc

SEQ ID NO: 1196196 - DNA, 22 bp, Artificial Sequence
  chemically synthesized
gtcaccaccaggcctgccctaa

SEQ ID NO: 1196197 - DNA, 22 bp, Artificial Sequence
  chemically synthesized
tcaccaccaggcctgccctaaa

SEQ ID NO: 1196198 - DNA, 22 bp, Artificial Sequence
  chemically synthesized
cttcaggagctcttttagggca

SEQ ID NO: 1196199 - DNA, 22 bp, Artificial Sequence
  chemically synthesized
ccttcaggagctcttttagggc

SEQ ID NO: 1196200 - DNA, 22 bp, Artificial Sequence
  chemically synthesized
gcgcttccttcaggagctcttt

SEQ ID NO: 1196201 - DNA, 22 bp, Artificial Sequence
  chemically synthesized
agcgcttccttcaggagctctt

SEQ ID NO: 1196202 - DNA, 22 bp, Artificial Sequence
  chemically synthesized
ccctaaaagagctcctgaagga

SEQ ID NO: 1196203 - DNA, 22 bp, Artificial Sequence
  chemically synthesized
catgtttagcgcttccttcagg

SEQ ID NO: 1196204 - DNA, 22 bp, Artificial Sequence
  chemically synthesized
ccatgtttagcgcttccttcag

SEQ ID NO: 1196205 - DNA, 22 bp, Artificial Sequence
  chemically synthesized
tccatgtttagcgcttccttca

SEQ ID NO: 1196206 - DNA, 22 bp, Artificial Sequence
  chemically synthesized
aaagagctcctgaaggaagcgc

SEQ ID NO: 1196207 - DNA, 22 bp, Artificial Sequence
  chemically synthesized
ctttccatgtttagcgcttcct

SEQ ID NO: 1196208 - DNA, 22 bp, Artificial Sequence
  chemically synthesized
ttcctttccatgtttagcgctt

SEQ ID NO: 1196209 - DNA, 22 bp, Artificial Sequence
  chemically synthesized
ctgaaggaagcgctaaacatgg

SEQ ID NO: 1196210 - DNA, 22 bp, Artificial Sequence
  chemically synthesized
aaggaagcgctaaacatggaaa

SEQ ID NO: 1196211 - DNA, 22 bp, Artificial Sequence
  chemically synthesized
gtaccggttgttcctttccatg

SEQ ID NO: 1196212 - DNA, 22 bp, Artificial Sequence
  chemically synthesized
cagcggctggtaccggttgttc

SEQ ID NO: 1196213 - DNA, 22 bp, Artificial Sequence
  chemically synthesized
aacatggaaaggaacaaccggt

SEQ ID NO: 1196214 - DNA, 22 bp, Artificial Sequence
  chemically synthesized
gcagcggctggtaccggttgtt

SEQ ID NO: 1196215 - DNA, 22 bp, Artificial Sequence
  chemically synthesized
tgcagcggctggtaccggttgt

SEQ ID NO: 1196216 - DNA, 22 bp, Artificial Sequence
  chemically synthesized
gcatgattttgcagcggctggt

SEQ ID NO: 1196217 - DNA, 22 bp, Artificial Sequence
  chemically synthesized
ggcatgattttgcagcggctgg

SEQ ID NO: 1196218 - DNA, 22 bp, Artificial Sequence
  chemically synthesized
tggcatgattttgcagcggctg

SEQ ID NO: 1196219 - DNA, 22 bp, Artificial Sequence
  chemically synthesized
cattttggcatgattttgcagc

SEQ ID NO: 1196220 - DNA, 22 bp, Artificial Sequence
  chemically synthesized
acattttggcatgattttgcag

SEQ ID NO: 1196221 - DNA, 22 bp, Artificial Sequence
  chemically synthesized
tacattttggcatgattttgca

SEQ ID NO: 1196222 - DNA, 22 bp, Artificial Sequence
  chemically synthesized
aatggtctttacattttggcat

SEQ ID NO: 1196223 - DNA, 22 bp, Artificial Sequence
  chemically synthesized
caaaatcatgccaaaatgtaaa

SEQ ID NO: 1196224 - DNA, 22 bp, Artificial Sequence
  chemically synthesized
gtctcaatggtctttacatttt

SEQ ID NO: 1196225 - DNA, 22 bp, Artificial Sequence
  chemically synthesized
ctagtctcaatggtctttacat

SEQ ID NO: 1196226 - DNA, 22 bp, Artificial Sequence
  chemically synthesized
cctagtctcaatggtctttaca

SEQ ID NO: 1196227 - DNA, 22 bp, Artificial Sequence
  chemically synthesized
ttcctagtctcaatggtcttta

SEQ ID NO: 1196228 - DNA, 22 bp, Artificial Sequence
  chemically synthesized
cttcctagtctcaatggtcttt

SEQ ID NO: 1196229 - DNA, 22 bp, Artificial Sequence
  chemically synthesized
atgcagtttcttcctagtctca

SEQ ID NO: 1196230 - DNA, 22 bp, Artificial Sequence
  chemically synthesized
gttgatgcagtttcttcctagt

SEQ ID NO: 1196231 - DNA, 22 bp, Artificial Sequence
  chemically synthesized
gttagttgatgcagtttcttcc

SEQ ID NO: 1196232 - DNA, 22 bp, Artificial Sequence
  chemically synthesized
ctcgttagttgatgcagtttct

SEQ ID NO: 1196233 - DNA, 22 bp, Artificial Sequence
  chemically synthesized
gctcgttagttgatgcagtttc

SEQ ID NO: 1196234 - DNA, 22 bp, Artificial Sequence
  chemically synthesized
tgctcgttagttgatgcagttt

SEQ ID NO: 1196235 - DNA, 22 bp, Artificial Sequence
  chemically synthesized
agactaggaagaaactgcatca

SEQ ID NO: 1196236 - DNA, 22 bp, Artificial Sequence
  chemically synthesized
ggaagaaactgcatcaactaac

SEQ ID NO: 1196237 - DNA, 22 bp, Artificial Sequence
  chemically synthesized
gtgattttgctcgttagttgat

SEQ ID NO: 1196238 - DNA, 22 bp, Artificial Sequence
  chemically synthesized
gctggtgattttgctcgttagt

SEQ ID NO: 1196239 - DNA, 22 bp, Artificial Sequence
  chemically synthesized
catcaactaacgagcaaaatca

SEQ ID NO: 1196240 - DNA, 22 bp, Artificial Sequence
  chemically synthesized
tgatgttagctggtgattttgc

SEQ ID NO: 1196241 - DNA, 22 bp, Artificial Sequence
  chemically synthesized
tcattatgatgttagctggtga

SEQ ID NO: 1196242 - DNA, 22 bp, Artificial Sequence
  chemically synthesized
acgagcaaaatcaccagctaac

SEQ ID NO: 1196243 - DNA, 22 bp, Artificial Sequence
  chemically synthesized
atcctgtcattatgatgttagc

SEQ ID NO: 1196244 - DNA, 22 bp, Artificial Sequence
  chemically synthesized
gatcctgtcattatgatgttag

SEQ ID NO: 1196245 - DNA, 22 bp, Artificial Sequence
  chemically synthesized
tgtgtgaatttgatcctgtcat

SEQ ID NO: 1196246 - DNA, 22 bp, Artificial Sequence
  chemically synthesized
ttatgtgtgaatttgatcctgt

SEQ ID NO: 1196247 - DNA, 22 bp, Artificial Sequence
  chemically synthesized
acatcataatgacaggatcaaa

SEQ ID NO: 1196248 - DNA, 22 bp, Artificial Sequence
  chemically synthesized
atattgttatgtgtgaatttga

SEQ ID NO: 1196249 - DNA, 22 bp, Artificial Sequence
  chemically synthesized
aggttaatattgttatgtgtga

SEQ ID NO: 1196250 - DNA, 22 bp, Artificial Sequence
  chemically synthesized
aaggttaatattgttatgtgtg

SEQ ID NO: 1196251 - DNA, 22 bp, Artificial Sequence
  chemically synthesized
catttaaggttaatattgttat

SEQ ID NO: 1196252 - DNA, 22 bp, Artificial Sequence
  chemically synthesized
acatttaaggttaatattgtta

SEQ ID NO: 1196253 - DNA, 22 bp, Artificial Sequence
  chemically synthesized
acacataacaatattaacctta

SEQ ID NO: 1196254 - DNA, 22 bp, Artificial Sequence
  chemically synthesized
gcccatttacatttaaggttaa

SEQ ID NO: 1196255 - DNA, 22 bp, Artificial Sequence
  chemically synthesized
agcccatttacatttaaggtta

SEQ ID NO: 1196256 - DNA, 22 bp, Artificial Sequence
  chemically synthesized
gagcatttagcccatttacatt

SEQ ID NO: 1196257 - DNA, 22 bp, Artificial Sequence
  chemically synthesized
gttggagcatttagcccattta

SEQ ID NO: 1196258 - DNA, 22 bp, Artificial Sequence
  chemically synthesized
agttggagcatttagcccattt

SEQ ID NO: 1196259 - DNA, 22 bp, Artificial Sequence
  chemically synthesized
accttaaatgtaaatgggctaa

SEQ ID NO: 1196260 - DNA, 22 bp, Artificial Sequence
  chemically synthesized
tagttggagcatttagcccatt

SEQ ID NO: 1196261 - DNA, 22 bp, Artificial Sequence
  chemically synthesized
ttagttggagcatttagcccat

SEQ ID NO: 1196262 - DNA, 22 bp, Artificial Sequence
  chemically synthesized
aaatgtaaatgggctaaatgct

SEQ ID NO: 1196263 - DNA, 22 bp, Artificial Sequence
  chemically synthesized
aatgtaaatgggctaaatgctc

SEQ ID NO: 1196264 - DNA, 22 bp, Artificial Sequence
  chemically synthesized
tgtcttttagttggagcattta

SEQ ID NO: 1196265 - DNA, 22 bp, Artificial Sequence
  chemically synthesized
ccagtctgtgtcttttagttgg

SEQ ID NO: 1196266 - DNA, 22 bp, Artificial Sequence
  chemically synthesized
aatgctccaactaaaagacaca

SEQ ID NO: 1196267 - DNA, 22 bp, Artificial Sequence
  chemically synthesized
tccaagttgccagtctgtgtct

SEQ ID NO: 1196268 - DNA, 22 bp, Artificial Sequence
  chemically synthesized
atccaagttgccagtctgtgtc

SEQ ID NO: 1196269 - DNA, 22 bp, Artificial Sequence
  chemically synthesized
tatccaagttgccagtctgtgt

SEQ ID NO: 1196270 - DNA, 22 bp, Artificial Sequence
  chemically synthesized
caactaaaagacacagactggc

SEQ ID NO: 1196271 - DNA, 22 bp, Artificial Sequence
  chemically synthesized
tttatccaagttgccagtctgt

SEQ ID NO: 1196272 - DNA, 22 bp, Artificial Sequence
  chemically synthesized
actctttatccaagttgccagt

SEQ ID NO: 1196273 - DNA, 22 bp, Artificial Sequence
  chemically synthesized
gactctttatccaagttgccag

SEQ ID NO: 1196274 - DNA, 22 bp, Artificial Sequence
  chemically synthesized
aaagacacagactggcaacttg

SEQ ID NO: 1196275 - DNA, 22 bp, Artificial Sequence
  chemically synthesized
atgggtcttgactctttatcca

SEQ ID NO: 1196276 - DNA, 22 bp, Artificial Sequence
  chemically synthesized
actgatgggtcttgactcttta

SEQ ID NO: 1196277 - DNA, 22 bp, Artificial Sequence
  chemically synthesized
gcaacttggataaagagtcaag

SEQ ID NO: 1196278 - DNA, 22 bp, Artificial Sequence
  chemically synthesized
ggataaagagtcaagacccatc

SEQ ID NO: 1196279 - DNA, 22 bp, Artificial Sequence
  chemically synthesized
gataaagagtcaagacccatca

SEQ ID NO: 1196280 - DNA, 22 bp, Artificial Sequence
  chemically synthesized
aatacagctcactgatgggtct

SEQ ID NO: 1196281 - DNA, 22 bp, Artificial Sequence
  chemically synthesized
ctgaatacagctcactgatggg

SEQ ID NO: 1196282 - DNA, 22 bp, Artificial Sequence
  chemically synthesized
cctgaatacagctcactgatgg

SEQ ID NO: 1196283 - DNA, 22 bp, Artificial Sequence
  chemically synthesized
cacatgagatgggtttcctgaa

SEQ ID NO: 1196284 - DNA, 22 bp, Artificial Sequence
  chemically synthesized
tgcacatgagatgggtttcctg

SEQ ID NO: 1196285 - DNA, 22 bp, Artificial Sequence
  chemically synthesized
tattcaggaaacccatctcatg

SEQ ID NO: 1196286 - DNA, 22 bp, Artificial Sequence
  chemically synthesized
tgtgtgtctctgcacatgagat

SEQ ID NO: 1196287 - DNA, 22 bp, Artificial Sequence
  chemically synthesized
aggaaacccatctcatgtgcag

SEQ ID NO: 1196288 - DNA, 22 bp, Artificial Sequence
  chemically synthesized
agcctatgtgtgtctctgcaca

SEQ ID NO: 1196289 - DNA, 22 bp, Artificial Sequence
  chemically synthesized
gagcctatgtgtgtctctgcac

SEQ ID NO: 1196290 - DNA, 22 bp, Artificial Sequence
  chemically synthesized
tgagcctatgtgtgtctctgca

SEQ ID NO: 1196291 - DNA, 22 bp, Artificial Sequence
  chemically synthesized
ttttgagcctatgtgtgtctct

SEQ ID NO: 1196292 - DNA, 22 bp, Artificial Sequence
  chemically synthesized
attttgagcctatgtgtgtctc

SEQ ID NO: 1196293 - DNA, 22 bp, Artificial Sequence
  chemically synthesized
tattttgagcctatgtgtgtct

SEQ ID NO: 1196294 - DNA, 22 bp, Artificial Sequence
  chemically synthesized
ttattttgagcctatgtgtgtc

SEQ ID NO: 1196295 - DNA, 22 bp, Artificial Sequence
  chemically synthesized
atgtgcagagacacacataggc

SEQ ID NO: 1196296 - DNA, 22 bp, Artificial Sequence
  chemically synthesized
catccttttattttgagcctat

SEQ ID NO: 1196297 - DNA, 22 bp, Artificial Sequence
  chemically synthesized
ctccatccttttattttgagcc

SEQ ID NO: 1196298 - DNA, 22 bp, Artificial Sequence
  chemically synthesized
cctccatccttttattttgagc

SEQ ID NO: 1196299 - DNA, 22 bp, Artificial Sequence
  chemically synthesized
gtagatcttcctccatcctttt

SEQ ID NO: 1196300 - DNA, 22 bp, Artificial Sequence
  chemically synthesized
ggtagatcttcctccatccttt

SEQ ID NO: 1196301 - DNA, 22 bp, Artificial Sequence
  chemically synthesized
cttggtagatcttcctccatcc

SEQ ID NO: 1196302 - DNA, 22 bp, Artificial Sequence
  chemically synthesized
gcttggtagatcttcctccatc

SEQ ID NO: 1196303 - DNA, 22 bp, Artificial Sequence
  chemically synthesized
aaaataaaaggatggaggaaga

SEQ ID NO: 1196304 - DNA, 22 bp, Artificial Sequence
  chemically synthesized
catttgcttggtagatcttcct

SEQ ID NO: 1196305 - DNA, 22 bp, Artificial Sequence
  chemically synthesized
ccatttgcttggtagatcttcc

SEQ ID NO: 1196306 - DNA, 22 bp, Artificial Sequence
  chemically synthesized
tccatttgcttggtagatcttc

SEQ ID NO: 1196307 - DNA, 22 bp, Artificial Sequence
  chemically synthesized
ttttccatttgcttggtagatc

SEQ ID NO: 1196308 - DNA, 22 bp, Artificial Sequence
  chemically synthesized
gttttccatttgcttggtagat

SEQ ID NO: 1196309 - DNA, 22 bp, Artificial Sequence
  chemically synthesized
tgttttccatttgcttggtaga

SEQ ID NO: 1196310 - DNA, 22 bp, Artificial Sequence
  chemically synthesized
ttgttttccatttgcttggtag

SEQ ID NO: 1196311 - DNA, 22 bp, Artificial Sequence
  chemically synthesized
tttgttttccatttgcttggta

SEQ ID NO: 1196312 - DNA, 22 bp, Artificial Sequence
  chemically synthesized
ttttgttttccatttgcttggt

SEQ ID NO: 1196313 - DNA, 22 bp, Artificial Sequence
  chemically synthesized
tttttgttttccatttgcttgg

SEQ ID NO: 1196314 - DNA, 22 bp, Artificial Sequence
  chemically synthesized
cctttttttgttttccatttgc

SEQ ID NO: 1196315 - DNA, 22 bp, Artificial Sequence
  chemically synthesized
ccaagcaaatggaaaacaaaaa

SEQ ID NO: 1196316 - DNA, 22 bp, Artificial Sequence
  chemically synthesized
caacccctgcctttttttgttt

SEQ ID NO: 1196317 - DNA, 22 bp, Artificial Sequence
  chemically synthesized
ggattgcaacccctgccttttt

SEQ ID NO: 1196318 - DNA, 22 bp, Artificial Sequence
  chemically synthesized
tcagagactaggattgcaaccc

SEQ ID NO: 1196319 - DNA, 22 bp, Artificial Sequence
  chemically synthesized
atcagagactaggattgcaacc

SEQ ID NO: 1196320 - DNA, 22 bp, Artificial Sequence
  chemically synthesized
tatcagagactaggattgcaac

SEQ ID NO: 1196321 - DNA, 22 bp, Artificial Sequence
  chemically synthesized
ttttatcagagactaggattgc

SEQ ID NO: 1196322 - DNA, 22 bp, Artificial Sequence
  chemically synthesized
aagtctgttttatcagagacta

SEQ ID NO: 1196323 - DNA, 22 bp, Artificial Sequence
  chemically synthesized
aaagtctgttttatcagagact

SEQ ID NO: 1196324 - DNA, 22 bp, Artificial Sequence
  chemically synthesized
gtttaaagtctgttttatcaga

SEQ ID NO: 1196325 - DNA, 22 bp, Artificial Sequence
  chemically synthesized
caatcctagtctctgataaaac

SEQ ID NO: 1196326 - DNA, 22 bp, Artificial Sequence
  chemically synthesized
ttggtttaaagtctgttttatc

SEQ ID NO: 1196327 - DNA, 22 bp, Artificial Sequence
  chemically synthesized
gttggtttaaagtctgttttat

SEQ ID NO: 1196328 - DNA, 22 bp, Artificial Sequence
  chemically synthesized
tgttggtttaaagtctgtttta

SEQ ID NO: 1196329 - DNA, 22 bp, Artificial Sequence
  chemically synthesized
gtctctgataaaacagacttta

SEQ ID NO: 1196330 - DNA, 22 bp, Artificial Sequence
  chemically synthesized
atctttgttggtttaaagtctg

SEQ ID NO: 1196331 - DNA, 22 bp, Artificial Sequence
  chemically synthesized
gatctttgttggtttaaagtct

SEQ ID NO: 1196332 - DNA, 22 bp, Artificial Sequence
  chemically synthesized
tgatctttgttggtttaaagtc

SEQ ID NO: 1196333 - DNA, 22 bp, Artificial Sequence
  chemically synthesized
ttgatctttgttggtttaaagt

SEQ ID NO: 1196334 - DNA, 22 bp, Artificial Sequence
  chemically synthesized
tgataaaacagactttaaacca

SEQ ID NO: 1196335 - DNA, 22 bp, Artificial Sequence
  chemically synthesized
ttttgatctttgttggtttaaa

SEQ ID NO: 1196336 - DNA, 22 bp, Artificial Sequence
  chemically synthesized
ataaaacagactttaaaccaac

SEQ ID NO: 1196337 - DNA, 22 bp, Artificial Sequence
  chemically synthesized
tctcttttgatctttgttggtt

SEQ ID NO: 1196338 - DNA, 22 bp, Artificial Sequence
  chemically synthesized
gtctcttttgatctttgttggt

SEQ ID NO: 1196339 - DNA, 22 bp, Artificial Sequence
  chemically synthesized
tgtctcttttgatctttgttgg

SEQ ID NO: 1196340 - DNA, 22 bp, Artificial Sequence
  chemically synthesized
tttgtctcttttgatctttgtt

SEQ ID NO: 1196341 - DNA, 22 bp, Artificial Sequence
  chemically synthesized
ctttgtctcttttgatctttgt

SEQ ID NO: 1196342 - DNA, 22 bp, Artificial Sequence
  chemically synthesized
taaaccaacaaagatcaaaaga

SEQ ID NO: 1196343 - DNA, 22 bp, Artificial Sequence
  chemically synthesized
aaaccaacaaagatcaaaagag

SEQ ID NO: 1196344 - DNA, 22 bp, Artificial Sequence
  chemically synthesized
aaccaacaaagatcaaaagaga

SEQ ID NO: 1196345 - DNA, 22 bp, Artificial Sequence
  chemically synthesized
tgtaatggccttctttgtctct

SEQ ID NO: 1196346 - DNA, 22 bp, Artificial Sequence
  chemically synthesized
ccattatgtaatggccttcttt

SEQ ID NO: 1196347 - DNA, 22 bp, Artificial Sequence
  chemically synthesized
accattatgtaatggccttctt

SEQ ID NO: 1196348 - DNA, 22 bp, Artificial Sequence
  chemically synthesized
taccattatgtaatggccttct

SEQ ID NO: 1196349 - DNA, 22 bp, Artificial Sequence
  chemically synthesized
ctttaccattatgtaatggcct

SEQ ID NO: 1196350 - DNA, 22 bp, Artificial Sequence
  chemically synthesized
attcctttaccattatgtaatg

SEQ ID NO: 1196351 - DNA, 22 bp, Artificial Sequence
  chemically synthesized
aattgattcctttaccattatg

SEQ ID NO: 1196352 - DNA, 22 bp, Artificial Sequence
  chemically synthesized
ttgaattgattcctttaccatt

SEQ ID NO: 1196353 - DNA, 22 bp, Artificial Sequence
  chemically synthesized
ctgttgaattgattcctttacc

SEQ ID NO: 1196354 - DNA, 22 bp, Artificial Sequence
  chemically synthesized
cctgttgaattgattcctttac

SEQ ID NO: 1196355 - DNA, 22 bp, Artificial Sequence
  chemically synthesized
ttcctgttgaattgattccttt

SEQ ID NO: 1196356 - DNA, 22 bp, Artificial Sequence
  chemically synthesized
cataatggtaaaggaatcaatt

SEQ ID NO: 1196357 - DNA, 22 bp, Artificial Sequence
  chemically synthesized
gctcttcctgttgaattgattc

SEQ ID NO: 1196358 - DNA, 22 bp, Artificial Sequence
  chemically synthesized
ggatagttagctcttcctgttg

SEQ ID NO: 1196359 - DNA, 22 bp, Artificial Sequence
  chemically synthesized
aggatagttagctcttcctgtt

SEQ ID NO: 1196360 - DNA, 22 bp, Artificial Sequence
  chemically synthesized
aacaggaagagctaactatcct

SEQ ID NO: 1196361 - DNA, 22 bp, Artificial Sequence
  chemically synthesized
ggtgcatatatatttaggatag

SEQ ID NO: 1196362 - DNA, 22 bp, Artificial Sequence
  chemically synthesized
ttgggtgcatatatatttagga

SEQ ID NO: 1196363 - DNA, 22 bp, Artificial Sequence
  chemically synthesized
gttgggtgcatatatatttagg

SEQ ID NO: 1196364 - DNA, 22 bp, Artificial Sequence
  chemically synthesized
tgttgggtgcatatatatttag

SEQ ID NO: 1196365 - DNA, 22 bp, Artificial Sequence
  chemically synthesized
ctttgttgggtgcatatatatt

SEQ ID NO: 1196366 - DNA, 22 bp, Artificial Sequence
  chemically synthesized
actatcctaaatatatatgcac

SEQ ID NO: 1196367 - DNA, 22 bp, Artificial Sequence
  chemically synthesized
tcctaaatatatatgcacccaa

SEQ ID NO: 1196368 - DNA, 22 bp, Artificial Sequence
  chemically synthesized
ggtgctcctttgttgggtgcat

SEQ ID NO: 1196369 - DNA, 22 bp, Artificial Sequence
  chemically synthesized
aatatatatgcacccaacaaag

SEQ ID NO: 1196370 - DNA, 22 bp, Artificial Sequence
  chemically synthesized
tgaatctgggtgctcctttgtt

SEQ ID NO: 1196371 - DNA, 22 bp, Artificial Sequence
  chemically synthesized
atgaatctgggtgctcctttgt

SEQ ID NO: 1196372 - DNA, 22 bp, Artificial Sequence
  chemically synthesized
tatgaatctgggtgctcctttg

SEQ ID NO: 1196373 - DNA, 22 bp, Artificial Sequence
  chemically synthesized
ctttatgaatctgggtgctcct

SEQ ID NO: 1196374 - DNA, 22 bp, Artificial Sequence
  chemically synthesized
gctttatgaatctgggtgctcc

SEQ ID NO: 1196375 - DNA, 22 bp, Artificial Sequence
  chemically synthesized
aggacttgctttatgaatctgg

SEQ ID NO: 1196376 - DNA, 22 bp, Artificial Sequence
  chemically synthesized
taggtcactcaggacttgcttt

SEQ ID NO: 1196377 - DNA, 22 bp, Artificial Sequence
  chemically synthesized
gtaggtcactcaggacttgctt

SEQ ID NO: 1196378 - DNA, 22 bp, Artificial Sequence
  chemically synthesized
tgtaggtcactcaggacttgct

SEQ ID NO: 1196379 - DNA, 22 bp, Artificial Sequence
  chemically synthesized
tttgtaggtcactcaggacttg

SEQ ID NO: 1196380 - DNA, 22 bp, Artificial Sequence
  chemically synthesized
ataaagcaagtcctgagtgacc

SEQ ID NO: 1196381 - DNA, 22 bp, Artificial Sequence
  chemically synthesized
agtctctttgtaggtcactcag

SEQ ID NO: 1196382 - DNA, 22 bp, Artificial Sequence
  chemically synthesized
agtgacctacaaagagacttag

SEQ ID NO: 1196383 - DNA, 22 bp, Artificial Sequence
  chemically synthesized
atgtgtgggagtctaagtctct

SEQ ID NO: 1196384 - DNA, 22 bp, Artificial Sequence
  chemically synthesized
ttaatgtgtgggagtctaagtc

SEQ ID NO: 1196385 - DNA, 22 bp, Artificial Sequence
  chemically synthesized
caaagagacttagactcccaca

SEQ ID NO: 1196386 - DNA, 22 bp, Artificial Sequence
  chemically synthesized
ccattattaatgtgtgggagtc

SEQ ID NO: 1196387 - DNA, 22 bp, Artificial Sequence
  chemically synthesized
aagtctcccattattaatgtgt

SEQ ID NO: 1196388 - DNA, 22 bp, Artificial Sequence
  chemically synthesized
agactcccacacattaataatg

SEQ ID NO: 1196389 - DNA, 22 bp, Artificial Sequence
  chemically synthesized
gactcccacacattaataatgg

SEQ ID NO: 1196390 - DNA, 22 bp, Artificial Sequence
  chemically synthesized
ccacacattaataatgggagac

SEQ ID NO: 1196391 - DNA, 22 bp, Artificial Sequence
  chemically synthesized
acagtggggtgttaaagtctcc

SEQ ID NO: 1196392 - DNA, 22 bp, Artificial Sequence
  chemically synthesized
ataatgggagactttaacaccc

SEQ ID NO: 1196393 - DNA, 22 bp, Artificial Sequence
  chemically synthesized
atgttgacagtggggtgttaaa

SEQ ID NO: 1196394 - DNA, 22 bp, Artificial Sequence
  chemically synthesized
tctaatgttgacagtggggtgt

SEQ ID NO: 1196395 - DNA, 22 bp, Artificial Sequence
  chemically synthesized
atctgtctaatgttgacagtgg

SEQ ID NO: 1196396 - DNA, 22 bp, Artificial Sequence
  chemically synthesized
gttgatctgtctaatgttgaca

SEQ ID NO: 1196397 - DNA, 22 bp, Artificial Sequence
  chemically synthesized
taacaccccactgtcaacatta

SEQ ID NO: 1196398 - DNA, 22 bp, Artificial Sequence
  chemically synthesized
aacaccccactgtcaacattag

SEQ ID NO: 1196399 - DNA, 22 bp, Artificial Sequence
  chemically synthesized
acaccccactgtcaacattaga

SEQ ID NO: 1196400 - DNA, 22 bp, Artificial Sequence
  chemically synthesized
tctcgttgatctgtctaatgtt

SEQ ID NO: 1196401 - DNA, 22 bp, Artificial Sequence
  chemically synthesized
tgtctcgttgatctgtctaatg

SEQ ID NO: 1196402 - DNA, 22 bp, Artificial Sequence
  chemically synthesized
ctgtctcgttgatctgtctaat

SEQ ID NO: 1196403 - DNA, 22 bp, Artificial Sequence
  chemically synthesized
tctgtctcgttgatctgtctaa

SEQ ID NO: 1196404 - DNA, 22 bp, Artificial Sequence
  chemically synthesized
gctttctgtctcgttgatctgt

SEQ ID NO: 1196405 - DNA, 22 bp, Artificial Sequence
  chemically synthesized
tcaacattagacagatcaacga

SEQ ID NO: 1196406 - DNA, 22 bp, Artificial Sequence
  chemically synthesized
ttggctttctgtctcgttgatc

SEQ ID NO: 1196407 - DNA, 22 bp, Artificial Sequence
  chemically synthesized
gttggctttctgtctcgttgat

SEQ ID NO: 1196408 - DNA, 22 bp, Artificial Sequence
  chemically synthesized
gacagatcaacgagacagaaag

SEQ ID NO: 1196409 - DNA, 22 bp, Artificial Sequence
  chemically synthesized
ggtatccttgttggctttctgt

SEQ ID NO: 1196410 - DNA, 22 bp, Artificial Sequence
  chemically synthesized
ctgggtatccttgttggctttc

SEQ ID NO: 1196411 - DNA, 22 bp, Artificial Sequence
  chemically synthesized
aattcctgggtatccttgttgg

SEQ ID NO: 1196412 - DNA, 22 bp, Artificial Sequence
  chemically synthesized
agttcaattcctgggtatcctt

SEQ ID NO: 1196413 - DNA, 22 bp, Artificial Sequence
  chemically synthesized
gtgcagagctgagttcaattcc

SEQ ID NO: 1196414 - DNA, 22 bp, Artificial Sequence
  chemically synthesized
ggtgcagagctgagttcaattc

SEQ ID NO: 1196415 - DNA, 22 bp, Artificial Sequence
  chemically synthesized
ggtccacttggtgcagagctga

SEQ ID NO: 1196416 - DNA, 22 bp, Artificial Sequence
  chemically synthesized
ttaggtccacttggtgcagagc

SEQ ID NO: 1196417 - DNA, 22 bp, Artificial Sequence
  chemically synthesized
aactcagctctgcaccaagtgg

SEQ ID NO: 1196418 - DNA, 22 bp, Artificial Sequence
  chemically synthesized
tagatgtctattaggtccactt

SEQ ID NO: 1196419 - DNA, 22 bp, Artificial Sequence
  chemically synthesized
agctctgcaccaagtggaccta

SEQ ID NO: 1196420 - DNA, 22 bp, Artificial Sequence
  chemically synthesized
tgtagatgtctattaggtccac

SEQ ID NO: 1196421 - DNA, 22 bp, Artificial Sequence
  chemically synthesized
tgcaccaagtggacctaataga

SEQ ID NO: 1196422 - DNA, 22 bp, Artificial Sequence
  chemically synthesized
caccaagtggacctaatagaca

SEQ ID NO: 1196423 - DNA, 22 bp, Artificial Sequence
  chemically synthesized
gggtggagagttctgtagatgt

SEQ ID NO: 1196424 - DNA, 22 bp, Artificial Sequence
  chemically synthesized
ggggtggagagttctgtagatg

SEQ ID NO: 1196425 - DNA, 22 bp, Artificial Sequence
  chemically synthesized
atttggggtggagagttctgta

SEQ ID NO: 1196426 - DNA, 22 bp, Artificial Sequence
  chemically synthesized
atagacatctacagaactctcc

SEQ ID NO: 1196427 - DNA, 22 bp, Artificial Sequence
  chemically synthesized
ttgatttggggtggagagttct

SEQ ID NO: 1196428 - DNA, 22 bp, Artificial Sequence
  chemically synthesized
tgttgatttggggtggagagtt

SEQ ID NO: 1196429 - DNA, 22 bp, Artificial Sequence
  chemically synthesized
cagaactctccaccccaaatca

SEQ ID NO: 1196430 - DNA, 22 bp, Artificial Sequence
  chemically synthesized
aaaagaatgtatattctgttga

SEQ ID NO: 1196431 - DNA, 22 bp, Artificial Sequence
  chemically synthesized
tccaccccaaatcaacagaata

SEQ ID NO: 1196432 - DNA, 22 bp, Artificial Sequence
  chemically synthesized
caccccaaatcaacagaatata

SEQ ID NO: 1196433 - DNA, 22 bp, Artificial Sequence
  chemically synthesized
tggaataggtgtggtgtggtgc

SEQ ID NO: 1196434 - DNA, 22 bp, Artificial Sequence
  chemically synthesized
ttttcagcaccacaccacacct

SEQ ID NO: 1196435 - DNA, 22 bp, Artificial Sequence
  chemically synthesized
ttcagcaccacaccacacctat

SEQ ID NO: 1196436 - DNA, 22 bp, Artificial Sequence
  chemically synthesized
tcagcaccacaccacacctatt

SEQ ID NO: 1196437 - DNA, 22 bp, Artificial Sequence
  chemically synthesized
cagcaccacaccacacctattc

SEQ ID NO: 1196438 - DNA, 22 bp, Artificial Sequence
  chemically synthesized
agcaccacaccacacctattcc

SEQ ID NO: 1196439 - DNA, 22 bp, Artificial Sequence
  chemically synthesized
caagtatgtggtcagttgtgga

SEQ ID NO: 1196440 - DNA, 22 bp, Artificial Sequence
  chemically synthesized
ccaagtatgtggtcagttgtgg

SEQ ID NO: 1196441 - DNA, 22 bp, Artificial Sequence
  chemically synthesized
cttccaagtatgtggtcagttg

SEQ ID NO: 1196442 - DNA, 22 bp, Artificial Sequence
  chemically synthesized
acttccaagtatgtggtcagtt

SEQ ID NO: 1196443 - DNA, 22 bp, Artificial Sequence
  chemically synthesized
tacttccaagtatgtggtcagt

SEQ ID NO: 1196444 - DNA, 22 bp, Artificial Sequence
  chemically synthesized
ttccacaactgaccacatactt

SEQ ID NO: 1196445 - DNA, 22 bp, Artificial Sequence
  chemically synthesized
cacaactgaccacatacttgga

SEQ ID NO: 1196446 - DNA, 22 bp, Artificial Sequence
  chemically synthesized
aggagagctttacttccaagta

SEQ ID NO: 1196447 - DNA, 22 bp, Artificial Sequence
  chemically synthesized
ctgaggagagctttacttccaa

SEQ ID NO: 1196448 - DNA, 22 bp, Artificial Sequence
  chemically synthesized
gctgaggagagctttacttcca

SEQ ID NO: 1196449 - DNA, 22 bp, Artificial Sequence
  chemically synthesized
accacatacttggaagtaaagc

SEQ ID NO: 1196450 - DNA, 22 bp, Artificial Sequence
  chemically synthesized
catttgctgaggagagctttac

SEQ ID NO: 1196451 - DNA, 22 bp, Artificial Sequence
  chemically synthesized
tacatttgctgaggagagcttt

SEQ ID NO: 1196452 - DNA, 22 bp, Artificial Sequence
  chemically synthesized
ctacatttgctgaggagagctt

SEQ ID NO: 1196453 - DNA, 22 bp, Artificial Sequence
  chemically synthesized
ttctacatttgctgaggagagc

SEQ ID NO: 1196454 - DNA, 22 bp, Artificial Sequence
  chemically synthesized
ggaagtaaagctctcctcagca

SEQ ID NO: 1196455 - DNA, 22 bp, Artificial Sequence
  chemically synthesized
ttcttctacatttgctgaggag

SEQ ID NO: 1196456 - DNA, 22 bp, Artificial Sequence
  chemically synthesized
gaagtaaagctctcctcagcaa

SEQ ID NO: 1196457 - DNA, 22 bp, Artificial Sequence
  chemically synthesized
tgttcttctacatttgctgagg

SEQ ID NO: 1196458 - DNA, 22 bp, Artificial Sequence
  chemically synthesized
ctgttcttctacatttgctgag

SEQ ID NO: 1196459 - DNA, 22 bp, Artificial Sequence
  chemically synthesized
taatttctgttcttctacattt

SEQ ID NO: 1196460 - DNA, 22 bp, Artificial Sequence
  chemically synthesized
ttataatttctgttcttctaca

SEQ ID NO: 1196461 - DNA, 22 bp, Artificial Sequence
  chemically synthesized
tcctcagcaaatgtagaagaac

SEQ ID NO: 1196462 - DNA, 22 bp, Artificial Sequence
  chemically synthesized
gttataatttctgttcttctac

SEQ ID NO: 1196463 - DNA, 22 bp, Artificial Sequence
  chemically synthesized
ctcagcaaatgtagaagaacag

SEQ ID NO: 1196464 - DNA, 22 bp, Artificial Sequence
  chemically synthesized
agcaaatgtagaagaacagaaa

SEQ ID NO: 1196465 - DNA, 22 bp, Artificial Sequence
  chemically synthesized
agagatagtttgttataatttc

SEQ ID NO: 1196466 - DNA, 22 bp, Artificial Sequence
  chemically synthesized
tggtctgagagatagtttgtta

SEQ ID NO: 1196467 - DNA, 22 bp, Artificial Sequence
  chemically synthesized
cactgtggtctgagagatagtt

SEQ ID NO: 1196468 - DNA, 22 bp, Artificial Sequence
  chemically synthesized
attgcactgtggtctgagagat

SEQ ID NO: 1196469 - DNA, 22 bp, Artificial Sequence
  chemically synthesized
gattgcactgtggtctgagaga

SEQ ID NO: 1196470 - DNA, 22 bp, Artificial Sequence
  chemically synthesized
taacaaactatctctcagacca

SEQ ID NO: 1196471 - DNA, 22 bp, Artificial Sequence
  chemically synthesized
gtttgattgcactgtggtctga

SEQ ID NO: 1196472 - DNA, 22 bp, Artificial Sequence
  chemically synthesized
tagtttgattgcactgtggtct

SEQ ID NO: 1196473 - DNA, 22 bp, Artificial Sequence
  chemically synthesized
agttctagtttgattgcactgt

SEQ ID NO: 1196474 - DNA, 22 bp, Artificial Sequence
  chemically synthesized
tctctcagaccacagtgcaatc

SEQ ID NO: 1196475 - DNA, 22 bp, Artificial Sequence
  chemically synthesized
tgagttctagtttgattgcact

SEQ ID NO: 1196476 - DNA, 22 bp, Artificial Sequence
  chemically synthesized
tcagaccacagtgcaatcaaac

SEQ ID NO: 1196477 - DNA, 22 bp, Artificial Sequence
  chemically synthesized
attctgagttctagtttgattg

SEQ ID NO: 1196478 - DNA, 22 bp, Artificial Sequence
  chemically synthesized
agaccacagtgcaatcaaacta

SEQ ID NO: 1196479 - DNA, 22 bp, Artificial Sequence
  chemically synthesized
aattctgagttctagtttgatt

SEQ ID NO: 1196480 - DNA, 22 bp, Artificial Sequence
  chemically synthesized
ttaattctgagttctagtttga

SEQ ID NO: 1196481 - DNA, 22 bp, Artificial Sequence
  chemically synthesized
agtgagattcttaattctgagt

SEQ ID NO: 1196482 - DNA, 22 bp, Artificial Sequence
  chemically synthesized
gagtgagattcttaattctgag

SEQ ID NO: 1196483 - DNA, 22 bp, Artificial Sequence
  chemically synthesized
tgagtgagattcttaattctga

SEQ ID NO: 1196484 - DNA, 22 bp, Artificial Sequence
  chemically synthesized
gaactcagaattaagaatctca

SEQ ID NO: 1196485 - DNA, 22 bp, Artificial Sequence
  chemically synthesized
agcggttttgagtgagattctt

SEQ ID NO: 1196486 - DNA, 22 bp, Artificial Sequence
  chemically synthesized
agaattaagaatctcactcaaa

SEQ ID NO: 1196487 - DNA, 22 bp, Artificial Sequence
  chemically synthesized
catgtagttgagcggttttgag

SEQ ID NO: 1196488 - DNA, 22 bp, Artificial Sequence
  chemically synthesized
ccatgtagttgagcggttttga

SEQ ID NO: 1196489 - DNA, 22 bp, Artificial Sequence
  chemically synthesized
agaatctcactcaaaaccgctc

SEQ ID NO: 1196490 - DNA, 22 bp, Artificial Sequence
  chemically synthesized
agtttccatgtagttgagcggt

SEQ ID NO: 1196491 - DNA, 22 bp, Artificial Sequence
  chemically synthesized
ttcagtttccatgtagttgagc

SEQ ID NO: 1196492 - DNA, 22 bp, Artificial Sequence
  chemically synthesized
actcaaaaccgctcaactacat

SEQ ID NO: 1196493 - DNA, 22 bp, Artificial Sequence
  chemically synthesized
aaaaccgctcaactacatggaa

SEQ ID NO: 1196494 - DNA, 22 bp, Artificial Sequence
  chemically synthesized
aggaggaggttgttcagtttcc

SEQ ID NO: 1196495 - DNA, 22 bp, Artificial Sequence
  chemically synthesized
aactacatggaaactgaacaac

SEQ ID NO: 1196496 - DNA, 22 bp, Artificial Sequence
  chemically synthesized
catggaaactgaacaacctcct

SEQ ID NO: 1196497 - DNA, 22 bp, Artificial Sequence
  chemically synthesized
tgcaccccgtagtcattcagga

SEQ ID NO: 1196498 - DNA, 22 bp, Artificial Sequence
  chemically synthesized
aacaacctcctcctgaatgact

SEQ ID NO: 1196499 - DNA, 22 bp, Artificial Sequence
  chemically synthesized
attatgcaccccgtagtcattc

SEQ ID NO: 1196500 - DNA, 22 bp, Artificial Sequence
  chemically synthesized
cattatgcaccccgtagtcatt

SEQ ID NO: 1196501 - DNA, 22 bp, Artificial Sequence
  chemically synthesized
atttcattatgcaccccgtagt

SEQ ID NO: 1196502 - DNA, 22 bp, Artificial Sequence
  chemically synthesized
catttcattatgcaccccgtag

SEQ ID NO: 1196503 - DNA, 22 bp, Artificial Sequence
  chemically synthesized
ctcctgaatgactacggggtgc

SEQ ID NO: 1196504 - DNA, 22 bp, Artificial Sequence
  chemically synthesized
ctgaatgactacggggtgcata

SEQ ID NO: 1196505 - DNA, 22 bp, Artificial Sequence
  chemically synthesized
ccttcatttcattatgcacccc

SEQ ID NO: 1196506 - DNA, 22 bp, Artificial Sequence
  chemically synthesized
tgccttcatttcattatgcacc

SEQ ID NO: 1196507 - DNA, 22 bp, Artificial Sequence
  chemically synthesized
aatgactacggggtgcataatg

SEQ ID NO: 1196508 - DNA, 22 bp, Artificial Sequence
  chemically synthesized
ctgccttcatttcattatgcac

SEQ ID NO: 1196509 - DNA, 22 bp, Artificial Sequence
  chemically synthesized
tttctgccttcatttcattatg

SEQ ID NO: 1196510 - DNA, 22 bp, Artificial Sequence
  chemically synthesized
atttctgccttcatttcattat

SEQ ID NO: 1196511 - DNA, 22 bp, Artificial Sequence
  chemically synthesized
tatttctgccttcatttcatta

SEQ ID NO: 1196512 - DNA, 22 bp, Artificial Sequence
  chemically synthesized
cggggtgcataatgaaatgaag

SEQ ID NO: 1196513 - DNA, 22 bp, Artificial Sequence
  chemically synthesized
aaagaacatctttatttctgcc

SEQ ID NO: 1196514 - DNA, 22 bp, Artificial Sequence
  chemically synthesized
caaagaacatctttatttctgc

SEQ ID NO: 1196515 - DNA, 22 bp, Artificial Sequence
  chemically synthesized
gtttcaaagaacatctttattt

SEQ ID NO: 1196516 - DNA, 22 bp, Artificial Sequence
  chemically synthesized
attggtttcaaagaacatcttt

SEQ ID NO: 1196517 - DNA, 22 bp, Artificial Sequence
  chemically synthesized
tcattggtttcaaagaacatct

SEQ ID NO: 1196518 - DNA, 22 bp, Artificial Sequence
  chemically synthesized
ttctcattggtttcaaagaaca

SEQ ID NO: 1196519 - DNA, 22 bp, Artificial Sequence
  chemically synthesized
gttctcattggtttcaaagaac

SEQ ID NO: 1196520 - DNA, 22 bp, Artificial Sequence
  chemically synthesized
tgttctcattggtttcaaagaa

SEQ ID NO: 1196521 - DNA, 22 bp, Artificial Sequence
  chemically synthesized
tgtctttgttctcattggtttc

SEQ ID NO: 1196522 - DNA, 22 bp, Artificial Sequence
  chemically synthesized
gtatgttgtgtctttgttctca

SEQ ID NO: 1196523 - DNA, 22 bp, Artificial Sequence
  chemically synthesized
tttgaaaccaatgagaacaaag

SEQ ID NO: 1196524 - DNA, 22 bp, Artificial Sequence
  chemically synthesized
tggtatgttgtgtctttgttct

SEQ ID NO: 1196525 - DNA, 22 bp, Artificial Sequence
  chemically synthesized
tgaaaccaatgagaacaaagac

SEQ ID NO: 1196526 - DNA, 22 bp, Artificial Sequence
  chemically synthesized
gaaaccaatgagaacaaagaca

SEQ ID NO: 1196527 - DNA, 22 bp, Artificial Sequence
  chemically synthesized
aaaccaatgagaacaaagacac

SEQ ID NO: 1196528 - DNA, 22 bp, Artificial Sequence
  chemically synthesized
aatgtgtcccagagattctggt

SEQ ID NO: 1196529 - DNA, 22 bp, Artificial Sequence
  chemically synthesized
gaatgtgtcccagagattctgg

SEQ ID NO: 1196530 - DNA, 22 bp, Artificial Sequence
  chemically synthesized
tgaatgtgtcccagagattctg

SEQ ID NO: 1196531 - DNA, 22 bp, Artificial Sequence
  chemically synthesized
ctttgaatgtgtcccagagatt

SEQ ID NO: 1196532 - DNA, 22 bp, Artificial Sequence
  chemically synthesized
cacactgctttgaatgtgtccc

SEQ ID NO: 1196533 - DNA, 22 bp, Artificial Sequence
  chemically synthesized
tacacactgctttgaatgtgtc

SEQ ID NO: 1196534 - DNA, 22 bp, Artificial Sequence
  chemically synthesized
cctctacacactgctttgaatg

SEQ ID NO: 1196535 - DNA, 22 bp, Artificial Sequence
  chemically synthesized
ccctctacacactgctttgaat

SEQ ID NO: 1196536 - DNA, 22 bp, Artificial Sequence
  chemically synthesized
tgggacacattcaaagcagtgt

SEQ ID NO: 1196537 - DNA, 22 bp, Artificial Sequence
  chemically synthesized
ggacacattcaaagcagtgtgt

SEQ ID NO: 1196538 - DNA, 22 bp, Artificial Sequence
  chemically synthesized
taaatttccctctacacactgc

SEQ ID NO: 1196539 - DNA, 22 bp, Artificial Sequence
  chemically synthesized
gtgctataaatttccctctaca

SEQ ID NO: 1196540 - DNA, 22 bp, Artificial Sequence
  chemically synthesized
agtgctataaatttccctctac

SEQ ID NO: 1196541 - DNA, 22 bp, Artificial Sequence
  chemically synthesized
aaagcagtgtgtagagggaaat

SEQ ID NO: 1196542 - DNA, 22 bp, Artificial Sequence
  chemically synthesized
tgggcatttagtgctataaatt

SEQ ID NO: 1196543 - DNA, 22 bp, Artificial Sequence
  chemically synthesized
gtgggcatttagtgctataaat

SEQ ID NO: 1196544 - DNA, 22 bp, Artificial Sequence
  chemically synthesized
ttgtgggcatttagtgctataa

SEQ ID NO: 1196545 - DNA, 22 bp, Artificial Sequence
  chemically synthesized
tcttgtgggcatttagtgctat

SEQ ID NO: 1196546 - DNA, 22 bp, Artificial Sequence
  chemically synthesized
ctcttgtgggcatttagtgcta

SEQ ID NO: 1196547 - DNA, 22 bp, Artificial Sequence
  chemically synthesized
tctcttgtgggcatttagtgct

SEQ ID NO: 1196548 - DNA, 22 bp, Artificial Sequence
  chemically synthesized
ctttctcttgtgggcatttagt

SEQ ID NO: 1196549 - DNA, 22 bp, Artificial Sequence
  chemically synthesized
ctgctttctcttgtgggcattt

SEQ ID NO: 1196550 - DNA, 22 bp, Artificial Sequence
  chemically synthesized
cctgctttctcttgtgggcatt

SEQ ID NO: 1196551 - DNA, 22 bp, Artificial Sequence
  chemically synthesized
tcctgctttctcttgtgggcat

SEQ ID NO: 1196552 - DNA, 22 bp, Artificial Sequence
  chemically synthesized
atagcactaaatgcccacaaga

SEQ ID NO: 1196553 - DNA, 22 bp, Artificial Sequence
  chemically synthesized
tagcactaaatgcccacaagag

SEQ ID NO: 1196554 - DNA, 22 bp, Artificial Sequence
  chemically synthesized
gatctttcctgctttctcttgt

SEQ ID NO: 1196555 - DNA, 22 bp, Artificial Sequence
  chemically synthesized
ggatctttcctgctttctcttg

SEQ ID NO: 1196556 - DNA, 22 bp, Artificial Sequence
  chemically synthesized
tggatctttcctgctttctctt

SEQ ID NO: 1196557 - DNA, 22 bp, Artificial Sequence
  chemically synthesized
aatgcccacaagagaaagcagg

SEQ ID NO: 1196558 - DNA, 22 bp, Artificial Sequence
  chemically synthesized
gggtgtcaattttggatctttc

SEQ ID NO: 1196559 - DNA, 22 bp, Artificial Sequence
  chemically synthesized
tgatgttagggtgtcaattttg

SEQ ID NO: 1196560 - DNA, 22 bp, Artificial Sequence
  chemically synthesized
attgtgatgttagggtgtcaat

SEQ ID NO: 1196561 - DNA, 22 bp, Artificial Sequence
  chemically synthesized
aattgtgatgttagggtgtcaa

SEQ ID NO: 1196562 - DNA, 22 bp, Artificial Sequence
  chemically synthesized
taattgtgatgttagggtgtca

SEQ ID NO: 1196563 - DNA, 22 bp, Artificial Sequence
  chemically synthesized
ttaattgtgatgttagggtgtc

SEQ ID NO: 1196564 - DNA, 22 bp, Artificial Sequence
  chemically synthesized
ttttaattgtgatgttagggtg

SEQ ID NO: 1196565 - DNA, 22 bp, Artificial Sequence
  chemically synthesized
gttcttttaattgtgatgttag

SEQ ID NO: 1196566 - DNA, 22 bp, Artificial Sequence
  chemically synthesized
tagttcttttaattgtgatgtt

SEQ ID NO: 1196567 - DNA, 22 bp, Artificial Sequence
  chemically synthesized
ctagttcttttaattgtgatgt

SEQ ID NO: 1196568 - DNA, 22 bp, Artificial Sequence
  chemically synthesized
tctagttcttttaattgtgatg

SEQ ID NO: 1196569 - DNA, 22 bp, Artificial Sequence
  chemically synthesized
ttctagttcttttaattgtgat

SEQ ID NO: 1196570 - DNA, 22 bp, Artificial Sequence
  chemically synthesized
acaccctaacatcacaattaaa

SEQ ID NO: 1196571 - DNA, 22 bp, Artificial Sequence
  chemically synthesized
cttttctagttcttttaattgt

SEQ ID NO: 1196572 - DNA, 22 bp, Artificial Sequence
  chemically synthesized
gcttttctagttcttttaattg

SEQ ID NO: 1196573 - DNA, 22 bp, Artificial Sequence
  chemically synthesized
ttgcttttctagttcttttaat

SEQ ID NO: 1196574 - DNA, 22 bp, Artificial Sequence
  chemically synthesized
ctcttgcttttctagttctttt

SEQ ID NO: 1196575 - DNA, 22 bp, Artificial Sequence
  chemically synthesized
acatcacaattaaaagaactag

SEQ ID NO: 1196576 - DNA, 22 bp, Artificial Sequence
  chemically synthesized
gctcttgcttttctagttcttt

SEQ ID NO: 1196577 - DNA, 22 bp, Artificial Sequence
  chemically synthesized
aatgtgtttgctcttgcttttc

SEQ ID NO: 1196578 - DNA, 22 bp, Artificial Sequence
  chemically synthesized
gaatgtgtttgctcttgctttt

SEQ ID NO: 1196579 - DNA, 22 bp, Artificial Sequence
  chemically synthesized
tgaatgtgtttgctcttgcttt

SEQ ID NO: 1196580 - DNA, 22 bp, Artificial Sequence
  chemically synthesized
aaagaactagaaaagcaagagc

SEQ ID NO: 1196581 - DNA, 22 bp, Artificial Sequence
  chemically synthesized
ttgaatgtgtttgctcttgctt

SEQ ID NO: 1196582 - DNA, 22 bp, Artificial Sequence
  chemically synthesized
gcttttgaatgtgtttgctctt

SEQ ID NO: 1196583 - DNA, 22 bp, Artificial Sequence
  chemically synthesized
ctagcttttgaatgtgtttgct

SEQ ID NO: 1196584 - DNA, 22 bp, Artificial Sequence
  chemically synthesized
gaaaagcaagagcaaacacatt

SEQ ID NO: 1196585 - DNA, 22 bp, Artificial Sequence
  chemically synthesized
tgctagcttttgaatgtgtttg

SEQ ID NO: 1196586 - DNA, 22 bp, Artificial Sequence
  chemically synthesized
ctgctagcttttgaatgtgttt

SEQ ID NO: 1196587 - DNA, 22 bp, Artificial Sequence
  chemically synthesized
tcttctgctagcttttgaatgt

SEQ ID NO: 1196588 - DNA, 22 bp, Artificial Sequence
  chemically synthesized
gtcttctgctagcttttgaatg

SEQ ID NO: 1196589 - DNA, 22 bp, Artificial Sequence
  chemically synthesized
ttgtcttctgctagcttttgaa

SEQ ID NO: 1196590 - DNA, 22 bp, Artificial Sequence
  chemically synthesized
cttgtcttctgctagcttttga

SEQ ID NO: 1196591 - DNA, 22 bp, Artificial Sequence
  chemically synthesized
tttcttgtcttctgctagcttt

SEQ ID NO: 1196592 - DNA, 22 bp, Artificial Sequence
  chemically synthesized
gttatttcttgtcttctgctag

SEQ ID NO: 1196593 - DNA, 22 bp, Artificial Sequence
  chemically synthesized
agttatttcttgtcttctgcta

SEQ ID NO: 1196594 - DNA, 22 bp, Artificial Sequence
  chemically synthesized
tagttatttcttgtcttctgct

SEQ ID NO: 1196595 - DNA, 22 bp, Artificial Sequence
  chemically synthesized
attttagttatttcttgtcttc

SEQ ID NO: 1196596 - DNA, 22 bp, Artificial Sequence
  chemically synthesized
aaaagctagcagaagacaagaa

SEQ ID NO: 1196597 - DNA, 22 bp, Artificial Sequence
  chemically synthesized
tgattttagttatttcttgtct

SEQ ID NO: 1196598 - DNA, 22 bp, Artificial Sequence
  chemically synthesized
ctctgattttagttatttcttg

SEQ ID NO: 1196599 - DNA, 22 bp, Artificial Sequence
  chemically synthesized
tgctctgattttagttatttct

SEQ ID NO: 1196600 - DNA, 22 bp, Artificial Sequence
  chemically synthesized
gcagaagacaagaaataactaa

SEQ ID NO: 1196601 - DNA, 22 bp, Artificial Sequence
  chemically synthesized
agttctgctctgattttagtta

SEQ ID NO: 1196602 - DNA, 22 bp, Artificial Sequence
  chemically synthesized
cagttctgctctgattttagtt

SEQ ID NO: 1196603 - DNA, 22 bp, Artificial Sequence
  chemically synthesized
cttcagttctgctctgatttta

SEQ ID NO: 1196604 - DNA, 22 bp, Artificial Sequence
  chemically synthesized
ccttcagttctgctctgatttt

SEQ ID NO: 1196605 - DNA, 22 bp, Artificial Sequence
  chemically synthesized
tttccttcagttctgctctgat

SEQ ID NO: 1196606 - DNA, 22 bp, Artificial Sequence
  chemically synthesized
tatttccttcagttctgctctg

SEQ ID NO: 1196607 - DNA, 22 bp, Artificial Sequence
  chemically synthesized
tgtctctatttccttcagttct

SEQ ID NO: 1196608 - DNA, 22 bp, Artificial Sequence
  chemically synthesized
gtgtctctatttccttcagttc

SEQ ID NO: 1196609 - DNA, 22 bp, Artificial Sequence
  chemically synthesized
aaatcagagcagaactgaagga

SEQ ID NO: 1196610 - DNA, 22 bp, Artificial Sequence
  chemically synthesized
tgtgtctctatttccttcagtt

SEQ ID NO: 1196611 - DNA, 22 bp, Artificial Sequence
  chemically synthesized
ttgtgtctctatttccttcagt

SEQ ID NO: 1196612 - DNA, 22 bp, Artificial Sequence
  chemically synthesized
tttgtgtctctatttccttcag

SEQ ID NO: 1196613 - DNA, 22 bp, Artificial Sequence
  chemically synthesized
aagggttttttgtgtctctatt

SEQ ID NO: 1196614 - DNA, 22 bp, Artificial Sequence
  chemically synthesized
gaagggttttttgtgtctctat

SEQ ID NO: 1196615 - DNA, 22 bp, Artificial Sequence
  chemically synthesized
tgaagggttttttgtgtctcta

SEQ ID NO: 1196616 - DNA, 22 bp, Artificial Sequence
  chemically synthesized
ttgaagggttttttgtgtctct

SEQ ID NO: 1196617 - DNA, 22 bp, Artificial Sequence
  chemically synthesized
tttgaagggttttttgtgtctc

SEQ ID NO: 1196618 - DNA, 22 bp, Artificial Sequence
  chemically synthesized
aaggaaatagagacacaaaaaa

SEQ ID NO: 1196619 - DNA, 22 bp, Artificial Sequence
  chemically synthesized
attttttgaagggttttttgtg

SEQ ID NO: 1196620 - DNA, 22 bp, Artificial Sequence
  chemically synthesized
attaattttttgaagggttttt

SEQ ID NO: 1196621 - DNA, 22 bp, Artificial Sequence
  chemically synthesized
gattcattaattttttgaaggg

SEQ ID NO: 1196622 - DNA, 22 bp, Artificial Sequence
  chemically synthesized
ctggattcattaattttttgaa

SEQ ID NO: 1196623 - DNA, 22 bp, Artificial Sequence
  chemically synthesized
aaaaaaccagctcctggattca

SEQ ID NO: 1196624 - DNA, 22 bp, Artificial Sequence
  chemically synthesized
caaaaaattaatgaatccagga

SEQ ID NO: 1196625 - DNA, 22 bp, Artificial Sequence
  chemically synthesized
caaaaaaccagctcctggattc

SEQ ID NO: 1196626 - DNA, 22 bp, Artificial Sequence
  chemically synthesized
aaaaaattaatgaatccaggag

SEQ ID NO: 1196627 - DNA, 22 bp, Artificial Sequence
  chemically synthesized
tcaaaaaaccagctcctggatt

SEQ ID NO: 1196628 - DNA, 22 bp, Artificial Sequence
  chemically synthesized
atcctttcaaaaaaccagctcc

SEQ ID NO: 1196629 - DNA, 22 bp, Artificial Sequence
  chemically synthesized
atgaatccaggagctggttttt

SEQ ID NO: 1196630 - DNA, 22 bp, Artificial Sequence
  chemically synthesized
ttgatcctttcaaaaaaccagc

SEQ ID NO: 1196631 - DNA, 22 bp, Artificial Sequence
  chemically synthesized
gttgatcctttcaaaaaaccag

SEQ ID NO: 1196632 - DNA, 22 bp, Artificial Sequence
  chemically synthesized
tgttgatcctttcaaaaaacca

SEQ ID NO: 1196633 - DNA, 22 bp, Artificial Sequence
  chemically synthesized
ttttgttgatcctttcaaaaaa

SEQ ID NO: 1196634 - DNA, 22 bp, Artificial Sequence
  chemically synthesized
tctattttgttgatcctttcaa

SEQ ID NO: 1196635 - DNA, 22 bp, Artificial Sequence
  chemically synthesized
gttttttgaaaggatcaacaaa

SEQ ID NO: 1196636 - DNA, 22 bp, Artificial Sequence
  chemically synthesized
gcagtctatctattttgttgat

SEQ ID NO: 1196637 - DNA, 22 bp, Artificial Sequence
  chemically synthesized
tttgaaaggatcaacaaaatag

SEQ ID NO: 1196638 - DNA, 22 bp, Artificial Sequence
  chemically synthesized
ctagcagtctatctattttgtt

SEQ ID NO: 1196639 - DNA, 22 bp, Artificial Sequence
  chemically synthesized
ttgaaaggatcaacaaaataga

SEQ ID NO: 1196640 - DNA, 22 bp, Artificial Sequence
  chemically synthesized
gctagcagtctatctattttgt

SEQ ID NO: 1196641 - DNA, 22 bp, Artificial Sequence
  chemically synthesized
tgaaaggatcaacaaaatagat

SEQ ID NO: 1196642 - DNA, 22 bp, Artificial Sequence
  chemically synthesized
gaaaggatcaacaaaatagata

SEQ ID NO: 1196643 - DNA, 22 bp, Artificial Sequence
  chemically synthesized
aaaggatcaacaaaatagatag

SEQ ID NO: 1196644 - DNA, 22 bp, Artificial Sequence
  chemically synthesized
gtcttgctagcagtctatctat

SEQ ID NO: 1196645 - DNA, 22 bp, Artificial Sequence
  chemically synthesized
ttagtcttgctagcagtctatc

SEQ ID NO: 1196646 - DNA, 22 bp, Artificial Sequence
  chemically synthesized
attagtcttgctagcagtctat

SEQ ID NO: 1196647 - DNA, 22 bp, Artificial Sequence
  chemically synthesized
tattagtcttgctagcagtcta

SEQ ID NO: 1196648 - DNA, 22 bp, Artificial Sequence
  chemically synthesized
tttattagtcttgctagcagtc

SEQ ID NO: 1196649 - DNA, 22 bp, Artificial Sequence
  chemically synthesized
ctttattagtcttgctagcagt

SEQ ID NO: 1196650 - DNA, 22 bp, Artificial Sequence
  chemically synthesized
tctttattagtcttgctagcag

SEQ ID NO: 1196651 - DNA, 22 bp, Artificial Sequence
  chemically synthesized
ttctttattagtcttgctagca

SEQ ID NO: 1196652 - DNA, 22 bp, Artificial Sequence
  chemically synthesized
tttctttattagtcttgctagc

SEQ ID NO: 1196653 - DNA, 22 bp, Artificial Sequence
  chemically synthesized
ttttctttattagtcttgctag

SEQ ID NO: 1196654 - DNA, 22 bp, Artificial Sequence
  chemically synthesized
tttttctttattagtcttgcta

SEQ ID NO: 1196655 - DNA, 22 bp, Artificial Sequence
  chemically synthesized
tttttttctttattagtcttgc

SEQ ID NO: 1196656 - DNA, 22 bp, Artificial Sequence
  chemically synthesized
tctttttttctttattagtctt

SEQ ID NO: 1196657 - DNA, 22 bp, Artificial Sequence
  chemically synthesized
tctctttttttctttattagtc

SEQ ID NO: 1196658 - DNA, 22 bp, Artificial Sequence
  chemically synthesized
ctctctttttttctttattagt

SEQ ID NO: 1196659 - DNA, 22 bp, Artificial Sequence
  chemically synthesized
ttctctctttttttctttatta

SEQ ID NO: 1196660 - DNA, 22 bp, Artificial Sequence
  chemically synthesized
ctagcaagactaataaagaaaa

SEQ ID NO: 1196661 - DNA, 22 bp, Artificial Sequence
  chemically synthesized
attcttctctctttttttcttt

SEQ ID NO: 1196662 - DNA, 22 bp, Artificial Sequence
  chemically synthesized
gcaagactaataaagaaaaaaa

SEQ ID NO: 1196663 - DNA, 22 bp, Artificial Sequence
  chemically synthesized
gattcttctctctttttttctt

SEQ ID NO: 1196664 - DNA, 22 bp, Artificial Sequence
  chemically synthesized
tttgattcttctctcttttttt

SEQ ID NO: 1196665 - DNA, 22 bp, Artificial Sequence
  chemically synthesized
ataaagaaaaaaagagagaaga

SEQ ID NO: 1196666 - DNA, 22 bp, Artificial Sequence
  chemically synthesized
catctatttgattcttctctct

SEQ ID NO: 1196667 - DNA, 22 bp, Artificial Sequence
  chemically synthesized
ttgcatctatttgattcttctc

SEQ ID NO: 1196668 - DNA, 22 bp, Artificial Sequence
  chemically synthesized
attgcatctatttgattcttct

SEQ ID NO: 1196669 - DNA, 22 bp, Artificial Sequence
  chemically synthesized
tattgcatctatttgattcttc

SEQ ID NO: 1196670 - DNA, 22 bp, Artificial Sequence
  chemically synthesized
ttattgcatctatttgattctt

SEQ ID NO: 1196671 - DNA, 22 bp, Artificial Sequence
  chemically synthesized
tttattgcatctatttgattct

SEQ ID NO: 1196672 - DNA, 22 bp, Artificial Sequence
  chemically synthesized
tcattttttattgcatctattt

SEQ ID NO: 1196673 - DNA, 22 bp, Artificial Sequence
  chemically synthesized
atcattttttattgcatctatt

SEQ ID NO: 1196674 - DNA, 22 bp, Artificial Sequence
  chemically synthesized
tatcattttttattgcatctat

SEQ ID NO: 1196675 - DNA, 22 bp, Artificial Sequence
  chemically synthesized
tgggatcagtggtgatatcccc

SEQ ID NO: 1196676 - DNA, 22 bp, Artificial Sequence
  chemically synthesized
tgtgggatcagtggtgatatcc

SEQ ID NO: 1196677 - DNA, 22 bp, Artificial Sequence
  chemically synthesized
ctgtgggatcagtggtgatatc

SEQ ID NO: 1196678 - DNA, 22 bp, Artificial Sequence
  chemically synthesized
tatttctgtgggatcagtggtg

SEQ ID NO: 1196679 - DNA, 22 bp, Artificial Sequence
  chemically synthesized
gtatttctgtgggatcagtggt

SEQ ID NO: 1196680 - DNA, 22 bp, Artificial Sequence
  chemically synthesized
atggtagtttgtatttctgtgg

SEQ ID NO: 1196681 - DNA, 22 bp, Artificial Sequence
  chemically synthesized
tgatggtagtttgtatttctgt

SEQ ID NO: 1196682 - DNA, 22 bp, Artificial Sequence
  chemically synthesized
tctgatggtagtttgtatttct

SEQ ID NO: 1196683 - DNA, 22 bp, Artificial Sequence
  chemically synthesized
atcccacagaaatacaaactac

SEQ ID NO: 1196684 - DNA, 22 bp, Artificial Sequence
  chemically synthesized
tagtattctctgatggtagttt

SEQ ID NO: 1196685 - DNA, 22 bp, Artificial Sequence
  chemically synthesized
gtagtattctctgatggtagtt

SEQ ID NO: 1196686 - DNA, 22 bp, Artificial Sequence
  chemically synthesized
cgtagaggtgtttgtagtattc

SEQ ID NO: 1196687 - DNA, 22 bp, Artificial Sequence
  chemically synthesized
gcgtagaggtgtttgtagtatt

SEQ ID NO: 1196688 - DNA, 22 bp, Artificial Sequence
  chemically synthesized
ccatcagagaatactacaaaca

SEQ ID NO: 1196689 - DNA, 22 bp, Artificial Sequence
  chemically synthesized
tttgcgtagaggtgtttgtagt

SEQ ID NO: 1196690 - DNA, 22 bp, Artificial Sequence
  chemically synthesized
atttgcgtagaggtgtttgtag

SEQ ID NO: 1196691 - DNA, 22 bp, Artificial Sequence
  chemically synthesized
gtttatttgcgtagaggtgttt

SEQ ID NO: 1196692 - DNA, 22 bp, Artificial Sequence
  chemically synthesized
tagtttatttgcgtagaggtgt

SEQ ID NO: 1196693 - DNA, 22 bp, Artificial Sequence
  chemically synthesized
ctagtttatttgcgtagaggtg

SEQ ID NO: 1196694 - DNA, 22 bp, Artificial Sequence
  chemically synthesized
tctagtttatttgcgtagaggt

SEQ ID NO: 1196695 - DNA, 22 bp, Artificial Sequence
  chemically synthesized
gattttctagtttatttgcgta

SEQ ID NO: 1196696 - DNA, 22 bp, Artificial Sequence
  chemically synthesized
caaacacctctacgcaaataaa

SEQ ID NO: 1196697 - DNA, 22 bp, Artificial Sequence
  chemically synthesized
tagattttctagtttatttgcg

SEQ ID NO: 1196698 - DNA, 22 bp, Artificial Sequence
  chemically synthesized
ctagattttctagtttatttgc

SEQ ID NO: 1196699 - DNA, 22 bp, Artificial Sequence
  chemically synthesized
ttctagattttctagtttattt

SEQ ID NO: 1196700 - DNA, 22 bp, Artificial Sequence
  chemically synthesized
cttctagattttctagtttatt

SEQ ID NO: 1196701 - DNA, 22 bp, Artificial Sequence
  chemically synthesized
tacgcaaataaactagaaaatc

SEQ ID NO: 1196702 - DNA, 22 bp, Artificial Sequence
  chemically synthesized
tccatttcttctagattttcta

SEQ ID NO: 1196703 - DNA, 22 bp, Artificial Sequence
  chemically synthesized
cgcaaataaactagaaaatcta

SEQ ID NO: 1196704 - DNA, 22 bp, Artificial Sequence
  chemically synthesized
atccatttcttctagattttct

SEQ ID NO: 1196705 - DNA, 22 bp, Artificial Sequence
  chemically synthesized
gaaaatctagaagaaatggata

SEQ ID NO: 1196706 - DNA, 22 bp, Artificial Sequence
  chemically synthesized
gaagaaatggataaattcctgc

SEQ ID NO: 1196707 - DNA, 22 bp, Artificial Sequence
  chemically synthesized
ggagagtgtatgtgtgcaggaa

SEQ ID NO: 1196708 - DNA, 22 bp, Artificial Sequence
  chemically synthesized
gggagagtgtatgtgtgcagga

SEQ ID NO: 1196709 - DNA, 22 bp, Artificial Sequence
  chemically synthesized
gtcttgggagagtgtatgtgtg

SEQ ID NO: 1196710 - DNA, 22 bp, Artificial Sequence
  chemically synthesized
agtcttgggagagtgtatgtgt

SEQ ID NO: 1196711 - DNA, 22 bp, Artificial Sequence
  chemically synthesized
gtttagtcttgggagagtgtat

SEQ ID NO: 1196712 - DNA, 22 bp, Artificial Sequence
  chemically synthesized
ctggtttagtcttgggagagtg

SEQ ID NO: 1196713 - DNA, 22 bp, Artificial Sequence
  chemically synthesized
ctgcacacatacactctcccaa

SEQ ID NO: 1196714 - DNA, 22 bp, Artificial Sequence
  chemically synthesized
cctggtttagtcttgggagagt

SEQ ID NO: 1196715 - DNA, 22 bp, Artificial Sequence
  chemically synthesized
ttcctggtttagtcttgggaga

SEQ ID NO: 1196716 - DNA, 22 bp, Artificial Sequence
  chemically synthesized
cacacatacactctcccaagac

SEQ ID NO: 1196717 - DNA, 22 bp, Artificial Sequence
  chemically synthesized
cttcctggtttagtcttgggag

SEQ ID NO: 1196718 - DNA, 22 bp, Artificial Sequence
  chemically synthesized
aacttcttcctggtttagtctt

SEQ ID NO: 1196719 - DNA, 22 bp, Artificial Sequence
  chemically synthesized
tcccaagactaaaccaggaaga

SEQ ID NO: 1196720 - DNA, 22 bp, Artificial Sequence
  chemically synthesized
agagattcaacttcttcctggt

SEQ ID NO: 1196721 - DNA, 22 bp, Artificial Sequence
  chemically synthesized
ccaagactaaaccaggaagaag

SEQ ID NO: 1196722 - DNA, 22 bp, Artificial Sequence
  chemically synthesized
ttcagagattcaacttcttcct

SEQ ID NO: 1196723 - DNA, 22 bp, Artificial Sequence
  chemically synthesized
gtctattcagagattcaacttc

SEQ ID NO: 1196724 - DNA, 22 bp, Artificial Sequence
  chemically synthesized
aaccaggaagaagttgaatctc

SEQ ID NO: 1196725 - DNA, 22 bp, Artificial Sequence
  chemically synthesized
ttggtctattcagagattcaac

SEQ ID NO: 1196726 - DNA, 22 bp, Artificial Sequence
  chemically synthesized
ttattggtctattcagagattc

SEQ ID NO: 1196727 - DNA, 22 bp, Artificial Sequence
  chemically synthesized
agatcctgttattggtctattc

SEQ ID NO: 1196728 - DNA, 22 bp, Artificial Sequence
  chemically synthesized
cagatcctgttattggtctatt

SEQ ID NO: 1196729 - DNA, 22 bp, Artificial Sequence
  chemically synthesized
aatctctgaatagaccaataac

SEQ ID NO: 1196730 - DNA, 22 bp, Artificial Sequence
  chemically synthesized
ccacaatttcagatcctgttat

SEQ ID NO: 1196731 - DNA, 22 bp, Artificial Sequence
  chemically synthesized
tgaatagaccaataacaggatc

SEQ ID NO: 1196732 - DNA, 22 bp, Artificial Sequence
  chemically synthesized
aatagaccaataacaggatctg

SEQ ID NO: 1196733 - DNA, 22 bp, Artificial Sequence
  chemically synthesized
ttgccacaatttcagatcctgt

SEQ ID NO: 1196734 - DNA, 22 bp, Artificial Sequence
  chemically synthesized
attattgccacaatttcagatc

SEQ ID NO: 1196735 - DNA, 22 bp, Artificial Sequence
  chemically synthesized
ttgattattgccacaatttcag

SEQ ID NO: 1196736 - DNA, 22 bp, Artificial Sequence
  chemically synthesized
gtaagctattgattattgccac

SEQ ID NO: 1196737 - DNA, 22 bp, Artificial Sequence
  chemically synthesized
gttggtaagctattgattattg

SEQ ID NO: 1196738 - DNA, 22 bp, Artificial Sequence
  chemically synthesized
ggttggtaagctattgattatt

SEQ ID NO: 1196739 - DNA, 22 bp, Artificial Sequence
  chemically synthesized
tggttggtaagctattgattat

SEQ ID NO: 1196740 - DNA, 22 bp, Artificial Sequence
  chemically synthesized
aaattgtggcaataatcaatag

SEQ ID NO: 1196741 - DNA, 22 bp, Artificial Sequence
  chemically synthesized
ttggttggtaagctattgatta

SEQ ID NO: 1196742 - DNA, 22 bp, Artificial Sequence
  chemically synthesized
tttggttggtaagctattgatt

SEQ ID NO: 1196743 - DNA, 22 bp, Artificial Sequence
  chemically synthesized
tttttggttggtaagctattga

SEQ ID NO: 1196744 - DNA, 22 bp, Artificial Sequence
  chemically synthesized
tggcaataatcaatagcttacc

SEQ ID NO: 1196745 - DNA, 22 bp, Artificial Sequence
  chemically synthesized
gactctttttggttggtaagct

SEQ ID NO: 1196746 - DNA, 22 bp, Artificial Sequence
  chemically synthesized
gtcctggactctttttggttgg

SEQ ID NO: 1196747 - DNA, 22 bp, Artificial Sequence
  chemically synthesized
accaaccaaaaagagtccagga

SEQ ID NO: 1196748 - DNA, 22 bp, Artificial Sequence
  chemically synthesized
ccaaccaaaaagagtccaggac

SEQ ID NO: 1196749 - DNA, 22 bp, Artificial Sequence
  chemically synthesized
tgaatccatctggtcctggact

SEQ ID NO: 1196750 - DNA, 22 bp, Artificial Sequence
  chemically synthesized
ggctgtgaatccatctggtcct

SEQ ID NO: 1196751 - DNA, 22 bp, Artificial Sequence
  chemically synthesized
gtcgaattcggctgtgaatcca

SEQ ID NO: 1196752 - DNA, 22 bp, Artificial Sequence
  chemically synthesized
tggtcgaattcggctgtgaatc

SEQ ID NO: 1196753 - DNA, 22 bp, Artificial Sequence
  chemically synthesized
tacctctggtcgaattcggctg

SEQ ID NO: 1196754 - DNA, 22 bp, Artificial Sequence
  chemically synthesized
gtacctctggtcgaattcggct

SEQ ID NO: 1196755 - DNA, 22 bp, Artificial Sequence
  chemically synthesized
cttgtacctctggtcgaattcg

SEQ ID NO: 1196756 - DNA, 22 bp, Artificial Sequence
  chemically synthesized
ctccttgtacctctggtcgaat

SEQ ID NO: 1196757 - DNA, 22 bp, Artificial Sequence
  chemically synthesized
acagccgaattcgaccagaggt

SEQ ID NO: 1196758 - DNA, 22 bp, Artificial Sequence
  chemically synthesized
gaccagaggtacaaggaggaac

SEQ ID NO: 1196759 - DNA, 22 bp, Artificial Sequence
  chemically synthesized
agaaggaatggtaccagttcct

SEQ ID NO: 1196760 - DNA, 22 bp, Artificial Sequence
  chemically synthesized
cagaaggaatggtaccagttcc

SEQ ID NO: 1196761 - DNA, 22 bp, Artificial Sequence
  chemically synthesized
gaatagtttcagaaggaatggt

SEQ ID NO: 1196762 - DNA, 22 bp, Artificial Sequence
  chemically synthesized
attggaatagtttcagaaggaa

SEQ ID NO: 1196763 - DNA, 22 bp, Artificial Sequence
  chemically synthesized
ttgattggaatagtttcagaag

SEQ ID NO: 1196764 - DNA, 22 bp, Artificial Sequence
  chemically synthesized
tattgattggaatagtttcaga

SEQ ID NO: 1196765 - DNA, 22 bp, Artificial Sequence
  chemically synthesized
gtaccattccttctgaaactat

SEQ ID NO: 1196766 - DNA, 22 bp, Artificial Sequence
  chemically synthesized
ctattgattggaatagtttcag

SEQ ID NO: 1196767 - DNA, 22 bp, Artificial Sequence
  chemically synthesized
tctattgattggaatagtttca

SEQ ID NO: 1196768 - DNA, 22 bp, Artificial Sequence
  chemically synthesized
ttctattgattggaatagtttc

SEQ ID NO: 1196769 - DNA, 22 bp, Artificial Sequence
  chemically synthesized
tttctattgattggaatagttt

SEQ ID NO: 1196770 - DNA, 22 bp, Artificial Sequence
  chemically synthesized
tttttctattgattggaatagt

SEQ ID NO: 1196771 - DNA, 22 bp, Artificial Sequence
  chemically synthesized
cttctgaaactattccaatcaa

SEQ ID NO: 1196772 - DNA, 22 bp, Artificial Sequence
  chemically synthesized
cctctttttctattgattggaa

SEQ ID NO: 1196773 - DNA, 22 bp, Artificial Sequence
  chemically synthesized
ctgaaactattccaatcaatag

SEQ ID NO: 1196774 - DNA, 22 bp, Artificial Sequence
  chemically synthesized
tgaaactattccaatcaataga

SEQ ID NO: 1196775 - DNA, 22 bp, Artificial Sequence
  chemically synthesized
aaactattccaatcaatagaaa

SEQ ID NO: 1196776 - DNA, 22 bp, Artificial Sequence
  chemically synthesized
gggaggattccctctttttcta

SEQ ID NO: 1196777 - DNA, 22 bp, Artificial Sequence
  chemically synthesized
ttccaatcaatagaaaaagagg

SEQ ID NO: 1196778 - DNA, 22 bp, Artificial Sequence
  chemically synthesized
caatcaatagaaaaagagggaa

SEQ ID NO: 1196779 - DNA, 22 bp, Artificial Sequence
  chemically synthesized
ataaaatgagttagggaggatt

SEQ ID NO: 1196780 - DNA, 22 bp, Artificial Sequence
  chemically synthesized
gcctcataaaatgagttaggga

SEQ ID NO: 1196781 - DNA, 22 bp, Artificial Sequence
  chemically synthesized
cctaactcattttatgaggcca

SEQ ID NO: 1196782 - DNA, 22 bp, Artificial Sequence
  chemically synthesized
gtatcaggatgatgctggcctc

SEQ ID NO: 1196783 - DNA, 22 bp, Artificial Sequence
  chemically synthesized
actcattttatgaggccagcat

SEQ ID NO: 1196784 - DNA, 22 bp, Artificial Sequence
  chemically synthesized
cgtatcaggatgatgctggcct

SEQ ID NO: 1196785 - DNA, 22 bp, Artificial Sequence
  chemically synthesized
tcgtatcaggatgatgctggcc

SEQ ID NO: 1196786 - DNA, 22 bp, Artificial Sequence
  chemically synthesized
attttatgaggccagcatcatc

SEQ ID NO: 1196787 - DNA, 22 bp, Artificial Sequence
  chemically synthesized
tatgaggccagcatcatcctga

SEQ ID NO: 1196788 - DNA, 22 bp, Artificial Sequence
  chemically synthesized
atgaggccagcatcatcctgat

SEQ ID NO: 1196789 - DNA, 22 bp, Artificial Sequence
  chemically synthesized
ccaggctttcgtatcaggatga

SEQ ID NO: 1196790 - DNA, 22 bp, Artificial Sequence
  chemically synthesized
tgaggccagcatcatcctgata

SEQ ID NO: 1196791 - DNA, 22 bp, Artificial Sequence
  chemically synthesized
tgccaggctttcgtatcaggat

SEQ ID NO: 1196792 - DNA, 22 bp, Artificial Sequence
  chemically synthesized
tgtctctgccaggctttcgtat

SEQ ID NO: 1196793 - DNA, 22 bp, Artificial Sequence
  chemically synthesized
gttgtgtctctgccaggctttc

SEQ ID NO: 1196794 - DNA, 22 bp, Artificial Sequence
  chemically synthesized
ggttgtgtctctgccaggcttt

SEQ ID NO: 1196795 - DNA, 22 bp, Artificial Sequence
  chemically synthesized
tggttgtgtctctgccaggctt

SEQ ID NO: 1196796 - DNA, 22 bp, Artificial Sequence
  chemically synthesized
ttggttgtgtctctgccaggct

SEQ ID NO: 1196797 - DNA, 22 bp, Artificial Sequence
  chemically synthesized
tttggttgtgtctctgccaggc

SEQ ID NO: 1196798 - DNA, 22 bp, Artificial Sequence
  chemically synthesized
ttttggttgtgtctctgccagg

SEQ ID NO: 1196799 - DNA, 22 bp, Artificial Sequence
  chemically synthesized
ttttttggttgtgtctctgcca

SEQ ID NO: 1196800 - DNA, 22 bp, Artificial Sequence
  chemically synthesized
atacgaaagcctggcagagaca

SEQ ID NO: 1196801 - DNA, 22 bp, Artificial Sequence
  chemically synthesized
tcttttttggttgtgtctctgc

SEQ ID NO: 1196802 - DNA, 22 bp, Artificial Sequence
  chemically synthesized
aaattctcttttttggttgtgt

SEQ ID NO: 1196803 - DNA, 22 bp, Artificial Sequence
  chemically synthesized
gtctaaaattctcttttttggt

SEQ ID NO: 1196804 - DNA, 22 bp, Artificial Sequence
  chemically synthesized
gcagagacacaaccaaaaaaga

SEQ ID NO: 1196805 - DNA, 22 bp, Artificial Sequence
  chemically synthesized
atcaaggatattggtctaaaat

SEQ ID NO: 1196806 - DNA, 22 bp, Artificial Sequence
  chemically synthesized
catcagtgttcatcaaggatat

SEQ ID NO: 1196807 - DNA, 22 bp, Artificial Sequence
  chemically synthesized
gcatcagtgttcatcaaggata

SEQ ID NO: 1196808 - DNA, 22 bp, Artificial Sequence
  chemically synthesized
tgcatcagtgttcatcaaggat

SEQ ID NO: 1196809 - DNA, 22 bp, Artificial Sequence
  chemically synthesized
ttgcatcagtgttcatcaagga

SEQ ID NO: 1196810 - DNA, 22 bp, Artificial Sequence
  chemically synthesized
tagaccaatatccttgatgaac

SEQ ID NO: 1196811 - DNA, 22 bp, Artificial Sequence
  chemically synthesized
agaccaatatccttgatgaaca

SEQ ID NO: 1196812 - DNA, 22 bp, Artificial Sequence
  chemically synthesized
gaccaatatccttgatgaacac

SEQ ID NO: 1196813 - DNA, 22 bp, Artificial Sequence
  chemically synthesized
aggatttttgcatcagtgttca

SEQ ID NO: 1196814 - DNA, 22 bp, Artificial Sequence
  chemically synthesized
ttgaggatttttgcatcagtgt

SEQ ID NO: 1196815 - DNA, 22 bp, Artificial Sequence
  chemically synthesized
attgaggatttttgcatcagtg

SEQ ID NO: 1196816 - DNA, 22 bp, Artificial Sequence
  chemically synthesized
tattgaggatttttgcatcagt

SEQ ID NO: 1196817 - DNA, 22 bp, Artificial Sequence
  chemically synthesized
gatgaacactgatgcaaaaatc

SEQ ID NO: 1196818 - DNA, 22 bp, Artificial Sequence
  chemically synthesized
atgaacactgatgcaaaaatcc

SEQ ID NO: 1196819 - DNA, 22 bp, Artificial Sequence
  chemically synthesized
ccagtattttattgaggatttt

SEQ ID NO: 1196820 - DNA, 22 bp, Artificial Sequence
  chemically synthesized
gccagtattttattgaggattt

SEQ ID NO: 1196821 - DNA, 22 bp, Artificial Sequence
  chemically synthesized
tgccagtattttattgaggatt

SEQ ID NO: 1196822 - DNA, 22 bp, Artificial Sequence
  chemically synthesized
gttttgccagtattttattgag

SEQ ID NO: 1196823 - DNA, 22 bp, Artificial Sequence
  chemically synthesized
atgcaaaaatcctcaataaaat

SEQ ID NO: 1196824 - DNA, 22 bp, Artificial Sequence
  chemically synthesized
gattcgttttgccagtatttta

SEQ ID NO: 1196825 - DNA, 22 bp, Artificial Sequence
  chemically synthesized
ctggattcgttttgccagtatt

SEQ ID NO: 1196826 - DNA, 22 bp, Artificial Sequence
  chemically synthesized
aataaaatactggcaaaacgaa

SEQ ID NO: 1196827 - DNA, 22 bp, Artificial Sequence
  chemically synthesized
atgtgctgctggattcgttttg

SEQ ID NO: 1196828 - DNA, 22 bp, Artificial Sequence
  chemically synthesized
gatgtgctgctggattcgtttt

SEQ ID NO: 1196829 - DNA, 22 bp, Artificial Sequence
  chemically synthesized
tgatgtgctgctggattcgttt

SEQ ID NO: 1196830 - DNA, 22 bp, Artificial Sequence
  chemically synthesized
ttgatgtgctgctggattcgtt

SEQ ID NO: 1196831 - DNA, 22 bp, Artificial Sequence
  chemically synthesized
tttgatgtgctgctggattcgt

SEQ ID NO: 1196832 - DNA, 22 bp, Artificial Sequence
  chemically synthesized
gcaaaacgaatccagcagcaca

SEQ ID NO: 1196833 - DNA, 22 bp, Artificial Sequence
  chemically synthesized
atcatggtggataagctttttg

SEQ ID NO: 1196834 - DNA, 22 bp, Artificial Sequence
  chemically synthesized
gatcatggtggataagcttttt

SEQ ID NO: 1196835 - DNA, 22 bp, Artificial Sequence
  chemically synthesized
atccaccatgatcaagtgggct

SEQ ID NO: 1196836 - DNA, 22 bp, Artificial Sequence
  chemically synthesized
tccaccatgatcaagtgggctt

SEQ ID NO: 1196837 - DNA, 22 bp, Artificial Sequence
  chemically synthesized
catcccagggatgaagcccact

SEQ ID NO: 1196838 - DNA, 22 bp, Artificial Sequence
  chemically synthesized
gcatcccagggatgaagcccac

SEQ ID NO: 1196839 - DNA, 22 bp, Artificial Sequence
  chemically synthesized
aaccagccttgcatcccaggga

SEQ ID NO: 1196840 - DNA, 22 bp, Artificial Sequence
  chemically synthesized
tgtatattgaaccagccttgca

SEQ ID NO: 1196841 - DNA, 22 bp, Artificial Sequence
  chemically synthesized
catccctgggatgcaaggctgg

SEQ ID NO: 1196842 - DNA, 22 bp, Artificial Sequence
  chemically synthesized
gtgtatattgaaccagccttgc

SEQ ID NO: 1196843 - DNA, 22 bp, Artificial Sequence
  chemically synthesized
atccctgggatgcaaggctggt

SEQ ID NO: 1196844 - DNA, 22 bp, Artificial Sequence
  chemically synthesized
atttgtgtatattgaaccagcc

SEQ ID NO: 1196845 - DNA, 22 bp, Artificial Sequence
  chemically synthesized
ttgatttgtgtatattgaacca

SEQ ID NO: 1196846 - DNA, 22 bp, Artificial Sequence
  chemically synthesized
ggatgcaaggctggttcaatat

SEQ ID NO: 1196847 - DNA, 22 bp, Artificial Sequence
  chemically synthesized
attgatttgtgtatattgaacc

SEQ ID NO: 1196848 - DNA, 22 bp, Artificial Sequence
  chemically synthesized
catttattgatttgtgtatatt

SEQ ID NO: 1196849 - DNA, 22 bp, Artificial Sequence
  chemically synthesized
gattacatttattgatttgtgt

SEQ ID NO: 1196850 - DNA, 22 bp, Artificial Sequence
  chemically synthesized
gttcaatatacacaaatcaata

SEQ ID NO: 1196851 - DNA, 22 bp, Artificial Sequence
  chemically synthesized
aatatacacaaatcaataaatg

SEQ ID NO: 1196852 - DNA, 22 bp, Artificial Sequence
  chemically synthesized
tatgctggattacatttattga

SEQ ID NO: 1196853 - DNA, 22 bp, Artificial Sequence
  chemically synthesized
atatgctggattacatttattg

SEQ ID NO: 1196854 - DNA, 22 bp, Artificial Sequence
  chemically synthesized
tttatatgctggattacattta

SEQ ID NO: 1196855 - DNA, 22 bp, Artificial Sequence
  chemically synthesized
tgtttatatgctggattacatt

SEQ ID NO: 1196856 - DNA, 22 bp, Artificial Sequence
  chemically synthesized
gctctgtttatatgctggatta

SEQ ID NO: 1196857 - DNA, 22 bp, Artificial Sequence
  chemically synthesized
ggctctgtttatatgctggatt

SEQ ID NO: 1196858 - DNA, 22 bp, Artificial Sequence
  chemically synthesized
tggctctgtttatatgctggat

SEQ ID NO: 1196859 - DNA, 22 bp, Artificial Sequence
  chemically synthesized
tctttggctctgtttatatgct

SEQ ID NO: 1196860 - DNA, 22 bp, Artificial Sequence
  chemically synthesized
gtctttggctctgtttatatgc

SEQ ID NO: 1196861 - DNA, 22 bp, Artificial Sequence
  chemically synthesized
tgtctttggctctgtttatatg

SEQ ID NO: 1196862 - DNA, 22 bp, Artificial Sequence
  chemically synthesized
ttgtctttggctctgtttatat

SEQ ID NO: 1196863 - DNA, 22 bp, Artificial Sequence
  chemically synthesized
tggagataatcatgtggttttt

SEQ ID NO: 1196864 - DNA, 22 bp, Artificial Sequence
  chemically synthesized
catctatggagataatcatgtg

SEQ ID NO: 1196865 - DNA, 22 bp, Artificial Sequence
  chemically synthesized
tgcatctatggagataatcatg

SEQ ID NO: 1196866 - DNA, 22 bp, Artificial Sequence
  chemically synthesized
ctgcatctatggagataatcat

SEQ ID NO: 1196867 - DNA, 22 bp, Artificial Sequence
  chemically synthesized
tctgcatctatggagataatca

SEQ ID NO: 1196868 - DNA, 22 bp, Artificial Sequence
  chemically synthesized
ttctgcatctatggagataatc

SEQ ID NO: 1196869 - DNA, 22 bp, Artificial Sequence
  chemically synthesized
tcaaaggccttttctgcatcta

SEQ ID NO: 1196870 - DNA, 22 bp, Artificial Sequence
  chemically synthesized
gtcaaaggccttttctgcatct

SEQ ID NO: 1196871 - DNA, 22 bp, Artificial Sequence
  chemically synthesized
tgtcaaaggccttttctgcatc

SEQ ID NO: 1196872 - DNA, 22 bp, Artificial Sequence
  chemically synthesized
tctccatagatgcagaaaaggc

SEQ ID NO: 1196873 - DNA, 22 bp, Artificial Sequence
  chemically synthesized
aattttgtcaaaggccttttct

SEQ ID NO: 1196874 - DNA, 22 bp, Artificial Sequence
  chemically synthesized
catagatgcagaaaaggccttt

SEQ ID NO: 1196875 - DNA, 22 bp, Artificial Sequence
  chemically synthesized
ttgaattttgtcaaaggccttt

SEQ ID NO: 1196876 - DNA, 22 bp, Artificial Sequence
  chemically synthesized
gcatgaagggttgttgaatttt

SEQ ID NO: 1196877 - DNA, 22 bp, Artificial Sequence
  chemically synthesized
agcatgaagggttgttgaattt

SEQ ID NO: 1196878 - DNA, 22 bp, Artificial Sequence
  chemically synthesized
tagcatgaagggttgttgaatt

SEQ ID NO: 1196879 - DNA, 22 bp, Artificial Sequence
  chemically synthesized
ttagcatgaagggttgttgaat

SEQ ID NO: 1196880 - DNA, 22 bp, Artificial Sequence
  chemically synthesized
tgacaaaattcaacaacccttc

SEQ ID NO: 1196881 - DNA, 22 bp, Artificial Sequence
  chemically synthesized
gacaaaattcaacaacccttca

SEQ ID NO: 1196882 - DNA, 22 bp, Artificial Sequence
  chemically synthesized
acaaaattcaacaacccttcat

SEQ ID NO: 1196883 - DNA, 22 bp, Artificial Sequence
  chemically synthesized
agagtttttagcatgaagggtt

SEQ ID NO: 1196884 - DNA, 22 bp, Artificial Sequence
  chemically synthesized
ctgagagtttttagcatgaagg

SEQ ID NO: 1196885 - DNA, 22 bp, Artificial Sequence
  chemically synthesized
actgagagtttttagcatgaag

SEQ ID NO: 1196886 - DNA, 22 bp, Artificial Sequence
  chemically synthesized
atttactgagagtttttagcat

SEQ ID NO: 1196887 - DNA, 22 bp, Artificial Sequence
  chemically synthesized
aacaacccttcatgctaaaaac

SEQ ID NO: 1196888 - DNA, 22 bp, Artificial Sequence
  chemically synthesized
catgctaaaaactctcagtaaa

SEQ ID NO: 1196889 - DNA, 22 bp, Artificial Sequence
  chemically synthesized
atgctaaaaactctcagtaaat

SEQ ID NO: 1196890 - DNA, 22 bp, Artificial Sequence
  chemically synthesized
aaaactctcagtaaattaggta

SEQ ID NO: 1196891 - DNA, 22 bp, Artificial Sequence
  chemically synthesized
aaatatgtcccgtcaataccta

SEQ ID NO: 1196892 - DNA, 22 bp, Artificial Sequence
  chemically synthesized
gaaatatgtcccgtcaatacct

SEQ ID NO: 1196893 - DNA, 22 bp, Artificial Sequence
  chemically synthesized
tgaaatatgtcccgtcaatacc

SEQ ID NO: 1196894 - DNA, 22 bp, Artificial Sequence
  chemically synthesized
tcagtaaattaggtattgacgg

SEQ ID NO: 1196895 - DNA, 22 bp, Artificial Sequence
  chemically synthesized
agtaaattaggtattgacggga

SEQ ID NO: 1196896 - DNA, 22 bp, Artificial Sequence
  chemically synthesized
ttttgaaatatgtcccgtcaat

SEQ ID NO: 1196897 - DNA, 22 bp, Artificial Sequence
  chemically synthesized
ttattttgaaatatgtcccgtc

SEQ ID NO: 1196898 - DNA, 22 bp, Artificial Sequence
  chemically synthesized
attattttgaaatatgtcccgt

SEQ ID NO: 1196899 - DNA, 22 bp, Artificial Sequence
  chemically synthesized
ttattattttgaaatatgtccc

SEQ ID NO: 1196900 - DNA, 22 bp, Artificial Sequence
  chemically synthesized
ggtattgacgggacatatttca

SEQ ID NO: 1196901 - DNA, 22 bp, Artificial Sequence
  chemically synthesized
acgggacatatttcaaaataat

SEQ ID NO: 1196902 - DNA, 22 bp, Artificial Sequence
  chemically synthesized
tcatagatagctcttattattt

SEQ ID NO: 1196903 - DNA, 22 bp, Artificial Sequence
  chemically synthesized
gtcatagatagctcttattatt

SEQ ID NO: 1196904 - DNA, 22 bp, Artificial Sequence
  chemically synthesized
tgggtttgtcatagatagctct

SEQ ID NO: 1196905 - DNA, 22 bp, Artificial Sequence
  chemically synthesized
caaaataataagagctatctat

SEQ ID NO: 1196906 - DNA, 22 bp, Artificial Sequence
  chemically synthesized
aaaataataagagctatctatg

SEQ ID NO: 1196907 - DNA, 22 bp, Artificial Sequence
  chemically synthesized
gctgtgggtttgtcatagatag

SEQ ID NO: 1196908 - DNA, 22 bp, Artificial Sequence
  chemically synthesized
agtatgatattggctgtgggtt

SEQ ID NO: 1196909 - DNA, 22 bp, Artificial Sequence
  chemically synthesized
tctatgacaaacccacagccaa

SEQ ID NO: 1196910 - DNA, 22 bp, Artificial Sequence
  chemically synthesized
tgacaaacccacagccaatatc

SEQ ID NO: 1196911 - DNA, 22 bp, Artificial Sequence
  chemically synthesized
cccattcagtatgatattggct

SEQ ID NO: 1196912 - DNA, 22 bp, Artificial Sequence
  chemically synthesized
gcccattcagtatgatattggc

SEQ ID NO: 1196913 - DNA, 22 bp, Artificial Sequence
  chemically synthesized
tgcccattcagtatgatattgg

SEQ ID NO: 1196914 - DNA, 22 bp, Artificial Sequence
  chemically synthesized
ttgcccattcagtatgatattg

SEQ ID NO: 1196915 - DNA, 22 bp, Artificial Sequence
  chemically synthesized
cagtttttgcccattcagtatg

SEQ ID NO: 1196916 - DNA, 22 bp, Artificial Sequence
  chemically synthesized
ccagtttttgcccattcagtat

SEQ ID NO: 1196917 - DNA, 22 bp, Artificial Sequence
  chemically synthesized
aaagggaatgcttccagttttt

SEQ ID NO: 1196918 - DNA, 22 bp, Artificial Sequence
  chemically synthesized
caaagggaatgcttccagtttt

SEQ ID NO: 1196919 - DNA, 22 bp, Artificial Sequence
  chemically synthesized
tcaaagggaatgcttccagttt

SEQ ID NO: 1196920 - DNA, 22 bp, Artificial Sequence
  chemically synthesized
aatgggcaaaaactggaagcat

SEQ ID NO: 1196921 - DNA, 22 bp, Artificial Sequence
  chemically synthesized
tgccagttttcaaagggaatgc

SEQ ID NO: 1196922 - DNA, 22 bp, Artificial Sequence
  chemically synthesized
gtgccagttttcaaagggaatg

SEQ ID NO: 1196923 - DNA, 22 bp, Artificial Sequence
  chemically synthesized
tcttgtgccagttttcaaaggg

SEQ ID NO: 1196924 - DNA, 22 bp, Artificial Sequence
  chemically synthesized
gaagcattccctttgaaaactg

SEQ ID NO: 1196925 - DNA, 22 bp, Artificial Sequence
  chemically synthesized
cctttgaaaactggcacaagac

SEQ ID NO: 1196926 - DNA, 22 bp, Artificial Sequence
  chemically synthesized
tgaaaactggcacaagacaggg

SEQ ID NO: 1196927 - DNA, 22 bp, Artificial Sequence
  chemically synthesized
gaaaactggcacaagacaggga

SEQ ID NO: 1196928 - DNA, 22 bp, Artificial Sequence
  chemically synthesized
aaaactggcacaagacagggat

SEQ ID NO: 1196929 - DNA, 22 bp, Artificial Sequence
  chemically synthesized
gcacaagacagggatgccctct

SEQ ID NO: 1196930 - DNA, 22 bp, Artificial Sequence
  chemically synthesized
aataggagtggtgagagagggc

SEQ ID NO: 1196931 - DNA, 22 bp, Artificial Sequence
  chemically synthesized
tgttgaataggagtggtgagag

SEQ ID NO: 1196932 - DNA, 22 bp, Artificial Sequence
  chemically synthesized
caacactatgttgaataggagt

SEQ ID NO: 1196933 - DNA, 22 bp, Artificial Sequence
  chemically synthesized
ccaacactatgttgaataggag

SEQ ID NO: 1196934 - DNA, 22 bp, Artificial Sequence
  chemically synthesized
tctcaccactcctattcaacat

SEQ ID NO: 1196935 - DNA, 22 bp, Artificial Sequence
  chemically synthesized
tcaccactcctattcaacatag

SEQ ID NO: 1196936 - DNA, 22 bp, Artificial Sequence
  chemically synthesized
accactcctattcaacatagtg

SEQ ID NO: 1196937 - DNA, 22 bp, Artificial Sequence
  chemically synthesized
gccagaacttccaacactatgt

SEQ ID NO: 1196938 - DNA, 22 bp, Artificial Sequence
  chemically synthesized
ctattcaacatagtgttggaag

SEQ ID NO: 1196939 - DNA, 22 bp, Artificial Sequence
  chemically synthesized
ccctggccagaacttccaacac

SEQ ID NO: 1196940 - DNA, 22 bp, Artificial Sequence
  chemically synthesized
ttcaacatagtgttggaagttc

SEQ ID NO: 1196941 - DNA, 22 bp, Artificial Sequence
  chemically synthesized
attgccctggccagaacttcca

SEQ ID NO: 1196942 - DNA, 22 bp, Artificial Sequence
  chemically synthesized
aacatagtgttggaagttctgg

SEQ ID NO: 1196943 - DNA, 22 bp, Artificial Sequence
  chemically synthesized
cctaattgccctggccagaact

SEQ ID NO: 1196944 - DNA, 22 bp, Artificial Sequence
  chemically synthesized
ctgcctaattgccctggccaga

SEQ ID NO: 1196945 - DNA, 22 bp, Artificial Sequence
  chemically synthesized
tcctgcctaattgccctggcca

SEQ ID NO: 1196946 - DNA, 22 bp, Artificial Sequence
  chemically synthesized
ctcctgcctaattgccctggcc

SEQ ID NO: 1196947 - DNA, 22 bp, Artificial Sequence
  chemically synthesized
cttctcctgcctaattgccctg

SEQ ID NO: 1196948 - DNA, 22 bp, Artificial Sequence
  chemically synthesized
gaagttctggccagggcaatta

SEQ ID NO: 1196949 - DNA, 22 bp, Artificial Sequence
  chemically synthesized
ccttctcctgcctaattgccct

SEQ ID NO: 1196950 - DNA, 22 bp, Artificial Sequence
  chemically synthesized
tttccttctcctgcctaattgc

SEQ ID NO: 1196951 - DNA, 22 bp, Artificial Sequence
  chemically synthesized
atttccttctcctgcctaattg

SEQ ID NO: 1196952 - DNA, 22 bp, Artificial Sequence
  chemically synthesized
tatttccttctcctgcctaatt

SEQ ID NO: 1196953 - DNA, 22 bp, Artificial Sequence
  chemically synthesized
tggccagggcaattaggcagga

SEQ ID NO: 1196954 - DNA, 22 bp, Artificial Sequence
  chemically synthesized
gccagggcaattaggcaggaga

SEQ ID NO: 1196955 - DNA, 22 bp, Artificial Sequence
  chemically synthesized
aataccctttatttccttctcc

SEQ ID NO: 1196956 - DNA, 22 bp, Artificial Sequence
  chemically synthesized
attgaataccctttatttcctt

SEQ ID NO: 1196957 - DNA, 22 bp, Artificial Sequence
  chemically synthesized
ctaattgaataccctttatttc

SEQ ID NO: 1196958 - DNA, 22 bp, Artificial Sequence
  chemically synthesized
ggcaggagaaggaaataaaggg

SEQ ID NO: 1196959 - DNA, 22 bp, Artificial Sequence
  chemically synthesized
cctaattgaataccctttattt

SEQ ID NO: 1196960 - DNA, 22 bp, Artificial Sequence
  chemically synthesized
tcctaattgaataccctttatt

SEQ ID NO: 1196961 - DNA, 22 bp, Artificial Sequence
  chemically synthesized
ttcctaattgaataccctttat

SEQ ID NO: 1196962 - DNA, 22 bp, Artificial Sequence
  chemically synthesized
ttttcctaattgaatacccttt

SEQ ID NO: 1196963 - DNA, 22 bp, Artificial Sequence
  chemically synthesized
tcttttcctaattgaataccct

SEQ ID NO: 1196964 - DNA, 22 bp, Artificial Sequence
  chemically synthesized
ctcttttcctaattgaataccc

SEQ ID NO: 1196965 - DNA, 22 bp, Artificial Sequence
  chemically synthesized
tctcttttcctaattgaatacc

SEQ ID NO: 1196966 - DNA, 22 bp, Artificial Sequence
  chemically synthesized
actttctcttttcctaattgaa

SEQ ID NO: 1196967 - DNA, 22 bp, Artificial Sequence
  chemically synthesized
gactttctcttttcctaattga

SEQ ID NO: 1196968 - DNA, 22 bp, Artificial Sequence
  chemically synthesized
aattaggaaaagagaaagtcaa

SEQ ID NO: 1196969 - DNA, 22 bp, Artificial Sequence
  chemically synthesized
caaacagggtcaatttgacttt

SEQ ID NO: 1196970 - DNA, 22 bp, Artificial Sequence
  chemically synthesized
ggaaaagagaaagtcaaattga

SEQ ID NO: 1196971 - DNA, 22 bp, Artificial Sequence
  chemically synthesized
gatatacaatcatgtcatctgc

SEQ ID NO: 1196972 - DNA, 22 bp, Artificial Sequence
  chemically synthesized
tagatatacaatcatgtcatct

SEQ ID NO: 1196973 - DNA, 22 bp, Artificial Sequence
  chemically synthesized
accctgtttgcagatgacatga

SEQ ID NO: 1196974 - DNA, 22 bp, Artificial Sequence
  chemically synthesized
ctagatatacaatcatgtcatc

SEQ ID NO: 1196975 - DNA, 22 bp, Artificial Sequence
  chemically synthesized
tctagatatacaatcatgtcat

SEQ ID NO: 1196976 - DNA, 22 bp, Artificial Sequence
  chemically synthesized
tttgcagatgacatgattgtat

SEQ ID NO: 1196977 - DNA, 22 bp, Artificial Sequence
  chemically synthesized
gcagatgacatgattgtatatc

SEQ ID NO: 1196978 - DNA, 22 bp, Artificial Sequence
  chemically synthesized
cagatgacatgattgtatatct

SEQ ID NO: 1196979 - DNA, 22 bp, Artificial Sequence
  chemically synthesized
agacagtggggttttctagata

SEQ ID NO: 1196980 - DNA, 22 bp, Artificial Sequence
  chemically synthesized
ggctgagacagtggggttttct

SEQ ID NO: 1196981 - DNA, 22 bp, Artificial Sequence
  chemically synthesized
aggctgagacagtggggttttc

SEQ ID NO: 1196982 - DNA, 22 bp, Artificial Sequence
  chemically synthesized
taggctgagacagtggggtttt

SEQ ID NO: 1196983 - DNA, 22 bp, Artificial Sequence
  chemically synthesized
tatatctagaaaaccccactgt

SEQ ID NO: 1196984 - DNA, 22 bp, Artificial Sequence
  chemically synthesized
aggagattttaggctgagacag

SEQ ID NO: 1196985 - DNA, 22 bp, Artificial Sequence
  chemically synthesized
aaggagattttaggctgagaca

SEQ ID NO: 1196986 - DNA, 22 bp, Artificial Sequence
  chemically synthesized
gaaaaccccactgtctcagcct

SEQ ID NO: 1196987 - DNA, 22 bp, Artificial Sequence
  chemically synthesized
tcagcttaaggagattttaggc

SEQ ID NO: 1196988 - DNA, 22 bp, Artificial Sequence
  chemically synthesized
cctatcagcttaaggagatttt

SEQ ID NO: 1196989 - DNA, 22 bp, Artificial Sequence
  chemically synthesized
tctcagcctaaaatctccttaa

SEQ ID NO: 1196990 - DNA, 22 bp, Artificial Sequence
  chemically synthesized
aagttccctatcagcttaagga

SEQ ID NO: 1196991 - DNA, 22 bp, Artificial Sequence
  chemically synthesized
agcctaaaatctccttaagctg

SEQ ID NO: 1196992 - DNA, 22 bp, Artificial Sequence
  chemically synthesized
ctgaagttccctatcagcttaa

SEQ ID NO: 1196993 - DNA, 22 bp, Artificial Sequence
  chemically synthesized
gctgaagttccctatcagctta

SEQ ID NO: 1196994 - DNA, 22 bp, Artificial Sequence
  chemically synthesized
tgctgaagttccctatcagctt

SEQ ID NO: 1196995 - DNA, 22 bp, Artificial Sequence
  chemically synthesized
aaatctccttaagctgataggg

SEQ ID NO: 1196996 - DNA, 22 bp, Artificial Sequence
  chemically synthesized
agactttgctgaagttccctat

SEQ ID NO: 1196997 - DNA, 22 bp, Artificial Sequence
  chemically synthesized
cttaagctgatagggaacttca

SEQ ID NO: 1196998 - DNA, 22 bp, Artificial Sequence
  chemically synthesized
aagctgatagggaacttcagca

SEQ ID NO: 1196999 - DNA, 22 bp, Artificial Sequence
  chemically synthesized
agctgatagggaacttcagcaa

SEQ ID NO: 1197000 - DNA, 22 bp, Artificial Sequence
  chemically synthesized
tatcctgagactttgctgaagt

SEQ ID NO: 1197001 - DNA, 22 bp, Artificial Sequence
  chemically synthesized
gtatcctgagactttgctgaag

SEQ ID NO: 1197002 - DNA, 22 bp, Artificial Sequence
  chemically synthesized
tgtatcctgagactttgctgaa

SEQ ID NO: 1197003 - DNA, 22 bp, Artificial Sequence
  chemically synthesized
atagggaacttcagcaaagtct

SEQ ID NO: 1197004 - DNA, 22 bp, Artificial Sequence
  chemically synthesized
attttgtatcctgagactttgc

SEQ ID NO: 1197005 - DNA, 22 bp, Artificial Sequence
  chemically synthesized
tacattgattttgtatcctgag

SEQ ID NO: 1197006 - DNA, 22 bp, Artificial Sequence
  chemically synthesized
gtacattgattttgtatcctga

SEQ ID NO: 1197007 - DNA, 22 bp, Artificial Sequence
  chemically synthesized
tgtacattgattttgtatcctg

SEQ ID NO: 1197008 - DNA, 22 bp, Artificial Sequence
  chemically synthesized
cagcaaagtctcaggatacaaa

SEQ ID NO: 1197009 - DNA, 22 bp, Artificial Sequence
  chemically synthesized
ttgtacattgattttgtatcct

SEQ ID NO: 1197010 - DNA, 22 bp, Artificial Sequence
  chemically synthesized
agcaaagtctcaggatacaaaa

SEQ ID NO: 1197011 - DNA, 22 bp, Artificial Sequence
  chemically synthesized
tgatttttgtacattgattttg

SEQ ID NO: 1197012 - DNA, 22 bp, Artificial Sequence
  chemically synthesized
gtgatttttgtacattgatttt

SEQ ID NO: 1197013 - DNA, 22 bp, Artificial Sequence
  chemically synthesized
aggatacaaaatcaatgtacaa

SEQ ID NO: 1197014 - DNA, 22 bp, Artificial Sequence
  chemically synthesized
gtgtataagaatgcttgtgatt

SEQ ID NO: 1197015 - DNA, 22 bp, Artificial Sequence
  chemically synthesized
ttggtgtataagaatgcttgtg

SEQ ID NO: 1197016 - DNA, 22 bp, Artificial Sequence
  chemically synthesized
ttgttggtgtataagaatgctt

SEQ ID NO: 1197017 - DNA, 22 bp, Artificial Sequence
  chemically synthesized
tctgttgttggtgtataagaat

SEQ ID NO: 1197018 - DNA, 22 bp, Artificial Sequence
  chemically synthesized
gtctgttgttggtgtataagaa

SEQ ID NO: 1197019 - DNA, 22 bp, Artificial Sequence
  chemically synthesized
cttgtctgttgttggtgtataa

SEQ ID NO: 1197020 - DNA, 22 bp, Artificial Sequence
  chemically synthesized
tgcttgtctgttgttggtgtat

SEQ ID NO: 1197021 - DNA, 22 bp, Artificial Sequence
  chemically synthesized
tctgcttgtctgttgttggtgt

SEQ ID NO: 1197022 - DNA, 22 bp, Artificial Sequence
  chemically synthesized
gctctctgcttgtctgttgttg

SEQ ID NO: 1197023 - DNA, 22 bp, Artificial Sequence
  chemically synthesized
ggctctctgcttgtctgttgtt

SEQ ID NO: 1197024 - DNA, 22 bp, Artificial Sequence
  chemically synthesized
ttatacaccaacaacagacaag

SEQ ID NO: 1197025 - DNA, 22 bp, Artificial Sequence
  chemically synthesized
atacaccaacaacagacaagca

SEQ ID NO: 1197026 - DNA, 22 bp, Artificial Sequence
  chemically synthesized
tacaccaacaacagacaagcag

SEQ ID NO: 1197027 - DNA, 22 bp, Artificial Sequence
  chemically synthesized
atgatttggctctctgcttgtc

SEQ ID NO: 1197028 - DNA, 22 bp, Artificial Sequence
  chemically synthesized
actcatgatttggctctctgct

SEQ ID NO: 1197029 - DNA, 22 bp, Artificial Sequence
  chemically synthesized
tgaatgggagttcactcatgat

SEQ ID NO: 1197030 - DNA, 22 bp, Artificial Sequence
  chemically synthesized
aagcaattgtgaatgggagttc

SEQ ID NO: 1197031 - DNA, 22 bp, Artificial Sequence
  chemically synthesized
gaagcaattgtgaatgggagtt

SEQ ID NO: 1197032 - DNA, 22 bp, Artificial Sequence
  chemically synthesized
tgaagcaattgtgaatgggagt

SEQ ID NO: 1197033 - DNA, 22 bp, Artificial Sequence
  chemically synthesized
tttgaagcaattgtgaatggga

SEQ ID NO: 1197034 - DNA, 22 bp, Artificial Sequence
  chemically synthesized
tctttgaagcaattgtgaatgg

SEQ ID NO: 1197035 - DNA, 22 bp, Artificial Sequence
  chemically synthesized
ttctctttgaagcaattgtgaa

SEQ ID NO: 1197036 - DNA, 22 bp, Artificial Sequence
  chemically synthesized
attctctttgaagcaattgtga

SEQ ID NO: 1197037 - DNA, 22 bp, Artificial Sequence
  chemically synthesized
tattctctttgaagcaattgtg

SEQ ID NO: 1197038 - DNA, 22 bp, Artificial Sequence
  chemically synthesized
ccattcacaattgcttcaaaga

SEQ ID NO: 1197039 - DNA, 22 bp, Artificial Sequence
  chemically synthesized
ggtattttattctctttgaagc

SEQ ID NO: 1197040 - DNA, 22 bp, Artificial Sequence
  chemically synthesized
ctaggtattttattctctttga

SEQ ID NO: 1197041 - DNA, 22 bp, Artificial Sequence
  chemically synthesized
acaattgcttcaaagagaataa

SEQ ID NO: 1197042 - DNA, 22 bp, Artificial Sequence
  chemically synthesized
gattcctaggtattttattctc

SEQ ID NO: 1197043 - DNA, 22 bp, Artificial Sequence
  chemically synthesized
cttcaaagagaataaaatacct

SEQ ID NO: 1197044 - DNA, 22 bp, Artificial Sequence
  chemically synthesized
taagttggattcctaggtattt

SEQ ID NO: 1197045 - DNA, 22 bp, Artificial Sequence
  chemically synthesized
caaagagaataaaatacctagg

SEQ ID NO: 1197046 - DNA, 22 bp, Artificial Sequence
  chemically synthesized
gtaagttggattcctaggtatt

SEQ ID NO: 1197047 - DNA, 22 bp, Artificial Sequence
  chemically synthesized
aaagagaataaaatacctagga

SEQ ID NO: 1197048 - DNA, 22 bp, Artificial Sequence
  chemically synthesized
acatcccttgtaagttggattc

SEQ ID NO: 1197049 - DNA, 22 bp, Artificial Sequence
  chemically synthesized
cacatcccttgtaagttggatt

SEQ ID NO: 1197050 - DNA, 22 bp, Artificial Sequence
  chemically synthesized
ggaatccaacttacaagggatg

SEQ ID NO: 1197051 - DNA, 22 bp, Artificial Sequence
  chemically synthesized
gaagaggtccttcacatccctt

SEQ ID NO: 1197052 - DNA, 22 bp, Artificial Sequence
  chemically synthesized
ctcgaagaggtccttcacatcc

SEQ ID NO: 1197053 - DNA, 22 bp, Artificial Sequence
  chemically synthesized
tcctcgaagaggtccttcacat

SEQ ID NO: 1197054 - DNA, 22 bp, Artificial Sequence
  chemically synthesized
acaagggatgtgaaggacctct

SEQ ID NO: 1197055 - DNA, 22 bp, Artificial Sequence
  chemically synthesized
caagggatgtgaaggacctctt

SEQ ID NO: 1197056 - DNA, 22 bp, Artificial Sequence
  chemically synthesized
tagttctcctcgaagaggtcct

SEQ ID NO: 1197057 - DNA, 22 bp, Artificial Sequence
  chemically synthesized
gtagttctcctcgaagaggtcc

SEQ ID NO: 1197058 - DNA, 22 bp, Artificial Sequence
  chemically synthesized
agcagtggtttgtagttctcct

SEQ ID NO: 1197059 - DNA, 22 bp, Artificial Sequence
  chemically synthesized
attgagcagtggtttgtagttc

SEQ ID NO: 1197060 - DNA, 22 bp, Artificial Sequence
  chemically synthesized
cattgagcagtggtttgtagtt

SEQ ID NO: 1197061 - DNA, 22 bp, Artificial Sequence
  chemically synthesized
ttcgaggagaactacaaaccac

SEQ ID NO: 1197062 - DNA, 22 bp, Artificial Sequence
  chemically synthesized
tttcattgagcagtggtttgta

SEQ ID NO: 1197063 - DNA, 22 bp, Artificial Sequence
  chemically synthesized
atttcattgagcagtggtttgt

SEQ ID NO: 1197064 - DNA, 22 bp, Artificial Sequence
  chemically synthesized
cgaggagaactacaaaccactg

SEQ ID NO: 1197065 - DNA, 22 bp, Artificial Sequence
  chemically synthesized
tatttcattgagcagtggtttg

SEQ ID NO: 1197066 - DNA, 22 bp, Artificial Sequence
  chemically synthesized
gaggagaactacaaaccactgc

SEQ ID NO: 1197067 - DNA, 22 bp, Artificial Sequence
  chemically synthesized
ttatttcattgagcagtggttt

SEQ ID NO: 1197068 - DNA, 22 bp, Artificial Sequence
  chemically synthesized
ttttatttcattgagcagtggt

SEQ ID NO: 1197069 - DNA, 22 bp, Artificial Sequence
  chemically synthesized
tatcctcttttatttcattgag

SEQ ID NO: 1197070 - DNA, 22 bp, Artificial Sequence
  chemically synthesized
gtatcctcttttatttcattga

SEQ ID NO: 1197071 - DNA, 22 bp, Artificial Sequence
  chemically synthesized
caaaccactgctcaatgaaata

SEQ ID NO: 1197072 - DNA, 22 bp, Artificial Sequence
  chemically synthesized
tttgtatcctcttttatttcat

SEQ ID NO: 1197073 - DNA, 22 bp, Artificial Sequence
  chemically synthesized
gtttgtatcctcttttatttca

SEQ ID NO: 1197074 - DNA, 22 bp, Artificial Sequence
  chemically synthesized
catttgtttgtatcctctttta

SEQ ID NO: 1197075 - DNA, 22 bp, Artificial Sequence
  chemically synthesized
ccatttgtttgtatcctctttt

SEQ ID NO: 1197076 - DNA, 22 bp, Artificial Sequence
  chemically synthesized
ctcaatgaaataaaagaggata

SEQ ID NO: 1197077 - DNA, 22 bp, Artificial Sequence
  chemically synthesized
ttccatttgtttgtatcctctt

SEQ ID NO: 1197078 - DNA, 22 bp, Artificial Sequence
  chemically synthesized
aatgaaataaaagaggatacaa

SEQ ID NO: 1197079 - DNA, 22 bp, Artificial Sequence
  chemically synthesized
cccatgagcatggaatgttctt

SEQ ID NO: 1197080 - DNA, 22 bp, Artificial Sequence
  chemically synthesized
ctacccatgagcatggaatgtt

SEQ ID NO: 1197081 - DNA, 22 bp, Artificial Sequence
  chemically synthesized
cctacccatgagcatggaatgt

SEQ ID NO: 1197082 - DNA, 22 bp, Artificial Sequence
  chemically synthesized
ttcctacccatgagcatggaat

SEQ ID NO: 1197083 - DNA, 22 bp, Artificial Sequence
  chemically synthesized
attcttcctacccatgagcatg

SEQ ID NO: 1197084 - DNA, 22 bp, Artificial Sequence
  chemically synthesized
acgatattgattcttcctaccc

SEQ ID NO: 1197085 - DNA, 22 bp, Artificial Sequence
  chemically synthesized
cacgatattgattcttcctacc

SEQ ID NO: 1197086 - DNA, 22 bp, Artificial Sequence
  chemically synthesized
tcacgatattgattcttcctac

SEQ ID NO: 1197087 - DNA, 22 bp, Artificial Sequence
  chemically synthesized
catgctcatgggtaggaagaat

SEQ ID NO: 1197088 - DNA, 22 bp, Artificial Sequence
  chemically synthesized
atgggtaggaagaatcaatatc

SEQ ID NO: 1197089 - DNA, 22 bp, Artificial Sequence
  chemically synthesized
ggcagtatggccattttcacga

SEQ ID NO: 1197090 - DNA, 22 bp, Artificial Sequence
  chemically synthesized
gggcagtatggccattttcacg

SEQ ID NO: 1197091 - DNA, 22 bp, Artificial Sequence
  chemically synthesized
ccttgggcagtatggccatttt

SEQ ID NO: 1197092 - DNA, 22 bp, Artificial Sequence
  chemically synthesized
taaattaccttgggcagtatgg

SEQ ID NO: 1197093 - DNA, 22 bp, Artificial Sequence
  chemically synthesized
aatctgtaaattaccttgggca

SEQ ID NO: 1197094 - DNA, 22 bp, Artificial Sequence
  chemically synthesized
cccaaggtaatttacagattca

SEQ ID NO: 1197095 - DNA, 22 bp, Artificial Sequence
  chemically synthesized
atggggatgacattgaatctgt

SEQ ID NO: 1197096 - DNA, 22 bp, Artificial Sequence
  chemically synthesized
gatggggatgacattgaatctg

SEQ ID NO: 1197097 - DNA, 22 bp, Artificial Sequence
  chemically synthesized
gtagcttgatggggatgacatt

SEQ ID NO: 1197098 - DNA, 22 bp, Artificial Sequence
  chemically synthesized
acagattcaatgtcatccccat

SEQ ID NO: 1197099 - DNA, 22 bp, Artificial Sequence
  chemically synthesized
cagattcaatgtcatccccatc

SEQ ID NO: 1197100 - DNA, 22 bp, Artificial Sequence
  chemically synthesized
aatgtcatccccatcaagctac

SEQ ID NO: 1197101 - DNA, 22 bp, Artificial Sequence
  chemically synthesized
tgaagaaaggcattggtagctt

SEQ ID NO: 1197102 - DNA, 22 bp, Artificial Sequence
  chemically synthesized
tgtgaagaaaggcattggtagc

SEQ ID NO: 1197103 - DNA, 22 bp, Artificial Sequence
  chemically synthesized
caattctgtgaagaaaggcatt

SEQ ID NO: 1197104 - DNA, 22 bp, Artificial Sequence
  chemically synthesized
ccaattctgtgaagaaaggcat

SEQ ID NO: 1197105 - DNA, 22 bp, Artificial Sequence
  chemically synthesized
tccaattctgtgaagaaaggca

SEQ ID NO: 1197106 - DNA, 22 bp, Artificial Sequence
  chemically synthesized
ttccaattctgtgaagaaaggc

SEQ ID NO: 1197107 - DNA, 22 bp, Artificial Sequence
  chemically synthesized
tttccaattctgtgaagaaagg

SEQ ID NO: 1197108 - DNA, 22 bp, Artificial Sequence
  chemically synthesized
ccaatgcctttcttcacagaat

SEQ ID NO: 1197109 - DNA, 22 bp, Artificial Sequence
  chemically synthesized
aagtagttttttccaattctgt

SEQ ID NO: 1197110 - DNA, 22 bp, Artificial Sequence
  chemically synthesized
aaagtagttttttccaattctg

SEQ ID NO: 1197111 - DNA, 22 bp, Artificial Sequence
  chemically synthesized
taaagtagttttttccaattct

SEQ ID NO: 1197112 - DNA, 22 bp, Artificial Sequence
  chemically synthesized
tcttcacagaattggaaaaaac

SEQ ID NO: 1197113 - DNA, 22 bp, Artificial Sequence
  chemically synthesized
cttcacagaattggaaaaaact

SEQ ID NO: 1197114 - DNA, 22 bp, Artificial Sequence
  chemically synthesized
ttcacagaattggaaaaaacta

SEQ ID NO: 1197115 - DNA, 22 bp, Artificial Sequence
  chemically synthesized
cacagaattggaaaaaactact

SEQ ID NO: 1197116 - DNA, 22 bp, Artificial Sequence
  chemically synthesized
acagaattggaaaaaactactt

SEQ ID NO: 1197117 - DNA, 22 bp, Artificial Sequence
  chemically synthesized
catatcaactttaaagtagttt

SEQ ID NO: 1197118 - DNA, 22 bp, Artificial Sequence
  chemically synthesized
gttccatatcaactttaaagta

SEQ ID NO: 1197119 - DNA, 22 bp, Artificial Sequence
  chemically synthesized
ggttccatatcaactttaaagt

SEQ ID NO: 1197120 - DNA, 22 bp, Artificial Sequence
  chemically synthesized
tggttccatatcaactttaaag

SEQ ID NO: 1197121 - DNA, 22 bp, Artificial Sequence
  chemically synthesized
ttggttccatatcaactttaaa

SEQ ID NO: 1197122 - DNA, 22 bp, Artificial Sequence
  chemically synthesized
gaaaaaactactttaaagttga

SEQ ID NO: 1197123 - DNA, 22 bp, Artificial Sequence
  chemically synthesized
tttggttccatatcaactttaa

SEQ ID NO: 1197124 - DNA, 22 bp, Artificial Sequence
  chemically synthesized
ttttggttccatatcaacttta

SEQ ID NO: 1197125 - DNA, 22 bp, Artificial Sequence
  chemically synthesized
ttttttggttccatatcaactt

SEQ ID NO: 1197126 - DNA, 22 bp, Artificial Sequence
  chemically synthesized
ctttaaagttgatatggaacca

SEQ ID NO: 1197127 - DNA, 22 bp, Artificial Sequence
  chemically synthesized
taaagttgatatggaaccaaaa

SEQ ID NO: 1197128 - DNA, 22 bp, Artificial Sequence
  chemically synthesized
aaagttgatatggaaccaaaaa

SEQ ID NO: 1197129 - DNA, 22 bp, Artificial Sequence
  chemically synthesized
aagttgatatggaaccaaaaaa

SEQ ID NO: 1197130 - DNA, 22 bp, Artificial Sequence
  chemically synthesized
gtgatgcgggctcttttttggt

SEQ ID NO: 1197131 - DNA, 22 bp, Artificial Sequence
  chemically synthesized
ggtgatgcgggctcttttttgg

SEQ ID NO: 1197132 - DNA, 22 bp, Artificial Sequence
  chemically synthesized
atatggaaccaaaaaagagccc

SEQ ID NO: 1197133 - DNA, 22 bp, Artificial Sequence
  chemically synthesized
ggagtgacttggtgatgcgggc

SEQ ID NO: 1197134 - DNA, 22 bp, Artificial Sequence
  chemically synthesized
aggagtgacttggtgatgcggg

SEQ ID NO: 1197135 - DNA, 22 bp, Artificial Sequence
  chemically synthesized
gcttaggagtgacttggtgatg

SEQ ID NO: 1197136 - DNA, 22 bp, Artificial Sequence
  chemically synthesized
ggcttaggagtgacttggtgat

SEQ ID NO: 1197137 - DNA, 22 bp, Artificial Sequence
  chemically synthesized
tggcttaggagtgacttggtga

SEQ ID NO: 1197138 - DNA, 22 bp, Artificial Sequence
  chemically synthesized
ttggcttaggagtgacttggtg

SEQ ID NO: 1197139 - DNA, 22 bp, Artificial Sequence
  chemically synthesized
ttttggcttaggagtgacttgg

SEQ ID NO: 1197140 - DNA, 22 bp, Artificial Sequence
  chemically synthesized
ttcttttggcttaggagtgact

SEQ ID NO: 1197141 - DNA, 22 bp, Artificial Sequence
  chemically synthesized
gttcttttggcttaggagtgac

SEQ ID NO: 1197142 - DNA, 22 bp, Artificial Sequence
  chemically synthesized
tgttcttttggcttaggagtga

SEQ ID NO: 1197143 - DNA, 22 bp, Artificial Sequence
  chemically synthesized
cagctttgttcttttggcttag

SEQ ID NO: 1197144 - DNA, 22 bp, Artificial Sequence
  chemically synthesized
ctaagccaaaagaacaaagctg

SEQ ID NO: 1197145 - DNA, 22 bp, Artificial Sequence
  chemically synthesized
agccaaaagaacaaagctggag

SEQ ID NO: 1197146 - DNA, 22 bp, Artificial Sequence
  chemically synthesized
aagtcaggtagtgtgatgcctc

SEQ ID NO: 1197147 - DNA, 22 bp, Artificial Sequence
  chemically synthesized
gaagtcaggtagtgtgatgcct

SEQ ID NO: 1197148 - DNA, 22 bp, Artificial Sequence
  chemically synthesized
gaggcatcacactacctgactt

SEQ ID NO: 1197149 - DNA, 22 bp, Artificial Sequence
  chemically synthesized
tagtatagtttgaagtcaggta

SEQ ID NO: 1197150 - DNA, 22 bp, Artificial Sequence
  chemically synthesized
gtagtatagtttgaagtcaggt

SEQ ID NO: 1197151 - DNA, 22 bp, Artificial Sequence
  chemically synthesized
cagccttgtagtatagtttgaa

SEQ ID NO: 1197152 - DNA, 22 bp, Artificial Sequence
  chemically synthesized
ctgcagccttgtagtatagttt

SEQ ID NO: 1197153 - DNA, 22 bp, Artificial Sequence
  chemically synthesized
cctgacttcaaactatactaca

SEQ ID NO: 1197154 - DNA, 22 bp, Artificial Sequence
  chemically synthesized
gttactgcagccttgtagtata

SEQ ID NO: 1197155 - DNA, 22 bp, Artificial Sequence
  chemically synthesized
ggttactgcagccttgtagtat

SEQ ID NO: 1197156 - DNA, 22 bp, Artificial Sequence
  chemically synthesized
tggttactgcagccttgtagta

SEQ ID NO: 1197157 - DNA, 22 bp, Artificial Sequence
  chemically synthesized
acttcaaactatactacaaggc

SEQ ID NO: 1197158 - DNA, 22 bp, Artificial Sequence
  chemically synthesized
ttttggttactgcagccttgta

SEQ ID NO: 1197159 - DNA, 22 bp, Artificial Sequence
  chemically synthesized
caaactatactacaaggctgca

SEQ ID NO: 1197160 - DNA, 22 bp, Artificial Sequence
  chemically synthesized
aaactatactacaaggctgcag

SEQ ID NO: 1197161 - DNA, 22 bp, Artificial Sequence
  chemically synthesized
tactacaaggctgcagtaacca

SEQ ID NO: 1197162 - DNA, 22 bp, Artificial Sequence
  chemically synthesized
caaggctgcagtaaccaaaaca

SEQ ID NO: 1197163 - DNA, 22 bp, Artificial Sequence
  chemically synthesized
gtaccagtaccatgctgttttg

SEQ ID NO: 1197164 - DNA, 22 bp, Artificial Sequence
  chemically synthesized
ggtaccagtaccatgctgtttt

SEQ ID NO: 1197165 - DNA, 22 bp, Artificial Sequence
  chemically synthesized
tggtaccagtaccatgctgttt

SEQ ID NO: 1197166 - DNA, 22 bp, Artificial Sequence
  chemically synthesized
cagtaaccaaaacagcatggta

SEQ ID NO: 1197167 - DNA, 22 bp, Artificial Sequence
  chemically synthesized
ttttggtaccagtaccatgctg

SEQ ID NO: 1197168 - DNA, 22 bp, Artificial Sequence
  chemically synthesized
tgttttggtaccagtaccatgc

SEQ ID NO: 1197169 - DNA, 22 bp, Artificial Sequence
  chemically synthesized
tatctctgttttggtaccagta

SEQ ID NO: 1197170 - DNA, 22 bp, Artificial Sequence
  chemically synthesized
atctatatctctgttttggtac

SEQ ID NO: 1197171 - DNA, 22 bp, Artificial Sequence
  chemically synthesized
cattgatctatatctctgtttt

SEQ ID NO: 1197172 - DNA, 22 bp, Artificial Sequence
  chemically synthesized
ttccattgatctatatctctgt

SEQ ID NO: 1197173 - DNA, 22 bp, Artificial Sequence
  chemically synthesized
tgttccattgatctatatctct

SEQ ID NO: 1197174 - DNA, 22 bp, Artificial Sequence
  chemically synthesized
gtaccaaaacagagatatagat

SEQ ID NO: 1197175 - DNA, 22 bp, Artificial Sequence
  chemically synthesized
ttctgttccattgatctatatc

SEQ ID NO: 1197176 - DNA, 22 bp, Artificial Sequence
  chemically synthesized
tgttctgttccattgatctata

SEQ ID NO: 1197177 - DNA, 22 bp, Artificial Sequence
  chemically synthesized
agggctctgttctgttccattg

SEQ ID NO: 1197178 - DNA, 22 bp, Artificial Sequence
  chemically synthesized
tgagggctctgttctgttccat

SEQ ID NO: 1197179 - DNA, 22 bp, Artificial Sequence
  chemically synthesized
ctgagggctctgttctgttcca

SEQ ID NO: 1197180 - DNA, 22 bp, Artificial Sequence
  chemically synthesized
tttctgagggctctgttctgtt

SEQ ID NO: 1197181 - DNA, 22 bp, Artificial Sequence
  chemically synthesized
agaaataacgccgcatatctac

SEQ ID NO: 1197182 - DNA, 22 bp, Artificial Sequence
  chemically synthesized
tcaaagatcagatagtggtaga

SEQ ID NO: 1197183 - DNA, 22 bp, Artificial Sequence
  chemically synthesized
gtcaaagatcagatagtggtag

SEQ ID NO: 1197184 - DNA, 22 bp, Artificial Sequence
  chemically synthesized
aggtttgtcaaagatcagatag

SEQ ID NO: 1197185 - DNA, 22 bp, Artificial Sequence
  chemically synthesized
tcaggtttgtcaaagatcagat

SEQ ID NO: 1197186 - DNA, 22 bp, Artificial Sequence
  chemically synthesized
ctcaggtttgtcaaagatcaga

SEQ ID NO: 1197187 - DNA, 22 bp, Artificial Sequence
  chemically synthesized
tctcaggtttgtcaaagatcag

SEQ ID NO: 1197188 - DNA, 22 bp, Artificial Sequence
  chemically synthesized
ttctcaggtttgtcaaagatca

SEQ ID NO: 1197189 - DNA, 22 bp, Artificial Sequence
  chemically synthesized
tttttctcaggtttgtcaaaga

SEQ ID NO: 1197190 - DNA, 22 bp, Artificial Sequence
  chemically synthesized
ccactatctgatctttgacaaa

SEQ ID NO: 1197191 - DNA, 22 bp, Artificial Sequence
  chemically synthesized
gtttttctcaggtttgtcaaag

SEQ ID NO: 1197192 - DNA, 22 bp, Artificial Sequence
  chemically synthesized
cttgtttttctcaggtttgtca

SEQ ID NO: 1197193 - DNA, 22 bp, Artificial Sequence
  chemically synthesized
tctgatctttgacaaacctgag

SEQ ID NO: 1197194 - DNA, 22 bp, Artificial Sequence
  chemically synthesized
atctttgacaaacctgagaaaa

SEQ ID NO: 1197195 - DNA, 22 bp, Artificial Sequence
  chemically synthesized
cccattgcttgtttttctcagg

SEQ ID NO: 1197196 - DNA, 22 bp, Artificial Sequence
  chemically synthesized
ccccattgcttgtttttctcag

SEQ ID NO: 1197197 - DNA, 22 bp, Artificial Sequence
  chemically synthesized
tccccattgcttgtttttctca

SEQ ID NO: 1197198 - DNA, 22 bp, Artificial Sequence
  chemically synthesized
tgacaaacctgagaaaaacaag

SEQ ID NO: 1197199 - DNA, 22 bp, Artificial Sequence
  chemically synthesized
gacaaacctgagaaaaacaagc

SEQ ID NO: 1197200 - DNA, 22 bp, Artificial Sequence
  chemically synthesized
acaaacctgagaaaaacaagca

SEQ ID NO: 1197201 - DNA, 22 bp, Artificial Sequence
  chemically synthesized
agaaaaacaagcaatggggaaa

SEQ ID NO: 1197202 - DNA, 22 bp, Artificial Sequence
  chemically synthesized
aatagggaatcctttccccatt

SEQ ID NO: 1197203 - DNA, 22 bp, Artificial Sequence
  chemically synthesized
ttaaatagggaatcctttcccc

SEQ ID NO: 1197204 - DNA, 22 bp, Artificial Sequence
  chemically synthesized
attaaatagggaatcctttccc

SEQ ID NO: 1197205 - DNA, 22 bp, Artificial Sequence
  chemically synthesized
gcaccatttattaaatagggaa

SEQ ID NO: 1197206 - DNA, 22 bp, Artificial Sequence
  chemically synthesized
ctagcaccatttattaaatagg

SEQ ID NO: 1197207 - DNA, 22 bp, Artificial Sequence
  chemically synthesized
cctagcaccatttattaaatag

SEQ ID NO: 1197208 - DNA, 22 bp, Artificial Sequence
  chemically synthesized
tcctagcaccatttattaaata

SEQ ID NO: 1197209 - DNA, 22 bp, Artificial Sequence
  chemically synthesized
gccagttttcctagcaccattt

SEQ ID NO: 1197210 - DNA, 22 bp, Artificial Sequence
  chemically synthesized
cctatttaataaatggtgctag

SEQ ID NO: 1197211 - DNA, 22 bp, Artificial Sequence
  chemically synthesized
tttaataaatggtgctaggaaa

SEQ ID NO: 1197212 - DNA, 22 bp, Artificial Sequence
  chemically synthesized
aataaatggtgctaggaaaact

SEQ ID NO: 1197213 - DNA, 22 bp, Artificial Sequence
  chemically synthesized
ataaatggtgctaggaaaactg

SEQ ID NO: 1197214 - DNA, 22 bp, Artificial Sequence
  chemically synthesized
catatggctagccagttttcct

SEQ ID NO: 1197215 - DNA, 22 bp, Artificial Sequence
  chemically synthesized
tacatatggctagccagttttc

SEQ ID NO: 1197216 - DNA, 22 bp, Artificial Sequence
  chemically synthesized
ctacatatggctagccagtttt

SEQ ID NO: 1197217 - DNA, 22 bp, Artificial Sequence
  chemically synthesized
tctacatatggctagccagttt

SEQ ID NO: 1197218 - DNA, 22 bp, Artificial Sequence
  chemically synthesized
agctttctacatatggctagcc

SEQ ID NO: 1197219 - DNA, 22 bp, Artificial Sequence
  chemically synthesized
cagctttctacatatggctagc

SEQ ID NO: 1197220 - DNA, 22 bp, Artificial Sequence
  chemically synthesized
ggaaaactggctagccatatgt

SEQ ID NO: 1197221 - DNA, 22 bp, Artificial Sequence
  chemically synthesized
gctagccatatgtagaaagctg

SEQ ID NO: 1197222 - DNA, 22 bp, Artificial Sequence
  chemically synthesized
gccatatgtagaaagctgaaac

SEQ ID NO: 1197223 - DNA, 22 bp, Artificial Sequence
  chemically synthesized
tataaggtgtgaggaagggatc

SEQ ID NO: 1197224 - DNA, 22 bp, Artificial Sequence
  chemically synthesized
gtataaggtgtgaggaagggat

SEQ ID NO: 1197225 - DNA, 22 bp, Artificial Sequence
  chemically synthesized
tgtataaggtgtgaggaaggga

SEQ ID NO: 1197226 - DNA, 22 bp, Artificial Sequence
  chemically synthesized
ttgtataaggtgtgaggaaggg

SEQ ID NO: 1197227 - DNA, 22 bp, Artificial Sequence
  chemically synthesized
aaactggatcccttcctcacac

SEQ ID NO: 1197228 - DNA, 22 bp, Artificial Sequence
  chemically synthesized
atttttgtataaggtgtgagga

SEQ ID NO: 1197229 - DNA, 22 bp, Artificial Sequence
  chemically synthesized
gatcccttcctcacaccttata

SEQ ID NO: 1197230 - DNA, 22 bp, Artificial Sequence
  chemically synthesized
aattgatttttgtataaggtgt

SEQ ID NO: 1197231 - DNA, 22 bp, Artificial Sequence
  chemically synthesized
cctcacaccttatacaaaaatc

SEQ ID NO: 1197232 - DNA, 22 bp, Artificial Sequence
  chemically synthesized
ctcacaccttatacaaaaatca

SEQ ID NO: 1197233 - DNA, 22 bp, Artificial Sequence
  chemically synthesized
atccatgttgaattgatttttg

SEQ ID NO: 1197234 - DNA, 22 bp, Artificial Sequence
  chemically synthesized
aatccatgttgaattgattttt

SEQ ID NO: 1197235 - DNA, 22 bp, Artificial Sequence
  chemically synthesized
acaccttatacaaaaatcaatt

SEQ ID NO: 1197236 - DNA, 22 bp, Artificial Sequence
  chemically synthesized
taatccatgttgaattgatttt

SEQ ID NO: 1197237 - DNA, 22 bp, Artificial Sequence
  chemically synthesized
ttaatccatgttgaattgattt

SEQ ID NO: 1197238 - DNA, 22 bp, Artificial Sequence
  chemically synthesized
agtttttaatccatgttgaatt

SEQ ID NO: 1197239 - DNA, 22 bp, Artificial Sequence
  chemically synthesized
atacaaaaatcaattcaacatg

SEQ ID NO: 1197240 - DNA, 22 bp, Artificial Sequence
  chemically synthesized
aagtttttaatccatgttgaat

SEQ ID NO: 1197241 - DNA, 22 bp, Artificial Sequence
  chemically synthesized
tacaaaaatcaattcaacatgg

SEQ ID NO: 1197242 - DNA, 22 bp, Artificial Sequence
  chemically synthesized
acgtttaagtttttaatccatg

SEQ ID NO: 1197243 - DNA, 22 bp, Artificial Sequence
  chemically synthesized
ggtctaacgtttaagtttttaa

SEQ ID NO: 1197244 - DNA, 22 bp, Artificial Sequence
  chemically synthesized
aggtctaacgtttaagttttta

SEQ ID NO: 1197245 - DNA, 22 bp, Artificial Sequence
  chemically synthesized
taggtctaacgtttaagttttt

SEQ ID NO: 1197246 - DNA, 22 bp, Artificial Sequence
  chemically synthesized
aacatggattaaaaacttaaac

SEQ ID NO: 1197247 - DNA, 22 bp, Artificial Sequence
  chemically synthesized
tggttttaggtctaacgtttaa

SEQ ID NO: 1197248 - DNA, 22 bp, Artificial Sequence
  chemically synthesized
atggttttaggtctaacgttta

SEQ ID NO: 1197249 - DNA, 22 bp, Artificial Sequence
  chemically synthesized
tatggttttaggtctaacgttt

SEQ ID NO: 1197250 - DNA, 22 bp, Artificial Sequence
  chemically synthesized
ttatggttttaggtctaacgtt

SEQ ID NO: 1197251 - DNA, 22 bp, Artificial Sequence
  chemically synthesized
aaaacttaaacgttagacctaa

SEQ ID NO: 1197252 - DNA, 22 bp, Artificial Sequence
  chemically synthesized
cagggtttttatggttttaggt

SEQ ID NO: 1197253 - DNA, 22 bp, Artificial Sequence
  chemically synthesized
ccagggtttttatggttttagg

SEQ ID NO: 1197254 - DNA, 22 bp, Artificial Sequence
  chemically synthesized
aaacgttagacctaaaaccata

SEQ ID NO: 1197255 - DNA, 22 bp, Artificial Sequence
  chemically synthesized
ttccagggtttttatggtttta

SEQ ID NO: 1197256 - DNA, 22 bp, Artificial Sequence
  chemically synthesized
aacgttagacctaaaaccataa

SEQ ID NO: 1197257 - DNA, 22 bp, Artificial Sequence
  chemically synthesized
cttccagggtttttatggtttt

SEQ ID NO: 1197258 - DNA, 22 bp, Artificial Sequence
  chemically synthesized
tcttccagggtttttatggttt

SEQ ID NO: 1197259 - DNA, 22 bp, Artificial Sequence
  chemically synthesized
ggttttcttccagggtttttat

SEQ ID NO: 1197260 - DNA, 22 bp, Artificial Sequence
  chemically synthesized
gacctaaaaccataaaaaccct

SEQ ID NO: 1197261 - DNA, 22 bp, Artificial Sequence
  chemically synthesized
aaaccataaaaaccctggaaga

SEQ ID NO: 1197262 - DNA, 22 bp, Artificial Sequence
  chemically synthesized
aatggtaatgcctaggttttct

SEQ ID NO: 1197263 - DNA, 22 bp, Artificial Sequence
  chemically synthesized
tgtcctgaatggtaatgcctag

SEQ ID NO: 1197264 - DNA, 22 bp, Artificial Sequence
  chemically synthesized
gaagaaaacctaggcattacca

SEQ ID NO: 1197265 - DNA, 22 bp, Artificial Sequence
  chemically synthesized
cccatgcctatgtcctgaatgg

SEQ ID NO: 1197266 - DNA, 22 bp, Artificial Sequence
  chemically synthesized
gcccatgcctatgtcctgaatg

SEQ ID NO: 1197267 - DNA, 22 bp, Artificial Sequence
  chemically synthesized
ggcattaccattcaggacatag

SEQ ID NO: 1197268 - DNA, 22 bp, Artificial Sequence
  chemically synthesized
ccattcaggacataggcatggg

SEQ ID NO: 1197269 - DNA, 22 bp, Artificial Sequence
  chemically synthesized
gacatgaagtccttgcccatgc

SEQ ID NO: 1197270 - DNA, 22 bp, Artificial Sequence
  chemically synthesized
agacatgaagtccttgcccatg

SEQ ID NO: 1197271 - DNA, 22 bp, Artificial Sequence
  chemically synthesized
tagacatgaagtccttgcccat

SEQ ID NO: 1197272 - DNA, 22 bp, Artificial Sequence
  chemically synthesized
aggacataggcatgggcaagga

SEQ ID NO: 1197273 - DNA, 22 bp, Artificial Sequence
  chemically synthesized
gtgttttagacatgaagtcctt

SEQ ID NO: 1197274 - DNA, 22 bp, Artificial Sequence
  chemically synthesized
ggtgttttagacatgaagtcct

SEQ ID NO: 1197275 - DNA, 22 bp, Artificial Sequence
  chemically synthesized
tggtgttttagacatgaagtcc

SEQ ID NO: 1197276 - DNA, 22 bp, Artificial Sequence
  chemically synthesized
ttggtgttttagacatgaagtc

SEQ ID NO: 1197277 - DNA, 22 bp, Artificial Sequence
  chemically synthesized
cttttggtgttttagacatgaa

SEQ ID NO: 1197278 - DNA, 22 bp, Artificial Sequence
  chemically synthesized
ccattgcttttggtgttttaga

SEQ ID NO: 1197279 - DNA, 22 bp, Artificial Sequence
  chemically synthesized
ttgccattgcttttggtgtttt

SEQ ID NO: 1197280 - DNA, 22 bp, Artificial Sequence
  chemically synthesized
gttgccattgcttttggtgttt

SEQ ID NO: 1197281 - DNA, 22 bp, Artificial Sequence
  chemically synthesized
tgttgccattgcttttggtgtt

SEQ ID NO: 1197282 - DNA, 22 bp, Artificial Sequence
  chemically synthesized
ttgttgccattgcttttggtgt

SEQ ID NO: 1197283 - DNA, 22 bp, Artificial Sequence
  chemically synthesized
catgtctaaaacaccaaaagca

SEQ ID NO: 1197284 - DNA, 22 bp, Artificial Sequence
  chemically synthesized
atgtctaaaacaccaaaagcaa

SEQ ID NO: 1197285 - DNA, 22 bp, Artificial Sequence
  chemically synthesized
gcttttgttgccattgcttttg

SEQ ID NO: 1197286 - DNA, 22 bp, Artificial Sequence
  chemically synthesized
tggcttttgttgccattgcttt

SEQ ID NO: 1197287 - DNA, 22 bp, Artificial Sequence
  chemically synthesized
aaacaccaaaagcaatggcaac

SEQ ID NO: 1197288 - DNA, 22 bp, Artificial Sequence
  chemically synthesized
tcagttctggcttttgttgcca

SEQ ID NO: 1197289 - DNA, 22 bp, Artificial Sequence
  chemically synthesized
gtcagttctggcttttgttgcc

SEQ ID NO: 1197290 - DNA, 22 bp, Artificial Sequence
  chemically synthesized
acgagatcccatttgtcagttc

SEQ ID NO: 1197291 - DNA, 22 bp, Artificial Sequence
  chemically synthesized
aacgagatcccatttgtcagtt

SEQ ID NO: 1197292 - DNA, 22 bp, Artificial Sequence
  chemically synthesized
gtttaacgagatcccatttgtc

SEQ ID NO: 1197293 - DNA, 22 bp, Artificial Sequence
  chemically synthesized
agtttaacgagatcccatttgt

SEQ ID NO: 1197294 - DNA, 22 bp, Artificial Sequence
  chemically synthesized
tagtttaacgagatcccatttg

SEQ ID NO: 1197295 - DNA, 22 bp, Artificial Sequence
  chemically synthesized
tttagtttaacgagatcccatt

SEQ ID NO: 1197296 - DNA, 22 bp, Artificial Sequence
  chemically synthesized
acaaatgggatctcgttaaact

SEQ ID NO: 1197297 - DNA, 22 bp, Artificial Sequence
  chemically synthesized
tgcagaagctctttagtttaac

SEQ ID NO: 1197298 - DNA, 22 bp, Artificial Sequence
  chemically synthesized
ttgtgcagaagctctttagttt

SEQ ID NO: 1197299 - DNA, 22 bp, Artificial Sequence
  chemically synthesized
gttgtgcagaagctctttagtt

SEQ ID NO: 1197300 - DNA, 22 bp, Artificial Sequence
  chemically synthesized
tgttgtgcagaagctctttagt

SEQ ID NO: 1197301 - DNA, 22 bp, Artificial Sequence
  chemically synthesized
ttgttgtgcagaagctctttag

SEQ ID NO: 1197302 - DNA, 22 bp, Artificial Sequence
  chemically synthesized
ttttgttgtgcagaagctcttt

SEQ ID NO: 1197303 - DNA, 22 bp, Artificial Sequence
  chemically synthesized
cttttgttgtgcagaagctctt

SEQ ID NO: 1197304 - DNA, 22 bp, Artificial Sequence
  chemically synthesized
gttaaactaaagagcttctgca

SEQ ID NO: 1197305 - DNA, 22 bp, Artificial Sequence
  chemically synthesized
aactaaagagcttctgcacaac

SEQ ID NO: 1197306 - DNA, 22 bp, Artificial Sequence
  chemically synthesized
atggtagtttcttttgttgtgc

SEQ ID NO: 1197307 - DNA, 22 bp, Artificial Sequence
  chemically synthesized
aagagcttctgcacaacaaaag

SEQ ID NO: 1197308 - DNA, 22 bp, Artificial Sequence
  chemically synthesized
tgatggtagtttcttttgttgt

SEQ ID NO: 1197309 - DNA, 22 bp, Artificial Sequence
  chemically synthesized
actctgatggtagtttcttttg

SEQ ID NO: 1197310 - DNA, 22 bp, Artificial Sequence
  chemically synthesized
ttcactctgatggtagtttctt

SEQ ID NO: 1197311 - DNA, 22 bp, Artificial Sequence
  chemically synthesized
ctgcacaacaaaagaaactacc

SEQ ID NO: 1197312 - DNA, 22 bp, Artificial Sequence
  chemically synthesized
tgcacaacaaaagaaactacca

SEQ ID NO: 1197313 - DNA, 22 bp, Artificial Sequence
  chemically synthesized
cacaacaaaagaaactaccatc

SEQ ID NO: 1197314 - DNA, 22 bp, Artificial Sequence
  chemically synthesized
cctgttcactctgatggtagtt

SEQ ID NO: 1197315 - DNA, 22 bp, Artificial Sequence
  chemically synthesized
taggttgcctgttcactctgat

SEQ ID NO: 1197316 - DNA, 22 bp, Artificial Sequence
  chemically synthesized
gtaggttgcctgttcactctga

SEQ ID NO: 1197317 - DNA, 22 bp, Artificial Sequence
  chemically synthesized
tgtaggttgcctgttcactctg

SEQ ID NO: 1197318 - DNA, 22 bp, Artificial Sequence
  chemically synthesized
ccattttgtaggttgcctgttc

SEQ ID NO: 1197319 - DNA, 22 bp, Artificial Sequence
  chemically synthesized
ccatcagagtgaacaggcaacc

SEQ ID NO: 1197320 - DNA, 22 bp, Artificial Sequence
  chemically synthesized
tcccattttgtaggttgcctgt

SEQ ID NO: 1197321 - DNA, 22 bp, Artificial Sequence
  chemically synthesized
ctcccattttgtaggttgcctg

SEQ ID NO: 1197322 - DNA, 22 bp, Artificial Sequence
  chemically synthesized
tctcccattttgtaggttgcct

SEQ ID NO: 1197323 - DNA, 22 bp, Artificial Sequence
  chemically synthesized
caaaaattttctcccattttgt

SEQ ID NO: 1197324 - DNA, 22 bp, Artificial Sequence
  chemically synthesized
caaaatgggagaaaatttttgc

SEQ ID NO: 1197325 - DNA, 22 bp, Artificial Sequence
  chemically synthesized
tcagatgagtaggttgcaaaaa

SEQ ID NO: 1197326 - DNA, 22 bp, Artificial Sequence
  chemically synthesized
gtcagatgagtaggttgcaaaa

SEQ ID NO: 1197327 - DNA, 22 bp, Artificial Sequence
  chemically synthesized
tgtcagatgagtaggttgcaaa

SEQ ID NO: 1197328 - DNA, 22 bp, Artificial Sequence
  chemically synthesized
gccctttgtcagatgagtaggt

SEQ ID NO: 1197329 - DNA, 22 bp, Artificial Sequence
  chemically synthesized
ttgcaacctactcatctgacaa

SEQ ID NO: 1197330 - DNA, 22 bp, Artificial Sequence
  chemically synthesized
gatattagccctttgtcagatg

SEQ ID NO: 1197331 - DNA, 22 bp, Artificial Sequence
  chemically synthesized
tgcaacctactcatctgacaaa

SEQ ID NO: 1197332 - DNA, 22 bp, Artificial Sequence
  chemically synthesized
gcaacctactcatctgacaaag

SEQ ID NO: 1197333 - DNA, 22 bp, Artificial Sequence
  chemically synthesized
tggatattagccctttgtcaga

SEQ ID NO: 1197334 - DNA, 22 bp, Artificial Sequence
  chemically synthesized
caacctactcatctgacaaagg

SEQ ID NO: 1197335 - DNA, 22 bp, Artificial Sequence
  chemically synthesized
tagattctggatattagccctt

SEQ ID NO: 1197336 - DNA, 22 bp, Artificial Sequence
  chemically synthesized
ctcatctgacaaagggctaata

SEQ ID NO: 1197337 - DNA, 22 bp, Artificial Sequence
  chemically synthesized
atctgacaaagggctaatatcc

SEQ ID NO: 1197338 - DNA, 22 bp, Artificial Sequence
  chemically synthesized
attgtagattctggatattagc

SEQ ID NO: 1197339 - DNA, 22 bp, Artificial Sequence
  chemically synthesized
acaaagggctaatatccagaat

SEQ ID NO: 1197340 - DNA, 22 bp, Artificial Sequence
  chemically synthesized
agttcattgtagattctggata

SEQ ID NO: 1197341 - DNA, 22 bp, Artificial Sequence
  chemically synthesized
gagttcattgtagattctggat

SEQ ID NO: 1197342 - DNA, 22 bp, Artificial Sequence
  chemically synthesized
tttgagttcattgtagattctg

SEQ ID NO: 1197343 - DNA, 22 bp, Artificial Sequence
  chemically synthesized
gtttgagttcattgtagattct

SEQ ID NO: 1197344 - DNA, 22 bp, Artificial Sequence
  chemically synthesized
atatccagaatctacaatgaac

SEQ ID NO: 1197345 - DNA, 22 bp, Artificial Sequence
  chemically synthesized
taaatttgtttgagttcattgt

SEQ ID NO: 1197346 - DNA, 22 bp, Artificial Sequence
  chemically synthesized
gtaaatttgtttgagttcattg

SEQ ID NO: 1197347 - DNA, 22 bp, Artificial Sequence
  chemically synthesized
ttgtaaatttgtttgagttcat

SEQ ID NO: 1197348 - DNA, 22 bp, Artificial Sequence
  chemically synthesized
cttgtaaatttgtttgagttca

SEQ ID NO: 1197349 - DNA, 22 bp, Artificial Sequence
  chemically synthesized
tcttgtaaatttgtttgagttc

SEQ ID NO: 1197350 - DNA, 22 bp, Artificial Sequence
  chemically synthesized
ttcttgtaaatttgtttgagtt

SEQ ID NO: 1197351 - DNA, 22 bp, Artificial Sequence
  chemically synthesized
tttcttgtaaatttgtttgagt

SEQ ID NO: 1197352 - DNA, 22 bp, Artificial Sequence
  chemically synthesized
ttttttcttgtaaatttgtttg

SEQ ID NO: 1197353 - DNA, 22 bp, Artificial Sequence
  chemically synthesized
gttttttcttgtaaatttgttt

SEQ ID NO: 1197354 - DNA, 22 bp, Artificial Sequence
  chemically synthesized
caatgaactcaaacaaatttac

SEQ ID NO: 1197355 - DNA, 22 bp, Artificial Sequence
  chemically synthesized
tttgttttttcttgtaaatttg

SEQ ID NO: 1197356 - DNA, 22 bp, Artificial Sequence
  chemically synthesized
aaacaaatttacaagaaaaaac

SEQ ID NO: 1197357 - DNA, 22 bp, Artificial Sequence
  chemically synthesized
atggggttgtttgttttttctt

SEQ ID NO: 1197358 - DNA, 22 bp, Artificial Sequence
  chemically synthesized
gatggggttgtttgttttttct

SEQ ID NO: 1197359 - DNA, 22 bp, Artificial Sequence
  chemically synthesized
tgatggggttgtttgttttttc

SEQ ID NO: 1197360 - DNA, 22 bp, Artificial Sequence
  chemically synthesized
ttgatggggttgtttgtttttt

SEQ ID NO: 1197361 - DNA, 22 bp, Artificial Sequence
  chemically synthesized
tttgatggggttgtttgttttt

SEQ ID NO: 1197362 - DNA, 22 bp, Artificial Sequence
  chemically synthesized
acaagaaaaaacaaacaacccc

SEQ ID NO: 1197363 - DNA, 22 bp, Artificial Sequence
  chemically synthesized
caagaaaaaacaaacaacccca

SEQ ID NO: 1197364 - DNA, 22 bp, Artificial Sequence
  chemically synthesized
gcccactttttgatggggttgt

SEQ ID NO: 1197365 - DNA, 22 bp, Artificial Sequence
  chemically synthesized
cgcccactttttgatggggttg

SEQ ID NO: 1197366 - DNA, 22 bp, Artificial Sequence
  chemically synthesized
atgtccttcgcccactttttga

SEQ ID NO: 1197367 - DNA, 22 bp, Artificial Sequence
  chemically synthesized
ttcatgtccttcgcccactttt

SEQ ID NO: 1197368 - DNA, 22 bp, Artificial Sequence
  chemically synthesized
tctgttcatgtccttcgcccac

SEQ ID NO: 1197369 - DNA, 22 bp, Artificial Sequence
  chemically synthesized
agaattgtctgttcatgtcctt

SEQ ID NO: 1197370 - DNA, 22 bp, Artificial Sequence
  chemically synthesized
gagaattgtctgttcatgtcct

SEQ ID NO: 1197371 - DNA, 22 bp, Artificial Sequence
  chemically synthesized
tgagaattgtctgttcatgtcc

SEQ ID NO: 1197372 - DNA, 22 bp, Artificial Sequence
  chemically synthesized
ttgagaattgtctgttcatgtc

SEQ ID NO: 1197373 - DNA, 22 bp, Artificial Sequence
  chemically synthesized
ttttgagaattgtctgttcatg

SEQ ID NO: 1197374 - DNA, 22 bp, Artificial Sequence
  chemically synthesized
cttttgagaattgtctgttcat

SEQ ID NO: 1197375 - DNA, 22 bp, Artificial Sequence
  chemically synthesized
cataaatgtcttcttttgagaa

SEQ ID NO: 1197376 - DNA, 22 bp, Artificial Sequence
  chemically synthesized
gctgcataaatgtcttcttttg

SEQ ID NO: 1197377 - DNA, 22 bp, Artificial Sequence
  chemically synthesized
ggctgcataaatgtcttctttt

SEQ ID NO: 1197378 - DNA, 22 bp, Artificial Sequence
  chemically synthesized
tggctgcataaatgtcttcttt

SEQ ID NO: 1197379 - DNA, 22 bp, Artificial Sequence
  chemically synthesized
ttggctgcataaatgtcttctt

SEQ ID NO: 1197380 - DNA, 22 bp, Artificial Sequence
  chemically synthesized
tcaaaagaagacatttatgcag

SEQ ID NO: 1197381 - DNA, 22 bp, Artificial Sequence
  chemically synthesized
atgtgtcttttggctgcataaa

SEQ ID NO: 1197382 - DNA, 22 bp, Artificial Sequence
  chemically synthesized
aaaagaagacatttatgcagcc

SEQ ID NO: 1197383 - DNA, 22 bp, Artificial Sequence
  chemically synthesized
catgtgtcttttggctgcataa

SEQ ID NO: 1197384 - DNA, 22 bp, Artificial Sequence
  chemically synthesized
tcatgtgtcttttggctgcata

SEQ ID NO: 1197385 - DNA, 22 bp, Artificial Sequence
  chemically synthesized
ttcatgtgtcttttggctgcat

SEQ ID NO: 1197386 - DNA, 22 bp, Artificial Sequence
  chemically synthesized
tttcatgtgtcttttggctgca

SEQ ID NO: 1197387 - DNA, 22 bp, Artificial Sequence
  chemically synthesized
atgcagccaaaagacacatgaa

SEQ ID NO: 1197388 - DNA, 22 bp, Artificial Sequence
  chemically synthesized
tgcagccaaaagacacatgaaa

SEQ ID NO: 1197389 - DNA, 22 bp, Artificial Sequence
  chemically synthesized
atgcccagtgatgatgagcatt

SEQ ID NO: 1197390 - DNA, 22 bp, Artificial Sequence
  chemically synthesized
tgatgcccagtgatgatgagca

SEQ ID NO: 1197391 - DNA, 22 bp, Artificial Sequence
  chemically synthesized
tctgatgcccagtgatgatgag

SEQ ID NO: 1197392 - DNA, 22 bp, Artificial Sequence
  chemically synthesized
ctctgatgcccagtgatgatga

SEQ ID NO: 1197393 - DNA, 22 bp, Artificial Sequence
  chemically synthesized
catttctctgatgcccagtgat

SEQ ID NO: 1197394 - DNA, 22 bp, Artificial Sequence
  chemically synthesized
gcatttctctgatgcccagtga

SEQ ID NO: 1197395 - DNA, 22 bp, Artificial Sequence
  chemically synthesized
atttgcatttctctgatgccca

SEQ ID NO: 1197396 - DNA, 22 bp, Artificial Sequence
  chemically synthesized
gatttgcatttctctgatgccc

SEQ ID NO: 1197397 - DNA, 22 bp, Artificial Sequence
  chemically synthesized
tgatttgcatttctctgatgcc

SEQ ID NO: 1197398 - DNA, 22 bp, Artificial Sequence
  chemically synthesized
atcatcactgggcatcagagaa

SEQ ID NO: 1197399 - DNA, 22 bp, Artificial Sequence
  chemically synthesized
tggttttgatttgcatttctct

SEQ ID NO: 1197400 - DNA, 22 bp, Artificial Sequence
  chemically synthesized
attgtggttttgatttgcattt

SEQ ID NO: 1197401 - DNA, 22 bp, Artificial Sequence
  chemically synthesized
ggcatcagagaaatgcaaatca

SEQ ID NO: 1197402 - DNA, 22 bp, Artificial Sequence
  chemically synthesized
gtgtgagatggtatctcattgt

SEQ ID NO: 1197403 - DNA, 22 bp, Artificial Sequence
  chemically synthesized
actggtgtgagatggtatctca

SEQ ID NO: 1197404 - DNA, 22 bp, Artificial Sequence
  chemically synthesized
taactggtgtgagatggtatct

SEQ ID NO: 1197405 - DNA, 22 bp, Artificial Sequence
  chemically synthesized
atgatcgccattctaactggtg

SEQ ID NO: 1197406 - DNA, 22 bp, Artificial Sequence
  chemically synthesized
aatgatcgccattctaactggt

SEQ ID NO: 1197407 - DNA, 22 bp, Artificial Sequence
  chemically synthesized
taatgatcgccattctaactgg

SEQ ID NO: 1197408 - DNA, 22 bp, Artificial Sequence
  chemically synthesized
ttaatgatcgccattctaactg

SEQ ID NO: 1197409 - DNA, 22 bp, Artificial Sequence
  chemically synthesized
tttaatgatcgccattctaact

SEQ ID NO: 1197410 - DNA, 22 bp, Artificial Sequence
  chemically synthesized
actttttaatgatcgccattct

SEQ ID NO: 1197411 - DNA, 22 bp, Artificial Sequence
  chemically synthesized
acaccagttagaatggcgatca

SEQ ID NO: 1197412 - DNA, 22 bp, Artificial Sequence
  chemically synthesized
ctgactttttaatgatcgccat

SEQ ID NO: 1197413 - DNA, 22 bp, Artificial Sequence
  chemically synthesized
cctgactttttaatgatcgcca

SEQ ID NO: 1197414 - DNA, 22 bp, Artificial Sequence
  chemically synthesized
tttcctgactttttaatgatcg

SEQ ID NO: 1197415 - DNA, 22 bp, Artificial Sequence
  chemically synthesized
ttgtttcctgactttttaatga

SEQ ID NO: 1197416 - DNA, 22 bp, Artificial Sequence
  chemically synthesized
gaatggcgatcattaaaaagtc

SEQ ID NO: 1197417 - DNA, 22 bp, Artificial Sequence
  chemically synthesized
cagcacctgttgtttcctgact

SEQ ID NO: 1197418 - DNA, 22 bp, Artificial Sequence
  chemically synthesized
tccagcacctgttgtttcctga

SEQ ID NO: 1197419 - DNA, 22 bp, Artificial Sequence
  chemically synthesized
aaaagtcaggaaacaacaggtg

SEQ ID NO: 1197420 - DNA, 22 bp, Artificial Sequence
  chemically synthesized
cacatcctctccagcacctgtt

SEQ ID NO: 1197421 - DNA, 22 bp, Artificial Sequence
  chemically synthesized
tccacatcctctccagcacctg

SEQ ID NO: 1197422 - DNA, 22 bp, Artificial Sequence
  chemically synthesized
ctccacatcctctccagcacct

SEQ ID NO: 1197423 - DNA, 22 bp, Artificial Sequence
  chemically synthesized
tttctccacatcctctccagca

SEQ ID NO: 1197424 - DNA, 22 bp, Artificial Sequence
  chemically synthesized
ctatttctccacatcctctcca

SEQ ID NO: 1197425 - DNA, 22 bp, Artificial Sequence
  chemically synthesized
gagaggatgtggagaaatagga

SEQ ID NO: 1197426 - DNA, 22 bp, Artificial Sequence
  chemically synthesized
cagtcccaccaacagtgaaaaa

SEQ ID NO: 1197427 - DNA, 22 bp, Artificial Sequence
  chemically synthesized
acagtcccaccaacagtgaaaa

SEQ ID NO: 1197428 - DNA, 22 bp, Artificial Sequence
  chemically synthesized
gtttacagtcccaccaacagtg

SEQ ID NO: 1197429 - DNA, 22 bp, Artificial Sequence
  chemically synthesized
aactagtttacagtcccaccaa

SEQ ID NO: 1197430 - DNA, 22 bp, Artificial Sequence
  chemically synthesized
tttcactgttggtgggactgta

SEQ ID NO: 1197431 - DNA, 22 bp, Artificial Sequence
  chemically synthesized
ttcactgttggtgggactgtaa

SEQ ID NO: 1197432 - DNA, 22 bp, Artificial Sequence
  chemically synthesized
tcactgttggtgggactgtaaa

SEQ ID NO: 1197433 - DNA, 22 bp, Artificial Sequence
  chemically synthesized
cactgttggtgggactgtaaac

SEQ ID NO: 1197434 - DNA, 22 bp, Artificial Sequence
  chemically synthesized
actgttggtgggactgtaaact

SEQ ID NO: 1197435 - DNA, 22 bp, Artificial Sequence
  chemically synthesized
cacaatggttgaactagtttac

SEQ ID NO: 1197436 - DNA, 22 bp, Artificial Sequence
  chemically synthesized
ttggtgggactgtaaactagtt

SEQ ID NO: 1197437 - DNA, 22 bp, Artificial Sequence
  chemically synthesized
ccacaatggttgaactagttta

SEQ ID NO: 1197438 - DNA, 22 bp, Artificial Sequence
  chemically synthesized
gtgggactgtaaactagttcaa

SEQ ID NO: 1197439 - DNA, 22 bp, Artificial Sequence
  chemically synthesized
acttccacaatggttgaactag

SEQ ID NO: 1197440 - DNA, 22 bp, Artificial Sequence
  chemically synthesized
taaactagttcaaccattgtgg

SEQ ID NO: 1197441 - DNA, 22 bp, Artificial Sequence
  chemically synthesized
gttcaaccattgtggaagtcag

SEQ ID NO: 1197442 - DNA, 22 bp, Artificial Sequence
  chemically synthesized
aggaatggccacactgacttcc

SEQ ID NO: 1197443 - DNA, 22 bp, Artificial Sequence
  chemically synthesized
aaccattgtggaagtcagtgtg

SEQ ID NO: 1197444 - DNA, 22 bp, Artificial Sequence
  chemically synthesized
gatccctgaggaatggccacac

SEQ ID NO: 1197445 - DNA, 22 bp, Artificial Sequence
  chemically synthesized
tagatccctgaggaatggccac

SEQ ID NO: 1197446 - DNA, 22 bp, Artificial Sequence
  chemically synthesized
tggaagtcagtgtggccattcc

SEQ ID NO: 1197447 - DNA, 22 bp, Artificial Sequence
  chemically synthesized
gttctagatccctgaggaatgg

SEQ ID NO: 1197448 - DNA, 22 bp, Artificial Sequence
  chemically synthesized
tagttctagatccctgaggaat

SEQ ID NO: 1197449 - DNA, 22 bp, Artificial Sequence
  chemically synthesized
ctagttctagatccctgaggaa

SEQ ID NO: 1197450 - DNA, 22 bp, Artificial Sequence
  chemically synthesized
ctcagggatctagaactagaaa

SEQ ID NO: 1197451 - DNA, 22 bp, Artificial Sequence
  chemically synthesized
ggtcaaatgcgatttctagttc

SEQ ID NO: 1197452 - DNA, 22 bp, Artificial Sequence
  chemically synthesized
agggatctagaactagaaatcg

SEQ ID NO: 1197453 - DNA, 22 bp, Artificial Sequence
  chemically synthesized
gaactagaaatcgcatttgacc

SEQ ID NO: 1197454 - DNA, 22 bp, Artificial Sequence
  chemically synthesized
gaaatcgcatttgacccagcca

SEQ ID NO: 1197455 - DNA, 22 bp, Artificial Sequence
  chemically synthesized
tgggtatatacccagtaacggg

SEQ ID NO: 1197456 - DNA, 22 bp, Artificial Sequence
  chemically synthesized
gacccagccatcccgttactgg

SEQ ID NO: 1197457 - DNA, 22 bp, Artificial Sequence
  chemically synthesized
acccagccatcccgttactggg

SEQ ID NO: 1197458 - DNA, 22 bp, Artificial Sequence
  chemically synthesized
tagtcctatgggtatataccca

SEQ ID NO: 1197459 - DNA, 22 bp, Artificial Sequence
  chemically synthesized
atagtcctatgggtatataccc

SEQ ID NO: 1197460 - DNA, 22 bp, Artificial Sequence
  chemically synthesized
ctgggtatatacccataggact

SEQ ID NO: 1197461 - DNA, 22 bp, Artificial Sequence
  chemically synthesized
ggtatatacccataggactata

SEQ ID NO: 1197462 - DNA, 22 bp, Artificial Sequence
  chemically synthesized
tagcagcatgatttatagtcct

SEQ ID NO: 1197463 - DNA, 22 bp, Artificial Sequence
  chemically synthesized
atagcagcatgatttatagtcc

SEQ ID NO: 1197464 - DNA, 22 bp, Artificial Sequence
  chemically synthesized
tatagcagcatgatttatagtc

SEQ ID NO: 1197465 - DNA, 22 bp, Artificial Sequence
  chemically synthesized
taaatcatgctgctataaagac

SEQ ID NO: 1197466 - DNA, 22 bp, Artificial Sequence
  chemically synthesized
ctataaagacacatgcacacgt

SEQ ID NO: 1197467 - DNA, 22 bp, Artificial Sequence
  chemically synthesized
taaagacacatgcacacgtatg

SEQ ID NO: 1197468 - DNA, 22 bp, Artificial Sequence
  chemically synthesized
tcgtgaataatgccgcaataaa

SEQ ID NO: 1197469 - DNA, 22 bp, Artificial Sequence
  chemically synthesized
ctatcgtgaataatgccgcaat

SEQ ID NO: 1197470 - DNA, 22 bp, Artificial Sequence
  chemically synthesized
gctatcgtgaataatgccgcaa

SEQ ID NO: 1197471 - DNA, 22 bp, Artificial Sequence
  chemically synthesized
tgctatcgtgaataatgccgca

SEQ ID NO: 1197472 - DNA, 22 bp, Artificial Sequence
  chemically synthesized
caagtctttgctatcgtgaata

SEQ ID NO: 1197473 - DNA, 22 bp, Artificial Sequence
  chemically synthesized
attgcggcattattcacgatag

SEQ ID NO: 1197474 - DNA, 22 bp, Artificial Sequence
  chemically synthesized
ttgcggcattattcacgatagc

SEQ ID NO: 1197475 - DNA, 22 bp, Artificial Sequence
  chemically synthesized
gttccaagtctttgctatcgtg

SEQ ID NO: 1197476 - DNA, 22 bp, Artificial Sequence
  chemically synthesized
cggcattattcacgatagcaaa

SEQ ID NO: 1197477 - DNA, 22 bp, Artificial Sequence
  chemically synthesized
ggttggttccaagtctttgcta

SEQ ID NO: 1197478 - DNA, 22 bp, Artificial Sequence
  chemically synthesized
gggttggttccaagtctttgct

SEQ ID NO: 1197479 - DNA, 22 bp, Artificial Sequence
  chemically synthesized
ttcacgatagcaaagacttgga

SEQ ID NO: 1197480 - DNA, 22 bp, Artificial Sequence
  chemically synthesized
acgatagcaaagacttggaacc

SEQ ID NO: 1197481 - DNA, 22 bp, Artificial Sequence
  chemically synthesized
gacatttgggttggttccaagt

SEQ ID NO: 1197482 - DNA, 22 bp, Artificial Sequence
  chemically synthesized
ttggacatttgggttggttcca

SEQ ID NO: 1197483 - DNA, 22 bp, Artificial Sequence
  chemically synthesized
tcattgttggacatttgggttg

SEQ ID NO: 1197484 - DNA, 22 bp, Artificial Sequence
  chemically synthesized
tatcattgttggacatttgggt

SEQ ID NO: 1197485 - DNA, 22 bp, Artificial Sequence
  chemically synthesized
ggaaccaacccaaatgtccaac

SEQ ID NO: 1197486 - DNA, 22 bp, Artificial Sequence
  chemically synthesized
gaaccaacccaaatgtccaaca

SEQ ID NO: 1197487 - DNA, 22 bp, Artificial Sequence
  chemically synthesized
atccactctatcattgttggac

SEQ ID NO: 1197488 - DNA, 22 bp, Artificial Sequence
  chemically synthesized
aatccactctatcattgttgga

SEQ ID NO: 1197489 - DNA, 22 bp, Artificial Sequence
  chemically synthesized
ttaatccactctatcattgttg

SEQ ID NO: 1197490 - DNA, 22 bp, Artificial Sequence
  chemically synthesized
cttaatccactctatcattgtt

SEQ ID NO: 1197491 - DNA, 22 bp, Artificial Sequence
  chemically synthesized
tcttaatccactctatcattgt

SEQ ID NO: 1197492 - DNA, 22 bp, Artificial Sequence
  chemically synthesized
catggtgtatatgtgccacatt

SEQ ID NO: 1197493 - DNA, 22 bp, Artificial Sequence
  chemically synthesized
agaaaatgtggcacatatacac

SEQ ID NO: 1197494 - DNA, 22 bp, Artificial Sequence
  chemically synthesized
tggccgcatagcattccatggt

SEQ ID NO: 1197495 - DNA, 22 bp, Artificial Sequence
  chemically synthesized
atggccgcatagcattccatgg

SEQ ID NO: 1197496 - DNA, 22 bp, Artificial Sequence
  chemically synthesized
tatggccgcatagcattccatg

SEQ ID NO: 1197497 - DNA, 22 bp, Artificial Sequence
  chemically synthesized
ttatggccgcatagcattccat

SEQ ID NO: 1197498 - DNA, 22 bp, Artificial Sequence
  chemically synthesized
tttatggccgcatagcattcca

SEQ ID NO: 1197499 - DNA, 22 bp, Artificial Sequence
  chemically synthesized
atcattttttatggccgcatag

SEQ ID NO: 1197500 - DNA, 22 bp, Artificial Sequence
  chemically synthesized
tgcggccataaaaaatgatgag

SEQ ID NO: 1197501 - DNA, 22 bp, Artificial Sequence
  chemically synthesized
caaaggacatgaactcatcatt

SEQ ID NO: 1197502 - DNA, 22 bp, Artificial Sequence
  chemically synthesized
atccatgtccctacaaaggaca

SEQ ID NO: 1197503 - DNA, 22 bp, Artificial Sequence
  chemically synthesized
catccatgtccctacaaaggac

SEQ ID NO: 1197504 - DNA, 22 bp, Artificial Sequence
  chemically synthesized
caatttcatccatgtccctaca

SEQ ID NO: 1197505 - DNA, 22 bp, Artificial Sequence
  chemically synthesized
ccaatttcatccatgtccctac

SEQ ID NO: 1197506 - DNA, 22 bp, Artificial Sequence
  chemically synthesized
atgtcctttgtagggacatgga

SEQ ID NO: 1197507 - DNA, 22 bp, Artificial Sequence
  chemically synthesized
tgtagggacatggatgaaattg

SEQ ID NO: 1197508 - DNA, 22 bp, Artificial Sequence
  chemically synthesized
gtagggacatggatgaaattgg

SEQ ID NO: 1197509 - DNA, 22 bp, Artificial Sequence
  chemically synthesized
tagggacatggatgaaattgga

SEQ ID NO: 1197510 - DNA, 22 bp, Artificial Sequence
  chemically synthesized
agaatgatgatttccaatttca

SEQ ID NO: 1197511 - DNA, 22 bp, Artificial Sequence
  chemically synthesized
ctgagaatgatgatttccaatt

SEQ ID NO: 1197512 - DNA, 22 bp, Artificial Sequence
  chemically synthesized
actgagaatgatgatttccaat

SEQ ID NO: 1197513 - DNA, 22 bp, Artificial Sequence
  chemically synthesized
cgatagtttactgagaatgatg

SEQ ID NO: 1197514 - DNA, 22 bp, Artificial Sequence
  chemically synthesized
gcgatagtttactgagaatgat

SEQ ID NO: 1197515 - DNA, 22 bp, Artificial Sequence
  chemically synthesized
ttgcgatagtttactgagaatg

SEQ ID NO: 1197516 - DNA, 22 bp, Artificial Sequence
  chemically synthesized
ttcttgcgatagtttactgaga

SEQ ID NO: 1197517 - DNA, 22 bp, Artificial Sequence
  chemically synthesized
gaaatcatcattctcagtaaac

SEQ ID NO: 1197518 - DNA, 22 bp, Artificial Sequence
  chemically synthesized
gttcttgcgatagtttactgag

SEQ ID NO: 1197519 - DNA, 22 bp, Artificial Sequence
  chemically synthesized
tgttcttgcgatagtttactga

SEQ ID NO: 1197520 - DNA, 22 bp, Artificial Sequence
  chemically synthesized
ttgttcttgcgatagtttactg

SEQ ID NO: 1197521 - DNA, 22 bp, Artificial Sequence
  chemically synthesized
tttgttcttgcgatagtttact

SEQ ID NO: 1197522 - DNA, 22 bp, Artificial Sequence
  chemically synthesized
gttttttgttcttgcgatagtt

SEQ ID NO: 1197523 - DNA, 22 bp, Artificial Sequence
  chemically synthesized
ggttttttgttcttgcgatagt

SEQ ID NO: 1197524 - DNA, 22 bp, Artificial Sequence
  chemically synthesized
tcagtaaactatcgcaagaaca

SEQ ID NO: 1197525 - DNA, 22 bp, Artificial Sequence
  chemically synthesized
agtaaactatcgcaagaacaaa

SEQ ID NO: 1197526 - DNA, 22 bp, Artificial Sequence
  chemically synthesized
tcgcaagaacaaaaaaccaaac

SEQ ID NO: 1197527 - DNA, 22 bp, Artificial Sequence
  chemically synthesized
tgagtgagaatatgtggtgttt

SEQ ID NO: 1197528 - DNA, 22 bp, Artificial Sequence
  chemically synthesized
ccacctatgagtgagaatatgt

SEQ ID NO: 1197529 - DNA, 22 bp, Artificial Sequence
  chemically synthesized
aattcccacctatgagtgagaa

SEQ ID NO: 1197530 - DNA, 22 bp, Artificial Sequence
  chemically synthesized
ttcaattcccacctatgagtga

SEQ ID NO: 1197531 - DNA, 22 bp, Artificial Sequence
  chemically synthesized
attgttcaattcccacctatga

SEQ ID NO: 1197532 - DNA, 22 bp, Artificial Sequence
  chemically synthesized
tcattgttcaattcccacctat

SEQ ID NO: 1197533 - DNA, 22 bp, Artificial Sequence
  chemically synthesized
tcactcataggtgggaattgaa

SEQ ID NO: 1197534 - DNA, 22 bp, Artificial Sequence
  chemically synthesized
actcataggtgggaattgaaca

SEQ ID NO: 1197535 - DNA, 22 bp, Artificial Sequence
  chemically synthesized
ataggtgggaattgaacaatga

SEQ ID NO: 1197536 - DNA, 22 bp, Artificial Sequence
  chemically synthesized
tgtccatgtgttctcattgttc

SEQ ID NO: 1197537 - DNA, 22 bp, Artificial Sequence
  chemically synthesized
ctgtgtccatgtgttctcattg

SEQ ID NO: 1197538 - DNA, 22 bp, Artificial Sequence
  chemically synthesized
cctgtgtccatgtgttctcatt

SEQ ID NO: 1197539 - DNA, 22 bp, Artificial Sequence
  chemically synthesized
cccttcctgtgtccatgtgttc

SEQ ID NO: 1197540 - DNA, 22 bp, Artificial Sequence
  chemically synthesized
aacaatgagaacacatggacac

SEQ ID NO: 1197541 - DNA, 22 bp, Artificial Sequence
  chemically synthesized
cccccaccccaccacagtcccc

SEQ ID NO: 1197542 - DNA, 22 bp, Artificial Sequence
  chemically synthesized
ccccctccccccaccccaccac

SEQ ID NO: 1197543 - DNA, 22 bp, Artificial Sequence
  chemically synthesized
tggggactgtggtggggtgggg

SEQ ID NO: 1197544 - DNA, 22 bp, Artificial Sequence
  chemically synthesized
gggactgtggtggggtgggggg

SEQ ID NO: 1197545 - DNA, 22 bp, Artificial Sequence
  chemically synthesized
tccctaccccctccccccaccc

SEQ ID NO: 1197546 - DNA, 22 bp, Artificial Sequence
  chemically synthesized
tggtggggtggggggagggggt

SEQ ID NO: 1197547 - DNA, 22 bp, Artificial Sequence
  chemically synthesized
ccagtgctatccctaccccctc

SEQ ID NO: 1197548 - DNA, 22 bp, Artificial Sequence
  chemically synthesized
gataaatctcccagtgctatcc

SEQ ID NO: 1197549 - DNA, 22 bp, Artificial Sequence
  chemically synthesized
gcattagataaatctcccagtg

SEQ ID NO: 1197550 - DNA, 22 bp, Artificial Sequence
  chemically synthesized
gtcatctagcattagataaatc

SEQ ID NO: 1197551 - DNA, 22 bp, Artificial Sequence
  chemically synthesized
actcgtcatctagcattagata

SEQ ID NO: 1197552 - DNA, 22 bp, Artificial Sequence
  chemically synthesized
ggagatttatctaatgctagat

SEQ ID NO: 1197553 - DNA, 22 bp, Artificial Sequence
  chemically synthesized
cacccactaactcgtcatctag

SEQ ID NO: 1197554 - DNA, 22 bp, Artificial Sequence
  chemically synthesized
atctaatgctagatgacgagtt

SEQ ID NO: 1197555 - DNA, 22 bp, Artificial Sequence
  chemically synthesized
tctaatgctagatgacgagtta

SEQ ID NO: 1197556 - DNA, 22 bp, Artificial Sequence
  chemically synthesized
gtgcgctgcacccactaactcg

SEQ ID NO: 1197557 - DNA, 22 bp, Artificial Sequence
  chemically synthesized
atgctagatgacgagttagtgg

SEQ ID NO: 1197558 - DNA, 22 bp, Artificial Sequence
  chemically synthesized
gatgacgagttagtgggtgcag

SEQ ID NO: 1197559 - DNA, 22 bp, Artificial Sequence
  chemically synthesized
gtgggtgcagcgcaccagcatg

SEQ ID NO: 1197560 - DNA, 22 bp, Artificial Sequence
  chemically synthesized
catacgtatacatgtgccatgc

SEQ ID NO: 1197561 - DNA, 22 bp, Artificial Sequence
  chemically synthesized
gttacatacgtatacatgtgcc

SEQ ID NO: 1197562 - DNA, 22 bp, Artificial Sequence
  chemically synthesized
tgcaggttagttacatacgtat

SEQ ID NO: 1197563 - DNA, 22 bp, Artificial Sequence
  chemically synthesized
gggtacatgtgcacattgtgca

SEQ ID NO: 1197564 - DNA, 22 bp, Artificial Sequence
  chemically synthesized
agggtacatgtgcacattgtgc

SEQ ID NO: 1197565 - DNA, 22 bp, Artificial Sequence
  chemically synthesized
tagggtacatgtgcacattgtg

SEQ ID NO: 1197566 - DNA, 22 bp, Artificial Sequence
  chemically synthesized
agctttagggtacatgtgcaca

SEQ ID NO: 1197567 - DNA, 22 bp, Artificial Sequence
  chemically synthesized
aagctttagggtacatgtgcac

SEQ ID NO: 1197568 - DNA, 22 bp, Artificial Sequence
  chemically synthesized
acctgcacaatgtgcacatgta

SEQ ID NO: 1197569 - DNA, 22 bp, Artificial Sequence
  chemically synthesized
taagctttagggtacatgtgca

SEQ ID NO: 1197570 - DNA, 22 bp, Artificial Sequence
  chemically synthesized
cacaatgtgcacatgtacccta

SEQ ID NO: 1197571 - DNA, 22 bp, Artificial Sequence
  chemically synthesized
tactttaagctttagggtacat

SEQ ID NO: 1197572 - DNA, 22 bp, Artificial Sequence
  chemically synthesized
ttatactttaagctttagggta

SEQ ID NO: 1197573 - DNA, 22 bp, Artificial Sequence
  chemically synthesized
ttattatactttaagctttagg

SEQ ID NO: 1197574 - DNA, 22 bp, Artificial Sequence
  chemically synthesized
attattatactttaagctttag

SEQ ID NO: 1197575 - DNA, 22 bp, Artificial Sequence
  chemically synthesized
tattattatactttaagcttta

SEQ ID NO: 1197576 - DNA, 22 bp, Artificial Sequence
  chemically synthesized
ttattattatactttaagcttt

SEQ ID NO: 1197577 - DNA, 22 bp, Artificial Sequence
  chemically synthesized
ttttattattatactttaagct

SEQ ID NO: 1197578 - DNA, 22 bp, Artificial Sequence
  chemically synthesized
cttttattattatactttaagc

SEQ ID NO: 1197579 - DNA, 22 bp, Artificial Sequence
  chemically synthesized
tcttttattattatactttaag

SEQ ID NO: 1197580 - DNA, 22 bp, Artificial Sequence
  chemically synthesized
ttcttttattattatactttaa

SEQ ID NO: 1197581 - DNA, 22 bp, Artificial Sequence
  chemically synthesized
tttcttttattattatacttta

SEQ ID NO: 1197582 - DNA, 22 bp, Artificial Sequence
  chemically synthesized
ttttcttttattattatacttt

SEQ ID NO: 1197583 - DNA, 22 bp, Artificial Sequence
  chemically synthesized
tttttcttttattattatactt

SEQ ID NO: 1197584 - DNA, 22 bp, Artificial Sequence
  chemically synthesized
ttttttcttttattattatact

SEQ ID NO: 1197585 - DNA, 22 bp, Artificial Sequence
  chemically synthesized
aagcttaaagtataataataaa

SEQ ID NO: 1197586 - DNA, 22 bp, Artificial Sequence
  chemically synthesized
agtttttttttcttttattatt

SEQ ID NO: 1197587 - DNA, 22 bp, Artificial Sequence
  chemically synthesized
aagtttttttttcttttattat

SEQ ID NO: 1197588 - DNA, 22 bp, Artificial Sequence
  chemically synthesized
taagtttttttttcttttatta

SEQ ID NO: 1197589 - DNA, 22 bp, Artificial Sequence
  chemically synthesized
ttaagtttttttttcttttatt

SEQ ID NO: 1197590 - DNA, 22 bp, Artificial Sequence
  chemically synthesized
aaagtataataataaaagaaaa

SEQ ID NO: 1197591 - DNA, 22 bp, Artificial Sequence
  chemically synthesized
aagtataataataaaagaaaaa

SEQ ID NO: 1197592 - DNA, 22 bp, Artificial Sequence
  chemically synthesized
aaatttttaagtttttttttct

SEQ ID NO: 1197593 - DNA, 22 bp, Artificial Sequence
  chemically synthesized
ctgaaatttttaagtttttttt

SEQ ID NO: 1197594 - DNA, 22 bp, Artificial Sequence
  chemically synthesized
gctgaaatttttaagttttttt

SEQ ID NO: 1197595 - DNA, 22 bp, Artificial Sequence
  chemically synthesized
gtttgctgaaatttttaagttt

SEQ ID NO: 1197596 - DNA, 22 bp, Artificial Sequence
  chemically synthesized
ggtttgctgaaatttttaagtt

SEQ ID NO: 1197597 - DNA, 22 bp, Artificial Sequence
  chemically synthesized
tggtttgctgaaatttttaagt

SEQ ID NO: 1197598 - DNA, 22 bp, Artificial Sequence
  chemically synthesized
acaaacattttggtttgctgaa

SEQ ID NO: 1197599 - DNA, 22 bp, Artificial Sequence
  chemically synthesized
aacaaacattttggtttgctga

SEQ ID NO: 1197600 - DNA, 22 bp, Artificial Sequence
  chemically synthesized
taacaaacattttggtttgctg

SEQ ID NO: 1197601 - DNA, 22 bp, Artificial Sequence
  chemically synthesized
ttttaacaaacattttggtttg

SEQ ID NO: 1197602 - DNA, 22 bp, Artificial Sequence
  chemically synthesized
aaaaatttcagcaaaccaaaat

SEQ ID NO: 1197603 - DNA, 22 bp, Artificial Sequence
  chemically synthesized
aaaatttcagcaaaccaaaatg

SEQ ID NO: 1197604 - DNA, 22 bp, Artificial Sequence
  chemically synthesized
atggttattttaacaaacattt

SEQ ID NO: 1197605 - DNA, 22 bp, Artificial Sequence
  chemically synthesized
cagcaaaccaaaatgtttgtta

SEQ ID NO: 1197606 - DNA, 22 bp, Artificial Sequence
  chemically synthesized
agcaaaccaaaatgtttgttaa

SEQ ID NO: 1197607 - DNA, 22 bp, Artificial Sequence
  chemically synthesized
gatatatatgtggttaatggtt

SEQ ID NO: 1197608 - DNA, 22 bp, Artificial Sequence
  chemically synthesized
ggatatatatgtggttaatggt

SEQ ID NO: 1197609 - DNA, 22 bp, Artificial Sequence
  chemically synthesized
gttaaaataaccattaaccaca

SEQ ID NO: 1197610 - DNA, 22 bp, Artificial Sequence
  chemically synthesized
ttaaaataaccattaaccacat

SEQ ID NO: 1197611 - DNA, 22 bp, Artificial Sequence
  chemically synthesized
aaataaccattaaccacatata

SEQ ID NO: 1197612 - DNA, 22 bp, Artificial Sequence
  chemically synthesized
tatataatgaatatttggatat

SEQ ID NO: 1197613 - DNA, 22 bp, Artificial Sequence
  chemically synthesized
atatataatgaatatttggata

SEQ ID NO: 1197614 - DNA, 22 bp, Artificial Sequence
  chemically synthesized
tatatataatgaatatttggat

SEQ ID NO: 1197615 - DNA, 22 bp, Artificial Sequence
  chemically synthesized
accacatatatatccaaatatt

SEQ ID NO: 1197616 - DNA, 22 bp, Artificial Sequence
  chemically synthesized
ttatatataatgaatatttgga

SEQ ID NO: 1197617 - DNA, 22 bp, Artificial Sequence
  chemically synthesized
tttatatataatgaatatttgg

SEQ ID NO: 1197618 - DNA, 22 bp, Artificial Sequence
  chemically synthesized
aagaaattttttatatataatg

SEQ ID NO: 1197619 - DNA, 22 bp, Artificial Sequence
  chemically synthesized
aaagaaattttttatatataat

SEQ ID NO: 1197620 - DNA, 22 bp, Artificial Sequence
  chemically synthesized
taaagaaattttttatatataa

SEQ ID NO: 1197621 - DNA, 22 bp, Artificial Sequence
  chemically synthesized
attatatataaaaaatttcttt

SEQ ID NO: 1197622 - DNA, 22 bp, Artificial Sequence
  chemically synthesized
tgagcatgatattttaaagaaa

SEQ ID NO: 1197623 - DNA, 22 bp, Artificial Sequence
  chemically synthesized
tatataaaaaatttctttaaaa

SEQ ID NO: 1197624 - DNA, 22 bp, Artificial Sequence
  chemically synthesized
atgagcatgatattttaaagaa

SEQ ID NO: 1197625 - DNA, 22 bp, Artificial Sequence
  chemically synthesized
tttatgagcatgatattttaaa

SEQ ID NO: 1197626 - DNA, 22 bp, Artificial Sequence
  chemically synthesized
tatttatgagcatgatatttta

SEQ ID NO: 1197627 - DNA, 22 bp, Artificial Sequence
  chemically synthesized
ctctatttatgagcatgatatt

SEQ ID NO: 1197628 - DNA, 22 bp, Artificial Sequence
  chemically synthesized
actctatttatgagcatgatat

SEQ ID NO: 1197629 - DNA, 22 bp, Artificial Sequence
  chemically synthesized
ctttaaaatatcatgctcataa

SEQ ID NO: 1197630 - DNA, 22 bp, Artificial Sequence
  chemically synthesized
tttaaaatatcatgctcataaa

SEQ ID NO: 1197631 - DNA, 22 bp, Artificial Sequence
  chemically synthesized
aaacttactctatttatgagca

SEQ ID NO: 1197632 - DNA, 22 bp, Artificial Sequence
  chemically synthesized
taaaatatcatgctcataaata

SEQ ID NO: 1197633 - DNA, 22 bp, Artificial Sequence
  chemically synthesized
aaaatatcatgctcataaatag

SEQ ID NO: 1197634 - DNA, 22 bp, Artificial Sequence
  chemically synthesized
aaatatcatgctcataaataga

SEQ ID NO: 1197635 - DNA, 22 bp, Artificial Sequence
  chemically synthesized
attaaaacttactctatttatg

SEQ ID NO: 1197636 - DNA, 22 bp, Artificial Sequence
  chemically synthesized
ttaattaaaacttactctattt

SEQ ID NO: 1197637 - DNA, 22 bp, Artificial Sequence
  chemically synthesized
ctgttaattaaaacttactcta

SEQ ID NO: 1197638 - DNA, 22 bp, Artificial Sequence
  chemically synthesized
cctgttaattaaaacttactct

SEQ ID NO: 1197639 - DNA, 22 bp, Artificial Sequence
  chemically synthesized
tcctgttaattaaaacttactc

SEQ ID NO: 1197640 - DNA, 22 bp, Artificial Sequence
  chemically synthesized
ataaatagagtaagttttaatt

SEQ ID NO: 1197641 - DNA, 22 bp, Artificial Sequence
  chemically synthesized
taattaacaggaaaattgtttc

SEQ ID NO: 1197642 - DNA, 22 bp, Artificial Sequence
  chemically synthesized
aattaacaggaaaattgtttca

SEQ ID NO: 1197643 - DNA, 22 bp, Artificial Sequence
  chemically synthesized
attaacaggaaaattgtttcat

SEQ ID NO: 1197644 - DNA, 22 bp, Artificial Sequence
  chemically synthesized
acaggaaaattgtttcatatgt

SEQ ID NO: 1197645 - DNA, 22 bp, Artificial Sequence
  chemically synthesized
gtaaagataataacatatgaaa

SEQ ID NO: 1197646 - DNA, 22 bp, Artificial Sequence
  chemically synthesized
ggtaaagataataacatatgaa

SEQ ID NO: 1197647 - DNA, 22 bp, Artificial Sequence
  chemically synthesized
tggtaaagataataacatatga

SEQ ID NO: 1197648 - DNA, 22 bp, Artificial Sequence
  chemically synthesized
ttggtaaagataataacatatg

SEQ ID NO: 1197649 - DNA, 22 bp, Artificial Sequence
  chemically synthesized
tttggtaaagataataacatat

SEQ ID NO: 1197650 - DNA, 22 bp, Artificial Sequence
  chemically synthesized
ttttttggtaaagataataaca

SEQ ID NO: 1197651 - DNA, 22 bp, Artificial Sequence
  chemically synthesized
attttttggtaaagataataac

SEQ ID NO: 1197652 - DNA, 22 bp, Artificial Sequence
  chemically synthesized
tattttttggtaaagataataa

SEQ ID NO: 1197653 - DNA, 22 bp, Artificial Sequence
  chemically synthesized
ttattttttggtaaagataata

SEQ ID NO: 1197654 - DNA, 22 bp, Artificial Sequence
  chemically synthesized
tttcatatgttattatctttac

SEQ ID NO: 1197655 - DNA, 22 bp, Artificial Sequence
  chemically synthesized
catatgttattatctttaccaa

SEQ ID NO: 1197656 - DNA, 22 bp, Artificial Sequence
  chemically synthesized
atatgttattatctttaccaaa

SEQ ID NO: 1197657 - DNA, 22 bp, Artificial Sequence
  chemically synthesized
ttatctttaccaaaaaataaaa

SEQ ID NO: 1197658 - DNA, 22 bp, Artificial Sequence
  chemically synthesized
tctttaccaaaaaataaaaatc

SEQ ID NO: 1197659 - DNA, 22 bp, Artificial Sequence
  chemically synthesized
gtggtggtggtggtgattttta

SEQ ID NO: 1197660 - DNA, 22 bp, Artificial Sequence
  chemically synthesized
taccaaaaaataaaaatcacca

SEQ ID NO: 1197661 - DNA, 22 bp, Artificial Sequence
  chemically synthesized
accaaaaaataaaaatcaccac

SEQ ID NO: 1197662 - DNA, 22 bp, Artificial Sequence
  chemically synthesized
ttggtggtggtggtggtgattt

SEQ ID NO: 1197663 - DNA, 22 bp, Artificial Sequence
  chemically synthesized
ccaaaaaataaaaatcaccacc

SEQ ID NO: 1197664 - DNA, 22 bp, Artificial Sequence
  chemically synthesized
ctgttggtggtggtggtggtga

SEQ ID NO: 1197665 - DNA, 22 bp, Artificial Sequence
  chemically synthesized
ttgctgttggtggtggtggtgg

SEQ ID NO: 1197666 - DNA, 22 bp, Artificial Sequence
  chemically synthesized
ttgttgctgttggtggtggtgg

SEQ ID NO: 1197667 - DNA, 22 bp, Artificial Sequence
  chemically synthesized
gttgttgctgttggtggtggtg

SEQ ID NO: 1197668 - DNA, 22 bp, Artificial Sequence
  chemically synthesized
tgttgttgctgttggtggtggt

SEQ ID NO: 1197669 - DNA, 22 bp, Artificial Sequence
  chemically synthesized
ttgttgttgctgttggtggtgg

SEQ ID NO: 1197670 - DNA, 22 bp, Artificial Sequence
  chemically synthesized
tgtccccccccttttgttgttg

SEQ ID NO: 1197671 - DNA, 22 bp, Artificial Sequence
  chemically synthesized
atgtccccccccttttgttgtt

SEQ ID NO: 1197672 - DNA, 22 bp, Artificial Sequence
  chemically synthesized
tatgtccccccccttttgttgt

SEQ ID NO: 1197673 - DNA, 22 bp, Artificial Sequence
  chemically synthesized
tatagattttatgtcccccccc

SEQ ID NO: 1197674 - DNA, 22 bp, Artificial Sequence
  chemically synthesized
aagaaaaaaaaaattatataga

SEQ ID NO: 1197675 - DNA, 22 bp, Artificial Sequence
  chemically synthesized
caagaaaaaaaaaattatatag

SEQ ID NO: 1197676 - DNA, 22 bp, Artificial Sequence
  chemically synthesized
tcaagaaaaaaaaaattatata

SEQ ID NO: 1197677 - DNA, 22 bp, Artificial Sequence
  chemically synthesized
agttttcaagaaaaaaaaaatt

SEQ ID NO: 1197678 - DNA, 22 bp, Artificial Sequence
  chemically synthesized
ggctgagttttcaagaaaaaaa

SEQ ID NO: 1197679 - DNA, 22 bp, Artificial Sequence
  chemically synthesized
gggctgagttttcaagaaaaaa

SEQ ID NO: 1197680 - DNA, 22 bp, Artificial Sequence
  chemically synthesized
tataattttttttttcttgaaa

SEQ ID NO: 1197681 - DNA, 22 bp, Artificial Sequence
  chemically synthesized
tttttttcttgaaaactcagcc

SEQ ID NO: 1197682 - DNA, 22 bp, Artificial Sequence
  chemically synthesized
ttttttcttgaaaactcagccc

SEQ ID NO: 1197683 - DNA, 22 bp, Artificial Sequence
  chemically synthesized
tttttcttgaaaactcagccca

SEQ ID NO: 1197684 - DNA, 22 bp, Artificial Sequence
  chemically synthesized
ttttcttgaaaactcagcccaa

SEQ ID NO: 1197685 - DNA, 22 bp, Artificial Sequence
  chemically synthesized
tttcttgaaaactcagcccaaa

SEQ ID NO: 1197686 - DNA, 22 bp, Artificial Sequence
  chemically synthesized
ttcttgaaaactcagcccaaat

SEQ ID NO: 1197687 - DNA, 22 bp, Artificial Sequence
  chemically synthesized
tcttgaaaactcagcccaaatg

SEQ ID NO: 1197688 - DNA, 22 bp, Artificial Sequence
  chemically synthesized
cttgaaaactcagcccaaatgg

SEQ ID NO: 1197689 - DNA, 22 bp, Artificial Sequence
  chemically synthesized
ttgaaaactcagcccaaatggc

SEQ ID NO: 1197690 - DNA, 22 bp, Artificial Sequence
  chemically synthesized
aagcaccaggtggccatttggg

SEQ ID NO: 1197691 - DNA, 22 bp, Artificial Sequence
  chemically synthesized
gaagcaccaggtggccatttgg

SEQ ID NO: 1197692 - DNA, 22 bp, Artificial Sequence
  chemically synthesized
gaaaactcagcccaaatggcca

SEQ ID NO: 1197693 - DNA, 22 bp, Artificial Sequence
  chemically synthesized
aaaactcagcccaaatggccac

SEQ ID NO: 1197694 - DNA, 22 bp, Artificial Sequence
  chemically synthesized
acgtcttgaagcaccaggtggc

SEQ ID NO: 1197695 - DNA, 22 bp, Artificial Sequence
  chemically synthesized
cacgtcttgaagcaccaggtgg

SEQ ID NO: 1197696 - DNA, 22 bp, Artificial Sequence
  chemically synthesized
agcccaaatggccacctggtgc

SEQ ID NO: 1197697 - DNA, 22 bp, Artificial Sequence
  chemically synthesized
acacttcacgtcttgaagcacc

SEQ ID NO: 1197698 - DNA, 22 bp, Artificial Sequence
  chemically synthesized
gtgcttcaagacgtgaagtgtg

SEQ ID NO: 1197699 - DNA, 22 bp, Artificial Sequence
  chemically synthesized
caagtgaaacatgtattcacac

SEQ ID NO: 1197700 - DNA, 22 bp, Artificial Sequence
  chemically synthesized
caagacgtgaagtgtgaataca

SEQ ID NO: 1197701 - DNA, 22 bp, Artificial Sequence
  chemically synthesized
aagacgtgaagtgtgaatacat

SEQ ID NO: 1197702 - DNA, 22 bp, Artificial Sequence
  chemically synthesized
ttccaagtgaaacatgtattca

SEQ ID NO: 1197703 - DNA, 22 bp, Artificial Sequence
  chemically synthesized
attccaagtgaaacatgtattc

SEQ ID NO: 1197704 - DNA, 22 bp, Artificial Sequence
  chemically synthesized
tattccaagtgaaacatgtatt

SEQ ID NO: 1197705 - DNA, 22 bp, Artificial Sequence
  chemically synthesized
ttttattccaagtgaaacatgt

SEQ ID NO: 1197706 - DNA, 22 bp, Artificial Sequence
  chemically synthesized
cacttggaataaaataatatct

SEQ ID NO: 1197707 - DNA, 22 bp, Artificial Sequence
  chemically synthesized
acttggaataaaataatatctt

SEQ ID NO: 1197708 - DNA, 22 bp, Artificial Sequence
  chemically synthesized
gatgtaaataagaaaagatatt

SEQ ID NO: 1197709 - DNA, 22 bp, Artificial Sequence
  chemically synthesized
ggaataaaataatatcttttct

SEQ ID NO: 1197710 - DNA, 22 bp, Artificial Sequence
  chemically synthesized
gaataaaataatatcttttctt

SEQ ID NO: 1197711 - DNA, 22 bp, Artificial Sequence
  chemically synthesized
aaatctggatgtaaataagaaa

SEQ ID NO: 1197712 - DNA, 22 bp, Artificial Sequence
  chemically synthesized
gaaatctggatgtaaataagaa

SEQ ID NO: 1197713 - DNA, 22 bp, Artificial Sequence
  chemically synthesized
ttcttatttacatccagatttc

SEQ ID NO: 1197714 - DNA, 22 bp, Artificial Sequence
  chemically synthesized
tcttatttacatccagatttca

SEQ ID NO: 1197715 - DNA, 22 bp, Artificial Sequence
  chemically synthesized
cttatttacatccagatttcaa

SEQ ID NO: 1197716 - DNA, 22 bp, Artificial Sequence
  chemically synthesized
ttatttacatccagatttcaaa

SEQ ID NO: 1197717 - DNA, 22 bp, Artificial Sequence
  chemically synthesized
atttacatccagatttcaaact

SEQ ID NO: 1197718 - DNA, 22 bp, Artificial Sequence
  chemically synthesized
aaggtaaaatggagtttgaaat

SEQ ID NO: 1197719 - DNA, 22 bp, Artificial Sequence
  chemically synthesized
tttacatccagatttcaaactc

SEQ ID NO: 1197720 - DNA, 22 bp, Artificial Sequence
  chemically synthesized
acatccagatttcaaactccat

SEQ ID NO: 1197721 - DNA, 22 bp, Artificial Sequence
  chemically synthesized
catccagatttcaaactccatt

SEQ ID NO: 1197722 - DNA, 22 bp, Artificial Sequence
  chemically synthesized
tgttcaaggtaaaatggagttt

SEQ ID NO: 1197723 - DNA, 22 bp, Artificial Sequence
  chemically synthesized
gtgttcaaggtaaaatggagtt

SEQ ID NO: 1197724 - DNA, 22 bp, Artificial Sequence
  chemically synthesized
tgtgttcaaggtaaaatggagt

SEQ ID NO: 1197725 - DNA, 22 bp, Artificial Sequence
  chemically synthesized
ctttgtgttcaaggtaaaatgg

SEQ ID NO: 1197726 - DNA, 22 bp, Artificial Sequence
  chemically synthesized
caaactccattttaccttgaac

SEQ ID NO: 1197727 - DNA, 22 bp, Artificial Sequence
  chemically synthesized
aaactccattttaccttgaaca

SEQ ID NO: 1197728 - DNA, 22 bp, Artificial Sequence
  chemically synthesized
aatcacattactttgtgttcaa

SEQ ID NO: 1197729 - DNA, 22 bp, Artificial Sequence
  chemically synthesized
cattttaccttgaacacaaagt

SEQ ID NO: 1197730 - DNA, 22 bp, Artificial Sequence
  chemically synthesized
acactaaatcacattactttgt

SEQ ID NO: 1197731 - DNA, 22 bp, Artificial Sequence
  chemically synthesized
taccttgaacacaaagtaatgt

SEQ ID NO: 1197732 - DNA, 22 bp, Artificial Sequence
  chemically synthesized
accttgaacacaaagtaatgtg

SEQ ID NO: 1197733 - DNA, 22 bp, Artificial Sequence
  chemically synthesized
ctcacactaaatcacattactt

SEQ ID NO: 1197734 - DNA, 22 bp, Artificial Sequence
  chemically synthesized
ccttgaacacaaagtaatgtga

SEQ ID NO: 1197735 - DNA, 22 bp, Artificial Sequence
  chemically synthesized
cctcacactaaatcacattact

SEQ ID NO: 1197736 - DNA, 22 bp, Artificial Sequence
  chemically synthesized
tcctcacactaaatcacattac

SEQ ID NO: 1197737 - DNA, 22 bp, Artificial Sequence
  chemically synthesized
tttcctcacactaaatcacatt

SEQ ID NO: 1197738 - DNA, 22 bp, Artificial Sequence
  chemically synthesized
gaacacaaagtaatgtgattta

SEQ ID NO: 1197739 - DNA, 22 bp, Artificial Sequence
  chemically synthesized
ctttcctcacactaaatcacat

SEQ ID NO: 1197740 - DNA, 22 bp, Artificial Sequence
  chemically synthesized
aacacaaagtaatgtgatttag

SEQ ID NO: 1197741 - DNA, 22 bp, Artificial Sequence
  chemically synthesized
tctttcctcacactaaatcaca

SEQ ID NO: 1197742 - DNA, 22 bp, Artificial Sequence
  chemically synthesized
ctttctttcctcacactaaatc

SEQ ID NO: 1197743 - DNA, 22 bp, Artificial Sequence
  chemically synthesized
cctttctttcctcacactaaat

SEQ ID NO: 1197744 - DNA, 22 bp, Artificial Sequence
  chemically synthesized
tcctttctttcctcacactaaa

SEQ ID NO: 1197745 - DNA, 22 bp, Artificial Sequence
  chemically synthesized
atagaaaaagctttcctttctt

SEQ ID NO: 1197746 - DNA, 22 bp, Artificial Sequence
  chemically synthesized
catagaaaaagctttcctttct

SEQ ID NO: 1197747 - DNA, 22 bp, Artificial Sequence
  chemically synthesized
agtgtgaggaaagaaaggaaag

SEQ ID NO: 1197748 - DNA, 22 bp, Artificial Sequence
  chemically synthesized
tcatagaaaaagctttcctttc

SEQ ID NO: 1197749 - DNA, 22 bp, Artificial Sequence
  chemically synthesized
gtgtgaggaaagaaaggaaagc

SEQ ID NO: 1197750 - DNA, 22 bp, Artificial Sequence
  chemically synthesized
gaaaataccataaaatagtcat

SEQ ID NO: 1197751 - DNA, 22 bp, Artificial Sequence
  chemically synthesized
tttctatgaaaatgactatttt

SEQ ID NO: 1197752 - DNA, 22 bp, Artificial Sequence
  chemically synthesized
ttctatgaaaatgactatttta

SEQ ID NO: 1197753 - DNA, 22 bp, Artificial Sequence
  chemically synthesized
tctatgaaaatgactattttat

SEQ ID NO: 1197754 - DNA, 22 bp, Artificial Sequence
  chemically synthesized
ttagaaaataccataaaatagt

SEQ ID NO: 1197755 - DNA, 22 bp, Artificial Sequence
  chemically synthesized
ctatgaaaatgactattttatg

SEQ ID NO: 1197756 - DNA, 22 bp, Artificial Sequence
  chemically synthesized
tatgaaaatgactattttatgg

SEQ ID NO: 1197757 - DNA, 22 bp, Artificial Sequence
  chemically synthesized
tgaaaatgactattttatggta

SEQ ID NO: 1197758 - DNA, 22 bp, Artificial Sequence
  chemically synthesized
attattagaaaataccataaaa

SEQ ID NO: 1197759 - DNA, 22 bp, Artificial Sequence
  chemically synthesized
taagacctaattattagaaaat

SEQ ID NO: 1197760 - DNA, 22 bp, Artificial Sequence
  chemically synthesized
ataagacctaattattagaaaa

SEQ ID NO: 1197761 - DNA, 22 bp, Artificial Sequence
  chemically synthesized
tataagacctaattattagaaa

SEQ ID NO: 1197762 - DNA, 22 bp, Artificial Sequence
  chemically synthesized
ttttatggtattttctaataat

SEQ ID NO: 1197763 - DNA, 22 bp, Artificial Sequence
  chemically synthesized
tatggtattttctaataattag

SEQ ID NO: 1197764 - DNA, 22 bp, Artificial Sequence
  chemically synthesized
atggtattttctaataattagg

SEQ ID NO: 1197765 - DNA, 22 bp, Artificial Sequence
  chemically synthesized
tggtattttctaataattaggt

SEQ ID NO: 1197766 - DNA, 22 bp, Artificial Sequence
  chemically synthesized
gggaagttttataagacctaat

SEQ ID NO: 1197767 - DNA, 22 bp, Artificial Sequence
  chemically synthesized
tctaataattaggtcttataaa

SEQ ID NO: 1197768 - DNA, 22 bp, Artificial Sequence
  chemically synthesized
ctaataattaggtcttataaaa

SEQ ID NO: 1197769 - DNA, 22 bp, Artificial Sequence
  chemically synthesized
taataattaggtcttataaaac

SEQ ID NO: 1197770 - DNA, 22 bp, Artificial Sequence
  chemically synthesized
ataattaggtcttataaaactt

SEQ ID NO: 1197771 - DNA, 22 bp, Artificial Sequence
  chemically synthesized
tagtaaaaacattggggaagtt

SEQ ID NO: 1197772 - DNA, 22 bp, Artificial Sequence
  chemically synthesized
ggtcttataaaacttccccaat

SEQ ID NO: 1197773 - DNA, 22 bp, Artificial Sequence
  chemically synthesized
ataaaacttccccaatgttttt

SEQ ID NO: 1197774 - DNA, 22 bp, Artificial Sequence
  chemically synthesized
taaaacttccccaatgttttta

SEQ ID NO: 1197775 - DNA, 22 bp, Artificial Sequence
  chemically synthesized
ccagcattgtagtaaaaacatt

SEQ ID NO: 1197776 - DNA, 22 bp, Artificial Sequence
  chemically synthesized
tggtctaccagcattgtagtaa

SEQ ID NO: 1197777 - DNA, 22 bp, Artificial Sequence
  chemically synthesized
ccccaatgtttttactacaatg

SEQ ID NO: 1197778 - DNA, 22 bp, Artificial Sequence
  chemically synthesized
cccaatgtttttactacaatgc

SEQ ID NO: 1197779 - DNA, 22 bp, Artificial Sequence
  chemically synthesized
gctgtggtctaccagcattgta

SEQ ID NO: 1197780 - DNA, 22 bp, Artificial Sequence
  chemically synthesized
ttactacaatgctggtagacca

SEQ ID NO: 1197781 - DNA, 22 bp, Artificial Sequence
  chemically synthesized
tactacaatgctggtagaccac

SEQ ID NO: 1197782 - DNA, 22 bp, Artificial Sequence
  chemically synthesized
actacaatgctggtagaccaca

SEQ ID NO: 1197783 - DNA, 22 bp, Artificial Sequence
  chemically synthesized
ctacaatgctggtagaccacag

SEQ ID NO: 1197784 - DNA, 22 bp, Artificial Sequence
  chemically synthesized
caatgctggtagaccacagcca

SEQ ID NO: 1197785 - DNA, 22 bp, Artificial Sequence
  chemically synthesized
gagcaagacagactggctgtgg

SEQ ID NO: 1197786 - DNA, 22 bp, Artificial Sequence
  chemically synthesized
gtagaccacagccagtctgtct

SEQ ID NO: 1197787 - DNA, 22 bp, Artificial Sequence
  chemically synthesized
tcttgctccaggatttctgatg

SEQ ID NO: 1197788 - DNA, 22 bp, Artificial Sequence
  chemically synthesized
atggaataagatcatcagaaat

SEQ ID NO: 1197789 - DNA, 22 bp, Artificial Sequence
  chemically synthesized
aatggaataagatcatcagaaa

SEQ ID NO: 1197790 - DNA, 22 bp, Artificial Sequence
  chemically synthesized
taatggaataagatcatcagaa

SEQ ID NO: 1197791 - DNA, 22 bp, Artificial Sequence
  chemically synthesized
ttaatggaataagatcatcaga

SEQ ID NO: 1197792 - DNA, 22 bp, Artificial Sequence
  chemically synthesized
gctccaggatttctgatgatct

SEQ ID NO: 1197793 - DNA, 22 bp, Artificial Sequence
  chemically synthesized
tttaatggaataagatcatcag

SEQ ID NO: 1197794 - DNA, 22 bp, Artificial Sequence
  chemically synthesized
ctccaggatttctgatgatctt

SEQ ID NO: 1197795 - DNA, 22 bp, Artificial Sequence
  chemically synthesized
ttttaatggaataagatcatca

SEQ ID NO: 1197796 - DNA, 22 bp, Artificial Sequence
  chemically synthesized
tttttaatggaataagatcatc

SEQ ID NO: 1197797 - DNA, 22 bp, Artificial Sequence
  chemically synthesized
ttttttaatggaataagatcat

SEQ ID NO: 1197798 - DNA, 22 bp, Artificial Sequence
  chemically synthesized
caggatttctgatgatcttatt

SEQ ID NO: 1197799 - DNA, 22 bp, Artificial Sequence
  chemically synthesized
tttttttaatggaataagatca

SEQ ID NO: 1197800 - DNA, 22 bp, Artificial Sequence
  chemically synthesized
ctgatgatcttattccattaaa

SEQ ID NO: 1197801 - DNA, 22 bp, Artificial Sequence
  chemically synthesized
tgatgatcttattccattaaaa

SEQ ID NO: 1197802 - DNA, 22 bp, Artificial Sequence
  chemically synthesized
tggagtctttttttttaatgga

SEQ ID NO: 1197803 - DNA, 22 bp, Artificial Sequence
  chemically synthesized
gtggagtctttttttttaatgg

SEQ ID NO: 1197804 - DNA, 22 bp, Artificial Sequence
  chemically synthesized
atgatcttattccattaaaaaa

SEQ ID NO: 1197805 - DNA, 22 bp, Artificial Sequence
  chemically synthesized
aagacttgtggagtcttttttt

SEQ ID NO: 1197806 - DNA, 22 bp, Artificial Sequence
  chemically synthesized
caagacttgtggagtctttttt

SEQ ID NO: 1197807 - DNA, 22 bp, Artificial Sequence
  chemically synthesized
attccattaaaaaaaaagactc

SEQ ID NO: 1197808 - DNA, 22 bp, Artificial Sequence
  chemically synthesized
tcaagacttgtggagtcttttt

SEQ ID NO: 1197809 - DNA, 22 bp, Artificial Sequence
  chemically synthesized
ttccattaaaaaaaaagactcc

SEQ ID NO: 1197810 - DNA, 22 bp, Artificial Sequence
  chemically synthesized
cattaaaaaaaaagactccaca

SEQ ID NO: 1197811 - DNA, 22 bp, Artificial Sequence
  chemically synthesized
gttttcaagacttgtggagtct

SEQ ID NO: 1197812 - DNA, 22 bp, Artificial Sequence
  chemically synthesized
agttttcaagacttgtggagtc

SEQ ID NO: 1197813 - DNA, 22 bp, Artificial Sequence
  chemically synthesized
aaaaaaaagactccacaagtct

SEQ ID NO: 1197814 - DNA, 22 bp, Artificial Sequence
  chemically synthesized
atatagtttagttttcaagact

SEQ ID NO: 1197815 - DNA, 22 bp, Artificial Sequence
  chemically synthesized
catgctaatatagtttagtttt

SEQ ID NO: 1197816 - DNA, 22 bp, Artificial Sequence
  chemically synthesized
cacaagtcttgaaaactaaact

SEQ ID NO: 1197817 - DNA, 22 bp, Artificial Sequence
  chemically synthesized
gaaaactaaactatattagcat

SEQ ID NO: 1197818 - DNA, 22 bp, Artificial Sequence
  chemically synthesized
aaaactaaactatattagcatg

SEQ ID NO: 1197819 - DNA, 22 bp, Artificial Sequence
  chemically synthesized
tatcaacccaaaactacatgct

SEQ ID NO: 1197820 - DNA, 22 bp, Artificial Sequence
  chemically synthesized
gtatcaacccaaaactacatgc

SEQ ID NO: 1197821 - DNA, 22 bp, Artificial Sequence
  chemically synthesized
aactatattagcatgtagtttt

SEQ ID NO: 1197822 - DNA, 22 bp, Artificial Sequence
  chemically synthesized
tattagcatgtagttttgggtt

SEQ ID NO: 1197823 - DNA, 22 bp, Artificial Sequence
  chemically synthesized
agagaagtttgtatcaacccaa

SEQ ID NO: 1197824 - DNA, 22 bp, Artificial Sequence
  chemically synthesized
gcatgtagttttgggttgatac

SEQ ID NO: 1197825 - DNA, 22 bp, Artificial Sequence
  chemically synthesized
tgggttgatacaaacttctctc

SEQ ID NO: 1197826 - DNA, 22 bp, Artificial Sequence
  chemically synthesized
gggttgatacaaacttctctca

SEQ ID NO: 1197827 - DNA, 22 bp, Artificial Sequence
  chemically synthesized
ggttgatacaaacttctctcag

SEQ ID NO: 1197828 - DNA, 22 bp, Artificial Sequence
  chemically synthesized
atgggaatgcagctgagagaag

SEQ ID NO: 1197829 - DNA, 22 bp, Artificial Sequence
  chemically synthesized
tctaatgggaatgcagctgaga

SEQ ID NO: 1197830 - DNA, 22 bp, Artificial Sequence
  chemically synthesized
atacaaacttctctcagctgca

SEQ ID NO: 1197831 - DNA, 22 bp, Artificial Sequence
  chemically synthesized
atctaatgggaatgcagctgag

SEQ ID NO: 1197832 - DNA, 22 bp, Artificial Sequence
  chemically synthesized
tatctaatgggaatgcagctga

SEQ ID NO: 1197833 - DNA, 22 bp, Artificial Sequence
  chemically synthesized
agttttatctaatgggaatgca

SEQ ID NO: 1197834 - DNA, 22 bp, Artificial Sequence
  chemically synthesized
ctctcagctgcattcccattag

SEQ ID NO: 1197835 - DNA, 22 bp, Artificial Sequence
  chemically synthesized
tctcagctgcattcccattaga

SEQ ID NO: 1197836 - DNA, 22 bp, Artificial Sequence
  chemically synthesized
tcagctgcattcccattagata

SEQ ID NO: 1197837 - DNA, 22 bp, Artificial Sequence
  chemically synthesized
agctgcattcccattagataaa

SEQ ID NO: 1197838 - DNA, 22 bp, Artificial Sequence
  chemically synthesized
caatgcatcattcagttttatc

SEQ ID NO: 1197839 - DNA, 22 bp, Artificial Sequence
  chemically synthesized
cattcccattagataaaactga

SEQ ID NO: 1197840 - DNA, 22 bp, Artificial Sequence
  chemically synthesized
ccaatgcatcattcagttttat

SEQ ID NO: 1197841 - DNA, 22 bp, Artificial Sequence
  chemically synthesized
ccattagataaaactgaatgat

SEQ ID NO: 1197842 - DNA, 22 bp, Artificial Sequence
  chemically synthesized
caagtttccaatgcatcattca

SEQ ID NO: 1197843 - DNA, 22 bp, Artificial Sequence
  chemically synthesized
ccaagtttccaatgcatcattc

SEQ ID NO: 1197844 - DNA, 22 bp, Artificial Sequence
  chemically synthesized
gataaaactgaatgatgcattg

SEQ ID NO: 1197845 - DNA, 22 bp, Artificial Sequence
  chemically synthesized
atttccaagtttccaatgcatc

SEQ ID NO: 1197846 - DNA, 22 bp, Artificial Sequence
  chemically synthesized
aatttccaagtttccaatgcat

SEQ ID NO: 1197847 - DNA, 22 bp, Artificial Sequence
  chemically synthesized
taatttccaagtttccaatgca

SEQ ID NO: 1197848 - DNA, 22 bp, Artificial Sequence
  chemically synthesized
ttaatttccaagtttccaatgc

SEQ ID NO: 1197849 - DNA, 22 bp, Artificial Sequence
  chemically synthesized
aatgatgcattggaaacttgga

SEQ ID NO: 1197850 - DNA, 22 bp, Artificial Sequence
  chemically synthesized
ccacagatacatgtttttaatt

SEQ ID NO: 1197851 - DNA, 22 bp, Artificial Sequence
  chemically synthesized
gaaacttggaaattaaaaacat

SEQ ID NO: 1197852 - DNA, 22 bp, Artificial Sequence
  chemically synthesized
tgccacagatacatgtttttaa

SEQ ID NO: 1197853 - DNA, 22 bp, Artificial Sequence
  chemically synthesized
ctgccacagatacatgttttta

SEQ ID NO: 1197854 - DNA, 22 bp, Artificial Sequence
  chemically synthesized
tctgccacagatacatgttttt

SEQ ID NO: 1197855 - DNA, 22 bp, Artificial Sequence
  chemically synthesized
tctttctgccacagatacatgt

SEQ ID NO: 1197856 - DNA, 22 bp, Artificial Sequence
  chemically synthesized
ggaaattaaaaacatgtatctg

SEQ ID NO: 1197857 - DNA, 22 bp, Artificial Sequence
  chemically synthesized
gaaattaaaaacatgtatctgt

SEQ ID NO: 1197858 - DNA, 22 bp, Artificial Sequence
  chemically synthesized
aaaacatgtatctgtggcagaa

SEQ ID NO: 1197859 - DNA, 22 bp, Artificial Sequence
  chemically synthesized
tggcagaaagataatactgcac

SEQ ID NO: 1197860 - DNA, 22 bp, Artificial Sequence
  chemically synthesized
gtgaagcagcaaaaagaaaaat

SEQ ID NO: 1197861 - DNA, 22 bp, Artificial Sequence
  chemically synthesized
agtgaagcagcaaaaagaaaaa

SEQ ID NO: 1197862 - DNA, 22 bp, Artificial Sequence
  chemically synthesized
cacacaccatttttctttttgc

SEQ ID NO: 1197863 - DNA, 22 bp, Artificial Sequence
  chemically synthesized
atttagtgaagcagcaaaaaga

SEQ ID NO: 1197864 - DNA, 22 bp, Artificial Sequence
  chemically synthesized
ttctttttgctgcttcactaaa

SEQ ID NO: 1197865 - DNA, 22 bp, Artificial Sequence
  chemically synthesized
agcatcaactgatttagtgaag

SEQ ID NO: 1197866 - DNA, 22 bp, Artificial Sequence
  chemically synthesized
tctttttgctgcttcactaaat

SEQ ID NO: 1197867 - DNA, 22 bp, Artificial Sequence
  chemically synthesized
ctttttgctgcttcactaaatc

SEQ ID NO: 1197868 - DNA, 22 bp, Artificial Sequence
  chemically synthesized
tttttgctgcttcactaaatca

SEQ ID NO: 1197869 - DNA, 22 bp, Artificial Sequence
  chemically synthesized
tttgctgcttcactaaatcagt

SEQ ID NO: 1197870 - DNA, 22 bp, Artificial Sequence
  chemically synthesized
ttgctgcttcactaaatcagtt

SEQ ID NO: 1197871 - DNA, 22 bp, Artificial Sequence
  chemically synthesized
tgctgcttcactaaatcagttg

SEQ ID NO: 1197872 - DNA, 22 bp, Artificial Sequence
  chemically synthesized
cgtgttcagcatcaactgattt

SEQ ID NO: 1197873 - DNA, 22 bp, Artificial Sequence
  chemically synthesized
gctgcttcactaaatcagttga

SEQ ID NO: 1197874 - DNA, 22 bp, Artificial Sequence
  chemically synthesized
ctgcttcactaaatcagttgat

SEQ ID NO: 1197875 - DNA, 22 bp, Artificial Sequence
  chemically synthesized
ttgcgtgttcagcatcaactga

SEQ ID NO: 1197876 - DNA, 22 bp, Artificial Sequence
  chemically synthesized
attgcgtgttcagcatcaactg

SEQ ID NO: 1197877 - DNA, 22 bp, Artificial Sequence
  chemically synthesized
cttcactaaatcagttgatgct

SEQ ID NO: 1197878 - DNA, 22 bp, Artificial Sequence
  chemically synthesized
cactaaatcagttgatgctgaa

SEQ ID NO: 1197879 - DNA, 22 bp, Artificial Sequence
  chemically synthesized
actaaatcagttgatgctgaac

SEQ ID NO: 1197880 - DNA, 22 bp, Artificial Sequence
  chemically synthesized
tacaccttattgcgtgttcagc

SEQ ID NO: 1197881 - DNA, 22 bp, Artificial Sequence
  chemically synthesized
aatcagttgatgctgaacacgc

SEQ ID NO: 1197882 - DNA, 22 bp, Artificial Sequence
  chemically synthesized
gcctatacaccttattgcgtgt

SEQ ID NO: 1197883 - DNA, 22 bp, Artificial Sequence
  chemically synthesized
atgctgaacacgcaataaggtg

SEQ ID NO: 1197884 - DNA, 22 bp, Artificial Sequence
  chemically synthesized
tgggcctggcctatacacctta

SEQ ID NO: 1197885 - DNA, 22 bp, Artificial Sequence
  chemically synthesized
aacacgcaataaggtgtatagg

SEQ ID NO: 1197886 - DNA, 22 bp, Artificial Sequence
  chemically synthesized
accaaaaggagctgtgggcctg

SEQ ID NO: 1197887 - DNA, 22 bp, Artificial Sequence
  chemically synthesized
cacctgaccaaaaggagctgtg

SEQ ID NO: 1197888 - DNA, 22 bp, Artificial Sequence
  chemically synthesized
attgcacctgaccaaaaggagc

SEQ ID NO: 1197889 - DNA, 22 bp, Artificial Sequence
  chemically synthesized
ctaattgcacctgaccaaaagg

SEQ ID NO: 1197890 - DNA, 22 bp, Artificial Sequence
  chemically synthesized
gttcctaattgcacctgaccaa

SEQ ID NO: 1197891 - DNA, 22 bp, Artificial Sequence
  chemically synthesized
acattagttcctaattgcacct

SEQ ID NO: 1197892 - DNA, 22 bp, Artificial Sequence
  chemically synthesized
cttttggtcaggtgcaattagg

SEQ ID NO: 1197893 - DNA, 22 bp, Artificial Sequence
  chemically synthesized
ttggtcaggtgcaattaggaac

SEQ ID NO: 1197894 - DNA, 22 bp, Artificial Sequence
  chemically synthesized
tggtcaggtgcaattaggaact

SEQ ID NO: 1197895 - DNA, 22 bp, Artificial Sequence
  chemically synthesized
ggtcaggtgcaattaggaacta

SEQ ID NO: 1197896 - DNA, 22 bp, Artificial Sequence
  chemically synthesized
gtcaggtgcaattaggaactaa

SEQ ID NO: 1197897 - DNA, 22 bp, Artificial Sequence
  chemically synthesized
gaagacagttaacattagttcc

SEQ ID NO: 1197898 - DNA, 22 bp, Artificial Sequence
  chemically synthesized
ggaactaatgttaactgtcttc

SEQ ID NO: 1197899 - DNA, 22 bp, Artificial Sequence
  chemically synthesized
atgtaacgcattagaagacagt

SEQ ID NO: 1197900 - DNA, 22 bp, Artificial Sequence
  chemically synthesized
ttgatgtaacgcattagaagac

SEQ ID NO: 1197901 - DNA, 22 bp, Artificial Sequence
  chemically synthesized
atgttaactgtcttctaatgcg

SEQ ID NO: 1197902 - DNA, 22 bp, Artificial Sequence
  chemically synthesized
atgtactattgatgtaacgcat

SEQ ID NO: 1197903 - DNA, 22 bp, Artificial Sequence
  chemically synthesized
actgtcttctaatgcgttacat

SEQ ID NO: 1197904 - DNA, 22 bp, Artificial Sequence
  chemically synthesized
attcatgtactattgatgtaac

SEQ ID NO: 1197905 - DNA, 22 bp, Artificial Sequence
  chemically synthesized
tcttctaatgcgttacatcaat

SEQ ID NO: 1197906 - DNA, 22 bp, Artificial Sequence
  chemically synthesized
ctcattcatgtactattgatgt

SEQ ID NO: 1197907 - DNA, 22 bp, Artificial Sequence
  chemically synthesized
ctaatgcgttacatcaatagta

SEQ ID NO: 1197908 - DNA, 22 bp, Artificial Sequence
  chemically synthesized
taatgcgttacatcaatagtac

SEQ ID NO: 1197909 - DNA, 22 bp, Artificial Sequence
  chemically synthesized
ttactcattcatgtactattga

SEQ ID NO: 1197910 - DNA, 22 bp, Artificial Sequence
  chemically synthesized
attactcattcatgtactattg

SEQ ID NO: 1197911 - DNA, 22 bp, Artificial Sequence
  chemically synthesized
atgcgttacatcaatagtacat

SEQ ID NO: 1197912 - DNA, 22 bp, Artificial Sequence
  chemically synthesized
gagcttattactcattcatgta

SEQ ID NO: 1197913 - DNA, 22 bp, Artificial Sequence
  chemically synthesized
catcaatagtacatgaatgagt

SEQ ID NO: 1197914 - DNA, 22 bp, Artificial Sequence
  chemically synthesized
caaaagttagagcttattactc

SEQ ID NO: 1197915 - DNA, 22 bp, Artificial Sequence
  chemically synthesized
gcaaaagttagagcttattact

SEQ ID NO: 1197916 - DNA, 22 bp, Artificial Sequence
  chemically synthesized
tgcaaaagttagagcttattac

SEQ ID NO: 1197917 - DNA, 22 bp, Artificial Sequence
  chemically synthesized
acatattttgcaaaagttagag

SEQ ID NO: 1197918 - DNA, 22 bp, Artificial Sequence
  chemically synthesized
ttcacatattttgcaaaagtta

SEQ ID NO: 1197919 - DNA, 22 bp, Artificial Sequence
  chemically synthesized
gttcacatattttgcaaaagtt

SEQ ID NO: 1197920 - DNA, 22 bp, Artificial Sequence
  chemically synthesized
taacttttgcaaaatatgtgaa

SEQ ID NO: 1197921 - DNA, 22 bp, Artificial Sequence
  chemically synthesized
acttttgcaaaatatgtgaaca

SEQ ID NO: 1197922 - DNA, 22 bp, Artificial Sequence
  chemically synthesized
ttgcaaaatatgtgaacaaatt

SEQ ID NO: 1197923 - DNA, 22 bp, Artificial Sequence
  chemically synthesized
tgcaaaatatgtgaacaaattg

SEQ ID NO: 1197924 - DNA, 22 bp, Artificial Sequence
  chemically synthesized
tgagtagtagatcaatttgttc

SEQ ID NO: 1197925 - DNA, 22 bp, Artificial Sequence
  chemically synthesized
gcaaaatatgtgaacaaattga

SEQ ID NO: 1197926 - DNA, 22 bp, Artificial Sequence
  chemically synthesized
gtgagtagtagatcaatttgtt

SEQ ID NO: 1197927 - DNA, 22 bp, Artificial Sequence
  chemically synthesized
caaaatatgtgaacaaattgat

SEQ ID NO: 1197928 - DNA, 22 bp, Artificial Sequence
  chemically synthesized
gataatgagtttgtgagtagta

SEQ ID NO: 1197929 - DNA, 22 bp, Artificial Sequence
  chemically synthesized
ttggataatgagtttgtgagta

SEQ ID NO: 1197930 - DNA, 22 bp, Artificial Sequence
  chemically synthesized
gttggataatgagtttgtgagt

SEQ ID NO: 1197931 - DNA, 22 bp, Artificial Sequence
  chemically synthesized
atctactactcacaaactcatt

SEQ ID NO: 1197932 - DNA, 22 bp, Artificial Sequence
  chemically synthesized
ctactcacaaactcattatcca

SEQ ID NO: 1197933 - DNA, 22 bp, Artificial Sequence
  chemically synthesized
ctcacaaactcattatccaaca

SEQ ID NO: 1197934 - DNA, 22 bp, Artificial Sequence
  chemically synthesized
acaaactcattatccaacaaat

SEQ ID NO: 1197935 - DNA, 22 bp, Artificial Sequence
  chemically synthesized
tgagggcaaaaataaatttgtt

SEQ ID NO: 1197936 - DNA, 22 bp, Artificial Sequence
  chemically synthesized
gtgagggcaaaaataaatttgt

SEQ ID NO: 1197937 - DNA, 22 bp, Artificial Sequence
  chemically synthesized
tgtgagggcaaaaataaatttg

SEQ ID NO: 1197938 - DNA, 22 bp, Artificial Sequence
  chemically synthesized
ttgtgagggcaaaaataaattt

SEQ ID NO: 1197939 - DNA, 22 bp, Artificial Sequence
  chemically synthesized
tttgtgagggcaaaaataaatt

SEQ ID NO: 1197940 - DNA, 22 bp, Artificial Sequence
  chemically synthesized
attatccaacaaatttattttt

SEQ ID NO: 1197941 - DNA, 22 bp, Artificial Sequence
  chemically synthesized
ttttttgtgagggcaaaaataa

SEQ ID NO: 1197942 - DNA, 22 bp, Artificial Sequence
  chemically synthesized
attttttgtgagggcaaaaata

SEQ ID NO: 1197943 - DNA, 22 bp, Artificial Sequence
  chemically synthesized
tccaacaaatttatttttgccc

SEQ ID NO: 1197944 - DNA, 22 bp, Artificial Sequence
  chemically synthesized
taagtttattttttgtgagggc

SEQ ID NO: 1197945 - DNA, 22 bp, Artificial Sequence
  chemically synthesized
atttttgccctcacaaaaaata

SEQ ID NO: 1197946 - DNA, 22 bp, Artificial Sequence
  chemically synthesized
tttttgccctcacaaaaaataa

SEQ ID NO: 1197947 - DNA, 22 bp, Artificial Sequence
  chemically synthesized
tcagttataagtttattttttg

SEQ ID NO: 1197948 - DNA, 22 bp, Artificial Sequence
  chemically synthesized
gtcagttataagtttatttttt

SEQ ID NO: 1197949 - DNA, 22 bp, Artificial Sequence
  chemically synthesized
tgtcagttataagtttattttt

SEQ ID NO: 1197950 - DNA, 22 bp, Artificial Sequence
  chemically synthesized
ttgccctcacaaaaaataaact

SEQ ID NO: 1197951 - DNA, 22 bp, Artificial Sequence
  chemically synthesized
ttgtcagttataagtttatttt

SEQ ID NO: 1197952 - DNA, 22 bp, Artificial Sequence
  chemically synthesized
tgccctcacaaaaaataaactt

SEQ ID NO: 1197953 - DNA, 22 bp, Artificial Sequence
  chemically synthesized
tttgtcagttataagtttattt

SEQ ID NO: 1197954 - DNA, 22 bp, Artificial Sequence
  chemically synthesized
gccctcacaaaaaataaactta

SEQ ID NO: 1197955 - DNA, 22 bp, Artificial Sequence
  chemically synthesized
ttttgtcagttataagtttatt

SEQ ID NO: 1197956 - DNA, 22 bp, Artificial Sequence
  chemically synthesized
ccctcacaaaaaataaacttat

SEQ ID NO: 1197957 - DNA, 22 bp, Artificial Sequence
  chemically synthesized
tttttttgtcagttataagttt

SEQ ID NO: 1197958 - DNA, 22 bp, Artificial Sequence
  chemically synthesized
atttttttgtcagttataagtt

SEQ ID NO: 1197959 - DNA, 22 bp, Artificial Sequence
  chemically synthesized
tatttttttgtcagttataagt

SEQ ID NO: 1197960 - DNA, 22 bp, Artificial Sequence
  chemically synthesized
acaaaaaataaacttataactg

SEQ ID NO: 1197961 - DNA, 22 bp, Artificial Sequence
  chemically synthesized
ttatttttttgtcagttataag

SEQ ID NO: 1197962 - DNA, 22 bp, Artificial Sequence
  chemically synthesized
tttatttttttgtcagttataa

SEQ ID NO: 1197963 - DNA, 22 bp, Artificial Sequence
  chemically synthesized
ttttatttttttgtcagttata

SEQ ID NO: 1197964 - DNA, 22 bp, Artificial Sequence
  chemically synthesized
ttttttatttttttgtcagtta

SEQ ID NO: 1197965 - DNA, 22 bp, Artificial Sequence
  chemically synthesized
cttttttatttttttgtcagtt

SEQ ID NO: 1197966 - DNA, 22 bp, Artificial Sequence
  chemically synthesized
ataactgacaaaaaaataaaaa

SEQ ID NO: 1197967 - DNA, 22 bp, Artificial Sequence
  chemically synthesized
taactgacaaaaaaataaaaaa

SEQ ID NO: 1197968 - DNA, 22 bp, Artificial Sequence
  chemically synthesized
tatcaaatcagatttctttttt

SEQ ID NO: 1197969 - DNA, 22 bp, Artificial Sequence
  chemically synthesized
acaaaaaaataaaaaagaaatc

SEQ ID NO: 1197970 - DNA, 22 bp, Artificial Sequence
  chemically synthesized
ttatatcaaatcagatttcttt

SEQ ID NO: 1197971 - DNA, 22 bp, Artificial Sequence
  chemically synthesized
ctgttatatcaaatcagatttc

SEQ ID NO: 1197972 - DNA, 22 bp, Artificial Sequence
  chemically synthesized
aaattcctgttatatcaaatca

SEQ ID NO: 1197973 - DNA, 22 bp, Artificial Sequence
  chemically synthesized
ctaaaattcctgttatatcaaa

SEQ ID NO: 1197974 - DNA, 22 bp, Artificial Sequence
  chemically synthesized
cctaaaattcctgttatatcaa

SEQ ID NO: 1197975 - DNA, 22 bp, Artificial Sequence
  chemically synthesized
tcctaaaattcctgttatatca

SEQ ID NO: 1197976 - DNA, 22 bp, Artificial Sequence
  chemically synthesized
attttcctaaaattcctgttat

SEQ ID NO: 1197977 - DNA, 22 bp, Artificial Sequence
  chemically synthesized
aattttcctaaaattcctgtta

SEQ ID NO: 1197978 - DNA, 22 bp, Artificial Sequence
  chemically synthesized
taattttcctaaaattcctgtt

SEQ ID NO: 1197979 - DNA, 22 bp, Artificial Sequence
  chemically synthesized
atttgatataacaggaatttta

SEQ ID NO: 1197980 - DNA, 22 bp, Artificial Sequence
  chemically synthesized
gatataacaggaattttaggaa

SEQ ID NO: 1197981 - DNA, 22 bp, Artificial Sequence
  chemically synthesized
atataacaggaattttaggaaa

SEQ ID NO: 1197982 - DNA, 22 bp, Artificial Sequence
  chemically synthesized
gtaatgctttaattttcctaaa

SEQ ID NO: 1197983 - DNA, 22 bp, Artificial Sequence
  chemically synthesized
ctagtaatgctttaattttcct

SEQ ID NO: 1197984 - DNA, 22 bp, Artificial Sequence
  chemically synthesized
aatctcctagtaatgctttaat

SEQ ID NO: 1197985 - DNA, 22 bp, Artificial Sequence
  chemically synthesized
gaatctcctagtaatgctttaa

SEQ ID NO: 1197986 - DNA, 22 bp, Artificial Sequence
  chemically synthesized
tgaatctcctagtaatgcttta

SEQ ID NO: 1197987 - DNA, 22 bp, Artificial Sequence
  chemically synthesized
ttgaatctcctagtaatgcttt

SEQ ID NO: 1197988 - DNA, 22 bp, Artificial Sequence
  chemically synthesized
taggaaaattaaagcattacta

SEQ ID NO: 1197989 - DNA, 22 bp, Artificial Sequence
  chemically synthesized
aggaaaattaaagcattactag

SEQ ID NO: 1197990 - DNA, 22 bp, Artificial Sequence
  chemically synthesized
ggaaaattaaagcattactagg

SEQ ID NO: 1197991 - DNA, 22 bp, Artificial Sequence
  chemically synthesized
aagcattactaggagattcaaa

SEQ ID NO: 1197992 - DNA, 22 bp, Artificial Sequence
  chemically synthesized
tatgaagccgtttttgaatctc

SEQ ID NO: 1197993 - DNA, 22 bp, Artificial Sequence
  chemically synthesized
tatatgaagccgtttttgaatc

SEQ ID NO: 1197994 - DNA, 22 bp, Artificial Sequence
  chemically synthesized
ctaggagattcaaaaacggctt

SEQ ID NO: 1197995 - DNA, 22 bp, Artificial Sequence
  chemically synthesized
ggagattcaaaaacggcttcat

SEQ ID NO: 1197996 - DNA, 22 bp, Artificial Sequence
  chemically synthesized
tatggtatcaactctatatgaa

SEQ ID NO: 1197997 - DNA, 22 bp, Artificial Sequence
  chemically synthesized
atatggtatcaactctatatga

SEQ ID NO: 1197998 - DNA, 22 bp, Artificial Sequence
  chemically synthesized
aaaaacggcttcatatagagtt

SEQ ID NO: 1197999 - DNA, 22 bp, Artificial Sequence
  chemically synthesized
tagacccaatttatatggtatc

SEQ ID NO: 1198000 - DNA, 22 bp, Artificial Sequence
  chemically synthesized
catatagagttgataccatata

SEQ ID NO: 1198001 - DNA, 22 bp, Artificial Sequence
  chemically synthesized
atatagagttgataccatataa

SEQ ID NO: 1198002 - DNA, 22 bp, Artificial Sequence
  chemically synthesized
tatagacccaatttatatggta

SEQ ID NO: 1198003 - DNA, 22 bp, Artificial Sequence
  chemically synthesized
ctatagacccaatttatatggt

SEQ ID NO: 1198004 - DNA, 22 bp, Artificial Sequence
  chemically synthesized
cttctatagacccaatttatat

SEQ ID NO: 1198005 - DNA, 22 bp, Artificial Sequence
  chemically synthesized
gcttctatagacccaatttata

SEQ ID NO: 1198006 - DNA, 22 bp, Artificial Sequence
  chemically synthesized
tgcttctatagacccaatttat

SEQ ID NO: 1198007 - DNA, 22 bp, Artificial Sequence
  chemically synthesized
ttgcttctatagacccaattta

SEQ ID NO: 1198008 - DNA, 22 bp, Artificial Sequence
  chemically synthesized
ataccatataaattgggtctat

SEQ ID NO: 1198009 - DNA, 22 bp, Artificial Sequence
  chemically synthesized
taggcttttgcttctatagacc

SEQ ID NO: 1198010 - DNA, 22 bp, Artificial Sequence
  chemically synthesized
tatgtctataggcttttgcttc

SEQ ID NO: 1198011 - DNA, 22 bp, Artificial Sequence
  chemically synthesized
ctgtatgtctataggcttttgc

SEQ ID NO: 1198012 - DNA, 22 bp, Artificial Sequence
  chemically synthesized
ggtctatagaagcaaaagccta

SEQ ID NO: 1198013 - DNA, 22 bp, Artificial Sequence
  chemically synthesized
cctgtatgtctataggcttttg

SEQ ID NO: 1198014 - DNA, 22 bp, Artificial Sequence
  chemically synthesized
tagaagcaaaagcctatagaca

SEQ ID NO: 1198015 - DNA, 22 bp, Artificial Sequence
  chemically synthesized
cagcttcctgtatgtctatagg

SEQ ID NO: 1198016 - DNA, 22 bp, Artificial Sequence
  chemically synthesized
attacagcttcctgtatgtcta

SEQ ID NO: 1198017 - DNA, 22 bp, Artificial Sequence
  chemically synthesized
aattacagcttcctgtatgtct

SEQ ID NO: 1198018 - DNA, 22 bp, Artificial Sequence
  chemically synthesized
ccttaattacagcttcctgtat

SEQ ID NO: 1198019 - DNA, 22 bp, Artificial Sequence
  chemically synthesized
attaccttaattacagcttcct

SEQ ID NO: 1198020 - DNA, 22 bp, Artificial Sequence
  chemically synthesized
tagacatacaggaagctgtaat

SEQ ID NO: 1198021 - DNA, 22 bp, Artificial Sequence
  chemically synthesized
gtctcattaccttaattacagc

SEQ ID NO: 1198022 - DNA, 22 bp, Artificial Sequence
  chemically synthesized
tagtctcattaccttaattaca

SEQ ID NO: 1198023 - DNA, 22 bp, Artificial Sequence
  chemically synthesized
agctctagtctcattaccttaa

SEQ ID NO: 1198024 - DNA, 22 bp, Artificial Sequence
  chemically synthesized
gagctctagtctcattacctta

SEQ ID NO: 1198025 - DNA, 22 bp, Artificial Sequence
  chemically synthesized
acttgagctctagtctcattac

SEQ ID NO: 1198026 - DNA, 22 bp, Artificial Sequence
  chemically synthesized
cacttgagctctagtctcatta

SEQ ID NO: 1198027 - DNA, 22 bp, Artificial Sequence
  chemically synthesized
taattaaggtaatgagactaga

SEQ ID NO: 1198028 - DNA, 22 bp, Artificial Sequence
  chemically synthesized
aggtaatgagactagagctcaa

SEQ ID NO: 1198029 - DNA, 22 bp, Artificial Sequence
  chemically synthesized
cccatatttcacttgagctcta

SEQ ID NO: 1198030 - DNA, 22 bp, Artificial Sequence
  chemically synthesized
gcccatatttcacttgagctct

SEQ ID NO: 1198031 - DNA, 22 bp, Artificial Sequence
  chemically synthesized
tgcccatatttcacttgagctc

SEQ ID NO: 1198032 - DNA, 22 bp, Artificial Sequence
  chemically synthesized
atcagttttgcccatatttcac

SEQ ID NO: 1198033 - DNA, 22 bp, Artificial Sequence
  chemically synthesized
ttcatcagttttgcccatattt

SEQ ID NO: 1198034 - DNA, 22 bp, Artificial Sequence
  chemically synthesized
gagctcaagtgaaatatgggca

SEQ ID NO: 1198035 - DNA, 22 bp, Artificial Sequence
  chemically synthesized
attcatcagttttgcccatatt

SEQ ID NO: 1198036 - DNA, 22 bp, Artificial Sequence
  chemically synthesized
aagtgaaatatgggcaaaactg

SEQ ID NO: 1198037 - DNA, 22 bp, Artificial Sequence
  chemically synthesized
atcaggtttattcatcagtttt

SEQ ID NO: 1198038 - DNA, 22 bp, Artificial Sequence
  chemically synthesized
aatcaggtttattcatcagttt

SEQ ID NO: 1198039 - DNA, 22 bp, Artificial Sequence
  chemically synthesized
gcttaatcaggtttattcatca

SEQ ID NO: 1198040 - DNA, 22 bp, Artificial Sequence
  chemically synthesized
ggcttaatcaggtttattcatc

SEQ ID NO: 1198041 - DNA, 22 bp, Artificial Sequence
  chemically synthesized
tggcttaatcaggtttattcat

SEQ ID NO: 1198042 - DNA, 22 bp, Artificial Sequence
  chemically synthesized
tgattttggcttaatcaggttt

SEQ ID NO: 1198043 - DNA, 22 bp, Artificial Sequence
  chemically synthesized
tgtgattttggcttaatcaggt

SEQ ID NO: 1198044 - DNA, 22 bp, Artificial Sequence
  chemically synthesized
atgaataaacctgattaagcca

SEQ ID NO: 1198045 - DNA, 22 bp, Artificial Sequence
  chemically synthesized
gtaaccctctgtgattttggct

SEQ ID NO: 1198046 - DNA, 22 bp, Artificial Sequence
  chemically synthesized
attaagccaaaatcacagaggg

SEQ ID NO: 1198047 - DNA, 22 bp, Artificial Sequence
  chemically synthesized
agccaaaatcacagagggttac

SEQ ID NO: 1198048 - DNA, 22 bp, Artificial Sequence
  chemically synthesized
accaagtcactggtaaccctct

SEQ ID NO: 1198049 - DNA, 22 bp, Artificial Sequence
  chemically synthesized
taaccaagtcactggtaaccct

SEQ ID NO: 1198050 - DNA, 22 bp, Artificial Sequence
  chemically synthesized
ctaaccaagtcactggtaaccc

SEQ ID NO: 1198051 - DNA, 22 bp, Artificial Sequence
  chemically synthesized
aaacttctaaccaagtcactgg

SEQ ID NO: 1198052 - DNA, 22 bp, Artificial Sequence
  chemically synthesized
gaaaatgttcaaacttctaacc

SEQ ID NO: 1198053 - DNA, 22 bp, Artificial Sequence
  chemically synthesized
ccagtgacttggttagaagttt

SEQ ID NO: 1198054 - DNA, 22 bp, Artificial Sequence
  chemically synthesized
gatgcctagaaaatgttcaaac

SEQ ID NO: 1198055 - DNA, 22 bp, Artificial Sequence
  chemically synthesized
ttggatgcctagaaaatgttca

SEQ ID NO: 1198056 - DNA, 22 bp, Artificial Sequence
  chemically synthesized
ggttagaagtttgaacattttc

SEQ ID NO: 1198057 - DNA, 22 bp, Artificial Sequence
  chemically synthesized
gttagaagtttgaacattttct

SEQ ID NO: 1198058 - DNA, 22 bp, Artificial Sequence
  chemically synthesized
gaagtttgaacattttctaggc

SEQ ID NO: 1198059 - DNA, 22 bp, Artificial Sequence
  chemically synthesized
gaacattttctaggcatccaat

SEQ ID NO: 1198060 - DNA, 22 bp, Artificial Sequence
  chemically synthesized
cgcaaccacattattggatgcc

SEQ ID NO: 1198061 - DNA, 22 bp, Artificial Sequence
  chemically synthesized
aacattttctaggcatccaata

SEQ ID NO: 1198062 - DNA, 22 bp, Artificial Sequence
  chemically synthesized
tgcctacgcaaccacattattg

SEQ ID NO: 1198063 - DNA, 22 bp, Artificial Sequence
  chemically synthesized
tctaggcatccaataatgtggt

SEQ ID NO: 1198064 - DNA, 22 bp, Artificial Sequence
  chemically synthesized
ctaggcatccaataatgtggtt

SEQ ID NO: 1198065 - DNA, 22 bp, Artificial Sequence
  chemically synthesized
ctgtgcctacgcaaccacatta

SEQ ID NO: 1198066 - DNA, 22 bp, Artificial Sequence
  chemically synthesized
taggcatccaataatgtggttg

SEQ ID NO: 1198067 - DNA, 22 bp, Artificial Sequence
  chemically synthesized
ggcatccaataatgtggttgcg

SEQ ID NO: 1198068 - DNA, 22 bp, Artificial Sequence
  chemically synthesized
ttcctgtgcctacgcaaccaca

SEQ ID NO: 1198069 - DNA, 22 bp, Artificial Sequence
  chemically synthesized
attcctgtgcctacgcaaccac

SEQ ID NO: 1198070 - DNA, 22 bp, Artificial Sequence
  chemically synthesized
tattcctgtgcctacgcaacca

SEQ ID NO: 1198071 - DNA, 22 bp, Artificial Sequence
  chemically synthesized
agttttattcctgtgcctacgc

SEQ ID NO: 1198072 - DNA, 22 bp, Artificial Sequence
  chemically synthesized
cgtaggcacaggaataaaactg

SEQ ID NO: 1198073 - DNA, 22 bp, Artificial Sequence
  chemically synthesized
ggtaaagtccatcatccaaaac

SEQ ID NO: 1198074 - DNA, 22 bp, Artificial Sequence
  chemically synthesized
aggtaaagtccatcatccaaaa

SEQ ID NO: 1198075 - DNA, 22 bp, Artificial Sequence
  chemically synthesized
agtttggttttggatgatggac

SEQ ID NO: 1198076 - DNA, 22 bp, Artificial Sequence
  chemically synthesized
ggttttggatgatggactttac

SEQ ID NO: 1198077 - DNA, 22 bp, Artificial Sequence
  chemically synthesized
gttttggatgatggactttacc

SEQ ID NO: 1198078 - DNA, 22 bp, Artificial Sequence
  chemically synthesized
tggatgatggactttacctaag

SEQ ID NO: 1198079 - DNA, 22 bp, Artificial Sequence
  chemically synthesized
ggatgatggactttacctaagg

SEQ ID NO: 1198080 - DNA, 22 bp, Artificial Sequence
  chemically synthesized
gatgatggactttacctaaggt

SEQ ID NO: 1198081 - DNA, 22 bp, Artificial Sequence
  chemically synthesized
aaagcaacaagacccaccttag

SEQ ID NO: 1198082 - DNA, 22 bp, Artificial Sequence
  chemically synthesized
aaaagcaacaagacccacctta

SEQ ID NO: 1198083 - DNA, 22 bp, Artificial Sequence
  chemically synthesized
taaaagcaacaagacccacctt

SEQ ID NO: 1198084 - DNA, 22 bp, Artificial Sequence
  chemically synthesized
tacctaaggtgggtcttgttgc

SEQ ID NO: 1198085 - DNA, 22 bp, Artificial Sequence
  chemically synthesized
acctaaggtgggtcttgttgct

SEQ ID NO: 1198086 - DNA, 22 bp, Artificial Sequence
  chemically synthesized
cctaaggtgggtcttgttgctt

SEQ ID NO: 1198087 - DNA, 22 bp, Artificial Sequence
  chemically synthesized
aggtgggtcttgttgcttttaa

SEQ ID NO: 1198088 - DNA, 22 bp, Artificial Sequence
  chemically synthesized
taagggagtgatgattttaaaa

SEQ ID NO: 1198089 - DNA, 22 bp, Artificial Sequence
  chemically synthesized
ataagggagtgatgattttaaa

SEQ ID NO: 1198090 - DNA, 22 bp, Artificial Sequence
  chemically synthesized
tataagggagtgatgattttaa

SEQ ID NO: 1198091 - DNA, 22 bp, Artificial Sequence
  chemically synthesized
tttataagggagtgatgatttt

SEQ ID NO: 1198092 - DNA, 22 bp, Artificial Sequence
  chemically synthesized
ctttataagggagtgatgattt

SEQ ID NO: 1198093 - DNA, 22 bp, Artificial Sequence
  chemically synthesized
tctttataagggagtgatgatt

SEQ ID NO: 1198094 - DNA, 22 bp, Artificial Sequence
  chemically synthesized
gttgcttttaaaatcatcactc

SEQ ID NO: 1198095 - DNA, 22 bp, Artificial Sequence
  chemically synthesized
ttctttataagggagtgatgat

SEQ ID NO: 1198096 - DNA, 22 bp, Artificial Sequence
  chemically synthesized
ttgcttttaaaatcatcactcc

SEQ ID NO: 1198097 - DNA, 22 bp, Artificial Sequence
  chemically synthesized
tttctttataagggagtgatga

SEQ ID NO: 1198098 - DNA, 22 bp, Artificial Sequence
  chemically synthesized
ttttctttataagggagtgatg

SEQ ID NO: 1198099 - DNA, 22 bp, Artificial Sequence
  chemically synthesized
tttttctttataagggagtgat

SEQ ID NO: 1198100 - DNA, 22 bp, Artificial Sequence
  chemically synthesized
cttttaaaatcatcactccctt

SEQ ID NO: 1198101 - DNA, 22 bp, Artificial Sequence
  chemically synthesized
ttttttctttataagggagtga

SEQ ID NO: 1198102 - DNA, 22 bp, Artificial Sequence
  chemically synthesized
ttaaaatcatcactcccttata

SEQ ID NO: 1198103 - DNA, 22 bp, Artificial Sequence
  chemically synthesized
taaaatcatcactcccttataa

SEQ ID NO: 1198104 - DNA, 22 bp, Artificial Sequence
  chemically synthesized
aaaatcatcactcccttataaa

SEQ ID NO: 1198105 - DNA, 22 bp, Artificial Sequence
  chemically synthesized
aaatcatcactcccttataaag

SEQ ID NO: 1198106 - DNA, 22 bp, Artificial Sequence
  chemically synthesized
catagatttttttttctttata

SEQ ID NO: 1198107 - DNA, 22 bp, Artificial Sequence
  chemically synthesized
ccttataaagaaaaaaaaatct

SEQ ID NO: 1198108 - DNA, 22 bp, Artificial Sequence
  chemically synthesized
ggatgtctgcatagattttttt

SEQ ID NO: 1198109 - DNA, 22 bp, Artificial Sequence
  chemically synthesized
gggatgtctgcatagatttttt

SEQ ID NO: 1198110 - DNA, 22 bp, Artificial Sequence
  chemically synthesized
tgggatgtctgcatagattttt

SEQ ID NO: 1198111 - DNA, 22 bp, Artificial Sequence
  chemically synthesized
ataaagaaaaaaaaatctatgc

SEQ ID NO: 1198112 - DNA, 22 bp, Artificial Sequence
  chemically synthesized
taaagaaaaaaaaatctatgca

SEQ ID NO: 1198113 - DNA, 22 bp, Artificial Sequence
  chemically synthesized
ttttgggatgtctgcatagatt

SEQ ID NO: 1198114 - DNA, 22 bp, Artificial Sequence
  chemically synthesized
atgttattttgggatgtctgca

SEQ ID NO: 1198115 - DNA, 22 bp, Artificial Sequence
  chemically synthesized
aatgttattttgggatgtctgc

SEQ ID NO: 1198116 - DNA, 22 bp, Artificial Sequence
  chemically synthesized
tgcagacatcccaaaataacat

SEQ ID NO: 1198117 - DNA, 22 bp, Artificial Sequence
  chemically synthesized
atgtcgaagcccagtgtcttaa

SEQ ID NO: 1198118 - DNA, 22 bp, Artificial Sequence
  chemically synthesized
agacactgggcttcgacatcag

SEQ ID NO: 1198119 - DNA, 22 bp, Artificial Sequence
  chemically synthesized
aatgaatccaggactgatgtcg

SEQ ID NO: 1198120 - DNA, 22 bp, Artificial Sequence
  chemically synthesized
gaatgaatccaggactgatgtc

SEQ ID NO: 1198121 - DNA, 22 bp, Artificial Sequence
  chemically synthesized
gatttgaatgaatccaggactg

SEQ ID NO: 1198122 - DNA, 22 bp, Artificial Sequence
  chemically synthesized
ggcttcgacatcagtcctggat

SEQ ID NO: 1198123 - DNA, 22 bp, Artificial Sequence
  chemically synthesized
cgacatcagtcctggattcatt

SEQ ID NO: 1198124 - DNA, 22 bp, Artificial Sequence
  chemically synthesized
gacatcagtcctggattcattc

SEQ ID NO: 1198125 - DNA, 22 bp, Artificial Sequence
  chemically synthesized
ataggaagtagagattggattt

SEQ ID NO: 1198126 - DNA, 22 bp, Artificial Sequence
  chemically synthesized
gattcattcaaatccaatctct

SEQ ID NO: 1198127 - DNA, 22 bp, Artificial Sequence
  chemically synthesized
attcaaatccaatctctacttc

SEQ ID NO: 1198128 - DNA, 22 bp, Artificial Sequence
  chemically synthesized
aaatccaatctctacttcctat

SEQ ID NO: 1198129 - DNA, 22 bp, Artificial Sequence
  chemically synthesized
tacagataactaataggaagta

SEQ ID NO: 1198130 - DNA, 22 bp, Artificial Sequence
  chemically synthesized
cccatattatacagataactaa

SEQ ID NO: 1198131 - DNA, 22 bp, Artificial Sequence
  chemically synthesized
acccatattatacagataacta

SEQ ID NO: 1198132 - DNA, 22 bp, Artificial Sequence
  chemically synthesized
tacttcctattagttatctgta

SEQ ID NO: 1198133 - DNA, 22 bp, Artificial Sequence
  chemically synthesized
cttcctattagttatctgtata

SEQ ID NO: 1198134 - DNA, 22 bp, Artificial Sequence
  chemically synthesized
cctattagttatctgtataata

SEQ ID NO: 1198135 - DNA, 22 bp, Artificial Sequence
  chemically synthesized
ctattagttatctgtataatat

SEQ ID NO: 1198136 - DNA, 22 bp, Artificial Sequence
  chemically synthesized
ttagttatctgtataatatggg

SEQ ID NO: 1198137 - DNA, 22 bp, Artificial Sequence
  chemically synthesized
gttatctgtataatatgggtaa

SEQ ID NO: 1198138 - DNA, 22 bp, Artificial Sequence
  chemically synthesized
aggagagaaaggaatttaccca

SEQ ID NO: 1198139 - DNA, 22 bp, Artificial Sequence
  chemically synthesized
tctgtataatatgggtaaattc

SEQ ID NO: 1198140 - DNA, 22 bp, Artificial Sequence
  chemically synthesized
ttgaggagagaaaggaatttac

SEQ ID NO: 1198141 - DNA, 22 bp, Artificial Sequence
  chemically synthesized
tataatatgggtaaattccttt

SEQ ID NO: 1198142 - DNA, 22 bp, Artificial Sequence
  chemically synthesized
aaatgtagaagcaaactgttga

SEQ ID NO: 1198143 - DNA, 22 bp, Artificial Sequence
  chemically synthesized
ctttctctcctcaacagtttgc

SEQ ID NO: 1198144 - DNA, 22 bp, Artificial Sequence
  chemically synthesized
tctctcctcaacagtttgcttc

SEQ ID NO: 1198145 - DNA, 22 bp, Artificial Sequence
  chemically synthesized
ctctcctcaacagtttgcttct

SEQ ID NO: 1198146 - DNA, 22 bp, Artificial Sequence
  chemically synthesized
tctcctcaacagtttgcttcta

SEQ ID NO: 1198147 - DNA, 22 bp, Artificial Sequence
  chemically synthesized
tcctcaacagtttgcttctaca

SEQ ID NO: 1198148 - DNA, 22 bp, Artificial Sequence
  chemically synthesized
ctcaacagtttgcttctacatt

SEQ ID NO: 1198149 - DNA, 22 bp, Artificial Sequence
  chemically synthesized
acatgtacattaaaatgtagaa

SEQ ID NO: 1198150 - DNA, 22 bp, Artificial Sequence
  chemically synthesized
cacatgtacattaaaatgtaga

SEQ ID NO: 1198151 - DNA, 22 bp, Artificial Sequence
  chemically synthesized
aacagtttgcttctacatttta

SEQ ID NO: 1198152 - DNA, 22 bp, Artificial Sequence
  chemically synthesized
ggaacttcacatgtacattaaa

SEQ ID NO: 1198153 - DNA, 22 bp, Artificial Sequence
  chemically synthesized
gcttctacattttaatgtacat

SEQ ID NO: 1198154 - DNA, 22 bp, Artificial Sequence
  chemically synthesized
cttctacattttaatgtacatg

SEQ ID NO: 1198155 - DNA, 22 bp, Artificial Sequence
  chemically synthesized
ctacattttaatgtacatgtga

SEQ ID NO: 1198156 - DNA, 22 bp, Artificial Sequence
  chemically synthesized
tacattttaatgtacatgtgaa

SEQ ID NO: 1198157 - DNA, 22 bp, Artificial Sequence
  chemically synthesized
agggctaggaacttcacatgta

SEQ ID NO: 1198158 - DNA, 22 bp, Artificial Sequence
  chemically synthesized
cattttaatgtacatgtgaagt

SEQ ID NO: 1198159 - DNA, 22 bp, Artificial Sequence
  chemically synthesized
ttaagggctaggaacttcacat

SEQ ID NO: 1198160 - DNA, 22 bp, Artificial Sequence
  chemically synthesized
attaagggctaggaacttcaca

SEQ ID NO: 1198161 - DNA, 22 bp, Artificial Sequence
  chemically synthesized
tattaagggctaggaacttcac

SEQ ID NO: 1198162 - DNA, 22 bp, Artificial Sequence
  chemically synthesized
taatgtacatgtgaagttccta

SEQ ID NO: 1198163 - DNA, 22 bp, Artificial Sequence
  chemically synthesized
aatgtacatgtgaagttcctag

SEQ ID NO: 1198164 - DNA, 22 bp, Artificial Sequence
  chemically synthesized
ctttattaagggctaggaactt

SEQ ID NO: 1198165 - DNA, 22 bp, Artificial Sequence
  chemically synthesized
atgtacatgtgaagttcctagc

SEQ ID NO: 1198166 - DNA, 22 bp, Artificial Sequence
  chemically synthesized
caattgctttattaagggctag

SEQ ID NO: 1198167 - DNA, 22 bp, Artificial Sequence
  chemically synthesized
acaattgctttattaagggcta

SEQ ID NO: 1198168 - DNA, 22 bp, Artificial Sequence
  chemically synthesized
agccttacaattgctttattaa

SEQ ID NO: 1198169 - DNA, 22 bp, Artificial Sequence
  chemically synthesized
aagccttacaattgctttatta

SEQ ID NO: 1198170 - DNA, 22 bp, Artificial Sequence
  chemically synthesized
tttaagccttacaattgcttta

SEQ ID NO: 1198171 - DNA, 22 bp, Artificial Sequence
  chemically synthesized
ctagcccttaataaagcaattg

SEQ ID NO: 1198172 - DNA, 22 bp, Artificial Sequence
  chemically synthesized
atttaagccttacaattgcttt

SEQ ID NO: 1198173 - DNA, 22 bp, Artificial Sequence
  chemically synthesized
ttatttaagccttacaattgct

SEQ ID NO: 1198174 - DNA, 22 bp, Artificial Sequence
  chemically synthesized
gcccttaataaagcaattgtaa

SEQ ID NO: 1198175 - DNA, 22 bp, Artificial Sequence
  chemically synthesized
cttatttaagccttacaattgc

SEQ ID NO: 1198176 - DNA, 22 bp, Artificial Sequence
  chemically synthesized
aataaagcaattgtaaggctta

SEQ ID NO: 1198177 - DNA, 22 bp, Artificial Sequence
  chemically synthesized
gagtttcttatttaagccttac

SEQ ID NO: 1198178 - DNA, 22 bp, Artificial Sequence
  chemically synthesized
ataaagcaattgtaaggcttaa

SEQ ID NO: 1198179 - DNA, 22 bp, Artificial Sequence
  chemically synthesized
cctggagtttcttatttaagcc

SEQ ID NO: 1198180 - DNA, 22 bp, Artificial Sequence
  chemically synthesized
acctggagtttcttatttaagc

SEQ ID NO: 1198181 - DNA, 22 bp, Artificial Sequence
  chemically synthesized
tacctggagtttcttatttaag

SEQ ID NO: 1198182 - DNA, 22 bp, Artificial Sequence
  chemically synthesized
ctttacctggagtttcttattt

SEQ ID NO: 1198183 - DNA, 22 bp, Artificial Sequence
  chemically synthesized
taaggcttaaataagaaactcc

SEQ ID NO: 1198184 - DNA, 22 bp, Artificial Sequence
  chemically synthesized
tgtgccagctactttacctgga

SEQ ID NO: 1198185 - DNA, 22 bp, Artificial Sequence
  chemically synthesized
aaataagaaactccaggtaaag

SEQ ID NO: 1198186 - DNA, 22 bp, Artificial Sequence
  chemically synthesized
aataagaaactccaggtaaagt

SEQ ID NO: 1198187 - DNA, 22 bp, Artificial Sequence
  chemically synthesized
ttatgtgccagctactttacct

SEQ ID NO: 1198188 - DNA, 22 bp, Artificial Sequence
  chemically synthesized
attatgtgccagctactttacc

SEQ ID NO: 1198189 - DNA, 22 bp, Artificial Sequence
  chemically synthesized
caggtaaagtagctggcacata

SEQ ID NO: 1198190 - DNA, 22 bp, Artificial Sequence
  chemically synthesized
atatgagcttattatgtgccag

SEQ ID NO: 1198191 - DNA, 22 bp, Artificial Sequence
  chemically synthesized
aatatgagcttattatgtgcca

SEQ ID NO: 1198192 - DNA, 22 bp, Artificial Sequence
  chemically synthesized
atatttaatatgagcttattat

SEQ ID NO: 1198193 - DNA, 22 bp, Artificial Sequence
  chemically synthesized
gcacataataagctcatattaa

SEQ ID NO: 1198194 - DNA, 22 bp, Artificial Sequence
  chemically synthesized
tgaaaatagctaatatttaata

SEQ ID NO: 1198195 - DNA, 22 bp, Artificial Sequence
  chemically synthesized
gtgaaaatagctaatatttaat

SEQ ID NO: 1198196 - DNA, 22 bp, Artificial Sequence
  chemically synthesized
atcagtttgtgaaaatagctaa

SEQ ID NO: 1198197 - DNA, 22 bp, Artificial Sequence
  chemically synthesized
atattaaatattagctattttc

SEQ ID NO: 1198198 - DNA, 22 bp, Artificial Sequence
  chemically synthesized
aatattagctattttcacaaac

SEQ ID NO: 1198199 - DNA, 22 bp, Artificial Sequence
  chemically synthesized
gctattttcacaaactgatcag

SEQ ID NO: 1198200 - DNA, 22 bp, Artificial Sequence
  chemically synthesized
ttttcacaaactgatcaggttt

SEQ ID NO: 1198201 - DNA, 22 bp, Artificial Sequence
  chemically synthesized
tcacaaactgatcaggtttctt

SEQ ID NO: 1198202 - DNA, 22 bp, Artificial Sequence
  chemically synthesized
cacaaactgatcaggtttcttt

SEQ ID NO: 1198203 - DNA, 22 bp, Artificial Sequence
  chemically synthesized
acaaactgatcaggtttctttt

SEQ ID NO: 1198204 - DNA, 22 bp, Artificial Sequence
  chemically synthesized
tgtcaccggcagtccaagaaaa

SEQ ID NO: 1198205 - DNA, 22 bp, Artificial Sequence
  chemically synthesized
atcaggtttcttttcttggact

SEQ ID NO: 1198206 - DNA, 22 bp, Artificial Sequence
  chemically synthesized
ctgtgtcaccggcagtccaaga

SEQ ID NO: 1198207 - DNA, 22 bp, Artificial Sequence
  chemically synthesized
tgctgtgtcaccggcagtccaa

SEQ ID NO: 1198208 - DNA, 22 bp, Artificial Sequence
  chemically synthesized
gttctgctgtgtcaccggcagt

SEQ ID NO: 1198209 - DNA, 22 bp, Artificial Sequence
  chemically synthesized
cttttcttggactgccggtgac

SEQ ID NO: 1198210 - DNA, 22 bp, Artificial Sequence
  chemically synthesized
ttttcttggactgccggtgaca

SEQ ID NO: 1198211 - DNA, 22 bp, Artificial Sequence
  chemically synthesized
ctagttctgctgtgtcaccggc

SEQ ID NO: 1198212 - DNA, 22 bp, Artificial Sequence
  chemically synthesized
ttcttggactgccggtgacaca

SEQ ID NO: 1198213 - DNA, 22 bp, Artificial Sequence
  chemically synthesized
tcttggactgccggtgacacag

SEQ ID NO: 1198214 - DNA, 22 bp, Artificial Sequence
  chemically synthesized
cttggactgccggtgacacagc

SEQ ID NO: 1198215 - DNA, 22 bp, Artificial Sequence
  chemically synthesized
ttggactgccggtgacacagca

SEQ ID NO: 1198216 - DNA, 22 bp, Artificial Sequence
  chemically synthesized
cattactagttctgctgtgtca

SEQ ID NO: 1198217 - DNA, 22 bp, Artificial Sequence
  chemically synthesized
ggactgccggtgacacagcaga

SEQ ID NO: 1198218 - DNA, 22 bp, Artificial Sequence
  chemically synthesized
gactgccggtgacacagcagaa

SEQ ID NO: 1198219 - DNA, 22 bp, Artificial Sequence
  chemically synthesized
aaatctacattactagttctgc

SEQ ID NO: 1198220 - DNA, 22 bp, Artificial Sequence
  chemically synthesized
ccggtgacacagcagaactagt

SEQ ID NO: 1198221 - DNA, 22 bp, Artificial Sequence
  chemically synthesized
aaaatctacattactagttctg

SEQ ID NO: 1198222 - DNA, 22 bp, Artificial Sequence
  chemically synthesized
taaaatctacattactagttct

SEQ ID NO: 1198223 - DNA, 22 bp, Artificial Sequence
  chemically synthesized
actttaaaatctacattactag

SEQ ID NO: 1198224 - DNA, 22 bp, Artificial Sequence
  chemically synthesized
aattaactttaaaatctacatt

SEQ ID NO: 1198225 - DNA, 22 bp, Artificial Sequence
  chemically synthesized
cattcaattaactttaaaatct

SEQ ID NO: 1198226 - DNA, 22 bp, Artificial Sequence
  chemically synthesized
cctccattcaattaactttaaa

SEQ ID NO: 1198227 - DNA, 22 bp, Artificial Sequence
  chemically synthesized
gtaatgtagattttaaagttaa

SEQ ID NO: 1198228 - DNA, 22 bp, Artificial Sequence
  chemically synthesized
acctccattcaattaactttaa

SEQ ID NO: 1198229 - DNA, 22 bp, Artificial Sequence
  chemically synthesized
tacctccattcaattaacttta

SEQ ID NO: 1198230 - DNA, 22 bp, Artificial Sequence
  chemically synthesized
gttttacctccattcaattaac

SEQ ID NO: 1198231 - DNA, 22 bp, Artificial Sequence
  chemically synthesized
ctagttttacctccattcaatt

SEQ ID NO: 1198232 - DNA, 22 bp, Artificial Sequence
  chemically synthesized
taaagttaattgaatggaggta

SEQ ID NO: 1198233 - DNA, 22 bp, Artificial Sequence
  chemically synthesized
aaagttaattgaatggaggtaa

SEQ ID NO: 1198234 - DNA, 22 bp, Artificial Sequence
  chemically synthesized
agtctcctagttttacctccat

SEQ ID NO: 1198235 - DNA, 22 bp, Artificial Sequence
  chemically synthesized
aagttaattgaatggaggtaaa

SEQ ID NO: 1198236 - DNA, 22 bp, Artificial Sequence
  chemically synthesized
cagtctcctagttttacctcca

SEQ ID NO: 1198237 - DNA, 22 bp, Artificial Sequence
  chemically synthesized
tcagtctcctagttttacctcc

SEQ ID NO: 1198238 - DNA, 22 bp, Artificial Sequence
  chemically synthesized
attgaatggaggtaaaactagg

SEQ ID NO: 1198239 - DNA, 22 bp, Artificial Sequence
  chemically synthesized
aatggaggtaaaactaggagac

SEQ ID NO: 1198240 - DNA, 22 bp, Artificial Sequence
  chemically synthesized
ggagactgaaaacttcttctac

SEQ ID NO: 1198241 - DNA, 22 bp, Artificial Sequence
  chemically synthesized
aaaacttcttctacatgttcac

SEQ ID NO: 1198242 - DNA, 22 bp, Artificial Sequence
  chemically synthesized
cagacgggtgacaagtgaacat

SEQ ID NO: 1198243 - DNA, 22 bp, Artificial Sequence
  chemically synthesized
tgcagacgggtgacaagtgaac

SEQ ID NO: 1198244 - DNA, 22 bp, Artificial Sequence
  chemically synthesized
cttctacatgttcacttgtcac

SEQ ID NO: 1198245 - DNA, 22 bp, Artificial Sequence
  chemically synthesized
ttctgcagacgggtgacaagtg

SEQ ID NO: 1198246 - DNA, 22 bp, Artificial Sequence
  chemically synthesized
ttctacatgttcacttgtcacc

SEQ ID NO: 1198247 - DNA, 22 bp, Artificial Sequence
  chemically synthesized
tgttctgcagacgggtgacaag

SEQ ID NO: 1198248 - DNA, 22 bp, Artificial Sequence
  chemically synthesized
ctacatgttcacttgtcacccg

SEQ ID NO: 1198249 - DNA, 22 bp, Artificial Sequence
  chemically synthesized
tacatgttcacttgtcacccgt

SEQ ID NO: 1198250 - DNA, 22 bp, Artificial Sequence
  chemically synthesized
catgttcacttgtcacccgtct

SEQ ID NO: 1198251 - DNA, 22 bp, Artificial Sequence
  chemically synthesized
caattctgttctgcagacgggt

SEQ ID NO: 1198252 - DNA, 22 bp, Artificial Sequence
  chemically synthesized
tccaattctgttctgcagacgg

SEQ ID NO: 1198253 - DNA, 22 bp, Artificial Sequence
  chemically synthesized
acttgtcacccgtctgcagaac

SEQ ID NO: 1198254 - DNA, 22 bp, Artificial Sequence
  chemically synthesized
gtcacccgtctgcagaacagaa

SEQ ID NO: 1198255 - DNA, 22 bp, Artificial Sequence
  chemically synthesized
tcacccgtctgcagaacagaat

SEQ ID NO: 1198256 - DNA, 22 bp, Artificial Sequence
  chemically synthesized
tggatgttctccaattctgttc

SEQ ID NO: 1198257 - DNA, 22 bp, Artificial Sequence
  chemically synthesized
ttatggatgttctccaattctg

SEQ ID NO: 1198258 - DNA, 22 bp, Artificial Sequence
  chemically synthesized
tgttattatggatgttctccaa

SEQ ID NO: 1198259 - DNA, 22 bp, Artificial Sequence
  chemically synthesized
gtgttattatggatgttctcca

SEQ ID NO: 1198260 - DNA, 22 bp, Artificial Sequence
  chemically synthesized
cagaacagaattggagaacatc

SEQ ID NO: 1198261 - DNA, 22 bp, Artificial Sequence
  chemically synthesized
cttgtgttattatggatgttct

SEQ ID NO: 1198262 - DNA, 22 bp, Artificial Sequence
  chemically synthesized
ccttgtgttattatggatgttc

SEQ ID NO: 1198263 - DNA, 22 bp, Artificial Sequence
  chemically synthesized
tccttgtgttattatggatgtt

SEQ ID NO: 1198264 - DNA, 22 bp, Artificial Sequence
  chemically synthesized
tttccttgtgttattatggatg

SEQ ID NO: 1198265 - DNA, 22 bp, Artificial Sequence
  chemically synthesized
actctttccttgtgttattatg

SEQ ID NO: 1198266 - DNA, 22 bp, Artificial Sequence
  chemically synthesized
gagaacatccataataacacaa

SEQ ID NO: 1198267 - DNA, 22 bp, Artificial Sequence
  chemically synthesized
ctaactctttccttgtgttatt

SEQ ID NO: 1198268 - DNA, 22 bp, Artificial Sequence
  chemically synthesized
tgctaactctttccttgtgtta

SEQ ID NO: 1198269 - DNA, 22 bp, Artificial Sequence
  chemically synthesized
ctctgctaactctttccttgtg

SEQ ID NO: 1198270 - DNA, 22 bp, Artificial Sequence
  chemically synthesized
tctgctctgctaactctttcct

SEQ ID NO: 1198271 - DNA, 22 bp, Artificial Sequence
  chemically synthesized
atctgctctgctaactctttcc

SEQ ID NO: 1198272 - DNA, 22 bp, Artificial Sequence
  chemically synthesized
tatcgtataccttatctgctct

SEQ ID NO: 1198273 - DNA, 22 bp, Artificial Sequence
  chemically synthesized
gcagagcagataaggtatacga

SEQ ID NO: 1198274 - DNA, 22 bp, Artificial Sequence
  chemically synthesized
taagtatatccatatcatctat

SEQ ID NO: 1198275 - DNA, 22 bp, Artificial Sequence
  chemically synthesized
catctataagtatatccatatc

SEQ ID NO: 1198276 - DNA, 22 bp, Artificial Sequence
  chemically synthesized
gtatgatattccatctataagt

SEQ ID NO: 1198277 - DNA, 22 bp, Artificial Sequence
  chemically synthesized
ctagtatgatattccatctata

SEQ ID NO: 1198278 - DNA, 22 bp, Artificial Sequence
  chemically synthesized
cctagtatgatattccatctat

SEQ ID NO: 1198279 - DNA, 22 bp, Artificial Sequence
  chemically synthesized
ggacagcttcctagtatgatat

SEQ ID NO: 1198280 - DNA, 22 bp, Artificial Sequence
  chemically synthesized
gggacagcttcctagtatgata

SEQ ID NO: 1198281 - DNA, 22 bp, Artificial Sequence
  chemically synthesized
atagatggaatatcatactagg

SEQ ID NO: 1198282 - DNA, 22 bp, Artificial Sequence
  chemically synthesized
tagatggaatatcatactagga

SEQ ID NO: 1198283 - DNA, 22 bp, Artificial Sequence
  chemically synthesized
tgaatttgggacagcttcctag

SEQ ID NO: 1198284 - DNA, 22 bp, Artificial Sequence
  chemically synthesized
tatgaatttgggacagcttcct

SEQ ID NO: 1198285 - DNA, 22 bp, Artificial Sequence
  chemically synthesized
ctatgaatttgggacagcttcc

SEQ ID NO: 1198286 - DNA, 22 bp, Artificial Sequence
  chemically synthesized
atttctatgaatttgggacagc

SEQ ID NO: 1198287 - DNA, 22 bp, Artificial Sequence
  chemically synthesized
ggaagctgtcccaaattcatag

SEQ ID NO: 1198288 - DNA, 22 bp, Artificial Sequence
  chemically synthesized
aaagattcatttctatgaattt

SEQ ID NO: 1198289 - DNA, 22 bp, Artificial Sequence
  chemically synthesized
gaaagattcatttctatgaatt

SEQ ID NO: 1198290 - DNA, 22 bp, Artificial Sequence
  chemically synthesized
tgaaagattcatttctatgaat

SEQ ID NO: 1198291 - DNA, 22 bp, Artificial Sequence
  chemically synthesized
ttgaaagattcatttctatgaa

SEQ ID NO: 1198292 - DNA, 22 bp, Artificial Sequence
  chemically synthesized
cttttgaaagattcatttctat

SEQ ID NO: 1198293 - DNA, 22 bp, Artificial Sequence
  chemically synthesized
tcccaaattcatagaaatgaat

SEQ ID NO: 1198294 - DNA, 22 bp, Artificial Sequence
  chemically synthesized
tccttttgaaagattcatttct

SEQ ID NO: 1198295 - DNA, 22 bp, Artificial Sequence
  chemically synthesized
acacctctccttttgaaagatt

SEQ ID NO: 1198296 - DNA, 22 bp, Artificial Sequence
  chemically synthesized
cacacctctccttttgaaagat

SEQ ID NO: 1198297 - DNA, 22 bp, Artificial Sequence
  chemically synthesized
atagaaatgaatctttcaaaag

SEQ ID NO: 1198298 - DNA, 22 bp, Artificial Sequence
  chemically synthesized
agagtgaatttcacacctctcc

SEQ ID NO: 1198299 - DNA, 22 bp, Artificial Sequence
  chemically synthesized
cagagtgaatttcacacctctc

SEQ ID NO: 1198300 - DNA, 22 bp, Artificial Sequence
  chemically synthesized
tcaaaaggagaggtgtgaaatt

SEQ ID NO: 1198301 - DNA, 22 bp, Artificial Sequence
  chemically synthesized
aatttcagagtgaatttcacac

SEQ ID NO: 1198302 - DNA, 22 bp, Artificial Sequence
  chemically synthesized
caaaaggagaggtgtgaaattc

SEQ ID NO: 1198303 - DNA, 22 bp, Artificial Sequence
  chemically synthesized
aaaaggagaggtgtgaaattca

SEQ ID NO: 1198304 - DNA, 22 bp, Artificial Sequence
  chemically synthesized
attgaatttcagagtgaatttc

SEQ ID NO: 1198305 - DNA, 22 bp, Artificial Sequence
  chemically synthesized
taattgaatttcagagtgaatt

SEQ ID NO: 1198306 - DNA, 22 bp, Artificial Sequence
  chemically synthesized
tattctaattgaatttcagagt

SEQ ID NO: 1198307 - DNA, 22 bp, Artificial Sequence
  chemically synthesized
attatattctaattgaatttca

SEQ ID NO: 1198308 - DNA, 22 bp, Artificial Sequence
  chemically synthesized
actctgaaattcaattagaata

SEQ ID NO: 1198309 - DNA, 22 bp, Artificial Sequence
  chemically synthesized
aacagtcactaattatattcta

SEQ ID NO: 1198310 - DNA, 22 bp, Artificial Sequence
  chemically synthesized
tgaaattcaattagaatataat

SEQ ID NO: 1198311 - DNA, 22 bp, Artificial Sequence
  chemically synthesized
tcaacagtcactaattatattc

SEQ ID NO: 1198312 - DNA, 22 bp, Artificial Sequence
  chemically synthesized
aaattcaattagaatataatta

SEQ ID NO: 1198313 - DNA, 22 bp, Artificial Sequence
  chemically synthesized
tattctcaacagtcactaatta

SEQ ID NO: 1198314 - DNA, 22 bp, Artificial Sequence
  chemically synthesized
aattagaatataattagtgact

SEQ ID NO: 1198315 - DNA, 22 bp, Artificial Sequence
  chemically synthesized
gaatataattagtgactgttga

SEQ ID NO: 1198316 - DNA, 22 bp, Artificial Sequence
  chemically synthesized
tcaaaactgtattctcaacagt

SEQ ID NO: 1198317 - DNA, 22 bp, Artificial Sequence
  chemically synthesized
tatcaaaactgtattctcaaca

SEQ ID NO: 1198318 - DNA, 22 bp, Artificial Sequence
  chemically synthesized
ttctatcaaaactgtattctca

SEQ ID NO: 1198319 - DNA, 22 bp, Artificial Sequence
  chemically synthesized
attctatcaaaactgtattctc

SEQ ID NO: 1198320 - DNA, 22 bp, Artificial Sequence
  chemically synthesized
gtgactgttgagaatacagttt

SEQ ID NO: 1198321 - DNA, 22 bp, Artificial Sequence
  chemically synthesized
atttattctatcaaaactgtat

SEQ ID NO: 1198322 - DNA, 22 bp, Artificial Sequence
  chemically synthesized
cctcatttattctatcaaaact

SEQ ID NO: 1198323 - DNA, 22 bp, Artificial Sequence
  chemically synthesized
ttgagaatacagttttgataga

SEQ ID NO: 1198324 - DNA, 22 bp, Artificial Sequence
  chemically synthesized
tgcctcatttattctatcaaaa

SEQ ID NO: 1198325 - DNA, 22 bp, Artificial Sequence
  chemically synthesized
ctgcctcatttattctatcaaa

SEQ ID NO: 1198326 - DNA, 22 bp, Artificial Sequence
  chemically synthesized
agaatacagttttgatagaata

SEQ ID NO: 1198327 - DNA, 22 bp, Artificial Sequence
  chemically synthesized
tcttctgcctcatttattctat

SEQ ID NO: 1198328 - DNA, 22 bp, Artificial Sequence
  chemically synthesized
aaagctgtcttctgcctcattt

SEQ ID NO: 1198329 - DNA, 22 bp, Artificial Sequence
  chemically synthesized
aaaagctgtcttctgcctcatt

SEQ ID NO: 1198330 - DNA, 22 bp, Artificial Sequence
  chemically synthesized
tgatagaataaatgaggcagaa

SEQ ID NO: 1198331 - DNA, 22 bp, Artificial Sequence
  chemically synthesized
gatagaataaatgaggcagaag

SEQ ID NO: 1198332 - DNA, 22 bp, Artificial Sequence
  chemically synthesized
atagaataaatgaggcagaaga

SEQ ID NO: 1198333 - DNA, 22 bp, Artificial Sequence
  chemically synthesized
atcccttaaaagctgtcttctg

SEQ ID NO: 1198334 - DNA, 22 bp, Artificial Sequence
  chemically synthesized
aatcccttaaaagctgtcttct

SEQ ID NO: 1198335 - DNA, 22 bp, Artificial Sequence
  chemically synthesized
cttaatcccttaaaagctgtct

SEQ ID NO: 1198336 - DNA, 22 bp, Artificial Sequence
  chemically synthesized
tccttaatcccttaaaagctgt

SEQ ID NO: 1198337 - DNA, 22 bp, Artificial Sequence
  chemically synthesized
ctccttaatcccttaaaagctg

SEQ ID NO: 1198338 - DNA, 22 bp, Artificial Sequence
  chemically synthesized
tctccttaatcccttaaaagct

SEQ ID NO: 1198339 - DNA, 22 bp, Artificial Sequence
  chemically synthesized
atatccattttctccttaatcc

SEQ ID NO: 1198340 - DNA, 22 bp, Artificial Sequence
  chemically synthesized
aatatccattttctccttaatc

SEQ ID NO: 1198341 - DNA, 22 bp, Artificial Sequence
  chemically synthesized
ttaatatccattttctccttaa

SEQ ID NO: 1198342 - DNA, 22 bp, Artificial Sequence
  chemically synthesized
cttaatatccattttctcctta

SEQ ID NO: 1198343 - DNA, 22 bp, Artificial Sequence
  chemically synthesized
tcttaatatccattttctcctt

SEQ ID NO: 1198344 - DNA, 22 bp, Artificial Sequence
  chemically synthesized
ttaagggattaaggagaaaatg

SEQ ID NO: 1198345 - DNA, 22 bp, Artificial Sequence
  chemically synthesized
taagggattaaggagaaaatgg

SEQ ID NO: 1198346 - DNA, 22 bp, Artificial Sequence
  chemically synthesized
aagggattaaggagaaaatgga

SEQ ID NO: 1198347 - DNA, 22 bp, Artificial Sequence
  chemically synthesized
agggattaaggagaaaatggat

SEQ ID NO: 1198348 - DNA, 22 bp, Artificial Sequence
  chemically synthesized
cattttcttaatatccattttc

SEQ ID NO: 1198349 - DNA, 22 bp, Artificial Sequence
  chemically synthesized
aagttacattttcttaatatcc

SEQ ID NO: 1198350 - DNA, 22 bp, Artificial Sequence
  chemically synthesized
aggagaaaatggatattaagaa

SEQ ID NO: 1198351 - DNA, 22 bp, Artificial Sequence
  chemically synthesized
tgcctgaagttacattttctta

SEQ ID NO: 1198352 - DNA, 22 bp, Artificial Sequence
  chemically synthesized
tatgcctgaagttacattttct

SEQ ID NO: 1198353 - DNA, 22 bp, Artificial Sequence
  chemically synthesized
tctatgcctgaagttacatttt

SEQ ID NO: 1198354 - DNA, 22 bp, Artificial Sequence
  chemically synthesized
ttctctatgcctgaagttacat

SEQ ID NO: 1198355 - DNA, 22 bp, Artificial Sequence
  chemically synthesized
aagttattctctatgcctgaag

SEQ ID NO: 1198356 - DNA, 22 bp, Artificial Sequence
  chemically synthesized
agaaaatgtaacttcaggcata

SEQ ID NO: 1198357 - DNA, 22 bp, Artificial Sequence
  chemically synthesized
caaaacatcctgaagttattct

SEQ ID NO: 1198358 - DNA, 22 bp, Artificial Sequence
  chemically synthesized
caggcatagagaataacttcag

SEQ ID NO: 1198359 - DNA, 22 bp, Artificial Sequence
  chemically synthesized
aggcatagagaataacttcagg

SEQ ID NO: 1198360 - DNA, 22 bp, Artificial Sequence
  chemically synthesized
taattgcaaaacatcctgaagt

SEQ ID NO: 1198361 - DNA, 22 bp, Artificial Sequence
  chemically synthesized
taaccattataattgcaaaaca

SEQ ID NO: 1198362 - DNA, 22 bp, Artificial Sequence
  chemically synthesized
caggatgttttgcaattataat

SEQ ID NO: 1198363 - DNA, 22 bp, Artificial Sequence
  chemically synthesized
aggatgttttgcaattataatg

SEQ ID NO: 1198364 - DNA, 22 bp, Artificial Sequence
  chemically synthesized
agccattataaccattataatt

SEQ ID NO: 1198365 - DNA, 22 bp, Artificial Sequence
  chemically synthesized
gagccattataaccattataat

SEQ ID NO: 1198366 - DNA, 22 bp, Artificial Sequence
  chemically synthesized
tgagccattataaccattataa

SEQ ID NO: 1198367 - DNA, 22 bp, Artificial Sequence
  chemically synthesized
tgcaattataatggttataatg

SEQ ID NO: 1198368 - DNA, 22 bp, Artificial Sequence
  chemically synthesized
gcaattataatggttataatgg

SEQ ID NO: 1198369 - DNA, 22 bp, Artificial Sequence
  chemically synthesized
gcaagttttgagccattataac

SEQ ID NO: 1198370 - DNA, 22 bp, Artificial Sequence
  chemically synthesized
caattataatggttataatggc

SEQ ID NO: 1198371 - DNA, 22 bp, Artificial Sequence
  chemically synthesized
ggcaagttttgagccattataa

SEQ ID NO: 1198372 - DNA, 22 bp, Artificial Sequence
  chemically synthesized
taatggttataatggctcaaaa

SEQ ID NO: 1198373 - DNA, 22 bp, Artificial Sequence
  chemically synthesized
gtgcaggacttggcaagttttg

SEQ ID NO: 1198374 - DNA, 22 bp, Artificial Sequence
  chemically synthesized
agtgcaggacttggcaagtttt

SEQ ID NO: 1198375 - DNA, 22 bp, Artificial Sequence
  chemically synthesized
taatggctcaaaacttgccaag

SEQ ID NO: 1198376 - DNA, 22 bp, Artificial Sequence
  chemically synthesized
aaacatttagtgcaggacttgg

SEQ ID NO: 1198377 - DNA, 22 bp, Artificial Sequence
  chemically synthesized
gaaacatttagtgcaggacttg

SEQ ID NO: 1198378 - DNA, 22 bp, Artificial Sequence
  chemically synthesized
aaaacttgccaagtcctgcact

SEQ ID NO: 1198379 - DNA, 22 bp, Artificial Sequence
  chemically synthesized
atttgaaacatttagtgcagga

SEQ ID NO: 1198380 - DNA, 22 bp, Artificial Sequence
  chemically synthesized
gttgatttgaaacatttagtgc

SEQ ID NO: 1198381 - DNA, 22 bp, Artificial Sequence
  chemically synthesized
gccaagtcctgcactaaatgtt

SEQ ID NO: 1198382 - DNA, 22 bp, Artificial Sequence
  chemically synthesized
ccaagtcctgcactaaatgttt

SEQ ID NO: 1198383 - DNA, 22 bp, Artificial Sequence
  chemically synthesized
aatgaattagttgatttgaaac

SEQ ID NO: 1198384 - DNA, 22 bp, Artificial Sequence
  chemically synthesized
cactaaatgtttcaaatcaact

SEQ ID NO: 1198385 - DNA, 22 bp, Artificial Sequence
  chemically synthesized
aatgtttcaaatcaactaattc

SEQ ID NO: 1198386 - DNA, 22 bp, Artificial Sequence
  chemically synthesized
caagaattaaatgaattagttg

SEQ ID NO: 1198387 - DNA, 22 bp, Artificial Sequence
  chemically synthesized
ttacaagaattaaatgaattag

SEQ ID NO: 1198388 - DNA, 22 bp, Artificial Sequence
  chemically synthesized
caaatcaactaattcatttaat

SEQ ID NO: 1198389 - DNA, 22 bp, Artificial Sequence
  chemically synthesized
aaatcaactaattcatttaatt

SEQ ID NO: 1198390 - DNA, 22 bp, Artificial Sequence
  chemically synthesized
ataccataggactgttacaaga

SEQ ID NO: 1198391 - DNA, 22 bp, Artificial Sequence
  chemically synthesized
attcatttaattcttgtaacag

SEQ ID NO: 1198392 - DNA, 22 bp, Artificial Sequence
  chemically synthesized
atttaattcttgtaacagtcct

SEQ ID NO: 1198393 - DNA, 22 bp, Artificial Sequence
  chemically synthesized
tattcataccataggactgtta

SEQ ID NO: 1198394 - DNA, 22 bp, Artificial Sequence
  chemically synthesized
aattcttgtaacagtcctatgg

SEQ ID NO: 1198395 - DNA, 22 bp, Artificial Sequence
  chemically synthesized
attcttgtaacagtcctatggt

SEQ ID NO: 1198396 - DNA, 22 bp, Artificial Sequence
  chemically synthesized
ttgtaacagtcctatggtatga

SEQ ID NO: 1198397 - DNA, 22 bp, Artificial Sequence
  chemically synthesized
gtaacagtcctatggtatgaat

SEQ ID NO: 1198398 - DNA, 22 bp, Artificial Sequence
  chemically synthesized
taacagtcctatggtatgaata

SEQ ID NO: 1198399 - DNA, 22 bp, Artificial Sequence
  chemically synthesized
gaaaatgaaagtgagaattgta

SEQ ID NO: 1198400 - DNA, 22 bp, Artificial Sequence
  chemically synthesized
tggtatgaatacaattctcact

SEQ ID NO: 1198401 - DNA, 22 bp, Artificial Sequence
  chemically synthesized
atctagaaaatgaaagtgagaa

SEQ ID NO: 1198402 - DNA, 22 bp, Artificial Sequence
  chemically synthesized
ctcatctagaaaatgaaagtga

SEQ ID NO: 1198403 - DNA, 22 bp, Artificial Sequence
  chemically synthesized
cctcatctagaaaatgaaagtg

SEQ ID NO: 1198404 - DNA, 22 bp, Artificial Sequence
  chemically synthesized
tcctcatctagaaaatgaaagt

SEQ ID NO: 1198405 - DNA, 22 bp, Artificial Sequence
  chemically synthesized
ttcctcatctagaaaatgaaag

SEQ ID NO: 1198406 - DNA, 22 bp, Artificial Sequence
  chemically synthesized
agccttttcctcatctagaaaa

SEQ ID NO: 1198407 - DNA, 22 bp, Artificial Sequence
  chemically synthesized
tcactttcattttctagatgag

SEQ ID NO: 1198408 - DNA, 22 bp, Artificial Sequence
  chemically synthesized
actttcattttctagatgagga

SEQ ID NO: 1198409 - DNA, 22 bp, Artificial Sequence
  chemically synthesized
tcattttctagatgaggaaaag

SEQ ID NO: 1198410 - DNA, 22 bp, Artificial Sequence
  chemically synthesized
agatccctgagccttttcctca

SEQ ID NO: 1198411 - DNA, 22 bp, Artificial Sequence
  chemically synthesized
cattttctagatgaggaaaagg

SEQ ID NO: 1198412 - DNA, 22 bp, Artificial Sequence
  chemically synthesized
aagatccctgagccttttcctc

SEQ ID NO: 1198413 - DNA, 22 bp, Artificial Sequence
  chemically synthesized
attttctagatgaggaaaaggc

SEQ ID NO: 1198414 - DNA, 22 bp, Artificial Sequence
  chemically synthesized
ttaagatccctgagccttttcc

SEQ ID NO: 1198415 - DNA, 22 bp, Artificial Sequence
  chemically synthesized
cttaagatccctgagccttttc

SEQ ID NO: 1198416 - DNA, 22 bp, Artificial Sequence
  chemically synthesized
tctagatgaggaaaaggctcag

SEQ ID NO: 1198417 - DNA, 22 bp, Artificial Sequence
  chemically synthesized
ctagatgaggaaaaggctcagg

SEQ ID NO: 1198418 - DNA, 22 bp, Artificial Sequence
  chemically synthesized
tagatgaggaaaaggctcaggg

SEQ ID NO: 1198419 - DNA, 22 bp, Artificial Sequence
  chemically synthesized
gatgaggaaaaggctcagggat

SEQ ID NO: 1198420 - DNA, 22 bp, Artificial Sequence
  chemically synthesized
tgcaaatttcttaagatccctg

SEQ ID NO: 1198421 - DNA, 22 bp, Artificial Sequence
  chemically synthesized
gtgcaaatttcttaagatccct

SEQ ID NO: 1198422 - DNA, 22 bp, Artificial Sequence
  chemically synthesized
tgtaaacttgtgcaaatttctt

SEQ ID NO: 1198423 - DNA, 22 bp, Artificial Sequence
  chemically synthesized
agggatcttaagaaatttgcac

SEQ ID NO: 1198424 - DNA, 22 bp, Artificial Sequence
  chemically synthesized
gctgtgtaaacttgtgcaaatt

SEQ ID NO: 1198425 - DNA, 22 bp, Artificial Sequence
  chemically synthesized
agctgtgtaaacttgtgcaaat

SEQ ID NO: 1198426 - DNA, 22 bp, Artificial Sequence
  chemically synthesized
tagctgtgtaaacttgtgcaaa

SEQ ID NO: 1198427 - DNA, 22 bp, Artificial Sequence
  chemically synthesized
ttagctgtgtaaacttgtgcaa

SEQ ID NO: 1198428 - DNA, 22 bp, Artificial Sequence
  chemically synthesized
tttagctgtgtaaacttgtgca

SEQ ID NO: 1198429 - DNA, 22 bp, Artificial Sequence
  chemically synthesized
aagaaatttgcacaagtttaca

SEQ ID NO: 1198430 - DNA, 22 bp, Artificial Sequence
  chemically synthesized
agaaatttgcacaagtttacac

SEQ ID NO: 1198431 - DNA, 22 bp, Artificial Sequence
  chemically synthesized
ccactttttagctgtgtaaact

SEQ ID NO: 1198432 - DNA, 22 bp, Artificial Sequence
  chemically synthesized
gccactttttagctgtgtaaac

SEQ ID NO: 1198433 - DNA, 22 bp, Artificial Sequence
  chemically synthesized
accttgccactttttagctgtg

SEQ ID NO: 1198434 - DNA, 22 bp, Artificial Sequence
  chemically synthesized
gcacaagtttacacagctaaaa

SEQ ID NO: 1198435 - DNA, 22 bp, Artificial Sequence
  chemically synthesized
cacaagtttacacagctaaaaa

SEQ ID NO: 1198436 - DNA, 22 bp, Artificial Sequence
  chemically synthesized
acacagctaaaaagtggcaagg

SEQ ID NO: 1198437 - DNA, 22 bp, Artificial Sequence
  chemically synthesized
ggtcaaaactaaccttgccact

SEQ ID NO: 1198438 - DNA, 22 bp, Artificial Sequence
  chemically synthesized
cacagctaaaaagtggcaaggt

SEQ ID NO: 1198439 - DNA, 22 bp, Artificial Sequence
  chemically synthesized
cctgggtcaaaactaaccttgc

SEQ ID NO: 1198440 - DNA, 22 bp, Artificial Sequence
  chemically synthesized
aaaagtggcaaggttagttttg

SEQ ID NO: 1198441 - DNA, 22 bp, Artificial Sequence
  chemically synthesized
gactgcctgggtcaaaactaac

SEQ ID NO: 1198442 - DNA, 22 bp, Artificial Sequence
  chemically synthesized
gagctggactgcctgggtcaaa

SEQ ID NO: 1198443 - DNA, 22 bp, Artificial Sequence
  chemically synthesized
tggagctggactgcctgggtca

SEQ ID NO: 1198444 - DNA, 22 bp, Artificial Sequence
  chemically synthesized
gttttgacccaggcagtccagc

SEQ ID NO: 1198445 - DNA, 22 bp, Artificial Sequence
  chemically synthesized
tgacccaggcagtccagctcca

SEQ ID NO: 1198446 - DNA, 22 bp, Artificial Sequence
  chemically synthesized
gacccaggcagtccagctccag

SEQ ID NO: 1198447 - DNA, 22 bp, Artificial Sequence
  chemically synthesized
acccaggcagtccagctccaga

SEQ ID NO: 1198448 - DNA, 22 bp, Artificial Sequence
  chemically synthesized
cagaacctatgctgtcctccct

SEQ ID NO: 1198449 - DNA, 22 bp, Artificial Sequence
  chemically synthesized
agaagccatgtgaacagtaggg

SEQ ID NO: 1198450 - DNA, 22 bp, Artificial Sequence
  chemically synthesized
tgctgtcctccctactgttcac

SEQ ID NO: 1198451 - DNA, 22 bp, Artificial Sequence
  chemically synthesized
tctcagaagccatgtgaacagt

SEQ ID NO: 1198452 - DNA, 22 bp, Artificial Sequence
  chemically synthesized
gtctcagaagccatgtgaacag

SEQ ID NO: 1198453 - DNA, 22 bp, Artificial Sequence
  chemically synthesized
ttgtctcagaagccatgtgaac

SEQ ID NO: 1198454 - DNA, 22 bp, Artificial Sequence
  chemically synthesized
tcctccctactgttcacatggc

SEQ ID NO: 1198455 - DNA, 22 bp, Artificial Sequence
  chemically synthesized
ctcttgtctcagaagccatgtg

SEQ ID NO: 1198456 - DNA, 22 bp, Artificial Sequence
  chemically synthesized
cctactgttcacatggcttctg

SEQ ID NO: 1198457 - DNA, 22 bp, Artificial Sequence
  chemically synthesized
ctgttcacatggcttctgagac

SEQ ID NO: 1198458 - DNA, 22 bp, Artificial Sequence
  chemically synthesized
aatcactactcttgtctcagaa

SEQ ID NO: 1198459 - DNA, 22 bp, Artificial Sequence
  chemically synthesized
aaatcactactcttgtctcaga

SEQ ID NO: 1198460 - DNA, 22 bp, Artificial Sequence
  chemically synthesized
ttcacatggcttctgagacaag

SEQ ID NO: 1198461 - DNA, 22 bp, Artificial Sequence
  chemically synthesized
acatggcttctgagacaagagt

SEQ ID NO: 1198462 - DNA, 22 bp, Artificial Sequence
  chemically synthesized
aatttaaatcactactcttgtc

SEQ ID NO: 1198463 - DNA, 22 bp, Artificial Sequence
  chemically synthesized
taaatttaaatcactactcttg

SEQ ID NO: 1198464 - DNA, 22 bp, Artificial Sequence
  chemically synthesized
ctgagacaagagtagtgattta

SEQ ID NO: 1198465 - DNA, 22 bp, Artificial Sequence
  chemically synthesized
tgagacaagagtagtgatttaa

SEQ ID NO: 1198466 - DNA, 22 bp, Artificial Sequence
  chemically synthesized
agacaagagtagtgatttaaat

SEQ ID NO: 1198467 - DNA, 22 bp, Artificial Sequence
  chemically synthesized
gccacatgttctaaatttaaat

SEQ ID NO: 1198468 - DNA, 22 bp, Artificial Sequence
  chemically synthesized
ggccacatgttctaaatttaaa

SEQ ID NO: 1198469 - DNA, 22 bp, Artificial Sequence
  chemically synthesized
gggtaaaagacttggccacatg

SEQ ID NO: 1198470 - DNA, 22 bp, Artificial Sequence
  chemically synthesized
aaatttagaacatgtggccaag

SEQ ID NO: 1198471 - DNA, 22 bp, Artificial Sequence
  chemically synthesized
aatttagaacatgtggccaagt

SEQ ID NO: 1198472 - DNA, 22 bp, Artificial Sequence
  chemically synthesized
agaacatgtggccaagtctttt

SEQ ID NO: 1198473 - DNA, 22 bp, Artificial Sequence
  chemically synthesized
ccacattagggtaaaagacttg

SEQ ID NO: 1198474 - DNA, 22 bp, Artificial Sequence
  chemically synthesized
gaacatgtggccaagtctttta

SEQ ID NO: 1198475 - DNA, 22 bp, Artificial Sequence
  chemically synthesized
gccacattagggtaaaagactt

SEQ ID NO: 1198476 - DNA, 22 bp, Artificial Sequence
  chemically synthesized
tgccacattagggtaaaagact

SEQ ID NO: 1198477 - DNA, 22 bp, Artificial Sequence
  chemically synthesized
attttgccacattagggtaaaa

SEQ ID NO: 1198478 - DNA, 22 bp, Artificial Sequence
  chemically synthesized
ctgattttgccacattagggta

SEQ ID NO: 1198479 - DNA, 22 bp, Artificial Sequence
  chemically synthesized
ttcctgattttgccacattagg

SEQ ID NO: 1198480 - DNA, 22 bp, Artificial Sequence
  chemically synthesized
attcctgattttgccacattag

SEQ ID NO: 1198481 - DNA, 22 bp, Artificial Sequence
  chemically synthesized
tattcctgattttgccacatta

SEQ ID NO: 1198482 - DNA, 22 bp, Artificial Sequence
  chemically synthesized
ttattcctgattttgccacatt

SEQ ID NO: 1198483 - DNA, 22 bp, Artificial Sequence
  chemically synthesized
tttattcctgattttgccacat

SEQ ID NO: 1198484 - DNA, 22 bp, Artificial Sequence
  chemically synthesized
ttaccctaatgtggcaaaatca

SEQ ID NO: 1198485 - DNA, 22 bp, Artificial Sequence
  chemically synthesized
attttttattcctgattttgcc

SEQ ID NO: 1198486 - DNA, 22 bp, Artificial Sequence
  chemically synthesized
taccctaatgtggcaaaatcag

SEQ ID NO: 1198487 - DNA, 22 bp, Artificial Sequence
  chemically synthesized
aattttttattcctgattttgc

SEQ ID NO: 1198488 - DNA, 22 bp, Artificial Sequence
  chemically synthesized
accctaatgtggcaaaatcagg

SEQ ID NO: 1198489 - DNA, 22 bp, Artificial Sequence
  chemically synthesized
ccctaatgtggcaaaatcagga

SEQ ID NO: 1198490 - DNA, 22 bp, Artificial Sequence
  chemically synthesized
atgtggcaaaatcaggaataaa

SEQ ID NO: 1198491 - DNA, 22 bp, Artificial Sequence
  chemically synthesized
aaacacttaattttttattcct

SEQ ID NO: 1198492 - DNA, 22 bp, Artificial Sequence
  chemically synthesized
cccaaaatgaatactaaaacac

SEQ ID NO: 1198493 - DNA, 22 bp, Artificial Sequence
  chemically synthesized
acccaaaatgaatactaaaaca

SEQ ID NO: 1198494 - DNA, 22 bp, Artificial Sequence
  chemically synthesized
agtgttttagtattcattttgg

SEQ ID NO: 1198495 - DNA, 22 bp, Artificial Sequence
  chemically synthesized
atagaaatttacccaaaatgaa

SEQ ID NO: 1198496 - DNA, 22 bp, Artificial Sequence
  chemically synthesized
tagtattcattttgggtaaatt

SEQ ID NO: 1198497 - DNA, 22 bp, Artificial Sequence
  chemically synthesized
agtattcattttgggtaaattt

SEQ ID NO: 1198498 - DNA, 22 bp, Artificial Sequence
  chemically synthesized
gtattcattttgggtaaatttc

SEQ ID NO: 1198499 - DNA, 22 bp, Artificial Sequence
  chemically synthesized
aagcgcactcatagaaatttac

SEQ ID NO: 1198500 - DNA, 22 bp, Artificial Sequence
  chemically synthesized
caagcgcactcatagaaattta

SEQ ID NO: 1198501 - DNA, 22 bp, Artificial Sequence
  chemically synthesized
tcaagcgcactcatagaaattt

SEQ ID NO: 1198502 - DNA, 22 bp, Artificial Sequence
  chemically synthesized
attttgggtaaatttctatgag

SEQ ID NO: 1198503 - DNA, 22 bp, Artificial Sequence
  chemically synthesized
ttttcaagcgcactcatagaaa

SEQ ID NO: 1198504 - DNA, 22 bp, Artificial Sequence
  chemically synthesized
tgggtaaatttctatgagtgcg

SEQ ID NO: 1198505 - DNA, 22 bp, Artificial Sequence
  chemically synthesized
gggtaaatttctatgagtgcgc

SEQ ID NO: 1198506 - DNA, 22 bp, Artificial Sequence
  chemically synthesized
ggtaaatttctatgagtgcgct

SEQ ID NO: 1198507 - DNA, 22 bp, Artificial Sequence
  chemically synthesized
atgaactgttttcaagcgcact

SEQ ID NO: 1198508 - DNA, 22 bp, Artificial Sequence
  chemically synthesized
catgaactgttttcaagcgcac

SEQ ID NO: 1198509 - DNA, 22 bp, Artificial Sequence
  chemically synthesized
agtttcatgaactgttttcaag

SEQ ID NO: 1198510 - DNA, 22 bp, Artificial Sequence
  chemically synthesized
ctatgagtgcgcttgaaaacag

SEQ ID NO: 1198511 - DNA, 22 bp, Artificial Sequence
  chemically synthesized
tatgagtgcgcttgaaaacagt

SEQ ID NO: 1198512 - DNA, 22 bp, Artificial Sequence
  chemically synthesized
tcagtttcatgaactgttttca

SEQ ID NO: 1198513 - DNA, 22 bp, Artificial Sequence
  chemically synthesized
ctcagtttcatgaactgttttc

SEQ ID NO: 1198514 - DNA, 22 bp, Artificial Sequence
  chemically synthesized
tgagtgcgcttgaaaacagttc

SEQ ID NO: 1198515 - DNA, 22 bp, Artificial Sequence
  chemically synthesized
tctcagtttcatgaactgtttt

SEQ ID NO: 1198516 - DNA, 22 bp, Artificial Sequence
  chemically synthesized
ttctcagtttcatgaactgttt

SEQ ID NO: 1198517 - DNA, 22 bp, Artificial Sequence
  chemically synthesized
tgtttttctcagtttcatgaac

SEQ ID NO: 1198518 - DNA, 22 bp, Artificial Sequence
  chemically synthesized
gtgtttttctcagtttcatgaa

SEQ ID NO: 1198519 - DNA, 22 bp, Artificial Sequence
  chemically synthesized
gaaaacagttcatgaaactgag

SEQ ID NO: 1198520 - DNA, 22 bp, Artificial Sequence
  chemically synthesized
aaaacagttcatgaaactgaga

SEQ ID NO: 1198521 - DNA, 22 bp, Artificial Sequence
  chemically synthesized
cacttgtgtttttctcagtttc

SEQ ID NO: 1198522 - DNA, 22 bp, Artificial Sequence
  chemically synthesized
acacttgtgtttttctcagttt

SEQ ID NO: 1198523 - DNA, 22 bp, Artificial Sequence
  chemically synthesized
atgaaactgagaaaaacacaag

SEQ ID NO: 1198524 - DNA, 22 bp, Artificial Sequence
  chemically synthesized
tggtaatcttacacttgtgttt

SEQ ID NO: 1198525 - DNA, 22 bp, Artificial Sequence
  chemically synthesized
tattatggtaatcttacacttg

SEQ ID NO: 1198526 - DNA, 22 bp, Artificial Sequence
  chemically synthesized
gtattatggtaatcttacactt

SEQ ID NO: 1198527 - DNA, 22 bp, Artificial Sequence
  chemically synthesized
tgtattatggtaatcttacact

SEQ ID NO: 1198528 - DNA, 22 bp, Artificial Sequence
  chemically synthesized
agaaaaacacaagtgtaagatt

SEQ ID NO: 1198529 - DNA, 22 bp, Artificial Sequence
  chemically synthesized
caaagtgatcacatgctttgta

SEQ ID NO: 1198530 - DNA, 22 bp, Artificial Sequence
  chemically synthesized
ccaaagtgatcacatgctttgt

SEQ ID NO: 1198531 - DNA, 22 bp, Artificial Sequence
  chemically synthesized
tccaaagtgatcacatgctttg

SEQ ID NO: 1198532 - DNA, 22 bp, Artificial Sequence
  chemically synthesized
ccataatacaaagcatgtgatc

SEQ ID NO: 1198533 - DNA, 22 bp, Artificial Sequence
  chemically synthesized
catagtagtatacacctttcca

SEQ ID NO: 1198534 - DNA, 22 bp, Artificial Sequence
  chemically synthesized
ccatagtagtatacacctttcc

SEQ ID NO: 1198535 - DNA, 22 bp, Artificial Sequence
  chemically synthesized
tccatagtagtatacacctttc

SEQ ID NO: 1198536 - DNA, 22 bp, Artificial Sequence
  chemically synthesized
ttccatagtagtatacaccttt

SEQ ID NO: 1198537 - DNA, 22 bp, Artificial Sequence
  chemically synthesized
taccttttccatagtagtatac

SEQ ID NO: 1198538 - DNA, 22 bp, Artificial Sequence
  chemically synthesized
tggaaaggtgtatactactatg

SEQ ID NO: 1198539 - DNA, 22 bp, Artificial Sequence
  chemically synthesized
ggaaaggtgtatactactatgg

SEQ ID NO: 1198540 - DNA, 22 bp, Artificial Sequence
  chemically synthesized
cctataccttttccatagtagt

SEQ ID NO: 1198541 - DNA, 22 bp, Artificial Sequence
  chemically synthesized
gaaaggtgtatactactatgga

SEQ ID NO: 1198542 - DNA, 22 bp, Artificial Sequence
  chemically synthesized
gaagtattgcctataccttttc

SEQ ID NO: 1198543 - DNA, 22 bp, Artificial Sequence
  chemically synthesized
actagaagtattgcctatacct

SEQ ID NO: 1198544 - DNA, 22 bp, Artificial Sequence
  chemically synthesized
taactagaagtattgcctatac

SEQ ID NO: 1198545 - DNA, 22 bp, Artificial Sequence
  chemically synthesized
ctatggaaaaggtataggcaat

SEQ ID NO: 1198546 - DNA, 22 bp, Artificial Sequence
  chemically synthesized
tggaaaaggtataggcaatact

SEQ ID NO: 1198547 - DNA, 22 bp, Artificial Sequence
  chemically synthesized
caaatcattctaactagaagta

SEQ ID NO: 1198548 - DNA, 22 bp, Artificial Sequence
  chemically synthesized
ccaaatcattctaactagaagt

SEQ ID NO: 1198549 - DNA, 22 bp, Artificial Sequence
  chemically synthesized
tccaaatcattctaactagaag

SEQ ID NO: 1198550 - DNA, 22 bp, Artificial Sequence
  chemically synthesized
ttccaaatcattctaactagaa

SEQ ID NO: 1198551 - DNA, 22 bp, Artificial Sequence
  chemically synthesized
caaaccttttccaaatcattct

SEQ ID NO: 1198552 - DNA, 22 bp, Artificial Sequence
  chemically synthesized
ctacaaaccttttccaaatcat

SEQ ID NO: 1198553 - DNA, 22 bp, Artificial Sequence
  chemically synthesized
cctacaaaccttttccaaatca

SEQ ID NO: 1198554 - DNA, 22 bp, Artificial Sequence
  chemically synthesized
tcctacaaaccttttccaaatc

SEQ ID NO: 1198555 - DNA, 22 bp, Artificial Sequence
  chemically synthesized
ctagttagaatgatttggaaaa

SEQ ID NO: 1198556 - DNA, 22 bp, Artificial Sequence
  chemically synthesized
tagttagaatgatttggaaaag

SEQ ID NO: 1198557 - DNA, 22 bp, Artificial Sequence
  chemically synthesized
gttagaatgatttggaaaaggt

SEQ ID NO: 1198558 - DNA, 22 bp, Artificial Sequence
  chemically synthesized
gaatgatttggaaaaggtttgt

SEQ ID NO: 1198559 - DNA, 22 bp, Artificial Sequence
  chemically synthesized
aaatatctttcctacaaacctt

SEQ ID NO: 1198560 - DNA, 22 bp, Artificial Sequence
  chemically synthesized
attaaaatatctttcctacaaa

SEQ ID NO: 1198561 - DNA, 22 bp, Artificial Sequence
  chemically synthesized
aattaaaatatctttcctacaa

SEQ ID NO: 1198562 - DNA, 22 bp, Artificial Sequence
  chemically synthesized
ggaaaaggtttgtaggaaagat

SEQ ID NO: 1198563 - DNA, 22 bp, Artificial Sequence
  chemically synthesized
gaaaaggtttgtaggaaagata

SEQ ID NO: 1198564 - DNA, 22 bp, Artificial Sequence
  chemically synthesized
gtggaatttaattaaaatatct

SEQ ID NO: 1198565 - DNA, 22 bp, Artificial Sequence
  chemically synthesized
tggtggaatttaattaaaatat

SEQ ID NO: 1198566 - DNA, 22 bp, Artificial Sequence
  chemically synthesized
gtaggaaagatattttaattaa

SEQ ID NO: 1198567 - DNA, 22 bp, Artificial Sequence
  chemically synthesized
ctctggtggaatttaattaaaa

SEQ ID NO: 1198568 - DNA, 22 bp, Artificial Sequence
  chemically synthesized
taggaaagatattttaattaaa

SEQ ID NO: 1198569 - DNA, 22 bp, Artificial Sequence
  chemically synthesized
cctctggtggaatttaattaaa

SEQ ID NO: 1198570 - DNA, 22 bp, Artificial Sequence
  chemically synthesized
tcctctggtggaatttaattaa

SEQ ID NO: 1198571 - DNA, 22 bp, Artificial Sequence
  chemically synthesized
ttcctctggtggaatttaatta

SEQ ID NO: 1198572 - DNA, 22 bp, Artificial Sequence
  chemically synthesized
ttttcctctggtggaatttaat

SEQ ID NO: 1198573 - DNA, 22 bp, Artificial Sequence
  chemically synthesized
cttttcctctggtggaatttaa

SEQ ID NO: 1198574 - DNA, 22 bp, Artificial Sequence
  chemically synthesized
tttcttttcctctggtggaatt

SEQ ID NO: 1198575 - DNA, 22 bp, Artificial Sequence
  chemically synthesized
tattatttcttttcctctggtg

SEQ ID NO: 1198576 - DNA, 22 bp, Artificial Sequence
  chemically synthesized
taattaaattccaccagaggaa

SEQ ID NO: 1198577 - DNA, 22 bp, Artificial Sequence
  chemically synthesized
aattaaattccaccagaggaaa

SEQ ID NO: 1198578 - DNA, 22 bp, Artificial Sequence
  chemically synthesized
attaaattccaccagaggaaaa

SEQ ID NO: 1198579 - DNA, 22 bp, Artificial Sequence
  chemically synthesized
ctgtattatttcttttcctctg

SEQ ID NO: 1198580 - DNA, 22 bp, Artificial Sequence
  chemically synthesized
aattccaccagaggaaaagaaa

SEQ ID NO: 1198581 - DNA, 22 bp, Artificial Sequence
  chemically synthesized
caccagaggaaaagaaataata

SEQ ID NO: 1198582 - DNA, 22 bp, Artificial Sequence
  chemically synthesized
ccaaaattgctgtattatttct

SEQ ID NO: 1198583 - DNA, 22 bp, Artificial Sequence
  chemically synthesized
cccaaaattgctgtattatttc

SEQ ID NO: 1198584 - DNA, 22 bp, Artificial Sequence
  chemically synthesized
ataatttcccaaaattgctgta

SEQ ID NO: 1198585 - DNA, 22 bp, Artificial Sequence
  chemically synthesized
ttaataatttcccaaaattgct

SEQ ID NO: 1198586 - DNA, 22 bp, Artificial Sequence
  chemically synthesized
gtctgttaataatttcccaaaa

SEQ ID NO: 1198587 - DNA, 22 bp, Artificial Sequence
  chemically synthesized
caaccactggtctgttaataat

SEQ ID NO: 1198588 - DNA, 22 bp, Artificial Sequence
  chemically synthesized
tgggaaattattaacagaccag

SEQ ID NO: 1198589 - DNA, 22 bp, Artificial Sequence
  chemically synthesized
aatctccaaccactggtctgtt

SEQ ID NO: 1198590 - DNA, 22 bp, Artificial Sequence
  chemically synthesized
gggaaattattaacagaccagt

SEQ ID NO: 1198591 - DNA, 22 bp, Artificial Sequence
  chemically synthesized
ggaaattattaacagaccagtg

SEQ ID NO: 1198592 - DNA, 22 bp, Artificial Sequence
  chemically synthesized
tctcaatctccaaccactggtc

SEQ ID NO: 1198593 - DNA, 22 bp, Artificial Sequence
  chemically synthesized
atctcaatctccaaccactggt

SEQ ID NO: 1198594 - DNA, 22 bp, Artificial Sequence
  chemically synthesized
ttaacagaccagtggttggaga

SEQ ID NO: 1198595 - DNA, 22 bp, Artificial Sequence
  chemically synthesized
caaatttatctcaatctccaac

SEQ ID NO: 1198596 - DNA, 22 bp, Artificial Sequence
  chemically synthesized
acagaccagtggttggagattg

SEQ ID NO: 1198597 - DNA, 22 bp, Artificial Sequence
  chemically synthesized
ccaaatttatctcaatctccaa

SEQ ID NO: 1198598 - DNA, 22 bp, Artificial Sequence
  chemically synthesized
aagtttccaaatttatctcaat

SEQ ID NO: 1198599 - DNA, 22 bp, Artificial Sequence
  chemically synthesized
tcaagtttccaaatttatctca

SEQ ID NO: 1198600 - DNA, 22 bp, Artificial Sequence
  chemically synthesized
ctcaagtttccaaatttatctc

SEQ ID NO: 1198601 - DNA, 22 bp, Artificial Sequence
  chemically synthesized
gagattgagataaatttggaaa

SEQ ID NO: 1198602 - DNA, 22 bp, Artificial Sequence
  chemically synthesized
aaccacatacttctcaagtttc

SEQ ID NO: 1198603 - DNA, 22 bp, Artificial Sequence
  chemically synthesized
agataaatttggaaacttgaga

SEQ ID NO: 1198604 - DNA, 22 bp, Artificial Sequence
  chemically synthesized
caaccacatacttctcaagttt

SEQ ID NO: 1198605 - DNA, 22 bp, Artificial Sequence
  chemically synthesized
ggaaacttgagaagtatgtggt

SEQ ID NO: 1198606 - DNA, 22 bp, Artificial Sequence
  chemically synthesized
gaaacttgagaagtatgtggtt

SEQ ID NO: 1198607 - DNA, 22 bp, Artificial Sequence
  chemically synthesized
tccatggtcacatttcaaccac

SEQ ID NO: 1198608 - DNA, 22 bp, Artificial Sequence
  chemically synthesized
gagaagtatgtggttgaaatgt

SEQ ID NO: 1198609 - DNA, 22 bp, Artificial Sequence
  chemically synthesized
agaagtatgtggttgaaatgtg

SEQ ID NO: 1198610 - DNA, 22 bp, Artificial Sequence
  chemically synthesized
gactgtccatggtcacatttca

SEQ ID NO: 1198611 - DNA, 22 bp, Artificial Sequence
  chemically synthesized
cgactgtccatggtcacatttc

SEQ ID NO: 1198612 - DNA, 22 bp, Artificial Sequence
  chemically synthesized
tcgactgtccatggtcacattt

SEQ ID NO: 1198613 - DNA, 22 bp, Artificial Sequence
  chemically synthesized
aaatgtgaccatggacagtcga

SEQ ID NO: 1198614 - DNA, 22 bp, Artificial Sequence
  chemically synthesized
aacagtggtactttcgactgtc

SEQ ID NO: 1198615 - DNA, 22 bp, Artificial Sequence
  chemically synthesized
caacagtggtactttcgactgt

SEQ ID NO: 1198616 - DNA, 22 bp, Artificial Sequence
  chemically synthesized
cacaatggaaaacacttcaaca

SEQ ID NO: 1198617 - DNA, 22 bp, Artificial Sequence
  chemically synthesized
agattccacaatggaaaacact

SEQ ID NO: 1198618 - DNA, 22 bp, Artificial Sequence
  chemically synthesized
aagattccacaatggaaaacac

SEQ ID NO: 1198619 - DNA, 22 bp, Artificial Sequence
  chemically synthesized
ttaagattccacaatggaaaac

SEQ ID NO: 1198620 - DNA, 22 bp, Artificial Sequence
  chemically synthesized
tcttaagattccacaatggaaa

SEQ ID NO: 1198621 - DNA, 22 bp, Artificial Sequence
  chemically synthesized
ctcttaagattccacaatggaa

SEQ ID NO: 1198622 - DNA, 22 bp, Artificial Sequence
  chemically synthesized
ttgaagtgttttccattgtgga

SEQ ID NO: 1198623 - DNA, 22 bp, Artificial Sequence
  chemically synthesized
ttctcttaagattccacaatgg

SEQ ID NO: 1198624 - DNA, 22 bp, Artificial Sequence
  chemically synthesized
aagtgttttccattgtggaatc

SEQ ID NO: 1198625 - DNA, 22 bp, Artificial Sequence
  chemically synthesized
tccattgtggaatcttaagaga

SEQ ID NO: 1198626 - DNA, 22 bp, Artificial Sequence
  chemically synthesized
ccattgtggaatcttaagagaa

SEQ ID NO: 1198627 - DNA, 22 bp, Artificial Sequence
  chemically synthesized
cattgtggaatcttaagagaag

SEQ ID NO: 1198628 - DNA, 22 bp, Artificial Sequence
  chemically synthesized
aagtataaaagctcttctctta

SEQ ID NO: 1198629 - DNA, 22 bp, Artificial Sequence
  chemically synthesized
tggaatcttaagagaagagctt

SEQ ID NO: 1198630 - DNA, 22 bp, Artificial Sequence
  chemically synthesized
ccctaaagtataaaagctcttc

SEQ ID NO: 1198631 - DNA, 22 bp, Artificial Sequence
  chemically synthesized
ctgccctaaagtataaaagctc

SEQ ID NO: 1198632 - DNA, 22 bp, Artificial Sequence
  chemically synthesized
aagagaagagcttttatacttt

SEQ ID NO: 1198633 - DNA, 22 bp, Artificial Sequence
  chemically synthesized
agagaagagcttttatacttta

SEQ ID NO: 1198634 - DNA, 22 bp, Artificial Sequence
  chemically synthesized
tgagaactgctgccctaaagta

SEQ ID NO: 1198635 - DNA, 22 bp, Artificial Sequence
  chemically synthesized
ttatactttagggcagcagttc

SEQ ID NO: 1198636 - DNA, 22 bp, Artificial Sequence
  chemically synthesized
tatactttagggcagcagttct

SEQ ID NO: 1198637 - DNA, 22 bp, Artificial Sequence
  chemically synthesized
atactttagggcagcagttctc

SEQ ID NO: 1198638 - DNA, 22 bp, Artificial Sequence
  chemically synthesized
tactttagggcagcagttctca

SEQ ID NO: 1198639 - DNA, 22 bp, Artificial Sequence
  chemically synthesized
agaaccacactatgagaactgc

SEQ ID NO: 1198640 - DNA, 22 bp, Artificial Sequence
  chemically synthesized
tagggcagcagttctcatagtg

SEQ ID NO: 1198641 - DNA, 22 bp, Artificial Sequence
  chemically synthesized
agggcagcagttctcatagtgt

SEQ ID NO: 1198642 - DNA, 22 bp, Artificial Sequence
  chemically synthesized
gggcagcagttctcatagtgtg

SEQ ID NO: 1198643 - DNA, 22 bp, Artificial Sequence
  chemically synthesized
atgtctgagaaccacactatga

SEQ ID NO: 1198644 - DNA, 22 bp, Artificial Sequence
  chemically synthesized
tgatgtctgagaaccacactat

SEQ ID NO: 1198645 - DNA, 22 bp, Artificial Sequence
  chemically synthesized
attctgatgtctgagaaccaca

SEQ ID NO: 1198646 - DNA, 22 bp, Artificial Sequence
  chemically synthesized
ttgattctgatgtctgagaacc

SEQ ID NO: 1198647 - DNA, 22 bp, Artificial Sequence
  chemically synthesized
tcatagtgtggttctcagacat

SEQ ID NO: 1198648 - DNA, 22 bp, Artificial Sequence
  chemically synthesized
ctgttgattctgatgtctgaga

SEQ ID NO: 1198649 - DNA, 22 bp, Artificial Sequence
  chemically synthesized
atagtgtggttctcagacatca

SEQ ID NO: 1198650 - DNA, 22 bp, Artificial Sequence
  chemically synthesized
ccagttgctgttgattctgatg

SEQ ID NO: 1198651 - DNA, 22 bp, Artificial Sequence
  chemically synthesized
tcagacatcagaatcaacagca

SEQ ID NO: 1198652 - DNA, 22 bp, Artificial Sequence
  chemically synthesized
acaaattcccagttgctgttga

SEQ ID NO: 1198653 - DNA, 22 bp, Artificial Sequence
  chemically synthesized
agacatcagaatcaacagcaac

SEQ ID NO: 1198654 - DNA, 22 bp, Artificial Sequence
  chemically synthesized
tcacaaattcccagttgctgtt

SEQ ID NO: 1198655 - DNA, 22 bp, Artificial Sequence
  chemically synthesized
ctcacaaattcccagttgctgt

SEQ ID NO: 1198656 - DNA, 22 bp, Artificial Sequence
  chemically synthesized
cacttctcacaaattcccagtt

SEQ ID NO: 1198657 - DNA, 22 bp, Artificial Sequence
  chemically synthesized
ggaatttgtgagaagtgcaacc

SEQ ID NO: 1198658 - DNA, 22 bp, Artificial Sequence
  chemically synthesized
gagtacagccagagcggttgca

SEQ ID NO: 1198659 - DNA, 22 bp, Artificial Sequence
  chemically synthesized
gtgagaagtgcaaccgctctgg

SEQ ID NO: 1198660 - DNA, 22 bp, Artificial Sequence
  chemically synthesized
tgagaagtgcaaccgctctggc

SEQ ID NO: 1198661 - DNA, 22 bp, Artificial Sequence
  chemically synthesized
taggtctagagtacagccagag

SEQ ID NO: 1198662 - DNA, 22 bp, Artificial Sequence
  chemically synthesized
atcctgtaggtctagagtacag

SEQ ID NO: 1198663 - DNA, 22 bp, Artificial Sequence
  chemically synthesized
tcatcctgtaggtctagagtac

SEQ ID NO: 1198664 - DNA, 22 bp, Artificial Sequence
  chemically synthesized
ctcatcctgtaggtctagagta

SEQ ID NO: 1198665 - DNA, 22 bp, Artificial Sequence
  chemically synthesized
agtttctcatcctgtaggtcta

SEQ ID NO: 1198666 - DNA, 22 bp, Artificial Sequence
  chemically synthesized
tggctgtactctagacctacag

SEQ ID NO: 1198667 - DNA, 22 bp, Artificial Sequence
  chemically synthesized
gctgtactctagacctacagga

SEQ ID NO: 1198668 - DNA, 22 bp, Artificial Sequence
  chemically synthesized
tactctagacctacaggatgag

SEQ ID NO: 1198669 - DNA, 22 bp, Artificial Sequence
  chemically synthesized
tagacctacaggatgagaaact

SEQ ID NO: 1198670 - DNA, 22 bp, Artificial Sequence
  chemically synthesized
gacctacaggatgagaaactca

SEQ ID NO: 1198671 - DNA, 22 bp, Artificial Sequence
  chemically synthesized
ggatccaccccctgagtttctc

SEQ ID NO: 1198672 - DNA, 22 bp, Artificial Sequence
  chemically synthesized
caggatgagaaactcagggggt

SEQ ID NO: 1198673 - DNA, 22 bp, Artificial Sequence
  chemically synthesized
aaacagggagtgttgggatcca

SEQ ID NO: 1198674 - DNA, 22 bp, Artificial Sequence
  chemically synthesized
ttaaaacagggagtgttgggat

SEQ ID NO: 1198675 - DNA, 22 bp, Artificial Sequence
  chemically synthesized
gttaaaacagggagtgttggga

SEQ ID NO: 1198676 - DNA, 22 bp, Artificial Sequence
  chemically synthesized
agggggtggatcccaacactcc

SEQ ID NO: 1198677 - DNA, 22 bp, Artificial Sequence
  chemically synthesized
gaggtttgttaaaacagggagt

SEQ ID NO: 1198678 - DNA, 22 bp, Artificial Sequence
  chemically synthesized
cctgttttaacaaacctctagg

SEQ ID NO: 1198679 - DNA, 22 bp, Artificial Sequence
  chemically synthesized
ttttaacaaacctctaggttat

SEQ ID NO: 1198680 - DNA, 22 bp, Artificial Sequence
  chemically synthesized
aacatgcatcagaataacctag

SEQ ID NO: 1198681 - DNA, 22 bp, Artificial Sequence
  chemically synthesized
gaacatgcatcagaataaccta

SEQ ID NO: 1198682 - DNA, 22 bp, Artificial Sequence
  chemically synthesized
taacaaacctctaggttattct

SEQ ID NO: 1198683 - DNA, 22 bp, Artificial Sequence
  chemically synthesized
aacaaacctctaggttattctg

SEQ ID NO: 1198684 - DNA, 22 bp, Artificial Sequence
  chemically synthesized
acaaacctctaggttattctga

SEQ ID NO: 1198685 - DNA, 22 bp, Artificial Sequence
  chemically synthesized
aaacttgaacatgcatcagaat

SEQ ID NO: 1198686 - DNA, 22 bp, Artificial Sequence
  chemically synthesized
tcaaacttgaacatgcatcaga

SEQ ID NO: 1198687 - DNA, 22 bp, Artificial Sequence
  chemically synthesized
taggttattctgatgcatgttc

SEQ ID NO: 1198688 - DNA, 22 bp, Artificial Sequence
  chemically synthesized
ggttattctgatgcatgttcaa

SEQ ID NO: 1198689 - DNA, 22 bp, Artificial Sequence
  chemically synthesized
ttctgatgcatgttcaagtttg

SEQ ID NO: 1198690 - DNA, 22 bp, Artificial Sequence
  chemically synthesized
aaacaagggttctcaaacttga

SEQ ID NO: 1198691 - DNA, 22 bp, Artificial Sequence
  chemically synthesized
aaaacaagggttctcaaacttg

SEQ ID NO: 1198692 - DNA, 22 bp, Artificial Sequence
  chemically synthesized
tgatgcatgttcaagtttgaga

SEQ ID NO: 1198693 - DNA, 22 bp, Artificial Sequence
  chemically synthesized
atgcatgttcaagtttgagaac

SEQ ID NO: 1198694 - DNA, 22 bp, Artificial Sequence
  chemically synthesized
aagtttgagaacccttgtttta

SEQ ID NO: 1198695 - DNA, 22 bp, Artificial Sequence
  chemically synthesized
atggcaaccacatcccttaaaa

SEQ ID NO: 1198696 - DNA, 22 bp, Artificial Sequence
  chemically synthesized
gagaacccttgttttaagggat

SEQ ID NO: 1198697 - DNA, 22 bp, Artificial Sequence
  chemically synthesized
aatggcaaccacatcccttaaa

SEQ ID NO: 1198698 - DNA, 22 bp, Artificial Sequence
  chemically synthesized
agaacccttgttttaagggatg

SEQ ID NO: 1198699 - DNA, 22 bp, Artificial Sequence
  chemically synthesized
gttttaagggatgtggttgcca

SEQ ID NO: 1198700 - DNA, 22 bp, Artificial Sequence
  chemically synthesized
ttttaagggatgtggttgccat

SEQ ID NO: 1198701 - DNA, 22 bp, Artificial Sequence
  chemically synthesized
gtgaatagacttaatggcaacc

SEQ ID NO: 1198702 - DNA, 22 bp, Artificial Sequence
  chemically synthesized
ggtgaatagacttaatggcaac

SEQ ID NO: 1198703 - DNA, 22 bp, Artificial Sequence
  chemically synthesized
taagggatgtggttgccattaa

SEQ ID NO: 1198704 - DNA, 22 bp, Artificial Sequence
  chemically synthesized
tggtgaatagacttaatggcaa

SEQ ID NO: 1198705 - DNA, 22 bp, Artificial Sequence
  chemically synthesized
aagggatgtggttgccattaag

SEQ ID NO: 1198706 - DNA, 22 bp, Artificial Sequence
  chemically synthesized
agggatgtggttgccattaagt

SEQ ID NO: 1198707 - DNA, 22 bp, Artificial Sequence
  chemically synthesized
ccattaagtctattcaccaaag

SEQ ID NO: 1198708 - DNA, 22 bp, Artificial Sequence
  chemically synthesized
gaataaaagaatggaactttgg

SEQ ID NO: 1198709 - DNA, 22 bp, Artificial Sequence
  chemically synthesized
agtctattcaccaaagttccat

SEQ ID NO: 1198710 - DNA, 22 bp, Artificial Sequence
  chemically synthesized
ttcaccaaagttccattctttt

SEQ ID NO: 1198711 - DNA, 22 bp, Artificial Sequence
  chemically synthesized
accaaagttccattcttttatt

SEQ ID NO: 1198712 - DNA, 22 bp, Artificial Sequence
  chemically synthesized
tcaggagcctggaataaaagaa

SEQ ID NO: 1198713 - DNA, 22 bp, Artificial Sequence
  chemically synthesized
cattcttttattccaggctcct

SEQ ID NO: 1198714 - DNA, 22 bp, Artificial Sequence
  chemically synthesized
ttttattccaggctcctgatag

SEQ ID NO: 1198715 - DNA, 22 bp, Artificial Sequence
  chemically synthesized
ttattccaggctcctgatagta

SEQ ID NO: 1198716 - DNA, 22 bp, Artificial Sequence
  chemically synthesized
tattccaggctcctgatagtat

SEQ ID NO: 1198717 - DNA, 22 bp, Artificial Sequence
  chemically synthesized
attccaggctcctgatagtatc

SEQ ID NO: 1198718 - DNA, 22 bp, Artificial Sequence
  chemically synthesized
ttccaggctcctgatagtatct

SEQ ID NO: 1198719 - DNA, 22 bp, Artificial Sequence
  chemically synthesized
caggctcctgatagtatctttt

SEQ ID NO: 1198720 - DNA, 22 bp, Artificial Sequence
  chemically synthesized
ctgatagtatcttttactctgc

SEQ ID NO: 1198721 - DNA, 22 bp, Artificial Sequence
  chemically synthesized
atagtatcttttactctgccta

SEQ ID NO: 1198722 - DNA, 22 bp, Artificial Sequence
  chemically synthesized
ttactctgcctacttgtacttt

SEQ ID NO: 1198723 - DNA, 22 bp, Artificial Sequence
  chemically synthesized
tactctgcctacttgtactttg

SEQ ID NO: 1198724 - DNA, 22 bp, Artificial Sequence
  chemically synthesized
actctgcctacttgtactttga

SEQ ID NO: 1198725 - DNA, 22 bp, Artificial Sequence
  chemically synthesized
ctctgcctacttgtactttgat

SEQ ID NO: 1198726 - DNA, 22 bp, Artificial Sequence
  chemically synthesized
tgcctacttgtactttgatatg

SEQ ID NO: 1198727 - DNA, 22 bp, Artificial Sequence
  chemically synthesized
cctacttgtactttgatatggc

SEQ ID NO: 1198728 - DNA, 22 bp, Artificial Sequence
  chemically synthesized
cttgtactttgatatggccatg

SEQ ID NO: 1198729 - DNA, 22 bp, Artificial Sequence
  chemically synthesized
atgaagtaagtcacatggccat

SEQ ID NO: 1198730 - DNA, 22 bp, Artificial Sequence
  chemically synthesized
gatgaagtaagtcacatggcca

SEQ ID NO: 1198731 - DNA, 22 bp, Artificial Sequence
  chemically synthesized
gtactttgatatggccatgtga

SEQ ID NO: 1198732 - DNA, 22 bp, Artificial Sequence
  chemically synthesized
tactttgatatggccatgtgac

SEQ ID NO: 1198733 - DNA, 22 bp, Artificial Sequence
  chemically synthesized
atttgatgaagtaagtcacatg

SEQ ID NO: 1198734 - DNA, 22 bp, Artificial Sequence
  chemically synthesized
aatttgatgaagtaagtcacat

SEQ ID NO: 1198735 - DNA, 22 bp, Artificial Sequence
  chemically synthesized
tgatatggccatgtgacttact

SEQ ID NO: 1198736 - DNA, 22 bp, Artificial Sequence
  chemically synthesized
gatatggccatgtgacttactt

SEQ ID NO: 1198737 - DNA, 22 bp, Artificial Sequence
  chemically synthesized
atatggccatgtgacttacttc

SEQ ID NO: 1198738 - DNA, 22 bp, Artificial Sequence
  chemically synthesized
acatttaatttgatgaagtaag

SEQ ID NO: 1198739 - DNA, 22 bp, Artificial Sequence
  chemically synthesized
ttcacatttaatttgatgaagt

SEQ ID NO: 1198740 - DNA, 22 bp, Artificial Sequence
  chemically synthesized
tgttcacatttaatttgatgaa

SEQ ID NO: 1198741 - DNA, 22 bp, Artificial Sequence
  chemically synthesized
ctgttcacatttaatttgatga

SEQ ID NO: 1198742 - DNA, 22 bp, Artificial Sequence
  chemically synthesized
acttcatcaaattaaatgtgaa

SEQ ID NO: 1198743 - DNA, 22 bp, Artificial Sequence
  chemically synthesized
cttcatcaaattaaatgtgaac

SEQ ID NO: 1198744 - DNA, 22 bp, Artificial Sequence
  chemically synthesized
catcaaattaaatgtgaacaga

SEQ ID NO: 1198745 - DNA, 22 bp, Artificial Sequence
  chemically synthesized
atcaaattaaatgtgaacagaa

SEQ ID NO: 1198746 - DNA, 22 bp, Artificial Sequence
  chemically synthesized
gaaatggcgcacatcacttctg

SEQ ID NO: 1198747 - DNA, 22 bp, Artificial Sequence
  chemically synthesized
ggaaatggcgcacatcacttct

SEQ ID NO: 1198748 - DNA, 22 bp, Artificial Sequence
  chemically synthesized
aatgtgaacagaagtgatgtgc

SEQ ID NO: 1198749 - DNA, 22 bp, Artificial Sequence
  chemically synthesized
cttggaaatggcgcacatcact

SEQ ID NO: 1198750 - DNA, 22 bp, Artificial Sequence
  chemically synthesized
tgcttggaaatggcgcacatca

SEQ ID NO: 1198751 - DNA, 22 bp, Artificial Sequence
  chemically synthesized
ctgcttggaaatggcgcacatc

SEQ ID NO: 1198752 - DNA, 22 bp, Artificial Sequence
  chemically synthesized
ccaagcagaagctttacgggtt

SEQ ID NO: 1198753 - DNA, 22 bp, Artificial Sequence
  chemically synthesized
caagcagaagctttacgggtta

SEQ ID NO: 1198754 - DNA, 22 bp, Artificial Sequence
  chemically synthesized
tacgggttatcgtgtgctttca

SEQ ID NO: 1198755 - DNA, 22 bp, Artificial Sequence
  chemically synthesized
acgggttatcgtgtgctttcac

SEQ ID NO: 1198756 - DNA, 22 bp, Artificial Sequence
  chemically synthesized
cgggttatcgtgtgctttcaca

SEQ ID NO: 1198757 - DNA, 22 bp, Artificial Sequence
  chemically synthesized
agaacgcaagagaacatgtgaa

SEQ ID NO: 1198758 - DNA, 22 bp, Artificial Sequence
  chemically synthesized
aagaacgcaagagaacatgtga

SEQ ID NO: 1198759 - DNA, 22 bp, Artificial Sequence
  chemically synthesized
taagaacgcaagagaacatgtg

SEQ ID NO: 1198760 - DNA, 22 bp, Artificial Sequence
  chemically synthesized
tcgtgtgctttcacatgttctc

SEQ ID NO: 1198761 - DNA, 22 bp, Artificial Sequence
  chemically synthesized
tcacatgttctcttgcgttctt

SEQ ID NO: 1198762 - DNA, 22 bp, Artificial Sequence
  chemically synthesized
aatataaactttaagaacgcaa

SEQ ID NO: 1198763 - DNA, 22 bp, Artificial Sequence
  chemically synthesized
cacatgttctcttgcgttctta

SEQ ID NO: 1198764 - DNA, 22 bp, Artificial Sequence
  chemically synthesized
acatgttctcttgcgttcttaa

SEQ ID NO: 1198765 - DNA, 22 bp, Artificial Sequence
  chemically synthesized
tcttgcgttcttaaagtttata

SEQ ID NO: 1198766 - DNA, 22 bp, Artificial Sequence
  chemically synthesized
ttgcgttcttaaagtttatatt

SEQ ID NO: 1198767 - DNA, 22 bp, Artificial Sequence
  chemically synthesized
gcgttcttaaagtttatattga

SEQ ID NO: 1198768 - DNA, 22 bp, Artificial Sequence
  chemically synthesized
cgttcttaaagtttatattgag

SEQ ID NO: 1198769 - DNA, 22 bp, Artificial Sequence
  chemically synthesized
agagaagggtcatctcaatata

SEQ ID NO: 1198770 - DNA, 22 bp, Artificial Sequence
  chemically synthesized
ttaaagtttatattgagatgac

SEQ ID NO: 1198771 - DNA, 22 bp, Artificial Sequence
  chemically synthesized
ggctgagagaagggtcatctca

SEQ ID NO: 1198772 - DNA, 22 bp, Artificial Sequence
  chemically synthesized
aaagtttatattgagatgaccc

SEQ ID NO: 1198773 - DNA, 22 bp, Artificial Sequence
  chemically synthesized
aagtttatattgagatgaccct

SEQ ID NO: 1198774 - DNA, 22 bp, Artificial Sequence
  chemically synthesized
atattgagatgacccttctctc

SEQ ID NO: 1198775 - DNA, 22 bp, Artificial Sequence
  chemically synthesized
tattgagatgacccttctctca

SEQ ID NO: 1198776 - DNA, 22 bp, Artificial Sequence
  chemically synthesized
aaggacctgggctgagagaagg

SEQ ID NO: 1198777 - DNA, 22 bp, Artificial Sequence
  chemically synthesized
agatgacccttctctcagccca

SEQ ID NO: 1198778 - DNA, 22 bp, Artificial Sequence
  chemically synthesized
agctgaaggacctgggctgaga

SEQ ID NO: 1198779 - DNA, 22 bp, Artificial Sequence
  chemically synthesized
tactcagctgaaggacctgggc

SEQ ID NO: 1198780 - DNA, 22 bp, Artificial Sequence
  chemically synthesized
attgtactcagctgaaggacct

SEQ ID NO: 1198781 - DNA, 22 bp, Artificial Sequence
  chemically synthesized
ctctcagcccaggtccttcagc

SEQ ID NO: 1198782 - DNA, 22 bp, Artificial Sequence
  chemically synthesized
tctcagcccaggtccttcagct

SEQ ID NO: 1198783 - DNA, 22 bp, Artificial Sequence
  chemically synthesized
tcagcccaggtccttcagctga

SEQ ID NO: 1198784 - DNA, 22 bp, Artificial Sequence
  chemically synthesized
aactcattgtactcagctgaag

SEQ ID NO: 1198785 - DNA, 22 bp, Artificial Sequence
  chemically synthesized
agcccaggtccttcagctgagt

SEQ ID NO: 1198786 - DNA, 22 bp, Artificial Sequence
  chemically synthesized
gtaggcgtctcaactcattgta

SEQ ID NO: 1198787 - DNA, 22 bp, Artificial Sequence
  chemically synthesized
cagctgagtacaatgagttgag

SEQ ID NO: 1198788 - DNA, 22 bp, Artificial Sequence
  chemically synthesized
agctgagtacaatgagttgaga

SEQ ID NO: 1198789 - DNA, 22 bp, Artificial Sequence
  chemically synthesized
tagattggtaggcgtctcaact

SEQ ID NO: 1198790 - DNA, 22 bp, Artificial Sequence
  chemically synthesized
agtacaatgagttgagacgcct

SEQ ID NO: 1198791 - DNA, 22 bp, Artificial Sequence
  chemically synthesized
atgtcactatagattggtaggc

SEQ ID NO: 1198792 - DNA, 22 bp, Artificial Sequence
  chemically synthesized
catgtcactatagattggtagg

SEQ ID NO: 1198793 - DNA, 22 bp, Artificial Sequence
  chemically synthesized
agacgcctaccaatctatagtg

SEQ ID NO: 1198794 - DNA, 22 bp, Artificial Sequence
  chemically synthesized
ccgccaaacttcatgtcactat

SEQ ID NO: 1198795 - DNA, 22 bp, Artificial Sequence
  chemically synthesized
cccgccaaacttcatgtcacta

SEQ ID NO: 1198796 - DNA, 22 bp, Artificial Sequence
  chemically synthesized
ttcccgccaaacttcatgtcac

SEQ ID NO: 1198797 - DNA, 22 bp, Artificial Sequence
  chemically synthesized
cttcccgccaaacttcatgtca

SEQ ID NO: 1198798 - DNA, 22 bp, Artificial Sequence
  chemically synthesized
ccaatctatagtgacatgaagt

SEQ ID NO: 1198799 - DNA, 22 bp, Artificial Sequence
  chemically synthesized
tcttcccgccaaacttcatgtc

SEQ ID NO: 1198800 - DNA, 22 bp, Artificial Sequence
  chemically synthesized
tagtgacatgaagtttggcggg

SEQ ID NO: 1198801 - DNA, 22 bp, Artificial Sequence
  chemically synthesized
aaaagaatagaattttcttccc

SEQ ID NO: 1198802 - DNA, 22 bp, Artificial Sequence
  chemically synthesized
agcgactcaaaagaatagaatt

SEQ ID NO: 1198803 - DNA, 22 bp, Artificial Sequence
  chemically synthesized
ggcgggaagaaaattctattct

SEQ ID NO: 1198804 - DNA, 22 bp, Artificial Sequence
  chemically synthesized
gcgggaagaaaattctattctt

SEQ ID NO: 1198805 - DNA, 22 bp, Artificial Sequence
  chemically synthesized
atatctcagcgactcaaaagaa

SEQ ID NO: 1198806 - DNA, 22 bp, Artificial Sequence
  chemically synthesized
tgatatctcagcgactcaaaag

SEQ ID NO: 1198807 - DNA, 22 bp, Artificial Sequence
  chemically synthesized
tattcttttgagtcgctgagat

SEQ ID NO: 1198808 - DNA, 22 bp, Artificial Sequence
  chemically synthesized
ttcttttgagtcgctgagatat

SEQ ID NO: 1198809 - DNA, 22 bp, Artificial Sequence
  chemically synthesized
taagaataattctgatatctca

SEQ ID NO: 1198810 - DNA, 22 bp, Artificial Sequence
  chemically synthesized
ttttgagtcgctgagatatcag

SEQ ID NO: 1198811 - DNA, 22 bp, Artificial Sequence
  chemically synthesized
ttgagtcgctgagatatcagaa

SEQ ID NO: 1198812 - DNA, 22 bp, Artificial Sequence
  chemically synthesized
tgagtcgctgagatatcagaat

SEQ ID NO: 1198813 - DNA, 22 bp, Artificial Sequence
  chemically synthesized
gagtcgctgagatatcagaatt

SEQ ID NO: 1198814 - DNA, 22 bp, Artificial Sequence
  chemically synthesized
agtcgctgagatatcagaatta

SEQ ID NO: 1198815 - DNA, 22 bp, Artificial Sequence
  chemically synthesized
tgcatctataagaataattctg

SEQ ID NO: 1198816 - DNA, 22 bp, Artificial Sequence
  chemically synthesized
cattatgcatctataagaataa

SEQ ID NO: 1198817 - DNA, 22 bp, Artificial Sequence
  chemically synthesized
agatatcagaattattcttata

SEQ ID NO: 1198818 - DNA, 22 bp, Artificial Sequence
  chemically synthesized
ttcttatagatgcataatgtag

SEQ ID NO: 1198819 - DNA, 22 bp, Artificial Sequence
  chemically synthesized
taaatcaggatacactacatta

SEQ ID NO: 1198820 - DNA, 22 bp, Artificial Sequence
  chemically synthesized
ttatagatgcataatgtagtgt

SEQ ID NO: 1198821 - DNA, 22 bp, Artificial Sequence
  chemically synthesized
atagatgcataatgtagtgtat

SEQ ID NO: 1198822 - DNA, 22 bp, Artificial Sequence
  chemically synthesized
tagatgcataatgtagtgtatc

SEQ ID NO: 1198823 - DNA, 22 bp, Artificial Sequence
  chemically synthesized
taccatggcccctataaatcag

SEQ ID NO: 1198824 - DNA, 22 bp, Artificial Sequence
  chemically synthesized
tgtaccatggcccctataaatc

SEQ ID NO: 1198825 - DNA, 22 bp, Artificial Sequence
  chemically synthesized
tctgtaccatggcccctataaa

SEQ ID NO: 1198826 - DNA, 22 bp, Artificial Sequence
  chemically synthesized
ctctgtaccatggcccctataa

SEQ ID NO: 1198827 - DNA, 22 bp, Artificial Sequence
  chemically synthesized
atttataggggccatggtacag

SEQ ID NO: 1198828 - DNA, 22 bp, Artificial Sequence
  chemically synthesized
ataggggccatggtacagagaa

SEQ ID NO: 1198829 - DNA, 22 bp, Artificial Sequence
  chemically synthesized
taggggccatggtacagagaag

SEQ ID NO: 1198830 - DNA, 22 bp, Artificial Sequence
  chemically synthesized
ccatgaaatagatcccttctct

SEQ ID NO: 1198831 - DNA, 22 bp, Artificial Sequence
  chemically synthesized
accatgaaatagatcccttctc

SEQ ID NO: 1198832 - DNA, 22 bp, Artificial Sequence
  chemically synthesized
taccatgaaatagatcccttct

SEQ ID NO: 1198833 - DNA, 22 bp, Artificial Sequence
  chemically synthesized
tttaccatgaaatagatccctt

SEQ ID NO: 1198834 - DNA, 22 bp, Artificial Sequence
  chemically synthesized
tctttaccatgaaatagatccc

SEQ ID NO: 1198835 - DNA, 22 bp, Artificial Sequence
  chemically synthesized
atacacatgttctctttaccat

SEQ ID NO: 1198836 - DNA, 22 bp, Artificial Sequence
  chemically synthesized
ttgatacacatgttctctttac

SEQ ID NO: 1198837 - DNA, 22 bp, Artificial Sequence
  chemically synthesized
tttcatggtaaagagaacatgt

SEQ ID NO: 1198838 - DNA, 22 bp, Artificial Sequence
  chemically synthesized
catggtaaagagaacatgtgta

SEQ ID NO: 1198839 - DNA, 22 bp, Artificial Sequence
  chemically synthesized
atggtaaagagaacatgtgtat

SEQ ID NO: 1198840 - DNA, 22 bp, Artificial Sequence
  chemically synthesized
catagataccataaatctgttg

SEQ ID NO: 1198841 - DNA, 22 bp, Artificial Sequence
  chemically synthesized
ccatagataccataaatctgtt

SEQ ID NO: 1198842 - DNA, 22 bp, Artificial Sequence
  chemically synthesized
ttccatagataccataaatctg

SEQ ID NO: 1198843 - DNA, 22 bp, Artificial Sequence
  chemically synthesized
ctcttccatagataccataaat

SEQ ID NO: 1198844 - DNA, 22 bp, Artificial Sequence
  chemically synthesized
cctcttccatagataccataaa

SEQ ID NO: 1198845 - DNA, 22 bp, Artificial Sequence
  chemically synthesized
tcctcttccatagataccataa

SEQ ID NO: 1198846 - DNA, 22 bp, Artificial Sequence
  chemically synthesized
ccatgttttcctcttccataga

SEQ ID NO: 1198847 - DNA, 22 bp, Artificial Sequence
  chemically synthesized
atggtatctatggaagaggaaa

SEQ ID NO: 1198848 - DNA, 22 bp, Artificial Sequence
  chemically synthesized
tggtatctatggaagaggaaaa

SEQ ID NO: 1198849 - DNA, 22 bp, Artificial Sequence
  chemically synthesized
atagtgattcccatgttttcct

SEQ ID NO: 1198850 - DNA, 22 bp, Artificial Sequence
  chemically synthesized
aatagtgattcccatgttttcc

SEQ ID NO: 1198851 - DNA, 22 bp, Artificial Sequence
  chemically synthesized
tggaagaggaaaacatgggaat

SEQ ID NO: 1198852 - DNA, 22 bp, Artificial Sequence
  chemically synthesized
aggtttaatagtgattcccatg

SEQ ID NO: 1198853 - DNA, 22 bp, Artificial Sequence
  chemically synthesized
tgaggtttaatagtgattccca

SEQ ID NO: 1198854 - DNA, 22 bp, Artificial Sequence
  chemically synthesized
ctgaggtttaatagtgattccc

SEQ ID NO: 1198855 - DNA, 22 bp, Artificial Sequence
  chemically synthesized
tctgaggtttaatagtgattcc

SEQ ID NO: 1198856 - DNA, 22 bp, Artificial Sequence
  chemically synthesized
ttctgaggtttaatagtgattc

SEQ ID NO: 1198857 - DNA, 22 bp, Artificial Sequence
  chemically synthesized
tttctgaggtttaatagtgatt

SEQ ID NO: 1198858 - DNA, 22 bp, Artificial Sequence
  chemically synthesized
ttttctgaggtttaatagtgat

SEQ ID NO: 1198859 - DNA, 22 bp, Artificial Sequence
  chemically synthesized
ttaaacctcagaaaaaaggatc

SEQ ID NO: 1198860 - DNA, 22 bp, Artificial Sequence
  chemically synthesized
tgtgacaatatatgatcctttt

SEQ ID NO: 1198861 - DNA, 22 bp, Artificial Sequence
  chemically synthesized
atgtgacaatatatgatccttt

SEQ ID NO: 1198862 - DNA, 22 bp, Artificial Sequence
  chemically synthesized
aacctcagaaaaaaggatcata

SEQ ID NO: 1198863 - DNA, 22 bp, Artificial Sequence
  chemically synthesized
tttatgtgacaatatatgatcc

SEQ ID NO: 1198864 - DNA, 22 bp, Artificial Sequence
  chemically synthesized
atttatgtgacaatatatgatc

SEQ ID NO: 1198865 - DNA, 22 bp, Artificial Sequence
  chemically synthesized
ttatttatgtgacaatatatga

SEQ ID NO: 1198866 - DNA, 22 bp, Artificial Sequence
  chemically synthesized
agaaaaaaggatcatatattgt

SEQ ID NO: 1198867 - DNA, 22 bp, Artificial Sequence
  chemically synthesized
tcttatttatgtgacaatatat

SEQ ID NO: 1198868 - DNA, 22 bp, Artificial Sequence
  chemically synthesized
ctctcttatttatgtgacaata

SEQ ID NO: 1198869 - DNA, 22 bp, Artificial Sequence
  chemically synthesized
tcctctcttatttatgtgacaa

SEQ ID NO: 1198870 - DNA, 22 bp, Artificial Sequence
  chemically synthesized
ctcctctcttatttatgtgaca

SEQ ID NO: 1198871 - DNA, 22 bp, Artificial Sequence
  chemically synthesized
tctcctctcttatttatgtgac

SEQ ID NO: 1198872 - DNA, 22 bp, Artificial Sequence
  chemically synthesized
tttctcctctcttatttatgtg

SEQ ID NO: 1198873 - DNA, 22 bp, Artificial Sequence
  chemically synthesized
ttctttctcctctcttatttat

SEQ ID NO: 1198874 - DNA, 22 bp, Artificial Sequence
  chemically synthesized
tgttctttctcctctcttattt

SEQ ID NO: 1198875 - DNA, 22 bp, Artificial Sequence
  chemically synthesized
tctgttctttctcctctcttat

SEQ ID NO: 1198876 - DNA, 22 bp, Artificial Sequence
  chemically synthesized
tctctgttctttctcctctctt

SEQ ID NO: 1198877 - DNA, 22 bp, Artificial Sequence
  chemically synthesized
ctctctgttctttctcctctct

SEQ ID NO: 1198878 - DNA, 22 bp, Artificial Sequence
  chemically synthesized
tcacataaataagagaggagaa

SEQ ID NO: 1198879 - DNA, 22 bp, Artificial Sequence
  chemically synthesized
cttctctctgttctttctcctc

SEQ ID NO: 1198880 - DNA, 22 bp, Artificial Sequence
  chemically synthesized
tccttctctctgttctttctcc

SEQ ID NO: 1198881 - DNA, 22 bp, Artificial Sequence
  chemically synthesized
ctccttctctctgttctttctc

SEQ ID NO: 1198882 - DNA, 22 bp, Artificial Sequence
  chemically synthesized
acttctccttctctctgttctt

SEQ ID NO: 1198883 - DNA, 22 bp, Artificial Sequence
  chemically synthesized
gtggtcattaacttctccttct

SEQ ID NO: 1198884 - DNA, 22 bp, Artificial Sequence
  chemically synthesized
atatgttggtggtcattaactt

SEQ ID NO: 1198885 - DNA, 22 bp, Artificial Sequence
  chemically synthesized
ttaatatgttggtggtcattaa

SEQ ID NO: 1198886 - DNA, 22 bp, Artificial Sequence
  chemically synthesized
atgaccaccaacatattaacaa

SEQ ID NO: 1198887 - DNA, 22 bp, Artificial Sequence
  chemically synthesized
caccgaaagataaatattgtta

SEQ ID NO: 1198888 - DNA, 22 bp, Artificial Sequence
  chemically synthesized
acaccgaaagataaatattgtt

SEQ ID NO: 1198889 - DNA, 22 bp, Artificial Sequence
  chemically synthesized
ttacaccgaaagataaatattg

SEQ ID NO: 1198890 - DNA, 22 bp, Artificial Sequence
  chemically synthesized
acaatatttatctttcggtgta

SEQ ID NO: 1198891 - DNA, 22 bp, Artificial Sequence
  chemically synthesized
atgtaaaattcttacaccgaaa

SEQ ID NO: 1198892 - DNA, 22 bp, Artificial Sequence
  chemically synthesized
atctttcggtgtaagaatttta

SEQ ID NO: 1198893 - DNA, 22 bp, Artificial Sequence
  chemically synthesized
tctttcggtgtaagaattttac

SEQ ID NO: 1198894 - DNA, 22 bp, Artificial Sequence
  chemically synthesized
tcggtgtaagaattttacatga

SEQ ID NO: 1198895 - DNA, 22 bp, Artificial Sequence
  chemically synthesized
cggtgtaagaattttacatgaa

SEQ ID NO: 1198896 - DNA, 22 bp, Artificial Sequence
  chemically synthesized
ggtgtaagaattttacatgaat

SEQ ID NO: 1198897 - DNA, 22 bp, Artificial Sequence
  chemically synthesized
aataataatatagtaaatattc

SEQ ID NO: 1198898 - DNA, 22 bp, Artificial Sequence
  chemically synthesized
aaataataatatagtaaatatt

SEQ ID NO: 1198899 - DNA, 22 bp, Artificial Sequence
  chemically synthesized
tacatgaatatttactatatta

SEQ ID NO: 1198900 - DNA, 22 bp, Artificial Sequence
  chemically synthesized
acatgaatatttactatattat

SEQ ID NO: 1198901 - DNA, 22 bp, Artificial Sequence
  chemically synthesized
catgaatatttactatattatt

SEQ ID NO: 1198902 - DNA, 22 bp, Artificial Sequence
  chemically synthesized
tataatgcttaaataataatat

SEQ ID NO: 1198903 - DNA, 22 bp, Artificial Sequence
  chemically synthesized
tgattatataatgcttaaataa

SEQ ID NO: 1198904 - DNA, 22 bp, Artificial Sequence
  chemically synthesized
atgattatataatgcttaaata

SEQ ID NO: 1198905 - DNA, 22 bp, Artificial Sequence
  chemically synthesized
tatgattatataatgcttaaat

SEQ ID NO: 1198906 - DNA, 22 bp, Artificial Sequence
  chemically synthesized
actatattattatttaagcatt

SEQ ID NO: 1198907 - DNA, 22 bp, Artificial Sequence
  chemically synthesized
ctatattattatttaagcatta

SEQ ID NO: 1198908 - DNA, 22 bp, Artificial Sequence
  chemically synthesized
ttttatgattatataatgctta

SEQ ID NO: 1198909 - DNA, 22 bp, Artificial Sequence
  chemically synthesized
tattattatttaagcattatat

SEQ ID NO: 1198910 - DNA, 22 bp, Artificial Sequence
  chemically synthesized
tattttatgattatataatgct

SEQ ID NO: 1198911 - DNA, 22 bp, Artificial Sequence
  chemically synthesized
ctattttatgattatataatgc

SEQ ID NO: 1198912 - DNA, 22 bp, Artificial Sequence
  chemically synthesized
ttatttaagcattatataatca

SEQ ID NO: 1198913 - DNA, 22 bp, Artificial Sequence
  chemically synthesized
atttctattttatgattatata

SEQ ID NO: 1198914 - DNA, 22 bp, Artificial Sequence
  chemically synthesized
tttaagcattatataatcataa

SEQ ID NO: 1198915 - DNA, 22 bp, Artificial Sequence
  chemically synthesized
aagcattatataatcataaaat

SEQ ID NO: 1198916 - DNA, 22 bp, Artificial Sequence
  chemically synthesized
agcattatataatcataaaata

SEQ ID NO: 1198917 - DNA, 22 bp, Artificial Sequence
  chemically synthesized
taatattcatttctattttatg

SEQ ID NO: 1198918 - DNA, 22 bp, Artificial Sequence
  chemically synthesized
ataatattcatttctattttat

SEQ ID NO: 1198919 - DNA, 22 bp, Artificial Sequence
  chemically synthesized
tataatattcatttctatttta

SEQ ID NO: 1198920 - DNA, 22 bp, Artificial Sequence
  chemically synthesized
ttataatattcatttctatttt

SEQ ID NO: 1198921 - DNA, 22 bp, Artificial Sequence
  chemically synthesized
tataatcataaaatagaaatga

SEQ ID NO: 1198922 - DNA, 22 bp, Artificial Sequence
  chemically synthesized
tgcttttataatattcatttct

SEQ ID NO: 1198923 - DNA, 22 bp, Artificial Sequence
  chemically synthesized
atgcttttataatattcatttc

SEQ ID NO: 1198924 - DNA, 22 bp, Artificial Sequence
  chemically synthesized
tatgcttttataatattcattt

SEQ ID NO: 1198925 - DNA, 22 bp, Artificial Sequence
  chemically synthesized
tgtcataaactttatgctttta

SEQ ID NO: 1198926 - DNA, 22 bp, Artificial Sequence
  chemically synthesized
gtgtcataaactttatgctttt

SEQ ID NO: 1198927 - DNA, 22 bp, Artificial Sequence
  chemically synthesized
tgtgtcataaactttatgcttt

SEQ ID NO: 1198928 - DNA, 22 bp, Artificial Sequence
  chemically synthesized
taaaagcataaagtttatgaca

SEQ ID NO: 1198929 - DNA, 22 bp, Artificial Sequence
  chemically synthesized
gaggccaattttgtgtcataaa

SEQ ID NO: 1198930 - DNA, 22 bp, Artificial Sequence
  chemically synthesized
atgacacaaaattggcctcgaa

SEQ ID NO: 1198931 - DNA, 22 bp, Artificial Sequence
  chemically synthesized
caaaagatgagattcgaggcca

SEQ ID NO: 1198932 - DNA, 22 bp, Artificial Sequence
  chemically synthesized
tgacacaaaattggcctcgaat

SEQ ID NO: 1198933 - DNA, 22 bp, Artificial Sequence
  chemically synthesized
tgccctccaaaagatgagattc

SEQ ID NO: 1198934 - DNA, 22 bp, Artificial Sequence
  chemically synthesized
atgccctccaaaagatgagatt

SEQ ID NO: 1198935 - DNA, 22 bp, Artificial Sequence
  chemically synthesized
gcctcgaatctcatcttttgga

SEQ ID NO: 1198936 - DNA, 22 bp, Artificial Sequence
  chemically synthesized
catgagtttatgccctccaaaa

SEQ ID NO: 1198937 - DNA, 22 bp, Artificial Sequence
  chemically synthesized
ccatgagtttatgccctccaaa

SEQ ID NO: 1198938 - DNA, 22 bp, Artificial Sequence
  chemically synthesized
gaatctcatcttttggagggca

SEQ ID NO: 1198939 - DNA, 22 bp, Artificial Sequence
  chemically synthesized
atcttttggagggcataaactc

SEQ ID NO: 1198940 - DNA, 22 bp, Artificial Sequence
  chemically synthesized
agaaagtcttccatgagtttat

SEQ ID NO: 1198941 - DNA, 22 bp, Artificial Sequence
  chemically synthesized
ttggagggcataaactcatgga

SEQ ID NO: 1198942 - DNA, 22 bp, Artificial Sequence
  chemically synthesized
tggagggcataaactcatggaa

SEQ ID NO: 1198943 - DNA, 22 bp, Artificial Sequence
  chemically synthesized
attaagaaagtcttccatgagt

SEQ ID NO: 1198944 - DNA, 22 bp, Artificial Sequence
  chemically synthesized
ggagggcataaactcatggaag

SEQ ID NO: 1198945 - DNA, 22 bp, Artificial Sequence
  chemically synthesized
gagggcataaactcatggaaga

SEQ ID NO: 1198946 - DNA, 22 bp, Artificial Sequence
  chemically synthesized
acaaaatggtctaattaagaaa

SEQ ID NO: 1198947 - DNA, 22 bp, Artificial Sequence
  chemically synthesized
atggaagactttcttaattaga

SEQ ID NO: 1198948 - DNA, 22 bp, Artificial Sequence
  chemically synthesized
tcttaattagaccattttgtga

SEQ ID NO: 1198949 - DNA, 22 bp, Artificial Sequence
  chemically synthesized
cttaattagaccattttgtgag

SEQ ID NO: 1198950 - DNA, 22 bp, Artificial Sequence
  chemically synthesized
ttaattagaccattttgtgagt

SEQ ID NO: 1198951 - DNA, 22 bp, Artificial Sequence
  chemically synthesized
aattagaccattttgtgagtgt

SEQ ID NO: 1198952 - DNA, 22 bp, Artificial Sequence
  chemically synthesized
attagaccattttgtgagtgta

SEQ ID NO: 1198953 - DNA, 22 bp, Artificial Sequence
  chemically synthesized
gaccattttgtgagtgtattta

SEQ ID NO: 1198954 - DNA, 22 bp, Artificial Sequence
  chemically synthesized
tgtgagtgtatttactacctct

SEQ ID NO: 1198955 - DNA, 22 bp, Artificial Sequence
  chemically synthesized
gtgagtgtatttactacctctt

SEQ ID NO: 1198956 - DNA, 22 bp, Artificial Sequence
  chemically synthesized
tgagtgtatttactacctcttg

SEQ ID NO: 1198957 - DNA, 22 bp, Artificial Sequence
  chemically synthesized
cacatggatacagatcaagagg

SEQ ID NO: 1198958 - DNA, 22 bp, Artificial Sequence
  chemically synthesized
actacctcttgatctgtatcca

SEQ ID NO: 1198959 - DNA, 22 bp, Artificial Sequence
  chemically synthesized
ctacctcttgatctgtatccat

SEQ ID NO: 1198960 - DNA, 22 bp, Artificial Sequence
  chemically synthesized
cctcttgatctgtatccatgtg

SEQ ID NO: 1198961 - DNA, 22 bp, Artificial Sequence
  chemically synthesized
aaacagtgtcctacacatggat

SEQ ID NO: 1198962 - DNA, 22 bp, Artificial Sequence
  chemically synthesized
aaaacagtgtcctacacatgga

SEQ ID NO: 1198963 - DNA, 22 bp, Artificial Sequence
  chemically synthesized
ttgatctgtatccatgtgtagg

SEQ ID NO: 1198964 - DNA, 22 bp, Artificial Sequence
  chemically synthesized
gatctgtatccatgtgtaggac

SEQ ID NO: 1198965 - DNA, 22 bp, Artificial Sequence
  chemically synthesized
atctgtatccatgtgtaggaca

SEQ ID NO: 1198966 - DNA, 22 bp, Artificial Sequence
  chemically synthesized
tatccatgtgtaggacactgtt

SEQ ID NO: 1198967 - DNA, 22 bp, Artificial Sequence
  chemically synthesized
ttttaagtacttcccatgcgtt

SEQ ID NO: 1198968 - DNA, 22 bp, Artificial Sequence
  chemically synthesized
taagtacttcccatgcgttatt

SEQ ID NO: 1198969 - DNA, 22 bp, Artificial Sequence
  chemically synthesized
aagtacttcccatgcgttattt

SEQ ID NO: 1198970 - DNA, 22 bp, Artificial Sequence
  chemically synthesized
agtacttcccatgcgttatttc

SEQ ID NO: 1198971 - DNA, 22 bp, Artificial Sequence
  chemically synthesized
tgagaaagatcatagaaataac

SEQ ID NO: 1198972 - DNA, 22 bp, Artificial Sequence
  chemically synthesized
cccatgcgttatttctatgatc

SEQ ID NO: 1198973 - DNA, 22 bp, Artificial Sequence
  chemically synthesized
ccatgcgttatttctatgatct

SEQ ID NO: 1198974 - DNA, 22 bp, Artificial Sequence
  chemically synthesized
cccagcaagtctatgagaaaga

SEQ ID NO: 1198975 - DNA, 22 bp, Artificial Sequence
  chemically synthesized
acccagcaagtctatgagaaag

SEQ ID NO: 1198976 - DNA, 22 bp, Artificial Sequence
  chemically synthesized
tacccagcaagtctatgagaaa

SEQ ID NO: 1198977 - DNA, 22 bp, Artificial Sequence
  chemically synthesized
tttctatgatctttctcataga

SEQ ID NO: 1198978 - DNA, 22 bp, Artificial Sequence
  chemically synthesized
ctatgatctttctcatagactt

SEQ ID NO: 1198979 - DNA, 22 bp, Artificial Sequence
  chemically synthesized
tatgatctttctcatagacttg

SEQ ID NO: 1198980 - DNA, 22 bp, Artificial Sequence
  chemically synthesized
tgatctttctcatagacttgct

SEQ ID NO: 1198981 - DNA, 22 bp, Artificial Sequence
  chemically synthesized
ggataacaaattttacccagca

SEQ ID NO: 1198982 - DNA, 22 bp, Artificial Sequence
  chemically synthesized
tctcatagacttgctgggtaaa

SEQ ID NO: 1198983 - DNA, 22 bp, Artificial Sequence
  chemically synthesized
gggataacaaattttacccagc

SEQ ID NO: 1198984 - DNA, 22 bp, Artificial Sequence
  chemically synthesized
ctcatagacttgctgggtaaaa

SEQ ID NO: 1198985 - DNA, 22 bp, Artificial Sequence
  chemically synthesized
tcatagacttgctgggtaaaat

SEQ ID NO: 1198986 - DNA, 22 bp, Artificial Sequence
  chemically synthesized
atagacttgctgggtaaaattt

SEQ ID NO: 1198987 - DNA, 22 bp, Artificial Sequence
  chemically synthesized
gctgggtaaaatttgttatccc

SEQ ID NO: 1198988 - DNA, 22 bp, Artificial Sequence
  chemically synthesized
aatgccaaccttgggataacaa

SEQ ID NO: 1198989 - DNA, 22 bp, Artificial Sequence
  chemically synthesized
ctgggtaaaatttgttatccca

SEQ ID NO: 1198990 - DNA, 22 bp, Artificial Sequence
  chemically synthesized
ggtaaaatttgttatcccaagg

SEQ ID NO: 1198991 - DNA, 22 bp, Artificial Sequence
  chemically synthesized
agaattcaatgccaaccttggg

SEQ ID NO: 1198992 - DNA, 22 bp, Artificial Sequence
  chemically synthesized
gagaattcaatgccaaccttgg

SEQ ID NO: 1198993 - DNA, 22 bp, Artificial Sequence
  chemically synthesized
gttatcccaaggttggcattga

SEQ ID NO: 1198994 - DNA, 22 bp, Artificial Sequence
  chemically synthesized
ttatcccaaggttggcattgaa

SEQ ID NO: 1198995 - DNA, 22 bp, Artificial Sequence
  chemically synthesized
tcccaaggttggcattgaattc

SEQ ID NO: 1198996 - DNA, 22 bp, Artificial Sequence
  chemically synthesized
tgtaaacacttgagaattcaat

SEQ ID NO: 1198997 - DNA, 22 bp, Artificial Sequence
  chemically synthesized
gcattgaattctcaagtgttta

SEQ ID NO: 1198998 - DNA, 22 bp, Artificial Sequence
  chemically synthesized
gggcatgttatgtaaacacttg

SEQ ID NO: 1198999 - DNA, 22 bp, Artificial Sequence
  chemically synthesized
aattctcaagtgtttacataac

SEQ ID NO: 1199000 - DNA, 22 bp, Artificial Sequence
  chemically synthesized
tataatctagggcatgttatgt

SEQ ID NO: 1199001 - DNA, 22 bp, Artificial Sequence
  chemically synthesized
tcaagtgtttacataacatgcc

SEQ ID NO: 1199002 - DNA, 22 bp, Artificial Sequence
  chemically synthesized
ctgtataatctagggcatgtta

SEQ ID NO: 1199003 - DNA, 22 bp, Artificial Sequence
  chemically synthesized
aagtgtttacataacatgccct

SEQ ID NO: 1199004 - DNA, 22 bp, Artificial Sequence
  chemically synthesized
actgtataatctagggcatgtt

SEQ ID NO: 1199005 - DNA, 22 bp, Artificial Sequence
  chemically synthesized
cttactgtataatctagggcat

SEQ ID NO: 1199006 - DNA, 22 bp, Artificial Sequence
  chemically synthesized
acttactgtataatctagggca

SEQ ID NO: 1199007 - DNA, 22 bp, Artificial Sequence
  chemically synthesized
acataacatgccctagattata

SEQ ID NO: 1199008 - DNA, 22 bp, Artificial Sequence
  chemically synthesized
cataacatgccctagattatac

SEQ ID NO: 1199009 - DNA, 22 bp, Artificial Sequence
  chemically synthesized
gattatacagtaagtaaatata

SEQ ID NO: 1199010 - DNA, 22 bp, Artificial Sequence
  chemically synthesized
aatccatgagtatatatttact

SEQ ID NO: 1199011 - DNA, 22 bp, Artificial Sequence
  chemically synthesized
gaatccatgagtatatatttac

SEQ ID NO: 1199012 - DNA, 22 bp, Artificial Sequence
  chemically synthesized
tacagtaagtaaatatatactc

SEQ ID NO: 1199013 - DNA, 22 bp, Artificial Sequence
  chemically synthesized
atttgaatccatgagtatatat

SEQ ID NO: 1199014 - DNA, 22 bp, Artificial Sequence
  chemically synthesized
gatttgaatccatgagtatata

SEQ ID NO: 1199015 - DNA, 22 bp, Artificial Sequence
  chemically synthesized
gagtcataaataacttgatttg

SEQ ID NO: 1199016 - DNA, 22 bp, Artificial Sequence
  chemically synthesized
agagtcataaataacttgattt

SEQ ID NO: 1199017 - DNA, 22 bp, Artificial Sequence
  chemically synthesized
tagagtcataaataacttgatt

SEQ ID NO: 1199018 - DNA, 22 bp, Artificial Sequence
  chemically synthesized
atggattcaaatcaagttattt

SEQ ID NO: 1199019 - DNA, 22 bp, Artificial Sequence
  chemically synthesized
agttttagagtcataaataact

SEQ ID NO: 1199020 - DNA, 22 bp, Artificial Sequence
  chemically synthesized
aagttttagagtcataaataac

SEQ ID NO: 1199021 - DNA, 22 bp, Artificial Sequence
  chemically synthesized
aaatcaagttatttatgactct

SEQ ID NO: 1199022 - DNA, 22 bp, Artificial Sequence
  chemically synthesized
taatgaaaagaacttaagtttt

SEQ ID NO: 1199023 - DNA, 22 bp, Artificial Sequence
  chemically synthesized
tttatgactctaaaacttaagt

SEQ ID NO: 1199024 - DNA, 22 bp, Artificial Sequence
  chemically synthesized
atgactctaaaacttaagttct

SEQ ID NO: 1199025 - DNA, 22 bp, Artificial Sequence
  chemically synthesized
tgactctaaaacttaagttctt

SEQ ID NO: 1199026 - DNA, 22 bp, Artificial Sequence
  chemically synthesized
taaaacttaagttcttttcatt

SEQ ID NO: 1199027 - DNA, 22 bp, Artificial Sequence
  chemically synthesized
aaacttaagttcttttcattat

SEQ ID NO: 1199028 - DNA, 22 bp, Artificial Sequence
  chemically synthesized
atacaacagcatgctataatga

SEQ ID NO: 1199029 - DNA, 22 bp, Artificial Sequence
  chemically synthesized
catacaacagcatgctataatg

SEQ ID NO: 1199030 - DNA, 22 bp, Artificial Sequence
  chemically synthesized
aagttcttttcattatagcatg

SEQ ID NO: 1199031 - DNA, 22 bp, Artificial Sequence
  chemically synthesized
agttcttttcattatagcatgc

SEQ ID NO: 1199032 - DNA, 22 bp, Artificial Sequence
  chemically synthesized
ttttcattatagcatgctgttg

SEQ ID NO: 1199033 - DNA, 22 bp, Artificial Sequence
  chemically synthesized
ttcattatagcatgctgttgta

SEQ ID NO: 1199034 - DNA, 22 bp, Artificial Sequence
  chemically synthesized
tcattatagcatgctgttgtat

SEQ ID NO: 1199035 - DNA, 22 bp, Artificial Sequence
  chemically synthesized
agataaatcttcatacaacagc

SEQ ID NO: 1199036 - DNA, 22 bp, Artificial Sequence
  chemically synthesized
cattatagcatgctgttgtatg

SEQ ID NO: 1199037 - DNA, 22 bp, Artificial Sequence
  chemically synthesized
attatagcatgctgttgtatga

SEQ ID NO: 1199038 - DNA, 22 bp, Artificial Sequence
  chemically synthesized
tagcatgctgttgtatgaagat

SEQ ID NO: 1199039 - DNA, 22 bp, Artificial Sequence
  chemically synthesized
ggtaggtacagactcagataaa

SEQ ID NO: 1199040 - DNA, 22 bp, Artificial Sequence
  chemically synthesized
ttgtatgaagatttatctgagt

SEQ ID NO: 1199041 - DNA, 22 bp, Artificial Sequence
  chemically synthesized
tatgaagatttatctgagtctg

SEQ ID NO: 1199042 - DNA, 22 bp, Artificial Sequence
  chemically synthesized
tatctgggtaggtacagactca

SEQ ID NO: 1199043 - DNA, 22 bp, Artificial Sequence
  chemically synthesized
ctatatctgggtaggtacagac

SEQ ID NO: 1199044 - DNA, 22 bp, Artificial Sequence
  chemically synthesized
cctatatctgggtaggtacaga

SEQ ID NO: 1199045 - DNA, 22 bp, Artificial Sequence
  chemically synthesized
atctgagtctgtacctacccag

SEQ ID NO: 1199046 - DNA, 22 bp, Artificial Sequence
  chemically synthesized
tctgagtctgtacctacccaga

SEQ ID NO: 1199047 - DNA, 22 bp, Artificial Sequence
  chemically synthesized
agtctgtacctacccagatata

SEQ ID NO: 1199048 - DNA, 22 bp, Artificial Sequence
  chemically synthesized
tacctacccagatataggaagg

SEQ ID NO: 1199049 - DNA, 22 bp, Artificial Sequence
  chemically synthesized
cccagatataggaaggtgtgtg

SEQ ID NO: 1199050 - DNA, 22 bp, Artificial Sequence
  chemically synthesized
aacaaacgtacacacacacctt

SEQ ID NO: 1199051 - DNA, 22 bp, Artificial Sequence
  chemically synthesized
aaacaaacgtacacacacacct

SEQ ID NO: 1199052 - DNA, 22 bp, Artificial Sequence
  chemically synthesized
tttaaacaaacgtacacacaca

SEQ ID NO: 1199053 - DNA, 22 bp, Artificial Sequence
  chemically synthesized
gtttaaacaaacgtacacacac

SEQ ID NO: 1199054 - DNA, 22 bp, Artificial Sequence
  chemically synthesized
acttgtttaaacaaacgtacac

SEQ ID NO: 1199055 - DNA, 22 bp, Artificial Sequence
  chemically synthesized
ccaaatatactaacttgtttaa

SEQ ID NO: 1199056 - DNA, 22 bp, Artificial Sequence
  chemically synthesized
aaggttaccaaatatactaact

SEQ ID NO: 1199057 - DNA, 22 bp, Artificial Sequence
  chemically synthesized
taaaggttaccaaatatactaa

SEQ ID NO: 1199058 - DNA, 22 bp, Artificial Sequence
  chemically synthesized
gtttaaacaagttagtatattt

SEQ ID NO: 1199059 - DNA, 22 bp, Artificial Sequence
  chemically synthesized
ctaaaggttaccaaatatacta

SEQ ID NO: 1199060 - DNA, 22 bp, Artificial Sequence
  chemically synthesized
tttaaacaagttagtatatttg

SEQ ID NO: 1199061 - DNA, 22 bp, Artificial Sequence
  chemically synthesized
tctaaaggttaccaaatatact

SEQ ID NO: 1199062 - DNA, 22 bp, Artificial Sequence
  chemically synthesized
aaacaagttagtatatttggta

SEQ ID NO: 1199063 - DNA, 22 bp, Artificial Sequence
  chemically synthesized
ttttctaaaggttaccaaatat

SEQ ID NO: 1199064 - DNA, 22 bp, Artificial Sequence
  chemically synthesized
aacaagttagtatatttggtaa

SEQ ID NO: 1199065 - DNA, 22 bp, Artificial Sequence
  chemically synthesized
attttctaaaggttaccaaata

SEQ ID NO: 1199066 - DNA, 22 bp, Artificial Sequence
  chemically synthesized
gtatatttggtaacctttagaa

SEQ ID NO: 1199067 - DNA, 22 bp, Artificial Sequence
  chemically synthesized
ggtaacctttagaaaataagtg

SEQ ID NO: 1199068 - DNA, 22 bp, Artificial Sequence
  chemically synthesized
gtaacctttagaaaataagtga

SEQ ID NO: 1199069 - DNA, 22 bp, Artificial Sequence
  chemically synthesized
ggcacatacaagagtcacttat

SEQ ID NO: 1199070 - DNA, 22 bp, Artificial Sequence
  chemically synthesized
tcggcacatacaagagtcactt

SEQ ID NO: 1199071 - DNA, 22 bp, Artificial Sequence
  chemically synthesized
ctcggcacatacaagagtcact

SEQ ID NO: 1199072 - DNA, 22 bp, Artificial Sequence
  chemically synthesized
tagaaaataagtgactcttgta

SEQ ID NO: 1199073 - DNA, 22 bp, Artificial Sequence
  chemically synthesized
cttctcggcacatacaagagtc

SEQ ID NO: 1199074 - DNA, 22 bp, Artificial Sequence
  chemically synthesized
agaaaataagtgactcttgtat

SEQ ID NO: 1199075 - DNA, 22 bp, Artificial Sequence
  chemically synthesized
gaaaataagtgactcttgtatg

SEQ ID NO: 1199076 - DNA, 22 bp, Artificial Sequence
  chemically synthesized
ttgtatgtgccgagaaggaggc

SEQ ID NO: 1199077 - DNA, 22 bp, Artificial Sequence
  chemically synthesized
gtatgtgccgagaaggaggctg

SEQ ID NO: 1199078 - DNA, 22 bp, Artificial Sequence
  chemically synthesized
agcataaatcaccagcctcctt

SEQ ID NO: 1199079 - DNA, 22 bp, Artificial Sequence
  chemically synthesized
tatgtgccgagaaggaggctgg

SEQ ID NO: 1199080 - DNA, 22 bp, Artificial Sequence
  chemically synthesized
tgacattgagcataaatcacca

SEQ ID NO: 1199081 - DNA, 22 bp, Artificial Sequence
  chemically synthesized
cactatgacattgagcataaat

SEQ ID NO: 1199082 - DNA, 22 bp, Artificial Sequence
  chemically synthesized
ttacactatgacattgagcata

SEQ ID NO: 1199083 - DNA, 22 bp, Artificial Sequence
  chemically synthesized
tattacactatgacattgagca

SEQ ID NO: 1199084 - DNA, 22 bp, Artificial Sequence
  chemically synthesized
gtgatttatgctcaatgtcata

SEQ ID NO: 1199085 - DNA, 22 bp, Artificial Sequence
  chemically synthesized
cagattctattacactatgaca

SEQ ID NO: 1199086 - DNA, 22 bp, Artificial Sequence
  chemically synthesized
ttacagattctattacactatg

SEQ ID NO: 1199087 - DNA, 22 bp, Artificial Sequence
  chemically synthesized
atgctcaatgtcatagtgtaat

SEQ ID NO: 1199088 - DNA, 22 bp, Artificial Sequence
  chemically synthesized
tgctcaatgtcatagtgtaata

SEQ ID NO: 1199089 - DNA, 22 bp, Artificial Sequence
  chemically synthesized
tgattattacagattctattac

SEQ ID NO: 1199090 - DNA, 22 bp, Artificial Sequence
  chemically synthesized
aatgtcatagtgtaatagaatc

SEQ ID NO: 1199091 - DNA, 22 bp, Artificial Sequence
  chemically synthesized
ttatgattattacagattctat

SEQ ID NO: 1199092 - DNA, 22 bp, Artificial Sequence
  chemically synthesized
cgttattatgattattacagat

SEQ ID NO: 1199093 - DNA, 22 bp, Artificial Sequence
  chemically synthesized
gcgttattatgattattacaga

SEQ ID NO: 1199094 - DNA, 22 bp, Artificial Sequence
  chemically synthesized
ttgcgttattatgattattaca

SEQ ID NO: 1199095 - DNA, 22 bp, Artificial Sequence
  chemically synthesized
cttgcgttattatgattattac

SEQ ID NO: 1199096 - DNA, 22 bp, Artificial Sequence
  chemically synthesized
tcttgcgttattatgattatta

SEQ ID NO: 1199097 - DNA, 22 bp, Artificial Sequence
  chemically synthesized
ttcttgcgttattatgattatt

SEQ ID NO: 1199098 - DNA, 22 bp, Artificial Sequence
  chemically synthesized
taataatcataataacgcaaga

SEQ ID NO: 1199099 - DNA, 22 bp, Artificial Sequence
  chemically synthesized
tgtccagtcatcagatttttct

SEQ ID NO: 1199100 - DNA, 22 bp, Artificial Sequence
  chemically synthesized
gctatgtccagtcatcagattt

SEQ ID NO: 1199101 - DNA, 22 bp, Artificial Sequence
  chemically synthesized
atgactggacatagctaatcac

SEQ ID NO: 1199102 - DNA, 22 bp, Artificial Sequence
  chemically synthesized
gtggcaatatccgtgtgattag

SEQ ID NO: 1199103 - DNA, 22 bp, Artificial Sequence
  chemically synthesized
agtggcaatatccgtgtgatta

SEQ ID NO: 1199104 - DNA, 22 bp, Artificial Sequence
  chemically synthesized
gacatagctaatcacacggata

SEQ ID NO: 1199105 - DNA, 22 bp, Artificial Sequence
  chemically synthesized
atcacacggatattgccactaa

SEQ ID NO: 1199106 - DNA, 22 bp, Artificial Sequence
  chemically synthesized
taaaatggaagtacatttagtg

SEQ ID NO: 1199107 - DNA, 22 bp, Artificial Sequence
  chemically synthesized
ttgtaaaatggaagtacattta

SEQ ID NO: 1199108 - DNA, 22 bp, Artificial Sequence
  chemically synthesized
attgtaaaatggaagtacattt

SEQ ID NO: 1199109 - DNA, 22 bp, Artificial Sequence
  chemically synthesized
tattgtaaaatggaagtacatt

SEQ ID NO: 1199110 - DNA, 22 bp, Artificial Sequence
  chemically synthesized
ccactaaatgtacttccatttt

SEQ ID NO: 1199111 - DNA, 22 bp, Artificial Sequence
  chemically synthesized
tcacatcgctttattgtaaaat

SEQ ID NO: 1199112 - DNA, 22 bp, Artificial Sequence
  chemically synthesized
aatgtacttccattttacaata

SEQ ID NO: 1199113 - DNA, 22 bp, Artificial Sequence
  chemically synthesized
atcacatcgctttattgtaaaa

SEQ ID NO: 1199114 - DNA, 22 bp, Artificial Sequence
  chemically synthesized
tatcacatcgctttattgtaaa

SEQ ID NO: 1199115 - DNA, 22 bp, Artificial Sequence
  chemically synthesized
tttatcacatcgctttattgta

SEQ ID NO: 1199116 - DNA, 22 bp, Artificial Sequence
  chemically synthesized
ccattttacaataaagcgatgt

SEQ ID NO: 1199117 - DNA, 22 bp, Artificial Sequence
  chemically synthesized
cattttacaataaagcgatgtg

SEQ ID NO: 1199118 - DNA, 22 bp, Artificial Sequence
  chemically synthesized
tacaataaagcgatgtgataaa

SEQ ID NO: 1199119 - DNA, 22 bp, Artificial Sequence
  chemically synthesized
acaataaagcgatgtgataaag

SEQ ID NO: 1199120 - DNA, 22 bp, Artificial Sequence
  chemically synthesized
caataaagcgatgtgataaaga

SEQ ID NO: 1199121 - DNA, 22 bp, Artificial Sequence
  chemically synthesized
aaagagtcatgattctttatca

SEQ ID NO: 1199122 - DNA, 22 bp, Artificial Sequence
  chemically synthesized
tcaaagagtcatgattctttat

SEQ ID NO: 1199123 - DNA, 22 bp, Artificial Sequence
  chemically synthesized
ccctctcaaagagtcatgattc

SEQ ID NO: 1199124 - DNA, 22 bp, Artificial Sequence
  chemically synthesized
ttgccctctcaaagagtcatga

SEQ ID NO: 1199125 - DNA, 22 bp, Artificial Sequence
  chemically synthesized
gaaatgtcagcgctgttgccct

SEQ ID NO: 1199126 - DNA, 22 bp, Artificial Sequence
  chemically synthesized
acctagaaatgtcagcgctgtt

SEQ ID NO: 1199127 - DNA, 22 bp, Artificial Sequence
  chemically synthesized
tttgagagggcaacagcgctga

SEQ ID NO: 1199128 - DNA, 22 bp, Artificial Sequence
  chemically synthesized
gacctagaaatgtcagcgctgt

SEQ ID NO: 1199129 - DNA, 22 bp, Artificial Sequence
  chemically synthesized
tgacctagaaatgtcagcgctg

SEQ ID NO: 1199130 - DNA, 22 bp, Artificial Sequence
  chemically synthesized
tgagagggcaacagcgctgaca

SEQ ID NO: 1199131 - DNA, 22 bp, Artificial Sequence
  chemically synthesized
ttgacctagaaatgtcagcgct

SEQ ID NO: 1199132 - DNA, 22 bp, Artificial Sequence
  chemically synthesized
gagagggcaacagcgctgacat

SEQ ID NO: 1199133 - DNA, 22 bp, Artificial Sequence
  chemically synthesized
agagggcaacagcgctgacatt

SEQ ID NO: 1199134 - DNA, 22 bp, Artificial Sequence
  chemically synthesized
atgaaaacttttgacctagaaa

SEQ ID NO: 1199135 - DNA, 22 bp, Artificial Sequence
  chemically synthesized
acatttctaggtcaaaagtttt

SEQ ID NO: 1199136 - DNA, 22 bp, Artificial Sequence
  chemically synthesized
cataatctcatgaaaacttttg

SEQ ID NO: 1199137 - DNA, 22 bp, Artificial Sequence
  chemically synthesized
ctaggtcaaaagttttcatgag

SEQ ID NO: 1199138 - DNA, 22 bp, Artificial Sequence
  chemically synthesized
taggtcaaaagttttcatgaga

SEQ ID NO: 1199139 - DNA, 22 bp, Artificial Sequence
  chemically synthesized
ggtactccataatctcatgaaa

SEQ ID NO: 1199140 - DNA, 22 bp, Artificial Sequence
  chemically synthesized
aggtactccataatctcatgaa

SEQ ID NO: 1199141 - DNA, 22 bp, Artificial Sequence
  chemically synthesized
ggtcaaaagttttcatgagatt

SEQ ID NO: 1199142 - DNA, 22 bp, Artificial Sequence
  chemically synthesized
tacatgtttaggtactccataa

SEQ ID NO: 1199143 - DNA, 22 bp, Artificial Sequence
  chemically synthesized
tcatgagattatggagtaccta

SEQ ID NO: 1199144 - DNA, 22 bp, Artificial Sequence
  chemically synthesized
attgtacatgtttaggtactcc

SEQ ID NO: 1199145 - DNA, 22 bp, Artificial Sequence
  chemically synthesized
catgagattatggagtacctaa

SEQ ID NO: 1199146 - DNA, 22 bp, Artificial Sequence
  chemically synthesized
atgagattatggagtacctaaa

SEQ ID NO: 1199147 - DNA, 22 bp, Artificial Sequence
  chemically synthesized
gaggctaattgtacatgtttag

SEQ ID NO: 1199148 - DNA, 22 bp, Artificial Sequence
  chemically synthesized
tggagtacctaaacatgtacaa

SEQ ID NO: 1199149 - DNA, 22 bp, Artificial Sequence
  chemically synthesized
aacatgtacaattagcctccag

SEQ ID NO: 1199150 - DNA, 22 bp, Artificial Sequence
  chemically synthesized
cagatgtgtgaacatctggagg

SEQ ID NO: 1199151 - DNA, 22 bp, Artificial Sequence
  chemically synthesized
gcctccagatgttcacacatct

SEQ ID NO: 1199152 - DNA, 22 bp, Artificial Sequence
  chemically synthesized
aaaaaatatattgcagatgtgt

SEQ ID NO: 1199153 - DNA, 22 bp, Artificial Sequence
  chemically synthesized
gaaaaaatatattgcagatgtg

SEQ ID NO: 1199154 - DNA, 22 bp, Artificial Sequence
  chemically synthesized
cagatgttcacacatctgcaat

SEQ ID NO: 1199155 - DNA, 22 bp, Artificial Sequence
  chemically synthesized
acacatctgcaatatatttttt

SEQ ID NO: 1199156 - DNA, 22 bp, Artificial Sequence
  chemically synthesized
caatatattttttcaaaccttt

SEQ ID NO: 1199157 - DNA, 22 bp, Artificial Sequence
  chemically synthesized
acagtgagtgacaaaggtttga

SEQ ID NO: 1199158 - DNA, 22 bp, Artificial Sequence
  chemically synthesized
actgacagtgagtgacaaaggt

SEQ ID NO: 1199159 - DNA, 22 bp, Artificial Sequence
  chemically synthesized
tttcaaacctttgtcactcact

SEQ ID NO: 1199160 - DNA, 22 bp, Artificial Sequence
  chemically synthesized
ttcaaacctttgtcactcactg

SEQ ID NO: 1199161 - DNA, 22 bp, Artificial Sequence
  chemically synthesized
tcaaacctttgtcactcactgt

SEQ ID NO: 1199162 - DNA, 22 bp, Artificial Sequence
  chemically synthesized
gaatcctaactgacagtgagtg

SEQ ID NO: 1199163 - DNA, 22 bp, Artificial Sequence
  chemically synthesized
caaacctttgtcactcactgtc

SEQ ID NO: 1199164 - DNA, 22 bp, Artificial Sequence
  chemically synthesized
cgaatcctaactgacagtgagt

SEQ ID NO: 1199165 - DNA, 22 bp, Artificial Sequence
  chemically synthesized
aaacctttgtcactcactgtca

SEQ ID NO: 1199166 - DNA, 22 bp, Artificial Sequence
  chemically synthesized
tgtcactcactgtcagttagga

SEQ ID NO: 1199167 - DNA, 22 bp, Artificial Sequence
  chemically synthesized
gtatgtttcgaatcctaactga

SEQ ID NO: 1199168 - DNA, 22 bp, Artificial Sequence
  chemically synthesized
gtcactcactgtcagttaggat

SEQ ID NO: 1199169 - DNA, 22 bp, Artificial Sequence
  chemically synthesized
agtatgtttcgaatcctaactg

SEQ ID NO: 1199170 - DNA, 22 bp, Artificial Sequence
  chemically synthesized
tcactcactgtcagttaggatt

SEQ ID NO: 1199171 - DNA, 22 bp, Artificial Sequence
  chemically synthesized
tagtatgtttcgaatcctaact

SEQ ID NO: 1199172 - DNA, 22 bp, Artificial Sequence
  chemically synthesized
actgtcagttaggattcgaaac

SEQ ID NO: 1199173 - DNA, 22 bp, Artificial Sequence
  chemically synthesized
tcagttaggattcgaaacatac

SEQ ID NO: 1199174 - DNA, 22 bp, Artificial Sequence
  chemically synthesized
ggattcgaaacatactaaagct

SEQ ID NO: 1199175 - DNA, 22 bp, Artificial Sequence
  chemically synthesized
aaaagggggagaaaagctttag

SEQ ID NO: 1199176 - DNA, 22 bp, Artificial Sequence
  chemically synthesized
aaaaagggggagaaaagcttta

SEQ ID NO: 1199177 - DNA, 22 bp, Artificial Sequence
  chemically synthesized
gaaacatactaaagcttttctc

SEQ ID NO: 1199178 - DNA, 22 bp, Artificial Sequence
  chemically synthesized
tgtttaaaaagggggagaaaag

SEQ ID NO: 1199179 - DNA, 22 bp, Artificial Sequence
  chemically synthesized
gtgtttaaaaagggggagaaaa

SEQ ID NO: 1199180 - DNA, 22 bp, Artificial Sequence
  chemically synthesized
tgtgtttaaaaagggggagaaa

SEQ ID NO: 1199181 - DNA, 22 bp, Artificial Sequence
  chemically synthesized
ggattttgtgtttaaaaagggg

SEQ ID NO: 1199182 - DNA, 22 bp, Artificial Sequence
  chemically synthesized
aagcttttctccccctttttaa

SEQ ID NO: 1199183 - DNA, 22 bp, Artificial Sequence
  chemically synthesized
aggattttgtgtttaaaaaggg

SEQ ID NO: 1199184 - DNA, 22 bp, Artificial Sequence
  chemically synthesized
taggattttgtgtttaaaaagg

SEQ ID NO: 1199185 - DNA, 22 bp, Artificial Sequence
  chemically synthesized
ttctccccctttttaaacacaa

SEQ ID NO: 1199186 - DNA, 22 bp, Artificial Sequence
  chemically synthesized
tctccccctttttaaacacaaa

SEQ ID NO: 1199187 - DNA, 22 bp, Artificial Sequence
  chemically synthesized
aagttttaggattttgtgttta

SEQ ID NO: 1199188 - DNA, 22 bp, Artificial Sequence
  chemically synthesized
ctccccctttttaaacacaaaa

SEQ ID NO: 1199189 - DNA, 22 bp, Artificial Sequence
  chemically synthesized
tccccctttttaaacacaaaat

SEQ ID NO: 1199190 - DNA, 22 bp, Artificial Sequence
  chemically synthesized
ctaaagttttaggattttgtgt

SEQ ID NO: 1199191 - DNA, 22 bp, Artificial Sequence
  chemically synthesized
cccctttttaaacacaaaatcc

SEQ ID NO: 1199192 - DNA, 22 bp, Artificial Sequence
  chemically synthesized
gctcctaaagttttaggatttt

SEQ ID NO: 1199193 - DNA, 22 bp, Artificial Sequence
  chemically synthesized
tttaaacacaaaatcctaaaac

SEQ ID NO: 1199194 - DNA, 22 bp, Artificial Sequence
  chemically synthesized
ttaaacacaaaatcctaaaact

SEQ ID NO: 1199195 - DNA, 22 bp, Artificial Sequence
  chemically synthesized
taaacacaaaatcctaaaactt

SEQ ID NO: 1199196 - DNA, 22 bp, Artificial Sequence
  chemically synthesized
aaacacaaaatcctaaaacttt

SEQ ID NO: 1199197 - DNA, 22 bp, Artificial Sequence
  chemically synthesized
aacacaaaatcctaaaacttta

SEQ ID NO: 1199198 - DNA, 22 bp, Artificial Sequence
  chemically synthesized
aaactttaggagccagacttgg

SEQ ID NO: 1199199 - DNA, 22 bp, Artificial Sequence
  chemically synthesized
taggagccagacttggcacata

SEQ ID NO: 1199200 - DNA, 22 bp, Artificial Sequence
  chemically synthesized
acgacaacaatatatgtgccaa

SEQ ID NO: 1199201 - DNA, 22 bp, Artificial Sequence
  chemically synthesized
aggagccagacttggcacatat

SEQ ID NO: 1199202 - DNA, 22 bp, Artificial Sequence
  chemically synthesized
aacgacaacaatatatgtgcca

SEQ ID NO: 1199203 - DNA, 22 bp, Artificial Sequence
  chemically synthesized
ggagccagacttggcacatata

SEQ ID NO: 1199204 - DNA, 22 bp, Artificial Sequence
  chemically synthesized
ggcacatatattgttgtcgtta

SEQ ID NO: 1199205 - DNA, 22 bp, Artificial Sequence
  chemically synthesized
gcacatatattgttgtcgttaa

SEQ ID NO: 1199206 - DNA, 22 bp, Artificial Sequence
  chemically synthesized
atggatatcaccttaacgacaa

SEQ ID NO: 1199207 - DNA, 22 bp, Artificial Sequence
  chemically synthesized
tggactcatggatatcacctta

SEQ ID NO: 1199208 - DNA, 22 bp, Artificial Sequence
  chemically synthesized
atggactcatggatatcacctt

SEQ ID NO: 1199209 - DNA, 22 bp, Artificial Sequence
  chemically synthesized
ttgtcgttaaggtgatatccat

SEQ ID NO: 1199210 - DNA, 22 bp, Artificial Sequence
  chemically synthesized
tcgttaaggtgatatccatgag

SEQ ID NO: 1199211 - DNA, 22 bp, Artificial Sequence
  chemically synthesized
atcgtcttatggactcatggat

SEQ ID NO: 1199212 - DNA, 22 bp, Artificial Sequence
  chemically synthesized
ttgatcgtcttatggactcatg

SEQ ID NO: 1199213 - DNA, 22 bp, Artificial Sequence
  chemically synthesized
aggtgatatccatgagtccata

SEQ ID NO: 1199214 - DNA, 22 bp, Artificial Sequence
  chemically synthesized
tacaatccagcagacagataag

SEQ ID NO: 1199215 - DNA, 22 bp, Artificial Sequence
  chemically synthesized
gtacaatccagcagacagataa

SEQ ID NO: 1199216 - DNA, 22 bp, Artificial Sequence
  chemically synthesized
tttgtacaatccagcagacaga

SEQ ID NO: 1199217 - DNA, 22 bp, Artificial Sequence
  chemically synthesized
tgtttgtacaatccagcagaca

SEQ ID NO: 1199218 - DNA, 22 bp, Artificial Sequence
  chemically synthesized
attctgtttgtacaatccagca

SEQ ID NO: 1199219 - DNA, 22 bp, Artificial Sequence
  chemically synthesized
ttaattctgtttgtacaatcca

SEQ ID NO: 1199220 - DNA, 22 bp, Artificial Sequence
  chemically synthesized
atctgtctgctggattgtacaa

SEQ ID NO: 1199221 - DNA, 22 bp, Artificial Sequence
  chemically synthesized
tctgtctgctggattgtacaaa

SEQ ID NO: 1199222 - DNA, 22 bp, Artificial Sequence
  chemically synthesized
tctgctggattgtacaaacaga

SEQ ID NO: 1199223 - DNA, 22 bp, Artificial Sequence
  chemically synthesized
aggcagctattaattctgtttg

SEQ ID NO: 1199224 - DNA, 22 bp, Artificial Sequence
  chemically synthesized
aaggcagctattaattctgttt

SEQ ID NO: 1199225 - DNA, 22 bp, Artificial Sequence
  chemically synthesized
ctggattgtacaaacagaatta

SEQ ID NO: 1199226 - DNA, 22 bp, Artificial Sequence
  chemically synthesized
gattgtacaaacagaattaata

SEQ ID NO: 1199227 - DNA, 22 bp, Artificial Sequence
  chemically synthesized
tcttaaggcagctattaattct

SEQ ID NO: 1199228 - DNA, 22 bp, Artificial Sequence
  chemically synthesized
tatcttaaggcagctattaatt

SEQ ID NO: 1199229 - DNA, 22 bp, Artificial Sequence
  chemically synthesized
tacaaacagaattaatagctgc

SEQ ID NO: 1199230 - DNA, 22 bp, Artificial Sequence
  chemically synthesized
agccaaactctatcttaaggca

SEQ ID NO: 1199231 - DNA, 22 bp, Artificial Sequence
  chemically synthesized
gttcagccaaactctatcttaa

SEQ ID NO: 1199232 - DNA, 22 bp, Artificial Sequence
  chemically synthesized
atagctgccttaagatagagtt

SEQ ID NO: 1199233 - DNA, 22 bp, Artificial Sequence
  chemically synthesized
ctcgttcagccaaactctatct

SEQ ID NO: 1199234 - DNA, 22 bp, Artificial Sequence
  chemically synthesized
ccttaagatagagtttggctga

SEQ ID NO: 1199235 - DNA, 22 bp, Artificial Sequence
  chemically synthesized
aagatagagtttggctgaacga

SEQ ID NO: 1199236 - DNA, 22 bp, Artificial Sequence
  chemically synthesized
agatagagtttggctgaacgag

SEQ ID NO: 1199237 - DNA, 22 bp, Artificial Sequence
  chemically synthesized
tatgcccagaagtactactcgt

SEQ ID NO: 1199238 - DNA, 22 bp, Artificial Sequence
  chemically synthesized
atatgcccagaagtactactcg

SEQ ID NO: 1199239 - DNA, 22 bp, Artificial Sequence
  chemically synthesized
ggctgaacgagtagtacttctg

SEQ ID NO: 1199240 - DNA, 22 bp, Artificial Sequence
  chemically synthesized
gctgaacgagtagtacttctgg

SEQ ID NO: 1199241 - DNA, 22 bp, Artificial Sequence
  chemically synthesized
aacgagtagtacttctgggcat

SEQ ID NO: 1199242 - DNA, 22 bp, Artificial Sequence
  chemically synthesized
aagtccatttatatgcccagaa

SEQ ID NO: 1199243 - DNA, 22 bp, Artificial Sequence
  chemically synthesized
tgaagtccatttatatgcccag

SEQ ID NO: 1199244 - DNA, 22 bp, Artificial Sequence
  chemically synthesized
tctgaagtccatttatatgccc

SEQ ID NO: 1199245 - DNA, 22 bp, Artificial Sequence
  chemically synthesized
ctctgaagtccatttatatgcc

SEQ ID NO: 1199246 - DNA, 22 bp, Artificial Sequence
  chemically synthesized
atggacttctctgaagtccatt

SEQ ID NO: 1199247 - DNA, 22 bp, Artificial Sequence
  chemically synthesized
ctgggcatataaatggacttca

SEQ ID NO: 1199248 - DNA, 22 bp, Artificial Sequence
  chemically synthesized
tgggcatataaatggacttcag

SEQ ID NO: 1199249 - DNA, 22 bp, Artificial Sequence
  chemically synthesized
ggcatataaatggacttcagag

SEQ ID NO: 1199250 - DNA, 22 bp, Artificial Sequence
  chemically synthesized
catatgataccagaaaattcat

SEQ ID NO: 1199251 - DNA, 22 bp, Artificial Sequence
  chemically synthesized
cagagaagtccatgaattttct

SEQ ID NO: 1199252 - DNA, 22 bp, Artificial Sequence
  chemically synthesized
gcatatgataccagaaaattca

SEQ ID NO: 1199253 - DNA, 22 bp, Artificial Sequence
  chemically synthesized
agagaagtccatgaattttctg

SEQ ID NO: 1199254 - DNA, 22 bp, Artificial Sequence
  chemically synthesized
tctggtatcatatgcaaattct

SEQ ID NO: 1199255 - DNA, 22 bp, Artificial Sequence
  chemically synthesized
tacaaacacaaaagaatttgca

SEQ ID NO: 1199256 - DNA, 22 bp, Artificial Sequence
  chemically synthesized
ctggtatcatatgcaaattctt

SEQ ID NO: 1199257 - DNA, 22 bp, Artificial Sequence
  chemically synthesized
gtacaaacacaaaagaatttgc

SEQ ID NO: 1199258 - DNA, 22 bp, Artificial Sequence
  chemically synthesized
tggtatcatatgcaaattcttt

SEQ ID NO: 1199259 - DNA, 22 bp, Artificial Sequence
  chemically synthesized
gtatcatatgcaaattcttttg

SEQ ID NO: 1199260 - DNA, 22 bp, Artificial Sequence
  chemically synthesized
atgcacatttgtacaaacacaa

SEQ ID NO: 1199261 - DNA, 22 bp, Artificial Sequence
  chemically synthesized
tcatgcacatttgtacaaacac

SEQ ID NO: 1199262 - DNA, 22 bp, Artificial Sequence
  chemically synthesized
gaccctctcatgcacatttgta

SEQ ID NO: 1199263 - DNA, 22 bp, Artificial Sequence
  chemically synthesized
ttttgtgtttgtacaaatgtgc

SEQ ID NO: 1199264 - DNA, 22 bp, Artificial Sequence
  chemically synthesized
ggaccctctcatgcacatttgt

SEQ ID NO: 1199265 - DNA, 22 bp, Artificial Sequence
  chemically synthesized
tggaccctctcatgcacatttg

SEQ ID NO: 1199266 - DNA, 22 bp, Artificial Sequence
  chemically synthesized
ttgtgtttgtacaaatgtgcat

SEQ ID NO: 1199267 - DNA, 22 bp, Artificial Sequence
  chemically synthesized
tgtgtttgtacaaatgtgcatg

SEQ ID NO: 1199268 - DNA, 22 bp, Artificial Sequence
  chemically synthesized
gtgtttgtacaaatgtgcatga

SEQ ID NO: 1199269 - DNA, 22 bp, Artificial Sequence
  chemically synthesized
tgtttgtacaaatgtgcatgag

SEQ ID NO: 1199270 - DNA, 22 bp, Artificial Sequence
  chemically synthesized
gtacaaatgtgcatgagagggt

SEQ ID NO: 1199271 - DNA, 22 bp, Artificial Sequence
  chemically synthesized
tacaaatgtgcatgagagggtc

SEQ ID NO: 1199272 - DNA, 22 bp, Artificial Sequence
  chemically synthesized
gagatatgacaaaagctttgga

SEQ ID NO: 1199273 - DNA, 22 bp, Artificial Sequence
  chemically synthesized
taccaattagagatatgacaaa

SEQ ID NO: 1199274 - DNA, 22 bp, Artificial Sequence
  chemically synthesized
gtattataccaattagagatat

SEQ ID NO: 1199275 - DNA, 22 bp, Artificial Sequence
  chemically synthesized
tgttggtattataccaattaga

SEQ ID NO: 1199276 - DNA, 22 bp, Artificial Sequence
  chemically synthesized
ttgtcatatctctaattggtat

SEQ ID NO: 1199277 - DNA, 22 bp, Artificial Sequence
  chemically synthesized
tgtcatatctctaattggtata

SEQ ID NO: 1199278 - DNA, 22 bp, Artificial Sequence
  chemically synthesized
gtcatatctctaattggtataa

SEQ ID NO: 1199279 - DNA, 22 bp, Artificial Sequence
  chemically synthesized
tcatatctctaattggtataat

SEQ ID NO: 1199280 - DNA, 22 bp, Artificial Sequence
  chemically synthesized
taattggtataataccaacaca

SEQ ID NO: 1199281 - DNA, 22 bp, Artificial Sequence
  chemically synthesized
tgcaaccaaatattgtgttggt

SEQ ID NO: 1199282 - DNA, 22 bp, Artificial Sequence
  chemically synthesized
attggtataataccaacacaat

SEQ ID NO: 1199283 - DNA, 22 bp, Artificial Sequence
  chemically synthesized
gtataataccaacacaatattt

SEQ ID NO: 1199284 - DNA, 22 bp, Artificial Sequence
  chemically synthesized
acaggactatgcaaccaaatat

SEQ ID NO: 1199285 - DNA, 22 bp, Artificial Sequence
  chemically synthesized
gtatattcacaggactatgcaa

SEQ ID NO: 1199286 - DNA, 22 bp, Artificial Sequence
  chemically synthesized
agtatattcacaggactatgca

SEQ ID NO: 1199287 - DNA, 22 bp, Artificial Sequence
  chemically synthesized
tagtatattcacaggactatgc

SEQ ID NO: 1199288 - DNA, 22 bp, Artificial Sequence
  chemically synthesized
ttagtatattcacaggactatg

SEQ ID NO: 1199289 - DNA, 22 bp, Artificial Sequence
  chemically synthesized
ggttgcatagtcctgtgaatat

SEQ ID NO: 1199290 - DNA, 22 bp, Artificial Sequence
  chemically synthesized
aatgtttttagtatattcacag

SEQ ID NO: 1199291 - DNA, 22 bp, Artificial Sequence
  chemically synthesized
gttgcatagtcctgtgaatata

SEQ ID NO: 1199292 - DNA, 22 bp, Artificial Sequence
  chemically synthesized
catagtcctgtgaatatactaa

SEQ ID NO: 1199293 - DNA, 22 bp, Artificial Sequence
  chemically synthesized
aagtatacaactcaatgttttt

SEQ ID NO: 1199294 - DNA, 22 bp, Artificial Sequence
  chemically synthesized
aaagtatacaactcaatgtttt

SEQ ID NO: 1199295 - DNA, 22 bp, Artificial Sequence
  chemically synthesized
tgaatatactaaaaacattgag

SEQ ID NO: 1199296 - DNA, 22 bp, Artificial Sequence
  chemically synthesized
tttaaagtatacaactcaatgt

SEQ ID NO: 1199297 - DNA, 22 bp, Artificial Sequence
  chemically synthesized
aaaacattgagttgtatacttt

SEQ ID NO: 1199298 - DNA, 22 bp, Artificial Sequence
  chemically synthesized
agttgtatactttaaacagatg

SEQ ID NO: 1199299 - DNA, 22 bp, Artificial Sequence
  chemically synthesized
tatgccatacaatcatctgttt

SEQ ID NO: 1199300 - DNA, 22 bp, Artificial Sequence
  chemically synthesized
atatgccatacaatcatctgtt

SEQ ID NO: 1199301 - DNA, 22 bp, Artificial Sequence
  chemically synthesized
tatactttaaacagatgattgt

SEQ ID NO: 1199302 - DNA, 22 bp, Artificial Sequence
  chemically synthesized
taaacagatgattgtatggcat

SEQ ID NO: 1199303 - DNA, 22 bp, Artificial Sequence
  chemically synthesized
aaacagatgattgtatggcata

SEQ ID NO: 1199304 - DNA, 22 bp, Artificial Sequence
  chemically synthesized
agatataatttatatgccatac

SEQ ID NO: 1199305 - DNA, 22 bp, Artificial Sequence
  chemically synthesized
aacagatgattgtatggcatat

SEQ ID NO: 1199306 - DNA, 22 bp, Artificial Sequence
  chemically synthesized
ttgagatataatttatatgcca

SEQ ID NO: 1199307 - DNA, 22 bp, Artificial Sequence
  chemically synthesized
attgagatataatttatatgcc

SEQ ID NO: 1199308 - DNA, 22 bp, Artificial Sequence
  chemically synthesized
tattgagatataatttatatgc

SEQ ID NO: 1199309 - DNA, 22 bp, Artificial Sequence
  chemically synthesized
tatggcatataaattatatctc

SEQ ID NO: 1199310 - DNA, 22 bp, Artificial Sequence
  chemically synthesized
aaatggaacagctttattgaga

SEQ ID NO: 1199311 - DNA, 22 bp, Artificial Sequence
  chemically synthesized
aaaatggaacagctttattgag

SEQ ID NO: 1199312 - DNA, 22 bp, Artificial Sequence
  chemically synthesized
tatctcaataaagctgttccat

SEQ ID NO: 1199313 - DNA, 22 bp, Artificial Sequence
  chemically synthesized
gtcatgtttaaaatggaacagc

SEQ ID NO: 1199314 - DNA, 22 bp, Artificial Sequence
  chemically synthesized
ggctagtcatgtttaaaatgga

SEQ ID NO: 1199315 - DNA, 22 bp, Artificial Sequence
  chemically synthesized
aataaagctgttccattttaaa

SEQ ID NO: 1199316 - DNA, 22 bp, Artificial Sequence
  chemically synthesized
taggctagtcatgtttaaaatg

SEQ ID NO: 1199317 - DNA, 22 bp, Artificial Sequence
  chemically synthesized
aaaggttctaggctagtcatgt

SEQ ID NO: 1199318 - DNA, 22 bp, Artificial Sequence
  chemically synthesized
ttccattttaaacatgactagc

SEQ ID NO: 1199319 - DNA, 22 bp, Artificial Sequence
  chemically synthesized
aaaaggttctaggctagtcatg

SEQ ID NO: 1199320 - DNA, 22 bp, Artificial Sequence
  chemically synthesized
cattttaaacatgactagccta

SEQ ID NO: 1199321 - DNA, 22 bp, Artificial Sequence
  chemically synthesized
tttaaaaggttctaggctagtc

SEQ ID NO: 1199322 - DNA, 22 bp, Artificial Sequence
  chemically synthesized
atttaaaaggttctaggctagt

SEQ ID NO: 1199323 - DNA, 22 bp, Artificial Sequence
  chemically synthesized
taaacatgactagcctagaacc

SEQ ID NO: 1199324 - DNA, 22 bp, Artificial Sequence
  chemically synthesized
aaacatgactagcctagaacct

SEQ ID NO: 1199325 - DNA, 22 bp, Artificial Sequence
  chemically synthesized
aacatgactagcctagaacctt

SEQ ID NO: 1199326 - DNA, 22 bp, Artificial Sequence
  chemically synthesized
acaagtttatttaaaaggttct

SEQ ID NO: 1199327 - DNA, 22 bp, Artificial Sequence
  chemically synthesized
cctaacaagtttatttaaaagg

SEQ ID NO: 1199328 - DNA, 22 bp, Artificial Sequence
  chemically synthesized
gcctaacaagtttatttaaaag

SEQ ID NO: 1199329 - DNA, 22 bp, Artificial Sequence
  chemically synthesized
tgcctaacaagtttatttaaaa

SEQ ID NO: 1199330 - DNA, 22 bp, Artificial Sequence
  chemically synthesized
ttgcctaacaagtttatttaaa

SEQ ID NO: 1199331 - DNA, 22 bp, Artificial Sequence
  chemically synthesized
gcctagaaccttttaaataaac

SEQ ID NO: 1199332 - DNA, 22 bp, Artificial Sequence
  chemically synthesized
aacttttgcctaacaagtttat

SEQ ID NO: 1199333 - DNA, 22 bp, Artificial Sequence
  chemically synthesized
gaaccttttaaataaacttgtt

SEQ ID NO: 1199334 - DNA, 22 bp, Artificial Sequence
  chemically synthesized
caacttttgcctaacaagttta

SEQ ID NO: 1199335 - DNA, 22 bp, Artificial Sequence
  chemically synthesized
ttaaataaacttgttaggcaaa

SEQ ID NO: 1199336 - DNA, 22 bp, Artificial Sequence
  chemically synthesized
taaataaacttgttaggcaaaa

SEQ ID NO: 1199337 - DNA, 22 bp, Artificial Sequence
  chemically synthesized
aaataaacttgttaggcaaaag

SEQ ID NO: 1199338 - DNA, 22 bp, Artificial Sequence
  chemically synthesized
aataaacttgttaggcaaaagt

SEQ ID NO: 1199339 - DNA, 22 bp, Artificial Sequence
  chemically synthesized
gttaggcaaaagttgaagccgc

SEQ ID NO: 1199340 - DNA, 22 bp, Artificial Sequence
  chemically synthesized
ttaggcaaaagttgaagccgct

SEQ ID NO: 1199341 - DNA, 22 bp, Artificial Sequence
  chemically synthesized
ggcaaaagttgaagccgcttga

SEQ ID NO: 1199342 - DNA, 22 bp, Artificial Sequence
  chemically synthesized
atagtaacataaacatcaagcg

SEQ ID NO: 1199343 - DNA, 22 bp, Artificial Sequence
  chemically synthesized
aagccgcttgatgtttatgtta

SEQ ID NO: 1199344 - DNA, 22 bp, Artificial Sequence
  chemically synthesized
caccaatctaatagtaacataa

SEQ ID NO: 1199345 - DNA, 22 bp, Artificial Sequence
  chemically synthesized
ttgcaccaatctaatagtaaca

SEQ ID NO: 1199346 - DNA, 22 bp, Artificial Sequence
  chemically synthesized
ctgttgcaccaatctaatagta

SEQ ID NO: 1199347 - DNA, 22 bp, Artificial Sequence
  chemically synthesized
gatgtttatgttactattagat

SEQ ID NO: 1199348 - DNA, 22 bp, Artificial Sequence
  chemically synthesized
atgtttatgttactattagatt

SEQ ID NO: 1199349 - DNA, 22 bp, Artificial Sequence
  chemically synthesized
atgttactattagattggtgca

SEQ ID NO: 1199350 - DNA, 22 bp, Artificial Sequence
  chemically synthesized
tgttactattagattggtgcaa

SEQ ID NO: 1199351 - DNA, 22 bp, Artificial Sequence
  chemically synthesized
ctattagattggtgcaacagta

SEQ ID NO: 1199352 - DNA, 22 bp, Artificial Sequence
  chemically synthesized
ttagattggtgcaacagtaatt

SEQ ID NO: 1199353 - DNA, 22 bp, Artificial Sequence
  chemically synthesized
gattggtgcaacagtaattgca

SEQ ID NO: 1199354 - DNA, 22 bp, Artificial Sequence
  chemically synthesized
aatggcaagaaaatgcaattac

SEQ ID NO: 1199355 - DNA, 22 bp, Artificial Sequence
  chemically synthesized
caatggcaagaaaatgcaatta

SEQ ID NO: 1199356 - DNA, 22 bp, Artificial Sequence
  chemically synthesized
tcaatggcaagaaaatgcaatt

SEQ ID NO: 1199357 - DNA, 22 bp, Artificial Sequence
  chemically synthesized
gtgcaacagtaattgcattttc

SEQ ID NO: 1199358 - DNA, 22 bp, Artificial Sequence
  chemically synthesized
ctttcaatggcaagaaaatgca

SEQ ID NO: 1199359 - DNA, 22 bp, Artificial Sequence
  chemically synthesized
ccattactttcaatggcaagaa

SEQ ID NO: 1199360 - DNA, 22 bp, Artificial Sequence
  chemically synthesized
gccattactttcaatggcaaga

SEQ ID NO: 1199361 - DNA, 22 bp, Artificial Sequence
  chemically synthesized
tgccattactttcaatggcaag

SEQ ID NO: 1199362 - DNA, 22 bp, Artificial Sequence
  chemically synthesized
ttgccattactttcaatggcaa

SEQ ID NO: 1199363 - DNA, 22 bp, Artificial Sequence
  chemically synthesized
cattttcttgccattgaaagta

SEQ ID NO: 1199364 - DNA, 22 bp, Artificial Sequence
  chemically synthesized
tcttgccattgaaagtaatggc

SEQ ID NO: 1199365 - DNA, 22 bp, Artificial Sequence
  chemically synthesized
cttgccattgaaagtaatggca

SEQ ID NO: 1199366 - DNA, 22 bp, Artificial Sequence
  chemically synthesized
ttgccattgaaagtaatggcaa

SEQ ID NO: 1199367 - DNA, 22 bp, Artificial Sequence
  chemically synthesized
gccattgaaagtaatggcaaaa

SEQ ID NO: 1199368 - DNA, 22 bp, Artificial Sequence
  chemically synthesized
ccattgaaagtaatggcaaaaa

SEQ ID NO: 1199369 - DNA, 22 bp, Artificial Sequence
  chemically synthesized
aaagtaatggcaaaaaccgtga

SEQ ID NO: 1199370 - DNA, 22 bp, Artificial Sequence
  chemically synthesized
gtgcaaaagtaatcacggtttt

SEQ ID NO: 1199371 - DNA, 22 bp, Artificial Sequence
  chemically synthesized
agttggtgcaaaagtaatcacg

SEQ ID NO: 1199372 - DNA, 22 bp, Artificial Sequence
  chemically synthesized
aaaatatattaagttggtgcaa

SEQ ID NO: 1199373 - DNA, 22 bp, Artificial Sequence
  chemically synthesized
taaaaatatattaagttggtgc

SEQ ID NO: 1199374 - DNA, 22 bp, Artificial Sequence
  chemically synthesized
cttttgcaccaacttaatatat

SEQ ID NO: 1199375 - DNA, 22 bp, Artificial Sequence
  chemically synthesized
ttgcaccaacttaatatatttt

SEQ ID NO: 1199376 - DNA, 22 bp, Artificial Sequence
  chemically synthesized
tgcaccaacttaatatattttt

SEQ ID NO: 1199377 - DNA, 22 bp, Artificial Sequence
  chemically synthesized
gcaccaacttaatatattttta

SEQ ID NO: 1199378 - DNA, 22 bp, Artificial Sequence
  chemically synthesized
caccaacttaatatatttttag

SEQ ID NO: 1199379 - DNA, 22 bp, Artificial Sequence
  chemically synthesized
acatggaacacacattctaaaa

SEQ ID NO: 1199380 - DNA, 22 bp, Artificial Sequence
  chemically synthesized
gacatggaacacacattctaaa

SEQ ID NO: 1199381 - DNA, 22 bp, Artificial Sequence
  chemically synthesized
aatatatttttagaatgtgtgt

SEQ ID NO: 1199382 - DNA, 22 bp, Artificial Sequence
  chemically synthesized
atatatttttagaatgtgtgtt

SEQ ID NO: 1199383 - DNA, 22 bp, Artificial Sequence
  chemically synthesized
gaccatttgacatggaacacac

SEQ ID NO: 1199384 - DNA, 22 bp, Artificial Sequence
  chemically synthesized
ttagaatgtgtgttccatgtca

SEQ ID NO: 1199385 - DNA, 22 bp, Artificial Sequence
  chemically synthesized
tagaatgtgtgttccatgtcaa

SEQ ID NO: 1199386 - DNA, 22 bp, Artificial Sequence
  chemically synthesized
agaatgtgtgttccatgtcaaa

SEQ ID NO: 1199387 - DNA, 22 bp, Artificial Sequence
  chemically synthesized
gaatgtgtgttccatgtcaaat

SEQ ID NO: 1199388 - DNA, 22 bp, Artificial Sequence
  chemically synthesized
agtcaagagttggaccatttga

SEQ ID NO: 1199389 - DNA, 22 bp, Artificial Sequence
  chemically synthesized
ggattgagtcaagagttggacc

SEQ ID NO: 1199390 - DNA, 22 bp, Artificial Sequence
  chemically synthesized
catgtcaaatggtccaactctt

SEQ ID NO: 1199391 - DNA, 22 bp, Artificial Sequence
  chemically synthesized
gttgggattgagtcaagagttg

SEQ ID NO: 1199392 - DNA, 22 bp, Artificial Sequence
  chemically synthesized
aacaggtcattagttgggattg

SEQ ID NO: 1199393 - DNA, 22 bp, Artificial Sequence
  chemically synthesized
ttgactcaatcccaactaatga

SEQ ID NO: 1199394 - DNA, 22 bp, Artificial Sequence
  chemically synthesized
gactcaatcccaactaatgacc

SEQ ID NO: 1199395 - DNA, 22 bp, Artificial Sequence
  chemically synthesized
actcaatcccaactaatgacct

SEQ ID NO: 1199396 - DNA, 22 bp, Artificial Sequence
  chemically synthesized
aatcccaactaatgacctgttc

SEQ ID NO: 1199397 - DNA, 22 bp, Artificial Sequence
  chemically synthesized
atgacctgttcagtgcccttga

SEQ ID NO: 1199398 - DNA, 22 bp, Artificial Sequence
  chemically synthesized
ttcagtgcccttgactatggtg

SEQ ID NO: 1199399 - DNA, 22 bp, Artificial Sequence
  chemically synthesized
agtgcccttgactatggtgccg

SEQ ID NO: 1199400 - DNA, 22 bp, Artificial Sequence
  chemically synthesized
gactatggtgccgtacacttgg

SEQ ID NO: 1199401 - DNA, 22 bp, Artificial Sequence
  chemically synthesized
actatggtgccgtacacttggc

SEQ ID NO: 1199402 - DNA, 22 bp, Artificial Sequence
  chemically synthesized
tggtgccgtacacttggctatg

SEQ ID NO: 1199403 - DNA, 22 bp, Artificial Sequence
  chemically synthesized
ggctatggtcatgccactatga

SEQ ID NO: 1199404 - DNA, 22 bp, Artificial Sequence
  chemically synthesized
gctatggtcatgccactatgat

SEQ ID NO: 1199405 - DNA, 22 bp, Artificial Sequence
  chemically synthesized
tgtaaccaggtcatcatagtgg

SEQ ID NO: 1199406 - DNA, 22 bp, Artificial Sequence
  chemically synthesized
tggtcatgccactatgatgacc

SEQ ID NO: 1199407 - DNA, 22 bp, Artificial Sequence
  chemically synthesized
tgatgacctggttacacagcta

SEQ ID NO: 1199408 - DNA, 22 bp, Artificial Sequence
  chemically synthesized
ccaaagggaatgggtggtagct

SEQ ID NO: 1199409 - DNA, 22 bp, Artificial Sequence
  chemically synthesized
ttaccaaagggaatgggtggta

SEQ ID NO: 1199410 - DNA, 22 bp, Artificial Sequence
  chemically synthesized
gttacacagctaccacccattc

SEQ ID NO: 1199411 - DNA, 22 bp, Artificial Sequence
  chemically synthesized
tctgttaccaaagggaatgggt

SEQ ID NO: 1199412 - DNA, 22 bp, Artificial Sequence
  chemically synthesized
cacagctaccacccattccctt

SEQ ID NO: 1199413 - DNA, 22 bp, Artificial Sequence
  chemically synthesized
ccacccattccctttggtaaca

SEQ ID NO: 1199414 - DNA, 22 bp, Artificial Sequence
  chemically synthesized
cctttggtaacagataacacac

SEQ ID NO: 1199415 - DNA, 22 bp, Artificial Sequence
  chemically synthesized
tggtaacagataacacaccatt

SEQ ID NO: 1199416 - DNA, 22 bp, Artificial Sequence
  chemically synthesized
ggtaacagataacacaccattc

SEQ ID NO: 1199417 - DNA, 22 bp, Artificial Sequence
  chemically synthesized
gtaacagataacacaccattct

SEQ ID NO: 1199418 - DNA, 22 bp, Artificial Sequence
  chemically synthesized
tgatattgtcactgcatcttct

SEQ ID NO: 1199419 - DNA, 22 bp, Artificial Sequence
  chemically synthesized
atattgtcactgcatcttctgg

SEQ ID NO: 1199420 - DNA, 22 bp, Artificial Sequence
  chemically synthesized
tagagtgatacaagccagaaga

SEQ ID NO: 1199421 - DNA, 22 bp, Artificial Sequence
  chemically synthesized
ctgtagagtgatacaagccaga

SEQ ID NO: 1199422 - DNA, 22 bp, Artificial Sequence
  chemically synthesized
tcactgcatcttctggcttgta

SEQ ID NO: 1199423 - DNA, 22 bp, Artificial Sequence
  chemically synthesized
catcttctggcttgtatcactc

SEQ ID NO: 1199424 - DNA, 22 bp, Artificial Sequence
  chemically synthesized
tgtcattactgtagagtgatac

SEQ ID NO: 1199425 - DNA, 22 bp, Artificial Sequence
  chemically synthesized
ctggcttgtatcactctacagt

SEQ ID NO: 1199426 - DNA, 22 bp, Artificial Sequence
  chemically synthesized
gattgtgtcattactgtagagt

SEQ ID NO: 1199427 - DNA, 22 bp, Artificial Sequence
  chemically synthesized
tggcttgtatcactctacagta

SEQ ID NO: 1199428 - DNA, 22 bp, Artificial Sequence
  chemically synthesized
gcttgtatcactctacagtaat

SEQ ID NO: 1199429 - DNA, 22 bp, Artificial Sequence
  chemically synthesized
gttggattgtgtcattactgta

SEQ ID NO: 1199430 - DNA, 22 bp, Artificial Sequence
  chemically synthesized
gtatcactctacagtaatgaca

SEQ ID NO: 1199431 - DNA, 22 bp, Artificial Sequence
  chemically synthesized
tatcactctacagtaatgacac

SEQ ID NO: 1199432 - DNA, 22 bp, Artificial Sequence
  chemically synthesized
tacagtaatgacacaatccaac

SEQ ID NO: 1199433 - DNA, 22 bp, Artificial Sequence
  chemically synthesized
cagtaatgacacaatccaacta

SEQ ID NO: 1199434 - DNA, 22 bp, Artificial Sequence
  chemically synthesized
aaaataaaagacatattagttg

SEQ ID NO: 1199435 - DNA, 22 bp, Artificial Sequence
  chemically synthesized
ctaaaaataaaagacatattag

SEQ ID NO: 1199436 - DNA, 22 bp, Artificial Sequence
  chemically synthesized
ctcctaaaaataaaagacatat

SEQ ID NO: 1199437 - DNA, 22 bp, Artificial Sequence
  chemically synthesized
cctcctaaaaataaaagacata

SEQ ID NO: 1199438 - DNA, 22 bp, Artificial Sequence
  chemically synthesized
tcctcctaaaaataaaagacat

SEQ ID NO: 1199439 - DNA, 22 bp, Artificial Sequence
  chemically synthesized
tttcctcctaaaaataaaagac

SEQ ID NO: 1199440 - DNA, 22 bp, Artificial Sequence
  chemically synthesized
atatgtcttttatttttaggag

SEQ ID NO: 1199441 - DNA, 22 bp, Artificial Sequence
  chemically synthesized
ttatttttaggaggaaagaatg

SEQ ID NO: 1199442 - DNA, 22 bp, Artificial Sequence
  chemically synthesized
tatttttaggaggaaagaatga

SEQ ID NO: 1199443 - DNA, 22 bp, Artificial Sequence
  chemically synthesized
atttttaggaggaaagaatgat

SEQ ID NO: 1199444 - DNA, 22 bp, Artificial Sequence
  chemically synthesized
tttttaggaggaaagaatgatg

SEQ ID NO: 1199445 - DNA, 22 bp, Artificial Sequence
  chemically synthesized
gaacggaataaacacatcattc

SEQ ID NO: 1199446 - DNA, 22 bp, Artificial Sequence
  chemically synthesized
ttaggaggaaagaatgatgtgt

SEQ ID NO: 1199447 - DNA, 22 bp, Artificial Sequence
  chemically synthesized
agaacggaataaacacatcatt

SEQ ID NO: 1199448 - DNA, 22 bp, Artificial Sequence
  chemically synthesized
taggaggaaagaatgatgtgtt

SEQ ID NO: 1199449 - DNA, 22 bp, Artificial Sequence
  chemically synthesized
tagaacggaataaacacatcat

SEQ ID NO: 1199450 - DNA, 22 bp, Artificial Sequence
  chemically synthesized
aggaggaaagaatgatgtgttt

SEQ ID NO: 1199451 - DNA, 22 bp, Artificial Sequence
  chemically synthesized
ggaggaaagaatgatgtgttta

SEQ ID NO: 1199452 - DNA, 22 bp, Artificial Sequence
  chemically synthesized
ttttagaacggaataaacacat

SEQ ID NO: 1199453 - DNA, 22 bp, Artificial Sequence
  chemically synthesized
attttagaacggaataaacaca

SEQ ID NO: 1199454 - DNA, 22 bp, Artificial Sequence
  chemically synthesized
tattttagaacggaataaacac

SEQ ID NO: 1199455 - DNA, 22 bp, Artificial Sequence
  chemically synthesized
gctttattttagaacggaataa

SEQ ID NO: 1199456 - DNA, 22 bp, Artificial Sequence
  chemically synthesized
ataaaaacattggctttatttt

SEQ ID NO: 1199457 - DNA, 22 bp, Artificial Sequence
  chemically synthesized
aataaaaacattggctttattt

SEQ ID NO: 1199458 - DNA, 22 bp, Artificial Sequence
  chemically synthesized
attccgttctaaaataaagcca

SEQ ID NO: 1199459 - DNA, 22 bp, Artificial Sequence
  chemically synthesized
ttccgttctaaaataaagccaa

SEQ ID NO: 1199460 - DNA, 22 bp, Artificial Sequence
  chemically synthesized
cgttctaaaataaagccaatgt

SEQ ID NO: 1199461 - DNA, 22 bp, Artificial Sequence
  chemically synthesized
taaaataaagccaatgttttta

SEQ ID NO: 1199462 - DNA, 22 bp, Artificial Sequence
  chemically synthesized
aaataaagccaatgtttttatt

SEQ ID NO: 1199463 - DNA, 22 bp, Artificial Sequence
  chemically synthesized
acatcccagtgggcacgaagaa

SEQ ID NO: 1199464 - DNA, 22 bp, Artificial Sequence
  chemically synthesized
ttattaaatattcttcgtgccc

SEQ ID NO: 1199465 - DNA, 22 bp, Artificial Sequence
  chemically synthesized
tattaaatattcttcgtgccca

SEQ ID NO: 1199466 - DNA, 22 bp, Artificial Sequence
  chemically synthesized
attaaatattcttcgtgcccac

SEQ ID NO: 1199467 - DNA, 22 bp, Artificial Sequence
  chemically synthesized
ttaaatattcttcgtgcccact

SEQ ID NO: 1199468 - DNA, 22 bp, Artificial Sequence
  chemically synthesized
gcattcacatcccagtgggcac

SEQ ID NO: 1199469 - DNA, 22 bp, Artificial Sequence
  chemically synthesized
aatattcttcgtgcccactggg

SEQ ID NO: 1199470 - DNA, 22 bp, Artificial Sequence
  chemically synthesized
ttggcattcacatcccagtggg

SEQ ID NO: 1199471 - DNA, 22 bp, Artificial Sequence
  chemically synthesized
tcctattggcattcacatccca

SEQ ID NO: 1199472 - DNA, 22 bp, Artificial Sequence
  chemically synthesized
ttcgtgcccactgggatgtgaa

SEQ ID NO: 1199473 - DNA, 22 bp, Artificial Sequence
  chemically synthesized
atcctattggcattcacatccc

SEQ ID NO: 1199474 - DNA, 22 bp, Artificial Sequence
  chemically synthesized
tatcctattggcattcacatcc

SEQ ID NO: 1199475 - DNA, 22 bp, Artificial Sequence
  chemically synthesized
cgtgcccactgggatgtgaatg

SEQ ID NO: 1199476 - DNA, 22 bp, Artificial Sequence
  chemically synthesized
gtgcccactgggatgtgaatgc

SEQ ID NO: 1199477 - DNA, 22 bp, Artificial Sequence
  chemically synthesized
atgtattttatcctattggcat

SEQ ID NO: 1199478 - DNA, 22 bp, Artificial Sequence
  chemically synthesized
tgatgtattttatcctattggc

SEQ ID NO: 1199479 - DNA, 22 bp, Artificial Sequence
  chemically synthesized
ggatgtgaatgccaataggata

SEQ ID NO: 1199480 - DNA, 22 bp, Artificial Sequence
  chemically synthesized
tctgatgtattttatcctattg

SEQ ID NO: 1199481 - DNA, 22 bp, Artificial Sequence
  chemically synthesized
ctctgatgtattttatcctatt

SEQ ID NO: 1199482 - DNA, 22 bp, Artificial Sequence
  chemically synthesized
ggcttctctgatgtattttatc

SEQ ID NO: 1199483 - DNA, 22 bp, Artificial Sequence
  chemically synthesized
aggcttctctgatgtattttat

SEQ ID NO: 1199484 - DNA, 22 bp, Artificial Sequence
  chemically synthesized
atggaatccttaggcttctctg

SEQ ID NO: 1199485 - DNA, 22 bp, Artificial Sequence
  chemically synthesized
tcatggaatccttaggcttctc

SEQ ID NO: 1199486 - DNA, 22 bp, Artificial Sequence
  chemically synthesized
ttctcatggaatccttaggctt

SEQ ID NO: 1199487 - DNA, 22 bp, Artificial Sequence
  chemically synthesized
gttctcatggaatccttaggct

SEQ ID NO: 1199488 - DNA, 22 bp, Artificial Sequence
  chemically synthesized
cttgttctcatggaatccttag

SEQ ID NO: 1199489 - DNA, 22 bp, Artificial Sequence
  chemically synthesized
attccttgttctcatggaatcc

SEQ ID NO: 1199490 - DNA, 22 bp, Artificial Sequence
  chemically synthesized
tctgattccttgttctcatgga

SEQ ID NO: 1199491 - DNA, 22 bp, Artificial Sequence
  chemically synthesized
gtctgattccttgttctcatgg

SEQ ID NO: 1199492 - DNA, 22 bp, Artificial Sequence
  chemically synthesized
cttgtctgattccttgttctca

SEQ ID NO: 1199493 - DNA, 22 bp, Artificial Sequence
  chemically synthesized
aggattccatgagaacaaggaa

SEQ ID NO: 1199494 - DNA, 22 bp, Artificial Sequence
  chemically synthesized
catgagaacaaggaatcagaca

SEQ ID NO: 1199495 - DNA, 22 bp, Artificial Sequence
  chemically synthesized
tggcacatgattacttgtctga

SEQ ID NO: 1199496 - DNA, 22 bp, Artificial Sequence
  chemically synthesized
tctgtggcacatgattacttgt

SEQ ID NO: 1199497 - DNA, 22 bp, Artificial Sequence
  chemically synthesized
agtctatctgtggcacatgatt

SEQ ID NO: 1199498 - DNA, 22 bp, Artificial Sequence
  chemically synthesized
caccagctgagtctatctgtgg

SEQ ID NO: 1199499 - DNA, 22 bp, Artificial Sequence
  chemically synthesized
ccaccagctgagtctatctgtg

SEQ ID NO: 1199500 - DNA, 22 bp, Artificial Sequence
  chemically synthesized
acttccaccagctgagtctatc

SEQ ID NO: 1199501 - DNA, 22 bp, Artificial Sequence
  chemically synthesized
cacttccaccagctgagtctat

SEQ ID NO: 1199502 - DNA, 22 bp, Artificial Sequence
  chemically synthesized
tcacttccaccagctgagtcta

SEQ ID NO: 1199503 - DNA, 22 bp, Artificial Sequence
  chemically synthesized
taatattttcacttccaccagc

SEQ ID NO: 1199504 - DNA, 22 bp, Artificial Sequence
  chemically synthesized
acctataatattttcacttcca

SEQ ID NO: 1199505 - DNA, 22 bp, Artificial Sequence
  chemically synthesized
gacctataatattttcacttcc

SEQ ID NO: 1199506 - DNA, 22 bp, Artificial Sequence
  chemically synthesized
agctggtggaagtgaaaatatt

SEQ ID NO: 1199507 - DNA, 22 bp, Artificial Sequence
  chemically synthesized
gtggaagtgaaaatattatagg

SEQ ID NO: 1199508 - DNA, 22 bp, Artificial Sequence
  chemically synthesized
tgaggcatcttgacctataata

SEQ ID NO: 1199509 - DNA, 22 bp, Artificial Sequence
  chemically synthesized
cctatgaggcatcttgacctat

SEQ ID NO: 1199510 - DNA, 22 bp, Artificial Sequence
  chemically synthesized
acctatgaggcatcttgaccta

SEQ ID NO: 1199511 - DNA, 22 bp, Artificial Sequence
  chemically synthesized
ttacctatgaggcatcttgacc

SEQ ID NO: 1199512 - DNA, 22 bp, Artificial Sequence
  chemically synthesized
ctcttacctatgaggcatcttg

SEQ ID NO: 1199513 - DNA, 22 bp, Artificial Sequence
  chemically synthesized
cctcttacctatgaggcatctt

SEQ ID NO: 1199514 - DNA, 22 bp, Artificial Sequence
  chemically synthesized
tcctcttacctatgaggcatct

SEQ ID NO: 1199515 - DNA, 22 bp, Artificial Sequence
  chemically synthesized
ttcctcttacctatgaggcatc

SEQ ID NO: 1199516 - DNA, 22 bp, Artificial Sequence
  chemically synthesized
taggtcaagatgcctcataggt

SEQ ID NO: 1199517 - DNA, 22 bp, Artificial Sequence
  chemically synthesized
gcatttttcctcttacctatga

SEQ ID NO: 1199518 - DNA, 22 bp, Artificial Sequence
  chemically synthesized
cctcgcatttttcctcttacct

SEQ ID NO: 1199519 - DNA, 22 bp, Artificial Sequence
  chemically synthesized
tacctcgcatttttcctcttac

SEQ ID NO: 1199520 - DNA, 22 bp, Artificial Sequence
  chemically synthesized
tctacctcgcatttttcctctt

SEQ ID NO: 1199521 - DNA, 22 bp, Artificial Sequence
  chemically synthesized
ctctacctcgcatttttcctct

SEQ ID NO: 1199522 - DNA, 22 bp, Artificial Sequence
  chemically synthesized
ataggtaagaggaaaaatgcga

SEQ ID NO: 1199523 - DNA, 22 bp, Artificial Sequence
  chemically synthesized
ccggtcttctctacctcgcatt

SEQ ID NO: 1199524 - DNA, 22 bp, Artificial Sequence
  chemically synthesized
actcccggtcttctctacctcg

SEQ ID NO: 1199525 - DNA, 22 bp, Artificial Sequence
  chemically synthesized
ttaactcccggtcttctctacc

SEQ ID NO: 1199526 - DNA, 22 bp, Artificial Sequence
  chemically synthesized
cactattaactcccggtcttct

SEQ ID NO: 1199527 - DNA, 22 bp, Artificial Sequence
  chemically synthesized
acactattaactcccggtcttc

SEQ ID NO: 1199528 - DNA, 22 bp, Artificial Sequence
  chemically synthesized
aacttacactattaactcccgg

SEQ ID NO: 1199529 - DNA, 22 bp, Artificial Sequence
  chemically synthesized
aaacttacactattaactcccg

SEQ ID NO: 1199530 - DNA, 22 bp, Artificial Sequence
  chemically synthesized
cccagcagcttaaacttacact

SEQ ID NO: 1199531 - DNA, 22 bp, Artificial Sequence
  chemically synthesized
gcccagcagcttaaacttacac

SEQ ID NO: 1199532 - DNA, 22 bp, Artificial Sequence
  chemically synthesized
ggccttgcccagcagcttaaac

SEQ ID NO: 1199533 - DNA, 22 bp, Artificial Sequence
  chemically synthesized
cggccttgcccagcagcttaaa

SEQ ID NO: 1199534 - DNA, 22 bp, Artificial Sequence
  chemically synthesized
atagtgtaagtttaagctgctg

SEQ ID NO: 1199535 - DNA, 22 bp, Artificial Sequence
  chemically synthesized
atgcttcggccttgcccagcag

SEQ ID NO: 1199536 - DNA, 22 bp, Artificial Sequence
  chemically synthesized
catgcttcggccttgcccagca

SEQ ID NO: 1199537 - DNA, 22 bp, Artificial Sequence
  chemically synthesized
aatatttcatgcttcggccttg

SEQ ID NO: 1199538 - DNA, 22 bp, Artificial Sequence
  chemically synthesized
aagctgctgggcaaggccgaag

SEQ ID NO: 1199539 - DNA, 22 bp, Artificial Sequence
  chemically synthesized
agctgctgggcaaggccgaagc

SEQ ID NO: 1199540 - DNA, 22 bp, Artificial Sequence
  chemically synthesized
tgaatatttcatgcttcggcct

SEQ ID NO: 1199541 - DNA, 22 bp, Artificial Sequence
  chemically synthesized
ctgaatatttcatgcttcggcc

SEQ ID NO: 1199542 - DNA, 22 bp, Artificial Sequence
  chemically synthesized
ctgggcaaggccgaagcatgaa

SEQ ID NO: 1199543 - DNA, 22 bp, Artificial Sequence
  chemically synthesized
ggcaaggccgaagcatgaaata

SEQ ID NO: 1199544 - DNA, 22 bp, Artificial Sequence
  chemically synthesized
tgtatcccttctgaatatttca

SEQ ID NO: 1199545 - DNA, 22 bp, Artificial Sequence
  chemically synthesized
ggtgtctgtgtatcccttctga

SEQ ID NO: 1199546 - DNA, 22 bp, Artificial Sequence
  chemically synthesized
gggtgtctgtgtatcccttctg

SEQ ID NO: 1199547 - DNA, 22 bp, Artificial Sequence
  chemically synthesized
gcttgggtgtctgtgtatccct

SEQ ID NO: 1199548 - DNA, 22 bp, Artificial Sequence
  chemically synthesized
agcttgggtgtctgtgtatccc

SEQ ID NO: 1199549 - DNA, 22 bp, Artificial Sequence
  chemically synthesized
tagcttgggtgtctgtgtatcc

SEQ ID NO: 1199550 - DNA, 22 bp, Artificial Sequence
  chemically synthesized
agaagggatacacagacaccca

SEQ ID NO: 1199551 - DNA, 22 bp, Artificial Sequence
  chemically synthesized
tccagatgagctttagcttggg

SEQ ID NO: 1199552 - DNA, 22 bp, Artificial Sequence
  chemically synthesized
tgattgtccagatgagctttag

SEQ ID NO: 1199553 - DNA, 22 bp, Artificial Sequence
  chemically synthesized
gtgattgtccagatgagcttta

SEQ ID NO: 1199554 - DNA, 22 bp, Artificial Sequence
  chemically synthesized
aacccttgtgattgtccagatg

SEQ ID NO: 1199555 - DNA, 22 bp, Artificial Sequence
  chemically synthesized
taaacccttgtgattgtccaga

SEQ ID NO: 1199556 - DNA, 22 bp, Artificial Sequence
  chemically synthesized
ctctaaacccttgtgattgtcc

SEQ ID NO: 1199557 - DNA, 22 bp, Artificial Sequence
  chemically synthesized
aagctcatctggacaatcacaa

SEQ ID NO: 1199558 - DNA, 22 bp, Artificial Sequence
  chemically synthesized
tcctctaaacccttgtgattgt

SEQ ID NO: 1199559 - DNA, 22 bp, Artificial Sequence
  chemically synthesized
ctctcctctaaacccttgtgat

SEQ ID NO: 1199560 - DNA, 22 bp, Artificial Sequence
  chemically synthesized
actctcctctaaacccttgtga

SEQ ID NO: 1199561 - DNA, 22 bp, Artificial Sequence
  chemically synthesized
atctggacaatcacaagggttt

SEQ ID NO: 1199562 - DNA, 22 bp, Artificial Sequence
  chemically synthesized
gacaatcacaagggtttagagg

SEQ ID NO: 1199563 - DNA, 22 bp, Artificial Sequence
  chemically synthesized
tcccatttactctcctctaaac

SEQ ID NO: 1199564 - DNA, 22 bp, Artificial Sequence
  chemically synthesized
gtcccatttactctcctctaaa

SEQ ID NO: 1199565 - DNA, 22 bp, Artificial Sequence
  chemically synthesized
tgtcccatttactctcctctaa

SEQ ID NO: 1199566 - DNA, 22 bp, Artificial Sequence
  chemically synthesized
ttgtcccatttactctcctcta

SEQ ID NO: 1199567 - DNA, 22 bp, Artificial Sequence
  chemically synthesized
ttttgtcccatttactctcctc

SEQ ID NO: 1199568 - DNA, 22 bp, Artificial Sequence
  chemically synthesized
attcttttgtcccatttactct

SEQ ID NO: 1199569 - DNA, 22 bp, Artificial Sequence
  chemically synthesized
ctgattcttttgtcccatttac

SEQ ID NO: 1199570 - DNA, 22 bp, Artificial Sequence
  chemically synthesized
agaggagagtaaatgggacaaa

SEQ ID NO: 1199571 - DNA, 22 bp, Artificial Sequence
  chemically synthesized
attcctgattcttttgtcccat

SEQ ID NO: 1199572 - DNA, 22 bp, Artificial Sequence
  chemically synthesized
gaggagagtaaatgggacaaaa

SEQ ID NO: 1199573 - DNA, 22 bp, Artificial Sequence
  chemically synthesized
ggtctcattcctgattcttttg

SEQ ID NO: 1199574 - DNA, 22 bp, Artificial Sequence
  chemically synthesized
aggtctcattcctgattctttt

SEQ ID NO: 1199575 - DNA, 22 bp, Artificial Sequence
  chemically synthesized
cttaggtctcattcctgattct

SEQ ID NO: 1199576 - DNA, 22 bp, Artificial Sequence
  chemically synthesized
attgcttaggtctcattcctga

SEQ ID NO: 1199577 - DNA, 22 bp, Artificial Sequence
  chemically synthesized
tcattgcttaggtctcattcct

SEQ ID NO: 1199578 - DNA, 22 bp, Artificial Sequence
  chemically synthesized
ctcattgcttaggtctcattcc

SEQ ID NO: 1199579 - DNA, 22 bp, Artificial Sequence
  chemically synthesized
tctcattgcttaggtctcattc

SEQ ID NO: 1199580 - DNA, 22 bp, Artificial Sequence
  chemically synthesized
ccattttctcattgcttaggtc

SEQ ID NO: 1199581 - DNA, 22 bp, Artificial Sequence
  chemically synthesized
cccattttctcattgcttaggt

SEQ ID NO: 1199582 - DNA, 22 bp, Artificial Sequence
  chemically synthesized
cttcccattttctcattgctta

SEQ ID NO: 1199583 - DNA, 22 bp, Artificial Sequence
  chemically synthesized
acttcccattttctcattgctt

SEQ ID NO: 1199584 - DNA, 22 bp, Artificial Sequence
  chemically synthesized
ataatttacttcccattttctc

SEQ ID NO: 1199585 - DNA, 22 bp, Artificial Sequence
  chemically synthesized
cataatttacttcccattttct

SEQ ID NO: 1199586 - DNA, 22 bp, Artificial Sequence
  chemically synthesized
agcaatgagaaaatgggaagta

SEQ ID NO: 1199587 - DNA, 22 bp, Artificial Sequence
  chemically synthesized
tatcttcataatttacttccca

SEQ ID NO: 1199588 - DNA, 22 bp, Artificial Sequence
  chemically synthesized
gtatcttcataatttacttccc

SEQ ID NO: 1199589 - DNA, 22 bp, Artificial Sequence
  chemically synthesized
ccttgtatcttcataatttact

SEQ ID NO: 1199590 - DNA, 22 bp, Artificial Sequence
  chemically synthesized
tgttgccttgtatcttcataat

SEQ ID NO: 1199591 - DNA, 22 bp, Artificial Sequence
  chemically synthesized
cccaatgtctgtgttgccttgt

SEQ ID NO: 1199592 - DNA, 22 bp, Artificial Sequence
  chemically synthesized
ctgcccaatgtctgtgttgcct

SEQ ID NO: 1199593 - DNA, 22 bp, Artificial Sequence
  chemically synthesized
tgaagatacaaggcaacacaga

SEQ ID NO: 1199594 - DNA, 22 bp, Artificial Sequence
  chemically synthesized
tacctactgcccaatgtctgtg

SEQ ID NO: 1199595 - DNA, 22 bp, Artificial Sequence
  chemically synthesized
atacctactgcccaatgtctgt

SEQ ID NO: 1199596 - DNA, 22 bp, Artificial Sequence
  chemically synthesized
cttatacctactgcccaatgtc

SEQ ID NO: 1199597 - DNA, 22 bp, Artificial Sequence
  chemically synthesized
ccttatacctactgcccaatgt

SEQ ID NO: 1199598 - DNA, 22 bp, Artificial Sequence
  chemically synthesized
tccttatacctactgcccaatg

SEQ ID NO: 1199599 - DNA, 22 bp, Artificial Sequence
  chemically synthesized
ttccttatacctactgcccaat

SEQ ID NO: 1199600 - DNA, 22 bp, Artificial Sequence
  chemically synthesized
tttccttatacctactgcccaa

SEQ ID NO: 1199601 - DNA, 22 bp, Artificial Sequence
  chemically synthesized
gccccagcctttttccttatac

SEQ ID NO: 1199602 - DNA, 22 bp, Artificial Sequence
  chemically synthesized
ggccccagcctttttccttata

SEQ ID NO: 1199603 - DNA, 22 bp, Artificial Sequence
  chemically synthesized
ttggccccagcctttttcctta

SEQ ID NO: 1199604 - DNA, 22 bp, Artificial Sequence
  chemically synthesized
ggcagtaggtataaggaaaaag

SEQ ID NO: 1199605 - DNA, 22 bp, Artificial Sequence
  chemically synthesized
attcttggccccagcctttttc

SEQ ID NO: 1199606 - DNA, 22 bp, Artificial Sequence
  chemically synthesized
gattcttggccccagccttttt

SEQ ID NO: 1199607 - DNA, 22 bp, Artificial Sequence
  chemically synthesized
gggccaagaatcaaggctttgg

SEQ ID NO: 1199608 - DNA, 22 bp, Artificial Sequence
  chemically synthesized
tcaaatatcacacatatgggaa

SEQ ID NO: 1199609 - DNA, 22 bp, Artificial Sequence
  chemically synthesized
gtcaaatatcacacatatggga

SEQ ID NO: 1199610 - DNA, 22 bp, Artificial Sequence
  chemically synthesized
tggcctgcttcccatatgtgtg

SEQ ID NO: 1199611 - DNA, 22 bp, Artificial Sequence
  chemically synthesized
cttgtcaaatatcacacatatg

SEQ ID NO: 1199612 - DNA, 22 bp, Artificial Sequence
  chemically synthesized
ggcctgcttcccatatgtgtga

SEQ ID NO: 1199613 - DNA, 22 bp, Artificial Sequence
  chemically synthesized
acttgtcaaatatcacacatat

SEQ ID NO: 1199614 - DNA, 22 bp, Artificial Sequence
  chemically synthesized
gcctgcttcccatatgtgtgat

SEQ ID NO: 1199615 - DNA, 22 bp, Artificial Sequence
  chemically synthesized
cttacttgtcaaatatcacaca

SEQ ID NO: 1199616 - DNA, 22 bp, Artificial Sequence
  chemically synthesized
cttcccatatgtgtgatatttg

SEQ ID NO: 1199617 - DNA, 22 bp, Artificial Sequence
  chemically synthesized
cccatatgtgtgatatttgaca

SEQ ID NO: 1199618 - DNA, 22 bp, Artificial Sequence
  chemically synthesized
ccatatgtgtgatatttgacaa

SEQ ID NO: 1199619 - DNA, 22 bp, Artificial Sequence
  chemically synthesized
gaaaagattacttacttgtcaa

SEQ ID NO: 1199620 - DNA, 22 bp, Artificial Sequence
  chemically synthesized
cgaaaagattacttacttgtca

SEQ ID NO: 1199621 - DNA, 22 bp, Artificial Sequence
  chemically synthesized
gacaagtaagtaatcttttcga

SEQ ID NO: 1199622 - DNA, 22 bp, Artificial Sequence
  chemically synthesized
acaagtaagtaatcttttcgaa

SEQ ID NO: 1199623 - DNA, 22 bp, Artificial Sequence
  chemically synthesized
cagaagagaacatgaaaatttc

SEQ ID NO: 1199624 - DNA, 22 bp, Artificial Sequence
  chemically synthesized
acagaagagaacatgaaaattt

SEQ ID NO: 1199625 - DNA, 22 bp, Artificial Sequence
  chemically synthesized
tacagaagagaacatgaaaatt

SEQ ID NO: 1199626 - DNA, 22 bp, Artificial Sequence
  chemically synthesized
ttcgaaattttcatgttctctt

SEQ ID NO: 1199627 - DNA, 22 bp, Artificial Sequence
  chemically synthesized
tcgaaattttcatgttctcttc

SEQ ID NO: 1199628 - DNA, 22 bp, Artificial Sequence
  chemically synthesized
cgaaattttcatgttctcttct

SEQ ID NO: 1199629 - DNA, 22 bp, Artificial Sequence
  chemically synthesized
gaaattttcatgttctcttctg

SEQ ID NO: 1199630 - DNA, 22 bp, Artificial Sequence
  chemically synthesized
atgtaacaattttacagaagag

SEQ ID NO: 1199631 - DNA, 22 bp, Artificial Sequence
  chemically synthesized
ttcatgtaacaattttacagaa

SEQ ID NO: 1199632 - DNA, 22 bp, Artificial Sequence
  chemically synthesized
tcatgttctcttctgtaaaatt

SEQ ID NO: 1199633 - DNA, 22 bp, Artificial Sequence
  chemically synthesized
catgttctcttctgtaaaattg

SEQ ID NO: 1199634 - DNA, 22 bp, Artificial Sequence
  chemically synthesized
atgttctcttctgtaaaattgt

SEQ ID NO: 1199635 - DNA, 22 bp, Artificial Sequence
  chemically synthesized
aataaattattcatgtaacaat

SEQ ID NO: 1199636 - DNA, 22 bp, Artificial Sequence
  chemically synthesized
tcttctgtaaaattgttacatg

SEQ ID NO: 1199637 - DNA, 22 bp, Artificial Sequence
  chemically synthesized
ttctgtaaaattgttacatgaa

SEQ ID NO: 1199638 - DNA, 22 bp, Artificial Sequence
  chemically synthesized
ctgtaaaattgttacatgaata

SEQ ID NO: 1199639 - DNA, 22 bp, Artificial Sequence
  chemically synthesized
tgtaaaattgttacatgaataa

SEQ ID NO: 1199640 - DNA, 22 bp, Artificial Sequence
  chemically synthesized
taaaattgttacatgaataatt

SEQ ID NO: 1199641 - DNA, 22 bp, Artificial Sequence
  chemically synthesized
cagtgaggattaaataaattat

SEQ ID NO: 1199642 - DNA, 22 bp, Artificial Sequence
  chemically synthesized
ttacatgaataatttatttaat

SEQ ID NO: 1199643 - DNA, 22 bp, Artificial Sequence
  chemically synthesized
catgaataatttatttaatcct

SEQ ID NO: 1199644 - DNA, 22 bp, Artificial Sequence
  chemically synthesized
catcgtaggattgcagtgagga

SEQ ID NO: 1199645 - DNA, 22 bp, Artificial Sequence
  chemically synthesized
atttaatcctcactgcaatcct

SEQ ID NO: 1199646 - DNA, 22 bp, Artificial Sequence
  chemically synthesized
tttaatcctcactgcaatccta

SEQ ID NO: 1199647 - DNA, 22 bp, Artificial Sequence
  chemically synthesized
aatcctcactgcaatcctacga

SEQ ID NO: 1199648 - DNA, 22 bp, Artificial Sequence
  chemically synthesized
atcctcactgcaatcctacgat

SEQ ID NO: 1199649 - DNA, 22 bp, Artificial Sequence
  chemically synthesized
actgcaatcctacgatgtagat

SEQ ID NO: 1199650 - DNA, 22 bp, Artificial Sequence
  chemically synthesized
caatcctacgatgtagatacta

SEQ ID NO: 1199651 - DNA, 22 bp, Artificial Sequence
  chemically synthesized
taaaatggggatcataatagta

SEQ ID NO: 1199652 - DNA, 22 bp, Artificial Sequence
  chemically synthesized
cgatgtagatactattatgatc

SEQ ID NO: 1199653 - DNA, 22 bp, Artificial Sequence
  chemically synthesized
atctgtaaaatggggatcataa

SEQ ID NO: 1199654 - DNA, 22 bp, Artificial Sequence
  chemically synthesized
catctgtaaaatggggatcata

SEQ ID NO: 1199655 - DNA, 22 bp, Artificial Sequence
  chemically synthesized
ttcatctgtaaaatggggatca

SEQ ID NO: 1199656 - DNA, 22 bp, Artificial Sequence
  chemically synthesized
cttcatctgtaaaatggggatc

SEQ ID NO: 1199657 - DNA, 22 bp, Artificial Sequence
  chemically synthesized
gtttcttcatctgtaaaatggg

SEQ ID NO: 1199658 - DNA, 22 bp, Artificial Sequence
  chemically synthesized
cgtttcttcatctgtaaaatgg

SEQ ID NO: 1199659 - DNA, 22 bp, Artificial Sequence
  chemically synthesized
ttatgatccccattttacagat

SEQ ID NO: 1199660 - DNA, 22 bp, Artificial Sequence
  chemically synthesized
gccttcgtttcttcatctgtaa

SEQ ID NO: 1199661 - DNA, 22 bp, Artificial Sequence
  chemically synthesized
tgatccccattttacagatgaa

SEQ ID NO: 1199662 - DNA, 22 bp, Artificial Sequence
  chemically synthesized
ggccttcgtttcttcatctgta

SEQ ID NO: 1199663 - DNA, 22 bp, Artificial Sequence
  chemically synthesized
ttggccttcgtttcttcatctg

SEQ ID NO: 1199664 - DNA, 22 bp, Artificial Sequence
  chemically synthesized
tcttggccttcgtttcttcatc

SEQ ID NO: 1199665 - DNA, 22 bp, Artificial Sequence
  chemically synthesized
tcctctcttggccttcgtttct

SEQ ID NO: 1199666 - DNA, 22 bp, Artificial Sequence
  chemically synthesized
atcctctcttggccttcgtttc

SEQ ID NO: 1199667 - DNA, 22 bp, Artificial Sequence
  chemically synthesized
tacagatgaagaaacgaaggcc

SEQ ID NO: 1199668 - DNA, 22 bp, Artificial Sequence
  chemically synthesized
acagatgaagaaacgaaggcca

SEQ ID NO: 1199669 - DNA, 22 bp, Artificial Sequence
  chemically synthesized
cttatcctctcttggccttcgt

SEQ ID NO: 1199670 - DNA, 22 bp, Artificial Sequence
  chemically synthesized
cagatgaagaaacgaaggccaa

SEQ ID NO: 1199671 - DNA, 22 bp, Artificial Sequence
  chemically synthesized
acttatcctctcttggccttcg

SEQ ID NO: 1199672 - DNA, 22 bp, Artificial Sequence
  chemically synthesized
gcaacttacttatcctctcttg

SEQ ID NO: 1199673 - DNA, 22 bp, Artificial Sequence
  chemically synthesized
tggcaacttacttatcctctct

SEQ ID NO: 1199674 - DNA, 22 bp, Artificial Sequence
  chemically synthesized
gcagtgtgatctctggcaactt

SEQ ID NO: 1199675 - DNA, 22 bp, Artificial Sequence
  chemically synthesized
ctagcagtgtgatctctggcaa

SEQ ID NO: 1199676 - DNA, 22 bp, Artificial Sequence
  chemically synthesized
actagcagtgtgatctctggca

SEQ ID NO: 1199677 - DNA, 22 bp, Artificial Sequence
  chemically synthesized
ccatttactagcagtgtgatct

SEQ ID NO: 1199678 - DNA, 22 bp, Artificial Sequence
  chemically synthesized
gccatttactagcagtgtgatc

SEQ ID NO: 1199679 - DNA, 22 bp, Artificial Sequence
  chemically synthesized
tgccatttactagcagtgtgat

SEQ ID NO: 1199680 - DNA, 22 bp, Artificial Sequence
  chemically synthesized
cattttgccatttactagcagt

SEQ ID NO: 1199681 - DNA, 22 bp, Artificial Sequence
  chemically synthesized
ccagagatcacactgctagtaa

SEQ ID NO: 1199682 - DNA, 22 bp, Artificial Sequence
  chemically synthesized
aatctccattttgccatttact

SEQ ID NO: 1199683 - DNA, 22 bp, Artificial Sequence
  chemically synthesized
gaatctccattttgccatttac

SEQ ID NO: 1199684 - DNA, 22 bp, Artificial Sequence
  chemically synthesized
ctagtaaatggcaaaatggaga

SEQ ID NO: 1199685 - DNA, 22 bp, Artificial Sequence
  chemically synthesized
atggggtttgaatctccatttt

SEQ ID NO: 1199686 - DNA, 22 bp, Artificial Sequence
  chemically synthesized
gtaaatggcaaaatggagattc

SEQ ID NO: 1199687 - DNA, 22 bp, Artificial Sequence
  chemically synthesized
aaaccccattaggctggtgctg

SEQ ID NO: 1199688 - DNA, 22 bp, Artificial Sequence
  chemically synthesized
agaggaagagacagggtatcat

SEQ ID NO: 1199689 - DNA, 22 bp, Artificial Sequence
  chemically synthesized
ggctggtgctgatgataccctg

SEQ ID NO: 1199690 - DNA, 22 bp, Artificial Sequence
  chemically synthesized
gtgctgatgataccctgtctct

SEQ ID NO: 1199691 - DNA, 22 bp, Artificial Sequence
  chemically synthesized
atgataccctgtctcttcctct

SEQ ID NO: 1199692 - DNA, 22 bp, Artificial Sequence
  chemically synthesized
aaatgcgaaggactcagaggaa

SEQ ID NO: 1199693 - DNA, 22 bp, Artificial Sequence
  chemically synthesized
tctcttcctctgagtccttcgc

SEQ ID NO: 1199694 - DNA, 22 bp, Artificial Sequence
  chemically synthesized
ttcctctgagtccttcgcattt

SEQ ID NO: 1199695 - DNA, 22 bp, Artificial Sequence
  chemically synthesized
cctctgagtccttcgcatttca

SEQ ID NO: 1199696 - DNA, 22 bp, Artificial Sequence
  chemically synthesized
ctctgagtccttcgcatttcag

SEQ ID NO: 1199697 - DNA, 22 bp, Artificial Sequence
  chemically synthesized
gaacaatgtccactgaaatgcg

SEQ ID NO: 1199698 - DNA, 22 bp, Artificial Sequence
  chemically synthesized
tgagtccttcgcatttcagtgg

SEQ ID NO: 1199699 - DNA, 22 bp, Artificial Sequence
  chemically synthesized
agtccttcgcatttcagtggac

SEQ ID NO: 1199700 - DNA, 22 bp, Artificial Sequence
  chemically synthesized
cgcatttcagtggacattgttc

SEQ ID NO: 1199701 - DNA, 22 bp, Artificial Sequence
  chemically synthesized
gcatttcagtggacattgttcc

SEQ ID NO: 1199702 - DNA, 22 bp, Artificial Sequence
  chemically synthesized
gcaggtggaagttggaacaatg

SEQ ID NO: 1199703 - DNA, 22 bp, Artificial Sequence
  chemically synthesized
cagtggacattgttccaacttc

SEQ ID NO: 1199704 - DNA, 22 bp, Artificial Sequence
  chemically synthesized
agtggacattgttccaacttcc

SEQ ID NO: 1199705 - DNA, 22 bp, Artificial Sequence
  chemically synthesized
ttccaacttccacctgccagct

SEQ ID NO: 1199706 - DNA, 22 bp, Artificial Sequence
  chemically synthesized
caacttccacctgccagctcct

SEQ ID NO: 1199707 - DNA, 22 bp, Artificial Sequence
  chemically synthesized
ccacctgccagctcctgcatct

SEQ ID NO: 1199708 - DNA, 22 bp, Artificial Sequence
  chemically synthesized
cagtaggcaaagagatgcagga

SEQ ID NO: 1199709 - DNA, 22 bp, Artificial Sequence
  chemically synthesized
cacctgccagctcctgcatctc

SEQ ID NO: 1199710 - DNA, 22 bp, Artificial Sequence
  chemically synthesized
ccagctcctgcatctctttgcc

SEQ ID NO: 1199711 - DNA, 22 bp, Artificial Sequence
  chemically synthesized
ctgcatctctttgcctactgga

SEQ ID NO: 1199712 - DNA, 22 bp, Artificial Sequence
  chemically synthesized
cggaagaacagactccagtagg

SEQ ID NO: 1199713 - DNA, 22 bp, Artificial Sequence
  chemically synthesized
catctctttgcctactggagtc

SEQ ID NO: 1199714 - DNA, 22 bp, Artificial Sequence
  chemically synthesized
tttgcctactggagtctgttct

SEQ ID NO: 1199715 - DNA, 22 bp, Artificial Sequence
  chemically synthesized
catgcactccggaagaacagac

SEQ ID NO: 1199716 - DNA, 22 bp, Artificial Sequence
  chemically synthesized
tgcctactggagtctgttcttc

SEQ ID NO: 1199717 - DNA, 22 bp, Artificial Sequence
  chemically synthesized
gcctactggagtctgttcttcc

SEQ ID NO: 1199718 - DNA, 22 bp, Artificial Sequence
  chemically synthesized
cctactggagtctgttcttccg

SEQ ID NO: 1199719 - DNA, 22 bp, Artificial Sequence
  chemically synthesized
ttgcatgcactccggaagaaca

SEQ ID NO: 1199720 - DNA, 22 bp, Artificial Sequence
  chemically synthesized
ctggagtctgttcttccggagt

SEQ ID NO: 1199721 - DNA, 22 bp, Artificial Sequence
  chemically synthesized
atctattgcatgcactccggaa

SEQ ID NO: 1199722 - DNA, 22 bp, Artificial Sequence
  chemically synthesized
gatctattgcatgcactccgga

SEQ ID NO: 1199723 - DNA, 22 bp, Artificial Sequence
  chemically synthesized
gagtctgttcttccggagtgca

SEQ ID NO: 1199724 - DNA, 22 bp, Artificial Sequence
  chemically synthesized
tgatctattgcatgcactccgg

SEQ ID NO: 1199725 - DNA, 22 bp, Artificial Sequence
  chemically synthesized
ttgatctattgcatgcactccg

SEQ ID NO: 1199726 - DNA, 22 bp, Artificial Sequence
  chemically synthesized
ttcttccggagtgcatgcaata

SEQ ID NO: 1199727 - DNA, 22 bp, Artificial Sequence
  chemically synthesized
gcatttttgatctattgcatgc

SEQ ID NO: 1199728 - DNA, 22 bp, Artificial Sequence
  chemically synthesized
ttccggagtgcatgcaatagat

SEQ ID NO: 1199729 - DNA, 22 bp, Artificial Sequence
  chemically synthesized
cctagcatttttgatctattgc

SEQ ID NO: 1199730 - DNA, 22 bp, Artificial Sequence
  chemically synthesized
ccggagtgcatgcaatagatca

SEQ ID NO: 1199731 - DNA, 22 bp, Artificial Sequence
  chemically synthesized
cggagtgcatgcaatagatcaa

SEQ ID NO: 1199732 - DNA, 22 bp, Artificial Sequence
  chemically synthesized
actccctagcatttttgatcta

SEQ ID NO: 1199733 - DNA, 22 bp, Artificial Sequence
  chemically synthesized
tgcattcactccctagcatttt

SEQ ID NO: 1199734 - DNA, 22 bp, Artificial Sequence
  chemically synthesized
gcagatcccgggaggggctgtg

SEQ ID NO: 1199735 - DNA, 22 bp, Artificial Sequence
  chemically synthesized
gggagtgaatgcacagcccctc

SEQ ID NO: 1199736 - DNA, 22 bp, Artificial Sequence
  chemically synthesized
ttggcagatcccgggaggggct

SEQ ID NO: 1199737 - DNA, 22 bp, Artificial Sequence
  chemically synthesized
gtcatctgttggcagatcccgg

SEQ ID NO: 1199738 - DNA, 22 bp, Artificial Sequence
  chemically synthesized
ctggtcatctgttggcagatcc

SEQ ID NO: 1199739 - DNA, 22 bp, Artificial Sequence
  chemically synthesized
ctgctggtcatctgttggcaga

SEQ ID NO: 1199740 - DNA, 22 bp, Artificial Sequence
  chemically synthesized
ccgggatctgccaacagatgac

SEQ ID NO: 1199741 - DNA, 22 bp, Artificial Sequence
  chemically synthesized
tacaccaactcctgctggtcat

SEQ ID NO: 1199742 - DNA, 22 bp, Artificial Sequence
  chemically synthesized
atacaccaactcctgctggtca

SEQ ID NO: 1199743 - DNA, 22 bp, Artificial Sequence
  chemically synthesized
ccaacagatgaccagcaggagt

SEQ ID NO: 1199744 - DNA, 22 bp, Artificial Sequence
  chemically synthesized
aggtatttatacaccaactcct

SEQ ID NO: 1199745 - DNA, 22 bp, Artificial Sequence
  chemically synthesized
aagagatgagaatgctaaggta

SEQ ID NO: 1199746 - DNA, 22 bp, Artificial Sequence
  chemically synthesized
gaagagatgagaatgctaaggt

SEQ ID NO: 1199747 - DNA, 22 bp, Artificial Sequence
  chemically synthesized
tgaagagatgagaatgctaagg

SEQ ID NO: 1199748 - DNA, 22 bp, Artificial Sequence
  chemically synthesized
gtgtataaataccttagcattc

SEQ ID NO: 1199749 - DNA, 22 bp, Artificial Sequence
  chemically synthesized
tcctttgaagagatgagaatgc

SEQ ID NO: 1199750 - DNA, 22 bp, Artificial Sequence
  chemically synthesized
atcctttgaagagatgagaatg

SEQ ID NO: 1199751 - DNA, 22 bp, Artificial Sequence
  chemically synthesized
agacttatcctttgaagagatg

SEQ ID NO: 1199752 - DNA, 22 bp, Artificial Sequence
  chemically synthesized
agcattctcatctcttcaaagg

SEQ ID NO: 1199753 - DNA, 22 bp, Artificial Sequence
  chemically synthesized
gcattctcatctcttcaaagga

SEQ ID NO: 1199754 - DNA, 22 bp, Artificial Sequence
  chemically synthesized
tcatctcttcaaaggataagtc

SEQ ID NO: 1199755 - DNA, 22 bp, Artificial Sequence
  chemically synthesized
atctcttcaaaggataagtctg

SEQ ID NO: 1199756 - DNA, 22 bp, Artificial Sequence
  chemically synthesized
tgtggaacacacacctcagact

SEQ ID NO: 1199757 - DNA, 22 bp, Artificial Sequence
  chemically synthesized
ttcaaaggataagtctgaggtg

SEQ ID NO: 1199758 - DNA, 22 bp, Artificial Sequence
  chemically synthesized
caaaggataagtctgaggtgtg

SEQ ID NO: 1199759 - DNA, 22 bp, Artificial Sequence
  chemically synthesized
aaaggataagtctgaggtgtgt

SEQ ID NO: 1199760 - DNA, 22 bp, Artificial Sequence
  chemically synthesized
aagaaaattatgtggaacacac

SEQ ID NO: 1199761 - DNA, 22 bp, Artificial Sequence
  chemically synthesized
gaagaaaattatgtggaacaca

SEQ ID NO: 1199762 - DNA, 22 bp, Artificial Sequence
  chemically synthesized
aggtgtgtgttccacataattt

SEQ ID NO: 1199763 - DNA, 22 bp, Artificial Sequence
  chemically synthesized
gggacttgaagaaaattatgtg

SEQ ID NO: 1199764 - DNA, 22 bp, Artificial Sequence
  chemically synthesized
actggggacttgaagaaaatta

SEQ ID NO: 1199765 - DNA, 22 bp, Artificial Sequence
  chemically synthesized
gactggggacttgaagaaaatt

SEQ ID NO: 1199766 - DNA, 22 bp, Artificial Sequence
  chemically synthesized
aatttgactggggacttgaaga

SEQ ID NO: 1199767 - DNA, 22 bp, Artificial Sequence
  chemically synthesized
cacataattttcttcaagtccc

SEQ ID NO: 1199768 - DNA, 22 bp, Artificial Sequence
  chemically synthesized
gcgctcaatttgactggggact

SEQ ID NO: 1199769 - DNA, 22 bp, Artificial Sequence
  chemically synthesized
tcttcaagtccccagtcaaatt

SEQ ID NO: 1199770 - DNA, 22 bp, Artificial Sequence
  chemically synthesized
cttcaagtccccagtcaaattg

SEQ ID NO: 1199771 - DNA, 22 bp, Artificial Sequence
  chemically synthesized
ttcaagtccccagtcaaattga

SEQ ID NO: 1199772 - DNA, 22 bp, Artificial Sequence
  chemically synthesized
caagtccccagtcaaattgagc

SEQ ID NO: 1199773 - DNA, 22 bp, Artificial Sequence
  chemically synthesized
aagtccccagtcaaattgagcg

SEQ ID NO: 1199774 - DNA, 22 bp, Artificial Sequence
  chemically synthesized
tggtggacaactggcgctcaat

SEQ ID NO: 1199775 - DNA, 22 bp, Artificial Sequence
  chemically synthesized
aactgtggtggacaactggcgc

SEQ ID NO: 1199776 - DNA, 22 bp, Artificial Sequence
  chemically synthesized
aaactgtggtggacaactggcg

SEQ ID NO: 1199777 - DNA, 22 bp, Artificial Sequence
  chemically synthesized
aagagtttaaactgtggtggac

SEQ ID NO: 1199778 - DNA, 22 bp, Artificial Sequence
  chemically synthesized
caagagtttaaactgtggtgga

SEQ ID NO: 1199779 - DNA, 22 bp, Artificial Sequence
  chemically synthesized
agcgccagttgtccaccacagt

SEQ ID NO: 1199780 - DNA, 22 bp, Artificial Sequence
  chemically synthesized
catttcaagagtttaaactgtg

SEQ ID NO: 1199781 - DNA, 22 bp, Artificial Sequence
  chemically synthesized
tccaccacagtttaaactcttg

SEQ ID NO: 1199782 - DNA, 22 bp, Artificial Sequence
  chemically synthesized
aaactcttgaaatgtagtcttc

SEQ ID NO: 1199783 - DNA, 22 bp, Artificial Sequence
  chemically synthesized
aactcttgaaatgtagtcttca

SEQ ID NO: 1199784 - DNA, 22 bp, Artificial Sequence
  chemically synthesized
ttgaaatgtagtcttcattgac

SEQ ID NO: 1199785 - DNA, 22 bp, Artificial Sequence
  chemically synthesized
gaaatgtagtcttcattgactt

SEQ ID NO: 1199786 - DNA, 22 bp, Artificial Sequence
  chemically synthesized
aaatgtagtcttcattgacttt

SEQ ID NO: 1199787 - DNA, 22 bp, Artificial Sequence
  chemically synthesized
cattgactttccttccttcttt

SEQ ID NO: 1199788 - DNA, 22 bp, Artificial Sequence
  chemically synthesized
attgactttccttccttctttg

SEQ ID NO: 1199789 - DNA, 22 bp, Artificial Sequence
  chemically synthesized
actttccttccttctttgtctc

SEQ ID NO: 1199790 - DNA, 22 bp, Artificial Sequence
  chemically synthesized
tccttccttctttgtctcactt

SEQ ID NO: 1199791 - DNA, 22 bp, Artificial Sequence
  chemically synthesized
ccttccttctttgtctcacttt

SEQ ID NO: 1199792 - DNA, 22 bp, Artificial Sequence
  chemically synthesized
cttccttctttgtctcacttta

SEQ ID NO: 1199793 - DNA, 22 bp, Artificial Sequence
  chemically synthesized
ccttctttgtctcactttatca

SEQ ID NO: 1199794 - DNA, 22 bp, Artificial Sequence
  chemically synthesized
cttctttgtctcactttatcat

SEQ ID NO: 1199795 - DNA, 22 bp, Artificial Sequence
  chemically synthesized
ctttgtctcactttatcatttt

SEQ ID NO: 1199796 - DNA, 22 bp, Artificial Sequence
  chemically synthesized
tttgtctcactttatcattttc

SEQ ID NO: 1199797 - DNA, 22 bp, Artificial Sequence
  chemically synthesized
tgtctcactttatcattttcct

SEQ ID NO: 1199798 - DNA, 22 bp, Artificial Sequence
  chemically synthesized
gggaatatgagtaggaaaatga

SEQ ID NO: 1199799 - DNA, 22 bp, Artificial Sequence
  chemically synthesized
gtctcactttatcattttccta

SEQ ID NO: 1199800 - DNA, 22 bp, Artificial Sequence
  chemically synthesized
tctcactttatcattttcctac

SEQ ID NO: 1199801 - DNA, 22 bp, Artificial Sequence
  chemically synthesized
actttatcattttcctactcat

SEQ ID NO: 1199802 - DNA, 22 bp, Artificial Sequence
  chemically synthesized
tatcattttcctactcatattc

SEQ ID NO: 1199803 - DNA, 22 bp, Artificial Sequence
  chemically synthesized
atcattttcctactcatattcc

SEQ ID NO: 1199804 - DNA, 22 bp, Artificial Sequence
  chemically synthesized
tcattttcctactcatattccc

SEQ ID NO: 1199805 - DNA, 22 bp, Artificial Sequence
  chemically synthesized
ggatgagatgctagggaatatg

SEQ ID NO: 1199806 - DNA, 22 bp, Artificial Sequence
  chemically synthesized
gggatgagatgctagggaatat

SEQ ID NO: 1199807 - DNA, 22 bp, Artificial Sequence
  chemically synthesized
tttgggatgagatgctagggaa

SEQ ID NO: 1199808 - DNA, 22 bp, Artificial Sequence
  chemically synthesized
tcctactcatattccctagcat

SEQ ID NO: 1199809 - DNA, 22 bp, Artificial Sequence
  chemically synthesized
atttgggatgagatgctaggga

SEQ ID NO: 1199810 - DNA, 22 bp, Artificial Sequence
  chemically synthesized
cctactcatattccctagcatc

SEQ ID NO: 1199811 - DNA, 22 bp, Artificial Sequence
  chemically synthesized
ctactcatattccctagcatct

SEQ ID NO: 1199812 - DNA, 22 bp, Artificial Sequence
  chemically synthesized
gtttatttgggatgagatgcta

SEQ ID NO: 1199813 - DNA, 22 bp, Artificial Sequence
  chemically synthesized
ctcatattccctagcatctcat

SEQ ID NO: 1199814 - DNA, 22 bp, Artificial Sequence
  chemically synthesized
tagtttatttgggatgagatgc

SEQ ID NO: 1199815 - DNA, 22 bp, Artificial Sequence
  chemically synthesized
ctagtttatttgggatgagatg

SEQ ID NO: 1199816 - DNA, 22 bp, Artificial Sequence
  chemically synthesized
atattccctagcatctcatccc

SEQ ID NO: 1199817 - DNA, 22 bp, Artificial Sequence
  chemically synthesized
ccccttctagtttatttgggat

SEQ ID NO: 1199818 - DNA, 22 bp, Artificial Sequence
  chemically synthesized
cctagcatctcatcccaaataa

SEQ ID NO: 1199819 - DNA, 22 bp, Artificial Sequence
  chemically synthesized
cccccttctagtttatttggga

SEQ ID NO: 1199820 - DNA, 22 bp, Artificial Sequence
  chemically synthesized
gcatctcatcccaaataaacta

SEQ ID NO: 1199821 - DNA, 22 bp, Artificial Sequence
  chemically synthesized
agaatacttcccccttctagtt

SEQ ID NO: 1199822 - DNA, 22 bp, Artificial Sequence
  chemically synthesized
cagaatacttcccccttctagt

SEQ ID NO: 1199823 - DNA, 22 bp, Artificial Sequence
  chemically synthesized
atcccaaataaactagaagggg

SEQ ID NO: 1199824 - DNA, 22 bp, Artificial Sequence
  chemically synthesized
tcagaatacttcccccttctag

SEQ ID NO: 1199825 - DNA, 22 bp, Artificial Sequence
  chemically synthesized
tgattttcagaatacttccccc

SEQ ID NO: 1199826 - DNA, 22 bp, Artificial Sequence
  chemically synthesized
atgattttcagaatacttcccc

SEQ ID NO: 1199827 - DNA, 22 bp, Artificial Sequence
  chemically synthesized
tatgattttcagaatacttccc

SEQ ID NO: 1199828 - DNA, 22 bp, Artificial Sequence
  chemically synthesized
tctttatgattttcagaatact

SEQ ID NO: 1199829 - DNA, 22 bp, Artificial Sequence
  chemically synthesized
gaagggggaagtattctgaaaa

SEQ ID NO: 1199830 - DNA, 22 bp, Artificial Sequence
  chemically synthesized
ccctgtctttatgattttcaga

SEQ ID NO: 1199831 - DNA, 22 bp, Artificial Sequence
  chemically synthesized
accctgtctttatgattttcag

SEQ ID NO: 1199832 - DNA, 22 bp, Artificial Sequence
  chemically synthesized
aatttaccctgtctttatgatt

SEQ ID NO: 1199833 - DNA, 22 bp, Artificial Sequence
  chemically synthesized
aaatttaccctgtctttatgat

SEQ ID NO: 1199834 - DNA, 22 bp, Artificial Sequence
  chemically synthesized
tgaaaatcataaagacagggta

SEQ ID NO: 1199835 - DNA, 22 bp, Artificial Sequence
  chemically synthesized
aaaatcataaagacagggtaaa

SEQ ID NO: 1199836 - DNA, 22 bp, Artificial Sequence
  chemically synthesized
ataatgataataaaataatagt

SEQ ID NO: 1199837 - DNA, 22 bp, Artificial Sequence
  chemically synthesized
ctaataatgataataaaataat

SEQ ID NO: 1199838 - DNA, 22 bp, Artificial Sequence
  chemically synthesized
aaactattattttattatcatt

SEQ ID NO: 1199839 - DNA, 22 bp, Artificial Sequence
  chemically synthesized
aactattattttattatcatta

SEQ ID NO: 1199840 - DNA, 22 bp, Artificial Sequence
  chemically synthesized
ttattttattatcattattagt

SEQ ID NO: 1199841 - DNA, 22 bp, Artificial Sequence
  chemically synthesized
agatatcgatgttactaataat

SEQ ID NO: 1199842 - DNA, 22 bp, Artificial Sequence
  chemically synthesized
ttttattatcattattagtaac

SEQ ID NO: 1199843 - DNA, 22 bp, Artificial Sequence
  chemically synthesized
gctcagatatcgatgttactaa

SEQ ID NO: 1199844 - DNA, 22 bp, Artificial Sequence
  chemically synthesized
tattatcattattagtaacatc

SEQ ID NO: 1199845 - DNA, 22 bp, Artificial Sequence
  chemically synthesized
ggctcagatatcgatgttacta

SEQ ID NO: 1199846 - DNA, 22 bp, Artificial Sequence
  chemically synthesized
attatcattattagtaacatcg

SEQ ID NO: 1199847 - DNA, 22 bp, Artificial Sequence
  chemically synthesized
tggctcagatatcgatgttact

SEQ ID NO: 1199848 - DNA, 22 bp, Artificial Sequence
  chemically synthesized
ttatcattattagtaacatcga

SEQ ID NO: 1199849 - DNA, 22 bp, Artificial Sequence
  chemically synthesized
tcattattagtaacatcgatat

SEQ ID NO: 1199850 - DNA, 22 bp, Artificial Sequence
  chemically synthesized
attttggctcagatatcgatgt

SEQ ID NO: 1199851 - DNA, 22 bp, Artificial Sequence
  chemically synthesized
gattttggctcagatatcgatg

SEQ ID NO: 1199852 - DNA, 22 bp, Artificial Sequence
  chemically synthesized
tgattttggctcagatatcgat

SEQ ID NO: 1199853 - DNA, 22 bp, Artificial Sequence
  chemically synthesized
ttgattttggctcagatatcga

SEQ ID NO: 1199854 - DNA, 22 bp, Artificial Sequence
  chemically synthesized
tttgattttggctcagatatcg

SEQ ID NO: 1199855 - DNA, 22 bp, Artificial Sequence
  chemically synthesized
ttttgattttggctcagatatc

SEQ ID NO: 1199856 - DNA, 22 bp, Artificial Sequence
  chemically synthesized
ttagtaacatcgatatctgagc

SEQ ID NO: 1199857 - DNA, 22 bp, Artificial Sequence
  chemically synthesized
ttttttgattttggctcagata

SEQ ID NO: 1199858 - DNA, 22 bp, Artificial Sequence
  chemically synthesized
cttttttgattttggctcagat

SEQ ID NO: 1199859 - DNA, 22 bp, Artificial Sequence
  chemically synthesized
gtaacatcgatatctgagccaa

SEQ ID NO: 1199860 - DNA, 22 bp, Artificial Sequence
  chemically synthesized
tcttttttgattttggctcaga

SEQ ID NO: 1199861 - DNA, 22 bp, Artificial Sequence
  chemically synthesized
agccaaaatcaaaaaagaaagg

SEQ ID NO: 1199862 - DNA, 22 bp, Artificial Sequence
  chemically synthesized
accagaaagagtacaaataagg

SEQ ID NO: 1199863 - DNA, 22 bp, Artificial Sequence
  chemically synthesized
gaatcctaaccagaaagagtac

SEQ ID NO: 1199864 - DNA, 22 bp, Artificial Sequence
  chemically synthesized
atggttagaatcctaaccagaa

SEQ ID NO: 1199865 - DNA, 22 bp, Artificial Sequence
  chemically synthesized
atttgtactctttctggttagg

SEQ ID NO: 1199866 - DNA, 22 bp, Artificial Sequence
  chemically synthesized
tttgtactctttctggttagga

SEQ ID NO: 1199867 - DNA, 22 bp, Artificial Sequence
  chemically synthesized
gtactctttctggttaggattc

SEQ ID NO: 1199868 - DNA, 22 bp, Artificial Sequence
  chemically synthesized
tactctttctggttaggattct

SEQ ID NO: 1199869 - DNA, 22 bp, Artificial Sequence
  chemically synthesized
acactcatggttagaatcctaa

SEQ ID NO: 1199870 - DNA, 22 bp, Artificial Sequence
  chemically synthesized
taacactcatggttagaatcct

SEQ ID NO: 1199871 - DNA, 22 bp, Artificial Sequence
  chemically synthesized
tttctggttaggattctaacca

SEQ ID NO: 1199872 - DNA, 22 bp, Artificial Sequence
  chemically synthesized
tctggttaggattctaaccatg

SEQ ID NO: 1199873 - DNA, 22 bp, Artificial Sequence
  chemically synthesized
ctggttaggattctaaccatga

SEQ ID NO: 1199874 - DNA, 22 bp, Artificial Sequence
  chemically synthesized
tggttaggattctaaccatgag

SEQ ID NO: 1199875 - DNA, 22 bp, Artificial Sequence
  chemically synthesized
gttaggattctaaccatgagtg

SEQ ID NO: 1199876 - DNA, 22 bp, Artificial Sequence
  chemically synthesized
ggattctaaccatgagtgttag

SEQ ID NO: 1199877 - DNA, 22 bp, Artificial Sequence
  chemically synthesized
agtgccaacaacattctaacac

SEQ ID NO: 1199878 - DNA, 22 bp, Artificial Sequence
  chemically synthesized
taaccatgagtgttagaatgtt

SEQ ID NO: 1199879 - DNA, 22 bp, Artificial Sequence
  chemically synthesized
accatgagtgttagaatgttgt

SEQ ID NO: 1199880 - DNA, 22 bp, Artificial Sequence
  chemically synthesized
tgggttcagtgccaacaacatt

SEQ ID NO: 1199881 - DNA, 22 bp, Artificial Sequence
  chemically synthesized
taactatgggttcagtgccaac

SEQ ID NO: 1199882 - DNA, 22 bp, Artificial Sequence
  chemically synthesized
gaatgttgttggcactgaaccc

SEQ ID NO: 1199883 - DNA, 22 bp, Artificial Sequence
  chemically synthesized
gaaactgtaactatgggttcag

SEQ ID NO: 1199884 - DNA, 22 bp, Artificial Sequence
  chemically synthesized
ttggaaactgtaactatgggtt

SEQ ID NO: 1199885 - DNA, 22 bp, Artificial Sequence
  chemically synthesized
ttggcactgaacccatagttac

SEQ ID NO: 1199886 - DNA, 22 bp, Artificial Sequence
  chemically synthesized
gcactgaacccatagttacagt

SEQ ID NO: 1199887 - DNA, 22 bp, Artificial Sequence
  chemically synthesized
agaaattattggaaactgtaac

SEQ ID NO: 1199888 - DNA, 22 bp, Artificial Sequence
  chemically synthesized
aacccatagttacagtttccaa

SEQ ID NO: 1199889 - DNA, 22 bp, Artificial Sequence
  chemically synthesized
gcattcagaaattattggaaac

SEQ ID NO: 1199890 - DNA, 22 bp, Artificial Sequence
  chemically synthesized
ggcattcagaaattattggaaa

SEQ ID NO: 1199891 - DNA, 22 bp, Artificial Sequence
  chemically synthesized
ttggcattcagaaattattgga

SEQ ID NO: 1199892 - DNA, 22 bp, Artificial Sequence
  chemically synthesized
cttggcattcagaaattattgg

SEQ ID NO: 1199893 - DNA, 22 bp, Artificial Sequence
  chemically synthesized
tcttggcattcagaaattattg

SEQ ID NO: 1199894 - DNA, 22 bp, Artificial Sequence
  chemically synthesized
ttcttggcattcagaaattatt

SEQ ID NO: 1199895 - DNA, 22 bp, Artificial Sequence
  chemically synthesized
cagtttccaataatttctgaat

SEQ ID NO: 1199896 - DNA, 22 bp, Artificial Sequence
  chemically synthesized
ccaataatttctgaatgccaag

SEQ ID NO: 1199897 - DNA, 22 bp, Artificial Sequence
  chemically synthesized
caataatttctgaatgccaaga

SEQ ID NO: 1199898 - DNA, 22 bp, Artificial Sequence
  chemically synthesized
cacggtcacttttcttggcatt

SEQ ID NO: 1199899 - DNA, 22 bp, Artificial Sequence
  chemically synthesized
ccacggtcacttttcttggcat

SEQ ID NO: 1199900 - DNA, 22 bp, Artificial Sequence
  chemically synthesized
cttccacggtcacttttcttgg

SEQ ID NO: 1199901 - DNA, 22 bp, Artificial Sequence
  chemically synthesized
ccttccacggtcacttttcttg

SEQ ID NO: 1199902 - DNA, 22 bp, Artificial Sequence
  chemically synthesized
tccttccacggtcacttttctt

SEQ ID NO: 1199903 - DNA, 22 bp, Artificial Sequence
  chemically synthesized
ctgaatgccaagaaaagtgacc

SEQ ID NO: 1199904 - DNA, 22 bp, Artificial Sequence
  chemically synthesized
ctttccttccacggtcactttt

SEQ ID NO: 1199905 - DNA, 22 bp, Artificial Sequence
  chemically synthesized
tgaatgccaagaaaagtgaccg

SEQ ID NO: 1199906 - DNA, 22 bp, Artificial Sequence
  chemically synthesized
tgctttccttccacggtcactt

SEQ ID NO: 1199907 - DNA, 22 bp, Artificial Sequence
  chemically synthesized
aatgccaagaaaagtgaccgtg

SEQ ID NO: 1199908 - DNA, 22 bp, Artificial Sequence
  chemically synthesized
aaaactctgctttccttccacg

SEQ ID NO: 1199909 - DNA, 22 bp, Artificial Sequence
  chemically synthesized
cacagagttaaaaactctgctt

SEQ ID NO: 1199910 - DNA, 22 bp, Artificial Sequence
  chemically synthesized
aacacattccacagagttaaaa

SEQ ID NO: 1199911 - DNA, 22 bp, Artificial Sequence
  chemically synthesized
acccactgaacacattccacag

SEQ ID NO: 1199912 - DNA, 22 bp, Artificial Sequence
  chemically synthesized
ctcacccactgaacacattcca

SEQ ID NO: 1199913 - DNA, 22 bp, Artificial Sequence
  chemically synthesized
ttaactctgtggaatgtgttca

SEQ ID NO: 1199914 - DNA, 22 bp, Artificial Sequence
  chemically synthesized
taactctgtggaatgtgttcag

SEQ ID NO: 1199915 - DNA, 22 bp, Artificial Sequence
  chemically synthesized
aactctgtggaatgtgttcagt

SEQ ID NO: 1199916 - DNA, 22 bp, Artificial Sequence
  chemically synthesized
actctgtggaatgtgttcagtg

SEQ ID NO: 1199917 - DNA, 22 bp, Artificial Sequence
  chemically synthesized
ccattcctcacccactgaacac

SEQ ID NO: 1199918 - DNA, 22 bp, Artificial Sequence
  chemically synthesized
ctcccattcctcacccactgaa

SEQ ID NO: 1199919 - DNA, 22 bp, Artificial Sequence
  chemically synthesized
tgtggaatgtgttcagtgggtg

SEQ ID NO: 1199920 - DNA, 22 bp, Artificial Sequence
  chemically synthesized
cctcccattcctcacccactga

SEQ ID NO: 1199921 - DNA, 22 bp, Artificial Sequence
  chemically synthesized
tggaatgtgttcagtgggtgag

SEQ ID NO: 1199922 - DNA, 22 bp, Artificial Sequence
  chemically synthesized
agtgggtgaggaatgggaggaa

SEQ ID NO: 1199923 - DNA, 22 bp, Artificial Sequence
  chemically synthesized
agagcaaaatagaacttcctcc

SEQ ID NO: 1199924 - DNA, 22 bp, Artificial Sequence
  chemically synthesized
ctgagagcaaaatagaacttcc

SEQ ID NO: 1199925 - DNA, 22 bp, Artificial Sequence
  chemically synthesized
tactgagagcaaaatagaactt

SEQ ID NO: 1199926 - DNA, 22 bp, Artificial Sequence
  chemically synthesized
atgttctactgagagcaaaata

SEQ ID NO: 1199927 - DNA, 22 bp, Artificial Sequence
  chemically synthesized
aatgttctactgagagcaaaat

SEQ ID NO: 1199928 - DNA, 22 bp, Artificial Sequence
  chemically synthesized
taatgttctactgagagcaaaa

SEQ ID NO: 1199929 - DNA, 22 bp, Artificial Sequence
  chemically synthesized
ttaatgttctactgagagcaaa

SEQ ID NO: 1199930 - DNA, 22 bp, Artificial Sequence
  chemically synthesized
tattttgctctcagtagaacat

SEQ ID NO: 1199931 - DNA, 22 bp, Artificial Sequence
  chemically synthesized
ttttgctctcagtagaacatta

SEQ ID NO: 1199932 - DNA, 22 bp, Artificial Sequence
  chemically synthesized
tgctctcagtagaacattaaaa

SEQ ID NO: 1199933 - DNA, 22 bp, Artificial Sequence
  chemically synthesized
gctctcagtagaacattaaaaa

SEQ ID NO: 1199934 - DNA, 22 bp, Artificial Sequence
  chemically synthesized
cagaggaagccatttttaatgt

SEQ ID NO: 1199935 - DNA, 22 bp, Artificial Sequence
  chemically synthesized
ctctcagtagaacattaaaaat

SEQ ID NO: 1199936 - DNA, 22 bp, Artificial Sequence
  chemically synthesized
acagaggaagccatttttaatg

SEQ ID NO: 1199937 - DNA, 22 bp, Artificial Sequence
  chemically synthesized
tacagaggaagccatttttaat

SEQ ID NO: 1199938 - DNA, 22 bp, Artificial Sequence
  chemically synthesized
tcagtagaacattaaaaatggc

SEQ ID NO: 1199939 - DNA, 22 bp, Artificial Sequence
  chemically synthesized
agtagaacattaaaaatggctt

SEQ ID NO: 1199940 - DNA, 22 bp, Artificial Sequence
  chemically synthesized
aaaatggcttcctctgtaaagc

SEQ ID NO: 1199941 - DNA, 22 bp, Artificial Sequence
  chemically synthesized
ggggaaccacagaatgctttac

SEQ ID NO: 1199942 - DNA, 22 bp, Artificial Sequence
  chemically synthesized
gggggaaccacagaatgcttta

SEQ ID NO: 1199943 - DNA, 22 bp, Artificial Sequence
  chemically synthesized
tcttgggggaaccacagaatgc

SEQ ID NO: 1199944 - DNA, 22 bp, Artificial Sequence
  chemically synthesized
atcttgggggaaccacagaatg

SEQ ID NO: 1199945 - DNA, 22 bp, Artificial Sequence
  chemically synthesized
cctctgtaaagcattctgtggt

SEQ ID NO: 1199946 - DNA, 22 bp, Artificial Sequence
  chemically synthesized
ctctgtaaagcattctgtggtt

SEQ ID NO: 1199947 - DNA, 22 bp, Artificial Sequence
  chemically synthesized
tgtaaagcattctgtggttccc

SEQ ID NO: 1199948 - DNA, 22 bp, Artificial Sequence
  chemically synthesized
cccttatcttgggggaaccaca

SEQ ID NO: 1199949 - DNA, 22 bp, Artificial Sequence
  chemically synthesized
taaagcattctgtggttccccc

SEQ ID NO: 1199950 - DNA, 22 bp, Artificial Sequence
  chemically synthesized
tgtggttcccccaagataaggg

SEQ ID NO: 1199951 - DNA, 22 bp, Artificial Sequence
  chemically synthesized
tggttcccccaagataagggca

SEQ ID NO: 1199952 - DNA, 22 bp, Artificial Sequence
  chemically synthesized
tgacagacagacctgcccttat

SEQ ID NO: 1199953 - DNA, 22 bp, Artificial Sequence
  chemically synthesized
atgacagacagacctgccctta

SEQ ID NO: 1199954 - DNA, 22 bp, Artificial Sequence
  chemically synthesized
ccccaagataagggcaggtctg

SEQ ID NO: 1199955 - DNA, 22 bp, Artificial Sequence
  chemically synthesized
tggcagtttatgacagacagac

SEQ ID NO: 1199956 - DNA, 22 bp, Artificial Sequence
  chemically synthesized
tctgtcataaactgccatagca

SEQ ID NO: 1199957 - DNA, 22 bp, Artificial Sequence
  chemically synthesized
tataagtaatgggtgctatggc

SEQ ID NO: 1199958 - DNA, 22 bp, Artificial Sequence
  chemically synthesized
tcataaactgccatagcaccca

SEQ ID NO: 1199959 - DNA, 22 bp, Artificial Sequence
  chemically synthesized
gttgtataagtaatgggtgcta

SEQ ID NO: 1199960 - DNA, 22 bp, Artificial Sequence
  chemically synthesized
agttgtataagtaatgggtgct

SEQ ID NO: 1199961 - DNA, 22 bp, Artificial Sequence
  chemically synthesized
tttagttgtataagtaatgggt

SEQ ID NO: 1199962 - DNA, 22 bp, Artificial Sequence
  chemically synthesized
atttagttgtataagtaatggg

SEQ ID NO: 1199963 - DNA, 22 bp, Artificial Sequence
  chemically synthesized
tatttagttgtataagtaatgg

SEQ ID NO: 1199964 - DNA, 22 bp, Artificial Sequence
  chemically synthesized
ccatagcacccattacttatac

SEQ ID NO: 1199965 - DNA, 22 bp, Artificial Sequence
  chemically synthesized
ttttatttagttgtataagtaa

SEQ ID NO: 1199966 - DNA, 22 bp, Artificial Sequence
  chemically synthesized
aatactattttatttagttgta

SEQ ID NO: 1199967 - DNA, 22 bp, Artificial Sequence
  chemically synthesized
cttatacaactaaataaaatag

SEQ ID NO: 1199968 - DNA, 22 bp, Artificial Sequence
  chemically synthesized
atacaactaaataaaatagtat

SEQ ID NO: 1199969 - DNA, 22 bp, Artificial Sequence
  chemically synthesized
tacaactaaataaaatagtatt

SEQ ID NO: 1199970 - DNA, 22 bp, Artificial Sequence
  chemically synthesized
accacccatcactcaatactat

SEQ ID NO: 1199971 - DNA, 22 bp, Artificial Sequence
  chemically synthesized
aataaaatagtattgagtgatg

SEQ ID NO: 1199972 - DNA, 22 bp, Artificial Sequence
  chemically synthesized
gagagactaaccacccatcact

SEQ ID NO: 1199973 - DNA, 22 bp, Artificial Sequence
  chemically synthesized
cattggagagactaaccaccca

SEQ ID NO: 1199974 - DNA, 22 bp, Artificial Sequence
  chemically synthesized
agtgatgggtggttagtctctc

SEQ ID NO: 1199975 - DNA, 22 bp, Artificial Sequence
  chemically synthesized
aaaaagagctacattggagaga

SEQ ID NO: 1199976 - DNA, 22 bp, Artificial Sequence
  chemically synthesized
attgaaaaagagctacattgga

SEQ ID NO: 1199977 - DNA, 22 bp, Artificial Sequence
  chemically synthesized
cattgaaaaagagctacattgg

SEQ ID NO: 1199978 - DNA, 22 bp, Artificial Sequence
  chemically synthesized
tcattgaaaaagagctacattg

SEQ ID NO: 1199979 - DNA, 22 bp, Artificial Sequence
  chemically synthesized
ttttcattgaaaaagagctaca

SEQ ID NO: 1199980 - DNA, 22 bp, Artificial Sequence
  chemically synthesized
gtctctccaatgtagctctttt

SEQ ID NO: 1199981 - DNA, 22 bp, Artificial Sequence
  chemically synthesized
tccaatgtagctctttttcaat

SEQ ID NO: 1199982 - DNA, 22 bp, Artificial Sequence
  chemically synthesized
caatgtagctctttttcaatga

SEQ ID NO: 1199983 - DNA, 22 bp, Artificial Sequence
  chemically synthesized
gaagaaacacaatgtctatttt

SEQ ID NO: 1199984 - DNA, 22 bp, Artificial Sequence
  chemically synthesized
tttttcaatgaaaatagacatt

SEQ ID NO: 1199985 - DNA, 22 bp, Artificial Sequence
  chemically synthesized
tttcaatgaaaatagacattgt

SEQ ID NO: 1199986 - DNA, 22 bp, Artificial Sequence
  chemically synthesized
ttcaatgaaaatagacattgtg

SEQ ID NO: 1199987 - DNA, 22 bp, Artificial Sequence
  chemically synthesized
tcaatgaaaatagacattgtgt

SEQ ID NO: 1199988 - DNA, 22 bp, Artificial Sequence
  chemically synthesized
caatgaaaatagacattgtgtt

SEQ ID NO: 1199989 - DNA, 22 bp, Artificial Sequence
  chemically synthesized
aatgaaaatagacattgtgttt

SEQ ID NO: 1199990 - DNA, 22 bp, Artificial Sequence
  chemically synthesized
tgtgaggccctggaagaaacac

SEQ ID NO: 1199991 - DNA, 22 bp, Artificial Sequence
  chemically synthesized
tgtttcttccagggcctcacac

SEQ ID NO: 1199992 - DNA, 22 bp, Artificial Sequence
  chemically synthesized
cttccagggcctcacacagttc

SEQ ID NO: 1199993 - DNA, 22 bp, Artificial Sequence
  chemically synthesized
ttccagggcctcacacagttcc

SEQ ID NO: 1199994 - DNA, 22 bp, Artificial Sequence
  chemically synthesized
ccagggcctcacacagttccct

SEQ ID NO: 1199995 - DNA, 22 bp, Artificial Sequence
  chemically synthesized
tgtaaaatatatagggaactgt

SEQ ID NO: 1199996 - DNA, 22 bp, Artificial Sequence
  chemically synthesized
cagggcctcacacagttcccta

SEQ ID NO: 1199997 - DNA, 22 bp, Artificial Sequence
  chemically synthesized
atgtaaaatatatagggaactg

SEQ ID NO: 1199998 - DNA, 22 bp, Artificial Sequence
  chemically synthesized
tatgtaaaatatatagggaact

SEQ ID NO: 1199999 - DNA, 22 bp, Artificial Sequence
  chemically synthesized
ttatgtaaaatatatagggaac

SEQ ID NO: 1200000 - DNA, 22 bp, Artificial Sequence
  chemically synthesized
tttatgtaaaatatatagggaa

SEQ ID NO: 1200001 - DNA, 22 bp, Artificial Sequence
  chemically synthesized
ttttatgtaaaatatataggga

SEQ ID NO: 1200002 - DNA, 22 bp, Artificial Sequence
  chemically synthesized
acacagttccctatatatttta

SEQ ID NO: 1200003 - DNA, 22 bp, Artificial Sequence
  chemically synthesized
ggtatatatttttttatgtaaa

SEQ ID NO: 1200004 - DNA, 22 bp, Artificial Sequence
  chemically synthesized
aggtatatatttttttatgtaa

SEQ ID NO: 1200005 - DNA, 22 bp, Artificial Sequence
  chemically synthesized
taggtatatatttttttatgta

SEQ ID NO: 1200006 - DNA, 22 bp, Artificial Sequence
  chemically synthesized
cctatatattttacataaaaaa

SEQ ID NO: 1200007 - DNA, 22 bp, Artificial Sequence
  chemically synthesized
tatattttacataaaaaaatat

SEQ ID NO: 1200008 - DNA, 22 bp, Artificial Sequence
  chemically synthesized
tacataaaaaaatatataccta

SEQ ID NO: 1200009 - DNA, 22 bp, Artificial Sequence
  chemically synthesized
acataaaaaaatatatacctaa

SEQ ID NO: 1200010 - DNA, 22 bp, Artificial Sequence
  chemically synthesized
cataaaaaaatatatacctaaa

SEQ ID NO: 1200011 - DNA, 22 bp, Artificial Sequence
  chemically synthesized
ggcaccaaatattttaggtata

SEQ ID NO: 1200012 - DNA, 22 bp, Artificial Sequence
  chemically synthesized
ttaggcaccaaatattttaggt

SEQ ID NO: 1200013 - DNA, 22 bp, Artificial Sequence
  chemically synthesized
attaggcaccaaatattttagg

SEQ ID NO: 1200014 - DNA, 22 bp, Artificial Sequence
  chemically synthesized
tatatttattaggcaccaaata

SEQ ID NO: 1200015 - DNA, 22 bp, Artificial Sequence
  chemically synthesized
tatatatttattaggcaccaaa

SEQ ID NO: 1200016 - DNA, 22 bp, Artificial Sequence
  chemically synthesized
ctatatatttattaggcaccaa

SEQ ID NO: 1200017 - DNA, 22 bp, Artificial Sequence
  chemically synthesized
aaatatttggtgcctaataaat

SEQ ID NO: 1200018 - DNA, 22 bp, Artificial Sequence
  chemically synthesized
gcatagtttctatatatttatt

SEQ ID NO: 1200019 - DNA, 22 bp, Artificial Sequence
  chemically synthesized
ggtgcctaataaatatatagaa

SEQ ID NO: 1200020 - DNA, 22 bp, Artificial Sequence
  chemically synthesized
gtgcctaataaatatatagaaa

SEQ ID NO: 1200021 - DNA, 22 bp, Artificial Sequence
  chemically synthesized
tgcctagcatagtttctatata

SEQ ID NO: 1200022 - DNA, 22 bp, Artificial Sequence
  chemically synthesized
ccctgtgcctagcatagtttct

SEQ ID NO: 1200023 - DNA, 22 bp, Artificial Sequence
  chemically synthesized
ataaatatatagaaactatgct

SEQ ID NO: 1200024 - DNA, 22 bp, Artificial Sequence
  chemically synthesized
aatcaccacaccctgccctgtg

SEQ ID NO: 1200025 - DNA, 22 bp, Artificial Sequence
  chemically synthesized
gctaaatcaccacaccctgccc

SEQ ID NO: 1200026 - DNA, 22 bp, Artificial Sequence
  chemically synthesized
tgctaggcacagggcagggtgt

SEQ ID NO: 1200027 - DNA, 22 bp, Artificial Sequence
  chemically synthesized
ggcacagggcagggtgtggtga

SEQ ID NO: 1200028 - DNA, 22 bp, Artificial Sequence
  chemically synthesized
tgaggacagggtaaatagtcta

SEQ ID NO: 1200029 - DNA, 22 bp, Artificial Sequence
  chemically synthesized
atgaggacagggtaaatagtct

SEQ ID NO: 1200030 - DNA, 22 bp, Artificial Sequence
  chemically synthesized
tgtgtttatgaggacagggtaa

SEQ ID NO: 1200031 - DNA, 22 bp, Artificial Sequence
  chemically synthesized
agctagactatttaccctgtcc

SEQ ID NO: 1200032 - DNA, 22 bp, Artificial Sequence
  chemically synthesized
gtgtgtttatgaggacagggta

SEQ ID NO: 1200033 - DNA, 22 bp, Artificial Sequence
  chemically synthesized
gctagactatttaccctgtcct

SEQ ID NO: 1200034 - DNA, 22 bp, Artificial Sequence
  chemically synthesized
tgtgtgtttatgaggacagggt

SEQ ID NO: 1200035 - DNA, 22 bp, Artificial Sequence
  chemically synthesized
gactatttaccctgtcctcata

SEQ ID NO: 1200036 - DNA, 22 bp, Artificial Sequence
  chemically synthesized
tttaccctgtcctcataaacac

SEQ ID NO: 1200037 - DNA, 22 bp, Artificial Sequence
  chemically synthesized
aatccattttgtgtgtttatga

SEQ ID NO: 1200038 - DNA, 22 bp, Artificial Sequence
  chemically synthesized
aaatccattttgtgtgtttatg

SEQ ID NO: 1200039 - DNA, 22 bp, Artificial Sequence
  chemically synthesized
accctgtcctcataaacacaca

SEQ ID NO: 1200040 - DNA, 22 bp, Artificial Sequence
  chemically synthesized
ccctgtcctcataaacacacaa

SEQ ID NO: 1200041 - DNA, 22 bp, Artificial Sequence
  chemically synthesized
cttaaatccattttgtgtgttt

SEQ ID NO: 1200042 - DNA, 22 bp, Artificial Sequence
  chemically synthesized
tcctcataaacacacaaaatgg

SEQ ID NO: 1200043 - DNA, 22 bp, Artificial Sequence
  chemically synthesized
ataaacacacaaaatggattta

SEQ ID NO: 1200044 - DNA, 22 bp, Artificial Sequence
  chemically synthesized
aagatgaatatgtgttccttaa

SEQ ID NO: 1200045 - DNA, 22 bp, Artificial Sequence
  chemically synthesized
aaagatgaatatgtgttcctta

SEQ ID NO: 1200046 - DNA, 22 bp, Artificial Sequence
  chemically synthesized
aaggaacacatattcatcttta

SEQ ID NO: 1200047 - DNA, 22 bp, Artificial Sequence
  chemically synthesized
aggaacacatattcatctttaa

SEQ ID NO: 1200048 - DNA, 22 bp, Artificial Sequence
  chemically synthesized
gtgagagagggtttaaagatga

SEQ ID NO: 1200049 - DNA, 22 bp, Artificial Sequence
  chemically synthesized
gctggtgagagagggtttaaag

SEQ ID NO: 1200050 - DNA, 22 bp, Artificial Sequence
  chemically synthesized
ctagctggtgagagagggttta

SEQ ID NO: 1200051 - DNA, 22 bp, Artificial Sequence
  chemically synthesized
actagctggtgagagagggttt

SEQ ID NO: 1200052 - DNA, 22 bp, Artificial Sequence
  chemically synthesized
atctttaaaccctctctcacca

SEQ ID NO: 1200053 - DNA, 22 bp, Artificial Sequence
  chemically synthesized
agtgtgcttactagctggtgag

SEQ ID NO: 1200054 - DNA, 22 bp, Artificial Sequence
  chemically synthesized
taaaccctctctcaccagctag

SEQ ID NO: 1200055 - DNA, 22 bp, Artificial Sequence
  chemically synthesized
aaaccctctctcaccagctagt

SEQ ID NO: 1200056 - DNA, 22 bp, Artificial Sequence
  chemically synthesized
aaccctctctcaccagctagta

SEQ ID NO: 1200057 - DNA, 22 bp, Artificial Sequence
  chemically synthesized
aaaagccctgagtgtgcttact

SEQ ID NO: 1200058 - DNA, 22 bp, Artificial Sequence
  chemically synthesized
tctcaccagctagtaagcacac

SEQ ID NO: 1200059 - DNA, 22 bp, Artificial Sequence
  chemically synthesized
tcaccagctagtaagcacactc

SEQ ID NO: 1200060 - DNA, 22 bp, Artificial Sequence
  chemically synthesized
accagctagtaagcacactcag

SEQ ID NO: 1200061 - DNA, 22 bp, Artificial Sequence
  chemically synthesized
gtaagcacactcagggcttttc

SEQ ID NO: 1200062 - DNA, 22 bp, Artificial Sequence
  chemically synthesized
taagtagagggtaactgaaaag

SEQ ID NO: 1200063 - DNA, 22 bp, Artificial Sequence
  chemically synthesized
gtaagtagagggtaactgaaaa

SEQ ID NO: 1200064 - DNA, 22 bp, Artificial Sequence
  chemically synthesized
agggcttttcagttaccctcta

SEQ ID NO: 1200065 - DNA, 22 bp, Artificial Sequence
  chemically synthesized
agaaatagcttgtaagtagagg

SEQ ID NO: 1200066 - DNA, 22 bp, Artificial Sequence
  chemically synthesized
ttcagttaccctctacttacaa

SEQ ID NO: 1200067 - DNA, 22 bp, Artificial Sequence
  chemically synthesized
tcagttaccctctacttacaag

SEQ ID NO: 1200068 - DNA, 22 bp, Artificial Sequence
  chemically synthesized
cagttaccctctacttacaagc

SEQ ID NO: 1200069 - DNA, 22 bp, Artificial Sequence
  chemically synthesized
agttaccctctacttacaagct

SEQ ID NO: 1200070 - DNA, 22 bp, Artificial Sequence
  chemically synthesized
ccctctacttacaagctatttc

SEQ ID NO: 1200071 - DNA, 22 bp, Artificial Sequence
  chemically synthesized
cagaaatgattcagaaatagct

SEQ ID NO: 1200072 - DNA, 22 bp, Artificial Sequence
  chemically synthesized
tacttacaagctatttctgaat

SEQ ID NO: 1200073 - DNA, 22 bp, Artificial Sequence
  chemically synthesized
cttacaagctatttctgaatca

SEQ ID NO: 1200074 - DNA, 22 bp, Artificial Sequence
  chemically synthesized
acaagctatttctgaatcattt

SEQ ID NO: 1200075 - DNA, 22 bp, Artificial Sequence
  chemically synthesized
caagctatttctgaatcatttc

SEQ ID NO: 1200076 - DNA, 22 bp, Artificial Sequence
  chemically synthesized
gaagatggttgcagaaatgatt

SEQ ID NO: 1200077 - DNA, 22 bp, Artificial Sequence
  chemically synthesized
ctagaagatggttgcagaaatg

SEQ ID NO: 1200078 - DNA, 22 bp, Artificial Sequence
  chemically synthesized
cctagaagatggttgcagaaat

SEQ ID NO: 1200079 - DNA, 22 bp, Artificial Sequence
  chemically synthesized
tttctgaatcatttctgcaacc

SEQ ID NO: 1200080 - DNA, 22 bp, Artificial Sequence
  chemically synthesized
ctgaatcatttctgcaaccatc

SEQ ID NO: 1200081 - DNA, 22 bp, Artificial Sequence
  chemically synthesized
tccttcctagaagatggttgca

SEQ ID NO: 1200082 - DNA, 22 bp, Artificial Sequence
  chemically synthesized
tgaatcatttctgcaaccatct

SEQ ID NO: 1200083 - DNA, 22 bp, Artificial Sequence
  chemically synthesized
aatcatttctgcaaccatcttc

SEQ ID NO: 1200084 - DNA, 22 bp, Artificial Sequence
  chemically synthesized
ctgcaaccatcttctaggaagg

SEQ ID NO: 1200085 - DNA, 22 bp, Artificial Sequence
  chemically synthesized
tgcaaccatcttctaggaagga

SEQ ID NO: 1200086 - DNA, 22 bp, Artificial Sequence
  chemically synthesized
taagaatggttatccttcctag

SEQ ID NO: 1200087 - DNA, 22 bp, Artificial Sequence
  chemically synthesized
caaccatcttctaggaaggata

SEQ ID NO: 1200088 - DNA, 22 bp, Artificial Sequence
  chemically synthesized
ctaggaaggataaccattctta

SEQ ID NO: 1200089 - DNA, 22 bp, Artificial Sequence
  chemically synthesized
taggaaggataaccattcttac

SEQ ID NO: 1200090 - DNA, 22 bp, Artificial Sequence
  chemically synthesized
ggaaggataaccattcttacaa

SEQ ID NO: 1200091 - DNA, 22 bp, Artificial Sequence
  chemically synthesized
gaggaatggcaaaaaaaaaaaa

SEQ ID NO: 1200092 - DNA, 22 bp, Artificial Sequence
  chemically synthesized
ggaggaatggcaaaaaaaaaaa

SEQ ID NO: 1200093 - DNA, 22 bp, Artificial Sequence
  chemically synthesized
tggaggaatggcaaaaaaaaaa

SEQ ID NO: 1200094 - DNA, 22 bp, Artificial Sequence
  chemically synthesized
ttacaattttttttttttttgc

SEQ ID NO: 1200095 - DNA, 22 bp, Artificial Sequence
  chemically synthesized
acaattttttttttttttgcca

SEQ ID NO: 1200096 - DNA, 22 bp, Artificial Sequence
  chemically synthesized
caattttttttttttttgccat

SEQ ID NO: 1200097 - DNA, 22 bp, Artificial Sequence
  chemically synthesized
tttttttttttgccattcctcc

SEQ ID NO: 1200098 - DNA, 22 bp, Artificial Sequence
  chemically synthesized
ttttttttttgccattcctcca

SEQ ID NO: 1200099 - DNA, 22 bp, Artificial Sequence
  chemically synthesized
tttttttttgccattcctccaa

SEQ ID NO: 1200100 - DNA, 22 bp, Artificial Sequence
  chemically synthesized
aaaagagcaactttggaggaat

SEQ ID NO: 1200101 - DNA, 22 bp, Artificial Sequence
  chemically synthesized
ttttttttgccattcctccaaa

SEQ ID NO: 1200102 - DNA, 22 bp, Artificial Sequence
  chemically synthesized
tttttttgccattcctccaaag

SEQ ID NO: 1200103 - DNA, 22 bp, Artificial Sequence
  chemically synthesized
ttttttgccattcctccaaagt

SEQ ID NO: 1200104 - DNA, 22 bp, Artificial Sequence
  chemically synthesized
tttttgccattcctccaaagtt

SEQ ID NO: 1200105 - DNA, 22 bp, Artificial Sequence
  chemically synthesized
ttttgccattcctccaaagttg

SEQ ID NO: 1200106 - DNA, 22 bp, Artificial Sequence
  chemically synthesized
tttgccattcctccaaagttgc

SEQ ID NO: 1200107 - DNA, 22 bp, Artificial Sequence
  chemically synthesized
ttgccattcctccaaagttgct

SEQ ID NO: 1200108 - DNA, 22 bp, Artificial Sequence
  chemically synthesized
tgccattcctccaaagttgctc

SEQ ID NO: 1200109 - DNA, 22 bp, Artificial Sequence
  chemically synthesized
gccattcctccaaagttgctct

SEQ ID NO: 1200110 - DNA, 22 bp, Artificial Sequence
  chemically synthesized
ataatattcaaaagagcaactt

SEQ ID NO: 1200111 - DNA, 22 bp, Artificial Sequence
  chemically synthesized
ccattcctccaaagttgctctt

SEQ ID NO: 1200112 - DNA, 22 bp, Artificial Sequence
  chemically synthesized
gataatattcaaaagagcaact

SEQ ID NO: 1200113 - DNA, 22 bp, Artificial Sequence
  chemically synthesized
tgataatattcaaaagagcaac

SEQ ID NO: 1200114 - DNA, 22 bp, Artificial Sequence
  chemically synthesized
ctccaaagttgctcttttgaat

SEQ ID NO: 1200115 - DNA, 22 bp, Artificial Sequence
  chemically synthesized
gaagttttgataatattcaaaa

SEQ ID NO: 1200116 - DNA, 22 bp, Artificial Sequence
  chemically synthesized
caaagttgctcttttgaatatt

SEQ ID NO: 1200117 - DNA, 22 bp, Artificial Sequence
  chemically synthesized
gcaaattggaagttttgataat

SEQ ID NO: 1200118 - DNA, 22 bp, Artificial Sequence
  chemically synthesized
ctcttttgaatattatcaaaac

SEQ ID NO: 1200119 - DNA, 22 bp, Artificial Sequence
  chemically synthesized
ggcaaattggaagttttgataa

SEQ ID NO: 1200120 - DNA, 22 bp, Artificial Sequence
  chemically synthesized
ttttgaatattatcaaaacttc

SEQ ID NO: 1200121 - DNA, 22 bp, Artificial Sequence
  chemically synthesized
ttgaatattatcaaaacttcca

SEQ ID NO: 1200122 - DNA, 22 bp, Artificial Sequence
  chemically synthesized
gatttggcaaattggaagtttt

SEQ ID NO: 1200123 - DNA, 22 bp, Artificial Sequence
  chemically synthesized
tgaatattatcaaaacttccaa

SEQ ID NO: 1200124 - DNA, 22 bp, Artificial Sequence
  chemically synthesized
gaatattatcaaaacttccaat

SEQ ID NO: 1200125 - DNA, 22 bp, Artificial Sequence
  chemically synthesized
aatattatcaaaacttccaatt

SEQ ID NO: 1200126 - DNA, 22 bp, Artificial Sequence
  chemically synthesized
ttagatttggcaaattggaagt

SEQ ID NO: 1200127 - DNA, 22 bp, Artificial Sequence
  chemically synthesized
attagatttggcaaattggaag

SEQ ID NO: 1200128 - DNA, 22 bp, Artificial Sequence
  chemically synthesized
tcaaaacttccaatttgccaaa

SEQ ID NO: 1200129 - DNA, 22 bp, Artificial Sequence
  chemically synthesized
aaatagtttattagatttggca

SEQ ID NO: 1200130 - DNA, 22 bp, Artificial Sequence
  chemically synthesized
ccaatttgccaaatctaataaa

SEQ ID NO: 1200131 - DNA, 22 bp, Artificial Sequence
  chemically synthesized
caatttgccaaatctaataaac

SEQ ID NO: 1200132 - DNA, 22 bp, Artificial Sequence
  chemically synthesized
gccaaatctaataaactatttt

SEQ ID NO: 1200133 - DNA, 22 bp, Artificial Sequence
  chemically synthesized
ccaaatctaataaactatttta

SEQ ID NO: 1200134 - DNA, 22 bp, Artificial Sequence
  chemically synthesized
agtaagatgtgggttaaaatag

SEQ ID NO: 1200135 - DNA, 22 bp, Artificial Sequence
  chemically synthesized
ataaactattttaacccacatc

SEQ ID NO: 1200136 - DNA, 22 bp, Artificial Sequence
  chemically synthesized
aaaacattaagtaagatgtggg

SEQ ID NO: 1200137 - DNA, 22 bp, Artificial Sequence
  chemically synthesized
cactgaaaacattaagtaagat

SEQ ID NO: 1200138 - DNA, 22 bp, Artificial Sequence
  chemically synthesized
ttttaacccacatcttacttaa

SEQ ID NO: 1200139 - DNA, 22 bp, Artificial Sequence
  chemically synthesized
taacccacatcttacttaatgt

SEQ ID NO: 1200140 - DNA, 22 bp, Artificial Sequence
  chemically synthesized
aacccacatcttacttaatgtt

SEQ ID NO: 1200141 - DNA, 22 bp, Artificial Sequence
  chemically synthesized
aattccactgaaaacattaagt

SEQ ID NO: 1200142 - DNA, 22 bp, Artificial Sequence
  chemically synthesized
acccacatcttacttaatgttt

SEQ ID NO: 1200143 - DNA, 22 bp, Artificial Sequence
  chemically synthesized
agtactaaattccactgaaaac

SEQ ID NO: 1200144 - DNA, 22 bp, Artificial Sequence
  chemically synthesized
acttaatgttttcagtggaatt

SEQ ID NO: 1200145 - DNA, 22 bp, Artificial Sequence
  chemically synthesized
cttaatgttttcagtggaattt

SEQ ID NO: 1200146 - DNA, 22 bp, Artificial Sequence
  chemically synthesized
aatgttttcagtggaatttagt

SEQ ID NO: 1200147 - DNA, 22 bp, Artificial Sequence
  chemically synthesized
atgttttcagtggaatttagta

SEQ ID NO: 1200148 - DNA, 22 bp, Artificial Sequence
  chemically synthesized
tcagtggaatttagtacttaat

SEQ ID NO: 1200149 - DNA, 22 bp, Artificial Sequence
  chemically synthesized
cagtggaatttagtacttaatt

SEQ ID NO: 1200150 - DNA, 22 bp, Artificial Sequence
  chemically synthesized
agtggaatttagtacttaatta

SEQ ID NO: 1200151 - DNA, 22 bp, Artificial Sequence
  chemically synthesized
atcatgagaggaataattaagt

SEQ ID NO: 1200152 - DNA, 22 bp, Artificial Sequence
  chemically synthesized
agtacttaattattcctctcat

SEQ ID NO: 1200153 - DNA, 22 bp, Artificial Sequence
  chemically synthesized
gtacttaattattcctctcatg

SEQ ID NO: 1200154 - DNA, 22 bp, Artificial Sequence
  chemically synthesized
aattattcctctcatgatcaac

SEQ ID NO: 1200155 - DNA, 22 bp, Artificial Sequence
  chemically synthesized
attattcctctcatgatcaacc

SEQ ID NO: 1200156 - DNA, 22 bp, Artificial Sequence
  chemically synthesized
ttcctctcatgatcaaccctcc

SEQ ID NO: 1200157 - DNA, 22 bp, Artificial Sequence
  chemically synthesized
tggcagagaggtgggagggttg

SEQ ID NO: 1200158 - DNA, 22 bp, Artificial Sequence
  chemically synthesized
ctctcatgatcaaccctcccac

SEQ ID NO: 1200159 - DNA, 22 bp, Artificial Sequence
  chemically synthesized
tcatgatcaaccctcccacctc

SEQ ID NO: 1200160 - DNA, 22 bp, Artificial Sequence
  chemically synthesized
atgatcaaccctcccacctctc

SEQ ID NO: 1200161 - DNA, 22 bp, Artificial Sequence
  chemically synthesized
ggaagaccaaaaaggttgtggc

SEQ ID NO: 1200162 - DNA, 22 bp, Artificial Sequence
  chemically synthesized
ccacctctctgccacaaccttt

SEQ ID NO: 1200163 - DNA, 22 bp, Artificial Sequence
  chemically synthesized
tctgccacaacctttttggtct

SEQ ID NO: 1200164 - DNA, 22 bp, Artificial Sequence
  chemically synthesized
tgccacaacctttttggtcttc

SEQ ID NO: 1200165 - DNA, 22 bp, Artificial Sequence
  chemically synthesized
ccacaacctttttggtcttcct

SEQ ID NO: 1200166 - DNA, 22 bp, Artificial Sequence
  chemically synthesized
tttggtcttcctagcattgtgt

SEQ ID NO: 1200167 - DNA, 22 bp, Artificial Sequence
  chemically synthesized
ttggtcttcctagcattgtgtg

SEQ ID NO: 1200168 - DNA, 22 bp, Artificial Sequence
  chemically synthesized
tggtcttcctagcattgtgtga

SEQ ID NO: 1200169 - DNA, 22 bp, Artificial Sequence
  chemically synthesized
ggtcttcctagcattgtgtgat

SEQ ID NO: 1200170 - DNA, 22 bp, Artificial Sequence
  chemically synthesized
gtcttcctagcattgtgtgatc

SEQ ID NO: 1200171 - DNA, 22 bp, Artificial Sequence
  chemically synthesized
cctagcattgtgtgatcttggt

SEQ ID NO: 1200172 - DNA, 22 bp, Artificial Sequence
  chemically synthesized
tgagaagaagacaccaagatca

SEQ ID NO: 1200173 - DNA, 22 bp, Artificial Sequence
  chemically synthesized
ctagcattgtgtgatcttggtg

SEQ ID NO: 1200174 - DNA, 22 bp, Artificial Sequence
  chemically synthesized
atgagaagaagacaccaagatc

SEQ ID NO: 1200175 - DNA, 22 bp, Artificial Sequence
  chemically synthesized
gcattgtgtgatcttggtgtct

SEQ ID NO: 1200176 - DNA, 22 bp, Artificial Sequence
  chemically synthesized
tgtgatcttggtgtcttcttct

SEQ ID NO: 1200177 - DNA, 22 bp, Artificial Sequence
  chemically synthesized
ggtgtcttcttctcataaggca

SEQ ID NO: 1200178 - DNA, 22 bp, Artificial Sequence
  chemically synthesized
gtgtcttcttctcataaggcat

SEQ ID NO: 1200179 - DNA, 22 bp, Artificial Sequence
  chemically synthesized
aaaccatgagagaatatgcctt

SEQ ID NO: 1200180 - DNA, 22 bp, Artificial Sequence
  chemically synthesized
cttctcataaggcatattctct

SEQ ID NO: 1200181 - DNA, 22 bp, Artificial Sequence
  chemically synthesized
ttctcataaggcatattctctc

SEQ ID NO: 1200182 - DNA, 22 bp, Artificial Sequence
  chemically synthesized
ctcataaggcatattctctcat

SEQ ID NO: 1200183 - DNA, 22 bp, Artificial Sequence
  chemically synthesized
acagttgaaaccatgagagaat

SEQ ID NO: 1200184 - DNA, 22 bp, Artificial Sequence
  chemically synthesized
tcataaggcatattctctcatg

SEQ ID NO: 1200185 - DNA, 22 bp, Artificial Sequence
  chemically synthesized
aacagttgaaaccatgagagaa

SEQ ID NO: 1200186 - DNA, 22 bp, Artificial Sequence
  chemically synthesized
ataaggcatattctctcatggt

SEQ ID NO: 1200187 - DNA, 22 bp, Artificial Sequence
  chemically synthesized
gcatatttaacagttgaaacca

SEQ ID NO: 1200188 - DNA, 22 bp, Artificial Sequence
  chemically synthesized
tctcatggtttcaactgttaaa

SEQ ID NO: 1200189 - DNA, 22 bp, Artificial Sequence
  chemically synthesized
atcattagcatatttaacagtt

SEQ ID NO: 1200190 - DNA, 22 bp, Artificial Sequence
  chemically synthesized
aatcattagcatatttaacagt

SEQ ID NO: 1200191 - DNA, 22 bp, Artificial Sequence
  chemically synthesized
tcatggtttcaactgttaaata

SEQ ID NO: 1200192 - DNA, 22 bp, Artificial Sequence
  chemically synthesized
taatcattagcatatttaacag

SEQ ID NO: 1200193 - DNA, 22 bp, Artificial Sequence
  chemically synthesized
ttaatcattagcatatttaaca

SEQ ID NO: 1200194 - DNA, 22 bp, Artificial Sequence
  chemically synthesized
atggtttcaactgttaaatatg

SEQ ID NO: 1200195 - DNA, 22 bp, Artificial Sequence
  chemically synthesized
caactgttaaatatgctaatga

SEQ ID NO: 1200196 - DNA, 22 bp, Artificial Sequence
  chemically synthesized
aactgttaaatatgctaatgat

SEQ ID NO: 1200197 - DNA, 22 bp, Artificial Sequence
  chemically synthesized
ttaaatatgctaatgattaaaa

SEQ ID NO: 1200198 - DNA, 22 bp, Artificial Sequence
  chemically synthesized
aatatgctaatgattaaaaact

SEQ ID NO: 1200199 - DNA, 22 bp, Artificial Sequence
  chemically synthesized
agcagataggtgcacagttttt

SEQ ID NO: 1200200 - DNA, 22 bp, Artificial Sequence
  chemically synthesized
gagcagataggtgcacagtttt

SEQ ID NO: 1200201 - DNA, 22 bp, Artificial Sequence
  chemically synthesized
atgattaaaaactgtgcaccta

SEQ ID NO: 1200202 - DNA, 22 bp, Artificial Sequence
  chemically synthesized
aaaactgtgcacctatctgctc

SEQ ID NO: 1200203 - DNA, 22 bp, Artificial Sequence
  chemically synthesized
aaaaggaggtttgagcagatag

SEQ ID NO: 1200204 - DNA, 22 bp, Artificial Sequence
  chemically synthesized
aaaaaggaggtttgagcagata

SEQ ID NO: 1200205 - DNA, 22 bp, Artificial Sequence
  chemically synthesized
tgcacctatctgctcaaacctc

SEQ ID NO: 1200206 - DNA, 22 bp, Artificial Sequence
  chemically synthesized
aaccttaaaaaggaggtttgag

SEQ ID NO: 1200207 - DNA, 22 bp, Artificial Sequence
  chemically synthesized
tctgctcaaacctcctttttaa

SEQ ID NO: 1200208 - DNA, 22 bp, Artificial Sequence
  chemically synthesized
ctcaaacctcctttttaaggtt

SEQ ID NO: 1200209 - DNA, 22 bp, Artificial Sequence
  chemically synthesized
aaacctcctttttaaggttcag

SEQ ID NO: 1200210 - DNA, 22 bp, Artificial Sequence
  chemically synthesized
ctttttaaggttcagattcata

SEQ ID NO: 1200211 - DNA, 22 bp, Artificial Sequence
  chemically synthesized
ggccaccatgtatatgaatctg

SEQ ID NO: 1200212 - DNA, 22 bp, Artificial Sequence
  chemically synthesized
tttaaggttcagattcatatac

SEQ ID NO: 1200213 - DNA, 22 bp, Artificial Sequence
  chemically synthesized
ctaggccaccatgtatatgaat

SEQ ID NO: 1200214 - DNA, 22 bp, Artificial Sequence
  chemically synthesized
ttaaggttcagattcatataca

SEQ ID NO: 1200215 - DNA, 22 bp, Artificial Sequence
  chemically synthesized
taaggttcagattcatatacat

SEQ ID NO: 1200216 - DNA, 22 bp, Artificial Sequence
  chemically synthesized
aaggttcagattcatatacatg

SEQ ID NO: 1200217 - DNA, 22 bp, Artificial Sequence
  chemically synthesized
aggttcagattcatatacatgg

SEQ ID NO: 1200218 - DNA, 22 bp, Artificial Sequence
  chemically synthesized
agattcatatacatggtggcct

SEQ ID NO: 1200219 - DNA, 22 bp, Artificial Sequence
  chemically synthesized
gtaaaatgtctactaggccacc

SEQ ID NO: 1200220 - DNA, 22 bp, Artificial Sequence
  chemically synthesized
ggtaaaatgtctactaggccac

SEQ ID NO: 1200221 - DNA, 22 bp, Artificial Sequence
  chemically synthesized
tggtaaaatgtctactaggcca

SEQ ID NO: 1200222 - DNA, 22 bp, Artificial Sequence
  chemically synthesized
ttggtaaaatgtctactaggcc

SEQ ID NO: 1200223 - DNA, 22 bp, Artificial Sequence
  chemically synthesized
atatacatggtggcctagtaga

SEQ ID NO: 1200224 - DNA, 22 bp, Artificial Sequence
  chemically synthesized
atgtgcttttggtaaaatgtct

SEQ ID NO: 1200225 - DNA, 22 bp, Artificial Sequence
  chemically synthesized
aatgtgcttttggtaaaatgtc

SEQ ID NO: 1200226 - DNA, 22 bp, Artificial Sequence
  chemically synthesized
atttaatgtgcttttggtaaaa

SEQ ID NO: 1200227 - DNA, 22 bp, Artificial Sequence
  chemically synthesized
gtagacattttaccaaaagcac

SEQ ID NO: 1200228 - DNA, 22 bp, Artificial Sequence
  chemically synthesized
ggtctaatttaatgtgcttttg

SEQ ID NO: 1200229 - DNA, 22 bp, Artificial Sequence
  chemically synthesized
aggtctaatttaatgtgctttt

SEQ ID NO: 1200230 - DNA, 22 bp, Artificial Sequence
  chemically synthesized
ttaggtctaatttaatgtgctt

SEQ ID NO: 1200231 - DNA, 22 bp, Artificial Sequence
  chemically synthesized
cttaggtctaatttaatgtgct

SEQ ID NO: 1200232 - DNA, 22 bp, Artificial Sequence
  chemically synthesized
tcttaggtctaatttaatgtgc

SEQ ID NO: 1200233 - DNA, 22 bp, Artificial Sequence
  chemically synthesized
ttcttaggtctaatttaatgtg

SEQ ID NO: 1200234 - DNA, 22 bp, Artificial Sequence
  chemically synthesized
taccaaaagcacattaaattag

SEQ ID NO: 1200235 - DNA, 22 bp, Artificial Sequence
  chemically synthesized
accaaaagcacattaaattaga

SEQ ID NO: 1200236 - DNA, 22 bp, Artificial Sequence
  chemically synthesized
atttttcttaggtctaatttaa

SEQ ID NO: 1200237 - DNA, 22 bp, Artificial Sequence
  chemically synthesized
ccaaaagcacattaaattagac

SEQ ID NO: 1200238 - DNA, 22 bp, Artificial Sequence
  chemically synthesized
catttttcttaggtctaattta

SEQ ID NO: 1200239 - DNA, 22 bp, Artificial Sequence
  chemically synthesized
aattagacctaagaaaaatgaa

SEQ ID NO: 1200240 - DNA, 22 bp, Artificial Sequence
  chemically synthesized
gacctaagaaaaatgaaatcca

SEQ ID NO: 1200241 - DNA, 22 bp, Artificial Sequence
  chemically synthesized
agaaaaatgaaatccatcttct

SEQ ID NO: 1200242 - DNA, 22 bp, Artificial Sequence
  chemically synthesized
gagggagggagtaaagaagatg

SEQ ID NO: 1200243 - DNA, 22 bp, Artificial Sequence
  chemically synthesized
ggagggagggagtaaagaagat

SEQ ID NO: 1200244 - DNA, 22 bp, Artificial Sequence
  chemically synthesized
aataacgaggtttggagggagg

SEQ ID NO: 1200245 - DNA, 22 bp, Artificial Sequence
  chemically synthesized
aaataacgaggtttggagggag

SEQ ID NO: 1200246 - DNA, 22 bp, Artificial Sequence
  chemically synthesized
ctttactccctccctccaaacc

SEQ ID NO: 1200247 - DNA, 22 bp, Artificial Sequence
  chemically synthesized
tttactccctccctccaaacct

SEQ ID NO: 1200248 - DNA, 22 bp, Artificial Sequence
  chemically synthesized
tactccctccctccaaacctcg

SEQ ID NO: 1200249 - DNA, 22 bp, Artificial Sequence
  chemically synthesized
actccctccctccaaacctcgt

SEQ ID NO: 1200250 - DNA, 22 bp, Artificial Sequence
  chemically synthesized
ctccctccctccaaacctcgtt

SEQ ID NO: 1200251 - DNA, 22 bp, Artificial Sequence
  chemically synthesized
cctccctccaaacctcgttatt

SEQ ID NO: 1200252 - DNA, 22 bp, Artificial Sequence
  chemically synthesized
cctccaaacctcgttatttaaa

SEQ ID NO: 1200253 - DNA, 22 bp, Artificial Sequence
  chemically synthesized
caaacctcgttatttaaactgg

SEQ ID NO: 1200254 - DNA, 22 bp, Artificial Sequence
  chemically synthesized
cacaagtgaacagaagtccagt

SEQ ID NO: 1200255 - DNA, 22 bp, Artificial Sequence
  chemically synthesized
acacaagtgaacagaagtccag

SEQ ID NO: 1200256 - DNA, 22 bp, Artificial Sequence
  chemically synthesized
gttatttaaactggacttctgt

SEQ ID NO: 1200257 - DNA, 22 bp, Artificial Sequence
  chemically synthesized
tttaaactggacttctgttcac

SEQ ID NO: 1200258 - DNA, 22 bp, Artificial Sequence
  chemically synthesized
aaactggacttctgttcacttg

SEQ ID NO: 1200259 - DNA, 22 bp, Artificial Sequence
  chemically synthesized
aactggacttctgttcacttgt

SEQ ID NO: 1200260 - DNA, 22 bp, Artificial Sequence
  chemically synthesized
tatgataatgtcttacacaagt

SEQ ID NO: 1200261 - DNA, 22 bp, Artificial Sequence
  chemically synthesized
gacttctgttcacttgtgtaag

SEQ ID NO: 1200262 - DNA, 22 bp, Artificial Sequence
  chemically synthesized
ctgttcacttgtgtaagacatt

SEQ ID NO: 1200263 - DNA, 22 bp, Artificial Sequence
  chemically synthesized
tgttcacttgtgtaagacatta

SEQ ID NO: 1200264 - DNA, 22 bp, Artificial Sequence
  chemically synthesized
ttcacttgtgtaagacattatc

SEQ ID NO: 1200265 - DNA, 22 bp, Artificial Sequence
  chemically synthesized
ggatgatctgtatgataatgtc

SEQ ID NO: 1200266 - DNA, 22 bp, Artificial Sequence
  chemically synthesized
acttgtgtaagacattatcata

SEQ ID NO: 1200267 - DNA, 22 bp, Artificial Sequence
  chemically synthesized
gtgtaagacattatcatacaga

SEQ ID NO: 1200268 - DNA, 22 bp, Artificial Sequence
  chemically synthesized
tgtaagacattatcatacagat

SEQ ID NO: 1200269 - DNA, 22 bp, Artificial Sequence
  chemically synthesized
tcatacagatcatcctagcata

SEQ ID NO: 1200270 - DNA, 22 bp, Artificial Sequence
  chemically synthesized
gatatgacaggatagggaggtg

SEQ ID NO: 1200271 - DNA, 22 bp, Artificial Sequence
  chemically synthesized
gcatacttcacctccctatcct

SEQ ID NO: 1200272 - DNA, 22 bp, Artificial Sequence
  chemically synthesized
aggaatgactagatatgacagg

SEQ ID NO: 1200273 - DNA, 22 bp, Artificial Sequence
  chemically synthesized
cacctccctatcctgtcatatc

SEQ ID NO: 1200274 - DNA, 22 bp, Artificial Sequence
  chemically synthesized
aaggaatgactagatatgacag

SEQ ID NO: 1200275 - DNA, 22 bp, Artificial Sequence
  chemically synthesized
acctccctatcctgtcatatct

SEQ ID NO: 1200276 - DNA, 22 bp, Artificial Sequence
  chemically synthesized
cctatcctgtcatatctagtca

SEQ ID NO: 1200277 - DNA, 22 bp, Artificial Sequence
  chemically synthesized
atgggacttaaggaatgactag

SEQ ID NO: 1200278 - DNA, 22 bp, Artificial Sequence
  chemically synthesized
tcctgtcatatctagtcattcc

SEQ ID NO: 1200279 - DNA, 22 bp, Artificial Sequence
  chemically synthesized
attgatgggacttaaggaatga

SEQ ID NO: 1200280 - DNA, 22 bp, Artificial Sequence
  chemically synthesized
tcatatctagtcattccttaag

SEQ ID NO: 1200281 - DNA, 22 bp, Artificial Sequence
  chemically synthesized
gtcattccttaagtcccatcaa

SEQ ID NO: 1200282 - DNA, 22 bp, Artificial Sequence
  chemically synthesized
ggatggagaagattcattgatg

SEQ ID NO: 1200283 - DNA, 22 bp, Artificial Sequence
  chemically synthesized
cttaagtcccatcaatgaatct

SEQ ID NO: 1200284 - DNA, 22 bp, Artificial Sequence
  chemically synthesized
attgggatggagaagattcatt

SEQ ID NO: 1200285 - DNA, 22 bp, Artificial Sequence
  chemically synthesized
aagtcccatcaatgaatcttct

SEQ ID NO: 1200286 - DNA, 22 bp, Artificial Sequence
  chemically synthesized
agtcccatcaatgaatcttctc

SEQ ID NO: 1200287 - DNA, 22 bp, Artificial Sequence
  chemically synthesized
ctccatcccaatcaatcctctt

SEQ ID NO: 1200288 - DNA, 22 bp, Artificial Sequence
  chemically synthesized
acaaagcagatgaagaggattg

SEQ ID NO: 1200289 - DNA, 22 bp, Artificial Sequence
  chemically synthesized
tccatcccaatcaatcctcttc

SEQ ID NO: 1200290 - DNA, 22 bp, Artificial Sequence
  chemically synthesized
catcccaatcaatcctcttcat

SEQ ID NO: 1200291 - DNA, 22 bp, Artificial Sequence
  chemically synthesized
gagtattgacaaagcagatgaa

SEQ ID NO: 1200292 - DNA, 22 bp, Artificial Sequence
  chemically synthesized
aacctagagtattgacaaagca

SEQ ID NO: 1200293 - DNA, 22 bp, Artificial Sequence
  chemically synthesized
ttcatctgctttgtcaatactc

SEQ ID NO: 1200294 - DNA, 22 bp, Artificial Sequence
  chemically synthesized
tatcctgaacctagagtattga

SEQ ID NO: 1200295 - DNA, 22 bp, Artificial Sequence
  chemically synthesized
catctgctttgtcaatactcta

SEQ ID NO: 1200296 - DNA, 22 bp, Artificial Sequence
  chemically synthesized
atatcctgaacctagagtattg

SEQ ID NO: 1200297 - DNA, 22 bp, Artificial Sequence
  chemically synthesized
atctgctttgtcaatactctag

SEQ ID NO: 1200298 - DNA, 22 bp, Artificial Sequence
  chemically synthesized
ctttgtcaatactctaggttca

SEQ ID NO: 1200299 - DNA, 22 bp, Artificial Sequence
  chemically synthesized
tgtcaatactctaggttcagga

SEQ ID NO: 1200300 - DNA, 22 bp, Artificial Sequence
  chemically synthesized
gtcaatactctaggttcaggat

SEQ ID NO: 1200301 - DNA, 22 bp, Artificial Sequence
  chemically synthesized
tcaatactctaggttcaggata

SEQ ID NO: 1200302 - DNA, 22 bp, Artificial Sequence
  chemically synthesized
taggttcaggatataaacactt

SEQ ID NO: 1200303 - DNA, 22 bp, Artificial Sequence
  chemically synthesized
ggttcaggatataaacactttt

SEQ ID NO: 1200304 - DNA, 22 bp, Artificial Sequence
  chemically synthesized
gtaatagtccagatgaaaagtg

SEQ ID NO: 1200305 - DNA, 22 bp, Artificial Sequence
  chemically synthesized
aggatataaacacttttcatct

SEQ ID NO: 1200306 - DNA, 22 bp, Artificial Sequence
  chemically synthesized
ggagactggtaatagtccagat

SEQ ID NO: 1200307 - DNA, 22 bp, Artificial Sequence
  chemically synthesized
cggagactggtaatagtccaga

SEQ ID NO: 1200308 - DNA, 22 bp, Artificial Sequence
  chemically synthesized
tcggagactggtaatagtccag

SEQ ID NO: 1200309 - DNA, 22 bp, Artificial Sequence
  chemically synthesized
ttcggagactggtaatagtcca

SEQ ID NO: 1200310 - DNA, 22 bp, Artificial Sequence
  chemically synthesized
ttcatctggactattaccagtc

SEQ ID NO: 1200311 - DNA, 22 bp, Artificial Sequence
  chemically synthesized
tatcttttcggagactggtaat

SEQ ID NO: 1200312 - DNA, 22 bp, Artificial Sequence
  chemically synthesized
tcatctggactattaccagtct

SEQ ID NO: 1200313 - DNA, 22 bp, Artificial Sequence
  chemically synthesized
catctggactattaccagtctc

SEQ ID NO: 1200314 - DNA, 22 bp, Artificial Sequence
  chemically synthesized
atctggactattaccagtctcc

SEQ ID NO: 1200315 - DNA, 22 bp, Artificial Sequence
  chemically synthesized
gactattaccagtctccgaaaa

SEQ ID NO: 1200316 - DNA, 22 bp, Artificial Sequence
  chemically synthesized
agaaaaattgtatcttttcgga

SEQ ID NO: 1200317 - DNA, 22 bp, Artificial Sequence
  chemically synthesized
gagaaaaattgtatcttttcgg

SEQ ID NO: 1200318 - DNA, 22 bp, Artificial Sequence
  chemically synthesized
ttaccagtctccgaaaagatac

SEQ ID NO: 1200319 - DNA, 22 bp, Artificial Sequence
  chemically synthesized
ccagtctccgaaaagatacaat

SEQ ID NO: 1200320 - DNA, 22 bp, Artificial Sequence
  chemically synthesized
cgaaaagatacaatttttctca

SEQ ID NO: 1200321 - DNA, 22 bp, Artificial Sequence
  chemically synthesized
aaatcatacgtatttgagaaaa

SEQ ID NO: 1200322 - DNA, 22 bp, Artificial Sequence
  chemically synthesized
taaaatcatacgtatttgagaa

SEQ ID NO: 1200323 - DNA, 22 bp, Artificial Sequence
  chemically synthesized
ctaaaatcatacgtatttgaga

SEQ ID NO: 1200324 - DNA, 22 bp, Artificial Sequence
  chemically synthesized
ttctaaaatcatacgtatttga

SEQ ID NO: 1200325 - DNA, 22 bp, Artificial Sequence
  chemically synthesized
ttctcaaatacgtatgatttta

SEQ ID NO: 1200326 - DNA, 22 bp, Artificial Sequence
  chemically synthesized
tctcaaatacgtatgattttag

SEQ ID NO: 1200327 - DNA, 22 bp, Artificial Sequence
  chemically synthesized
ctcaaatacgtatgattttaga

SEQ ID NO: 1200328 - DNA, 22 bp, Artificial Sequence
  chemically synthesized
atggtaatctcttctaaaatca

SEQ ID NO: 1200329 - DNA, 22 bp, Artificial Sequence
  chemically synthesized
tcaaatacgtatgattttagaa

SEQ ID NO: 1200330 - DNA, 22 bp, Artificial Sequence
  chemically synthesized
aaatacgtatgattttagaaga

SEQ ID NO: 1200331 - DNA, 22 bp, Artificial Sequence
  chemically synthesized
tagaagagattaccatcaggat

SEQ ID NO: 1200332 - DNA, 22 bp, Artificial Sequence
  chemically synthesized
agaagagattaccatcaggatc

SEQ ID NO: 1200333 - DNA, 22 bp, Artificial Sequence
  chemically synthesized
gaagagattaccatcaggatca

SEQ ID NO: 1200334 - DNA, 22 bp, Artificial Sequence
  chemically synthesized
aagataatgagccaatgatcct

SEQ ID NO: 1200335 - DNA, 22 bp, Artificial Sequence
  chemically synthesized
ccctgaagataatgagccaatg

SEQ ID NO: 1200336 - DNA, 22 bp, Artificial Sequence
  chemically synthesized
ccatcaggatcattggctcatt

SEQ ID NO: 1200337 - DNA, 22 bp, Artificial Sequence
  chemically synthesized
ccaccccgcatcactgccctga

SEQ ID NO: 1200338 - DNA, 22 bp, Artificial Sequence
  chemically synthesized
gctcattatcttcagggcagtg

SEQ ID NO: 1200339 - DNA, 22 bp, Artificial Sequence
  chemically synthesized
tcccaccccgcatcactgccct

SEQ ID NO: 1200340 - DNA, 22 bp, Artificial Sequence
  chemically synthesized
attatcttcagggcagtgatgc

SEQ ID NO: 1200341 - DNA, 22 bp, Artificial Sequence
  chemically synthesized
tcttcagggcagtgatgcgggg

SEQ ID NO: 1200342 - DNA, 22 bp, Artificial Sequence
  chemically synthesized
agaactctcccaccccgcatca

SEQ ID NO: 1200343 - DNA, 22 bp, Artificial Sequence
  chemically synthesized
aagaactctcccaccccgcatc

SEQ ID NO: 1200344 - DNA, 22 bp, Artificial Sequence
  chemically synthesized
taagaactctcccaccccgcat

SEQ ID NO: 1200345 - DNA, 22 bp, Artificial Sequence
  chemically synthesized
cagggcagtgatgcggggtggg

SEQ ID NO: 1200346 - DNA, 22 bp, Artificial Sequence
  chemically synthesized
agggcagtgatgcggggtggga

SEQ ID NO: 1200347 - DNA, 22 bp, Artificial Sequence
  chemically synthesized
ataatcacatgtagaatacagt

SEQ ID NO: 1200348 - DNA, 22 bp, Artificial Sequence
  chemically synthesized
actcataatcacatgtagaata

SEQ ID NO: 1200349 - DNA, 22 bp, Artificial Sequence
  chemically synthesized
ttaaaggactgtattctacatg

SEQ ID NO: 1200350 - DNA, 22 bp, Artificial Sequence
  chemically synthesized
gactcataatcacatgtagaat

SEQ ID NO: 1200351 - DNA, 22 bp, Artificial Sequence
  chemically synthesized
aaaggactgtattctacatgtg

SEQ ID NO: 1200352 - DNA, 22 bp, Artificial Sequence
  chemically synthesized
aaggactgtattctacatgtga

SEQ ID NO: 1200353 - DNA, 22 bp, Artificial Sequence
  chemically synthesized
gaaaatttgactcataatcaca

SEQ ID NO: 1200354 - DNA, 22 bp, Artificial Sequence
  chemically synthesized
tattctacatgtgattatgagt

SEQ ID NO: 1200355 - DNA, 22 bp, Artificial Sequence
  chemically synthesized
tacatgtgattatgagtcaaat

SEQ ID NO: 1200356 - DNA, 22 bp, Artificial Sequence
  chemically synthesized
catgtgattatgagtcaaattt

SEQ ID NO: 1200357 - DNA, 22 bp, Artificial Sequence
  chemically synthesized
cagtggtctggaaaatttgact

SEQ ID NO: 1200358 - DNA, 22 bp, Artificial Sequence
  chemically synthesized
tgtctacagtggtctggaaaat

SEQ ID NO: 1200359 - DNA, 22 bp, Artificial Sequence
  chemically synthesized
tgagtcaaattttccagaccac

SEQ ID NO: 1200360 - DNA, 22 bp, Artificial Sequence
  chemically synthesized
tccagaccactgtagacacaat

SEQ ID NO: 1200361 - DNA, 22 bp, Artificial Sequence
  chemically synthesized
ccagaccactgtagacacaatc

SEQ ID NO: 1200362 - DNA, 22 bp, Artificial Sequence
  chemically synthesized
cagaccactgtagacacaatct

SEQ ID NO: 1200363 - DNA, 22 bp, Artificial Sequence
  chemically synthesized
cgtgaaacagtgaagtgtaaga

SEQ ID NO: 1200364 - DNA, 22 bp, Artificial Sequence
  chemically synthesized
tagacacaatcttacacttcac

SEQ ID NO: 1200365 - DNA, 22 bp, Artificial Sequence
  chemically synthesized
acacttcactgtttcacgcagc

SEQ ID NO: 1200366 - DNA, 22 bp, Artificial Sequence
  chemically synthesized
cacttcactgtttcacgcagct

SEQ ID NO: 1200367 - DNA, 22 bp, Artificial Sequence
  chemically synthesized
tgtaggtatcatagctgcgtga

SEQ ID NO: 1200368 - DNA, 22 bp, Artificial Sequence
  chemically synthesized
ttgtgtaggtatcatagctgcg

SEQ ID NO: 1200369 - DNA, 22 bp, Artificial Sequence
  chemically synthesized
cactgtttcacgcagctatgat

SEQ ID NO: 1200370 - DNA, 22 bp, Artificial Sequence
  chemically synthesized
actgtttcacgcagctatgata

SEQ ID NO: 1200371 - DNA, 22 bp, Artificial Sequence
  chemically synthesized
cagttgttgtgtaggtatcata

SEQ ID NO: 1200372 - DNA, 22 bp, Artificial Sequence
  chemically synthesized
tttcacgcagctatgataccta

SEQ ID NO: 1200373 - DNA, 22 bp, Artificial Sequence
  chemically synthesized
acagttgttgtgtaggtatcat

SEQ ID NO: 1200374 - DNA, 22 bp, Artificial Sequence
  chemically synthesized
cacgcagctatgatacctacac

SEQ ID NO: 1200375 - DNA, 22 bp, Artificial Sequence
  chemically synthesized
acgcagctatgatacctacaca

SEQ ID NO: 1200376 - DNA, 22 bp, Artificial Sequence
  chemically synthesized
acatccttacagttgttgtgta

SEQ ID NO: 1200377 - DNA, 22 bp, Artificial Sequence
  chemically synthesized
tgatacctacacaacaactgta

SEQ ID NO: 1200378 - DNA, 22 bp, Artificial Sequence
  chemically synthesized
aaactcacatccttacagttgt

SEQ ID NO: 1200379 - DNA, 22 bp, Artificial Sequence
  chemically synthesized
catctcaaactcacatccttac

SEQ ID NO: 1200380 - DNA, 22 bp, Artificial Sequence
  chemically synthesized
cacaacaactgtaaggatgtga

SEQ ID NO: 1200381 - DNA, 22 bp, Artificial Sequence
  chemically synthesized
taaggatgtgagtttgagatgt

SEQ ID NO: 1200382 - DNA, 22 bp, Artificial Sequence
  chemically synthesized
caataacaatctacatctcaaa

SEQ ID NO: 1200383 - DNA, 22 bp, Artificial Sequence
  chemically synthesized
gtctgcaataacaatctacatc

SEQ ID NO: 1200384 - DNA, 22 bp, Artificial Sequence
  chemically synthesized
ttagtctgcaataacaatctac

SEQ ID NO: 1200385 - DNA, 22 bp, Artificial Sequence
  chemically synthesized
gagatgtagattgttattgcag

SEQ ID NO: 1200386 - DNA, 22 bp, Artificial Sequence
  chemically synthesized
agatgtagattgttattgcaga

SEQ ID NO: 1200387 - DNA, 22 bp, Artificial Sequence
  chemically synthesized
gcaaggagtggttgttagtctg

SEQ ID NO: 1200388 - DNA, 22 bp, Artificial Sequence
  chemically synthesized
agcaaggagtggttgttagtct

SEQ ID NO: 1200389 - DNA, 22 bp, Artificial Sequence
  chemically synthesized
ttattgcagactaacaaccact

SEQ ID NO: 1200390 - DNA, 22 bp, Artificial Sequence
  chemically synthesized
ttgcagactaacaaccactcct

SEQ ID NO: 1200391 - DNA, 22 bp, Artificial Sequence
  chemically synthesized
aaacaaacttagcaaggagtgg

SEQ ID NO: 1200392 - DNA, 22 bp, Artificial Sequence
  chemically synthesized
cagactaacaaccactccttgc

SEQ ID NO: 1200393 - DNA, 22 bp, Artificial Sequence
  chemically synthesized
gaaacaaacttagcaaggagtg

SEQ ID NO: 1200394 - DNA, 22 bp, Artificial Sequence
  chemically synthesized
tgaaacaaacttagcaaggagt

SEQ ID NO: 1200395 - DNA, 22 bp, Artificial Sequence
  chemically synthesized
acaaccactccttgctaagttt

SEQ ID NO: 1200396 - DNA, 22 bp, Artificial Sequence
  chemically synthesized
agtccattttgaaacaaactta

SEQ ID NO: 1200397 - DNA, 22 bp, Artificial Sequence
  chemically synthesized
aagtccattttgaaacaaactt

SEQ ID NO: 1200398 - DNA, 22 bp, Artificial Sequence
  chemically synthesized
cttgctaagtttgtttcaaaat

SEQ ID NO: 1200399 - DNA, 22 bp, Artificial Sequence
  chemically synthesized
gctaagtttgtttcaaaatgga

SEQ ID NO: 1200400 - DNA, 22 bp, Artificial Sequence
  chemically synthesized
ctaagtttgtttcaaaatggac

SEQ ID NO: 1200401 - DNA, 22 bp, Artificial Sequence
  chemically synthesized
agtttgtttcaaaatggactta

SEQ ID NO: 1200402 - DNA, 22 bp, Artificial Sequence
  chemically synthesized
agatcacccccttaagtccatt

SEQ ID NO: 1200403 - DNA, 22 bp, Artificial Sequence
  chemically synthesized
gtttcaaaatggacttaagggg

SEQ ID NO: 1200404 - DNA, 22 bp, Artificial Sequence
  chemically synthesized
tttcaaaatggacttaaggggg

SEQ ID NO: 1200405 - DNA, 22 bp, Artificial Sequence
  chemically synthesized
caaaatggacttaagggggtga

SEQ ID NO: 1200406 - DNA, 22 bp, Artificial Sequence
  chemically synthesized
aaaatggacttaagggggtgat

SEQ ID NO: 1200407 - DNA, 22 bp, Artificial Sequence
  chemically synthesized
ccaaaaacaactgagatcaccc

SEQ ID NO: 1200408 - DNA, 22 bp, Artificial Sequence
  chemically synthesized
gccaaaaacaactgagatcacc

SEQ ID NO: 1200409 - DNA, 22 bp, Artificial Sequence
  chemically synthesized
ttgccaaaaacaactgagatca

SEQ ID NO: 1200410 - DNA, 22 bp, Artificial Sequence
  chemically synthesized
cttgccaaaaacaactgagatc

SEQ ID NO: 1200411 - DNA, 22 bp, Artificial Sequence
  chemically synthesized
tcttgccaaaaacaactgagat

SEQ ID NO: 1200412 - DNA, 22 bp, Artificial Sequence
  chemically synthesized
ttcttgccaaaaacaactgaga

SEQ ID NO: 1200413 - DNA, 22 bp, Artificial Sequence
  chemically synthesized
tttcttgccaaaaacaactgag

SEQ ID NO: 1200414 - DNA, 22 bp, Artificial Sequence
  chemically synthesized
aagggggtgatctcagttgttt

SEQ ID NO: 1200415 - DNA, 22 bp, Artificial Sequence
  chemically synthesized
ttttcttgccaaaaacaactga

SEQ ID NO: 1200416 - DNA, 22 bp, Artificial Sequence
  chemically synthesized
agggggtgatctcagttgtttt

SEQ ID NO: 1200417 - DNA, 22 bp, Artificial Sequence
  chemically synthesized
cttttttcttgccaaaaacaac

SEQ ID NO: 1200418 - DNA, 22 bp, Artificial Sequence
  chemically synthesized
ccaattacttttttcttgccaa

SEQ ID NO: 1200419 - DNA, 22 bp, Artificial Sequence
  chemically synthesized
gccaattacttttttcttgcca

SEQ ID NO: 1200420 - DNA, 22 bp, Artificial Sequence
  chemically synthesized
ttgccaattacttttttcttgc

SEQ ID NO: 1200421 - DNA, 22 bp, Artificial Sequence
  chemically synthesized
agttgtttttggcaagaaaaaa

SEQ ID NO: 1200422 - DNA, 22 bp, Artificial Sequence
  chemically synthesized
cttgccaattacttttttcttg

SEQ ID NO: 1200423 - DNA, 22 bp, Artificial Sequence
  chemically synthesized
tcttgccaattacttttttctt

SEQ ID NO: 1200424 - DNA, 22 bp, Artificial Sequence
  chemically synthesized
ttcttgccaattacttttttct

SEQ ID NO: 1200425 - DNA, 22 bp, Artificial Sequence
  chemically synthesized
tttcttgccaattacttttttc

SEQ ID NO: 1200426 - DNA, 22 bp, Artificial Sequence
  chemically synthesized
ttttcttgccaattactttttt

SEQ ID NO: 1200427 - DNA, 22 bp, Artificial Sequence
  chemically synthesized
tttttggcaagaaaaaagtaat

SEQ ID NO: 1200428 - DNA, 22 bp, Artificial Sequence
  chemically synthesized
cttttttcttgccaattacttt

SEQ ID NO: 1200429 - DNA, 22 bp, Artificial Sequence
  chemically synthesized
ttggcaagaaaaaagtaattgg

SEQ ID NO: 1200430 - DNA, 22 bp, Artificial Sequence
  chemically synthesized
tggcaagaaaaaagtaattggc

SEQ ID NO: 1200431 - DNA, 22 bp, Artificial Sequence
  chemically synthesized
ggcaagaaaaaagtaattggca

SEQ ID NO: 1200432 - DNA, 22 bp, Artificial Sequence
  chemically synthesized
gcaagaaaaaagtaattggcaa

SEQ ID NO: 1200433 - DNA, 22 bp, Artificial Sequence
  chemically synthesized
ccaattacttttttcttgccaa

SEQ ID NO: 1200434 - DNA, 22 bp, Artificial Sequence
  chemically synthesized
gccaattacttttttcttgcca

SEQ ID NO: 1200435 - DNA, 22 bp, Artificial Sequence
  chemically synthesized
ttgccaattacttttttcttgc

SEQ ID NO: 1200436 - DNA, 22 bp, Artificial Sequence
  chemically synthesized
cttgccaattacttttttcttg

SEQ ID NO: 1200437 - DNA, 22 bp, Artificial Sequence
  chemically synthesized
tcttgccaattacttttttctt

SEQ ID NO: 1200438 - DNA, 22 bp, Artificial Sequence
  chemically synthesized
gctttcttgccaattacttttt

SEQ ID NO: 1200439 - DNA, 22 bp, Artificial Sequence
  chemically synthesized
tggctttcttgccaattacttt

SEQ ID NO: 1200440 - DNA, 22 bp, Artificial Sequence
  chemically synthesized
tctggctttcttgccaattact

SEQ ID NO: 1200441 - DNA, 22 bp, Artificial Sequence
  chemically synthesized
ctctggctttcttgccaattac

SEQ ID NO: 1200442 - DNA, 22 bp, Artificial Sequence
  chemically synthesized
gcaagaaaaaagtaattggcaa

SEQ ID NO: 1200443 - DNA, 22 bp, Artificial Sequence
  chemically synthesized
tctctggctttcttgccaatta

SEQ ID NO: 1200444 - DNA, 22 bp, Artificial Sequence
  chemically synthesized
tttctctggctttcttgccaat

SEQ ID NO: 1200445 - DNA, 22 bp, Artificial Sequence
  chemically synthesized
tctttctctggctttcttgcca

SEQ ID NO: 1200446 - DNA, 22 bp, Artificial Sequence
  chemically synthesized
ctctttctctggctttcttgcc

SEQ ID NO: 1200447 - DNA, 22 bp, Artificial Sequence
  chemically synthesized
tctctttctctggctttcttgc

SEQ ID NO: 1200448 - DNA, 22 bp, Artificial Sequence
  chemically synthesized
tttctctttctctggctttctt

SEQ ID NO: 1200449 - DNA, 22 bp, Artificial Sequence
  chemically synthesized
ctctttctctttctctggcttt

SEQ ID NO: 1200450 - DNA, 22 bp, Artificial Sequence
  chemically synthesized
cctctttctctttctctggctt

SEQ ID NO: 1200451 - DNA, 22 bp, Artificial Sequence
  chemically synthesized
gcaagaaagccagagaaagaga

SEQ ID NO: 1200452 - DNA, 22 bp, Artificial Sequence
  chemically synthesized
aacaaacatttcctctttctct

SEQ ID NO: 1200453 - DNA, 22 bp, Artificial Sequence
  chemically synthesized
atgggctgaacaaacatttcct

SEQ ID NO: 1200454 - DNA, 22 bp, Artificial Sequence
  chemically synthesized
attcatgggctgaacaaacatt

SEQ ID NO: 1200455 - DNA, 22 bp, Artificial Sequence
  chemically synthesized
ctcattcatgggctgaacaaac

SEQ ID NO: 1200456 - DNA, 22 bp, Artificial Sequence
  chemically synthesized
taatgttactcattcatgggct

SEQ ID NO: 1200457 - DNA, 22 bp, Artificial Sequence
  chemically synthesized
gttcagcccatgaatgagtaac

SEQ ID NO: 1200458 - DNA, 22 bp, Artificial Sequence
  chemically synthesized
ttcagcccatgaatgagtaaca

SEQ ID NO: 1200459 - DNA, 22 bp, Artificial Sequence
  chemically synthesized
agcccatgaatgagtaacatta

SEQ ID NO: 1200460 - DNA, 22 bp, Artificial Sequence
  chemically synthesized
taaaaagcattgtaatgttact

SEQ ID NO: 1200461 - DNA, 22 bp, Artificial Sequence
  chemically synthesized
aagttataaaaagcattgtaat

SEQ ID NO: 1200462 - DNA, 22 bp, Artificial Sequence
  chemically synthesized
gaagttataaaaagcattgtaa

SEQ ID NO: 1200463 - DNA, 22 bp, Artificial Sequence
  chemically synthesized
caatgctttttataacttcaaa

SEQ ID NO: 1200464 - DNA, 22 bp, Artificial Sequence
  chemically synthesized
tatgggggtgaatgtttgaagt

SEQ ID NO: 1200465 - DNA, 22 bp, Artificial Sequence
  chemically synthesized
gtatgggggtgaatgtttgaag

SEQ ID NO: 1200466 - DNA, 22 bp, Artificial Sequence
  chemically synthesized
tttataacttcaaacattcacc

SEQ ID NO: 1200467 - DNA, 22 bp, Artificial Sequence
  chemically synthesized
ttataacttcaaacattcaccc

SEQ ID NO: 1200468 - DNA, 22 bp, Artificial Sequence
  chemically synthesized
tataacttcaaacattcacccc

SEQ ID NO: 1200469 - DNA, 22 bp, Artificial Sequence
  chemically synthesized
ataacttcaaacattcaccccc

SEQ ID NO: 1200470 - DNA, 22 bp, Artificial Sequence
  chemically synthesized
taacttcaaacattcaccccca

SEQ ID NO: 1200471 - DNA, 22 bp, Artificial Sequence
  chemically synthesized
tagagcatttgtatgggggtga

SEQ ID NO: 1200472 - DNA, 22 bp, Artificial Sequence
  chemically synthesized
atagagcatttgtatgggggtg

SEQ ID NO: 1200473 - DNA, 22 bp, Artificial Sequence
  chemically synthesized
tatagagcatttgtatgggggt

SEQ ID NO: 1200474 - DNA, 22 bp, Artificial Sequence
  chemically synthesized
caaacattcacccccatacaaa

SEQ ID NO: 1200475 - DNA, 22 bp, Artificial Sequence
  chemically synthesized
aaacattcacccccatacaaat

SEQ ID NO: 1200476 - DNA, 22 bp, Artificial Sequence
  chemically synthesized
acccccatacaaatgctctata

SEQ ID NO: 1200477 - DNA, 22 bp, Artificial Sequence
  chemically synthesized
atcatcatgacaatagttttat

SEQ ID NO: 1200478 - DNA, 22 bp, Artificial Sequence
  chemically synthesized
attgatcatcatgacaatagtt

SEQ ID NO: 1200479 - DNA, 22 bp, Artificial Sequence
  chemically synthesized
tataaaactattgtcatgatga

SEQ ID NO: 1200480 - DNA, 22 bp, Artificial Sequence
  chemically synthesized
aaatgctgattgatcatcatga

SEQ ID NO: 1200481 - DNA, 22 bp, Artificial Sequence
  chemically synthesized
taaaactattgtcatgatgatc

SEQ ID NO: 1200482 - DNA, 22 bp, Artificial Sequence
  chemically synthesized
aaaatgctgattgatcatcatg

SEQ ID NO: 1200483 - DNA, 22 bp, Artificial Sequence
  chemically synthesized
aacttaaaatgctgattgatca

SEQ ID NO: 1200484 - DNA, 22 bp, Artificial Sequence
  chemically synthesized
caacttaaaatgctgattgatc

SEQ ID NO: 1200485 - DNA, 22 bp, Artificial Sequence
  chemically synthesized
ttgtcatgatgatcaatcagca

SEQ ID NO: 1200486 - DNA, 22 bp, Artificial Sequence
  chemically synthesized
tcatgatgatcaatcagcattt

SEQ ID NO: 1200487 - DNA, 22 bp, Artificial Sequence
  chemically synthesized
gatatatatgtttcaacttaaa

SEQ ID NO: 1200488 - DNA, 22 bp, Artificial Sequence
  chemically synthesized
ggatatatatgtttcaacttaa

SEQ ID NO: 1200489 - DNA, 22 bp, Artificial Sequence
  chemically synthesized
taagttgaaacatatatatcca

SEQ ID NO: 1200490 - DNA, 22 bp, Artificial Sequence
  chemically synthesized
aagttgaaacatatatatccaa

SEQ ID NO: 1200491 - DNA, 22 bp, Artificial Sequence
  chemically synthesized
agttgaaacatatatatccaag

SEQ ID NO: 1200492 - DNA, 22 bp, Artificial Sequence
  chemically synthesized
aaacatatatatccaagtttct

SEQ ID NO: 1200493 - DNA, 22 bp, Artificial Sequence
  chemically synthesized
atacagaacaagatcagaaact

SEQ ID NO: 1200494 - DNA, 22 bp, Artificial Sequence
  chemically synthesized
tgttgatacagaacaagatcag

SEQ ID NO: 1200495 - DNA, 22 bp, Artificial Sequence
  chemically synthesized
tgagtgctgtgttgatacagaa

SEQ ID NO: 1200496 - DNA, 22 bp, Artificial Sequence
  chemically synthesized
tgtgagtgctgtgttgatacag

SEQ ID NO: 1200497 - DNA, 22 bp, Artificial Sequence
  chemically synthesized
ctgatcttgttctgtatcaaca

SEQ ID NO: 1200498 - DNA, 22 bp, Artificial Sequence
  chemically synthesized
tgatcttgttctgtatcaacac

SEQ ID NO: 1200499 - DNA, 22 bp, Artificial Sequence
  chemically synthesized
atcttgttctgtatcaacacag

SEQ ID NO: 1200500 - DNA, 22 bp, Artificial Sequence
  chemically synthesized
agttctgtgagtgctgtgttga

SEQ ID NO: 1200501 - DNA, 22 bp, Artificial Sequence
  chemically synthesized
ctgagttctgtgagtgctgtgt

SEQ ID NO: 1200502 - DNA, 22 bp, Artificial Sequence
  chemically synthesized
gttctgtatcaacacagcactc

SEQ ID NO: 1200503 - DNA, 22 bp, Artificial Sequence
  chemically synthesized
cctgagttctgtgagtgctgtg

SEQ ID NO: 1200504 - DNA, 22 bp, Artificial Sequence
  chemically synthesized
ttctgtatcaacacagcactca

SEQ ID NO: 1200505 - DNA, 22 bp, Artificial Sequence
  chemically synthesized
tgtatcaacacagcactcacag

SEQ ID NO: 1200506 - DNA, 22 bp, Artificial Sequence
  chemically synthesized
tatcaacacagcactcacagaa

SEQ ID NO: 1200507 - DNA, 22 bp, Artificial Sequence
  chemically synthesized
tagggatttcctgagttctgtg

SEQ ID NO: 1200508 - DNA, 22 bp, Artificial Sequence
  chemically synthesized
aggaggctatagggatttcctg

SEQ ID NO: 1200509 - DNA, 22 bp, Artificial Sequence
  chemically synthesized
acagaactcaggaaatccctat

SEQ ID NO: 1200510 - DNA, 22 bp, Artificial Sequence
  chemically synthesized
aggaaatccctatagcctcctt

SEQ ID NO: 1200511 - DNA, 22 bp, Artificial Sequence
  chemically synthesized
tagcctccttagcttccatctt

SEQ ID NO: 1200512 - DNA, 22 bp, Artificial Sequence
  chemically synthesized
aaaagacaagagaaagatggaa

SEQ ID NO: 1200513 - DNA, 22 bp, Artificial Sequence
  chemically synthesized
caaaagacaagagaaagatgga

SEQ ID NO: 1200514 - DNA, 22 bp, Artificial Sequence
  chemically synthesized
cttagcttccatctttctcttg

SEQ ID NO: 1200515 - DNA, 22 bp, Artificial Sequence
  chemically synthesized
agcttccatctttctcttgtct

SEQ ID NO: 1200516 - DNA, 22 bp, Artificial Sequence
  chemically synthesized
aggtatttcaaaagacaagaga

SEQ ID NO: 1200517 - DNA, 22 bp, Artificial Sequence
  chemically synthesized
gcttccatctttctcttgtctt

SEQ ID NO: 1200518 - DNA, 22 bp, Artificial Sequence
  chemically synthesized
aaggtatttcaaaagacaagag

SEQ ID NO: 1200519 - DNA, 22 bp, Artificial Sequence
  chemically synthesized
taaggtatttcaaaagacaaga

SEQ ID NO: 1200520 - DNA, 22 bp, Artificial Sequence
  chemically synthesized
ccatctttctcttgtcttttga

SEQ ID NO: 1200521 - DNA, 22 bp, Artificial Sequence
  chemically synthesized
catctttctcttgtcttttgaa

SEQ ID NO: 1200522 - DNA, 22 bp, Artificial Sequence
  chemically synthesized
tgctttaaggtatttcaaaaga

SEQ ID NO: 1200523 - DNA, 22 bp, Artificial Sequence
  chemically synthesized
gtgctttaaggtatttcaaaag

SEQ ID NO: 1200524 - DNA, 22 bp, Artificial Sequence
  chemically synthesized
tgtgctttaaggtatttcaaaa

SEQ ID NO: 1200525 - DNA, 22 bp, Artificial Sequence
  chemically synthesized
ttgtgctttaaggtatttcaaa

SEQ ID NO: 1200526 - DNA, 22 bp, Artificial Sequence
  chemically synthesized
tctcttgtcttttgaaatacct

SEQ ID NO: 1200527 - DNA, 22 bp, Artificial Sequence
  chemically synthesized
ctcttgtcttttgaaatacctt

SEQ ID NO: 1200528 - DNA, 22 bp, Artificial Sequence
  chemically synthesized
tcttgtcttttgaaatacctta

SEQ ID NO: 1200529 - DNA, 22 bp, Artificial Sequence
  chemically synthesized
ttgtcttttgaaataccttaaa

SEQ ID NO: 1200530 - DNA, 22 bp, Artificial Sequence
  chemically synthesized
gtcttttgaaataccttaaagc

SEQ ID NO: 1200531 - DNA, 22 bp, Artificial Sequence
  chemically synthesized
tcttttgaaataccttaaagca

SEQ ID NO: 1200532 - DNA, 22 bp, Artificial Sequence
  chemically synthesized
aaaatatgcttttgtgctttaa

SEQ ID NO: 1200533 - DNA, 22 bp, Artificial Sequence
  chemically synthesized
ttgaaataccttaaagcacaaa

SEQ ID NO: 1200534 - DNA, 22 bp, Artificial Sequence
  chemically synthesized
tgaaataccttaaagcacaaaa

SEQ ID NO: 1200535 - DNA, 22 bp, Artificial Sequence
  chemically synthesized
gaaataccttaaagcacaaaag

SEQ ID NO: 1200536 - DNA, 22 bp, Artificial Sequence
  chemically synthesized
cctgaaaatatgcttttgtgct

SEQ ID NO: 1200537 - DNA, 22 bp, Artificial Sequence
  chemically synthesized
aaataccttaaagcacaaaagc

SEQ ID NO: 1200538 - DNA, 22 bp, Artificial Sequence
  chemically synthesized
gcctgaaaatatgcttttgtgc

SEQ ID NO: 1200539 - DNA, 22 bp, Artificial Sequence
  chemically synthesized
tgcctgaaaatatgcttttgtg

SEQ ID NO: 1200540 - DNA, 22 bp, Artificial Sequence
  chemically synthesized
cctttgcctgaaaatatgcttt

SEQ ID NO: 1200541 - DNA, 22 bp, Artificial Sequence
  chemically synthesized
acctttgcctgaaaatatgctt

SEQ ID NO: 1200542 - DNA, 22 bp, Artificial Sequence
  chemically synthesized
tacctttgcctgaaaatatgct

SEQ ID NO: 1200543 - DNA, 22 bp, Artificial Sequence
  chemically synthesized
ttacctttgcctgaaaatatgc

SEQ ID NO: 1200544 - DNA, 22 bp, Artificial Sequence
  chemically synthesized
aaagcacaaaagcatattttca

SEQ ID NO: 1200545 - DNA, 22 bp, Artificial Sequence
  chemically synthesized
aagcacaaaagcatattttcag

SEQ ID NO: 1200546 - DNA, 22 bp, Artificial Sequence
  chemically synthesized
tttttacctttgcctgaaaata

SEQ ID NO: 1200547 - DNA, 22 bp, Artificial Sequence
  chemically synthesized
caattatttttacctttgcctg

SEQ ID NO: 1200548 - DNA, 22 bp, Artificial Sequence
  chemically synthesized
ctacaattatttttacctttgc

SEQ ID NO: 1200549 - DNA, 22 bp, Artificial Sequence
  chemically synthesized
tcaggcaaaggtaaaaataatt

SEQ ID NO: 1200550 - DNA, 22 bp, Artificial Sequence
  chemically synthesized
caggcaaaggtaaaaataattg

SEQ ID NO: 1200551 - DNA, 22 bp, Artificial Sequence
  chemically synthesized
aggcaaaggtaaaaataattgt

SEQ ID NO: 1200552 - DNA, 22 bp, Artificial Sequence
  chemically synthesized
tgaaaccatcattcctacaatt

SEQ ID NO: 1200553 - DNA, 22 bp, Artificial Sequence
  chemically synthesized
tctgtgaaaccatcattcctac

SEQ ID NO: 1200554 - DNA, 22 bp, Artificial Sequence
  chemically synthesized
aagacaccctgtctgtgaaacc

SEQ ID NO: 1200555 - DNA, 22 bp, Artificial Sequence
  chemically synthesized
taggaatgatggtttcacagac

SEQ ID NO: 1200556 - DNA, 22 bp, Artificial Sequence
  chemically synthesized
tcactgaagacaccctgtctgt

SEQ ID NO: 1200557 - DNA, 22 bp, Artificial Sequence
  chemically synthesized
actgtcactgaagacaccctgt

SEQ ID NO: 1200558 - DNA, 22 bp, Artificial Sequence
  chemically synthesized
aactgtcactgaagacaccctg

SEQ ID NO: 1200559 - DNA, 22 bp, Artificial Sequence
  chemically synthesized
cacagacagggtgtcttcagtg

SEQ ID NO: 1200560 - DNA, 22 bp, Artificial Sequence
  chemically synthesized
acagacagggtgtcttcagtga

SEQ ID NO: 1200561 - DNA, 22 bp, Artificial Sequence
  chemically synthesized
accataggaacttaactgtcac

SEQ ID NO: 1200562 - DNA, 22 bp, Artificial Sequence
  chemically synthesized
cagtgtctcaccataggaactt

SEQ ID NO: 1200563 - DNA, 22 bp, Artificial Sequence
  chemically synthesized
cagtgacagttaagttcctatg

SEQ ID NO: 1200564 - DNA, 22 bp, Artificial Sequence
  chemically synthesized
agtgacagttaagttcctatgg

SEQ ID NO: 1200565 - DNA, 22 bp, Artificial Sequence
  chemically synthesized
attacagtgtctcaccatagga

SEQ ID NO: 1200566 - DNA, 22 bp, Artificial Sequence
  chemically synthesized
aactcattacagtgtctcacca

SEQ ID NO: 1200567 - DNA, 22 bp, Artificial Sequence
  chemically synthesized
gaactcattacagtgtctcacc

SEQ ID NO: 1200568 - DNA, 22 bp, Artificial Sequence
  chemically synthesized
tgaactcattacagtgtctcac

SEQ ID NO: 1200569 - DNA, 22 bp, Artificial Sequence
  chemically synthesized
agttcctatggtgagacactgt

SEQ ID NO: 1200570 - DNA, 22 bp, Artificial Sequence
  chemically synthesized
ctatggtgagacactgtaatga

SEQ ID NO: 1200571 - DNA, 22 bp, Artificial Sequence
  chemically synthesized
taaacactttgaactcattaca

SEQ ID NO: 1200572 - DNA, 22 bp, Artificial Sequence
  chemically synthesized
tggtgagacactgtaatgagtt

SEQ ID NO: 1200573 - DNA, 22 bp, Artificial Sequence
  chemically synthesized
aagctgtaaacactttgaactc

SEQ ID NO: 1200574 - DNA, 22 bp, Artificial Sequence
  chemically synthesized
taatgagttcaaagtgtttaca

SEQ ID NO: 1200575 - DNA, 22 bp, Artificial Sequence
  chemically synthesized
acaagcagtattgaagctgtaa

SEQ ID NO: 1200576 - DNA, 22 bp, Artificial Sequence
  chemically synthesized
gacaagcagtattgaagctgta

SEQ ID NO: 1200577 - DNA, 22 bp, Artificial Sequence
  chemically synthesized
aaagtgtttacagcttcaatac

SEQ ID NO: 1200578 - DNA, 22 bp, Artificial Sequence
  chemically synthesized
aaggagtgtttgacaagcagta

SEQ ID NO: 1200579 - DNA, 22 bp, Artificial Sequence
  chemically synthesized
acagcttcaatactgcttgtca

SEQ ID NO: 1200580 - DNA, 22 bp, Artificial Sequence
  chemically synthesized
cagcttcaatactgcttgtcaa

SEQ ID NO: 1200581 - DNA, 22 bp, Artificial Sequence
  chemically synthesized
cattgaaggagtgtttgacaag

SEQ ID NO: 1200582 - DNA, 22 bp, Artificial Sequence
  chemically synthesized
caatactgcttgtcaaacactc

SEQ ID NO: 1200583 - DNA, 22 bp, Artificial Sequence
  chemically synthesized
attgcattgaaggagtgtttga

SEQ ID NO: 1200584 - DNA, 22 bp, Artificial Sequence
  chemically synthesized
aatactgcttgtcaaacactcc

SEQ ID NO: 1200585 - DNA, 22 bp, Artificial Sequence
  chemically synthesized
cttgtcaaacactccttcaatg

SEQ ID NO: 1200586 - DNA, 22 bp, Artificial Sequence
  chemically synthesized
gtcaaacactccttcaatgcaa

SEQ ID NO: 1200587 - DNA, 22 bp, Artificial Sequence
  chemically synthesized
tcaaacactccttcaatgcaat

SEQ ID NO: 1200588 - DNA, 22 bp, Artificial Sequence
  chemically synthesized
tagccaagaattcattgcattg

SEQ ID NO: 1200589 - DNA, 22 bp, Artificial Sequence
  chemically synthesized
gtagccaagaattcattgcatt

SEQ ID NO: 1200590 - DNA, 22 bp, Artificial Sequence
  chemically synthesized
tggcttgtagccaagaattcat

SEQ ID NO: 1200591 - DNA, 22 bp, Artificial Sequence
  chemically synthesized
gtggcttgtagccaagaattca

SEQ ID NO: 1200592 - DNA, 22 bp, Artificial Sequence
  chemically synthesized
cttcaatgcaatgaattcttgg

SEQ ID NO: 1200593 - DNA, 22 bp, Artificial Sequence
  chemically synthesized
caatgcaatgaattcttggcta

SEQ ID NO: 1200594 - DNA, 22 bp, Artificial Sequence
  chemically synthesized
aatgcaatgaattcttggctac

SEQ ID NO: 1200595 - DNA, 22 bp, Artificial Sequence
  chemically synthesized
aaagcacatttgtggcttgtag

SEQ ID NO: 1200596 - DNA, 22 bp, Artificial Sequence
  chemically synthesized
tcaaagcacatttgtggcttgt

SEQ ID NO: 1200597 - DNA, 22 bp, Artificial Sequence
  chemically synthesized
ctcaaagcacatttgtggcttg

SEQ ID NO: 1200598 - DNA, 22 bp, Artificial Sequence
  chemically synthesized
tttctcaaagcacatttgtggc

SEQ ID NO: 1200599 - DNA, 22 bp, Artificial Sequence
  chemically synthesized
atttctcaaagcacatttgtgg

SEQ ID NO: 1200600 - DNA, 22 bp, Artificial Sequence
  chemically synthesized
ttggctacaagccacaaatgtg

SEQ ID NO: 1200601 - DNA, 22 bp, Artificial Sequence
  chemically synthesized
tatttctcaaagcacatttgtg

SEQ ID NO: 1200602 - DNA, 22 bp, Artificial Sequence
  chemically synthesized
ttatttctcaaagcacatttgt

SEQ ID NO: 1200603 - DNA, 22 bp, Artificial Sequence
  chemically synthesized
ggctacaagccacaaatgtgct

SEQ ID NO: 1200604 - DNA, 22 bp, Artificial Sequence
  chemically synthesized
tttatttctcaaagcacatttg

SEQ ID NO: 1200605 - DNA, 22 bp, Artificial Sequence
  chemically synthesized
gctacaagccacaaatgtgctt

SEQ ID NO: 1200606 - DNA, 22 bp, Artificial Sequence
  chemically synthesized
gctttttatttctcaaagcaca

SEQ ID NO: 1200607 - DNA, 22 bp, Artificial Sequence
  chemically synthesized
caagccacaaatgtgctttgag

SEQ ID NO: 1200608 - DNA, 22 bp, Artificial Sequence
  chemically synthesized
actcgctttttatttctcaaag

SEQ ID NO: 1200609 - DNA, 22 bp, Artificial Sequence
  chemically synthesized
tgagaaataaaaagcgagtgaa

SEQ ID NO: 1200610 - DNA, 22 bp, Artificial Sequence
  chemically synthesized
gagaaataaaaagcgagtgaat

SEQ ID NO: 1200611 - DNA, 22 bp, Artificial Sequence
  chemically synthesized
agaaataaaaagcgagtgaata

SEQ ID NO: 1200612 - DNA, 22 bp, Artificial Sequence
  chemically synthesized
gaccaataatagaaacaccagt

SEQ ID NO: 1200613 - DNA, 22 bp, Artificial Sequence
  chemically synthesized
agctggaccaataatagaaaca

SEQ ID NO: 1200614 - DNA, 22 bp, Artificial Sequence
  chemically synthesized
tctcagctggaccaataataga

SEQ ID NO: 1200615 - DNA, 22 bp, Artificial Sequence
  chemically synthesized
gtgtttctattattggtccagc

SEQ ID NO: 1200616 - DNA, 22 bp, Artificial Sequence
  chemically synthesized
ctattattggtccagctgagat

SEQ ID NO: 1200617 - DNA, 22 bp, Artificial Sequence
  chemically synthesized
tattattggtccagctgagata

SEQ ID NO: 1200618 - DNA, 22 bp, Artificial Sequence
  chemically synthesized
ttattggtccagctgagatagt

SEQ ID NO: 1200619 - DNA, 22 bp, Artificial Sequence
  chemically synthesized
agaataaaaaagcaactatctc

SEQ ID NO: 1200620 - DNA, 22 bp, Artificial Sequence
  chemically synthesized
ttggtccagctgagatagttgc

SEQ ID NO: 1200621 - DNA, 22 bp, Artificial Sequence
  chemically synthesized
ttaagaataaaaaagcaactat

SEQ ID NO: 1200622 - DNA, 22 bp, Artificial Sequence
  chemically synthesized
gtccagctgagatagttgcttt

SEQ ID NO: 1200623 - DNA, 22 bp, Artificial Sequence
  chemically synthesized
attaagaataaaaaagcaacta

SEQ ID NO: 1200624 - DNA, 22 bp, Artificial Sequence
  chemically synthesized
tattaagaataaaaaagcaact

SEQ ID NO: 1200625 - DNA, 22 bp, Artificial Sequence
  chemically synthesized
ttattaagaataaaaaagcaac

SEQ ID NO: 1200626 - DNA, 22 bp, Artificial Sequence
  chemically synthesized
agatagttgcttttttattctt

SEQ ID NO: 1200627 - DNA, 22 bp, Artificial Sequence
  chemically synthesized
gagaaaacttttattaagaata

SEQ ID NO: 1200628 - DNA, 22 bp, Artificial Sequence
  chemically synthesized
cctcgagaaaacttttattaag

SEQ ID NO: 1200629 - DNA, 22 bp, Artificial Sequence
  chemically synthesized
cttttttattcttaataaaagt

SEQ ID NO: 1200630 - DNA, 22 bp, Artificial Sequence
  chemically synthesized
ttttattcttaataaaagtttt

SEQ ID NO: 1200631 - DNA, 22 bp, Artificial Sequence
  chemically synthesized
tttattcttaataaaagttttc

SEQ ID NO: 1200632 - DNA, 22 bp, Artificial Sequence
  chemically synthesized
tgactacctcgagaaaactttt

SEQ ID NO: 1200633 - DNA, 22 bp, Artificial Sequence
  chemically synthesized
ttattcttaataaaagttttct

SEQ ID NO: 1200634 - DNA, 22 bp, Artificial Sequence
  chemically synthesized
tattcttaataaaagttttctc

SEQ ID NO: 1200635 - DNA, 22 bp, Artificial Sequence
  chemically synthesized
attcttaataaaagttttctcg

SEQ ID NO: 1200636 - DNA, 22 bp, Artificial Sequence
  chemically synthesized
ttcttaataaaagttttctcga

SEQ ID NO: 1200637 - DNA, 22 bp, Artificial Sequence
  chemically synthesized
aaattatgactacctcgagaaa

SEQ ID NO: 1200638 - DNA, 22 bp, Artificial Sequence
  chemically synthesized
ttaataaaagttttctcgaggt

SEQ ID NO: 1200639 - DNA, 22 bp, Artificial Sequence
  chemically synthesized
gaaattatgactacctcgagaa

SEQ ID NO: 1200640 - DNA, 22 bp, Artificial Sequence
  chemically synthesized
tgaaattatgactacctcgaga

SEQ ID NO: 1200641 - DNA, 22 bp, Artificial Sequence
  chemically synthesized
aataaaagttttctcgaggtag

SEQ ID NO: 1200642 - DNA, 22 bp, Artificial Sequence
  chemically synthesized
ataaaagttttctcgaggtagt

SEQ ID NO: 1200643 - DNA, 22 bp, Artificial Sequence
  chemically synthesized
tctcgaggtagtcataatttca

SEQ ID NO: 1200644 - DNA, 22 bp, Artificial Sequence
  chemically synthesized
taagcagggttttgaaattatg

SEQ ID NO: 1200645 - DNA, 22 bp, Artificial Sequence
  chemically synthesized
ctcgaggtagtcataatttcaa

SEQ ID NO: 1200646 - DNA, 22 bp, Artificial Sequence
  chemically synthesized
tcgaggtagtcataatttcaaa

SEQ ID NO: 1200647 - DNA, 22 bp, Artificial Sequence
  chemically synthesized
ctataagcagggttttgaaatt

SEQ ID NO: 1200648 - DNA, 22 bp, Artificial Sequence
  chemically synthesized
gaggtagtcataatttcaaaac

SEQ ID NO: 1200649 - DNA, 22 bp, Artificial Sequence
  chemically synthesized
attactataagcagggttttga

SEQ ID NO: 1200650 - DNA, 22 bp, Artificial Sequence
  chemically synthesized
caaaaccctgcttatagtaatg

SEQ ID NO: 1200651 - DNA, 22 bp, Artificial Sequence
  chemically synthesized
aaaaccctgcttatagtaatga

SEQ ID NO: 1200652 - DNA, 22 bp, Artificial Sequence
  chemically synthesized
taaataaccatgattcattact

SEQ ID NO: 1200653 - DNA, 22 bp, Artificial Sequence
  chemically synthesized
gtaaataaccatgattcattac

SEQ ID NO: 1200654 - DNA, 22 bp, Artificial Sequence
  chemically synthesized
tgtaaataaccatgattcatta

SEQ ID NO: 1200655 - DNA, 22 bp, Artificial Sequence
  chemically synthesized
ctttgtaaataaccatgattca

SEQ ID NO: 1200656 - DNA, 22 bp, Artificial Sequence
  chemically synthesized
cttatagtaatgaatcatggtt

SEQ ID NO: 1200657 - DNA, 22 bp, Artificial Sequence
  chemically synthesized
atagtaatgaatcatggttatt

SEQ ID NO: 1200658 - DNA, 22 bp, Artificial Sequence
  chemically synthesized
aattactttgtaaataaccatg

SEQ ID NO: 1200659 - DNA, 22 bp, Artificial Sequence
  chemically synthesized
tagtaatgaatcatggttattt

SEQ ID NO: 1200660 - DNA, 22 bp, Artificial Sequence
  chemically synthesized
tttacaaagtaattcagtttca

SEQ ID NO: 1200661 - DNA, 22 bp, Artificial Sequence
  chemically synthesized
acaaagtaattcagtttcacta

SEQ ID NO: 1200662 - DNA, 22 bp, Artificial Sequence
  chemically synthesized
caaagtaattcagtttcactat

SEQ ID NO: 1200663 - DNA, 22 bp, Artificial Sequence
  chemically synthesized
tacaaatcgtgatcatagtgaa

SEQ ID NO: 1200664 - DNA, 22 bp, Artificial Sequence
  chemically synthesized
atacaaatcgtgatcatagtga

SEQ ID NO: 1200665 - DNA, 22 bp, Artificial Sequence
  chemically synthesized
cttatacaaatcgtgatcatag

SEQ ID NO: 1200666 - DNA, 22 bp, Artificial Sequence
  chemically synthesized
agtttcactatgatcacgattt

SEQ ID NO: 1200667 - DNA, 22 bp, Artificial Sequence
  chemically synthesized
cattacttatacaaatcgtgat

SEQ ID NO: 1200668 - DNA, 22 bp, Artificial Sequence
  chemically synthesized
cactatgatcacgatttgtata

SEQ ID NO: 1200669 - DNA, 22 bp, Artificial Sequence
  chemically synthesized
actatgatcacgatttgtataa

SEQ ID NO: 1200670 - DNA, 22 bp, Artificial Sequence
  chemically synthesized
tatgactacattacttatacaa

SEQ ID NO: 1200671 - DNA, 22 bp, Artificial Sequence
  chemically synthesized
tgatcacgatttgtataagtaa

SEQ ID NO: 1200672 - DNA, 22 bp, Artificial Sequence
  chemically synthesized
gactatatgactacattactta

SEQ ID NO: 1200673 - DNA, 22 bp, Artificial Sequence
  chemically synthesized
cgactatatgactacattactt

SEQ ID NO: 1200674 - DNA, 22 bp, Artificial Sequence
  chemically synthesized
gtataagtaatgtagtcatata

SEQ ID NO: 1200675 - DNA, 22 bp, Artificial Sequence
  chemically synthesized
tataagtaatgtagtcatatag

SEQ ID NO: 1200676 - DNA, 22 bp, Artificial Sequence
  chemically synthesized
aaaagtcttcgactatatgact

SEQ ID NO: 1200677 - DNA, 22 bp, Artificial Sequence
  chemically synthesized
aacagaaaacatccctgaaaag

SEQ ID NO: 1200678 - DNA, 22 bp, Artificial Sequence
  chemically synthesized
aaacagaaaacatccctgaaaa

SEQ ID NO: 1200679 - DNA, 22 bp, Artificial Sequence
  chemically synthesized
tcagtttaaacagaaaacatcc

SEQ ID NO: 1200680 - DNA, 22 bp, Artificial Sequence
  chemically synthesized
atcagtttaaacagaaaacatc

SEQ ID NO: 1200681 - DNA, 22 bp, Artificial Sequence
  chemically synthesized
ttcagggatgttttctgtttaa

SEQ ID NO: 1200682 - DNA, 22 bp, Artificial Sequence
  chemically synthesized
cagcttatcagtttaaacagaa

SEQ ID NO: 1200683 - DNA, 22 bp, Artificial Sequence
  chemically synthesized
tcagggatgttttctgtttaaa

SEQ ID NO: 1200684 - DNA, 22 bp, Artificial Sequence
  chemically synthesized
gcagcttatcagtttaaacaga

SEQ ID NO: 1200685 - DNA, 22 bp, Artificial Sequence
  chemically synthesized
cagggatgttttctgtttaaac

SEQ ID NO: 1200686 - DNA, 22 bp, Artificial Sequence
  chemically synthesized
tgcagcttatcagtttaaacag

SEQ ID NO: 1200687 - DNA, 22 bp, Artificial Sequence
  chemically synthesized
agggatgttttctgtttaaact

SEQ ID NO: 1200688 - DNA, 22 bp, Artificial Sequence
  chemically synthesized
tctgtttaaactgataagctgc

SEQ ID NO: 1200689 - DNA, 22 bp, Artificial Sequence
  chemically synthesized
ctgtttaaactgataagctgca

SEQ ID NO: 1200690 - DNA, 22 bp, Artificial Sequence
  chemically synthesized
tgtttaaactgataagctgcaa

SEQ ID NO: 1200691 - DNA, 22 bp, Artificial Sequence
  chemically synthesized
tttaaactgataagctgcaaaa

SEQ ID NO: 1200692 - DNA, 22 bp, Artificial Sequence
  chemically synthesized
aggaaaatacagaattttgcag

SEQ ID NO: 1200693 - DNA, 22 bp, Artificial Sequence
  chemically synthesized
aaactgataagctgcaaaattc

SEQ ID NO: 1200694 - DNA, 22 bp, Artificial Sequence
  chemically synthesized
aactgataagctgcaaaattct

SEQ ID NO: 1200695 - DNA, 22 bp, Artificial Sequence
  chemically synthesized
ttaaggaaaatacagaattttg

SEQ ID NO: 1200696 - DNA, 22 bp, Artificial Sequence
  chemically synthesized
attaaggaaaatacagaatttt

SEQ ID NO: 1200697 - DNA, 22 bp, Artificial Sequence
  chemically synthesized
tattaaggaaaatacagaattt

SEQ ID NO: 1200698 - DNA, 22 bp, Artificial Sequence
  chemically synthesized
ttattaaggaaaatacagaatt

SEQ ID NO: 1200699 - DNA, 22 bp, Artificial Sequence
  chemically synthesized
ataagctgcaaaattctgtatt

SEQ ID NO: 1200700 - DNA, 22 bp, Artificial Sequence
  chemically synthesized
aaacatttttattaaggaaaat

SEQ ID NO: 1200701 - DNA, 22 bp, Artificial Sequence
  chemically synthesized
caaaattctgtattttccttaa

SEQ ID NO: 1200702 - DNA, 22 bp, Artificial Sequence
  chemically synthesized
ctgaaacatttttattaaggaa

SEQ ID NO: 1200703 - DNA, 22 bp, Artificial Sequence
  chemically synthesized
cctgaaacatttttattaagga

SEQ ID NO: 1200704 - DNA, 22 bp, Artificial Sequence
  chemically synthesized
tcctgaaacatttttattaagg

SEQ ID NO: 1200705 - DNA, 22 bp, Artificial Sequence
  chemically synthesized
ttcctgaaacatttttattaag

SEQ ID NO: 1200706 - DNA, 22 bp, Artificial Sequence
  chemically synthesized
tttcctgaaacatttttattaa

SEQ ID NO: 1200707 - DNA, 22 bp, Artificial Sequence
  chemically synthesized
tgtattttccttaataaaaatg

SEQ ID NO: 1200708 - DNA, 22 bp, Artificial Sequence
  chemically synthesized
tattttccttaataaaaatgtt

SEQ ID NO: 1200709 - DNA, 22 bp, Artificial Sequence
  chemically synthesized
tctttttcctgaaacattttta

SEQ ID NO: 1200710 - DNA, 22 bp, Artificial Sequence
  chemically synthesized
gctgtctttttcctgaaacatt

SEQ ID NO: 1200711 - DNA, 22 bp, Artificial Sequence
  chemically synthesized
tccttaataaaaatgtttcagg

SEQ ID NO: 1200712 - DNA, 22 bp, Artificial Sequence
  chemically synthesized
ccttaataaaaatgtttcagga

SEQ ID NO: 1200713 - DNA, 22 bp, Artificial Sequence
  chemically synthesized
cttaataaaaatgtttcaggaa

SEQ ID NO: 1200714 - DNA, 22 bp, Artificial Sequence
  chemically synthesized
ttcgctgtctttttcctgaaac

SEQ ID NO: 1200715 - DNA, 22 bp, Artificial Sequence
  chemically synthesized
aataaaaatgtttcaggaaaaa

SEQ ID NO: 1200716 - DNA, 22 bp, Artificial Sequence
  chemically synthesized
ataaaaatgtttcaggaaaaag

SEQ ID NO: 1200717 - DNA, 22 bp, Artificial Sequence
  chemically synthesized
gctgttcgctgtctttttcctg

SEQ ID NO: 1200718 - DNA, 22 bp, Artificial Sequence
  chemically synthesized
aaatctagctgttcgctgtctt

SEQ ID NO: 1200719 - DNA, 22 bp, Artificial Sequence
  chemically synthesized
caaatctagctgttcgctgtct

SEQ ID NO: 1200720 - DNA, 22 bp, Artificial Sequence
  chemically synthesized
ttcaaatctagctgttcgctgt

SEQ ID NO: 1200721 - DNA, 22 bp, Artificial Sequence
  chemically synthesized
caggaaaaagacagcgaacagc

SEQ ID NO: 1200722 - DNA, 22 bp, Artificial Sequence
  chemically synthesized
aggaaaaagacagcgaacagct

SEQ ID NO: 1200723 - DNA, 22 bp, Artificial Sequence
  chemically synthesized
ctcttcaaatctagctgttcgc

SEQ ID NO: 1200724 - DNA, 22 bp, Artificial Sequence
  chemically synthesized
actcttcaaatctagctgttcg

SEQ ID NO: 1200725 - DNA, 22 bp, Artificial Sequence
  chemically synthesized
tactcttcaaatctagctgttc

SEQ ID NO: 1200726 - DNA, 22 bp, Artificial Sequence
  chemically synthesized
ttactcttcaaatctagctgtt

SEQ ID NO: 1200727 - DNA, 22 bp, Artificial Sequence
  chemically synthesized
tttttactcttcaaatctagct

SEQ ID NO: 1200728 - DNA, 22 bp, Artificial Sequence
  chemically synthesized
atttttactcttcaaatctagc

SEQ ID NO: 1200729 - DNA, 22 bp, Artificial Sequence
  chemically synthesized
tatttttactcttcaaatctag

SEQ ID NO: 1200730 - DNA, 22 bp, Artificial Sequence
  chemically synthesized
tttatttttactcttcaaatct

SEQ ID NO: 1200731 - DNA, 22 bp, Artificial Sequence
  chemically synthesized
ttctttatttttactcttcaaa

SEQ ID NO: 1200732 - DNA, 22 bp, Artificial Sequence
  chemically synthesized
attctttatttttactcttcaa

SEQ ID NO: 1200733 - DNA, 22 bp, Artificial Sequence
  chemically synthesized
tattctttatttttactcttca

SEQ ID NO: 1200734 - DNA, 22 bp, Artificial Sequence
  chemically synthesized
gctttattctttatttttactc

SEQ ID NO: 1200735 - DNA, 22 bp, Artificial Sequence
  chemically synthesized
ctggctttattctttattttta

SEQ ID NO: 1200736 - DNA, 22 bp, Artificial Sequence
  chemically synthesized
gatttgaagagtaaaaataaag

SEQ ID NO: 1200737 - DNA, 22 bp, Artificial Sequence
  chemically synthesized
ctactggctttattctttattt

SEQ ID NO: 1200738 - DNA, 22 bp, Artificial Sequence
  chemically synthesized
cctactggctttattctttatt

SEQ ID NO: 1200739 - DNA, 22 bp, Artificial Sequence
  chemically synthesized
gaagagtaaaaataaagaataa

SEQ ID NO: 1200740 - DNA, 22 bp, Artificial Sequence
  chemically synthesized
aagagtaaaaataaagaataaa

SEQ ID NO: 1200741 - DNA, 22 bp, Artificial Sequence
  chemically synthesized
tgtttcctactggctttattct

SEQ ID NO: 1200742 - DNA, 22 bp, Artificial Sequence
  chemically synthesized
gtgtttcctactggctttattc

SEQ ID NO: 1200743 - DNA, 22 bp, Artificial Sequence
  chemically synthesized
gaagtttgtgtttcctactggc

SEQ ID NO: 1200744 - DNA, 22 bp, Artificial Sequence
  chemically synthesized
tagaagtttgtgtttcctactg

SEQ ID NO: 1200745 - DNA, 22 bp, Artificial Sequence
  chemically synthesized
aaagttctagaagtttgtgttt

SEQ ID NO: 1200746 - DNA, 22 bp, Artificial Sequence
  chemically synthesized
aaaagttctagaagtttgtgtt

SEQ ID NO: 1200747 - DNA, 22 bp, Artificial Sequence
  chemically synthesized
acaatttaaaagttctagaagt

SEQ ID NO: 1200748 - DNA, 22 bp, Artificial Sequence
  chemically synthesized
aacaatttaaaagttctagaag

SEQ ID NO: 1200749 - DNA, 22 bp, Artificial Sequence
  chemically synthesized
cacaaagatgtttaacaattta

SEQ ID NO: 1200750 - DNA, 22 bp, Artificial Sequence
  chemically synthesized
ccacaaagatgtttaacaattt

SEQ ID NO: 1200751 - DNA, 22 bp, Artificial Sequence
  chemically synthesized
ctagaacttttaaattgttaaa

SEQ ID NO: 1200752 - DNA, 22 bp, Artificial Sequence
  chemically synthesized
tagaacttttaaattgttaaac

SEQ ID NO: 1200753 - DNA, 22 bp, Artificial Sequence
  chemically synthesized
cttccacaaagatgtttaacaa

SEQ ID NO: 1200754 - DNA, 22 bp, Artificial Sequence
  chemically synthesized
gaacttttaaattgttaaacat

SEQ ID NO: 1200755 - DNA, 22 bp, Artificial Sequence
  chemically synthesized
ttaaattgttaaacatctttgt

SEQ ID NO: 1200756 - DNA, 22 bp, Artificial Sequence
  chemically synthesized
taaattgttaaacatctttgtg

SEQ ID NO: 1200757 - DNA, 22 bp, Artificial Sequence
  chemically synthesized
aaattgttaaacatctttgtgg

SEQ ID NO: 1200758 - DNA, 22 bp, Artificial Sequence
  chemically synthesized
aattgttaaacatctttgtgga

SEQ ID NO: 1200759 - DNA, 22 bp, Artificial Sequence
  chemically synthesized
ttaaacatctttgtggaagtaa

SEQ ID NO: 1200760 - DNA, 22 bp, Artificial Sequence
  chemically synthesized
gtgaaaatggtagttacttcca

SEQ ID NO: 1200761 - DNA, 22 bp, Artificial Sequence
  chemically synthesized
ggtgaaaatggtagttacttcc

SEQ ID NO: 1200762 - DNA, 22 bp, Artificial Sequence
  chemically synthesized
aacatctttgtggaagtaacta

SEQ ID NO: 1200763 - DNA, 22 bp, Artificial Sequence
  chemically synthesized
cagatttggtgaaaatggtagt

SEQ ID NO: 1200764 - DNA, 22 bp, Artificial Sequence
  chemically synthesized
gcagatttggtgaaaatggtag

SEQ ID NO: 1200765 - DNA, 22 bp, Artificial Sequence
  chemically synthesized
tgtggaagtaactaccattttc

SEQ ID NO: 1200766 - DNA, 22 bp, Artificial Sequence
  chemically synthesized
gtggaagtaactaccattttca

SEQ ID NO: 1200767 - DNA, 22 bp, Artificial Sequence
  chemically synthesized
tggaagtaactaccattttcac

SEQ ID NO: 1200768 - DNA, 22 bp, Artificial Sequence
  chemically synthesized
gaatatgatttgcagatttggt

SEQ ID NO: 1200769 - DNA, 22 bp, Artificial Sequence
  chemically synthesized
ttggaatatgatttgcagattt

SEQ ID NO: 1200770 - DNA, 22 bp, Artificial Sequence
  chemically synthesized
ccattttcaccaaatctgcaaa

SEQ ID NO: 1200771 - DNA, 22 bp, Artificial Sequence
  chemically synthesized
gttggaatatgatttgcagatt

SEQ ID NO: 1200772 - DNA, 22 bp, Artificial Sequence
  chemically synthesized
tcaccaaatctgcaaatcatat

SEQ ID NO: 1200773 - DNA, 22 bp, Artificial Sequence
  chemically synthesized
caacttgttggaatatgatttg

SEQ ID NO: 1200774 - DNA, 22 bp, Artificial Sequence
  chemically synthesized
caccaaatctgcaaatcatatt

SEQ ID NO: 1200775 - DNA, 22 bp, Artificial Sequence
  chemically synthesized
acaacttgttggaatatgattt

SEQ ID NO: 1200776 - DNA, 22 bp, Artificial Sequence
  chemically synthesized
accaaatctgcaaatcatattc

SEQ ID NO: 1200777 - DNA, 22 bp, Artificial Sequence
  chemically synthesized
tacaacttgttggaatatgatt

SEQ ID NO: 1200778 - DNA, 22 bp, Artificial Sequence
  chemically synthesized
ttacaacttgttggaatatgat

SEQ ID NO: 1200779 - DNA, 22 bp, Artificial Sequence
  chemically synthesized
tttttacaacttgttggaatat

SEQ ID NO: 1200780 - DNA, 22 bp, Artificial Sequence
  chemically synthesized
atttttacaacttgttggaata

SEQ ID NO: 1200781 - DNA, 22 bp, Artificial Sequence
  chemically synthesized
caaatcatattccaacaagttg

SEQ ID NO: 1200782 - DNA, 22 bp, Artificial Sequence
  chemically synthesized
tggcttatttttacaacttgtt

SEQ ID NO: 1200783 - DNA, 22 bp, Artificial Sequence
  chemically synthesized
agaattatggcttatttttaca

SEQ ID NO: 1200784 - DNA, 22 bp, Artificial Sequence
  chemically synthesized
taagaattatggcttattttta

SEQ ID NO: 1200785 - DNA, 22 bp, Artificial Sequence
  chemically synthesized
caacaagttgtaaaaataagcc

SEQ ID NO: 1200786 - DNA, 22 bp, Artificial Sequence
  chemically synthesized
aattctaagaattatggcttat

SEQ ID NO: 1200787 - DNA, 22 bp, Artificial Sequence
  chemically synthesized
caattctaagaattatggctta

SEQ ID NO: 1200788 - DNA, 22 bp, Artificial Sequence
  chemically synthesized
tcaattctaagaattatggctt

SEQ ID NO: 1200789 - DNA, 22 bp, Artificial Sequence
  chemically synthesized
taaaaataagccataattctta

SEQ ID NO: 1200790 - DNA, 22 bp, Artificial Sequence
  chemically synthesized
tagaatgataagagactttcaa

SEQ ID NO: 1200791 - DNA, 22 bp, Artificial Sequence
  chemically synthesized
cctgtagaatgataagagactt

SEQ ID NO: 1200792 - DNA, 22 bp, Artificial Sequence
  chemically synthesized
ttagaattgaaagtctcttatc

SEQ ID NO: 1200793 - DNA, 22 bp, Artificial Sequence
  chemically synthesized
ttacctgtagaatgataagaga

SEQ ID NO: 1200794 - DNA, 22 bp, Artificial Sequence
  chemically synthesized
agaattgaaagtctcttatcat

SEQ ID NO: 1200795 - DNA, 22 bp, Artificial Sequence
  chemically synthesized
gaattgaaagtctcttatcatt

SEQ ID NO: 1200796 - DNA, 22 bp, Artificial Sequence
  chemically synthesized
aaagtctcttatcattctacag

SEQ ID NO: 1200797 - DNA, 22 bp, Artificial Sequence
  chemically synthesized
ttatcattctacaggtaataac

SEQ ID NO: 1200798 - DNA, 22 bp, Artificial Sequence
  chemically synthesized
atcattctacaggtaataacat

SEQ ID NO: 1200799 - DNA, 22 bp, Artificial Sequence
  chemically synthesized
tcattctacaggtaataacatg

SEQ ID NO: 1200800 - DNA, 22 bp, Artificial Sequence
  chemically synthesized
tacaggtaataacatgacttgg

SEQ ID NO: 1200801 - DNA, 22 bp, Artificial Sequence
  chemically synthesized
caggtaataacatgacttggtc

SEQ ID NO: 1200802 - DNA, 22 bp, Artificial Sequence
  chemically synthesized
cccagagaacaggaccaagtca

SEQ ID NO: 1200803 - DNA, 22 bp, Artificial Sequence
  chemically synthesized
cattacccagagaacaggacca

SEQ ID NO: 1200804 - DNA, 22 bp, Artificial Sequence
  chemically synthesized
ctccattacccagagaacagga

SEQ ID NO: 1200805 - DNA, 22 bp, Artificial Sequence
  chemically synthesized
actccattacccagagaacagg

SEQ ID NO: 1200806 - DNA, 22 bp, Artificial Sequence
  chemically synthesized
tactccattacccagagaacag

SEQ ID NO: 1200807 - DNA, 22 bp, Artificial Sequence
  chemically synthesized
ggtcctgttctctgggtaatgg

SEQ ID NO: 1200808 - DNA, 22 bp, Artificial Sequence
  chemically synthesized
gtcctgttctctgggtaatgga

SEQ ID NO: 1200809 - DNA, 22 bp, Artificial Sequence
  chemically synthesized
ttctctgggtaatggagtaaaa

SEQ ID NO: 1200810 - DNA, 22 bp, Artificial Sequence
  chemically synthesized
tctgggtaatggagtaaaatgt

SEQ ID NO: 1200811 - DNA, 22 bp, Artificial Sequence
  chemically synthesized
tgggtaatggagtaaaatgtta

SEQ ID NO: 1200812 - DNA, 22 bp, Artificial Sequence
  chemically synthesized
ggtaatggagtaaaatgttact

SEQ ID NO: 1200813 - DNA, 22 bp, Artificial Sequence
  chemically synthesized
aacatgggaatatgccagtaac

SEQ ID NO: 1200814 - DNA, 22 bp, Artificial Sequence
  chemically synthesized
tctaaacatgggaatatgccag

SEQ ID NO: 1200815 - DNA, 22 bp, Artificial Sequence
  chemically synthesized
caaatctgtctaaacatgggaa

SEQ ID NO: 1200816 - DNA, 22 bp, Artificial Sequence
  chemically synthesized
gcaaatctgtctaaacatggga

SEQ ID NO: 1200817 - DNA, 22 bp, Artificial Sequence
  chemically synthesized
ctggcatattcccatgtttaga

SEQ ID NO: 1200818 - DNA, 22 bp, Artificial Sequence
  chemically synthesized
tttgcaaatctgtctaaacatg

SEQ ID NO: 1200819 - DNA, 22 bp, Artificial Sequence
  chemically synthesized
gcatattcccatgtttagacag

SEQ ID NO: 1200820 - DNA, 22 bp, Artificial Sequence
  chemically synthesized
gggctatttgcaaatctgtcta

SEQ ID NO: 1200821 - DNA, 22 bp, Artificial Sequence
  chemically synthesized
tggggctatttgcaaatctgtc

SEQ ID NO: 1200822 - DNA, 22 bp, Artificial Sequence
  chemically synthesized
tctggggctatttgcaaatctg

SEQ ID NO: 1200823 - DNA, 22 bp, Artificial Sequence
  chemically synthesized
ccatgtttagacagatttgcaa

SEQ ID NO: 1200824 - DNA, 22 bp, Artificial Sequence
  chemically synthesized
agacagatttgcaaatagcccc

SEQ ID NO: 1200825 - DNA, 22 bp, Artificial Sequence
  chemically synthesized
gacagatttgcaaatagcccca

SEQ ID NO: 1200826 - DNA, 22 bp, Artificial Sequence
  chemically synthesized
ggaatggaattctctggggcta

SEQ ID NO: 1200827 - DNA, 22 bp, Artificial Sequence
  chemically synthesized
gcaaatagccccagagaattcc

SEQ ID NO: 1200828 - DNA, 22 bp, Artificial Sequence
  chemically synthesized
caaatagccccagagaattcca

SEQ ID NO: 1200829 - DNA, 22 bp, Artificial Sequence
  chemically synthesized
agtaacatatcccaggttagga

SEQ ID NO: 1200830 - DNA, 22 bp, Artificial Sequence
  chemically synthesized
gagtaacatatcccaggttagg

SEQ ID NO: 1200831 - DNA, 22 bp, Artificial Sequence
  chemically synthesized
tgagtaacatatcccaggttag

SEQ ID NO: 1200832 - DNA, 22 bp, Artificial Sequence
  chemically synthesized
cattcctaacctgggatatgtt

SEQ ID NO: 1200833 - DNA, 22 bp, Artificial Sequence
  chemically synthesized
ctaacctgggatatgttactca

SEQ ID NO: 1200834 - DNA, 22 bp, Artificial Sequence
  chemically synthesized
acctgggatatgttactcaaag

SEQ ID NO: 1200835 - DNA, 22 bp, Artificial Sequence
  chemically synthesized
cagatagaacgtctttgagtaa

SEQ ID NO: 1200836 - DNA, 22 bp, Artificial Sequence
  chemically synthesized
actccagatagaacgtctttga

SEQ ID NO: 1200837 - DNA, 22 bp, Artificial Sequence
  chemically synthesized
ggatatgttactcaaagacgtt

SEQ ID NO: 1200838 - DNA, 22 bp, Artificial Sequence
  chemically synthesized
gactccagatagaacgtctttg

SEQ ID NO: 1200839 - DNA, 22 bp, Artificial Sequence
  chemically synthesized
ctcaaagacgttctatctggag

SEQ ID NO: 1200840 - DNA, 22 bp, Artificial Sequence
  chemically synthesized
tatgaaagcttgactccagata

SEQ ID NO: 1200841 - DNA, 22 bp, Artificial Sequence
  chemically synthesized
gtatgaaagcttgactccagat

SEQ ID NO: 1200842 - DNA, 22 bp, Artificial Sequence
  chemically synthesized
aaagacgttctatctggagtca

SEQ ID NO: 1200843 - DNA, 22 bp, Artificial Sequence
  chemically synthesized
ttgtatgaaagcttgactccag

SEQ ID NO: 1200844 - DNA, 22 bp, Artificial Sequence
  chemically synthesized
tgattcttgtatgaaagcttga

SEQ ID NO: 1200845 - DNA, 22 bp, Artificial Sequence
  chemically synthesized
tatctggagtcaagctttcata

SEQ ID NO: 1200846 - DNA, 22 bp, Artificial Sequence
  chemically synthesized
tctggagtcaagctttcataca

SEQ ID NO: 1200847 - DNA, 22 bp, Artificial Sequence
  chemically synthesized
gagtcaagctttcatacaagaa

SEQ ID NO: 1200848 - DNA, 22 bp, Artificial Sequence
  chemically synthesized
aagtatgtctatgattcttgta

SEQ ID NO: 1200849 - DNA, 22 bp, Artificial Sequence
  chemically synthesized
gaagtatgtctatgattcttgt

SEQ ID NO: 1200850 - DNA, 22 bp, Artificial Sequence
  chemically synthesized
tcatacaagaatcatagacata

SEQ ID NO: 1200851 - DNA, 22 bp, Artificial Sequence
  chemically synthesized
catacaagaatcatagacatac

SEQ ID NO: 1200852 - DNA, 22 bp, Artificial Sequence
  chemically synthesized
atacaagaatcatagacatact

SEQ ID NO: 1200853 - DNA, 22 bp, Artificial Sequence
  chemically synthesized
atggatcccttgaagtatgtct

SEQ ID NO: 1200854 - DNA, 22 bp, Artificial Sequence
  chemically synthesized
cagtgttcatggatcccttgaa

SEQ ID NO: 1200855 - DNA, 22 bp, Artificial Sequence
  chemically synthesized
ccagtgttcatggatcccttga

SEQ ID NO: 1200856 - DNA, 22 bp, Artificial Sequence
  chemically synthesized
tccagtgttcatggatcccttg

SEQ ID NO: 1200857 - DNA, 22 bp, Artificial Sequence
  chemically synthesized
catatactttccagtgttcatg

SEQ ID NO: 1200858 - DNA, 22 bp, Artificial Sequence
  chemically synthesized
ccatatactttccagtgttcat

SEQ ID NO: 1200859 - DNA, 22 bp, Artificial Sequence
  chemically synthesized
caagggatccatgaacactgga

SEQ ID NO: 1200860 - DNA, 22 bp, Artificial Sequence
  chemically synthesized
aagggatccatgaacactggaa

SEQ ID NO: 1200861 - DNA, 22 bp, Artificial Sequence
  chemically synthesized
gaaagtatatggaaactatgtt

SEQ ID NO: 1200862 - DNA, 22 bp, Artificial Sequence
  chemically synthesized
aaaaataaaaaacgtgaacata

SEQ ID NO: 1200863 - DNA, 22 bp, Artificial Sequence
  chemically synthesized
gaaaaataaaaaacgtgaacat

SEQ ID NO: 1200864 - DNA, 22 bp, Artificial Sequence
  chemically synthesized
ttgaaaaataaaaaacgtgaac

SEQ ID NO: 1200865 - DNA, 22 bp, Artificial Sequence
  chemically synthesized
cttgaaaaataaaaaacgtgaa

SEQ ID NO: 1200866 - DNA, 22 bp, Artificial Sequence
  chemically synthesized
tcttgaaaaataaaaaacgtga

SEQ ID NO: 1200867 - DNA, 22 bp, Artificial Sequence
  chemically synthesized
tgttcacgttttttatttttca

SEQ ID NO: 1200868 - DNA, 22 bp, Artificial Sequence
  chemically synthesized
acgttttttatttttcaagaaa

SEQ ID NO: 1200869 - DNA, 22 bp, Artificial Sequence
  chemically synthesized
gatggtgtagattttcttgaaa

SEQ ID NO: 1200870 - DNA, 22 bp, Artificial Sequence
  chemically synthesized
ctggatggtgtagattttcttg

SEQ ID NO: 1200871 - DNA, 22 bp, Artificial Sequence
  chemically synthesized
tgctggatggtgtagattttct

SEQ ID NO: 1200872 - DNA, 22 bp, Artificial Sequence
  chemically synthesized
tttatttttcaagaaaatctac

SEQ ID NO: 1200873 - DNA, 22 bp, Artificial Sequence
  chemically synthesized
ttatttttcaagaaaatctaca

SEQ ID NO: 1200874 - DNA, 22 bp, Artificial Sequence
  chemically synthesized
tatttttcaagaaaatctacac

SEQ ID NO: 1200875 - DNA, 22 bp, Artificial Sequence
  chemically synthesized
atttttcaagaaaatctacacc

SEQ ID NO: 1200876 - DNA, 22 bp, Artificial Sequence
  chemically synthesized
tttttcaagaaaatctacacca

SEQ ID NO: 1200877 - DNA, 22 bp, Artificial Sequence
  chemically synthesized
ttcaagaaaatctacaccatcc

SEQ ID NO: 1200878 - DNA, 22 bp, Artificial Sequence
  chemically synthesized
tcaagaaaatctacaccatcca

SEQ ID NO: 1200879 - DNA, 22 bp, Artificial Sequence
  chemically synthesized
caagaaaatctacaccatccag

SEQ ID NO: 1200880 - DNA, 22 bp, Artificial Sequence
  chemically synthesized
tgtgagattctgctggatggtg

SEQ ID NO: 1200881 - DNA, 22 bp, Artificial Sequence
  chemically synthesized
aagaaaatctacaccatccagc

SEQ ID NO: 1200882 - DNA, 22 bp, Artificial Sequence
  chemically synthesized
aggatctgtgtgagattctgct

SEQ ID NO: 1200883 - DNA, 22 bp, Artificial Sequence
  chemically synthesized
caccatccagcagaatctcaca

SEQ ID NO: 1200884 - DNA, 22 bp, Artificial Sequence
  chemically synthesized
aaattaaggatctgtgtgagat

SEQ ID NO: 1200885 - DNA, 22 bp, Artificial Sequence
  chemically synthesized
aaaattaaggatctgtgtgaga

SEQ ID NO: 1200886 - DNA, 22 bp, Artificial Sequence
  chemically synthesized
taaaattaaggatctgtgtgag

SEQ ID NO: 1200887 - DNA, 22 bp, Artificial Sequence
  chemically synthesized
attttaaaattaaggatctgtg

SEQ ID NO: 1200888 - DNA, 22 bp, Artificial Sequence
  chemically synthesized
actcattttaaaattaaggatc

SEQ ID NO: 1200889 - DNA, 22 bp, Artificial Sequence
  chemically synthesized
aactcattttaaaattaaggat

SEQ ID NO: 1200890 - DNA, 22 bp, Artificial Sequence
  chemically synthesized
ttaactcattttaaaattaagg

SEQ ID NO: 1200891 - DNA, 22 bp, Artificial Sequence
  chemically synthesized
cttaactcattttaaaattaag

SEQ ID NO: 1200892 - DNA, 22 bp, Artificial Sequence
  chemically synthesized
acacagatccttaattttaaaa

SEQ ID NO: 1200893 - DNA, 22 bp, Artificial Sequence
  chemically synthesized
cttcttaactcattttaaaatt

SEQ ID NO: 1200894 - DNA, 22 bp, Artificial Sequence
  chemically synthesized
gaccactgcttcttaactcatt

SEQ ID NO: 1200895 - DNA, 22 bp, Artificial Sequence
  chemically synthesized
aattttaaaatgagttaagaag

SEQ ID NO: 1200896 - DNA, 22 bp, Artificial Sequence
  chemically synthesized
attttaaaatgagttaagaagc

SEQ ID NO: 1200897 - DNA, 22 bp, Artificial Sequence
  chemically synthesized
ccctagaccactgcttcttaac

SEQ ID NO: 1200898 - DNA, 22 bp, Artificial Sequence
  chemically synthesized
taaaatgagttaagaagcagtg

SEQ ID NO: 1200899 - DNA, 22 bp, Artificial Sequence
  chemically synthesized
aaaatgagttaagaagcagtgg

SEQ ID NO: 1200900 - DNA, 22 bp, Artificial Sequence
  chemically synthesized
aaatgagttaagaagcagtggt

SEQ ID NO: 1200901 - DNA, 22 bp, Artificial Sequence
  chemically synthesized
agaaccatagcctgccctagac

SEQ ID NO: 1200902 - DNA, 22 bp, Artificial Sequence
  chemically synthesized
gagaaccatagcctgccctaga

SEQ ID NO: 1200903 - DNA, 22 bp, Artificial Sequence
  chemically synthesized
agaagcagtggtctagggcagg

SEQ ID NO: 1200904 - DNA, 22 bp, Artificial Sequence
  chemically synthesized
tgagaaccatagcctgccctag

SEQ ID NO: 1200905 - DNA, 22 bp, Artificial Sequence
  chemically synthesized
gatccacactttgagaaccata

SEQ ID NO: 1200906 - DNA, 22 bp, Artificial Sequence
  chemically synthesized
gggcaggctatggttctcaaag

SEQ ID NO: 1200907 - DNA, 22 bp, Artificial Sequence
  chemically synthesized
gtctggatccacactttgagaa

SEQ ID NO: 1200908 - DNA, 22 bp, Artificial Sequence
  chemically synthesized
atgctggtctggatccacactt

SEQ ID NO: 1200909 - DNA, 22 bp, Artificial Sequence
  chemically synthesized
tggttctcaaagtgtggatcca

SEQ ID NO: 1200910 - DNA, 22 bp, Artificial Sequence
  chemically synthesized
tcaaagtgtggatccagaccag

SEQ ID NO: 1200911 - DNA, 22 bp, Artificial Sequence
  chemically synthesized
aaagtgtggatccagaccagca

SEQ ID NO: 1200912 - DNA, 22 bp, Artificial Sequence
  chemically synthesized
aaaaggtcccaggtgacgctga

SEQ ID NO: 1200913 - DNA, 22 bp, Artificial Sequence
  chemically synthesized
taaaaaggtcccaggtgacgct

SEQ ID NO: 1200914 - DNA, 22 bp, Artificial Sequence
  chemically synthesized
ctaaaaaggtcccaggtgacgc

SEQ ID NO: 1200915 - DNA, 22 bp, Artificial Sequence
  chemically synthesized
ggtatttctaaaaaggtcccag

SEQ ID NO: 1200916 - DNA, 22 bp, Artificial Sequence
  chemically synthesized
aaattcggtatttctaaaaagg

SEQ ID NO: 1200917 - DNA, 22 bp, Artificial Sequence
  chemically synthesized
ggacctttttagaaataccgaa

SEQ ID NO: 1200918 - DNA, 22 bp, Artificial Sequence
  chemically synthesized
ggagagtcctgaaattcggtat

SEQ ID NO: 1200919 - DNA, 22 bp, Artificial Sequence
  chemically synthesized
tttagaaataccgaatttcagg

SEQ ID NO: 1200920 - DNA, 22 bp, Artificial Sequence
  chemically synthesized
ttagaaataccgaatttcagga

SEQ ID NO: 1200921 - DNA, 22 bp, Artificial Sequence
  chemically synthesized
tagaaataccgaatttcaggac

SEQ ID NO: 1200922 - DNA, 22 bp, Artificial Sequence
  chemically synthesized
agaaataccgaatttcaggact

SEQ ID NO: 1200923 - DNA, 22 bp, Artificial Sequence
  chemically synthesized
gaaataccgaatttcaggactc

SEQ ID NO: 1200924 - DNA, 22 bp, Artificial Sequence
  chemically synthesized
accaagtaagtctgggagagtc

SEQ ID NO: 1200925 - DNA, 22 bp, Artificial Sequence
  chemically synthesized
agatactaaccaagtaagtctg

SEQ ID NO: 1200926 - DNA, 22 bp, Artificial Sequence
  chemically synthesized
caggactctcccagacttactt

SEQ ID NO: 1200927 - DNA, 22 bp, Artificial Sequence
  chemically synthesized
aggactctcccagacttacttg

SEQ ID NO: 1200928 - DNA, 22 bp, Artificial Sequence
  chemically synthesized
cctgagatactaaccaagtaag

SEQ ID NO: 1200929 - DNA, 22 bp, Artificial Sequence
  chemically synthesized
actccctgagatactaaccaag

SEQ ID NO: 1200930 - DNA, 22 bp, Artificial Sequence
  chemically synthesized
tcccagacttacttggttagta

SEQ ID NO: 1200931 - DNA, 22 bp, Artificial Sequence
  chemically synthesized
ccagacttacttggttagtatc

SEQ ID NO: 1200932 - DNA, 22 bp, Artificial Sequence
  chemically synthesized
ggtctcactccctgagatacta

SEQ ID NO: 1200933 - DNA, 22 bp, Artificial Sequence
  chemically synthesized
tgggtctcactccctgagatac

SEQ ID NO: 1200934 - DNA, 22 bp, Artificial Sequence
  chemically synthesized
ctgggtctcactccctgagata

SEQ ID NO: 1200935 - DNA, 22 bp, Artificial Sequence
  chemically synthesized
acttggttagtatctcagggag

SEQ ID NO: 1200936 - DNA, 22 bp, Artificial Sequence
  chemically synthesized
cttggttagtatctcagggagt

SEQ ID NO: 1200937 - DNA, 22 bp, Artificial Sequence
  chemically synthesized
ggttagtatctcagggagtgag

SEQ ID NO: 1200938 - DNA, 22 bp, Artificial Sequence
  chemically synthesized
gttagtatctcagggagtgaga

SEQ ID NO: 1200939 - DNA, 22 bp, Artificial Sequence
  chemically synthesized
gtatctcagggagtgagaccca

SEQ ID NO: 1200940 - DNA, 22 bp, Artificial Sequence
  chemically synthesized
agggagtgagacccagaaatct

SEQ ID NO: 1200941 - DNA, 22 bp, Artificial Sequence
  chemically synthesized
aaaagaaaacacagatttctgg

SEQ ID NO: 1200942 - DNA, 22 bp, Artificial Sequence
  chemically synthesized
aacattaaaaagaaaacacaga

SEQ ID NO: 1200943 - DNA, 22 bp, Artificial Sequence
  chemically synthesized
tgtgtcgattaaacattaaaaa

SEQ ID NO: 1200944 - DNA, 22 bp, Artificial Sequence
  chemically synthesized
tgttttctttttaatgtttaat

SEQ ID NO: 1200945 - DNA, 22 bp, Artificial Sequence
  chemically synthesized
tctttttaatgtttaatcgaca

SEQ ID NO: 1200946 - DNA, 22 bp, Artificial Sequence
  chemically synthesized
ctttttaatgtttaatcgacac

SEQ ID NO: 1200947 - DNA, 22 bp, Artificial Sequence
  chemically synthesized
tttttaatgtttaatcgacaca

SEQ ID NO: 1200948 - DNA, 22 bp, Artificial Sequence
  chemically synthesized
tttaatgtttaatcgacacata

SEQ ID NO: 1200949 - DNA, 22 bp, Artificial Sequence
  chemically synthesized
aatatgcataattatgtgtcga

SEQ ID NO: 1200950 - DNA, 22 bp, Artificial Sequence
  chemically synthesized
ttaatgtttaatcgacacataa

SEQ ID NO: 1200951 - DNA, 22 bp, Artificial Sequence
  chemically synthesized
taatgtttaatcgacacataat

SEQ ID NO: 1200952 - DNA, 22 bp, Artificial Sequence
  chemically synthesized
aatgtttaatcgacacataatt

SEQ ID NO: 1200953 - DNA, 22 bp, Artificial Sequence
  chemically synthesized
ctaaatatgcataattatgtgt

SEQ ID NO: 1200954 - DNA, 22 bp, Artificial Sequence
  chemically synthesized
atgtttaatcgacacataatta

SEQ ID NO: 1200955 - DNA, 22 bp, Artificial Sequence
  chemically synthesized
tacctcctaaatatgcataatt

SEQ ID NO: 1200956 - DNA, 22 bp, Artificial Sequence
  chemically synthesized
aatcgacacataattatgcata

SEQ ID NO: 1200957 - DNA, 22 bp, Artificial Sequence
  chemically synthesized
atcgacacataattatgcatat

SEQ ID NO: 1200958 - DNA, 22 bp, Artificial Sequence
  chemically synthesized
tgtacctcctaaatatgcataa

SEQ ID NO: 1200959 - DNA, 22 bp, Artificial Sequence
  chemically synthesized
tgcatatttaggaggtacagag

SEQ ID NO: 1200960 - DNA, 22 bp, Artificial Sequence
  chemically synthesized
atataggaaaatatcactctgt

SEQ ID NO: 1200961 - DNA, 22 bp, Artificial Sequence
  chemically synthesized
aggaggtacagagtgatatttt

SEQ ID NO: 1200962 - DNA, 22 bp, Artificial Sequence
  chemically synthesized
tattcatataggaaaatatcac

SEQ ID NO: 1200963 - DNA, 22 bp, Artificial Sequence
  chemically synthesized
ggaggtacagagtgatattttc

SEQ ID NO: 1200964 - DNA, 22 bp, Artificial Sequence
  chemically synthesized
catgttatattcatataggaaa

SEQ ID NO: 1200965 - DNA, 22 bp, Artificial Sequence
  chemically synthesized
ttacatgttatattcatatagg

SEQ ID NO: 1200966 - DNA, 22 bp, Artificial Sequence
  chemically synthesized
attattacatgttatattcata

SEQ ID NO: 1200967 - DNA, 22 bp, Artificial Sequence
  chemically synthesized
gattattacatgttatattcat

SEQ ID NO: 1200968 - DNA, 22 bp, Artificial Sequence
  chemically synthesized
atttgattattacatgttatat

SEQ ID NO: 1200969 - DNA, 22 bp, Artificial Sequence
  chemically synthesized
tcctatatgaatataacatgta

SEQ ID NO: 1200970 - DNA, 22 bp, Artificial Sequence
  chemically synthesized
cctatatgaatataacatgtaa

SEQ ID NO: 1200971 - DNA, 22 bp, Artificial Sequence
  chemically synthesized
ctatatgaatataacatgtaat

SEQ ID NO: 1200972 - DNA, 22 bp, Artificial Sequence
  chemically synthesized
gcctgatttgattattacatgt

SEQ ID NO: 1200973 - DNA, 22 bp, Artificial Sequence
  chemically synthesized
tatgaatataacatgtaataat

SEQ ID NO: 1200974 - DNA, 22 bp, Artificial Sequence
  chemically synthesized
aggtaatggatatgataattag

SEQ ID NO: 1200975 - DNA, 22 bp, Artificial Sequence
  chemically synthesized
gaggtaatggatatgataatta

SEQ ID NO: 1200976 - DNA, 22 bp, Artificial Sequence
  chemically synthesized
attatcatatccattacctcaa

SEQ ID NO: 1200977 - DNA, 22 bp, Artificial Sequence
  chemically synthesized
tcatatccattacctcaaatat

SEQ ID NO: 1200978 - DNA, 22 bp, Artificial Sequence
  chemically synthesized
ccaacacaaagaaatgacaaat

SEQ ID NO: 1200979 - DNA, 22 bp, Artificial Sequence
  chemically synthesized
cccaacacaaagaaatgacaaa

SEQ ID NO: 1200980 - DNA, 22 bp, Artificial Sequence
  chemically synthesized
cctcaaatatttgtcatttctt

SEQ ID NO: 1200981 - DNA, 22 bp, Artificial Sequence
  chemically synthesized
aaacttcccaacacaaagaaat

SEQ ID NO: 1200982 - DNA, 22 bp, Artificial Sequence
  chemically synthesized
aaatatttgtcatttctttgtg

SEQ ID NO: 1200983 - DNA, 22 bp, Artificial Sequence
  chemically synthesized
gaaacttcccaacacaaagaaa

SEQ ID NO: 1200984 - DNA, 22 bp, Artificial Sequence
  chemically synthesized
tgaaacttcccaacacaaagaa

SEQ ID NO: 1200985 - DNA, 22 bp, Artificial Sequence
  chemically synthesized
gtcatttctttgtgttgggaag

SEQ ID NO: 1200986 - DNA, 22 bp, Artificial Sequence
  chemically synthesized
tcatttctttgtgttgggaagt

SEQ ID NO: 1200987 - DNA, 22 bp, Artificial Sequence
  chemically synthesized
gaagagaggattttgaaacttc

SEQ ID NO: 1200988 - DNA, 22 bp, Artificial Sequence
  chemically synthesized
ctttgtgttgggaagtttcaaa

SEQ ID NO: 1200989 - DNA, 22 bp, Artificial Sequence
  chemically synthesized
tttgtgttgggaagtttcaaaa

SEQ ID NO: 1200990 - DNA, 22 bp, Artificial Sequence
  chemically synthesized
tgtgttgggaagtttcaaaatc

SEQ ID NO: 1200991 - DNA, 22 bp, Artificial Sequence
  chemically synthesized
gtgttgggaagtttcaaaatcc

SEQ ID NO: 1200992 - DNA, 22 bp, Artificial Sequence
  chemically synthesized
tgttgggaagtttcaaaatcct

SEQ ID NO: 1200993 - DNA, 22 bp, Artificial Sequence
  chemically synthesized
aatagctagaagagaggatttt

SEQ ID NO: 1200994 - DNA, 22 bp, Artificial Sequence
  chemically synthesized
aaatagctagaagagaggattt

SEQ ID NO: 1200995 - DNA, 22 bp, Artificial Sequence
  chemically synthesized
ggaagtttcaaaatcctctctt

SEQ ID NO: 1200996 - DNA, 22 bp, Artificial Sequence
  chemically synthesized
tgcatgtttaaatagctagaag

SEQ ID NO: 1200997 - DNA, 22 bp, Artificial Sequence
  chemically synthesized
caaaatcctctcttctagctat

SEQ ID NO: 1200998 - DNA, 22 bp, Artificial Sequence
  chemically synthesized
aaaatcctctcttctagctatt

SEQ ID NO: 1200999 - DNA, 22 bp, Artificial Sequence
  chemically synthesized
ttgtgcatgtttaaatagctag

SEQ ID NO: 1201000 - DNA, 22 bp, Artificial Sequence
  chemically synthesized
attgtgcatgtttaaatagcta

SEQ ID NO: 1201001 - DNA, 22 bp, Artificial Sequence
  chemically synthesized
tcttctagctatttaaacatgc

SEQ ID NO: 1201002 - DNA, 22 bp, Artificial Sequence
  chemically synthesized
ttctagctatttaaacatgcac

SEQ ID NO: 1201003 - DNA, 22 bp, Artificial Sequence
  chemically synthesized
acagtaatttattgtgcatgtt

SEQ ID NO: 1201004 - DNA, 22 bp, Artificial Sequence
  chemically synthesized
ctagctatttaaacatgcacaa

SEQ ID NO: 1201005 - DNA, 22 bp, Artificial Sequence
  chemically synthesized
tagctatttaaacatgcacaat

SEQ ID NO: 1201006 - DNA, 22 bp, Artificial Sequence
  chemically synthesized
gctatttaaacatgcacaataa

SEQ ID NO: 1201007 - DNA, 22 bp, Artificial Sequence
  chemically synthesized
agttaacagtaatttattgtgc

SEQ ID NO: 1201008 - DNA, 22 bp, Artificial Sequence
  chemically synthesized
cagttaacagtaatttattgtg

SEQ ID NO: 1201009 - DNA, 22 bp, Artificial Sequence
  chemically synthesized
tttaaacatgcacaataaatta

SEQ ID NO: 1201010 - DNA, 22 bp, Artificial Sequence
  chemically synthesized
aaacatgcacaataaattactg

SEQ ID NO: 1201011 - DNA, 22 bp, Artificial Sequence
  chemically synthesized
aacatgcacaataaattactgt

SEQ ID NO: 1201012 - DNA, 22 bp, Artificial Sequence
  chemically synthesized
taaggtaacttcagttaacagt

SEQ ID NO: 1201013 - DNA, 22 bp, Artificial Sequence
  chemically synthesized
aagcactgtaaggtaacttcag

SEQ ID NO: 1201014 - DNA, 22 bp, Artificial Sequence
  chemically synthesized
taaagcactgtaaggtaacttc

SEQ ID NO: 1201015 - DNA, 22 bp, Artificial Sequence
  chemically synthesized
ctgttaactgaagttaccttac

SEQ ID NO: 1201016 - DNA, 22 bp, Artificial Sequence
  chemically synthesized
ttaactgaagttaccttacagt

SEQ ID NO: 1201017 - DNA, 22 bp, Artificial Sequence
  chemically synthesized
gtgttctaaagcactgtaaggt

SEQ ID NO: 1201018 - DNA, 22 bp, Artificial Sequence
  chemically synthesized
actgaagttaccttacagtgct

SEQ ID NO: 1201019 - DNA, 22 bp, Artificial Sequence
  chemically synthesized
aagttaccttacagtgctttag

SEQ ID NO: 1201020 - DNA, 22 bp, Artificial Sequence
  chemically synthesized
ccttacagtgctttagaacact

SEQ ID NO: 1201021 - DNA, 22 bp, Artificial Sequence
  chemically synthesized
acagtgctttagaacactagta

SEQ ID NO: 1201022 - DNA, 22 bp, Artificial Sequence
  chemically synthesized
cagtgctttagaacactagtac

SEQ ID NO: 1201023 - DNA, 22 bp, Artificial Sequence
  chemically synthesized
aataggacggatatgtactagt

SEQ ID NO: 1201024 - DNA, 22 bp, Artificial Sequence
  chemically synthesized
tagaacactagtacatatccgt

SEQ ID NO: 1201025 - DNA, 22 bp, Artificial Sequence
  chemically synthesized
agaacactagtacatatccgtc

SEQ ID NO: 1201026 - DNA, 22 bp, Artificial Sequence
  chemically synthesized
gaacactagtacatatccgtcc

SEQ ID NO: 1201027 - DNA, 22 bp, Artificial Sequence
  chemically synthesized
gtacatatccgtcctatttagc

SEQ ID NO: 1201028 - DNA, 22 bp, Artificial Sequence
  chemically synthesized
acagatacaaaatgataagcta

SEQ ID NO: 1201029 - DNA, 22 bp, Artificial Sequence
  chemically synthesized
gttaacagatacaaaatgataa

SEQ ID NO: 1201030 - DNA, 22 bp, Artificial Sequence
  chemically synthesized
tttagcttatcattttgtatct

SEQ ID NO: 1201031 - DNA, 22 bp, Artificial Sequence
  chemically synthesized
agcttatcattttgtatctgtt

SEQ ID NO: 1201032 - DNA, 22 bp, Artificial Sequence
  chemically synthesized
gcttatcattttgtatctgtta

SEQ ID NO: 1201033 - DNA, 22 bp, Artificial Sequence
  chemically synthesized
atcattttgtatctgttaacta

SEQ ID NO: 1201034 - DNA, 22 bp, Artificial Sequence
  chemically synthesized
tcattttgtatctgttaactag

SEQ ID NO: 1201035 - DNA, 22 bp, Artificial Sequence
  chemically synthesized
tgtatctgttaactagcttgtc

SEQ ID NO: 1201036 - DNA, 22 bp, Artificial Sequence
  chemically synthesized
gtatctgttaactagcttgtcc

SEQ ID NO: 1201037 - DNA, 22 bp, Artificial Sequence
  chemically synthesized
tatctgttaactagcttgtccc

SEQ ID NO: 1201038 - DNA, 22 bp, Artificial Sequence
  chemically synthesized
ttaactagcttgtccctttcct

SEQ ID NO: 1201039 - DNA, 22 bp, Artificial Sequence
  chemically synthesized
actagcttgtccctttcctccc

SEQ ID NO: 1201040 - DNA, 22 bp, Artificial Sequence
  chemically synthesized
gcttgtccctttcctccctctc

SEQ ID NO: 1201041 - DNA, 22 bp, Artificial Sequence
  chemically synthesized
gtccctttcctccctctcctcc

SEQ ID NO: 1201042 - DNA, 22 bp, Artificial Sequence
  chemically synthesized
tccctttcctccctctcctccc

SEQ ID NO: 1201043 - DNA, 22 bp, Artificial Sequence
  chemically synthesized
tcctccctctcctccctcttac

SEQ ID NO: 1201044 - DNA, 22 bp, Artificial Sequence
  chemically synthesized
cctccctctcctccctcttacc

SEQ ID NO: 1201045 - DNA, 22 bp, Artificial Sequence
  chemically synthesized
ctccctctcctccctcttaccc

SEQ ID NO: 1201046 - DNA, 22 bp, Artificial Sequence
  chemically synthesized
gcagaagccggggagggtaaga

SEQ ID NO: 1201047 - DNA, 22 bp, Artificial Sequence
  chemically synthesized
cctctcctccctcttaccctcc

SEQ ID NO: 1201048 - DNA, 22 bp, Artificial Sequence
  chemically synthesized
tcctccctcttaccctccccgg

SEQ ID NO: 1201049 - DNA, 22 bp, Artificial Sequence
  chemically synthesized
ctccctcttaccctccccggct

SEQ ID NO: 1201050 - DNA, 22 bp, Artificial Sequence
  chemically synthesized
cctcttaccctccccggcttct

SEQ ID NO: 1201051 - DNA, 22 bp, Artificial Sequence
  chemically synthesized
ttaccctccccggcttctgcta

SEQ ID NO: 1201052 - DNA, 22 bp, Artificial Sequence
  chemically synthesized
accctccccggcttctgctaac

SEQ ID NO: 1201053 - DNA, 22 bp, Artificial Sequence
  chemically synthesized
ccctccccggcttctgctaacc

SEQ ID NO: 1201054 - DNA, 22 bp, Artificial Sequence
  chemically synthesized
cccggcttctgctaaccactat

SEQ ID NO: 1201055 - DNA, 22 bp, Artificial Sequence
  chemically synthesized
atagaagcaggcagtagaatag

SEQ ID NO: 1201056 - DNA, 22 bp, Artificial Sequence
  chemically synthesized
catagaagcaggcagtagaata

SEQ ID NO: 1201057 - DNA, 22 bp, Artificial Sequence
  chemically synthesized
ctgctaaccactattctactgc

SEQ ID NO: 1201058 - DNA, 22 bp, Artificial Sequence
  chemically synthesized
tgctaaccactattctactgcc

SEQ ID NO: 1201059 - DNA, 22 bp, Artificial Sequence
  chemically synthesized
ctaaccactattctactgcctg

SEQ ID NO: 1201060 - DNA, 22 bp, Artificial Sequence
  chemically synthesized
atttcatagaagcaggcagtag

SEQ ID NO: 1201061 - DNA, 22 bp, Artificial Sequence
  chemically synthesized
gatttcatagaagcaggcagta

SEQ ID NO: 1201062 - DNA, 22 bp, Artificial Sequence
  chemically synthesized
accactattctactgcctgctt

SEQ ID NO: 1201063 - DNA, 22 bp, Artificial Sequence
  chemically synthesized
aaaagtttgatttcatagaagc

SEQ ID NO: 1201064 - DNA, 22 bp, Artificial Sequence
  chemically synthesized
ttctactgcctgcttctatgaa

SEQ ID NO: 1201065 - DNA, 22 bp, Artificial Sequence
  chemically synthesized
tactgcctgcttctatgaaatc

SEQ ID NO: 1201066 - DNA, 22 bp, Artificial Sequence
  chemically synthesized
ctgcctgcttctatgaaatcaa

SEQ ID NO: 1201067 - DNA, 22 bp, Artificial Sequence
  chemically synthesized
gagctaaaaagtttgatttcat

SEQ ID NO: 1201068 - DNA, 22 bp, Artificial Sequence
  chemically synthesized
cctgcttctatgaaatcaaact

SEQ ID NO: 1201069 - DNA, 22 bp, Artificial Sequence
  chemically synthesized
cttctatgaaatcaaacttttt

SEQ ID NO: 1201070 - DNA, 22 bp, Artificial Sequence
  chemically synthesized
atatgttagagctaaaaagttt

SEQ ID NO: 1201071 - DNA, 22 bp, Artificial Sequence
  chemically synthesized
catatgttagagctaaaaagtt

SEQ ID NO: 1201072 - DNA, 22 bp, Artificial Sequence
  chemically synthesized
ctatgaaatcaaactttttagc

SEQ ID NO: 1201073 - DNA, 22 bp, Artificial Sequence
  chemically synthesized
tcatatgttagagctaaaaagt

SEQ ID NO: 1201074 - DNA, 22 bp, Artificial Sequence
  chemically synthesized
tatgaaatcaaactttttagct

SEQ ID NO: 1201075 - DNA, 22 bp, Artificial Sequence
  chemically synthesized
tgaaatcaaactttttagctct

SEQ ID NO: 1201076 - DNA, 22 bp, Artificial Sequence
  chemically synthesized
tttagctctaacatatgaaaac

SEQ ID NO: 1201077 - DNA, 22 bp, Artificial Sequence
  chemically synthesized
ttagctctaacatatgaaaact

SEQ ID NO: 1201078 - DNA, 22 bp, Artificial Sequence
  chemically synthesized
tagctctaacatatgaaaactt

SEQ ID NO: 1201079 - DNA, 22 bp, Artificial Sequence
  chemically synthesized
agctctaacatatgaaaacttg

SEQ ID NO: 1201080 - DNA, 22 bp, Artificial Sequence
  chemically synthesized
gctctaacatatgaaaacttgt

SEQ ID NO: 1201081 - DNA, 22 bp, Artificial Sequence
  chemically synthesized
taacatatgaaaacttgtgata

SEQ ID NO: 1201082 - DNA, 22 bp, Artificial Sequence
  chemically synthesized
acatatgaaaacttgtgatatt

SEQ ID NO: 1201083 - DNA, 22 bp, Artificial Sequence
  chemically synthesized
gtgatatttatctcttcgtgcc

SEQ ID NO: 1201084 - DNA, 22 bp, Artificial Sequence
  chemically synthesized
tgatatttatctcttcgtgccc

SEQ ID NO: 1201085 - DNA, 22 bp, Artificial Sequence
  chemically synthesized
agtgaaataagtcgggcacgaa

SEQ ID NO: 1201086 - DNA, 22 bp, Artificial Sequence
  chemically synthesized
ttaagtgaaataagtcgggcac

SEQ ID NO: 1201087 - DNA, 22 bp, Artificial Sequence
  chemically synthesized
atctcttcgtgcccgacttatt

SEQ ID NO: 1201088 - DNA, 22 bp, Artificial Sequence
  chemically synthesized
tctcttcgtgcccgacttattt

SEQ ID NO: 1201089 - DNA, 22 bp, Artificial Sequence
  chemically synthesized
gatactgttaagtgaaataagt

SEQ ID NO: 1201090 - DNA, 22 bp, Artificial Sequence
  chemically synthesized
ttcgtgcccgacttatttcact

SEQ ID NO: 1201091 - DNA, 22 bp, Artificial Sequence
  chemically synthesized
cgtgcccgacttatttcactta

SEQ ID NO: 1201092 - DNA, 22 bp, Artificial Sequence
  chemically synthesized
gtgcccgacttatttcacttaa

SEQ ID NO: 1201093 - DNA, 22 bp, Artificial Sequence
  chemically synthesized
atttcacttaacagtatccagg

SEQ ID NO: 1201094 - DNA, 22 bp, Artificial Sequence
  chemically synthesized
tttcacttaacagtatccaggc

SEQ ID NO: 1201095 - DNA, 22 bp, Artificial Sequence
  chemically synthesized
cacttaacagtatccaggctca

SEQ ID NO: 1201096 - DNA, 22 bp, Artificial Sequence
  chemically synthesized
acttaacagtatccaggctcat

SEQ ID NO: 1201097 - DNA, 22 bp, Artificial Sequence
  chemically synthesized
gtggtaacatggatgagcctgg

SEQ ID NO: 1201098 - DNA, 22 bp, Artificial Sequence
  chemically synthesized
aacagtatccaggctcatccat

SEQ ID NO: 1201099 - DNA, 22 bp, Artificial Sequence
  chemically synthesized
acagtatccaggctcatccatg

SEQ ID NO: 1201100 - DNA, 22 bp, Artificial Sequence
  chemically synthesized
taattggtggtaacatggatga

SEQ ID NO: 1201101 - DNA, 22 bp, Artificial Sequence
  chemically synthesized
atccatgttaccaccaattaca

SEQ ID NO: 1201102 - DNA, 22 bp, Artificial Sequence
  chemically synthesized
ccaccaattacaggatttcatt

SEQ ID NO: 1201103 - DNA, 22 bp, Artificial Sequence
  chemically synthesized
agccataaaaagaatgaaatcc

SEQ ID NO: 1201104 - DNA, 22 bp, Artificial Sequence
  chemically synthesized
ttcagccataaaaagaatgaaa

SEQ ID NO: 1201105 - DNA, 22 bp, Artificial Sequence
  chemically synthesized
caggatttcattctttttatgg

SEQ ID NO: 1201106 - DNA, 22 bp, Artificial Sequence
  chemically synthesized
cattctttttatggctgaataa

SEQ ID NO: 1201107 - DNA, 22 bp, Artificial Sequence
  chemically synthesized
attctttttatggctgaataat

SEQ ID NO: 1201108 - DNA, 22 bp, Artificial Sequence
  chemically synthesized
tttttatggctgaataatattc

SEQ ID NO: 1201109 - DNA, 22 bp, Artificial Sequence
  chemically synthesized
tttatggctgaataatattcca

SEQ ID NO: 1201110 - DNA, 22 bp, Artificial Sequence
  chemically synthesized
ttatggctgaataatattccat

SEQ ID NO: 1201111 - DNA, 22 bp, Artificial Sequence
  chemically synthesized
tatggctgaataatattccatt

SEQ ID NO: 1201112 - DNA, 22 bp, Artificial Sequence
  chemically synthesized
atggctgaataatattccattg

SEQ ID NO: 1201113 - DNA, 22 bp, Artificial Sequence
  chemically synthesized
tggctgaataatattccattgt

SEQ ID NO: 1201114 - DNA, 22 bp, Artificial Sequence
  chemically synthesized
aataatattccattgtgtttat

SEQ ID NO: 1201115 - DNA, 22 bp, Artificial Sequence
  chemically synthesized
aaaatatggcatataaacacaa

SEQ ID NO: 1201116 - DNA, 22 bp, Artificial Sequence
  chemically synthesized
aaaaatatggcatataaacaca

SEQ ID NO: 1201117 - DNA, 22 bp, Artificial Sequence
  chemically synthesized
cattgtgtttatatgccatatt

SEQ ID NO: 1201118 - DNA, 22 bp, Artificial Sequence
  chemically synthesized
tgtttatatgccatatttttaa

SEQ ID NO: 1201119 - DNA, 22 bp, Artificial Sequence
  chemically synthesized
acagataaatgaatttaaaaat

SEQ ID NO: 1201120 - DNA, 22 bp, Artificial Sequence
  chemically synthesized
atatgccatatttttaaattca

SEQ ID NO: 1201121 - DNA, 22 bp, Artificial Sequence
  chemically synthesized
tatgccatatttttaaattcat

SEQ ID NO: 1201122 - DNA, 22 bp, Artificial Sequence
  chemically synthesized
agtgtccattaacagataaatg

SEQ ID NO: 1201123 - DNA, 22 bp, Artificial Sequence
  chemically synthesized
ttaaattcatttatctgttaat

SEQ ID NO: 1201124 - DNA, 22 bp, Artificial Sequence
  chemically synthesized
taaattcatttatctgttaatg

SEQ ID NO: 1201125 - DNA, 22 bp, Artificial Sequence
  chemically synthesized
aaattcatttatctgttaatgg

SEQ ID NO: 1201126 - DNA, 22 bp, Artificial Sequence
  chemically synthesized
aattcatttatctgttaatgga

SEQ ID NO: 1201127 - DNA, 22 bp, Artificial Sequence
  chemically synthesized
atttatctgttaatggacactt

SEQ ID NO: 1201128 - DNA, 22 bp, Artificial Sequence
  chemically synthesized
atctgttaatggacacttaggt

SEQ ID NO: 1201129 - DNA, 22 bp, Artificial Sequence
  chemically synthesized
tctgttaatggacacttaggtt

SEQ ID NO: 1201130 - DNA, 22 bp, Artificial Sequence
  chemically synthesized
agatacggaatcaacctaagtg

SEQ ID NO: 1201131 - DNA, 22 bp, Artificial Sequence
  chemically synthesized
ttgagatacggaatcaacctaa

SEQ ID NO: 1201132 - DNA, 22 bp, Artificial Sequence
  chemically synthesized
ttaatggacacttaggttgatt

SEQ ID NO: 1201133 - DNA, 22 bp, Artificial Sequence
  chemically synthesized
atggacacttaggttgattccg

SEQ ID NO: 1201134 - DNA, 22 bp, Artificial Sequence
  chemically synthesized
aaacagattgttgagatacgga

SEQ ID NO: 1201135 - DNA, 22 bp, Artificial Sequence
  chemically synthesized
ttaaaacagattgttgagatac

SEQ ID NO: 1201136 - DNA, 22 bp, Artificial Sequence
  chemically synthesized
aggttgattccgtatctcaaca

SEQ ID NO: 1201137 - DNA, 22 bp, Artificial Sequence
  chemically synthesized
gttaaaacagattgttgagata

SEQ ID NO: 1201138 - DNA, 22 bp, Artificial Sequence
  chemically synthesized
ggttgattccgtatctcaacaa

SEQ ID NO: 1201139 - DNA, 22 bp, Artificial Sequence
  chemically synthesized
attccgtatctcaacaatctgt

SEQ ID NO: 1201140 - DNA, 22 bp, Artificial Sequence
  chemically synthesized
gaggccttgttaaaacagattg

SEQ ID NO: 1201141 - DNA, 22 bp, Artificial Sequence
  chemically synthesized
cgtatctcaacaatctgtttta

SEQ ID NO: 1201142 - DNA, 22 bp, Artificial Sequence
  chemically synthesized
tggaggccttgttaaaacagat

SEQ ID NO: 1201143 - DNA, 22 bp, Artificial Sequence
  chemically synthesized
ctggaggccttgttaaaacaga

SEQ ID NO: 1201144 - DNA, 22 bp, Artificial Sequence
  chemically synthesized
tctggaggccttgttaaaacag

SEQ ID NO: 1201145 - DNA, 22 bp, Artificial Sequence
  chemically synthesized
aacaatctgttttaacaaggcc

SEQ ID NO: 1201146 - DNA, 22 bp, Artificial Sequence
  chemically synthesized
ttttaacaaggcctccagaaaa

SEQ ID NO: 1201147 - DNA, 22 bp, Artificial Sequence
  chemically synthesized
agtgcacatcagaattttctgg

SEQ ID NO: 1201148 - DNA, 22 bp, Artificial Sequence
  chemically synthesized
taacaaggcctccagaaaattc

SEQ ID NO: 1201149 - DNA, 22 bp, Artificial Sequence
  chemically synthesized
gagtgcacatcagaattttctg

SEQ ID NO: 1201150 - DNA, 22 bp, Artificial Sequence
  chemically synthesized
aacaaggcctccagaaaattct

SEQ ID NO: 1201151 - DNA, 22 bp, Artificial Sequence
  chemically synthesized
acaaggcctccagaaaattctg

SEQ ID NO: 1201152 - DNA, 22 bp, Artificial Sequence
  chemically synthesized
aaacttgagtgcacatcagaat

SEQ ID NO: 1201153 - DNA, 22 bp, Artificial Sequence
  chemically synthesized
tcaaacttgagtgcacatcaga

SEQ ID NO: 1201154 - DNA, 22 bp, Artificial Sequence
  chemically synthesized
cagaaaattctgatgtgcactc

SEQ ID NO: 1201155 - DNA, 22 bp, Artificial Sequence
  chemically synthesized
gaggttctcaaacttgagtgca

SEQ ID NO: 1201156 - DNA, 22 bp, Artificial Sequence
  chemically synthesized
tgatgtgcactcaagtttgaga

SEQ ID NO: 1201157 - DNA, 22 bp, Artificial Sequence
  chemically synthesized
atgtgcactcaagtttgagaac

SEQ ID NO: 1201158 - DNA, 22 bp, Artificial Sequence
  chemically synthesized
cgcaaattagaggttctcaaac

SEQ ID NO: 1201159 - DNA, 22 bp, Artificial Sequence
  chemically synthesized
ttgcgcaaattagaggttctca

SEQ ID NO: 1201160 - DNA, 22 bp, Artificial Sequence
  chemically synthesized
aagtttgagaacctctaatttg

SEQ ID NO: 1201161 - DNA, 22 bp, Artificial Sequence
  chemically synthesized
aaaattgttgcgcaaattagag

SEQ ID NO: 1201162 - DNA, 22 bp, Artificial Sequence
  chemically synthesized
gaaaattgttgcgcaaattaga

SEQ ID NO: 1201163 - DNA, 22 bp, Artificial Sequence
  chemically synthesized
gagaacctctaatttgcgcaac

SEQ ID NO: 1201164 - DNA, 22 bp, Artificial Sequence
  chemically synthesized
agaacctctaatttgcgcaaca

SEQ ID NO: 1201165 - DNA, 22 bp, Artificial Sequence
  chemically synthesized
taatttgcgcaacaattttcaa

SEQ ID NO: 1201166 - DNA, 22 bp, Artificial Sequence
  chemically synthesized
taaaaaatccatttgaaaattg

SEQ ID NO: 1201167 - DNA, 22 bp, Artificial Sequence
  chemically synthesized
atttgcgcaacaattttcaaat

SEQ ID NO: 1201168 - DNA, 22 bp, Artificial Sequence
  chemically synthesized
gcgcaacaattttcaaatggat

SEQ ID NO: 1201169 - DNA, 22 bp, Artificial Sequence
  chemically synthesized
cgcaacaattttcaaatggatt

SEQ ID NO: 1201170 - DNA, 22 bp, Artificial Sequence
  chemically synthesized
aggagacattgtaaaaaatcca

SEQ ID NO: 1201171 - DNA, 22 bp, Artificial Sequence
  chemically synthesized
gaggagacattgtaaaaaatcc

SEQ ID NO: 1201172 - DNA, 22 bp, Artificial Sequence
  chemically synthesized
tcaaatggattttttacaatgt

SEQ ID NO: 1201173 - DNA, 22 bp, Artificial Sequence
  chemically synthesized
caaatggattttttacaatgtc

SEQ ID NO: 1201174 - DNA, 22 bp, Artificial Sequence
  chemically synthesized
aaatggattttttacaatgtct

SEQ ID NO: 1201175 - DNA, 22 bp, Artificial Sequence
  chemically synthesized
aatcaaaatttgaggagacatt

SEQ ID NO: 1201176 - DNA, 22 bp, Artificial Sequence
  chemically synthesized
tttacaatgtctcctcaaattt

SEQ ID NO: 1201177 - DNA, 22 bp, Artificial Sequence
  chemically synthesized
ttacaatgtctcctcaaatttt

SEQ ID NO: 1201178 - DNA, 22 bp, Artificial Sequence
  chemically synthesized
tacaatgtctcctcaaattttg

SEQ ID NO: 1201179 - DNA, 22 bp, Artificial Sequence
  chemically synthesized
acaatgtctcctcaaattttga

SEQ ID NO: 1201180 - DNA, 22 bp, Artificial Sequence
  chemically synthesized
caatgtctcctcaaattttgat

SEQ ID NO: 1201181 - DNA, 22 bp, Artificial Sequence
  chemically synthesized
ccaaacataactgaatcaaaat

SEQ ID NO: 1201182 - DNA, 22 bp, Artificial Sequence
  chemically synthesized
cccaaacataactgaatcaaaa

SEQ ID NO: 1201183 - DNA, 22 bp, Artificial Sequence
  chemically synthesized
ctcaaattttgattcagttatg

SEQ ID NO: 1201184 - DNA, 22 bp, Artificial Sequence
  chemically synthesized
aaattttgattcagttatgttt

SEQ ID NO: 1201185 - DNA, 22 bp, Artificial Sequence
  chemically synthesized
aaatatatttcccaaacataac

SEQ ID NO: 1201186 - DNA, 22 bp, Artificial Sequence
  chemically synthesized
aaaatatatttcccaaacataa

SEQ ID NO: 1201187 - DNA, 22 bp, Artificial Sequence
  chemically synthesized
tgattcagttatgtttgggaaa

SEQ ID NO: 1201188 - DNA, 22 bp, Artificial Sequence
  chemically synthesized
gattcagttatgtttgggaaat

SEQ ID NO: 1201189 - DNA, 22 bp, Artificial Sequence
  chemically synthesized
attcagttatgtttgggaaata

SEQ ID NO: 1201190 - DNA, 22 bp, Artificial Sequence
  chemically synthesized
ggaagatttaaaatatatttcc

SEQ ID NO: 1201191 - DNA, 22 bp, Artificial Sequence
  chemically synthesized
agttatgtttgggaaatatatt

SEQ ID NO: 1201192 - DNA, 22 bp, Artificial Sequence
  chemically synthesized
cctgggaagatttaaaatatat

SEQ ID NO: 1201193 - DNA, 22 bp, Artificial Sequence
  chemically synthesized
tgtttgggaaatatattttaaa

SEQ ID NO: 1201194 - DNA, 22 bp, Artificial Sequence
  chemically synthesized
gggaaatatattttaaatcttc

SEQ ID NO: 1201195 - DNA, 22 bp, Artificial Sequence
  chemically synthesized
agaattgcctgggaagatttaa

SEQ ID NO: 1201196 - DNA, 22 bp, Artificial Sequence
  chemically synthesized
ggaaatatattttaaatcttcc

SEQ ID NO: 1201197 - DNA, 22 bp, Artificial Sequence
  chemically synthesized
atcctcagaattgcctgggaag

SEQ ID NO: 1201198 - DNA, 22 bp, Artificial Sequence
  chemically synthesized
taaatcttcccaggcaattctg

SEQ ID NO: 1201199 - DNA, 22 bp, Artificial Sequence
  chemically synthesized
aaatcttcccaggcaattctga

SEQ ID NO: 1201200 - DNA, 22 bp, Artificial Sequence
  chemically synthesized
aatcttcccaggcaattctgag

SEQ ID NO: 1201201 - DNA, 22 bp, Artificial Sequence
  chemically synthesized
tcccaaacaggttaatcctcag

SEQ ID NO: 1201202 - DNA, 22 bp, Artificial Sequence
  chemically synthesized
cccaggcaattctgaggattaa

SEQ ID NO: 1201203 - DNA, 22 bp, Artificial Sequence
  chemically synthesized
ccaggcaattctgaggattaac

SEQ ID NO: 1201204 - DNA, 22 bp, Artificial Sequence
  chemically synthesized
gagtagctgtcccaaacaggtt

SEQ ID NO: 1201205 - DNA, 22 bp, Artificial Sequence
  chemically synthesized
tgaggattaacctgtttgggac

SEQ ID NO: 1201206 - DNA, 22 bp, Artificial Sequence
  chemically synthesized
ccctggagtagctgtcccaaac

SEQ ID NO: 1201207 - DNA, 22 bp, Artificial Sequence
  chemically synthesized
aggattaacctgtttgggacag

SEQ ID NO: 1201208 - DNA, 22 bp, Artificial Sequence
  chemically synthesized
gccctggagtagctgtcccaaa

SEQ ID NO: 1201209 - DNA, 22 bp, Artificial Sequence
  chemically synthesized
tgccctggagtagctgtcccaa

SEQ ID NO: 1201210 - DNA, 22 bp, Artificial Sequence
  chemically synthesized
acctgtttgggacagctactcc

SEQ ID NO: 1201211 - DNA, 22 bp, Artificial Sequence
  chemically synthesized
agtagctttgccctggagtagc

SEQ ID NO: 1201212 - DNA, 22 bp, Artificial Sequence
  chemically synthesized
gagtagctttgccctggagtag

SEQ ID NO: 1201213 - DNA, 22 bp, Artificial Sequence
  chemically synthesized
tttgggacagctactccagggc

SEQ ID NO: 1201214 - DNA, 22 bp, Artificial Sequence
  chemically synthesized
gggacagctactccagggcaaa

SEQ ID NO: 1201215 - DNA, 22 bp, Artificial Sequence
  chemically synthesized
ggacagctactccagggcaaag

SEQ ID NO: 1201216 - DNA, 22 bp, Artificial Sequence
  chemically synthesized
aagtttgagtagctttgccctg

SEQ ID NO: 1201217 - DNA, 22 bp, Artificial Sequence
  chemically synthesized
caactaaagtttgagtagcttt

SEQ ID NO: 1201218 - DNA, 22 bp, Artificial Sequence
  chemically synthesized
tccaactaaagtttgagtagct

SEQ ID NO: 1201219 - DNA, 22 bp, Artificial Sequence
  chemically synthesized
ctccagggcaaagctactcaaa

SEQ ID NO: 1201220 - DNA, 22 bp, Artificial Sequence
  chemically synthesized
cagggcaaagctactcaaactt

SEQ ID NO: 1201221 - DNA, 22 bp, Artificial Sequence
  chemically synthesized
gttctccaactaaagtttgagt

SEQ ID NO: 1201222 - DNA, 22 bp, Artificial Sequence
  chemically synthesized
atggtactcgttctccaactaa

SEQ ID NO: 1201223 - DNA, 22 bp, Artificial Sequence
  chemically synthesized
ctcaaactttagttggagaacg

SEQ ID NO: 1201224 - DNA, 22 bp, Artificial Sequence
  chemically synthesized
aaactttagttggagaacgagt

SEQ ID NO: 1201225 - DNA, 22 bp, Artificial Sequence
  chemically synthesized
tagttggagaacgagtaccatc

SEQ ID NO: 1201226 - DNA, 22 bp, Artificial Sequence
  chemically synthesized
ccaggtgaggctgatggtactc

SEQ ID NO: 1201227 - DNA, 22 bp, Artificial Sequence
  chemically synthesized
agttggagaacgagtaccatca

SEQ ID NO: 1201228 - DNA, 22 bp, Artificial Sequence
  chemically synthesized
gttggagaacgagtaccatcag

SEQ ID NO: 1201229 - DNA, 22 bp, Artificial Sequence
  chemically synthesized
tctcccaggtgaggctgatggt

SEQ ID NO: 1201230 - DNA, 22 bp, Artificial Sequence
  chemically synthesized
gagaacgagtaccatcagcctc

SEQ ID NO: 1201231 - DNA, 22 bp, Artificial Sequence
  chemically synthesized
cagccacaactgtctcccaggt

SEQ ID NO: 1201232 - DNA, 22 bp, Artificial Sequence
  chemically synthesized
tgcagccacaactgtctcccag

SEQ ID NO: 1201233 - DNA, 22 bp, Artificial Sequence
  chemically synthesized
acctgggagacagttgtggctg

SEQ ID NO: 1201234 - DNA, 22 bp, Artificial Sequence
  chemically synthesized
ggagacagttgtggctgcagaa

SEQ ID NO: 1201235 - DNA, 22 bp, Artificial Sequence
  chemically synthesized
aggatgtgggcaagattctgca

SEQ ID NO: 1201236 - DNA, 22 bp, Artificial Sequence
  chemically synthesized
tggctgcagaatcttgcccaca

SEQ ID NO: 1201237 - DNA, 22 bp, Artificial Sequence
  chemically synthesized
agtatgtctaaggatgtgggca

SEQ ID NO: 1201238 - DNA, 22 bp, Artificial Sequence
  chemically synthesized
cagaatcttgcccacatcctta

SEQ ID NO: 1201239 - DNA, 22 bp, Artificial Sequence
  chemically synthesized
attgagtatgtctaaggatgtg

SEQ ID NO: 1201240 - DNA, 22 bp, Artificial Sequence
  chemically synthesized
gattgagtatgtctaaggatgt

SEQ ID NO: 1201241 - DNA, 22 bp, Artificial Sequence
  chemically synthesized
acgcttgattgagtatgtctaa

SEQ ID NO: 1201242 - DNA, 22 bp, Artificial Sequence
  chemically synthesized
gcccacatccttagacatactc

SEQ ID NO: 1201243 - DNA, 22 bp, Artificial Sequence
  chemically synthesized
tcacgcttgattgagtatgtct

SEQ ID NO: 1201244 - DNA, 22 bp, Artificial Sequence
  chemically synthesized
cccacatccttagacatactca

SEQ ID NO: 1201245 - DNA, 22 bp, Artificial Sequence
  chemically synthesized
actctcacgcttgattgagtat

SEQ ID NO: 1201246 - DNA, 22 bp, Artificial Sequence
  chemically synthesized
ggtctcactctcacgcttgatt

SEQ ID NO: 1201247 - DNA, 22 bp, Artificial Sequence
  chemically synthesized
agacatactcaatcaagcgtga

SEQ ID NO: 1201248 - DNA, 22 bp, Artificial Sequence
  chemically synthesized
gacatactcaatcaagcgtgag

SEQ ID NO: 1201249 - DNA, 22 bp, Artificial Sequence
  chemically synthesized
aatcaagcgtgagagtgagacc

SEQ ID NO: 1201250 - DNA, 22 bp, Artificial Sequence
  chemically synthesized
gggatctgtgttttgctgggtt

SEQ ID NO: 1201251 - DNA, 22 bp, Artificial Sequence
  chemically synthesized
tgttttgctgggtttatttatt

SEQ ID NO: 1201252 - DNA, 22 bp, Artificial Sequence
  chemically synthesized
tgctgggtttatttatttactt

SEQ ID NO: 1201253 - DNA, 22 bp, Artificial Sequence
  chemically synthesized
gctgggtttatttatttactta

SEQ ID NO: 1201254 - DNA, 22 bp, Artificial Sequence
  chemically synthesized
aaatacagtaagtaagtaaata

SEQ ID NO: 1201255 - DNA, 22 bp, Artificial Sequence
  chemically synthesized
ctgggtttatttatttacttac

SEQ ID NO: 1201256 - DNA, 22 bp, Artificial Sequence
  chemically synthesized
caaatacagtaagtaagtaaat

SEQ ID NO: 1201257 - DNA, 22 bp, Artificial Sequence
  chemically synthesized
ggtttatttatttacttactta

SEQ ID NO: 1201258 - DNA, 22 bp, Artificial Sequence
  chemically synthesized
tttcaaatacagtaagtaagta

SEQ ID NO: 1201259 - DNA, 22 bp, Artificial Sequence
  chemically synthesized
gtttcaaatacagtaagtaagt

SEQ ID NO: 1201260 - DNA, 22 bp, Artificial Sequence
  chemically synthesized
atttatttacttacttactgta

SEQ ID NO: 1201261 - DNA, 22 bp, Artificial Sequence
  chemically synthesized
tttatttacttacttactgtat

SEQ ID NO: 1201262 - DNA, 22 bp, Artificial Sequence
  chemically synthesized
atttacttacttactgtatttg

SEQ ID NO: 1201263 - DNA, 22 bp, Artificial Sequence
  chemically synthesized
tttacttacttactgtatttga

SEQ ID NO: 1201264 - DNA, 22 bp, Artificial Sequence
  chemically synthesized
acttacttactgtatttgaaac

SEQ ID NO: 1201265 - DNA, 22 bp, Artificial Sequence
  chemically synthesized
cttacttactgtatttgaaaca

SEQ ID NO: 1201266 - DNA, 22 bp, Artificial Sequence
  chemically synthesized
acttactgtatttgaaacaaga

SEQ ID NO: 1201267 - DNA, 22 bp, Artificial Sequence
  chemically synthesized
cttactgtatttgaaacaagat

SEQ ID NO: 1201268 - DNA, 22 bp, Artificial Sequence
  chemically synthesized
gacaacagagtgagatcttgtt

SEQ ID NO: 1201269 - DNA, 22 bp, Artificial Sequence
  chemically synthesized
actgtatttgaaacaagatctc

SEQ ID NO: 1201270 - DNA, 22 bp, Artificial Sequence
  chemically synthesized
ctgtatttgaaacaagatctca

SEQ ID NO: 1201271 - DNA, 22 bp, Artificial Sequence
  chemically synthesized
tatttgaaacaagatctcactc

SEQ ID NO: 1201272 - DNA, 22 bp, Artificial Sequence
  chemically synthesized
gagcctggacaacagagtgaga

SEQ ID NO: 1201273 - DNA, 22 bp, Artificial Sequence
  chemically synthesized
gaaacaagatctcactctgttg

SEQ ID NO: 1201274 - DNA, 22 bp, Artificial Sequence
  chemically synthesized
aaacaagatctcactctgttgt

SEQ ID NO: 1201275 - DNA, 22 bp, Artificial Sequence
  chemically synthesized
cactcgagcctggacaacagag

SEQ ID NO: 1201276 - DNA, 22 bp, Artificial Sequence
  chemically synthesized
actctgttgtccaggctcgagt

SEQ ID NO: 1201277 - DNA, 22 bp, Artificial Sequence
  chemically synthesized
tgttgtccaggctcgagtgcag

SEQ ID NO: 1201278 - DNA, 22 bp, Artificial Sequence
  chemically synthesized
ttgtccaggctcgagtgcagtg

SEQ ID NO: 1201279 - DNA, 22 bp, Artificial Sequence
  chemically synthesized
tccaggctcgagtgcagtggca

SEQ ID NO: 1201280 - DNA, 22 bp, Artificial Sequence
  chemically synthesized
cagtgagtgcatgatcatgcca

SEQ ID NO: 1201281 - DNA, 22 bp, Artificial Sequence
  chemically synthesized
gagtgcagtggcatgatcatgc

SEQ ID NO: 1201282 - DNA, 22 bp, Artificial Sequence
  chemically synthesized
atgctacagtgagtgcatgatc

SEQ ID NO: 1201283 - DNA, 22 bp, Artificial Sequence
  chemically synthesized
gatgctacagtgagtgcatgat

SEQ ID NO: 1201284 - DNA, 22 bp, Artificial Sequence
  chemically synthesized
aacacaggagtttgatgctaca

SEQ ID NO: 1201285 - DNA, 22 bp, Artificial Sequence
  chemically synthesized
aaacacaggagtttgatgctac

SEQ ID NO: 1201286 - DNA, 22 bp, Artificial Sequence
  chemically synthesized
cttaaacacaggagtttgatgc

SEQ ID NO: 1201287 - DNA, 22 bp, Artificial Sequence
  chemically synthesized
actgtagcatcaaactcctgtg

SEQ ID NO: 1201288 - DNA, 22 bp, Artificial Sequence
  chemically synthesized
tagcatcaaactcctgtgttta

SEQ ID NO: 1201289 - DNA, 22 bp, Artificial Sequence
  chemically synthesized
aggcgggaggatcaggattgct

SEQ ID NO: 1201290 - DNA, 22 bp, Artificial Sequence
  chemically synthesized
ctgtgtttaagcaatcctgatc

SEQ ID NO: 1201291 - DNA, 22 bp, Artificial Sequence
  chemically synthesized
tgtttaagcaatcctgatcctc

SEQ ID NO: 1201292 - DNA, 22 bp, Artificial Sequence
  chemically synthesized
gggacgctgaggcgggaggatc

SEQ ID NO: 1201293 - DNA, 22 bp, Artificial Sequence
  chemically synthesized
aagcaatcctgatcctcccgcc

SEQ ID NO: 1201294 - DNA, 22 bp, Artificial Sequence
  chemically synthesized
agcaatcctgatcctcccgcct

SEQ ID NO: 1201295 - DNA, 22 bp, Artificial Sequence
  chemically synthesized
ttcgggacgctgaggcgggagg

SEQ ID NO: 1201296 - DNA, 22 bp, Artificial Sequence
  chemically synthesized
actattcgggacgctgaggcgg

SEQ ID NO: 1201297 - DNA, 22 bp, Artificial Sequence
  chemically synthesized
atcctcccgcctcagcgtcccg

SEQ ID NO: 1201298 - DNA, 22 bp, Artificial Sequence
  chemically synthesized
tagtcctaactattcgggacgc

SEQ ID NO: 1201299 - DNA, 22 bp, Artificial Sequence
  chemically synthesized
ccgcctcagcgtcccgaatagt

SEQ ID NO: 1201300 - DNA, 22 bp, Artificial Sequence
  chemically synthesized
agcgtcccgaatagttaggact

SEQ ID NO: 1201301 - DNA, 22 bp, Artificial Sequence
  chemically synthesized
gcgaggtgtggtagtgcaaacc

SEQ ID NO: 1201302 - DNA, 22 bp, Artificial Sequence
  chemically synthesized
ggactacaggtttgcactacca

SEQ ID NO: 1201303 - DNA, 22 bp, Artificial Sequence
  chemically synthesized
caggtttgcactaccacacctc

SEQ ID NO: 1201304 - DNA, 22 bp, Artificial Sequence
  chemically synthesized
aaaaaaaaattagcgaggtgtg

SEQ ID NO: 1201305 - DNA, 22 bp, Artificial Sequence
  chemically synthesized
aaaaaaaaaattagcgaggtgt

SEQ ID NO: 1201306 - DNA, 22 bp, Artificial Sequence
  chemically synthesized
gcactaccacacctcgctaatt

SEQ ID NO: 1201307 - DNA, 22 bp, Artificial Sequence
  chemically synthesized
cactaccacacctcgctaattt

SEQ ID NO: 1201308 - DNA, 22 bp, Artificial Sequence
  chemically synthesized
ccacacctcgctaatttttttt

SEQ ID NO: 1201309 - DNA, 22 bp, Artificial Sequence
  chemically synthesized
gctaattttttttttaagtatt

SEQ ID NO: 1201310 - DNA, 22 bp, Artificial Sequence
  chemically synthesized
agaaacacagcaaaaaatactt

SEQ ID NO: 1201311 - DNA, 22 bp, Artificial Sequence
  chemically synthesized
attttttttttaagtatttttt

SEQ ID NO: 1201312 - DNA, 22 bp, Artificial Sequence
  chemically synthesized
tttttttaagtattttttgctg

SEQ ID NO: 1201313 - DNA, 22 bp, Artificial Sequence
  chemically synthesized
ttttttaagtattttttgctgt

SEQ ID NO: 1201314 - DNA, 22 bp, Artificial Sequence
  chemically synthesized
tttttaagtattttttgctgtg

SEQ ID NO: 1201315 - DNA, 22 bp, Artificial Sequence
  chemically synthesized
ttttaagtattttttgctgtgt

SEQ ID NO: 1201316 - DNA, 22 bp, Artificial Sequence
  chemically synthesized
tttaagtattttttgctgtgtt

SEQ ID NO: 1201317 - DNA, 22 bp, Artificial Sequence
  chemically synthesized
ttaagtattttttgctgtgttt

SEQ ID NO: 1201318 - DNA, 22 bp, Artificial Sequence
  chemically synthesized
taagtattttttgctgtgtttc

SEQ ID NO: 1201319 - DNA, 22 bp, Artificial Sequence
  chemically synthesized
aagtattttttgctgtgtttct

SEQ ID NO: 1201320 - DNA, 22 bp, Artificial Sequence
  chemically synthesized
cagacaagactgagaaacacag

SEQ ID NO: 1201321 - DNA, 22 bp, Artificial Sequence
  chemically synthesized
agtattttttgctgtgtttctc

SEQ ID NO: 1201322 - DNA, 22 bp, Artificial Sequence
  chemically synthesized
tttgctgtgtttctcagtcttg

SEQ ID NO: 1201323 - DNA, 22 bp, Artificial Sequence
  chemically synthesized
ttgctgtgtttctcagtcttgt

SEQ ID NO: 1201324 - DNA, 22 bp, Artificial Sequence
  chemically synthesized
tgctgtgtttctcagtcttgtc

SEQ ID NO: 1201325 - DNA, 22 bp, Artificial Sequence
  chemically synthesized
gctgtgtttctcagtcttgtct

SEQ ID NO: 1201326 - DNA, 22 bp, Artificial Sequence
  chemically synthesized
ctgtgtttctcagtcttgtctg

SEQ ID NO: 1201327 - DNA, 22 bp, Artificial Sequence
  chemically synthesized
agcccaggagttccagacaaga

SEQ ID NO: 1201328 - DNA, 22 bp, Artificial Sequence
  chemically synthesized
cagcccaggagttccagacaag

SEQ ID NO: 1201329 - DNA, 22 bp, Artificial Sequence
  chemically synthesized
tgtttctcagtcttgtctggaa

SEQ ID NO: 1201330 - DNA, 22 bp, Artificial Sequence
  chemically synthesized
ctcagtcttgtctggaactcct

SEQ ID NO: 1201331 - DNA, 22 bp, Artificial Sequence
  chemically synthesized
tcagtcttgtctggaactcctg

SEQ ID NO: 1201332 - DNA, 22 bp, Artificial Sequence
  chemically synthesized
agtcttgtctggaactcctggg

SEQ ID NO: 1201333 - DNA, 22 bp, Artificial Sequence
  chemically synthesized
gtctggaactcctgggctgaag

SEQ ID NO: 1201334 - DNA, 22 bp, Artificial Sequence
  chemically synthesized
tctggaactcctgggctgaagg

SEQ ID NO: 1201335 - DNA, 22 bp, Artificial Sequence
  chemically synthesized
gaactcctgggctgaagggatc

SEQ ID NO: 1201336 - DNA, 22 bp, Artificial Sequence
  chemically synthesized
ggaggccaaggcaggcagatcc

SEQ ID NO: 1201337 - DNA, 22 bp, Artificial Sequence
  chemically synthesized
ctgggctgaagggatctgcctg

SEQ ID NO: 1201338 - DNA, 22 bp, Artificial Sequence
  chemically synthesized
gggaggccaaggcaggcagatc

SEQ ID NO: 1201339 - DNA, 22 bp, Artificial Sequence
  chemically synthesized
tgggaggccaaggcaggcagat

SEQ ID NO: 1201340 - DNA, 22 bp, Artificial Sequence
  chemically synthesized
ggctgaagggatctgcctgcct

SEQ ID NO: 1201341 - DNA, 22 bp, Artificial Sequence
  chemically synthesized
aagggatctgcctgccttggcc

SEQ ID NO: 1201342 - DNA, 22 bp, Artificial Sequence
  chemically synthesized
tagtcccagcactttgggaggc

SEQ ID NO: 1201343 - DNA, 22 bp, Artificial Sequence
  chemically synthesized
cctgccttggcctcccaaagtg

SEQ ID NO: 1201344 - DNA, 22 bp, Artificial Sequence
  chemically synthesized
ccttggcctcccaaagtgctgg

SEQ ID NO: 1201345 - DNA, 22 bp, Artificial Sequence
  chemically synthesized
acacctgtagtcccagcacttt

SEQ ID NO: 1201346 - DNA, 22 bp, Artificial Sequence
  chemically synthesized
ggcctcccaaagtgctgggact

SEQ ID NO: 1201347 - DNA, 22 bp, Artificial Sequence
  chemically synthesized
gctcacacctgtagtcccagca

SEQ ID NO: 1201348 - DNA, 22 bp, Artificial Sequence
  chemically synthesized
gcctcccaaagtgctgggacta

SEQ ID NO: 1201349 - DNA, 22 bp, Artificial Sequence
  chemically synthesized
ccaaagtgctgggactacaggt

SEQ ID NO: 1201350 - DNA, 22 bp, Artificial Sequence
  chemically synthesized
cccggcatgttggctcacacct

SEQ ID NO: 1201351 - DNA, 22 bp, Artificial Sequence
  chemically synthesized
ctccccggcatgttggctcaca

SEQ ID NO: 1201352 - DNA, 22 bp, Artificial Sequence
  chemically synthesized
ggactacaggtgtgagccaaca

SEQ ID NO: 1201353 - DNA, 22 bp, Artificial Sequence
  chemically synthesized
caggtgtgagccaacatgccgg

SEQ ID NO: 1201354 - DNA, 22 bp, Artificial Sequence
  chemically synthesized
aaacggattcctccccggcatg

SEQ ID NO: 1201355 - DNA, 22 bp, Artificial Sequence
  chemically synthesized
catcagagtcatcagggaaggt

SEQ ID NO: 1201356 - DNA, 22 bp, Artificial Sequence
  chemically synthesized
taaccaccaccttccctgatga

SEQ ID NO: 1201357 - DNA, 22 bp, Artificial Sequence
  chemically synthesized
aaccaccaccttccctgatgac

SEQ ID NO: 1201358 - DNA, 22 bp, Artificial Sequence
  chemically synthesized
accaccaccttccctgatgact

SEQ ID NO: 1201359 - DNA, 22 bp, Artificial Sequence
  chemically synthesized
aaagtgtggcctgcatcagagt

SEQ ID NO: 1201360 - DNA, 22 bp, Artificial Sequence
  chemically synthesized
tcaaagtgtggcctgcatcaga

SEQ ID NO: 1201361 - DNA, 22 bp, Artificial Sequence
  chemically synthesized
ccctgatgactctgatgcaggc

SEQ ID NO: 1201362 - DNA, 22 bp, Artificial Sequence
  chemically synthesized
cctgatgactctgatgcaggcc

SEQ ID NO: 1201363 - DNA, 22 bp, Artificial Sequence
  chemically synthesized
ctctcaaagtgtggcctgcatc

SEQ ID NO: 1201364 - DNA, 22 bp, Artificial Sequence
  chemically synthesized
gctctcaaagtgtggcctgcat

SEQ ID NO: 1201365 - DNA, 22 bp, Artificial Sequence
  chemically synthesized
tgctctcaaagtgtggcctgca

SEQ ID NO: 1201366 - DNA, 22 bp, Artificial Sequence
  chemically synthesized
atgactctgatgcaggccacac

SEQ ID NO: 1201367 - DNA, 22 bp, Artificial Sequence
  chemically synthesized
tgctttgctctcaaagtgtggc

SEQ ID NO: 1201368 - DNA, 22 bp, Artificial Sequence
  chemically synthesized
tgatgcaggccacactttgaga

SEQ ID NO: 1201369 - DNA, 22 bp, Artificial Sequence
  chemically synthesized
atgcaggccacactttgagagc

SEQ ID NO: 1201370 - DNA, 22 bp, Artificial Sequence
  chemically synthesized
tggctgtgctttgctctcaaag

SEQ ID NO: 1201371 - DNA, 22 bp, Artificial Sequence
  chemically synthesized
tgtggctgtgctttgctctcaa

SEQ ID NO: 1201372 - DNA, 22 bp, Artificial Sequence
  chemically synthesized
ctgtggctgtgctttgctctca

SEQ ID NO: 1201373 - DNA, 22 bp, Artificial Sequence
  chemically synthesized
tctgtggctgtgctttgctctc

SEQ ID NO: 1201374 - DNA, 22 bp, Artificial Sequence
  chemically synthesized
ttctgtggctgtgctttgctct

SEQ ID NO: 1201375 - DNA, 22 bp, Artificial Sequence
  chemically synthesized
tttctgtggctgtgctttgctc

SEQ ID NO: 1201376 - DNA, 22 bp, Artificial Sequence
  chemically synthesized
attttttctgtggctgtgcttt

SEQ ID NO: 1201377 - DNA, 22 bp, Artificial Sequence
  chemically synthesized
taattttttctgtggctgtgct

SEQ ID NO: 1201378 - DNA, 22 bp, Artificial Sequence
  chemically synthesized
ctaattttttctgtggctgtgc

SEQ ID NO: 1201379 - DNA, 22 bp, Artificial Sequence
  chemically synthesized
tctaattttttctgtggctgtg

SEQ ID NO: 1201380 - DNA, 22 bp, Artificial Sequence
  chemically synthesized
tgagagcaaagcacagccacag

SEQ ID NO: 1201381 - DNA, 22 bp, Artificial Sequence
  chemically synthesized
ttctaattttttctgtggctgt

SEQ ID NO: 1201382 - DNA, 22 bp, Artificial Sequence
  chemically synthesized
gagagcaaagcacagccacaga

SEQ ID NO: 1201383 - DNA, 22 bp, Artificial Sequence
  chemically synthesized
agagcaaagcacagccacagaa

SEQ ID NO: 1201384 - DNA, 22 bp, Artificial Sequence
  chemically synthesized
tgtcacatgaatagtcaacttt

SEQ ID NO: 1201385 - DNA, 22 bp, Artificial Sequence
  chemically synthesized
gtgtcacatgaatagtcaactt

SEQ ID NO: 1201386 - DNA, 22 bp, Artificial Sequence
  chemically synthesized
tgtgtcacatgaatagtcaact

SEQ ID NO: 1201387 - DNA, 22 bp, Artificial Sequence
  chemically synthesized
gaaaagttgactattcatgtga

SEQ ID NO: 1201388 - DNA, 22 bp, Artificial Sequence
  chemically synthesized
tatgcctttgtgtcacatgaat

SEQ ID NO: 1201389 - DNA, 22 bp, Artificial Sequence
  chemically synthesized
actattcatgtgacacaaaggc

SEQ ID NO: 1201390 - DNA, 22 bp, Artificial Sequence
  chemically synthesized
ttcatgtgacacaaaggcatat

SEQ ID NO: 1201391 - DNA, 22 bp, Artificial Sequence
  chemically synthesized
atgtgacacaaaggcatatagc

SEQ ID NO: 1201392 - DNA, 22 bp, Artificial Sequence
  chemically synthesized
catatagaaggcatagctatat

SEQ ID NO: 1201393 - DNA, 22 bp, Artificial Sequence
  chemically synthesized
aaagcctacatatagaaggcat

SEQ ID NO: 1201394 - DNA, 22 bp, Artificial Sequence
  chemically synthesized
ttcaaagcctacatatagaagg

SEQ ID NO: 1201395 - DNA, 22 bp, Artificial Sequence
  chemically synthesized
aaagttattcaaagcctacata

SEQ ID NO: 1201396 - DNA, 22 bp, Artificial Sequence
  chemically synthesized
tgccttctatatgtaggctttg

SEQ ID NO: 1201397 - DNA, 22 bp, Artificial Sequence
  chemically synthesized
ttaaaagttattcaaagcctac

SEQ ID NO: 1201398 - DNA, 22 bp, Artificial Sequence
  chemically synthesized
ttattaaaagttattcaaagcc

SEQ ID NO: 1201399 - DNA, 22 bp, Artificial Sequence
  chemically synthesized
ctatatgtaggctttgaataac

SEQ ID NO: 1201400 - DNA, 22 bp, Artificial Sequence
  chemically synthesized
ctattattaaaagttattcaaa

SEQ ID NO: 1201401 - DNA, 22 bp, Artificial Sequence
  chemically synthesized
tatatgtaggctttgaataact

SEQ ID NO: 1201402 - DNA, 22 bp, Artificial Sequence
  chemically synthesized
actattattaaaagttattcaa

SEQ ID NO: 1201403 - DNA, 22 bp, Artificial Sequence
  chemically synthesized
tactattattaaaagttattca

SEQ ID NO: 1201404 - DNA, 22 bp, Artificial Sequence
  chemically synthesized
tatgtaggctttgaataacttt

SEQ ID NO: 1201405 - DNA, 22 bp, Artificial Sequence
  chemically synthesized
ttactattattaaaagttattc

SEQ ID NO: 1201406 - DNA, 22 bp, Artificial Sequence
  chemically synthesized
tttactattattaaaagttatt

SEQ ID NO: 1201407 - DNA, 22 bp, Artificial Sequence
  chemically synthesized
ttttactattattaaaagttat

SEQ ID NO: 1201408 - DNA, 22 bp, Artificial Sequence
  chemically synthesized
gcttttttactattattaaaag

SEQ ID NO: 1201409 - DNA, 22 bp, Artificial Sequence
  chemically synthesized
tgaataacttttaataatagta

SEQ ID NO: 1201410 - DNA, 22 bp, Artificial Sequence
  chemically synthesized
tcctggcttttttactattatt

SEQ ID NO: 1201411 - DNA, 22 bp, Artificial Sequence
  chemically synthesized
gaataacttttaataatagtaa

SEQ ID NO: 1201412 - DNA, 22 bp, Artificial Sequence
  chemically synthesized
aataacttttaataatagtaaa

SEQ ID NO: 1201413 - DNA, 22 bp, Artificial Sequence
  chemically synthesized
aaagctatcctggcttttttac

SEQ ID NO: 1201414 - DNA, 22 bp, Artificial Sequence
  chemically synthesized
ttaataatagtaaaaaagccag

SEQ ID NO: 1201415 - DNA, 22 bp, Artificial Sequence
  chemically synthesized
ttaaaagctatcctggcttttt

SEQ ID NO: 1201416 - DNA, 22 bp, Artificial Sequence
  chemically synthesized
taataatagtaaaaaagccagg

SEQ ID NO: 1201417 - DNA, 22 bp, Artificial Sequence
  chemically synthesized
aataatagtaaaaaagccagga

SEQ ID NO: 1201418 - DNA, 22 bp, Artificial Sequence
  chemically synthesized
ataatagtaaaaaagccaggat

SEQ ID NO: 1201419 - DNA, 22 bp, Artificial Sequence
  chemically synthesized
ccattattaaaagctatcctgg

SEQ ID NO: 1201420 - DNA, 22 bp, Artificial Sequence
  chemically synthesized
taccattattaaaagctatcct

SEQ ID NO: 1201421 - DNA, 22 bp, Artificial Sequence
  chemically synthesized
ctaccattattaaaagctatcc

SEQ ID NO: 1201422 - DNA, 22 bp, Artificial Sequence
  chemically synthesized
ttaataatggtagaagctactc

SEQ ID NO: 1201423 - DNA, 22 bp, Artificial Sequence
  chemically synthesized
taataatggtagaagctactct

SEQ ID NO: 1201424 - DNA, 22 bp, Artificial Sequence
  chemically synthesized
aataatggtagaagctactctt

SEQ ID NO: 1201425 - DNA, 22 bp, Artificial Sequence
  chemically synthesized
ataatggtagaagctactcttt

SEQ ID NO: 1201426 - DNA, 22 bp, Artificial Sequence
  chemically synthesized
tcatatagtaagtaccaaataa

SEQ ID NO: 1201427 - DNA, 22 bp, Artificial Sequence
  chemically synthesized
gtcatatagtaagtaccaaata

SEQ ID NO: 1201428 - DNA, 22 bp, Artificial Sequence
  chemically synthesized
tgcttgtcatatagtaagtacc

SEQ ID NO: 1201429 - DNA, 22 bp, Artificial Sequence
  chemically synthesized
ctctttatttggtacttactat

SEQ ID NO: 1201430 - DNA, 22 bp, Artificial Sequence
  chemically synthesized
tttatttggtacttactatatg

SEQ ID NO: 1201431 - DNA, 22 bp, Artificial Sequence
  chemically synthesized
ccattgtgcttgtcatatagta

SEQ ID NO: 1201432 - DNA, 22 bp, Artificial Sequence
  chemically synthesized
tatttggtacttactatatgac

SEQ ID NO: 1201433 - DNA, 22 bp, Artificial Sequence
  chemically synthesized
atttggtacttactatatgaca

SEQ ID NO: 1201434 - DNA, 22 bp, Artificial Sequence
  chemically synthesized
tttggtacttactatatgacaa

SEQ ID NO: 1201435 - DNA, 22 bp, Artificial Sequence
  chemically synthesized
ggtacttactatatgacaagca

SEQ ID NO: 1201436 - DNA, 22 bp, Artificial Sequence
  chemically synthesized
gtacttactatatgacaagcac

SEQ ID NO: 1201437 - DNA, 22 bp, Artificial Sequence
  chemically synthesized
actatatgacaagcacaatggt

SEQ ID NO: 1201438 - DNA, 22 bp, Artificial Sequence
  chemically synthesized
ctatatgacaagcacaatggta

SEQ ID NO: 1201439 - DNA, 22 bp, Artificial Sequence
  chemically synthesized
tatgacaagcacaatggtaata

SEQ ID NO: 1201440 - DNA, 22 bp, Artificial Sequence
  chemically synthesized
aggataaaagggaaatacgtgt

SEQ ID NO: 1201441 - DNA, 22 bp, Artificial Sequence
  chemically synthesized
aaggataaaagggaaatacgtg

SEQ ID NO: 1201442 - DNA, 22 bp, Artificial Sequence
  chemically synthesized
taaggataaaagggaaatacgt

SEQ ID NO: 1201443 - DNA, 22 bp, Artificial Sequence
  chemically synthesized
tttaaggataaaagggaaatac

SEQ ID NO: 1201444 - DNA, 22 bp, Artificial Sequence
  chemically synthesized
ctttaaggataaaagggaaata

SEQ ID NO: 1201445 - DNA, 22 bp, Artificial Sequence
  chemically synthesized
tctttaaggataaaagggaaat

SEQ ID NO: 1201446 - DNA, 22 bp, Artificial Sequence
  chemically synthesized
ttctttaaggataaaagggaaa

SEQ ID NO: 1201447 - DNA, 22 bp, Artificial Sequence
  chemically synthesized
tttctttaaggataaaagggaa

SEQ ID NO: 1201448 - DNA, 22 bp, Artificial Sequence
  chemically synthesized
cactttttctttaaggataaaa

SEQ ID NO: 1201449 - DNA, 22 bp, Artificial Sequence
  chemically synthesized
gcctacactttttctttaagga

SEQ ID NO: 1201450 - DNA, 22 bp, Artificial Sequence
  chemically synthesized
cccttttatccttaaagaaaaa

SEQ ID NO: 1201451 - DNA, 22 bp, Artificial Sequence
  chemically synthesized
ccttttatccttaaagaaaaag

SEQ ID NO: 1201452 - DNA, 22 bp, Artificial Sequence
  chemically synthesized
ttatccttaaagaaaaagtgta

SEQ ID NO: 1201453 - DNA, 22 bp, Artificial Sequence
  chemically synthesized
tatccttaaagaaaaagtgtag

SEQ ID NO: 1201454 - DNA, 22 bp, Artificial Sequence
  chemically synthesized
atccttaaagaaaaagtgtagg

SEQ ID NO: 1201455 - DNA, 22 bp, Artificial Sequence
  chemically synthesized
tccttaaagaaaaagtgtaggc

SEQ ID NO: 1201456 - DNA, 22 bp, Artificial Sequence
  chemically synthesized
aaagaaaaagtgtaggccaggt

SEQ ID NO: 1201457 - DNA, 22 bp, Artificial Sequence
  chemically synthesized
aagaaaaagtgtaggccaggtg

SEQ ID NO: 1201458 - DNA, 22 bp, Artificial Sequence
  chemically synthesized
caggtgtaagccaccacacctg

SEQ ID NO: 1201459 - DNA, 22 bp, Artificial Sequence
  chemically synthesized
ggattacaggtgtaagccacca

SEQ ID NO: 1201460 - DNA, 22 bp, Artificial Sequence
  chemically synthesized
ccaaagtgctgggattacaggt

SEQ ID NO: 1201461 - DNA, 22 bp, Artificial Sequence
  chemically synthesized
agcctcccaaagtgctgggatt

SEQ ID NO: 1201462 - DNA, 22 bp, Artificial Sequence
  chemically synthesized
acacctgtaatcccagcacttt

SEQ ID NO: 1201463 - DNA, 22 bp, Artificial Sequence
  chemically synthesized
cctcagcctcccaaagtgctgg

SEQ ID NO: 1201464 - DNA, 22 bp, Artificial Sequence
  chemically synthesized
cacctgtaatcccagcactttg

SEQ ID NO: 1201465 - DNA, 22 bp, Artificial Sequence
  chemically synthesized
cctgcctcagcctcccaaagtg

SEQ ID NO: 1201466 - DNA, 22 bp, Artificial Sequence
  chemically synthesized
taatcccagcactttgggaggc

SEQ ID NO: 1201467 - DNA, 22 bp, Artificial Sequence
  chemically synthesized
aggtgatctgcctgcctcagcc

SEQ ID NO: 1201468 - DNA, 22 bp, Artificial Sequence
  chemically synthesized
tcctcaggtgatctgcctgcct

SEQ ID NO: 1201469 - DNA, 22 bp, Artificial Sequence
  chemically synthesized
tgggaggctgaggcaggcagat

SEQ ID NO: 1201470 - DNA, 22 bp, Artificial Sequence
  chemically synthesized
tgtcctcaggtgatctgcctgc

SEQ ID NO: 1201471 - DNA, 22 bp, Artificial Sequence
  chemically synthesized
gggaggctgaggcaggcagatc

SEQ ID NO: 1201472 - DNA, 22 bp, Artificial Sequence
  chemically synthesized
ctgtcctcaggtgatctgcctg

SEQ ID NO: 1201473 - DNA, 22 bp, Artificial Sequence
  chemically synthesized
ggaggctgaggcaggcagatca

SEQ ID NO: 1201474 - DNA, 22 bp, Artificial Sequence
  chemically synthesized
gtacttctgtcctcaggtgatc

SEQ ID NO: 1201475 - DNA, 22 bp, Artificial Sequence
  chemically synthesized
aggcaggcagatcacctgagga

SEQ ID NO: 1201476 - DNA, 22 bp, Artificial Sequence
  chemically synthesized
gtctcgtacttctgtcctcagg

SEQ ID NO: 1201477 - DNA, 22 bp, Artificial Sequence
  chemically synthesized
gccaggctggtctcgtacttct

SEQ ID NO: 1201478 - DNA, 22 bp, Artificial Sequence
  chemically synthesized
aggacagaagtacgagaccagc

SEQ ID NO: 1201479 - DNA, 22 bp, Artificial Sequence
  chemically synthesized
ccatgttggccaggctggtctc

SEQ ID NO: 1201480 - DNA, 22 bp, Artificial Sequence
  chemically synthesized
gccatgttggccaggctggtct

SEQ ID NO: 1201481 - DNA, 22 bp, Artificial Sequence
  chemically synthesized
tgccatgttggccaggctggtc

SEQ ID NO: 1201482 - DNA, 22 bp, Artificial Sequence
  chemically synthesized
gtagaaacggggttttgccatg

SEQ ID NO: 1201483 - DNA, 22 bp, Artificial Sequence
  chemically synthesized
agtagaaacggggttttgccat

SEQ ID NO: 1201484 - DNA, 22 bp, Artificial Sequence
  chemically synthesized
tagtagaaacggggttttgcca

SEQ ID NO: 1201485 - DNA, 22 bp, Artificial Sequence
  chemically synthesized
ttagtagaaacggggttttgcc

SEQ ID NO: 1201486 - DNA, 22 bp, Artificial Sequence
  chemically synthesized
gccaacatggcaaaaccccgtt

SEQ ID NO: 1201487 - DNA, 22 bp, Artificial Sequence
  chemically synthesized
gtgtatttttagtagaaacggg

SEQ ID NO: 1201488 - DNA, 22 bp, Artificial Sequence
  chemically synthesized
attcgtgtatttttagtagaaa

SEQ ID NO: 1201489 - DNA, 22 bp, Artificial Sequence
  chemically synthesized
gctaattcgtgtatttttagta

SEQ ID NO: 1201490 - DNA, 22 bp, Artificial Sequence
  chemically synthesized
ctactaaaaatacacgaattag

SEQ ID NO: 1201491 - DNA, 22 bp, Artificial Sequence
  chemically synthesized
tactaaaaatacacgaattagc

SEQ ID NO: 1201492 - DNA, 22 bp, Artificial Sequence
  chemically synthesized
ctaaaaatacacgaattagcca

SEQ ID NO: 1201493 - DNA, 22 bp, Artificial Sequence
  chemically synthesized
aaaatacacgaattagccaggt

SEQ ID NO: 1201494 - DNA, 22 bp, Artificial Sequence
  chemically synthesized
caggcatccgcaaccacacctg

SEQ ID NO: 1201495 - DNA, 22 bp, Artificial Sequence
  chemically synthesized
ggactacaggcatccgcaacca

SEQ ID NO: 1201496 - DNA, 22 bp, Artificial Sequence
  chemically synthesized
gccaggtgtggttgcggatgcc

SEQ ID NO: 1201497 - DNA, 22 bp, Artificial Sequence
  chemically synthesized
cccgagtagctgggactacagg

SEQ ID NO: 1201498 - DNA, 22 bp, Artificial Sequence
  chemically synthesized
cggatgcctgtagtcccagcta

SEQ ID NO: 1201499 - DNA, 22 bp, Artificial Sequence
  chemically synthesized
agcctccccgagtagctgggac

SEQ ID NO: 1201500 - DNA, 22 bp, Artificial Sequence
  chemically synthesized
cctcagcctccccgagtagctg

SEQ ID NO: 1201501 - DNA, 22 bp, Artificial Sequence
  chemically synthesized
ctgcctcagcctccccgagtag

SEQ ID NO: 1201502 - DNA, 22 bp, Artificial Sequence
  chemically synthesized
tcctgcctcagcctccccgagt

SEQ ID NO: 1201503 - DNA, 22 bp, Artificial Sequence
  chemically synthesized
tagtcccagctactcggggagg

SEQ ID NO: 1201504 - DNA, 22 bp, Artificial Sequence
  chemically synthesized
aagcaattctcctgcctcagcc

SEQ ID NO: 1201505 - DNA, 22 bp, Artificial Sequence
  chemically synthesized
ctcggggaggctgaggcaggag

SEQ ID NO: 1201506 - DNA, 22 bp, Artificial Sequence
  chemically synthesized
ggggaggctgaggcaggagaat

SEQ ID NO: 1201507 - DNA, 22 bp, Artificial Sequence
  chemically synthesized
ccgggttcaagcaattctcctg

SEQ ID NO: 1201508 - DNA, 22 bp, Artificial Sequence
  chemically synthesized
cctcccgggttcaagcaattct

SEQ ID NO: 1201509 - DNA, 22 bp, Artificial Sequence
  chemically synthesized
aggcaggagaattgcttgaacc

SEQ ID NO: 1201510 - DNA, 22 bp, Artificial Sequence
  chemically synthesized
ccgctgcctcccgggttcaagc

SEQ ID NO: 1201511 - DNA, 22 bp, Artificial Sequence
  chemically synthesized
ctaccgctgcctcccgggttca

SEQ ID NO: 1201512 - DNA, 22 bp, Artificial Sequence
  chemically synthesized
actgctaccgctgcctcccggg

SEQ ID NO: 1201513 - DNA, 22 bp, Artificial Sequence
  chemically synthesized
gctcactgctaccgctgcctcc

SEQ ID NO: 1201514 - DNA, 22 bp, Artificial Sequence
  chemically synthesized
ggctcactgctaccgctgcctc

SEQ ID NO: 1201515 - DNA, 22 bp, Artificial Sequence
  chemically synthesized
cttgaacccgggaggcagcggt

SEQ ID NO: 1201516 - DNA, 22 bp, Artificial Sequence
  chemically synthesized
gaacccgggaggcagcggtagc

SEQ ID NO: 1201517 - DNA, 22 bp, Artificial Sequence
  chemically synthesized
aacccgggaggcagcggtagca

SEQ ID NO: 1201518 - DNA, 22 bp, Artificial Sequence
  chemically synthesized
gagagtgcagtggcatgatctt

SEQ ID NO: 1201519 - DNA, 22 bp, Artificial Sequence
  chemically synthesized
tcacccagtctggagagtgcag

SEQ ID NO: 1201520 - DNA, 22 bp, Artificial Sequence
  chemically synthesized
tgtcacccagtctggagagtgc

SEQ ID NO: 1201521 - DNA, 22 bp, Artificial Sequence
  chemically synthesized
ttctgtcacccagtctggagag

SEQ ID NO: 1201522 - DNA, 22 bp, Artificial Sequence
  chemically synthesized
gttctgtcacccagtctggaga

SEQ ID NO: 1201523 - DNA, 22 bp, Artificial Sequence
  chemically synthesized
cactctccagactgggtgacag

SEQ ID NO: 1201524 - DNA, 22 bp, Artificial Sequence
  chemically synthesized
agacggagtcttgttctgtcac

SEQ ID NO: 1201525 - DNA, 22 bp, Artificial Sequence
  chemically synthesized
gagacggagtcttgttctgtca

SEQ ID NO: 1201526 - DNA, 22 bp, Artificial Sequence
  chemically synthesized
tccagactgggtgacagaacaa

SEQ ID NO: 1201527 - DNA, 22 bp, Artificial Sequence
  chemically synthesized
tgagacggagtcttgttctgtc

SEQ ID NO: 1201528 - DNA, 22 bp, Artificial Sequence
  chemically synthesized
ttgagacggagtcttgttctgt

SEQ ID NO: 1201529 - DNA, 22 bp, Artificial Sequence
  chemically synthesized
cagactgggtgacagaacaaga

SEQ ID NO: 1201530 - DNA, 22 bp, Artificial Sequence
  chemically synthesized
tttgagacggagtcttgttctg

SEQ ID NO: 1201531 - DNA, 22 bp, Artificial Sequence
  chemically synthesized
ttttgagacggagtcttgttct

SEQ ID NO: 1201532 - DNA, 22 bp, Artificial Sequence
  chemically synthesized
tttttgagacggagtcttgttc

SEQ ID NO: 1201533 - DNA, 22 bp, Artificial Sequence
  chemically synthesized
ttttttgagacggagtcttgtt

SEQ ID NO: 1201534 - DNA, 22 bp, Artificial Sequence
  chemically synthesized
tttttttgagacggagtcttgt

SEQ ID NO: 1201535 - DNA, 22 bp, Artificial Sequence
  chemically synthesized
ttttttttgagacggagtcttg

SEQ ID NO: 1201536 - DNA, 22 bp, Artificial Sequence
  chemically synthesized
tttttttttgagacggagtctt

SEQ ID NO: 1201537 - DNA, 22 bp, Artificial Sequence
  chemically synthesized
ggtgacagaacaagactccgtc

SEQ ID NO: 1201538 - DNA, 22 bp, Artificial Sequence
  chemically synthesized
ttttttttttgagacggagtct

SEQ ID NO: 1201539 - DNA, 22 bp, Artificial Sequence
  chemically synthesized
tttttttttttgagacggagtc

SEQ ID NO: 1201540 - DNA, 22 bp, Artificial Sequence
  chemically synthesized
ttttttttttttgagacggagt

SEQ ID NO: 1201541 - DNA, 22 bp, Artificial Sequence
  chemically synthesized
ttttttttttttttgagacgga

SEQ ID NO: 1201542 - DNA, 22 bp, Artificial Sequence
  chemically synthesized
cttttttttttttttgagacgg

SEQ ID NO: 1201543 - DNA, 22 bp, Artificial Sequence
  chemically synthesized
tcttttttttttttttgagacg

SEQ ID NO: 1201544 - DNA, 22 bp, Artificial Sequence
  chemically synthesized
ttcttttttttttttttgagac

SEQ ID NO: 1201545 - DNA, 22 bp, Artificial Sequence
  chemically synthesized
ttttcttttttttttttttgag

SEQ ID NO: 1201546 - DNA, 22 bp, Artificial Sequence
  chemically synthesized
cttttcttttttttttttttga

SEQ ID NO: 1201547 - DNA, 22 bp, Artificial Sequence
  chemically synthesized
tcttttcttttttttttttttg

SEQ ID NO: 1201548 - DNA, 22 bp, Artificial Sequence
  chemically synthesized
ttcttttctttttttttttttt

SEQ ID NO: 1201549 - DNA, 22 bp, Artificial Sequence
  chemically synthesized
ttttcttttctttttttttttt

SEQ ID NO: 1201550 - DNA, 22 bp, Artificial Sequence
  chemically synthesized
cttttcttttcttttttttttt

SEQ ID NO: 1201551 - DNA, 22 bp, Artificial Sequence
  chemically synthesized
tcttttcttttctttttttttt

SEQ ID NO: 1201552 - DNA, 22 bp, Artificial Sequence
  chemically synthesized
ttcttttcttttcttttttttt

SEQ ID NO: 1201553 - DNA, 22 bp, Artificial Sequence
  chemically synthesized
cgtctcaaaaaaaaaaaaaaga

SEQ ID NO: 1201554 - DNA, 22 bp, Artificial Sequence
  chemically synthesized
ttttcttttcttttcttttttt

SEQ ID NO: 1201555 - DNA, 22 bp, Artificial Sequence
  chemically synthesized
cttttcttttcttttctttttt

SEQ ID NO: 1201556 - DNA, 22 bp, Artificial Sequence
  chemically synthesized
tcttttcttttcttttcttttt

SEQ ID NO: 1201557 - DNA, 22 bp, Artificial Sequence
  chemically synthesized
ttcttttcttttcttttctttt

SEQ ID NO: 1201558 - DNA, 22 bp, Artificial Sequence
  chemically synthesized
tttcttttcttttcttttcttt

SEQ ID NO: 1201559 - DNA, 22 bp, Artificial Sequence
  chemically synthesized
aaaaaaaaaaaaaagaaaagaa

SEQ ID NO: 1201560 - DNA, 22 bp, Artificial Sequence
  chemically synthesized
tttttcttttcttttcttttct

SEQ ID NO: 1201561 - DNA, 22 bp, Artificial Sequence
  chemically synthesized
ctttttcttttcttttcttttc

SEQ ID NO: 1201562 - DNA, 22 bp, Artificial Sequence
  chemically synthesized
tctttttcttttcttttctttt

SEQ ID NO: 1201563 - DNA, 22 bp, Artificial Sequence
  chemically synthesized
ttctttttcttttcttttcttt

SEQ ID NO: 1201564 - DNA, 22 bp, Artificial Sequence
  chemically synthesized
tttctttttcttttcttttctt

SEQ ID NO: 1201565 - DNA, 22 bp, Artificial Sequence
  chemically synthesized
ttttctttttcttttcttttct

SEQ ID NO: 1201566 - DNA, 22 bp, Artificial Sequence
  chemically synthesized
cttttttctttttcttttcttt

SEQ ID NO: 1201567 - DNA, 22 bp, Artificial Sequence
  chemically synthesized
ccttttttctttttcttttctt

SEQ ID NO: 1201568 - DNA, 22 bp, Artificial Sequence
  chemically synthesized
tccttttttctttttcttttct

SEQ ID NO: 1201569 - DNA, 22 bp, Artificial Sequence
  chemically synthesized
gcagttttccttttttcttttt

SEQ ID NO: 1201570 - DNA, 22 bp, Artificial Sequence
  chemically synthesized
aatgccccaccctcgcagtttt

SEQ ID NO: 1201571 - DNA, 22 bp, Artificial Sequence
  chemically synthesized
tataacaggattaaatgcccca

SEQ ID NO: 1201572 - DNA, 22 bp, Artificial Sequence
  chemically synthesized
tctgtataacaggattaaatgc

SEQ ID NO: 1201573 - DNA, 22 bp, Artificial Sequence
  chemically synthesized
atctgtataacaggattaaatg

SEQ ID NO: 1201574 - DNA, 22 bp, Artificial Sequence
  chemically synthesized
cgagggtggggcatttaatcct

SEQ ID NO: 1201575 - DNA, 22 bp, Artificial Sequence
  chemically synthesized
ttatctgtataacaggattaaa

SEQ ID NO: 1201576 - DNA, 22 bp, Artificial Sequence
  chemically synthesized
cttatctgtataacaggattaa

SEQ ID NO: 1201577 - DNA, 22 bp, Artificial Sequence
  chemically synthesized
tcttatctgtataacaggatta

SEQ ID NO: 1201578 - DNA, 22 bp, Artificial Sequence
  chemically synthesized
agttttcttatctgtataacag

SEQ ID NO: 1201579 - DNA, 22 bp, Artificial Sequence
  chemically synthesized
ctcagttttcttatctgtataa

SEQ ID NO: 1201580 - DNA, 22 bp, Artificial Sequence
  chemically synthesized
ctcctcagttttcttatctgta

SEQ ID NO: 1201581 - DNA, 22 bp, Artificial Sequence
  chemically synthesized
gctcctcagttttcttatctgt

SEQ ID NO: 1201582 - DNA, 22 bp, Artificial Sequence
  chemically synthesized
aatcctgttatacagataagaa

SEQ ID NO: 1201583 - DNA, 22 bp, Artificial Sequence
  chemically synthesized
tgctcctcagttttcttatctg

SEQ ID NO: 1201584 - DNA, 22 bp, Artificial Sequence
  chemically synthesized
atcctgttatacagataagaaa

SEQ ID NO: 1201585 - DNA, 22 bp, Artificial Sequence
  chemically synthesized
ttgctcctcagttttcttatct

SEQ ID NO: 1201586 - DNA, 22 bp, Artificial Sequence
  chemically synthesized
tttgctcctcagttttcttatc

SEQ ID NO: 1201587 - DNA, 22 bp, Artificial Sequence
  chemically synthesized
ttatacagataagaaaactgag

SEQ ID NO: 1201588 - DNA, 22 bp, Artificial Sequence
  chemically synthesized
aactttttgctcctcagttttc

SEQ ID NO: 1201589 - DNA, 22 bp, Artificial Sequence
  chemically synthesized
tacagataagaaaactgaggag

SEQ ID NO: 1201590 - DNA, 22 bp, Artificial Sequence
  chemically synthesized
atgaaaattaaactttttgctc

SEQ ID NO: 1201591 - DNA, 22 bp, Artificial Sequence
  chemically synthesized
aatgaaaattaaactttttgct

SEQ ID NO: 1201592 - DNA, 22 bp, Artificial Sequence
  chemically synthesized
tggtacttaatgaaaattaaac

SEQ ID NO: 1201593 - DNA, 22 bp, Artificial Sequence
  chemically synthesized
aggagcaaaaagtttaattttc

SEQ ID NO: 1201594 - DNA, 22 bp, Artificial Sequence
  chemically synthesized
gctatggtacttaatgaaaatt

SEQ ID NO: 1201595 - DNA, 22 bp, Artificial Sequence
  chemically synthesized
aattttcattaagtaccatagc

SEQ ID NO: 1201596 - DNA, 22 bp, Artificial Sequence
  chemically synthesized
ataccccagctggctatggtac

SEQ ID NO: 1201597 - DNA, 22 bp, Artificial Sequence
  chemically synthesized
attttcattaagtaccatagcc

SEQ ID NO: 1201598 - DNA, 22 bp, Artificial Sequence
  chemically synthesized
tcattaagtaccatagccagct

SEQ ID NO: 1201599 - DNA, 22 bp, Artificial Sequence
  chemically synthesized
gactcataccccagctggctat

SEQ ID NO: 1201600 - DNA, 22 bp, Artificial Sequence
  chemically synthesized
cattaagtaccatagccagctg

SEQ ID NO: 1201601 - DNA, 22 bp, Artificial Sequence
  chemically synthesized
attaagtaccatagccagctgg

SEQ ID NO: 1201602 - DNA, 22 bp, Artificial Sequence
  chemically synthesized
agtaccatagccagctggggta

SEQ ID NO: 1201603 - DNA, 22 bp, Artificial Sequence
  chemically synthesized
aaactggactcataccccagct

SEQ ID NO: 1201604 - DNA, 22 bp, Artificial Sequence
  chemically synthesized
caaactggactcataccccagc

SEQ ID NO: 1201605 - DNA, 22 bp, Artificial Sequence
  chemically synthesized
tcaaactggactcataccccag

SEQ ID NO: 1201606 - DNA, 22 bp, Artificial Sequence
  chemically synthesized
aaatcacaaactttcaaactgg

SEQ ID NO: 1201607 - DNA, 22 bp, Artificial Sequence
  chemically synthesized
gggtatgagtccagtttgaaag

SEQ ID NO: 1201608 - DNA, 22 bp, Artificial Sequence
  chemically synthesized
ttaaaatcacaaactttcaaac

SEQ ID NO: 1201609 - DNA, 22 bp, Artificial Sequence
  chemically synthesized
tagatgtaattattaaaatcac

SEQ ID NO: 1201610 - DNA, 22 bp, Artificial Sequence
  chemically synthesized
tgtagatgtaattattaaaatc

SEQ ID NO: 1201611 - DNA, 22 bp, Artificial Sequence
  chemically synthesized
gaaagtttgtgattttaataat

SEQ ID NO: 1201612 - DNA, 22 bp, Artificial Sequence
  chemically synthesized
aaagtttgtgattttaataatt

SEQ ID NO: 1201613 - DNA, 22 bp, Artificial Sequence
  chemically synthesized
aagttctgtagatgtaattatt

SEQ ID NO: 1201614 - DNA, 22 bp, Artificial Sequence
  chemically synthesized
tgaagttctgtagatgtaatta

SEQ ID NO: 1201615 - DNA, 22 bp, Artificial Sequence
  chemically synthesized
ctgaagttctgtagatgtaatt

SEQ ID NO: 1201616 - DNA, 22 bp, Artificial Sequence
  chemically synthesized
gtgattttaataattacatcta

SEQ ID NO: 1201617 - DNA, 22 bp, Artificial Sequence
  chemically synthesized
tctgaagttctgtagatgtaat

SEQ ID NO: 1201618 - DNA, 22 bp, Artificial Sequence
  chemically synthesized
tgattttaataattacatctac

SEQ ID NO: 1201619 - DNA, 22 bp, Artificial Sequence
  chemically synthesized
taataattacatctacagaact

SEQ ID NO: 1201620 - DNA, 22 bp, Artificial Sequence
  chemically synthesized
aataattacatctacagaactt

SEQ ID NO: 1201621 - DNA, 22 bp, Artificial Sequence
  chemically synthesized
ataattacatctacagaacttc

SEQ ID NO: 1201622 - DNA, 22 bp, Artificial Sequence
  chemically synthesized
aaaatatattttctgaagttct

SEQ ID NO: 1201623 - DNA, 22 bp, Artificial Sequence
  chemically synthesized
caaaatatattttctgaagttc

SEQ ID NO: 1201624 - DNA, 22 bp, Artificial Sequence
  chemically synthesized
catctacagaacttcagaaaat

SEQ ID NO: 1201625 - DNA, 22 bp, Artificial Sequence
  chemically synthesized
atttcaaaatatattttctgaa

SEQ ID NO: 1201626 - DNA, 22 bp, Artificial Sequence
  chemically synthesized
cagaacttcagaaaatatattt

SEQ ID NO: 1201627 - DNA, 22 bp, Artificial Sequence
  chemically synthesized
agactcatttcaaaatatattt

SEQ ID NO: 1201628 - DNA, 22 bp, Artificial Sequence
  chemically synthesized
gccctaagactcatttcaaaat

SEQ ID NO: 1201629 - DNA, 22 bp, Artificial Sequence
  chemically synthesized
cagaaaatatattttgaaatga

SEQ ID NO: 1201630 - DNA, 22 bp, Artificial Sequence
  chemically synthesized
agaaaatatattttgaaatgag

SEQ ID NO: 1201631 - DNA, 22 bp, Artificial Sequence
  chemically synthesized
cctagccctaagactcatttca

SEQ ID NO: 1201632 - DNA, 22 bp, Artificial Sequence
  chemically synthesized
acctagccctaagactcatttc

SEQ ID NO: 1201633 - DNA, 22 bp, Artificial Sequence
  chemically synthesized
tgaaatgagtcttagggctagg

SEQ ID NO: 1201634 - DNA, 22 bp, Artificial Sequence
  chemically synthesized
gaaatgagtcttagggctaggt

SEQ ID NO: 1201635 - DNA, 22 bp, Artificial Sequence
  chemically synthesized
aaatgagtcttagggctaggta

SEQ ID NO: 1201636 - DNA, 22 bp, Artificial Sequence
  chemically synthesized
agggctaggtaaacccatgcat

SEQ ID NO: 1201637 - DNA, 22 bp, Artificial Sequence
  chemically synthesized
ataatacatgtaatgcatgggt

SEQ ID NO: 1201638 - DNA, 22 bp, Artificial Sequence
  chemically synthesized
gggctaggtaaacccatgcatt

SEQ ID NO: 1201639 - DNA, 22 bp, Artificial Sequence
  chemically synthesized
aataatacatgtaatgcatggg

SEQ ID NO: 1201640 - DNA, 22 bp, Artificial Sequence
  chemically synthesized
taataatacatgtaatgcatgg

SEQ ID NO: 1201641 - DNA, 22 bp, Artificial Sequence
  chemically synthesized
cctttaataatacatgtaatgc

SEQ ID NO: 1201642 - DNA, 22 bp, Artificial Sequence
  chemically synthesized
ggtaaacccatgcattacatgt

SEQ ID NO: 1201643 - DNA, 22 bp, Artificial Sequence
  chemically synthesized
ccctttaataatacatgtaatg

SEQ ID NO: 1201644 - DNA, 22 bp, Artificial Sequence
  chemically synthesized
atttccctttaataatacatgt

SEQ ID NO: 1201645 - DNA, 22 bp, Artificial Sequence
  chemically synthesized
aatttccctttaataatacatg

SEQ ID NO: 1201646 - DNA, 22 bp, Artificial Sequence
  chemically synthesized
ttaatttccctttaataataca

SEQ ID NO: 1201647 - DNA, 22 bp, Artificial Sequence
  chemically synthesized
catgtattattaaagggaaatt

SEQ ID NO: 1201648 - DNA, 22 bp, Artificial Sequence
  chemically synthesized
agatatcattcttaatttccct

SEQ ID NO: 1201649 - DNA, 22 bp, Artificial Sequence
  chemically synthesized
gagatatcattcttaatttccc

SEQ ID NO: 1201650 - DNA, 22 bp, Artificial Sequence
  chemically synthesized
tggtttgagatatcattcttaa

SEQ ID NO: 1201651 - DNA, 22 bp, Artificial Sequence
  chemically synthesized
ttaaagggaaattaagaatgat

SEQ ID NO: 1201652 - DNA, 22 bp, Artificial Sequence
  chemically synthesized
atggtttgagatatcattctta

SEQ ID NO: 1201653 - DNA, 22 bp, Artificial Sequence
  chemically synthesized
aagggaaattaagaatgatatc

SEQ ID NO: 1201654 - DNA, 22 bp, Artificial Sequence
  chemically synthesized
ataccatcatttatggtttgag

SEQ ID NO: 1201655 - DNA, 22 bp, Artificial Sequence
  chemically synthesized
agaatgatatctcaaaccataa

SEQ ID NO: 1201656 - DNA, 22 bp, Artificial Sequence
  chemically synthesized
cctaataccatcatttatggtt

SEQ ID NO: 1201657 - DNA, 22 bp, Artificial Sequence
  chemically synthesized
acctaataccatcatttatggt

SEQ ID NO: 1201658 - DNA, 22 bp, Artificial Sequence
  chemically synthesized
acttacctaataccatcattta

SEQ ID NO: 1201659 - DNA, 22 bp, Artificial Sequence
  chemically synthesized
ctgacttacctaataccatcat

SEQ ID NO: 1201660 - DNA, 22 bp, Artificial Sequence
  chemically synthesized
actgacttacctaataccatca

SEQ ID NO: 1201661 - DNA, 22 bp, Artificial Sequence
  chemically synthesized
aaaccataaatgatggtattag

SEQ ID NO: 1201662 - DNA, 22 bp, Artificial Sequence
  chemically synthesized
atatacttactgacttacctaa

SEQ ID NO: 1201663 - DNA, 22 bp, Artificial Sequence
  chemically synthesized
catgttgatatacttactgact

SEQ ID NO: 1201664 - DNA, 22 bp, Artificial Sequence
  chemically synthesized
gcatgttgatatacttactgac

SEQ ID NO: 1201665 - DNA, 22 bp, Artificial Sequence
  chemically synthesized
atttgcatgttgatatacttac

SEQ ID NO: 1201666 - DNA, 22 bp, Artificial Sequence
  chemically synthesized
aatttgcatgttgatatactta

SEQ ID NO: 1201667 - DNA, 22 bp, Artificial Sequence
  chemically synthesized
taatttgcatgttgatatactt

SEQ ID NO: 1201668 - DNA, 22 bp, Artificial Sequence
  chemically synthesized
ggtaagtcagtaagtatatcaa

SEQ ID NO: 1201669 - DNA, 22 bp, Artificial Sequence
  chemically synthesized
ttttaatttgcatgttgatata

SEQ ID NO: 1201670 - DNA, 22 bp, Artificial Sequence
  chemically synthesized
ataatctgttttaatttgcatg

SEQ ID NO: 1201671 - DNA, 22 bp, Artificial Sequence
  chemically synthesized
tgtattgataatctgttttaat

SEQ ID NO: 1201672 - DNA, 22 bp, Artificial Sequence
  chemically synthesized
gtcaatccctatgtattgataa

SEQ ID NO: 1201673 - DNA, 22 bp, Artificial Sequence
  chemically synthesized
agtcaatccctatgtattgata

SEQ ID NO: 1201674 - DNA, 22 bp, Artificial Sequence
  chemically synthesized
aaacagattatcaatacatagg

SEQ ID NO: 1201675 - DNA, 22 bp, Artificial Sequence
  chemically synthesized
tacttagtcaatccctatgtat

SEQ ID NO: 1201676 - DNA, 22 bp, Artificial Sequence
  chemically synthesized
ccatattatacttagtcaatcc

SEQ ID NO: 1201677 - DNA, 22 bp, Artificial Sequence
  chemically synthesized
tcaatacatagggattgactaa

SEQ ID NO: 1201678 - DNA, 22 bp, Artificial Sequence
  chemically synthesized
gttgccatattatacttagtca

SEQ ID NO: 1201679 - DNA, 22 bp, Artificial Sequence
  chemically synthesized
ggttgccatattatacttagtc

SEQ ID NO: 1201680 - DNA, 22 bp, Artificial Sequence
  chemically synthesized
ggataatttggttgccatatta

SEQ ID NO: 1201681 - DNA, 22 bp, Artificial Sequence
  chemically synthesized
tgggataatttggttgccatat

SEQ ID NO: 1201682 - DNA, 22 bp, Artificial Sequence
  chemically synthesized
actaagtataatatggcaacca

SEQ ID NO: 1201683 - DNA, 22 bp, Artificial Sequence
  chemically synthesized
agtataatatggcaaccaaatt

SEQ ID NO: 1201684 - DNA, 22 bp, Artificial Sequence
  chemically synthesized
agagggcaattctgggataatt

SEQ ID NO: 1201685 - DNA, 22 bp, Artificial Sequence
  chemically synthesized
gagagggcaattctgggataat

SEQ ID NO: 1201686 - DNA, 22 bp, Artificial Sequence
  chemically synthesized
tgagagggcaattctgggataa

SEQ ID NO: 1201687 - DNA, 22 bp, Artificial Sequence
  chemically synthesized
ctttgagagggcaattctggga

SEQ ID NO: 1201688 - DNA, 22 bp, Artificial Sequence
  chemically synthesized
ttactttgagagggcaattctg

SEQ ID NO: 1201689 - DNA, 22 bp, Artificial Sequence
  chemically synthesized
gttactttgagagggcaattct

SEQ ID NO: 1201690 - DNA, 22 bp, Artificial Sequence
  chemically synthesized
ttgttactttgagagggcaatt

SEQ ID NO: 1201691 - DNA, 22 bp, Artificial Sequence
  chemically synthesized
tcccagaattgccctctcaaag

SEQ ID NO: 1201692 - DNA, 22 bp, Artificial Sequence
  chemically synthesized
acatgtataagctcttgttact

SEQ ID NO: 1201693 - DNA, 22 bp, Artificial Sequence
  chemically synthesized
ccctctcaaagtaacaagagct

SEQ ID NO: 1201694 - DNA, 22 bp, Artificial Sequence
  chemically synthesized
ttcacatgtataagctcttgtt

SEQ ID NO: 1201695 - DNA, 22 bp, Artificial Sequence
  chemically synthesized
gttcacatgtataagctcttgt

SEQ ID NO: 1201696 - DNA, 22 bp, Artificial Sequence
  chemically synthesized
tcaaagtaacaagagcttatac

SEQ ID NO: 1201697 - DNA, 22 bp, Artificial Sequence
  chemically synthesized
aaagtaacaagagcttatacat

SEQ ID NO: 1201698 - DNA, 22 bp, Artificial Sequence
  chemically synthesized
atacatgtgaacaaattttaca

SEQ ID NO: 1201699 - DNA, 22 bp, Artificial Sequence
  chemically synthesized
catcacagaatgtgtaaaattt

SEQ ID NO: 1201700 - DNA, 22 bp, Artificial Sequence
  chemically synthesized
tacatgtgaacaaattttacac

SEQ ID NO: 1201701 - DNA, 22 bp, Artificial Sequence
  chemically synthesized
acatcacagaatgtgtaaaatt

SEQ ID NO: 1201702 - DNA, 22 bp, Artificial Sequence
  chemically synthesized
tacatcacagaatgtgtaaaat

SEQ ID NO: 1201703 - DNA, 22 bp, Artificial Sequence
  chemically synthesized
ttacatcacagaatgtgtaaaa

SEQ ID NO: 1201704 - DNA, 22 bp, Artificial Sequence
  chemically synthesized
tttacatcacagaatgtgtaaa

SEQ ID NO: 1201705 - DNA, 22 bp, Artificial Sequence
  chemically synthesized
atgacacagtctttttacatca

SEQ ID NO: 1201706 - DNA, 22 bp, Artificial Sequence
  chemically synthesized
tacacattctgtgatgtaaaaa

SEQ ID NO: 1201707 - DNA, 22 bp, Artificial Sequence
  chemically synthesized
acacattctgtgatgtaaaaag

SEQ ID NO: 1201708 - DNA, 22 bp, Artificial Sequence
  chemically synthesized
cacattctgtgatgtaaaaaga

SEQ ID NO: 1201709 - DNA, 22 bp, Artificial Sequence
  chemically synthesized
caatgactgatgacacagtctt

SEQ ID NO: 1201710 - DNA, 22 bp, Artificial Sequence
  chemically synthesized
tgtgatgtaaaaagactgtgtc

SEQ ID NO: 1201711 - DNA, 22 bp, Artificial Sequence
  chemically synthesized
tgcaatgactgatgacacagtc

SEQ ID NO: 1201712 - DNA, 22 bp, Artificial Sequence
  chemically synthesized
tgatgtaaaaagactgtgtcat

SEQ ID NO: 1201713 - DNA, 22 bp, Artificial Sequence
  chemically synthesized
tctgcaatgactgatgacacag

SEQ ID NO: 1201714 - DNA, 22 bp, Artificial Sequence
  chemically synthesized
gttctctgcaatgactgatgac

SEQ ID NO: 1201715 - DNA, 22 bp, Artificial Sequence
  chemically synthesized
cctggttctctgcaatgactga

SEQ ID NO: 1201716 - DNA, 22 bp, Artificial Sequence
  chemically synthesized
ctgcctggttctctgcaatgac

SEQ ID NO: 1201717 - DNA, 22 bp, Artificial Sequence
  chemically synthesized
gctgcctggttctctgcaatga

SEQ ID NO: 1201718 - DNA, 22 bp, Artificial Sequence
  chemically synthesized
tgtcatcagtcattgcagagaa

SEQ ID NO: 1201719 - DNA, 22 bp, Artificial Sequence
  chemically synthesized
taaggaagtgacttgctgcctg

SEQ ID NO: 1201720 - DNA, 22 bp, Artificial Sequence
  chemically synthesized
cagagaaccaggcagcaagtca

SEQ ID NO: 1201721 - DNA, 22 bp, Artificial Sequence
  chemically synthesized
tgaacaattgtaaggaagtgac

SEQ ID NO: 1201722 - DNA, 22 bp, Artificial Sequence
  chemically synthesized
atcagagagctgtgaacaattg

SEQ ID NO: 1201723 - DNA, 22 bp, Artificial Sequence
  chemically synthesized
ccttacaattgttcacagctct

SEQ ID NO: 1201724 - DNA, 22 bp, Artificial Sequence
  chemically synthesized
cttacaattgttcacagctctc

SEQ ID NO: 1201725 - DNA, 22 bp, Artificial Sequence
  chemically synthesized
acaattgttcacagctctctga

SEQ ID NO: 1201726 - DNA, 22 bp, Artificial Sequence
  chemically synthesized
caattgttcacagctctctgat

SEQ ID NO: 1201727 - DNA, 22 bp, Artificial Sequence
  chemically synthesized
aggcaaagtagctaatcagaga

SEQ ID NO: 1201728 - DNA, 22 bp, Artificial Sequence
  chemically synthesized
caggcaaagtagctaatcagag

SEQ ID NO: 1201729 - DNA, 22 bp, Artificial Sequence
  chemically synthesized
ttcacagctctctgattagcta

SEQ ID NO: 1201730 - DNA, 22 bp, Artificial Sequence
  chemically synthesized
tgcttcaggcaaagtagctaat

SEQ ID NO: 1201731 - DNA, 22 bp, Artificial Sequence
  chemically synthesized
acagctctctgattagctactt

SEQ ID NO: 1201732 - DNA, 22 bp, Artificial Sequence
  chemically synthesized
atgcttcaggcaaagtagctaa

SEQ ID NO: 1201733 - DNA, 22 bp, Artificial Sequence
  chemically synthesized
tatgcttcaggcaaagtagcta

SEQ ID NO: 1201734 - DNA, 22 bp, Artificial Sequence
  chemically synthesized
tgttttatgcttcaggcaaagt

SEQ ID NO: 1201735 - DNA, 22 bp, Artificial Sequence
  chemically synthesized
tctgattagctactttgcctga

SEQ ID NO: 1201736 - DNA, 22 bp, Artificial Sequence
  chemically synthesized
atgttttatgcttcaggcaaag

SEQ ID NO: 1201737 - DNA, 22 bp, Artificial Sequence
  chemically synthesized
tgattagctactttgcctgaag

SEQ ID NO: 1201738 - DNA, 22 bp, Artificial Sequence
  chemically synthesized
attagctactttgcctgaagca

SEQ ID NO: 1201739 - DNA, 22 bp, Artificial Sequence
  chemically synthesized
gctactttgcctgaagcataaa

SEQ ID NO: 1201740 - DNA, 22 bp, Artificial Sequence
  chemically synthesized
ctttgcctgaagcataaaacat

SEQ ID NO: 1201741 - DNA, 22 bp, Artificial Sequence
  chemically synthesized
tgcctgaagcataaaacataag

SEQ ID NO: 1201742 - DNA, 22 bp, Artificial Sequence
  chemically synthesized
gcctgaagcataaaacataagc

SEQ ID NO: 1201743 - DNA, 22 bp, Artificial Sequence
  chemically synthesized
cctgaagcataaaacataagca

SEQ ID NO: 1201744 - DNA, 22 bp, Artificial Sequence
  chemically synthesized
aagcataaaacataagcacatt

SEQ ID NO: 1201745 - DNA, 22 bp, Artificial Sequence
  chemically synthesized
gtacccatagaggtgaggaaga

SEQ ID NO: 1201746 - DNA, 22 bp, Artificial Sequence
  chemically synthesized
aacagtccagttagtacccata

SEQ ID NO: 1201747 - DNA, 22 bp, Artificial Sequence
  chemically synthesized
ttcctcacctctatgggtacta

SEQ ID NO: 1201748 - DNA, 22 bp, Artificial Sequence
  chemically synthesized
cctcacctctatgggtactaac

SEQ ID NO: 1201749 - DNA, 22 bp, Artificial Sequence
  chemically synthesized
ctcacctctatgggtactaact

SEQ ID NO: 1201750 - DNA, 22 bp, Artificial Sequence
  chemically synthesized
acctctatgggtactaactgga

SEQ ID NO: 1201751 - DNA, 22 bp, Artificial Sequence
  chemically synthesized
catcacattaaacagtccagtt

SEQ ID NO: 1201752 - DNA, 22 bp, Artificial Sequence
  chemically synthesized
tatgggtactaactggactgtt

SEQ ID NO: 1201753 - DNA, 22 bp, Artificial Sequence
  chemically synthesized
ctccatcacattaaacagtcca

SEQ ID NO: 1201754 - DNA, 22 bp, Artificial Sequence
  chemically synthesized
tgggtactaactggactgttta

SEQ ID NO: 1201755 - DNA, 22 bp, Artificial Sequence
  chemically synthesized
attactccatcacattaaacag

SEQ ID NO: 1201756 - DNA, 22 bp, Artificial Sequence
  chemically synthesized
ttaattactccatcacattaaa

SEQ ID NO: 1201757 - DNA, 22 bp, Artificial Sequence
  chemically synthesized
tgttaattactccatcacatta

SEQ ID NO: 1201758 - DNA, 22 bp, Artificial Sequence
  chemically synthesized
actggactgtttaatgtgatgg

SEQ ID NO: 1201759 - DNA, 22 bp, Artificial Sequence
  chemically synthesized
gactgtttaatgtgatggagta

SEQ ID NO: 1201760 - DNA, 22 bp, Artificial Sequence
  chemically synthesized
tttaatgtgatggagtaattaa

SEQ ID NO: 1201761 - DNA, 22 bp, Artificial Sequence
  chemically synthesized
aatgtgatggagtaattaacag

SEQ ID NO: 1201762 - DNA, 22 bp, Artificial Sequence
  chemically synthesized
atgtgatggagtaattaacaga

SEQ ID NO: 1201763 - DNA, 22 bp, Artificial Sequence
  chemically synthesized
acagaaccttttctcccattgg

SEQ ID NO: 1201764 - DNA, 22 bp, Artificial Sequence
  chemically synthesized
ccacgtaggtccccaatgggag

SEQ ID NO: 1201765 - DNA, 22 bp, Artificial Sequence
  chemically synthesized
gccacgtaggtccccaatggga

SEQ ID NO: 1201766 - DNA, 22 bp, Artificial Sequence
  chemically synthesized
ttctcccattggggacctacgt

SEQ ID NO: 1201767 - DNA, 22 bp, Artificial Sequence
  chemically synthesized
tctcccattggggacctacgtg

SEQ ID NO: 1201768 - DNA, 22 bp, Artificial Sequence
  chemically synthesized
ctcccattggggacctacgtgg

SEQ ID NO: 1201769 - DNA, 22 bp, Artificial Sequence
  chemically synthesized
atggggcacttgccacgtaggt

SEQ ID NO: 1201770 - DNA, 22 bp, Artificial Sequence
  chemically synthesized
tcccattggggacctacgtggc

SEQ ID NO: 1201771 - DNA, 22 bp, Artificial Sequence
  chemically synthesized
ccattggggacctacgtggcaa

SEQ ID NO: 1201772 - DNA, 22 bp, Artificial Sequence
  chemically synthesized
ggacctaatggggcacttgcca

SEQ ID NO: 1201773 - DNA, 22 bp, Artificial Sequence
  chemically synthesized
gggacctacgtggcaagtgccc

SEQ ID NO: 1201774 - DNA, 22 bp, Artificial Sequence
  chemically synthesized
cgtggcaagtgccccattaggt

SEQ ID NO: 1201775 - DNA, 22 bp, Artificial Sequence
  chemically synthesized
tatgtacctaggacctaatggg

SEQ ID NO: 1201776 - DNA, 22 bp, Artificial Sequence
  chemically synthesized
tgtatgtacctaggacctaatg

SEQ ID NO: 1201777 - DNA, 22 bp, Artificial Sequence
  chemically synthesized
ggttctgtatgtacctaggacc

SEQ ID NO: 1201778 - DNA, 22 bp, Artificial Sequence
  chemically synthesized
gggttctgtatgtacctaggac

SEQ ID NO: 1201779 - DNA, 22 bp, Artificial Sequence
  chemically synthesized
tgggttctgtatgtacctagga

SEQ ID NO: 1201780 - DNA, 22 bp, Artificial Sequence
  chemically synthesized
ttgggttctgtatgtacctagg

SEQ ID NO: 1201781 - DNA, 22 bp, Artificial Sequence
  chemically synthesized
tttgggttctgtatgtacctag

SEQ ID NO: 1201782 - DNA, 22 bp, Artificial Sequence
  chemically synthesized
ttttttgggttctgtatgtacc

SEQ ID NO: 1201783 - DNA, 22 bp, Artificial Sequence
  chemically synthesized
tattttttgggttctgtatgta

SEQ ID NO: 1201784 - DNA, 22 bp, Artificial Sequence
  chemically synthesized
ctattttttgggttctgtatgt

SEQ ID NO: 1201785 - DNA, 22 bp, Artificial Sequence
  chemically synthesized
ggtcctaggtacatacagaacc

SEQ ID NO: 1201786 - DNA, 22 bp, Artificial Sequence
  chemically synthesized
gcttctattttttgggttctgt

SEQ ID NO: 1201787 - DNA, 22 bp, Artificial Sequence
  chemically synthesized
ggtacatacagaacccaaaaaa

SEQ ID NO: 1201788 - DNA, 22 bp, Artificial Sequence
  chemically synthesized
cccacattggcttctatttttt

SEQ ID NO: 1201789 - DNA, 22 bp, Artificial Sequence
  chemically synthesized
ctccccacattggcttctattt

SEQ ID NO: 1201790 - DNA, 22 bp, Artificial Sequence
  chemically synthesized
cctccccacattggcttctatt

SEQ ID NO: 1201791 - DNA, 22 bp, Artificial Sequence
  chemically synthesized
catttcctccccacattggctt

SEQ ID NO: 1201792 - DNA, 22 bp, Artificial Sequence
  chemically synthesized
attattttatatgctatggcac

SEQ ID NO: 1201793 - DNA, 22 bp, Artificial Sequence
  chemically synthesized
gtaggggggaaatcgtgccata

SEQ ID NO: 1201794 - DNA, 22 bp, Artificial Sequence
  chemically synthesized
ggtaggggggaaatcgtgccat

SEQ ID NO: 1201795 - DNA, 22 bp, Artificial Sequence
  chemically synthesized
ttttatatgctatggcacgatt

SEQ ID NO: 1201796 - DNA, 22 bp, Artificial Sequence
  chemically synthesized
tatatgctatggcacgatttcc

SEQ ID NO: 1201797 - DNA, 22 bp, Artificial Sequence
  chemically synthesized
atatgctatggcacgatttccc

SEQ ID NO: 1201798 - DNA, 22 bp, Artificial Sequence
  chemically synthesized
tatgctatggcacgatttcccc

SEQ ID NO: 1201799 - DNA, 22 bp, Artificial Sequence
  chemically synthesized
gtaaatttggtaggggggaaat

SEQ ID NO: 1201800 - DNA, 22 bp, Artificial Sequence
  chemically synthesized
tggcacgatttcccccctacca

SEQ ID NO: 1201801 - DNA, 22 bp, Artificial Sequence
  chemically synthesized
atcagtctagtaaatttggtag

SEQ ID NO: 1201802 - DNA, 22 bp, Artificial Sequence
  chemically synthesized
ctaatcagtctagtaaatttgg

SEQ ID NO: 1201803 - DNA, 22 bp, Artificial Sequence
  chemically synthesized
actaatcagtctagtaaatttg

SEQ ID NO: 1201804 - DNA, 22 bp, Artificial Sequence
  chemically synthesized
cccccctaccaaatttactaga

SEQ ID NO: 1201805 - DNA, 22 bp, Artificial Sequence
  chemically synthesized
ccccctaccaaatttactagac

SEQ ID NO: 1201806 - DNA, 22 bp, Artificial Sequence
  chemically synthesized
catttactaatcagtctagtaa

SEQ ID NO: 1201807 - DNA, 22 bp, Artificial Sequence
  chemically synthesized
acatttactaatcagtctagta

SEQ ID NO: 1201808 - DNA, 22 bp, Artificial Sequence
  chemically synthesized
gcttacatttactaatcagtct

SEQ ID NO: 1201809 - DNA, 22 bp, Artificial Sequence
  chemically synthesized
ccaaatttactagactgattag

SEQ ID NO: 1201810 - DNA, 22 bp, Artificial Sequence
  chemically synthesized
ggcttacatttactaatcagtc

SEQ ID NO: 1201811 - DNA, 22 bp, Artificial Sequence
  chemically synthesized
tggcttacatttactaatcagt

SEQ ID NO: 1201812 - DNA, 22 bp, Artificial Sequence
  chemically synthesized
gattttggcttacatttactaa

SEQ ID NO: 1201813 - DNA, 22 bp, Artificial Sequence
  chemically synthesized
agattttggcttacatttacta

SEQ ID NO: 1201814 - DNA, 22 bp, Artificial Sequence
  chemically synthesized
actagactgattagtaaatgta

SEQ ID NO: 1201815 - DNA, 22 bp, Artificial Sequence
  chemically synthesized
ctagactgattagtaaatgtaa

SEQ ID NO: 1201816 - DNA, 22 bp, Artificial Sequence
  chemically synthesized
gactgattagtaaatgtaagcc

SEQ ID NO: 1201817 - DNA, 22 bp, Artificial Sequence
  chemically synthesized
attagtaaatgtaagccaaaat

SEQ ID NO: 1201818 - DNA, 22 bp, Artificial Sequence
  chemically synthesized
aatcacaccttagattttggct

SEQ ID NO: 1201819 - DNA, 22 bp, Artificial Sequence
  chemically synthesized
gtaaatgtaagccaaaatctaa

SEQ ID NO: 1201820 - DNA, 22 bp, Artificial Sequence
  chemically synthesized
tagtgattcaatcacaccttag

SEQ ID NO: 1201821 - DNA, 22 bp, Artificial Sequence
  chemically synthesized
aggtgtgattgaatcactataa

SEQ ID NO: 1201822 - DNA, 22 bp, Artificial Sequence
  chemically synthesized
aagggatggatattatagtgat

SEQ ID NO: 1201823 - DNA, 22 bp, Artificial Sequence
  chemically synthesized
tcaagggatggatattatagtg

SEQ ID NO: 1201824 - DNA, 22 bp, Artificial Sequence
  chemically synthesized
aatcactataatatccatccct

SEQ ID NO: 1201825 - DNA, 22 bp, Artificial Sequence
  chemically synthesized
agtcacagttctcaagggatgg

SEQ ID NO: 1201826 - DNA, 22 bp, Artificial Sequence
  chemically synthesized
ctgagtcacagttctcaaggga

SEQ ID NO: 1201827 - DNA, 22 bp, Artificial Sequence
  chemically synthesized
taatatccatcccttgagaact

SEQ ID NO: 1201828 - DNA, 22 bp, Artificial Sequence
  chemically synthesized
tctgctgagtcacagttctcaa

SEQ ID NO: 1201829 - DNA, 22 bp, Artificial Sequence
  chemically synthesized
ctatctgctgagtcacagttct

SEQ ID NO: 1201830 - DNA, 22 bp, Artificial Sequence
  chemically synthesized
cctatctgctgagtcacagttc

SEQ ID NO: 1201831 - DNA, 22 bp, Artificial Sequence
  chemically synthesized
tcctatctgctgagtcacagtt

SEQ ID NO: 1201832 - DNA, 22 bp, Artificial Sequence
  chemically synthesized
ttcctatctgctgagtcacagt

SEQ ID NO: 1201833 - DNA, 22 bp, Artificial Sequence
  chemically synthesized
ttttcctatctgctgagtcaca

SEQ ID NO: 1201834 - DNA, 22 bp, Artificial Sequence
  chemically synthesized
tcttttcctatctgctgagtca

SEQ ID NO: 1201835 - DNA, 22 bp, Artificial Sequence
  chemically synthesized
ctcttttcctatctgctgagtc

SEQ ID NO: 1201836 - DNA, 22 bp, Artificial Sequence
  chemically synthesized
tctcttttcctatctgctgagt

SEQ ID NO: 1201837 - DNA, 22 bp, Artificial Sequence
  chemically synthesized
gagaactgtgactcagcagata

SEQ ID NO: 1201838 - DNA, 22 bp, Artificial Sequence
  chemically synthesized
agaactgtgactcagcagatag

SEQ ID NO: 1201839 - DNA, 22 bp, Artificial Sequence
  chemically synthesized
gttttctcttttcctatctgct

SEQ ID NO: 1201840 - DNA, 22 bp, Artificial Sequence
  chemically synthesized
tgactcagcagataggaaaaga

SEQ ID NO: 1201841 - DNA, 22 bp, Artificial Sequence
  chemically synthesized
gacattagttttctcttttcct

SEQ ID NO: 1201842 - DNA, 22 bp, Artificial Sequence
  chemically synthesized
agcagataggaaaagagaaaac

SEQ ID NO: 1201843 - DNA, 22 bp, Artificial Sequence
  chemically synthesized
acaagtgtcagtgacaagatgt

SEQ ID NO: 1201844 - DNA, 22 bp, Artificial Sequence
  chemically synthesized
cacaagtgtcagtgacaagatg

SEQ ID NO: 1201845 - DNA, 22 bp, Artificial Sequence
  chemically synthesized
atgtccaacatcttgtcactga

SEQ ID NO: 1201846 - DNA, 22 bp, Artificial Sequence
  chemically synthesized
tcaaatgataatttcacaagtg

SEQ ID NO: 1201847 - DNA, 22 bp, Artificial Sequence
  chemically synthesized
gtcaaatgataatttcacaagt

SEQ ID NO: 1201848 - DNA, 22 bp, Artificial Sequence
  chemically synthesized
gtcactgacacttgtgaaatta

SEQ ID NO: 1201849 - DNA, 22 bp, Artificial Sequence
  chemically synthesized
tcactgacacttgtgaaattat

SEQ ID NO: 1201850 - DNA, 22 bp, Artificial Sequence
  chemically synthesized
atggtttgtcaaatgataattt

SEQ ID NO: 1201851 - DNA, 22 bp, Artificial Sequence
  chemically synthesized
catggtttgtcaaatgataatt

SEQ ID NO: 1201852 - DNA, 22 bp, Artificial Sequence
  chemically synthesized
acacttgtgaaattatcatttg

SEQ ID NO: 1201853 - DNA, 22 bp, Artificial Sequence
  chemically synthesized
tttcatggtttgtcaaatgata

SEQ ID NO: 1201854 - DNA, 22 bp, Artificial Sequence
  chemically synthesized
gtgaaattatcatttgacaaac

SEQ ID NO: 1201855 - DNA, 22 bp, Artificial Sequence
  chemically synthesized
tgaaattatcatttgacaaacc

SEQ ID NO: 1201856 - DNA, 22 bp, Artificial Sequence
  chemically synthesized
ccaaattatttcatggtttgtc

SEQ ID NO: 1201857 - DNA, 22 bp, Artificial Sequence
  chemically synthesized
ctgccaaattatttcatggttt

SEQ ID NO: 1201858 - DNA, 22 bp, Artificial Sequence
  chemically synthesized
tcatttgacaaaccatgaaata

SEQ ID NO: 1201859 - DNA, 22 bp, Artificial Sequence
  chemically synthesized
gattcctgccaaattatttcat

SEQ ID NO: 1201860 - DNA, 22 bp, Artificial Sequence
  chemically synthesized
gacaaaccatgaaataatttgg

SEQ ID NO: 1201861 - DNA, 22 bp, Artificial Sequence
  chemically synthesized
acaaaccatgaaataatttggc

SEQ ID NO: 1201862 - DNA, 22 bp, Artificial Sequence
  chemically synthesized
tattggattcctgccaaattat

SEQ ID NO: 1201863 - DNA, 22 bp, Artificial Sequence
  chemically synthesized
ttgtattggattcctgccaaat

SEQ ID NO: 1201864 - DNA, 22 bp, Artificial Sequence
  chemically synthesized
gttgtattggattcctgccaaa

SEQ ID NO: 1201865 - DNA, 22 bp, Artificial Sequence
  chemically synthesized
atttgttgtattggattcctgc

SEQ ID NO: 1201866 - DNA, 22 bp, Artificial Sequence
  chemically synthesized
ggcaggaatccaatacaacaaa

SEQ ID NO: 1201867 - DNA, 22 bp, Artificial Sequence
  chemically synthesized
gcaggaatccaatacaacaaat

SEQ ID NO: 1201868 - DNA, 22 bp, Artificial Sequence
  chemically synthesized
atgaaatgactcatttgttgta

SEQ ID NO: 1201869 - DNA, 22 bp, Artificial Sequence
  chemically synthesized
aatgaaatgactcatttgttgt

SEQ ID NO: 1201870 - DNA, 22 bp, Artificial Sequence
  chemically synthesized
tatttaatgaaatgactcattt

SEQ ID NO: 1201871 - DNA, 22 bp, Artificial Sequence
  chemically synthesized
gggagacagaattgtatttaat

SEQ ID NO: 1201872 - DNA, 22 bp, Artificial Sequence
  chemically synthesized
gctggggagacagaattgtatt

SEQ ID NO: 1201873 - DNA, 22 bp, Artificial Sequence
  chemically synthesized
agctggggagacagaattgtat

SEQ ID NO: 1201874 - DNA, 22 bp, Artificial Sequence
  chemically synthesized
cattaaatacaattctgtctcc

SEQ ID NO: 1201875 - DNA, 22 bp, Artificial Sequence
  chemically synthesized
attaaatacaattctgtctccc

SEQ ID NO: 1201876 - DNA, 22 bp, Artificial Sequence
  chemically synthesized
cataccatttagctggggagac

SEQ ID NO: 1201877 - DNA, 22 bp, Artificial Sequence
  chemically synthesized
aatacaattctgtctccccagc

SEQ ID NO: 1201878 - DNA, 22 bp, Artificial Sequence
  chemically synthesized
tcattgcataccatttagctgg

SEQ ID NO: 1201879 - DNA, 22 bp, Artificial Sequence
  chemically synthesized
atcattgcataccatttagctg

SEQ ID NO: 1201880 - DNA, 22 bp, Artificial Sequence
  chemically synthesized
tgtctccccagctaaatggtat

SEQ ID NO: 1201881 - DNA, 22 bp, Artificial Sequence
  chemically synthesized
tctccccagctaaatggtatgc

SEQ ID NO: 1201882 - DNA, 22 bp, Artificial Sequence
  chemically synthesized
cccagctaaatggtatgcaatg

SEQ ID NO: 1201883 - DNA, 22 bp, Artificial Sequence
  chemically synthesized
aaatggtgatcttatcattgca

SEQ ID NO: 1201884 - DNA, 22 bp, Artificial Sequence
  chemically synthesized
ttaaaatggtgatcttatcatt

SEQ ID NO: 1201885 - DNA, 22 bp, Artificial Sequence
  chemically synthesized
aatggtatgcaatgataagatc

SEQ ID NO: 1201886 - DNA, 22 bp, Artificial Sequence
  chemically synthesized
gataactattaaaatggtgatc

SEQ ID NO: 1201887 - DNA, 22 bp, Artificial Sequence
  chemically synthesized
tagataactattaaaatggtga

SEQ ID NO: 1201888 - DNA, 22 bp, Artificial Sequence
  chemically synthesized
ctagataactattaaaatggtg

SEQ ID NO: 1201889 - DNA, 22 bp, Artificial Sequence
  chemically synthesized
tttctagataactattaaaatg

SEQ ID NO: 1201890 - DNA, 22 bp, Artificial Sequence
  chemically synthesized
ggcatctatttctagataacta

SEQ ID NO: 1201891 - DNA, 22 bp, Artificial Sequence
  chemically synthesized
aggcatctatttctagataact

SEQ ID NO: 1201892 - DNA, 22 bp, Artificial Sequence
  chemically synthesized
taggcatctatttctagataac

SEQ ID NO: 1201893 - DNA, 22 bp, Artificial Sequence
  chemically synthesized
taatagttatctagaaatagat

SEQ ID NO: 1201894 - DNA, 22 bp, Artificial Sequence
  chemically synthesized
aatagttatctagaaatagatg

SEQ ID NO: 1201895 - DNA, 22 bp, Artificial Sequence
  chemically synthesized
atagttatctagaaatagatgc

SEQ ID NO: 1201896 - DNA, 22 bp, Artificial Sequence
  chemically synthesized
tctagaaatagatgcctaaaat

SEQ ID NO: 1201897 - DNA, 22 bp, Artificial Sequence
  chemically synthesized
gaaatagatgcctaaaattctt

SEQ ID NO: 1201898 - DNA, 22 bp, Artificial Sequence
  chemically synthesized
aaaagtcataaaggaaagaatt

SEQ ID NO: 1201899 - DNA, 22 bp, Artificial Sequence
  chemically synthesized
ttaaaaagtcataaaggaaaga

SEQ ID NO: 1201900 - DNA, 22 bp, Artificial Sequence
  chemically synthesized
gctgttaaaaagtcataaagga

SEQ ID NO: 1201901 - DNA, 22 bp, Artificial Sequence
  chemically synthesized
aaattctttcctttatgacttt

SEQ ID NO: 1201902 - DNA, 22 bp, Artificial Sequence
  chemically synthesized
aggttggctgttaaaaagtcat

SEQ ID NO: 1201903 - DNA, 22 bp, Artificial Sequence
  chemically synthesized
tttcctttatgactttttaaca

SEQ ID NO: 1201904 - DNA, 22 bp, Artificial Sequence
  chemically synthesized
tactcaggttggctgttaaaaa

SEQ ID NO: 1201905 - DNA, 22 bp, Artificial Sequence
  chemically synthesized
tcctttatgactttttaacagc

SEQ ID NO: 1201906 - DNA, 22 bp, Artificial Sequence
  chemically synthesized
cctttatgactttttaacagcc

SEQ ID NO: 1201907 - DNA, 22 bp, Artificial Sequence
  chemically synthesized
ctttatgactttttaacagcca

SEQ ID NO: 1201908 - DNA, 22 bp, Artificial Sequence
  chemically synthesized
ttgtactcaggttggctgttaa

SEQ ID NO: 1201909 - DNA, 22 bp, Artificial Sequence
  chemically synthesized
tatgactttttaacagccaacc

SEQ ID NO: 1201910 - DNA, 22 bp, Artificial Sequence
  chemically synthesized
atgactttttaacagccaacct

SEQ ID NO: 1201911 - DNA, 22 bp, Artificial Sequence
  chemically synthesized
tgactttttaacagccaacctg

SEQ ID NO: 1201912 - DNA, 22 bp, Artificial Sequence
  chemically synthesized
tttaacagccaacctgagtaca

SEQ ID NO: 1201913 - DNA, 22 bp, Artificial Sequence
  chemically synthesized
ttaacagccaacctgagtacaa

SEQ ID NO: 1201914 - DNA, 22 bp, Artificial Sequence
  chemically synthesized
taacagccaacctgagtacaat

SEQ ID NO: 1201915 - DNA, 22 bp, Artificial Sequence
  chemically synthesized
gataatatcattattgtactca

SEQ ID NO: 1201916 - DNA, 22 bp, Artificial Sequence
  chemically synthesized
aacagccaacctgagtacaata

SEQ ID NO: 1201917 - DNA, 22 bp, Artificial Sequence
  chemically synthesized
acagccaacctgagtacaataa

SEQ ID NO: 1201918 - DNA, 22 bp, Artificial Sequence
  chemically synthesized
tggataatatcattattgtact

SEQ ID NO: 1201919 - DNA, 22 bp, Artificial Sequence
  chemically synthesized
agtacaataatgatattatcca

SEQ ID NO: 1201920 - DNA, 22 bp, Artificial Sequence
  chemically synthesized
accatataaattctggataata

SEQ ID NO: 1201921 - DNA, 22 bp, Artificial Sequence
  chemically synthesized
aatgttgaccatataaattctg

SEQ ID NO: 1201922 - DNA, 22 bp, Artificial Sequence
  chemically synthesized
tccagaatttatatggtcaaca

SEQ ID NO: 1201923 - DNA, 22 bp, Artificial Sequence
  chemically synthesized
tgagcaattgaatgttgaccat

SEQ ID NO: 1201924 - DNA, 22 bp, Artificial Sequence
  chemically synthesized
gtgagcaattgaatgttgacca

SEQ ID NO: 1201925 - DNA, 22 bp, Artificial Sequence
  chemically synthesized
ataaccttgtgagcaattgaat

SEQ ID NO: 1201926 - DNA, 22 bp, Artificial Sequence
  chemically synthesized
atatggtcaacattcaattgct

SEQ ID NO: 1201927 - DNA, 22 bp, Artificial Sequence
  chemically synthesized
aataaccttgtgagcaattgaa

SEQ ID NO: 1201928 - DNA, 22 bp, Artificial Sequence
  chemically synthesized
tatggtcaacattcaattgctc

SEQ ID NO: 1201929 - DNA, 22 bp, Artificial Sequence
  chemically synthesized
tttaataaccttgtgagcaatt

SEQ ID NO: 1201930 - DNA, 22 bp, Artificial Sequence
  chemically synthesized
taaactgtttaataaccttgtg

SEQ ID NO: 1201931 - DNA, 22 bp, Artificial Sequence
  chemically synthesized
ataaactgtttaataaccttgt

SEQ ID NO: 1201932 - DNA, 22 bp, Artificial Sequence
  chemically synthesized
aattgctcacaaggttattaaa

SEQ ID NO: 1201933 - DNA, 22 bp, Artificial Sequence
  chemically synthesized
ctcacaaggttattaaacagtt

SEQ ID NO: 1201934 - DNA, 22 bp, Artificial Sequence
  chemically synthesized
acaaggttattaaacagtttat

SEQ ID NO: 1201935 - DNA, 22 bp, Artificial Sequence
  chemically synthesized
ttaaacagtttataaattatcc

SEQ ID NO: 1201936 - DNA, 22 bp, Artificial Sequence
  chemically synthesized
aacagtttataaattatcctgt

SEQ ID NO: 1201937 - DNA, 22 bp, Artificial Sequence
  chemically synthesized
ataaattatcctgttttcttcc

SEQ ID NO: 1201938 - DNA, 22 bp, Artificial Sequence
  chemically synthesized
taaattatcctgttttcttccc

SEQ ID NO: 1201939 - DNA, 22 bp, Artificial Sequence
  chemically synthesized
ggagcagagagcaggggaagaa

SEQ ID NO: 1201940 - DNA, 22 bp, Artificial Sequence
  chemically synthesized
aggagcagagagcaggggaaga

SEQ ID NO: 1201941 - DNA, 22 bp, Artificial Sequence
  chemically synthesized
ttaggagcagagagcaggggaa

SEQ ID NO: 1201942 - DNA, 22 bp, Artificial Sequence
  chemically synthesized
tcctgttttcttcccctgctct

SEQ ID NO: 1201943 - DNA, 22 bp, Artificial Sequence
  chemically synthesized
ttttcttcccctgctctctgct

SEQ ID NO: 1201944 - DNA, 22 bp, Artificial Sequence
  chemically synthesized
tcttcccctgctctctgctcct

SEQ ID NO: 1201945 - DNA, 22 bp, Artificial Sequence
  chemically synthesized
cttcccctgctctctgctccta

SEQ ID NO: 1201946 - DNA, 22 bp, Artificial Sequence
  chemically synthesized
ttcccctgctctctgctcctaa

SEQ ID NO: 1201947 - DNA, 22 bp, Artificial Sequence
  chemically synthesized
cccctgctctctgctcctaaga

SEQ ID NO: 1201948 - DNA, 22 bp, Artificial Sequence
  chemically synthesized
ccctgctctctgctcctaagaa

SEQ ID NO: 1201949 - DNA, 22 bp, Artificial Sequence
  chemically synthesized
ataagaaatgtaattcttagga

SEQ ID NO: 1201950 - DNA, 22 bp, Artificial Sequence
  chemically synthesized
taataagaaatgtaattcttag

SEQ ID NO: 1201951 - DNA, 22 bp, Artificial Sequence
  chemically synthesized
ctctctgctcctaagaattaca

SEQ ID NO: 1201952 - DNA, 22 bp, Artificial Sequence
  chemically synthesized
tctgctcctaagaattacattt

SEQ ID NO: 1201953 - DNA, 22 bp, Artificial Sequence
  chemically synthesized
tgctcctaagaattacatttct

SEQ ID NO: 1201954 - DNA, 22 bp, Artificial Sequence
  chemically synthesized
ctcctaagaattacatttctta

SEQ ID NO: 1201955 - DNA, 22 bp, Artificial Sequence
  chemically synthesized
ggaaaattctaataagaaatgt

SEQ ID NO: 1201956 - DNA, 22 bp, Artificial Sequence
  chemically synthesized
aggaaaattctaataagaaatg

SEQ ID NO: 1201957 - DNA, 22 bp, Artificial Sequence
  chemically synthesized
ctaagaattacatttcttatta

SEQ ID NO: 1201958 - DNA, 22 bp, Artificial Sequence
  chemically synthesized
cttaggaaaattctaataagaa

SEQ ID NO: 1201959 - DNA, 22 bp, Artificial Sequence
  chemically synthesized
ccttaggaaaattctaataaga

SEQ ID NO: 1201960 - DNA, 22 bp, Artificial Sequence
  chemically synthesized
agaattacatttcttattagaa

SEQ ID NO: 1201961 - DNA, 22 bp, Artificial Sequence
  chemically synthesized
catttccttaggaaaattctaa

SEQ ID NO: 1201962 - DNA, 22 bp, Artificial Sequence
  chemically synthesized
ccatttccttaggaaaattcta

SEQ ID NO: 1201963 - DNA, 22 bp, Artificial Sequence
  chemically synthesized
tccatttccttaggaaaattct

SEQ ID NO: 1201964 - DNA, 22 bp, Artificial Sequence
  chemically synthesized
catttcttattagaattttcct

SEQ ID NO: 1201965 - DNA, 22 bp, Artificial Sequence
  chemically synthesized
tttccatttccttaggaaaatt

SEQ ID NO: 1201966 - DNA, 22 bp, Artificial Sequence
  chemically synthesized
cttattagaattttcctaagga

SEQ ID NO: 1201967 - DNA, 22 bp, Artificial Sequence
  chemically synthesized
attctttccatttccttaggaa

SEQ ID NO: 1201968 - DNA, 22 bp, Artificial Sequence
  chemically synthesized
ttattagaattttcctaaggaa

SEQ ID NO: 1201969 - DNA, 22 bp, Artificial Sequence
  chemically synthesized
attagaattttcctaaggaaat

SEQ ID NO: 1201970 - DNA, 22 bp, Artificial Sequence
  chemically synthesized
ttagaattttcctaaggaaatg

SEQ ID NO: 1201971 - DNA, 22 bp, Artificial Sequence
  chemically synthesized
cattcattctttccatttcctt

SEQ ID NO: 1201972 - DNA, 22 bp, Artificial Sequence
  chemically synthesized
ccattcattctttccatttcct

SEQ ID NO: 1201973 - DNA, 22 bp, Artificial Sequence
  chemically synthesized
gaattttcctaaggaaatggaa

SEQ ID NO: 1201974 - DNA, 22 bp, Artificial Sequence
  chemically synthesized
atttccattcattctttccatt

SEQ ID NO: 1201975 - DNA, 22 bp, Artificial Sequence
  chemically synthesized
catttccattcattctttccat

SEQ ID NO: 1201976 - DNA, 22 bp, Artificial Sequence
  chemically synthesized
tcctaaggaaatggaaagaatg

SEQ ID NO: 1201977 - DNA, 22 bp, Artificial Sequence
  chemically synthesized
cctaaggaaatggaaagaatga

SEQ ID NO: 1201978 - DNA, 22 bp, Artificial Sequence
  chemically synthesized
ctaaggaaatggaaagaatgaa

SEQ ID NO: 1201979 - DNA, 22 bp, Artificial Sequence
  chemically synthesized
cacttcatttccattcattctt

SEQ ID NO: 1201980 - DNA, 22 bp, Artificial Sequence
  chemically synthesized
ccacttcatttccattcattct

SEQ ID NO: 1201981 - DNA, 22 bp, Artificial Sequence
  chemically synthesized
aggaaatggaaagaatgaatgg

SEQ ID NO: 1201982 - DNA, 22 bp, Artificial Sequence
  chemically synthesized
aacatttccacttcatttccat

SEQ ID NO: 1201983 - DNA, 22 bp, Artificial Sequence
  chemically synthesized
aaatattgaacatttccacttc

SEQ ID NO: 1201984 - DNA, 22 bp, Artificial Sequence
  chemically synthesized
gaaatattgaacatttccactt

SEQ ID NO: 1201985 - DNA, 22 bp, Artificial Sequence
  chemically synthesized
agaacttgaaatattgaacatt

SEQ ID NO: 1201986 - DNA, 22 bp, Artificial Sequence
  chemically synthesized
aatatttcaagttcttaacacg

SEQ ID NO: 1201987 - DNA, 22 bp, Artificial Sequence
  chemically synthesized
aaataatgtccaaacgtgttaa

SEQ ID NO: 1201988 - DNA, 22 bp, Artificial Sequence
  chemically synthesized
caagttcttaacacgtttggac

SEQ ID NO: 1201989 - DNA, 22 bp, Artificial Sequence
  chemically synthesized
aagttcttaacacgtttggaca

SEQ ID NO: 1201990 - DNA, 22 bp, Artificial Sequence
  chemically synthesized
ttaacacgtttggacattattt

SEQ ID NO: 1201991 - DNA, 22 bp, Artificial Sequence
  chemically synthesized
gccaggatcctcaaataatgtc

SEQ ID NO: 1201992 - DNA, 22 bp, Artificial Sequence
  chemically synthesized
agccaggatcctcaaataatgt

SEQ ID NO: 1201993 - DNA, 22 bp, Artificial Sequence
  chemically synthesized
aacacgtttggacattatttga

SEQ ID NO: 1201994 - DNA, 22 bp, Artificial Sequence
  chemically synthesized
tagccaggatcctcaaataatg

SEQ ID NO: 1201995 - DNA, 22 bp, Artificial Sequence
  chemically synthesized
acacgtttggacattatttgag

SEQ ID NO: 1201996 - DNA, 22 bp, Artificial Sequence
  chemically synthesized
gctttagccaggatcctcaaat

SEQ ID NO: 1201997 - DNA, 22 bp, Artificial Sequence
  chemically synthesized
ggctttagccaggatcctcaaa

SEQ ID NO: 1201998 - DNA, 22 bp, Artificial Sequence
  chemically synthesized
ggacattatttgaggatcctgg

SEQ ID NO: 1201999 - DNA, 22 bp, Artificial Sequence
  chemically synthesized
gacattatttgaggatcctggc

SEQ ID NO: 1202000 - DNA, 22 bp, Artificial Sequence
  chemically synthesized
agcaaatcttggctttagccag

SEQ ID NO: 1202001 - DNA, 22 bp, Artificial Sequence
  chemically synthesized
cagcaaatcttggctttagcca

SEQ ID NO: 1202002 - DNA, 22 bp, Artificial Sequence
  chemically synthesized
tttgaggatcctggctaaagcc

SEQ ID NO: 1202003 - DNA, 22 bp, Artificial Sequence
  chemically synthesized
gaggatcctggctaaagccaag

SEQ ID NO: 1202004 - DNA, 22 bp, Artificial Sequence
  chemically synthesized
aggatcctggctaaagccaaga

SEQ ID NO: 1202005 - DNA, 22 bp, Artificial Sequence
  chemically synthesized
aaagccttcagcaaatcttggc

SEQ ID NO: 1202006 - DNA, 22 bp, Artificial Sequence
  chemically synthesized
gctaaagccaagatttgctgaa

SEQ ID NO: 1202007 - DNA, 22 bp, Artificial Sequence
  chemically synthesized
ggaaccctaaaagccttcagca

SEQ ID NO: 1202008 - DNA, 22 bp, Artificial Sequence
  chemically synthesized
aagccaagatttgctgaaggct

SEQ ID NO: 1202009 - DNA, 22 bp, Artificial Sequence
  chemically synthesized
tagcaactgggaaccctaaaag

SEQ ID NO: 1202010 - DNA, 22 bp, Artificial Sequence
  chemically synthesized
gctgaaggcttttagggttccc

SEQ ID NO: 1202011 - DNA, 22 bp, Artificial Sequence
  chemically synthesized
ctgaaggcttttagggttccca

SEQ ID NO: 1202012 - DNA, 22 bp, Artificial Sequence
  chemically synthesized
aaggcttttagggttcccagtt

SEQ ID NO: 1202013 - DNA, 22 bp, Artificial Sequence
  chemically synthesized
aagagattatagcaactgggaa

SEQ ID NO: 1202014 - DNA, 22 bp, Artificial Sequence
  chemically synthesized
aaagagattatagcaactggga

SEQ ID NO: 1202015 - DNA, 22 bp, Artificial Sequence
  chemically synthesized
ttagggttcccagttgctataa

SEQ ID NO: 1202016 - DNA, 22 bp, Artificial Sequence
  chemically synthesized
tagggttcccagttgctataat

SEQ ID NO: 1202017 - DNA, 22 bp, Artificial Sequence
  chemically synthesized
agggttcccagttgctataatc

SEQ ID NO: 1202018 - DNA, 22 bp, Artificial Sequence
  chemically synthesized
gggttcccagttgctataatct

SEQ ID NO: 1202019 - DNA, 22 bp, Artificial Sequence
  chemically synthesized
tcagagtcttaaagagattata

SEQ ID NO: 1202020 - DNA, 22 bp, Artificial Sequence
  chemically synthesized
ccagttgctataatctctttaa

SEQ ID NO: 1202021 - DNA, 22 bp, Artificial Sequence
  chemically synthesized
aattatcagagtcttaaagaga

SEQ ID NO: 1202022 - DNA, 22 bp, Artificial Sequence
  chemically synthesized
cctcaattatcagagtcttaaa

SEQ ID NO: 1202023 - DNA, 22 bp, Artificial Sequence
  chemically synthesized
ctataatctctttaagactctg

SEQ ID NO: 1202024 - DNA, 22 bp, Artificial Sequence
  chemically synthesized
taatctctttaagactctgata

SEQ ID NO: 1202025 - DNA, 22 bp, Artificial Sequence
  chemically synthesized
gtgtctacctcaattatcagag

SEQ ID NO: 1202026 - DNA, 22 bp, Artificial Sequence
  chemically synthesized
ggtgtctacctcaattatcaga

SEQ ID NO: 1202027 - DNA, 22 bp, Artificial Sequence
  chemically synthesized
tttaagactctgataattgagg

SEQ ID NO: 1202028 - DNA, 22 bp, Artificial Sequence
  chemically synthesized
ccttggtgtctacctcaattat

SEQ ID NO: 1202029 - DNA, 22 bp, Artificial Sequence
  chemically synthesized
taagactctgataattgaggta

SEQ ID NO: 1202030 - DNA, 22 bp, Artificial Sequence
  chemically synthesized
tgccttggtgtctacctcaatt

SEQ ID NO: 1202031 - DNA, 22 bp, Artificial Sequence
  chemically synthesized
aagactctgataattgaggtag

SEQ ID NO: 1202032 - DNA, 22 bp, Artificial Sequence
  chemically synthesized
agactctgataattgaggtaga

SEQ ID NO: 1202033 - DNA, 22 bp, Artificial Sequence
  chemically synthesized
tgataattgaggtagacaccaa

SEQ ID NO: 1202034 - DNA, 22 bp, Artificial Sequence
  chemically synthesized
cgtagttctgccttggtgtcta

SEQ ID NO: 1202035 - DNA, 22 bp, Artificial Sequence
  chemically synthesized
acgtagttctgccttggtgtct

SEQ ID NO: 1202036 - DNA, 22 bp, Artificial Sequence
  chemically synthesized
ataattgaggtagacaccaagg

SEQ ID NO: 1202037 - DNA, 22 bp, Artificial Sequence
  chemically synthesized
tacgtagttctgccttggtgtc

SEQ ID NO: 1202038 - DNA, 22 bp, Artificial Sequence
  chemically synthesized
aggtagacaccaaggcagaact

SEQ ID NO: 1202039 - DNA, 22 bp, Artificial Sequence
  chemically synthesized
cagacatgataattttacgtag

SEQ ID NO: 1202040 - DNA, 22 bp, Artificial Sequence
  chemically synthesized
acagacatgataattttacgta

SEQ ID NO: 1202041 - DNA, 22 bp, Artificial Sequence
  chemically synthesized
tttacagacatgataattttac

SEQ ID NO: 1202042 - DNA, 22 bp, Artificial Sequence
  chemically synthesized
ttgtttacagacatgataattt

SEQ ID NO: 1202043 - DNA, 22 bp, Artificial Sequence
  chemically synthesized
gttgtttacagacatgataatt

SEQ ID NO: 1202044 - DNA, 22 bp, Artificial Sequence
  chemically synthesized
tgttgtttacagacatgataat

SEQ ID NO: 1202045 - DNA, 22 bp, Artificial Sequence
  chemically synthesized
ttgttgtttacagacatgataa

SEQ ID NO: 1202046 - DNA, 22 bp, Artificial Sequence
  chemically synthesized
tttgttgtttacagacatgata

SEQ ID NO: 1202047 - DNA, 22 bp, Artificial Sequence
  chemically synthesized
ttttgttgtttacagacatgat

SEQ ID NO: 1202048 - DNA, 22 bp, Artificial Sequence
  chemically synthesized
cgtaaaattatcatgtctgtaa

SEQ ID NO: 1202049 - DNA, 22 bp, Artificial Sequence
  chemically synthesized
tgtgtcatttttttgttgttta

SEQ ID NO: 1202050 - DNA, 22 bp, Artificial Sequence
  chemically synthesized
tcatgtctgtaaacaacaaaaa

SEQ ID NO: 1202051 - DNA, 22 bp, Artificial Sequence
  chemically synthesized
attgtgtgtcatttttttgttg

SEQ ID NO: 1202052 - DNA, 22 bp, Artificial Sequence
  chemically synthesized
aattgtgtgtcatttttttgtt

SEQ ID NO: 1202053 - DNA, 22 bp, Artificial Sequence
  chemically synthesized
taattgtgtgtcatttttttgt

SEQ ID NO: 1202054 - DNA, 22 bp, Artificial Sequence
  chemically synthesized
ttaattgtgtgtcatttttttg

SEQ ID NO: 1202055 - DNA, 22 bp, Artificial Sequence
  chemically synthesized
gcttttaattgtgtgtcatttt

SEQ ID NO: 1202056 - DNA, 22 bp, Artificial Sequence
  chemically synthesized
taaacaacaaaaaaatgacaca

SEQ ID NO: 1202057 - DNA, 22 bp, Artificial Sequence
  chemically synthesized
ggcttttaattgtgtgtcattt

SEQ ID NO: 1202058 - DNA, 22 bp, Artificial Sequence
  chemically synthesized
tggcttttaattgtgtgtcatt

SEQ ID NO: 1202059 - DNA, 22 bp, Artificial Sequence
  chemically synthesized
ttggcttttaattgtgtgtcat

SEQ ID NO: 1202060 - DNA, 22 bp, Artificial Sequence
  chemically synthesized
tttggcttttaattgtgtgtca

SEQ ID NO: 1202061 - DNA, 22 bp, Artificial Sequence
  chemically synthesized
aataatgagttttttggctttt

SEQ ID NO: 1202062 - DNA, 22 bp, Artificial Sequence
  chemically synthesized
attcaataatgagttttttggc

SEQ ID NO: 1202063 - DNA, 22 bp, Artificial Sequence
  chemically synthesized
ttgattcaataatgagtttttt

SEQ ID NO: 1202064 - DNA, 22 bp, Artificial Sequence
  chemically synthesized
actattgattcaataatgagtt

SEQ ID NO: 1202065 - DNA, 22 bp, Artificial Sequence
  chemically synthesized
aaagccaaaaaactcattattg

SEQ ID NO: 1202066 - DNA, 22 bp, Artificial Sequence
  chemically synthesized
tcactattgattcaataatgag

SEQ ID NO: 1202067 - DNA, 22 bp, Artificial Sequence
  chemically synthesized
gccacataaattctcactattg

SEQ ID NO: 1202068 - DNA, 22 bp, Artificial Sequence
  chemically synthesized
attattgaatcaatagtgagaa

SEQ ID NO: 1202069 - DNA, 22 bp, Artificial Sequence
  chemically synthesized
ttgaatcaatagtgagaattta

SEQ ID NO: 1202070 - DNA, 22 bp, Artificial Sequence
  chemically synthesized
aatcaatagtgagaatttatgt

SEQ ID NO: 1202071 - DNA, 22 bp, Artificial Sequence
  chemically synthesized
tgtgtggtgttagccacataaa

SEQ ID NO: 1202072 - DNA, 22 bp, Artificial Sequence
  chemically synthesized
ctatgtgtggtgttagccacat

SEQ ID NO: 1202073 - DNA, 22 bp, Artificial Sequence
  chemically synthesized
gctatgtgtggtgttagccaca

SEQ ID NO: 1202074 - DNA, 22 bp, Artificial Sequence
  chemically synthesized
tgctatgtgtggtgttagccac

SEQ ID NO: 1202075 - DNA, 22 bp, Artificial Sequence
  chemically synthesized
ttgctatgtgtggtgttagcca

SEQ ID NO: 1202076 - DNA, 22 bp, Artificial Sequence
  chemically synthesized
tttgctatgtgtggtgttagcc

SEQ ID NO: 1202077 - DNA, 22 bp, Artificial Sequence
  chemically synthesized
ttttgctatgtgtggtgttagc

SEQ ID NO: 1202078 - DNA, 22 bp, Artificial Sequence
  chemically synthesized
atgtggctaacaccacacatag

SEQ ID NO: 1202079 - DNA, 22 bp, Artificial Sequence
  chemically synthesized
tgtggctaacaccacacatagc

SEQ ID NO: 1202080 - DNA, 22 bp, Artificial Sequence
  chemically synthesized
acatcaaatcttttttgctatg

SEQ ID NO: 1202081 - DNA, 22 bp, Artificial Sequence
  chemically synthesized
acaccacacatagcaaaaaaga

SEQ ID NO: 1202082 - DNA, 22 bp, Artificial Sequence
  chemically synthesized
atacctaacatcaaatcttttt

SEQ ID NO: 1202083 - DNA, 22 bp, Artificial Sequence
  chemically synthesized
ctaatacctaacatcaaatctt

SEQ ID NO: 1202084 - DNA, 22 bp, Artificial Sequence
  chemically synthesized
caattcctaatacctaacatca

SEQ ID NO: 1202085 - DNA, 22 bp, Artificial Sequence
  chemically synthesized
atataacagctgcaattcctaa

SEQ ID NO: 1202086 - DNA, 22 bp, Artificial Sequence
  chemically synthesized
gatgttaggtattaggaattgc

SEQ ID NO: 1202087 - DNA, 22 bp, Artificial Sequence
  chemically synthesized
atgttaggtattaggaattgca

SEQ ID NO: 1202088 - DNA, 22 bp, Artificial Sequence
  chemically synthesized
gttcatataacagctgcaattc

SEQ ID NO: 1202089 - DNA, 22 bp, Artificial Sequence
  chemically synthesized
ggtattaggaattgcagctgtt

SEQ ID NO: 1202090 - DNA, 22 bp, Artificial Sequence
  chemically synthesized
attggttcatataacagctgca

SEQ ID NO: 1202091 - DNA, 22 bp, Artificial Sequence
  chemically synthesized
tgattcattggttcatataaca

SEQ ID NO: 1202092 - DNA, 22 bp, Artificial Sequence
  chemically synthesized
ggaattgcagctgttatatgaa

SEQ ID NO: 1202093 - DNA, 22 bp, Artificial Sequence
  chemically synthesized
cagctgttatatgaaccaatga

SEQ ID NO: 1202094 - DNA, 22 bp, Artificial Sequence
  chemically synthesized
ttatatgaaccaatgaatcaca

SEQ ID NO: 1202095 - DNA, 22 bp, Artificial Sequence
  chemically synthesized
atatgaacaaattgtgattcat

SEQ ID NO: 1202096 - DNA, 22 bp, Artificial Sequence
  chemically synthesized
aatatgaacaaattgtgattca

SEQ ID NO: 1202097 - DNA, 22 bp, Artificial Sequence
  chemically synthesized
tatgaaccaatgaatcacaatt

SEQ ID NO: 1202098 - DNA, 22 bp, Artificial Sequence
  chemically synthesized
tgtcttaatatgaacaaattgt

SEQ ID NO: 1202099 - DNA, 22 bp, Artificial Sequence
  chemically synthesized
cctatgtcttaatatgaacaaa

SEQ ID NO: 1202100 - DNA, 22 bp, Artificial Sequence
  chemically synthesized
tatataactacctatgtcttaa

SEQ ID NO: 1202101 - DNA, 22 bp, Artificial Sequence
  chemically synthesized
gttcatattaagacataggtag

SEQ ID NO: 1202102 - DNA, 22 bp, Artificial Sequence
  chemically synthesized
ttcatattaagacataggtagt

SEQ ID NO: 1202103 - DNA, 22 bp, Artificial Sequence
  chemically synthesized
atattaagacataggtagttat

SEQ ID NO: 1202104 - DNA, 22 bp, Artificial Sequence
  chemically synthesized
agacataggtagttatatacag

SEQ ID NO: 1202105 - DNA, 22 bp, Artificial Sequence
  chemically synthesized
aaaaaagatcagtgaactgtat

SEQ ID NO: 1202106 - DNA, 22 bp, Artificial Sequence
  chemically synthesized
caaaaaagatcagtgaactgta

SEQ ID NO: 1202107 - DNA, 22 bp, Artificial Sequence
  chemically synthesized
tatacagttcactgatcttttt

SEQ ID NO: 1202108 - DNA, 22 bp, Artificial Sequence
  chemically synthesized
acaatcacatttcaaaaaagat

SEQ ID NO: 1202109 - DNA, 22 bp, Artificial Sequence
  chemically synthesized
actgatcttttttgaaatgtga

SEQ ID NO: 1202110 - DNA, 22 bp, Artificial Sequence
  chemically synthesized
atcttttttgaaatgtgattgt

SEQ ID NO: 1202111 - DNA, 22 bp, Artificial Sequence
  chemically synthesized
ttttgaaatgtgattgtgagcc

SEQ ID NO: 1202112 - DNA, 22 bp, Artificial Sequence
  chemically synthesized
tttgaaatgtgattgtgagcca

SEQ ID NO: 1202113 - DNA, 22 bp, Artificial Sequence
  chemically synthesized
atccaatggaaatggctcacaa

SEQ ID NO: 1202114 - DNA, 22 bp, Artificial Sequence
  chemically synthesized
ttgaaatgtgattgtgagccat

SEQ ID NO: 1202115 - DNA, 22 bp, Artificial Sequence
  chemically synthesized
catccaatggaaatggctcaca

SEQ ID NO: 1202116 - DNA, 22 bp, Artificial Sequence
  chemically synthesized
tgaaatgtgattgtgagccatt

SEQ ID NO: 1202117 - DNA, 22 bp, Artificial Sequence
  chemically synthesized
tcatccaatggaaatggctcac

SEQ ID NO: 1202118 - DNA, 22 bp, Artificial Sequence
  chemically synthesized
gaaatgtgattgtgagccattt

SEQ ID NO: 1202119 - DNA, 22 bp, Artificial Sequence
  chemically synthesized
ttcatccaatggaaatggctca

SEQ ID NO: 1202120 - DNA, 22 bp, Artificial Sequence
  chemically synthesized
aaatgtgattgtgagccatttc

SEQ ID NO: 1202121 - DNA, 22 bp, Artificial Sequence
  chemically synthesized
tttcatccaatggaaatggctc

SEQ ID NO: 1202122 - DNA, 22 bp, Artificial Sequence
  chemically synthesized
ttttttcatccaatggaaatgg

SEQ ID NO: 1202123 - DNA, 22 bp, Artificial Sequence
  chemically synthesized
tgagccatttccattggatgaa

SEQ ID NO: 1202124 - DNA, 22 bp, Artificial Sequence
  chemically synthesized
ccattggatgaaaaaacagacg

SEQ ID NO: 1202125 - DNA, 22 bp, Artificial Sequence
  chemically synthesized
cattggatgaaaaaacagacgc

SEQ ID NO: 1202126 - DNA, 22 bp, Artificial Sequence
  chemically synthesized
gatgaaaaaacagacgccttgc

SEQ ID NO: 1202127 - DNA, 22 bp, Artificial Sequence
  chemically synthesized
atgggtaaaagtgacaaataag

SEQ ID NO: 1202128 - DNA, 22 bp, Artificial Sequence
  chemically synthesized
catgggtaaaagtgacaaataa

SEQ ID NO: 1202129 - DNA, 22 bp, Artificial Sequence
  chemically synthesized
ggtttcatgggtaaaagtgaca

SEQ ID NO: 1202130 - DNA, 22 bp, Artificial Sequence
  chemically synthesized
gccttatttgtcacttttaccc

SEQ ID NO: 1202131 - DNA, 22 bp, Artificial Sequence
  chemically synthesized
ccttatttgtcacttttaccca

SEQ ID NO: 1202132 - DNA, 22 bp, Artificial Sequence
  chemically synthesized
atttgtcacttttacccatgaa

SEQ ID NO: 1202133 - DNA, 22 bp, Artificial Sequence
  chemically synthesized
tttgtcacttttacccatgaaa

SEQ ID NO: 1202134 - DNA, 22 bp, Artificial Sequence
  chemically synthesized
gtcacttttacccatgaaacct

SEQ ID NO: 1202135 - DNA, 22 bp, Artificial Sequence
  chemically synthesized
tcacttttacccatgaaaccta

SEQ ID NO: 1202136 - DNA, 22 bp, Artificial Sequence
  chemically synthesized
tatatgtagaaatgtactaggt

SEQ ID NO: 1202137 - DNA, 22 bp, Artificial Sequence
  chemically synthesized
ttacccatgaaacctagtacat

SEQ ID NO: 1202138 - DNA, 22 bp, Artificial Sequence
  chemically synthesized
tacccatgaaacctagtacatt

SEQ ID NO: 1202139 - DNA, 22 bp, Artificial Sequence
  chemically synthesized
tatatatgtagaaatgtactag

SEQ ID NO: 1202140 - DNA, 22 bp, Artificial Sequence
  chemically synthesized
acccatgaaacctagtacattt

SEQ ID NO: 1202141 - DNA, 22 bp, Artificial Sequence
  chemically synthesized
ctatatatgtagaaatgtacta

SEQ ID NO: 1202142 - DNA, 22 bp, Artificial Sequence
  chemically synthesized
cccatgaaacctagtacatttc

SEQ ID NO: 1202143 - DNA, 22 bp, Artificial Sequence
  chemically synthesized
tgagtgtcttctatatatgtag

SEQ ID NO: 1202144 - DNA, 22 bp, Artificial Sequence
  chemically synthesized
atgagtgtcttctatatatgta

SEQ ID NO: 1202145 - DNA, 22 bp, Artificial Sequence
  chemically synthesized
gtacatttctacatatatagaa

SEQ ID NO: 1202146 - DNA, 22 bp, Artificial Sequence
  chemically synthesized
ctacatatatagaagacactca

SEQ ID NO: 1202147 - DNA, 22 bp, Artificial Sequence
  chemically synthesized
tacatatatagaagacactcat

SEQ ID NO: 1202148 - DNA, 22 bp, Artificial Sequence
  chemically synthesized
catatatagaagacactcataa

SEQ ID NO: 1202149 - DNA, 22 bp, Artificial Sequence
  chemically synthesized
taaatcacaagtcaataaacac

SEQ ID NO: 1202150 - DNA, 22 bp, Artificial Sequence
  chemically synthesized
atgttgtaaatcacaagtcaat

SEQ ID NO: 1202151 - DNA, 22 bp, Artificial Sequence
  chemically synthesized
aatgttgtaaatcacaagtcaa

SEQ ID NO: 1202152 - DNA, 22 bp, Artificial Sequence
  chemically synthesized
ataagtgtttattgacttgtga

SEQ ID NO: 1202153 - DNA, 22 bp, Artificial Sequence
  chemically synthesized
ttaatgttgtaaatcacaagtc

SEQ ID NO: 1202154 - DNA, 22 bp, Artificial Sequence
  chemically synthesized
ttcttaatgttgtaaatcacaa

SEQ ID NO: 1202155 - DNA, 22 bp, Artificial Sequence
  chemically synthesized
attcttaatgttgtaaatcaca

SEQ ID NO: 1202156 - DNA, 22 bp, Artificial Sequence
  chemically synthesized
tttattcttaatgttgtaaatc

SEQ ID NO: 1202157 - DNA, 22 bp, Artificial Sequence
  chemically synthesized
attgacttgtgatttacaacat

SEQ ID NO: 1202158 - DNA, 22 bp, Artificial Sequence
  chemically synthesized
tgtttattcttaatgttgtaaa

SEQ ID NO: 1202159 - DNA, 22 bp, Artificial Sequence
  chemically synthesized
ttgacttgtgatttacaacatt

SEQ ID NO: 1202160 - DNA, 22 bp, Artificial Sequence
  chemically synthesized
acttgtgatttacaacattaag

SEQ ID NO: 1202161 - DNA, 22 bp, Artificial Sequence
  chemically synthesized
gtgatttacaacattaagaata

SEQ ID NO: 1202162 - DNA, 22 bp, Artificial Sequence
  chemically synthesized
tgatttacaacattaagaataa

SEQ ID NO: 1202163 - DNA, 22 bp, Artificial Sequence
  chemically synthesized
gggaaaaatctctgtttattct

SEQ ID NO: 1202164 - DNA, 22 bp, Artificial Sequence
  chemically synthesized
acaacattaagaataaacagag

SEQ ID NO: 1202165 - DNA, 22 bp, Artificial Sequence
  chemically synthesized
caacattaagaataaacagaga

SEQ ID NO: 1202166 - DNA, 22 bp, Artificial Sequence
  chemically synthesized
cgttagggaaaaatctctgttt

SEQ ID NO: 1202167 - DNA, 22 bp, Artificial Sequence
  chemically synthesized
ccgttagggaaaaatctctgtt

SEQ ID NO: 1202168 - DNA, 22 bp, Artificial Sequence
  chemically synthesized
tccgttagggaaaaatctctgt

SEQ ID NO: 1202169 - DNA, 22 bp, Artificial Sequence
  chemically synthesized
agaataaacagagatttttccc

SEQ ID NO: 1202170 - DNA, 22 bp, Artificial Sequence
  chemically synthesized
ttccctaacggaaaatcatgta

SEQ ID NO: 1202171 - DNA, 22 bp, Artificial Sequence
  chemically synthesized
tccctaacggaaaatcatgtat

SEQ ID NO: 1202172 - DNA, 22 bp, Artificial Sequence
  chemically synthesized
ccctaacggaaaatcatgtata

SEQ ID NO: 1202173 - DNA, 22 bp, Artificial Sequence
  chemically synthesized
cctaacggaaaatcatgtatat

SEQ ID NO: 1202174 - DNA, 22 bp, Artificial Sequence
  chemically synthesized
acataaatgtagcaatatacat

SEQ ID NO: 1202175 - DNA, 22 bp, Artificial Sequence
  chemically synthesized
acggaaaatcatgtatattgct

SEQ ID NO: 1202176 - DNA, 22 bp, Artificial Sequence
  chemically synthesized
tgattaacataaatgtagcaat

SEQ ID NO: 1202177 - DNA, 22 bp, Artificial Sequence
  chemically synthesized
atgattaacataaatgtagcaa

SEQ ID NO: 1202178 - DNA, 22 bp, Artificial Sequence
  chemically synthesized
atagagtttatgattaacataa

SEQ ID NO: 1202179 - DNA, 22 bp, Artificial Sequence
  chemically synthesized
catagagtttatgattaacata

SEQ ID NO: 1202180 - DNA, 22 bp, Artificial Sequence
  chemically synthesized
tcatagagtttatgattaacat

SEQ ID NO: 1202181 - DNA, 22 bp, Artificial Sequence
  chemically synthesized
ctacatttatgttaatcataaa

SEQ ID NO: 1202182 - DNA, 22 bp, Artificial Sequence
  chemically synthesized
gttttcatagagtttatgatta

SEQ ID NO: 1202183 - DNA, 22 bp, Artificial Sequence
  chemically synthesized
catttatgttaatcataaactc

SEQ ID NO: 1202184 - DNA, 22 bp, Artificial Sequence
  chemically synthesized
tgctagttttcatagagtttat

SEQ ID NO: 1202185 - DNA, 22 bp, Artificial Sequence
  chemically synthesized
atgttaatcataaactctatga

SEQ ID NO: 1202186 - DNA, 22 bp, Artificial Sequence
  chemically synthesized
tgttaatcataaactctatgaa

SEQ ID NO: 1202187 - DNA, 22 bp, Artificial Sequence
  chemically synthesized
atgctatgctagttttcataga

SEQ ID NO: 1202188 - DNA, 22 bp, Artificial Sequence
  chemically synthesized
taatgctatgctagttttcata

SEQ ID NO: 1202189 - DNA, 22 bp, Artificial Sequence
  chemically synthesized
atcataaactctatgaaaacta

SEQ ID NO: 1202190 - DNA, 22 bp, Artificial Sequence
  chemically synthesized
actctaatgctatgctagtttt

SEQ ID NO: 1202191 - DNA, 22 bp, Artificial Sequence
  chemically synthesized
taactctaatgctatgctagtt

SEQ ID NO: 1202192 - DNA, 22 bp, Artificial Sequence
  chemically synthesized
ctaactctaatgctatgctagt

SEQ ID NO: 1202193 - DNA, 22 bp, Artificial Sequence
  chemically synthesized
tctaactctaatgctatgctag

SEQ ID NO: 1202194 - DNA, 22 bp, Artificial Sequence
  chemically synthesized
tatgaaaactagcatagcatta

SEQ ID NO: 1202195 - DNA, 22 bp, Artificial Sequence
  chemically synthesized
agttttctaactctaatgctat

SEQ ID NO: 1202196 - DNA, 22 bp, Artificial Sequence
  chemically synthesized
tgaaaactagcatagcattaga

SEQ ID NO: 1202197 - DNA, 22 bp, Artificial Sequence
  chemically synthesized
gcatagcattagagttagaaaa

SEQ ID NO: 1202198 - DNA, 22 bp, Artificial Sequence
  chemically synthesized
aaaatgatagacatgattcagt

SEQ ID NO: 1202199 - DNA, 22 bp, Artificial Sequence
  chemically synthesized
gaaaatgatagacatgattcag

SEQ ID NO: 1202200 - DNA, 22 bp, Artificial Sequence
  chemically synthesized
gagttagaaaactgaatcatgt

SEQ ID NO: 1202201 - DNA, 22 bp, Artificial Sequence
  chemically synthesized
gaaaactgaatcatgtctatca

SEQ ID NO: 1202202 - DNA, 22 bp, Artificial Sequence
  chemically synthesized
aatcatgtctatcattttcaaa

SEQ ID NO: 1202203 - DNA, 22 bp, Artificial Sequence
  chemically synthesized
aaggatggatagagtttgaaaa

SEQ ID NO: 1202204 - DNA, 22 bp, Artificial Sequence
  chemically synthesized
tcaaggatggatagagtttgaa

SEQ ID NO: 1202205 - DNA, 22 bp, Artificial Sequence
  chemically synthesized
ctcaaggatggatagagtttga

SEQ ID NO: 1202206 - DNA, 22 bp, Artificial Sequence
  chemically synthesized
tctcaaggatggatagagtttg

SEQ ID NO: 1202207 - DNA, 22 bp, Artificial Sequence
  chemically synthesized
gctttctcaaggatggatagag

SEQ ID NO: 1202208 - DNA, 22 bp, Artificial Sequence
  chemically synthesized
tcattttcaaactctatccatc

SEQ ID NO: 1202209 - DNA, 22 bp, Artificial Sequence
  chemically synthesized
tcaaactctatccatccttgag

SEQ ID NO: 1202210 - DNA, 22 bp, Artificial Sequence
  chemically synthesized
caaactctatccatccttgaga

SEQ ID NO: 1202211 - DNA, 22 bp, Artificial Sequence
  chemically synthesized
aaactctatccatccttgagaa

SEQ ID NO: 1202212 - DNA, 22 bp, Artificial Sequence
  chemically synthesized
aagaaactagctttctcaagga

SEQ ID NO: 1202213 - DNA, 22 bp, Artificial Sequence
  chemically synthesized
atctgaagaaactagctttctc

SEQ ID NO: 1202214 - DNA, 22 bp, Artificial Sequence
  chemically synthesized
tatccatccttgagaaagctag

SEQ ID NO: 1202215 - DNA, 22 bp, Artificial Sequence
  chemically synthesized
aatctgaagaaactagctttct

SEQ ID NO: 1202216 - DNA, 22 bp, Artificial Sequence
  chemically synthesized
taatctgaagaaactagctttc

SEQ ID NO: 1202217 - DNA, 22 bp, Artificial Sequence
  chemically synthesized
tccatccttgagaaagctagtt

SEQ ID NO: 1202218 - DNA, 22 bp, Artificial Sequence
  chemically synthesized
tattttaatctgaagaaactag

SEQ ID NO: 1202219 - DNA, 22 bp, Artificial Sequence
  chemically synthesized
atattttaatctgaagaaacta

SEQ ID NO: 1202220 - DNA, 22 bp, Artificial Sequence
  chemically synthesized
gagaaagctagtttcttcagat

SEQ ID NO: 1202221 - DNA, 22 bp, Artificial Sequence
  chemically synthesized
agaaagctagtttcttcagatt

SEQ ID NO: 1202222 - DNA, 22 bp, Artificial Sequence
  chemically synthesized
aatgtatttatattttaatctg

SEQ ID NO: 1202223 - DNA, 22 bp, Artificial Sequence
  chemically synthesized
aaatgtatttatattttaatct

SEQ ID NO: 1202224 - DNA, 22 bp, Artificial Sequence
  chemically synthesized
taaatgtatttatattttaatc

SEQ ID NO: 1202225 - DNA, 22 bp, Artificial Sequence
  chemically synthesized
ttaaatgtatttatattttaat

SEQ ID NO: 1202226 - DNA, 22 bp, Artificial Sequence
  chemically synthesized
gtttcttcagattaaaatataa

SEQ ID NO: 1202227 - DNA, 22 bp, Artificial Sequence
  chemically synthesized
cttcagattaaaatataaatac

SEQ ID NO: 1202228 - DNA, 22 bp, Artificial Sequence
  chemically synthesized
ttcagattaaaatataaataca

SEQ ID NO: 1202229 - DNA, 22 bp, Artificial Sequence
  chemically synthesized
cagattaaaatataaatacatt

SEQ ID NO: 1202230 - DNA, 22 bp, Artificial Sequence
  chemically synthesized
tcagaatttttaaatgtattta

SEQ ID NO: 1202231 - DNA, 22 bp, Artificial Sequence
  chemically synthesized
agattaaaatataaatacattt

SEQ ID NO: 1202232 - DNA, 22 bp, Artificial Sequence
  chemically synthesized
gtcagaatttttaaatgtattt

SEQ ID NO: 1202233 - DNA, 22 bp, Artificial Sequence
  chemically synthesized
tgtcagaatttttaaatgtatt

SEQ ID NO: 1202234 - DNA, 22 bp, Artificial Sequence
  chemically synthesized
ttgtcagaatttttaaatgtat

SEQ ID NO: 1202235 - DNA, 22 bp, Artificial Sequence
  chemically synthesized
aaatataaatacatttaaaaat

SEQ ID NO: 1202236 - DNA, 22 bp, Artificial Sequence
  chemically synthesized
ccttttgtcagaatttttaaat

SEQ ID NO: 1202237 - DNA, 22 bp, Artificial Sequence
  chemically synthesized
tcccttttgtcagaatttttaa

SEQ ID NO: 1202238 - DNA, 22 bp, Artificial Sequence
  chemically synthesized
ctcccttttgtcagaattttta

SEQ ID NO: 1202239 - DNA, 22 bp, Artificial Sequence
  chemically synthesized
tctcccttttgtcagaattttt

SEQ ID NO: 1202240 - DNA, 22 bp, Artificial Sequence
  chemically synthesized
ttctcccttttgtcagaatttt

SEQ ID NO: 1202241 - DNA, 22 bp, Artificial Sequence
  chemically synthesized
aaaaattctgacaaaagggaga

SEQ ID NO: 1202242 - DNA, 22 bp, Artificial Sequence
  chemically synthesized
aaaattctgacaaaagggagaa

SEQ ID NO: 1202243 - DNA, 22 bp, Artificial Sequence
  chemically synthesized
tgacaaaagggagaaaaacttc

SEQ ID NO: 1202244 - DNA, 22 bp, Artificial Sequence
  chemically synthesized
atatgaaacacgggaagttttt

SEQ ID NO: 1202245 - DNA, 22 bp, Artificial Sequence
  chemically synthesized
acaaaagggagaaaaacttccc

SEQ ID NO: 1202246 - DNA, 22 bp, Artificial Sequence
  chemically synthesized
catatgaaacacgggaagtttt

SEQ ID NO: 1202247 - DNA, 22 bp, Artificial Sequence
  chemically synthesized
acttcatatgaaacacgggaag

SEQ ID NO: 1202248 - DNA, 22 bp, Artificial Sequence
  chemically synthesized
gcctaacttcatatgaaacacg

SEQ ID NO: 1202249 - DNA, 22 bp, Artificial Sequence
  chemically synthesized
cgcctaacttcatatgaaacac

SEQ ID NO: 1202250 - DNA, 22 bp, Artificial Sequence
  chemically synthesized
cccgtgtttcatatgaagttag

SEQ ID NO: 1202251 - DNA, 22 bp, Artificial Sequence
  chemically synthesized
ccgtgtttcatatgaagttagg

SEQ ID NO: 1202252 - DNA, 22 bp, Artificial Sequence
  chemically synthesized
catatgaagttaggcgaaattt

SEQ ID NO: 1202253 - DNA, 22 bp, Artificial Sequence
  chemically synthesized
caaatgtaaatcaaatttcgcc

SEQ ID NO: 1202254 - DNA, 22 bp, Artificial Sequence
  chemically synthesized
atatgaagttaggcgaaatttg

SEQ ID NO: 1202255 - DNA, 22 bp, Artificial Sequence
  chemically synthesized
ccaaatgtaaatcaaatttcgc

SEQ ID NO: 1202256 - DNA, 22 bp, Artificial Sequence
  chemically synthesized
tccaaatgtaaatcaaatttcg

SEQ ID NO: 1202257 - DNA, 22 bp, Artificial Sequence
  chemically synthesized
tttccaaatgtaaatcaaattt

SEQ ID NO: 1202258 - DNA, 22 bp, Artificial Sequence
  chemically synthesized
ctttccaaatgtaaatcaaatt

SEQ ID NO: 1202259 - DNA, 22 bp, Artificial Sequence
  chemically synthesized
ttctttccaaatgtaaatcaaa

SEQ ID NO: 1202260 - DNA, 22 bp, Artificial Sequence
  chemically synthesized
tcttctttccaaatgtaaatca

SEQ ID NO: 1202261 - DNA, 22 bp, Artificial Sequence
  chemically synthesized
ctcttctttccaaatgtaaatc

SEQ ID NO: 1202262 - DNA, 22 bp, Artificial Sequence
  chemically synthesized
ggcgaaatttgatttacatttg

SEQ ID NO: 1202263 - DNA, 22 bp, Artificial Sequence
  chemically synthesized
gatttacatttggaaagaagag

SEQ ID NO: 1202264 - DNA, 22 bp, Artificial Sequence
  chemically synthesized
atttacatttggaaagaagaga

SEQ ID NO: 1202265 - DNA, 22 bp, Artificial Sequence
  chemically synthesized
aaataagtggatttctcttctt

SEQ ID NO: 1202266 - DNA, 22 bp, Artificial Sequence
  chemically synthesized
taaaataagtggatttctcttc

SEQ ID NO: 1202267 - DNA, 22 bp, Artificial Sequence
  chemically synthesized
acatttggaaagaagagaaatc

SEQ ID NO: 1202268 - DNA, 22 bp, Artificial Sequence
  chemically synthesized
ctaaaataagtggatttctctt

SEQ ID NO: 1202269 - DNA, 22 bp, Artificial Sequence
  chemically synthesized
catttggaaagaagagaaatcc

SEQ ID NO: 1202270 - DNA, 22 bp, Artificial Sequence
  chemically synthesized
cttctaaaataagtggatttct

SEQ ID NO: 1202271 - DNA, 22 bp, Artificial Sequence
  chemically synthesized
acttctaaaataagtggatttc

SEQ ID NO: 1202272 - DNA, 22 bp, Artificial Sequence
  chemically synthesized
ggaaagaagagaaatccactta

SEQ ID NO: 1202273 - DNA, 22 bp, Artificial Sequence
  chemically synthesized
gaaagaagagaaatccacttat

SEQ ID NO: 1202274 - DNA, 22 bp, Artificial Sequence
  chemically synthesized
atttacttctaaaataagtgga

SEQ ID NO: 1202275 - DNA, 22 bp, Artificial Sequence
  chemically synthesized
gatttacttctaaaataagtgg

SEQ ID NO: 1202276 - DNA, 22 bp, Artificial Sequence
  chemically synthesized
ttgatttacttctaaaataagt

SEQ ID NO: 1202277 - DNA, 22 bp, Artificial Sequence
  chemically synthesized
cttgatttacttctaaaataag

SEQ ID NO: 1202278 - DNA, 22 bp, Artificial Sequence
  chemically synthesized
cacatttcttgatttacttcta

SEQ ID NO: 1202279 - DNA, 22 bp, Artificial Sequence
  chemically synthesized
gcacatttcttgatttacttct

SEQ ID NO: 1202280 - DNA, 22 bp, Artificial Sequence
  chemically synthesized
tgcacatttcttgatttacttc

SEQ ID NO: 1202281 - DNA, 22 bp, Artificial Sequence
  chemically synthesized
attttagaagtaaatcaagaaa

SEQ ID NO: 1202282 - DNA, 22 bp, Artificial Sequence
  chemically synthesized
ttttagaagtaaatcaagaaat

SEQ ID NO: 1202283 - DNA, 22 bp, Artificial Sequence
  chemically synthesized
tagaagtaaatcaagaaatgtg

SEQ ID NO: 1202284 - DNA, 22 bp, Artificial Sequence
  chemically synthesized
atagatattttgcacatttctt

SEQ ID NO: 1202285 - DNA, 22 bp, Artificial Sequence
  chemically synthesized
agaagtaaatcaagaaatgtgc

SEQ ID NO: 1202286 - DNA, 22 bp, Artificial Sequence
  chemically synthesized
gaagtaaatcaagaaatgtgca

SEQ ID NO: 1202287 - DNA, 22 bp, Artificial Sequence
  chemically synthesized
atacctgatagatattttgcac

SEQ ID NO: 1202288 - DNA, 22 bp, Artificial Sequence
  chemically synthesized
aattcatacctgatagatattt

SEQ ID NO: 1202289 - DNA, 22 bp, Artificial Sequence
  chemically synthesized
aaattcatacctgatagatatt

SEQ ID NO: 1202290 - DNA, 22 bp, Artificial Sequence
  chemically synthesized
taaattcatacctgatagatat

SEQ ID NO: 1202291 - DNA, 22 bp, Artificial Sequence
  chemically synthesized
aatgaatatcatattttaaatt

SEQ ID NO: 1202292 - DNA, 22 bp, Artificial Sequence
  chemically synthesized
tcaggtatgaatttaaaatatg

SEQ ID NO: 1202293 - DNA, 22 bp, Artificial Sequence
  chemically synthesized
ttgaatgaatatcatattttaa

SEQ ID NO: 1202294 - DNA, 22 bp, Artificial Sequence
  chemically synthesized
taaattattgaatgaatatcat

SEQ ID NO: 1202295 - DNA, 22 bp, Artificial Sequence
  chemically synthesized
ttataaattattgaatgaatat

SEQ ID NO: 1202296 - DNA, 22 bp, Artificial Sequence
  chemically synthesized
aaaatatgatattcattcaata

SEQ ID NO: 1202297 - DNA, 22 bp, Artificial Sequence
  chemically synthesized
aaatatgatattcattcaataa

SEQ ID NO: 1202298 - DNA, 22 bp, Artificial Sequence
  chemically synthesized
tagcaatctgttataaattatt

SEQ ID NO: 1202299 - DNA, 22 bp, Artificial Sequence
  chemically synthesized
atagcaatctgttataaattat

SEQ ID NO: 1202300 - DNA, 22 bp, Artificial Sequence
  chemically synthesized
atttatagcaatctgttataaa

SEQ ID NO: 1202301 - DNA, 22 bp, Artificial Sequence
  chemically synthesized
attcaataatttataacagatt

SEQ ID NO: 1202302 - DNA, 22 bp, Artificial Sequence
  chemically synthesized
aataatttataacagattgcta

SEQ ID NO: 1202303 - DNA, 22 bp, Artificial Sequence
  chemically synthesized
ataacagattgctataaatcag

SEQ ID NO: 1202304 - DNA, 22 bp, Artificial Sequence
  chemically synthesized
taacagattgctataaatcaga

SEQ ID NO: 1202305 - DNA, 22 bp, Artificial Sequence
  chemically synthesized
ctataaatcagatacctgtatt

SEQ ID NO: 1202306 - DNA, 22 bp, Artificial Sequence
  chemically synthesized
taaatcagatacctgtattgta

SEQ ID NO: 1202307 - DNA, 22 bp, Artificial Sequence
  chemically synthesized
acacagggaagaaatacaatac

SEQ ID NO: 1202308 - DNA, 22 bp, Artificial Sequence
  chemically synthesized
caaaacctgacacagggaagaa

SEQ ID NO: 1202309 - DNA, 22 bp, Artificial Sequence
  chemically synthesized
ccaaaacctgacacagggaaga

SEQ ID NO: 1202310 - DNA, 22 bp, Artificial Sequence
  chemically synthesized
tattgtatttcttccctgtgtc

SEQ ID NO: 1202311 - DNA, 22 bp, Artificial Sequence
  chemically synthesized
tggtttccaaaacctgacacag

SEQ ID NO: 1202312 - DNA, 22 bp, Artificial Sequence
  chemically synthesized
tatttcttccctgtgtcaggtt

SEQ ID NO: 1202313 - DNA, 22 bp, Artificial Sequence
  chemically synthesized
tgtggtttccaaaacctgacac

SEQ ID NO: 1202314 - DNA, 22 bp, Artificial Sequence
  chemically synthesized
tctgtggtttccaaaacctgac

SEQ ID NO: 1202315 - DNA, 22 bp, Artificial Sequence
  chemically synthesized
ctctgtggtttccaaaacctga

SEQ ID NO: 1202316 - DNA, 22 bp, Artificial Sequence
  chemically synthesized
cttccctgtgtcaggttttgga

SEQ ID NO: 1202317 - DNA, 22 bp, Artificial Sequence
  chemically synthesized
ttccctgtgtcaggttttggaa

SEQ ID NO: 1202318 - DNA, 22 bp, Artificial Sequence
  chemically synthesized
ccctgtgtcaggttttggaaac

SEQ ID NO: 1202319 - DNA, 22 bp, Artificial Sequence
  chemically synthesized
cctgtgtcaggttttggaaacc

SEQ ID NO: 1202320 - DNA, 22 bp, Artificial Sequence
  chemically synthesized
tgtcaggttttggaaaccacag

SEQ ID NO: 1202321 - DNA, 22 bp, Artificial Sequence
  chemically synthesized
tcatatgcacttctctgtggtt

SEQ ID NO: 1202322 - DNA, 22 bp, Artificial Sequence
  chemically synthesized
tcactgtcatatgcacttctct

SEQ ID NO: 1202323 - DNA, 22 bp, Artificial Sequence
  chemically synthesized
tggaaaccacagagaagtgcat

SEQ ID NO: 1202324 - DNA, 22 bp, Artificial Sequence
  chemically synthesized
ggaaaccacagagaagtgcata

SEQ ID NO: 1202325 - DNA, 22 bp, Artificial Sequence
  chemically synthesized
ctgtcactgtcatatgcacttc

SEQ ID NO: 1202326 - DNA, 22 bp, Artificial Sequence
  chemically synthesized
gaaaccacagagaagtgcatat

SEQ ID NO: 1202327 - DNA, 22 bp, Artificial Sequence
  chemically synthesized
cctgtcactgtcatatgcactt

SEQ ID NO: 1202328 - DNA, 22 bp, Artificial Sequence
  chemically synthesized
cttcctgtcactgtcatatgca

SEQ ID NO: 1202329 - DNA, 22 bp, Artificial Sequence
  chemically synthesized
tgcttcctgtcactgtcatatg

SEQ ID NO: 1202330 - DNA, 22 bp, Artificial Sequence
  chemically synthesized
gctctgcttcctgtcactgtca

SEQ ID NO: 1202331 - DNA, 22 bp, Artificial Sequence
  chemically synthesized
ggctctgcttcctgtcactgtc

SEQ ID NO: 1202332 - DNA, 22 bp, Artificial Sequence
  chemically synthesized
ggagtttggctctgcttcctgt

SEQ ID NO: 1202333 - DNA, 22 bp, Artificial Sequence
  chemically synthesized
cctaggagtttggctctgcttc

SEQ ID NO: 1202334 - DNA, 22 bp, Artificial Sequence
  chemically synthesized
tctgcctaggagtttggctctg

SEQ ID NO: 1202335 - DNA, 22 bp, Artificial Sequence
  chemically synthesized
ggtacccacccctatctgccta

SEQ ID NO: 1202336 - DNA, 22 bp, Artificial Sequence
  chemically synthesized
actgggtacccacccctatctg

SEQ ID NO: 1202337 - DNA, 22 bp, Artificial Sequence
  chemically synthesized
cactgggtacccacccctatct

SEQ ID NO: 1202338 - DNA, 22 bp, Artificial Sequence
  chemically synthesized
ctaggcagataggggtgggtac

SEQ ID NO: 1202339 - DNA, 22 bp, Artificial Sequence
  chemically synthesized
ggcagataggggtgggtaccca

SEQ ID NO: 1202340 - DNA, 22 bp, Artificial Sequence
  chemically synthesized
gaagtggggtttcactgggtac

SEQ ID NO: 1202341 - DNA, 22 bp, Artificial Sequence
  chemically synthesized
ggaagtggggtttcactgggta

SEQ ID NO: 1202342 - DNA, 22 bp, Artificial Sequence
  chemically synthesized
agcttggaagtggggtttcact

SEQ ID NO: 1202343 - DNA, 22 bp, Artificial Sequence
  chemically synthesized
cagcttggaagtggggtttcac

SEQ ID NO: 1202344 - DNA, 22 bp, Artificial Sequence
  chemically synthesized
tcttcagcttggaagtggggtt

SEQ ID NO: 1202345 - DNA, 22 bp, Artificial Sequence
  chemically synthesized
actgtcttcagcttggaagtgg

SEQ ID NO: 1202346 - DNA, 22 bp, Artificial Sequence
  chemically synthesized
aactgtcttcagcttggaagtg

SEQ ID NO: 1202347 - DNA, 22 bp, Artificial Sequence
  chemically synthesized
taactgtcttcagcttggaagt

SEQ ID NO: 1202348 - DNA, 22 bp, Artificial Sequence
  chemically synthesized
aggcctttaactgtcttcagct

SEQ ID NO: 1202349 - DNA, 22 bp, Artificial Sequence
  chemically synthesized
caggcctttaactgtcttcagc

SEQ ID NO: 1202350 - DNA, 22 bp, Artificial Sequence
  chemically synthesized
tcaggcctttaactgtcttcag

SEQ ID NO: 1202351 - DNA, 22 bp, Artificial Sequence
  chemically synthesized
gctttcaggcctttaactgtct

SEQ ID NO: 1202352 - DNA, 22 bp, Artificial Sequence
  chemically synthesized
ggctttcaggcctttaactgtc

SEQ ID NO: 1202353 - DNA, 22 bp, Artificial Sequence
  chemically synthesized
ccaagctgaagacagttaaagg

SEQ ID NO: 1202354 - DNA, 22 bp, Artificial Sequence
  chemically synthesized
caagctgaagacagttaaaggc

SEQ ID NO: 1202355 - DNA, 22 bp, Artificial Sequence
  chemically synthesized
tagtttggctttcaggccttta

SEQ ID NO: 1202356 - DNA, 22 bp, Artificial Sequence
  chemically synthesized
gtagtttggctttcaggccttt

SEQ ID NO: 1202357 - DNA, 22 bp, Artificial Sequence
  chemically synthesized
aagacagttaaaggcctgaaag

SEQ ID NO: 1202358 - DNA, 22 bp, Artificial Sequence
  chemically synthesized
atttgtagtttggctttcaggc

SEQ ID NO: 1202359 - DNA, 22 bp, Artificial Sequence
  chemically synthesized
gatttgtagtttggctttcagg

SEQ ID NO: 1202360 - DNA, 22 bp, Artificial Sequence
  chemically synthesized
aaggcctgaaagccaaactaca

SEQ ID NO: 1202361 - DNA, 22 bp, Artificial Sequence
  chemically synthesized
caaggatttgatttgtagtttg

SEQ ID NO: 1202362 - DNA, 22 bp, Artificial Sequence
  chemically synthesized
aaagccaaactacaaatcaaat

SEQ ID NO: 1202363 - DNA, 22 bp, Artificial Sequence
  chemically synthesized
aatccactgcaaggatttgatt

SEQ ID NO: 1202364 - DNA, 22 bp, Artificial Sequence
  chemically synthesized
tcaatccactgcaaggatttga

SEQ ID NO: 1202365 - DNA, 22 bp, Artificial Sequence
  chemically synthesized
caaatcaaatccttgcagtgga

SEQ ID NO: 1202366 - DNA, 22 bp, Artificial Sequence
  chemically synthesized
gcagtggattgagaacttgtcc

SEQ ID NO: 1202367 - DNA, 22 bp, Artificial Sequence
  chemically synthesized
cagtggattgagaacttgtcct

SEQ ID NO: 1202368 - DNA, 22 bp, Artificial Sequence
  chemically synthesized
agaacttgtcctcctatttggt

SEQ ID NO: 1202369 - DNA, 22 bp, Artificial Sequence
  chemically synthesized
gtcctcctatttggtgtgcttt

SEQ ID NO: 1202370 - DNA, 22 bp, Artificial Sequence
  chemically synthesized
tcctcctatttggtgtgctttc

SEQ ID NO: 1202371 - DNA, 22 bp, Artificial Sequence
  chemically synthesized
ctatttggtgtgctttcctctg

SEQ ID NO: 1202372 - DNA, 22 bp, Artificial Sequence
  chemically synthesized
tttggtgtgctttcctctgatt

SEQ ID NO: 1202373 - DNA, 22 bp, Artificial Sequence
  chemically synthesized
ggtgtgctttcctctgattgat

SEQ ID NO: 1202374 - DNA, 22 bp, Artificial Sequence
  chemically synthesized
gtgtgctttcctctgattgatc

SEQ ID NO: 1202375 - DNA, 22 bp, Artificial Sequence
  chemically synthesized
tcctctgattgatctccaccct

SEQ ID NO: 1202376 - DNA, 22 bp, Artificial Sequence
  chemically synthesized
cctctgattgatctccaccctt

SEQ ID NO: 1202377 - DNA, 22 bp, Artificial Sequence
  chemically synthesized
ctctgattgatctccacccttc

SEQ ID NO: 1202378 - DNA, 22 bp, Artificial Sequence
  chemically synthesized
tgattgatctccacccttcacc

SEQ ID NO: 1202379 - DNA, 22 bp, Artificial Sequence
  chemically synthesized
attgatctccacccttcaccta

SEQ ID NO: 1202380 - DNA, 22 bp, Artificial Sequence
  chemically synthesized
atctccacccttcacctatttt

SEQ ID NO: 1202381 - DNA, 22 bp, Artificial Sequence
  chemically synthesized
cacccttcacctattttactta

SEQ ID NO: 1202382 - DNA, 22 bp, Artificial Sequence
  chemically synthesized
cacctattttacttatacctac

SEQ ID NO: 1202383 - DNA, 22 bp, Artificial Sequence
  chemically synthesized
acctattttacttatacctact

SEQ ID NO: 1202384 - DNA, 22 bp, Artificial Sequence
  chemically synthesized
ttttacttatacctactgatat

SEQ ID NO: 1202385 - DNA, 22 bp, Artificial Sequence
  chemically synthesized
tacttatacctactgatatggt

SEQ ID NO: 1202386 - DNA, 22 bp, Artificial Sequence
  chemically synthesized
acttatacctactgatatggtt

SEQ ID NO: 1202387 - DNA, 22 bp, Artificial Sequence
  chemically synthesized
cttatacctactgatatggttt

SEQ ID NO: 1202388 - DNA, 22 bp, Artificial Sequence
  chemically synthesized
atacctactgatatggtttggc

SEQ ID NO: 1202389 - DNA, 22 bp, Artificial Sequence
  chemically synthesized
ggtgagggcacagccaaaccat

SEQ ID NO: 1202390 - DNA, 22 bp, Artificial Sequence
  chemically synthesized
tacctactgatatggtttggct

SEQ ID NO: 1202391 - DNA, 22 bp, Artificial Sequence
  chemically synthesized
gggtgagggcacagccaaacca

SEQ ID NO: 1202392 - DNA, 22 bp, Artificial Sequence
  chemically synthesized
ctgatatggtttggctgtgccc

SEQ ID NO: 1202393 - DNA, 22 bp, Artificial Sequence
  chemically synthesized
atatggtttggctgtgccctca

SEQ ID NO: 1202394 - DNA, 22 bp, Artificial Sequence
  chemically synthesized
atgatgatatttgggtgagggc

SEQ ID NO: 1202395 - DNA, 22 bp, Artificial Sequence
  chemically synthesized
ggctgtgccctcacccaaatat

SEQ ID NO: 1202396 - DNA, 22 bp, Artificial Sequence
  chemically synthesized
gctgtgccctcacccaaatatc

SEQ ID NO: 1202397 - DNA, 22 bp, Artificial Sequence
  chemically synthesized
tgccctcacccaaatatcatca

SEQ ID NO: 1202398 - DNA, 22 bp, Artificial Sequence
  chemically synthesized
caacatgtgggaattcatgatg

SEQ ID NO: 1202399 - DNA, 22 bp, Artificial Sequence
  chemically synthesized
acccaaatatcatcatgaattc

SEQ ID NO: 1202400 - DNA, 22 bp, Artificial Sequence
  chemically synthesized
ctacaacatgtgggaattcatg

SEQ ID NO: 1202401 - DNA, 22 bp, Artificial Sequence
  chemically synthesized
cctacaacatgtgggaattcat

SEQ ID NO: 1202402 - DNA, 22 bp, Artificial Sequence
  chemically synthesized
ggtccttcctacaacatgtggg

SEQ ID NO: 1202403 - DNA, 22 bp, Artificial Sequence
  chemically synthesized
ccactgggtccttcctacaaca

SEQ ID NO: 1202404 - DNA, 22 bp, Artificial Sequence
  chemically synthesized
cctcccactgggtccttcctac

SEQ ID NO: 1202405 - DNA, 22 bp, Artificial Sequence
  chemically synthesized
ccacatgttgtaggaaggaccc

SEQ ID NO: 1202406 - DNA, 22 bp, Artificial Sequence
  chemically synthesized
taggaaggacccagtgggaggt

SEQ ID NO: 1202407 - DNA, 22 bp, Artificial Sequence
  chemically synthesized
accccatgatccagttacctcc

SEQ ID NO: 1202408 - DNA, 22 bp, Artificial Sequence
  chemically synthesized
gatcatggggtcaggtatttcc

SEQ ID NO: 1202409 - DNA, 22 bp, Artificial Sequence
  chemically synthesized
tcatgagaacagcacgggaaat

SEQ ID NO: 1202410 - DNA, 22 bp, Artificial Sequence
  chemically synthesized
actatcatgagaacagcacggg

SEQ ID NO: 1202411 - DNA, 22 bp, Artificial Sequence
  chemically synthesized
ttcactatcatgagaacagcac

SEQ ID NO: 1202412 - DNA, 22 bp, Artificial Sequence
  chemically synthesized
attcactatcatgagaacagca

SEQ ID NO: 1202413 - DNA, 22 bp, Artificial Sequence
  chemically synthesized
cccgtgctgttctcatgatagt

SEQ ID NO: 1202414 - DNA, 22 bp, Artificial Sequence
  chemically synthesized
tgaaacttattcactatcatga

SEQ ID NO: 1202415 - DNA, 22 bp, Artificial Sequence
  chemically synthesized
ccgtgctgttctcatgatagtg

SEQ ID NO: 1202416 - DNA, 22 bp, Artificial Sequence
  chemically synthesized
gtgaaacttattcactatcatg

SEQ ID NO: 1202417 - DNA, 22 bp, Artificial Sequence
  chemically synthesized
tgtgaaacttattcactatcat

SEQ ID NO: 1202418 - DNA, 22 bp, Artificial Sequence
  chemically synthesized
ttctcatgatagtgaataagtt

SEQ ID NO: 1202419 - DNA, 22 bp, Artificial Sequence
  chemically synthesized
tcatgatagtgaataagtttca

SEQ ID NO: 1202420 - DNA, 22 bp, Artificial Sequence
  chemically synthesized
atgatagtgaataagtttcaca

SEQ ID NO: 1202421 - DNA, 22 bp, Artificial Sequence
  chemically synthesized
caaagccatcagattttgtgaa

SEQ ID NO: 1202422 - DNA, 22 bp, Artificial Sequence
  chemically synthesized
acaaagccatcagattttgtga

SEQ ID NO: 1202423 - DNA, 22 bp, Artificial Sequence
  chemically synthesized
ccccttacaaagccatcagatt

SEQ ID NO: 1202424 - DNA, 22 bp, Artificial Sequence
  chemically synthesized
cacaaaatctgatggctttgta

SEQ ID NO: 1202425 - DNA, 22 bp, Artificial Sequence
  chemically synthesized
acaaaatctgatggctttgtaa

SEQ ID NO: 1202426 - DNA, 22 bp, Artificial Sequence
  chemically synthesized
tgtggggaaactcccccttaca

SEQ ID NO: 1202427 - DNA, 22 bp, Artificial Sequence
  chemically synthesized
gtgtggggaaactcccccttac

SEQ ID NO: 1202428 - DNA, 22 bp, Artificial Sequence
  chemically synthesized
atggctttgtaagggggagttt

SEQ ID NO: 1202429 - DNA, 22 bp, Artificial Sequence
  chemically synthesized
tgtaagggggagtttccccaca

SEQ ID NO: 1202430 - DNA, 22 bp, Artificial Sequence
  chemically synthesized
gtaagggggagtttccccacac

SEQ ID NO: 1202431 - DNA, 22 bp, Artificial Sequence
  chemically synthesized
taagggggagtttccccacaca

SEQ ID NO: 1202432 - DNA, 22 bp, Artificial Sequence
  chemically synthesized
ccccacacaagctctctgtctg

SEQ ID NO: 1202433 - DNA, 22 bp, Artificial Sequence
  chemically synthesized
catggatggcagcagacagaga

SEQ ID NO: 1202434 - DNA, 22 bp, Artificial Sequence
  chemically synthesized
cccacacaagctctctgtctgc

SEQ ID NO: 1202435 - DNA, 22 bp, Artificial Sequence
  chemically synthesized
acatggatggcagcagacagag

SEQ ID NO: 1202436 - DNA, 22 bp, Artificial Sequence
  chemically synthesized
tctgtctgctgccatccatgta

SEQ ID NO: 1202437 - DNA, 22 bp, Artificial Sequence
  chemically synthesized
tgtctgctgccatccatgtaag

SEQ ID NO: 1202438 - DNA, 22 bp, Artificial Sequence
  chemically synthesized
tctgctgccatccatgtaagac

SEQ ID NO: 1202439 - DNA, 22 bp, Artificial Sequence
  chemically synthesized
ctgccatccatgtaagacgtga

SEQ ID NO: 1202440 - DNA, 22 bp, Artificial Sequence
  chemically synthesized
ccatccatgtaagacgtgactt

SEQ ID NO: 1202441 - DNA, 22 bp, Artificial Sequence
  chemically synthesized
gaaggcaaggaagagcaagtca

SEQ ID NO: 1202442 - DNA, 22 bp, Artificial Sequence
  chemically synthesized
acaatcatgctggaaggcaagg

SEQ ID NO: 1202443 - DNA, 22 bp, Artificial Sequence
  chemically synthesized
cacaatcatgctggaaggcaag

SEQ ID NO: 1202444 - DNA, 22 bp, Artificial Sequence
  chemically synthesized
gctcttccttgccttccagcat

SEQ ID NO: 1202445 - DNA, 22 bp, Artificial Sequence
  chemically synthesized
ctcttccttgccttccagcatg

SEQ ID NO: 1202446 - DNA, 22 bp, Artificial Sequence
  chemically synthesized
ttccttgccttccagcatgatt

SEQ ID NO: 1202447 - DNA, 22 bp, Artificial Sequence
  chemically synthesized
gggaagcttcacaatcatgctg

SEQ ID NO: 1202448 - DNA, 22 bp, Artificial Sequence
  chemically synthesized
ccttgccttccagcatgattgt

SEQ ID NO: 1202449 - DNA, 22 bp, Artificial Sequence
  chemically synthesized
cttgccttccagcatgattgtg

SEQ ID NO: 1202450 - DNA, 22 bp, Artificial Sequence
  chemically synthesized
gccttccagcatgattgtgaag

SEQ ID NO: 1202451 - DNA, 22 bp, Artificial Sequence
  chemically synthesized
ccttccagcatgattgtgaagc

SEQ ID NO: 1202452 - DNA, 22 bp, Artificial Sequence
  chemically synthesized
cacgtagctagggaagcttcac

SEQ ID NO: 1202453 - DNA, 22 bp, Artificial Sequence
  chemically synthesized
ccagcatgattgtgaagcttcc

SEQ ID NO: 1202454 - DNA, 22 bp, Artificial Sequence
  chemically synthesized
cagcatgattgtgaagcttccc

SEQ ID NO: 1202455 - DNA, 22 bp, Artificial Sequence
  chemically synthesized
gagttccacgtagctagggaag

SEQ ID NO: 1202456 - DNA, 22 bp, Artificial Sequence
  chemically synthesized
agagttccacgtagctagggaa

SEQ ID NO: 1202457 - DNA, 22 bp, Artificial Sequence
  chemically synthesized
tgaagcttccctagctacgtgg

SEQ ID NO: 1202458 - DNA, 22 bp, Artificial Sequence
  chemically synthesized
atggacttagagttccacgtag

SEQ ID NO: 1202459 - DNA, 22 bp, Artificial Sequence
  chemically synthesized
aatggacttagagttccacgta

SEQ ID NO: 1202460 - DNA, 22 bp, Artificial Sequence
  chemically synthesized
ccctagctacgtggaactctaa

SEQ ID NO: 1202461 - DNA, 22 bp, Artificial Sequence
  chemically synthesized
cctagctacgtggaactctaag

SEQ ID NO: 1202462 - DNA, 22 bp, Artificial Sequence
  chemically synthesized
gctacgtggaactctaagtcca

SEQ ID NO: 1202463 - DNA, 22 bp, Artificial Sequence
  chemically synthesized
cgtggaactctaagtccattaa

SEQ ID NO: 1202464 - DNA, 22 bp, Artificial Sequence
  chemically synthesized
tacaggaaaaagagtttaatgg

SEQ ID NO: 1202465 - DNA, 22 bp, Artificial Sequence
  chemically synthesized
atacaggaaaaagagtttaatg

SEQ ID NO: 1202466 - DNA, 22 bp, Artificial Sequence
  chemically synthesized
taagtccattaaactctttttc

SEQ ID NO: 1202467 - DNA, 22 bp, Artificial Sequence
  chemically synthesized
agtccattaaactctttttcct

SEQ ID NO: 1202468 - DNA, 22 bp, Artificial Sequence
  chemically synthesized
aactctttttcctgtataaatt

SEQ ID NO: 1202469 - DNA, 22 bp, Artificial Sequence
  chemically synthesized
tttttcctgtataaattatcca

SEQ ID NO: 1202470 - DNA, 22 bp, Artificial Sequence
  chemically synthesized
tttcctgtataaattatccatt

SEQ ID NO: 1202471 - DNA, 22 bp, Artificial Sequence
  chemically synthesized
ttcctgtataaattatccattc

SEQ ID NO: 1202472 - DNA, 22 bp, Artificial Sequence
  chemically synthesized
tcctgtataaattatccattct

SEQ ID NO: 1202473 - DNA, 22 bp, Artificial Sequence
  chemically synthesized
cctgtataaattatccattctc

SEQ ID NO: 1202474 - DNA, 22 bp, Artificial Sequence
  chemically synthesized
ctgtataaattatccattctct

SEQ ID NO: 1202475 - DNA, 22 bp, Artificial Sequence
  chemically synthesized
ataaagtcatgccagagaatgg

SEQ ID NO: 1202476 - DNA, 22 bp, Artificial Sequence
  chemically synthesized
tataaattatccattctctggc

SEQ ID NO: 1202477 - DNA, 22 bp, Artificial Sequence
  chemically synthesized
ctgataaagtcatgccagagaa

SEQ ID NO: 1202478 - DNA, 22 bp, Artificial Sequence
  chemically synthesized
tactgctgataaagtcatgcca

SEQ ID NO: 1202479 - DNA, 22 bp, Artificial Sequence
  chemically synthesized
atactgctgataaagtcatgcc

SEQ ID NO: 1202480 - DNA, 22 bp, Artificial Sequence
  chemically synthesized
tatactgctgataaagtcatgc

SEQ ID NO: 1202481 - DNA, 22 bp, Artificial Sequence
  chemically synthesized
tccattctctggcatgacttta

SEQ ID NO: 1202482 - DNA, 22 bp, Artificial Sequence
  chemically synthesized
ttatactgctgataaagtcatg

SEQ ID NO: 1202483 - DNA, 22 bp, Artificial Sequence
  chemically synthesized
tttttatactgctgataaagtc

SEQ ID NO: 1202484 - DNA, 22 bp, Artificial Sequence
  chemically synthesized
gtttttatactgctgataaagt

SEQ ID NO: 1202485 - DNA, 22 bp, Artificial Sequence
  chemically synthesized
tctggcatgactttatcagcag

SEQ ID NO: 1202486 - DNA, 22 bp, Artificial Sequence
  chemically synthesized
atttgtttttatactgctgata

SEQ ID NO: 1202487 - DNA, 22 bp, Artificial Sequence
  chemically synthesized
tggcatgactttatcagcagta

SEQ ID NO: 1202488 - DNA, 22 bp, Artificial Sequence
  chemically synthesized
gcatgactttatcagcagtata

SEQ ID NO: 1202489 - DNA, 22 bp, Artificial Sequence
  chemically synthesized
tattaatttgtttttatactgc

SEQ ID NO: 1202490 - DNA, 22 bp, Artificial Sequence
  chemically synthesized
actgtattaatttgtttttata

SEQ ID NO: 1202491 - DNA, 22 bp, Artificial Sequence
  chemically synthesized
tatcagcagtataaaaacaaat

SEQ ID NO: 1202492 - DNA, 22 bp, Artificial Sequence
  chemically synthesized
atcagcagtataaaaacaaatt

SEQ ID NO: 1202493 - DNA, 22 bp, Artificial Sequence
  chemically synthesized
tcagcagtataaaaacaaatta

SEQ ID NO: 1202494 - DNA, 22 bp, Artificial Sequence
  chemically synthesized
gtaccaattcactgtattaatt

SEQ ID NO: 1202495 - DNA, 22 bp, Artificial Sequence
  chemically synthesized
ctggtaccaattcactgtatta

SEQ ID NO: 1202496 - DNA, 22 bp, Artificial Sequence
  chemically synthesized
tactggtaccaattcactgtat

SEQ ID NO: 1202497 - DNA, 22 bp, Artificial Sequence
  chemically synthesized
atacagtgaattggtaccagta

SEQ ID NO: 1202498 - DNA, 22 bp, Artificial Sequence
  chemically synthesized
agcagcaccccactctactggt

SEQ ID NO: 1202499 - DNA, 22 bp, Artificial Sequence
  chemically synthesized
cagcagcaccccactctactgg

SEQ ID NO: 1202500 - DNA, 22 bp, Artificial Sequence
  chemically synthesized
tcagcagcaccccactctactg

SEQ ID NO: 1202501 - DNA, 22 bp, Artificial Sequence
  chemically synthesized
ttcagcagcaccccactctact

SEQ ID NO: 1202502 - DNA, 22 bp, Artificial Sequence
  chemically synthesized
gtaccagtagagtggggtgctg

SEQ ID NO: 1202503 - DNA, 22 bp, Artificial Sequence
  chemically synthesized
acgtgtcttttcagcagcaccc

SEQ ID NO: 1202504 - DNA, 22 bp, Artificial Sequence
  chemically synthesized
cacgtgtcttttcagcagcacc

SEQ ID NO: 1202505 - DNA, 22 bp, Artificial Sequence
  chemically synthesized
tcacgtgtcttttcagcagcac

SEQ ID NO: 1202506 - DNA, 22 bp, Artificial Sequence
  chemically synthesized
cacattttcacgtgtcttttca

SEQ ID NO: 1202507 - DNA, 22 bp, Artificial Sequence
  chemically synthesized
ccacattttcacgtgtcttttc

SEQ ID NO: 1202508 - DNA, 22 bp, Artificial Sequence
  chemically synthesized
cttccacattttcacgtgtctt

SEQ ID NO: 1202509 - DNA, 22 bp, Artificial Sequence
  chemically synthesized
ctgaaaagacacgtgaaaatgt

SEQ ID NO: 1202510 - DNA, 22 bp, Artificial Sequence
  chemically synthesized
caaagttgcttccacattttca

SEQ ID NO: 1202511 - DNA, 22 bp, Artificial Sequence
  chemically synthesized
aaaagacacgtgaaaatgtgga

SEQ ID NO: 1202512 - DNA, 22 bp, Artificial Sequence
  chemically synthesized
cccagttccaaagttgcttcca

SEQ ID NO: 1202513 - DNA, 22 bp, Artificial Sequence
  chemically synthesized
ttacccagttccaaagttgctt

SEQ ID NO: 1202514 - DNA, 22 bp, Artificial Sequence
  chemically synthesized
cctgttacccagttccaaagtt

SEQ ID NO: 1202515 - DNA, 22 bp, Artificial Sequence
  chemically synthesized
tgcctgttacccagttccaaag

SEQ ID NO: 1202516 - DNA, 22 bp, Artificial Sequence
  chemically synthesized
caacctctgcctgttacccagt

SEQ ID NO: 1202517 - DNA, 22 bp, Artificial Sequence
  chemically synthesized
ttgcaacctctgcctgttaccc

SEQ ID NO: 1202518 - DNA, 22 bp, Artificial Sequence
  chemically synthesized
tggaactgggtaacaggcagag

SEQ ID NO: 1202519 - DNA, 22 bp, Artificial Sequence
  chemically synthesized
ggaactgggtaacaggcagagg

SEQ ID NO: 1202520 - DNA, 22 bp, Artificial Sequence
  chemically synthesized
aaactgttgcaacctctgcctg

SEQ ID NO: 1202521 - DNA, 22 bp, Artificial Sequence
  chemically synthesized
gaactgggtaacaggcagaggt

SEQ ID NO: 1202522 - DNA, 22 bp, Artificial Sequence
  chemically synthesized
tcaaactgttgcaacctctgcc

SEQ ID NO: 1202523 - DNA, 22 bp, Artificial Sequence
  chemically synthesized
ggtaacaggcagaggttgcaac

SEQ ID NO: 1202524 - DNA, 22 bp, Artificial Sequence
  chemically synthesized
agctctcaaactgttgcaacct

SEQ ID NO: 1202525 - DNA, 22 bp, Artificial Sequence
  chemically synthesized
tgagctctcaaactgttgcaac

SEQ ID NO: 1202526 - DNA, 22 bp, Artificial Sequence
  chemically synthesized
ctgagctctcaaactgttgcaa

SEQ ID NO: 1202527 - DNA, 22 bp, Artificial Sequence
  chemically synthesized
tcttctgagctctcaaactgtt

SEQ ID NO: 1202528 - DNA, 22 bp, Artificial Sequence
  chemically synthesized
ctgtcttctgagctctcaaact

SEQ ID NO: 1202529 - DNA, 22 bp, Artificial Sequence
  chemically synthesized
cctgtcttctgagctctcaaac

SEQ ID NO: 1202530 - DNA, 22 bp, Artificial Sequence
  chemically synthesized
tcctgtcttctgagctctcaaa

SEQ ID NO: 1202531 - DNA, 22 bp, Artificial Sequence
  chemically synthesized
caacagtttgagagctcagaag

SEQ ID NO: 1202532 - DNA, 22 bp, Artificial Sequence
  chemically synthesized
ccacattttcctgtcttctgag

SEQ ID NO: 1202533 - DNA, 22 bp, Artificial Sequence
  chemically synthesized
cccacattttcctgtcttctga

SEQ ID NO: 1202534 - DNA, 22 bp, Artificial Sequence
  chemically synthesized
tcccacattttcctgtcttctg

SEQ ID NO: 1202535 - DNA, 22 bp, Artificial Sequence
  chemically synthesized
gagagctcagaagacaggaaaa

SEQ ID NO: 1202536 - DNA, 22 bp, Artificial Sequence
  chemically synthesized
agagctcagaagacaggaaaat

SEQ ID NO: 1202537 - DNA, 22 bp, Artificial Sequence
  chemically synthesized
agaagacaggaaaatgtgggaa

SEQ ID NO: 1202538 - DNA, 22 bp, Artificial Sequence
  chemically synthesized
ggaagtcccaaactttcccaca

SEQ ID NO: 1202539 - DNA, 22 bp, Artificial Sequence
  chemically synthesized
taggaagtcccaaactttccca

SEQ ID NO: 1202540 - DNA, 22 bp, Artificial Sequence
  chemically synthesized
aagtctctaggaagtcccaaac

SEQ ID NO: 1202541 - DNA, 22 bp, Artificial Sequence
  chemically synthesized
ttcaagtctctaggaagtccca

SEQ ID NO: 1202542 - DNA, 22 bp, Artificial Sequence
  chemically synthesized
gtcaaagctattcaagtctcta

SEQ ID NO: 1202543 - DNA, 22 bp, Artificial Sequence
  chemically synthesized
ggtcaaagctattcaagtctct

SEQ ID NO: 1202544 - DNA, 22 bp, Artificial Sequence
  chemically synthesized
gggacttcctagagacttgaat

SEQ ID NO: 1202545 - DNA, 22 bp, Artificial Sequence
  chemically synthesized
ggacttcctagagacttgaata

SEQ ID NO: 1202546 - DNA, 22 bp, Artificial Sequence
  chemically synthesized
cctagagacttgaatagctttg

SEQ ID NO: 1202547 - DNA, 22 bp, Artificial Sequence
  chemically synthesized
ctagagacttgaatagctttga

SEQ ID NO: 1202548 - DNA, 22 bp, Artificial Sequence
  chemically synthesized
tcagcatcttggtcaaagctat

SEQ ID NO: 1202549 - DNA, 22 bp, Artificial Sequence
  chemically synthesized
gagacttgaatagctttgacca

SEQ ID NO: 1202550 - DNA, 22 bp, Artificial Sequence
  chemically synthesized
catcattatcagcatcttggtc

SEQ ID NO: 1202551 - DNA, 22 bp, Artificial Sequence
  chemically synthesized
gaatagctttgaccaagatgct

SEQ ID NO: 1202552 - DNA, 22 bp, Artificial Sequence
  chemically synthesized
tacatcattatcagcatcttgg

SEQ ID NO: 1202553 - DNA, 22 bp, Artificial Sequence
  chemically synthesized
aatagctttgaccaagatgctg

SEQ ID NO: 1202554 - DNA, 22 bp, Artificial Sequence
  chemically synthesized
tctacatcattatcagcatctt

SEQ ID NO: 1202555 - DNA, 22 bp, Artificial Sequence
  chemically synthesized
attctctacatcattatcagca

SEQ ID NO: 1202556 - DNA, 22 bp, Artificial Sequence
  chemically synthesized
cattctctacatcattatcagc

SEQ ID NO: 1202557 - DNA, 22 bp, Artificial Sequence
  chemically synthesized
tgaccaagatgctgataatgat

SEQ ID NO: 1202558 - DNA, 22 bp, Artificial Sequence
  chemically synthesized
gaccaagatgctgataatgatg

SEQ ID NO: 1202559 - DNA, 22 bp, Artificial Sequence
  chemically synthesized
accaagatgctgataatgatgt

SEQ ID NO: 1202560 - DNA, 22 bp, Artificial Sequence
  chemically synthesized
gatttcattctctacatcatta

SEQ ID NO: 1202561 - DNA, 22 bp, Artificial Sequence
  chemically synthesized
ggatttcattctctacatcatt

SEQ ID NO: 1202562 - DNA, 22 bp, Artificial Sequence
  chemically synthesized
agcttggatttcattctctaca

SEQ ID NO: 1202563 - DNA, 22 bp, Artificial Sequence
  chemically synthesized
ataatgatgtagagaatgaaat

SEQ ID NO: 1202564 - DNA, 22 bp, Artificial Sequence
  chemically synthesized
agaccatctcagcttggatttc

SEQ ID NO: 1202565 - DNA, 22 bp, Artificial Sequence
  chemically synthesized
tctgagaccatctcagcttgga

SEQ ID NO: 1202566 - DNA, 22 bp, Artificial Sequence
  chemically synthesized
tatctgagaccatctcagcttg

SEQ ID NO: 1202567 - DNA, 22 bp, Artificial Sequence
  chemically synthesized
atctctatctgagaccatctca

SEQ ID NO: 1202568 - DNA, 22 bp, Artificial Sequence
  chemically synthesized
ctcatctctatctgagaccatc

SEQ ID NO: 1202569 - DNA, 22 bp, Artificial Sequence
  chemically synthesized
agatggtctcagatagagatga

SEQ ID NO: 1202570 - DNA, 22 bp, Artificial Sequence
  chemically synthesized
ccaacaagttgctcatctctat

SEQ ID NO: 1202571 - DNA, 22 bp, Artificial Sequence
  chemically synthesized
gggctcccaacaagttgctcat

SEQ ID NO: 1202572 - DNA, 22 bp, Artificial Sequence
  chemically synthesized
ttcgggctcccaacaagttgct

SEQ ID NO: 1202573 - DNA, 22 bp, Artificial Sequence
  chemically synthesized
agatagagatgagcaacttgtt

SEQ ID NO: 1202574 - DNA, 22 bp, Artificial Sequence
  chemically synthesized
gttcgggctcccaacaagttgc

SEQ ID NO: 1202575 - DNA, 22 bp, Artificial Sequence
  chemically synthesized
tgttcgggctcccaacaagttg

SEQ ID NO: 1202576 - DNA, 22 bp, Artificial Sequence
  chemically synthesized
ttgttcgggctcccaacaagtt

SEQ ID NO: 1202577 - DNA, 22 bp, Artificial Sequence
  chemically synthesized
gttgggagcccgaacaaaagtg

SEQ ID NO: 1202578 - DNA, 22 bp, Artificial Sequence
  chemically synthesized
ttgggagcccgaacaaaagtga

SEQ ID NO: 1202579 - DNA, 22 bp, Artificial Sequence
  chemically synthesized
aaatataatgagtcacttttgt

SEQ ID NO: 1202580 - DNA, 22 bp, Artificial Sequence
  chemically synthesized
ggagcccgaacaaaagtgactc

SEQ ID NO: 1202581 - DNA, 22 bp, Artificial Sequence
  chemically synthesized
ctaaaatataatgagtcacttt

SEQ ID NO: 1202582 - DNA, 22 bp, Artificial Sequence
  chemically synthesized
gctaaaatataatgagtcactt

SEQ ID NO: 1202583 - DNA, 22 bp, Artificial Sequence
  chemically synthesized
tgctaaaatataatgagtcact

SEQ ID NO: 1202584 - DNA, 22 bp, Artificial Sequence
  chemically synthesized
tttgctaaaatataatgagtca

SEQ ID NO: 1202585 - DNA, 22 bp, Artificial Sequence
  chemically synthesized
ccagtctctttgctaaaatata

SEQ ID NO: 1202586 - DNA, 22 bp, Artificial Sequence
  chemically synthesized
attatattttagcaaagagact

SEQ ID NO: 1202587 - DNA, 22 bp, Artificial Sequence
  chemically synthesized
tattttagcaaagagactggga

SEQ ID NO: 1202588 - DNA, 22 bp, Artificial Sequence
  chemically synthesized
tagcaaagagactgggagcatt

SEQ ID NO: 1202589 - DNA, 22 bp, Artificial Sequence
  chemically synthesized
gggcaggagcaaaatgctccca

SEQ ID NO: 1202590 - DNA, 22 bp, Artificial Sequence
  chemically synthesized
agcaaagagactgggagcattt

SEQ ID NO: 1202591 - DNA, 22 bp, Artificial Sequence
  chemically synthesized
gcaaagagactgggagcatttt

SEQ ID NO: 1202592 - DNA, 22 bp, Artificial Sequence
  chemically synthesized
tagggcaggagcaaaatgctcc

SEQ ID NO: 1202593 - DNA, 22 bp, Artificial Sequence
  chemically synthesized
taactctagggcaggagcaaaa

SEQ ID NO: 1202594 - DNA, 22 bp, Artificial Sequence
  chemically synthesized
cctataactctagggcaggagc

SEQ ID NO: 1202595 - DNA, 22 bp, Artificial Sequence
  chemically synthesized
ggagcattttgctcctgcccta

SEQ ID NO: 1202596 - DNA, 22 bp, Artificial Sequence
  chemically synthesized
aaagttccctataactctaggg

SEQ ID NO: 1202597 - DNA, 22 bp, Artificial Sequence
  chemically synthesized
tgctcctgccctagagttatag

SEQ ID NO: 1202598 - DNA, 22 bp, Artificial Sequence
  chemically synthesized
gctcctgccctagagttatagg

SEQ ID NO: 1202599 - DNA, 22 bp, Artificial Sequence
  chemically synthesized
ctcctgccctagagttataggg

SEQ ID NO: 1202600 - DNA, 22 bp, Artificial Sequence
  chemically synthesized
aagctcaaagttccctataact

SEQ ID NO: 1202601 - DNA, 22 bp, Artificial Sequence
  chemically synthesized
tcaagctcaaagttccctataa

SEQ ID NO: 1202602 - DNA, 22 bp, Artificial Sequence
  chemically synthesized
ctgccctagagttatagggaac

SEQ ID NO: 1202603 - DNA, 22 bp, Artificial Sequence
  chemically synthesized
ccctagagttatagggaacttt

SEQ ID NO: 1202604 - DNA, 22 bp, Artificial Sequence
  chemically synthesized
gagttatagggaactttgagct

SEQ ID NO: 1202605 - DNA, 22 bp, Artificial Sequence
  chemically synthesized
aatcacccctctcaagctcaaa

SEQ ID NO: 1202606 - DNA, 22 bp, Artificial Sequence
  chemically synthesized
tagggaactttgagcttgagag

SEQ ID NO: 1202607 - DNA, 22 bp, Artificial Sequence
  chemically synthesized
tgagcttgagaggggtgattta

SEQ ID NO: 1202608 - DNA, 22 bp, Artificial Sequence
  chemically synthesized
gagcttgagaggggtgatttag

SEQ ID NO: 1202609 - DNA, 22 bp, Artificial Sequence
  chemically synthesized
agcttgagaggggtgatttagc

SEQ ID NO: 1202610 - DNA, 22 bp, Artificial Sequence
  chemically synthesized
ccaccagataacgctaaatcac

SEQ ID NO: 1202611 - DNA, 22 bp, Artificial Sequence
  chemically synthesized
tcccaccagataacgctaaatc

SEQ ID NO: 1202612 - DNA, 22 bp, Artificial Sequence
  chemically synthesized
ctcccaccagataacgctaaat

SEQ ID NO: 1202613 - DNA, 22 bp, Artificial Sequence
  chemically synthesized
gagaggggtgatttagcgttat

SEQ ID NO: 1202614 - DNA, 22 bp, Artificial Sequence
  chemically synthesized
agaggggtgatttagcgttatc

SEQ ID NO: 1202615 - DNA, 22 bp, Artificial Sequence
  chemically synthesized
gaagtttctcccaccagataac

SEQ ID NO: 1202616 - DNA, 22 bp, Artificial Sequence
  chemically synthesized
agaagtttctcccaccagataa

SEQ ID NO: 1202617 - DNA, 22 bp, Artificial Sequence
  chemically synthesized
cttagaagtttctcccaccaga

SEQ ID NO: 1202618 - DNA, 22 bp, Artificial Sequence
  chemically synthesized
ctgcttagaagtttctcccacc

SEQ ID NO: 1202619 - DNA, 22 bp, Artificial Sequence
  chemically synthesized
gctgcttagaagtttctcccac

SEQ ID NO: 1202620 - DNA, 22 bp, Artificial Sequence
  chemically synthesized
agcgttatctggtgggagaaac

SEQ ID NO: 1202621 - DNA, 22 bp, Artificial Sequence
  chemically synthesized
tgctgcttagaagtttctccca

SEQ ID NO: 1202622 - DNA, 22 bp, Artificial Sequence
  chemically synthesized
gcgttatctggtgggagaaact

SEQ ID NO: 1202623 - DNA, 22 bp, Artificial Sequence
  chemically synthesized
tctggtgggagaaacttctaag

SEQ ID NO: 1202624 - DNA, 22 bp, Artificial Sequence
  chemically synthesized
acgaatgctttgctgcttagaa

SEQ ID NO: 1202625 - DNA, 22 bp, Artificial Sequence
  chemically synthesized
gtgggagaaacttctaagcagc

SEQ ID NO: 1202626 - DNA, 22 bp, Artificial Sequence
  chemically synthesized
ctaagcagcaaagcattcgtga

SEQ ID NO: 1202627 - DNA, 22 bp, Artificial Sequence
  chemically synthesized
taagcagcaaagcattcgtgag

SEQ ID NO: 1202628 - DNA, 22 bp, Artificial Sequence
  chemically synthesized
agcagcaaagcattcgtgaggt

SEQ ID NO: 1202629 - DNA, 22 bp, Artificial Sequence
  chemically synthesized
acaggacccaagtcacctcacg

SEQ ID NO: 1202630 - DNA, 22 bp, Artificial Sequence
  chemically synthesized
aacaggacccaagtcacctcac

SEQ ID NO: 1202631 - DNA, 22 bp, Artificial Sequence
  chemically synthesized
aatgccttaacaggacccaagt

SEQ ID NO: 1202632 - DNA, 22 bp, Artificial Sequence
  chemically synthesized
gtgaggtgacttgggtcctgtt

SEQ ID NO: 1202633 - DNA, 22 bp, Artificial Sequence
  chemically synthesized
aaactgaatgccttaacaggac

SEQ ID NO: 1202634 - DNA, 22 bp, Artificial Sequence
  chemically synthesized
aaaactgaatgccttaacagga

SEQ ID NO: 1202635 - DNA, 22 bp, Artificial Sequence
  chemically synthesized
taaaactgaatgccttaacagg

SEQ ID NO: 1202636 - DNA, 22 bp, Artificial Sequence
  chemically synthesized
ttaaaactgaatgccttaacag

SEQ ID NO: 1202637 - DNA, 22 bp, Artificial Sequence
  chemically synthesized
ccttttaaaactgaatgcctta

SEQ ID NO: 1202638 - DNA, 22 bp, Artificial Sequence
  chemically synthesized
cccttttaaaactgaatgcctt

SEQ ID NO: 1202639 - DNA, 22 bp, Artificial Sequence
  chemically synthesized
gggtcctgttaaggcattcagt

SEQ ID NO: 1202640 - DNA, 22 bp, Artificial Sequence
  chemically synthesized
ggtcctgttaaggcattcagtt

SEQ ID NO: 1202641 - DNA, 22 bp, Artificial Sequence
  chemically synthesized
tttcccttttaaaactgaatgc

SEQ ID NO: 1202642 - DNA, 22 bp, Artificial Sequence
  chemically synthesized
tgtttcccttttaaaactgaat

SEQ ID NO: 1202643 - DNA, 22 bp, Artificial Sequence
  chemically synthesized
ttaaggcattcagttttaaaag

SEQ ID NO: 1202644 - DNA, 22 bp, Artificial Sequence
  chemically synthesized
tgctctgtttcccttttaaaac

SEQ ID NO: 1202645 - DNA, 22 bp, Artificial Sequence
  chemically synthesized
atgctctgtttcccttttaaaa

SEQ ID NO: 1202646 - DNA, 22 bp, Artificial Sequence
  chemically synthesized
tatgctctgtttcccttttaaa

SEQ ID NO: 1202647 - DNA, 22 bp, Artificial Sequence
  chemically synthesized
aggcattcagttttaaaaggga

SEQ ID NO: 1202648 - DNA, 22 bp, Artificial Sequence
  chemically synthesized
ttatgctctgtttcccttttaa

SEQ ID NO: 1202649 - DNA, 22 bp, Artificial Sequence
  chemically synthesized
caaacttttatgctctgtttcc

SEQ ID NO: 1202650 - DNA, 22 bp, Artificial Sequence
  chemically synthesized
agttttaaaagggaaacagagc

SEQ ID NO: 1202651 - DNA, 22 bp, Artificial Sequence
  chemically synthesized
ccaaacttttatgctctgtttc

SEQ ID NO: 1202652 - DNA, 22 bp, Artificial Sequence
  chemically synthesized
tccaaacttttatgctctgttt

SEQ ID NO: 1202653 - DNA, 22 bp, Artificial Sequence
  chemically synthesized
ttccaaacttttatgctctgtt

SEQ ID NO: 1202654 - DNA, 22 bp, Artificial Sequence
  chemically synthesized
taaaagggaaacagagcataaa

SEQ ID NO: 1202655 - DNA, 22 bp, Artificial Sequence
  chemically synthesized
aaaagggaaacagagcataaaa

SEQ ID NO: 1202656 - DNA, 22 bp, Artificial Sequence
  chemically synthesized
aaagggaaacagagcataaaag

SEQ ID NO: 1202657 - DNA, 22 bp, Artificial Sequence
  chemically synthesized
taatttttccaaacttttatgc

SEQ ID NO: 1202658 - DNA, 22 bp, Artificial Sequence
  chemically synthesized
tcaggctgtaatttttccaaac

SEQ ID NO: 1202659 - DNA, 22 bp, Artificial Sequence
  chemically synthesized
tcacattgtcaggctgtaattt

SEQ ID NO: 1202660 - DNA, 22 bp, Artificial Sequence
  chemically synthesized
atcacattgtcaggctgtaatt

SEQ ID NO: 1202661 - DNA, 22 bp, Artificial Sequence
  chemically synthesized
tatcacattgtcaggctgtaat

SEQ ID NO: 1202662 - DNA, 22 bp, Artificial Sequence
  chemically synthesized
ttatcacattgtcaggctgtaa

SEQ ID NO: 1202663 - DNA, 22 bp, Artificial Sequence
  chemically synthesized
tttatcacattgtcaggctgta

SEQ ID NO: 1202664 - DNA, 22 bp, Artificial Sequence
  chemically synthesized
ttttatcacattgtcaggctgt

SEQ ID NO: 1202665 - DNA, 22 bp, Artificial Sequence
  chemically synthesized
ttttttatcacattgtcaggct

SEQ ID NO: 1202666 - DNA, 22 bp, Artificial Sequence
  chemically synthesized
ggaaaaattacagcctgacaat

SEQ ID NO: 1202667 - DNA, 22 bp, Artificial Sequence
  chemically synthesized
cttttttatcacattgtcaggc

SEQ ID NO: 1202668 - DNA, 22 bp, Artificial Sequence
  chemically synthesized
gaaaaattacagcctgacaatg

SEQ ID NO: 1202669 - DNA, 22 bp, Artificial Sequence
  chemically synthesized
tcttttttatcacattgtcagg

SEQ ID NO: 1202670 - DNA, 22 bp, Artificial Sequence
  chemically synthesized
cagcctgacaatgtgataaaaa

SEQ ID NO: 1202671 - DNA, 22 bp, Artificial Sequence
  chemically synthesized
agaaagtgtgattttctttttt

SEQ ID NO: 1202672 - DNA, 22 bp, Artificial Sequence
  chemically synthesized
acaatgtgataaaaaagaaaat

SEQ ID NO: 1202673 - DNA, 22 bp, Artificial Sequence
  chemically synthesized
tcagaaagtgtgattttctttt

SEQ ID NO: 1202674 - DNA, 22 bp, Artificial Sequence
  chemically synthesized
ctcagaaagtgtgattttcttt

SEQ ID NO: 1202675 - DNA, 22 bp, Artificial Sequence
  chemically synthesized
ttctcagaaagtgtgattttct

SEQ ID NO: 1202676 - DNA, 22 bp, Artificial Sequence
  chemically synthesized
cttctcagaaagtgtgattttc

SEQ ID NO: 1202677 - DNA, 22 bp, Artificial Sequence
  chemically synthesized
cagtgggcgtgaatttcttctc

SEQ ID NO: 1202678 - DNA, 22 bp, Artificial Sequence
  chemically synthesized
tgcagtgggcgtgaatttcttc

SEQ ID NO: 1202679 - DNA, 22 bp, Artificial Sequence
  chemically synthesized
ctgcagtgggcgtgaatttctt

SEQ ID NO: 1202680 - DNA, 22 bp, Artificial Sequence
  chemically synthesized
tctgagaagaaattcacgccca

SEQ ID NO: 1202681 - DNA, 22 bp, Artificial Sequence
  chemically synthesized
ctgagaagaaattcacgcccac

SEQ ID NO: 1202682 - DNA, 22 bp, Artificial Sequence
  chemically synthesized
tgagaagaaattcacgcccact

SEQ ID NO: 1202683 - DNA, 22 bp, Artificial Sequence
  chemically synthesized
tacaaatttctgcagtgggcgt

SEQ ID NO: 1202684 - DNA, 22 bp, Artificial Sequence
  chemically synthesized
agaagaaattcacgcccactgc

SEQ ID NO: 1202685 - DNA, 22 bp, Artificial Sequence
  chemically synthesized
atacaaatttctgcagtgggcg

SEQ ID NO: 1202686 - DNA, 22 bp, Artificial Sequence
  chemically synthesized
cttatacaaatttctgcagtgg

SEQ ID NO: 1202687 - DNA, 22 bp, Artificial Sequence
  chemically synthesized
ttacttatacaaatttctgcag

SEQ ID NO: 1202688 - DNA, 22 bp, Artificial Sequence
  chemically synthesized
gttacttatacaaatttctgca

SEQ ID NO: 1202689 - DNA, 22 bp, Artificial Sequence
  chemically synthesized
cttgttacttatacaaatttct

SEQ ID NO: 1202690 - DNA, 22 bp, Artificial Sequence
  chemically synthesized
acgcccactgcagaaatttgta

SEQ ID NO: 1202691 - DNA, 22 bp, Artificial Sequence
  chemically synthesized
agttccttgttacttatacaaa

SEQ ID NO: 1202692 - DNA, 22 bp, Artificial Sequence
  chemically synthesized
cagaaatttgtataagtaacaa

SEQ ID NO: 1202693 - DNA, 22 bp, Artificial Sequence
  chemically synthesized
acattcagttccttgttactta

SEQ ID NO: 1202694 - DNA, 22 bp, Artificial Sequence
  chemically synthesized
gtgattaacattcagttccttg

SEQ ID NO: 1202695 - DNA, 22 bp, Artificial Sequence
  chemically synthesized
ggtgattaacattcagttcctt

SEQ ID NO: 1202696 - DNA, 22 bp, Artificial Sequence
  chemically synthesized
gtataagtaacaaggaactgaa

SEQ ID NO: 1202697 - DNA, 22 bp, Artificial Sequence
  chemically synthesized
tataagtaacaaggaactgaat

SEQ ID NO: 1202698 - DNA, 22 bp, Artificial Sequence
  chemically synthesized
tcttggtgattaacattcagtt

SEQ ID NO: 1202699 - DNA, 22 bp, Artificial Sequence
  chemically synthesized
attgtcttggtgattaacattc

SEQ ID NO: 1202700 - DNA, 22 bp, Artificial Sequence
  chemically synthesized
tcattgtcttggtgattaacat

SEQ ID NO: 1202701 - DNA, 22 bp, Artificial Sequence
  chemically synthesized
ctcattgtcttggtgattaaca

SEQ ID NO: 1202702 - DNA, 22 bp, Artificial Sequence
  chemically synthesized
tctcattgtcttggtgattaac

SEQ ID NO: 1202703 - DNA, 22 bp, Artificial Sequence
  chemically synthesized
ttctcattgtcttggtgattaa

SEQ ID NO: 1202704 - DNA, 22 bp, Artificial Sequence
  chemically synthesized
aatgttaatcaccaagacaatg

SEQ ID NO: 1202705 - DNA, 22 bp, Artificial Sequence
  chemically synthesized
gagacatttttctcattgtctt

SEQ ID NO: 1202706 - DNA, 22 bp, Artificial Sequence
  chemically synthesized
atcaccaagacaatgagaaaaa

SEQ ID NO: 1202707 - DNA, 22 bp, Artificial Sequence
  chemically synthesized
acgtgccctggagacatttttc

SEQ ID NO: 1202708 - DNA, 22 bp, Artificial Sequence
  chemically synthesized
tgacgtgccctggagacatttt

SEQ ID NO: 1202709 - DNA, 22 bp, Artificial Sequence
  chemically synthesized
ccacaaaggtctctgacgtgcc

SEQ ID NO: 1202710 - DNA, 22 bp, Artificial Sequence
  chemically synthesized
cagggcacgtcagagacctttg

SEQ ID NO: 1202711 - DNA, 22 bp, Artificial Sequence
  chemically synthesized
cagacatgtgatgggaggggct

SEQ ID NO: 1202712 - DNA, 22 bp, Artificial Sequence
  chemically synthesized
aactccagacatgtgatgggag

SEQ ID NO: 1202713 - DNA, 22 bp, Artificial Sequence
  chemically synthesized
tgtggcagcccctcccatcaca

SEQ ID NO: 1202714 - DNA, 22 bp, Artificial Sequence
  chemically synthesized
gtggcagcccctcccatcacat

SEQ ID NO: 1202715 - DNA, 22 bp, Artificial Sequence
  chemically synthesized
tggcagcccctcccatcacatg

SEQ ID NO: 1202716 - DNA, 22 bp, Artificial Sequence
  chemically synthesized
ctaaactccagacatgtgatgg

SEQ ID NO: 1202717 - DNA, 22 bp, Artificial Sequence
  chemically synthesized
ctcctaaactccagacatgtga

SEQ ID NO: 1202718 - DNA, 22 bp, Artificial Sequence
  chemically synthesized
cctcctaaactccagacatgtg

SEQ ID NO: 1202719 - DNA, 22 bp, Artificial Sequence
  chemically synthesized
tcctcctaaactccagacatgt

SEQ ID NO: 1202720 - DNA, 22 bp, Artificial Sequence
  chemically synthesized
ttcctcctaaactccagacatg

SEQ ID NO: 1202721 - DNA, 22 bp, Artificial Sequence
  chemically synthesized
tttcctcctaaactccagacat

SEQ ID NO: 1202722 - DNA, 22 bp, Artificial Sequence
  chemically synthesized
ccatcacatgtctggagtttag

SEQ ID NO: 1202723 - DNA, 22 bp, Artificial Sequence
  chemically synthesized
gcccacaaaaccattttttcct

SEQ ID NO: 1202724 - DNA, 22 bp, Artificial Sequence
  chemically synthesized
gagtttaggaggaaaaaatggt

SEQ ID NO: 1202725 - DNA, 22 bp, Artificial Sequence
  chemically synthesized
ggcctagcccacaaaaccattt

SEQ ID NO: 1202726 - DNA, 22 bp, Artificial Sequence
  chemically synthesized
aggaggaaaaaatggttttgtg

SEQ ID NO: 1202727 - DNA, 22 bp, Artificial Sequence
  chemically synthesized
ggaggaaaaaatggttttgtgg

SEQ ID NO: 1202728 - DNA, 22 bp, Artificial Sequence
  chemically synthesized
cacaccacagagggaccctggg

SEQ ID NO: 1202729 - DNA, 22 bp, Artificial Sequence
  chemically synthesized
tgtgggctaggcccagggtccc

SEQ ID NO: 1202730 - DNA, 22 bp, Artificial Sequence
  chemically synthesized
gtgggctaggcccagggtccct

SEQ ID NO: 1202731 - DNA, 22 bp, Artificial Sequence
  chemically synthesized
tgggctaggcccagggtccctc

SEQ ID NO: 1202732 - DNA, 22 bp, Artificial Sequence
  chemically synthesized
ggctgcacaccacagagggacc

SEQ ID NO: 1202733 - DNA, 22 bp, Artificial Sequence
  chemically synthesized
taggctgcacaccacagaggga

SEQ ID NO: 1202734 - DNA, 22 bp, Artificial Sequence
  chemically synthesized
ggcccagggtccctctgtggtg

SEQ ID NO: 1202735 - DNA, 22 bp, Artificial Sequence
  chemically synthesized
tgtggtgtgcagcctagagact

SEQ ID NO: 1202736 - DNA, 22 bp, Artificial Sequence
  chemically synthesized
tggtgtgcagcctagagacttg

SEQ ID NO: 1202737 - DNA, 22 bp, Artificial Sequence
  chemically synthesized
ggacacagggcaccaagtctct

SEQ ID NO: 1202738 - DNA, 22 bp, Artificial Sequence
  chemically synthesized
gagtggctgggacacagggcac

SEQ ID NO: 1202739 - DNA, 22 bp, Artificial Sequence
  chemically synthesized
gagacttggtgccctgtgtccc

SEQ ID NO: 1202740 - DNA, 22 bp, Artificial Sequence
  chemically synthesized
gtcacagctggagtggctggga

SEQ ID NO: 1202741 - DNA, 22 bp, Artificial Sequence
  chemically synthesized
ggtgccctgtgtcccagccact

SEQ ID NO: 1202742 - DNA, 22 bp, Artificial Sequence
  chemically synthesized
agtcacagctggagtggctggg

SEQ ID NO: 1202743 - DNA, 22 bp, Artificial Sequence
  chemically synthesized
gtgccctgtgtcccagccactc

SEQ ID NO: 1202744 - DNA, 22 bp, Artificial Sequence
  chemically synthesized
tagtcacagctggagtggctgg

SEQ ID NO: 1202745 - DNA, 22 bp, Artificial Sequence
  chemically synthesized
ttagtcacagctggagtggctg

SEQ ID NO: 1202746 - DNA, 22 bp, Artificial Sequence
  chemically synthesized
tgtcccagccactccagctgtg

SEQ ID NO: 1202747 - DNA, 22 bp, Artificial Sequence
  chemically synthesized
ggccccttttagtcacagctgg

SEQ ID NO: 1202748 - DNA, 22 bp, Artificial Sequence
  chemically synthesized
tacctcggccccttttagtcac

SEQ ID NO: 1202749 - DNA, 22 bp, Artificial Sequence
  chemically synthesized
cagctgtgactaaaaggggccg

SEQ ID NO: 1202750 - DNA, 22 bp, Artificial Sequence
  chemically synthesized
tgactaaaaggggccgaggtac

SEQ ID NO: 1202751 - DNA, 22 bp, Artificial Sequence
  chemically synthesized
aagtaacagcccaagctgtacc

SEQ ID NO: 1202752 - DNA, 22 bp, Artificial Sequence
  chemically synthesized
aaaggggccgaggtacagcttg

SEQ ID NO: 1202753 - DNA, 22 bp, Artificial Sequence
  chemically synthesized
tgaagtaacagcccaagctgta

SEQ ID NO: 1202754 - DNA, 22 bp, Artificial Sequence
  chemically synthesized
cgccctctgaagtaacagccca

SEQ ID NO: 1202755 - DNA, 22 bp, Artificial Sequence
  chemically synthesized
ccgccctctgaagtaacagccc

SEQ ID NO: 1202756 - DNA, 22 bp, Artificial Sequence
  chemically synthesized
ggcttccgccctctgaagtaac

SEQ ID NO: 1202757 - DNA, 22 bp, Artificial Sequence
  chemically synthesized
gggcttccgccctctgaagtaa

SEQ ID NO: 1202758 - DNA, 22 bp, Artificial Sequence
  chemically synthesized
gggctgttacttcagagggcgg

SEQ ID NO: 1202759 - DNA, 22 bp, Artificial Sequence
  chemically synthesized
ggctgttacttcagagggcgga

SEQ ID NO: 1202760 - DNA, 22 bp, Artificial Sequence
  chemically synthesized
ccaaggcttgggcttccgccct

SEQ ID NO: 1202761 - DNA, 22 bp, Artificial Sequence
  chemically synthesized
ttacttcagagggcggaagccc

SEQ ID NO: 1202762 - DNA, 22 bp, Artificial Sequence
  chemically synthesized
cttcagagggcggaagcccaag

SEQ ID NO: 1202763 - DNA, 22 bp, Artificial Sequence
  chemically synthesized
cagagggcggaagcccaagcct

SEQ ID NO: 1202764 - DNA, 22 bp, Artificial Sequence
  chemically synthesized
agagggcggaagcccaagcctt

SEQ ID NO: 1202765 - DNA, 22 bp, Artificial Sequence
  chemically synthesized
aacacgacgtggaagctgccaa

SEQ ID NO: 1202766 - DNA, 22 bp, Artificial Sequence
  chemically synthesized
cgggctcaacacgacgtggaag

SEQ ID NO: 1202767 - DNA, 22 bp, Artificial Sequence
  chemically synthesized
ggcagcttccacgtcgtgttga

SEQ ID NO: 1202768 - DNA, 22 bp, Artificial Sequence
  chemically synthesized
gcagcttccacgtcgtgttgag

SEQ ID NO: 1202769 - DNA, 22 bp, Artificial Sequence
  chemically synthesized
tgcacctgcgggctcaacacga

SEQ ID NO: 1202770 - DNA, 22 bp, Artificial Sequence
  chemically synthesized
tgtgcacctgcgggctcaacac

SEQ ID NO: 1202771 - DNA, 22 bp, Artificial Sequence
  chemically synthesized
ctgtgcacctgcgggctcaaca

SEQ ID NO: 1202772 - DNA, 22 bp, Artificial Sequence
  chemically synthesized
ccacgtcgtgttgagcccgcag

SEQ ID NO: 1202773 - DNA, 22 bp, Artificial Sequence
  chemically synthesized
acttctgtgcacctgcgggctc

SEQ ID NO: 1202774 - DNA, 22 bp, Artificial Sequence
  chemically synthesized
cacgtcgtgttgagcccgcagg

SEQ ID NO: 1202775 - DNA, 22 bp, Artificial Sequence
  chemically synthesized
gacttctgtgcacctgcgggct

SEQ ID NO: 1202776 - DNA, 22 bp, Artificial Sequence
  chemically synthesized
ttgacttctgtgcacctgcggg

SEQ ID NO: 1202777 - DNA, 22 bp, Artificial Sequence
  chemically synthesized
agcccgcaggtgcacagaagtc

SEQ ID NO: 1202778 - DNA, 22 bp, Artificial Sequence
  chemically synthesized
ccaaaccgcagttcttgacttc

SEQ ID NO: 1202779 - DNA, 22 bp, Artificial Sequence
  chemically synthesized
ggcagaggttcccaaaccgcag

SEQ ID NO: 1202780 - DNA, 22 bp, Artificial Sequence
  chemically synthesized
aaatctaggcagaggttcccaa

SEQ ID NO: 1202781 - DNA, 22 bp, Artificial Sequence
  chemically synthesized
tgaaatctaggcagaggttccc

SEQ ID NO: 1202782 - DNA, 22 bp, Artificial Sequence
  chemically synthesized
cggtttgggaacctctgcctag

SEQ ID NO: 1202783 - DNA, 22 bp, Artificial Sequence
  chemically synthesized
catacatcctctgaaatctagg

SEQ ID NO: 1202784 - DNA, 22 bp, Artificial Sequence
  chemically synthesized
gggaacctctgcctagatttca

SEQ ID NO: 1202785 - DNA, 22 bp, Artificial Sequence
  chemically synthesized
ccatacatcctctgaaatctag

SEQ ID NO: 1202786 - DNA, 22 bp, Artificial Sequence
  chemically synthesized
ggaacctctgcctagatttcag

SEQ ID NO: 1202787 - DNA, 22 bp, Artificial Sequence
  chemically synthesized
tccatacatcctctgaaatcta

SEQ ID NO: 1202788 - DNA, 22 bp, Artificial Sequence
  chemically synthesized
ttccatacatcctctgaaatct

SEQ ID NO: 1202789 - DNA, 22 bp, Artificial Sequence
  chemically synthesized
tgcctagatttcagaggatgta

SEQ ID NO: 1202790 - DNA, 22 bp, Artificial Sequence
  chemically synthesized
cctagatttcagaggatgtatg

SEQ ID NO: 1202791 - DNA, 22 bp, Artificial Sequence
  chemically synthesized
gatttcagaggatgtatggaaa

SEQ ID NO: 1202792 - DNA, 22 bp, Artificial Sequence
  chemically synthesized
ggcatccaggtttttccataca

SEQ ID NO: 1202793 - DNA, 22 bp, Artificial Sequence
  chemically synthesized
cctgggcatccaggtttttcca

SEQ ID NO: 1202794 - DNA, 22 bp, Artificial Sequence
  chemically synthesized
cagaggatgtatggaaaaacct

SEQ ID NO: 1202795 - DNA, 22 bp, Artificial Sequence
  chemically synthesized
agaggatgtatggaaaaacctg

SEQ ID NO: 1202796 - DNA, 22 bp, Artificial Sequence
  chemically synthesized
tacctgggcatccaggtttttc

SEQ ID NO: 1202797 - DNA, 22 bp, Artificial Sequence
  chemically synthesized
ctacctgggcatccaggttttt

SEQ ID NO: 1202798 - DNA, 22 bp, Artificial Sequence
  chemically synthesized
cagcaaacttctacctgggcat

SEQ ID NO: 1202799 - DNA, 22 bp, Artificial Sequence
  chemically synthesized
cccctacagcaaacttctacct

SEQ ID NO: 1202800 - DNA, 22 bp, Artificial Sequence
  chemically synthesized
gatgcccaggtagaagtttgct

SEQ ID NO: 1202801 - DNA, 22 bp, Artificial Sequence
  chemically synthesized
catgagggccctgcccctacag

SEQ ID NO: 1202802 - DNA, 22 bp, Artificial Sequence
  chemically synthesized
tccatgagggccctgcccctac

SEQ ID NO: 1202803 - DNA, 22 bp, Artificial Sequence
  chemically synthesized
gctgtaggggcagggccctcat

SEQ ID NO: 1202804 - DNA, 22 bp, Artificial Sequence
  chemically synthesized
ctgtaggggcagggccctcatg

SEQ ID NO: 1202805 - DNA, 22 bp, Artificial Sequence
  chemically synthesized
gcagaggttctccatgagggcc

SEQ ID NO: 1202806 - DNA, 22 bp, Artificial Sequence
  chemically synthesized
taggggcagggccctcatggag

SEQ ID NO: 1202807 - DNA, 22 bp, Artificial Sequence
  chemically synthesized
ccctagcagaggttctccatga

SEQ ID NO: 1202808 - DNA, 22 bp, Artificial Sequence
  chemically synthesized
cactgccctagcagaggttctc

SEQ ID NO: 1202809 - DNA, 22 bp, Artificial Sequence
  chemically synthesized
gcactgccctagcagaggttct

SEQ ID NO: 1202810 - DNA, 22 bp, Artificial Sequence
  chemically synthesized
tgcactgccctagcagaggttc

SEQ ID NO: 1202811 - DNA, 22 bp, Artificial Sequence
  chemically synthesized
ttgcactgccctagcagaggtt

SEQ ID NO: 1202812 - DNA, 22 bp, Artificial Sequence
  chemically synthesized
ttttgcactgccctagcagagg

SEQ ID NO: 1202813 - DNA, 22 bp, Artificial Sequence
  chemically synthesized
cttttgcactgccctagcagag

SEQ ID NO: 1202814 - DNA, 22 bp, Artificial Sequence
  chemically synthesized
tcttttgcactgccctagcaga

SEQ ID NO: 1202815 - DNA, 22 bp, Artificial Sequence
  chemically synthesized
ttcttttgcactgccctagcag

SEQ ID NO: 1202816 - DNA, 22 bp, Artificial Sequence
  chemically synthesized
atggagaacctctgctagggca

SEQ ID NO: 1202817 - DNA, 22 bp, Artificial Sequence
  chemically synthesized
accccacatttttcttttgcac

SEQ ID NO: 1202818 - DNA, 22 bp, Artificial Sequence
  chemically synthesized
tgctagggcagtgcaaaagaaa

SEQ ID NO: 1202819 - DNA, 22 bp, Artificial Sequence
  chemically synthesized
taaccccacatttttcttttgc

SEQ ID NO: 1202820 - DNA, 22 bp, Artificial Sequence
  chemically synthesized
ctagggcagtgcaaaagaaaaa

SEQ ID NO: 1202821 - DNA, 22 bp, Artificial Sequence
  chemically synthesized
gggcagtgcaaaagaaaaatgt

SEQ ID NO: 1202822 - DNA, 22 bp, Artificial Sequence
  chemically synthesized
tgtgagggctctaaccccacat

SEQ ID NO: 1202823 - DNA, 22 bp, Artificial Sequence
  chemically synthesized
tgtgtgagggctctaaccccac

SEQ ID NO: 1202824 - DNA, 22 bp, Artificial Sequence
  chemically synthesized
gtagggtctctgtgtgagggct

SEQ ID NO: 1202825 - DNA, 22 bp, Artificial Sequence
  chemically synthesized
tagtagggtctctgtgtgaggg

SEQ ID NO: 1202826 - DNA, 22 bp, Artificial Sequence
  chemically synthesized
gagccctcacacagagacccta

SEQ ID NO: 1202827 - DNA, 22 bp, Artificial Sequence
  chemically synthesized
atagacagtgctctagtagggt

SEQ ID NO: 1202828 - DNA, 22 bp, Artificial Sequence
  chemically synthesized
taatagacagtgctctagtagg

SEQ ID NO: 1202829 - DNA, 22 bp, Artificial Sequence
  chemically synthesized
acacagagaccctactagagca

SEQ ID NO: 1202830 - DNA, 22 bp, Artificial Sequence
  chemically synthesized
atggctctaatagacagtgctc

SEQ ID NO: 1202831 - DNA, 22 bp, Artificial Sequence
  chemically synthesized
catggctctaatagacagtgct

SEQ ID NO: 1202832 - DNA, 22 bp, Artificial Sequence
  chemically synthesized
tcatggctctaatagacagtgc

SEQ ID NO: 1202833 - DNA, 22 bp, Artificial Sequence
  chemically synthesized
ttcatggctctaatagacagtg

SEQ ID NO: 1202834 - DNA, 22 bp, Artificial Sequence
  chemically synthesized
ttttcatggctctaatagacag

SEQ ID NO: 1202835 - DNA, 22 bp, Artificial Sequence
  chemically synthesized
ctagagcactgtctattagagc

SEQ ID NO: 1202836 - DNA, 22 bp, Artificial Sequence
  chemically synthesized
gagcactgtctattagagccat

SEQ ID NO: 1202837 - DNA, 22 bp, Artificial Sequence
  chemically synthesized
tctattagagccatgaaaagag

SEQ ID NO: 1202838 - DNA, 22 bp, Artificial Sequence
  chemically synthesized
gaggacagtggccctcttttca

SEQ ID NO: 1202839 - DNA, 22 bp, Artificial Sequence
  chemically synthesized
ttagagccatgaaaagagggcc

SEQ ID NO: 1202840 - DNA, 22 bp, Artificial Sequence
  chemically synthesized
gagccatgaaaagagggccact

SEQ ID NO: 1202841 - DNA, 22 bp, Artificial Sequence
  chemically synthesized
gggtctggaggacagtggccct

SEQ ID NO: 1202842 - DNA, 22 bp, Artificial Sequence
  chemically synthesized
tggggtctggaggacagtggcc

SEQ ID NO: 1202843 - DNA, 22 bp, Artificial Sequence
  chemically synthesized
ccattctggggtctggaggaca

SEQ ID NO: 1202844 - DNA, 22 bp, Artificial Sequence
  chemically synthesized
ccagtggatctaccattctggg

SEQ ID NO: 1202845 - DNA, 22 bp, Artificial Sequence
  chemically synthesized
tcctccagaccccagaatggta

SEQ ID NO: 1202846 - DNA, 22 bp, Artificial Sequence
  chemically synthesized
cagaccccagaatggtagatcc

SEQ ID NO: 1202847 - DNA, 22 bp, Artificial Sequence
  chemically synthesized
caagctgccagtggatctacca

SEQ ID NO: 1202848 - DNA, 22 bp, Artificial Sequence
  chemically synthesized
ggtgtgtgttgcaagctgccag

SEQ ID NO: 1202849 - DNA, 22 bp, Artificial Sequence
  chemically synthesized
ctcggtgtgtgttgcaagctgc

SEQ ID NO: 1202850 - DNA, 22 bp, Artificial Sequence
  chemically synthesized
cctcggtgtgtgttgcaagctg

SEQ ID NO: 1202851 - DNA, 22 bp, Artificial Sequence
  chemically synthesized
tcctcggtgtgtgttgcaagct

SEQ ID NO: 1202852 - DNA, 22 bp, Artificial Sequence
  chemically synthesized
tggctttcctcggtgtgtgttg

SEQ ID NO: 1202853 - DNA, 22 bp, Artificial Sequence
  chemically synthesized
gcagcttgcaacacacaccgag

SEQ ID NO: 1202854 - DNA, 22 bp, Artificial Sequence
  chemically synthesized
attgtggctttcctcggtgtgt

SEQ ID NO: 1202855 - DNA, 22 bp, Artificial Sequence
  chemically synthesized
gcattgattgtggctttcctcg

SEQ ID NO: 1202856 - DNA, 22 bp, Artificial Sequence
  chemically synthesized
gcaacacacaccgaggaaagcc

SEQ ID NO: 1202857 - DNA, 22 bp, Artificial Sequence
  chemically synthesized
caacacacaccgaggaaagcca

SEQ ID NO: 1202858 - DNA, 22 bp, Artificial Sequence
  chemically synthesized
atgagctggcattgattgtggc

SEQ ID NO: 1202859 - DNA, 22 bp, Artificial Sequence
  chemically synthesized
catgagctggcattgattgtgg

SEQ ID NO: 1202860 - DNA, 22 bp, Artificial Sequence
  chemically synthesized
tcatgagctggcattgattgtg

SEQ ID NO: 1202861 - DNA, 22 bp, Artificial Sequence
  chemically synthesized
gatgctttcatgagctggcatt

SEQ ID NO: 1202862 - DNA, 22 bp, Artificial Sequence
  chemically synthesized
ctggatgctttcatgagctggc

SEQ ID NO: 1202863 - DNA, 22 bp, Artificial Sequence
  chemically synthesized
cctcctggatgctttcatgagc

SEQ ID NO: 1202864 - DNA, 22 bp, Artificial Sequence
  chemically synthesized
agggtacagcctccctcctgga

SEQ ID NO: 1202865 - DNA, 22 bp, Artificial Sequence
  chemically synthesized
cagggtacagcctccctcctgg

SEQ ID NO: 1202866 - DNA, 22 bp, Artificial Sequence
  chemically synthesized
tcagggtacagcctccctcctg

SEQ ID NO: 1202867 - DNA, 22 bp, Artificial Sequence
  chemically synthesized
atgaaagcatccaggagggagg

SEQ ID NO: 1202868 - DNA, 22 bp, Artificial Sequence
  chemically synthesized
ttcagggtacagcctccctcct

SEQ ID NO: 1202869 - DNA, 22 bp, Artificial Sequence
  chemically synthesized
cggcttttcagggtacagcctc

SEQ ID NO: 1202870 - DNA, 22 bp, Artificial Sequence
  chemically synthesized
cccctgcggcttttcagggtac

SEQ ID NO: 1202871 - DNA, 22 bp, Artificial Sequence
  chemically synthesized
tgcccctgcggcttttcagggt

SEQ ID NO: 1202872 - DNA, 22 bp, Artificial Sequence
  chemically synthesized
ggccactctgcccctgcggctt

SEQ ID NO: 1202873 - DNA, 22 bp, Artificial Sequence
  chemically synthesized
gggccactctgcccctgcggct

SEQ ID NO: 1202874 - DNA, 22 bp, Artificial Sequence
  chemically synthesized
taccctgaaaagccgcaggggc

SEQ ID NO: 1202875 - DNA, 22 bp, Artificial Sequence
  chemically synthesized
aaaagccgcaggggcagagtgg

SEQ ID NO: 1202876 - DNA, 22 bp, Artificial Sequence
  chemically synthesized
acgtggtcttgggccactctgc

SEQ ID NO: 1202877 - DNA, 22 bp, Artificial Sequence
  chemically synthesized
atgcaagagaggggttcacgtg

SEQ ID NO: 1202878 - DNA, 22 bp, Artificial Sequence
  chemically synthesized
acatccaggtcatgctgatgca

SEQ ID NO: 1202879 - DNA, 22 bp, Artificial Sequence
  chemically synthesized
cgtatctcacatccaggtcatg

SEQ ID NO: 1202880 - DNA, 22 bp, Artificial Sequence
  chemically synthesized
tcttgcatcagcatgacctgga

SEQ ID NO: 1202881 - DNA, 22 bp, Artificial Sequence
  chemically synthesized
ttgcatcagcatgacctggatg

SEQ ID NO: 1202882 - DNA, 22 bp, Artificial Sequence
  chemically synthesized
actgcgtatctcacatccaggt

SEQ ID NO: 1202883 - DNA, 22 bp, Artificial Sequence
  chemically synthesized
gcatcagcatgacctggatgtg

SEQ ID NO: 1202884 - DNA, 22 bp, Artificial Sequence
  chemically synthesized
gactgcgtatctcacatccagg

SEQ ID NO: 1202885 - DNA, 22 bp, Artificial Sequence
  chemically synthesized
catcagcatgacctggatgtga

SEQ ID NO: 1202886 - DNA, 22 bp, Artificial Sequence
  chemically synthesized
tgactgcgtatctcacatccag

SEQ ID NO: 1202887 - DNA, 22 bp, Artificial Sequence
  chemically synthesized
ctttgactgcgtatctcacatc

SEQ ID NO: 1202888 - DNA, 22 bp, Artificial Sequence
  chemically synthesized
gatgtgagatacgcagtcaaag

SEQ ID NO: 1202889 - DNA, 22 bp, Artificial Sequence
  chemically synthesized
caaaatgatctcctttgactgc

SEQ ID NO: 1202890 - DNA, 22 bp, Artificial Sequence
  chemically synthesized
aagctccaaaatgatctccttt

SEQ ID NO: 1202891 - DNA, 22 bp, Artificial Sequence
  chemically synthesized
aaagctccaaaatgatctcctt

SEQ ID NO: 1202892 - DNA, 22 bp, Artificial Sequence
  chemically synthesized
tcaaatcttaaagctccaaaat

SEQ ID NO: 1202893 - DNA, 22 bp, Artificial Sequence
  chemically synthesized
tggagctttaagatttgacagc

SEQ ID NO: 1202894 - DNA, 22 bp, Artificial Sequence
  chemically synthesized
aaatccagcagggctgtcaaat

SEQ ID NO: 1202895 - DNA, 22 bp, Artificial Sequence
  chemically synthesized
ggagctttaagatttgacagcc

SEQ ID NO: 1202896 - DNA, 22 bp, Artificial Sequence
  chemically synthesized
gagctttaagatttgacagccc

SEQ ID NO: 1202897 - DNA, 22 bp, Artificial Sequence
  chemically synthesized
taagatttgacagccctgctgg

SEQ ID NO: 1202898 - DNA, 22 bp, Artificial Sequence
  chemically synthesized
aagatttgacagccctgctgga

SEQ ID NO: 1202899 - DNA, 22 bp, Artificial Sequence
  chemically synthesized
agatttgacagccctgctggat

SEQ ID NO: 1202900 - DNA, 22 bp, Artificial Sequence
  chemically synthesized
gacagccctgctggatttcaga

SEQ ID NO: 1202901 - DNA, 22 bp, Artificial Sequence
  chemically synthesized
acagccctgctggatttcagac

SEQ ID NO: 1202902 - DNA, 22 bp, Artificial Sequence
  chemically synthesized
agggcacatgcaagtctgaaat

SEQ ID NO: 1202903 - DNA, 22 bp, Artificial Sequence
  chemically synthesized
cagggcacatgcaagtctgaaa

SEQ ID NO: 1202904 - DNA, 22 bp, Artificial Sequence
  chemically synthesized
ctggatttcagacttgcatgtg

SEQ ID NO: 1202905 - DNA, 22 bp, Artificial Sequence
  chemically synthesized
gatttcagacttgcatgtgccc

SEQ ID NO: 1202906 - DNA, 22 bp, Artificial Sequence
  chemically synthesized
cagacttgcatgtgccctgaag

SEQ ID NO: 1202907 - DNA, 22 bp, Artificial Sequence
  chemically synthesized
agacttgcatgtgccctgaagc

SEQ ID NO: 1202908 - DNA, 22 bp, Artificial Sequence
  chemically synthesized
tccaaaacaaaggggcttcagg

SEQ ID NO: 1202909 - DNA, 22 bp, Artificial Sequence
  chemically synthesized
gcatgtgccctgaagccccttt

SEQ ID NO: 1202910 - DNA, 22 bp, Artificial Sequence
  chemically synthesized
catgtgccctgaagcccctttg

SEQ ID NO: 1202911 - DNA, 22 bp, Artificial Sequence
  chemically synthesized
aagcccctttgttttggacaat

SEQ ID NO: 1202912 - DNA, 22 bp, Artificial Sequence
  chemically synthesized
caaataggagaaattgtccaaa

SEQ ID NO: 1202913 - DNA, 22 bp, Artificial Sequence
  chemically synthesized
ccaaataggagaaattgtccaa

SEQ ID NO: 1202914 - DNA, 22 bp, Artificial Sequence
  chemically synthesized
tgttttggacaatttctcctat

SEQ ID NO: 1202915 - DNA, 22 bp, Artificial Sequence
  chemically synthesized
gttttggacaatttctcctatt

SEQ ID NO: 1202916 - DNA, 22 bp, Artificial Sequence
  chemically synthesized
ttttggacaatttctcctattt

SEQ ID NO: 1202917 - DNA, 22 bp, Artificial Sequence
  chemically synthesized
tggacaatttctcctatttgga

SEQ ID NO: 1202918 - DNA, 22 bp, Artificial Sequence
  chemically synthesized
ggacaatttctcctatttggaa

SEQ ID NO: 1202919 - DNA, 22 bp, Artificial Sequence
  chemically synthesized
gacaatttctcctatttggaag

SEQ ID NO: 1202920 - DNA, 22 bp, Artificial Sequence
  chemically synthesized
ggtaaatatagcccttccaaat

SEQ ID NO: 1202921 - DNA, 22 bp, Artificial Sequence
  chemically synthesized
ctcctatttggaagggctatat

SEQ ID NO: 1202922 - DNA, 22 bp, Artificial Sequence
  chemically synthesized
tcctatttggaagggctatatt

SEQ ID NO: 1202923 - DNA, 22 bp, Artificial Sequence
  chemically synthesized
caggcattgggtaaatatagcc

SEQ ID NO: 1202924 - DNA, 22 bp, Artificial Sequence
  chemically synthesized
ctatttggaagggctatattta

SEQ ID NO: 1202925 - DNA, 22 bp, Artificial Sequence
  chemically synthesized
tttggaagggctatatttaccc

SEQ ID NO: 1202926 - DNA, 22 bp, Artificial Sequence
  chemically synthesized
ggaagggctatatttacccaat

SEQ ID NO: 1202927 - DNA, 22 bp, Artificial Sequence
  chemically synthesized
gaagggctatatttacccaatg

SEQ ID NO: 1202928 - DNA, 22 bp, Artificial Sequence
  chemically synthesized
gatacagtggggttacaggcat

SEQ ID NO: 1202929 - DNA, 22 bp, Artificial Sequence
  chemically synthesized
tatttacccaatgcctgtaacc

SEQ ID NO: 1202930 - DNA, 22 bp, Artificial Sequence
  chemically synthesized
ctagatacagtggggttacagg

SEQ ID NO: 1202931 - DNA, 22 bp, Artificial Sequence
  chemically synthesized
cctagatacagtggggttacag

SEQ ID NO: 1202932 - DNA, 22 bp, Artificial Sequence
  chemically synthesized
acccaatgcctgtaaccccact

SEQ ID NO: 1202933 - DNA, 22 bp, Artificial Sequence
  chemically synthesized
cttcctagatacagtggggtta

SEQ ID NO: 1202934 - DNA, 22 bp, Artificial Sequence
  chemically synthesized
cccaatgcctgtaaccccactg

SEQ ID NO: 1202935 - DNA, 22 bp, Artificial Sequence
  chemically synthesized
gttacttcctagatacagtggg

SEQ ID NO: 1202936 - DNA, 22 bp, Artificial Sequence
  chemically synthesized
taaccccactgtatctaggaag

SEQ ID NO: 1202937 - DNA, 22 bp, Artificial Sequence
  chemically synthesized
tatctaggaagtaactaatctg

SEQ ID NO: 1202938 - DNA, 22 bp, Artificial Sequence
  chemically synthesized
taaaatcaaaagcagattagtt

SEQ ID NO: 1202939 - DNA, 22 bp, Artificial Sequence
  chemically synthesized
ggaagtaactaatctgcttttg

SEQ ID NO: 1202940 - DNA, 22 bp, Artificial Sequence
  chemically synthesized
tgagcctataaaatcaaaagca

SEQ ID NO: 1202941 - DNA, 22 bp, Artificial Sequence
  chemically synthesized
cctgtgagcctataaaatcaaa

SEQ ID NO: 1202942 - DNA, 22 bp, Artificial Sequence
  chemically synthesized
tgcctgtgagcctataaaatca

SEQ ID NO: 1202943 - DNA, 22 bp, Artificial Sequence
  chemically synthesized
ctgcctgtgagcctataaaatc

SEQ ID NO: 1202944 - DNA, 22 bp, Artificial Sequence
  chemically synthesized
atctgcttttgattttataggc

SEQ ID NO: 1202945 - DNA, 22 bp, Artificial Sequence
  chemically synthesized
cttctgcctgtgagcctataaa

SEQ ID NO: 1202946 - DNA, 22 bp, Artificial Sequence
  chemically synthesized
ccttctgcctgtgagcctataa

SEQ ID NO: 1202947 - DNA, 22 bp, Artificial Sequence
  chemically synthesized
cttttgattttataggctcaca

SEQ ID NO: 1202948 - DNA, 22 bp, Artificial Sequence
  chemically synthesized
ttgattttataggctcacaggc

SEQ ID NO: 1202949 - DNA, 22 bp, Artificial Sequence
  chemically synthesized
tgattttataggctcacaggca

SEQ ID NO: 1202950 - DNA, 22 bp, Artificial Sequence
  chemically synthesized
gattttataggctcacaggcag

SEQ ID NO: 1202951 - DNA, 22 bp, Artificial Sequence
  chemically synthesized
attttataggctcacaggcaga

SEQ ID NO: 1202952 - DNA, 22 bp, Artificial Sequence
  chemically synthesized
tataggctcacaggcagaagga

SEQ ID NO: 1202953 - DNA, 22 bp, Artificial Sequence
  chemically synthesized
gataaggcaatttccttctgcc

SEQ ID NO: 1202954 - DNA, 22 bp, Artificial Sequence
  chemically synthesized
ataggctcacaggcagaaggaa

SEQ ID NO: 1202955 - DNA, 22 bp, Artificial Sequence
  chemically synthesized
taggctcacaggcagaaggaaa

SEQ ID NO: 1202956 - DNA, 22 bp, Artificial Sequence
  chemically synthesized
acaggcagaaggaaattgcctt

SEQ ID NO: 1202957 - DNA, 22 bp, Artificial Sequence
  chemically synthesized
cacagtccaaagtgtcatccta

SEQ ID NO: 1202958 - DNA, 22 bp, Artificial Sequence
  chemically synthesized
ccttatctaggatgacactttg

SEQ ID NO: 1202959 - DNA, 22 bp, Artificial Sequence
  chemically synthesized
aaaactccacagtccaaagtgt

SEQ ID NO: 1202960 - DNA, 22 bp, Artificial Sequence
  chemically synthesized
atctaggatgacactttggact

SEQ ID NO: 1202961 - DNA, 22 bp, Artificial Sequence
  chemically synthesized
tctaggatgacactttggactg

SEQ ID NO: 1202962 - DNA, 22 bp, Artificial Sequence
  chemically synthesized
actcaaaactccacagtccaaa

SEQ ID NO: 1202963 - DNA, 22 bp, Artificial Sequence
  chemically synthesized
ggatgacactttggactgtgga

SEQ ID NO: 1202964 - DNA, 22 bp, Artificial Sequence
  chemically synthesized
attaactcaaaactccacagtc

SEQ ID NO: 1202965 - DNA, 22 bp, Artificial Sequence
  chemically synthesized
cctcattaactcaaaactccac

SEQ ID NO: 1202966 - DNA, 22 bp, Artificial Sequence
  chemically synthesized
attccctcattaactcaaaact

SEQ ID NO: 1202967 - DNA, 22 bp, Artificial Sequence
  chemically synthesized
tggactgtggagttttgagtta

SEQ ID NO: 1202968 - DNA, 22 bp, Artificial Sequence
  chemically synthesized
ggactgtggagttttgagttaa

SEQ ID NO: 1202969 - DNA, 22 bp, Artificial Sequence
  chemically synthesized
ctcattccctcattaactcaaa

SEQ ID NO: 1202970 - DNA, 22 bp, Artificial Sequence
  chemically synthesized
gactgtggagttttgagttaat

SEQ ID NO: 1202971 - DNA, 22 bp, Artificial Sequence
  chemically synthesized
actcattccctcattaactcaa

SEQ ID NO: 1202972 - DNA, 22 bp, Artificial Sequence
  chemically synthesized
tactcattccctcattaactca

SEQ ID NO: 1202973 - DNA, 22 bp, Artificial Sequence
  chemically synthesized
tggagttttgagttaatgaggg

SEQ ID NO: 1202974 - DNA, 22 bp, Artificial Sequence
  chemically synthesized
tgagttaatgagggaatgagta

SEQ ID NO: 1202975 - DNA, 22 bp, Artificial Sequence
  chemically synthesized
gagttaatgagggaatgagtaa

SEQ ID NO: 1202976 - DNA, 22 bp, Artificial Sequence
  chemically synthesized
agttaatgagggaatgagtaaa

SEQ ID NO: 1202977 - DNA, 22 bp, Artificial Sequence
  chemically synthesized
atgagggaatgagtaaagactt

SEQ ID NO: 1202978 - DNA, 22 bp, Artificial Sequence
  chemically synthesized
ccaacagtgcaccaaagtcttt

SEQ ID NO: 1202979 - DNA, 22 bp, Artificial Sequence
  chemically synthesized
cccaacagtgcaccaaagtctt

SEQ ID NO: 1202980 - DNA, 22 bp, Artificial Sequence
  chemically synthesized
ccttcccaacagtgcaccaaag

SEQ ID NO: 1202981 - DNA, 22 bp, Artificial Sequence
  chemically synthesized
gccttcccaacagtgcaccaaa

SEQ ID NO: 1202982 - DNA, 22 bp, Artificial Sequence
  chemically synthesized
aaaaccaatcttgccttcccaa

SEQ ID NO: 1202983 - DNA, 22 bp, Artificial Sequence
  chemically synthesized
gaaaaccaatcttgccttccca

SEQ ID NO: 1202984 - DNA, 22 bp, Artificial Sequence
  chemically synthesized
tggtgcactgttgggaaggcaa

SEQ ID NO: 1202985 - DNA, 22 bp, Artificial Sequence
  chemically synthesized
ggtgcactgttgggaaggcaag

SEQ ID NO: 1202986 - DNA, 22 bp, Artificial Sequence
  chemically synthesized
gtgcactgttgggaaggcaaga

SEQ ID NO: 1202987 - DNA, 22 bp, Artificial Sequence
  chemically synthesized
acatttgaaaaccaatcttgcc

SEQ ID NO: 1202988 - DNA, 22 bp, Artificial Sequence
  chemically synthesized
ttgggaaggcaagattggtttt

SEQ ID NO: 1202989 - DNA, 22 bp, Artificial Sequence
  chemically synthesized
ggaaggcaagattggttttcaa

SEQ ID NO: 1202990 - DNA, 22 bp, Artificial Sequence
  chemically synthesized
atatcctcacatttgaaaacca

SEQ ID NO: 1202991 - DNA, 22 bp, Artificial Sequence
  chemically synthesized
ccaaatctcatatcctcacatt

SEQ ID NO: 1202992 - DNA, 22 bp, Artificial Sequence
  chemically synthesized
gttttcaaatgtgaggatatga

SEQ ID NO: 1202993 - DNA, 22 bp, Artificial Sequence
  chemically synthesized
tcaaatgtgaggatatgagatt

SEQ ID NO: 1202994 - DNA, 22 bp, Artificial Sequence
  chemically synthesized
caaatgtgaggatatgagattt

SEQ ID NO: 1202995 - DNA, 22 bp, Artificial Sequence
  chemically synthesized
aaatgtgaggatatgagatttg

SEQ ID NO: 1202996 - DNA, 22 bp, Artificial Sequence
  chemically synthesized
cacccccggcccctcccaaatc

SEQ ID NO: 1202997 - DNA, 22 bp, Artificial Sequence
  chemically synthesized
gggaggggccgggggtggaatg

SEQ ID NO: 1202998 - DNA, 22 bp, Artificial Sequence
  chemically synthesized
ggaggggccgggggtggaatga

SEQ ID NO: 1202999 - DNA, 22 bp, Artificial Sequence
  chemically synthesized
agccaaaccatatcattccacc

SEQ ID NO: 1203000 - DNA, 22 bp, Artificial Sequence
  chemically synthesized
ggtggggactcagccaaaccat

SEQ ID NO: 1203001 - DNA, 22 bp, Artificial Sequence
  chemically synthesized
gggtggggactcagccaaacca

SEQ ID NO: 1203002 - DNA, 22 bp, Artificial Sequence
  chemically synthesized
aagatgagatttgggtggggac

SEQ ID NO: 1203003 - DNA, 22 bp, Artificial Sequence
  chemically synthesized
ggctgagtccccacccaaatct

SEQ ID NO: 1203004 - DNA, 22 bp, Artificial Sequence
  chemically synthesized
gctgagtccccacccaaatctc

SEQ ID NO: 1203005 - DNA, 22 bp, Artificial Sequence
  chemically synthesized
agtccccacccaaatctcatct

SEQ ID NO: 1203006 - DNA, 22 bp, Artificial Sequence
  chemically synthesized
acaacatgtgggaattcaagat

SEQ ID NO: 1203007 - DNA, 22 bp, Artificial Sequence
  chemically synthesized
tgacaacatgtgggaattcaag

SEQ ID NO: 1203008 - DNA, 22 bp, Artificial Sequence
  chemically synthesized
atcttgaattcccacatgttgt

SEQ ID NO: 1203009 - DNA, 22 bp, Artificial Sequence
  chemically synthesized
ccacagggatcctctgacaaca

SEQ ID NO: 1203010 - DNA, 22 bp, Artificial Sequence
  chemically synthesized
gaattcccacatgttgtcagag

SEQ ID NO: 1203011 - DNA, 22 bp, Artificial Sequence
  chemically synthesized
aattcccacatgttgtcagagg

SEQ ID NO: 1203012 - DNA, 22 bp, Artificial Sequence
  chemically synthesized
cctcccacagggatcctctgac

SEQ ID NO: 1203013 - DNA, 22 bp, Artificial Sequence
  chemically synthesized
ccacatgttgtcagaggatccc

SEQ ID NO: 1203014 - DNA, 22 bp, Artificial Sequence
  chemically synthesized
aattacctcccacagggatcct

SEQ ID NO: 1203015 - DNA, 22 bp, Artificial Sequence
  chemically synthesized
tcagaggatccctgtgggaggt

SEQ ID NO: 1203016 - DNA, 22 bp, Artificial Sequence
  chemically synthesized
tccccatgattcaattacctcc

SEQ ID NO: 1203017 - DNA, 22 bp, Artificial Sequence
  chemically synthesized
tgggaggtaattgaatcatggg

SEQ ID NO: 1203018 - DNA, 22 bp, Artificial Sequence
  chemically synthesized
aatcatggggacaggtctttcc

SEQ ID NO: 1203019 - DNA, 22 bp, Artificial Sequence
  chemically synthesized
ccacaagaacagcatgggaaag

SEQ ID NO: 1203020 - DNA, 22 bp, Artificial Sequence
  chemically synthesized
actaccacaagaacagcatggg

SEQ ID NO: 1203021 - DNA, 22 bp, Artificial Sequence
  chemically synthesized
cactaccacaagaacagcatgg

SEQ ID NO: 1203022 - DNA, 22 bp, Artificial Sequence
  chemically synthesized
tcactaccacaagaacagcatg

SEQ ID NO: 1203023 - DNA, 22 bp, Artificial Sequence
  chemically synthesized
tcccatgctgttcttgtggtag

SEQ ID NO: 1203024 - DNA, 22 bp, Artificial Sequence
  chemically synthesized
gtgagactttcactaccacaag

SEQ ID NO: 1203025 - DNA, 22 bp, Artificial Sequence
  chemically synthesized
cccatgctgttcttgtggtagt

SEQ ID NO: 1203026 - DNA, 22 bp, Artificial Sequence
  chemically synthesized
ccatgctgttcttgtggtagtg

SEQ ID NO: 1203027 - DNA, 22 bp, Artificial Sequence
  chemically synthesized
ttcttgtggtagtgaaagtctc

SEQ ID NO: 1203028 - DNA, 22 bp, Artificial Sequence
  chemically synthesized
ttgtggtagtgaaagtctcacg

SEQ ID NO: 1203029 - DNA, 22 bp, Artificial Sequence
  chemically synthesized
gtggtagtgaaagtctcacgag

SEQ ID NO: 1203030 - DNA, 22 bp, Artificial Sequence
  chemically synthesized
tggtagtgaaagtctcacgaga

SEQ ID NO: 1203031 - DNA, 22 bp, Artificial Sequence
  chemically synthesized
caaagccatcagatctcgtgag

SEQ ID NO: 1203032 - DNA, 22 bp, Artificial Sequence
  chemically synthesized
acaaagccatcagatctcgtga

SEQ ID NO: 1203033 - DNA, 22 bp, Artificial Sequence
  chemically synthesized
cacttacaaagccatcagatct

SEQ ID NO: 1203034 - DNA, 22 bp, Artificial Sequence
  chemically synthesized
acgagatctgatggctttgtaa

SEQ ID NO: 1203035 - DNA, 22 bp, Artificial Sequence
  chemically synthesized
tgcagggaaactccacttacaa

SEQ ID NO: 1203036 - DNA, 22 bp, Artificial Sequence
  chemically synthesized
gtgcagggaaactccacttaca

SEQ ID NO: 1203037 - DNA, 22 bp, Artificial Sequence
  chemically synthesized
atggctttgtaagtggagtttc

SEQ ID NO: 1203038 - DNA, 22 bp, Artificial Sequence
  chemically synthesized
tgtaagtggagtttccctgcac

SEQ ID NO: 1203039 - DNA, 22 bp, Artificial Sequence
  chemically synthesized
gtaagtggagtttccctgcaca

SEQ ID NO: 1203040 - DNA, 22 bp, Artificial Sequence
  chemically synthesized
taagtggagtttccctgcacaa

SEQ ID NO: 1203041 - DNA, 22 bp, Artificial Sequence
  chemically synthesized
ccctgcacaagctttctttgcc

SEQ ID NO: 1203042 - DNA, 22 bp, Artificial Sequence
  chemically synthesized
cctgcacaagctttctttgccc

SEQ ID NO: 1203043 - DNA, 22 bp, Artificial Sequence
  chemically synthesized
caggaatgacagagggcaaaga

SEQ ID NO: 1203044 - DNA, 22 bp, Artificial Sequence
  chemically synthesized
acaggaatgacagagggcaaag

SEQ ID NO: 1203045 - DNA, 22 bp, Artificial Sequence
  chemically synthesized
tacaggaatgacagagggcaaa

SEQ ID NO: 1203046 - DNA, 22 bp, Artificial Sequence
  chemically synthesized
cacaagctttctttgccctctg

SEQ ID NO: 1203047 - DNA, 22 bp, Artificial Sequence
  chemically synthesized
tctttgccctctgtcattcctg

SEQ ID NO: 1203048 - DNA, 22 bp, Artificial Sequence
  chemically synthesized
ctttgccctctgtcattcctgt

SEQ ID NO: 1203049 - DNA, 22 bp, Artificial Sequence
  chemically synthesized
tttgccctctgtcattcctgta

SEQ ID NO: 1203050 - DNA, 22 bp, Artificial Sequence
  chemically synthesized
tgccctctgtcattcctgtaaa

SEQ ID NO: 1203051 - DNA, 22 bp, Artificial Sequence
  chemically synthesized
gccctctgtcattcctgtaaaa

SEQ ID NO: 1203052 - DNA, 22 bp, Artificial Sequence
  chemically synthesized
ccctctgtcattcctgtaaaat

SEQ ID NO: 1203053 - DNA, 22 bp, Artificial Sequence
  chemically synthesized
tgtcattcctgtaaaatgtgac

SEQ ID NO: 1203054 - DNA, 22 bp, Artificial Sequence
  chemically synthesized
tcattcctgtaaaatgtgactt

SEQ ID NO: 1203055 - DNA, 22 bp, Artificial Sequence
  chemically synthesized
ctgtaaaatgtgacttactcct

SEQ ID NO: 1203056 - DNA, 22 bp, Artificial Sequence
  chemically synthesized
taaaatgtgacttactcctcct

SEQ ID NO: 1203057 - DNA, 22 bp, Artificial Sequence
  chemically synthesized
acaatcatggtggaaggcaagg

SEQ ID NO: 1203058 - DNA, 22 bp, Artificial Sequence
  chemically synthesized
actcctccttgccttccaccat

SEQ ID NO: 1203059 - DNA, 22 bp, Artificial Sequence
  chemically synthesized
ctcctccttgccttccaccatg

SEQ ID NO: 1203060 - DNA, 22 bp, Artificial Sequence
  chemically synthesized
ctccttgccttccaccatgatt

SEQ ID NO: 1203061 - DNA, 22 bp, Artificial Sequence
  chemically synthesized
cttgccttccaccatgattgtg

SEQ ID NO: 1203062 - DNA, 22 bp, Artificial Sequence
  chemically synthesized
gccttccaccatgattgtgagg

SEQ ID NO: 1203063 - DNA, 22 bp, Artificial Sequence
  chemically synthesized
ccttccaccatgattgtgaggc

SEQ ID NO: 1203064 - DNA, 22 bp, Artificial Sequence
  chemically synthesized
tgtggatggggaagcctcacaa

SEQ ID NO: 1203065 - DNA, 22 bp, Artificial Sequence
  chemically synthesized
tatgtggatggggaagcctcac

SEQ ID NO: 1203066 - DNA, 22 bp, Artificial Sequence
  chemically synthesized
ccaccatgattgtgaggcttcc

SEQ ID NO: 1203067 - DNA, 22 bp, Artificial Sequence
  chemically synthesized
caccatgattgtgaggcttccc

SEQ ID NO: 1203068 - DNA, 22 bp, Artificial Sequence
  chemically synthesized
caattctatgtggatggggaag

SEQ ID NO: 1203069 - DNA, 22 bp, Artificial Sequence
  chemically synthesized
gcaattctatgtggatggggaa

SEQ ID NO: 1203070 - DNA, 22 bp, Artificial Sequence
  chemically synthesized
tgaggcttccccatccacatag

SEQ ID NO: 1203071 - DNA, 22 bp, Artificial Sequence
  chemically synthesized
atagacttgcaattctatgtgg

SEQ ID NO: 1203072 - DNA, 22 bp, Artificial Sequence
  chemically synthesized
aatagacttgcaattctatgtg

SEQ ID NO: 1203073 - DNA, 22 bp, Artificial Sequence
  chemically synthesized
ccccatccacatagaattgcaa

SEQ ID NO: 1203074 - DNA, 22 bp, Artificial Sequence
  chemically synthesized
cccatccacatagaattgcaag

SEQ ID NO: 1203075 - DNA, 22 bp, Artificial Sequence
  chemically synthesized
tacagcaaaaagggtttaatag

SEQ ID NO: 1203076 - DNA, 22 bp, Artificial Sequence
  chemically synthesized
atacagcaaaaagggtttaata

SEQ ID NO: 1203077 - DNA, 22 bp, Artificial Sequence
  chemically synthesized
caagtctattaaaccctttttg

SEQ ID NO: 1203078 - DNA, 22 bp, Artificial Sequence
  chemically synthesized
ggtaatttatacagcaaaaagg

SEQ ID NO: 1203079 - DNA, 22 bp, Artificial Sequence
  chemically synthesized
ttaaaccctttttgctgtataa

SEQ ID NO: 1203080 - DNA, 22 bp, Artificial Sequence
  chemically synthesized
agattgggtaatttatacagca

SEQ ID NO: 1203081 - DNA, 22 bp, Artificial Sequence
  chemically synthesized
aaccctttttgctgtataaatt

SEQ ID NO: 1203082 - DNA, 22 bp, Artificial Sequence
  chemically synthesized
tttgctgtataaattacccaat

SEQ ID NO: 1203083 - DNA, 22 bp, Artificial Sequence
  chemically synthesized
ttgctgtataaattacccaatc

SEQ ID NO: 1203084 - DNA, 22 bp, Artificial Sequence
  chemically synthesized
tgctgtataaattacccaatct

SEQ ID NO: 1203085 - DNA, 22 bp, Artificial Sequence
  chemically synthesized
gctgtataaattacccaatctc

SEQ ID NO: 1203086 - DNA, 22 bp, Artificial Sequence
  chemically synthesized
ctgtataaattacccaatctca

SEQ ID NO: 1203087 - DNA, 22 bp, Artificial Sequence
  chemically synthesized
ataaagagatacctgagattgg

SEQ ID NO: 1203088 - DNA, 22 bp, Artificial Sequence
  chemically synthesized
tataaattacccaatctcaggt

SEQ ID NO: 1203089 - DNA, 22 bp, Artificial Sequence
  chemically synthesized
ctgataaagagatacctgagat

SEQ ID NO: 1203090 - DNA, 22 bp, Artificial Sequence
  chemically synthesized
atgctgctgataaagagatacc

SEQ ID NO: 1203091 - DNA, 22 bp, Artificial Sequence
  chemically synthesized
catgctgctgataaagagatac

SEQ ID NO: 1203092 - DNA, 22 bp, Artificial Sequence
  chemically synthesized
cccaatctcaggtatctcttta

SEQ ID NO: 1203093 - DNA, 22 bp, Artificial Sequence
  chemically synthesized
tcatgctgctgataaagagata

SEQ ID NO: 1203094 - DNA, 22 bp, Artificial Sequence
  chemically synthesized
gtccgttttcatgctgctgata

SEQ ID NO: 1203095 - DNA, 22 bp, Artificial Sequence
  chemically synthesized
aggtatctctttatcagcagca

SEQ ID NO: 1203096 - DNA, 22 bp, Artificial Sequence
  chemically synthesized
tgtattagtccgttttcatgct

SEQ ID NO: 1203097 - DNA, 22 bp, Artificial Sequence
  chemically synthesized
gtgtattagtccgttttcatgc

SEQ ID NO: 1203098 - DNA, 22 bp, Artificial Sequence
  chemically synthesized
tttatcagcagcatgaaaacgg

SEQ ID NO: 1203099 - DNA, 22 bp, Artificial Sequence
  chemically synthesized
tatcagcagcatgaaaacggac

SEQ ID NO: 1203100 - DNA, 22 bp, Artificial Sequence
  chemically synthesized
atcagcagcatgaaaacggact

SEQ ID NO: 1203101 - DNA, 22 bp, Artificial Sequence
  chemically synthesized
tcagcagcatgaaaacggacta

SEQ ID NO: 1203102 - DNA, 22 bp, Artificial Sequence
  chemically synthesized
agcagggagaagtcagtgcttg

SEQ ID NO: 1203103 - DNA, 22 bp, Artificial Sequence
  chemically synthesized
taagcagggagaagtcagtgct

SEQ ID NO: 1203104 - DNA, 22 bp, Artificial Sequence
  chemically synthesized
atacacaagcactgacttctcc

SEQ ID NO: 1203105 - DNA, 22 bp, Artificial Sequence
  chemically synthesized
acttctccctgcttagaacacc

SEQ ID NO: 1203106 - DNA, 22 bp, Artificial Sequence
  chemically synthesized
ctccctgcttagaacacctttc

SEQ ID NO: 1203107 - DNA, 22 bp, Artificial Sequence
  chemically synthesized
tccctgcttagaacacctttcc

SEQ ID NO: 1203108 - DNA, 22 bp, Artificial Sequence
  chemically synthesized
cctgcttagaacacctttccat

SEQ ID NO: 1203109 - DNA, 22 bp, Artificial Sequence
  chemically synthesized
cttagaacacctttccatcccc

SEQ ID NO: 1203110 - DNA, 22 bp, Artificial Sequence
  chemically synthesized
agaacacctttccatccccacc

SEQ ID NO: 1203111 - DNA, 22 bp, Artificial Sequence
  chemically synthesized
gaacacctttccatccccacct

SEQ ID NO: 1203112 - DNA, 22 bp, Artificial Sequence
  chemically synthesized
tccatccccacctgtattttcc

SEQ ID NO: 1203113 - DNA, 22 bp, Artificial Sequence
  chemically synthesized
ccatccccacctgtattttcct

SEQ ID NO: 1203114 - DNA, 22 bp, Artificial Sequence
  chemically synthesized
catccccacctgtattttcctc

SEQ ID NO: 1203115 - DNA, 22 bp, Artificial Sequence
  chemically synthesized
tattttcctccctcatgccttt

SEQ ID NO: 1203116 - DNA, 22 bp, Artificial Sequence
  chemically synthesized
tcctccctcatgcctttaccct

SEQ ID NO: 1203117 - DNA, 22 bp, Artificial Sequence
  chemically synthesized
tggagaaggaagagggtaaagg

SEQ ID NO: 1203118 - DNA, 22 bp, Artificial Sequence
  chemically synthesized
cctccctcatgcctttaccctc

SEQ ID NO: 1203119 - DNA, 22 bp, Artificial Sequence
  chemically synthesized
ctccctcatgcctttaccctct

SEQ ID NO: 1203120 - DNA, 22 bp, Artificial Sequence
  chemically synthesized
ttgtggagaaggaagagggtaa

SEQ ID NO: 1203121 - DNA, 22 bp, Artificial Sequence
  chemically synthesized
gttgtggagaaggaagagggta

SEQ ID NO: 1203122 - DNA, 22 bp, Artificial Sequence
  chemically synthesized
cctcatgcctttaccctcttcc

SEQ ID NO: 1203123 - DNA, 22 bp, Artificial Sequence
  chemically synthesized
gcttgttgtggagaaggaagag

SEQ ID NO: 1203124 - DNA, 22 bp, Artificial Sequence
  chemically synthesized
atgcctttaccctcttccttct

SEQ ID NO: 1203125 - DNA, 22 bp, Artificial Sequence
  chemically synthesized
ggtactagcttgttgtggagaa

SEQ ID NO: 1203126 - DNA, 22 bp, Artificial Sequence
  chemically synthesized
taccctcttccttctccacaac

SEQ ID NO: 1203127 - DNA, 22 bp, Artificial Sequence
  chemically synthesized
accctcttccttctccacaaca

SEQ ID NO: 1203128 - DNA, 22 bp, Artificial Sequence
  chemically synthesized
ccctcttccttctccacaacaa

SEQ ID NO: 1203129 - DNA, 22 bp, Artificial Sequence
  chemically synthesized
ttccttctccacaacaagctag

SEQ ID NO: 1203130 - DNA, 22 bp, Artificial Sequence
  chemically synthesized
ccttctccacaacaagctagta

SEQ ID NO: 1203131 - DNA, 22 bp, Artificial Sequence
  chemically synthesized
cttctccacaacaagctagtac

SEQ ID NO: 1203132 - DNA, 22 bp, Artificial Sequence
  chemically synthesized
gatggaagtctgggtactagct

SEQ ID NO: 1203133 - DNA, 22 bp, Artificial Sequence
  chemically synthesized
agatggaagtctgggtactagc

SEQ ID NO: 1203134 - DNA, 22 bp, Artificial Sequence
  chemically synthesized
ctccacaacaagctagtaccca

SEQ ID NO: 1203135 - DNA, 22 bp, Artificial Sequence
  chemically synthesized
tccacaacaagctagtacccag

SEQ ID NO: 1203136 - DNA, 22 bp, Artificial Sequence
  chemically synthesized
cacaacaagctagtacccagac

SEQ ID NO: 1203137 - DNA, 22 bp, Artificial Sequence
  chemically synthesized
aaggaagtgatatttagatgga

SEQ ID NO: 1203138 - DNA, 22 bp, Artificial Sequence
  chemically synthesized
gtacccagacttccatctaaat

SEQ ID NO: 1203139 - DNA, 22 bp, Artificial Sequence
  chemically synthesized
gaaggaagtgatatttagatgg

SEQ ID NO: 1203140 - DNA, 22 bp, Artificial Sequence
  chemically synthesized
tgaaggaagtgatatttagatg

SEQ ID NO: 1203141 - DNA, 22 bp, Artificial Sequence
  chemically synthesized
ttgaaggaagtgatatttagat

SEQ ID NO: 1203142 - DNA, 22 bp, Artificial Sequence
  chemically synthesized
tttgaaggaagtgatatttaga

SEQ ID NO: 1203143 - DNA, 22 bp, Artificial Sequence
  chemically synthesized
ccatctaaatatcacttccttc

SEQ ID NO: 1203144 - DNA, 22 bp, Artificial Sequence
  chemically synthesized
catctaaatatcacttccttca

SEQ ID NO: 1203145 - DNA, 22 bp, Artificial Sequence
  chemically synthesized
aatatcacttccttcaaaaaga

SEQ ID NO: 1203146 - DNA, 22 bp, Artificial Sequence
  chemically synthesized
gaggaataagaaatgaagtctt

SEQ ID NO: 1203147 - DNA, 22 bp, Artificial Sequence
  chemically synthesized
ccttcaaaaagacttcatttct

SEQ ID NO: 1203148 - DNA, 22 bp, Artificial Sequence
  chemically synthesized
cttcaaaaagacttcatttctt

SEQ ID NO: 1203149 - DNA, 22 bp, Artificial Sequence
  chemically synthesized
tatctggaggaataagaaatga

SEQ ID NO: 1203150 - DNA, 22 bp, Artificial Sequence
  chemically synthesized
caaaaagacttcatttcttatt

SEQ ID NO: 1203151 - DNA, 22 bp, Artificial Sequence
  chemically synthesized
aaaaagacttcatttcttattc

SEQ ID NO: 1203152 - DNA, 22 bp, Artificial Sequence
  chemically synthesized
catttcttattcctccagatac

SEQ ID NO: 1203153 - DNA, 22 bp, Artificial Sequence
  chemically synthesized
atttcttattcctccagataca

SEQ ID NO: 1203154 - DNA, 22 bp, Artificial Sequence
  chemically synthesized
cttattcctccagatacagatt

SEQ ID NO: 1203155 - DNA, 22 bp, Artificial Sequence
  chemically synthesized
ttattcctccagatacagattc

SEQ ID NO: 1203156 - DNA, 22 bp, Artificial Sequence
  chemically synthesized
attcctccagatacagattccc

SEQ ID NO: 1203157 - DNA, 22 bp, Artificial Sequence
  chemically synthesized
ttcctccagatacagattccct

SEQ ID NO: 1203158 - DNA, 22 bp, Artificial Sequence
  chemically synthesized
ctccagatacagattccctgat

SEQ ID NO: 1203159 - DNA, 22 bp, Artificial Sequence
  chemically synthesized
taaaaatagtaaatcagggaat

SEQ ID NO: 1203160 - DNA, 22 bp, Artificial Sequence
  chemically synthesized
cagatacagattccctgattta

SEQ ID NO: 1203161 - DNA, 22 bp, Artificial Sequence
  chemically synthesized
agagtgctataaaaatagtaaa

SEQ ID NO: 1203162 - DNA, 22 bp, Artificial Sequence
  chemically synthesized
aaattcagagtgctataaaaat

SEQ ID NO: 1203163 - DNA, 22 bp, Artificial Sequence
  chemically synthesized
cctgatttactatttttatagc

SEQ ID NO: 1203164 - DNA, 22 bp, Artificial Sequence
  chemically synthesized
aaaattcagagtgctataaaaa

SEQ ID NO: 1203165 - DNA, 22 bp, Artificial Sequence
  chemically synthesized
tttaaaattcagagtgctataa

SEQ ID NO: 1203166 - DNA, 22 bp, Artificial Sequence
  chemically synthesized
atttactatttttatagcactc

SEQ ID NO: 1203167 - DNA, 22 bp, Artificial Sequence
  chemically synthesized
actatttttatagcactctgaa

SEQ ID NO: 1203168 - DNA, 22 bp, Artificial Sequence
  chemically synthesized
ctatttttatagcactctgaat

SEQ ID NO: 1203169 - DNA, 22 bp, Artificial Sequence
  chemically synthesized
tttttatagcactctgaatttt

SEQ ID NO: 1203170 - DNA, 22 bp, Artificial Sequence
  chemically synthesized
atgtgtactatttaaaattcag

SEQ ID NO: 1203171 - DNA, 22 bp, Artificial Sequence
  chemically synthesized
gatgtgtactatttaaaattca

SEQ ID NO: 1203172 - DNA, 22 bp, Artificial Sequence
  chemically synthesized
ttatagcactctgaattttaaa

SEQ ID NO: 1203173 - DNA, 22 bp, Artificial Sequence
  chemically synthesized
tgatgtgtactatttaaaattc

SEQ ID NO: 1203174 - DNA, 22 bp, Artificial Sequence
  chemically synthesized
tatagcactctgaattttaaat

SEQ ID NO: 1203175 - DNA, 22 bp, Artificial Sequence
  chemically synthesized
ttgatgtgtactatttaaaatt

SEQ ID NO: 1203176 - DNA, 22 bp, Artificial Sequence
  chemically synthesized
atagcactctgaattttaaata

SEQ ID NO: 1203177 - DNA, 22 bp, Artificial Sequence
  chemically synthesized
tagcactctgaattttaaatag

SEQ ID NO: 1203178 - DNA, 22 bp, Artificial Sequence
  chemically synthesized
tttttgatgtgtactatttaaa

SEQ ID NO: 1203179 - DNA, 22 bp, Artificial Sequence
  chemically synthesized
atttttgatgtgtactatttaa

SEQ ID NO: 1203180 - DNA, 22 bp, Artificial Sequence
  chemically synthesized
tatttttgatgtgtactattta

SEQ ID NO: 1203181 - DNA, 22 bp, Artificial Sequence
  chemically synthesized
attttatttttgatgtgtacta

SEQ ID NO: 1203182 - DNA, 22 bp, Artificial Sequence
  chemically synthesized
tgaattttaaatagtacacatc

SEQ ID NO: 1203183 - DNA, 22 bp, Artificial Sequence
  chemically synthesized
aattttatttttgatgtgtact

SEQ ID NO: 1203184 - DNA, 22 bp, Artificial Sequence
  chemically synthesized
aattttaaatagtacacatcaa

SEQ ID NO: 1203185 - DNA, 22 bp, Artificial Sequence
  chemically synthesized
taaatagtacacatcaaaaata

SEQ ID NO: 1203186 - DNA, 22 bp, Artificial Sequence
  chemically synthesized
aaatagtacacatcaaaaataa

SEQ ID NO: 1203187 - DNA, 22 bp, Artificial Sequence
  chemically synthesized
aatagtacacatcaaaaataaa

SEQ ID NO: 1203188 - DNA, 22 bp, Artificial Sequence
  chemically synthesized
tataatagtttaattttatttt

SEQ ID NO: 1203189 - DNA, 22 bp, Artificial Sequence
  chemically synthesized
tgattgtataatagtttaattt

SEQ ID NO: 1203190 - DNA, 22 bp, Artificial Sequence
  chemically synthesized
aactattatacaatcataatta

SEQ ID NO: 1203191 - DNA, 22 bp, Artificial Sequence
  chemically synthesized
aggaataccagcataattatga

SEQ ID NO: 1203192 - DNA, 22 bp, Artificial Sequence
  chemically synthesized
gaggaataccagcataattatg

SEQ ID NO: 1203193 - DNA, 22 bp, Artificial Sequence
  chemically synthesized
tgaggaataccagcataattat

SEQ ID NO: 1203194 - DNA, 22 bp, Artificial Sequence
  chemically synthesized
ttgaggaataccagcataatta

SEQ ID NO: 1203195 - DNA, 22 bp, Artificial Sequence
  chemically synthesized
ttatacaatcataattatgctg

SEQ ID NO: 1203196 - DNA, 22 bp, Artificial Sequence
  chemically synthesized
tacaatcataattatgctggta

SEQ ID NO: 1203197 - DNA, 22 bp, Artificial Sequence
  chemically synthesized
tcttttgaggaataccagcata

SEQ ID NO: 1203198 - DNA, 22 bp, Artificial Sequence
  chemically synthesized
gaatatattgtcttttgaggaa

SEQ ID NO: 1203199 - DNA, 22 bp, Artificial Sequence
  chemically synthesized
ggaatatattgtcttttgagga

SEQ ID NO: 1203200 - DNA, 22 bp, Artificial Sequence
  chemically synthesized
tgctggtattcctcaaaagaca

SEQ ID NO: 1203201 - DNA, 22 bp, Artificial Sequence
  chemically synthesized
atgtcttggaatatattgtctt

SEQ ID NO: 1203202 - DNA, 22 bp, Artificial Sequence
  chemically synthesized
gtattcctcaaaagacaatata

SEQ ID NO: 1203203 - DNA, 22 bp, Artificial Sequence
  chemically synthesized
ctcaaaagacaatatattccaa

SEQ ID NO: 1203204 - DNA, 22 bp, Artificial Sequence
  chemically synthesized
aaaagacaatatattccaagac

SEQ ID NO: 1203205 - DNA, 22 bp, Artificial Sequence
  chemically synthesized
aagacataagaaaaggctcatg

SEQ ID NO: 1203206 - DNA, 22 bp, Artificial Sequence
  chemically synthesized
ttgaagacataagaaaaggctc

SEQ ID NO: 1203207 - DNA, 22 bp, Artificial Sequence
  chemically synthesized
attgaagacataagaaaaggct

SEQ ID NO: 1203208 - DNA, 22 bp, Artificial Sequence
  chemically synthesized
caagacatgagccttttcttat

SEQ ID NO: 1203209 - DNA, 22 bp, Artificial Sequence
  chemically synthesized
aatgaatttattgaagacataa

SEQ ID NO: 1203210 - DNA, 22 bp, Artificial Sequence
  chemically synthesized
ggcctgaatgaatttattgaag

SEQ ID NO: 1203211 - DNA, 22 bp, Artificial Sequence
  chemically synthesized
ttcttatgtcttcaataaattc

SEQ ID NO: 1203212 - DNA, 22 bp, Artificial Sequence
  chemically synthesized
ttaggcctgaatgaatttattg

SEQ ID NO: 1203213 - DNA, 22 bp, Artificial Sequence
  chemically synthesized
tcttatgtcttcaataaattca

SEQ ID NO: 1203214 - DNA, 22 bp, Artificial Sequence
  chemically synthesized
cttatgtcttcaataaattcat

SEQ ID NO: 1203215 - DNA, 22 bp, Artificial Sequence
  chemically synthesized
tgttaggcctgaatgaatttat

SEQ ID NO: 1203216 - DNA, 22 bp, Artificial Sequence
  chemically synthesized
ttatgtcttcaataaattcatt

SEQ ID NO: 1203217 - DNA, 22 bp, Artificial Sequence
  chemically synthesized
atgtcttcaataaattcattca

SEQ ID NO: 1203218 - DNA, 22 bp, Artificial Sequence
  chemically synthesized
tgtcttcaataaattcattcag

SEQ ID NO: 1203219 - DNA, 22 bp, Artificial Sequence
  chemically synthesized
caataaattcattcaggcctaa

SEQ ID NO: 1203220 - DNA, 22 bp, Artificial Sequence
  chemically synthesized
aataaattcattcaggcctaac

SEQ ID NO: 1203221 - DNA, 22 bp, Artificial Sequence
  chemically synthesized
tgggcaaagtgttctgttaggc

SEQ ID NO: 1203222 - DNA, 22 bp, Artificial Sequence
  chemically synthesized
ctatgggcaaagtgttctgtta

SEQ ID NO: 1203223 - DNA, 22 bp, Artificial Sequence
  chemically synthesized
attcaggcctaacagaacactt

SEQ ID NO: 1203224 - DNA, 22 bp, Artificial Sequence
  chemically synthesized
aggcctaacagaacactttgcc

SEQ ID NO: 1203225 - DNA, 22 bp, Artificial Sequence
  chemically synthesized
agcacctcctatgggcaaagtg

SEQ ID NO: 1203226 - DNA, 22 bp, Artificial Sequence
  chemically synthesized
attaagcacctcctatgggcaa

SEQ ID NO: 1203227 - DNA, 22 bp, Artificial Sequence
  chemically synthesized
acagaacactttgcccatagga

SEQ ID NO: 1203228 - DNA, 22 bp, Artificial Sequence
  chemically synthesized
cataaatgttcattaagcacct

SEQ ID NO: 1203229 - DNA, 22 bp, Artificial Sequence
  chemically synthesized
tgcccataggaggtgcttaatg

SEQ ID NO: 1203230 - DNA, 22 bp, Artificial Sequence
  chemically synthesized
gcccataggaggtgcttaatga

SEQ ID NO: 1203231 - DNA, 22 bp, Artificial Sequence
  chemically synthesized
cccataggaggtgcttaatgaa

SEQ ID NO: 1203232 - DNA, 22 bp, Artificial Sequence
  chemically synthesized
taaattccataaatgttcatta

SEQ ID NO: 1203233 - DNA, 22 bp, Artificial Sequence
  chemically synthesized
gaagaactataaattccataaa

SEQ ID NO: 1203234 - DNA, 22 bp, Artificial Sequence
  chemically synthesized
aatgaacatttatggaatttat

SEQ ID NO: 1203235 - DNA, 22 bp, Artificial Sequence
  chemically synthesized
atgaacatttatggaatttata

SEQ ID NO: 1203236 - DNA, 22 bp, Artificial Sequence
  chemically synthesized
atggaatttatagttcttccag

SEQ ID NO: 1203237 - DNA, 22 bp, Artificial Sequence
  chemically synthesized
tggaatttatagttcttccaga

SEQ ID NO: 1203238 - DNA, 22 bp, Artificial Sequence
  chemically synthesized
aatgcaaagtcgaaccacatct

SEQ ID NO: 1203239 - DNA, 22 bp, Artificial Sequence
  chemically synthesized
atagttcttccagatgtggttc

SEQ ID NO: 1203240 - DNA, 22 bp, Artificial Sequence
  chemically synthesized
tagttcttccagatgtggttcg

SEQ ID NO: 1203241 - DNA, 22 bp, Artificial Sequence
  chemically synthesized
ttccagatgtggttcgactttg

SEQ ID NO: 1203242 - DNA, 22 bp, Artificial Sequence
  chemically synthesized
ccagatgtggttcgactttgca

SEQ ID NO: 1203243 - DNA, 22 bp, Artificial Sequence
  chemically synthesized
aggtagactcaatgcaaagtcg

SEQ ID NO: 1203244 - DNA, 22 bp, Artificial Sequence
  chemically synthesized
cagatgtggttcgactttgcat

SEQ ID NO: 1203245 - DNA, 22 bp, Artificial Sequence
  chemically synthesized
taaggtagactcaatgcaaagt

SEQ ID NO: 1203246 - DNA, 22 bp, Artificial Sequence
  chemically synthesized
ctaaggtagactcaatgcaaag

SEQ ID NO: 1203247 - DNA, 22 bp, Artificial Sequence
  chemically synthesized
gactttgcattgagtctacctt

SEQ ID NO: 1203248 - DNA, 22 bp, Artificial Sequence
  chemically synthesized
tgcattgagtctaccttagaaa

SEQ ID NO: 1203249 - DNA, 22 bp, Artificial Sequence
  chemically synthesized
gcattgagtctaccttagaaat

SEQ ID NO: 1203250 - DNA, 22 bp, Artificial Sequence
  chemically synthesized
cattgagtctaccttagaaatt

SEQ ID NO: 1203251 - DNA, 22 bp, Artificial Sequence
  chemically synthesized
tgagtatgaaaaacaaatttct

SEQ ID NO: 1203252 - DNA, 22 bp, Artificial Sequence
  chemically synthesized
atgagtatgaaaaacaaatttc

SEQ ID NO: 1203253 - DNA, 22 bp, Artificial Sequence
  chemically synthesized
agtctaccttagaaatttgttt

SEQ ID NO: 1203254 - DNA, 22 bp, Artificial Sequence
  chemically synthesized
tatgagtatgaaaaacaaattt

SEQ ID NO: 1203255 - DNA, 22 bp, Artificial Sequence
  chemically synthesized
ccttagaaatttgtttttcata

SEQ ID NO: 1203256 - DNA, 22 bp, Artificial Sequence
  chemically synthesized
agaaatttgtttttcatactca

SEQ ID NO: 1203257 - DNA, 22 bp, Artificial Sequence
  chemically synthesized
gaaatttgtttttcatactcat

SEQ ID NO: 1203258 - DNA, 22 bp, Artificial Sequence
  chemically synthesized
gtttttcatactcataaagatt

SEQ ID NO: 1203259 - DNA, 22 bp, Artificial Sequence
  chemically synthesized
tttttcatactcataaagattt

SEQ ID NO: 1203260 - DNA, 22 bp, Artificial Sequence
  chemically synthesized
ttcatactcataaagatttcct

SEQ ID NO: 1203261 - DNA, 22 bp, Artificial Sequence
  chemically synthesized
tggtggtcaaataggaaatctt

SEQ ID NO: 1203262 - DNA, 22 bp, Artificial Sequence
  chemically synthesized
tcatactcataaagatttccta

SEQ ID NO: 1203263 - DNA, 22 bp, Artificial Sequence
  chemically synthesized
gtggtggtcaaataggaaatct

SEQ ID NO: 1203264 - DNA, 22 bp, Artificial Sequence
  chemically synthesized
catactcataaagatttcctat

SEQ ID NO: 1203265 - DNA, 22 bp, Artificial Sequence
  chemically synthesized
atactcataaagatttcctatt

SEQ ID NO: 1203266 - DNA, 22 bp, Artificial Sequence
  chemically synthesized
ataaagatttcctatttgacca

SEQ ID NO: 1203267 - DNA, 22 bp, Artificial Sequence
  chemically synthesized
cctatttgaccaccacaaaccc

SEQ ID NO: 1203268 - DNA, 22 bp, Artificial Sequence
  chemically synthesized
ctatttgaccaccacaaaccct

SEQ ID NO: 1203269 - DNA, 22 bp, Artificial Sequence
  chemically synthesized
tttgaccaccacaaaccctctg

SEQ ID NO: 1203270 - DNA, 22 bp, Artificial Sequence
  chemically synthesized
tgagtggcagtgcagagggttt

SEQ ID NO: 1203271 - DNA, 22 bp, Artificial Sequence
  chemically synthesized
gaccaccacaaaccctctgcac

SEQ ID NO: 1203272 - DNA, 22 bp, Artificial Sequence
  chemically synthesized
ctatgagtggcagtgcagaggg

SEQ ID NO: 1203273 - DNA, 22 bp, Artificial Sequence
  chemically synthesized
accaccacaaaccctctgcact

SEQ ID NO: 1203274 - DNA, 22 bp, Artificial Sequence
  chemically synthesized
actatgagtggcagtgcagagg

SEQ ID NO: 1203275 - DNA, 22 bp, Artificial Sequence
  chemically synthesized
tgtggcttactatgagtggcag

SEQ ID NO: 1203276 - DNA, 22 bp, Artificial Sequence
  chemically synthesized
cctgtgtggcttactatgagtg

SEQ ID NO: 1203277 - DNA, 22 bp, Artificial Sequence
  chemically synthesized
tgcactgccactcatagtaagc

SEQ ID NO: 1203278 - DNA, 22 bp, Artificial Sequence
  chemically synthesized
cactgccactcatagtaagcca

SEQ ID NO: 1203279 - DNA, 22 bp, Artificial Sequence
  chemically synthesized
gagtatactccctgtgtggctt

SEQ ID NO: 1203280 - DNA, 22 bp, Artificial Sequence
  chemically synthesized
ccactcatagtaagccacacag

SEQ ID NO: 1203281 - DNA, 22 bp, Artificial Sequence
  chemically synthesized
gttggagtatactccctgtgtg

SEQ ID NO: 1203282 - DNA, 22 bp, Artificial Sequence
  chemically synthesized
ggttggagtatactccctgtgt

SEQ ID NO: 1203283 - DNA, 22 bp, Artificial Sequence
  chemically synthesized
atagtaagccacacagggagta

SEQ ID NO: 1203284 - DNA, 22 bp, Artificial Sequence
  chemically synthesized
aagcttggttggagtatactcc

SEQ ID NO: 1203285 - DNA, 22 bp, Artificial Sequence
  chemically synthesized
tactgaagcttggttggagtat

SEQ ID NO: 1203286 - DNA, 22 bp, Artificial Sequence
  chemically synthesized
gtactgaagcttggttggagta

SEQ ID NO: 1203287 - DNA, 22 bp, Artificial Sequence
  chemically synthesized
agggaagaatttgtactgaagc

SEQ ID NO: 1203288 - DNA, 22 bp, Artificial Sequence
  chemically synthesized
caaccaagcttcagtacaaatt

SEQ ID NO: 1203289 - DNA, 22 bp, Artificial Sequence
  chemically synthesized
cagtacaaattcttccctcagc

SEQ ID NO: 1203290 - DNA, 22 bp, Artificial Sequence
  chemically synthesized
agtacaaattcttccctcagct

SEQ ID NO: 1203291 - DNA, 22 bp, Artificial Sequence
  chemically synthesized
tagaacacccacagctgaggga

SEQ ID NO: 1203292 - DNA, 22 bp, Artificial Sequence
  chemically synthesized
aatgttatagaacacccacagc

SEQ ID NO: 1203293 - DNA, 22 bp, Artificial Sequence
  chemically synthesized
ttccctcagctgtgggtgttct

SEQ ID NO: 1203294 - DNA, 22 bp, Artificial Sequence
  chemically synthesized
ccctcagctgtgggtgttctat

SEQ ID NO: 1203295 - DNA, 22 bp, Artificial Sequence
  chemically synthesized
cctcagctgtgggtgttctata

SEQ ID NO: 1203296 - DNA, 22 bp, Artificial Sequence
  chemically synthesized
agctgtgggtgttctataacat

SEQ ID NO: 1203297 - DNA, 22 bp, Artificial Sequence
  chemically synthesized
agaaagccaattaaatgttata

SEQ ID NO: 1203298 - DNA, 22 bp, Artificial Sequence
  chemically synthesized
aagaaagccaattaaatgttat

SEQ ID NO: 1203299 - DNA, 22 bp, Artificial Sequence
  chemically synthesized
taagaaagccaattaaatgtta

SEQ ID NO: 1203300 - DNA, 22 bp, Artificial Sequence
  chemically synthesized
tgggtgttctataacatttaat

SEQ ID NO: 1203301 - DNA, 22 bp, Artificial Sequence
  chemically synthesized
tataacatttaattggctttct

SEQ ID NO: 1203302 - DNA, 22 bp, Artificial Sequence
  chemically synthesized
tgtcagattttaagaaagccaa

SEQ ID NO: 1203303 - DNA, 22 bp, Artificial Sequence
  chemically synthesized
gtgtcagattttaagaaagcca

SEQ ID NO: 1203304 - DNA, 22 bp, Artificial Sequence
  chemically synthesized
taacatttaattggctttctta

SEQ ID NO: 1203305 - DNA, 22 bp, Artificial Sequence
  chemically synthesized
tttgtgtcagattttaagaaag

SEQ ID NO: 1203306 - DNA, 22 bp, Artificial Sequence
  chemically synthesized
gttatttgtgtcagattttaag

SEQ ID NO: 1203307 - DNA, 22 bp, Artificial Sequence
  chemically synthesized
agttatttgtgtcagattttaa

SEQ ID NO: 1203308 - DNA, 22 bp, Artificial Sequence
  chemically synthesized
aattggctttcttaaaatctga

SEQ ID NO: 1203309 - DNA, 22 bp, Artificial Sequence
  chemically synthesized
tagttatttgtgtcagatttta

SEQ ID NO: 1203310 - DNA, 22 bp, Artificial Sequence
  chemically synthesized
attggctttcttaaaatctgac

SEQ ID NO: 1203311 - DNA, 22 bp, Artificial Sequence
  chemically synthesized
gctttcttaaaatctgacacaa

SEQ ID NO: 1203312 - DNA, 22 bp, Artificial Sequence
  chemically synthesized
tcttaaaatctgacacaaataa

SEQ ID NO: 1203313 - DNA, 22 bp, Artificial Sequence
  chemically synthesized
cttaaaatctgacacaaataac

SEQ ID NO: 1203314 - DNA, 22 bp, Artificial Sequence
  chemically synthesized
ttaaaatctgacacaaataact

SEQ ID NO: 1203315 - DNA, 22 bp, Artificial Sequence
  chemically synthesized
aaaatctgacacaaataactaa

SEQ ID NO: 1203316 - DNA, 22 bp, Artificial Sequence
  chemically synthesized
aaatctgacacaaataactaaa

SEQ ID NO: 1203317 - DNA, 22 bp, Artificial Sequence
  chemically synthesized
acaaagcatcaagagtctttag

SEQ ID NO: 1203318 - DNA, 22 bp, Artificial Sequence
  chemically synthesized
acacaaataactaaagactctt

SEQ ID NO: 1203319 - DNA, 22 bp, Artificial Sequence
  chemically synthesized
tgacaaagcatcaagagtcttt

SEQ ID NO: 1203320 - DNA, 22 bp, Artificial Sequence
  chemically synthesized
ctctgacaaagcatcaagagtc

SEQ ID NO: 1203321 - DNA, 22 bp, Artificial Sequence
  chemically synthesized
gctctgacaaagcatcaagagt

SEQ ID NO: 1203322 - DNA, 22 bp, Artificial Sequence
  chemically synthesized
tgctctgacaaagcatcaagag

SEQ ID NO: 1203323 - DNA, 22 bp, Artificial Sequence
  chemically synthesized
ctttgctctgacaaagcatcaa

SEQ ID NO: 1203324 - DNA, 22 bp, Artificial Sequence
  chemically synthesized
aagactcttgatgctttgtcag

SEQ ID NO: 1203325 - DNA, 22 bp, Artificial Sequence
  chemically synthesized
acactcctttgctctgacaaag

SEQ ID NO: 1203326 - DNA, 22 bp, Artificial Sequence
  chemically synthesized
cacactcctttgctctgacaaa

SEQ ID NO: 1203327 - DNA, 22 bp, Artificial Sequence
  chemically synthesized
ttgatgctttgtcagagcaaag

SEQ ID NO: 1203328 - DNA, 22 bp, Artificial Sequence
  chemically synthesized
gatgctttgtcagagcaaagga

SEQ ID NO: 1203329 - DNA, 22 bp, Artificial Sequence
  chemically synthesized
atgctttgtcagagcaaaggag

SEQ ID NO: 1203330 - DNA, 22 bp, Artificial Sequence
  chemically synthesized
tgtcagagcaaaggagtgtgaa

SEQ ID NO: 1203331 - DNA, 22 bp, Artificial Sequence
  chemically synthesized
gtcagagcaaaggagtgtgaaa

SEQ ID NO: 1203332 - DNA, 22 bp, Artificial Sequence
  chemically synthesized
tcagagcaaaggagtgtgaaac

SEQ ID NO: 1203333 - DNA, 22 bp, Artificial Sequence
  chemically synthesized
gaggagataatggtttcacact

SEQ ID NO: 1203334 - DNA, 22 bp, Artificial Sequence
  chemically synthesized
agaggagataatggtttcacac

SEQ ID NO: 1203335 - DNA, 22 bp, Artificial Sequence
  chemically synthesized
tctcctctaaatactacattat

SEQ ID NO: 1203336 - DNA, 22 bp, Artificial Sequence
  chemically synthesized
ctctaaatactacattatacta

SEQ ID NO: 1203337 - DNA, 22 bp, Artificial Sequence
  chemically synthesized
taaatactacattatactatac

SEQ ID NO: 1203338 - DNA, 22 bp, Artificial Sequence
  chemically synthesized
aatactacattatactatactt

SEQ ID NO: 1203339 - DNA, 22 bp, Artificial Sequence
  chemically synthesized
acagaaatatgatacaaagtat

SEQ ID NO: 1203340 - DNA, 22 bp, Artificial Sequence
  chemically synthesized
cattatactatactttgtatca

SEQ ID NO: 1203341 - DNA, 22 bp, Artificial Sequence
  chemically synthesized
aattaacagaaatatgatacaa

SEQ ID NO: 1203342 - DNA, 22 bp, Artificial Sequence
  chemically synthesized
tactatactttgtatcatattt

SEQ ID NO: 1203343 - DNA, 22 bp, Artificial Sequence
  chemically synthesized
tactttgtatcatatttctgtt

SEQ ID NO: 1203344 - DNA, 22 bp, Artificial Sequence
  chemically synthesized
aaaatgctaaattaacagaaat

SEQ ID NO: 1203345 - DNA, 22 bp, Artificial Sequence
  chemically synthesized
taaaaatgctaaattaacagaa

SEQ ID NO: 1203346 - DNA, 22 bp, Artificial Sequence
  chemically synthesized
tgtatcatatttctgttaattt

SEQ ID NO: 1203347 - DNA, 22 bp, Artificial Sequence
  chemically synthesized
gtatcatatttctgttaattta

SEQ ID NO: 1203348 - DNA, 22 bp, Artificial Sequence
  chemically synthesized
tatcatatttctgttaatttag

SEQ ID NO: 1203349 - DNA, 22 bp, Artificial Sequence
  chemically synthesized
taaatattctaaaaatgctaaa

SEQ ID NO: 1203350 - DNA, 22 bp, Artificial Sequence
  chemically synthesized
ctgttaatttagcatttttaga

SEQ ID NO: 1203351 - DNA, 22 bp, Artificial Sequence
  chemically synthesized
tattataaatattctaaaaatg

SEQ ID NO: 1203352 - DNA, 22 bp, Artificial Sequence
  chemically synthesized
tgttaatttagcatttttagaa

SEQ ID NO: 1203353 - DNA, 22 bp, Artificial Sequence
  chemically synthesized
ttaatttagcatttttagaata

SEQ ID NO: 1203354 - DNA, 22 bp, Artificial Sequence
  chemically synthesized
atttagcatttttagaatattt

SEQ ID NO: 1203355 - DNA, 22 bp, Artificial Sequence
  chemically synthesized
acattgtattataaatattcta

SEQ ID NO: 1203356 - DNA, 22 bp, Artificial Sequence
  chemically synthesized
agcatttttagaatatttataa

SEQ ID NO: 1203357 - DNA, 22 bp, Artificial Sequence
  chemically synthesized
gcatttttagaatatttataat

SEQ ID NO: 1203358 - DNA, 22 bp, Artificial Sequence
  chemically synthesized
ttagaatatttataatacaatg

SEQ ID NO: 1203359 - DNA, 22 bp, Artificial Sequence
  chemically synthesized
tagaatatttataatacaatgt

SEQ ID NO: 1203360 - DNA, 22 bp, Artificial Sequence
  chemically synthesized
agaatatttataatacaatgtt

SEQ ID NO: 1203361 - DNA, 22 bp, Artificial Sequence
  chemically synthesized
gaatatttataatacaatgtta

SEQ ID NO: 1203362 - DNA, 22 bp, Artificial Sequence
  chemically synthesized
ataatacaatgttagttctccc

SEQ ID NO: 1203363 - DNA, 22 bp, Artificial Sequence
  chemically synthesized
taatacaatgttagttctccct

SEQ ID NO: 1203364 - DNA, 22 bp, Artificial Sequence
  chemically synthesized
acatgtagacgcaagtacagaa

SEQ ID NO: 1203365 - DNA, 22 bp, Artificial Sequence
  chemically synthesized
gttctccctttctgtacttgcg

SEQ ID NO: 1203366 - DNA, 22 bp, Artificial Sequence
  chemically synthesized
tccctttctgtacttgcgtcta

SEQ ID NO: 1203367 - DNA, 22 bp, Artificial Sequence
  chemically synthesized
cctttctgtacttgcgtctaca

SEQ ID NO: 1203368 - DNA, 22 bp, Artificial Sequence
  chemically synthesized
aagaacatattaacatgtagac

SEQ ID NO: 1203369 - DNA, 22 bp, Artificial Sequence
  chemically synthesized
tctgtacttgcgtctacatgtt

SEQ ID NO: 1203370 - DNA, 22 bp, Artificial Sequence
  chemically synthesized
ctgtacttgcgtctacatgtta

SEQ ID NO: 1203371 - DNA, 22 bp, Artificial Sequence
  chemically synthesized
tgtacttgcgtctacatgttaa

SEQ ID NO: 1203372 - DNA, 22 bp, Artificial Sequence
  chemically synthesized
cctcaagaacatattaacatgt

SEQ ID NO: 1203373 - DNA, 22 bp, Artificial Sequence
  chemically synthesized
tacttgcgtctacatgttaata

SEQ ID NO: 1203374 - DNA, 22 bp, Artificial Sequence
  chemically synthesized
ccctcaagaacatattaacatg

SEQ ID NO: 1203375 - DNA, 22 bp, Artificial Sequence
  chemically synthesized
cttccctcaagaacatattaac

SEQ ID NO: 1203376 - DNA, 22 bp, Artificial Sequence
  chemically synthesized
gcgtctacatgttaatatgttc

SEQ ID NO: 1203377 - DNA, 22 bp, Artificial Sequence
  chemically synthesized
cgtctacatgttaatatgttct

SEQ ID NO: 1203378 - DNA, 22 bp, Artificial Sequence
  chemically synthesized
ggttccttccctcaagaacata

SEQ ID NO: 1203379 - DNA, 22 bp, Artificial Sequence
  chemically synthesized
catgttaatatgttcttgaggg

SEQ ID NO: 1203380 - DNA, 22 bp, Artificial Sequence
  chemically synthesized
atatgttcttgagggaaggaac

SEQ ID NO: 1203381 - DNA, 22 bp, Artificial Sequence
  chemically synthesized
ttgagggaaggaaccgagcctt

SEQ ID NO: 1203382 - DNA, 22 bp, Artificial Sequence
  chemically synthesized
tataaaggtgaataaggctcgg

SEQ ID NO: 1203383 - DNA, 22 bp, Artificial Sequence
  chemically synthesized
gagggaaggaaccgagccttat

SEQ ID NO: 1203384 - DNA, 22 bp, Artificial Sequence
  chemically synthesized
agggaaggaaccgagccttatt

SEQ ID NO: 1203385 - DNA, 22 bp, Artificial Sequence
  chemically synthesized
ggttatataaaggtgaataagg

SEQ ID NO: 1203386 - DNA, 22 bp, Artificial Sequence
  chemically synthesized
ctaggttatataaaggtgaata

SEQ ID NO: 1203387 - DNA, 22 bp, Artificial Sequence
  chemically synthesized
gctaggttatataaaggtgaat

SEQ ID NO: 1203388 - DNA, 22 bp, Artificial Sequence
  chemically synthesized
attcacctttatataacctagc

SEQ ID NO: 1203389 - DNA, 22 bp, Artificial Sequence
  chemically synthesized
ttcacctttatataacctagca

SEQ ID NO: 1203390 - DNA, 22 bp, Artificial Sequence
  chemically synthesized
acctttatataacctagcaagt

SEQ ID NO: 1203391 - DNA, 22 bp, Artificial Sequence
  chemically synthesized
tatataacctagcaagttgacc

SEQ ID NO: 1203392 - DNA, 22 bp, Artificial Sequence
  chemically synthesized
atataacctagcaagttgacca

SEQ ID NO: 1203393 - DNA, 22 bp, Artificial Sequence
  chemically synthesized
tataacctagcaagttgaccac

SEQ ID NO: 1203394 - DNA, 22 bp, Artificial Sequence
  chemically synthesized
tgtaacaccaaccatgtggtca

SEQ ID NO: 1203395 - DNA, 22 bp, Artificial Sequence
  chemically synthesized
ttatgtaacaccaaccatgtgg

SEQ ID NO: 1203396 - DNA, 22 bp, Artificial Sequence
  chemically synthesized
gttatgtaacaccaaccatgtg

SEQ ID NO: 1203397 - DNA, 22 bp, Artificial Sequence
  chemically synthesized
gcaagttgaccacatggttggt

SEQ ID NO: 1203398 - DNA, 22 bp, Artificial Sequence
  chemically synthesized
aatggcttgttatgtaacacca

SEQ ID NO: 1203399 - DNA, 22 bp, Artificial Sequence
  chemically synthesized
caatggcttgttatgtaacacc

SEQ ID NO: 1203400 - DNA, 22 bp, Artificial Sequence
  chemically synthesized
accacatggttggtgttacata

SEQ ID NO: 1203401 - DNA, 22 bp, Artificial Sequence
  chemically synthesized
tcaatggcttgttatgtaacac

SEQ ID NO: 1203402 - DNA, 22 bp, Artificial Sequence
  chemically synthesized
ttttcaatggcttgttatgtaa

SEQ ID NO: 1203403 - DNA, 22 bp, Artificial Sequence
  chemically synthesized
attttcaatggcttgttatgta

SEQ ID NO: 1203404 - DNA, 22 bp, Artificial Sequence
  chemically synthesized
tattttcaatggcttgttatgt

SEQ ID NO: 1203405 - DNA, 22 bp, Artificial Sequence
  chemically synthesized
ctttattttcaatggcttgtta

SEQ ID NO: 1203406 - DNA, 22 bp, Artificial Sequence
  chemically synthesized
gctttattttcaatggcttgtt

SEQ ID NO: 1203407 - DNA, 22 bp, Artificial Sequence
  chemically synthesized
gtgttacataacaagccattga

SEQ ID NO: 1203408 - DNA, 22 bp, Artificial Sequence
  chemically synthesized
cttgctttattttcaatggctt

SEQ ID NO: 1203409 - DNA, 22 bp, Artificial Sequence
  chemically synthesized
gcttgctttattttcaatggct

SEQ ID NO: 1203410 - DNA, 22 bp, Artificial Sequence
  chemically synthesized
cttgcttgctttattttcaatg

SEQ ID NO: 1203411 - DNA, 22 bp, Artificial Sequence
  chemically synthesized
cataacaagccattgaaaataa

SEQ ID NO: 1203412 - DNA, 22 bp, Artificial Sequence
  chemically synthesized
attgcttgcttgctttattttc

SEQ ID NO: 1203413 - DNA, 22 bp, Artificial Sequence
  chemically synthesized
aattgcttgcttgctttatttt

SEQ ID NO: 1203414 - DNA, 22 bp, Artificial Sequence
  chemically synthesized
ttaattgcttgcttgctttatt

SEQ ID NO: 1203415 - DNA, 22 bp, Artificial Sequence
  chemically synthesized
cttaattgcttgcttgctttat

SEQ ID NO: 1203416 - DNA, 22 bp, Artificial Sequence
  chemically synthesized
gtaccttcttaattgcttgctt

SEQ ID NO: 1203417 - DNA, 22 bp, Artificial Sequence
  chemically synthesized
ggtaccttcttaattgcttgct

SEQ ID NO: 1203418 - DNA, 22 bp, Artificial Sequence
  chemically synthesized
aaaataaagcaagcaagcaatt

SEQ ID NO: 1203419 - DNA, 22 bp, Artificial Sequence
  chemically synthesized
agcagggtttggtaccttctta

SEQ ID NO: 1203420 - DNA, 22 bp, Artificial Sequence
  chemically synthesized
agaaggtaccaaaccctgctca

SEQ ID NO: 1203421 - DNA, 22 bp, Artificial Sequence
  chemically synthesized
ctcaattctattttgtgggttt

SEQ ID NO: 1203422 - DNA, 22 bp, Artificial Sequence
  chemically synthesized
aatcacggggtcaaaacccaca

SEQ ID NO: 1203423 - DNA, 22 bp, Artificial Sequence
  chemically synthesized
aattctattttgtgggttttga

SEQ ID NO: 1203424 - DNA, 22 bp, Artificial Sequence
  chemically synthesized
tattttgtgggttttgaccccg

SEQ ID NO: 1203425 - DNA, 22 bp, Artificial Sequence
  chemically synthesized
ttttgtgggttttgaccccgtg

SEQ ID NO: 1203426 - DNA, 22 bp, Artificial Sequence
  chemically synthesized
atgataggctaaatcacggggt

SEQ ID NO: 1203427 - DNA, 22 bp, Artificial Sequence
  chemically synthesized
tgtgggttttgaccccgtgatt

SEQ ID NO: 1203428 - DNA, 22 bp, Artificial Sequence
  chemically synthesized
catgataggctaaatcacgggg

SEQ ID NO: 1203429 - DNA, 22 bp, Artificial Sequence
  chemically synthesized
gtgggttttgaccccgtgattt

SEQ ID NO: 1203430 - DNA, 22 bp, Artificial Sequence
  chemically synthesized
tcatgataggctaaatcacggg

SEQ ID NO: 1203431 - DNA, 22 bp, Artificial Sequence
  chemically synthesized
tgggttttgaccccgtgattta

SEQ ID NO: 1203432 - DNA, 22 bp, Artificial Sequence
  chemically synthesized
ttcatgataggctaaatcacgg

SEQ ID NO: 1203433 - DNA, 22 bp, Artificial Sequence
  chemically synthesized
tgaccccgtgatttagcctatc

SEQ ID NO: 1203434 - DNA, 22 bp, Artificial Sequence
  chemically synthesized
gaccccgtgatttagcctatca

SEQ ID NO: 1203435 - DNA, 22 bp, Artificial Sequence
  chemically synthesized
accccgtgatttagcctatcat

SEQ ID NO: 1203436 - DNA, 22 bp, Artificial Sequence
  chemically synthesized
agcctatcatgaaaaattctca

SEQ ID NO: 1203437 - DNA, 22 bp, Artificial Sequence
  chemically synthesized
gcctatcatgaaaaattctcat

SEQ ID NO: 1203438 - DNA, 22 bp, Artificial Sequence
  chemically synthesized
tcatgaaaaattctcatcttca

SEQ ID NO: 1203439 - DNA, 22 bp, Artificial Sequence
  chemically synthesized
ggtggggggtcaaaatgaagat

SEQ ID NO: 1203440 - DNA, 22 bp, Artificial Sequence
  chemically synthesized
tcatcttcattttgacccccca

SEQ ID NO: 1203441 - DNA, 22 bp, Artificial Sequence
  chemically synthesized
atcttcattttgaccccccacc

SEQ ID NO: 1203442 - DNA, 22 bp, Artificial Sequence
  chemically synthesized
cattttgaccccccacccagat

SEQ ID NO: 1203443 - DNA, 22 bp, Artificial Sequence
  chemically synthesized
cagatggcacaaatctgggtgg

SEQ ID NO: 1203444 - DNA, 22 bp, Artificial Sequence
  chemically synthesized
attttgaccccccacccagatt

SEQ ID NO: 1203445 - DNA, 22 bp, Artificial Sequence
  chemically synthesized
gcagatggcacaaatctgggtg

SEQ ID NO: 1203446 - DNA, 22 bp, Artificial Sequence
  chemically synthesized
tgcagatggcacaaatctgggt

SEQ ID NO: 1203447 - DNA, 22 bp, Artificial Sequence
  chemically synthesized
tgaccccccacccagatttgtg

SEQ ID NO: 1203448 - DNA, 22 bp, Artificial Sequence
  chemically synthesized
gaccccccacccagatttgtgc

SEQ ID NO: 1203449 - DNA, 22 bp, Artificial Sequence
  chemically synthesized
accccccacccagatttgtgcc

SEQ ID NO: 1203450 - DNA, 22 bp, Artificial Sequence
  chemically synthesized
aattttgcagatggcacaaatc

SEQ ID NO: 1203451 - DNA, 22 bp, Artificial Sequence
  chemically synthesized
caattttgcagatggcacaaat

SEQ ID NO: 1203452 - DNA, 22 bp, Artificial Sequence
  chemically synthesized
tcaattttgcagatggcacaaa

SEQ ID NO: 1203453 - DNA, 22 bp, Artificial Sequence
  chemically synthesized
gtgccatctgcaaaattgaaaa

SEQ ID NO: 1203454 - DNA, 22 bp, Artificial Sequence
  chemically synthesized
tgccatctgcaaaattgaaaat

SEQ ID NO: 1203455 - DNA, 22 bp, Artificial Sequence
  chemically synthesized
caaaattgaaaattaccccttt

SEQ ID NO: 1203456 - DNA, 22 bp, Artificial Sequence
  chemically synthesized
cataacatcagcaaaggggtaa

SEQ ID NO: 1203457 - DNA, 22 bp, Artificial Sequence
  chemically synthesized
acataacatcagcaaaggggta

SEQ ID NO: 1203458 - DNA, 22 bp, Artificial Sequence
  chemically synthesized
aaaattacccctttgctgatgt

SEQ ID NO: 1203459 - DNA, 22 bp, Artificial Sequence
  chemically synthesized
atcaataccttacataacatca

SEQ ID NO: 1203460 - DNA, 22 bp, Artificial Sequence
  chemically synthesized
cccctttgctgatgttatgtaa

SEQ ID NO: 1203461 - DNA, 22 bp, Artificial Sequence
  chemically synthesized
aataattgatcaataccttaca

SEQ ID NO: 1203462 - DNA, 22 bp, Artificial Sequence
  chemically synthesized
tgctgatgttatgtaaggtatt

SEQ ID NO: 1203463 - DNA, 22 bp, Artificial Sequence
  chemically synthesized
gctgatgttatgtaaggtattg

SEQ ID NO: 1203464 - DNA, 22 bp, Artificial Sequence
  chemically synthesized
ctgatgttatgtaaggtattga

SEQ ID NO: 1203465 - DNA, 22 bp, Artificial Sequence
  chemically synthesized
ctgaataattgatcaatacctt

SEQ ID NO: 1203466 - DNA, 22 bp, Artificial Sequence
  chemically synthesized
atgttatgtaaggtattgatca

SEQ ID NO: 1203467 - DNA, 22 bp, Artificial Sequence
  chemically synthesized
tgctgctgaataattgatcaat

SEQ ID NO: 1203468 - DNA, 22 bp, Artificial Sequence
  chemically synthesized
tgtgctgctgaataattgatca

SEQ ID NO: 1203469 - DNA, 22 bp, Artificial Sequence
  chemically synthesized
tgtaaggtattgatcaattatt

SEQ ID NO: 1203470 - DNA, 22 bp, Artificial Sequence
  chemically synthesized
ccacaggttctgtgctgctgaa

SEQ ID NO: 1203471 - DNA, 22 bp, Artificial Sequence
  chemically synthesized
atcaattattcagcagcacaga

SEQ ID NO: 1203472 - DNA, 22 bp, Artificial Sequence
  chemically synthesized
gtaagctaccacaggttctgtg

SEQ ID NO: 1203473 - DNA, 22 bp, Artificial Sequence
  chemically synthesized
ttcagcagcacagaacctgtgg

SEQ ID NO: 1203474 - DNA, 22 bp, Artificial Sequence
  chemically synthesized
taattagtaagctaccacaggt

SEQ ID NO: 1203475 - DNA, 22 bp, Artificial Sequence
  chemically synthesized
agcagcacagaacctgtggtag

SEQ ID NO: 1203476 - DNA, 22 bp, Artificial Sequence
  chemically synthesized
ttataattagtaagctaccaca

SEQ ID NO: 1203477 - DNA, 22 bp, Artificial Sequence
  chemically synthesized
attataattagtaagctaccac

SEQ ID NO: 1203478 - DNA, 22 bp, Artificial Sequence
  chemically synthesized
tattataattagtaagctacca

SEQ ID NO: 1203479 - DNA, 22 bp, Artificial Sequence
  chemically synthesized
ttttattataattagtaagcta

SEQ ID NO: 1203480 - DNA, 22 bp, Artificial Sequence
  chemically synthesized
aatattgttttattataattag

SEQ ID NO: 1203481 - DNA, 22 bp, Artificial Sequence
  chemically synthesized
tggtagcttactaattataata

SEQ ID NO: 1203482 - DNA, 22 bp, Artificial Sequence
  chemically synthesized
taaatattgttttattataatt

SEQ ID NO: 1203483 - DNA, 22 bp, Artificial Sequence
  chemically synthesized
actaattataataaaacaatat

SEQ ID NO: 1203484 - DNA, 22 bp, Artificial Sequence
  chemically synthesized
ctaattataataaaacaatatt

SEQ ID NO: 1203485 - DNA, 22 bp, Artificial Sequence
  chemically synthesized
attataataaaacaatatttag

SEQ ID NO: 1203486 - DNA, 22 bp, Artificial Sequence
  chemically synthesized
agtgaccagcaactctaaatat

SEQ ID NO: 1203487 - DNA, 22 bp, Artificial Sequence
  chemically synthesized
taataaaacaatatttagagtt

SEQ ID NO: 1203488 - DNA, 22 bp, Artificial Sequence
  chemically synthesized
gtagatattaagtgaccagcaa

SEQ ID NO: 1203489 - DNA, 22 bp, Artificial Sequence
  chemically synthesized
ggtagatattaagtgaccagca

SEQ ID NO: 1203490 - DNA, 22 bp, Artificial Sequence
  chemically synthesized
agagttgctggtcacttaatat

SEQ ID NO: 1203491 - DNA, 22 bp, Artificial Sequence
  chemically synthesized
gagttgctggtcacttaatatc

SEQ ID NO: 1203492 - DNA, 22 bp, Artificial Sequence
  chemically synthesized
aaaaggtgcttggtagatatta

SEQ ID NO: 1203493 - DNA, 22 bp, Artificial Sequence
  chemically synthesized
aaaaaggtgcttggtagatatt

SEQ ID NO: 1203494 - DNA, 22 bp, Artificial Sequence
  chemically synthesized
ctggtcacttaatatctaccaa

SEQ ID NO: 1203495 - DNA, 22 bp, Artificial Sequence
  chemically synthesized
gtcacttaatatctaccaagca

SEQ ID NO: 1203496 - DNA, 22 bp, Artificial Sequence
  chemically synthesized
aatatctaccaagcaccttttt

SEQ ID NO: 1203497 - DNA, 22 bp, Artificial Sequence
  chemically synthesized
atatctaccaagcaccttttta

SEQ ID NO: 1203498 - DNA, 22 bp, Artificial Sequence
  chemically synthesized
catacatgtaaaagtatttaaa

SEQ ID NO: 1203499 - DNA, 22 bp, Artificial Sequence
  chemically synthesized
ccaagcacctttttaaatactt

SEQ ID NO: 1203500 - DNA, 22 bp, Artificial Sequence
  chemically synthesized
tttaaatacttttacatgtatg

SEQ ID NO: 1203501 - DNA, 22 bp, Artificial Sequence
  chemically synthesized
ttaaatacttttacatgtatgt

SEQ ID NO: 1203502 - DNA, 22 bp, Artificial Sequence
  chemically synthesized
taaatacttttacatgtatgta

SEQ ID NO: 1203503 - DNA, 22 bp, Artificial Sequence
  chemically synthesized
aaatacttttacatgtatgtaa

SEQ ID NO: 1203504 - DNA, 22 bp, Artificial Sequence
  chemically synthesized
aatacttttacatgtatgtaac

SEQ ID NO: 1203505 - DNA, 22 bp, Artificial Sequence
  chemically synthesized
acatgtatgtatgtagttacat

SEQ ID NO: 1203506 - DNA, 22 bp, Artificial Sequence
  chemically synthesized
aacatgtatgtatgtagttaca

SEQ ID NO: 1203507 - DNA, 22 bp, Artificial Sequence
  chemically synthesized
ttacatgtatgtaactacatac

SEQ ID NO: 1203508 - DNA, 22 bp, Artificial Sequence
  chemically synthesized
tacatgtatgtaactacataca

SEQ ID NO: 1203509 - DNA, 22 bp, Artificial Sequence
  chemically synthesized
acatgtatgtaactacatacat

SEQ ID NO: 1203510 - DNA, 22 bp, Artificial Sequence
  chemically synthesized
agtttaacatgtatgtatgtag

SEQ ID NO: 1203511 - DNA, 22 bp, Artificial Sequence
  chemically synthesized
catgtatgtaactacatacata

SEQ ID NO: 1203512 - DNA, 22 bp, Artificial Sequence
  chemically synthesized
aagtttaacatgtatgtatgta

SEQ ID NO: 1203513 - DNA, 22 bp, Artificial Sequence
  chemically synthesized
aaaatatttaagtttaacatgt

SEQ ID NO: 1203514 - DNA, 22 bp, Artificial Sequence
  chemically synthesized
gaaaatatttaagtttaacatg

SEQ ID NO: 1203515 - DNA, 22 bp, Artificial Sequence
  chemically synthesized
tgaaaatatttaagtttaacat

SEQ ID NO: 1203516 - DNA, 22 bp, Artificial Sequence
  chemically synthesized
catacatacatgttaaacttaa

SEQ ID NO: 1203517 - DNA, 22 bp, Artificial Sequence
  chemically synthesized
ttttgaaaatatttaagtttaa

SEQ ID NO: 1203518 - DNA, 22 bp, Artificial Sequence
  chemically synthesized
ataagattgttttgaaaatatt

SEQ ID NO: 1203519 - DNA, 22 bp, Artificial Sequence
  chemically synthesized
aacttaaatattttcaaaacaa

SEQ ID NO: 1203520 - DNA, 22 bp, Artificial Sequence
  chemically synthesized
tatccatctgataagattgttt

SEQ ID NO: 1203521 - DNA, 22 bp, Artificial Sequence
  chemically synthesized
aaatattttcaaaacaatctta

SEQ ID NO: 1203522 - DNA, 22 bp, Artificial Sequence
  chemically synthesized
aatattttcaaaacaatcttat

SEQ ID NO: 1203523 - DNA, 22 bp, Artificial Sequence
  chemically synthesized
tcaaaacaatcttatcagatgg

SEQ ID NO: 1203524 - DNA, 22 bp, Artificial Sequence
  chemically synthesized
caaaacaatcttatcagatgga

SEQ ID NO: 1203525 - DNA, 22 bp, Artificial Sequence
  chemically synthesized
aaaacaatcttatcagatggat

SEQ ID NO: 1203526 - DNA, 22 bp, Artificial Sequence
  chemically synthesized
taaaatggcgataattgtatcc

SEQ ID NO: 1203527 - DNA, 22 bp, Artificial Sequence
  chemically synthesized
atcagatggatacaattatcgc

SEQ ID NO: 1203528 - DNA, 22 bp, Artificial Sequence
  chemically synthesized
atctgtaaaatggcgataattg

SEQ ID NO: 1203529 - DNA, 22 bp, Artificial Sequence
  chemically synthesized
tcagatggatacaattatcgcc

SEQ ID NO: 1203530 - DNA, 22 bp, Artificial Sequence
  chemically synthesized
ctcatctgtaaaatggcgataa

SEQ ID NO: 1203531 - DNA, 22 bp, Artificial Sequence
  chemically synthesized
cctcatctgtaaaatggcgata

SEQ ID NO: 1203532 - DNA, 22 bp, Artificial Sequence
  chemically synthesized
agtttcctcatctgtaaaatgg

SEQ ID NO: 1203533 - DNA, 22 bp, Artificial Sequence
  chemically synthesized
cagtttcctcatctgtaaaatg

SEQ ID NO: 1203534 - DNA, 22 bp, Artificial Sequence
  chemically synthesized
tgtttcagtttcctcatctgta

SEQ ID NO: 1203535 - DNA, 22 bp, Artificial Sequence
  chemically synthesized
tcgccattttacagatgaggaa

SEQ ID NO: 1203536 - DNA, 22 bp, Artificial Sequence
  chemically synthesized
gtcatactgtgtttcagtttcc

SEQ ID NO: 1203537 - DNA, 22 bp, Artificial Sequence
  chemically synthesized
tacagatgaggaaactgaaaca

SEQ ID NO: 1203538 - DNA, 22 bp, Artificial Sequence
  chemically synthesized
acagatgaggaaactgaaacac

SEQ ID NO: 1203539 - DNA, 22 bp, Artificial Sequence
  chemically synthesized
cagatgaggaaactgaaacaca

SEQ ID NO: 1203540 - DNA, 22 bp, Artificial Sequence
  chemically synthesized
agaaagttagtcatactgtgtt

SEQ ID NO: 1203541 - DNA, 22 bp, Artificial Sequence
  chemically synthesized
tgtggccctcagaaagttagtc

SEQ ID NO: 1203542 - DNA, 22 bp, Artificial Sequence
  chemically synthesized
aaacacagtatgactaactttc

SEQ ID NO: 1203543 - DNA, 22 bp, Artificial Sequence
  chemically synthesized
aaagctgtgtggccctcagaaa

SEQ ID NO: 1203544 - DNA, 22 bp, Artificial Sequence
  chemically synthesized
aaaagctgtgtggccctcagaa

SEQ ID NO: 1203545 - DNA, 22 bp, Artificial Sequence
  chemically synthesized
cttaaaagctgtgtggccctca

SEQ ID NO: 1203546 - DNA, 22 bp, Artificial Sequence
  chemically synthesized
tattacttaaaagctgtgtggc

SEQ ID NO: 1203547 - DNA, 22 bp, Artificial Sequence
  chemically synthesized
actttctgagggccacacagct

SEQ ID NO: 1203548 - DNA, 22 bp, Artificial Sequence
  chemically synthesized
gctgtattacttaaaagctgtg

SEQ ID NO: 1203549 - DNA, 22 bp, Artificial Sequence
  chemically synthesized
tctgagggccacacagctttta

SEQ ID NO: 1203550 - DNA, 22 bp, Artificial Sequence
  chemically synthesized
ctgagggccacacagcttttaa

SEQ ID NO: 1203551 - DNA, 22 bp, Artificial Sequence
  chemically synthesized
tgagggccacacagcttttaag

SEQ ID NO: 1203552 - DNA, 22 bp, Artificial Sequence
  chemically synthesized
agggccacacagcttttaagta

SEQ ID NO: 1203553 - DNA, 22 bp, Artificial Sequence
  chemically synthesized
aatcctagctgtattacttaaa

SEQ ID NO: 1203554 - DNA, 22 bp, Artificial Sequence
  chemically synthesized
gaatcctagctgtattacttaa

SEQ ID NO: 1203555 - DNA, 22 bp, Artificial Sequence
  chemically synthesized
ggtttgaatcctagctgtatta

SEQ ID NO: 1203556 - DNA, 22 bp, Artificial Sequence
  chemically synthesized
gggtttgaatcctagctgtatt

SEQ ID NO: 1203557 - DNA, 22 bp, Artificial Sequence
  chemically synthesized
cttgggtttgaatcctagctgt

SEQ ID NO: 1203558 - DNA, 22 bp, Artificial Sequence
  chemically synthesized
ttaagtaatacagctaggattc

SEQ ID NO: 1203559 - DNA, 22 bp, Artificial Sequence
  chemically synthesized
taagtaatacagctaggattca

SEQ ID NO: 1203560 - DNA, 22 bp, Artificial Sequence
  chemically synthesized
aagtaatacagctaggattcaa

SEQ ID NO: 1203561 - DNA, 22 bp, Artificial Sequence
  chemically synthesized
agtaatacagctaggattcaaa

SEQ ID NO: 1203562 - DNA, 22 bp, Artificial Sequence
  chemically synthesized
agatgcactgcttgggtttgaa

SEQ ID NO: 1203563 - DNA, 22 bp, Artificial Sequence
  chemically synthesized
gagatgcactgcttgggtttga

SEQ ID NO: 1203564 - DNA, 22 bp, Artificial Sequence
  chemically synthesized
agatcttgagatgcactgcttg

SEQ ID NO: 1203565 - DNA, 22 bp, Artificial Sequence
  chemically synthesized
ggattcaaacccaagcagtgca

SEQ ID NO: 1203566 - DNA, 22 bp, Artificial Sequence
  chemically synthesized
aaacccaagcagtgcatctcaa

SEQ ID NO: 1203567 - DNA, 22 bp, Artificial Sequence
  chemically synthesized
aagatctcagacttttaccact

SEQ ID NO: 1203568 - DNA, 22 bp, Artificial Sequence
  chemically synthesized
gtcaggagggcagagtggtaaa

SEQ ID NO: 1203569 - DNA, 22 bp, Artificial Sequence
  chemically synthesized
agtcaggagggcagagtggtaa

SEQ ID NO: 1203570 - DNA, 22 bp, Artificial Sequence
  chemically synthesized
tagtcaggagggcagagtggta

SEQ ID NO: 1203571 - DNA, 22 bp, Artificial Sequence
  chemically synthesized
agacttttaccactctgccctc

SEQ ID NO: 1203572 - DNA, 22 bp, Artificial Sequence
  chemically synthesized
ttaccactctgccctcctgact

SEQ ID NO: 1203573 - DNA, 22 bp, Artificial Sequence
  chemically synthesized
taccactctgccctcctgacta

SEQ ID NO: 1203574 - DNA, 22 bp, Artificial Sequence
  chemically synthesized
accactctgccctcctgactaa

SEQ ID NO: 1203575 - DNA, 22 bp, Artificial Sequence
  chemically synthesized
ccactctgccctcctgactaaa

SEQ ID NO: 1203576 - DNA, 22 bp, Artificial Sequence
  chemically synthesized
tatatagaatacacattttagt

SEQ ID NO: 1203577 - DNA, 22 bp, Artificial Sequence
  chemically synthesized
tgccctcctgactaaaatgtgt

SEQ ID NO: 1203578 - DNA, 22 bp, Artificial Sequence
  chemically synthesized
tgtatatagaatacacatttta

SEQ ID NO: 1203579 - DNA, 22 bp, Artificial Sequence
  chemically synthesized
ccctcctgactaaaatgtgtat

SEQ ID NO: 1203580 - DNA, 22 bp, Artificial Sequence
  chemically synthesized
ctgactaaaatgtgtattctat

SEQ ID NO: 1203581 - DNA, 22 bp, Artificial Sequence
  chemically synthesized
actaaaatgtgtattctatata

SEQ ID NO: 1203582 - DNA, 22 bp, Artificial Sequence
  chemically synthesized
ggagagtgagctctgtatatag

SEQ ID NO: 1203583 - DNA, 22 bp, Artificial Sequence
  chemically synthesized
aaatgtgtattctatatacaga

SEQ ID NO: 1203584 - DNA, 22 bp, Artificial Sequence
  chemically synthesized
gggagagtgagctctgtatata

SEQ ID NO: 1203585 - DNA, 22 bp, Artificial Sequence
  chemically synthesized
acttgggagagtgagctctgta

SEQ ID NO: 1203586 - DNA, 22 bp, Artificial Sequence
  chemically synthesized
tatatacagagctcactctccc

SEQ ID NO: 1203587 - DNA, 22 bp, Artificial Sequence
  chemically synthesized
tatacagagctcactctcccaa

SEQ ID NO: 1203588 - DNA, 22 bp, Artificial Sequence
  chemically synthesized
ataaccatattgacttgggaga

SEQ ID NO: 1203589 - DNA, 22 bp, Artificial Sequence
  chemically synthesized
actctcccaagtcaatatggtt

SEQ ID NO: 1203590 - DNA, 22 bp, Artificial Sequence
  chemically synthesized
gcagaggaattaataaccatat

SEQ ID NO: 1203591 - DNA, 22 bp, Artificial Sequence
  chemically synthesized
tcccaagtcaatatggttatta

SEQ ID NO: 1203592 - DNA, 22 bp, Artificial Sequence
  chemically synthesized
ccaagtcaatatggttattaat

SEQ ID NO: 1203593 - DNA, 22 bp, Artificial Sequence
  chemically synthesized
tatgacagagttggcagaggaa

SEQ ID NO: 1203594 - DNA, 22 bp, Artificial Sequence
  chemically synthesized
ttaattcctctgccaactctgt

SEQ ID NO: 1203595 - DNA, 22 bp, Artificial Sequence
  chemically synthesized
attcctctgccaactctgtcat

SEQ ID NO: 1203596 - DNA, 22 bp, Artificial Sequence
  chemically synthesized
ctctgccaactctgtcatatag

SEQ ID NO: 1203597 - DNA, 22 bp, Artificial Sequence
  chemically synthesized
tgccaactctgtcatatagatc

SEQ ID NO: 1203598 - DNA, 22 bp, Artificial Sequence
  chemically synthesized
ccaactctgtcatatagatcac

SEQ ID NO: 1203599 - DNA, 22 bp, Artificial Sequence
  chemically synthesized
tgtcatatagatcacttatcac

SEQ ID NO: 1203600 - DNA, 22 bp, Artificial Sequence
  chemically synthesized
tcatatagatcacttatcacca

SEQ ID NO: 1203601 - DNA, 22 bp, Artificial Sequence
  chemically synthesized
tggtatcgggataagatggtga

SEQ ID NO: 1203602 - DNA, 22 bp, Artificial Sequence
  chemically synthesized
tatggtatcgggataagatggt

SEQ ID NO: 1203603 - DNA, 22 bp, Artificial Sequence
  chemically synthesized
aggttctatggtatcgggataa

SEQ ID NO: 1203604 - DNA, 22 bp, Artificial Sequence
  chemically synthesized
atcaccatcttatcccgatacc

SEQ ID NO: 1203605 - DNA, 22 bp, Artificial Sequence
  chemically synthesized
tcaccatcttatcccgatacca

SEQ ID NO: 1203606 - DNA, 22 bp, Artificial Sequence
  chemically synthesized
atcccgataccatagaacctta

SEQ ID NO: 1203607 - DNA, 22 bp, Artificial Sequence
  chemically synthesized
tcccgataccatagaaccttag

SEQ ID NO: 1203608 - DNA, 22 bp, Artificial Sequence
  chemically synthesized
agtaaaacagtggctaaggttc

SEQ ID NO: 1203609 - DNA, 22 bp, Artificial Sequence
  chemically synthesized
gagtaaaacagtggctaaggtt

SEQ ID NO: 1203610 - DNA, 22 bp, Artificial Sequence
  chemically synthesized
tttgagtaaaacagtggctaag

SEQ ID NO: 1203611 - DNA, 22 bp, Artificial Sequence
  chemically synthesized
tatttgagtaaaacagtggcta

SEQ ID NO: 1203612 - DNA, 22 bp, Artificial Sequence
  chemically synthesized
ctatttgagtaaaacagtggct

SEQ ID NO: 1203613 - DNA, 22 bp, Artificial Sequence
  chemically synthesized
tttctatttgagtaaaacagtg

SEQ ID NO: 1203614 - DNA, 22 bp, Artificial Sequence
  chemically synthesized
atttctatttgagtaaaacagt

SEQ ID NO: 1203615 - DNA, 22 bp, Artificial Sequence
  chemically synthesized
atggtttatttctatttgagta

SEQ ID NO: 1203616 - DNA, 22 bp, Artificial Sequence
  chemically synthesized
agccactgttttactcaaatag

SEQ ID NO: 1203617 - DNA, 22 bp, Artificial Sequence
  chemically synthesized
aatggtttatttctatttgagt

SEQ ID NO: 1203618 - DNA, 22 bp, Artificial Sequence
  chemically synthesized
gccactgttttactcaaataga

SEQ ID NO: 1203619 - DNA, 22 bp, Artificial Sequence
  chemically synthesized
taatggtttatttctatttgag

SEQ ID NO: 1203620 - DNA, 22 bp, Artificial Sequence
  chemically synthesized
ttaatggtttatttctatttga

SEQ ID NO: 1203621 - DNA, 22 bp, Artificial Sequence
  chemically synthesized
tttaatggtttatttctatttg

SEQ ID NO: 1203622 - DNA, 22 bp, Artificial Sequence
  chemically synthesized
ttttaatggtttatttctattt

SEQ ID NO: 1203623 - DNA, 22 bp, Artificial Sequence
  chemically synthesized
tttttaatggtttatttctatt

SEQ ID NO: 1203624 - DNA, 22 bp, Artificial Sequence
  chemically synthesized
ttttttaatggtttatttctat

SEQ ID NO: 1203625 - DNA, 22 bp, Artificial Sequence
  chemically synthesized
tttttttaatggtttatttcta

SEQ ID NO: 1203626 - DNA, 22 bp, Artificial Sequence
  chemically synthesized
ttttactcaaatagaaataaac

SEQ ID NO: 1203627 - DNA, 22 bp, Artificial Sequence
  chemically synthesized
ttttttttaatggtttatttct

SEQ ID NO: 1203628 - DNA, 22 bp, Artificial Sequence
  chemically synthesized
tttttttttaatggtttatttc

SEQ ID NO: 1203629 - DNA, 22 bp, Artificial Sequence
  chemically synthesized
tactcaaatagaaataaaccat

SEQ ID NO: 1203630 - DNA, 22 bp, Artificial Sequence
  chemically synthesized
actcaaatagaaataaaccatt

SEQ ID NO: 1203631 - DNA, 22 bp, Artificial Sequence
  chemically synthesized
ttttttttttttaatggtttat

SEQ ID NO: 1203632 - DNA, 22 bp, Artificial Sequence
  chemically synthesized
ctcaaatagaaataaaccatta

SEQ ID NO: 1203633 - DNA, 22 bp, Artificial Sequence
  chemically synthesized
aaatagaaataaaccattaaaa

SEQ ID NO: 1203634 - DNA, 22 bp, Artificial Sequence
  chemically synthesized
tggcacctatttttttttttta

SEQ ID NO: 1203635 - DNA, 22 bp, Artificial Sequence
  chemically synthesized
ctgtggcacctatttttttttt

SEQ ID NO: 1203636 - DNA, 22 bp, Artificial Sequence
  chemically synthesized
actgtggcacctattttttttt

SEQ ID NO: 1203637 - DNA, 22 bp, Artificial Sequence
  chemically synthesized
tactgtggcacctatttttttt

SEQ ID NO: 1203638 - DNA, 22 bp, Artificial Sequence
  chemically synthesized
ttactgtggcacctattttttt

SEQ ID NO: 1203639 - DNA, 22 bp, Artificial Sequence
  chemically synthesized
aaaaaaaaaaataggtgccaca

SEQ ID NO: 1203640 - DNA, 22 bp, Artificial Sequence
  chemically synthesized
aagagatcatacttttactgtg

SEQ ID NO: 1203641 - DNA, 22 bp, Artificial Sequence
  chemically synthesized
atcaggttgaagagatcatact

SEQ ID NO: 1203642 - DNA, 22 bp, Artificial Sequence
  chemically synthesized
tgatggtctcatcaggttgaag

SEQ ID NO: 1203643 - DNA, 22 bp, Artificial Sequence
  chemically synthesized
gttgtgatggtctcatcaggtt

SEQ ID NO: 1203644 - DNA, 22 bp, Artificial Sequence
  chemically synthesized
agactggttgtgatggtctcat

SEQ ID NO: 1203645 - DNA, 22 bp, Artificial Sequence
  chemically synthesized
gagactggttgtgatggtctca

SEQ ID NO: 1203646 - DNA, 22 bp, Artificial Sequence
  chemically synthesized
tgagactggttgtgatggtctc

SEQ ID NO: 1203647 - DNA, 22 bp, Artificial Sequence
  chemically synthesized
ttcaacctgatgagaccatcac

SEQ ID NO: 1203648 - DNA, 22 bp, Artificial Sequence
  chemically synthesized
caacctgatgagaccatcacaa

SEQ ID NO: 1203649 - DNA, 22 bp, Artificial Sequence
  chemically synthesized
aacctgatgagaccatcacaac

SEQ ID NO: 1203650 - DNA, 22 bp, Artificial Sequence
  chemically synthesized
atgagaccatcacaaccagtct

SEQ ID NO: 1203651 - DNA, 22 bp, Artificial Sequence
  chemically synthesized
agaaaagaagttttgagactgg

SEQ ID NO: 1203652 - DNA, 22 bp, Artificial Sequence
  chemically synthesized
cagaaaagaagttttgagactg

SEQ ID NO: 1203653 - DNA, 22 bp, Artificial Sequence
  chemically synthesized
ttcagaaaagaagttttgagac

SEQ ID NO: 1203654 - DNA, 22 bp, Artificial Sequence
  chemically synthesized
ttcttcagaaaagaagttttga

SEQ ID NO: 1203655 - DNA, 22 bp, Artificial Sequence
  chemically synthesized
gttcttcagaaaagaagttttg

SEQ ID NO: 1203656 - DNA, 22 bp, Artificial Sequence
  chemically synthesized
atagcttgttcttcagaaaaga

SEQ ID NO: 1203657 - DNA, 22 bp, Artificial Sequence
  chemically synthesized
aattaatagcttgttcttcaga

SEQ ID NO: 1203658 - DNA, 22 bp, Artificial Sequence
  chemically synthesized
aaaacttcttttctgaagaaca

SEQ ID NO: 1203659 - DNA, 22 bp, Artificial Sequence
  chemically synthesized
atctaaattaatagcttgttct

SEQ ID NO: 1203660 - DNA, 22 bp, Artificial Sequence
  chemically synthesized
cttttctgaagaacaagctatt

SEQ ID NO: 1203661 - DNA, 22 bp, Artificial Sequence
  chemically synthesized
ttttctgaagaacaagctatta

SEQ ID NO: 1203662 - DNA, 22 bp, Artificial Sequence
  chemically synthesized
attcatctaaattaatagcttg

SEQ ID NO: 1203663 - DNA, 22 bp, Artificial Sequence
  chemically synthesized
ttctgaagaacaagctattaat

SEQ ID NO: 1203664 - DNA, 22 bp, Artificial Sequence
  chemically synthesized
tctgaagaacaagctattaatt

SEQ ID NO: 1203665 - DNA, 22 bp, Artificial Sequence
  chemically synthesized
ctgaagaacaagctattaattt

SEQ ID NO: 1203666 - DNA, 22 bp, Artificial Sequence
  chemically synthesized
actcattcatctaaattaatag

SEQ ID NO: 1203667 - DNA, 22 bp, Artificial Sequence
  chemically synthesized
tgaagaacaagctattaattta

SEQ ID NO: 1203668 - DNA, 22 bp, Artificial Sequence
  chemically synthesized
aagaacaagctattaatttaga

SEQ ID NO: 1203669 - DNA, 22 bp, Artificial Sequence
  chemically synthesized
ttgactcattcatctaaattaa

SEQ ID NO: 1203670 - DNA, 22 bp, Artificial Sequence
  chemically synthesized
ttattgactcattcatctaaat

SEQ ID NO: 1203671 - DNA, 22 bp, Artificial Sequence
  chemically synthesized
gttattgactcattcatctaaa

SEQ ID NO: 1203672 - DNA, 22 bp, Artificial Sequence
  chemically synthesized
ttaatttagatgaatgagtcaa

SEQ ID NO: 1203673 - DNA, 22 bp, Artificial Sequence
  chemically synthesized
cgataagtttgttattgactca

SEQ ID NO: 1203674 - DNA, 22 bp, Artificial Sequence
  chemically synthesized
atttagatgaatgagtcaataa

SEQ ID NO: 1203675 - DNA, 22 bp, Artificial Sequence
  chemically synthesized
agatgaatgagtcaataacaaa

SEQ ID NO: 1203676 - DNA, 22 bp, Artificial Sequence
  chemically synthesized
gatgaatgagtcaataacaaac

SEQ ID NO: 1203677 - DNA, 22 bp, Artificial Sequence
  chemically synthesized
aatctgcgataagtttgttatt

SEQ ID NO: 1203678 - DNA, 22 bp, Artificial Sequence
  chemically synthesized
aaatctgcgataagtttgttat

SEQ ID NO: 1203679 - DNA, 22 bp, Artificial Sequence
  chemically synthesized
tatgtttaaatctgcgataagt

SEQ ID NO: 1203680 - DNA, 22 bp, Artificial Sequence
  chemically synthesized
tgtatgtttaaatctgcgataa

SEQ ID NO: 1203681 - DNA, 22 bp, Artificial Sequence
  chemically synthesized
ctgtatgtttaaatctgcgata

SEQ ID NO: 1203682 - DNA, 22 bp, Artificial Sequence
  chemically synthesized
ccgtgaaaatttctgtatgttt

SEQ ID NO: 1203683 - DNA, 22 bp, Artificial Sequence
  chemically synthesized
atcgcagatttaaacatacaga

SEQ ID NO: 1203684 - DNA, 22 bp, Artificial Sequence
  chemically synthesized
gccgtgaaaatttctgtatgtt

SEQ ID NO: 1203685 - DNA, 22 bp, Artificial Sequence
  chemically synthesized
tcgcagatttaaacatacagaa

SEQ ID NO: 1203686 - DNA, 22 bp, Artificial Sequence
  chemically synthesized
cagatttgccgtgaaaatttct

SEQ ID NO: 1203687 - DNA, 22 bp, Artificial Sequence
  chemically synthesized
acagatttgccgtgaaaatttc

SEQ ID NO: 1203688 - DNA, 22 bp, Artificial Sequence
  chemically synthesized
tacagatttgccgtgaaaattt

SEQ ID NO: 1203689 - DNA, 22 bp, Artificial Sequence
  chemically synthesized
aaacatacagaaattttcacgg

SEQ ID NO: 1203690 - DNA, 22 bp, Artificial Sequence
  chemically synthesized
aacatacagaaattttcacggc

SEQ ID NO: 1203691 - DNA, 22 bp, Artificial Sequence
  chemically synthesized
atattttacagatttgccgtga

SEQ ID NO: 1203692 - DNA, 22 bp, Artificial Sequence
  chemically synthesized
acctcatattttacagatttgc

SEQ ID NO: 1203693 - DNA, 22 bp, Artificial Sequence
  chemically synthesized
ttgacctcatattttacagatt

SEQ ID NO: 1203694 - DNA, 22 bp, Artificial Sequence
  chemically synthesized
attgacctcatattttacagat

SEQ ID NO: 1203695 - DNA, 22 bp, Artificial Sequence
  chemically synthesized
tcacggcaaatctgtaaaatat

SEQ ID NO: 1203696 - DNA, 22 bp, Artificial Sequence
  chemically synthesized
cacggcaaatctgtaaaatatg

SEQ ID NO: 1203697 - DNA, 22 bp, Artificial Sequence
  chemically synthesized
acggcaaatctgtaaaatatga

SEQ ID NO: 1203698 - DNA, 22 bp, Artificial Sequence
  chemically synthesized
gatatttattgacctcatattt

SEQ ID NO: 1203699 - DNA, 22 bp, Artificial Sequence
  chemically synthesized
taaaatatgaggtcaataaata

SEQ ID NO: 1203700 - DNA, 22 bp, Artificial Sequence
  chemically synthesized
agtataaattagatatttattg

SEQ ID NO: 1203701 - DNA, 22 bp, Artificial Sequence
  chemically synthesized
ttgagtataaattagatattta

SEQ ID NO: 1203702 - DNA, 22 bp, Artificial Sequence
  chemically synthesized
taacagtataaatgctattgag

SEQ ID NO: 1203703 - DNA, 22 bp, Artificial Sequence
  chemically synthesized
tataacagtataaatgctattg

SEQ ID NO: 1203704 - DNA, 22 bp, Artificial Sequence
  chemically synthesized
ctataacagtataaatgctatt

SEQ ID NO: 1203705 - DNA, 22 bp, Artificial Sequence
  chemically synthesized
atttatactcaatagcatttat

SEQ ID NO: 1203706 - DNA, 22 bp, Artificial Sequence
  chemically synthesized
atactcaatagcatttatactg

SEQ ID NO: 1203707 - DNA, 22 bp, Artificial Sequence
  chemically synthesized
tactcaatagcatttatactgt

SEQ ID NO: 1203708 - DNA, 22 bp, Artificial Sequence
  chemically synthesized
catcatttctataacagtataa

SEQ ID NO: 1203709 - DNA, 22 bp, Artificial Sequence
  chemically synthesized
aatagcatttatactgttatag

SEQ ID NO: 1203710 - DNA, 22 bp, Artificial Sequence
  chemically synthesized
tatattgcatcatttctataac

SEQ ID NO: 1203711 - DNA, 22 bp, Artificial Sequence
  chemically synthesized
gtatattgcatcatttctataa

SEQ ID NO: 1203712 - DNA, 22 bp, Artificial Sequence
  chemically synthesized
atactgttatagaaatgatgca

SEQ ID NO: 1203713 - DNA, 22 bp, Artificial Sequence
  chemically synthesized
tactgttatagaaatgatgcaa

SEQ ID NO: 1203714 - DNA, 22 bp, Artificial Sequence
  chemically synthesized
tgtgtcttgtatattgcatcat

SEQ ID NO: 1203715 - DNA, 22 bp, Artificial Sequence
  chemically synthesized
ttatagaaatgatgcaatatac

SEQ ID NO: 1203716 - DNA, 22 bp, Artificial Sequence
  chemically synthesized
tagaaatgatgcaatatacaag

SEQ ID NO: 1203717 - DNA, 22 bp, Artificial Sequence
  chemically synthesized
tgtacagttatgtgtcttgtat

SEQ ID NO: 1203718 - DNA, 22 bp, Artificial Sequence
  chemically synthesized
gggtgttatgtacagttatgtg

SEQ ID NO: 1203719 - DNA, 22 bp, Artificial Sequence
  chemically synthesized
atggctagggtgttatgtacag

SEQ ID NO: 1203720 - DNA, 22 bp, Artificial Sequence
  chemically synthesized
aatggctagggtgttatgtaca

SEQ ID NO: 1203721 - DNA, 22 bp, Artificial Sequence
  chemically synthesized
cacaatgatttaatggctaggg

SEQ ID NO: 1203722 - DNA, 22 bp, Artificial Sequence
  chemically synthesized
tacataacaccctagccattaa

SEQ ID NO: 1203723 - DNA, 22 bp, Artificial Sequence
  chemically synthesized
gccattaaatcattgtgcagat

SEQ ID NO: 1203724 - DNA, 22 bp, Artificial Sequence
  chemically synthesized
aatcattgtgcagatggctccc

SEQ ID NO: 1203725 - DNA, 22 bp, Artificial Sequence
  chemically synthesized
tgcagatggctcccactatcat

SEQ ID NO: 1203726 - DNA, 22 bp, Artificial Sequence
  chemically synthesized
ccactatcattgtgacttctgt

SEQ ID NO: 1203727 - DNA, 22 bp, Artificial Sequence
  chemically synthesized
tggggaaagaggcacagaagtc

SEQ ID NO: 1203728 - DNA, 22 bp, Artificial Sequence
  chemically synthesized
tcattgtgacttctgtgcctct

SEQ ID NO: 1203729 - DNA, 22 bp, Artificial Sequence
  chemically synthesized
gcaaacactatggggaaagagg

SEQ ID NO: 1203730 - DNA, 22 bp, Artificial Sequence
  chemically synthesized
tgacttctgtgcctctttcccc

SEQ ID NO: 1203731 - DNA, 22 bp, Artificial Sequence
  chemically synthesized
ggcaaacactatggggaaagag

SEQ ID NO: 1203732 - DNA, 22 bp, Artificial Sequence
  chemically synthesized
ctgtgcctctttccccatagtg

SEQ ID NO: 1203733 - DNA, 22 bp, Artificial Sequence
  chemically synthesized
tggcttggcaaacactatgggg

SEQ ID NO: 1203734 - DNA, 22 bp, Artificial Sequence
  chemically synthesized
tgtgcctctttccccatagtgt

SEQ ID NO: 1203735 - DNA, 22 bp, Artificial Sequence
  chemically synthesized
atggcttggcaaacactatggg

SEQ ID NO: 1203736 - DNA, 22 bp, Artificial Sequence
  chemically synthesized
tgcctctttccccatagtgttt

SEQ ID NO: 1203737 - DNA, 22 bp, Artificial Sequence
  chemically synthesized
tttccccatagtgtttgccaag

SEQ ID NO: 1203738 - DNA, 22 bp, Artificial Sequence
  chemically synthesized
tccccatagtgtttgccaagcc

SEQ ID NO: 1203739 - DNA, 22 bp, Artificial Sequence
  chemically synthesized
ccccatagtgtttgccaagcca

SEQ ID NO: 1203740 - DNA, 22 bp, Artificial Sequence
  chemically synthesized
cccatagtgtttgccaagccat

SEQ ID NO: 1203741 - DNA, 22 bp, Artificial Sequence
  chemically synthesized
aaggtaaaataaaatatcagct

SEQ ID NO: 1203742 - DNA, 22 bp, Artificial Sequence
  chemically synthesized
gccaagccataagctgatattt

SEQ ID NO: 1203743 - DNA, 22 bp, Artificial Sequence
  chemically synthesized
ccaagccataagctgatatttt

SEQ ID NO: 1203744 - DNA, 22 bp, Artificial Sequence
  chemically synthesized
atattttattttaccttcagtt

SEQ ID NO: 1203745 - DNA, 22 bp, Artificial Sequence
  chemically synthesized
taatgtacagagaactgaaggt

SEQ ID NO: 1203746 - DNA, 22 bp, Artificial Sequence
  chemically synthesized
tattttaccttcagttctctgt

SEQ ID NO: 1203747 - DNA, 22 bp, Artificial Sequence
  chemically synthesized
attttaccttcagttctctgta

SEQ ID NO: 1203748 - DNA, 22 bp, Artificial Sequence
  chemically synthesized
ttttaccttcagttctctgtac

SEQ ID NO: 1203749 - DNA, 22 bp, Artificial Sequence
  chemically synthesized
taccttcagttctctgtacatt

SEQ ID NO: 1203750 - DNA, 22 bp, Artificial Sequence
  chemically synthesized
accttcagttctctgtacatta

SEQ ID NO: 1203751 - DNA, 22 bp, Artificial Sequence
  chemically synthesized
ccttcagttctctgtacattac

SEQ ID NO: 1203752 - DNA, 22 bp, Artificial Sequence
  chemically synthesized
caggcagagaagctgtaatgta

SEQ ID NO: 1203753 - DNA, 22 bp, Artificial Sequence
  chemically synthesized
cagttctctgtacattacagct

SEQ ID NO: 1203754 - DNA, 22 bp, Artificial Sequence
  chemically synthesized
agttctctgtacattacagctt

SEQ ID NO: 1203755 - DNA, 22 bp, Artificial Sequence
  chemically synthesized
tctgtacattacagcttctctg

SEQ ID NO: 1203756 - DNA, 22 bp, Artificial Sequence
  chemically synthesized
tgtacattacagcttctctgcc

SEQ ID NO: 1203757 - DNA, 22 bp, Artificial Sequence
  chemically synthesized
tacattacagcttctctgcctg

SEQ ID NO: 1203758 - DNA, 22 bp, Artificial Sequence
  chemically synthesized
cagcttctctgcctgcaacatc

SEQ ID NO: 1203759 - DNA, 22 bp, Artificial Sequence
  chemically synthesized
ctctgcctgcaacatccttttc

SEQ ID NO: 1203760 - DNA, 22 bp, Artificial Sequence
  chemically synthesized
tctgcctgcaacatccttttca

SEQ ID NO: 1203761 - DNA, 22 bp, Artificial Sequence
  chemically synthesized
tgcctgcaacatccttttcatc

SEQ ID NO: 1203762 - DNA, 22 bp, Artificial Sequence
  chemically synthesized
cctgcaacatccttttcatctg

SEQ ID NO: 1203763 - DNA, 22 bp, Artificial Sequence
  chemically synthesized
acatgtaaaggagccagatgaa

SEQ ID NO: 1203764 - DNA, 22 bp, Artificial Sequence
  chemically synthesized
caacatccttttcatctggctc

SEQ ID NO: 1203765 - DNA, 22 bp, Artificial Sequence
  chemically synthesized
cctgacatgtaaaggagccaga

SEQ ID NO: 1203766 - DNA, 22 bp, Artificial Sequence
  chemically synthesized
acctgacatgtaaaggagccag

SEQ ID NO: 1203767 - DNA, 22 bp, Artificial Sequence
  chemically synthesized
ttcatctggctcctttacatgt

SEQ ID NO: 1203768 - DNA, 22 bp, Artificial Sequence
  chemically synthesized
tcatctggctcctttacatgtc

SEQ ID NO: 1203769 - DNA, 22 bp, Artificial Sequence
  chemically synthesized
catctggctcctttacatgtca

SEQ ID NO: 1203770 - DNA, 22 bp, Artificial Sequence
  chemically synthesized
atctggctcctttacatgtcag

SEQ ID NO: 1203771 - DNA, 22 bp, Artificial Sequence
  chemically synthesized
gctcctttacatgtcaggtaag

SEQ ID NO: 1203772 - DNA, 22 bp, Artificial Sequence
  chemically synthesized
aaggggcagtggtaacttacct

SEQ ID NO: 1203773 - DNA, 22 bp, Artificial Sequence
  chemically synthesized
ctttacatgtcaggtaagttac

SEQ ID NO: 1203774 - DNA, 22 bp, Artificial Sequence
  chemically synthesized
gaaggggcagtggtaacttacc

SEQ ID NO: 1203775 - DNA, 22 bp, Artificial Sequence
  chemically synthesized
tgaaggggcagtggtaacttac

SEQ ID NO: 1203776 - DNA, 22 bp, Artificial Sequence
  chemically synthesized
tacatgtcaggtaagttaccac

SEQ ID NO: 1203777 - DNA, 22 bp, Artificial Sequence
  chemically synthesized
acatgtcaggtaagttaccact

SEQ ID NO: 1203778 - DNA, 22 bp, Artificial Sequence
  chemically synthesized
catgtcaggtaagttaccactg

SEQ ID NO: 1203779 - DNA, 22 bp, Artificial Sequence
  chemically synthesized
aggccgtaaggaaaggctttga

SEQ ID NO: 1203780 - DNA, 22 bp, Artificial Sequence
  chemically synthesized
ccactgccccttcaaagccttt

SEQ ID NO: 1203781 - DNA, 22 bp, Artificial Sequence
  chemically synthesized
ccccttcaaagcctttccttac

SEQ ID NO: 1203782 - DNA, 22 bp, Artificial Sequence
  chemically synthesized
aaccaaaactcaggccgtaagg

SEQ ID NO: 1203783 - DNA, 22 bp, Artificial Sequence
  chemically synthesized
caaagcctttccttacggcctg

SEQ ID NO: 1203784 - DNA, 22 bp, Artificial Sequence
  chemically synthesized
aaagcctttccttacggcctga

SEQ ID NO: 1203785 - DNA, 22 bp, Artificial Sequence
  chemically synthesized
tccttacggcctgagttttggt

SEQ ID NO: 1203786 - DNA, 22 bp, Artificial Sequence
  chemically synthesized
ccttacggcctgagttttggtt

SEQ ID NO: 1203787 - DNA, 22 bp, Artificial Sequence
  chemically synthesized
cttacggcctgagttttggttc

SEQ ID NO: 1203788 - DNA, 22 bp, Artificial Sequence
  chemically synthesized
acggcctgagttttggttcaat

SEQ ID NO: 1203789 - DNA, 22 bp, Artificial Sequence
  chemically synthesized
cggcctgagttttggttcaatg

SEQ ID NO: 1203790 - DNA, 22 bp, Artificial Sequence
  chemically synthesized
cagtcaggtcatgcattgaacc

SEQ ID NO: 1203791 - DNA, 22 bp, Artificial Sequence
  chemically synthesized
acagtcaggtcatgcattgaac

SEQ ID NO: 1203792 - DNA, 22 bp, Artificial Sequence
  chemically synthesized
tacagtcaggtcatgcattgaa

SEQ ID NO: 1203793 - DNA, 22 bp, Artificial Sequence
  chemically synthesized
agttttggttcaatgcatgacc

SEQ ID NO: 1203794 - DNA, 22 bp, Artificial Sequence
  chemically synthesized
tggttcaatgcatgacctgact

SEQ ID NO: 1203795 - DNA, 22 bp, Artificial Sequence
  chemically synthesized
ggttcaatgcatgacctgactg

SEQ ID NO: 1203796 - DNA, 22 bp, Artificial Sequence
  chemically synthesized
gttcaatgcatgacctgactgt

SEQ ID NO: 1203797 - DNA, 22 bp, Artificial Sequence
  chemically synthesized
aatgcatgacctgactgtaaaa

SEQ ID NO: 1203798 - DNA, 22 bp, Artificial Sequence
  chemically synthesized
actgtaaaacactatttcccac

SEQ ID NO: 1203799 - DNA, 22 bp, Artificial Sequence
  chemically synthesized
taaaacactatttcccacatca

SEQ ID NO: 1203800 - DNA, 22 bp, Artificial Sequence
  chemically synthesized
tttcccacatcatgtatgtctt

SEQ ID NO: 1203801 - DNA, 22 bp, Artificial Sequence
  chemically synthesized
cccacatcatgtatgtctttcc

SEQ ID NO: 1203802 - DNA, 22 bp, Artificial Sequence
  chemically synthesized
ccacatcatgtatgtctttccc

SEQ ID NO: 1203803 - DNA, 22 bp, Artificial Sequence
  chemically synthesized
agcaatgtgatgagtagggaaa

SEQ ID NO: 1203804 - DNA, 22 bp, Artificial Sequence
  chemically synthesized
cagcaatgtgatgagtagggaa

SEQ ID NO: 1203805 - DNA, 22 bp, Artificial Sequence
  chemically synthesized
ttcagcaatgtgatgagtaggg

SEQ ID NO: 1203806 - DNA, 22 bp, Artificial Sequence
  chemically synthesized
tccctactcatcacattgctga

SEQ ID NO: 1203807 - DNA, 22 bp, Artificial Sequence
  chemically synthesized
ccctactcatcacattgctgaa

SEQ ID NO: 1203808 - DNA, 22 bp, Artificial Sequence
  chemically synthesized
cctactcatcacattgctgaag

SEQ ID NO: 1203809 - DNA, 22 bp, Artificial Sequence
  chemically synthesized
ctcatcacattgctgaagaatt

SEQ ID NO: 1203810 - DNA, 22 bp, Artificial Sequence
  chemically synthesized
atcacattgctgaagaattgcc

SEQ ID NO: 1203811 - DNA, 22 bp, Artificial Sequence
  chemically synthesized
ctgaagaattgcccatgtatct

SEQ ID NO: 1203812 - DNA, 22 bp, Artificial Sequence
  chemically synthesized
aagaattgcccatgtatctgct

SEQ ID NO: 1203813 - DNA, 22 bp, Artificial Sequence
  chemically synthesized
tcatgggagacaagcagataca

SEQ ID NO: 1203814 - DNA, 22 bp, Artificial Sequence
  chemically synthesized
atcatgggagacaagcagatac

SEQ ID NO: 1203815 - DNA, 22 bp, Artificial Sequence
  chemically synthesized
tccttatcatgggagacaagca

SEQ ID NO: 1203816 - DNA, 22 bp, Artificial Sequence
  chemically synthesized
cccatgtatctgcttgtctccc

SEQ ID NO: 1203817 - DNA, 22 bp, Artificial Sequence
  chemically synthesized
cttgtctcccatgataaggaca

SEQ ID NO: 1203818 - DNA, 22 bp, Artificial Sequence
  chemically synthesized
gtctcccatgataaggacaatg

SEQ ID NO: 1203819 - DNA, 22 bp, Artificial Sequence
  chemically synthesized
tctcccatgataaggacaatgt

SEQ ID NO: 1203820 - DNA, 22 bp, Artificial Sequence
  chemically synthesized
taaaggaaaaagacattgtcct

SEQ ID NO: 1203821 - DNA, 22 bp, Artificial Sequence
  chemically synthesized
ccatgataaggacaatgtcttt

SEQ ID NO: 1203822 - DNA, 22 bp, Artificial Sequence
  chemically synthesized
tgttataaaggaaaaagacatt

SEQ ID NO: 1203823 - DNA, 22 bp, Artificial Sequence
  chemically synthesized
attatgttataaaggaaaaaga

SEQ ID NO: 1203824 - DNA, 22 bp, Artificial Sequence
  chemically synthesized
ctcattatgttataaaggaaaa

SEQ ID NO: 1203825 - DNA, 22 bp, Artificial Sequence
  chemically synthesized
tcctcattatgttataaaggaa

SEQ ID NO: 1203826 - DNA, 22 bp, Artificial Sequence
  chemically synthesized
agctctcctcattatgttataa

SEQ ID NO: 1203827 - DNA, 22 bp, Artificial Sequence
  chemically synthesized
ttgagctctcctcattatgtta

SEQ ID NO: 1203828 - DNA, 22 bp, Artificial Sequence
  chemically synthesized
tttcctttataacataatgagg

SEQ ID NO: 1203829 - DNA, 22 bp, Artificial Sequence
  chemically synthesized
ttcctttataacataatgagga

SEQ ID NO: 1203830 - DNA, 22 bp, Artificial Sequence
  chemically synthesized
attattgagctctcctcattat

SEQ ID NO: 1203831 - DNA, 22 bp, Artificial Sequence
  chemically synthesized
tcctttataacataatgaggag

SEQ ID NO: 1203832 - DNA, 22 bp, Artificial Sequence
  chemically synthesized
cattattgagctctcctcatta

SEQ ID NO: 1203833 - DNA, 22 bp, Artificial Sequence
  chemically synthesized
cctttataacataatgaggaga

SEQ ID NO: 1203834 - DNA, 22 bp, Artificial Sequence
  chemically synthesized
tcattattgagctctcctcatt

SEQ ID NO: 1203835 - DNA, 22 bp, Artificial Sequence
  chemically synthesized
ctttataacataatgaggagag

SEQ ID NO: 1203836 - DNA, 22 bp, Artificial Sequence
  chemically synthesized
tataacataatgaggagagctc

SEQ ID NO: 1203837 - DNA, 22 bp, Artificial Sequence
  chemically synthesized
ataacataatgaggagagctca

SEQ ID NO: 1203838 - DNA, 22 bp, Artificial Sequence
  chemically synthesized
agctttcattattgagctctcc

SEQ ID NO: 1203839 - DNA, 22 bp, Artificial Sequence
  chemically synthesized
taacataatgaggagagctcaa

SEQ ID NO: 1203840 - DNA, 22 bp, Artificial Sequence
  chemically synthesized
aataatgaaagctcaacttttt

SEQ ID NO: 1203841 - DNA, 22 bp, Artificial Sequence
  chemically synthesized
acccatacaaaaaaaaagttga

SEQ ID NO: 1203842 - DNA, 22 bp, Artificial Sequence
  chemically synthesized
attcacccatacaaaaaaaaag

SEQ ID NO: 1203843 - DNA, 22 bp, Artificial Sequence
  chemically synthesized
ctcattcacccatacaaaaaaa

SEQ ID NO: 1203844 - DNA, 22 bp, Artificial Sequence
  chemically synthesized
gaactactcattcacccataca

SEQ ID NO: 1203845 - DNA, 22 bp, Artificial Sequence
  chemically synthesized
aactttttttttgtatgggtga

SEQ ID NO: 1203846 - DNA, 22 bp, Artificial Sequence
  chemically synthesized
agaactactcattcacccatac

SEQ ID NO: 1203847 - DNA, 22 bp, Artificial Sequence
  chemically synthesized
cttagaactactcattcaccca

SEQ ID NO: 1203848 - DNA, 22 bp, Artificial Sequence
  chemically synthesized
acttagaactactcattcaccc

SEQ ID NO: 1203849 - DNA, 22 bp, Artificial Sequence
  chemically synthesized
tttttttgtatgggtgaatgag

SEQ ID NO: 1203850 - DNA, 22 bp, Artificial Sequence
  chemically synthesized
ttttttgtatgggtgaatgagt

SEQ ID NO: 1203851 - DNA, 22 bp, Artificial Sequence
  chemically synthesized
tttttgtatgggtgaatgagta

SEQ ID NO: 1203852 - DNA, 22 bp, Artificial Sequence
  chemically synthesized
ttttgtatgggtgaatgagtag

SEQ ID NO: 1203853 - DNA, 22 bp, Artificial Sequence
  chemically synthesized
tttgtatgggtgaatgagtagt

SEQ ID NO: 1203854 - DNA, 22 bp, Artificial Sequence
  chemically synthesized
tatttacttagaactactcatt

SEQ ID NO: 1203855 - DNA, 22 bp, Artificial Sequence
  chemically synthesized
ttgtatgggtgaatgagtagtt

SEQ ID NO: 1203856 - DNA, 22 bp, Artificial Sequence
  chemically synthesized
tgtatgggtgaatgagtagttc

SEQ ID NO: 1203857 - DNA, 22 bp, Artificial Sequence
  chemically synthesized
gtatgggtgaatgagtagttct

SEQ ID NO: 1203858 - DNA, 22 bp, Artificial Sequence
  chemically synthesized
ctgtatttacttagaactactc

SEQ ID NO: 1203859 - DNA, 22 bp, Artificial Sequence
  chemically synthesized
tatgggtgaatgagtagttcta

SEQ ID NO: 1203860 - DNA, 22 bp, Artificial Sequence
  chemically synthesized
actgtatttacttagaactact

SEQ ID NO: 1203861 - DNA, 22 bp, Artificial Sequence
  chemically synthesized
taagtaaatttactgtatttac

SEQ ID NO: 1203862 - DNA, 22 bp, Artificial Sequence
  chemically synthesized
atactgtaagtaaatttactgt

SEQ ID NO: 1203863 - DNA, 22 bp, Artificial Sequence
  chemically synthesized
taagtaaatacagtaaatttac

SEQ ID NO: 1203864 - DNA, 22 bp, Artificial Sequence
  chemically synthesized
agtaaatacagtaaatttactt

SEQ ID NO: 1203865 - DNA, 22 bp, Artificial Sequence
  chemically synthesized
aaattgatactgtaagtaaatt

SEQ ID NO: 1203866 - DNA, 22 bp, Artificial Sequence
  chemically synthesized
gaaattgatactgtaagtaaat

SEQ ID NO: 1203867 - DNA, 22 bp, Artificial Sequence
  chemically synthesized
tgaaattgatactgtaagtaaa

SEQ ID NO: 1203868 - DNA, 22 bp, Artificial Sequence
  chemically synthesized
tttgaaattgatactgtaagta

SEQ ID NO: 1203869 - DNA, 22 bp, Artificial Sequence
  chemically synthesized
ctttgaaattgatactgtaagt

SEQ ID NO: 1203870 - DNA, 22 bp, Artificial Sequence
  chemically synthesized
acttacagtatcaatttcaaag

SEQ ID NO: 1203871 - DNA, 22 bp, Artificial Sequence
  chemically synthesized
cttacagtatcaatttcaaaga

SEQ ID NO: 1203872 - DNA, 22 bp, Artificial Sequence
  chemically synthesized
gaggagagaatttctttgaaat

SEQ ID NO: 1203873 - DNA, 22 bp, Artificial Sequence
  chemically synthesized
agaggagagaatttctttgaaa

SEQ ID NO: 1203874 - DNA, 22 bp, Artificial Sequence
  chemically synthesized
tagaggagagaatttctttgaa

SEQ ID NO: 1203875 - DNA, 22 bp, Artificial Sequence
  chemically synthesized
acagtatcaatttcaaagaaat

SEQ ID NO: 1203876 - DNA, 22 bp, Artificial Sequence
  chemically synthesized
ttagaggagagaatttctttga

SEQ ID NO: 1203877 - DNA, 22 bp, Artificial Sequence
  chemically synthesized
cagtatcaatttcaaagaaatt

SEQ ID NO: 1203878 - DNA, 22 bp, Artificial Sequence
  chemically synthesized
aagacaatatttttagaggaga

SEQ ID NO: 1203879 - DNA, 22 bp, Artificial Sequence
  chemically synthesized
caaagaaattctctcctctaaa

SEQ ID NO: 1203880 - DNA, 22 bp, Artificial Sequence
  chemically synthesized
aaagaaattctctcctctaaaa

SEQ ID NO: 1203881 - DNA, 22 bp, Artificial Sequence
  chemically synthesized
tctgaagacaatatttttagag

SEQ ID NO: 1203882 - DNA, 22 bp, Artificial Sequence
  chemically synthesized
gtctgaagacaatatttttaga

SEQ ID NO: 1203883 - DNA, 22 bp, Artificial Sequence
  chemically synthesized
cttgtctgaagacaatattttt

SEQ ID NO: 1203884 - DNA, 22 bp, Artificial Sequence
  chemically synthesized
ccttgtctgaagacaatatttt

SEQ ID NO: 1203885 - DNA, 22 bp, Artificial Sequence
  chemically synthesized
tccttgtctgaagacaatattt

SEQ ID NO: 1203886 - DNA, 22 bp, Artificial Sequence
  chemically synthesized
ttccttgtctgaagacaatatt

SEQ ID NO: 1203887 - DNA, 22 bp, Artificial Sequence
  chemically synthesized
tctcctctaaaaatattgtctt

SEQ ID NO: 1203888 - DNA, 22 bp, Artificial Sequence
  chemically synthesized
tttccttgtctgaagacaatat

SEQ ID NO: 1203889 - DNA, 22 bp, Artificial Sequence
  chemically synthesized
ttttccttgtctgaagacaata

SEQ ID NO: 1203890 - DNA, 22 bp, Artificial Sequence
  chemically synthesized
tcctctaaaaatattgtcttca

SEQ ID NO: 1203891 - DNA, 22 bp, Artificial Sequence
  chemically synthesized
tttttccttgtctgaagacaat

SEQ ID NO: 1203892 - DNA, 22 bp, Artificial Sequence
  chemically synthesized
ctctaaaaatattgtcttcaga

SEQ ID NO: 1203893 - DNA, 22 bp, Artificial Sequence
  chemically synthesized
taaaaatattgtcttcagacaa

SEQ ID NO: 1203894 - DNA, 22 bp, Artificial Sequence
  chemically synthesized
tgttttttttccttgtctgaag

SEQ ID NO: 1203895 - DNA, 22 bp, Artificial Sequence
  chemically synthesized
gtgttttttttccttgtctgaa

SEQ ID NO: 1203896 - DNA, 22 bp, Artificial Sequence
  chemically synthesized
aaaatattgtcttcagacaagg

SEQ ID NO: 1203897 - DNA, 22 bp, Artificial Sequence
  chemically synthesized
tgtgttttttttccttgtctga

SEQ ID NO: 1203898 - DNA, 22 bp, Artificial Sequence
  chemically synthesized
ttgtgttttttttccttgtctg

SEQ ID NO: 1203899 - DNA, 22 bp, Artificial Sequence
  chemically synthesized
tttgtgttttttttccttgtct

SEQ ID NO: 1203900 - DNA, 22 bp, Artificial Sequence
  chemically synthesized
cgttttttgtgttttttttcct

SEQ ID NO: 1203901 - DNA, 22 bp, Artificial Sequence
  chemically synthesized
tcttcagacaaggaaaaaaaac

SEQ ID NO: 1203902 - DNA, 22 bp, Artificial Sequence
  chemically synthesized
cagacaaggaaaaaaaacacaa

SEQ ID NO: 1203903 - DNA, 22 bp, Artificial Sequence
  chemically synthesized
agacaaggaaaaaaaacacaaa

SEQ ID NO: 1203904 - DNA, 22 bp, Artificial Sequence
  chemically synthesized
gtcatgttccgttttttgtgtt

SEQ ID NO: 1203905 - DNA, 22 bp, Artificial Sequence
  chemically synthesized
agtcatgttccgttttttgtgt

SEQ ID NO: 1203906 - DNA, 22 bp, Artificial Sequence
  chemically synthesized
tagtcatgttccgttttttgtg

SEQ ID NO: 1203907 - DNA, 22 bp, Artificial Sequence
  chemically synthesized
agattttagtcatgttccgttt

SEQ ID NO: 1203908 - DNA, 22 bp, Artificial Sequence
  chemically synthesized
aagattttagtcatgttccgtt

SEQ ID NO: 1203909 - DNA, 22 bp, Artificial Sequence
  chemically synthesized
taagattttagtcatgttccgt

SEQ ID NO: 1203910 - DNA, 22 bp, Artificial Sequence
  chemically synthesized
ctttaagattttagtcatgttc

SEQ ID NO: 1203911 - DNA, 22 bp, Artificial Sequence
  chemically synthesized
cctttaagattttagtcatgtt

SEQ ID NO: 1203912 - DNA, 22 bp, Artificial Sequence
  chemically synthesized
cgtatcttcctttaagatttta

SEQ ID NO: 1203913 - DNA, 22 bp, Artificial Sequence
  chemically synthesized
ccgtatcttcctttaagatttt

SEQ ID NO: 1203914 - DNA, 22 bp, Artificial Sequence
  chemically synthesized
acttccgtatcttcctttaaga

SEQ ID NO: 1203915 - DNA, 22 bp, Artificial Sequence
  chemically synthesized
tgtgctcacttccgtatcttcc

SEQ ID NO: 1203916 - DNA, 22 bp, Artificial Sequence
  chemically synthesized
aaatcttaaaggaagatacgga

SEQ ID NO: 1203917 - DNA, 22 bp, Artificial Sequence
  chemically synthesized
aaaggaagatacggaagtgagc

SEQ ID NO: 1203918 - DNA, 22 bp, Artificial Sequence
  chemically synthesized
aaggaagatacggaagtgagca

SEQ ID NO: 1203919 - DNA, 22 bp, Artificial Sequence
  chemically synthesized
agaaggattgtgtgctcacttc

SEQ ID NO: 1203920 - DNA, 22 bp, Artificial Sequence
  chemically synthesized
cagaaggattgtgtgctcactt

SEQ ID NO: 1203921 - DNA, 22 bp, Artificial Sequence
  chemically synthesized
acttcagaaggattgtgtgctc

SEQ ID NO: 1203922 - DNA, 22 bp, Artificial Sequence
  chemically synthesized
aacttcagaaggattgtgtgct

SEQ ID NO: 1203923 - DNA, 22 bp, Artificial Sequence
  chemically synthesized
taacttcagaaggattgtgtgc

SEQ ID NO: 1203924 - DNA, 22 bp, Artificial Sequence
  chemically synthesized
tagaaatattttaacttcagaa

SEQ ID NO: 1203925 - DNA, 22 bp, Artificial Sequence
  chemically synthesized
atagaaatattttaacttcaga

SEQ ID NO: 1203926 - DNA, 22 bp, Artificial Sequence
  chemically synthesized
tatgaatttatagaaatatttt

SEQ ID NO: 1203927 - DNA, 22 bp, Artificial Sequence
  chemically synthesized
ctgaagttaaaatatttctata

SEQ ID NO: 1203928 - DNA, 22 bp, Artificial Sequence
  chemically synthesized
tgaagttaaaatatttctataa

SEQ ID NO: 1203929 - DNA, 22 bp, Artificial Sequence
  chemically synthesized
aagttaaaatatttctataaat

SEQ ID NO: 1203930 - DNA, 22 bp, Artificial Sequence
  chemically synthesized
gaatacagctatatgaatttat

SEQ ID NO: 1203931 - DNA, 22 bp, Artificial Sequence
  chemically synthesized
agaatacagctatatgaattta

SEQ ID NO: 1203932 - DNA, 22 bp, Artificial Sequence
  chemically synthesized
aaatatttctataaattcatat

SEQ ID NO: 1203933 - DNA, 22 bp, Artificial Sequence
  chemically synthesized
ctataaattcatatagctgtat

SEQ ID NO: 1203934 - DNA, 22 bp, Artificial Sequence
  chemically synthesized
tataaattcatatagctgtatt

SEQ ID NO: 1203935 - DNA, 22 bp, Artificial Sequence
  chemically synthesized
taaattcatatagctgtattct

SEQ ID NO: 1203936 - DNA, 22 bp, Artificial Sequence
  chemically synthesized
ccaaaaagatttagaatacagc

SEQ ID NO: 1203937 - DNA, 22 bp, Artificial Sequence
  chemically synthesized
accaaaaagatttagaatacag

SEQ ID NO: 1203938 - DNA, 22 bp, Artificial Sequence
  chemically synthesized
ttaccaaaaagatttagaatac

SEQ ID NO: 1203939 - DNA, 22 bp, Artificial Sequence
  chemically synthesized
atatagctgtattctaaatctt

SEQ ID NO: 1203940 - DNA, 22 bp, Artificial Sequence
  chemically synthesized
agggattcttaccaaaaagatt

SEQ ID NO: 1203941 - DNA, 22 bp, Artificial Sequence
  chemically synthesized
cagggattcttaccaaaaagat

SEQ ID NO: 1203942 - DNA, 22 bp, Artificial Sequence
  chemically synthesized
tattctaaatctttttggtaag

SEQ ID NO: 1203943 - DNA, 22 bp, Artificial Sequence
  chemically synthesized
taaatctttttggtaagaatcc

SEQ ID NO: 1203944 - DNA, 22 bp, Artificial Sequence
  chemically synthesized
aatctttttggtaagaatccct

SEQ ID NO: 1203945 - DNA, 22 bp, Artificial Sequence
  chemically synthesized
agaatacatttcagggattctt

SEQ ID NO: 1203946 - DNA, 22 bp, Artificial Sequence
  chemically synthesized
tttggtaagaatccctgaaatg

SEQ ID NO: 1203947 - DNA, 22 bp, Artificial Sequence
  chemically synthesized
gaattcagaatacatttcaggg

SEQ ID NO: 1203948 - DNA, 22 bp, Artificial Sequence
  chemically synthesized
ttggtaagaatccctgaaatgt

SEQ ID NO: 1203949 - DNA, 22 bp, Artificial Sequence
  chemically synthesized
tggtaagaatccctgaaatgta

SEQ ID NO: 1203950 - DNA, 22 bp, Artificial Sequence
  chemically synthesized
ggtaagaatccctgaaatgtat

SEQ ID NO: 1203951 - DNA, 22 bp, Artificial Sequence
  chemically synthesized
ttagaattcagaatacatttca

SEQ ID NO: 1203952 - DNA, 22 bp, Artificial Sequence
  chemically synthesized
gtaagaatccctgaaatgtatt

SEQ ID NO: 1203953 - DNA, 22 bp, Artificial Sequence
  chemically synthesized
atctattagaattcagaataca

SEQ ID NO: 1203954 - DNA, 22 bp, Artificial Sequence
  chemically synthesized
catctattagaattcagaatac

SEQ ID NO: 1203955 - DNA, 22 bp, Artificial Sequence
  chemically synthesized
tcatctattagaattcagaata

SEQ ID NO: 1203956 - DNA, 22 bp, Artificial Sequence
  chemically synthesized
ttcatctattagaattcagaat

SEQ ID NO: 1203957 - DNA, 22 bp, Artificial Sequence
  chemically synthesized
aaatgtattctgaattctaata

SEQ ID NO: 1203958 - DNA, 22 bp, Artificial Sequence
  chemically synthesized
cccacagggaacttttcatcta

SEQ ID NO: 1203959 - DNA, 22 bp, Artificial Sequence
  chemically synthesized
tgaattctaatagatgaaaagt

SEQ ID NO: 1203960 - DNA, 22 bp, Artificial Sequence
  chemically synthesized
aattctaatagatgaaaagttc

SEQ ID NO: 1203961 - DNA, 22 bp, Artificial Sequence
  chemically synthesized
cctgcccacagggaacttttca

SEQ ID NO: 1203962 - DNA, 22 bp, Artificial Sequence
  chemically synthesized
taatagatgaaaagttccctgt

SEQ ID NO: 1203963 - DNA, 22 bp, Artificial Sequence
  chemically synthesized
atagatgaaaagttccctgtgg

SEQ ID NO: 1203964 - DNA, 22 bp, Artificial Sequence
  chemically synthesized
gagtaaacacattacctgccca

SEQ ID NO: 1203965 - DNA, 22 bp, Artificial Sequence
  chemically synthesized
gttggagtaaacacattacctg

SEQ ID NO: 1203966 - DNA, 22 bp, Artificial Sequence
  chemically synthesized
agttggagtaaacacattacct

SEQ ID NO: 1203967 - DNA, 22 bp, Artificial Sequence
  chemically synthesized
ttagttggagtaaacacattac

SEQ ID NO: 1203968 - DNA, 22 bp, Artificial Sequence
  chemically synthesized
cctgtgggcaggtaatgtgttt

SEQ ID NO: 1203969 - DNA, 22 bp, Artificial Sequence
  chemically synthesized
ctcttagttggagtaaacacat

SEQ ID NO: 1203970 - DNA, 22 bp, Artificial Sequence
  chemically synthesized
tgggcaggtaatgtgtttactc

SEQ ID NO: 1203971 - DNA, 22 bp, Artificial Sequence
  chemically synthesized
ggctgctcttagttggagtaaa

SEQ ID NO: 1203972 - DNA, 22 bp, Artificial Sequence
  chemically synthesized
tgttgggctgctcttagttgga

SEQ ID NO: 1203973 - DNA, 22 bp, Artificial Sequence
  chemically synthesized
ctgtgttgggctgctcttagtt

SEQ ID NO: 1203974 - DNA, 22 bp, Artificial Sequence
  chemically synthesized
actccaactaagagcagcccaa

SEQ ID NO: 1203975 - DNA, 22 bp, Artificial Sequence
  chemically synthesized
ctccaactaagagcagcccaac

SEQ ID NO: 1203976 - DNA, 22 bp, Artificial Sequence
  chemically synthesized
caactaagagcagcccaacaca

SEQ ID NO: 1203977 - DNA, 22 bp, Artificial Sequence
  chemically synthesized
aaagagcaaatattcctgtgtt

SEQ ID NO: 1203978 - DNA, 22 bp, Artificial Sequence
  chemically synthesized
agagcagcccaacacaggaata

SEQ ID NO: 1203979 - DNA, 22 bp, Artificial Sequence
  chemically synthesized
ctcaaagagcaaatattcctgt

SEQ ID NO: 1203980 - DNA, 22 bp, Artificial Sequence
  chemically synthesized
ctcctcaaagagcaaatattcc

SEQ ID NO: 1203981 - DNA, 22 bp, Artificial Sequence
  chemically synthesized
taaaacatgtattactcctcaa

SEQ ID NO: 1203982 - DNA, 22 bp, Artificial Sequence
  chemically synthesized
agttataaaacatgtattactc

SEQ ID NO: 1203983 - DNA, 22 bp, Artificial Sequence
  chemically synthesized
gctctttgaggagtaatacatg

SEQ ID NO: 1203984 - DNA, 22 bp, Artificial Sequence
  chemically synthesized
ctctttgaggagtaatacatgt

SEQ ID NO: 1203985 - DNA, 22 bp, Artificial Sequence
  chemically synthesized
tttgaggagtaatacatgtttt

SEQ ID NO: 1203986 - DNA, 22 bp, Artificial Sequence
  chemically synthesized
tgaggagtaatacatgttttat

SEQ ID NO: 1203987 - DNA, 22 bp, Artificial Sequence
  chemically synthesized
gaggagtaatacatgttttata

SEQ ID NO: 1203988 - DNA, 22 bp, Artificial Sequence
  chemically synthesized
aggagtaatacatgttttataa

SEQ ID NO: 1203989 - DNA, 22 bp, Artificial Sequence
  chemically synthesized
aagaatatgaaaacatcattga

SEQ ID NO: 1203990 - DNA, 22 bp, Artificial Sequence
  chemically synthesized
tataactcaatgatgttttcat

SEQ ID NO: 1203991 - DNA, 22 bp, Artificial Sequence
  chemically synthesized
ataactcaatgatgttttcata

SEQ ID NO: 1203992 - DNA, 22 bp, Artificial Sequence
  chemically synthesized
agaactcaagaatatgaaaaca

SEQ ID NO: 1203993 - DNA, 22 bp, Artificial Sequence
  chemically synthesized
taactcaatgatgttttcatat

SEQ ID NO: 1203994 - DNA, 22 bp, Artificial Sequence
  chemically synthesized
taattaagaactcaagaatatg

SEQ ID NO: 1203995 - DNA, 22 bp, Artificial Sequence
  chemically synthesized
aatgatgttttcatattcttga

SEQ ID NO: 1203996 - DNA, 22 bp, Artificial Sequence
  chemically synthesized
gtaattaagaactcaagaatat

SEQ ID NO: 1203997 - DNA, 22 bp, Artificial Sequence
  chemically synthesized
aaaatatttgtaattaagaact

SEQ ID NO: 1203998 - DNA, 22 bp, Artificial Sequence
  chemically synthesized
tcatattcttgagttcttaatt

SEQ ID NO: 1203999 - DNA, 22 bp, Artificial Sequence
  chemically synthesized
gaaaatatttgtaattaagaac

SEQ ID NO: 1204000 - DNA, 22 bp, Artificial Sequence
  chemically synthesized
catattcttgagttcttaatta

SEQ ID NO: 1204001 - DNA, 22 bp, Artificial Sequence
  chemically synthesized
atattcttgagttcttaattac

SEQ ID NO: 1204002 - DNA, 22 bp, Artificial Sequence
  chemically synthesized
tttgaaaatatttgtaattaag

SEQ ID NO: 1204003 - DNA, 22 bp, Artificial Sequence
  chemically synthesized
ttgagttcttaattacaaatat

SEQ ID NO: 1204004 - DNA, 22 bp, Artificial Sequence
  chemically synthesized
gagttcttaattacaaatattt

SEQ ID NO: 1204005 - DNA, 22 bp, Artificial Sequence
  chemically synthesized
aatattgtttgaaaatatttgt

SEQ ID NO: 1204006 - DNA, 22 bp, Artificial Sequence
  chemically synthesized
agttcttaattacaaatatttt

SEQ ID NO: 1204007 - DNA, 22 bp, Artificial Sequence
  chemically synthesized
ttaattacaaatattttcaaac

SEQ ID NO: 1204008 - DNA, 22 bp, Artificial Sequence
  chemically synthesized
aattacaaatattttcaaacaa

SEQ ID NO: 1204009 - DNA, 22 bp, Artificial Sequence
  chemically synthesized
attacaaatattttcaaacaat

SEQ ID NO: 1204010 - DNA, 22 bp, Artificial Sequence
  chemically synthesized
caaatattttcaaacaatattc

SEQ ID NO: 1204011 - DNA, 22 bp, Artificial Sequence
  chemically synthesized
gcaagcaaataattgaatattg

SEQ ID NO: 1204012 - DNA, 22 bp, Artificial Sequence
  chemically synthesized
tacctggcaagcaaataattga

SEQ ID NO: 1204013 - DNA, 22 bp, Artificial Sequence
  chemically synthesized
tcaaacaatattcaattatttg

SEQ ID NO: 1204014 - DNA, 22 bp, Artificial Sequence
  chemically synthesized
atacctggcaagcaaataattg

SEQ ID NO: 1204015 - DNA, 22 bp, Artificial Sequence
  chemically synthesized
caaacaatattcaattatttgc

SEQ ID NO: 1204016 - DNA, 22 bp, Artificial Sequence
  chemically synthesized
tatacctggcaagcaaataatt

SEQ ID NO: 1204017 - DNA, 22 bp, Artificial Sequence
  chemically synthesized
aaacaatattcaattatttgct

SEQ ID NO: 1204018 - DNA, 22 bp, Artificial Sequence
  chemically synthesized
tattttatacctggcaagcaaa

SEQ ID NO: 1204019 - DNA, 22 bp, Artificial Sequence
  chemically synthesized
atattttatacctggcaagcaa

SEQ ID NO: 1204020 - DNA, 22 bp, Artificial Sequence
  chemically synthesized
acttatattttatacctggcaa

SEQ ID NO: 1204021 - DNA, 22 bp, Artificial Sequence
  chemically synthesized
aacttatattttatacctggca

SEQ ID NO: 1204022 - DNA, 22 bp, Artificial Sequence
  chemically synthesized
aattatttgcttgccaggtata

SEQ ID NO: 1204023 - DNA, 22 bp, Artificial Sequence
  chemically synthesized
tttaacttatattttatacctg

SEQ ID NO: 1204024 - DNA, 22 bp, Artificial Sequence
  chemically synthesized
tttgcttgccaggtataaaata

SEQ ID NO: 1204025 - DNA, 22 bp, Artificial Sequence
  chemically synthesized
ctatttaacttatattttatac

SEQ ID NO: 1204026 - DNA, 22 bp, Artificial Sequence
  chemically synthesized
gcttgccaggtataaaatataa

SEQ ID NO: 1204027 - DNA, 22 bp, Artificial Sequence
  chemically synthesized
ttgctatttaacttatatttta

SEQ ID NO: 1204028 - DNA, 22 bp, Artificial Sequence
  chemically synthesized
cttgccaggtataaaatataag

SEQ ID NO: 1204029 - DNA, 22 bp, Artificial Sequence
  chemically synthesized
attgctatttaacttatatttt

SEQ ID NO: 1204030 - DNA, 22 bp, Artificial Sequence
  chemically synthesized
tattgctatttaacttatattt

SEQ ID NO: 1204031 - DNA, 22 bp, Artificial Sequence
  chemically synthesized
ttattgctatttaacttatatt

SEQ ID NO: 1204032 - DNA, 22 bp, Artificial Sequence
  chemically synthesized
gccaggtataaaatataagtta

SEQ ID NO: 1204033 - DNA, 22 bp, Artificial Sequence
  chemically synthesized
ccaggtataaaatataagttaa

SEQ ID NO: 1204034 - DNA, 22 bp, Artificial Sequence
  chemically synthesized
atatttttattgctatttaact

SEQ ID NO: 1204035 - DNA, 22 bp, Artificial Sequence
  chemically synthesized
aaaccattgatatttttattgc

SEQ ID NO: 1204036 - DNA, 22 bp, Artificial Sequence
  chemically synthesized
aattcaaaccattgatattttt

SEQ ID NO: 1204037 - DNA, 22 bp, Artificial Sequence
  chemically synthesized
aatagcaataaaaatatcaatg

SEQ ID NO: 1204038 - DNA, 22 bp, Artificial Sequence
  chemically synthesized
ttaaattcaaaccattgatatt

SEQ ID NO: 1204039 - DNA, 22 bp, Artificial Sequence
  chemically synthesized
aggaaaaaacatgttattaaat

SEQ ID NO: 1204040 - DNA, 22 bp, Artificial Sequence
  chemically synthesized
gaatttaataacatgttttttc

SEQ ID NO: 1204041 - DNA, 22 bp, Artificial Sequence
  chemically synthesized
aatttaataacatgttttttcc

SEQ ID NO: 1204042 - DNA, 22 bp, Artificial Sequence
  chemically synthesized
gaaaatatagtgctaaggaaaa

SEQ ID NO: 1204043 - DNA, 22 bp, Artificial Sequence
  chemically synthesized
aataacatgttttttccttagc

SEQ ID NO: 1204044 - DNA, 22 bp, Artificial Sequence
  chemically synthesized
agaaaatatagtgctaaggaaa

SEQ ID NO: 1204045 - DNA, 22 bp, Artificial Sequence
  chemically synthesized
ataacatgttttttccttagca

SEQ ID NO: 1204046 - DNA, 22 bp, Artificial Sequence
  chemically synthesized
tttagaaaatatagtgctaagg

SEQ ID NO: 1204047 - DNA, 22 bp, Artificial Sequence
  chemically synthesized
atactatttagaaaatatagtg

SEQ ID NO: 1204048 - DNA, 22 bp, Artificial Sequence
  chemically synthesized
tttccttagcactatattttct

SEQ ID NO: 1204049 - DNA, 22 bp, Artificial Sequence
  chemically synthesized
ttccttagcactatattttcta

SEQ ID NO: 1204050 - DNA, 22 bp, Artificial Sequence
  chemically synthesized
tccttagcactatattttctaa

SEQ ID NO: 1204051 - DNA, 22 bp, Artificial Sequence
  chemically synthesized
ccttagcactatattttctaaa

SEQ ID NO: 1204052 - DNA, 22 bp, Artificial Sequence
  chemically synthesized
cttagcactatattttctaaat

SEQ ID NO: 1204053 - DNA, 22 bp, Artificial Sequence
  chemically synthesized
agtagctaatactatttagaaa

SEQ ID NO: 1204054 - DNA, 22 bp, Artificial Sequence
  chemically synthesized
agcactatattttctaaatagt

SEQ ID NO: 1204055 - DNA, 22 bp, Artificial Sequence
  chemically synthesized
gcactatattttctaaatagta

SEQ ID NO: 1204056 - DNA, 22 bp, Artificial Sequence
  chemically synthesized
attaagtagctaatactattta

SEQ ID NO: 1204057 - DNA, 22 bp, Artificial Sequence
  chemically synthesized
aattaagtagctaatactattt

SEQ ID NO: 1204058 - DNA, 22 bp, Artificial Sequence
  chemically synthesized
tattttctaaatagtattagct

SEQ ID NO: 1204059 - DNA, 22 bp, Artificial Sequence
  chemically synthesized
tctaaatagtattagctactta

SEQ ID NO: 1204060 - DNA, 22 bp, Artificial Sequence
  chemically synthesized
ctaaatagtattagctacttaa

SEQ ID NO: 1204061 - DNA, 22 bp, Artificial Sequence
  chemically synthesized
taaatagtattagctacttaat

SEQ ID NO: 1204062 - DNA, 22 bp, Artificial Sequence
  chemically synthesized
aggaaaagtttaattaagtagc

SEQ ID NO: 1204063 - DNA, 22 bp, Artificial Sequence
  chemically synthesized
aatagtattagctacttaatta

SEQ ID NO: 1204064 - DNA, 22 bp, Artificial Sequence
  chemically synthesized
ccaattgaggaaaagtttaatt

SEQ ID NO: 1204065 - DNA, 22 bp, Artificial Sequence
  chemically synthesized
cccaattgaggaaaagtttaat

SEQ ID NO: 1204066 - DNA, 22 bp, Artificial Sequence
  chemically synthesized
gctacttaattaaacttttcct

SEQ ID NO: 1204067 - DNA, 22 bp, Artificial Sequence
  chemically synthesized
atcacttcccaattgaggaaaa

SEQ ID NO: 1204068 - DNA, 22 bp, Artificial Sequence
  chemically synthesized
cttaattaaacttttcctcaat

SEQ ID NO: 1204069 - DNA, 22 bp, Artificial Sequence
  chemically synthesized
gatcacttcccaattgaggaaa

SEQ ID NO: 1204070 - DNA, 22 bp, Artificial Sequence
  chemically synthesized
ttgatcacttcccaattgagga

SEQ ID NO: 1204071 - DNA, 22 bp, Artificial Sequence
  chemically synthesized
aattaaacttttcctcaattgg

SEQ ID NO: 1204072 - DNA, 22 bp, Artificial Sequence
  chemically synthesized
cttgatcacttcccaattgagg

SEQ ID NO: 1204073 - DNA, 22 bp, Artificial Sequence
  chemically synthesized
attaaacttttcctcaattggg

SEQ ID NO: 1204074 - DNA, 22 bp, Artificial Sequence
  chemically synthesized
tcttgatcacttcccaattgag

SEQ ID NO: 1204075 - DNA, 22 bp, Artificial Sequence
  chemically synthesized
aacttttcctcaattgggaagt

SEQ ID NO: 1204076 - DNA, 22 bp, Artificial Sequence
  chemically synthesized
ttcctcaattgggaagtgatca

SEQ ID NO: 1204077 - DNA, 22 bp, Artificial Sequence
  chemically synthesized
tcctcaattgggaagtgatcaa

SEQ ID NO: 1204078 - DNA, 22 bp, Artificial Sequence
  chemically synthesized
cctcaattgggaagtgatcaag

SEQ ID NO: 1204079 - DNA, 22 bp, Artificial Sequence
  chemically synthesized
ctcaattgggaagtgatcaaga

SEQ ID NO: 1204080 - DNA, 22 bp, Artificial Sequence
  chemically synthesized
atacacaaccattttcttgatc

SEQ ID NO: 1204081 - DNA, 22 bp, Artificial Sequence
  chemically synthesized
aattgggaagtgatcaagaaaa

SEQ ID NO: 1204082 - DNA, 22 bp, Artificial Sequence
  chemically synthesized
gatacacaaccattttcttgat

SEQ ID NO: 1204083 - DNA, 22 bp, Artificial Sequence
  chemically synthesized
tgatacacaaccattttcttga

SEQ ID NO: 1204084 - DNA, 22 bp, Artificial Sequence
  chemically synthesized
ttgatacacaaccattttcttg

SEQ ID NO: 1204085 - DNA, 22 bp, Artificial Sequence
  chemically synthesized
ggaagtgatcaagaaaatggtt

SEQ ID NO: 1204086 - DNA, 22 bp, Artificial Sequence
  chemically synthesized
ccttttgatacacaaccatttt

SEQ ID NO: 1204087 - DNA, 22 bp, Artificial Sequence
  chemically synthesized
tgccttttgatacacaaccatt

SEQ ID NO: 1204088 - DNA, 22 bp, Artificial Sequence
  chemically synthesized
ctctgccttttgatacacaacc

SEQ ID NO: 1204089 - DNA, 22 bp, Artificial Sequence
  chemically synthesized
actctgccttttgatacacaac

SEQ ID NO: 1204090 - DNA, 22 bp, Artificial Sequence
  chemically synthesized
acttactctgccttttgataca

SEQ ID NO: 1204091 - DNA, 22 bp, Artificial Sequence
  chemically synthesized
cacttactctgccttttgatac

SEQ ID NO: 1204092 - DNA, 22 bp, Artificial Sequence
  chemically synthesized
tcacttactctgccttttgata

SEQ ID NO: 1204093 - DNA, 22 bp, Artificial Sequence
  chemically synthesized
ttttcacttactctgccttttg

SEQ ID NO: 1204094 - DNA, 22 bp, Artificial Sequence
  chemically synthesized
gttttcacttactctgcctttt

SEQ ID NO: 1204095 - DNA, 22 bp, Artificial Sequence
  chemically synthesized
tgtatcaaaaggcagagtaagt

SEQ ID NO: 1204096 - DNA, 22 bp, Artificial Sequence
  chemically synthesized
taaccaacttgttttcacttac

SEQ ID NO: 1204097 - DNA, 22 bp, Artificial Sequence
  chemically synthesized
ctgtaaccaacttgttttcact

SEQ ID NO: 1204098 - DNA, 22 bp, Artificial Sequence
  chemically synthesized
ctcctgtaaccaacttgttttc

SEQ ID NO: 1204099 - DNA, 22 bp, Artificial Sequence
  chemically synthesized
cctcctgtaaccaacttgtttt

SEQ ID NO: 1204100 - DNA, 22 bp, Artificial Sequence
  chemically synthesized
cttcctcctgtaaccaacttgt

SEQ ID NO: 1204101 - DNA, 22 bp, Artificial Sequence
  chemically synthesized
gttacaggaggaagcagggtat

SEQ ID NO: 1204102 - DNA, 22 bp, Artificial Sequence
  chemically synthesized
caggaggaagcagggtatgggt

SEQ ID NO: 1204103 - DNA, 22 bp, Artificial Sequence
  chemically synthesized
atatagcacaagcgaaacccat

SEQ ID NO: 1204104 - DNA, 22 bp, Artificial Sequence
  chemically synthesized
cagtggagcagttaatatagca

SEQ ID NO: 1204105 - DNA, 22 bp, Artificial Sequence
  chemically synthesized
ctccagtggagcagttaatata

SEQ ID NO: 1204106 - DNA, 22 bp, Artificial Sequence
  chemically synthesized
gctccagtggagcagttaatat

SEQ ID NO: 1204107 - DNA, 22 bp, Artificial Sequence
  chemically synthesized
cgcttgtgctatattaactgct

SEQ ID NO: 1204108 - DNA, 22 bp, Artificial Sequence
  chemically synthesized
gcttgtgctatattaactgctc

SEQ ID NO: 1204109 - DNA, 22 bp, Artificial Sequence
  chemically synthesized
gtttgctccagtggagcagtta

SEQ ID NO: 1204110 - DNA, 22 bp, Artificial Sequence
  chemically synthesized
gtgctatattaactgctccact

SEQ ID NO: 1204111 - DNA, 22 bp, Artificial Sequence
  chemically synthesized
tgctatattaactgctccactg

SEQ ID NO: 1204112 - DNA, 22 bp, Artificial Sequence
  chemically synthesized
attagtttgctccagtggagca

SEQ ID NO: 1204113 - DNA, 22 bp, Artificial Sequence
  chemically synthesized
tattaactgctccactggagca

SEQ ID NO: 1204114 - DNA, 22 bp, Artificial Sequence
  chemically synthesized
actgctccactggagcaaacta

SEQ ID NO: 1204115 - DNA, 22 bp, Artificial Sequence
  chemically synthesized
ctccactggagcaaactaatta

SEQ ID NO: 1204116 - DNA, 22 bp, Artificial Sequence
  chemically synthesized
cactggagcaaactaattaatt

SEQ ID NO: 1204117 - DNA, 22 bp, Artificial Sequence
  chemically synthesized
cagtgcaatgaagaaaaattaa

SEQ ID NO: 1204118 - DNA, 22 bp, Artificial Sequence
  chemically synthesized
gagcaaactaattaatttttct

SEQ ID NO: 1204119 - DNA, 22 bp, Artificial Sequence
  chemically synthesized
attacagtgcaatgaagaaaaa

SEQ ID NO: 1204120 - DNA, 22 bp, Artificial Sequence
  chemically synthesized
ctgattacagtgcaatgaagaa

SEQ ID NO: 1204121 - DNA, 22 bp, Artificial Sequence
  chemically synthesized
gctgattacagtgcaatgaaga

SEQ ID NO: 1204122 - DNA, 22 bp, Artificial Sequence
  chemically synthesized
attaatttttcttcattgcact

SEQ ID NO: 1204123 - DNA, 22 bp, Artificial Sequence
  chemically synthesized
agcttgctgattacagtgcaat

SEQ ID NO: 1204124 - DNA, 22 bp, Artificial Sequence
  chemically synthesized
atttttcttcattgcactgtaa

SEQ ID NO: 1204125 - DNA, 22 bp, Artificial Sequence
  chemically synthesized
gattaagcttgctgattacagt

SEQ ID NO: 1204126 - DNA, 22 bp, Artificial Sequence
  chemically synthesized
ttcttcattgcactgtaatcag

SEQ ID NO: 1204127 - DNA, 22 bp, Artificial Sequence
  chemically synthesized
tcttcattgcactgtaatcagc

SEQ ID NO: 1204128 - DNA, 22 bp, Artificial Sequence
  chemically synthesized
cttcattgcactgtaatcagca

SEQ ID NO: 1204129 - DNA, 22 bp, Artificial Sequence
  chemically synthesized
ttcattgcactgtaatcagcaa

SEQ ID NO: 1204130 - DNA, 22 bp, Artificial Sequence
  chemically synthesized
ccctagattaagcttgctgatt

SEQ ID NO: 1204131 - DNA, 22 bp, Artificial Sequence
  chemically synthesized
cattgcactgtaatcagcaagc

SEQ ID NO: 1204132 - DNA, 22 bp, Artificial Sequence
  chemically synthesized
gccctagattaagcttgctgat

SEQ ID NO: 1204133 - DNA, 22 bp, Artificial Sequence
  chemically synthesized
attgcactgtaatcagcaagct

SEQ ID NO: 1204134 - DNA, 22 bp, Artificial Sequence
  chemically synthesized
tgccctagattaagcttgctga

SEQ ID NO: 1204135 - DNA, 22 bp, Artificial Sequence
  chemically synthesized
tttgccctagattaagcttgct

SEQ ID NO: 1204136 - DNA, 22 bp, Artificial Sequence
  chemically synthesized
ctttgccctagattaagcttgc

SEQ ID NO: 1204137 - DNA, 22 bp, Artificial Sequence
  chemically synthesized
cactgtaatcagcaagcttaat

SEQ ID NO: 1204138 - DNA, 22 bp, Artificial Sequence
  chemically synthesized
ttctttgccctagattaagctt

SEQ ID NO: 1204139 - DNA, 22 bp, Artificial Sequence
  chemically synthesized
taatcagcaagcttaatctagg

SEQ ID NO: 1204140 - DNA, 22 bp, Artificial Sequence
  chemically synthesized
tattcttctttgccctagatta

SEQ ID NO: 1204141 - DNA, 22 bp, Artificial Sequence
  chemically synthesized
caatcacaattgtattcttctt

SEQ ID NO: 1204142 - DNA, 22 bp, Artificial Sequence
  chemically synthesized
aatctagggcaaagaagaatac

SEQ ID NO: 1204143 - DNA, 22 bp, Artificial Sequence
  chemically synthesized
gcaatcacaattgtattcttct

SEQ ID NO: 1204144 - DNA, 22 bp, Artificial Sequence
  chemically synthesized
atctagggcaaagaagaataca

SEQ ID NO: 1204145 - DNA, 22 bp, Artificial Sequence
  chemically synthesized
gggcaaagaagaatacaattgt

SEQ ID NO: 1204146 - DNA, 22 bp, Artificial Sequence
  chemically synthesized
atatttgcaatcacaattgtat

SEQ ID NO: 1204147 - DNA, 22 bp, Artificial Sequence
  chemically synthesized
aatatttgcaatcacaattgta

SEQ ID NO: 1204148 - DNA, 22 bp, Artificial Sequence
  chemically synthesized
tgattgcaaatattaaggtctt

SEQ ID NO: 1204149 - DNA, 22 bp, Artificial Sequence
  chemically synthesized
aatgacaggtagtaagacctta

SEQ ID NO: 1204150 - DNA, 22 bp, Artificial Sequence
  chemically synthesized
caaatattaaggtcttactacc

SEQ ID NO: 1204151 - DNA, 22 bp, Artificial Sequence
  chemically synthesized
caactgaatgacaggtagtaag

SEQ ID NO: 1204152 - DNA, 22 bp, Artificial Sequence
  chemically synthesized
ctgcaactgaatgacaggtagt

SEQ ID NO: 1204153 - DNA, 22 bp, Artificial Sequence
  chemically synthesized
aggtcttactacctgtcattca

SEQ ID NO: 1204154 - DNA, 22 bp, Artificial Sequence
  chemically synthesized
tagttactgcaactgaatgaca

SEQ ID NO: 1204155 - DNA, 22 bp, Artificial Sequence
  chemically synthesized
tgtagttactgcaactgaatga

SEQ ID NO: 1204156 - DNA, 22 bp, Artificial Sequence
  chemically synthesized
ctgtagttactgcaactgaatg

SEQ ID NO: 1204157 - DNA, 22 bp, Artificial Sequence
  chemically synthesized
tctgtagttactgcaactgaat

SEQ ID NO: 1204158 - DNA, 22 bp, Artificial Sequence
  chemically synthesized
actacctgtcattcagttgcag

SEQ ID NO: 1204159 - DNA, 22 bp, Artificial Sequence
  chemically synthesized
ctacctgtcattcagttgcagt

SEQ ID NO: 1204160 - DNA, 22 bp, Artificial Sequence
  chemically synthesized
cctgtcattcagttgcagtaac

SEQ ID NO: 1204161 - DNA, 22 bp, Artificial Sequence
  chemically synthesized
aatagactttctgtagttactg

SEQ ID NO: 1204162 - DNA, 22 bp, Artificial Sequence
  chemically synthesized
tcattcagttgcagtaactaca

SEQ ID NO: 1204163 - DNA, 22 bp, Artificial Sequence
  chemically synthesized
ttgaatagactttctgtagtta

SEQ ID NO: 1204164 - DNA, 22 bp, Artificial Sequence
  chemically synthesized
agttgcagtaactacagaaagt

SEQ ID NO: 1204165 - DNA, 22 bp, Artificial Sequence
  chemically synthesized
attattgaatagactttctgta

SEQ ID NO: 1204166 - DNA, 22 bp, Artificial Sequence
  chemically synthesized
cagtaactacagaaagtctatt

SEQ ID NO: 1204167 - DNA, 22 bp, Artificial Sequence
  chemically synthesized
cagaaagtctattcaataatta

SEQ ID NO: 1204168 - DNA, 22 bp, Artificial Sequence
  chemically synthesized
ttcaataattaatgtgctatgg

SEQ ID NO: 1204169 - DNA, 22 bp, Artificial Sequence
  chemically synthesized
aataattaatgtgctatggcta

SEQ ID NO: 1204170 - DNA, 22 bp, Artificial Sequence
  chemically synthesized
aataacaaaacaaagccaatag

SEQ ID NO: 1204171 - DNA, 22 bp, Artificial Sequence
  chemically synthesized
atgtgctatggctattggcttt

SEQ ID NO: 1204172 - DNA, 22 bp, Artificial Sequence
  chemically synthesized
tggctattggctttgttttgtt

SEQ ID NO: 1204173 - DNA, 22 bp, Artificial Sequence
  chemically synthesized
aaataaatgtattcaataacaa

SEQ ID NO: 1204174 - DNA, 22 bp, Artificial Sequence
  chemically synthesized
ttggctttgttttgttattgaa

SEQ ID NO: 1204175 - DNA, 22 bp, Artificial Sequence
  chemically synthesized
aaaataaatgtattcaataaca

SEQ ID NO: 1204176 - DNA, 22 bp, Artificial Sequence
  chemically synthesized
gctttgttttgttattgaatac

SEQ ID NO: 1204177 - DNA, 22 bp, Artificial Sequence
  chemically synthesized
cttaaaataaatgtattcaata

SEQ ID NO: 1204178 - DNA, 22 bp, Artificial Sequence
  chemically synthesized
tgttttgttattgaatacattt

SEQ ID NO: 1204179 - DNA, 22 bp, Artificial Sequence
  chemically synthesized
gttttgttattgaatacattta

SEQ ID NO: 1204180 - DNA, 22 bp, Artificial Sequence
  chemically synthesized
ttttgttattgaatacatttat

SEQ ID NO: 1204181 - DNA, 22 bp, Artificial Sequence
  chemically synthesized
atgctgcttaaaataaatgtat

SEQ ID NO: 1204182 - DNA, 22 bp, Artificial Sequence
  chemically synthesized
aatgctgcttaaaataaatgta

SEQ ID NO: 1204183 - DNA, 22 bp, Artificial Sequence
  chemically synthesized
tgttattgaatacatttatttt

SEQ ID NO: 1204184 - DNA, 22 bp, Artificial Sequence
  chemically synthesized
gttattgaatacatttatttta

SEQ ID NO: 1204185 - DNA, 22 bp, Artificial Sequence
  chemically synthesized
ttattgaatacatttattttaa

SEQ ID NO: 1204186 - DNA, 22 bp, Artificial Sequence
  chemically synthesized
ttgaatacatttattttaagca

SEQ ID NO: 1204187 - DNA, 22 bp, Artificial Sequence
  chemically synthesized
tgcgcttaatgctgcttaaaat

SEQ ID NO: 1204188 - DNA, 22 bp, Artificial Sequence
  chemically synthesized
atgcgcttaatgctgcttaaaa

SEQ ID NO: 1204189 - DNA, 22 bp, Artificial Sequence
  chemically synthesized
aatacatttattttaagcagca

SEQ ID NO: 1204190 - DNA, 22 bp, Artificial Sequence
  chemically synthesized
atttatgcgcttaatgctgctt

SEQ ID NO: 1204191 - DNA, 22 bp, Artificial Sequence
  chemically synthesized
aatttatgcgcttaatgctgct

SEQ ID NO: 1204192 - DNA, 22 bp, Artificial Sequence
  chemically synthesized
attttaagcagcattaagcgca

SEQ ID NO: 1204193 - DNA, 22 bp, Artificial Sequence
  chemically synthesized
agatttaatttatgcgcttaat

SEQ ID NO: 1204194 - DNA, 22 bp, Artificial Sequence
  chemically synthesized
ttttaagcagcattaagcgcat

SEQ ID NO: 1204195 - DNA, 22 bp, Artificial Sequence
  chemically synthesized
ctaagatttaatttatgcgctt

SEQ ID NO: 1204196 - DNA, 22 bp, Artificial Sequence
  chemically synthesized
taagcagcattaagcgcataaa

SEQ ID NO: 1204197 - DNA, 22 bp, Artificial Sequence
  chemically synthesized
aagcagcattaagcgcataaat

SEQ ID NO: 1204198 - DNA, 22 bp, Artificial Sequence
  chemically synthesized
agcagcattaagcgcataaatt

SEQ ID NO: 1204199 - DNA, 22 bp, Artificial Sequence
  chemically synthesized
agcgcataaattaaatcttagt

SEQ ID NO: 1204200 - DNA, 22 bp, Artificial Sequence
  chemically synthesized
tatgaaaatgttactaagattt

SEQ ID NO: 1204201 - DNA, 22 bp, Artificial Sequence
  chemically synthesized
atatgaaaatgttactaagatt

SEQ ID NO: 1204202 - DNA, 22 bp, Artificial Sequence
  chemically synthesized
cttatatgaaaatgttactaag

SEQ ID NO: 1204203 - DNA, 22 bp, Artificial Sequence
  chemically synthesized
aatcttagtaacattttcatat

SEQ ID NO: 1204204 - DNA, 22 bp, Artificial Sequence
  chemically synthesized
atgatagttacttatatgaaaa

SEQ ID NO: 1204205 - DNA, 22 bp, Artificial Sequence
  chemically synthesized
aatgatagttacttatatgaaa

SEQ ID NO: 1204206 - DNA, 22 bp, Artificial Sequence
  chemically synthesized
taatgatagttacttatatgaa

SEQ ID NO: 1204207 - DNA, 22 bp, Artificial Sequence
  chemically synthesized
agtaacattttcatataagtaa

SEQ ID NO: 1204208 - DNA, 22 bp, Artificial Sequence
  chemically synthesized
gtaacattttcatataagtaac

SEQ ID NO: 1204209 - DNA, 22 bp, Artificial Sequence
  chemically synthesized
tcatataagtaactatcattaa

SEQ ID NO: 1204210 - DNA, 22 bp, Artificial Sequence
  chemically synthesized
catataagtaactatcattaaa

SEQ ID NO: 1204211 - DNA, 22 bp, Artificial Sequence
  chemically synthesized
atataagtaactatcattaaaa

SEQ ID NO: 1204212 - DNA, 22 bp, Artificial Sequence
  chemically synthesized
tggaacaaatgcattttaatga

SEQ ID NO: 1204213 - DNA, 22 bp, Artificial Sequence
  chemically synthesized
tgtggaacaaatgcattttaat

SEQ ID NO: 1204214 - DNA, 22 bp, Artificial Sequence
  chemically synthesized
ctgtggaacaaatgcattttaa

SEQ ID NO: 1204215 - DNA, 22 bp, Artificial Sequence
  chemically synthesized
ttctgtggaacaaatgcatttt

SEQ ID NO: 1204216 - DNA, 22 bp, Artificial Sequence
  chemically synthesized
cttctgtggaacaaatgcattt

SEQ ID NO: 1204217 - DNA, 22 bp, Artificial Sequence
  chemically synthesized
tcttctgtggaacaaatgcatt

SEQ ID NO: 1204218 - DNA, 22 bp, Artificial Sequence
  chemically synthesized
tttcttctgtggaacaaatgca

SEQ ID NO: 1204219 - DNA, 22 bp, Artificial Sequence
  chemically synthesized
tcattaaaatgcatttgttcca

SEQ ID NO: 1204220 - DNA, 22 bp, Artificial Sequence
  chemically synthesized
aaatgcatttgttccacagaag

SEQ ID NO: 1204221 - DNA, 22 bp, Artificial Sequence
  chemically synthesized
gttccacagaagaaagaattat

SEQ ID NO: 1204222 - DNA, 22 bp, Artificial Sequence
  chemically synthesized
ttccacagaagaaagaattatc

SEQ ID NO: 1204223 - DNA, 22 bp, Artificial Sequence
  chemically synthesized
agccggaatggtgagataattc

SEQ ID NO: 1204224 - DNA, 22 bp, Artificial Sequence
  chemically synthesized
cacagaagaaagaattatctca

SEQ ID NO: 1204225 - DNA, 22 bp, Artificial Sequence
  chemically synthesized
ttgagccggaatggtgagataa

SEQ ID NO: 1204226 - DNA, 22 bp, Artificial Sequence
  chemically synthesized
gttgagccggaatggtgagata

SEQ ID NO: 1204227 - DNA, 22 bp, Artificial Sequence
  chemically synthesized
ttgttgagccggaatggtgaga

SEQ ID NO: 1204228 - DNA, 22 bp, Artificial Sequence
  chemically synthesized
cttgttgagccggaatggtgag

SEQ ID NO: 1204229 - DNA, 22 bp, Artificial Sequence
  chemically synthesized
aatttcttgttgagccggaatg

SEQ ID NO: 1204230 - DNA, 22 bp, Artificial Sequence
  chemically synthesized
tctcaccattccggctcaacaa

SEQ ID NO: 1204231 - DNA, 22 bp, Artificial Sequence
  chemically synthesized
aggactgaatttcttgttgagc

SEQ ID NO: 1204232 - DNA, 22 bp, Artificial Sequence
  chemically synthesized
accattccggctcaacaagaaa

SEQ ID NO: 1204233 - DNA, 22 bp, Artificial Sequence
  chemically synthesized
ttcaggactgaatttcttgttg

SEQ ID NO: 1204234 - DNA, 22 bp, Artificial Sequence
  chemically synthesized
tctgttcaggactgaatttctt

SEQ ID NO: 1204235 - DNA, 22 bp, Artificial Sequence
  chemically synthesized
gtctgttcaggactgaatttct

SEQ ID NO: 1204236 - DNA, 22 bp, Artificial Sequence
  chemically synthesized
tgtctgttcaggactgaatttc

SEQ ID NO: 1204237 - DNA, 22 bp, Artificial Sequence
  chemically synthesized
cggctcaacaagaaattcagtc

SEQ ID NO: 1204238 - DNA, 22 bp, Artificial Sequence
  chemically synthesized
ttgtctgttcaggactgaattt

SEQ ID NO: 1204239 - DNA, 22 bp, Artificial Sequence
  chemically synthesized
tttgtctgttcaggactgaatt

SEQ ID NO: 1204240 - DNA, 22 bp, Artificial Sequence
  chemically synthesized
ttttgtctgttcaggactgaat

SEQ ID NO: 1204241 - DNA, 22 bp, Artificial Sequence
  chemically synthesized
aacaagaaattcagtcctgaac

SEQ ID NO: 1204242 - DNA, 22 bp, Artificial Sequence
  chemically synthesized
aacttttttgtctgttcaggac

SEQ ID NO: 1204243 - DNA, 22 bp, Artificial Sequence
  chemically synthesized
aaacttttttgtctgttcagga

SEQ ID NO: 1204244 - DNA, 22 bp, Artificial Sequence
  chemically synthesized
taaacttttttgtctgttcagg

SEQ ID NO: 1204245 - DNA, 22 bp, Artificial Sequence
  chemically synthesized
ttaaacttttttgtctgttcag

SEQ ID NO: 1204246 - DNA, 22 bp, Artificial Sequence
  chemically synthesized
agtcctgaacagacaaaaaagt

SEQ ID NO: 1204247 - DNA, 22 bp, Artificial Sequence
  chemically synthesized
taaaatatttttaaactttttt

SEQ ID NO: 1204248 - DNA, 22 bp, Artificial Sequence
  chemically synthesized
ataaaatatttttaaacttttt

SEQ ID NO: 1204249 - DNA, 22 bp, Artificial Sequence
  chemically synthesized
aacagacaaaaaagtttaaaaa

SEQ ID NO: 1204250 - DNA, 22 bp, Artificial Sequence
  chemically synthesized
atgtttataaaatatttttaaa

SEQ ID NO: 1204251 - DNA, 22 bp, Artificial Sequence
  chemically synthesized
aaaaatattttataaacattaa

SEQ ID NO: 1204252 - DNA, 22 bp, Artificial Sequence
  chemically synthesized
aaaatattttataaacattaac

SEQ ID NO: 1204253 - DNA, 22 bp, Artificial Sequence
  chemically synthesized
cgaaaagtccaggttaatgttt

SEQ ID NO: 1204254 - DNA, 22 bp, Artificial Sequence
  chemically synthesized
tacgaaaagtccaggttaatgt

SEQ ID NO: 1204255 - DNA, 22 bp, Artificial Sequence
  chemically synthesized
ctacgaaaagtccaggttaatg

SEQ ID NO: 1204256 - DNA, 22 bp, Artificial Sequence
  chemically synthesized
ttctacgaaaagtccaggttaa

SEQ ID NO: 1204257 - DNA, 22 bp, Artificial Sequence
  chemically synthesized
cttctacgaaaagtccaggtta

SEQ ID NO: 1204258 - DNA, 22 bp, Artificial Sequence
  chemically synthesized
tataaacattaacctggacttt

SEQ ID NO: 1204259 - DNA, 22 bp, Artificial Sequence
  chemically synthesized
tttcttctacgaaaagtccagg

SEQ ID NO: 1204260 - DNA, 22 bp, Artificial Sequence
  chemically synthesized
ataaacattaacctggactttt

SEQ ID NO: 1204261 - DNA, 22 bp, Artificial Sequence
  chemically synthesized
atttcttctacgaaaagtccag

SEQ ID NO: 1204262 - DNA, 22 bp, Artificial Sequence
  chemically synthesized
taaacattaacctggacttttc

SEQ ID NO: 1204263 - DNA, 22 bp, Artificial Sequence
  chemically synthesized
tatttcttctacgaaaagtcca

SEQ ID NO: 1204264 - DNA, 22 bp, Artificial Sequence
  chemically synthesized
agctttatttcttctacgaaaa

SEQ ID NO: 1204265 - DNA, 22 bp, Artificial Sequence
  chemically synthesized
tcagctttatttcttctacgaa

SEQ ID NO: 1204266 - DNA, 22 bp, Artificial Sequence
  chemically synthesized
acctggacttttcgtagaagaa

SEQ ID NO: 1204267 - DNA, 22 bp, Artificial Sequence
  chemically synthesized
gacttttcgtagaagaaataaa

SEQ ID NO: 1204268 - DNA, 22 bp, Artificial Sequence
  chemically synthesized
ttcgtagaagaaataaagctga

SEQ ID NO: 1204269 - DNA, 22 bp, Artificial Sequence
  chemically synthesized
tcgtagaagaaataaagctgag

SEQ ID NO: 1204270 - DNA, 22 bp, Artificial Sequence
  chemically synthesized
aaatatgacgttctcagcttta

SEQ ID NO: 1204271 - DNA, 22 bp, Artificial Sequence
  chemically synthesized
cgtagaagaaataaagctgaga

SEQ ID NO: 1204272 - DNA, 22 bp, Artificial Sequence
  chemically synthesized
gtagaagaaataaagctgagaa

SEQ ID NO: 1204273 - DNA, 22 bp, Artificial Sequence
  chemically synthesized
ctgaaatatgacgttctcagct

SEQ ID NO: 1204274 - DNA, 22 bp, Artificial Sequence
  chemically synthesized
aagctgctgaaatatgacgttc

SEQ ID NO: 1204275 - DNA, 22 bp, Artificial Sequence
  chemically synthesized
agaacgtcatatttcagcagct

SEQ ID NO: 1204276 - DNA, 22 bp, Artificial Sequence
  chemically synthesized
aatcagaaaacaagtattgaag

SEQ ID NO: 1204277 - DNA, 22 bp, Artificial Sequence
  chemically synthesized
cagcagcttcaatacttgtttt

SEQ ID NO: 1204278 - DNA, 22 bp, Artificial Sequence
  chemically synthesized
tgattcaatcagaaaacaagta

SEQ ID NO: 1204279 - DNA, 22 bp, Artificial Sequence
  chemically synthesized
agcagcttcaatacttgttttc

SEQ ID NO: 1204280 - DNA, 22 bp, Artificial Sequence
  chemically synthesized
atgattcaatcagaaaacaagt

SEQ ID NO: 1204281 - DNA, 22 bp, Artificial Sequence
  chemically synthesized
caatacttgttttctgattgaa

SEQ ID NO: 1204282 - DNA, 22 bp, Artificial Sequence
  chemically synthesized
aatacttgttttctgattgaat

SEQ ID NO: 1204283 - DNA, 22 bp, Artificial Sequence
  chemically synthesized
gttttctgattgaatcataaat

SEQ ID NO: 1204284 - DNA, 22 bp, Artificial Sequence
  chemically synthesized
ttttctgattgaatcataaatt

SEQ ID NO: 1204285 - DNA, 22 bp, Artificial Sequence
  chemically synthesized
tctgattgaatcataaatttca

SEQ ID NO: 1204286 - DNA, 22 bp, Artificial Sequence
  chemically synthesized
ctgattgaatcataaatttcat

SEQ ID NO: 1204287 - DNA, 22 bp, Artificial Sequence
  chemically synthesized
tgattgaatcataaatttcatt

SEQ ID NO: 1204288 - DNA, 22 bp, Artificial Sequence
  chemically synthesized
attgaatcataaatttcattac

SEQ ID NO: 1204289 - DNA, 22 bp, Artificial Sequence
  chemically synthesized
aatcataaatttcattacttta

SEQ ID NO: 1204290 - DNA, 22 bp, Artificial Sequence
  chemically synthesized
tagaagcaagtataaagtaatg

SEQ ID NO: 1204291 - DNA, 22 bp, Artificial Sequence
  chemically synthesized
tcattgtagaagcaagtataaa

SEQ ID NO: 1204292 - DNA, 22 bp, Artificial Sequence
  chemically synthesized
gtcattgtagaagcaagtataa

SEQ ID NO: 1204293 - DNA, 22 bp, Artificial Sequence
  chemically synthesized
tgtcattgtagaagcaagtata

SEQ ID NO: 1204294 - DNA, 22 bp, Artificial Sequence
  chemically synthesized
cattactttatacttgcttcta

SEQ ID NO: 1204295 - DNA, 22 bp, Artificial Sequence
  chemically synthesized
attactttatacttgcttctac

SEQ ID NO: 1204296 - DNA, 22 bp, Artificial Sequence
  chemically synthesized
ggtactttgtcattgtagaagc

SEQ ID NO: 1204297 - DNA, 22 bp, Artificial Sequence
  chemically synthesized
gggtactttgtcattgtagaag

SEQ ID NO: 1204298 - DNA, 22 bp, Artificial Sequence
  chemically synthesized
ctttatacttgcttctacaatg

SEQ ID NO: 1204299 - DNA, 22 bp, Artificial Sequence
  chemically synthesized
tgggtactttgtcattgtagaa

SEQ ID NO: 1204300 - DNA, 22 bp, Artificial Sequence
  chemically synthesized
tatacttgcttctacaatgaca

SEQ ID NO: 1204301 - DNA, 22 bp, Artificial Sequence
  chemically synthesized
atacttgcttctacaatgacaa

SEQ ID NO: 1204302 - DNA, 22 bp, Artificial Sequence
  chemically synthesized
gctttgggtactttgtcattgt

SEQ ID NO: 1204303 - DNA, 22 bp, Artificial Sequence
  chemically synthesized
tacttgcttctacaatgacaaa

SEQ ID NO: 1204304 - DNA, 22 bp, Artificial Sequence
  chemically synthesized
agctttgggtactttgtcattg

SEQ ID NO: 1204305 - DNA, 22 bp, Artificial Sequence
  chemically synthesized
gcttctacaatgacaaagtacc

SEQ ID NO: 1204306 - DNA, 22 bp, Artificial Sequence
  chemically synthesized
cttctacaatgacaaagtaccc

SEQ ID NO: 1204307 - DNA, 22 bp, Artificial Sequence
  chemically synthesized
acatttagctttgggtactttg

SEQ ID NO: 1204308 - DNA, 22 bp, Artificial Sequence
  chemically synthesized
ctacaatgacaaagtacccaaa

SEQ ID NO: 1204309 - DNA, 22 bp, Artificial Sequence
  chemically synthesized
tacaatgacaaagtacccaaag

SEQ ID NO: 1204310 - DNA, 22 bp, Artificial Sequence
  chemically synthesized
caatgacaaagtacccaaagct

SEQ ID NO: 1204311 - DNA, 22 bp, Artificial Sequence
  chemically synthesized
gacattcacatttagctttggg

SEQ ID NO: 1204312 - DNA, 22 bp, Artificial Sequence
  chemically synthesized
ctagacattcacatttagcttt

SEQ ID NO: 1204313 - DNA, 22 bp, Artificial Sequence
  chemically synthesized
acctactagacattcacattta

SEQ ID NO: 1204314 - DNA, 22 bp, Artificial Sequence
  chemically synthesized
tgacctactagacattcacatt

SEQ ID NO: 1204315 - DNA, 22 bp, Artificial Sequence
  chemically synthesized
ctgacctactagacattcacat

SEQ ID NO: 1204316 - DNA, 22 bp, Artificial Sequence
  chemically synthesized
tctgacctactagacattcaca

SEQ ID NO: 1204317 - DNA, 22 bp, Artificial Sequence
  chemically synthesized
ttctgacctactagacattcac

SEQ ID NO: 1204318 - DNA, 22 bp, Artificial Sequence
  chemically synthesized
cacatttttctgacctactaga

SEQ ID NO: 1204319 - DNA, 22 bp, Artificial Sequence
  chemically synthesized
aatgtgaatgtctagtaggtca

SEQ ID NO: 1204320 - DNA, 22 bp, Artificial Sequence
  chemically synthesized
gactacacatttttctgaccta

SEQ ID NO: 1204321 - DNA, 22 bp, Artificial Sequence
  chemically synthesized
gtaggtcagaaaaatgtgtagt

SEQ ID NO: 1204322 - DNA, 22 bp, Artificial Sequence
  chemically synthesized
tcatcaaaaaccatattcgact

SEQ ID NO: 1204323 - DNA, 22 bp, Artificial Sequence
  chemically synthesized
ttgtcatcaaaaaccatattcg

SEQ ID NO: 1204324 - DNA, 22 bp, Artificial Sequence
  chemically synthesized
attgtcatcaaaaaccatattc

SEQ ID NO: 1204325 - DNA, 22 bp, Artificial Sequence
  chemically synthesized
tattgtcatcaaaaaccatatt

SEQ ID NO: 1204326 - DNA, 22 bp, Artificial Sequence
  chemically synthesized
gcgattttattgtcatcaaaaa

SEQ ID NO: 1204327 - DNA, 22 bp, Artificial Sequence
  chemically synthesized
agcgattttattgtcatcaaaa

SEQ ID NO: 1204328 - DNA, 22 bp, Artificial Sequence
  chemically synthesized
tagcgattttattgtcatcaaa

SEQ ID NO: 1204329 - DNA, 22 bp, Artificial Sequence
  chemically synthesized
ttagcgattttattgtcatcaa

SEQ ID NO: 1204330 - DNA, 22 bp, Artificial Sequence
  chemically synthesized
gtttttagcgattttattgtca

SEQ ID NO: 1204331 - DNA, 22 bp, Artificial Sequence
  chemically synthesized
ggtttttagcgattttattgtc

SEQ ID NO: 1204332 - DNA, 22 bp, Artificial Sequence
  chemically synthesized
tggtttttagcgattttattgt

SEQ ID NO: 1204333 - DNA, 22 bp, Artificial Sequence
  chemically synthesized
ttggtttttagcgattttattg

SEQ ID NO: 1204334 - DNA, 22 bp, Artificial Sequence
  chemically synthesized
ttgatgacaataaaatcgctaa

SEQ ID NO: 1204335 - DNA, 22 bp, Artificial Sequence
  chemically synthesized
tgatgacaataaaatcgctaaa

SEQ ID NO: 1204336 - DNA, 22 bp, Artificial Sequence
  chemically synthesized
gatgacaataaaatcgctaaaa

SEQ ID NO: 1204337 - DNA, 22 bp, Artificial Sequence
  chemically synthesized
aatgcttttggtttttagcgat

SEQ ID NO: 1204338 - DNA, 22 bp, Artificial Sequence
  chemically synthesized
atgacaataaaatcgctaaaaa

SEQ ID NO: 1204339 - DNA, 22 bp, Artificial Sequence
  chemically synthesized
tgaatgcttttggtttttagcg

SEQ ID NO: 1204340 - DNA, 22 bp, Artificial Sequence
  chemically synthesized
tctgaatgcttttggtttttag

SEQ ID NO: 1204341 - DNA, 22 bp, Artificial Sequence
  chemically synthesized
cactctctgaatgcttttggtt

SEQ ID NO: 1204342 - DNA, 22 bp, Artificial Sequence
  chemically synthesized
acactctctgaatgcttttggt

SEQ ID NO: 1204343 - DNA, 22 bp, Artificial Sequence
  chemically synthesized
ttacactctctgaatgcttttg

SEQ ID NO: 1204344 - DNA, 22 bp, Artificial Sequence
  chemically synthesized
tcttacactctctgaatgcttt

SEQ ID NO: 1204345 - DNA, 22 bp, Artificial Sequence
  chemically synthesized
ttctcttacactctctgaatgc

SEQ ID NO: 1204346 - DNA, 22 bp, Artificial Sequence
  chemically synthesized
gttctcttacactctctgaatg

SEQ ID NO: 1204347 - DNA, 22 bp, Artificial Sequence
  chemically synthesized
aaaaccaaaagcattcagagag

SEQ ID NO: 1204348 - DNA, 22 bp, Artificial Sequence
  chemically synthesized
aagagatgtgtttgttctctta

SEQ ID NO: 1204349 - DNA, 22 bp, Artificial Sequence
  chemically synthesized
gaagagatgtgtttgttctctt

SEQ ID NO: 1204350 - DNA, 22 bp, Artificial Sequence
  chemically synthesized
agagagtgtaagagaacaaaca

SEQ ID NO: 1204351 - DNA, 22 bp, Artificial Sequence
  chemically synthesized
aatatttgaagagatgtgtttg

SEQ ID NO: 1204352 - DNA, 22 bp, Artificial Sequence
  chemically synthesized
aaatatttgaagagatgtgttt

SEQ ID NO: 1204353 - DNA, 22 bp, Artificial Sequence
  chemically synthesized
tttaaatatttgaagagatgtg

SEQ ID NO: 1204354 - DNA, 22 bp, Artificial Sequence
  chemically synthesized
cccatagggttatttaaatatt

SEQ ID NO: 1204355 - DNA, 22 bp, Artificial Sequence
  chemically synthesized
ttcaaatatttaaataacccta

SEQ ID NO: 1204356 - DNA, 22 bp, Artificial Sequence
  chemically synthesized
caaatatttaaataaccctatg

SEQ ID NO: 1204357 - DNA, 22 bp, Artificial Sequence
  chemically synthesized
aaatatttaaataaccctatgg

SEQ ID NO: 1204358 - DNA, 22 bp, Artificial Sequence
  chemically synthesized
acatcatatcaagttgcccata

SEQ ID NO: 1204359 - DNA, 22 bp, Artificial Sequence
  chemically synthesized
aaataaccctatgggcaacttg

SEQ ID NO: 1204360 - DNA, 22 bp, Artificial Sequence
  chemically synthesized
aataaccctatgggcaacttga

SEQ ID NO: 1204361 - DNA, 22 bp, Artificial Sequence
  chemically synthesized
tgggcaacttgatatgatgtca

SEQ ID NO: 1204362 - DNA, 22 bp, Artificial Sequence
  chemically synthesized
gatgcgtaagacatataatatt

SEQ ID NO: 1204363 - DNA, 22 bp, Artificial Sequence
  chemically synthesized
gatatgatgtcaatattatatg

SEQ ID NO: 1204364 - DNA, 22 bp, Artificial Sequence
  chemically synthesized
atatgatgtcaatattatatgt

SEQ ID NO: 1204365 - DNA, 22 bp, Artificial Sequence
  chemically synthesized
taaactagatgcgtaagacata

SEQ ID NO: 1204366 - DNA, 22 bp, Artificial Sequence
  chemically synthesized
ataaactagatgcgtaagacat

SEQ ID NO: 1204367 - DNA, 22 bp, Artificial Sequence
  chemically synthesized
tataaactagatgcgtaagaca

SEQ ID NO: 1204368 - DNA, 22 bp, Artificial Sequence
  chemically synthesized
ttataaactagatgcgtaagac

SEQ ID NO: 1204369 - DNA, 22 bp, Artificial Sequence
  chemically synthesized
atgacttttataaactagatgc

SEQ ID NO: 1204370 - DNA, 22 bp, Artificial Sequence
  chemically synthesized
tatgtcttacgcatctagttta

SEQ ID NO: 1204371 - DNA, 22 bp, Artificial Sequence
  chemically synthesized
ctgatgacttttataaactaga

SEQ ID NO: 1204372 - DNA, 22 bp, Artificial Sequence
  chemically synthesized
cctgatgacttttataaactag

SEQ ID NO: 1204373 - DNA, 22 bp, Artificial Sequence
  chemically synthesized
tcctgatgacttttataaacta

SEQ ID NO: 1204374 - DNA, 22 bp, Artificial Sequence
  chemically synthesized
ttcctgatgacttttataaact

SEQ ID NO: 1204375 - DNA, 22 bp, Artificial Sequence
  chemically synthesized
tttcctgatgacttttataaac

SEQ ID NO: 1204376 - DNA, 22 bp, Artificial Sequence
  chemically synthesized
ttttcctgatgacttttataaa

SEQ ID NO: 1204377 - DNA, 22 bp, Artificial Sequence
  chemically synthesized
acgcatctagtttataaaagtc

SEQ ID NO: 1204378 - DNA, 22 bp, Artificial Sequence
  chemically synthesized
cgcatctagtttataaaagtca

SEQ ID NO: 1204379 - DNA, 22 bp, Artificial Sequence
  chemically synthesized
tatttttttcctgatgactttt

SEQ ID NO: 1204380 - DNA, 22 bp, Artificial Sequence
  chemically synthesized
gtatttttttcctgatgacttt

SEQ ID NO: 1204381 - DNA, 22 bp, Artificial Sequence
  chemically synthesized
gtttataaaagtcatcaggaaa

SEQ ID NO: 1204382 - DNA, 22 bp, Artificial Sequence
  chemically synthesized
atcttgtatttttttcctgatg

SEQ ID NO: 1204383 - DNA, 22 bp, Artificial Sequence
  chemically synthesized
ataaaagtcatcaggaaaaaaa

SEQ ID NO: 1204384 - DNA, 22 bp, Artificial Sequence
  chemically synthesized
taaaagtcatcaggaaaaaaat

SEQ ID NO: 1204385 - DNA, 22 bp, Artificial Sequence
  chemically synthesized
atccacaaggagattaatcttg

SEQ ID NO: 1204386 - DNA, 22 bp, Artificial Sequence
  chemically synthesized
ccaaattgatccacaaggagat

SEQ ID NO: 1204387 - DNA, 22 bp, Artificial Sequence
  chemically synthesized
cccaaattgatccacaaggaga

SEQ ID NO: 1204388 - DNA, 22 bp, Artificial Sequence
  chemically synthesized
tttcccaaattgatccacaagg

SEQ ID NO: 1204389 - DNA, 22 bp, Artificial Sequence
  chemically synthesized
gtttcccaaattgatccacaag

SEQ ID NO: 1204390 - DNA, 22 bp, Artificial Sequence
  chemically synthesized
atttgtttcccaaattgatcca

SEQ ID NO: 1204391 - DNA, 22 bp, Artificial Sequence
  chemically synthesized
atctccttgtggatcaatttgg

SEQ ID NO: 1204392 - DNA, 22 bp, Artificial Sequence
  chemically synthesized
ttcatttgtttcccaaattgat

SEQ ID NO: 1204393 - DNA, 22 bp, Artificial Sequence
  chemically synthesized
attcatttgtttcccaaattga

SEQ ID NO: 1204394 - DNA, 22 bp, Artificial Sequence
  chemically synthesized
tattcatttgtttcccaaattg

SEQ ID NO: 1204395 - DNA, 22 bp, Artificial Sequence
  chemically synthesized
cttgtggatcaatttgggaaac

SEQ ID NO: 1204396 - DNA, 22 bp, Artificial Sequence
  chemically synthesized
gtggatcaatttgggaaacaaa

SEQ ID NO: 1204397 - DNA, 22 bp, Artificial Sequence
  chemically synthesized
tggttttattcatttgtttccc

SEQ ID NO: 1204398 - DNA, 22 bp, Artificial Sequence
  chemically synthesized
tggatcaatttgggaaacaaat

SEQ ID NO: 1204399 - DNA, 22 bp, Artificial Sequence
  chemically synthesized
gggaaacaaatgaataaaacca

SEQ ID NO: 1204400 - DNA, 22 bp, Artificial Sequence
  chemically synthesized
tgtgtagatctgtggttttatt

SEQ ID NO: 1204401 - DNA, 22 bp, Artificial Sequence
  chemically synthesized
ggaaacaaatgaataaaaccac

SEQ ID NO: 1204402 - DNA, 22 bp, Artificial Sequence
  chemically synthesized
tctatgtgtagatctgtggttt

SEQ ID NO: 1204403 - DNA, 22 bp, Artificial Sequence
  chemically synthesized
tatctatgtgtagatctgtggt

SEQ ID NO: 1204404 - DNA, 22 bp, Artificial Sequence
  chemically synthesized
gaatgtccctctatctatgtgt

SEQ ID NO: 1204405 - DNA, 22 bp, Artificial Sequence
  chemically synthesized
ggaatgtccctctatctatgtg

SEQ ID NO: 1204406 - DNA, 22 bp, Artificial Sequence
  chemically synthesized
tccttggaatgtccctctatct

SEQ ID NO: 1204407 - DNA, 22 bp, Artificial Sequence
  chemically synthesized
cacatagatagagggacattcc

SEQ ID NO: 1204408 - DNA, 22 bp, Artificial Sequence
  chemically synthesized
aagtagtgattgtccttggaat

SEQ ID NO: 1204409 - DNA, 22 bp, Artificial Sequence
  chemically synthesized
aaggctgaagtagtgattgtcc

SEQ ID NO: 1204410 - DNA, 22 bp, Artificial Sequence
  chemically synthesized
caaggacaatcactacttcagc

SEQ ID NO: 1204411 - DNA, 22 bp, Artificial Sequence
  chemically synthesized
tccagaagattaaaggctgaag

SEQ ID NO: 1204412 - DNA, 22 bp, Artificial Sequence
  chemically synthesized
accagttatccagaagattaaa

SEQ ID NO: 1204413 - DNA, 22 bp, Artificial Sequence
  chemically synthesized
caccagttatccagaagattaa

SEQ ID NO: 1204414 - DNA, 22 bp, Artificial Sequence
  chemically synthesized
tcaccagttatccagaagatta

SEQ ID NO: 1204415 - DNA, 22 bp, Artificial Sequence
  chemically synthesized
cttcagcctttaatcttctgga

SEQ ID NO: 1204416 - DNA, 22 bp, Artificial Sequence
  chemically synthesized
cagcctttaatcttctggataa

SEQ ID NO: 1204417 - DNA, 22 bp, Artificial Sequence
  chemically synthesized
agcctttaatcttctggataac

SEQ ID NO: 1204418 - DNA, 22 bp, Artificial Sequence
  chemically synthesized
ccaaggctttcaccagttatcc

SEQ ID NO: 1204419 - DNA, 22 bp, Artificial Sequence
  chemically synthesized
taatcttctggataactggtga

SEQ ID NO: 1204420 - DNA, 22 bp, Artificial Sequence
  chemically synthesized
ctgccaaggctttcaccagtta

SEQ ID NO: 1204421 - DNA, 22 bp, Artificial Sequence
  chemically synthesized
aatcttctggataactggtgaa

SEQ ID NO: 1204422 - DNA, 22 bp, Artificial Sequence
  chemically synthesized
cctgccaaggctttcaccagtt

SEQ ID NO: 1204423 - DNA, 22 bp, Artificial Sequence
  chemically synthesized
atcttctggataactggtgaaa

SEQ ID NO: 1204424 - DNA, 22 bp, Artificial Sequence
  chemically synthesized
ctggataactggtgaaagcctt

SEQ ID NO: 1204425 - DNA, 22 bp, Artificial Sequence
  chemically synthesized
tggataactggtgaaagccttg

SEQ ID NO: 1204426 - DNA, 22 bp, Artificial Sequence
  chemically synthesized
gagtgcttcctgccaaggcttt

SEQ ID NO: 1204427 - DNA, 22 bp, Artificial Sequence
  chemically synthesized
gataactggtgaaagccttggc

SEQ ID NO: 1204428 - DNA, 22 bp, Artificial Sequence
  chemically synthesized
ggagtgcttcctgccaaggctt

SEQ ID NO: 1204429 - DNA, 22 bp, Artificial Sequence
  chemically synthesized
gtgaaagccttggcaggaagca

SEQ ID NO: 1204430 - DNA, 22 bp, Artificial Sequence
  chemically synthesized
ataagtagcttggagtgcttcc

SEQ ID NO: 1204431 - DNA, 22 bp, Artificial Sequence
  chemically synthesized
aataagtagcttggagtgcttc

SEQ ID NO: 1204432 - DNA, 22 bp, Artificial Sequence
  chemically synthesized
taataagtagcttggagtgctt

SEQ ID NO: 1204433 - DNA, 22 bp, Artificial Sequence
  chemically synthesized
ttaataagtagcttggagtgct

SEQ ID NO: 1204434 - DNA, 22 bp, Artificial Sequence
  chemically synthesized
tttaataagtagcttggagtgc

SEQ ID NO: 1204435 - DNA, 22 bp, Artificial Sequence
  chemically synthesized
ggcaggaagcactccaagctac

SEQ ID NO: 1204436 - DNA, 22 bp, Artificial Sequence
  chemically synthesized
cctttttaataagtagcttgga

SEQ ID NO: 1204437 - DNA, 22 bp, Artificial Sequence
  chemically synthesized
gcaggaagcactccaagctact

SEQ ID NO: 1204438 - DNA, 22 bp, Artificial Sequence
  chemically synthesized
acctttttaataagtagcttgg

SEQ ID NO: 1204439 - DNA, 22 bp, Artificial Sequence
  chemically synthesized
ttacctttttaataagtagctt

SEQ ID NO: 1204440 - DNA, 22 bp, Artificial Sequence
  chemically synthesized
caagctacttattaaaaaggta

SEQ ID NO: 1204441 - DNA, 22 bp, Artificial Sequence
  chemically synthesized
cttattaaaaaggtaagaggat

SEQ ID NO: 1204442 - DNA, 22 bp, Artificial Sequence
  chemically synthesized
tatccataagaacatcctctta

SEQ ID NO: 1204443 - DNA, 22 bp, Artificial Sequence
  chemically synthesized
attaaaaaggtaagaggatgtt

SEQ ID NO: 1204444 - DNA, 22 bp, Artificial Sequence
  chemically synthesized
ttaaaaaggtaagaggatgttc

SEQ ID NO: 1204445 - DNA, 22 bp, Artificial Sequence
  chemically synthesized
attgtatccataagaacatcct

SEQ ID NO: 1204446 - DNA, 22 bp, Artificial Sequence
  chemically synthesized
gattgtatccataagaacatcc

SEQ ID NO: 1204447 - DNA, 22 bp, Artificial Sequence
  chemically synthesized
aaaaggtaagaggatgttctta

SEQ ID NO: 1204448 - DNA, 22 bp, Artificial Sequence
  chemically synthesized
atatatacttgattgtatccat

SEQ ID NO: 1204449 - DNA, 22 bp, Artificial Sequence
  chemically synthesized
gatatatacttgattgtatcca

SEQ ID NO: 1204450 - DNA, 22 bp, Artificial Sequence
  chemically synthesized
ttatggatacaatcaagtatat

SEQ ID NO: 1204451 - DNA, 22 bp, Artificial Sequence
  chemically synthesized
atggatacaatcaagtatatat

SEQ ID NO: 1204452 - DNA, 22 bp, Artificial Sequence
  chemically synthesized
tggatacaatcaagtatatatc

SEQ ID NO: 1204453 - DNA, 22 bp, Artificial Sequence
  chemically synthesized
ggaaaatgtagatggggcaagt

SEQ ID NO: 1204454 - DNA, 22 bp, Artificial Sequence
  chemically synthesized
taaagttgggaaaatgtagatg

SEQ ID NO: 1204455 - DNA, 22 bp, Artificial Sequence
  chemically synthesized
tcacttgccccatctacatttt

SEQ ID NO: 1204456 - DNA, 22 bp, Artificial Sequence
  chemically synthesized
actgtaaagttgggaaaatgta

SEQ ID NO: 1204457 - DNA, 22 bp, Artificial Sequence
  chemically synthesized
taactgtaaagttgggaaaatg

SEQ ID NO: 1204458 - DNA, 22 bp, Artificial Sequence
  chemically synthesized
gccccatctacattttcccaac

SEQ ID NO: 1204459 - DNA, 22 bp, Artificial Sequence
  chemically synthesized
ccccatctacattttcccaact

SEQ ID NO: 1204460 - DNA, 22 bp, Artificial Sequence
  chemically synthesized
attctaactgtaaagttgggaa

SEQ ID NO: 1204461 - DNA, 22 bp, Artificial Sequence
  chemically synthesized
aattctaactgtaaagttggga

SEQ ID NO: 1204462 - DNA, 22 bp, Artificial Sequence
  chemically synthesized
cattttcccaactttacagtta

SEQ ID NO: 1204463 - DNA, 22 bp, Artificial Sequence
  chemically synthesized
catcacttaattctaactgtaa

SEQ ID NO: 1204464 - DNA, 22 bp, Artificial Sequence
  chemically synthesized
gcatcacttaattctaactgta

SEQ ID NO: 1204465 - DNA, 22 bp, Artificial Sequence
  chemically synthesized
tgcatcacttaattctaactgt

SEQ ID NO: 1204466 - DNA, 22 bp, Artificial Sequence
  chemically synthesized
tcccaactttacagttagaatt

SEQ ID NO: 1204467 - DNA, 22 bp, Artificial Sequence
  chemically synthesized
cccaactttacagttagaatta

SEQ ID NO: 1204468 - DNA, 22 bp, Artificial Sequence
  chemically synthesized
ttttgcatcacttaattctaac

SEQ ID NO: 1204469 - DNA, 22 bp, Artificial Sequence
  chemically synthesized
ccaactttacagttagaattaa

SEQ ID NO: 1204470 - DNA, 22 bp, Artificial Sequence
  chemically synthesized
agctgttttgcatcacttaatt

SEQ ID NO: 1204471 - DNA, 22 bp, Artificial Sequence
  chemically synthesized
aagctgttttgcatcacttaat

SEQ ID NO: 1204472 - DNA, 22 bp, Artificial Sequence
  chemically synthesized
tacagttagaattaagtgatgc

SEQ ID NO: 1204473 - DNA, 22 bp, Artificial Sequence
  chemically synthesized
ttaagctgttttgcatcactta

SEQ ID NO: 1204474 - DNA, 22 bp, Artificial Sequence
  chemically synthesized
acagttagaattaagtgatgca

SEQ ID NO: 1204475 - DNA, 22 bp, Artificial Sequence
  chemically synthesized
cagttagaattaagtgatgcaa

SEQ ID NO: 1204476 - DNA, 22 bp, Artificial Sequence
  chemically synthesized
tcttaagctgttttgcatcact

SEQ ID NO: 1204477 - DNA, 22 bp, Artificial Sequence
  chemically synthesized
gaattaagtgatgcaaaacagc

SEQ ID NO: 1204478 - DNA, 22 bp, Artificial Sequence
  chemically synthesized
agtgatgcaaaacagcttaaga

SEQ ID NO: 1204479 - DNA, 22 bp, Artificial Sequence
  chemically synthesized
catcagatcctctcttaagctg

SEQ ID NO: 1204480 - DNA, 22 bp, Artificial Sequence
  chemically synthesized
ccatcagatcctctcttaagct

SEQ ID NO: 1204481 - DNA, 22 bp, Artificial Sequence
  chemically synthesized
tccatcagatcctctcttaagc

SEQ ID NO: 1204482 - DNA, 22 bp, Artificial Sequence
  chemically synthesized
ctttccatcagatcctctctta

SEQ ID NO: 1204483 - DNA, 22 bp, Artificial Sequence
  chemically synthesized
gctttccatcagatcctctctt

SEQ ID NO: 1204484 - DNA, 22 bp, Artificial Sequence
  chemically synthesized
tgctttccatcagatcctctct

SEQ ID NO: 1204485 - DNA, 22 bp, Artificial Sequence
  chemically synthesized
aagagaggatctgatggaaagc

SEQ ID NO: 1204486 - DNA, 22 bp, Artificial Sequence
  chemically synthesized
agagaggatctgatggaaagca

SEQ ID NO: 1204487 - DNA, 22 bp, Artificial Sequence
  chemically synthesized
tggagggatatagggcactttg

SEQ ID NO: 1204488 - DNA, 22 bp, Artificial Sequence
  chemically synthesized
atggaaagcaaagtgccctata

SEQ ID NO: 1204489 - DNA, 22 bp, Artificial Sequence
  chemically synthesized
aaaccagtgatgagctgtggag

SEQ ID NO: 1204490 - DNA, 22 bp, Artificial Sequence
  chemically synthesized
caaaccagtgatgagctgtgga

SEQ ID NO: 1204491 - DNA, 22 bp, Artificial Sequence
  chemically synthesized
acttcaaaccagtgatgagctg

SEQ ID NO: 1204492 - DNA, 22 bp, Artificial Sequence
  chemically synthesized
tatccctccacagctcatcact

SEQ ID NO: 1204493 - DNA, 22 bp, Artificial Sequence
  chemically synthesized
tggcctgacttcaaaccagtga

SEQ ID NO: 1204494 - DNA, 22 bp, Artificial Sequence
  chemically synthesized
atggcctgacttcaaaccagtg

SEQ ID NO: 1204495 - DNA, 22 bp, Artificial Sequence
  chemically synthesized
cacagctcatcactggtttgaa

SEQ ID NO: 1204496 - DNA, 22 bp, Artificial Sequence
  chemically synthesized
atcactggtttgaagtcaggcc

SEQ ID NO: 1204497 - DNA, 22 bp, Artificial Sequence
  chemically synthesized
atgtcaccatgaacttatggcc

SEQ ID NO: 1204498 - DNA, 22 bp, Artificial Sequence
  chemically synthesized
gtttgaagtcaggccataagtt

SEQ ID NO: 1204499 - DNA, 22 bp, Artificial Sequence
  chemically synthesized
catgtcaccatgaacttatggc

SEQ ID NO: 1204500 - DNA, 22 bp, Artificial Sequence
  chemically synthesized
gaagtcaggccataagttcatg

SEQ ID NO: 1204501 - DNA, 22 bp, Artificial Sequence
  chemically synthesized
aagtcaggccataagttcatgg

SEQ ID NO: 1204502 - DNA, 22 bp, Artificial Sequence
  chemically synthesized
aagagaatttcatgtcaccatg

SEQ ID NO: 1204503 - DNA, 22 bp, Artificial Sequence
  chemically synthesized
gaagagaatttcatgtcaccat

SEQ ID NO: 1204504 - DNA, 22 bp, Artificial Sequence
  chemically synthesized
gtcttgaagagaatttcatgtc

SEQ ID NO: 1204505 - DNA, 22 bp, Artificial Sequence
  chemically synthesized
ggtcttgaagagaatttcatgt

SEQ ID NO: 1204506 - DNA, 22 bp, Artificial Sequence
  chemically synthesized
atttggtcttgaagagaatttc

SEQ ID NO: 1204507 - DNA, 22 bp, Artificial Sequence
  chemically synthesized
atggtgacatgaaattctcttc

SEQ ID NO: 1204508 - DNA, 22 bp, Artificial Sequence
  chemically synthesized
acgaagactaatttggtcttga

SEQ ID NO: 1204509 - DNA, 22 bp, Artificial Sequence
  chemically synthesized
ctgacgaagactaatttggtct

SEQ ID NO: 1204510 - DNA, 22 bp, Artificial Sequence
  chemically synthesized
gctgacgaagactaatttggtc

SEQ ID NO: 1204511 - DNA, 22 bp, Artificial Sequence
  chemically synthesized
ttgctgacgaagactaatttgg

SEQ ID NO: 1204512 - DNA, 22 bp, Artificial Sequence
  chemically synthesized
cttgctgacgaagactaatttg

SEQ ID NO: 1204513 - DNA, 22 bp, Artificial Sequence
  chemically synthesized
tcttcaagaccaaattagtctt

SEQ ID NO: 1204514 - DNA, 22 bp, Artificial Sequence
  chemically synthesized
ttcaagaccaaattagtcttcg

SEQ ID NO: 1204515 - DNA, 22 bp, Artificial Sequence
  chemically synthesized
caagaccaaattagtcttcgtc

SEQ ID NO: 1204516 - DNA, 22 bp, Artificial Sequence
  chemically synthesized
aagaccaaattagtcttcgtca

SEQ ID NO: 1204517 - DNA, 22 bp, Artificial Sequence
  chemically synthesized
tagggaatttcttgctgacgaa

SEQ ID NO: 1204518 - DNA, 22 bp, Artificial Sequence
  chemically synthesized
aattgtagggaatttcttgctg

SEQ ID NO: 1204519 - DNA, 22 bp, Artificial Sequence
  chemically synthesized
gtcttcgtcagcaagaaattcc

SEQ ID NO: 1204520 - DNA, 22 bp, Artificial Sequence
  chemically synthesized
aaccctgaattgtagggaattt

SEQ ID NO: 1204521 - DNA, 22 bp, Artificial Sequence
  chemically synthesized
cgtcagcaagaaattccctaca

SEQ ID NO: 1204522 - DNA, 22 bp, Artificial Sequence
  chemically synthesized
gtcagcaagaaattccctacaa

SEQ ID NO: 1204523 - DNA, 22 bp, Artificial Sequence
  chemically synthesized
agagttaaaccctgaattgtag

SEQ ID NO: 1204524 - DNA, 22 bp, Artificial Sequence
  chemically synthesized
aagagttaaaccctgaattgta

SEQ ID NO: 1204525 - DNA, 22 bp, Artificial Sequence
  chemically synthesized
taagagttaaaccctgaattgt

SEQ ID NO: 1204526 - DNA, 22 bp, Artificial Sequence
  chemically synthesized
tttaagagttaaaccctgaatt

SEQ ID NO: 1204527 - DNA, 22 bp, Artificial Sequence
  chemically synthesized
atctctttaagagttaaaccct

SEQ ID NO: 1204528 - DNA, 22 bp, Artificial Sequence
  chemically synthesized
cctacaattcagggtttaactc

SEQ ID NO: 1204529 - DNA, 22 bp, Artificial Sequence
  chemically synthesized
caattcagggtttaactcttaa

SEQ ID NO: 1204530 - DNA, 22 bp, Artificial Sequence
  chemically synthesized
agggtttaactcttaaagagat

SEQ ID NO: 1204531 - DNA, 22 bp, Artificial Sequence
  chemically synthesized
gaaaaaaaatggagctaatctc

SEQ ID NO: 1204532 - DNA, 22 bp, Artificial Sequence
  chemically synthesized
aactcttaaagagattagctcc

SEQ ID NO: 1204533 - DNA, 22 bp, Artificial Sequence
  chemically synthesized
actcttaaagagattagctcca

SEQ ID NO: 1204534 - DNA, 22 bp, Artificial Sequence
  chemically synthesized
ttaaagagattagctccatttt

SEQ ID NO: 1204535 - DNA, 22 bp, Artificial Sequence
  chemically synthesized
gaaattagaaaaaaaatggagc

SEQ ID NO: 1204536 - DNA, 22 bp, Artificial Sequence
  chemically synthesized
aaagagattagctccatttttt

SEQ ID NO: 1204537 - DNA, 22 bp, Artificial Sequence
  chemically synthesized
aagagattagctccattttttt

SEQ ID NO: 1204538 - DNA, 22 bp, Artificial Sequence
  chemically synthesized
agtaaattcgaaattagaaaaa

SEQ ID NO: 1204539 - DNA, 22 bp, Artificial Sequence
  chemically synthesized
gctccattttttttctaatttc

SEQ ID NO: 1204540 - DNA, 22 bp, Artificial Sequence
  chemically synthesized
cattttttttctaatttcgaat

SEQ ID NO: 1204541 - DNA, 22 bp, Artificial Sequence
  chemically synthesized
tcatgttaagtaaattcgaaat

SEQ ID NO: 1204542 - DNA, 22 bp, Artificial Sequence
  chemically synthesized
gtcatgttaagtaaattcgaaa

SEQ ID NO: 1204543 - DNA, 22 bp, Artificial Sequence
  chemically synthesized
tttttctaatttcgaatttact

SEQ ID NO: 1204544 - DNA, 22 bp, Artificial Sequence
  chemically synthesized
ttttctaatttcgaatttactt

SEQ ID NO: 1204545 - DNA, 22 bp, Artificial Sequence
  chemically synthesized
tttctaatttcgaatttactta

SEQ ID NO: 1204546 - DNA, 22 bp, Artificial Sequence
  chemically synthesized
ttctaatttcgaatttacttaa

SEQ ID NO: 1204547 - DNA, 22 bp, Artificial Sequence
  chemically synthesized
tctaatttcgaatttacttaac

SEQ ID NO: 1204548 - DNA, 22 bp, Artificial Sequence
  chemically synthesized
ctaatttcgaatttacttaaca

SEQ ID NO: 1204549 - DNA, 22 bp, Artificial Sequence
  chemically synthesized
taatttcgaatttacttaacat

SEQ ID NO: 1204550 - DNA, 22 bp, Artificial Sequence
  chemically synthesized
atttcgaatttacttaacatga

SEQ ID NO: 1204551 - DNA, 22 bp, Artificial Sequence
  chemically synthesized
cgaatttacttaacatgacaaa

SEQ ID NO: 1204552 - DNA, 22 bp, Artificial Sequence
  chemically synthesized
gaatttacttaacatgacaaat

SEQ ID NO: 1204553 - DNA, 22 bp, Artificial Sequence
  chemically synthesized
taaatatataaaatttgtcatg

SEQ ID NO: 1204554 - DNA, 22 bp, Artificial Sequence
  chemically synthesized
acttaacatgacaaattttata

SEQ ID NO: 1204555 - DNA, 22 bp, Artificial Sequence
  chemically synthesized
cttaacatgacaaattttatat

SEQ ID NO: 1204556 - DNA, 22 bp, Artificial Sequence
  chemically synthesized
tatactataaatatataaaatt

SEQ ID NO: 1204557 - DNA, 22 bp, Artificial Sequence
  chemically synthesized
aacatgacaaattttatatatt

SEQ ID NO: 1204558 - DNA, 22 bp, Artificial Sequence
  chemically synthesized
acatgacaaattttatatattt

SEQ ID NO: 1204559 - DNA, 22 bp, Artificial Sequence
  chemically synthesized
tcaagatatattgtatactata

SEQ ID NO: 1204560 - DNA, 22 bp, Artificial Sequence
  chemically synthesized
tatatatttatagtatacaata

SEQ ID NO: 1204561 - DNA, 22 bp, Artificial Sequence
  chemically synthesized
atatatttatagtatacaatat

SEQ ID NO: 1204562 - DNA, 22 bp, Artificial Sequence
  chemically synthesized
tatatttatagtatacaatata

SEQ ID NO: 1204563 - DNA, 22 bp, Artificial Sequence
  chemically synthesized
atagtatacaatatatcttgat

SEQ ID NO: 1204564 - DNA, 22 bp, Artificial Sequence
  chemically synthesized
tagtatacaatatatcttgata

SEQ ID NO: 1204565 - DNA, 22 bp, Artificial Sequence
  chemically synthesized
aatgtatatgcctatcaagata

SEQ ID NO: 1204566 - DNA, 22 bp, Artificial Sequence
  chemically synthesized
aaatgtatatgcctatcaagat

SEQ ID NO: 1204567 - DNA, 22 bp, Artificial Sequence
  chemically synthesized
taaatgtatatgcctatcaaga

SEQ ID NO: 1204568 - DNA, 22 bp, Artificial Sequence
  chemically synthesized
ttaaatgtatatgcctatcaag

SEQ ID NO: 1204569 - DNA, 22 bp, Artificial Sequence
  chemically synthesized
agccatttttaaatgtatatgc

SEQ ID NO: 1204570 - DNA, 22 bp, Artificial Sequence
  chemically synthesized
attgagccatttttaaatgtat

SEQ ID NO: 1204571 - DNA, 22 bp, Artificial Sequence
  chemically synthesized
gattgagccatttttaaatgta

SEQ ID NO: 1204572 - DNA, 22 bp, Artificial Sequence
  chemically synthesized
gataggcatatacatttaaaaa

SEQ ID NO: 1204573 - DNA, 22 bp, Artificial Sequence
  chemically synthesized
ataggcatatacatttaaaaat

SEQ ID NO: 1204574 - DNA, 22 bp, Artificial Sequence
  chemically synthesized
gcttgattgagccatttttaaa

SEQ ID NO: 1204575 - DNA, 22 bp, Artificial Sequence
  chemically synthesized
aaaaatggctcaatcaagccaa

SEQ ID NO: 1204576 - DNA, 22 bp, Artificial Sequence
  chemically synthesized
aaaatggctcaatcaagccaat

SEQ ID NO: 1204577 - DNA, 22 bp, Artificial Sequence
  chemically synthesized
aatcaagccaattgatatatcc

SEQ ID NO: 1204578 - DNA, 22 bp, Artificial Sequence
  chemically synthesized
acaagcatgtgaggtaatggat

SEQ ID NO: 1204579 - DNA, 22 bp, Artificial Sequence
  chemically synthesized
tcacaagcatgtgaggtaatgg

SEQ ID NO: 1204580 - DNA, 22 bp, Artificial Sequence
  chemically synthesized
atatatccattacctcacatgc

SEQ ID NO: 1204581 - DNA, 22 bp, Artificial Sequence
  chemically synthesized
aatgttctcacaagcatgtgag

SEQ ID NO: 1204582 - DNA, 22 bp, Artificial Sequence
  chemically synthesized
aaatgttctcacaagcatgtga

SEQ ID NO: 1204583 - DNA, 22 bp, Artificial Sequence
  chemically synthesized
taaatgttctcacaagcatgtg

SEQ ID NO: 1204584 - DNA, 22 bp, Artificial Sequence
  chemically synthesized
cctcacatgcttgtgagaacat

SEQ ID NO: 1204585 - DNA, 22 bp, Artificial Sequence
  chemically synthesized
acatgcttgtgagaacatttaa

SEQ ID NO: 1204586 - DNA, 22 bp, Artificial Sequence
  chemically synthesized
aaaaagaatagactttaaatgt

SEQ ID NO: 1204587 - DNA, 22 bp, Artificial Sequence
  chemically synthesized
caaaaagaatagactttaaatg

SEQ ID NO: 1204588 - DNA, 22 bp, Artificial Sequence
  chemically synthesized
gtgagaacatttaaagtctatt

SEQ ID NO: 1204589 - DNA, 22 bp, Artificial Sequence
  chemically synthesized
tgagaacatttaaagtctattc

SEQ ID NO: 1204590 - DNA, 22 bp, Artificial Sequence
  chemically synthesized
aaaatttcaaaaagaatagact

SEQ ID NO: 1204591 - DNA, 22 bp, Artificial Sequence
  chemically synthesized
gaaaatttcaaaaagaatagac

SEQ ID NO: 1204592 - DNA, 22 bp, Artificial Sequence
  chemically synthesized
tatgcttgaaaatttcaaaaag

SEQ ID NO: 1204593 - DNA, 22 bp, Artificial Sequence
  chemically synthesized
aaagtctattctttttgaaatt

SEQ ID NO: 1204594 - DNA, 22 bp, Artificial Sequence
  chemically synthesized
aagtctattctttttgaaattt

SEQ ID NO: 1204595 - DNA, 22 bp, Artificial Sequence
  chemically synthesized
ttctttttgaaattttcaagca

SEQ ID NO: 1204596 - DNA, 22 bp, Artificial Sequence
  chemically synthesized
tttttgaaattttcaagcatac

SEQ ID NO: 1204597 - DNA, 22 bp, Artificial Sequence
  chemically synthesized
atagcaatgtattgtatgcttg

SEQ ID NO: 1204598 - DNA, 22 bp, Artificial Sequence
  chemically synthesized
tttgaaattttcaagcatacaa

SEQ ID NO: 1204599 - DNA, 22 bp, Artificial Sequence
  chemically synthesized
ttgaaattttcaagcatacaat

SEQ ID NO: 1204600 - DNA, 22 bp, Artificial Sequence
  chemically synthesized
tgaaattttcaagcatacaata

SEQ ID NO: 1204601 - DNA, 22 bp, Artificial Sequence
  chemically synthesized
gaaattttcaagcatacaatac

SEQ ID NO: 1204602 - DNA, 22 bp, Artificial Sequence
  chemically synthesized
aaattttcaagcatacaataca

SEQ ID NO: 1204603 - DNA, 22 bp, Artificial Sequence
  chemically synthesized
tagttaatagcaatgtattgta

SEQ ID NO: 1204604 - DNA, 22 bp, Artificial Sequence
  chemically synthesized
tcaagcatacaatacattgcta

SEQ ID NO: 1204605 - DNA, 22 bp, Artificial Sequence
  chemically synthesized
caagcatacaatacattgctat

SEQ ID NO: 1204606 - DNA, 22 bp, Artificial Sequence
  chemically synthesized
aagcatacaatacattgctatt

SEQ ID NO: 1204607 - DNA, 22 bp, Artificial Sequence
  chemically synthesized
ggtgtatataacaagactatag

SEQ ID NO: 1204608 - DNA, 22 bp, Artificial Sequence
  chemically synthesized
ttgggtgtatataacaagacta

SEQ ID NO: 1204609 - DNA, 22 bp, Artificial Sequence
  chemically synthesized
ctattaactatagtcttgttat

SEQ ID NO: 1204610 - DNA, 22 bp, Artificial Sequence
  chemically synthesized
ttaactatagtcttgttatata

SEQ ID NO: 1204611 - DNA, 22 bp, Artificial Sequence
  chemically synthesized
actatagtcttgttatatacac

SEQ ID NO: 1204612 - DNA, 22 bp, Artificial Sequence
  chemically synthesized
aagagaactgttgggtgtatat

SEQ ID NO: 1204613 - DNA, 22 bp, Artificial Sequence
  chemically synthesized
tagtcttgttatatacacccaa

SEQ ID NO: 1204614 - DNA, 22 bp, Artificial Sequence
  chemically synthesized
gttatatacacccaacagttct

SEQ ID NO: 1204615 - DNA, 22 bp, Artificial Sequence
  chemically synthesized
ttatatacacccaacagttctc

SEQ ID NO: 1204616 - DNA, 22 bp, Artificial Sequence
  chemically synthesized
tatacacccaacagttctcttg

SEQ ID NO: 1204617 - DNA, 22 bp, Artificial Sequence
  chemically synthesized
gagagggaaattcaagagaact

SEQ ID NO: 1204618 - DNA, 22 bp, Artificial Sequence
  chemically synthesized
ggttggagagggaaattcaaga

SEQ ID NO: 1204619 - DNA, 22 bp, Artificial Sequence
  chemically synthesized
agttaggttggagagggaaatt

SEQ ID NO: 1204620 - DNA, 22 bp, Artificial Sequence
  chemically synthesized
cagttaggttggagagggaaat

SEQ ID NO: 1204621 - DNA, 22 bp, Artificial Sequence
  chemically synthesized
tcttgaatttccctctccaacc

SEQ ID NO: 1204622 - DNA, 22 bp, Artificial Sequence
  chemically synthesized
ttgaatttccctctccaaccta

SEQ ID NO: 1204623 - DNA, 22 bp, Artificial Sequence
  chemically synthesized
gaatttccctctccaacctaac

SEQ ID NO: 1204624 - DNA, 22 bp, Artificial Sequence
  chemically synthesized
cacaaaatttcagttaggttgg

SEQ ID NO: 1204625 - DNA, 22 bp, Artificial Sequence
  chemically synthesized
aatttccctctccaacctaact

SEQ ID NO: 1204626 - DNA, 22 bp, Artificial Sequence
  chemically synthesized
ccctctccaacctaactgaaat

SEQ ID NO: 1204627 - DNA, 22 bp, Artificial Sequence
  chemically synthesized
cctctccaacctaactgaaatt

SEQ ID NO: 1204628 - DNA, 22 bp, Artificial Sequence
  chemically synthesized
tccaacctaactgaaattttgt

SEQ ID NO: 1204629 - DNA, 22 bp, Artificial Sequence
  chemically synthesized
agaatggggttacacaaaattt

SEQ ID NO: 1204630 - DNA, 22 bp, Artificial Sequence
  chemically synthesized
caacctaactgaaattttgtgt

SEQ ID NO: 1204631 - DNA, 22 bp, Artificial Sequence
  chemically synthesized
ttaagaatggggttacacaaaa

SEQ ID NO: 1204632 - DNA, 22 bp, Artificial Sequence
  chemically synthesized
gttaagaatggggttacacaaa

SEQ ID NO: 1204633 - DNA, 22 bp, Artificial Sequence
  chemically synthesized
actgaaattttgtgtaacccca

SEQ ID NO: 1204634 - DNA, 22 bp, Artificial Sequence
  chemically synthesized
aaattttgtgtaaccccattct

SEQ ID NO: 1204635 - DNA, 22 bp, Artificial Sequence
  chemically synthesized
aatcatataacttgttaagaat

SEQ ID NO: 1204636 - DNA, 22 bp, Artificial Sequence
  chemically synthesized
tgtgtaaccccattcttaacaa

SEQ ID NO: 1204637 - DNA, 22 bp, Artificial Sequence
  chemically synthesized
gtgtaaccccattcttaacaag

SEQ ID NO: 1204638 - DNA, 22 bp, Artificial Sequence
  chemically synthesized
tgtaaccccattcttaacaagt

SEQ ID NO: 1204639 - DNA, 22 bp, Artificial Sequence
  chemically synthesized
tatccctgaatcatataacttg

SEQ ID NO: 1204640 - DNA, 22 bp, Artificial Sequence
  chemically synthesized
ttatatccctgaatcatataac

SEQ ID NO: 1204641 - DNA, 22 bp, Artificial Sequence
  chemically synthesized
tattatatccctgaatcatata

SEQ ID NO: 1204642 - DNA, 22 bp, Artificial Sequence
  chemically synthesized
ctattatatccctgaatcatat

SEQ ID NO: 1204643 - DNA, 22 bp, Artificial Sequence
  chemically synthesized
tctattatatccctgaatcata

SEQ ID NO: 1204644 - DNA, 22 bp, Artificial Sequence
  chemically synthesized
ttaacaagttatatgattcagg

SEQ ID NO: 1204645 - DNA, 22 bp, Artificial Sequence
  chemically synthesized
aacaagttatatgattcaggga

SEQ ID NO: 1204646 - DNA, 22 bp, Artificial Sequence
  chemically synthesized
acaagttatatgattcagggat

SEQ ID NO: 1204647 - DNA, 22 bp, Artificial Sequence
  chemically synthesized
aacattttctattatatccctg

SEQ ID NO: 1204648 - DNA, 22 bp, Artificial Sequence
  chemically synthesized
tatgattcagggatataataga

SEQ ID NO: 1204649 - DNA, 22 bp, Artificial Sequence
  chemically synthesized
agggatataatagaaaatgttg

SEQ ID NO: 1204650 - DNA, 22 bp, Artificial Sequence
  chemically synthesized
gatagaatgtgtatgtctcaac

SEQ ID NO: 1204651 - DNA, 22 bp, Artificial Sequence
  chemically synthesized
aaactagatagaatgtgtatgt

SEQ ID NO: 1204652 - DNA, 22 bp, Artificial Sequence
  chemically synthesized
ggctaaaactagatagaatgtg

SEQ ID NO: 1204653 - DNA, 22 bp, Artificial Sequence
  chemically synthesized
agacatacacattctatctagt

SEQ ID NO: 1204654 - DNA, 22 bp, Artificial Sequence
  chemically synthesized
aaagttgggctaaaactagata

SEQ ID NO: 1204655 - DNA, 22 bp, Artificial Sequence
  chemically synthesized
gaaagttgggctaaaactagat

SEQ ID NO: 1204656 - DNA, 22 bp, Artificial Sequence
  chemically synthesized
gagagccttgaaagttgggcta

SEQ ID NO: 1204657 - DNA, 22 bp, Artificial Sequence
  chemically synthesized
tatctagttttagcccaacttt

SEQ ID NO: 1204658 - DNA, 22 bp, Artificial Sequence
  chemically synthesized
tggagagccttgaaagttgggc

SEQ ID NO: 1204659 - DNA, 22 bp, Artificial Sequence
  chemically synthesized
tctagttttagcccaactttca

SEQ ID NO: 1204660 - DNA, 22 bp, Artificial Sequence
  chemically synthesized
gttttagcccaactttcaaggc

SEQ ID NO: 1204661 - DNA, 22 bp, Artificial Sequence
  chemically synthesized
tagcccaactttcaaggctctc

SEQ ID NO: 1204662 - DNA, 22 bp, Artificial Sequence
  chemically synthesized
agcccaactttcaaggctctcc

SEQ ID NO: 1204663 - DNA, 22 bp, Artificial Sequence
  chemically synthesized
gcccaactttcaaggctctcca

SEQ ID NO: 1204664 - DNA, 22 bp, Artificial Sequence
  chemically synthesized
tcaaggctctccagaatttcct

SEQ ID NO: 1204665 - DNA, 22 bp, Artificial Sequence
  chemically synthesized
caaggctctccagaatttcctc

SEQ ID NO: 1204666 - DNA, 22 bp, Artificial Sequence
  chemically synthesized
aaggctctccagaatttcctct

SEQ ID NO: 1204667 - DNA, 22 bp, Artificial Sequence
  chemically synthesized
taaagtcaaagtagaggaaatt

SEQ ID NO: 1204668 - DNA, 22 bp, Artificial Sequence
  chemically synthesized
tccagaatttcctctactttga

SEQ ID NO: 1204669 - DNA, 22 bp, Artificial Sequence
  chemically synthesized
cagaatttcctctactttgact

SEQ ID NO: 1204670 - DNA, 22 bp, Artificial Sequence
  chemically synthesized
cctctactttgactttataatt

SEQ ID NO: 1204671 - DNA, 22 bp, Artificial Sequence
  chemically synthesized
ctctactttgactttataattt

SEQ ID NO: 1204672 - DNA, 22 bp, Artificial Sequence
  chemically synthesized
tactttgactttataatttttc

SEQ ID NO: 1204673 - DNA, 22 bp, Artificial Sequence
  chemically synthesized
ctttgactttataatttttctt

SEQ ID NO: 1204674 - DNA, 22 bp, Artificial Sequence
  chemically synthesized
tgactttataatttttctttcg

SEQ ID NO: 1204675 - DNA, 22 bp, Artificial Sequence
  chemically synthesized
gactttataatttttctttcga

SEQ ID NO: 1204676 - DNA, 22 bp, Artificial Sequence
  chemically synthesized
actttataatttttctttcgat

SEQ ID NO: 1204677 - DNA, 22 bp, Artificial Sequence
  chemically synthesized
tataatttttctttcgattctg

SEQ ID NO: 1204678 - DNA, 22 bp, Artificial Sequence
  chemically synthesized
ataatttttctttcgattctga

SEQ ID NO: 1204679 - DNA, 22 bp, Artificial Sequence
  chemically synthesized
taatttttctttcgattctgat

SEQ ID NO: 1204680 - DNA, 22 bp, Artificial Sequence
  chemically synthesized
ttctttcgattctgatatggtt

SEQ ID NO: 1204681 - DNA, 22 bp, Artificial Sequence
  chemically synthesized
tctttcgattctgatatggttt

SEQ ID NO: 1204682 - DNA, 22 bp, Artificial Sequence
  chemically synthesized
ctttcgattctgatatggtttg

SEQ ID NO: 1204683 - DNA, 22 bp, Artificial Sequence
  chemically synthesized
tttcgattctgatatggtttgg

SEQ ID NO: 1204684 - DNA, 22 bp, Artificial Sequence
  chemically synthesized
ggggaagaaacaaccaaaccat

SEQ ID NO: 1204685 - DNA, 22 bp, Artificial Sequence
  chemically synthesized
tcgattctgatatggtttggtt

SEQ ID NO: 1204686 - DNA, 22 bp, Artificial Sequence
  chemically synthesized
gggggaagaaacaaccaaacca

SEQ ID NO: 1204687 - DNA, 22 bp, Artificial Sequence
  chemically synthesized
cgattctgatatggtttggttg

SEQ ID NO: 1204688 - DNA, 22 bp, Artificial Sequence
  chemically synthesized
gattctgatatggtttggttgt

SEQ ID NO: 1204689 - DNA, 22 bp, Artificial Sequence
  chemically synthesized
tgatatggtttggttgtttctt

SEQ ID NO: 1204690 - DNA, 22 bp, Artificial Sequence
  chemically synthesized
aagatttgggggaagaaacaac

SEQ ID NO: 1204691 - DNA, 22 bp, Artificial Sequence
  chemically synthesized
atatggtttggttgtttcttcc

SEQ ID NO: 1204692 - DNA, 22 bp, Artificial Sequence
  chemically synthesized
caattcaagatttgggggaaga

SEQ ID NO: 1204693 - DNA, 22 bp, Artificial Sequence
  chemically synthesized
ggttgtttcttcccccaaatct

SEQ ID NO: 1204694 - DNA, 22 bp, Artificial Sequence
  chemically synthesized
gttgtttcttcccccaaatctt

SEQ ID NO: 1204695 - DNA, 22 bp, Artificial Sequence
  chemically synthesized
cgggagctacaattcaagattt

SEQ ID NO: 1204696 - DNA, 22 bp, Artificial Sequence
  chemically synthesized
tttcttcccccaaatcttgaat

SEQ ID NO: 1204697 - DNA, 22 bp, Artificial Sequence
  chemically synthesized
cttcccccaaatcttgaattgt

SEQ ID NO: 1204698 - DNA, 22 bp, Artificial Sequence
  chemically synthesized
ttcccccaaatcttgaattgta

SEQ ID NO: 1204699 - DNA, 22 bp, Artificial Sequence
  chemically synthesized
cccccaaatcttgaattgtagc

SEQ ID NO: 1204700 - DNA, 22 bp, Artificial Sequence
  chemically synthesized
ccccaaatcttgaattgtagct

SEQ ID NO: 1204701 - DNA, 22 bp, Artificial Sequence
  chemically synthesized
gaattgtagctcccgtaattcc

SEQ ID NO: 1204702 - DNA, 22 bp, Artificial Sequence
  chemically synthesized
aattgtagctcccgtaattccc

SEQ ID NO: 1204703 - DNA, 22 bp, Artificial Sequence
  chemically synthesized
ccatgacatggtgggaattacg

SEQ ID NO: 1204704 - DNA, 22 bp, Artificial Sequence
  chemically synthesized
tagctcccgtaattcccaccat

SEQ ID NO: 1204705 - DNA, 22 bp, Artificial Sequence
  chemically synthesized
ccgtaattcccaccatgtcatg

SEQ ID NO: 1204706 - DNA, 22 bp, Artificial Sequence
  chemically synthesized
ccaggtccctcccatgacatgg

SEQ ID NO: 1204707 - DNA, 22 bp, Artificial Sequence
  chemically synthesized
ctaccaggtccctcccatgaca

SEQ ID NO: 1204708 - DNA, 22 bp, Artificial Sequence
  chemically synthesized
cctcctaccaggtccctcccat

SEQ ID NO: 1204709 - DNA, 22 bp, Artificial Sequence
  chemically synthesized
ccaccatgtcatgggagggacc

SEQ ID NO: 1204710 - DNA, 22 bp, Artificial Sequence
  chemically synthesized
agttacctcctaccaggtccct

SEQ ID NO: 1204711 - DNA, 22 bp, Artificial Sequence
  chemically synthesized
ccgccatgattcagttacctcc

SEQ ID NO: 1204712 - DNA, 22 bp, Artificial Sequence
  chemically synthesized
gtaggaggtaactgaatcatgg

SEQ ID NO: 1204713 - DNA, 22 bp, Artificial Sequence
  chemically synthesized
aatcatggcggcaggtctttcc

SEQ ID NO: 1204714 - DNA, 22 bp, Artificial Sequence
  chemically synthesized
tcacgagaacagcatgggaaag

SEQ ID NO: 1204715 - DNA, 22 bp, Artificial Sequence
  chemically synthesized
actatcacgagaacagcatggg

SEQ ID NO: 1204716 - DNA, 22 bp, Artificial Sequence
  chemically synthesized
tcccatgctgttctcgtgatag

SEQ ID NO: 1204717 - DNA, 22 bp, Artificial Sequence
  chemically synthesized
cccatgctgttctcgtgatagt

SEQ ID NO: 1204718 - DNA, 22 bp, Artificial Sequence
  chemically synthesized
ccatgctgttctcgtgatagtg

SEQ ID NO: 1204719 - DNA, 22 bp, Artificial Sequence
  chemically synthesized
gtgagacgtattcactatcacg

SEQ ID NO: 1204720 - DNA, 22 bp, Artificial Sequence
  chemically synthesized
ttctcgtgatagtgaatacgtc

SEQ ID NO: 1204721 - DNA, 22 bp, Artificial Sequence
  chemically synthesized
tcgtgatagtgaatacgtctca

SEQ ID NO: 1204722 - DNA, 22 bp, Artificial Sequence
  chemically synthesized
gtgatagtgaatacgtctcacg

SEQ ID NO: 1204723 - DNA, 22 bp, Artificial Sequence
  chemically synthesized
tataaaaccatcagatctcgtg

SEQ ID NO: 1204724 - DNA, 22 bp, Artificial Sequence
  chemically synthesized
gtataaaaccatcagatctcgt

SEQ ID NO: 1204725 - DNA, 22 bp, Artificial Sequence
  chemically synthesized
ttgtataaaaccatcagatctc

SEQ ID NO: 1204726 - DNA, 22 bp, Artificial Sequence
  chemically synthesized
cttgtataaaaccatcagatct

SEQ ID NO: 1204727 - DNA, 22 bp, Artificial Sequence
  chemically synthesized
tcttgtataaaaccatcagatc

SEQ ID NO: 1204728 - DNA, 22 bp, Artificial Sequence
  chemically synthesized
acgagatctgatggttttatac

SEQ ID NO: 1204729 - DNA, 22 bp, Artificial Sequence
  chemically synthesized
cgggaaactttcttgtataaaa

SEQ ID NO: 1204730 - DNA, 22 bp, Artificial Sequence
  chemically synthesized
atggttttatacaagaaagttt

SEQ ID NO: 1204731 - DNA, 22 bp, Artificial Sequence
  chemically synthesized
tatacaagaaagtttcccggaa

SEQ ID NO: 1204732 - DNA, 22 bp, Artificial Sequence
  chemically synthesized
atacaagaaagtttcccggaac

SEQ ID NO: 1204733 - DNA, 22 bp, Artificial Sequence
  chemically synthesized
tacaagaaagtttcccggaaca

SEQ ID NO: 1204734 - DNA, 22 bp, Artificial Sequence
  chemically synthesized
cccggaacatgctttctcttct

SEQ ID NO: 1204735 - DNA, 22 bp, Artificial Sequence
  chemically synthesized
ccggaacatgctttctcttctt

SEQ ID NO: 1204736 - DNA, 22 bp, Artificial Sequence
  chemically synthesized
catggagacaggcaagaagaga

SEQ ID NO: 1204737 - DNA, 22 bp, Artificial Sequence
  chemically synthesized
ccatggagacaggcaagaagag

SEQ ID NO: 1204738 - DNA, 22 bp, Artificial Sequence
  chemically synthesized
tctcttcttgcctgtctccatg

SEQ ID NO: 1204739 - DNA, 22 bp, Artificial Sequence
  chemically synthesized
ctcttcttgcctgtctccatgg

SEQ ID NO: 1204740 - DNA, 22 bp, Artificial Sequence
  chemically synthesized
tcttcttgcctgtctccatgga

SEQ ID NO: 1204741 - DNA, 22 bp, Artificial Sequence
  chemically synthesized
ttcttgcctgtctccatggaag

SEQ ID NO: 1204742 - DNA, 22 bp, Artificial Sequence
  chemically synthesized
cttgcctgtctccatggaagat

SEQ ID NO: 1204743 - DNA, 22 bp, Artificial Sequence
  chemically synthesized
ttgcctgtctccatggaagatg

SEQ ID NO: 1204744 - DNA, 22 bp, Artificial Sequence
  chemically synthesized
gcctgtctccatggaagatgtg

SEQ ID NO: 1204745 - DNA, 22 bp, Artificial Sequence
  chemically synthesized
cctgtctccatggaagatgtga

SEQ ID NO: 1204746 - DNA, 22 bp, Artificial Sequence
  chemically synthesized
tctccatggaagatgtgacttt

SEQ ID NO: 1204747 - DNA, 22 bp, Artificial Sequence
  chemically synthesized
catggaagatgtgactttgctg

SEQ ID NO: 1204748 - DNA, 22 bp, Artificial Sequence
  chemically synthesized
acaatcatggtggagggcaaat

SEQ ID NO: 1204749 - DNA, 22 bp, Artificial Sequence
  chemically synthesized
tgctgctcatttgccctccacc

SEQ ID NO: 1204750 - DNA, 22 bp, Artificial Sequence
  chemically synthesized
gctgctcatttgccctccacca

SEQ ID NO: 1204751 - DNA, 22 bp, Artificial Sequence
  chemically synthesized
ctgctcatttgccctccaccat

SEQ ID NO: 1204752 - DNA, 22 bp, Artificial Sequence
  chemically synthesized
ctcatttgccctccaccatgat

SEQ ID NO: 1204753 - DNA, 22 bp, Artificial Sequence
  chemically synthesized
gggaggcctcacaatcatggtg

SEQ ID NO: 1204754 - DNA, 22 bp, Artificial Sequence
  chemically synthesized
atttgccctccaccatgattgt

SEQ ID NO: 1204755 - DNA, 22 bp, Artificial Sequence
  chemically synthesized
gccctccaccatgattgtgagg

SEQ ID NO: 1204756 - DNA, 22 bp, Artificial Sequence
  chemically synthesized
ccctccaccatgattgtgaggc

SEQ ID NO: 1204757 - DNA, 22 bp, Artificial Sequence
  chemically synthesized
catggctggggaggcctcacaa

SEQ ID NO: 1204758 - DNA, 22 bp, Artificial Sequence
  chemically synthesized
tacatggctggggaggcctcac

SEQ ID NO: 1204759 - DNA, 22 bp, Artificial Sequence
  chemically synthesized
caccatgattgtgaggcctccc

SEQ ID NO: 1204760 - DNA, 22 bp, Artificial Sequence
  chemically synthesized
atagttctacatggctggggag

SEQ ID NO: 1204761 - DNA, 22 bp, Artificial Sequence
  chemically synthesized
actcatagttctacatggctgg

SEQ ID NO: 1204762 - DNA, 22 bp, Artificial Sequence
  chemically synthesized
tgaggcctccccagccatgtag

SEQ ID NO: 1204763 - DNA, 22 bp, Artificial Sequence
  chemically synthesized
attgactcatagttctacatgg

SEQ ID NO: 1204764 - DNA, 22 bp, Artificial Sequence
  chemically synthesized
aattgactcatagttctacatg

SEQ ID NO: 1204765 - DNA, 22 bp, Artificial Sequence
  chemically synthesized
cccagccatgtagaactatgag

SEQ ID NO: 1204766 - DNA, 22 bp, Artificial Sequence
  chemically synthesized
taaaggaaaggtttaattgact

SEQ ID NO: 1204767 - DNA, 22 bp, Artificial Sequence
  chemically synthesized
ataaaggaaaggtttaattgac

SEQ ID NO: 1204768 - DNA, 22 bp, Artificial Sequence
  chemically synthesized
ggtaatttataaaggaaaggtt

SEQ ID NO: 1204769 - DNA, 22 bp, Artificial Sequence
  chemically synthesized
tgagtcaattaaacctttcctt

SEQ ID NO: 1204770 - DNA, 22 bp, Artificial Sequence
  chemically synthesized
aacctttcctttataaattacc

SEQ ID NO: 1204771 - DNA, 22 bp, Artificial Sequence
  chemically synthesized
tcctttataaattacctagtct

SEQ ID NO: 1204772 - DNA, 22 bp, Artificial Sequence
  chemically synthesized
cctttataaattacctagtctt

SEQ ID NO: 1204773 - DNA, 22 bp, Artificial Sequence
  chemically synthesized
ctttataaattacctagtcttt

SEQ ID NO: 1204774 - DNA, 22 bp, Artificial Sequence
  chemically synthesized
ataaaggcgtaccaaagactag

SEQ ID NO: 1204775 - DNA, 22 bp, Artificial Sequence
  chemically synthesized
tataaattacctagtctttggt

SEQ ID NO: 1204776 - DNA, 22 bp, Artificial Sequence
  chemically synthesized
ataaattacctagtctttggta

SEQ ID NO: 1204777 - DNA, 22 bp, Artificial Sequence
  chemically synthesized
ctaataaaggcgtaccaaagac

SEQ ID NO: 1204778 - DNA, 22 bp, Artificial Sequence
  chemically synthesized
taaattacctagtctttggtac

SEQ ID NO: 1204779 - DNA, 22 bp, Artificial Sequence
  chemically synthesized
atgctgctaataaaggcgtacc

SEQ ID NO: 1204780 - DNA, 22 bp, Artificial Sequence
  chemically synthesized
cctagtctttggtacgccttta

SEQ ID NO: 1204781 - DNA, 22 bp, Artificial Sequence
  chemically synthesized
tcatgctgctaataaaggcgta

SEQ ID NO: 1204782 - DNA, 22 bp, Artificial Sequence
  chemically synthesized
ttctcatgctgctaataaaggc

SEQ ID NO: 1204783 - DNA, 22 bp, Artificial Sequence
  chemically synthesized
gtctttggtacgcctttattag

SEQ ID NO: 1204784 - DNA, 22 bp, Artificial Sequence
  chemically synthesized
gtctgttctcatgctgctaata

SEQ ID NO: 1204785 - DNA, 22 bp, Artificial Sequence
  chemically synthesized
tggtacgcctttattagcagca

SEQ ID NO: 1204786 - DNA, 22 bp, Artificial Sequence
  chemically synthesized
ggtacgcctttattagcagcat

SEQ ID NO: 1204787 - DNA, 22 bp, Artificial Sequence
  chemically synthesized
gtacgcctttattagcagcatg

SEQ ID NO: 1204788 - DNA, 22 bp, Artificial Sequence
  chemically synthesized
tattagtctgttctcatgctgc

SEQ ID NO: 1204789 - DNA, 22 bp, Artificial Sequence
  chemically synthesized
tattagcagcatgagaacagac

SEQ ID NO: 1204790 - DNA, 22 bp, Artificial Sequence
  chemically synthesized
attagcagcatgagaacagact

SEQ ID NO: 1204791 - DNA, 22 bp, Artificial Sequence
  chemically synthesized
ttagcagcatgagaacagacta

SEQ ID NO: 1204792 - DNA, 22 bp, Artificial Sequence
  chemically synthesized
gcagcatgagaacagactaata

SEQ ID NO: 1204793 - DNA, 22 bp, Artificial Sequence
  chemically synthesized
taaaggaatctgtattagtctg

SEQ ID NO: 1204794 - DNA, 22 bp, Artificial Sequence
  chemically synthesized
aaaataaacctataaaggaatc

SEQ ID NO: 1204795 - DNA, 22 bp, Artificial Sequence
  chemically synthesized
ttcaaaataaacctataaagga

SEQ ID NO: 1204796 - DNA, 22 bp, Artificial Sequence
  chemically synthesized
ctgttcaaaataaacctataaa

SEQ ID NO: 1204797 - DNA, 22 bp, Artificial Sequence
  chemically synthesized
atacagattcctttataggttt

SEQ ID NO: 1204798 - DNA, 22 bp, Artificial Sequence
  chemically synthesized
ctttataggtttattttgaaca

SEQ ID NO: 1204799 - DNA, 22 bp, Artificial Sequence
  chemically synthesized
tataggtttattttgaacagta

SEQ ID NO: 1204800 - DNA, 22 bp, Artificial Sequence
  chemically synthesized
ataggtttattttgaacagtag

SEQ ID NO: 1204801 - DNA, 22 bp, Artificial Sequence
  chemically synthesized
taggtttattttgaacagtaga

SEQ ID NO: 1204802 - DNA, 22 bp, Artificial Sequence
  chemically synthesized
attttgaacagtagatgcctct

SEQ ID NO: 1204803 - DNA, 22 bp, Artificial Sequence
  chemically synthesized
ttttgaacagtagatgcctctt

SEQ ID NO: 1204804 - DNA, 22 bp, Artificial Sequence
  chemically synthesized
tgaacagtagatgcctctttgt

SEQ ID NO: 1204805 - DNA, 22 bp, Artificial Sequence
  chemically synthesized
gaacagtagatgcctctttgta

SEQ ID NO: 1204806 - DNA, 22 bp, Artificial Sequence
  chemically synthesized
aacagtagatgcctctttgtat

SEQ ID NO: 1204807 - DNA, 22 bp, Artificial Sequence
  chemically synthesized
atgggatacagtgcaaaataca

SEQ ID NO: 1204808 - DNA, 22 bp, Artificial Sequence
  chemically synthesized
tttgtattttgcactgtatccc

SEQ ID NO: 1204809 - DNA, 22 bp, Artificial Sequence
  chemically synthesized
tgtattttgcactgtatcccat

SEQ ID NO: 1204810 - DNA, 22 bp, Artificial Sequence
  chemically synthesized
gtattttgcactgtatcccatc

SEQ ID NO: 1204811 - DNA, 22 bp, Artificial Sequence
  chemically synthesized
tattttgcactgtatcccatca

SEQ ID NO: 1204812 - DNA, 22 bp, Artificial Sequence
  chemically synthesized
tgcactgtatcccatcaaccca

SEQ ID NO: 1204813 - DNA, 22 bp, Artificial Sequence
  chemically synthesized
gcactgtatcccatcaacccat

SEQ ID NO: 1204814 - DNA, 22 bp, Artificial Sequence
  chemically synthesized
cactgtatcccatcaacccatc

SEQ ID NO: 1204815 - DNA, 22 bp, Artificial Sequence
  chemically synthesized
cagcaaaaatgagagatgggtt

SEQ ID NO: 1204816 - DNA, 22 bp, Artificial Sequence
  chemically synthesized
tatcccatcaacccatctctca

SEQ ID NO: 1204817 - DNA, 22 bp, Artificial Sequence
  chemically synthesized
acagcagaaacaggaactgcag

SEQ ID NO: 1204818 - DNA, 22 bp, Artificial Sequence
  chemically synthesized
taacagcagaaacaggaactgc

SEQ ID NO: 1204819 - DNA, 22 bp, Artificial Sequence
  chemically synthesized
tcatttttgctgcagttcctgt

SEQ ID NO: 1204820 - DNA, 22 bp, Artificial Sequence
  chemically synthesized
atttttgctgcagttcctgttt

SEQ ID NO: 1204821 - DNA, 22 bp, Artificial Sequence
  chemically synthesized
accctctaacagcagaaacagg

SEQ ID NO: 1204822 - DNA, 22 bp, Artificial Sequence
  chemically synthesized
ttgctgcagttcctgtttctgc

SEQ ID NO: 1204823 - DNA, 22 bp, Artificial Sequence
  chemically synthesized
tgctgcagttcctgtttctgct

SEQ ID NO: 1204824 - DNA, 22 bp, Artificial Sequence
  chemically synthesized
gctgcagttcctgtttctgctg

SEQ ID NO: 1204825 - DNA, 22 bp, Artificial Sequence
  chemically synthesized
ctgcagttcctgtttctgctgt

SEQ ID NO: 1204826 - DNA, 22 bp, Artificial Sequence
  chemically synthesized
cagttcctgtttctgctgttag

SEQ ID NO: 1204827 - DNA, 22 bp, Artificial Sequence
  chemically synthesized
ctgtttctgctgttagagggtt

SEQ ID NO: 1204828 - DNA, 22 bp, Artificial Sequence
  chemically synthesized
tttctgctgttagagggttaac

SEQ ID NO: 1204829 - DNA, 22 bp, Artificial Sequence
  chemically synthesized
ggaagtgaaagggtgttaaccc

SEQ ID NO: 1204830 - DNA, 22 bp, Artificial Sequence
  chemically synthesized
ctgctgttagagggttaacacc

SEQ ID NO: 1204831 - DNA, 22 bp, Artificial Sequence
  chemically synthesized
tgctgttagagggttaacaccc

SEQ ID NO: 1204832 - DNA, 22 bp, Artificial Sequence
  chemically synthesized
ctgttagagggttaacaccctt

SEQ ID NO: 1204833 - DNA, 22 bp, Artificial Sequence
  chemically synthesized
gagctaggaagtgaaagggtgt

SEQ ID NO: 1204834 - DNA, 22 bp, Artificial Sequence
  chemically synthesized
ttagagggttaacaccctttca

SEQ ID NO: 1204835 - DNA, 22 bp, Artificial Sequence
  chemically synthesized
ctagagctaggaagtgaaaggg

SEQ ID NO: 1204836 - DNA, 22 bp, Artificial Sequence
  chemically synthesized
gagggttaacaccctttcactt

SEQ ID NO: 1204837 - DNA, 22 bp, Artificial Sequence
  chemically synthesized
ttgctagagctaggaagtgaaa

SEQ ID NO: 1204838 - DNA, 22 bp, Artificial Sequence
  chemically synthesized
ctgttgctagagctaggaagtg

SEQ ID NO: 1204839 - DNA, 22 bp, Artificial Sequence
  chemically synthesized
acaccctttcacttcctagctc

SEQ ID NO: 1204840 - DNA, 22 bp, Artificial Sequence
  chemically synthesized
ctcctgttgctagagctaggaa

SEQ ID NO: 1204841 - DNA, 22 bp, Artificial Sequence
  chemically synthesized
ctcctcctgttgctagagctag

SEQ ID NO: 1204842 - DNA, 22 bp, Artificial Sequence
  chemically synthesized
ctcctcctcctgttgctagagc

SEQ ID NO: 1204843 - DNA, 22 bp, Artificial Sequence
  chemically synthesized
tcacttcctagctctagcaaca

SEQ ID NO: 1204844 - DNA, 22 bp, Artificial Sequence
  chemically synthesized
cacttcctagctctagcaacag

SEQ ID NO: 1204845 - DNA, 22 bp, Artificial Sequence
  chemically synthesized
ctcctcctcctcctgttgctag

SEQ ID NO: 1204846 - DNA, 22 bp, Artificial Sequence
  chemically synthesized
acttcctagctctagcaacagg

SEQ ID NO: 1204847 - DNA, 22 bp, Artificial Sequence
  chemically synthesized
cctcctcctcctcctgttgcta

SEQ ID NO: 1204848 - DNA, 22 bp, Artificial Sequence
  chemically synthesized
ttcctcctcctcctcctgttgc

SEQ ID NO: 1204849 - DNA, 22 bp, Artificial Sequence
  chemically synthesized
cctagctctagcaacaggagga

SEQ ID NO: 1204850 - DNA, 22 bp, Artificial Sequence
  chemically synthesized
ctagctctagcaacaggaggag

SEQ ID NO: 1204851 - DNA, 22 bp, Artificial Sequence
  chemically synthesized
ctcttcctcctcctcctcctgt

SEQ ID NO: 1204852 - DNA, 22 bp, Artificial Sequence
  chemically synthesized
gctctagcaacaggaggaggag

SEQ ID NO: 1204853 - DNA, 22 bp, Artificial Sequence
  chemically synthesized
cctcctcttcctcctcctcctc

SEQ ID NO: 1204854 - DNA, 22 bp, Artificial Sequence
  chemically synthesized
tagcaacaggaggaggaggagg

SEQ ID NO: 1204855 - DNA, 22 bp, Artificial Sequence
  chemically synthesized
ctccctcctcttcctcctcctc

SEQ ID NO: 1204856 - DNA, 22 bp, Artificial Sequence
  chemically synthesized
cctccctcctcttcctcctcct

SEQ ID NO: 1204857 - DNA, 22 bp, Artificial Sequence
  chemically synthesized
gcaacaggaggaggaggaggaa

SEQ ID NO: 1204858 - DNA, 22 bp, Artificial Sequence
  chemically synthesized
tcctccctcctcttcctcctcc

SEQ ID NO: 1204859 - DNA, 22 bp, Artificial Sequence
  chemically synthesized
ttttcctccctcctcttcctcc

SEQ ID NO: 1204860 - DNA, 22 bp, Artificial Sequence
  chemically synthesized
attttcctccctcctcttcctc

SEQ ID NO: 1204861 - DNA, 22 bp, Artificial Sequence
  chemically synthesized
aaggacaatttattttcctccc

SEQ ID NO: 1204862 - DNA, 22 bp, Artificial Sequence
  chemically synthesized
gaaggacaatttattttcctcc

SEQ ID NO: 1204863 - DNA, 22 bp, Artificial Sequence
  chemically synthesized
tgaaggacaatttattttcctc

SEQ ID NO: 1204864 - DNA, 22 bp, Artificial Sequence
  chemically synthesized
agaaatgtccctttgaaggaca

SEQ ID NO: 1204865 - DNA, 22 bp, Artificial Sequence
  chemically synthesized
tcctcagaaatgtccctttgaa

SEQ ID NO: 1204866 - DNA, 22 bp, Artificial Sequence
  chemically synthesized
tagaactgtcctcagaaatgtc

SEQ ID NO: 1204867 - DNA, 22 bp, Artificial Sequence
  chemically synthesized
tccttcaaagggacatttctga

SEQ ID NO: 1204868 - DNA, 22 bp, Artificial Sequence
  chemically synthesized
atagaactgtcctcagaaatgt

SEQ ID NO: 1204869 - DNA, 22 bp, Artificial Sequence
  chemically synthesized
caaagggacatttctgaggaca

SEQ ID NO: 1204870 - DNA, 22 bp, Artificial Sequence
  chemically synthesized
aaagggacatttctgaggacag

SEQ ID NO: 1204871 - DNA, 22 bp, Artificial Sequence
  chemically synthesized
tagaaccttatagaactgtcct

SEQ ID NO: 1204872 - DNA, 22 bp, Artificial Sequence
  chemically synthesized
ggacattatagaaccttataga

SEQ ID NO: 1204873 - DNA, 22 bp, Artificial Sequence
  chemically synthesized
ctgaggacagttctataaggtt

SEQ ID NO: 1204874 - DNA, 22 bp, Artificial Sequence
  chemically synthesized
tgaggacagttctataaggttc

SEQ ID NO: 1204875 - DNA, 22 bp, Artificial Sequence
  chemically synthesized
aggacagttctataaggttcta

SEQ ID NO: 1204876 - DNA, 22 bp, Artificial Sequence
  chemically synthesized
cctgggacattatagaacctta

SEQ ID NO: 1204877 - DNA, 22 bp, Artificial Sequence
  chemically synthesized
gcctgggacattatagaacctt

SEQ ID NO: 1204878 - DNA, 22 bp, Artificial Sequence
  chemically synthesized
aaccttgcctgggacattatag

SEQ ID NO: 1204879 - DNA, 22 bp, Artificial Sequence
  chemically synthesized
tataaggttctataatgtccca

SEQ ID NO: 1204880 - DNA, 22 bp, Artificial Sequence
  chemically synthesized
taaggttctataatgtcccagg

SEQ ID NO: 1204881 - DNA, 22 bp, Artificial Sequence
  chemically synthesized
tacctcaaccttgcctgggaca

SEQ ID NO: 1204882 - DNA, 22 bp, Artificial Sequence
  chemically synthesized
tataatgtcccaggcaaggttg

SEQ ID NO: 1204883 - DNA, 22 bp, Artificial Sequence
  chemically synthesized
taatgtcccaggcaaggttgag

SEQ ID NO: 1204884 - DNA, 22 bp, Artificial Sequence
  chemically synthesized
atgaccataataggtaactgta

SEQ ID NO: 1204885 - DNA, 22 bp, Artificial Sequence
  chemically synthesized
aactgatgaccataataggtaa

SEQ ID NO: 1204886 - DNA, 22 bp, Artificial Sequence
  chemically synthesized
ttgaactgatgaccataatagg

SEQ ID NO: 1204887 - DNA, 22 bp, Artificial Sequence
  chemically synthesized
aggtacagttacctattatggt

SEQ ID NO: 1204888 - DNA, 22 bp, Artificial Sequence
  chemically synthesized
cctattatggtcatcagttcaa

SEQ ID NO: 1204889 - DNA, 22 bp, Artificial Sequence
  chemically synthesized
ataaagataacattgttgaact

SEQ ID NO: 1204890 - DNA, 22 bp, Artificial Sequence
  chemically synthesized
ttatggtcatcagttcaacaat

SEQ ID NO: 1204891 - DNA, 22 bp, Artificial Sequence
  chemically synthesized
tggtcatcagttcaacaatgtt

SEQ ID NO: 1204892 - DNA, 22 bp, Artificial Sequence
  chemically synthesized
aacaatgttatctttattagct

SEQ ID NO: 1204893 - DNA, 22 bp, Artificial Sequence
  chemically synthesized
tctttattagcttttccttctt

SEQ ID NO: 1204894 - DNA, 22 bp, Artificial Sequence
  chemically synthesized
tattagcttttccttcttcctt

SEQ ID NO: 1204895 - DNA, 22 bp, Artificial Sequence
  chemically synthesized
gaaaagtgagacaaggaagaag

SEQ ID NO: 1204896 - DNA, 22 bp, Artificial Sequence
  chemically synthesized
attagcttttccttcttccttg

SEQ ID NO: 1204897 - DNA, 22 bp, Artificial Sequence
  chemically synthesized
ttagcttttccttcttccttgt

SEQ ID NO: 1204898 - DNA, 22 bp, Artificial Sequence
  chemically synthesized
gcttttccttcttccttgtctc

SEQ ID NO: 1204899 - DNA, 22 bp, Artificial Sequence
  chemically synthesized
ttccttcttccttgtctcactt

SEQ ID NO: 1204900 - DNA, 22 bp, Artificial Sequence
  chemically synthesized
tccttcttccttgtctcacttt

SEQ ID NO: 1204901 - DNA, 22 bp, Artificial Sequence
  chemically synthesized
ccttcttccttgtctcactttt

SEQ ID NO: 1204902 - DNA, 22 bp, Artificial Sequence
  chemically synthesized
cttcttccttgtctcacttttc

SEQ ID NO: 1204903 - DNA, 22 bp, Artificial Sequence
  chemically synthesized
cttccttgtctcacttttccag

SEQ ID NO: 1204904 - DNA, 22 bp, Artificial Sequence
  chemically synthesized
ttccttgtctcacttttccagg

SEQ ID NO: 1204905 - DNA, 22 bp, Artificial Sequence
  chemically synthesized
ccttgtctcacttttccaggtc

SEQ ID NO: 1204906 - DNA, 22 bp, Artificial Sequence
  chemically synthesized
aggaacatgtgggacctggaaa

SEQ ID NO: 1204907 - DNA, 22 bp, Artificial Sequence
  chemically synthesized
cttgtctcacttttccaggtcc

SEQ ID NO: 1204908 - DNA, 22 bp, Artificial Sequence
  chemically synthesized
gtctcacttttccaggtcccac

SEQ ID NO: 1204909 - DNA, 22 bp, Artificial Sequence
  chemically synthesized
tctcacttttccaggtcccaca

SEQ ID NO: 1204910 - DNA, 22 bp, Artificial Sequence
  chemically synthesized
acttttccaggtcccacatgtt

SEQ ID NO: 1204911 - DNA, 22 bp, Artificial Sequence
  chemically synthesized
gtaagaaaactcaggaacatgt

SEQ ID NO: 1204912 - DNA, 22 bp, Artificial Sequence
  chemically synthesized
ttccaggtcccacatgttcctg

SEQ ID NO: 1204913 - DNA, 22 bp, Artificial Sequence
  chemically synthesized
tccaggtcccacatgttcctga

SEQ ID NO: 1204914 - DNA, 22 bp, Artificial Sequence
  chemically synthesized
ccaggtcccacatgttcctgag

SEQ ID NO: 1204915 - DNA, 22 bp, Artificial Sequence
  chemically synthesized
caggtcccacatgttcctgagt

SEQ ID NO: 1204916 - DNA, 22 bp, Artificial Sequence
  chemically synthesized
tcaaagaaactagtaagaaaac

SEQ ID NO: 1204917 - DNA, 22 bp, Artificial Sequence
  chemically synthesized
attatcaaagaaactagtaaga

SEQ ID NO: 1204918 - DNA, 22 bp, Artificial Sequence
  chemically synthesized
ctgagttttcttactagtttct

SEQ ID NO: 1204919 - DNA, 22 bp, Artificial Sequence
  chemically synthesized
gctgattatcaaagaaactagt

SEQ ID NO: 1204920 - DNA, 22 bp, Artificial Sequence
  chemically synthesized
agttttcttactagtttctttg

SEQ ID NO: 1204921 - DNA, 22 bp, Artificial Sequence
  chemically synthesized
tcttactagtttctttgataat

SEQ ID NO: 1204922 - DNA, 22 bp, Artificial Sequence
  chemically synthesized
cttactagtttctttgataatc

SEQ ID NO: 1204923 - DNA, 22 bp, Artificial Sequence
  chemically synthesized
ttactagtttctttgataatca

SEQ ID NO: 1204924 - DNA, 22 bp, Artificial Sequence
  chemically synthesized
actagtttctttgataatcagc

SEQ ID NO: 1204925 - DNA, 22 bp, Artificial Sequence
  chemically synthesized
ctagtttctttgataatcagcc

SEQ ID NO: 1204926 - DNA, 22 bp, Artificial Sequence
  chemically synthesized
gtttctttgataatcagccaat

SEQ ID NO: 1204927 - DNA, 22 bp, Artificial Sequence
  chemically synthesized
acagaaagccatgattggctga

SEQ ID NO: 1204928 - DNA, 22 bp, Artificial Sequence
  chemically synthesized
ctttgataatcagccaatcatg

SEQ ID NO: 1204929 - DNA, 22 bp, Artificial Sequence
  chemically synthesized
tttgataatcagccaatcatgg

SEQ ID NO: 1204930 - DNA, 22 bp, Artificial Sequence
  chemically synthesized
tgataatcagccaatcatggct

SEQ ID NO: 1204931 - DNA, 22 bp, Artificial Sequence
  chemically synthesized
gataatcagccaatcatggctt

SEQ ID NO: 1204932 - DNA, 22 bp, Artificial Sequence
  chemically synthesized
ataatcagccaatcatggcttt

SEQ ID NO: 1204933 - DNA, 22 bp, Artificial Sequence
  chemically synthesized
ccccaaagcaaagcctgacaga

SEQ ID NO: 1204934 - DNA, 22 bp, Artificial Sequence
  chemically synthesized
cccccaaagcaaagcctgacag

SEQ ID NO: 1204935 - DNA, 22 bp, Artificial Sequence
  chemically synthesized
tcccccaaagcaaagcctgaca

SEQ ID NO: 1204936 - DNA, 22 bp, Artificial Sequence
  chemically synthesized
agttttcccccaaagcaaagcc

SEQ ID NO: 1204937 - DNA, 22 bp, Artificial Sequence
  chemically synthesized
gagttttcccccaaagcaaagc

SEQ ID NO: 1204938 - DNA, 22 bp, Artificial Sequence
  chemically synthesized
tctgtcaggctttgctttgggg

SEQ ID NO: 1204939 - DNA, 22 bp, Artificial Sequence
  chemically synthesized
ctgtcaggctttgctttggggg

SEQ ID NO: 1204940 - DNA, 22 bp, Artificial Sequence
  chemically synthesized
tgtcaggctttgctttggggga

SEQ ID NO: 1204941 - DNA, 22 bp, Artificial Sequence
  chemically synthesized
tcaggctttgctttgggggaaa

SEQ ID NO: 1204942 - DNA, 22 bp, Artificial Sequence
  chemically synthesized
tgctttgggggaaaactcaaac

SEQ ID NO: 1204943 - DNA, 22 bp, Artificial Sequence
  chemically synthesized
gctttgggggaaaactcaaact

SEQ ID NO: 1204944 - DNA, 22 bp, Artificial Sequence
  chemically synthesized
ctttgggggaaaactcaaactg

SEQ ID NO: 1204945 - DNA, 22 bp, Artificial Sequence
  chemically synthesized
tgggggaaaactcaaactgaca

SEQ ID NO: 1204946 - DNA, 22 bp, Artificial Sequence
  chemically synthesized
gggggaaaactcaaactgacac

SEQ ID NO: 1204947 - DNA, 22 bp, Artificial Sequence
  chemically synthesized
ggggaaaactcaaactgacact

SEQ ID NO: 1204948 - DNA, 22 bp, Artificial Sequence
  chemically synthesized
agtgacagcaatagtcaagagt

SEQ ID NO: 1204949 - DNA, 22 bp, Artificial Sequence
  chemically synthesized
aagtgacagcaatagtcaagag

SEQ ID NO: 1204950 - DNA, 22 bp, Artificial Sequence
  chemically synthesized
aaactgacactcttgactattg

SEQ ID NO: 1204951 - DNA, 22 bp, Artificial Sequence
  chemically synthesized
agtttaagtgacagcaatagtc

SEQ ID NO: 1204952 - DNA, 22 bp, Artificial Sequence
  chemically synthesized
acactcttgactattgctgtca

SEQ ID NO: 1204953 - DNA, 22 bp, Artificial Sequence
  chemically synthesized
agagttcagtttaagtgacagc

SEQ ID NO: 1204954 - DNA, 22 bp, Artificial Sequence
  chemically synthesized
taagagttcagtttaagtgaca

SEQ ID NO: 1204955 - DNA, 22 bp, Artificial Sequence
  chemically synthesized
ttgactattgctgtcacttaaa

SEQ ID NO: 1204956 - DNA, 22 bp, Artificial Sequence
  chemically synthesized
tctaagagttcagtttaagtga

SEQ ID NO: 1204957 - DNA, 22 bp, Artificial Sequence
  chemically synthesized
gactattgctgtcacttaaact

SEQ ID NO: 1204958 - DNA, 22 bp, Artificial Sequence
  chemically synthesized
actattgctgtcacttaaactg

SEQ ID NO: 1204959 - DNA, 22 bp, Artificial Sequence
  chemically synthesized
ctctctaagagttcagtttaag

SEQ ID NO: 1204960 - DNA, 22 bp, Artificial Sequence
  chemically synthesized
ttgctgtcacttaaactgaact

SEQ ID NO: 1204961 - DNA, 22 bp, Artificial Sequence
  chemically synthesized
ctgtcacttaaactgaactctt

SEQ ID NO: 1204962 - DNA, 22 bp, Artificial Sequence
  chemically synthesized
tcacttaaactgaactcttaga

SEQ ID NO: 1204963 - DNA, 22 bp, Artificial Sequence
  chemically synthesized
aaactgaactcttagagagcag

SEQ ID NO: 1204964 - DNA, 22 bp, Artificial Sequence
  chemically synthesized
aactgaactcttagagagcagt

SEQ ID NO: 1204965 - DNA, 22 bp, Artificial Sequence
  chemically synthesized
aaatgtatcaccactgctctct

SEQ ID NO: 1204966 - DNA, 22 bp, Artificial Sequence
  chemically synthesized
aactcttagagagcagtggtga

SEQ ID NO: 1204967 - DNA, 22 bp, Artificial Sequence
  chemically synthesized
aagaattaaaatgtatcaccac

SEQ ID NO: 1204968 - DNA, 22 bp, Artificial Sequence
  chemically synthesized
ttagagagcagtggtgatacat

SEQ ID NO: 1204969 - DNA, 22 bp, Artificial Sequence
  chemically synthesized
agagagcagtggtgatacattt

SEQ ID NO: 1204970 - DNA, 22 bp, Artificial Sequence
  chemically synthesized
gagagcagtggtgatacatttt

SEQ ID NO: 1204971 - DNA, 22 bp, Artificial Sequence
  chemically synthesized
aagctaaagaattaaaatgtat

SEQ ID NO: 1204972 - DNA, 22 bp, Artificial Sequence
  chemically synthesized
gcccctaaagctaaagaattaa

SEQ ID NO: 1204973 - DNA, 22 bp, Artificial Sequence
  chemically synthesized
tggcccctaaagctaaagaatt

SEQ ID NO: 1204974 - DNA, 22 bp, Artificial Sequence
  chemically synthesized
tctggcccctaaagctaaagaa

SEQ ID NO: 1204975 - DNA, 22 bp, Artificial Sequence
  chemically synthesized
cctctctggcccctaaagctaa

SEQ ID NO: 1204976 - DNA, 22 bp, Artificial Sequence
  chemically synthesized
ccctctctggcccctaaagcta

SEQ ID NO: 1204977 - DNA, 22 bp, Artificial Sequence
  chemically synthesized
taattctttagctttaggggcc

SEQ ID NO: 1204978 - DNA, 22 bp, Artificial Sequence
  chemically synthesized
aattctttagctttaggggcca

SEQ ID NO: 1204979 - DNA, 22 bp, Artificial Sequence
  chemically synthesized
attctttagctttaggggccag

SEQ ID NO: 1204980 - DNA, 22 bp, Artificial Sequence
  chemically synthesized
catcatcttccctctctggccc

SEQ ID NO: 1204981 - DNA, 22 bp, Artificial Sequence
  chemically synthesized
tttagctttaggggccagagag

SEQ ID NO: 1204982 - DNA, 22 bp, Artificial Sequence
  chemically synthesized
tagctttaggggccagagaggg

SEQ ID NO: 1204983 - DNA, 22 bp, Artificial Sequence
  chemically synthesized
agctttaggggccagagaggga

SEQ ID NO: 1204984 - DNA, 22 bp, Artificial Sequence
  chemically synthesized
gctttaggggccagagagggaa

SEQ ID NO: 1204985 - DNA, 22 bp, Artificial Sequence
  chemically synthesized
taggggccagagagggaagatg

SEQ ID NO: 1204986 - DNA, 22 bp, Artificial Sequence
  chemically synthesized
agaagtctgcatcatcttccct

SEQ ID NO: 1204987 - DNA, 22 bp, Artificial Sequence
  chemically synthesized
aggggccagagagggaagatga

SEQ ID NO: 1204988 - DNA, 22 bp, Artificial Sequence
  chemically synthesized
gagaagtctgcatcatcttccc

SEQ ID NO: 1204989 - DNA, 22 bp, Artificial Sequence
  chemically synthesized
ggggccagagagggaagatgat

SEQ ID NO: 1204990 - DNA, 22 bp, Artificial Sequence
  chemically synthesized
cgtgagcttgagaagtctgcat

SEQ ID NO: 1204991 - DNA, 22 bp, Artificial Sequence
  chemically synthesized
gagctgcgtgagcttgagaagt

SEQ ID NO: 1204992 - DNA, 22 bp, Artificial Sequence
  chemically synthesized
ccatctagagctgcgtgagctt

SEQ ID NO: 1204993 - DNA, 22 bp, Artificial Sequence
  chemically synthesized
tgccatctagagctgcgtgagc

SEQ ID NO: 1204994 - DNA, 22 bp, Artificial Sequence
  chemically synthesized
ctcaagctcacgcagctctaga

SEQ ID NO: 1204995 - DNA, 22 bp, Artificial Sequence
  chemically synthesized
tcaagctcacgcagctctagat

SEQ ID NO: 1204996 - DNA, 22 bp, Artificial Sequence
  chemically synthesized
aagctcacgcagctctagatgg

SEQ ID NO: 1204997 - DNA, 22 bp, Artificial Sequence
  chemically synthesized
aatgcagtctctgccatctaga

SEQ ID NO: 1204998 - DNA, 22 bp, Artificial Sequence
  chemically synthesized
aaatgcagtctctgccatctag

SEQ ID NO: 1204999 - DNA, 22 bp, Artificial Sequence
  chemically synthesized
acgcagctctagatggcagaga

SEQ ID NO: 1205000 - DNA, 22 bp, Artificial Sequence
  chemically synthesized
gatttaaatgcagtctctgcca

SEQ ID NO: 1205001 - DNA, 22 bp, Artificial Sequence
  chemically synthesized
tagatggcagagactgcattta

SEQ ID NO: 1205002 - DNA, 22 bp, Artificial Sequence
  chemically synthesized
gatggcagagactgcatttaaa

SEQ ID NO: 1205003 - DNA, 22 bp, Artificial Sequence
  chemically synthesized
catttaaatccaggtctttctc

SEQ ID NO: 1205004 - DNA, 22 bp, Artificial Sequence
  chemically synthesized
aaatccaggtctttctcctccc

SEQ ID NO: 1205005 - DNA, 22 bp, Artificial Sequence
  chemically synthesized
aatccaggtctttctcctccct

SEQ ID NO: 1205006 - DNA, 22 bp, Artificial Sequence
  chemically synthesized
tctcctccctgcgtgttgctac

SEQ ID NO: 1205007 - DNA, 22 bp, Artificial Sequence
  chemically synthesized
ctcctccctgcgtgttgctaca

SEQ ID NO: 1205008 - DNA, 22 bp, Artificial Sequence
  chemically synthesized
tcctccctgcgtgttgctacat

SEQ ID NO: 1205009 - DNA, 22 bp, Artificial Sequence
  chemically synthesized
ctccctgcgtgttgctacatgc

SEQ ID NO: 1205010 - DNA, 22 bp, Artificial Sequence
  chemically synthesized
cctgcgtgttgctacatgccat

SEQ ID NO: 1205011 - DNA, 22 bp, Artificial Sequence
  chemically synthesized
tagagaggtaccaaaatggcat

SEQ ID NO: 1205012 - DNA, 22 bp, Artificial Sequence
  chemically synthesized
cgtgttgctacatgccattttg

SEQ ID NO: 1205013 - DNA, 22 bp, Artificial Sequence
  chemically synthesized
ctacatgccattttggtacctc

SEQ ID NO: 1205014 - DNA, 22 bp, Artificial Sequence
  chemically synthesized
catgccattttggtacctctct

SEQ ID NO: 1205015 - DNA, 22 bp, Artificial Sequence
  chemically synthesized
tggaaggcaagcctgtagagag

SEQ ID NO: 1205016 - DNA, 22 bp, Artificial Sequence
  chemically synthesized
tggtacctctctacaggcttgc

SEQ ID NO: 1205017 - DNA, 22 bp, Artificial Sequence
  chemically synthesized
ggtacctctctacaggcttgcc

SEQ ID NO: 1205018 - DNA, 22 bp, Artificial Sequence
  chemically synthesized
gtacctctctacaggcttgcct

SEQ ID NO: 1205019 - DNA, 22 bp, Artificial Sequence
  chemically synthesized
aaaggttatggaaggcaagcct

SEQ ID NO: 1205020 - DNA, 22 bp, Artificial Sequence
  chemically synthesized
gaaaggttatggaaggcaagcc

SEQ ID NO: 1205021 - DNA, 22 bp, Artificial Sequence
  chemically synthesized
tgaaaggttatggaaggcaagc

SEQ ID NO: 1205022 - DNA, 22 bp, Artificial Sequence
  chemically synthesized
tctacaggcttgccttccataa

SEQ ID NO: 1205023 - DNA, 22 bp, Artificial Sequence
  chemically synthesized
aactttgaaaggttatggaagg

SEQ ID NO: 1205024 - DNA, 22 bp, Artificial Sequence
  chemically synthesized
tacaggcttgccttccataacc

SEQ ID NO: 1205025 - DNA, 22 bp, Artificial Sequence
  chemically synthesized
caggcttgccttccataacctt

SEQ ID NO: 1205026 - DNA, 22 bp, Artificial Sequence
  chemically synthesized
gccttccataacctttcaaagt

SEQ ID NO: 1205027 - DNA, 22 bp, Artificial Sequence
  chemically synthesized
ccttccataacctttcaaagtt

SEQ ID NO: 1205028 - DNA, 22 bp, Artificial Sequence
  chemically synthesized
ccataacctttcaaagttcagc

SEQ ID NO: 1205029 - DNA, 22 bp, Artificial Sequence
  chemically synthesized
cataacctttcaaagttcagca

SEQ ID NO: 1205030 - DNA, 22 bp, Artificial Sequence
  chemically synthesized
gatgagtaggagaatgctgaac

SEQ ID NO: 1205031 - DNA, 22 bp, Artificial Sequence
  chemically synthesized
ggatgagtaggagaatgctgaa

SEQ ID NO: 1205032 - DNA, 22 bp, Artificial Sequence
  chemically synthesized
atttggatgagtaggagaatgc

SEQ ID NO: 1205033 - DNA, 22 bp, Artificial Sequence
  chemically synthesized
tcaaagttcagcattctcctac

SEQ ID NO: 1205034 - DNA, 22 bp, Artificial Sequence
  chemically synthesized
caaagttcagcattctcctact

SEQ ID NO: 1205035 - DNA, 22 bp, Artificial Sequence
  chemically synthesized
aaagttcagcattctcctactc

SEQ ID NO: 1205036 - DNA, 22 bp, Artificial Sequence
  chemically synthesized
tgttcatttggatgagtaggag

SEQ ID NO: 1205037 - DNA, 22 bp, Artificial Sequence
  chemically synthesized
ctgtgttcatttggatgagtag

SEQ ID NO: 1205038 - DNA, 22 bp, Artificial Sequence
  chemically synthesized
agcattctcctactcatccaaa

SEQ ID NO: 1205039 - DNA, 22 bp, Artificial Sequence
  chemically synthesized
tcctactcatccaaatgaacac

SEQ ID NO: 1205040 - DNA, 22 bp, Artificial Sequence
  chemically synthesized
ctactcatccaaatgaacacag

SEQ ID NO: 1205041 - DNA, 22 bp, Artificial Sequence
  chemically synthesized
ctcatccaaatgaacacagtag

SEQ ID NO: 1205042 - DNA, 22 bp, Artificial Sequence
  chemically synthesized
atccaaatgaacacagtagtca

SEQ ID NO: 1205043 - DNA, 22 bp, Artificial Sequence
  chemically synthesized
tcaagtggatggaataaaacat

SEQ ID NO: 1205044 - DNA, 22 bp, Artificial Sequence
  chemically synthesized
atcaagtggatggaataaaaca

SEQ ID NO: 1205045 - DNA, 22 bp, Artificial Sequence
  chemically synthesized
tatcaagtggatggaataaaac

SEQ ID NO: 1205046 - DNA, 22 bp, Artificial Sequence
  chemically synthesized
ttttatcaagtggatggaataa

SEQ ID NO: 1205047 - DNA, 22 bp, Artificial Sequence
  chemically synthesized
tgacccattattttatcaagtg

SEQ ID NO: 1205048 - DNA, 22 bp, Artificial Sequence
  chemically synthesized
tattccatccacttgataaaat

SEQ ID NO: 1205049 - DNA, 22 bp, Artificial Sequence
  chemically synthesized
attccatccacttgataaaata

SEQ ID NO: 1205050 - DNA, 22 bp, Artificial Sequence
  chemically synthesized
ttccatccacttgataaaataa

SEQ ID NO: 1205051 - DNA, 22 bp, Artificial Sequence
  chemically synthesized
tgctgtgacccattattttatc

SEQ ID NO: 1205052 - DNA, 22 bp, Artificial Sequence
  chemically synthesized
catccacttgataaaataatgg

SEQ ID NO: 1205053 - DNA, 22 bp, Artificial Sequence
  chemically synthesized
gataaaataatgggtcacagca

SEQ ID NO: 1205054 - DNA, 22 bp, Artificial Sequence
  chemically synthesized
ataaaataatgggtcacagcac

SEQ ID NO: 1205055 - DNA, 22 bp, Artificial Sequence
  chemically synthesized
aataacaatggatcaagtgctg

SEQ ID NO: 1205056 - DNA, 22 bp, Artificial Sequence
  chemically synthesized
gtcgttgaataacaatggatca

SEQ ID NO: 1205057 - DNA, 22 bp, Artificial Sequence
  chemically synthesized
ggtcgttgaataacaatggatc

SEQ ID NO: 1205058 - DNA, 22 bp, Artificial Sequence
  chemically synthesized
aagagtcttggtcgttgaataa

SEQ ID NO: 1205059 - DNA, 22 bp, Artificial Sequence
  chemically synthesized
gatccattgttattcaacgacc

SEQ ID NO: 1205060 - DNA, 22 bp, Artificial Sequence
  chemically synthesized
atccattgttattcaacgacca

SEQ ID NO: 1205061 - DNA, 22 bp, Artificial Sequence
  chemically synthesized
caggaactcaagagtcttggtc

SEQ ID NO: 1205062 - DNA, 22 bp, Artificial Sequence
  chemically synthesized
ttattcaacgaccaagactctt

SEQ ID NO: 1205063 - DNA, 22 bp, Artificial Sequence
  chemically synthesized
ttcaacgaccaagactcttgag

SEQ ID NO: 1205064 - DNA, 22 bp, Artificial Sequence
  chemically synthesized
cataattacaggaactcaagag

SEQ ID NO: 1205065 - DNA, 22 bp, Artificial Sequence
  chemically synthesized
aacgaccaagactcttgagttc

SEQ ID NO: 1205066 - DNA, 22 bp, Artificial Sequence
  chemically synthesized
ttacataattacaggaactcaa

SEQ ID NO: 1205067 - DNA, 22 bp, Artificial Sequence
  chemically synthesized
gttacataattacaggaactca

SEQ ID NO: 1205068 - DNA, 22 bp, Artificial Sequence
  chemically synthesized
aggggcttgttacataattaca

SEQ ID NO: 1205069 - DNA, 22 bp, Artificial Sequence
  chemically synthesized
ttgagttcctgtaattatgtaa

SEQ ID NO: 1205070 - DNA, 22 bp, Artificial Sequence
  chemically synthesized
gagttcctgtaattatgtaaca

SEQ ID NO: 1205071 - DNA, 22 bp, Artificial Sequence
  chemically synthesized
agttcctgtaattatgtaacaa

SEQ ID NO: 1205072 - DNA, 22 bp, Artificial Sequence
  chemically synthesized
acagttaaggggcttgttacat

SEQ ID NO: 1205073 - DNA, 22 bp, Artificial Sequence
  chemically synthesized
ctgtaattatgtaacaagcccc

SEQ ID NO: 1205074 - DNA, 22 bp, Artificial Sequence
  chemically synthesized
taattatgtaacaagcccctta

SEQ ID NO: 1205075 - DNA, 22 bp, Artificial Sequence
  chemically synthesized
tgaccactgacagttaaggggc

SEQ ID NO: 1205076 - DNA, 22 bp, Artificial Sequence
  chemically synthesized
atgaccactgacagttaagggg

SEQ ID NO: 1205077 - DNA, 22 bp, Artificial Sequence
  chemically synthesized
tatgaccactgacagttaaggg

SEQ ID NO: 1205078 - DNA, 22 bp, Artificial Sequence
  chemically synthesized
tgtaacaagccccttaactgtc

SEQ ID NO: 1205079 - DNA, 22 bp, Artificial Sequence
  chemically synthesized
cctttatgaccactgacagtta

SEQ ID NO: 1205080 - DNA, 22 bp, Artificial Sequence
  chemically synthesized
gcctttatgaccactgacagtt

SEQ ID NO: 1205081 - DNA, 22 bp, Artificial Sequence
  chemically synthesized
ttgcctttatgaccactgacag

SEQ ID NO: 1205082 - DNA, 22 bp, Artificial Sequence
  chemically synthesized
agattcttgcctttatgaccac

SEQ ID NO: 1205083 - DNA, 22 bp, Artificial Sequence
  chemically synthesized
aactgtcagtggtcataaaggc

SEQ ID NO: 1205084 - DNA, 22 bp, Artificial Sequence
  chemically synthesized
actgtcagtggtcataaaggca

SEQ ID NO: 1205085 - DNA, 22 bp, Artificial Sequence
  chemically synthesized
tcagtggtcataaaggcaagaa

SEQ ID NO: 1205086 - DNA, 22 bp, Artificial Sequence
  chemically synthesized
cgaagtctgagattcttgcctt

SEQ ID NO: 1205087 - DNA, 22 bp, Artificial Sequence
  chemically synthesized
attccgaagtctgagattcttg

SEQ ID NO: 1205088 - DNA, 22 bp, Artificial Sequence
  chemically synthesized
gattccgaagtctgagattctt

SEQ ID NO: 1205089 - DNA, 22 bp, Artificial Sequence
  chemically synthesized
agacttcggaatcaaacccccc

SEQ ID NO: 1205090 - DNA, 22 bp, Artificial Sequence
  chemically synthesized
cagtaagagtaaatggggggtt

SEQ ID NO: 1205091 - DNA, 22 bp, Artificial Sequence
  chemically synthesized
cggaatcaaaccccccatttac

SEQ ID NO: 1205092 - DNA, 22 bp, Artificial Sequence
  chemically synthesized
ggaatcaaaccccccatttact

SEQ ID NO: 1205093 - DNA, 22 bp, Artificial Sequence
  chemically synthesized
tgtgagggcaaattgcagtaag

SEQ ID NO: 1205094 - DNA, 22 bp, Artificial Sequence
  chemically synthesized
actcttactgcaatttgccctc

SEQ ID NO: 1205095 - DNA, 22 bp, Artificial Sequence
  chemically synthesized
ctcttactgcaatttgccctca

SEQ ID NO: 1205096 - DNA, 22 bp, Artificial Sequence
  chemically synthesized
agaatacctgtgtgagggcaaa

SEQ ID NO: 1205097 - DNA, 22 bp, Artificial Sequence
  chemically synthesized
gagaatacctgtgtgagggcaa

SEQ ID NO: 1205098 - DNA, 22 bp, Artificial Sequence
  chemically synthesized
ttactgcaatttgccctcacac

SEQ ID NO: 1205099 - DNA, 22 bp, Artificial Sequence
  chemically synthesized
actgcaatttgccctcacacag

SEQ ID NO: 1205100 - DNA, 22 bp, Artificial Sequence
  chemically synthesized
ctgcaatttgccctcacacagg

SEQ ID NO: 1205101 - DNA, 22 bp, Artificial Sequence
  chemically synthesized
caatttgccctcacacaggtat

SEQ ID NO: 1205102 - DNA, 22 bp, Artificial Sequence
  chemically synthesized
gtaatcttgagaatacctgtgt

SEQ ID NO: 1205103 - DNA, 22 bp, Artificial Sequence
  chemically synthesized
tctcgtaatcttgagaatacct

SEQ ID NO: 1205104 - DNA, 22 bp, Artificial Sequence
  chemically synthesized
gccctcacacaggtattctcaa

SEQ ID NO: 1205105 - DNA, 22 bp, Artificial Sequence
  chemically synthesized
ccctcacacaggtattctcaag

SEQ ID NO: 1205106 - DNA, 22 bp, Artificial Sequence
  chemically synthesized
ttatctcgtaatcttgagaata

SEQ ID NO: 1205107 - DNA, 22 bp, Artificial Sequence
  chemically synthesized
gttatctcgtaatcttgagaat

SEQ ID NO: 1205108 - DNA, 22 bp, Artificial Sequence
  chemically synthesized
tgttatctcgtaatcttgagaa

SEQ ID NO: 1205109 - DNA, 22 bp, Artificial Sequence
  chemically synthesized
acacaggtattctcaagattac

SEQ ID NO: 1205110 - DNA, 22 bp, Artificial Sequence
  chemically synthesized
cactttgttatctcgtaatctt

SEQ ID NO: 1205111 - DNA, 22 bp, Artificial Sequence
  chemically synthesized
acactttgttatctcgtaatct

SEQ ID NO: 1205112 - DNA, 22 bp, Artificial Sequence
  chemically synthesized
ttacactttgttatctcgtaat

SEQ ID NO: 1205113 - DNA, 22 bp, Artificial Sequence
  chemically synthesized
agctcttacactttgttatctc

SEQ ID NO: 1205114 - DNA, 22 bp, Artificial Sequence
  chemically synthesized
tcaagattacgagataacaaag

SEQ ID NO: 1205115 - DNA, 22 bp, Artificial Sequence
  chemically synthesized
aagattacgagataacaaagtg

SEQ ID NO: 1205116 - DNA, 22 bp, Artificial Sequence
  chemically synthesized
tgctaagctcttacactttgtt

SEQ ID NO: 1205117 - DNA, 22 bp, Artificial Sequence
  chemically synthesized
cgagataacaaagtgtaagagc

SEQ ID NO: 1205118 - DNA, 22 bp, Artificial Sequence
  chemically synthesized
aggcactgtgctaagctcttac

SEQ ID NO: 1205119 - DNA, 22 bp, Artificial Sequence
  chemically synthesized
caggcactgtgctaagctctta

SEQ ID NO: 1205120 - DNA, 22 bp, Artificial Sequence
  chemically synthesized
tgtttcaggcactgtgctaagc

SEQ ID NO: 1205121 - DNA, 22 bp, Artificial Sequence
  chemically synthesized
aacacatcctgtgtttcaggca

SEQ ID NO: 1205122 - DNA, 22 bp, Artificial Sequence
  chemically synthesized
ttgaacacatcctgtgtttcag

SEQ ID NO: 1205123 - DNA, 22 bp, Artificial Sequence
  chemically synthesized
attgaacacatcctgtgtttca

SEQ ID NO: 1205124 - DNA, 22 bp, Artificial Sequence
  chemically synthesized
agcacagtgcctgaaacacagg

SEQ ID NO: 1205125 - DNA, 22 bp, Artificial Sequence
  chemically synthesized
tattgaacacatcctgtgtttc

SEQ ID NO: 1205126 - DNA, 22 bp, Artificial Sequence
  chemically synthesized
gcacagtgcctgaaacacagga

SEQ ID NO: 1205127 - DNA, 22 bp, Artificial Sequence
  chemically synthesized
aaacacaggatgtgttcaataa

SEQ ID NO: 1205128 - DNA, 22 bp, Artificial Sequence
  chemically synthesized
caggtgaaaataatagccaccc

SEQ ID NO: 1205129 - DNA, 22 bp, Artificial Sequence
  chemically synthesized
ctccaggtgaaaataatagcca

SEQ ID NO: 1205130 - DNA, 22 bp, Artificial Sequence
  chemically synthesized
gctccaggtgaaaataatagcc

SEQ ID NO: 1205131 - DNA, 22 bp, Artificial Sequence
  chemically synthesized
tgctccaggtgaaaataatagc

SEQ ID NO: 1205132 - DNA, 22 bp, Artificial Sequence
  chemically synthesized
aataaagggtggctattatttt

SEQ ID NO: 1205133 - DNA, 22 bp, Artificial Sequence
  chemically synthesized
tggtcgttttgctccaggtgaa

SEQ ID NO: 1205134 - DNA, 22 bp, Artificial Sequence
  chemically synthesized
gtggtcgttttgctccaggtga

SEQ ID NO: 1205135 - DNA, 22 bp, Artificial Sequence
  chemically synthesized
tttgtggtcgttttgctccagg

SEQ ID NO: 1205136 - DNA, 22 bp, Artificial Sequence
  chemically synthesized
ttattttcacctggagcaaaac

SEQ ID NO: 1205137 - DNA, 22 bp, Artificial Sequence
  chemically synthesized
ttttcacctggagcaaaacgac

SEQ ID NO: 1205138 - DNA, 22 bp, Artificial Sequence
  chemically synthesized
tcacctggagcaaaacgaccac

SEQ ID NO: 1205139 - DNA, 22 bp, Artificial Sequence
  chemically synthesized
cacctggagcaaaacgaccaca

SEQ ID NO: 1205140 - DNA, 22 bp, Artificial Sequence
  chemically synthesized
acctggagcaaaacgaccacaa

SEQ ID NO: 1205141 - DNA, 22 bp, Artificial Sequence
  chemically synthesized
gagcaaaacgaccacaaatagg

SEQ ID NO: 1205142 - DNA, 22 bp, Artificial Sequence
  chemically synthesized
cggagcacatggcccctatttg

SEQ ID NO: 1205143 - DNA, 22 bp, Artificial Sequence
  chemically synthesized
ggagacaggcaggggatgctgc

SEQ ID NO: 1205144 - DNA, 22 bp, Artificial Sequence
  chemically synthesized
gggagacaggcaggggatgctg

SEQ ID NO: 1205145 - DNA, 22 bp, Artificial Sequence
  chemically synthesized
tgggagacaggcaggggatgct

SEQ ID NO: 1205146 - DNA, 22 bp, Artificial Sequence
  chemically synthesized
gctttgggagacaggcagggga

SEQ ID NO: 1205147 - DNA, 22 bp, Artificial Sequence
  chemically synthesized
tggctttgggagacaggcaggg

SEQ ID NO: 1205148 - DNA, 22 bp, Artificial Sequence
  chemically synthesized
cgcagcatcccctgcctgtctc

SEQ ID NO: 1205149 - DNA, 22 bp, Artificial Sequence
  chemically synthesized
ttctggctttgggagacaggca

SEQ ID NO: 1205150 - DNA, 22 bp, Artificial Sequence
  chemically synthesized
attgttctggctttgggagaca

SEQ ID NO: 1205151 - DNA, 22 bp, Artificial Sequence
  chemically synthesized
gtctcattgttctggctttggg

SEQ ID NO: 1205152 - DNA, 22 bp, Artificial Sequence
  chemically synthesized
ggtctcattgttctggctttgg

SEQ ID NO: 1205153 - DNA, 22 bp, Artificial Sequence
  chemically synthesized
tttggtctcattgttctggctt

SEQ ID NO: 1205154 - DNA, 22 bp, Artificial Sequence
  chemically synthesized
cctgtctcccaaagccagaaca

SEQ ID NO: 1205155 - DNA, 22 bp, Artificial Sequence
  chemically synthesized
tctcccaaagccagaacaatga

SEQ ID NO: 1205156 - DNA, 22 bp, Artificial Sequence
  chemically synthesized
ccaaagccagaacaatgagacc

SEQ ID NO: 1205157 - DNA, 22 bp, Artificial Sequence
  chemically synthesized
tggacgcctatttggtctcatt

SEQ ID NO: 1205158 - DNA, 22 bp, Artificial Sequence
  chemically synthesized
gtggacgcctatttggtctcat

SEQ ID NO: 1205159 - DNA, 22 bp, Artificial Sequence
  chemically synthesized
tttgtggacgcctatttggtct

SEQ ID NO: 1205160 - DNA, 22 bp, Artificial Sequence
  chemically synthesized
gtttgtggacgcctatttggtc

SEQ ID NO: 1205161 - DNA, 22 bp, Artificial Sequence
  chemically synthesized
tgtttgtggacgcctatttggt

SEQ ID NO: 1205162 - DNA, 22 bp, Artificial Sequence
  chemically synthesized
ttttgtttgtggacgcctattt

SEQ ID NO: 1205163 - DNA, 22 bp, Artificial Sequence
  chemically synthesized
catgtctgttttgtttgtggac

SEQ ID NO: 1205164 - DNA, 22 bp, Artificial Sequence
  chemically synthesized
acatgtctgttttgtttgtgga

SEQ ID NO: 1205165 - DNA, 22 bp, Artificial Sequence
  chemically synthesized
tacatgtctgttttgtttgtgg

SEQ ID NO: 1205166 - DNA, 22 bp, Artificial Sequence
  chemically synthesized
attttacatgtctgttttgttt

SEQ ID NO: 1205167 - DNA, 22 bp, Artificial Sequence
  chemically synthesized
cattttacatgtctgttttgtt

SEQ ID NO: 1205168 - DNA, 22 bp, Artificial Sequence
  chemically synthesized
tcattttacatgtctgttttgt

SEQ ID NO: 1205169 - DNA, 22 bp, Artificial Sequence
  chemically synthesized
ttcattttacatgtctgttttg

SEQ ID NO: 1205170 - DNA, 22 bp, Artificial Sequence
  chemically synthesized
tttcattttacatgtctgtttt

SEQ ID NO: 1205171 - DNA, 22 bp, Artificial Sequence
  chemically synthesized
ttttcattttacatgtctgttt

SEQ ID NO: 1205172 - DNA, 22 bp, Artificial Sequence
  chemically synthesized
tttttttcattttacatgtctg

SEQ ID NO: 1205173 - DNA, 22 bp, Artificial Sequence
  chemically synthesized
atttttttcattttacatgtct

SEQ ID NO: 1205174 - DNA, 22 bp, Artificial Sequence
  chemically synthesized
tatttttttcattttacatgtc

SEQ ID NO: 1205175 - DNA, 22 bp, Artificial Sequence
  chemically synthesized
ttatttttttcattttacatgt

SEQ ID NO: 1205176 - DNA, 22 bp, Artificial Sequence
  chemically synthesized
tttatttttttcattttacatg

SEQ ID NO: 1205177 - DNA, 22 bp, Artificial Sequence
  chemically synthesized
ttttatttttttcattttacat

SEQ ID NO: 1205178 - DNA, 22 bp, Artificial Sequence
  chemically synthesized
tcttttttatttttttcatttt

SEQ ID NO: 1205179 - DNA, 22 bp, Artificial Sequence
  chemically synthesized
atcttttttatttttttcattt

SEQ ID NO: 1205180 - DNA, 22 bp, Artificial Sequence
  chemically synthesized
tatcttttttatttttttcatt

SEQ ID NO: 1205181 - DNA, 22 bp, Artificial Sequence
  chemically synthesized
ttttacttcatctgtatgtttt

SEQ ID NO: 1205182 - DNA, 22 bp, Artificial Sequence
  chemically synthesized
ttacttcatctgtatgtttttc

SEQ ID NO: 1205183 - DNA, 22 bp, Artificial Sequence
  chemically synthesized
tacttcatctgtatgtttttcc

SEQ ID NO: 1205184 - DNA, 22 bp, Artificial Sequence
  chemically synthesized
acttcatctgtatgtttttcct

SEQ ID NO: 1205185 - DNA, 22 bp, Artificial Sequence
  chemically synthesized
cttcatctgtatgtttttccta

SEQ ID NO: 1205186 - DNA, 22 bp, Artificial Sequence
  chemically synthesized
catctgtatgtttttcctatgc

SEQ ID NO: 1205187 - DNA, 22 bp, Artificial Sequence
  chemically synthesized
atctgtatgtttttcctatgcc

SEQ ID NO: 1205188 - DNA, 22 bp, Artificial Sequence
  chemically synthesized
tatgtttttcctatgcccatcc

SEQ ID NO: 1205189 - DNA, 22 bp, Artificial Sequence
  chemically synthesized
gaaatagagaagagggatgggc

SEQ ID NO: 1205190 - DNA, 22 bp, Artificial Sequence
  chemically synthesized
cgaaatagagaagagggatggg

SEQ ID NO: 1205191 - DNA, 22 bp, Artificial Sequence
  chemically synthesized
ttcctatgcccatccctcttct

SEQ ID NO: 1205192 - DNA, 22 bp, Artificial Sequence
  chemically synthesized
tcctatgcccatccctcttctc

SEQ ID NO: 1205193 - DNA, 22 bp, Artificial Sequence
  chemically synthesized
cctatgcccatccctcttctct

SEQ ID NO: 1205194 - DNA, 22 bp, Artificial Sequence
  chemically synthesized
ctatgcccatccctcttctcta

SEQ ID NO: 1205195 - DNA, 22 bp, Artificial Sequence
  chemically synthesized
tgcccatccctcttctctattt

SEQ ID NO: 1205196 - DNA, 22 bp, Artificial Sequence
  chemically synthesized
ttctctatttcgaaacatgctc

SEQ ID NO: 1205197 - DNA, 22 bp, Artificial Sequence
  chemically synthesized
caaaacaatgtgagagcatgtt

SEQ ID NO: 1205198 - DNA, 22 bp, Artificial Sequence
  chemically synthesized
ctctatttcgaaacatgctctc

SEQ ID NO: 1205199 - DNA, 22 bp, Artificial Sequence
  chemically synthesized
tctatttcgaaacatgctctca

SEQ ID NO: 1205200 - DNA, 22 bp, Artificial Sequence
  chemically synthesized
tatttcgaaacatgctctcaca

SEQ ID NO: 1205201 - DNA, 22 bp, Artificial Sequence
  chemically synthesized
tttcgaaacatgctctcacatt

SEQ ID NO: 1205202 - DNA, 22 bp, Artificial Sequence
  chemically synthesized
ccagttgcaaaacaatgtgaga

SEQ ID NO: 1205203 - DNA, 22 bp, Artificial Sequence
  chemically synthesized
cgaaacatgctctcacattgtt

SEQ ID NO: 1205204 - DNA, 22 bp, Artificial Sequence
  chemically synthesized
gaaacatgctctcacattgttt

SEQ ID NO: 1205205 - DNA, 22 bp, Artificial Sequence
  chemically synthesized
tcacattgttttgcaactggga

SEQ ID NO: 1205206 - DNA, 22 bp, Artificial Sequence
  chemically synthesized
acattgttttgcaactgggaat

SEQ ID NO: 1205207 - DNA, 22 bp, Artificial Sequence
  chemically synthesized
gataagataaaatgagtattcc

SEQ ID NO: 1205208 - DNA, 22 bp, Artificial Sequence
  chemically synthesized
ttttgcaactgggaatactcat

SEQ ID NO: 1205209 - DNA, 22 bp, Artificial Sequence
  chemically synthesized
tgcaactgggaatactcatttt

SEQ ID NO: 1205210 - DNA, 22 bp, Artificial Sequence
  chemically synthesized
gcaactgggaatactcatttta

SEQ ID NO: 1205211 - DNA, 22 bp, Artificial Sequence
  chemically synthesized
caactgggaatactcattttat

SEQ ID NO: 1205212 - DNA, 22 bp, Artificial Sequence
  chemically synthesized
gaattggataagataaaatgag

SEQ ID NO: 1205213 - DNA, 22 bp, Artificial Sequence
  chemically synthesized
ggaatactcattttatcttatc

SEQ ID NO: 1205214 - DNA, 22 bp, Artificial Sequence
  chemically synthesized
aagatagttagaattggataag

SEQ ID NO: 1205215 - DNA, 22 bp, Artificial Sequence
  chemically synthesized
aaagatagttagaattggataa

SEQ ID NO: 1205216 - DNA, 22 bp, Artificial Sequence
  chemically synthesized
attttatcttatccaattctaa

SEQ ID NO: 1205217 - DNA, 22 bp, Artificial Sequence
  chemically synthesized
aaacttaaagatagttagaatt

SEQ ID NO: 1205218 - DNA, 22 bp, Artificial Sequence
  chemically synthesized
tatcttatccaattctaactat

SEQ ID NO: 1205219 - DNA, 22 bp, Artificial Sequence
  chemically synthesized
atcttatccaattctaactatc

SEQ ID NO: 1205220 - DNA, 22 bp, Artificial Sequence
  chemically synthesized
tcttatccaattctaactatct

SEQ ID NO: 1205221 - DNA, 22 bp, Artificial Sequence
  chemically synthesized
agctgaaacttaaagatagtta

SEQ ID NO: 1205222 - DNA, 22 bp, Artificial Sequence
  chemically synthesized
atccaattctaactatctttaa

SEQ ID NO: 1205223 - DNA, 22 bp, Artificial Sequence
  chemically synthesized
tccaattctaactatctttaag

SEQ ID NO: 1205224 - DNA, 22 bp, Artificial Sequence
  chemically synthesized
taactatctttaagtttcagct

SEQ ID NO: 1205225 - DNA, 22 bp, Artificial Sequence
  chemically synthesized
actatctttaagtttcagctca

SEQ ID NO: 1205226 - DNA, 22 bp, Artificial Sequence
  chemically synthesized
tctttaagtttcagctcaactt

SEQ ID NO: 1205227 - DNA, 22 bp, Artificial Sequence
  chemically synthesized
taagtttcagctcaacttctac

SEQ ID NO: 1205228 - DNA, 22 bp, Artificial Sequence
  chemically synthesized
aagtttcagctcaacttctact

SEQ ID NO: 1205229 - DNA, 22 bp, Artificial Sequence
  chemically synthesized
agtttcagctcaacttctactt

SEQ ID NO: 1205230 - DNA, 22 bp, Artificial Sequence
  chemically synthesized
cagctcaacttctacttctgga

SEQ ID NO: 1205231 - DNA, 22 bp, Artificial Sequence
  chemically synthesized
agctcaacttctacttctggat

SEQ ID NO: 1205232 - DNA, 22 bp, Artificial Sequence
  chemically synthesized
aacttctacttctggatgtttc

SEQ ID NO: 1205233 - DNA, 22 bp, Artificial Sequence
  chemically synthesized
tgatggaaaataggaaacatcc

SEQ ID NO: 1205234 - DNA, 22 bp, Artificial Sequence
  chemically synthesized
ctacttctggatgtttcctatt

SEQ ID NO: 1205235 - DNA, 22 bp, Artificial Sequence
  chemically synthesized
tacttctggatgtttcctattt

SEQ ID NO: 1205236 - DNA, 22 bp, Artificial Sequence
  chemically synthesized
cttctggatgtttcctattttc

SEQ ID NO: 1205237 - DNA, 22 bp, Artificial Sequence
  chemically synthesized
ctggatgtttcctattttccat

SEQ ID NO: 1205238 - DNA, 22 bp, Artificial Sequence
  chemically synthesized
tggatgtttcctattttccatc

SEQ ID NO: 1205239 - DNA, 22 bp, Artificial Sequence
  chemically synthesized
gatgtttcctattttccatcac

SEQ ID NO: 1205240 - DNA, 22 bp, Artificial Sequence
  chemically synthesized
cctattttccatcacagccctt

SEQ ID NO: 1205241 - DNA, 22 bp, Artificial Sequence
  chemically synthesized
ctattttccatcacagcccttg

SEQ ID NO: 1205242 - DNA, 22 bp, Artificial Sequence
  chemically synthesized
ttttccatcacagcccttgttg

SEQ ID NO: 1205243 - DNA, 22 bp, Artificial Sequence
  chemically synthesized
tccatcacagcccttgttgatt

SEQ ID NO: 1205244 - DNA, 22 bp, Artificial Sequence
  chemically synthesized
ccatcacagcccttgttgattt

SEQ ID NO: 1205245 - DNA, 22 bp, Artificial Sequence
  chemically synthesized
catcacagcccttgttgatttc

SEQ ID NO: 1205246 - DNA, 22 bp, Artificial Sequence
  chemically synthesized
tagaaatatatgagagaaatca

SEQ ID NO: 1205247 - DNA, 22 bp, Artificial Sequence
  chemically synthesized
gttgatttctctcatatatttc

SEQ ID NO: 1205248 - DNA, 22 bp, Artificial Sequence
  chemically synthesized
ttgatttctctcatatatttct

SEQ ID NO: 1205249 - DNA, 22 bp, Artificial Sequence
  chemically synthesized
atttctctcatatatttctaca

SEQ ID NO: 1205250 - DNA, 22 bp, Artificial Sequence
  chemically synthesized
tagtgtatgaatgctgtagaaa

SEQ ID NO: 1205251 - DNA, 22 bp, Artificial Sequence
  chemically synthesized
atagtgtatgaatgctgtagaa

SEQ ID NO: 1205252 - DNA, 22 bp, Artificial Sequence
  chemically synthesized
ctctcatatatttctacagcat

SEQ ID NO: 1205253 - DNA, 22 bp, Artificial Sequence
  chemically synthesized
tatagtgtatgaatgctgtaga

SEQ ID NO: 1205254 - DNA, 22 bp, Artificial Sequence
  chemically synthesized
tctcatatatttctacagcatt

SEQ ID NO: 1205255 - DNA, 22 bp, Artificial Sequence
  chemically synthesized
tcatatatttctacagcattca

SEQ ID NO: 1205256 - DNA, 22 bp, Artificial Sequence
  chemically synthesized
actttatagtgtatgaatgctg

SEQ ID NO: 1205257 - DNA, 22 bp, Artificial Sequence
  chemically synthesized
atatatttctacagcattcata

SEQ ID NO: 1205258 - DNA, 22 bp, Artificial Sequence
  chemically synthesized
cactttatagtgtatgaatgct

SEQ ID NO: 1205259 - DNA, 22 bp, Artificial Sequence
  chemically synthesized
ctacagcattcatacactataa

SEQ ID NO: 1205260 - DNA, 22 bp, Artificial Sequence
  chemically synthesized
tacagcattcatacactataaa

SEQ ID NO: 1205261 - DNA, 22 bp, Artificial Sequence
  chemically synthesized
cagcattcatacactataaagt

SEQ ID NO: 1205262 - DNA, 22 bp, Artificial Sequence
  chemically synthesized
tgaagtagtaaatttcacttta

SEQ ID NO: 1205263 - DNA, 22 bp, Artificial Sequence
  chemically synthesized
gtgaagtagtaaatttcacttt

SEQ ID NO: 1205264 - DNA, 22 bp, Artificial Sequence
  chemically synthesized
atacactataaagtgaaattta

SEQ ID NO: 1205265 - DNA, 22 bp, Artificial Sequence
  chemically synthesized
tttgtgaagtagtaaatttcac

SEQ ID NO: 1205266 - DNA, 22 bp, Artificial Sequence
  chemically synthesized
taaagtgaaatttactacttca

SEQ ID NO: 1205267 - DNA, 22 bp, Artificial Sequence
  chemically synthesized
aagtaaaattatttgtgaagta

SEQ ID NO: 1205268 - DNA, 22 bp, Artificial Sequence
  chemically synthesized
actacttcacaaataattttac

SEQ ID NO: 1205269 - DNA, 22 bp, Artificial Sequence
  chemically synthesized
aataggtctgaagtaaaattat

SEQ ID NO: 1205270 - DNA, 22 bp, Artificial Sequence
  chemically synthesized
ctacttcacaaataattttact

SEQ ID NO: 1205271 - DNA, 22 bp, Artificial Sequence
  chemically synthesized
cttcacaaataattttacttca

SEQ ID NO: 1205272 - DNA, 22 bp, Artificial Sequence
  chemically synthesized
cacaaataattttacttcagac

SEQ ID NO: 1205273 - DNA, 22 bp, Artificial Sequence
  chemically synthesized
acaaataattttacttcagacc

SEQ ID NO: 1205274 - DNA, 22 bp, Artificial Sequence
  chemically synthesized
accaaaatagttcaataggtct

SEQ ID NO: 1205275 - DNA, 22 bp, Artificial Sequence
  chemically synthesized
tacttcagacctattgaactat

SEQ ID NO: 1205276 - DNA, 22 bp, Artificial Sequence
  chemically synthesized
acttcagacctattgaactatt

SEQ ID NO: 1205277 - DNA, 22 bp, Artificial Sequence
  chemically synthesized
cttcagacctattgaactattt

SEQ ID NO: 1205278 - DNA, 22 bp, Artificial Sequence
  chemically synthesized
cagacctattgaactattttgg

SEQ ID NO: 1205279 - DNA, 22 bp, Artificial Sequence
  chemically synthesized
agacctattgaactattttggt

SEQ ID NO: 1205280 - DNA, 22 bp, Artificial Sequence
  chemically synthesized
agagtcaggactgaccaaaata

SEQ ID NO: 1205281 - DNA, 22 bp, Artificial Sequence
  chemically synthesized
gagagtcaggactgaccaaaat

SEQ ID NO: 1205282 - DNA, 22 bp, Artificial Sequence
  chemically synthesized
ttgaactattttggtcagtcct

SEQ ID NO: 1205283 - DNA, 22 bp, Artificial Sequence
  chemically synthesized
aactattttggtcagtcctgac

SEQ ID NO: 1205284 - DNA, 22 bp, Artificial Sequence
  chemically synthesized
agtgtaacttgagagtcaggac

SEQ ID NO: 1205285 - DNA, 22 bp, Artificial Sequence
  chemically synthesized
cagtgtaacttgagagtcagga

SEQ ID NO: 1205286 - DNA, 22 bp, Artificial Sequence
  chemically synthesized
tcagtgtaacttgagagtcagg

SEQ ID NO: 1205287 - DNA, 22 bp, Artificial Sequence
  chemically synthesized
ttttggtcagtcctgactctca

SEQ ID NO: 1205288 - DNA, 22 bp, Artificial Sequence
  chemically synthesized
tggtcagtcctgactctcaagt

SEQ ID NO: 1205289 - DNA, 22 bp, Artificial Sequence
  chemically synthesized
ggtcagtcctgactctcaagtt

SEQ ID NO: 1205290 - DNA, 22 bp, Artificial Sequence
  chemically synthesized
gtcagtcctgactctcaagtta

SEQ ID NO: 1205291 - DNA, 22 bp, Artificial Sequence
  chemically synthesized
gcaactttcagtgtaacttgag

SEQ ID NO: 1205292 - DNA, 22 bp, Artificial Sequence
  chemically synthesized
tagcaactttcagtgtaacttg

SEQ ID NO: 1205293 - DNA, 22 bp, Artificial Sequence
  chemically synthesized
ctagcaactttcagtgtaactt

SEQ ID NO: 1205294 - DNA, 22 bp, Artificial Sequence
  chemically synthesized
cttctagcaactttcagtgtaa

SEQ ID NO: 1205295 - DNA, 22 bp, Artificial Sequence
  chemically synthesized
ccttctagcaactttcagtgta

SEQ ID NO: 1205296 - DNA, 22 bp, Artificial Sequence
  chemically synthesized
tccttctagcaactttcagtgt

SEQ ID NO: 1205297 - DNA, 22 bp, Artificial Sequence
  chemically synthesized
actctcaagttacactgaaagt

SEQ ID NO: 1205298 - DNA, 22 bp, Artificial Sequence
  chemically synthesized
tcaagttacactgaaagttgct

SEQ ID NO: 1205299 - DNA, 22 bp, Artificial Sequence
  chemically synthesized
aagttacactgaaagttgctag

SEQ ID NO: 1205300 - DNA, 22 bp, Artificial Sequence
  chemically synthesized
gaaatgatcctttccttctagc

SEQ ID NO: 1205301 - DNA, 22 bp, Artificial Sequence
  chemically synthesized
cactgaaagttgctagaaggaa

SEQ ID NO: 1205302 - DNA, 22 bp, Artificial Sequence
  chemically synthesized
aaagttgctagaaggaaaggat

SEQ ID NO: 1205303 - DNA, 22 bp, Artificial Sequence
  chemically synthesized
ctagaaggaaaggatcatttct

SEQ ID NO: 1205304 - DNA, 22 bp, Artificial Sequence
  chemically synthesized
gaaggaaaggatcatttctaat

SEQ ID NO: 1205305 - DNA, 22 bp, Artificial Sequence
  chemically synthesized
tgccagaggaccccagagaaaa

SEQ ID NO: 1205306 - DNA, 22 bp, Artificial Sequence
  chemically synthesized
gtattgtgccagaggaccccag

SEQ ID NO: 1205307 - DNA, 22 bp, Artificial Sequence
  chemically synthesized
ctaatttttctctggggtcctc

SEQ ID NO: 1205308 - DNA, 22 bp, Artificial Sequence
  chemically synthesized
agtattgtgccagaggacccca

SEQ ID NO: 1205309 - DNA, 22 bp, Artificial Sequence
  chemically synthesized
taatttttctctggggtcctct

SEQ ID NO: 1205310 - DNA, 22 bp, Artificial Sequence
  chemically synthesized
atttttctctggggtcctctgg

SEQ ID NO: 1205311 - DNA, 22 bp, Artificial Sequence
  chemically synthesized
ttctctggggtcctctggcaca

SEQ ID NO: 1205312 - DNA, 22 bp, Artificial Sequence
  chemically synthesized
tctctggggtcctctggcacaa

SEQ ID NO: 1205313 - DNA, 22 bp, Artificial Sequence
  chemically synthesized
ataagtttagtattgtgccaga

SEQ ID NO: 1205314 - DNA, 22 bp, Artificial Sequence
  chemically synthesized
ctctggggtcctctggcacaat

SEQ ID NO: 1205315 - DNA, 22 bp, Artificial Sequence
  chemically synthesized
tctggggtcctctggcacaata

SEQ ID NO: 1205316 - DNA, 22 bp, Artificial Sequence
  chemically synthesized
tggggtcctctggcacaatact

SEQ ID NO: 1205317 - DNA, 22 bp, Artificial Sequence
  chemically synthesized
gggtcctctggcacaatactaa

SEQ ID NO: 1205318 - DNA, 22 bp, Artificial Sequence
  chemically synthesized
agtgcctgataagtttagtatt

SEQ ID NO: 1205319 - DNA, 22 bp, Artificial Sequence
  chemically synthesized
tggcacaatactaaacttatca

SEQ ID NO: 1205320 - DNA, 22 bp, Artificial Sequence
  chemically synthesized
agcattcagtgcctgataagtt

SEQ ID NO: 1205321 - DNA, 22 bp, Artificial Sequence
  chemically synthesized
gcacaatactaaacttatcagg

SEQ ID NO: 1205322 - DNA, 22 bp, Artificial Sequence
  chemically synthesized
caggattaagcattcagtgcct

SEQ ID NO: 1205323 - DNA, 22 bp, Artificial Sequence
  chemically synthesized
aacttatcaggcactgaatgct

SEQ ID NO: 1205324 - DNA, 22 bp, Artificial Sequence
  chemically synthesized
tctacaggattaagcattcagt

SEQ ID NO: 1205325 - DNA, 22 bp, Artificial Sequence
  chemically synthesized
gtctacaggattaagcattcag

SEQ ID NO: 1205326 - DNA, 22 bp, Artificial Sequence
  chemically synthesized
tgtctacaggattaagcattca

SEQ ID NO: 1205327 - DNA, 22 bp, Artificial Sequence
  chemically synthesized
atcaggcactgaatgcttaatc

SEQ ID NO: 1205328 - DNA, 22 bp, Artificial Sequence
  chemically synthesized
tcaggcactgaatgcttaatcc

SEQ ID NO: 1205329 - DNA, 22 bp, Artificial Sequence
  chemically synthesized
cacattttgtctacaggattaa

SEQ ID NO: 1205330 - DNA, 22 bp, Artificial Sequence
  chemically synthesized
ccacattttgtctacaggatta

SEQ ID NO: 1205331 - DNA, 22 bp, Artificial Sequence
  chemically synthesized
cttccacattttgtctacagga

SEQ ID NO: 1205332 - DNA, 22 bp, Artificial Sequence
  chemically synthesized
aatgcttaatcctgtagacaaa

SEQ ID NO: 1205333 - DNA, 22 bp, Artificial Sequence
  chemically synthesized
ttacttccacattttgtctaca

SEQ ID NO: 1205334 - DNA, 22 bp, Artificial Sequence
  chemically synthesized
gttacttccacattttgtctac

SEQ ID NO: 1205335 - DNA, 22 bp, Artificial Sequence
  chemically synthesized
tgttacttccacattttgtcta

SEQ ID NO: 1205336 - DNA, 22 bp, Artificial Sequence
  chemically synthesized
tctttgttacttccacattttg

SEQ ID NO: 1205337 - DNA, 22 bp, Artificial Sequence
  chemically synthesized
aatcctgtagacaaaatgtgga

SEQ ID NO: 1205338 - DNA, 22 bp, Artificial Sequence
  chemically synthesized
atcctgtagacaaaatgtggaa

SEQ ID NO: 1205339 - DNA, 22 bp, Artificial Sequence
  chemically synthesized
agtcctgtctttgttacttcca

SEQ ID NO: 1205340 - DNA, 22 bp, Artificial Sequence
  chemically synthesized
tagacaaaatgtggaagtaaca

SEQ ID NO: 1205341 - DNA, 22 bp, Artificial Sequence
  chemically synthesized
gagtcctgtctttgttacttcc

SEQ ID NO: 1205342 - DNA, 22 bp, Artificial Sequence
  chemically synthesized
ttgagtcctgtctttgttactt

SEQ ID NO: 1205343 - DNA, 22 bp, Artificial Sequence
  chemically synthesized
cttgagtcctgtctttgttact

SEQ ID NO: 1205344 - DNA, 22 bp, Artificial Sequence
  chemically synthesized
tcttgagtcctgtctttgttac

SEQ ID NO: 1205345 - DNA, 22 bp, Artificial Sequence
  chemically synthesized
ttcttgagtcctgtctttgtta

SEQ ID NO: 1205346 - DNA, 22 bp, Artificial Sequence
  chemically synthesized
ggtttttcttgagtcctgtctt

SEQ ID NO: 1205347 - DNA, 22 bp, Artificial Sequence
  chemically synthesized
aagaaaaacctaatttactctt

SEQ ID NO: 1205348 - DNA, 22 bp, Artificial Sequence
  chemically synthesized
agggggaatgagaaagagaaga

SEQ ID NO: 1205349 - DNA, 22 bp, Artificial Sequence
  chemically synthesized
atttactcttctctttctcatt

SEQ ID NO: 1205350 - DNA, 22 bp, Artificial Sequence
  chemically synthesized
actcttctctttctcattcccc

SEQ ID NO: 1205351 - DNA, 22 bp, Artificial Sequence
  chemically synthesized
ctcttctctttctcattccccc

SEQ ID NO: 1205352 - DNA, 22 bp, Artificial Sequence
  chemically synthesized
ttctctttctcattccccctta

SEQ ID NO: 1205353 - DNA, 22 bp, Artificial Sequence
  chemically synthesized
ctctttctcattcccccttaga

SEQ ID NO: 1205354 - DNA, 22 bp, Artificial Sequence
  chemically synthesized
tctttctcattcccccttagat

SEQ ID NO: 1205355 - DNA, 22 bp, Artificial Sequence
  chemically synthesized
aatatagaaatgcatctaaggg

SEQ ID NO: 1205356 - DNA, 22 bp, Artificial Sequence
  chemically synthesized
tttctcattcccccttagatgc

SEQ ID NO: 1205357 - DNA, 22 bp, Artificial Sequence
  chemically synthesized
tctcattcccccttagatgcat

SEQ ID NO: 1205358 - DNA, 22 bp, Artificial Sequence
  chemically synthesized
ctcattcccccttagatgcatt

SEQ ID NO: 1205359 - DNA, 22 bp, Artificial Sequence
  chemically synthesized
tcattcccccttagatgcattt

SEQ ID NO: 1205360 - DNA, 22 bp, Artificial Sequence
  chemically synthesized
attcccccttagatgcatttct

SEQ ID NO: 1205361 - DNA, 22 bp, Artificial Sequence
  chemically synthesized
ccccttagatgcatttctatat

SEQ ID NO: 1205362 - DNA, 22 bp, Artificial Sequence
  chemically synthesized
agatgcatttctatattcaatg

SEQ ID NO: 1205363 - DNA, 22 bp, Artificial Sequence
  chemically synthesized
gatgcatttctatattcaatgt

SEQ ID NO: 1205364 - DNA, 22 bp, Artificial Sequence
  chemically synthesized
gaaatcagaatgaacattgaat

SEQ ID NO: 1205365 - DNA, 22 bp, Artificial Sequence
  chemically synthesized
cctggaaatcagaatgaacatt

SEQ ID NO: 1205366 - DNA, 22 bp, Artificial Sequence
  chemically synthesized
ctatattcaatgttcattctga

SEQ ID NO: 1205367 - DNA, 22 bp, Artificial Sequence
  chemically synthesized
tatattcaatgttcattctgat

SEQ ID NO: 1205368 - DNA, 22 bp, Artificial Sequence
  chemically synthesized
tattcaatgttcattctgattt

SEQ ID NO: 1205369 - DNA, 22 bp, Artificial Sequence
  chemically synthesized
aatgttcattctgatttccagg

SEQ ID NO: 1205370 - DNA, 22 bp, Artificial Sequence
  chemically synthesized
attctgatttccaggtagcact

SEQ ID NO: 1205371 - DNA, 22 bp, Artificial Sequence
  chemically synthesized
tgatttccaggtagcactttcc

SEQ ID NO: 1205372 - DNA, 22 bp, Artificial Sequence
  chemically synthesized
ggaaagaaagtggggaaagtgc

SEQ ID NO: 1205373 - DNA, 22 bp, Artificial Sequence
  chemically synthesized
atttccaggtagcactttcccc

SEQ ID NO: 1205374 - DNA, 22 bp, Artificial Sequence
  chemically synthesized
ccaggtagcactttccccactt

SEQ ID NO: 1205375 - DNA, 22 bp, Artificial Sequence
  chemically synthesized
agctaggaaagaaagtggggaa

SEQ ID NO: 1205376 - DNA, 22 bp, Artificial Sequence
  chemically synthesized
caggtagcactttccccacttt

SEQ ID NO: 1205377 - DNA, 22 bp, Artificial Sequence
  chemically synthesized
tccccactttctttcctagctt

SEQ ID NO: 1205378 - DNA, 22 bp, Artificial Sequence
  chemically synthesized
ccccactttctttcctagctta

SEQ ID NO: 1205379 - DNA, 22 bp, Artificial Sequence
  chemically synthesized
cccactttctttcctagcttaa

SEQ ID NO: 1205380 - DNA, 22 bp, Artificial Sequence
  chemically synthesized
agcagtgaaaggattaagctag

SEQ ID NO: 1205381 - DNA, 22 bp, Artificial Sequence
  chemically synthesized
ctgagcagtgaaaggattaagc

SEQ ID NO: 1205382 - DNA, 22 bp, Artificial Sequence
  chemically synthesized
tctttcctagcttaatcctttc

SEQ ID NO: 1205383 - DNA, 22 bp, Artificial Sequence
  chemically synthesized
ctttcctagcttaatcctttca

SEQ ID NO: 1205384 - DNA, 22 bp, Artificial Sequence
  chemically synthesized
tttcctagcttaatcctttcac

SEQ ID NO: 1205385 - DNA, 22 bp, Artificial Sequence
  chemically synthesized
tcctagcttaatcctttcactg

SEQ ID NO: 1205386 - DNA, 22 bp, Artificial Sequence
  chemically synthesized
cctagcttaatcctttcactgc

SEQ ID NO: 1205387 - DNA, 22 bp, Artificial Sequence
  chemically synthesized
ctagcttaatcctttcactgct

SEQ ID NO: 1205388 - DNA, 22 bp, Artificial Sequence
  chemically synthesized
gcttaatcctttcactgctcag

SEQ ID NO: 1205389 - DNA, 22 bp, Artificial Sequence
  chemically synthesized
aatcctttcactgctcagcaat

SEQ ID NO: 1205390 - DNA, 22 bp, Artificial Sequence
  chemically synthesized
atcctttcactgctcagcaata

SEQ ID NO: 1205391 - DNA, 22 bp, Artificial Sequence
  chemically synthesized
ccaggtgtgccgcatattgctg

SEQ ID NO: 1205392 - DNA, 22 bp, Artificial Sequence
  chemically synthesized
tcactgctcagcaatatgcggc

SEQ ID NO: 1205393 - DNA, 22 bp, Artificial Sequence
  chemically synthesized
cactgctcagcaatatgcggca

SEQ ID NO: 1205394 - DNA, 22 bp, Artificial Sequence
  chemically synthesized
actgctcagcaatatgcggcac

SEQ ID NO: 1205395 - DNA, 22 bp, Artificial Sequence
  chemically synthesized
ccatgttgccaggtgtgccgca

SEQ ID NO: 1205396 - DNA, 22 bp, Artificial Sequence
  chemically synthesized
ctcagcaatatgcggcacacct

SEQ ID NO: 1205397 - DNA, 22 bp, Artificial Sequence
  chemically synthesized
tcccatgttgccaggtgtgccg

SEQ ID NO: 1205398 - DNA, 22 bp, Artificial Sequence
  chemically synthesized
agcaatatgcggcacacctggc

SEQ ID NO: 1205399 - DNA, 22 bp, Artificial Sequence
  chemically synthesized
atctctcccatgttgccaggtg

SEQ ID NO: 1205400 - DNA, 22 bp, Artificial Sequence
  chemically synthesized
actcatctctcccatgttgcca

SEQ ID NO: 1205401 - DNA, 22 bp, Artificial Sequence
  chemically synthesized
cagtaactaactcatctctccc

SEQ ID NO: 1205402 - DNA, 22 bp, Artificial Sequence
  chemically synthesized
gcagtaactaactcatctctcc

SEQ ID NO: 1205403 - DNA, 22 bp, Artificial Sequence
  chemically synthesized
tgcagtaactaactcatctctc

SEQ ID NO: 1205404 - DNA, 22 bp, Artificial Sequence
  chemically synthesized
gcaacatgggagagatgagtta

SEQ ID NO: 1205405 - DNA, 22 bp, Artificial Sequence
  chemically synthesized
agagaacaagcaaacaattttg

SEQ ID NO: 1205406 - DNA, 22 bp, Artificial Sequence
  chemically synthesized
gttactgcaaaattgtttgctt

SEQ ID NO: 1205407 - DNA, 22 bp, Artificial Sequence
  chemically synthesized
ctgcaaaattgtttgcttgttc

SEQ ID NO: 1205408 - DNA, 22 bp, Artificial Sequence
  chemically synthesized
caaaattgtttgcttgttctct

SEQ ID NO: 1205409 - DNA, 22 bp, Artificial Sequence
  chemically synthesized
aggtaaggcattaagagaacaa

SEQ ID NO: 1205410 - DNA, 22 bp, Artificial Sequence
  chemically synthesized
tttgcttgttctcttaatgcct

SEQ ID NO: 1205411 - DNA, 22 bp, Artificial Sequence
  chemically synthesized
gcttgttctcttaatgccttac

SEQ ID NO: 1205412 - DNA, 22 bp, Artificial Sequence
  chemically synthesized
cttgttctcttaatgccttacc

SEQ ID NO: 1205413 - DNA, 22 bp, Artificial Sequence
  chemically synthesized
gttctcttaatgccttacctca

SEQ ID NO: 1205414 - DNA, 22 bp, Artificial Sequence
  chemically synthesized
ccatagagaaattgaggtaagg

SEQ ID NO: 1205415 - DNA, 22 bp, Artificial Sequence
  chemically synthesized
ttctcttaatgccttacctcaa

SEQ ID NO: 1205416 - DNA, 22 bp, Artificial Sequence
  chemically synthesized
ttgccatagagaaattgaggta

SEQ ID NO: 1205417 - DNA, 22 bp, Artificial Sequence
  chemically synthesized
tcttaatgccttacctcaattt

SEQ ID NO: 1205418 - DNA, 22 bp, Artificial Sequence
  chemically synthesized
attgccatagagaaattgaggt

SEQ ID NO: 1205419 - DNA, 22 bp, Artificial Sequence
  chemically synthesized
ttaatgccttacctcaatttct

SEQ ID NO: 1205420 - DNA, 22 bp, Artificial Sequence
  chemically synthesized
aatgccttacctcaatttctct

SEQ ID NO: 1205421 - DNA, 22 bp, Artificial Sequence
  chemically synthesized
atgccttacctcaatttctcta

SEQ ID NO: 1205422 - DNA, 22 bp, Artificial Sequence
  chemically synthesized
acctcaatttctctatggcaat

SEQ ID NO: 1205423 - DNA, 22 bp, Artificial Sequence
  chemically synthesized
cctcaatttctctatggcaata

SEQ ID NO: 1205424 - DNA, 22 bp, Artificial Sequence
  chemically synthesized
gatatgatagccttattgccat

SEQ ID NO: 1205425 - DNA, 22 bp, Artificial Sequence
  chemically synthesized
ggatatgatagccttattgcca

SEQ ID NO: 1205426 - DNA, 22 bp, Artificial Sequence
  chemically synthesized
aatttctctatggcaataaggc

SEQ ID NO: 1205427 - DNA, 22 bp, Artificial Sequence
  chemically synthesized
tttggatatgatagccttattg

SEQ ID NO: 1205428 - DNA, 22 bp, Artificial Sequence
  chemically synthesized
tgtttggatatgatagccttat

SEQ ID NO: 1205429 - DNA, 22 bp, Artificial Sequence
  chemically synthesized
ctgtttggatatgatagcctta

SEQ ID NO: 1205430 - DNA, 22 bp, Artificial Sequence
  chemically synthesized
ctctatggcaataaggctatca

SEQ ID NO: 1205431 - DNA, 22 bp, Artificial Sequence
  chemically synthesized
tctatggcaataaggctatcat

SEQ ID NO: 1205432 - DNA, 22 bp, Artificial Sequence
  chemically synthesized
ttctgtttggatatgatagcct

SEQ ID NO: 1205433 - DNA, 22 bp, Artificial Sequence
  chemically synthesized
tatggcaataaggctatcatat

SEQ ID NO: 1205434 - DNA, 22 bp, Artificial Sequence
  chemically synthesized
tggcaataaggctatcatatcc

SEQ ID NO: 1205435 - DNA, 22 bp, Artificial Sequence
  chemically synthesized
gttcttctgtttggatatgata

SEQ ID NO: 1205436 - DNA, 22 bp, Artificial Sequence
  chemically synthesized
agttcttctgtttggatatgat

SEQ ID NO: 1205437 - DNA, 22 bp, Artificial Sequence
  chemically synthesized
gcttagttcttctgtttggata

SEQ ID NO: 1205438 - DNA, 22 bp, Artificial Sequence
  chemically synthesized
agcttagttcttctgtttggat

SEQ ID NO: 1205439 - DNA, 22 bp, Artificial Sequence
  chemically synthesized
tcatatccaaacagaagaacta

SEQ ID NO: 1205440 - DNA, 22 bp, Artificial Sequence
  chemically synthesized
tgaaatgatgaatccatttagc

SEQ ID NO: 1205441 - DNA, 22 bp, Artificial Sequence
  chemically synthesized
gtgaaatgatgaatccatttag

SEQ ID NO: 1205442 - DNA, 22 bp, Artificial Sequence
  chemically synthesized
tgtgaaatgatgaatccattta

SEQ ID NO: 1205443 - DNA, 22 bp, Artificial Sequence
  chemically synthesized
agctaaatggattcatcatttc

SEQ ID NO: 1205444 - DNA, 22 bp, Artificial Sequence
  chemically synthesized
aagaatcactttgtgaaatgat

SEQ ID NO: 1205445 - DNA, 22 bp, Artificial Sequence
  chemically synthesized
aatggattcatcatttcacaaa

SEQ ID NO: 1205446 - DNA, 22 bp, Artificial Sequence
  chemically synthesized
ctaaagaatcactttgtgaaat

SEQ ID NO: 1205447 - DNA, 22 bp, Artificial Sequence
  chemically synthesized
atcatttcacaaagtgattctt

SEQ ID NO: 1205448 - DNA, 22 bp, Artificial Sequence
  chemically synthesized
cacaaagtgattctttagcaat

SEQ ID NO: 1205449 - DNA, 22 bp, Artificial Sequence
  chemically synthesized
acaaagtgattctttagcaatt

SEQ ID NO: 1205450 - DNA, 22 bp, Artificial Sequence
  chemically synthesized
tttagcaattttcttattattt

SEQ ID NO: 1205451 - DNA, 22 bp, Artificial Sequence
  chemically synthesized
tagcaattttcttattatttta

SEQ ID NO: 1205452 - DNA, 22 bp, Artificial Sequence
  chemically synthesized
agcaattttcttattattttat

SEQ ID NO: 1205453 - DNA, 22 bp, Artificial Sequence
  chemically synthesized
gcaattttcttattattttata

SEQ ID NO: 1205454 - DNA, 22 bp, Artificial Sequence
  chemically synthesized
tatatgaaaccaaaaatatata

SEQ ID NO: 1205455 - DNA, 22 bp, Artificial Sequence
  chemically synthesized
tcttattattttatatattttt

SEQ ID NO: 1205456 - DNA, 22 bp, Artificial Sequence
  chemically synthesized
cttattattttatatatttttg

SEQ ID NO: 1205457 - DNA, 22 bp, Artificial Sequence
  chemically synthesized
ttattattttatatatttttgg

SEQ ID NO: 1205458 - DNA, 22 bp, Artificial Sequence
  chemically synthesized
attattttatatatttttggtt

SEQ ID NO: 1205459 - DNA, 22 bp, Artificial Sequence
  chemically synthesized
ttattttatatatttttggttt

SEQ ID NO: 1205460 - DNA, 22 bp, Artificial Sequence
  chemically synthesized
ttttatatatttttggtttcat

SEQ ID NO: 1205461 - DNA, 22 bp, Artificial Sequence
  chemically synthesized
aggtagcattatatatgaaacc

SEQ ID NO: 1205462 - DNA, 22 bp, Artificial Sequence
  chemically synthesized
tatatatttttggtttcatata

SEQ ID NO: 1205463 - DNA, 22 bp, Artificial Sequence
  chemically synthesized
atatatttttggtttcatatat

SEQ ID NO: 1205464 - DNA, 22 bp, Artificial Sequence
  chemically synthesized
tgaggtagcattatatatgaaa

SEQ ID NO: 1205465 - DNA, 22 bp, Artificial Sequence
  chemically synthesized
tatatttttggtttcatatata

SEQ ID NO: 1205466 - DNA, 22 bp, Artificial Sequence
  chemically synthesized
ctgaggtagcattatatatgaa

SEQ ID NO: 1205467 - DNA, 22 bp, Artificial Sequence
  chemically synthesized
aatttctgaggtagcattatat

SEQ ID NO: 1205468 - DNA, 22 bp, Artificial Sequence
  chemically synthesized
ttggtttcatatataatgctac

SEQ ID NO: 1205469 - DNA, 22 bp, Artificial Sequence
  chemically synthesized
tggtttcatatataatgctacc

SEQ ID NO: 1205470 - DNA, 22 bp, Artificial Sequence
  chemically synthesized
ggtttcatatataatgctacct

SEQ ID NO: 1205471 - DNA, 22 bp, Artificial Sequence
  chemically synthesized
gtttcatatataatgctacctc

SEQ ID NO: 1205472 - DNA, 22 bp, Artificial Sequence
  chemically synthesized
catatctgaatttctgaggtag

SEQ ID NO: 1205473 - DNA, 22 bp, Artificial Sequence
  chemically synthesized
catatataatgctacctcagaa

SEQ ID NO: 1205474 - DNA, 22 bp, Artificial Sequence
  chemically synthesized
gcatatctgaatttctgaggta

SEQ ID NO: 1205475 - DNA, 22 bp, Artificial Sequence
  chemically synthesized
atatataatgctacctcagaaa

SEQ ID NO: 1205476 - DNA, 22 bp, Artificial Sequence
  chemically synthesized
tgcatatctgaatttctgaggt

SEQ ID NO: 1205477 - DNA, 22 bp, Artificial Sequence
  chemically synthesized
aactttgcatatctgaatttct

SEQ ID NO: 1205478 - DNA, 22 bp, Artificial Sequence
  chemically synthesized
aaactttgcatatctgaatttc

SEQ ID NO: 1205479 - DNA, 22 bp, Artificial Sequence
  chemically synthesized
taaactttgcatatctgaattt

SEQ ID NO: 1205480 - DNA, 22 bp, Artificial Sequence
  chemically synthesized
cctcagaaattcagatatgcaa

SEQ ID NO: 1205481 - DNA, 22 bp, Artificial Sequence
  chemically synthesized
agaaattcagatatgcaaagtt

SEQ ID NO: 1205482 - DNA, 22 bp, Artificial Sequence
  chemically synthesized
aaaaaggagttttaaactttgc

SEQ ID NO: 1205483 - DNA, 22 bp, Artificial Sequence
  chemically synthesized
aaaaaaggagttttaaactttg

SEQ ID NO: 1205484 - DNA, 22 bp, Artificial Sequence
  chemically synthesized
taaaaaaggagttttaaacttt

SEQ ID NO: 1205485 - DNA, 22 bp, Artificial Sequence
  chemically synthesized
agatatgcaaagtttaaaactc

SEQ ID NO: 1205486 - DNA, 22 bp, Artificial Sequence
  chemically synthesized
aaactttaaaaaaggagtttta

SEQ ID NO: 1205487 - DNA, 22 bp, Artificial Sequence
  chemically synthesized
tgaaactttaaaaaaggagttt

SEQ ID NO: 1205488 - DNA, 22 bp, Artificial Sequence
  chemically synthesized
tctgaaactttaaaaaaggagt

SEQ ID NO: 1205489 - DNA, 22 bp, Artificial Sequence
  chemically synthesized
tagctctctgaaactttaaaaa

SEQ ID NO: 1205490 - DNA, 22 bp, Artificial Sequence
  chemically synthesized
aaaactccttttttaaagtttc

SEQ ID NO: 1205491 - DNA, 22 bp, Artificial Sequence
  chemically synthesized
aaactccttttttaaagtttca

SEQ ID NO: 1205492 - DNA, 22 bp, Artificial Sequence
  chemically synthesized
tagttgtagctctctgaaactt

SEQ ID NO: 1205493 - DNA, 22 bp, Artificial Sequence
  chemically synthesized
cttttttaaagtttcagagagc

SEQ ID NO: 1205494 - DNA, 22 bp, Artificial Sequence
  chemically synthesized
gtctgtagttgtagctctctga

SEQ ID NO: 1205495 - DNA, 22 bp, Artificial Sequence
  chemically synthesized
ttttaaagtttcagagagctac

SEQ ID NO: 1205496 - DNA, 22 bp, Artificial Sequence
  chemically synthesized
tttaaagtttcagagagctaca

SEQ ID NO: 1205497 - DNA, 22 bp, Artificial Sequence
  chemically synthesized
ttaaagtttcagagagctacaa

SEQ ID NO: 1205498 - DNA, 22 bp, Artificial Sequence
  chemically synthesized
tctcgtctgtagttgtagctct

SEQ ID NO: 1205499 - DNA, 22 bp, Artificial Sequence
  chemically synthesized
taaagtttcagagagctacaac

SEQ ID NO: 1205500 - DNA, 22 bp, Artificial Sequence
  chemically synthesized
atctcgtctgtagttgtagctc

SEQ ID NO: 1205501 - DNA, 22 bp, Artificial Sequence
  chemically synthesized
aaagtttcagagagctacaact

SEQ ID NO: 1205502 - DNA, 22 bp, Artificial Sequence
  chemically synthesized
aagtttcagagagctacaacta

SEQ ID NO: 1205503 - DNA, 22 bp, Artificial Sequence
  chemically synthesized
aagcttatctcgtctgtagttg

SEQ ID NO: 1205504 - DNA, 22 bp, Artificial Sequence
  chemically synthesized
cagagagctacaactacagacg

SEQ ID NO: 1205505 - DNA, 22 bp, Artificial Sequence
  chemically synthesized
agagagctacaactacagacga

SEQ ID NO: 1205506 - DNA, 22 bp, Artificial Sequence
  chemically synthesized
atcaagctaaagcttatctcgt

SEQ ID NO: 1205507 - DNA, 22 bp, Artificial Sequence
  chemically synthesized
caactacagacgagataagctt

SEQ ID NO: 1205508 - DNA, 22 bp, Artificial Sequence
  chemically synthesized
cagacgagataagctttagctt

SEQ ID NO: 1205509 - DNA, 22 bp, Artificial Sequence
  chemically synthesized
tagcttgatgaatttcatactg

SEQ ID NO: 1205510 - DNA, 22 bp, Artificial Sequence
  chemically synthesized
agcttgatgaatttcatactga

SEQ ID NO: 1205511 - DNA, 22 bp, Artificial Sequence
  chemically synthesized
gcttgatgaatttcatactgac

SEQ ID NO: 1205512 - DNA, 22 bp, Artificial Sequence
  chemically synthesized
gatgaatttcatactgactact

SEQ ID NO: 1205513 - DNA, 22 bp, Artificial Sequence
  chemically synthesized
aacataagatccagtagtcagt

SEQ ID NO: 1205514 - DNA, 22 bp, Artificial Sequence
  chemically synthesized
atgaatttcatactgactactg

SEQ ID NO: 1205515 - DNA, 22 bp, Artificial Sequence
  chemically synthesized
aaacataagatccagtagtcag

SEQ ID NO: 1205516 - DNA, 22 bp, Artificial Sequence
  chemically synthesized
ccttaaacataagatccagtag

SEQ ID NO: 1205517 - DNA, 22 bp, Artificial Sequence
  chemically synthesized
catactgactactggatcttat

SEQ ID NO: 1205518 - DNA, 22 bp, Artificial Sequence
  chemically synthesized
atactgactactggatcttatg

SEQ ID NO: 1205519 - DNA, 22 bp, Artificial Sequence
  chemically synthesized
catctgccttaaacataagatc

SEQ ID NO: 1205520 - DNA, 22 bp, Artificial Sequence
  chemically synthesized
actactggatcttatgtttaag

SEQ ID NO: 1205521 - DNA, 22 bp, Artificial Sequence
  chemically synthesized
ctggatcttatgtttaaggcag

SEQ ID NO: 1205522 - DNA, 22 bp, Artificial Sequence
  chemically synthesized
gatcttatgtttaaggcagatg

SEQ ID NO: 1205523 - DNA, 22 bp, Artificial Sequence
  chemically synthesized
atgtttaaggcagatgcaggtt

SEQ ID NO: 1205524 - DNA, 22 bp, Artificial Sequence
  chemically synthesized
tgtttaaggcagatgcaggttt

SEQ ID NO: 1205525 - DNA, 22 bp, Artificial Sequence
  chemically synthesized
aaggcagatgcaggtttttctt

SEQ ID NO: 1205526 - DNA, 22 bp, Artificial Sequence
  chemically synthesized
aggcagatgcaggtttttcttg

SEQ ID NO: 1205527 - DNA, 22 bp, Artificial Sequence
  chemically synthesized
ccccgcccccccccccccccca

SEQ ID NO: 1205528 - DNA, 22 bp, Artificial Sequence
  chemically synthesized
cccccgcccccccccccccccc

SEQ ID NO: 1205529 - DNA, 22 bp, Artificial Sequence
  chemically synthesized
ggtcttcccccgcccccccccc

SEQ ID NO: 1205530 - DNA, 22 bp, Artificial Sequence
  chemically synthesized
ttcttggggggggggggggggc

SEQ ID NO: 1205531 - DNA, 22 bp, Artificial Sequence
  chemically synthesized
tcttggggggggggggggggcg

SEQ ID NO: 1205532 - DNA, 22 bp, Artificial Sequence
  chemically synthesized
cttggggggggggggggggcgg

SEQ ID NO: 1205533 - DNA, 22 bp, Artificial Sequence
  chemically synthesized
ttggggggggggggggggcggg

SEQ ID NO: 1205534 - DNA, 22 bp, Artificial Sequence
  chemically synthesized
cctgggtcttcccccgcccccc

SEQ ID NO: 1205535 - DNA, 22 bp, Artificial Sequence
  chemically synthesized
ggggggggggggggggcggggg

SEQ ID NO: 1205536 - DNA, 22 bp, Artificial Sequence
  chemically synthesized
gggggggggggggggcggggga

SEQ ID NO: 1205537 - DNA, 22 bp, Artificial Sequence
  chemically synthesized
aagaaatgtatcacatgggcct

SEQ ID NO: 1205538 - DNA, 22 bp, Artificial Sequence
  chemically synthesized
gaatcctgaagaaatgtatcac

SEQ ID NO: 1205539 - DNA, 22 bp, Artificial Sequence
  chemically synthesized
ttagaatcctgaagaaatgtat

SEQ ID NO: 1205540 - DNA, 22 bp, Artificial Sequence
  chemically synthesized
agtggaaaattgttagaatcct

SEQ ID NO: 1205541 - DNA, 22 bp, Artificial Sequence
  chemically synthesized
tgagtggaaaattgttagaatc

SEQ ID NO: 1205542 - DNA, 22 bp, Artificial Sequence
  chemically synthesized
ctgagtggaaaattgttagaat

SEQ ID NO: 1205543 - DNA, 22 bp, Artificial Sequence
  chemically synthesized
tctgagtggaaaattgttagaa

SEQ ID NO: 1205544 - DNA, 22 bp, Artificial Sequence
  chemically synthesized
ctttctgagtggaaaattgtta

SEQ ID NO: 1205545 - DNA, 22 bp, Artificial Sequence
  chemically synthesized
cttcaggattctaacaattttc

SEQ ID NO: 1205546 - DNA, 22 bp, Artificial Sequence
  chemically synthesized
ttcaggattctaacaattttcc

SEQ ID NO: 1205547 - DNA, 22 bp, Artificial Sequence
  chemically synthesized
caggattctaacaattttccac

SEQ ID NO: 1205548 - DNA, 22 bp, Artificial Sequence
  chemically synthesized
aggattctaacaattttccact

SEQ ID NO: 1205549 - DNA, 22 bp, Artificial Sequence
  chemically synthesized
agggactactttctgagtggaa

SEQ ID NO: 1205550 - DNA, 22 bp, Artificial Sequence
  chemically synthesized
ctgagggactactttctgagtg

SEQ ID NO: 1205551 - DNA, 22 bp, Artificial Sequence
  chemically synthesized
taacaattttccactcagaaag

SEQ ID NO: 1205552 - DNA, 22 bp, Artificial Sequence
  chemically synthesized
cctgagggactactttctgagt

SEQ ID NO: 1205553 - DNA, 22 bp, Artificial Sequence
  chemically synthesized
acaattttccactcagaaagta

SEQ ID NO: 1205554 - DNA, 22 bp, Artificial Sequence
  chemically synthesized
ataatttcctgagggactactt

SEQ ID NO: 1205555 - DNA, 22 bp, Artificial Sequence
  chemically synthesized
tccactcagaaagtagtccctc

SEQ ID NO: 1205556 - DNA, 22 bp, Artificial Sequence
  chemically synthesized
ccactcagaaagtagtccctca

SEQ ID NO: 1205557 - DNA, 22 bp, Artificial Sequence
  chemically synthesized
cactcagaaagtagtccctcag

SEQ ID NO: 1205558 - DNA, 22 bp, Artificial Sequence
  chemically synthesized
cagttaataatttcctgaggga

SEQ ID NO: 1205559 - DNA, 22 bp, Artificial Sequence
  chemically synthesized
acagttaataatttcctgaggg

SEQ ID NO: 1205560 - DNA, 22 bp, Artificial Sequence
  chemically synthesized
tacagttaataatttcctgagg

SEQ ID NO: 1205561 - DNA, 22 bp, Artificial Sequence
  chemically synthesized
agaaagtagtccctcaggaaat

SEQ ID NO: 1205562 - DNA, 22 bp, Artificial Sequence
  chemically synthesized
ttttacagttaataatttcctg

SEQ ID NO: 1205563 - DNA, 22 bp, Artificial Sequence
  chemically synthesized
attttacagttaataatttcct

SEQ ID NO: 1205564 - DNA, 22 bp, Artificial Sequence
  chemically synthesized
tcttattttacagttaataatt

SEQ ID NO: 1205565 - DNA, 22 bp, Artificial Sequence
  chemically synthesized
tatcttattttacagttaataa

SEQ ID NO: 1205566 - DNA, 22 bp, Artificial Sequence
  chemically synthesized
tcctctatcttattttacagtt

SEQ ID NO: 1205567 - DNA, 22 bp, Artificial Sequence
  chemically synthesized
aggaaattattaactgtaaaat

SEQ ID NO: 1205568 - DNA, 22 bp, Artificial Sequence
  chemically synthesized
atcctctatcttattttacagt

SEQ ID NO: 1205569 - DNA, 22 bp, Artificial Sequence
  chemically synthesized
tatcctctatcttattttacag

SEQ ID NO: 1205570 - DNA, 22 bp, Artificial Sequence
  chemically synthesized
ttatcctctatcttattttaca

SEQ ID NO: 1205571 - DNA, 22 bp, Artificial Sequence
  chemically synthesized
tttatcctctatcttattttac

SEQ ID NO: 1205572 - DNA, 22 bp, Artificial Sequence
  chemically synthesized
ttttatcctctatcttatttta

SEQ ID NO: 1205573 - DNA, 22 bp, Artificial Sequence
  chemically synthesized
tttttatcctctatcttatttt

SEQ ID NO: 1205574 - DNA, 22 bp, Artificial Sequence
  chemically synthesized
tttttttatcctctatcttatt

SEQ ID NO: 1205575 - DNA, 22 bp, Artificial Sequence
  chemically synthesized
ttaactgtaaaataagatagag

SEQ ID NO: 1205576 - DNA, 22 bp, Artificial Sequence
  chemically synthesized
actgtaaaataagatagaggat

SEQ ID NO: 1205577 - DNA, 22 bp, Artificial Sequence
  chemically synthesized
agaattctttttttatcctcta

SEQ ID NO: 1205578 - DNA, 22 bp, Artificial Sequence
  chemically synthesized
cagaattctttttttatcctct

SEQ ID NO: 1205579 - DNA, 22 bp, Artificial Sequence
  chemically synthesized
taaaataagatagaggataaaa

SEQ ID NO: 1205580 - DNA, 22 bp, Artificial Sequence
  chemically synthesized
cttcagaattctttttttatcc

SEQ ID NO: 1205581 - DNA, 22 bp, Artificial Sequence
  chemically synthesized
tgcttcagaattctttttttat

SEQ ID NO: 1205582 - DNA, 22 bp, Artificial Sequence
  chemically synthesized
ctgcttcagaattcttttttta

SEQ ID NO: 1205583 - DNA, 22 bp, Artificial Sequence
  chemically synthesized
tctgcttcagaattcttttttt

SEQ ID NO: 1205584 - DNA, 22 bp, Artificial Sequence
  chemically synthesized
ttctgcttcagaattctttttt

SEQ ID NO: 1205585 - DNA, 22 bp, Artificial Sequence
  chemically synthesized
catgtatttttctgcttcagaa

SEQ ID NO: 1205586 - DNA, 22 bp, Artificial Sequence
  chemically synthesized
attccatgtatttttctgcttc

SEQ ID NO: 1205587 - DNA, 22 bp, Artificial Sequence
  chemically synthesized
tgattccatgtatttttctgct

SEQ ID NO: 1205588 - DNA, 22 bp, Artificial Sequence
  chemically synthesized
ctgattccatgtatttttctgc

SEQ ID NO: 1205589 - DNA, 22 bp, Artificial Sequence
  chemically synthesized
cttctgattccatgtatttttc

SEQ ID NO: 1205590 - DNA, 22 bp, Artificial Sequence
  chemically synthesized
gcttctgattccatgtattttt

SEQ ID NO: 1205591 - DNA, 22 bp, Artificial Sequence
  chemically synthesized
tgcttctgattccatgtatttt

SEQ ID NO: 1205592 - DNA, 22 bp, Artificial Sequence
  chemically synthesized
tgaagcagaaaaatacatggaa

SEQ ID NO: 1205593 - DNA, 22 bp, Artificial Sequence
  chemically synthesized
aagcagaaaaatacatggaatc

SEQ ID NO: 1205594 - DNA, 22 bp, Artificial Sequence
  chemically synthesized
agcatctttgcttctgattcca

SEQ ID NO: 1205595 - DNA, 22 bp, Artificial Sequence
  chemically synthesized
ttcagcatctttgcttctgatt

SEQ ID NO: 1205596 - DNA, 22 bp, Artificial Sequence
  chemically synthesized
attcagcatctttgcttctgat

SEQ ID NO: 1205597 - DNA, 22 bp, Artificial Sequence
  chemically synthesized
aatgcagatttattcagcatct

SEQ ID NO: 1205598 - DNA, 22 bp, Artificial Sequence
  chemically synthesized
caatgcagatttattcagcatc

SEQ ID NO: 1205599 - DNA, 22 bp, Artificial Sequence
  chemically synthesized
tcaatgcagatttattcagcat

SEQ ID NO: 1205600 - DNA, 22 bp, Artificial Sequence
  chemically synthesized
ttcaatgcagatttattcagca

SEQ ID NO: 1205601 - DNA, 22 bp, Artificial Sequence
  chemically synthesized
catttttcaatgcagatttatt

SEQ ID NO: 1205602 - DNA, 22 bp, Artificial Sequence
  chemically synthesized
ccatttttcaatgcagatttat

SEQ ID NO: 1205603 - DNA, 22 bp, Artificial Sequence
  chemically synthesized
tccatttttcaatgcagattta

SEQ ID NO: 1205604 - DNA, 22 bp, Artificial Sequence
  chemically synthesized
aataaatctgcattgaaaaatg

SEQ ID NO: 1205605 - DNA, 22 bp, Artificial Sequence
  chemically synthesized
cattgaaaaatggaaagttcct

SEQ ID NO: 1205606 - DNA, 22 bp, Artificial Sequence
  chemically synthesized
aaaaatggaaagttcctatttt

SEQ ID NO: 1205607 - DNA, 22 bp, Artificial Sequence
  chemically synthesized
ctattttgtgtttatattatac

SEQ ID NO: 1205608 - DNA, 22 bp, Artificial Sequence
  chemically synthesized
caagagtcaaaagtataatata

SEQ ID NO: 1205609 - DNA, 22 bp, Artificial Sequence
  chemically synthesized
ttttgtgtttatattatacttt

SEQ ID NO: 1205610 - DNA, 22 bp, Artificial Sequence
  chemically synthesized
tgtgtttatattatacttttga

SEQ ID NO: 1205611 - DNA, 22 bp, Artificial Sequence
  chemically synthesized
gtgtttatattatacttttgac

SEQ ID NO: 1205612 - DNA, 22 bp, Artificial Sequence
  chemically synthesized
tgtttatattatacttttgact

SEQ ID NO: 1205613 - DNA, 22 bp, Artificial Sequence
  chemically synthesized
atattatacttttgactcttgt

SEQ ID NO: 1205614 - DNA, 22 bp, Artificial Sequence
  chemically synthesized
agaagaataattacaagagtca

SEQ ID NO: 1205615 - DNA, 22 bp, Artificial Sequence
  chemically synthesized
tattatacttttgactcttgta

SEQ ID NO: 1205616 - DNA, 22 bp, Artificial Sequence
  chemically synthesized
aagaagaataattacaagagtc

SEQ ID NO: 1205617 - DNA, 22 bp, Artificial Sequence
  chemically synthesized
tacttttgactcttgtaattat

SEQ ID NO: 1205618 - DNA, 22 bp, Artificial Sequence
  chemically synthesized
tgacatttaagaagaataatta

SEQ ID NO: 1205619 - DNA, 22 bp, Artificial Sequence
  chemically synthesized
gtgacatttaagaagaataatt

SEQ ID NO: 1205620 - DNA, 22 bp, Artificial Sequence
  chemically synthesized
ttgactcttgtaattattcttc

SEQ ID NO: 1205621 - DNA, 22 bp, Artificial Sequence
  chemically synthesized
tgtgacatttaagaagaataat

SEQ ID NO: 1205622 - DNA, 22 bp, Artificial Sequence
  chemically synthesized
tgactcttgtaattattcttct

SEQ ID NO: 1205623 - DNA, 22 bp, Artificial Sequence
  chemically synthesized
ttgtgacatttaagaagaataa

SEQ ID NO: 1205624 - DNA, 22 bp, Artificial Sequence
  chemically synthesized
gactcttgtaattattcttctt

SEQ ID NO: 1205625 - DNA, 22 bp, Artificial Sequence
  chemically synthesized
actcttgtaattattcttctta

SEQ ID NO: 1205626 - DNA, 22 bp, Artificial Sequence
  chemically synthesized
ttgtaattattcttcttaaatg

SEQ ID NO: 1205627 - DNA, 22 bp, Artificial Sequence
  chemically synthesized
gtaattattcttcttaaatgtc

SEQ ID NO: 1205628 - DNA, 22 bp, Artificial Sequence
  chemically synthesized
taattattcttcttaaatgtca

SEQ ID NO: 1205629 - DNA, 22 bp, Artificial Sequence
  chemically synthesized
gggggatttttgtgacatttaa

SEQ ID NO: 1205630 - DNA, 22 bp, Artificial Sequence
  chemically synthesized
ttcttcttaaatgtcacaaaaa

SEQ ID NO: 1205631 - DNA, 22 bp, Artificial Sequence
  chemically synthesized
ttcttaaatgtcacaaaaatcc

SEQ ID NO: 1205632 - DNA, 22 bp, Artificial Sequence
  chemically synthesized
cttaaatgtcacaaaaatcccc

SEQ ID NO: 1205633 - DNA, 22 bp, Artificial Sequence
  chemically synthesized
ttaaatgtcacaaaaatccccc

SEQ ID NO: 1205634 - DNA, 22 bp, Artificial Sequence
  chemically synthesized
aaatgtcacaaaaatcccccca

SEQ ID NO: 1205635 - DNA, 22 bp, Artificial Sequence
  chemically synthesized
aatgtcacaaaaatccccccaa

SEQ ID NO: 1205636 - DNA, 22 bp, Artificial Sequence
  chemically synthesized
cacatacatagcagtggaatag

SEQ ID NO: 1205637 - DNA, 22 bp, Artificial Sequence
  chemically synthesized
ttactattccactgctatgtat

SEQ ID NO: 1205638 - DNA, 22 bp, Artificial Sequence
  chemically synthesized
ctattccactgctatgtatgtg

SEQ ID NO: 1205639 - DNA, 22 bp, Artificial Sequence
  chemically synthesized
ggtatgtacatctccacataca

SEQ ID NO: 1205640 - DNA, 22 bp, Artificial Sequence
  chemically synthesized
ttccactgctatgtatgtggag

SEQ ID NO: 1205641 - DNA, 22 bp, Artificial Sequence
  chemically synthesized
cactgctatgtatgtggagatg

SEQ ID NO: 1205642 - DNA, 22 bp, Artificial Sequence
  chemically synthesized
ataattgggtatgtacatctcc

SEQ ID NO: 1205643 - DNA, 22 bp, Artificial Sequence
  chemically synthesized
ctatgtatgtggagatgtacat

SEQ ID NO: 1205644 - DNA, 22 bp, Artificial Sequence
  chemically synthesized
cctaataattgggtatgtacat

SEQ ID NO: 1205645 - DNA, 22 bp, Artificial Sequence
  chemically synthesized
tgtatgtggagatgtacatacc

SEQ ID NO: 1205646 - DNA, 22 bp, Artificial Sequence
  chemically synthesized
ggtacgttacctaataattggg

SEQ ID NO: 1205647 - DNA, 22 bp, Artificial Sequence
  chemically synthesized
gggtacgttacctaataattgg

SEQ ID NO: 1205648 - DNA, 22 bp, Artificial Sequence
  chemically synthesized
atccttgggtacgttacctaat

SEQ ID NO: 1205649 - DNA, 22 bp, Artificial Sequence
  chemically synthesized
attgatccttgggtacgttacc

SEQ ID NO: 1205650 - DNA, 22 bp, Artificial Sequence
  chemically synthesized
tctaattgatccttgggtacgt

SEQ ID NO: 1205651 - DNA, 22 bp, Artificial Sequence
  chemically synthesized
ttatctaattgatccttgggta

SEQ ID NO: 1205652 - DNA, 22 bp, Artificial Sequence
  chemically synthesized
attatctaattgatccttgggt

SEQ ID NO: 1205653 - DNA, 22 bp, Artificial Sequence
  chemically synthesized
ttaggtaacgtacccaaggatc

SEQ ID NO: 1205654 - DNA, 22 bp, Artificial Sequence
  chemically synthesized
tattatctaattgatccttggg

SEQ ID NO: 1205655 - DNA, 22 bp, Artificial Sequence
  chemically synthesized
ttattatctaattgatccttgg

SEQ ID NO: 1205656 - DNA, 22 bp, Artificial Sequence
  chemically synthesized
ggtaacgtacccaaggatcaat

SEQ ID NO: 1205657 - DNA, 22 bp, Artificial Sequence
  chemically synthesized
ttttattatctaattgatcctt

SEQ ID NO: 1205658 - DNA, 22 bp, Artificial Sequence
  chemically synthesized
cttttattatctaattgatcct

SEQ ID NO: 1205659 - DNA, 22 bp, Artificial Sequence
  chemically synthesized
cagtaatgtttcttttattatc

SEQ ID NO: 1205660 - DNA, 22 bp, Artificial Sequence
  chemically synthesized
tgttacagtaatgtttctttta

SEQ ID NO: 1205661 - DNA, 22 bp, Artificial Sequence
  chemically synthesized
gataataaaagaaacattactg

SEQ ID NO: 1205662 - DNA, 22 bp, Artificial Sequence
  chemically synthesized
ctgtaacacaggacttcttttt

SEQ ID NO: 1205663 - DNA, 22 bp, Artificial Sequence
  chemically synthesized
atagaaggtagtgtaaaaagaa

SEQ ID NO: 1205664 - DNA, 22 bp, Artificial Sequence
  chemically synthesized
taacacaggacttctttttaca

SEQ ID NO: 1205665 - DNA, 22 bp, Artificial Sequence
  chemically synthesized
aatagaaggtagtgtaaaaaga

SEQ ID NO: 1205666 - DNA, 22 bp, Artificial Sequence
  chemically synthesized
taatagaaggtagtgtaaaaag

SEQ ID NO: 1205667 - DNA, 22 bp, Artificial Sequence
  chemically synthesized
ttaatagaaggtagtgtaaaaa

SEQ ID NO: 1205668 - DNA, 22 bp, Artificial Sequence
  chemically synthesized
tttaatagaaggtagtgtaaaa

SEQ ID NO: 1205669 - DNA, 22 bp, Artificial Sequence
  chemically synthesized
tttttaatagaaggtagtgtaa

SEQ ID NO: 1205670 - DNA, 22 bp, Artificial Sequence
  chemically synthesized
ctctttttaatagaaggtagtg

SEQ ID NO: 1205671 - DNA, 22 bp, Artificial Sequence
  chemically synthesized
ctttttacactaccttctatta

SEQ ID NO: 1205672 - DNA, 22 bp, Artificial Sequence
  chemically synthesized
tttttacactaccttctattaa

SEQ ID NO: 1205673 - DNA, 22 bp, Artificial Sequence
  chemically synthesized
tgtctcctctttttaatagaag

SEQ ID NO: 1205674 - DNA, 22 bp, Artificial Sequence
  chemically synthesized
atgtctcctctttttaatagaa

SEQ ID NO: 1205675 - DNA, 22 bp, Artificial Sequence
  chemically synthesized
tttacactaccttctattaaaa

SEQ ID NO: 1205676 - DNA, 22 bp, Artificial Sequence
  chemically synthesized
ttacactaccttctattaaaaa

SEQ ID NO: 1205677 - DNA, 22 bp, Artificial Sequence
  chemically synthesized
tacactaccttctattaaaaag

SEQ ID NO: 1205678 - DNA, 22 bp, Artificial Sequence
  chemically synthesized
acactaccttctattaaaaaga

SEQ ID NO: 1205679 - DNA, 22 bp, Artificial Sequence
  chemically synthesized
cactaccttctattaaaaagag

SEQ ID NO: 1205680 - DNA, 22 bp, Artificial Sequence
  chemically synthesized
acatacttatgtctcctctttt

SEQ ID NO: 1205681 - DNA, 22 bp, Artificial Sequence
  chemically synthesized
cacatacttatgtctcctcttt

SEQ ID NO: 1205682 - DNA, 22 bp, Artificial Sequence
  chemically synthesized
ccttctattaaaaagaggagac

SEQ ID NO: 1205683 - DNA, 22 bp, Artificial Sequence
  chemically synthesized
ctattaaaaagaggagacataa

SEQ ID NO: 1205684 - DNA, 22 bp, Artificial Sequence
  chemically synthesized
catttcacatacttatgtctcc

SEQ ID NO: 1205685 - DNA, 22 bp, Artificial Sequence
  chemically synthesized
tattaaaaagaggagacataag

SEQ ID NO: 1205686 - DNA, 22 bp, Artificial Sequence
  chemically synthesized
ttaaaaagaggagacataagta

SEQ ID NO: 1205687 - DNA, 22 bp, Artificial Sequence
  chemically synthesized
attccatttcacatacttatgt

SEQ ID NO: 1205688 - DNA, 22 bp, Artificial Sequence
  chemically synthesized
aaaagaggagacataagtatgt

SEQ ID NO: 1205689 - DNA, 22 bp, Artificial Sequence
  chemically synthesized
tgtggcatactgattccatttc

SEQ ID NO: 1205690 - DNA, 22 bp, Artificial Sequence
  chemically synthesized
aatactatgtggcatactgatt

SEQ ID NO: 1205691 - DNA, 22 bp, Artificial Sequence
  chemically synthesized
ttaaatactatgtggcatactg

SEQ ID NO: 1205692 - DNA, 22 bp, Artificial Sequence
  chemically synthesized
aataatgctgttaaatactatg

SEQ ID NO: 1205693 - DNA, 22 bp, Artificial Sequence
  chemically synthesized
acaaatatgacaattgaataat

SEQ ID NO: 1205694 - DNA, 22 bp, Artificial Sequence
  chemically synthesized
aacagcattattcaattgtcat

SEQ ID NO: 1205695 - DNA, 22 bp, Artificial Sequence
  chemically synthesized
acagcattattcaattgtcata

SEQ ID NO: 1205696 - DNA, 22 bp, Artificial Sequence
  chemically synthesized
tcatgaggtactaacaaatatg

SEQ ID NO: 1205697 - DNA, 22 bp, Artificial Sequence
  chemically synthesized
atcatgaggtactaacaaatat

SEQ ID NO: 1205698 - DNA, 22 bp, Artificial Sequence
  chemically synthesized
ttcaattgtcatatttgttagt

SEQ ID NO: 1205699 - DNA, 22 bp, Artificial Sequence
  chemically synthesized
aattgtcatatttgttagtacc

SEQ ID NO: 1205700 - DNA, 22 bp, Artificial Sequence
  chemically synthesized
acatttatcatgaggtactaac

SEQ ID NO: 1205701 - DNA, 22 bp, Artificial Sequence
  chemically synthesized
tcatatttgttagtacctcatg

SEQ ID NO: 1205702 - DNA, 22 bp, Artificial Sequence
  chemically synthesized
cctaacatttatcatgaggtac

SEQ ID NO: 1205703 - DNA, 22 bp, Artificial Sequence
  chemically synthesized
tgcctaacatttatcatgaggt

SEQ ID NO: 1205704 - DNA, 22 bp, Artificial Sequence
  chemically synthesized
ctgcctaacatttatcatgagg

SEQ ID NO: 1205705 - DNA, 22 bp, Artificial Sequence
  chemically synthesized
tctgcctaacatttatcatgag

SEQ ID NO: 1205706 - DNA, 22 bp, Artificial Sequence
  chemically synthesized
gttagtacctcatgataaatgt

SEQ ID NO: 1205707 - DNA, 22 bp, Artificial Sequence
  chemically synthesized
ttagtacctcatgataaatgtt

SEQ ID NO: 1205708 - DNA, 22 bp, Artificial Sequence
  chemically synthesized
gtacctcatgataaatgttagg

SEQ ID NO: 1205709 - DNA, 22 bp, Artificial Sequence
  chemically synthesized
atgataaatgttaggcagaaag

SEQ ID NO: 1205710 - DNA, 22 bp, Artificial Sequence
  chemically synthesized
gaaggtgaagagagatagagaa

SEQ ID NO: 1205711 - DNA, 22 bp, Artificial Sequence
  chemically synthesized
ggcagaaagccttctctatctc

SEQ ID NO: 1205712 - DNA, 22 bp, Artificial Sequence
  chemically synthesized
ccctggaaggtgaagagagata

SEQ ID NO: 1205713 - DNA, 22 bp, Artificial Sequence
  chemically synthesized
gccctggaaggtgaagagagat

SEQ ID NO: 1205714 - DNA, 22 bp, Artificial Sequence
  chemically synthesized
ctctatctctcttcaccttcca

SEQ ID NO: 1205715 - DNA, 22 bp, Artificial Sequence
  chemically synthesized
tctatctctcttcaccttccag

SEQ ID NO: 1205716 - DNA, 22 bp, Artificial Sequence
  chemically synthesized
tatctctcttcaccttccaggg

SEQ ID NO: 1205717 - DNA, 22 bp, Artificial Sequence
  chemically synthesized
tctctcttcaccttccagggca

SEQ ID NO: 1205718 - DNA, 22 bp, Artificial Sequence
  chemically synthesized
tcttcaccttccagggcaaata

SEQ ID NO: 1205719 - DNA, 22 bp, Artificial Sequence
  chemically synthesized
ttcaccttccagggcaaatatc

SEQ ID NO: 1205720 - DNA, 22 bp, Artificial Sequence
  chemically synthesized
caccttccagggcaaatatctg

SEQ ID NO: 1205721 - DNA, 22 bp, Artificial Sequence
  chemically synthesized
accttccagggcaaatatctgc

SEQ ID NO: 1205722 - DNA, 22 bp, Artificial Sequence
  chemically synthesized
tggcaacaaagtagggcagata

SEQ ID NO: 1205723 - DNA, 22 bp, Artificial Sequence
  chemically synthesized
ccagggcaaatatctgccctac

SEQ ID NO: 1205724 - DNA, 22 bp, Artificial Sequence
  chemically synthesized
tgtggcaacaaagtagggcaga

SEQ ID NO: 1205725 - DNA, 22 bp, Artificial Sequence
  chemically synthesized
cagggcaaatatctgccctact

SEQ ID NO: 1205726 - DNA, 22 bp, Artificial Sequence
  chemically synthesized
tctgtggcaacaaagtagggca

SEQ ID NO: 1205727 - DNA, 22 bp, Artificial Sequence
  chemically synthesized
ttctctgtggcaacaaagtagg

SEQ ID NO: 1205728 - DNA, 22 bp, Artificial Sequence
  chemically synthesized
attctctgtggcaacaaagtag

SEQ ID NO: 1205729 - DNA, 22 bp, Artificial Sequence
  chemically synthesized
ccctactttgttgccacagaga

SEQ ID NO: 1205730 - DNA, 22 bp, Artificial Sequence
  chemically synthesized
ctttgttgccacagagaataaa

SEQ ID NO: 1205731 - DNA, 22 bp, Artificial Sequence
  chemically synthesized
cagtcatggaaaatttattctc

SEQ ID NO: 1205732 - DNA, 22 bp, Artificial Sequence
  chemically synthesized
gcagtcatggaaaatttattct

SEQ ID NO: 1205733 - DNA, 22 bp, Artificial Sequence
  chemically synthesized
tgttgccacagagaataaattt

SEQ ID NO: 1205734 - DNA, 22 bp, Artificial Sequence
  chemically synthesized
gttgccacagagaataaatttt

SEQ ID NO: 1205735 - DNA, 22 bp, Artificial Sequence
  chemically synthesized
ttgccacagagaataaattttc

SEQ ID NO: 1205736 - DNA, 22 bp, Artificial Sequence
  chemically synthesized
ccacagagaataaattttccat

SEQ ID NO: 1205737 - DNA, 22 bp, Artificial Sequence
  chemically synthesized
aatagagcttgcagtcatggaa

SEQ ID NO: 1205738 - DNA, 22 bp, Artificial Sequence
  chemically synthesized
caatagagcttgcagtcatgga

SEQ ID NO: 1205739 - DNA, 22 bp, Artificial Sequence
  chemically synthesized
tcaatagagcttgcagtcatgg

SEQ ID NO: 1205740 - DNA, 22 bp, Artificial Sequence
  chemically synthesized
ttttcaatagagcttgcagtca

SEQ ID NO: 1205741 - DNA, 22 bp, Artificial Sequence
  chemically synthesized
tattttcaatagagcttgcagt

SEQ ID NO: 1205742 - DNA, 22 bp, Artificial Sequence
  chemically synthesized
ctattttcaatagagcttgcag

SEQ ID NO: 1205743 - DNA, 22 bp, Artificial Sequence
  chemically synthesized
ttctattttcaatagagcttgc

SEQ ID NO: 1205744 - DNA, 22 bp, Artificial Sequence
  chemically synthesized
tcttctattttcaatagagctt

SEQ ID NO: 1205745 - DNA, 22 bp, Artificial Sequence
  chemically synthesized
tccatgactgcaagctctattg

SEQ ID NO: 1205746 - DNA, 22 bp, Artificial Sequence
  chemically synthesized
ctcttctattttcaatagagct

SEQ ID NO: 1205747 - DNA, 22 bp, Artificial Sequence
  chemically synthesized
ccatgactgcaagctctattga

SEQ ID NO: 1205748 - DNA, 22 bp, Artificial Sequence
  chemically synthesized
catgactgcaagctctattgaa

SEQ ID NO: 1205749 - DNA, 22 bp, Artificial Sequence
  chemically synthesized
catttctcttctattttcaata

SEQ ID NO: 1205750 - DNA, 22 bp, Artificial Sequence
  chemically synthesized
ccatttctcttctattttcaat

SEQ ID NO: 1205751 - DNA, 22 bp, Artificial Sequence
  chemically synthesized
tccatttctcttctattttcaa

SEQ ID NO: 1205752 - DNA, 22 bp, Artificial Sequence
  chemically synthesized
caagctctattgaaaatagaag

SEQ ID NO: 1205753 - DNA, 22 bp, Artificial Sequence
  chemically synthesized
gacctttccatttctcttctat

SEQ ID NO: 1205754 - DNA, 22 bp, Artificial Sequence
  chemically synthesized
tggacctttccatttctcttct

SEQ ID NO: 1205755 - DNA, 22 bp, Artificial Sequence
  chemically synthesized
tattgaaaatagaagagaaatg

SEQ ID NO: 1205756 - DNA, 22 bp, Artificial Sequence
  chemically synthesized
ttgaaaatagaagagaaatgga

SEQ ID NO: 1205757 - DNA, 22 bp, Artificial Sequence
  chemically synthesized
aattctggacctttccatttct

SEQ ID NO: 1205758 - DNA, 22 bp, Artificial Sequence
  chemically synthesized
aaattctggacctttccatttc

SEQ ID NO: 1205759 - DNA, 22 bp, Artificial Sequence
  chemically synthesized
aaaatagaagagaaatggaaag

SEQ ID NO: 1205760 - DNA, 22 bp, Artificial Sequence
  chemically synthesized
taaattctggacctttccattt

SEQ ID NO: 1205761 - DNA, 22 bp, Artificial Sequence
  chemically synthesized
ctttaaattctggacctttcca

SEQ ID NO: 1205762 - DNA, 22 bp, Artificial Sequence
  chemically synthesized
aaaggaactgtatctctctccc

SEQ ID NO: 1205763 - DNA, 22 bp, Artificial Sequence
  chemically synthesized
aaggaactgtatctctctccca

SEQ ID NO: 1205764 - DNA, 22 bp, Artificial Sequence
  chemically synthesized
aagggacatacagtagaatggg

SEQ ID NO: 1205765 - DNA, 22 bp, Artificial Sequence
  chemically synthesized
tatctctctcccattctactgt

SEQ ID NO: 1205766 - DNA, 22 bp, Artificial Sequence
  chemically synthesized
atctcaagggacatacagtaga

SEQ ID NO: 1205767 - DNA, 22 bp, Artificial Sequence
  chemically synthesized
taatctcaagggacatacagta

SEQ ID NO: 1205768 - DNA, 22 bp, Artificial Sequence
  chemically synthesized
tctcccattctactgtatgtcc

SEQ ID NO: 1205769 - DNA, 22 bp, Artificial Sequence
  chemically synthesized
tcccattctactgtatgtccct

SEQ ID NO: 1205770 - DNA, 22 bp, Artificial Sequence
  chemically synthesized
ccattctactgtatgtcccttg

SEQ ID NO: 1205771 - DNA, 22 bp, Artificial Sequence
  chemically synthesized
tactgtatgtcccttgagatta

SEQ ID NO: 1205772 - DNA, 22 bp, Artificial Sequence
  chemically synthesized
ctgtatgtcccttgagattaga

SEQ ID NO: 1205773 - DNA, 22 bp, Artificial Sequence
  chemically synthesized
gggaaacaaatgtctctaatct

SEQ ID NO: 1205774 - DNA, 22 bp, Artificial Sequence
  chemically synthesized
tatgtcccttgagattagagac

SEQ ID NO: 1205775 - DNA, 22 bp, Artificial Sequence
  chemically synthesized
gcactggggaaacaaatgtctc

SEQ ID NO: 1205776 - DNA, 22 bp, Artificial Sequence
  chemically synthesized
attggcactggggaaacaaatg

SEQ ID NO: 1205777 - DNA, 22 bp, Artificial Sequence
  chemically synthesized
gagattagagacatttgtttcc

SEQ ID NO: 1205778 - DNA, 22 bp, Artificial Sequence
  chemically synthesized
agattagagacatttgtttccc

SEQ ID NO: 1205779 - DNA, 22 bp, Artificial Sequence
  chemically synthesized
tgattggcactggggaaacaaa

SEQ ID NO: 1205780 - DNA, 22 bp, Artificial Sequence
  chemically synthesized
gagacatttgtttccccagtgc

SEQ ID NO: 1205781 - DNA, 22 bp, Artificial Sequence
  chemically synthesized
tgtatcatgtctctgattggca

SEQ ID NO: 1205782 - DNA, 22 bp, Artificial Sequence
  chemically synthesized
gtttccccagtgccaatcagag

SEQ ID NO: 1205783 - DNA, 22 bp, Artificial Sequence
  chemically synthesized
tttccccagtgccaatcagaga

SEQ ID NO: 1205784 - DNA, 22 bp, Artificial Sequence
  chemically synthesized
ccccagtgccaatcagagacat

SEQ ID NO: 1205785 - DNA, 22 bp, Artificial Sequence
  chemically synthesized
cccagtgccaatcagagacatg

SEQ ID NO: 1205786 - DNA, 22 bp, Artificial Sequence
  chemically synthesized
aacactatgtatcatgtctctg

SEQ ID NO: 1205787 - DNA, 22 bp, Artificial Sequence
  chemically synthesized
ttgaacactatgtatcatgtct

SEQ ID NO: 1205788 - DNA, 22 bp, Artificial Sequence
  chemically synthesized
attgaacactatgtatcatgtc

SEQ ID NO: 1205789 - DNA, 22 bp, Artificial Sequence
  chemically synthesized
accaagcatttattgaacacta

SEQ ID NO: 1205790 - DNA, 22 bp, Artificial Sequence
  chemically synthesized
attcaccaagcatttattgaac

SEQ ID NO: 1205791 - DNA, 22 bp, Artificial Sequence
  chemically synthesized
accaattcattcaccaagcatt

SEQ ID NO: 1205792 - DNA, 22 bp, Artificial Sequence
  chemically synthesized
caccaattcattcaccaagcat

SEQ ID NO: 1205793 - DNA, 22 bp, Artificial Sequence
  chemically synthesized
tcaccaattcattcaccaagca

SEQ ID NO: 1205794 - DNA, 22 bp, Artificial Sequence
  chemically synthesized
ttttcaccaattcattcaccaa

SEQ ID NO: 1205795 - DNA, 22 bp, Artificial Sequence
  chemically synthesized
aataaatgcttggtgaatgaat

SEQ ID NO: 1205796 - DNA, 22 bp, Artificial Sequence
  chemically synthesized
ataagttattttcaccaattca

SEQ ID NO: 1205797 - DNA, 22 bp, Artificial Sequence
  chemically synthesized
ggtgaatgaattggtgaaaata

SEQ ID NO: 1205798 - DNA, 22 bp, Artificial Sequence
  chemically synthesized
gtgaatgaattggtgaaaataa

SEQ ID NO: 1205799 - DNA, 22 bp, Artificial Sequence
  chemically synthesized
caaccataattcataagttatt

SEQ ID NO: 1205800 - DNA, 22 bp, Artificial Sequence
  chemically synthesized
ctgcaaccataattcataagtt

SEQ ID NO: 1205801 - DNA, 22 bp, Artificial Sequence
  chemically synthesized
gtgaaaataacttatgaattat

SEQ ID NO: 1205802 - DNA, 22 bp, Artificial Sequence
  chemically synthesized
cctcctgcaaccataattcata

SEQ ID NO: 1205803 - DNA, 22 bp, Artificial Sequence
  chemically synthesized
ccctcctgcaaccataattcat

SEQ ID NO: 1205804 - DNA, 22 bp, Artificial Sequence
  chemically synthesized
ttccctcctgcaaccataattc

SEQ ID NO: 1205805 - DNA, 22 bp, Artificial Sequence
  chemically synthesized
ttcttccctcctgcaaccataa

SEQ ID NO: 1205806 - DNA, 22 bp, Artificial Sequence
  chemically synthesized
tgttcttccctcctgcaaccat

SEQ ID NO: 1205807 - DNA, 22 bp, Artificial Sequence
  chemically synthesized
atgaattatggttgcaggaggg

SEQ ID NO: 1205808 - DNA, 22 bp, Artificial Sequence
  chemically synthesized
tgaattatggttgcaggaggga

SEQ ID NO: 1205809 - DNA, 22 bp, Artificial Sequence
  chemically synthesized
tatcactctgttcttccctcct

SEQ ID NO: 1205810 - DNA, 22 bp, Artificial Sequence
  chemically synthesized
tggttgcaggagggaagaacag

SEQ ID NO: 1205811 - DNA, 22 bp, Artificial Sequence
  chemically synthesized
acattatatcactctgttcttc

SEQ ID NO: 1205812 - DNA, 22 bp, Artificial Sequence
  chemically synthesized
aacattatatcactctgttctt

SEQ ID NO: 1205813 - DNA, 22 bp, Artificial Sequence
  chemically synthesized
caggagggaagaacagagtgat

SEQ ID NO: 1205814 - DNA, 22 bp, Artificial Sequence
  chemically synthesized
aatatgtttaacattatatcac

SEQ ID NO: 1205815 - DNA, 22 bp, Artificial Sequence
  chemically synthesized
caagtaaacctgaatatgttta

SEQ ID NO: 1205816 - DNA, 22 bp, Artificial Sequence
  chemically synthesized
gcaagtaaacctgaatatgttt

SEQ ID NO: 1205817 - DNA, 22 bp, Artificial Sequence
  chemically synthesized
cttgcaagtaaacctgaatatg

SEQ ID NO: 1205818 - DNA, 22 bp, Artificial Sequence
  chemically synthesized
ccattccttgcaagtaaacctg

SEQ ID NO: 1205819 - DNA, 22 bp, Artificial Sequence
  chemically synthesized
cccattccttgcaagtaaacct

SEQ ID NO: 1205820 - DNA, 22 bp, Artificial Sequence
  chemically synthesized
aacatattcaggtttacttgca

SEQ ID NO: 1205821 - DNA, 22 bp, Artificial Sequence
  chemically synthesized
agtttcccattccttgcaagta

SEQ ID NO: 1205822 - DNA, 22 bp, Artificial Sequence
  chemically synthesized
aggtttacttgcaaggaatggg

SEQ ID NO: 1205823 - DNA, 22 bp, Artificial Sequence
  chemically synthesized
acttgcaaggaatgggaaactg

SEQ ID NO: 1205824 - DNA, 22 bp, Artificial Sequence
  chemically synthesized
cttgcaaggaatgggaaactga

SEQ ID NO: 1205825 - DNA, 22 bp, Artificial Sequence
  chemically synthesized
gcaaggaatgggaaactgaata

SEQ ID NO: 1205826 - DNA, 22 bp, Artificial Sequence
  chemically synthesized
caaggaatgggaaactgaatac

SEQ ID NO: 1205827 - DNA, 22 bp, Artificial Sequence
  chemically synthesized
tatgcaacatcaatatatgaag

SEQ ID NO: 1205828 - DNA, 22 bp, Artificial Sequence
  chemically synthesized
aatacttcatatattgatgttg

SEQ ID NO: 1205829 - DNA, 22 bp, Artificial Sequence
  chemically synthesized
catatattgatgttgcatatag

SEQ ID NO: 1205830 - DNA, 22 bp, Artificial Sequence
  chemically synthesized
atatattgatgttgcatatagg

SEQ ID NO: 1205831 - DNA, 22 bp, Artificial Sequence
  chemically synthesized
caaatgatcataatgatgccta

SEQ ID NO: 1205832 - DNA, 22 bp, Artificial Sequence
  chemically synthesized
ccaaatgatcataatgatgcct

SEQ ID NO: 1205833 - DNA, 22 bp, Artificial Sequence
  chemically synthesized
atgttgcatataggcatcatta

SEQ ID NO: 1205834 - DNA, 22 bp, Artificial Sequence
  chemically synthesized
atttccaaatgatcataatgat

SEQ ID NO: 1205835 - DNA, 22 bp, Artificial Sequence
  chemically synthesized
catataggcatcattatgatca

SEQ ID NO: 1205836 - DNA, 22 bp, Artificial Sequence
  chemically synthesized
actaatttccaaatgatcataa

SEQ ID NO: 1205837 - DNA, 22 bp, Artificial Sequence
  chemically synthesized
gactaatttccaaatgatcata

SEQ ID NO: 1205838 - DNA, 22 bp, Artificial Sequence
  chemically synthesized
tgactaatttccaaatgatcat

SEQ ID NO: 1205839 - DNA, 22 bp, Artificial Sequence
  chemically synthesized
aagacattttgactaatttcca

SEQ ID NO: 1205840 - DNA, 22 bp, Artificial Sequence
  chemically synthesized
tgatcatttggaaattagtcaa

SEQ ID NO: 1205841 - DNA, 22 bp, Artificial Sequence
  chemically synthesized
ggaaattagtcaaaatgtcttt

SEQ ID NO: 1205842 - DNA, 22 bp, Artificial Sequence
  chemically synthesized
gaaattagtcaaaatgtcttta

SEQ ID NO: 1205843 - DNA, 22 bp, Artificial Sequence
  chemically synthesized
gatcaaaaggtatgcattaaag

SEQ ID NO: 1205844 - DNA, 22 bp, Artificial Sequence
  chemically synthesized
gtcaaaatgtctttaatgcata

SEQ ID NO: 1205845 - DNA, 22 bp, Artificial Sequence
  chemically synthesized
taatgcataccttttgatctag

SEQ ID NO: 1205846 - DNA, 22 bp, Artificial Sequence
  chemically synthesized
aatgcataccttttgatctagc

SEQ ID NO: 1205847 - DNA, 22 bp, Artificial Sequence
  chemically synthesized
atgcataccttttgatctagct

SEQ ID NO: 1205848 - DNA, 22 bp, Artificial Sequence
  chemically synthesized
ggaacccaggatagctagatca

SEQ ID NO: 1205849 - DNA, 22 bp, Artificial Sequence
  chemically synthesized
ttgatctagctatcctgggttc

SEQ ID NO: 1205850 - DNA, 22 bp, Artificial Sequence
  chemically synthesized
tgatctagctatcctgggttcc

SEQ ID NO: 1205851 - DNA, 22 bp, Artificial Sequence
  chemically synthesized
gatctagctatcctgggttcct

SEQ ID NO: 1205852 - DNA, 22 bp, Artificial Sequence
  chemically synthesized
atctagctatcctgggttccta

SEQ ID NO: 1205853 - DNA, 22 bp, Artificial Sequence
  chemically synthesized
gctatcctgggttcctagcatg

SEQ ID NO: 1205854 - DNA, 22 bp, Artificial Sequence
  chemically synthesized
tatatgaggtatcatgctagga

SEQ ID NO: 1205855 - DNA, 22 bp, Artificial Sequence
  chemically synthesized
atatatgaggtatcatgctagg

SEQ ID NO: 1205856 - DNA, 22 bp, Artificial Sequence
  chemically synthesized
tcctgggttcctagcatgatac

SEQ ID NO: 1205857 - DNA, 22 bp, Artificial Sequence
  chemically synthesized
ggttcctagcatgatacctcat

SEQ ID NO: 1205858 - DNA, 22 bp, Artificial Sequence
  chemically synthesized
ctagcatgatacctcatatata

SEQ ID NO: 1205859 - DNA, 22 bp, Artificial Sequence
  chemically synthesized
tcgagtgtgcatttatatatga

SEQ ID NO: 1205860 - DNA, 22 bp, Artificial Sequence
  chemically synthesized
gcatgatacctcatatataaat

SEQ ID NO: 1205861 - DNA, 22 bp, Artificial Sequence
  chemically synthesized
atatataaatgcacactcgata

SEQ ID NO: 1205862 - DNA, 22 bp, Artificial Sequence
  chemically synthesized
tgtgaggtacaaaaagctatcg

SEQ ID NO: 1205863 - DNA, 22 bp, Artificial Sequence
  chemically synthesized
gatagctttttgtacctcacat

SEQ ID NO: 1205864 - DNA, 22 bp, Artificial Sequence
  chemically synthesized
tttgtacctcacataatgacat

SEQ ID NO: 1205865 - DNA, 22 bp, Artificial Sequence
  chemically synthesized
ttgtacctcacataatgacatg

SEQ ID NO: 1205866 - DNA, 22 bp, Artificial Sequence
  chemically synthesized
tgtacctcacataatgacatga

SEQ ID NO: 1205867 - DNA, 22 bp, Artificial Sequence
  chemically synthesized
gtacctcacataatgacatgat

SEQ ID NO: 1205868 - DNA, 22 bp, Artificial Sequence
  chemically synthesized
aaggtatagaaaatcatgtcat

SEQ ID NO: 1205869 - DNA, 22 bp, Artificial Sequence
  chemically synthesized
tacctcacataatgacatgatt

SEQ ID NO: 1205870 - DNA, 22 bp, Artificial Sequence
  chemically synthesized
acataatgacatgattttctat

SEQ ID NO: 1205871 - DNA, 22 bp, Artificial Sequence
  chemically synthesized
tctataccttgaatatgccttc

SEQ ID NO: 1205872 - DNA, 22 bp, Artificial Sequence
  chemically synthesized
ctataccttgaatatgccttcc

SEQ ID NO: 1205873 - DNA, 22 bp, Artificial Sequence
  chemically synthesized
tataccttgaatatgccttcct

SEQ ID NO: 1205874 - DNA, 22 bp, Artificial Sequence
  chemically synthesized
taccttgaatatgccttcctct

SEQ ID NO: 1205875 - DNA, 22 bp, Artificial Sequence
  chemically synthesized
gaatatgccttcctcttatttc

SEQ ID NO: 1205876 - DNA, 22 bp, Artificial Sequence
  chemically synthesized
aatatgccttcctcttatttct

SEQ ID NO: 1205877 - DNA, 22 bp, Artificial Sequence
  chemically synthesized
cctcttatttcttcttcattgg

SEQ ID NO: 1205878 - DNA, 22 bp, Artificial Sequence
  chemically synthesized
ctcttatttcttcttcattggt

SEQ ID NO: 1205879 - DNA, 22 bp, Artificial Sequence
  chemically synthesized
ttatttcttcttcattggtgct

SEQ ID NO: 1205880 - DNA, 22 bp, Artificial Sequence
  chemically synthesized
atttcttcttcattggtgcttt

SEQ ID NO: 1205881 - DNA, 22 bp, Artificial Sequence
  chemically synthesized
tttcttcttcattggtgctttt

SEQ ID NO: 1205882 - DNA, 22 bp, Artificial Sequence
  chemically synthesized
cttcttcattggtgcttttgcc

SEQ ID NO: 1205883 - DNA, 22 bp, Artificial Sequence
  chemically synthesized
ttcttcattggtgcttttgcct

SEQ ID NO: 1205884 - DNA, 22 bp, Artificial Sequence
  chemically synthesized
cttcattggtgcttttgccttg

SEQ ID NO: 1205885 - DNA, 22 bp, Artificial Sequence
  chemically synthesized
caggtgaaatagcaaggcaaaa

SEQ ID NO: 1205886 - DNA, 22 bp, Artificial Sequence
  chemically synthesized
ttcattggtgcttttgccttgc

SEQ ID NO: 1205887 - DNA, 22 bp, Artificial Sequence
  chemically synthesized
cattggtgcttttgccttgcta

SEQ ID NO: 1205888 - DNA, 22 bp, Artificial Sequence
  chemically synthesized
attggtgcttttgccttgctat

SEQ ID NO: 1205889 - DNA, 22 bp, Artificial Sequence
  chemically synthesized
gtgcttttgccttgctatttca

SEQ ID NO: 1205890 - DNA, 22 bp, Artificial Sequence
  chemically synthesized
ttgccttgctatttcacctgga

SEQ ID NO: 1205891 - DNA, 22 bp, Artificial Sequence
  chemically synthesized
tgccttgctatttcacctggaa

SEQ ID NO: 1205892 - DNA, 22 bp, Artificial Sequence
  chemically synthesized
gccttgctatttcacctggaat

SEQ ID NO: 1205893 - DNA, 22 bp, Artificial Sequence
  chemically synthesized
ccttgctatttcacctggaatg

SEQ ID NO: 1205894 - DNA, 22 bp, Artificial Sequence
  chemically synthesized
gctatttcacctggaatgctat

SEQ ID NO: 1205895 - DNA, 22 bp, Artificial Sequence
  chemically synthesized
ctatttcacctggaatgctatt

SEQ ID NO: 1205896 - DNA, 22 bp, Artificial Sequence
  chemically synthesized
tttcacctggaatgctattctt

SEQ ID NO: 1205897 - DNA, 22 bp, Artificial Sequence
  chemically synthesized
cacctggaatgctattcttccc

SEQ ID NO: 1205898 - DNA, 22 bp, Artificial Sequence
  chemically synthesized
acctggaatgctattcttccct

SEQ ID NO: 1205899 - DNA, 22 bp, Artificial Sequence
  chemically synthesized
ataggtagaaatagggaagaat

SEQ ID NO: 1205900 - DNA, 22 bp, Artificial Sequence
  chemically synthesized
gataggtagaaatagggaagaa

SEQ ID NO: 1205901 - DNA, 22 bp, Artificial Sequence
  chemically synthesized
gaatgctattcttccctatttc

SEQ ID NO: 1205902 - DNA, 22 bp, Artificial Sequence
  chemically synthesized
ttcttccctatttctacctatc

SEQ ID NO: 1205903 - DNA, 22 bp, Artificial Sequence
  chemically synthesized
gagaaaggccttgataggtaga

SEQ ID NO: 1205904 - DNA, 22 bp, Artificial Sequence
  chemically synthesized
agagaaaggccttgataggtag

SEQ ID NO: 1205905 - DNA, 22 bp, Artificial Sequence
  chemically synthesized
tagagaaaggccttgataggta

SEQ ID NO: 1205906 - DNA, 22 bp, Artificial Sequence
  chemically synthesized
ttccctatttctacctatcaag

SEQ ID NO: 1205907 - DNA, 22 bp, Artificial Sequence
  chemically synthesized
ccctatttctacctatcaaggc

SEQ ID NO: 1205908 - DNA, 22 bp, Artificial Sequence
  chemically synthesized
cctatttctacctatcaaggcc

SEQ ID NO: 1205909 - DNA, 22 bp, Artificial Sequence
  chemically synthesized
tattttagagaaaggccttgat

SEQ ID NO: 1205910 - DNA, 22 bp, Artificial Sequence
  chemically synthesized
tttctacctatcaaggcctttc

SEQ ID NO: 1205911 - DNA, 22 bp, Artificial Sequence
  chemically synthesized
ggctatattttagagaaaggcc

SEQ ID NO: 1205912 - DNA, 22 bp, Artificial Sequence
  chemically synthesized
ctacctatcaaggcctttctct

SEQ ID NO: 1205913 - DNA, 22 bp, Artificial Sequence
  chemically synthesized
gggctatattttagagaaaggc

SEQ ID NO: 1205914 - DNA, 22 bp, Artificial Sequence
  chemically synthesized
tacctatcaaggcctttctcta

SEQ ID NO: 1205915 - DNA, 22 bp, Artificial Sequence
  chemically synthesized
cctatcaaggcctttctctaaa

SEQ ID NO: 1205916 - DNA, 22 bp, Artificial Sequence
  chemically synthesized
tcaaggcctttctctaaaatat

SEQ ID NO: 1205917 - DNA, 22 bp, Artificial Sequence
  chemically synthesized
tctctaaaatatagcccaaatg

SEQ ID NO: 1205918 - DNA, 22 bp, Artificial Sequence
  chemically synthesized
ctctaaaatatagcccaaatgt

SEQ ID NO: 1205919 - DNA, 22 bp, Artificial Sequence
  chemically synthesized
tctaaaatatagcccaaatgta

SEQ ID NO: 1205920 - DNA, 22 bp, Artificial Sequence
  chemically synthesized
taaaatatagcccaaatgtact

SEQ ID NO: 1205921 - DNA, 22 bp, Artificial Sequence
  chemically synthesized
aaatatagcccaaatgtactct

SEQ ID NO: 1205922 - DNA, 22 bp, Artificial Sequence
  chemically synthesized
agagagagagagaaataatgcc

SEQ ID NO: 1205923 - DNA, 22 bp, Artificial Sequence
  chemically synthesized
gagagagagagagaaataatgc

SEQ ID NO: 1205924 - DNA, 22 bp, Artificial Sequence
  chemically synthesized
tccgggcattatttctctctct

SEQ ID NO: 1205925 - DNA, 22 bp, Artificial Sequence
  chemically synthesized
cgggcattatttctctctctct

SEQ ID NO: 1205926 - DNA, 22 bp, Artificial Sequence
  chemically synthesized
caatcacttgagagagagagag

SEQ ID NO: 1205927 - DNA, 22 bp, Artificial Sequence
  chemically synthesized
tttctctctctctctcaagtga

SEQ ID NO: 1205928 - DNA, 22 bp, Artificial Sequence
  chemically synthesized
ctctctctctctcaagtgattg

SEQ ID NO: 1205929 - DNA, 22 bp, Artificial Sequence
  chemically synthesized
tctctctctctcaagtgattgc

SEQ ID NO: 1205930 - DNA, 22 bp, Artificial Sequence
  chemically synthesized
tctctctctcaagtgattgcaa

SEQ ID NO: 1205931 - DNA, 22 bp, Artificial Sequence
  chemically synthesized
aaataaaaaggcattgcaatca

SEQ ID NO: 1205932 - DNA, 22 bp, Artificial Sequence
  chemically synthesized
tctctctcaagtgattgcaatg

SEQ ID NO: 1205933 - DNA, 22 bp, Artificial Sequence
  chemically synthesized
tctctcaagtgattgcaatgcc

SEQ ID NO: 1205934 - DNA, 22 bp, Artificial Sequence
  chemically synthesized
tctcaagtgattgcaatgcctt

SEQ ID NO: 1205935 - DNA, 22 bp, Artificial Sequence
  chemically synthesized
tcaagtgattgcaatgcctttt

SEQ ID NO: 1205936 - DNA, 22 bp, Artificial Sequence
  chemically synthesized
aagtgattgcaatgccttttta

SEQ ID NO: 1205937 - DNA, 22 bp, Artificial Sequence
  chemically synthesized
caatgcctttttatttgaactc

SEQ ID NO: 1205938 - DNA, 22 bp, Artificial Sequence
  chemically synthesized
agtgtagtccaaagagttcaaa

SEQ ID NO: 1205939 - DNA, 22 bp, Artificial Sequence
  chemically synthesized
aagtgtagtccaaagagttcaa

SEQ ID NO: 1205940 - DNA, 22 bp, Artificial Sequence
  chemically synthesized
tttatttgaactctttggacta

SEQ ID NO: 1205941 - DNA, 22 bp, Artificial Sequence
  chemically synthesized
ttatttgaactctttggactac

SEQ ID NO: 1205942 - DNA, 22 bp, Artificial Sequence
  chemically synthesized
tatttgaactctttggactaca

SEQ ID NO: 1205943 - DNA, 22 bp, Artificial Sequence
  chemically synthesized
ataacatttaagtgtagtccaa

SEQ ID NO: 1205944 - DNA, 22 bp, Artificial Sequence
  chemically synthesized
atttgaactctttggactacac

SEQ ID NO: 1205945 - DNA, 22 bp, Artificial Sequence
  chemically synthesized
tttgaactctttggactacact

SEQ ID NO: 1205946 - DNA, 22 bp, Artificial Sequence
  chemically synthesized
gaactctttggactacacttaa

SEQ ID NO: 1205947 - DNA, 22 bp, Artificial Sequence
  chemically synthesized
aactctttggactacacttaaa

SEQ ID NO: 1205948 - DNA, 22 bp, Artificial Sequence
  chemically synthesized
tttggactacacttaaatgtta

SEQ ID NO: 1205949 - DNA, 22 bp, Artificial Sequence
  chemically synthesized
gacatgagttgataacatttaa

SEQ ID NO: 1205950 - DNA, 22 bp, Artificial Sequence
  chemically synthesized
ggacatgagttgataacattta

SEQ ID NO: 1205951 - DNA, 22 bp, Artificial Sequence
  chemically synthesized
tggactacacttaaatgttatc

SEQ ID NO: 1205952 - DNA, 22 bp, Artificial Sequence
  chemically synthesized
ggactacacttaaatgttatca

SEQ ID NO: 1205953 - DNA, 22 bp, Artificial Sequence
  chemically synthesized
gactacacttaaatgttatcaa

SEQ ID NO: 1205954 - DNA, 22 bp, Artificial Sequence
  chemically synthesized
cacttaaatgttatcaactcat

SEQ ID NO: 1205955 - DNA, 22 bp, Artificial Sequence
  chemically synthesized
taaacatcttggacatgagttg

SEQ ID NO: 1205956 - DNA, 22 bp, Artificial Sequence
  chemically synthesized
gtaaacatcttggacatgagtt

SEQ ID NO: 1205957 - DNA, 22 bp, Artificial Sequence
  chemically synthesized
aaatgttatcaactcatgtcca

SEQ ID NO: 1205958 - DNA, 22 bp, Artificial Sequence
  chemically synthesized
aatgttatcaactcatgtccaa

SEQ ID NO: 1205959 - DNA, 22 bp, Artificial Sequence
  chemically synthesized
tcaactcatgtccaagatgttt

SEQ ID NO: 1205960 - DNA, 22 bp, Artificial Sequence
  chemically synthesized
atgtccaagatgtttacaagtg

SEQ ID NO: 1205961 - DNA, 22 bp, Artificial Sequence
  chemically synthesized
aagtcacaggaacaaatgacac

SEQ ID NO: 1205962 - DNA, 22 bp, Artificial Sequence
  chemically synthesized
ttaaagtcacaggaacaaatga

SEQ ID NO: 1205963 - DNA, 22 bp, Artificial Sequence
  chemically synthesized
acaagtgtcatttgttcctgtg

SEQ ID NO: 1205964 - DNA, 22 bp, Artificial Sequence
  chemically synthesized
caagtgtcatttgttcctgtga

SEQ ID NO: 1205965 - DNA, 22 bp, Artificial Sequence
  chemically synthesized
gttcctgtgactttaataatgt

SEQ ID NO: 1205966 - DNA, 22 bp, Artificial Sequence
  chemically synthesized
ttcctgtgactttaataatgtt

SEQ ID NO: 1205967 - DNA, 22 bp, Artificial Sequence
  chemically synthesized
caaaaaaaggagacaacattat

SEQ ID NO: 1205968 - DNA, 22 bp, Artificial Sequence
  chemically synthesized
ctgtgactttaataatgttgtc

SEQ ID NO: 1205969 - DNA, 22 bp, Artificial Sequence
  chemically synthesized
tgactttaataatgttgtctcc

SEQ ID NO: 1205970 - DNA, 22 bp, Artificial Sequence
  chemically synthesized
taataatgttgtctcctttttt

SEQ ID NO: 1205971 - DNA, 22 bp, Artificial Sequence
  chemically synthesized
aataatgttgtctccttttttt

SEQ ID NO: 1205972 - DNA, 22 bp, Artificial Sequence
  chemically synthesized
aatagacgctgcaaaaaaagga

SEQ ID NO: 1205973 - DNA, 22 bp, Artificial Sequence
  chemically synthesized
ataatgttgtctcctttttttg

SEQ ID NO: 1205974 - DNA, 22 bp, Artificial Sequence
  chemically synthesized
tctcctttttttgcagcgtcta

SEQ ID NO: 1205975 - DNA, 22 bp, Artificial Sequence
  chemically synthesized
ctttttttgcagcgtctattta

SEQ ID NO: 1205976 - DNA, 22 bp, Artificial Sequence
  chemically synthesized
tttttgcagcgtctatttaatt

SEQ ID NO: 1205977 - DNA, 22 bp, Artificial Sequence
  chemically synthesized
ttttgcagcgtctatttaattt

SEQ ID NO: 1205978 - DNA, 22 bp, Artificial Sequence
  chemically synthesized
tggtaagagataaaattaaata

SEQ ID NO: 1205979 - DNA, 22 bp, Artificial Sequence
  chemically synthesized
tttgcagcgtctatttaatttt

SEQ ID NO: 1205980 - DNA, 22 bp, Artificial Sequence
  chemically synthesized
atggtaagagataaaattaaat

SEQ ID NO: 1205981 - DNA, 22 bp, Artificial Sequence
  chemically synthesized
ttgcagcgtctatttaatttta

SEQ ID NO: 1205982 - DNA, 22 bp, Artificial Sequence
  chemically synthesized
tgcagcgtctatttaattttat

SEQ ID NO: 1205983 - DNA, 22 bp, Artificial Sequence
  chemically synthesized
gcagcgtctatttaattttatc

SEQ ID NO: 1205984 - DNA, 22 bp, Artificial Sequence
  chemically synthesized
cagcgtctatttaattttatct

SEQ ID NO: 1205985 - DNA, 22 bp, Artificial Sequence
  chemically synthesized
tttaattttatctcttaccata

SEQ ID NO: 1205986 - DNA, 22 bp, Artificial Sequence
  chemically synthesized
aattttatctcttaccataaac

SEQ ID NO: 1205987 - DNA, 22 bp, Artificial Sequence
  chemically synthesized
attttatctcttaccataaacc

SEQ ID NO: 1205988 - DNA, 22 bp, Artificial Sequence
  chemically synthesized
gataggccaggtgggtttatgg

SEQ ID NO: 1205989 - DNA, 22 bp, Artificial Sequence
  chemically synthesized
tatctcttaccataaacccacc

SEQ ID NO: 1205990 - DNA, 22 bp, Artificial Sequence
  chemically synthesized
atctcttaccataaacccacct

SEQ ID NO: 1205991 - DNA, 22 bp, Artificial Sequence
  chemically synthesized
tctcttaccataaacccacctg

SEQ ID NO: 1205992 - DNA, 22 bp, Artificial Sequence
  chemically synthesized
ttaccataaacccacctggcct

SEQ ID NO: 1205993 - DNA, 22 bp, Artificial Sequence
  chemically synthesized
accataaacccacctggcctat

SEQ ID NO: 1205994 - DNA, 22 bp, Artificial Sequence
  chemically synthesized
ccataaacccacctggcctatc

SEQ ID NO: 1205995 - DNA, 22 bp, Artificial Sequence
  chemically synthesized
aagaaatccctggataggccag

SEQ ID NO: 1205996 - DNA, 22 bp, Artificial Sequence
  chemically synthesized
gaagaaatccctggataggcca

SEQ ID NO: 1205997 - DNA, 22 bp, Artificial Sequence
  chemically synthesized
ttgaagaaatccctggataggc

SEQ ID NO: 1205998 - DNA, 22 bp, Artificial Sequence
  chemically synthesized
cttgaagaaatccctggatagg

SEQ ID NO: 1205999 - DNA, 22 bp, Artificial Sequence
  chemically synthesized
tgcttcttgaagaaatccctgg

SEQ ID NO: 1206000 - DNA, 22 bp, Artificial Sequence
  chemically synthesized
gcctatccagggatttcttcaa

SEQ ID NO: 1206001 - DNA, 22 bp, Artificial Sequence
  chemically synthesized
tccagggatttcttcaagaagc

SEQ ID NO: 1206002 - DNA, 22 bp, Artificial Sequence
  chemically synthesized
cttcaagaagcacagctactgt

SEQ ID NO: 1206003 - DNA, 22 bp, Artificial Sequence
  chemically synthesized
ttcaagaagcacagctactgta

SEQ ID NO: 1206004 - DNA, 22 bp, Artificial Sequence
  chemically synthesized
caagaagcacagctactgtatg

SEQ ID NO: 1206005 - DNA, 22 bp, Artificial Sequence
  chemically synthesized
aagaagcacagctactgtatgg

SEQ ID NO: 1206006 - DNA, 22 bp, Artificial Sequence
  chemically synthesized
gtgtagaatgtgccatacagta

SEQ ID NO: 1206007 - DNA, 22 bp, Artificial Sequence
  chemically synthesized
agtgtagaatgtgccatacagt

SEQ ID NO: 1206008 - DNA, 22 bp, Artificial Sequence
  chemically synthesized
gggatttagtgtagaatgtgcc

SEQ ID NO: 1206009 - DNA, 22 bp, Artificial Sequence
  chemically synthesized
ctgtatggcacattctacacta

SEQ ID NO: 1206010 - DNA, 22 bp, Artificial Sequence
  chemically synthesized
tatactggggatttagtgtaga

SEQ ID NO: 1206011 - DNA, 22 bp, Artificial Sequence
  chemically synthesized
tatggcacattctacactaaat

SEQ ID NO: 1206012 - DNA, 22 bp, Artificial Sequence
  chemically synthesized
aatgagcagattatatactggg

SEQ ID NO: 1206013 - DNA, 22 bp, Artificial Sequence
  chemically synthesized
tacactaaatccccagtatata

SEQ ID NO: 1206014 - DNA, 22 bp, Artificial Sequence
  chemically synthesized
cactaaatccccagtatataat

SEQ ID NO: 1206015 - DNA, 22 bp, Artificial Sequence
  chemically synthesized
tcactaaatgagcagattatat

SEQ ID NO: 1206016 - DNA, 22 bp, Artificial Sequence
  chemically synthesized
atcactaaatgagcagattata

SEQ ID NO: 1206017 - DNA, 22 bp, Artificial Sequence
  chemically synthesized
aatccccagtatataatctgct

SEQ ID NO: 1206018 - DNA, 22 bp, Artificial Sequence
  chemically synthesized
tgaagagcatcaccgatttatc

SEQ ID NO: 1206019 - DNA, 22 bp, Artificial Sequence
  chemically synthesized
ctcatttagtgataaatcggtg

SEQ ID NO: 1206020 - DNA, 22 bp, Artificial Sequence
  chemically synthesized
ctgtgaagagcatcaccgattt

SEQ ID NO: 1206021 - DNA, 22 bp, Artificial Sequence
  chemically synthesized
atttagtgataaatcggtgatg

SEQ ID NO: 1206022 - DNA, 22 bp, Artificial Sequence
  chemically synthesized
agtgataaatcggtgatgctct

SEQ ID NO: 1206023 - DNA, 22 bp, Artificial Sequence
  chemically synthesized
agtctcctgtgaagagcatcac

SEQ ID NO: 1206024 - DNA, 22 bp, Artificial Sequence
  chemically synthesized
gtgataaatcggtgatgctctt

SEQ ID NO: 1206025 - DNA, 22 bp, Artificial Sequence
  chemically synthesized
cagtctcctgtgaagagcatca

SEQ ID NO: 1206026 - DNA, 22 bp, Artificial Sequence
  chemically synthesized
ttcagtctcctgtgaagagcat

SEQ ID NO: 1206027 - DNA, 22 bp, Artificial Sequence
  chemically synthesized
tcttcagtctcctgtgaagagc

SEQ ID NO: 1206028 - DNA, 22 bp, Artificial Sequence
  chemically synthesized
agtgtctctcttcagtctcctg

SEQ ID NO: 1206029 - DNA, 22 bp, Artificial Sequence
  chemically synthesized
tgagtgtctctcttcagtctcc

SEQ ID NO: 1206030 - DNA, 22 bp, Artificial Sequence
  chemically synthesized
ctgagtgtctctcttcagtctc

SEQ ID NO: 1206031 - DNA, 22 bp, Artificial Sequence
  chemically synthesized
ttcacaggagactgaagagaga

SEQ ID NO: 1206032 - DNA, 22 bp, Artificial Sequence
  chemically synthesized
agacttctgagtgtctctcttc

SEQ ID NO: 1206033 - DNA, 22 bp, Artificial Sequence
  chemically synthesized
cacaggagactgaagagagaca

SEQ ID NO: 1206034 - DNA, 22 bp, Artificial Sequence
  chemically synthesized
acaggagactgaagagagacac

SEQ ID NO: 1206035 - DNA, 22 bp, Artificial Sequence
  chemically synthesized
taagacttctgagtgtctctct

SEQ ID NO: 1206036 - DNA, 22 bp, Artificial Sequence
  chemically synthesized
aagagagacactcagaagtctt

SEQ ID NO: 1206037 - DNA, 22 bp, Artificial Sequence
  chemically synthesized
gaagcacacaattctaagactt

SEQ ID NO: 1206038 - DNA, 22 bp, Artificial Sequence
  chemically synthesized
tagaagcacacaattctaagac

SEQ ID NO: 1206039 - DNA, 22 bp, Artificial Sequence
  chemically synthesized
tattctagaagcacacaattct

SEQ ID NO: 1206040 - DNA, 22 bp, Artificial Sequence
  chemically synthesized
gtattctagaagcacacaattc

SEQ ID NO: 1206041 - DNA, 22 bp, Artificial Sequence
  chemically synthesized
tgtattctagaagcacacaatt

SEQ ID NO: 1206042 - DNA, 22 bp, Artificial Sequence
  chemically synthesized
agaagtcttagaattgtgtgct

SEQ ID NO: 1206043 - DNA, 22 bp, Artificial Sequence
  chemically synthesized
tttgtattctagaagcacacaa

SEQ ID NO: 1206044 - DNA, 22 bp, Artificial Sequence
  chemically synthesized
agaattgtgtgcttctagaata

SEQ ID NO: 1206045 - DNA, 22 bp, Artificial Sequence
  chemically synthesized
gaattgtgtgcttctagaatac

SEQ ID NO: 1206046 - DNA, 22 bp, Artificial Sequence
  chemically synthesized
tggaaattctttgtattctaga

SEQ ID NO: 1206047 - DNA, 22 bp, Artificial Sequence
  chemically synthesized
tgtgcttctagaatacaaagaa

SEQ ID NO: 1206048 - DNA, 22 bp, Artificial Sequence
  chemically synthesized
tgattgtggaaattctttgtat

SEQ ID NO: 1206049 - DNA, 22 bp, Artificial Sequence
  chemically synthesized
tatgattgtggaaattctttgt

SEQ ID NO: 1206050 - DNA, 22 bp, Artificial Sequence
  chemically synthesized
ctagaatacaaagaatttccac

SEQ ID NO: 1206051 - DNA, 22 bp, Artificial Sequence
  chemically synthesized
tagaatacaaagaatttccaca

SEQ ID NO: 1206052 - DNA, 22 bp, Artificial Sequence
  chemically synthesized
agactctatgattgtggaaatt

SEQ ID NO: 1206053 - DNA, 22 bp, Artificial Sequence
  chemically synthesized
gaatacaaagaatttccacaat

SEQ ID NO: 1206054 - DNA, 22 bp, Artificial Sequence
  chemically synthesized
aaagtcctcagactctatgatt

SEQ ID NO: 1206055 - DNA, 22 bp, Artificial Sequence
  chemically synthesized
ccacaatcatagagtctgagga

SEQ ID NO: 1206056 - DNA, 22 bp, Artificial Sequence
  chemically synthesized
cacaatcatagagtctgaggac

SEQ ID NO: 1206057 - DNA, 22 bp, Artificial Sequence
  chemically synthesized
tgaaaatagtaatgattaaaag

SEQ ID NO: 1206058 - DNA, 22 bp, Artificial Sequence
  chemically synthesized
aggacttttaatcattactatt

SEQ ID NO: 1206059 - DNA, 22 bp, Artificial Sequence
  chemically synthesized
caaaagctgtgaaaatagtaat

SEQ ID NO: 1206060 - DNA, 22 bp, Artificial Sequence
  chemically synthesized
ctccaaaagctgtgaaaatagt

SEQ ID NO: 1206061 - DNA, 22 bp, Artificial Sequence
  chemically synthesized
ttaatcattactattttcacag

SEQ ID NO: 1206062 - DNA, 22 bp, Artificial Sequence
  chemically synthesized
taatcattactattttcacagc

SEQ ID NO: 1206063 - DNA, 22 bp, Artificial Sequence
  chemically synthesized
tctactccaaaagctgtgaaaa

SEQ ID NO: 1206064 - DNA, 22 bp, Artificial Sequence
  chemically synthesized
aatcattactattttcacagct

SEQ ID NO: 1206065 - DNA, 22 bp, Artificial Sequence
  chemically synthesized
atcattactattttcacagctt

SEQ ID NO: 1206066 - DNA, 22 bp, Artificial Sequence
  chemically synthesized
agtctgtctactccaaaagctg

SEQ ID NO: 1206067 - DNA, 22 bp, Artificial Sequence
  chemically synthesized
ctattttcacagcttttggagt

SEQ ID NO: 1206068 - DNA, 22 bp, Artificial Sequence
  chemically synthesized
ttttcacagcttttggagtaga

SEQ ID NO: 1206069 - DNA, 22 bp, Artificial Sequence
  chemically synthesized
gggactgagtctgtctactcca

SEQ ID NO: 1206070 - DNA, 22 bp, Artificial Sequence
  chemically synthesized
tcacagcttttggagtagacag

SEQ ID NO: 1206071 - DNA, 22 bp, Artificial Sequence
  chemically synthesized
tggggactgagtctgtctactc

SEQ ID NO: 1206072 - DNA, 22 bp, Artificial Sequence
  chemically synthesized
cacagcttttggagtagacaga

SEQ ID NO: 1206073 - DNA, 22 bp, Artificial Sequence
  chemically synthesized
ctggggactgagtctgtctact

SEQ ID NO: 1206074 - DNA, 22 bp, Artificial Sequence
  chemically synthesized
acagcttttggagtagacagac

SEQ ID NO: 1206075 - DNA, 22 bp, Artificial Sequence
  chemically synthesized
tctggggactgagtctgtctac

SEQ ID NO: 1206076 - DNA, 22 bp, Artificial Sequence
  chemically synthesized
ttctggggactgagtctgtcta

SEQ ID NO: 1206077 - DNA, 22 bp, Artificial Sequence
  chemically synthesized
ttggagtagacagactcagtcc

SEQ ID NO: 1206078 - DNA, 22 bp, Artificial Sequence
  chemically synthesized
tggagtagacagactcagtccc

SEQ ID NO: 1206079 - DNA, 22 bp, Artificial Sequence
  chemically synthesized
gccatttttctggggactgagt

SEQ ID NO: 1206080 - DNA, 22 bp, Artificial Sequence
  chemically synthesized
ggagtagacagactcagtcccc

SEQ ID NO: 1206081 - DNA, 22 bp, Artificial Sequence
  chemically synthesized
gagtagacagactcagtcccca

SEQ ID NO: 1206082 - DNA, 22 bp, Artificial Sequence
  chemically synthesized
cattggccatttttctggggac

SEQ ID NO: 1206083 - DNA, 22 bp, Artificial Sequence
  chemically synthesized
agtccccagaaaaatggccaat

SEQ ID NO: 1206084 - DNA, 22 bp, Artificial Sequence
  chemically synthesized
tgtatgtgtgtgtataagttac

SEQ ID NO: 1206085 - DNA, 22 bp, Artificial Sequence
  chemically synthesized
atacacacacatacacaatgat

SEQ ID NO: 1206086 - DNA, 22 bp, Artificial Sequence
  chemically synthesized
tacacacacatacacaatgatg

SEQ ID NO: 1206087 - DNA, 22 bp, Artificial Sequence
  chemically synthesized
aagataatcatcatcatcattg

SEQ ID NO: 1206088 - DNA, 22 bp, Artificial Sequence
  chemically synthesized
aaagataatcatcatcatcatt

SEQ ID NO: 1206089 - DNA, 22 bp, Artificial Sequence
  chemically synthesized
tcacatttaaagataatcatca

SEQ ID NO: 1206090 - DNA, 22 bp, Artificial Sequence
  chemically synthesized
ggtggacctgtcacatttaaag

SEQ ID NO: 1206091 - DNA, 22 bp, Artificial Sequence
  chemically synthesized
ctgggtggacctgtcacattta

SEQ ID NO: 1206092 - DNA, 22 bp, Artificial Sequence
  chemically synthesized
tctttaaatgtgacaggtccac

SEQ ID NO: 1206093 - DNA, 22 bp, Artificial Sequence
  chemically synthesized
taaatgtgacaggtccacccag

SEQ ID NO: 1206094 - DNA, 22 bp, Artificial Sequence
  chemically synthesized
aaatgtgacaggtccacccagt

SEQ ID NO: 1206095 - DNA, 22 bp, Artificial Sequence
  chemically synthesized
aatgtgacaggtccacccagta

SEQ ID NO: 1206096 - DNA, 22 bp, Artificial Sequence
  chemically synthesized
cacatggaaatctactgggtgg

SEQ ID NO: 1206097 - DNA, 22 bp, Artificial Sequence
  chemically synthesized
attccacatggaaatctactgg

SEQ ID NO: 1206098 - DNA, 22 bp, Artificial Sequence
  chemically synthesized
gattccacatggaaatctactg

SEQ ID NO: 1206099 - DNA, 22 bp, Artificial Sequence
  chemically synthesized
tgattccacatggaaatctact

SEQ ID NO: 1206100 - DNA, 22 bp, Artificial Sequence
  chemically synthesized
actttgattccacatggaaatc

SEQ ID NO: 1206101 - DNA, 22 bp, Artificial Sequence
  chemically synthesized
tggcatctgactttgattccac

SEQ ID NO: 1206102 - DNA, 22 bp, Artificial Sequence
  chemically synthesized
atggcatctgactttgattcca

SEQ ID NO: 1206103 - DNA, 22 bp, Artificial Sequence
  chemically synthesized
ccatgtggaatcaaagtcagat

SEQ ID NO: 1206104 - DNA, 22 bp, Artificial Sequence
  chemically synthesized
catgtggaatcaaagtcagatg

SEQ ID NO: 1206105 - DNA, 22 bp, Artificial Sequence
  chemically synthesized
cagtcatttatggcatctgact

SEQ ID NO: 1206106 - DNA, 22 bp, Artificial Sequence
  chemically synthesized
ccactccagtcatttatggcat

SEQ ID NO: 1206107 - DNA, 22 bp, Artificial Sequence
  chemically synthesized
tgccactccagtcatttatggc

SEQ ID NO: 1206108 - DNA, 22 bp, Artificial Sequence
  chemically synthesized
acagactctgccactccagtca

SEQ ID NO: 1206109 - DNA, 22 bp, Artificial Sequence
  chemically synthesized
cactgacagactctgccactcc

SEQ ID NO: 1206110 - DNA, 22 bp, Artificial Sequence
  chemically synthesized
tgtaactccactgacagactct

SEQ ID NO: 1206111 - DNA, 22 bp, Artificial Sequence
  chemically synthesized
atgtaactccactgacagactc

SEQ ID NO: 1206112 - DNA, 22 bp, Artificial Sequence
  chemically synthesized
gagtggcagagtctgtcagtgg

SEQ ID NO: 1206113 - DNA, 22 bp, Artificial Sequence
  chemically synthesized
gccatacacacagtttatgtaa

SEQ ID NO: 1206114 - DNA, 22 bp, Artificial Sequence
  chemically synthesized
tcagtggagttacataaactgt

SEQ ID NO: 1206115 - DNA, 22 bp, Artificial Sequence
  chemically synthesized
cactcgccatacacacagttta

SEQ ID NO: 1206116 - DNA, 22 bp, Artificial Sequence
  chemically synthesized
gagctgcactcgccatacacac

SEQ ID NO: 1206117 - DNA, 22 bp, Artificial Sequence
  chemically synthesized
cataaactgtgtgtatggcgag

SEQ ID NO: 1206118 - DNA, 22 bp, Artificial Sequence
  chemically synthesized
agtctggagctgcactcgccat

SEQ ID NO: 1206119 - DNA, 22 bp, Artificial Sequence
  chemically synthesized
ttcagtctggagctgcactcgc

SEQ ID NO: 1206120 - DNA, 22 bp, Artificial Sequence
  chemically synthesized
ctgttcagtctggagctgcact

SEQ ID NO: 1206121 - DNA, 22 bp, Artificial Sequence
  chemically synthesized
tgtgtatggcgagtgcagctcc

SEQ ID NO: 1206122 - DNA, 22 bp, Artificial Sequence
  chemically synthesized
aaagcgggcacattactgttca

SEQ ID NO: 1206123 - DNA, 22 bp, Artificial Sequence
  chemically synthesized
cctcaaagcgggcacattactg

SEQ ID NO: 1206124 - DNA, 22 bp, Artificial Sequence
  chemically synthesized
cagactgaacagtaatgtgccc

SEQ ID NO: 1206125 - DNA, 22 bp, Artificial Sequence
  chemically synthesized
ctccctcaaagcgggcacatta

SEQ ID NO: 1206126 - DNA, 22 bp, Artificial Sequence
  chemically synthesized
tcctccctcaaagcgggcacat

SEQ ID NO: 1206127 - DNA, 22 bp, Artificial Sequence
  chemically synthesized
ctctcctccctcaaagcgggca

SEQ ID NO: 1206128 - DNA, 22 bp, Artificial Sequence
  chemically synthesized
aacagtaatgtgcccgctttga

SEQ ID NO: 1206129 - DNA, 22 bp, Artificial Sequence
  chemically synthesized
aggagtgctactctcctccctc

SEQ ID NO: 1206130 - DNA, 22 bp, Artificial Sequence
  chemically synthesized
gtagtactgaggagtgctactc

SEQ ID NO: 1206131 - DNA, 22 bp, Artificial Sequence
  chemically synthesized
tgagggaggagagtagcactcc

SEQ ID NO: 1206132 - DNA, 22 bp, Artificial Sequence
  chemically synthesized
gagggaggagagtagcactcct

SEQ ID NO: 1206133 - DNA, 22 bp, Artificial Sequence
  chemically synthesized
agggaggagagtagcactcctc

SEQ ID NO: 1206134 - DNA, 22 bp, Artificial Sequence
  chemically synthesized
caatggcaccatcctggtagta

SEQ ID NO: 1206135 - DNA, 22 bp, Artificial Sequence
  chemically synthesized
tgcaatggcaccatcctggtag

SEQ ID NO: 1206136 - DNA, 22 bp, Artificial Sequence
  chemically synthesized
ctcagtactaccaggatggtgc

SEQ ID NO: 1206137 - DNA, 22 bp, Artificial Sequence
  chemically synthesized
agtactaccaggatggtgccat

SEQ ID NO: 1206138 - DNA, 22 bp, Artificial Sequence
  chemically synthesized
gggcaacattctgcaatggcac

SEQ ID NO: 1206139 - DNA, 22 bp, Artificial Sequence
  chemically synthesized
tggggcaacattctgcaatggc

SEQ ID NO: 1206140 - DNA, 22 bp, Artificial Sequence
  chemically synthesized
ccaggatggtgccattgcagaa

SEQ ID NO: 1206141 - DNA, 22 bp, Artificial Sequence
  chemically synthesized
gcagctctggggcaacattctg

SEQ ID NO: 1206142 - DNA, 22 bp, Artificial Sequence
  chemically synthesized
gcagatctagcagctctggggc

SEQ ID NO: 1206143 - DNA, 22 bp, Artificial Sequence
  chemically synthesized
cagaatgttgccccagagctgc

SEQ ID NO: 1206144 - DNA, 22 bp, Artificial Sequence
  chemically synthesized
ttagcagatctagcagctctgg

SEQ ID NO: 1206145 - DNA, 22 bp, Artificial Sequence
  chemically synthesized
tgttagcagatctagcagctct

SEQ ID NO: 1206146 - DNA, 22 bp, Artificial Sequence
  chemically synthesized
ctgttagcagatctagcagctc

SEQ ID NO: 1206147 - DNA, 22 bp, Artificial Sequence
  chemically synthesized
ggtttctgttagcagatctagc

SEQ ID NO: 1206148 - DNA, 22 bp, Artificial Sequence
  chemically synthesized
gggtttctgttagcagatctag

SEQ ID NO: 1206149 - DNA, 22 bp, Artificial Sequence
  chemically synthesized
ccccagagctgctagatctgct

SEQ ID NO: 1206150 - DNA, 22 bp, Artificial Sequence
  chemically synthesized
cagatttgggtttctgttagca

SEQ ID NO: 1206151 - DNA, 22 bp, Artificial Sequence
  chemically synthesized
ctacagatttgggtttctgtta

SEQ ID NO: 1206152 - DNA, 22 bp, Artificial Sequence
  chemically synthesized
actacagatttgggtttctgtt

SEQ ID NO: 1206153 - DNA, 22 bp, Artificial Sequence
  chemically synthesized
ctagatctgctaacagaaaccc

SEQ ID NO: 1206154 - DNA, 22 bp, Artificial Sequence
  chemically synthesized
gatctgctaacagaaacccaaa

SEQ ID NO: 1206155 - DNA, 22 bp, Artificial Sequence
  chemically synthesized
caccttactacagatttgggtt

SEQ ID NO: 1206156 - DNA, 22 bp, Artificial Sequence
  chemically synthesized
ctaacagaaacccaaatctgta

SEQ ID NO: 1206157 - DNA, 22 bp, Artificial Sequence
  chemically synthesized
atctacaccttactacagattt

SEQ ID NO: 1206158 - DNA, 22 bp, Artificial Sequence
  chemically synthesized
gatctacaccttactacagatt

SEQ ID NO: 1206159 - DNA, 22 bp, Artificial Sequence
  chemically synthesized
acagaaacccaaatctgtagta

SEQ ID NO: 1206160 - DNA, 22 bp, Artificial Sequence
  chemically synthesized
tttgatctacaccttactacag

SEQ ID NO: 1206161 - DNA, 22 bp, Artificial Sequence
  chemically synthesized
gtttgatctacaccttactaca

SEQ ID NO: 1206162 - DNA, 22 bp, Artificial Sequence
  chemically synthesized
tgtttgatctacaccttactac

SEQ ID NO: 1206163 - DNA, 22 bp, Artificial Sequence
  chemically synthesized
tagtaaggtgtagatcaaacaa

SEQ ID NO: 1206164 - DNA, 22 bp, Artificial Sequence
  chemically synthesized
gaaggaacccagagatatgttt

SEQ ID NO: 1206165 - DNA, 22 bp, Artificial Sequence
  chemically synthesized
atggaaagtctggaaggaaccc

SEQ ID NO: 1206166 - DNA, 22 bp, Artificial Sequence
  chemically synthesized
ttaatggaaagtctggaaggaa

SEQ ID NO: 1206167 - DNA, 22 bp, Artificial Sequence
  chemically synthesized
taaactgttaatggaaagtctg

SEQ ID NO: 1206168 - DNA, 22 bp, Artificial Sequence
  chemically synthesized
tgggttccttccagactttcca

SEQ ID NO: 1206169 - DNA, 22 bp, Artificial Sequence
  chemically synthesized
ggttccttccagactttccatt

SEQ ID NO: 1206170 - DNA, 22 bp, Artificial Sequence
  chemically synthesized
cttccagactttccattaacag

SEQ ID NO: 1206171 - DNA, 22 bp, Artificial Sequence
  chemically synthesized
ccagactttccattaacagttt

SEQ ID NO: 1206172 - DNA, 22 bp, Artificial Sequence
  chemically synthesized
agaagacgttataaactgttaa

SEQ ID NO: 1206173 - DNA, 22 bp, Artificial Sequence
  chemically synthesized
cagactttccattaacagttta

SEQ ID NO: 1206174 - DNA, 22 bp, Artificial Sequence
  chemically synthesized
tccattaacagtttataacgtc

SEQ ID NO: 1206175 - DNA, 22 bp, Artificial Sequence
  chemically synthesized
ccattaacagtttataacgtct

SEQ ID NO: 1206176 - DNA, 22 bp, Artificial Sequence
  chemically synthesized
cattaacagtttataacgtctt

SEQ ID NO: 1206177 - DNA, 22 bp, Artificial Sequence
  chemically synthesized
acagtttataacgtcttctgaa

SEQ ID NO: 1206178 - DNA, 22 bp, Artificial Sequence
  chemically synthesized
agtatgtgaacagatagttcag

SEQ ID NO: 1206179 - DNA, 22 bp, Artificial Sequence
  chemically synthesized
aagtatgtgaacagatagttca

SEQ ID NO: 1206180 - DNA, 22 bp, Artificial Sequence
  chemically synthesized
ataacgtcttctgaactatctg

SEQ ID NO: 1206181 - DNA, 22 bp, Artificial Sequence
  chemically synthesized
taacgtcttctgaactatctgt

SEQ ID NO: 1206182 - DNA, 22 bp, Artificial Sequence
  chemically synthesized
aggtttaagtatgtgaacagat

SEQ ID NO: 1206183 - DNA, 22 bp, Artificial Sequence
  chemically synthesized
ctgaactatctgttcacatact

SEQ ID NO: 1206184 - DNA, 22 bp, Artificial Sequence
  chemically synthesized
tgaactatctgttcacatactt

SEQ ID NO: 1206185 - DNA, 22 bp, Artificial Sequence
  chemically synthesized
aactatctgttcacatacttaa

SEQ ID NO: 1206186 - DNA, 22 bp, Artificial Sequence
  chemically synthesized
tctgttcacatacttaaacctg

SEQ ID NO: 1206187 - DNA, 22 bp, Artificial Sequence
  chemically synthesized
ttcacatacttaaacctgagtc

SEQ ID NO: 1206188 - DNA, 22 bp, Artificial Sequence
  chemically synthesized
acatacttaaacctgagtcctc

SEQ ID NO: 1206189 - DNA, 22 bp, Artificial Sequence
  chemically synthesized
aaacctgagtcctcgggctggg

SEQ ID NO: 1206190 - DNA, 22 bp, Artificial Sequence
  chemically synthesized
aacctgagtcctcgggctgggc

SEQ ID NO: 1206191 - DNA, 22 bp, Artificial Sequence
  chemically synthesized
agtcctcgggctgggcatggtg

SEQ ID NO: 1206192 - DNA, 22 bp, Artificial Sequence
  chemically synthesized
ggataacaagcatgagccacca

SEQ ID NO: 1206193 - DNA, 22 bp, Artificial Sequence
  chemically synthesized
gggctgggcatggtggctcatg

SEQ ID NO: 1206194 - DNA, 22 bp, Artificial Sequence
  chemically synthesized
ggcatggtggctcatgcttgtt

SEQ ID NO: 1206195 - DNA, 22 bp, Artificial Sequence
  chemically synthesized
ccaaagtgctgggataacaagc

SEQ ID NO: 1206196 - DNA, 22 bp, Artificial Sequence
  chemically synthesized
ggcctcccaaagtgctgggata

SEQ ID NO: 1206197 - DNA, 22 bp, Artificial Sequence
  chemically synthesized
atgcttgttatcccagcacttt

SEQ ID NO: 1206198 - DNA, 22 bp, Artificial Sequence
  chemically synthesized
cccatctcggcctcccaaagtg

SEQ ID NO: 1206199 - DNA, 22 bp, Artificial Sequence
  chemically synthesized
gttatcccagcactttgggagg

SEQ ID NO: 1206200 - DNA, 22 bp, Artificial Sequence
  chemically synthesized
ttatcccagcactttgggaggc

SEQ ID NO: 1206201 - DNA, 22 bp, Artificial Sequence
  chemically synthesized
tcccagcactttgggaggccga

SEQ ID NO: 1206202 - DNA, 22 bp, Artificial Sequence
  chemically synthesized
tgatctgcccatctcggcctcc

SEQ ID NO: 1206203 - DNA, 22 bp, Artificial Sequence
  chemically synthesized
gtgatctgcccatctcggcctc

SEQ ID NO: 1206204 - DNA, 22 bp, Artificial Sequence
  chemically synthesized
ccttgtgatctgcccatctcgg

SEQ ID NO: 1206205 - DNA, 22 bp, Artificial Sequence
  chemically synthesized
accttgtgatctgcccatctcg

SEQ ID NO: 1206206 - DNA, 22 bp, Artificial Sequence
  chemically synthesized
cttaccttgtgatctgcccatc

SEQ ID NO: 1206207 - DNA, 22 bp, Artificial Sequence
  chemically synthesized
tgggaggccgagatgggcagat

SEQ ID NO: 1206208 - DNA, 22 bp, Artificial Sequence
  chemically synthesized
gggaggccgagatgggcagatc

SEQ ID NO: 1206209 - DNA, 22 bp, Artificial Sequence
  chemically synthesized
ggaggccgagatgggcagatca

SEQ ID NO: 1206210 - DNA, 22 bp, Artificial Sequence
  chemically synthesized
gatctccttaccttgtgatctg

SEQ ID NO: 1206211 - DNA, 22 bp, Artificial Sequence
  chemically synthesized
gccagaatggtctcgatctcct

SEQ ID NO: 1206212 - DNA, 22 bp, Artificial Sequence
  chemically synthesized
tgttagccagaatggtctcgat

SEQ ID NO: 1206213 - DNA, 22 bp, Artificial Sequence
  chemically synthesized
actgtgttagccagaatggtct

SEQ ID NO: 1206214 - DNA, 22 bp, Artificial Sequence
  chemically synthesized
cactgtgttagccagaatggtc

SEQ ID NO: 1206215 - DNA, 22 bp, Artificial Sequence
  chemically synthesized
ggtttcactgtgttagccagaa

SEQ ID NO: 1206216 - DNA, 22 bp, Artificial Sequence
  chemically synthesized
gtagagactgggtttcactgtg

SEQ ID NO: 1206217 - DNA, 22 bp, Artificial Sequence
  chemically synthesized
agtagagactgggtttcactgt

SEQ ID NO: 1206218 - DNA, 22 bp, Artificial Sequence
  chemically synthesized
tagtagagactgggtttcactg

SEQ ID NO: 1206219 - DNA, 22 bp, Artificial Sequence
  chemically synthesized
ttagtagagactgggtttcact

SEQ ID NO: 1206220 - DNA, 22 bp, Artificial Sequence
  chemically synthesized
tggctaacacagtgaaacccag

SEQ ID NO: 1206221 - DNA, 22 bp, Artificial Sequence
  chemically synthesized
gctaacacagtgaaacccagtc

SEQ ID NO: 1206222 - DNA, 22 bp, Artificial Sequence
  chemically synthesized
tgtttttagtagagactgggtt

SEQ ID NO: 1206223 - DNA, 22 bp, Artificial Sequence
  chemically synthesized
gtgtttttagtagagactgggt

SEQ ID NO: 1206224 - DNA, 22 bp, Artificial Sequence
  chemically synthesized
tgtgtttttagtagagactggg

SEQ ID NO: 1206225 - DNA, 22 bp, Artificial Sequence
  chemically synthesized
acacagtgaaacccagtctcta

SEQ ID NO: 1206226 - DNA, 22 bp, Artificial Sequence
  chemically synthesized
ttgtgtttttagtagagactgg

SEQ ID NO: 1206227 - DNA, 22 bp, Artificial Sequence
  chemically synthesized
tttgtgtttttagtagagactg

SEQ ID NO: 1206228 - DNA, 22 bp, Artificial Sequence
  chemically synthesized
attttttgtgtttttagtagag

SEQ ID NO: 1206229 - DNA, 22 bp, Artificial Sequence
  chemically synthesized
gctaattttttgtgtttttagt

SEQ ID NO: 1206230 - DNA, 22 bp, Artificial Sequence
  chemically synthesized
tgcctggctaattttttgtgtt

SEQ ID NO: 1206231 - DNA, 22 bp, Artificial Sequence
  chemically synthesized
tactaaaaacacaaaaaattag

SEQ ID NO: 1206232 - DNA, 22 bp, Artificial Sequence
  chemically synthesized
ctaaaaacacaaaaaattagcc

SEQ ID NO: 1206233 - DNA, 22 bp, Artificial Sequence
  chemically synthesized
aaaacacaaaaaattagccagg

SEQ ID NO: 1206234 - DNA, 22 bp, Artificial Sequence
  chemically synthesized
caggcgcgtgcaactatgcctg

SEQ ID NO: 1206235 - DNA, 22 bp, Artificial Sequence
  chemically synthesized
ggattacaggcgcgtgcaacta

SEQ ID NO: 1206236 - DNA, 22 bp, Artificial Sequence
  chemically synthesized
gccaggcatagttgcacgcgcc

SEQ ID NO: 1206237 - DNA, 22 bp, Artificial Sequence
  chemically synthesized
ccgagtagctgggattacaggc

SEQ ID NO: 1206238 - DNA, 22 bp, Artificial Sequence
  chemically synthesized
agcctcccgagtagctgggatt

SEQ ID NO: 1206239 - DNA, 22 bp, Artificial Sequence
  chemically synthesized
cacgcgcctgtaatcccagcta

SEQ ID NO: 1206240 - DNA, 22 bp, Artificial Sequence
  chemically synthesized
tctcagcctcccgagtagctgg

SEQ ID NO: 1206241 - DNA, 22 bp, Artificial Sequence
  chemically synthesized
ctgtctcagcctcccgagtagc

SEQ ID NO: 1206242 - DNA, 22 bp, Artificial Sequence
  chemically synthesized
ctcctgtctcagcctcccgagt

SEQ ID NO: 1206243 - DNA, 22 bp, Artificial Sequence
  chemically synthesized
taatcccagctactcgggaggc

SEQ ID NO: 1206244 - DNA, 22 bp, Artificial Sequence
  chemically synthesized
aaatgattcctcctgtctcagc

SEQ ID NO: 1206245 - DNA, 22 bp, Artificial Sequence
  chemically synthesized
ctcgggaggctgagacaggagg

SEQ ID NO: 1206246 - DNA, 22 bp, Artificial Sequence
  chemically synthesized
ggttcaaatgattcctcctgtc

SEQ ID NO: 1206247 - DNA, 22 bp, Artificial Sequence
  chemically synthesized
gggaggctgagacaggaggaat

SEQ ID NO: 1206248 - DNA, 22 bp, Artificial Sequence
  chemically synthesized
ctaggttcaaatgattcctcct

SEQ ID NO: 1206249 - DNA, 22 bp, Artificial Sequence
  chemically synthesized
cctcctaggttcaaatgattcc

SEQ ID NO: 1206250 - DNA, 22 bp, Artificial Sequence
  chemically synthesized
tgcctcctaggttcaaatgatt

SEQ ID NO: 1206251 - DNA, 22 bp, Artificial Sequence
  chemically synthesized
agacaggaggaatcatttgaac

SEQ ID NO: 1206252 - DNA, 22 bp, Artificial Sequence
  chemically synthesized
caacctctgcctcctaggttca

SEQ ID NO: 1206253 - DNA, 22 bp, Artificial Sequence
  chemically synthesized
actgcaacctctgcctcctagg

SEQ ID NO: 1206254 - DNA, 22 bp, Artificial Sequence
  chemically synthesized
gcctcactgcaacctctgcctc

SEQ ID NO: 1206255 - DNA, 22 bp, Artificial Sequence
  chemically synthesized
gaacctaggaggcagaggttgc

SEQ ID NO: 1206256 - DNA, 22 bp, Artificial Sequence
  chemically synthesized
aacctaggaggcagaggttgca

SEQ ID NO: 1206257 - DNA, 22 bp, Artificial Sequence
  chemically synthesized
ggaggcagaggttgcagtgagg

SEQ ID NO: 1206258 - DNA, 22 bp, Artificial Sequence
  chemically synthesized
gagtgcagtggtacgatctggc

SEQ ID NO: 1206259 - DNA, 22 bp, Artificial Sequence
  chemically synthesized
cagtgaggccagatcgtaccac

SEQ ID NO: 1206260 - DNA, 22 bp, Artificial Sequence
  chemically synthesized
gactggagtgcagtggtacgat

SEQ ID NO: 1206261 - DNA, 22 bp, Artificial Sequence
  chemically synthesized
tcacctagactggagtgcagtg

SEQ ID NO: 1206262 - DNA, 22 bp, Artificial Sequence
  chemically synthesized
tgtcacctagactggagtgcag

SEQ ID NO: 1206263 - DNA, 22 bp, Artificial Sequence
  chemically synthesized
ctctgtcacctagactggagtg

SEQ ID NO: 1206264 - DNA, 22 bp, Artificial Sequence
  chemically synthesized
gctctgtcacctagactggagt

SEQ ID NO: 1206265 - DNA, 22 bp, Artificial Sequence
  chemically synthesized
cactccagtctaggtgacagag

SEQ ID NO: 1206266 - DNA, 22 bp, Artificial Sequence
  chemically synthesized
agacagagtcttgctctgtcac

SEQ ID NO: 1206267 - DNA, 22 bp, Artificial Sequence
  chemically synthesized
gagacagagtcttgctctgtca

SEQ ID NO: 1206268 - DNA, 22 bp, Artificial Sequence
  chemically synthesized
tgagacagagtcttgctctgtc

SEQ ID NO: 1206269 - DNA, 22 bp, Artificial Sequence
  chemically synthesized
ttgagacagagtcttgctctgt

SEQ ID NO: 1206270 - DNA, 22 bp, Artificial Sequence
  chemically synthesized
cagtctaggtgacagagcaaga

SEQ ID NO: 1206271 - DNA, 22 bp, Artificial Sequence
  chemically synthesized
tttgagacagagtcttgctctg

SEQ ID NO: 1206272 - DNA, 22 bp, Artificial Sequence
  chemically synthesized
ttttgagacagagtcttgctct

SEQ ID NO: 1206273 - DNA, 22 bp, Artificial Sequence
  chemically synthesized
tttttgagacagagtcttgctc

SEQ ID NO: 1206274 - DNA, 22 bp, Artificial Sequence
  chemically synthesized
tttttttgagacagagtcttgc

SEQ ID NO: 1206275 - DNA, 22 bp, Artificial Sequence
  chemically synthesized
ctttttttgagacagagtcttg

SEQ ID NO: 1206276 - DNA, 22 bp, Artificial Sequence
  chemically synthesized
tctttttttgagacagagtctt

SEQ ID NO: 1206277 - DNA, 22 bp, Artificial Sequence
  chemically synthesized
ggtgacagagcaagactctgtc

SEQ ID NO: 1206278 - DNA, 22 bp, Artificial Sequence
  chemically synthesized
ttctttttttgagacagagtct

SEQ ID NO: 1206279 - DNA, 22 bp, Artificial Sequence
  chemically synthesized
tttctttttttgagacagagtc

SEQ ID NO: 1206280 - DNA, 22 bp, Artificial Sequence
  chemically synthesized
ttttctttttttgagacagagt

SEQ ID NO: 1206281 - DNA, 22 bp, Artificial Sequence
  chemically synthesized
tttttctttttttgagacagag

SEQ ID NO: 1206282 - DNA, 22 bp, Artificial Sequence
  chemically synthesized
ttttttctttttttgagacaga

SEQ ID NO: 1206283 - DNA, 22 bp, Artificial Sequence
  chemically synthesized
tttttttctttttttgagacag

SEQ ID NO: 1206284 - DNA, 22 bp, Artificial Sequence
  chemically synthesized
tttttttttctttttttgagac

SEQ ID NO: 1206285 - DNA, 22 bp, Artificial Sequence
  chemically synthesized
ctttttttttctttttttgaga

SEQ ID NO: 1206286 - DNA, 22 bp, Artificial Sequence
  chemically synthesized
tctttttttttctttttttgag

SEQ ID NO: 1206287 - DNA, 22 bp, Artificial Sequence
  chemically synthesized
ttctttttttttctttttttga

SEQ ID NO: 1206288 - DNA, 22 bp, Artificial Sequence
  chemically synthesized
tttctttttttttctttttttg

SEQ ID NO: 1206289 - DNA, 22 bp, Artificial Sequence
  chemically synthesized
ttttctttttttttcttttttt

SEQ ID NO: 1206290 - DNA, 22 bp, Artificial Sequence
  chemically synthesized
tttttctttttttttctttttt

SEQ ID NO: 1206291 - DNA, 22 bp, Artificial Sequence
  chemically synthesized
ttttttctttttttttcttttt

SEQ ID NO: 1206292 - DNA, 22 bp, Artificial Sequence
  chemically synthesized
tttttttctttttttttctttt

SEQ ID NO: 1206293 - DNA, 22 bp, Artificial Sequence
  chemically synthesized
tgtctcaaaaaaagaaaaaaaa

SEQ ID NO: 1206294 - DNA, 22 bp, Artificial Sequence
  chemically synthesized
attttttttttctttttttttc

SEQ ID NO: 1206295 - DNA, 22 bp, Artificial Sequence
  chemically synthesized
tctcaaaaaaagaaaaaaaaag

SEQ ID NO: 1206296 - DNA, 22 bp, Artificial Sequence
  chemically synthesized
gattttttttttcttttttttt

SEQ ID NO: 1206297 - DNA, 22 bp, Artificial Sequence
  chemically synthesized
tgattttttttttctttttttt

SEQ ID NO: 1206298 - DNA, 22 bp, Artificial Sequence
  chemically synthesized
ttgattttttttttcttttttt

SEQ ID NO: 1206299 - DNA, 22 bp, Artificial Sequence
  chemically synthesized
tttgattttttttttctttttt

SEQ ID NO: 1206300 - DNA, 22 bp, Artificial Sequence
  chemically synthesized
aaaaaaagaaaaaaaaagaaaa

SEQ ID NO: 1206301 - DNA, 22 bp, Artificial Sequence
  chemically synthesized
ttttgattttttttttcttttt

SEQ ID NO: 1206302 - DNA, 22 bp, Artificial Sequence
  chemically synthesized
tttttgattttttttttctttt

SEQ ID NO: 1206303 - DNA, 22 bp, Artificial Sequence
  chemically synthesized
ttttttttgattttttttttct

SEQ ID NO: 1206304 - DNA, 22 bp, Artificial Sequence
  chemically synthesized
gttttttttgattttttttttc

SEQ ID NO: 1206305 - DNA, 22 bp, Artificial Sequence
  chemically synthesized
tgttttttttgatttttttttt

SEQ ID NO: 1206306 - DNA, 22 bp, Artificial Sequence
  chemically synthesized
ttgttttttttgattttttttt

SEQ ID NO: 1206307 - DNA, 22 bp, Artificial Sequence
  chemically synthesized
tttgttttttttgatttttttt

SEQ ID NO: 1206308 - DNA, 22 bp, Artificial Sequence
  chemically synthesized
ttttgttttttttgattttttt

SEQ ID NO: 1206309 - DNA, 22 bp, Artificial Sequence
  chemically synthesized
agggtttttttgttttttttga

SEQ ID NO: 1206310 - DNA, 22 bp, Artificial Sequence
  chemically synthesized
gtcaggactcagggtttttttg

SEQ ID NO: 1206311 - DNA, 22 bp, Artificial Sequence
  chemically synthesized
caggagagctagtcaggactca

SEQ ID NO: 1206312 - DNA, 22 bp, Artificial Sequence
  chemically synthesized
ctgcaggagagctagtcaggac

SEQ ID NO: 1206313 - DNA, 22 bp, Artificial Sequence
  chemically synthesized
tcctgcaggagagctagtcagg

SEQ ID NO: 1206314 - DNA, 22 bp, Artificial Sequence
  chemically synthesized
agtcctgactagctctcctgca

SEQ ID NO: 1206315 - DNA, 22 bp, Artificial Sequence
  chemically synthesized
agtaacactctcctgcaggaga

SEQ ID NO: 1206316 - DNA, 22 bp, Artificial Sequence
  chemically synthesized
actcagtaacactctcctgcag

SEQ ID NO: 1206317 - DNA, 22 bp, Artificial Sequence
  chemically synthesized
aactcagtaacactctcctgca

SEQ ID NO: 1206318 - DNA, 22 bp, Artificial Sequence
  chemically synthesized
actagctctcctgcaggagagt

SEQ ID NO: 1206319 - DNA, 22 bp, Artificial Sequence
  chemically synthesized
cttaactcagtaacactctcct

SEQ ID NO: 1206320 - DNA, 22 bp, Artificial Sequence
  chemically synthesized
gctctcctgcaggagagtgtta

SEQ ID NO: 1206321 - DNA, 22 bp, Artificial Sequence
  chemically synthesized
attgcttaactcagtaacactc

SEQ ID NO: 1206322 - DNA, 22 bp, Artificial Sequence
  chemically synthesized
tcctgcaggagagtgttactga

SEQ ID NO: 1206323 - DNA, 22 bp, Artificial Sequence
  chemically synthesized
ctgattgcttaactcagtaaca

SEQ ID NO: 1206324 - DNA, 22 bp, Artificial Sequence
  chemically synthesized
ctgcaggagagtgttactgagt

SEQ ID NO: 1206325 - DNA, 22 bp, Artificial Sequence
  chemically synthesized
tcctgattgcttaactcagtaa

SEQ ID NO: 1206326 - DNA, 22 bp, Artificial Sequence
  chemically synthesized
ctcctgattgcttaactcagta

SEQ ID NO: 1206327 - DNA, 22 bp, Artificial Sequence
  chemically synthesized
caggagagtgttactgagttaa

SEQ ID NO: 1206328 - DNA, 22 bp, Artificial Sequence
  chemically synthesized
atttctcctgattgcttaactc

SEQ ID NO: 1206329 - DNA, 22 bp, Artificial Sequence
  chemically synthesized
catttctcctgattgcttaact

SEQ ID NO: 1206330 - DNA, 22 bp, Artificial Sequence
  chemically synthesized
ctgagttaagcaatcaggagaa

SEQ ID NO: 1206331 - DNA, 22 bp, Artificial Sequence
  chemically synthesized
atagagtttcatttctcctgat

SEQ ID NO: 1206332 - DNA, 22 bp, Artificial Sequence
  chemically synthesized
agttaagcaatcaggagaaatg

SEQ ID NO: 1206333 - DNA, 22 bp, Artificial Sequence
  chemically synthesized
agcaatcaggagaaatgaaact

SEQ ID NO: 1206334 - DNA, 22 bp, Artificial Sequence
  chemically synthesized
ataggtgaccatcggttgatag

SEQ ID NO: 1206335 - DNA, 22 bp, Artificial Sequence
  chemically synthesized
ttaataggtgaccatcggttga

SEQ ID NO: 1206336 - DNA, 22 bp, Artificial Sequence
  chemically synthesized
gttaataggtgaccatcggttg

SEQ ID NO: 1206337 - DNA, 22 bp, Artificial Sequence
  chemically synthesized
tttgttaataggtgaccatcgg

SEQ ID NO: 1206338 - DNA, 22 bp, Artificial Sequence
  chemically synthesized
atttgttaataggtgaccatcg

SEQ ID NO: 1206339 - DNA, 22 bp, Artificial Sequence
  chemically synthesized
tatcaaccgatggtcacctatt

SEQ ID NO: 1206340 - DNA, 22 bp, Artificial Sequence
  chemically synthesized
tcaaccgatggtcacctattaa

SEQ ID NO: 1206341 - DNA, 22 bp, Artificial Sequence
  chemically synthesized
ttaacaaataagatggcatact

SEQ ID NO: 1206342 - DNA, 22 bp, Artificial Sequence
  chemically synthesized
acaaataagatggcatacttct

SEQ ID NO: 1206343 - DNA, 22 bp, Artificial Sequence
  chemically synthesized
ctgtactattgctattcattta

SEQ ID NO: 1206344 - DNA, 22 bp, Artificial Sequence
  chemically synthesized
tgtactattgctattcatttat

SEQ ID NO: 1206345 - DNA, 22 bp, Artificial Sequence
  chemically synthesized
tggaatggataaataaatgaat

SEQ ID NO: 1206346 - DNA, 22 bp, Artificial Sequence
  chemically synthesized
gtggaatggataaataaatgaa

SEQ ID NO: 1206347 - DNA, 22 bp, Artificial Sequence
  chemically synthesized
tactattgctattcatttattt

SEQ ID NO: 1206348 - DNA, 22 bp, Artificial Sequence
  chemically synthesized
ttgctattcatttatttatcca

SEQ ID NO: 1206349 - DNA, 22 bp, Artificial Sequence
  chemically synthesized
ctattcatttatttatccattc

SEQ ID NO: 1206350 - DNA, 22 bp, Artificial Sequence
  chemically synthesized
ttcatttatttatccattccac

SEQ ID NO: 1206351 - DNA, 22 bp, Artificial Sequence
  chemically synthesized
atttatttatccattccacaaa

SEQ ID NO: 1206352 - DNA, 22 bp, Artificial Sequence
  chemically synthesized
atttatccattccacaaacatt

SEQ ID NO: 1206353 - DNA, 22 bp, Artificial Sequence
  chemically synthesized
tttatccattccacaaacattt

SEQ ID NO: 1206354 - DNA, 22 bp, Artificial Sequence
  chemically synthesized
atccattccacaaacatttttc

SEQ ID NO: 1206355 - DNA, 22 bp, Artificial Sequence
  chemically synthesized
tccattccacaaacatttttca

SEQ ID NO: 1206356 - DNA, 22 bp, Artificial Sequence
  chemically synthesized
cacaaacatttttcacctacca

SEQ ID NO: 1206357 - DNA, 22 bp, Artificial Sequence
  chemically synthesized
ggagaatgccgaagagatggta

SEQ ID NO: 1206358 - DNA, 22 bp, Artificial Sequence
  chemically synthesized
ttcacctaccatctcttcggca

SEQ ID NO: 1206359 - DNA, 22 bp, Artificial Sequence
  chemically synthesized
tcacctaccatctcttcggcat

SEQ ID NO: 1206360 - DNA, 22 bp, Artificial Sequence
  chemically synthesized
cacctaccatctcttcggcatt

SEQ ID NO: 1206361 - DNA, 22 bp, Artificial Sequence
  chemically synthesized
acctaccatctcttcggcattc

SEQ ID NO: 1206362 - DNA, 22 bp, Artificial Sequence
  chemically synthesized
ccatctcttcggcattctccta

SEQ ID NO: 1206363 - DNA, 22 bp, Artificial Sequence
  chemically synthesized
tatagccagtagctaggagaat

SEQ ID NO: 1206364 - DNA, 22 bp, Artificial Sequence
  chemically synthesized
ttcggcattctcctagctactg

SEQ ID NO: 1206365 - DNA, 22 bp, Artificial Sequence
  chemically synthesized
agtactgtatagccagtagcta

SEQ ID NO: 1206366 - DNA, 22 bp, Artificial Sequence
  chemically synthesized
cggcattctcctagctactggc

SEQ ID NO: 1206367 - DNA, 22 bp, Artificial Sequence
  chemically synthesized
cagtactgtatagccagtagct

SEQ ID NO: 1206368 - DNA, 22 bp, Artificial Sequence
  chemically synthesized
ggcattctcctagctactggct

SEQ ID NO: 1206369 - DNA, 22 bp, Artificial Sequence
  chemically synthesized
gcttcagtactgtatagccagt

SEQ ID NO: 1206370 - DNA, 22 bp, Artificial Sequence
  chemically synthesized
tcctagctactggctatacagt

SEQ ID NO: 1206371 - DNA, 22 bp, Artificial Sequence
  chemically synthesized
ctagctactggctatacagtac

SEQ ID NO: 1206372 - DNA, 22 bp, Artificial Sequence
  chemically synthesized
tccgttggcttcagtactgtat

SEQ ID NO: 1206373 - DNA, 22 bp, Artificial Sequence
  chemically synthesized
gtccgttggcttcagtactgta

SEQ ID NO: 1206374 - DNA, 22 bp, Artificial Sequence
  chemically synthesized
gctactggctatacagtactga

SEQ ID NO: 1206375 - DNA, 22 bp, Artificial Sequence
  chemically synthesized
tgtccgttggcttcagtactgt

SEQ ID NO: 1206376 - DNA, 22 bp, Artificial Sequence
  chemically synthesized
ctggctatacagtactgaagcc

SEQ ID NO: 1206377 - DNA, 22 bp, Artificial Sequence
  chemically synthesized
gctatacagtactgaagccaac

SEQ ID NO: 1206378 - DNA, 22 bp, Artificial Sequence
  chemically synthesized
tacagtactgaagccaacggac

SEQ ID NO: 1206379 - DNA, 22 bp, Artificial Sequence
  chemically synthesized
gtgtcaaggactttgtccgttg

SEQ ID NO: 1206380 - DNA, 22 bp, Artificial Sequence
  chemically synthesized
ggtgtcaaggactttgtccgtt

SEQ ID NO: 1206381 - DNA, 22 bp, Artificial Sequence
  chemically synthesized
aagccaacggacaaagtccttg

SEQ ID NO: 1206382 - DNA, 22 bp, Artificial Sequence
  chemically synthesized
gaatgtttggtgtcaaggactt

SEQ ID NO: 1206383 - DNA, 22 bp, Artificial Sequence
  chemically synthesized
ctagaatgtttggtgtcaagga

SEQ ID NO: 1206384 - DNA, 22 bp, Artificial Sequence
  chemically synthesized
ccctactagaatgtttggtgtc

SEQ ID NO: 1206385 - DNA, 22 bp, Artificial Sequence
  chemically synthesized
cccctactagaatgtttggtgt

SEQ ID NO: 1206386 - DNA, 22 bp, Artificial Sequence
  chemically synthesized
cttcccctactagaatgtttgg

SEQ ID NO: 1206387 - DNA, 22 bp, Artificial Sequence
  chemically synthesized
tgcttcccctactagaatgttt

SEQ ID NO: 1206388 - DNA, 22 bp, Artificial Sequence
  chemically synthesized
tctgcttcccctactagaatgt

SEQ ID NO: 1206389 - DNA, 22 bp, Artificial Sequence
  chemically synthesized
ctctgcttcccctactagaatg

SEQ ID NO: 1206390 - DNA, 22 bp, Artificial Sequence
  chemically synthesized
ttctctgcttcccctactagaa

SEQ ID NO: 1206391 - DNA, 22 bp, Artificial Sequence
  chemically synthesized
gacaccaaacattctagtaggg

SEQ ID NO: 1206392 - DNA, 22 bp, Artificial Sequence
  chemically synthesized
cttctctgcttcccctactaga

SEQ ID NO: 1206393 - DNA, 22 bp, Artificial Sequence
  chemically synthesized
acaccaaacattctagtagggg

SEQ ID NO: 1206394 - DNA, 22 bp, Artificial Sequence
  chemically synthesized
tttcttctctgcttcccctact

SEQ ID NO: 1206395 - DNA, 22 bp, Artificial Sequence
  chemically synthesized
atttcttctctgcttcccctac

SEQ ID NO: 1206396 - DNA, 22 bp, Artificial Sequence
  chemically synthesized
gcttatttcttctctgcttccc

SEQ ID NO: 1206397 - DNA, 22 bp, Artificial Sequence
  chemically synthesized
tctagcttatttcttctctgct

SEQ ID NO: 1206398 - DNA, 22 bp, Artificial Sequence
  chemically synthesized
tagtaggggaagcagagaagaa

SEQ ID NO: 1206399 - DNA, 22 bp, Artificial Sequence
  chemically synthesized
gtaggggaagcagagaagaaat

SEQ ID NO: 1206400 - DNA, 22 bp, Artificial Sequence
  chemically synthesized
attatctagcttatttcttctc

SEQ ID NO: 1206401 - DNA, 22 bp, Artificial Sequence
  chemically synthesized
gattatctagcttatttcttct

SEQ ID NO: 1206402 - DNA, 22 bp, Artificial Sequence
  chemically synthesized
tttgattatctagcttatttct

SEQ ID NO: 1206403 - DNA, 22 bp, Artificial Sequence
  chemically synthesized
gtttgattatctagcttatttc

SEQ ID NO: 1206404 - DNA, 22 bp, Artificial Sequence
  chemically synthesized
ccttgtttgattatctagctta

SEQ ID NO: 1206405 - DNA, 22 bp, Artificial Sequence
  chemically synthesized
aaattaccttgtttgattatct

SEQ ID NO: 1206406 - DNA, 22 bp, Artificial Sequence
  chemically synthesized
tctgaaattaccttgtttgatt

SEQ ID NO: 1206407 - DNA, 22 bp, Artificial Sequence
  chemically synthesized
gataatcaaacaaggtaatttc

SEQ ID NO: 1206408 - DNA, 22 bp, Artificial Sequence
  chemically synthesized
aaatcatcatcattatctgaaa

SEQ ID NO: 1206409 - DNA, 22 bp, Artificial Sequence
  chemically synthesized
aaaatcatcatcattatctgaa

SEQ ID NO: 1206410 - DNA, 22 bp, Artificial Sequence
  chemically synthesized
taaaatcatcatcattatctga

SEQ ID NO: 1206411 - DNA, 22 bp, Artificial Sequence
  chemically synthesized
ctttaaaatcatcatcattatc

SEQ ID NO: 1206412 - DNA, 22 bp, Artificial Sequence
  chemically synthesized
gctttaaaatcatcatcattat

SEQ ID NO: 1206413 - DNA, 22 bp, Artificial Sequence
  chemically synthesized
ttgctttaaaatcatcatcatt

SEQ ID NO: 1206414 - DNA, 22 bp, Artificial Sequence
  chemically synthesized
cttgctttaaaatcatcatcat

SEQ ID NO: 1206415 - DNA, 22 bp, Artificial Sequence
  chemically synthesized
cagataatgatgatgattttaa

SEQ ID NO: 1206416 - DNA, 22 bp, Artificial Sequence
  chemically synthesized
acacttcttgctttaaaatcat

SEQ ID NO: 1206417 - DNA, 22 bp, Artificial Sequence
  chemically synthesized
agataatgatgatgattttaaa

SEQ ID NO: 1206418 - DNA, 22 bp, Artificial Sequence
  chemically synthesized
ttcacacttcttgctttaaaat

SEQ ID NO: 1206419 - DNA, 22 bp, Artificial Sequence
  chemically synthesized
tatcctattcacacttcttgct

SEQ ID NO: 1206420 - DNA, 22 bp, Artificial Sequence
  chemically synthesized
ctgtatcctattcacacttctt

SEQ ID NO: 1206421 - DNA, 22 bp, Artificial Sequence
  chemically synthesized
taaagcaagaagtgtgaatagg

SEQ ID NO: 1206422 - DNA, 22 bp, Artificial Sequence
  chemically synthesized
aaagcaagaagtgtgaatagga

SEQ ID NO: 1206423 - DNA, 22 bp, Artificial Sequence
  chemically synthesized
aagcaagaagtgtgaataggat

SEQ ID NO: 1206424 - DNA, 22 bp, Artificial Sequence
  chemically synthesized
ccagccattcctgtatcctatt

SEQ ID NO: 1206425 - DNA, 22 bp, Artificial Sequence
  chemically synthesized
atgagccctcccagccattcct

SEQ ID NO: 1206426 - DNA, 22 bp, Artificial Sequence
  chemically synthesized
ctgatgagccctcccagccatt

SEQ ID NO: 1206427 - DNA, 22 bp, Artificial Sequence
  chemically synthesized
tcctgatgagccctcccagcca

SEQ ID NO: 1206428 - DNA, 22 bp, Artificial Sequence
  chemically synthesized
ggagggctcatcaggagagctc

SEQ ID NO: 1206429 - DNA, 22 bp, Artificial Sequence
  chemically synthesized
ccatatgtaaaagagctctcct

SEQ ID NO: 1206430 - DNA, 22 bp, Artificial Sequence
  chemically synthesized
cagtctaccatatgtaaaagag

SEQ ID NO: 1206431 - DNA, 22 bp, Artificial Sequence
  chemically synthesized
gcagtctaccatatgtaaaaga

SEQ ID NO: 1206432 - DNA, 22 bp, Artificial Sequence
  chemically synthesized
atcaggagagctcttttacata

SEQ ID NO: 1206433 - DNA, 22 bp, Artificial Sequence
  chemically synthesized
tgcagtctaccatatgtaaaag

SEQ ID NO: 1206434 - DNA, 22 bp, Artificial Sequence
  chemically synthesized
agaagaatcctttgcagtctac

SEQ ID NO: 1206435 - DNA, 22 bp, Artificial Sequence
  chemically synthesized
ttttacatatggtagactgcaa

SEQ ID NO: 1206436 - DNA, 22 bp, Artificial Sequence
  chemically synthesized
cagaagaatcctttgcagtcta

SEQ ID NO: 1206437 - DNA, 22 bp, Artificial Sequence
  chemically synthesized
ttacatatggtagactgcaaag

SEQ ID NO: 1206438 - DNA, 22 bp, Artificial Sequence
  chemically synthesized
tacatatggtagactgcaaagg

SEQ ID NO: 1206439 - DNA, 22 bp, Artificial Sequence
  chemically synthesized
acatatggtagactgcaaagga

SEQ ID NO: 1206440 - DNA, 22 bp, Artificial Sequence
  chemically synthesized
catatggtagactgcaaaggat

SEQ ID NO: 1206441 - DNA, 22 bp, Artificial Sequence
  chemically synthesized
atcttcagaagaatcctttgca

SEQ ID NO: 1206442 - DNA, 22 bp, Artificial Sequence
  chemically synthesized
caaaggattcttctgaagatga

SEQ ID NO: 1206443 - DNA, 22 bp, Artificial Sequence
  chemically synthesized
agccgaaaggtctcatcttcag

SEQ ID NO: 1206444 - DNA, 22 bp, Artificial Sequence
  chemically synthesized
agtctgagccgaaaggtctcat

SEQ ID NO: 1206445 - DNA, 22 bp, Artificial Sequence
  chemically synthesized
ttctgaagatgagacctttcgg

SEQ ID NO: 1206446 - DNA, 22 bp, Artificial Sequence
  chemically synthesized
ctgaagatgagacctttcggct

SEQ ID NO: 1206447 - DNA, 22 bp, Artificial Sequence
  chemically synthesized
ccattcagtctgagccgaaagg

SEQ ID NO: 1206448 - DNA, 22 bp, Artificial Sequence
  chemically synthesized
tgaagatgagacctttcggctc

SEQ ID NO: 1206449 - DNA, 22 bp, Artificial Sequence
  chemically synthesized
aagatgagacctttcggctcag

SEQ ID NO: 1206450 - DNA, 22 bp, Artificial Sequence
  chemically synthesized
ctgccattcagtctgagccgaa

SEQ ID NO: 1206451 - DNA, 22 bp, Artificial Sequence
  chemically synthesized
cctgccattcagtctgagccga

SEQ ID NO: 1206452 - DNA, 22 bp, Artificial Sequence
  chemically synthesized
acaacttcctgccattcagtct

SEQ ID NO: 1206453 - DNA, 22 bp, Artificial Sequence
  chemically synthesized
tcggctcagactgaatggcagg

SEQ ID NO: 1206454 - DNA, 22 bp, Artificial Sequence
  chemically synthesized
cggctcagactgaatggcagga

SEQ ID NO: 1206455 - DNA, 22 bp, Artificial Sequence
  chemically synthesized
ggctcagactgaatggcaggaa

SEQ ID NO: 1206456 - DNA, 22 bp, Artificial Sequence
  chemically synthesized
tatagctgacaacttcctgcca

SEQ ID NO: 1206457 - DNA, 22 bp, Artificial Sequence
  chemically synthesized
atatagctgacaacttcctgcc

SEQ ID NO: 1206458 - DNA, 22 bp, Artificial Sequence
  chemically synthesized
tatatagctgacaacttcctgc

SEQ ID NO: 1206459 - DNA, 22 bp, Artificial Sequence
  chemically synthesized
agactgaatggcaggaagttgt

SEQ ID NO: 1206460 - DNA, 22 bp, Artificial Sequence
  chemically synthesized
tttatatagctgacaacttcct

SEQ ID NO: 1206461 - DNA, 22 bp, Artificial Sequence
  chemically synthesized
cctctttatatagctgacaact

SEQ ID NO: 1206462 - DNA, 22 bp, Artificial Sequence
  chemically synthesized
aatggcaggaagttgtcagcta

SEQ ID NO: 1206463 - DNA, 22 bp, Artificial Sequence
  chemically synthesized
tccctctttatatagctgacaa

SEQ ID NO: 1206464 - DNA, 22 bp, Artificial Sequence
  chemically synthesized
ctccctctttatatagctgaca

SEQ ID NO: 1206465 - DNA, 22 bp, Artificial Sequence
  chemically synthesized
ttctccctctttatatagctga

SEQ ID NO: 1206466 - DNA, 22 bp, Artificial Sequence
  chemically synthesized
cttctccctctttatatagctg

SEQ ID NO: 1206467 - DNA, 22 bp, Artificial Sequence
  chemically synthesized
tcagctatataaagagggagaa

SEQ ID NO: 1206468 - DNA, 22 bp, Artificial Sequence
  chemically synthesized
tataaagagggagaagaagtat

SEQ ID NO: 1206469 - DNA, 22 bp, Artificial Sequence
  chemically synthesized
cggtcaagcaagaacatacttc

SEQ ID NO: 1206470 - DNA, 22 bp, Artificial Sequence
  chemically synthesized
accaggctccggtcaagcaaga

SEQ ID NO: 1206471 - DNA, 22 bp, Artificial Sequence
  chemically synthesized
caccaggctccggtcaagcaag

SEQ ID NO: 1206472 - DNA, 22 bp, Artificial Sequence
  chemically synthesized
cttcaccaggctccggtcaagc

SEQ ID NO: 1206473 - DNA, 22 bp, Artificial Sequence
  chemically synthesized
acttcaccaggctccggtcaag

SEQ ID NO: 1206474 - DNA, 22 bp, Artificial Sequence
  chemically synthesized
ccttacttcaccaggctccggt

SEQ ID NO: 1206475 - DNA, 22 bp, Artificial Sequence
  chemically synthesized
gttcccttacttcaccaggctc

SEQ ID NO: 1206476 - DNA, 22 bp, Artificial Sequence
  chemically synthesized
ttgcttgaccggagcctggtga

SEQ ID NO: 1206477 - DNA, 22 bp, Artificial Sequence
  chemically synthesized
gcttgaccggagcctggtgaag

SEQ ID NO: 1206478 - DNA, 22 bp, Artificial Sequence
  chemically synthesized
cttgaccggagcctggtgaagt

SEQ ID NO: 1206479 - DNA, 22 bp, Artificial Sequence
  chemically synthesized
acactggttcccttacttcacc

SEQ ID NO: 1206480 - DNA, 22 bp, Artificial Sequence
  chemically synthesized
gaccggagcctggtgaagtaag

SEQ ID NO: 1206481 - DNA, 22 bp, Artificial Sequence
  chemically synthesized
cacactggttcccttacttcac

SEQ ID NO: 1206482 - DNA, 22 bp, Artificial Sequence
  chemically synthesized
accggagcctggtgaagtaagg

SEQ ID NO: 1206483 - DNA, 22 bp, Artificial Sequence
  chemically synthesized
acttcacactggttcccttact

SEQ ID NO: 1206484 - DNA, 22 bp, Artificial Sequence
  chemically synthesized
atctcacttcacactggttccc

SEQ ID NO: 1206485 - DNA, 22 bp, Artificial Sequence
  chemically synthesized
gatctcacttcacactggttcc

SEQ ID NO: 1206486 - DNA, 22 bp, Artificial Sequence
  chemically synthesized
gtgaagtaagggaaccagtgtg

SEQ ID NO: 1206487 - DNA, 22 bp, Artificial Sequence
  chemically synthesized
ttgatctcacttcacactggtt

SEQ ID NO: 1206488 - DNA, 22 bp, Artificial Sequence
  chemically synthesized
cttgatctcacttcacactggt

SEQ ID NO: 1206489 - DNA, 22 bp, Artificial Sequence
  chemically synthesized
cttcttgatctcacttcacact

SEQ ID NO: 1206490 - DNA, 22 bp, Artificial Sequence
  chemically synthesized
gcttcttgatctcacttcacac

SEQ ID NO: 1206491 - DNA, 22 bp, Artificial Sequence
  chemically synthesized
cttgcttcttgatctcacttca

SEQ ID NO: 1206492 - DNA, 22 bp, Artificial Sequence
  chemically synthesized
tcccctgcttgcttcttgatct

SEQ ID NO: 1206493 - DNA, 22 bp, Artificial Sequence
  chemically synthesized
tgtgatctgtcccctgcttgct

SEQ ID NO: 1206494 - DNA, 22 bp, Artificial Sequence
  chemically synthesized
aaagcagccagcaagaccctgt

SEQ ID NO: 1206495 - DNA, 22 bp, Artificial Sequence
  chemically synthesized
gagtctgaaagcagccagcaag

SEQ ID NO: 1206496 - DNA, 22 bp, Artificial Sequence
  chemically synthesized
gaaaaatgtctggagtctgaaa

SEQ ID NO: 1206497 - DNA, 22 bp, Artificial Sequence
  chemically synthesized
agaaaaatgtctggagtctgaa

SEQ ID NO: 1206498 - DNA, 22 bp, Artificial Sequence
  chemically synthesized
gctggctgctttcagactccag

SEQ ID NO: 1206499 - DNA, 22 bp, Artificial Sequence
  chemically synthesized
ctggctgctttcagactccaga

SEQ ID NO: 1206500 - DNA, 22 bp, Artificial Sequence
  chemically synthesized
tacttagaaaaatgtctggagt

SEQ ID NO: 1206501 - DNA, 22 bp, Artificial Sequence
  chemically synthesized
gctgctttcagactccagacat

SEQ ID NO: 1206502 - DNA, 22 bp, Artificial Sequence
  chemically synthesized
ctttcagactccagacattttt

SEQ ID NO: 1206503 - DNA, 22 bp, Artificial Sequence
  chemically synthesized
cattgtacttagaaaaatgtct

SEQ ID NO: 1206504 - DNA, 22 bp, Artificial Sequence
  chemically synthesized
tacattgtacttagaaaaatgt

SEQ ID NO: 1206505 - DNA, 22 bp, Artificial Sequence
  chemically synthesized
tcagactccagacatttttcta

SEQ ID NO: 1206506 - DNA, 22 bp, Artificial Sequence
  chemically synthesized
cagactccagacatttttctaa

SEQ ID NO: 1206507 - DNA, 22 bp, Artificial Sequence
  chemically synthesized
agactccagacatttttctaag

SEQ ID NO: 1206508 - DNA, 22 bp, Artificial Sequence
  chemically synthesized
aagactctacattgtacttaga

SEQ ID NO: 1206509 - DNA, 22 bp, Artificial Sequence
  chemically synthesized
cagacatttttctaagtacaat

SEQ ID NO: 1206510 - DNA, 22 bp, Artificial Sequence
  chemically synthesized
tgaagactctacattgtactta

SEQ ID NO: 1206511 - DNA, 22 bp, Artificial Sequence
  chemically synthesized
ctgaagactctacattgtactt

SEQ ID NO: 1206512 - DNA, 22 bp, Artificial Sequence
  chemically synthesized
acaccttctgaagactctacat

SEQ ID NO: 1206513 - DNA, 22 bp, Artificial Sequence
  chemically synthesized
ttctaagtacaatgtagagtct

SEQ ID NO: 1206514 - DNA, 22 bp, Artificial Sequence
  chemically synthesized
aacaccttctgaagactctaca

SEQ ID NO: 1206515 - DNA, 22 bp, Artificial Sequence
  chemically synthesized
tctaagtacaatgtagagtctt

SEQ ID NO: 1206516 - DNA, 22 bp, Artificial Sequence
  chemically synthesized
ctaagtacaatgtagagtcttc

SEQ ID NO: 1206517 - DNA, 22 bp, Artificial Sequence
  chemically synthesized
taagtacaatgtagagtcttca

SEQ ID NO: 1206518 - DNA, 22 bp, Artificial Sequence
  chemically synthesized
tttaacaccttctgaagactct

SEQ ID NO: 1206519 - DNA, 22 bp, Artificial Sequence
  chemically synthesized
agtacaatgtagagtcttcaga

SEQ ID NO: 1206520 - DNA, 22 bp, Artificial Sequence
  chemically synthesized
cctatttaacaccttctgaaga

SEQ ID NO: 1206521 - DNA, 22 bp, Artificial Sequence
  chemically synthesized
ggtcatgtgttccctatttaac

SEQ ID NO: 1206522 - DNA, 22 bp, Artificial Sequence
  chemically synthesized
cagaaggtgttaaatagggaac

SEQ ID NO: 1206523 - DNA, 22 bp, Artificial Sequence
  chemically synthesized
attaggtcatgtgttccctatt

SEQ ID NO: 1206524 - DNA, 22 bp, Artificial Sequence
  chemically synthesized
agaaggtgttaaatagggaaca

SEQ ID NO: 1206525 - DNA, 22 bp, Artificial Sequence
  chemically synthesized
cattaattaggtcatgtgttcc

SEQ ID NO: 1206526 - DNA, 22 bp, Artificial Sequence
  chemically synthesized
ctacattaattaggtcatgtgt

SEQ ID NO: 1206527 - DNA, 22 bp, Artificial Sequence
  chemically synthesized
actacattaattaggtcatgtg

SEQ ID NO: 1206528 - DNA, 22 bp, Artificial Sequence
  chemically synthesized
tactacattaattaggtcatgt

SEQ ID NO: 1206529 - DNA, 22 bp, Artificial Sequence
  chemically synthesized
ttactacattaattaggtcatg

SEQ ID NO: 1206530 - DNA, 22 bp, Artificial Sequence
  chemically synthesized
aatagggaacacatgacctaat

SEQ ID NO: 1206531 - DNA, 22 bp, Artificial Sequence
  chemically synthesized
tttactacattaattaggtcat

SEQ ID NO: 1206532 - DNA, 22 bp, Artificial Sequence
  chemically synthesized
tctttttactacattaattagg

SEQ ID NO: 1206533 - DNA, 22 bp, Artificial Sequence
  chemically synthesized
tacaaagttatctttttactac

SEQ ID NO: 1206534 - DNA, 22 bp, Artificial Sequence
  chemically synthesized
attaatgtagtaaaaagataac

SEQ ID NO: 1206535 - DNA, 22 bp, Artificial Sequence
  chemically synthesized
gcattatacaaagttatctttt

SEQ ID NO: 1206536 - DNA, 22 bp, Artificial Sequence
  chemically synthesized
cgcattatacaaagttatcttt

SEQ ID NO: 1206537 - DNA, 22 bp, Artificial Sequence
  chemically synthesized
ttcgcattatacaaagttatct

SEQ ID NO: 1206538 - DNA, 22 bp, Artificial Sequence
  chemically synthesized
atgtagtaaaaagataactttg

SEQ ID NO: 1206539 - DNA, 22 bp, Artificial Sequence
  chemically synthesized
agttcttcgcattatacaaagt

SEQ ID NO: 1206540 - DNA, 22 bp, Artificial Sequence
  chemically synthesized
tcagttcttcgcattatacaaa

SEQ ID NO: 1206541 - DNA, 22 bp, Artificial Sequence
  chemically synthesized
agcagtctctcagttcttcgca

SEQ ID NO: 1206542 - DNA, 22 bp, Artificial Sequence
  chemically synthesized
ctaagcagtctctcagttcttc

SEQ ID NO: 1206543 - DNA, 22 bp, Artificial Sequence
  chemically synthesized
cctaagcagtctctcagttctt

SEQ ID NO: 1206544 - DNA, 22 bp, Artificial Sequence
  chemically synthesized
tgtataatgcgaagaactgaga

SEQ ID NO: 1206545 - DNA, 22 bp, Artificial Sequence
  chemically synthesized
gtataatgcgaagaactgagag

SEQ ID NO: 1206546 - DNA, 22 bp, Artificial Sequence
  chemically synthesized
tataatgcgaagaactgagaga

SEQ ID NO: 1206547 - DNA, 22 bp, Artificial Sequence
  chemically synthesized
cagtaacttcctaagcagtctc

SEQ ID NO: 1206548 - DNA, 22 bp, Artificial Sequence
  chemically synthesized
atattgcagtaacttcctaagc

SEQ ID NO: 1206549 - DNA, 22 bp, Artificial Sequence
  chemically synthesized
ctaatattgcagtaacttccta

SEQ ID NO: 1206550 - DNA, 22 bp, Artificial Sequence
  chemically synthesized
agagactgcttaggaagttact

SEQ ID NO: 1206551 - DNA, 22 bp, Artificial Sequence
  chemically synthesized
catagcctcctaatattgcagt

SEQ ID NO: 1206552 - DNA, 22 bp, Artificial Sequence
  chemically synthesized
cttaggaagttactgcaatatt

SEQ ID NO: 1206553 - DNA, 22 bp, Artificial Sequence
  chemically synthesized
aggaagttactgcaatattagg

SEQ ID NO: 1206554 - DNA, 22 bp, Artificial Sequence
  chemically synthesized
ggaagttactgcaatattagga

SEQ ID NO: 1206555 - DNA, 22 bp, Artificial Sequence
  chemically synthesized
catcatattccatagcctccta

SEQ ID NO: 1206556 - DNA, 22 bp, Artificial Sequence
  chemically synthesized
ctgcaatattaggaggctatgg

SEQ ID NO: 1206557 - DNA, 22 bp, Artificial Sequence
  chemically synthesized
caatattaggaggctatggaat

SEQ ID NO: 1206558 - DNA, 22 bp, Artificial Sequence
  chemically synthesized
acactccatcatattccatagc

SEQ ID NO: 1206559 - DNA, 22 bp, Artificial Sequence
  chemically synthesized
ggaggctatggaatatgatgga

SEQ ID NO: 1206560 - DNA, 22 bp, Artificial Sequence
  chemically synthesized
tggaatatgatggagtgtcagt

SEQ ID NO: 1206561 - DNA, 22 bp, Artificial Sequence
  chemically synthesized
aaaggaagcaccactgacactc

SEQ ID NO: 1206562 - DNA, 22 bp, Artificial Sequence
  chemically synthesized
ttcaaaggaagcaccactgaca

SEQ ID NO: 1206563 - DNA, 22 bp, Artificial Sequence
  chemically synthesized
attcaaaggaagcaccactgac

SEQ ID NO: 1206564 - DNA, 22 bp, Artificial Sequence
  chemically synthesized
tattcaaaggaagcaccactga

SEQ ID NO: 1206565 - DNA, 22 bp, Artificial Sequence
  chemically synthesized
ttattcaaaggaagcaccactg

SEQ ID NO: 1206566 - DNA, 22 bp, Artificial Sequence
  chemically synthesized
cttttattcaaaggaagcacca

SEQ ID NO: 1206567 - DNA, 22 bp, Artificial Sequence
  chemically synthesized
aaaaataaaagctgcttttatt

SEQ ID NO: 1206568 - DNA, 22 bp, Artificial Sequence
  chemically synthesized
attgaaaaataaaagctgcttt

SEQ ID NO: 1206569 - DNA, 22 bp, Artificial Sequence
  chemically synthesized
aattgaaaaataaaagctgctt

SEQ ID NO: 1206570 - DNA, 22 bp, Artificial Sequence
  chemically synthesized
cctttgaataaaagcagctttt

SEQ ID NO: 1206571 - DNA, 22 bp, Artificial Sequence
  chemically synthesized
taattgaaaaataaaagctgct

SEQ ID NO: 1206572 - DNA, 22 bp, Artificial Sequence
  chemically synthesized
ctttgaataaaagcagctttta

SEQ ID NO: 1206573 - DNA, 22 bp, Artificial Sequence
  chemically synthesized
tgaataaaagcagcttttattt

SEQ ID NO: 1206574 - DNA, 22 bp, Artificial Sequence
  chemically synthesized
gaataaaagcagcttttatttt

SEQ ID NO: 1206575 - DNA, 22 bp, Artificial Sequence
  chemically synthesized
cattttaattgaaaaataaaag

SEQ ID NO: 1206576 - DNA, 22 bp, Artificial Sequence
  chemically synthesized
aataaaagcagcttttattttt

SEQ ID NO: 1206577 - DNA, 22 bp, Artificial Sequence
  chemically synthesized
tgttacattttaattgaaaaat

SEQ ID NO: 1206578 - DNA, 22 bp, Artificial Sequence
  chemically synthesized
ttatttttcaattaaaatgtaa

SEQ ID NO: 1206579 - DNA, 22 bp, Artificial Sequence
  chemically synthesized
aaaccaattatgttacatttta

SEQ ID NO: 1206580 - DNA, 22 bp, Artificial Sequence
  chemically synthesized
tatttttcaattaaaatgtaac

SEQ ID NO: 1206581 - DNA, 22 bp, Artificial Sequence
  chemically synthesized
atttttcaattaaaatgtaaca

SEQ ID NO: 1206582 - DNA, 22 bp, Artificial Sequence
  chemically synthesized
tttttcaattaaaatgtaacat

SEQ ID NO: 1206583 - DNA, 22 bp, Artificial Sequence
  chemically synthesized
ctgaaaccaattatgttacatt

SEQ ID NO: 1206584 - DNA, 22 bp, Artificial Sequence
  chemically synthesized
actgaaaccaattatgttacat

SEQ ID NO: 1206585 - DNA, 22 bp, Artificial Sequence
  chemically synthesized
tactgaaaccaattatgttaca

SEQ ID NO: 1206586 - DNA, 22 bp, Artificial Sequence
  chemically synthesized
ttcaattaaaatgtaacataat

SEQ ID NO: 1206587 - DNA, 22 bp, Artificial Sequence
  chemically synthesized
ttactgaaaccaattatgttac

SEQ ID NO: 1206588 - DNA, 22 bp, Artificial Sequence
  chemically synthesized
tcaattaaaatgtaacataatt

SEQ ID NO: 1206589 - DNA, 22 bp, Artificial Sequence
  chemically synthesized
caattaaaatgtaacataattg

SEQ ID NO: 1206590 - DNA, 22 bp, Artificial Sequence
  chemically synthesized
aattaaaatgtaacataattgg

SEQ ID NO: 1206591 - DNA, 22 bp, Artificial Sequence
  chemically synthesized
aaatgtaacataattggtttca

SEQ ID NO: 1206592 - DNA, 22 bp, Artificial Sequence
  chemically synthesized
agacatttttactgaaaccaat

SEQ ID NO: 1206593 - DNA, 22 bp, Artificial Sequence
  chemically synthesized
gtttcagtaaaaatgtctcagt

SEQ ID NO: 1206594 - DNA, 22 bp, Artificial Sequence
  chemically synthesized
cagtaaaaatgtctcagttgac

SEQ ID NO: 1206595 - DNA, 22 bp, Artificial Sequence
  chemically synthesized
agtaaaaatgtctcagttgacc

SEQ ID NO: 1206596 - DNA, 22 bp, Artificial Sequence
  chemically synthesized
atgcaggagaaataaggtcaac

SEQ ID NO: 1206597 - DNA, 22 bp, Artificial Sequence
  chemically synthesized
agttgaccttatttctcctgca

SEQ ID NO: 1206598 - DNA, 22 bp, Artificial Sequence
  chemically synthesized
accttatttctcctgcattaat

SEQ ID NO: 1206599 - DNA, 22 bp, Artificial Sequence
  chemically synthesized
atttctcctgcattaatggggt

SEQ ID NO: 1206600 - DNA, 22 bp, Artificial Sequence
  chemically synthesized
tttctcctgcattaatggggtc

SEQ ID NO: 1206601 - DNA, 22 bp, Artificial Sequence
  chemically synthesized
ctcctgcattaatggggtcatt

SEQ ID NO: 1206602 - DNA, 22 bp, Artificial Sequence
  chemically synthesized
acatatcatataaatgacccca

SEQ ID NO: 1206603 - DNA, 22 bp, Artificial Sequence
  chemically synthesized
tcctgcattaatggggtcattt

SEQ ID NO: 1206604 - DNA, 22 bp, Artificial Sequence
  chemically synthesized
ctgcattaatggggtcatttat

SEQ ID NO: 1206605 - DNA, 22 bp, Artificial Sequence
  chemically synthesized
ctgacatatcatataaatgacc

SEQ ID NO: 1206606 - DNA, 22 bp, Artificial Sequence
  chemically synthesized
cattaatggggtcatttatatg

SEQ ID NO: 1206607 - DNA, 22 bp, Artificial Sequence
  chemically synthesized
atggggtcatttatatgatatg

SEQ ID NO: 1206608 - DNA, 22 bp, Artificial Sequence
  chemically synthesized
tgtacagcggtagcactcctga

SEQ ID NO: 1206609 - DNA, 22 bp, Artificial Sequence
  chemically synthesized
atatgatatgtcaggagtgcta

SEQ ID NO: 1206610 - DNA, 22 bp, Artificial Sequence
  chemically synthesized
tatgatatgtcaggagtgctac

SEQ ID NO: 1206611 - DNA, 22 bp, Artificial Sequence
  chemically synthesized
attgtgtacagcggtagcactc

SEQ ID NO: 1206612 - DNA, 22 bp, Artificial Sequence
  chemically synthesized
ttcattgtgtacagcggtagca

SEQ ID NO: 1206613 - DNA, 22 bp, Artificial Sequence
  chemically synthesized
aaaaaagctgttcattgtgtac

SEQ ID NO: 1206614 - DNA, 22 bp, Artificial Sequence
  chemically synthesized
attgaaaaaagctgttcattgt

SEQ ID NO: 1206615 - DNA, 22 bp, Artificial Sequence
  chemically synthesized
aattgaaaaaagctgttcattg

SEQ ID NO: 1206616 - DNA, 22 bp, Artificial Sequence
  chemically synthesized
taattgaaaaaagctgttcatt

SEQ ID NO: 1206617 - DNA, 22 bp, Artificial Sequence
  chemically synthesized
ccgctgtacacaatgaacagct

SEQ ID NO: 1206618 - DNA, 22 bp, Artificial Sequence
  chemically synthesized
cgttttaattgaaaaaagctgt

SEQ ID NO: 1206619 - DNA, 22 bp, Artificial Sequence
  chemically synthesized
tacacaatgaacagcttttttc

SEQ ID NO: 1206620 - DNA, 22 bp, Artificial Sequence
  chemically synthesized
agctacgttttaattgaaaaaa

SEQ ID NO: 1206621 - DNA, 22 bp, Artificial Sequence
  chemically synthesized
aagtcaattaagctacgtttta

SEQ ID NO: 1206622 - DNA, 22 bp, Artificial Sequence
  chemically synthesized
ttttcaattaaaacgtagctta

SEQ ID NO: 1206623 - DNA, 22 bp, Artificial Sequence
  chemically synthesized
gttcaagtcaattaagctacgt

SEQ ID NO: 1206624 - DNA, 22 bp, Artificial Sequence
  chemically synthesized
tttcaattaaaacgtagcttaa

SEQ ID NO: 1206625 - DNA, 22 bp, Artificial Sequence
  chemically synthesized
ttcaattaaaacgtagcttaat

SEQ ID NO: 1206626 - DNA, 22 bp, Artificial Sequence
  chemically synthesized
tggttcaagtcaattaagctac

SEQ ID NO: 1206627 - DNA, 22 bp, Artificial Sequence
  chemically synthesized
tcaattaaaacgtagcttaatt

SEQ ID NO: 1206628 - DNA, 22 bp, Artificial Sequence
  chemically synthesized
ctggttcaagtcaattaagcta

SEQ ID NO: 1206629 - DNA, 22 bp, Artificial Sequence
  chemically synthesized
caattaaaacgtagcttaattg

SEQ ID NO: 1206630 - DNA, 22 bp, Artificial Sequence
  chemically synthesized
aattaaaacgtagcttaattga

SEQ ID NO: 1206631 - DNA, 22 bp, Artificial Sequence
  chemically synthesized
aaacgtagcttaattgacttga

SEQ ID NO: 1206632 - DNA, 22 bp, Artificial Sequence
  chemically synthesized
aattgacttgaaccagaaatga

SEQ ID NO: 1206633 - DNA, 22 bp, Artificial Sequence
  chemically synthesized
attgacttgaaccagaaatgac

SEQ ID NO: 1206634 - DNA, 22 bp, Artificial Sequence
  chemically synthesized
acttgaaccagaaatgactctt

SEQ ID NO: 1206635 - DNA, 22 bp, Artificial Sequence
  chemically synthesized
atacaaagatgtcaagagtcat

SEQ ID NO: 1206636 - DNA, 22 bp, Artificial Sequence
  chemically synthesized
gaaccagaaatgactcttgaca

SEQ ID NO: 1206637 - DNA, 22 bp, Artificial Sequence
  chemically synthesized
ttaatacaaagatgtcaagagt

SEQ ID NO: 1206638 - DNA, 22 bp, Artificial Sequence
  chemically synthesized
aaccagaaatgactcttgacat

SEQ ID NO: 1206639 - DNA, 22 bp, Artificial Sequence
  chemically synthesized
tagaaatggtcctattaataca

SEQ ID NO: 1206640 - DNA, 22 bp, Artificial Sequence
  chemically synthesized
ttgacatctttgtattaatagg

SEQ ID NO: 1206641 - DNA, 22 bp, Artificial Sequence
  chemically synthesized
gacatctttgtattaataggac

SEQ ID NO: 1206642 - DNA, 22 bp, Artificial Sequence
  chemically synthesized
acatctttgtattaataggacc

SEQ ID NO: 1206643 - DNA, 22 bp, Artificial Sequence
  chemically synthesized
tgtattaataggaccatttcta

SEQ ID NO: 1206644 - DNA, 22 bp, Artificial Sequence
  chemically synthesized
gcatgatcattatagaaatggt

SEQ ID NO: 1206645 - DNA, 22 bp, Artificial Sequence
  chemically synthesized
gtattaataggaccatttctat

SEQ ID NO: 1206646 - DNA, 22 bp, Artificial Sequence
  chemically synthesized
tattaataggaccatttctata

SEQ ID NO: 1206647 - DNA, 22 bp, Artificial Sequence
  chemically synthesized
attagcatgatcattatagaaa

SEQ ID NO: 1206648 - DNA, 22 bp, Artificial Sequence
  chemically synthesized
ataggaccatttctataatgat

SEQ ID NO: 1206649 - DNA, 22 bp, Artificial Sequence
  chemically synthesized
aatgaagaagattaattagcat

SEQ ID NO: 1206650 - DNA, 22 bp, Artificial Sequence
  chemically synthesized
ctataatgatcatgctaattaa

SEQ ID NO: 1206651 - DNA, 22 bp, Artificial Sequence
  chemically synthesized
gaatgaagaagattaattagca

SEQ ID NO: 1206652 - DNA, 22 bp, Artificial Sequence
  chemically synthesized
tataatgatcatgctaattaat

SEQ ID NO: 1206653 - DNA, 22 bp, Artificial Sequence
  chemically synthesized
tgaatgaagaagattaattagc

SEQ ID NO: 1206654 - DNA, 22 bp, Artificial Sequence
  chemically synthesized
ttgaatgaagaagattaattag

SEQ ID NO: 1206655 - DNA, 22 bp, Artificial Sequence
  chemically synthesized
taatgatcatgctaattaatct

SEQ ID NO: 1206656 - DNA, 22 bp, Artificial Sequence
  chemically synthesized
aataaacaatacttttgaatga

SEQ ID NO: 1206657 - DNA, 22 bp, Artificial Sequence
  chemically synthesized
attaatcttcttcattcaaaag

SEQ ID NO: 1206658 - DNA, 22 bp, Artificial Sequence
  chemically synthesized
tgaataaacaatacttttgaat

SEQ ID NO: 1206659 - DNA, 22 bp, Artificial Sequence
  chemically synthesized
atcttcttcattcaaaagtatt

SEQ ID NO: 1206660 - DNA, 22 bp, Artificial Sequence
  chemically synthesized
cttcattcaaaagtattgttta

SEQ ID NO: 1206661 - DNA, 22 bp, Artificial Sequence
  chemically synthesized
aataattctgaataaacaatac

SEQ ID NO: 1206662 - DNA, 22 bp, Artificial Sequence
  chemically synthesized
ttcattcaaaagtattgtttat

SEQ ID NO: 1206663 - DNA, 22 bp, Artificial Sequence
  chemically synthesized
cattcaaaagtattgtttattc

SEQ ID NO: 1206664 - DNA, 22 bp, Artificial Sequence
  chemically synthesized
attcaaaagtattgtttattca

SEQ ID NO: 1206665 - DNA, 22 bp, Artificial Sequence
  chemically synthesized
tattaaataattctgaataaac

SEQ ID NO: 1206666 - DNA, 22 bp, Artificial Sequence
  chemically synthesized
aaaagtattgtttattcagaat

SEQ ID NO: 1206667 - DNA, 22 bp, Artificial Sequence
  chemically synthesized
tttattcagaattatttaatac

SEQ ID NO: 1206668 - DNA, 22 bp, Artificial Sequence
  chemically synthesized
aaagtataacgattgtattaaa

SEQ ID NO: 1206669 - DNA, 22 bp, Artificial Sequence
  chemically synthesized
attcagaattatttaatacaat

SEQ ID NO: 1206670 - DNA, 22 bp, Artificial Sequence
  chemically synthesized
aaaagtataacgattgtattaa

SEQ ID NO: 1206671 - DNA, 22 bp, Artificial Sequence
  chemically synthesized
ttcagaattatttaatacaatc

SEQ ID NO: 1206672 - DNA, 22 bp, Artificial Sequence
  chemically synthesized
agaattatttaatacaatcgtt

SEQ ID NO: 1206673 - DNA, 22 bp, Artificial Sequence
  chemically synthesized
aaatgatttaaaagtataacga

SEQ ID NO: 1206674 - DNA, 22 bp, Artificial Sequence
  chemically synthesized
tttaatacaatcgttatacttt

SEQ ID NO: 1206675 - DNA, 22 bp, Artificial Sequence
  chemically synthesized
aatacaatcgttatacttttaa

SEQ ID NO: 1206676 - DNA, 22 bp, Artificial Sequence
  chemically synthesized
atacaatcgttatacttttaaa

SEQ ID NO: 1206677 - DNA, 22 bp, Artificial Sequence
  chemically synthesized
ataacattaaaatgatttaaaa

SEQ ID NO: 1206678 - DNA, 22 bp, Artificial Sequence
  chemically synthesized
aataacattaaaatgatttaaa

SEQ ID NO: 1206679 - DNA, 22 bp, Artificial Sequence
  chemically synthesized
tacttttaaatcattttaatgt

SEQ ID NO: 1206680 - DNA, 22 bp, Artificial Sequence
  chemically synthesized
agataatatttaataacattaa

SEQ ID NO: 1206681 - DNA, 22 bp, Artificial Sequence
  chemically synthesized
ttaaatcattttaatgttatta

SEQ ID NO: 1206682 - DNA, 22 bp, Artificial Sequence
  chemically synthesized
taaatcattttaatgttattaa

SEQ ID NO: 1206683 - DNA, 22 bp, Artificial Sequence
  chemically synthesized
aaatcattttaatgttattaaa

SEQ ID NO: 1206684 - DNA, 22 bp, Artificial Sequence
  chemically synthesized
aatcattttaatgttattaaat

SEQ ID NO: 1206685 - DNA, 22 bp, Artificial Sequence
  chemically synthesized
aagatcctgagataatatttaa

SEQ ID NO: 1206686 - DNA, 22 bp, Artificial Sequence
  chemically synthesized
caagatcctgagataatattta

SEQ ID NO: 1206687 - DNA, 22 bp, Artificial Sequence
  chemically synthesized
taatgttattaaatattatctc

SEQ ID NO: 1206688 - DNA, 22 bp, Artificial Sequence
  chemically synthesized
aatgttattaaatattatctca

SEQ ID NO: 1206689 - DNA, 22 bp, Artificial Sequence
  chemically synthesized
atgttattaaatattatctcag

SEQ ID NO: 1206690 - DNA, 22 bp, Artificial Sequence
  chemically synthesized
ttaaatattatctcaggatctt

SEQ ID NO: 1206691 - DNA, 22 bp, Artificial Sequence
  chemically synthesized
aatattatctcaggatcttgaa

SEQ ID NO: 1206692 - DNA, 22 bp, Artificial Sequence
  chemically synthesized
tctcaggatcttgaagtctatt

SEQ ID NO: 1206693 - DNA, 22 bp, Artificial Sequence
  chemically synthesized
aggatcttgaagtctattggat

SEQ ID NO: 1206694 - DNA, 22 bp, Artificial Sequence
  chemically synthesized
aatcagcataacaatccaatag

SEQ ID NO: 1206695 - DNA, 22 bp, Artificial Sequence
  chemically synthesized
aaatcagcataacaatccaata

SEQ ID NO: 1206696 - DNA, 22 bp, Artificial Sequence
  chemically synthesized
taaatcagcataacaatccaat

SEQ ID NO: 1206697 - DNA, 22 bp, Artificial Sequence
  chemically synthesized
tttaaatcagcataacaatcca

SEQ ID NO: 1206698 - DNA, 22 bp, Artificial Sequence
  chemically synthesized
gaagtctattggattgttatgc

SEQ ID NO: 1206699 - DNA, 22 bp, Artificial Sequence
  chemically synthesized
aagtctattggattgttatgct

SEQ ID NO: 1206700 - DNA, 22 bp, Artificial Sequence
  chemically synthesized
cactctttaaatcagcataaca

SEQ ID NO: 1206701 - DNA, 22 bp, Artificial Sequence
  chemically synthesized
gcactctttaaatcagcataac

SEQ ID NO: 1206702 - DNA, 22 bp, Artificial Sequence
  chemically synthesized
tgcactctttaaatcagcataa

SEQ ID NO: 1206703 - DNA, 22 bp, Artificial Sequence
  chemically synthesized
ttgcactctttaaatcagcata

SEQ ID NO: 1206704 - DNA, 22 bp, Artificial Sequence
  chemically synthesized
ttggattgttatgctgatttaa

SEQ ID NO: 1206705 - DNA, 22 bp, Artificial Sequence
  chemically synthesized
gattgttatgctgatttaaaga

SEQ ID NO: 1206706 - DNA, 22 bp, Artificial Sequence
  chemically synthesized
taaatatttttgcactctttaa

SEQ ID NO: 1206707 - DNA, 22 bp, Artificial Sequence
  chemically synthesized
ttatgctgatttaaagagtgca

SEQ ID NO: 1206708 - DNA, 22 bp, Artificial Sequence
  chemically synthesized
tgctgatttaaagagtgcaaaa

SEQ ID NO: 1206709 - DNA, 22 bp, Artificial Sequence
  chemically synthesized
atttaaagagtgcaaaaatatt

SEQ ID NO: 1206710 - DNA, 22 bp, Artificial Sequence
  chemically synthesized
aaacataactataaatattttt

SEQ ID NO: 1206711 - DNA, 22 bp, Artificial Sequence
  chemically synthesized
aaagagtgcaaaaatatttata

SEQ ID NO: 1206712 - DNA, 22 bp, Artificial Sequence
  chemically synthesized
aagagtgcaaaaatatttatag

SEQ ID NO: 1206713 - DNA, 22 bp, Artificial Sequence
  chemically synthesized
aactaaaacataactataaata

SEQ ID NO: 1206714 - DNA, 22 bp, Artificial Sequence
  chemically synthesized
aaactaaaacataactataaat

SEQ ID NO: 1206715 - DNA, 22 bp, Artificial Sequence
  chemically synthesized
taaactaaaacataactataaa

SEQ ID NO: 1206716 - DNA, 22 bp, Artificial Sequence
  chemically synthesized
ctttaaactaaaacataactat

SEQ ID NO: 1206717 - DNA, 22 bp, Artificial Sequence
  chemically synthesized
atcactgctttaaactaaaaca

SEQ ID NO: 1206718 - DNA, 22 bp, Artificial Sequence
  chemically synthesized
aatcactgctttaaactaaaac

SEQ ID NO: 1206719 - DNA, 22 bp, Artificial Sequence
  chemically synthesized
atagttatgttttagtttaaag

SEQ ID NO: 1206720 - DNA, 22 bp, Artificial Sequence
  chemically synthesized
tagttatgttttagtttaaagc

SEQ ID NO: 1206721 - DNA, 22 bp, Artificial Sequence
  chemically synthesized
tatttaatcactgctttaaact

SEQ ID NO: 1206722 - DNA, 22 bp, Artificial Sequence
  chemically synthesized
tgttttagtttaaagcagtgat

SEQ ID NO: 1206723 - DNA, 22 bp, Artificial Sequence
  chemically synthesized
tagtttaaagcagtgattaaat

SEQ ID NO: 1206724 - DNA, 22 bp, Artificial Sequence
  chemically synthesized
agtttaaagcagtgattaaata

SEQ ID NO: 1206725 - DNA, 22 bp, Artificial Sequence
  chemically synthesized
gtttaaagcagtgattaaatat

SEQ ID NO: 1206726 - DNA, 22 bp, Artificial Sequence
  chemically synthesized
aaagcagtgattaaatataatt

SEQ ID NO: 1206727 - DNA, 22 bp, Artificial Sequence
  chemically synthesized
aagcagtgattaaatataattt

SEQ ID NO: 1206728 - DNA, 22 bp, Artificial Sequence
  chemically synthesized
cagggtcacaggcaaattatat

SEQ ID NO: 1206729 - DNA, 22 bp, Artificial Sequence
  chemically synthesized
gcctacagggtcacaggcaaat

SEQ ID NO: 1206730 - DNA, 22 bp, Artificial Sequence
  chemically synthesized
ggcctacagggtcacaggcaaa

SEQ ID NO: 1206731 - DNA, 22 bp, Artificial Sequence
  chemically synthesized
tggcctacagggtcacaggcaa

SEQ ID NO: 1206732 - DNA, 22 bp, Artificial Sequence
  chemically synthesized
ttttggcctacagggtcacagg

SEQ ID NO: 1206733 - DNA, 22 bp, Artificial Sequence
  chemically synthesized
aatataatttgcctgtgaccct

SEQ ID NO: 1206734 - DNA, 22 bp, Artificial Sequence
  chemically synthesized
gcctgtgaccctgtaggccaaa

SEQ ID NO: 1206735 - DNA, 22 bp, Artificial Sequence
  chemically synthesized
cctgtgaccctgtaggccaaaa

SEQ ID NO: 1206736 - DNA, 22 bp, Artificial Sequence
  chemically synthesized
tcgtgatacattattttggcct

SEQ ID NO: 1206737 - DNA, 22 bp, Artificial Sequence
  chemically synthesized
atcgtgatacattattttggcc

SEQ ID NO: 1206738 - DNA, 22 bp, Artificial Sequence
  chemically synthesized
tgaccctgtaggccaaaataat

SEQ ID NO: 1206739 - DNA, 22 bp, Artificial Sequence
  chemically synthesized
cagtttatcgtgatacattatt

SEQ ID NO: 1206740 - DNA, 22 bp, Artificial Sequence
  chemically synthesized
taggccaaaataatgtatcacg

SEQ ID NO: 1206741 - DNA, 22 bp, Artificial Sequence
  chemically synthesized
tctacagtttatcgtgatacat

SEQ ID NO: 1206742 - DNA, 22 bp, Artificial Sequence
  chemically synthesized
acactatctacagtttatcgtg

SEQ ID NO: 1206743 - DNA, 22 bp, Artificial Sequence
  chemically synthesized
tgacactatctacagtttatcg

SEQ ID NO: 1206744 - DNA, 22 bp, Artificial Sequence
  chemically synthesized
atctctgacactatctacagtt

SEQ ID NO: 1206745 - DNA, 22 bp, Artificial Sequence
  chemically synthesized
catctctgacactatctacagt

SEQ ID NO: 1206746 - DNA, 22 bp, Artificial Sequence
  chemically synthesized
tcatctctgacactatctacag

SEQ ID NO: 1206747 - DNA, 22 bp, Artificial Sequence
  chemically synthesized
ttttcatctctgacactatcta

SEQ ID NO: 1206748 - DNA, 22 bp, Artificial Sequence
  chemically synthesized
tagatagtgtcagagatgaaaa

SEQ ID NO: 1206749 - DNA, 22 bp, Artificial Sequence
  chemically synthesized
aagcagacaaacactgttttca

SEQ ID NO: 1206750 - DNA, 22 bp, Artificial Sequence
  chemically synthesized
acatatgaatacactaaagcag

SEQ ID NO: 1206751 - DNA, 22 bp, Artificial Sequence
  chemically synthesized
atcctcacatatgaatacacta

SEQ ID NO: 1206752 - DNA, 22 bp, Artificial Sequence
  chemically synthesized
gtctgctttagtgtattcatat

SEQ ID NO: 1206753 - DNA, 22 bp, Artificial Sequence
  chemically synthesized
tctgctttagtgtattcatatg

SEQ ID NO: 1206754 - DNA, 22 bp, Artificial Sequence
  chemically synthesized
ctttagtgtattcatatgtgag

SEQ ID NO: 1206755 - DNA, 22 bp, Artificial Sequence
  chemically synthesized
tagtgtattcatatgtgaggat

SEQ ID NO: 1206756 - DNA, 22 bp, Artificial Sequence
  chemically synthesized
agtgtattcatatgtgaggatg

SEQ ID NO: 1206757 - DNA, 22 bp, Artificial Sequence
  chemically synthesized
gtgtattcatatgtgaggatga

SEQ ID NO: 1206758 - DNA, 22 bp, Artificial Sequence
  chemically synthesized
acaagtgccaaaattcatcctc

SEQ ID NO: 1206759 - DNA, 22 bp, Artificial Sequence
  chemically synthesized
atatgtgaggatgaattttggc

SEQ ID NO: 1206760 - DNA, 22 bp, Artificial Sequence
  chemically synthesized
ataggctgacaagtgccaaaat

SEQ ID NO: 1206761 - DNA, 22 bp, Artificial Sequence
  chemically synthesized
tcataggctgacaagtgccaaa

SEQ ID NO: 1206762 - DNA, 22 bp, Artificial Sequence
  chemically synthesized
ctcataggctgacaagtgccaa

SEQ ID NO: 1206763 - DNA, 22 bp, Artificial Sequence
  chemically synthesized
gtagtaatttctcataggctga

SEQ ID NO: 1206764 - DNA, 22 bp, Artificial Sequence
  chemically synthesized
tggcacttgtcagcctatgaga

SEQ ID NO: 1206765 - DNA, 22 bp, Artificial Sequence
  chemically synthesized
ggcacttgtcagcctatgagaa

SEQ ID NO: 1206766 - DNA, 22 bp, Artificial Sequence
  chemically synthesized
gcacttgtcagcctatgagaaa

SEQ ID NO: 1206767 - DNA, 22 bp, Artificial Sequence
  chemically synthesized
gtctagtagtaatttctcatag

SEQ ID NO: 1206768 - DNA, 22 bp, Artificial Sequence
  chemically synthesized
gtcagcctatgagaaattacta

SEQ ID NO: 1206769 - DNA, 22 bp, Artificial Sequence
  chemically synthesized
tcagcctatgagaaattactac

SEQ ID NO: 1206770 - DNA, 22 bp, Artificial Sequence
  chemically synthesized
acaagtattagtctagtagtaa

SEQ ID NO: 1206771 - DNA, 22 bp, Artificial Sequence
  chemically synthesized
tgagaaattactactagactaa

SEQ ID NO: 1206772 - DNA, 22 bp, Artificial Sequence
  chemically synthesized
tactgacaagtattagtctagt

SEQ ID NO: 1206773 - DNA, 22 bp, Artificial Sequence
  chemically synthesized
ctgtactgacaagtattagtct

SEQ ID NO: 1206774 - DNA, 22 bp, Artificial Sequence
  chemically synthesized
ttactgtactgacaagtattag

SEQ ID NO: 1206775 - DNA, 22 bp, Artificial Sequence
  chemically synthesized
ctactagactaatacttgtcag

SEQ ID NO: 1206776 - DNA, 22 bp, Artificial Sequence
  chemically synthesized
ctagactaatacttgtcagtac

SEQ ID NO: 1206777 - DNA, 22 bp, Artificial Sequence
  chemically synthesized
gactaatacttgtcagtacagt

SEQ ID NO: 1206778 - DNA, 22 bp, Artificial Sequence
  chemically synthesized
atacttgtcagtacagtaacaa

SEQ ID NO: 1206779 - DNA, 22 bp, Artificial Sequence
  chemically synthesized
gagcatgatgagttgttactgt

SEQ ID NO: 1206780 - DNA, 22 bp, Artificial Sequence
  chemically synthesized
agagcatgatgagttgttactg

SEQ ID NO: 1206781 - DNA, 22 bp, Artificial Sequence
  chemically synthesized
gtcagtacagtaacaactcatc

SEQ ID NO: 1206782 - DNA, 22 bp, Artificial Sequence
  chemically synthesized
tcagtacagtaacaactcatca

SEQ ID NO: 1206783 - DNA, 22 bp, Artificial Sequence
  chemically synthesized
gtggtgtttagagcatgatgag

SEQ ID NO: 1206784 - DNA, 22 bp, Artificial Sequence
  chemically synthesized
agtggtgtttagagcatgatga

SEQ ID NO: 1206785 - DNA, 22 bp, Artificial Sequence
  chemically synthesized
ccttagtggtgtttagagcatg

SEQ ID NO: 1206786 - DNA, 22 bp, Artificial Sequence
  chemically synthesized
tcccttagtggtgtttagagca

SEQ ID NO: 1206787 - DNA, 22 bp, Artificial Sequence
  chemically synthesized
ctcccttagtggtgtttagagc

SEQ ID NO: 1206788 - DNA, 22 bp, Artificial Sequence
  chemically synthesized
tctcccttagtggtgtttagag

SEQ ID NO: 1206789 - DNA, 22 bp, Artificial Sequence
  chemically synthesized
ttctcccttagtggtgtttaga

SEQ ID NO: 1206790 - DNA, 22 bp, Artificial Sequence
  chemically synthesized
atcatgctctaaacaccactaa

SEQ ID NO: 1206791 - DNA, 22 bp, Artificial Sequence
  chemically synthesized
atcacttttctcccttagtggt

SEQ ID NO: 1206792 - DNA, 22 bp, Artificial Sequence
  chemically synthesized
ttcatcacttttctcccttagt

SEQ ID NO: 1206793 - DNA, 22 bp, Artificial Sequence
  chemically synthesized
taaacaccactaagggagaaaa

SEQ ID NO: 1206794 - DNA, 22 bp, Artificial Sequence
  chemically synthesized
aacaccactaagggagaaaagt

SEQ ID NO: 1206795 - DNA, 22 bp, Artificial Sequence
  chemically synthesized
tatgttattcatcacttttctc

SEQ ID NO: 1206796 - DNA, 22 bp, Artificial Sequence
  chemically synthesized
gtatgttattcatcacttttct

SEQ ID NO: 1206797 - DNA, 22 bp, Artificial Sequence
  chemically synthesized
tgtatgttattcatcacttttc

SEQ ID NO: 1206798 - DNA, 22 bp, Artificial Sequence
  chemically synthesized
ctttgtatgttattcatcactt

SEQ ID NO: 1206799 - DNA, 22 bp, Artificial Sequence
  chemically synthesized
actttgtatgttattcatcact

SEQ ID NO: 1206800 - DNA, 22 bp, Artificial Sequence
  chemically synthesized
tactttgtatgttattcatcac

SEQ ID NO: 1206801 - DNA, 22 bp, Artificial Sequence
  chemically synthesized
ttactttgtatgttattcatca

SEQ ID NO: 1206802 - DNA, 22 bp, Artificial Sequence
  chemically synthesized
agggagaaaagtgatgaataac

SEQ ID NO: 1206803 - DNA, 22 bp, Artificial Sequence
  chemically synthesized
tgaaaatttttactttgtatgt

SEQ ID NO: 1206804 - DNA, 22 bp, Artificial Sequence
  chemically synthesized
atgtgattgtgaaaatttttac

SEQ ID NO: 1206805 - DNA, 22 bp, Artificial Sequence
  chemically synthesized
gagtcattaatgtgattgtgaa

SEQ ID NO: 1206806 - DNA, 22 bp, Artificial Sequence
  chemically synthesized
aactagagtcattaatgtgatt

SEQ ID NO: 1206807 - DNA, 22 bp, Artificial Sequence
  chemically synthesized
gaactagagtcattaatgtgat

SEQ ID NO: 1206808 - DNA, 22 bp, Artificial Sequence
  chemically synthesized
tgaactagagtcattaatgtga

SEQ ID NO: 1206809 - DNA, 22 bp, Artificial Sequence
  chemically synthesized
tgctttgaactagagtcattaa

SEQ ID NO: 1206810 - DNA, 22 bp, Artificial Sequence
  chemically synthesized
tcacaatcacattaatgactct

SEQ ID NO: 1206811 - DNA, 22 bp, Artificial Sequence
  chemically synthesized
cacaatcacattaatgactcta

SEQ ID NO: 1206812 - DNA, 22 bp, Artificial Sequence
  chemically synthesized
acaatcacattaatgactctag

SEQ ID NO: 1206813 - DNA, 22 bp, Artificial Sequence
  chemically synthesized
ctgtgctttgaactagagtcat

SEQ ID NO: 1206814 - DNA, 22 bp, Artificial Sequence
  chemically synthesized
gtagaccattactgtgctttga

SEQ ID NO: 1206815 - DNA, 22 bp, Artificial Sequence
  chemically synthesized
atgactctagttcaaagcacag

SEQ ID NO: 1206816 - DNA, 22 bp, Artificial Sequence
  chemically synthesized
tagttcaaagcacagtaatggt

SEQ ID NO: 1206817 - DNA, 22 bp, Artificial Sequence
  chemically synthesized
gttcaaagcacagtaatggtct

SEQ ID NO: 1206818 - DNA, 22 bp, Artificial Sequence
  chemically synthesized
gacaataaggttggtagaccat

SEQ ID NO: 1206819 - DNA, 22 bp, Artificial Sequence
  chemically synthesized
aaagcacagtaatggtctacca

SEQ ID NO: 1206820 - DNA, 22 bp, Artificial Sequence
  chemically synthesized
aaatatagattggacaataagg

SEQ ID NO: 1206821 - DNA, 22 bp, Artificial Sequence
  chemically synthesized
gaaatatagattggacaataag

SEQ ID NO: 1206822 - DNA, 22 bp, Artificial Sequence
  chemically synthesized
ccaaccttattgtccaatctat

SEQ ID NO: 1206823 - DNA, 22 bp, Artificial Sequence
  chemically synthesized
attgtccaatctatatttcaag

SEQ ID NO: 1206824 - DNA, 22 bp, Artificial Sequence
  chemically synthesized
ttgtccaatctatatttcaagt

SEQ ID NO: 1206825 - DNA, 22 bp, Artificial Sequence
  chemically synthesized
tccaatctatatttcaagtgtc

SEQ ID NO: 1206826 - DNA, 22 bp, Artificial Sequence
  chemically synthesized
aaagatatcaaggtagacactt

SEQ ID NO: 1206827 - DNA, 22 bp, Artificial Sequence
  chemically synthesized
tgaaagatatcaaggtagacac

SEQ ID NO: 1206828 - DNA, 22 bp, Artificial Sequence
  chemically synthesized
tatttcaagtgtctaccttgat

SEQ ID NO: 1206829 - DNA, 22 bp, Artificial Sequence
  chemically synthesized
attctgaaagatatcaaggtag

SEQ ID NO: 1206830 - DNA, 22 bp, Artificial Sequence
  chemically synthesized
caagtgtctaccttgatatctt

SEQ ID NO: 1206831 - DNA, 22 bp, Artificial Sequence
  chemically synthesized
aagtgtctaccttgatatcttt

SEQ ID NO: 1206832 - DNA, 22 bp, Artificial Sequence
  chemically synthesized
acgtaaaattgattctgaaaga

SEQ ID NO: 1206833 - DNA, 22 bp, Artificial Sequence
  chemically synthesized
gacgtaaaattgattctgaaag

SEQ ID NO: 1206834 - DNA, 22 bp, Artificial Sequence
  chemically synthesized
ccttgatatctttcagaatcaa

SEQ ID NO: 1206835 - DNA, 22 bp, Artificial Sequence
  chemically synthesized
gaatttgacgtaaaattgattc

SEQ ID NO: 1206836 - DNA, 22 bp, Artificial Sequence
  chemically synthesized
gatatctttcagaatcaatttt

SEQ ID NO: 1206837 - DNA, 22 bp, Artificial Sequence
  chemically synthesized
atatctttcagaatcaatttta

SEQ ID NO: 1206838 - DNA, 22 bp, Artificial Sequence
  chemically synthesized
attggaatttgacgtaaaattg

SEQ ID NO: 1206839 - DNA, 22 bp, Artificial Sequence
  chemically synthesized
tcagaatcaattttacgtcaaa

SEQ ID NO: 1206840 - DNA, 22 bp, Artificial Sequence
  chemically synthesized
tgttaattggaatttgacgtaa

SEQ ID NO: 1206841 - DNA, 22 bp, Artificial Sequence
  chemically synthesized
cagaatcaattttacgtcaaat

SEQ ID NO: 1206842 - DNA, 22 bp, Artificial Sequence
  chemically synthesized
agaatcaattttacgtcaaatt

SEQ ID NO: 1206843 - DNA, 22 bp, Artificial Sequence
  chemically synthesized
tatgttaattggaatttgacgt

SEQ ID NO: 1206844 - DNA, 22 bp, Artificial Sequence
  chemically synthesized
ctatgttaattggaatttgacg

SEQ ID NO: 1206845 - DNA, 22 bp, Artificial Sequence
  chemically synthesized
tctatgttaattggaatttgac

SEQ ID NO: 1206846 - DNA, 22 bp, Artificial Sequence
  chemically synthesized
ttctatgttaattggaatttga

SEQ ID NO: 1206847 - DNA, 22 bp, Artificial Sequence
  chemically synthesized
tttctatgttaattggaatttg

SEQ ID NO: 1206848 - DNA, 22 bp, Artificial Sequence
  chemically synthesized
ttttctatgttaattggaattt

SEQ ID NO: 1206849 - DNA, 22 bp, Artificial Sequence
  chemically synthesized
tttttctatgttaattggaatt

SEQ ID NO: 1206850 - DNA, 22 bp, Artificial Sequence
  chemically synthesized
ctttttttctatgttaattgga

SEQ ID NO: 1206851 - DNA, 22 bp, Artificial Sequence
  chemically synthesized
tacgtcaaattccaattaacat

SEQ ID NO: 1206852 - DNA, 22 bp, Artificial Sequence
  chemically synthesized
acgtcaaattccaattaacata

SEQ ID NO: 1206853 - DNA, 22 bp, Artificial Sequence
  chemically synthesized
ctgctttttttctatgttaatt

SEQ ID NO: 1206854 - DNA, 22 bp, Artificial Sequence
  chemically synthesized
cgtcaaattccaattaacatag

SEQ ID NO: 1206855 - DNA, 22 bp, Artificial Sequence
  chemically synthesized
tcgctactgctttttttctatg

SEQ ID NO: 1206856 - DNA, 22 bp, Artificial Sequence
  chemically synthesized
atcgctactgctttttttctat

SEQ ID NO: 1206857 - DNA, 22 bp, Artificial Sequence
  chemically synthesized
tatcgctactgctttttttcta

SEQ ID NO: 1206858 - DNA, 22 bp, Artificial Sequence
  chemically synthesized
ttatcgctactgctttttttct

SEQ ID NO: 1206859 - DNA, 22 bp, Artificial Sequence
  chemically synthesized
caattaacatagaaaaaaagca

SEQ ID NO: 1206860 - DNA, 22 bp, Artificial Sequence
  chemically synthesized
acatagaaaaaaagcagtagcg

SEQ ID NO: 1206861 - DNA, 22 bp, Artificial Sequence
  chemically synthesized
gaaaagtcaatagagacatgtt

SEQ ID NO: 1206862 - DNA, 22 bp, Artificial Sequence
  chemically synthesized
ggaaaagtcaatagagacatgt

SEQ ID NO: 1206863 - DNA, 22 bp, Artificial Sequence
  chemically synthesized
tggaaaagtcaatagagacatg

SEQ ID NO: 1206864 - DNA, 22 bp, Artificial Sequence
  chemically synthesized
ttggaaaagtcaatagagacat

SEQ ID NO: 1206865 - DNA, 22 bp, Artificial Sequence
  chemically synthesized
cttttggaaaagtcaatagaga

SEQ ID NO: 1206866 - DNA, 22 bp, Artificial Sequence
  chemically synthesized
gagagcacgattgcttttggaa

SEQ ID NO: 1206867 - DNA, 22 bp, Artificial Sequence
  chemically synthesized
ggagagcacgattgcttttgga

SEQ ID NO: 1206868 - DNA, 22 bp, Artificial Sequence
  chemically synthesized
tattgacttttccaaaagcaat

SEQ ID NO: 1206869 - DNA, 22 bp, Artificial Sequence
  chemically synthesized
ttgacttttccaaaagcaatcg

SEQ ID NO: 1206870 - DNA, 22 bp, Artificial Sequence
  chemically synthesized
gggtttggagagcacgattgct

SEQ ID NO: 1206871 - DNA, 22 bp, Artificial Sequence
  chemically synthesized
acttttccaaaagcaatcgtgc

SEQ ID NO: 1206872 - DNA, 22 bp, Artificial Sequence
  chemically synthesized
ttccaaaagcaatcgtgctctc

SEQ ID NO: 1206873 - DNA, 22 bp, Artificial Sequence
  chemically synthesized
tccaaaagcaatcgtgctctcc

SEQ ID NO: 1206874 - DNA, 22 bp, Artificial Sequence
  chemically synthesized
ccaaaagcaatcgtgctctcca

SEQ ID NO: 1206875 - DNA, 22 bp, Artificial Sequence
  chemically synthesized
caaaagcaatcgtgctctccaa

SEQ ID NO: 1206876 - DNA, 22 bp, Artificial Sequence
  chemically synthesized
agtaatagtaaatgaggctggg

SEQ ID NO: 1206877 - DNA, 22 bp, Artificial Sequence
  chemically synthesized
cagtaatagtaaatgaggctgg

SEQ ID NO: 1206878 - DNA, 22 bp, Artificial Sequence
  chemically synthesized
cttcagtaatagtaaatgaggc

SEQ ID NO: 1206879 - DNA, 22 bp, Artificial Sequence
  chemically synthesized
tccaaaccccagcctcatttac

SEQ ID NO: 1206880 - DNA, 22 bp, Artificial Sequence
  chemically synthesized
gcttcagtaatagtaaatgagg

SEQ ID NO: 1206881 - DNA, 22 bp, Artificial Sequence
  chemically synthesized
tgcttcagtaatagtaaatgag

SEQ ID NO: 1206882 - DNA, 22 bp, Artificial Sequence
  chemically synthesized
caaaccccagcctcatttacta

SEQ ID NO: 1206883 - DNA, 22 bp, Artificial Sequence
  chemically synthesized
gttttgcttcagtaatagtaaa

SEQ ID NO: 1206884 - DNA, 22 bp, Artificial Sequence
  chemically synthesized
cgttttgcttcagtaatagtaa

SEQ ID NO: 1206885 - DNA, 22 bp, Artificial Sequence
  chemically synthesized
gtatttcgttttgcttcagtaa

SEQ ID NO: 1206886 - DNA, 22 bp, Artificial Sequence
  chemically synthesized
agtatttcgttttgcttcagta

SEQ ID NO: 1206887 - DNA, 22 bp, Artificial Sequence
  chemically synthesized
ttagtatttcgttttgcttcag

SEQ ID NO: 1206888 - DNA, 22 bp, Artificial Sequence
  chemically synthesized
atttactattactgaagcaaaa

SEQ ID NO: 1206889 - DNA, 22 bp, Artificial Sequence
  chemically synthesized
actattactgaagcaaaacgaa

SEQ ID NO: 1206890 - DNA, 22 bp, Artificial Sequence
  chemically synthesized
ctattactgaagcaaaacgaaa

SEQ ID NO: 1206891 - DNA, 22 bp, Artificial Sequence
  chemically synthesized
ttactgaagcaaaacgaaatac

SEQ ID NO: 1206892 - DNA, 22 bp, Artificial Sequence
  chemically synthesized
ctgaagcaaaacgaaatactaa

SEQ ID NO: 1206893 - DNA, 22 bp, Artificial Sequence
  chemically synthesized
cacacagtactcttagtatttc

SEQ ID NO: 1206894 - DNA, 22 bp, Artificial Sequence
  chemically synthesized
gcacacagtactcttagtattt

SEQ ID NO: 1206895 - DNA, 22 bp, Artificial Sequence
  chemically synthesized
aagcaaaacgaaatactaagag

SEQ ID NO: 1206896 - DNA, 22 bp, Artificial Sequence
  chemically synthesized
tttgcacacagtactcttagta

SEQ ID NO: 1206897 - DNA, 22 bp, Artificial Sequence
  chemically synthesized
atttgcacacagtactcttagt

SEQ ID NO: 1206898 - DNA, 22 bp, Artificial Sequence
  chemically synthesized
tatttgcacacagtactcttag

SEQ ID NO: 1206899 - DNA, 22 bp, Artificial Sequence
  chemically synthesized
ttatttgcacacagtactctta

SEQ ID NO: 1206900 - DNA, 22 bp, Artificial Sequence
  chemically synthesized
tttatttgcacacagtactctt

SEQ ID NO: 1206901 - DNA, 22 bp, Artificial Sequence
  chemically synthesized
agagtactgtgtgcaaataaaa

SEQ ID NO: 1206902 - DNA, 22 bp, Artificial Sequence
  chemically synthesized
acagataatcaacaaacgtttt

SEQ ID NO: 1206903 - DNA, 22 bp, Artificial Sequence
  chemically synthesized
tgtgcaaataaaaaacgtttgt

SEQ ID NO: 1206904 - DNA, 22 bp, Artificial Sequence
  chemically synthesized
aacagataatcaacaaacgttt

SEQ ID NO: 1206905 - DNA, 22 bp, Artificial Sequence
  chemically synthesized
taacagataatcaacaaacgtt

SEQ ID NO: 1206906 - DNA, 22 bp, Artificial Sequence
  chemically synthesized
ttaacagataatcaacaaacgt

SEQ ID NO: 1206907 - DNA, 22 bp, Artificial Sequence
  chemically synthesized
tttaacagataatcaacaaacg

SEQ ID NO: 1206908 - DNA, 22 bp, Artificial Sequence
  chemically synthesized
ttttaacagataatcaacaaac

SEQ ID NO: 1206909 - DNA, 22 bp, Artificial Sequence
  chemically synthesized
gggtcttttttaacagataatc

SEQ ID NO: 1206910 - DNA, 22 bp, Artificial Sequence
  chemically synthesized
ggggtcttttttaacagataat

SEQ ID NO: 1206911 - DNA, 22 bp, Artificial Sequence
  chemically synthesized
atttggggtcttttttaacaga

SEQ ID NO: 1206912 - DNA, 22 bp, Artificial Sequence
  chemically synthesized
aatttggggtcttttttaacag

SEQ ID NO: 1206913 - DNA, 22 bp, Artificial Sequence
  chemically synthesized
taatttggggtcttttttaaca

SEQ ID NO: 1206914 - DNA, 22 bp, Artificial Sequence
  chemically synthesized
ttaatttggggtcttttttaac

SEQ ID NO: 1206915 - DNA, 22 bp, Artificial Sequence
  chemically synthesized
gttgattatctgttaaaaaaga

SEQ ID NO: 1206916 - DNA, 22 bp, Artificial Sequence
  chemically synthesized
ttgattatctgttaaaaaagac

SEQ ID NO: 1206917 - DNA, 22 bp, Artificial Sequence
  chemically synthesized
tttttaatttggggtctttttt

SEQ ID NO: 1206918 - DNA, 22 bp, Artificial Sequence
  chemically synthesized
attatctgttaaaaaagacccc

SEQ ID NO: 1206919 - DNA, 22 bp, Artificial Sequence
  chemically synthesized
ggctgtttttaatttggggtct

SEQ ID NO: 1206920 - DNA, 22 bp, Artificial Sequence
  chemically synthesized
tctgttaaaaaagaccccaaat

SEQ ID NO: 1206921 - DNA, 22 bp, Artificial Sequence
  chemically synthesized
aggctgtttttaatttggggtc

SEQ ID NO: 1206922 - DNA, 22 bp, Artificial Sequence
  chemically synthesized
tttaggctgtttttaatttggg

SEQ ID NO: 1206923 - DNA, 22 bp, Artificial Sequence
  chemically synthesized
ttaaaaaagaccccaaattaaa

SEQ ID NO: 1206924 - DNA, 22 bp, Artificial Sequence
  chemically synthesized
aaaaagaccccaaattaaaaac

SEQ ID NO: 1206925 - DNA, 22 bp, Artificial Sequence
  chemically synthesized
attatttaggctgtttttaatt

SEQ ID NO: 1206926 - DNA, 22 bp, Artificial Sequence
  chemically synthesized
tgtgcgggtaatactcattatt

SEQ ID NO: 1206927 - DNA, 22 bp, Artificial Sequence
  chemically synthesized
aaaacagcctaaataatgagta

SEQ ID NO: 1206928 - DNA, 22 bp, Artificial Sequence
  chemically synthesized
ttgtgtgcgggtaatactcatt

SEQ ID NO: 1206929 - DNA, 22 bp, Artificial Sequence
  chemically synthesized
ttgttgtgtgcgggtaatactc

SEQ ID NO: 1206930 - DNA, 22 bp, Artificial Sequence
  chemically synthesized
aataatgagtattacccgcaca

SEQ ID NO: 1206931 - DNA, 22 bp, Artificial Sequence
  chemically synthesized
taaatccatagcatactgttgt

SEQ ID NO: 1206932 - DNA, 22 bp, Artificial Sequence
  chemically synthesized
ataaatccatagcatactgttg

SEQ ID NO: 1206933 - DNA, 22 bp, Artificial Sequence
  chemically synthesized
cccgcacacaacaacagtatgc

SEQ ID NO: 1206934 - DNA, 22 bp, Artificial Sequence
  chemically synthesized
tataaatccatagcatactgtt

SEQ ID NO: 1206935 - DNA, 22 bp, Artificial Sequence
  chemically synthesized
ggaagaatgataattttataaa

SEQ ID NO: 1206936 - DNA, 22 bp, Artificial Sequence
  chemically synthesized
aggaagaatgataattttataa

SEQ ID NO: 1206937 - DNA, 22 bp, Artificial Sequence
  chemically synthesized
tggatttataaaattatcattc

SEQ ID NO: 1206938 - DNA, 22 bp, Artificial Sequence
  chemically synthesized
tcagtttaggaagaatgataat

SEQ ID NO: 1206939 - DNA, 22 bp, Artificial Sequence
  chemically synthesized
gttatcagtttaggaagaatga

SEQ ID NO: 1206940 - DNA, 22 bp, Artificial Sequence
  chemically synthesized
cgttatcagtttaggaagaatg

SEQ ID NO: 1206941 - DNA, 22 bp, Artificial Sequence
  chemically synthesized
tcgttatcagtttaggaagaat

SEQ ID NO: 1206942 - DNA, 22 bp, Artificial Sequence
  chemically synthesized
ataaaattatcattcttcctaa

SEQ ID NO: 1206943 - DNA, 22 bp, Artificial Sequence
  chemically synthesized
taaaattatcattcttcctaaa

SEQ ID NO: 1206944 - DNA, 22 bp, Artificial Sequence
  chemically synthesized
aagattttcgttatcagtttag

SEQ ID NO: 1206945 - DNA, 22 bp, Artificial Sequence
  chemically synthesized
aaagattttcgttatcagttta

SEQ ID NO: 1206946 - DNA, 22 bp, Artificial Sequence
  chemically synthesized
taaagattttcgttatcagttt

SEQ ID NO: 1206947 - DNA, 22 bp, Artificial Sequence
  chemically synthesized
tcattcttcctaaactgataac

SEQ ID NO: 1206948 - DNA, 22 bp, Artificial Sequence
  chemically synthesized
attttaaagattttcgttatca

SEQ ID NO: 1206949 - DNA, 22 bp, Artificial Sequence
  chemically synthesized
ttcctaaactgataacgaaaat

SEQ ID NO: 1206950 - DNA, 22 bp, Artificial Sequence
  chemically synthesized
ttcattttaaagattttcgtta

SEQ ID NO: 1206951 - DNA, 22 bp, Artificial Sequence
  chemically synthesized
attcattttaaagattttcgtt

SEQ ID NO: 1206952 - DNA, 22 bp, Artificial Sequence
  chemically synthesized
cctaaactgataacgaaaatct

SEQ ID NO: 1206953 - DNA, 22 bp, Artificial Sequence
  chemically synthesized
tattcattttaaagattttcgt

SEQ ID NO: 1206954 - DNA, 22 bp, Artificial Sequence
  chemically synthesized
ctaaactgataacgaaaatctt

SEQ ID NO: 1206955 - DNA, 22 bp, Artificial Sequence
  chemically synthesized
aactgataacgaaaatctttaa

SEQ ID NO: 1206956 - DNA, 22 bp, Artificial Sequence
  chemically synthesized
ataacgaaaatctttaaaatga

SEQ ID NO: 1206957 - DNA, 22 bp, Artificial Sequence
  chemically synthesized
gtaacattttattcattttaaa

SEQ ID NO: 1206958 - DNA, 22 bp, Artificial Sequence
  chemically synthesized
tgaaatatattagtaacatttt

SEQ ID NO: 1206959 - DNA, 22 bp, Artificial Sequence
  chemically synthesized
taaaatgaataaaatgttacta

SEQ ID NO: 1206960 - DNA, 22 bp, Artificial Sequence
  chemically synthesized
aaaatgaataaaatgttactaa

SEQ ID NO: 1206961 - DNA, 22 bp, Artificial Sequence
  chemically synthesized
aaatgaataaaatgttactaat

SEQ ID NO: 1206962 - DNA, 22 bp, Artificial Sequence
  chemically synthesized
agtgcatactgtgaaatatatt

SEQ ID NO: 1206963 - DNA, 22 bp, Artificial Sequence
  chemically synthesized
ctaatatatttcacagtatgca

SEQ ID NO: 1206964 - DNA, 22 bp, Artificial Sequence
  chemically synthesized
tgtagtccattcagtgcatact

SEQ ID NO: 1206965 - DNA, 22 bp, Artificial Sequence
  chemically synthesized
atatatttcacagtatgcactg

SEQ ID NO: 1206966 - DNA, 22 bp, Artificial Sequence
  chemically synthesized
cacagtatgcactgaatggact

SEQ ID NO: 1206967 - DNA, 22 bp, Artificial Sequence
  chemically synthesized
acagtatgcactgaatggacta

SEQ ID NO: 1206968 - DNA, 22 bp, Artificial Sequence
  chemically synthesized
aacccaaatggaattatgtagt

SEQ ID NO: 1206969 - DNA, 22 bp, Artificial Sequence
  chemically synthesized
aaacccaaatggaattatgtag

SEQ ID NO: 1206970 - DNA, 22 bp, Artificial Sequence
  chemically synthesized
aacttaaacccaaatggaatta

SEQ ID NO: 1206971 - DNA, 22 bp, Artificial Sequence
  chemically synthesized
aatggactacataattccattt

SEQ ID NO: 1206972 - DNA, 22 bp, Artificial Sequence
  chemically synthesized
cataattccatttgggtttaag

SEQ ID NO: 1206973 - DNA, 22 bp, Artificial Sequence
  chemically synthesized
gaaaaaaaaaaaacctcaactt

SEQ ID NO: 1206974 - DNA, 22 bp, Artificial Sequence
  chemically synthesized
catttgggtttaagttgaggtt

SEQ ID NO: 1206975 - DNA, 22 bp, Artificial Sequence
  chemically synthesized
gttggaaaaaaaaaaaacctca

SEQ ID NO: 1206976 - DNA, 22 bp, Artificial Sequence
  chemically synthesized
agttggaaaaaaaaaaaacctc

SEQ ID NO: 1206977 - DNA, 22 bp, Artificial Sequence
  chemically synthesized
gggtttaagttgaggttttttt

SEQ ID NO: 1206978 - DNA, 22 bp, Artificial Sequence
  chemically synthesized
ggtttaagttgaggtttttttt

SEQ ID NO: 1206979 - DNA, 22 bp, Artificial Sequence
  chemically synthesized
aagttgaggttttttttttttc

SEQ ID NO: 1206980 - DNA, 22 bp, Artificial Sequence
  chemically synthesized
accatttagttggaaaaaaaaa

SEQ ID NO: 1206981 - DNA, 22 bp, Artificial Sequence
  chemically synthesized
agttgaggttttttttttttcc

SEQ ID NO: 1206982 - DNA, 22 bp, Artificial Sequence
  chemically synthesized
aaccatttagttggaaaaaaaa

SEQ ID NO: 1206983 - DNA, 22 bp, Artificial Sequence
  chemically synthesized
taaccatttagttggaaaaaaa

SEQ ID NO: 1206984 - DNA, 22 bp, Artificial Sequence
  chemically synthesized
ttaaccatttagttggaaaaaa

SEQ ID NO: 1206985 - DNA, 22 bp, Artificial Sequence
  chemically synthesized
aggttttttttttttccaacta

SEQ ID NO: 1206986 - DNA, 22 bp, Artificial Sequence
  chemically synthesized
tttttttttccaactaaatggt

SEQ ID NO: 1206987 - DNA, 22 bp, Artificial Sequence
  chemically synthesized
ttttttttccaactaaatggtt

SEQ ID NO: 1206988 - DNA, 22 bp, Artificial Sequence
  chemically synthesized
aacataatttttaaccatttag

SEQ ID NO: 1206989 - DNA, 22 bp, Artificial Sequence
  chemically synthesized
tttttttccaactaaatggtta

SEQ ID NO: 1206990 - DNA, 22 bp, Artificial Sequence
  chemically synthesized
ttttttccaactaaatggttaa

SEQ ID NO: 1206991 - DNA, 22 bp, Artificial Sequence
  chemically synthesized
taaacataatttttaaccattt

SEQ ID NO: 1206992 - DNA, 22 bp, Artificial Sequence
  chemically synthesized
tttttccaactaaatggttaaa

SEQ ID NO: 1206993 - DNA, 22 bp, Artificial Sequence
  chemically synthesized
ttttccaactaaatggttaaaa

SEQ ID NO: 1206994 - DNA, 22 bp, Artificial Sequence
  chemically synthesized
tctaaacataatttttaaccat

SEQ ID NO: 1206995 - DNA, 22 bp, Artificial Sequence
  chemically synthesized
tttccaactaaatggttaaaaa

SEQ ID NO: 1206996 - DNA, 22 bp, Artificial Sequence
  chemically synthesized
ttccaactaaatggttaaaaat

SEQ ID NO: 1206997 - DNA, 22 bp, Artificial Sequence
  chemically synthesized
tccaactaaatggttaaaaatt

SEQ ID NO: 1206998 - DNA, 22 bp, Artificial Sequence
  chemically synthesized
ttctctaaacataatttttaac

SEQ ID NO: 1206999 - DNA, 22 bp, Artificial Sequence
  chemically synthesized
ccaactaaatggttaaaaatta

SEQ ID NO: 1207000 - DNA, 22 bp, Artificial Sequence
  chemically synthesized
caactaaatggttaaaaattat

SEQ ID NO: 1207001 - DNA, 22 bp, Artificial Sequence
  chemically synthesized
cagattgttctctaaacataat

SEQ ID NO: 1207002 - DNA, 22 bp, Artificial Sequence
  chemically synthesized
aatggttaaaaattatgtttag

SEQ ID NO: 1207003 - DNA, 22 bp, Artificial Sequence
  chemically synthesized
ccagattgttctctaaacataa

SEQ ID NO: 1207004 - DNA, 22 bp, Artificial Sequence
  chemically synthesized
tccagattgttctctaaacata

SEQ ID NO: 1207005 - DNA, 22 bp, Artificial Sequence
  chemically synthesized
aaaattatgtttagagaacaat

SEQ ID NO: 1207006 - DNA, 22 bp, Artificial Sequence
  chemically synthesized
tgagtatatattttccagattg

SEQ ID NO: 1207007 - DNA, 22 bp, Artificial Sequence
  chemically synthesized
tgtttagagaacaatctggaaa

SEQ ID NO: 1207008 - DNA, 22 bp, Artificial Sequence
  chemically synthesized
tctgtgagtatatattttccag

SEQ ID NO: 1207009 - DNA, 22 bp, Artificial Sequence
  chemically synthesized
agagaacaatctggaaaatata

SEQ ID NO: 1207010 - DNA, 22 bp, Artificial Sequence
  chemically synthesized
gagaacaatctggaaaatatat

SEQ ID NO: 1207011 - DNA, 22 bp, Artificial Sequence
  chemically synthesized
ttgtctgtgagtatatattttc

SEQ ID NO: 1207012 - DNA, 22 bp, Artificial Sequence
  chemically synthesized
tatgcctattgtctgtgagtat

SEQ ID NO: 1207013 - DNA, 22 bp, Artificial Sequence
  chemically synthesized
gaaaatatatactcacagacaa

SEQ ID NO: 1207014 - DNA, 22 bp, Artificial Sequence
  chemically synthesized
tcaattgtatgcctattgtctg

SEQ ID NO: 1207015 - DNA, 22 bp, Artificial Sequence
  chemically synthesized
aattgtcaattgtatgcctatt

SEQ ID NO: 1207016 - DNA, 22 bp, Artificial Sequence
  chemically synthesized
tgctcaattgtcaattgtatgc

SEQ ID NO: 1207017 - DNA, 22 bp, Artificial Sequence
  chemically synthesized
acagacaataggcatacaattg

SEQ ID NO: 1207018 - DNA, 22 bp, Artificial Sequence
  chemically synthesized
atgtagttgtgctcaattgtca

SEQ ID NO: 1207019 - DNA, 22 bp, Artificial Sequence
  chemically synthesized
aatgtagttgtgctcaattgtc

SEQ ID NO: 1207020 - DNA, 22 bp, Artificial Sequence
  chemically synthesized
tagtgtaaatttaatgtagttg

SEQ ID NO: 1207021 - DNA, 22 bp, Artificial Sequence
  chemically synthesized
acaattgagcacaactacatta

SEQ ID NO: 1207022 - DNA, 22 bp, Artificial Sequence
  chemically synthesized
atagtgtaaatttaatgtagtt

SEQ ID NO: 1207023 - DNA, 22 bp, Artificial Sequence
  chemically synthesized
tatagtgtaaatttaatgtagt

SEQ ID NO: 1207024 - DNA, 22 bp, Artificial Sequence
  chemically synthesized
agttttatagtgtaaatttaat

SEQ ID NO: 1207025 - DNA, 22 bp, Artificial Sequence
  chemically synthesized
agcacaactacattaaatttac

SEQ ID NO: 1207026 - DNA, 22 bp, Artificial Sequence
  chemically synthesized
gatgattgagttttatagtgta

SEQ ID NO: 1207027 - DNA, 22 bp, Artificial Sequence
  chemically synthesized
cattaaatttacactataaaac

SEQ ID NO: 1207028 - DNA, 22 bp, Artificial Sequence
  chemically synthesized
aatttacactataaaactcaat

SEQ ID NO: 1207029 - DNA, 22 bp, Artificial Sequence
  chemically synthesized
ataagtgttggatgattgagtt

SEQ ID NO: 1207030 - DNA, 22 bp, Artificial Sequence
  chemically synthesized
acactataaaactcaatcatcc

SEQ ID NO: 1207031 - DNA, 22 bp, Artificial Sequence
  chemically synthesized
cactataaaactcaatcatcca

SEQ ID NO: 1207032 - DNA, 22 bp, Artificial Sequence
  chemically synthesized
gattcataagtgttggatgatt

SEQ ID NO: 1207033 - DNA, 22 bp, Artificial Sequence
  chemically synthesized
ggattcataagtgttggatgat

SEQ ID NO: 1207034 - DNA, 22 bp, Artificial Sequence
  chemically synthesized
taaaactcaatcatccaacact

SEQ ID NO: 1207035 - DNA, 22 bp, Artificial Sequence
  chemically synthesized
gaaaatgtttggattcataagt

SEQ ID NO: 1207036 - DNA, 22 bp, Artificial Sequence
  chemically synthesized
aatcatccaacacttatgaatc

SEQ ID NO: 1207037 - DNA, 22 bp, Artificial Sequence
  chemically synthesized
agaaaatgtttggattcataag

SEQ ID NO: 1207038 - DNA, 22 bp, Artificial Sequence
  chemically synthesized
tagaaaatgtttggattcataa

SEQ ID NO: 1207039 - DNA, 22 bp, Artificial Sequence
  chemically synthesized
taaagttttagaaaatgtttgg

SEQ ID NO: 1207040 - DNA, 22 bp, Artificial Sequence
  chemically synthesized
gtaaagttttagaaaatgtttg

SEQ ID NO: 1207041 - DNA, 22 bp, Artificial Sequence
  chemically synthesized
ttgtaaagttttagaaaatgtt

SEQ ID NO: 1207042 - DNA, 22 bp, Artificial Sequence
  chemically synthesized
cttgtaaagttttagaaaatgt

SEQ ID NO: 1207043 - DNA, 22 bp, Artificial Sequence
  chemically synthesized
tcttgtaaagttttagaaaatg

SEQ ID NO: 1207044 - DNA, 22 bp, Artificial Sequence
  chemically synthesized
atgaatccaaacattttctaaa

SEQ ID NO: 1207045 - DNA, 22 bp, Artificial Sequence
  chemically synthesized
tgaatccaaacattttctaaaa

SEQ ID NO: 1207046 - DNA, 22 bp, Artificial Sequence
  chemically synthesized
taagctttcttgtaaagtttta

SEQ ID NO: 1207047 - DNA, 22 bp, Artificial Sequence
  chemically synthesized
tctaaaactttacaagaaagct

SEQ ID NO: 1207048 - DNA, 22 bp, Artificial Sequence
  chemically synthesized
ctaaaactttacaagaaagctt

SEQ ID NO: 1207049 - DNA, 22 bp, Artificial Sequence
  chemically synthesized
taaaactttacaagaaagctta

SEQ ID NO: 1207050 - DNA, 22 bp, Artificial Sequence
  chemically synthesized
aaactttacaagaaagcttata

SEQ ID NO: 1207051 - DNA, 22 bp, Artificial Sequence
  chemically synthesized
ccatgataaaaacctataagct

SEQ ID NO: 1207052 - DNA, 22 bp, Artificial Sequence
  chemically synthesized
accatgataaaaacctataagc

SEQ ID NO: 1207053 - DNA, 22 bp, Artificial Sequence
  chemically synthesized
taccatgataaaaacctataag

SEQ ID NO: 1207054 - DNA, 22 bp, Artificial Sequence
  chemically synthesized
tacaagaaagcttataggtttt

SEQ ID NO: 1207055 - DNA, 22 bp, Artificial Sequence
  chemically synthesized
acaagaaagcttataggttttt

SEQ ID NO: 1207056 - DNA, 22 bp, Artificial Sequence
  chemically synthesized
caagaaagcttataggttttta

SEQ ID NO: 1207057 - DNA, 22 bp, Artificial Sequence
  chemically synthesized
tatatattttaccatgataaaa

SEQ ID NO: 1207058 - DNA, 22 bp, Artificial Sequence
  chemically synthesized
tgttatatatattttaccatga

SEQ ID NO: 1207059 - DNA, 22 bp, Artificial Sequence
  chemically synthesized
ataggtttttatcatggtaaaa

SEQ ID NO: 1207060 - DNA, 22 bp, Artificial Sequence
  chemically synthesized
atgttatatatattttaccatg

SEQ ID NO: 1207061 - DNA, 22 bp, Artificial Sequence
  chemically synthesized
taggtttttatcatggtaaaat

SEQ ID NO: 1207062 - DNA, 22 bp, Artificial Sequence
  chemically synthesized
tatgttatatatattttaccat

SEQ ID NO: 1207063 - DNA, 22 bp, Artificial Sequence
  chemically synthesized
ttatcatggtaaaatatatata

SEQ ID NO: 1207064 - DNA, 22 bp, Artificial Sequence
  chemically synthesized
tatgttttatgttatatatatt

SEQ ID NO: 1207065 - DNA, 22 bp, Artificial Sequence
  chemically synthesized
tatcatggtaaaatatatataa

SEQ ID NO: 1207066 - DNA, 22 bp, Artificial Sequence
  chemically synthesized
atcatggtaaaatatatataac

SEQ ID NO: 1207067 - DNA, 22 bp, Artificial Sequence
  chemically synthesized
tcatggtaaaatatatataaca

SEQ ID NO: 1207068 - DNA, 22 bp, Artificial Sequence
  chemically synthesized
gaattatatgttttatgttata

SEQ ID NO: 1207069 - DNA, 22 bp, Artificial Sequence
  chemically synthesized
taaatgattagaattatatgtt

SEQ ID NO: 1207070 - DNA, 22 bp, Artificial Sequence
  chemically synthesized
ataaatgattagaattatatgt

SEQ ID NO: 1207071 - DNA, 22 bp, Artificial Sequence
  chemically synthesized
tatgcttataaatgattagaat

SEQ ID NO: 1207072 - DNA, 22 bp, Artificial Sequence
  chemically synthesized
ataaattgtatgcttataaatg

SEQ ID NO: 1207073 - DNA, 22 bp, Artificial Sequence
  chemically synthesized
atgctgataaattgtatgctta

SEQ ID NO: 1207074 - DNA, 22 bp, Artificial Sequence
  chemically synthesized
aatgctgataaattgtatgctt

SEQ ID NO: 1207075 - DNA, 22 bp, Artificial Sequence
  chemically synthesized
taatcatttataagcatacaat

SEQ ID NO: 1207076 - DNA, 22 bp, Artificial Sequence
  chemically synthesized
atcatttataagcatacaattt

SEQ ID NO: 1207077 - DNA, 22 bp, Artificial Sequence
  chemically synthesized
ataagcatacaatttatcagca

SEQ ID NO: 1207078 - DNA, 22 bp, Artificial Sequence
  chemically synthesized
taagcatacaatttatcagcat

SEQ ID NO: 1207079 - DNA, 22 bp, Artificial Sequence
  chemically synthesized
atcagcattaagtatatttacc

SEQ ID NO: 1207080 - DNA, 22 bp, Artificial Sequence
  chemically synthesized
tcagcattaagtatatttacct

SEQ ID NO: 1207081 - DNA, 22 bp, Artificial Sequence
  chemically synthesized
agtatatttaccttgttgtgtc

SEQ ID NO: 1207082 - DNA, 22 bp, Artificial Sequence
  chemically synthesized
accttgttgtgtcaccatcccc

SEQ ID NO: 1207083 - DNA, 22 bp, Artificial Sequence
  chemically synthesized
gaggtggatggtggggatggtg

SEQ ID NO: 1207084 - DNA, 22 bp, Artificial Sequence
  chemically synthesized
ccttgttgtgtcaccatcccca

SEQ ID NO: 1207085 - DNA, 22 bp, Artificial Sequence
  chemically synthesized
ggaggtggatggtggggatggt

SEQ ID NO: 1207086 - DNA, 22 bp, Artificial Sequence
  chemically synthesized
tggaggtggatggtggggatgg

SEQ ID NO: 1207087 - DNA, 22 bp, Artificial Sequence
  chemically synthesized
ttggaggtggatggtggggatg

SEQ ID NO: 1207088 - DNA, 22 bp, Artificial Sequence
  chemically synthesized
gttgtgtcaccatccccaccat

SEQ ID NO: 1207089 - DNA, 22 bp, Artificial Sequence
  chemically synthesized
ttgtgtcaccatccccaccatc

SEQ ID NO: 1207090 - DNA, 22 bp, Artificial Sequence
  chemically synthesized
tgtcaccatccccaccatccac

SEQ ID NO: 1207091 - DNA, 22 bp, Artificial Sequence
  chemically synthesized
ggggaagataatttttggaggt

SEQ ID NO: 1207092 - DNA, 22 bp, Artificial Sequence
  chemically synthesized
gggggaagataatttttggagg

SEQ ID NO: 1207093 - DNA, 22 bp, Artificial Sequence
  chemically synthesized
tgggggaagataatttttggag

SEQ ID NO: 1207094 - DNA, 22 bp, Artificial Sequence
  chemically synthesized
ttgggggaagataatttttgga

SEQ ID NO: 1207095 - DNA, 22 bp, Artificial Sequence
  chemically synthesized
tttgggggaagataatttttgg

SEQ ID NO: 1207096 - DNA, 22 bp, Artificial Sequence
  chemically synthesized
caaaaattatcttcccccaaaa

SEQ ID NO: 1207097 - DNA, 22 bp, Artificial Sequence
  chemically synthesized
atggatatgaagttttttgggg

SEQ ID NO: 1207098 - DNA, 22 bp, Artificial Sequence
  chemically synthesized
aatggatatgaagttttttggg

SEQ ID NO: 1207099 - DNA, 22 bp, Artificial Sequence
  chemically synthesized
tttaatggatatgaagtttttt

SEQ ID NO: 1207100 - DNA, 22 bp, Artificial Sequence
  chemically synthesized
tcttcccccaaaaaacttcata

SEQ ID NO: 1207101 - DNA, 22 bp, Artificial Sequence
  chemically synthesized
cccccaaaaaacttcatatcca

SEQ ID NO: 1207102 - DNA, 22 bp, Artificial Sequence
  chemically synthesized
ccccaaaaaacttcatatccat

SEQ ID NO: 1207103 - DNA, 22 bp, Artificial Sequence
  chemically synthesized
catatccattaaataactcccc

SEQ ID NO: 1207104 - DNA, 22 bp, Artificial Sequence
  chemically synthesized
atatccattaaataactcccca

SEQ ID NO: 1207105 - DNA, 22 bp, Artificial Sequence
  chemically synthesized
ggggagagaaggtatggggagt

SEQ ID NO: 1207106 - DNA, 22 bp, Artificial Sequence
  chemically synthesized
gaagctgggggagagaaggtat

SEQ ID NO: 1207107 - DNA, 22 bp, Artificial Sequence
  chemically synthesized
aataactccccataccttctct

SEQ ID NO: 1207108 - DNA, 22 bp, Artificial Sequence
  chemically synthesized
tagaagctgggggagagaaggt

SEQ ID NO: 1207109 - DNA, 22 bp, Artificial Sequence
  chemically synthesized
cccataccttctctcccccagc

SEQ ID NO: 1207110 - DNA, 22 bp, Artificial Sequence
  chemically synthesized
ctctcccccagcttctagaggc

SEQ ID NO: 1207111 - DNA, 22 bp, Artificial Sequence
  chemically synthesized
tctcccccagcttctagaggcc

SEQ ID NO: 1207112 - DNA, 22 bp, Artificial Sequence
  chemically synthesized
tcccccagcttctagaggccac

SEQ ID NO: 1207113 - DNA, 22 bp, Artificial Sequence
  chemically synthesized
ccccagcttctagaggccacca

SEQ ID NO: 1207114 - DNA, 22 bp, Artificial Sequence
  chemically synthesized
ctagaggccaccattctacttt

SEQ ID NO: 1207115 - DNA, 22 bp, Artificial Sequence
  chemically synthesized
tagaggccaccattctacttta

SEQ ID NO: 1207116 - DNA, 22 bp, Artificial Sequence
  chemically synthesized
gaggccaccattctactttatc

SEQ ID NO: 1207117 - DNA, 22 bp, Artificial Sequence
  chemically synthesized
gagcagtaaaatgcatagataa

SEQ ID NO: 1207118 - DNA, 22 bp, Artificial Sequence
  chemically synthesized
tctagagcagtaaaatgcatag

SEQ ID NO: 1207119 - DNA, 22 bp, Artificial Sequence
  chemically synthesized
tactttatctatgcattttact

SEQ ID NO: 1207120 - DNA, 22 bp, Artificial Sequence
  chemically synthesized
ctttatctatgcattttactgc

SEQ ID NO: 1207121 - DNA, 22 bp, Artificial Sequence
  chemically synthesized
tatctatgcattttactgctct

SEQ ID NO: 1207122 - DNA, 22 bp, Artificial Sequence
  chemically synthesized
tatgagctatctagagcagtaa

SEQ ID NO: 1207123 - DNA, 22 bp, Artificial Sequence
  chemically synthesized
atctatgcattttactgctcta

SEQ ID NO: 1207124 - DNA, 22 bp, Artificial Sequence
  chemically synthesized
gtatgagctatctagagcagta

SEQ ID NO: 1207125 - DNA, 22 bp, Artificial Sequence
  chemically synthesized
tctatgcattttactgctctag

SEQ ID NO: 1207126 - DNA, 22 bp, Artificial Sequence
  chemically synthesized
tttgtatgagctatctagagca

SEQ ID NO: 1207127 - DNA, 22 bp, Artificial Sequence
  chemically synthesized
tgcattttactgctctagatag

SEQ ID NO: 1207128 - DNA, 22 bp, Artificial Sequence
  chemically synthesized
tatttgtatgagctatctagag

SEQ ID NO: 1207129 - DNA, 22 bp, Artificial Sequence
  chemically synthesized
tactgctctagatagctcatac

SEQ ID NO: 1207130 - DNA, 22 bp, Artificial Sequence
  chemically synthesized
actgctctagatagctcataca

SEQ ID NO: 1207131 - DNA, 22 bp, Artificial Sequence
  chemically synthesized
ctgctctagatagctcatacaa

SEQ ID NO: 1207132 - DNA, 22 bp, Artificial Sequence
  chemically synthesized
ctctagatagctcatacaaata

SEQ ID NO: 1207133 - DNA, 22 bp, Artificial Sequence
  chemically synthesized
tagatagctcatacaaatagaa

SEQ ID NO: 1207134 - DNA, 22 bp, Artificial Sequence
  chemically synthesized
gatagctcatacaaatagaatc

SEQ ID NO: 1207135 - DNA, 22 bp, Artificial Sequence
  chemically synthesized
atacaaatagaatcatatgtta

SEQ ID NO: 1207136 - DNA, 22 bp, Artificial Sequence
  chemically synthesized
aggggaaaaagccagatacaaa

SEQ ID NO: 1207137 - DNA, 22 bp, Artificial Sequence
  chemically synthesized
tccttttgtatctggctttttc

SEQ ID NO: 1207138 - DNA, 22 bp, Artificial Sequence
  chemically synthesized
ttgtatctggctttttcccctt

SEQ ID NO: 1207139 - DNA, 22 bp, Artificial Sequence
  chemically synthesized
tgtatctggctttttcccctta

SEQ ID NO: 1207140 - DNA, 22 bp, Artificial Sequence
  chemically synthesized
atgatgatatgctaaggggaaa

SEQ ID NO: 1207141 - DNA, 22 bp, Artificial Sequence
  chemically synthesized
gtatctggctttttccccttag

SEQ ID NO: 1207142 - DNA, 22 bp, Artificial Sequence
  chemically synthesized
gatgatgatatgctaaggggaa

SEQ ID NO: 1207143 - DNA, 22 bp, Artificial Sequence
  chemically synthesized
tatctggctttttccccttagc

SEQ ID NO: 1207144 - DNA, 22 bp, Artificial Sequence
  chemically synthesized
gctttttccccttagcatatca

SEQ ID NO: 1207145 - DNA, 22 bp, Artificial Sequence
  chemically synthesized
tttccccttagcatatcatcat

SEQ ID NO: 1207146 - DNA, 22 bp, Artificial Sequence
  chemically synthesized
ttccccttagcatatcatcatc

SEQ ID NO: 1207147 - DNA, 22 bp, Artificial Sequence
  chemically synthesized
tccccttagcatatcatcatca

SEQ ID NO: 1207148 - DNA, 22 bp, Artificial Sequence
  chemically synthesized
ccccttagcatatcatcatcaa

SEQ ID NO: 1207149 - DNA, 22 bp, Artificial Sequence
  chemically synthesized
cccttagcatatcatcatcaag

SEQ ID NO: 1207150 - DNA, 22 bp, Artificial Sequence
  chemically synthesized
tagcatggatgaatcttgatga

SEQ ID NO: 1207151 - DNA, 22 bp, Artificial Sequence
  chemically synthesized
agcatatcatcatcaagattca

SEQ ID NO: 1207152 - DNA, 22 bp, Artificial Sequence
  chemically synthesized
gcatatcatcatcaagattcat

SEQ ID NO: 1207153 - DNA, 22 bp, Artificial Sequence
  chemically synthesized
acacacattatagcatggatga

SEQ ID NO: 1207154 - DNA, 22 bp, Artificial Sequence
  chemically synthesized
tgacacacattatagcatggat

SEQ ID NO: 1207155 - DNA, 22 bp, Artificial Sequence
  chemically synthesized
agaaagttctgacacacattat

SEQ ID NO: 1207156 - DNA, 22 bp, Artificial Sequence
  chemically synthesized
aagaaagttctgacacacatta

SEQ ID NO: 1207157 - DNA, 22 bp, Artificial Sequence
  chemically synthesized
atccatgctataatgtgtgtca

SEQ ID NO: 1207158 - DNA, 22 bp, Artificial Sequence
  chemically synthesized
agccttaagaaagttctgacac

SEQ ID NO: 1207159 - DNA, 22 bp, Artificial Sequence
  chemically synthesized
ttcagccttaagaaagttctga

SEQ ID NO: 1207160 - DNA, 22 bp, Artificial Sequence
  chemically synthesized
taatgtgtgtcagaactttctt

SEQ ID NO: 1207161 - DNA, 22 bp, Artificial Sequence
  chemically synthesized
tcttaaggctgaataatattct

SEQ ID NO: 1207162 - DNA, 22 bp, Artificial Sequence
  chemically synthesized
cttaaggctgaataatattcta

SEQ ID NO: 1207163 - DNA, 22 bp, Artificial Sequence
  chemically synthesized
ttaaggctgaataatattctac

SEQ ID NO: 1207164 - DNA, 22 bp, Artificial Sequence
  chemically synthesized
aaggctgaataatattctactg

SEQ ID NO: 1207165 - DNA, 22 bp, Artificial Sequence
  chemically synthesized
aggctgaataatattctactgt

SEQ ID NO: 1207166 - DNA, 22 bp, Artificial Sequence
  chemically synthesized
aataatattctactgtatacat

SEQ ID NO: 1207167 - DNA, 22 bp, Artificial Sequence
  chemically synthesized
tactgtatacatttaccacatt

SEQ ID NO: 1207168 - DNA, 22 bp, Artificial Sequence
  chemically synthesized
ctgtatacatttaccacatttt

SEQ ID NO: 1207169 - DNA, 22 bp, Artificial Sequence
  chemically synthesized
tatacatttaccacattttgtt

SEQ ID NO: 1207170 - DNA, 22 bp, Artificial Sequence
  chemically synthesized
aagatgaatggataaacaaaat

SEQ ID NO: 1207171 - DNA, 22 bp, Artificial Sequence
  chemically synthesized
accacattttgtttatccattc

SEQ ID NO: 1207172 - DNA, 22 bp, Artificial Sequence
  chemically synthesized
ccacattttgtttatccattca

SEQ ID NO: 1207173 - DNA, 22 bp, Artificial Sequence
  chemically synthesized
aaatgtccatctgaagatgaat

SEQ ID NO: 1207174 - DNA, 22 bp, Artificial Sequence
  chemically synthesized
tgtttatccattcatcttcaga

SEQ ID NO: 1207175 - DNA, 22 bp, Artificial Sequence
  chemically synthesized
gtttatccattcatcttcagat

SEQ ID NO: 1207176 - DNA, 22 bp, Artificial Sequence
  chemically synthesized
tttatccattcatcttcagatg

SEQ ID NO: 1207177 - DNA, 22 bp, Artificial Sequence
  chemically synthesized
atccattcatcttcagatggac

SEQ ID NO: 1207178 - DNA, 22 bp, Artificial Sequence
  chemically synthesized
tccattcatcttcagatggaca

SEQ ID NO: 1207179 - DNA, 22 bp, Artificial Sequence
  chemically synthesized
atcttcagatggacatttgagt

SEQ ID NO: 1207180 - DNA, 22 bp, Artificial Sequence
  chemically synthesized
cagatggacatttgagttgctc

SEQ ID NO: 1207181 - DNA, 22 bp, Artificial Sequence
  chemically synthesized
agatggacatttgagttgctcc

SEQ ID NO: 1207182 - DNA, 22 bp, Artificial Sequence
  chemically synthesized
atagtagcaaaagatggagcaa

SEQ ID NO: 1207183 - DNA, 22 bp, Artificial Sequence
  chemically synthesized
ttcatagtagcaaaagatggag

SEQ ID NO: 1207184 - DNA, 22 bp, Artificial Sequence
  chemically synthesized
gagttgctccatcttttgctac

SEQ ID NO: 1207185 - DNA, 22 bp, Artificial Sequence
  chemically synthesized
agttgctccatcttttgctact

SEQ ID NO: 1207186 - DNA, 22 bp, Artificial Sequence
  chemically synthesized
tagcagcattattcatagtagc

SEQ ID NO: 1207187 - DNA, 22 bp, Artificial Sequence
  chemically synthesized
ctccatcttttgctactatgaa

SEQ ID NO: 1207188 - DNA, 22 bp, Artificial Sequence
  chemically synthesized
atagcagcattattcatagtag

SEQ ID NO: 1207189 - DNA, 22 bp, Artificial Sequence
  chemically synthesized
catcttttgctactatgaataa

SEQ ID NO: 1207190 - DNA, 22 bp, Artificial Sequence
  chemically synthesized
ttgctactatgaataatgctgc

SEQ ID NO: 1207191 - DNA, 22 bp, Artificial Sequence
  chemically synthesized
tgctactatgaataatgctgct

SEQ ID NO: 1207192 - DNA, 22 bp, Artificial Sequence
  chemically synthesized
gctactatgaataatgctgcta

SEQ ID NO: 1207193 - DNA, 22 bp, Artificial Sequence
  chemically synthesized
ctactatgaataatgctgctat

SEQ ID NO: 1207194 - DNA, 22 bp, Artificial Sequence
  chemically synthesized
tacacccatgtttatagcagca

SEQ ID NO: 1207195 - DNA, 22 bp, Artificial Sequence
  chemically synthesized
gtacacccatgtttatagcagc

SEQ ID NO: 1207196 - DNA, 22 bp, Artificial Sequence
  chemically synthesized
ctatgaataatgctgctataaa

SEQ ID NO: 1207197 - DNA, 22 bp, Artificial Sequence
  chemically synthesized
tgaataatgctgctataaacat

SEQ ID NO: 1207198 - DNA, 22 bp, Artificial Sequence
  chemically synthesized
aaaatatatttgtacacccatg

SEQ ID NO: 1207199 - DNA, 22 bp, Artificial Sequence
  chemically synthesized
caaaatatatttgtacacccat

SEQ ID NO: 1207200 - DNA, 22 bp, Artificial Sequence
  chemically synthesized
ctataaacatgggtgtacaaat

SEQ ID NO: 1207201 - DNA, 22 bp, Artificial Sequence
  chemically synthesized
taaacatgggtgtacaaatata

SEQ ID NO: 1207202 - DNA, 22 bp, Artificial Sequence
  chemically synthesized
aaaaaaggaccttcaaaatata

SEQ ID NO: 1207203 - DNA, 22 bp, Artificial Sequence
  chemically synthesized
aaaagaattgaaaaaaggacct

SEQ ID NO: 1207204 - DNA, 22 bp, Artificial Sequence
  chemically synthesized
tgaaggtccttttttcaattct

SEQ ID NO: 1207205 - DNA, 22 bp, Artificial Sequence
  chemically synthesized
gaaggtccttttttcaattctt

SEQ ID NO: 1207206 - DNA, 22 bp, Artificial Sequence
  chemically synthesized
aaggtccttttttcaattcttt

SEQ ID NO: 1207207 - DNA, 22 bp, Artificial Sequence
  chemically synthesized
ggaatatactcaaaagaattga

SEQ ID NO: 1207208 - DNA, 22 bp, Artificial Sequence
  chemically synthesized
tgggaatatactcaaaagaatt

SEQ ID NO: 1207209 - DNA, 22 bp, Artificial Sequence
  chemically synthesized
ctgggaatatactcaaaagaat

SEQ ID NO: 1207210 - DNA, 22 bp, Artificial Sequence
  chemically synthesized
cacttctgggaatatactcaaa

SEQ ID NO: 1207211 - DNA, 22 bp, Artificial Sequence
  chemically synthesized
ttttcaattcttttgagtatat

SEQ ID NO: 1207212 - DNA, 22 bp, Artificial Sequence
  chemically synthesized
tttcaattcttttgagtatatt

SEQ ID NO: 1207213 - DNA, 22 bp, Artificial Sequence
  chemically synthesized
ttcaattcttttgagtatattc

SEQ ID NO: 1207214 - DNA, 22 bp, Artificial Sequence
  chemically synthesized
tcaattcttttgagtatattcc

SEQ ID NO: 1207215 - DNA, 22 bp, Artificial Sequence
  chemically synthesized
caattcttttgagtatattccc

SEQ ID NO: 1207216 - DNA, 22 bp, Artificial Sequence
  chemically synthesized
aattcttttgagtatattccca

SEQ ID NO: 1207217 - DNA, 22 bp, Artificial Sequence
  chemically synthesized
ttttgagtatattcccagaagt

SEQ ID NO: 1207218 - DNA, 22 bp, Artificial Sequence
  chemically synthesized
ttgagtatattcccagaagtgg

SEQ ID NO: 1207219 - DNA, 22 bp, Artificial Sequence
  chemically synthesized
tgagtatattcccagaagtgga

SEQ ID NO: 1207220 - DNA, 22 bp, Artificial Sequence
  chemically synthesized
gagtatattcccagaagtggaa

SEQ ID NO: 1207221 - DNA, 22 bp, Artificial Sequence
  chemically synthesized
agtatattcccagaagtggaat

SEQ ID NO: 1207222 - DNA, 22 bp, Artificial Sequence
  chemically synthesized
ccatgtgatccagcaattccac

SEQ ID NO: 1207223 - DNA, 22 bp, Artificial Sequence
  chemically synthesized
ccagaagtggaattgctggatc

SEQ ID NO: 1207224 - DNA, 22 bp, Artificial Sequence
  chemically synthesized
ctggatcacatggtaattctac

SEQ ID NO: 1207225 - DNA, 22 bp, Artificial Sequence
  chemically synthesized
aaaatatagaacgtagaattac

SEQ ID NO: 1207226 - DNA, 22 bp, Artificial Sequence
  chemically synthesized
tcaaaatatagaacgtagaatt

SEQ ID NO: 1207227 - DNA, 22 bp, Artificial Sequence
  chemically synthesized
gatcacatggtaattctacgtt

SEQ ID NO: 1207228 - DNA, 22 bp, Artificial Sequence
  chemically synthesized
ctcaaaatatagaacgtagaat

SEQ ID NO: 1207229 - DNA, 22 bp, Artificial Sequence
  chemically synthesized
gtttctcaaaatatagaacgta

SEQ ID NO: 1207230 - DNA, 22 bp, Artificial Sequence
  chemically synthesized
tacgttctatattttgagaaac

SEQ ID NO: 1207231 - DNA, 22 bp, Artificial Sequence
  chemically synthesized
cgttctatattttgagaaacca

SEQ ID NO: 1207232 - DNA, 22 bp, Artificial Sequence
  chemically synthesized
tggaaacaaatatgttggtttc

SEQ ID NO: 1207233 - DNA, 22 bp, Artificial Sequence
  chemically synthesized
tatattttgagaaaccaacata

SEQ ID NO: 1207234 - DNA, 22 bp, Artificial Sequence
  chemically synthesized
tattttgagaaaccaacatatt

SEQ ID NO: 1207235 - DNA, 22 bp, Artificial Sequence
  chemically synthesized
tgagaaaccaacatatttgttt

SEQ ID NO: 1207236 - DNA, 22 bp, Artificial Sequence
  chemically synthesized
cagtcactgtggaaacaaatat

SEQ ID NO: 1207237 - DNA, 22 bp, Artificial Sequence
  chemically synthesized
gagaaaccaacatatttgtttc

SEQ ID NO: 1207238 - DNA, 22 bp, Artificial Sequence
  chemically synthesized
gcagtcactgtggaaacaaata

SEQ ID NO: 1207239 - DNA, 22 bp, Artificial Sequence
  chemically synthesized
agaaaccaacatatttgtttcc

SEQ ID NO: 1207240 - DNA, 22 bp, Artificial Sequence
  chemically synthesized
gtttccacagtgactgcaaggt

SEQ ID NO: 1207241 - DNA, 22 bp, Artificial Sequence
  chemically synthesized
tttccacagtgactgcaaggtt

SEQ ID NO: 1207242 - DNA, 22 bp, Artificial Sequence
  chemically synthesized
gagggaatgtaaaaccttgcag

SEQ ID NO: 1207243 - DNA, 22 bp, Artificial Sequence
  chemically synthesized
ccacagtgactgcaaggtttta

SEQ ID NO: 1207244 - DNA, 22 bp, Artificial Sequence
  chemically synthesized
ctggagggaatgtaaaaccttg

SEQ ID NO: 1207245 - DNA, 22 bp, Artificial Sequence
  chemically synthesized
cacagtgactgcaaggttttac

SEQ ID NO: 1207246 - DNA, 22 bp, Artificial Sequence
  chemically synthesized
tgaactgctggagggaatgtaa

SEQ ID NO: 1207247 - DNA, 22 bp, Artificial Sequence
  chemically synthesized
gtgaactgctggagggaatgta

SEQ ID NO: 1207248 - DNA, 22 bp, Artificial Sequence
  chemically synthesized
caaggttttacattccctccag

SEQ ID NO: 1207249 - DNA, 22 bp, Artificial Sequence
  chemically synthesized
aacacttgtgaactgctggagg

SEQ ID NO: 1207250 - DNA, 22 bp, Artificial Sequence
  chemically synthesized
gaacacttgtgaactgctggag

SEQ ID NO: 1207251 - DNA, 22 bp, Artificial Sequence
  chemically synthesized
tacattccctccagcagttcac

SEQ ID NO: 1207252 - DNA, 22 bp, Artificial Sequence
  chemically synthesized
acattccctccagcagttcaca

SEQ ID NO: 1207253 - DNA, 22 bp, Artificial Sequence
  chemically synthesized
cattccctccagcagttcacaa

SEQ ID NO: 1207254 - DNA, 22 bp, Artificial Sequence
  chemically synthesized
cctccagcagttcacaagtgtt

SEQ ID NO: 1207255 - DNA, 22 bp, Artificial Sequence
  chemically synthesized
cagcagttcacaagtgttcaaa

SEQ ID NO: 1207256 - DNA, 22 bp, Artificial Sequence
  chemically synthesized
aggatgtggaaaaatttgaaca

SEQ ID NO: 1207257 - DNA, 22 bp, Artificial Sequence
  chemically synthesized
acaagtgttcaaatttttccac

SEQ ID NO: 1207258 - DNA, 22 bp, Artificial Sequence
  chemically synthesized
aaatttttccacatcctcaacc

SEQ ID NO: 1207259 - DNA, 22 bp, Artificial Sequence
  chemically synthesized
ttccacatcctcaaccatattt

SEQ ID NO: 1207260 - DNA, 22 bp, Artificial Sequence
  chemically synthesized
tccacatcctcaaccatattta

SEQ ID NO: 1207261 - DNA, 22 bp, Artificial Sequence
  chemically synthesized
ccacatcctcaaccatatttat

SEQ ID NO: 1207262 - DNA, 22 bp, Artificial Sequence
  chemically synthesized
cacatcctcaaccatatttatt

SEQ ID NO: 1207263 - DNA, 22 bp, Artificial Sequence
  chemically synthesized
aaccatatttattttctgggtt

SEQ ID NO: 1207264 - DNA, 22 bp, Artificial Sequence
  chemically synthesized
attttctgggtttttttttttt

SEQ ID NO: 1207265 - DNA, 22 bp, Artificial Sequence
  chemically synthesized
aaacaccaaaaaaaaaaaaaaa

SEQ ID NO: 1207266 - DNA, 22 bp, Artificial Sequence
  chemically synthesized
ttttctgggttttttttttttt

SEQ ID NO: 1207267 - DNA, 22 bp, Artificial Sequence
  chemically synthesized
aaaacaccaaaaaaaaaaaaaa

SEQ ID NO: 1207268 - DNA, 22 bp, Artificial Sequence
  chemically synthesized
taaaacaccaaaaaaaaaaaaa

SEQ ID NO: 1207269 - DNA, 22 bp, Artificial Sequence
  chemically synthesized
tctgggtttttttttttttttt

SEQ ID NO: 1207270 - DNA, 22 bp, Artificial Sequence
  chemically synthesized
ctgggttttttttttttttttt

SEQ ID NO: 1207271 - DNA, 22 bp, Artificial Sequence
  chemically synthesized
ttttaaaacaccaaaaaaaaaa

SEQ ID NO: 1207272 - DNA, 22 bp, Artificial Sequence
  chemically synthesized
tgggtttttttttttttttttg

SEQ ID NO: 1207273 - DNA, 22 bp, Artificial Sequence
  chemically synthesized
ggtttttttttttttttttggt

SEQ ID NO: 1207274 - DNA, 22 bp, Artificial Sequence
  chemically synthesized
ttttttttttttttggtgtttt

SEQ ID NO: 1207275 - DNA, 22 bp, Artificial Sequence
  chemically synthesized
tttttttttttttggtgtttta

SEQ ID NO: 1207276 - DNA, 22 bp, Artificial Sequence
  chemically synthesized
ttttttttttttggtgttttaa

SEQ ID NO: 1207277 - DNA, 22 bp, Artificial Sequence
  chemically synthesized
tttttttttttggtgttttaaa

SEQ ID NO: 1207278 - DNA, 22 bp, Artificial Sequence
  chemically synthesized
ttttttttttggtgttttaaaa

SEQ ID NO: 1207279 - DNA, 22 bp, Artificial Sequence
  chemically synthesized
ggatgatgattattttaaaaca

SEQ ID NO: 1207280 - DNA, 22 bp, Artificial Sequence
  chemically synthesized
tttttttttggtgttttaaaat

SEQ ID NO: 1207281 - DNA, 22 bp, Artificial Sequence
  chemically synthesized
ttttttttggtgttttaaaata

SEQ ID NO: 1207282 - DNA, 22 bp, Artificial Sequence
  chemically synthesized
tttttttggtgttttaaaataa

SEQ ID NO: 1207283 - DNA, 22 bp, Artificial Sequence
  chemically synthesized
ttttttggtgttttaaaataat

SEQ ID NO: 1207284 - DNA, 22 bp, Artificial Sequence
  chemically synthesized
tttttggtgttttaaaataatc

SEQ ID NO: 1207285 - DNA, 22 bp, Artificial Sequence
  chemically synthesized
ttttggtgttttaaaataatca

SEQ ID NO: 1207286 - DNA, 22 bp, Artificial Sequence
  chemically synthesized
tttggtgttttaaaataatcat

SEQ ID NO: 1207287 - DNA, 22 bp, Artificial Sequence
  chemically synthesized
ttggtgttttaaaataatcatc

SEQ ID NO: 1207288 - DNA, 22 bp, Artificial Sequence
  chemically synthesized
tggtgttttaaaataatcatca

SEQ ID NO: 1207289 - DNA, 22 bp, Artificial Sequence
  chemically synthesized
ggtgttttaaaataatcatcat

SEQ ID NO: 1207290 - DNA, 22 bp, Artificial Sequence
  chemically synthesized
acacccattaggatgatgatta

SEQ ID NO: 1207291 - DNA, 22 bp, Artificial Sequence
  chemically synthesized
gtgttttaaaataatcatcatc

SEQ ID NO: 1207292 - DNA, 22 bp, Artificial Sequence
  chemically synthesized
cacacccattaggatgatgatt

SEQ ID NO: 1207293 - DNA, 22 bp, Artificial Sequence
  chemically synthesized
taaaataatcatcatcctaatg

SEQ ID NO: 1207294 - DNA, 22 bp, Artificial Sequence
  chemically synthesized
aaaataatcatcatcctaatgg

SEQ ID NO: 1207295 - DNA, 22 bp, Artificial Sequence
  chemically synthesized
aaataatcatcatcctaatggg

SEQ ID NO: 1207296 - DNA, 22 bp, Artificial Sequence
  chemically synthesized
atgggtgtgaagtgctatctca

SEQ ID NO: 1207297 - DNA, 22 bp, Artificial Sequence
  chemically synthesized
gggaaatgcagataaatcccaa

SEQ ID NO: 1207298 - DNA, 22 bp, Artificial Sequence
  chemically synthesized
tctcatttgggatttatctgca

SEQ ID NO: 1207299 - DNA, 22 bp, Artificial Sequence
  chemically synthesized
atcattagggaaatgcagataa

SEQ ID NO: 1207300 - DNA, 22 bp, Artificial Sequence
  chemically synthesized
atttgggatttatctgcatttc

SEQ ID NO: 1207301 - DNA, 22 bp, Artificial Sequence
  chemically synthesized
gggatttatctgcatttcccta

SEQ ID NO: 1207302 - DNA, 22 bp, Artificial Sequence
  chemically synthesized
ggatttatctgcatttccctaa

SEQ ID NO: 1207303 - DNA, 22 bp, Artificial Sequence
  chemically synthesized
atctgcatttccctaatgatca

SEQ ID NO: 1207304 - DNA, 22 bp, Artificial Sequence
  chemically synthesized
tctgcatttccctaatgatcag

SEQ ID NO: 1207305 - DNA, 22 bp, Artificial Sequence
  chemically synthesized
catttccctaatgatcagcgat

SEQ ID NO: 1207306 - DNA, 22 bp, Artificial Sequence
  chemically synthesized
ccctaatgatcagcgatatcga

SEQ ID NO: 1207307 - DNA, 22 bp, Artificial Sequence
  chemically synthesized
cctaatgatcagcgatatcgat

SEQ ID NO: 1207308 - DNA, 22 bp, Artificial Sequence
  chemically synthesized
atgatcagcgatatcgattatc

SEQ ID NO: 1207309 - DNA, 22 bp, Artificial Sequence
  chemically synthesized
gccagtaagaccatgagtagat

SEQ ID NO: 1207310 - DNA, 22 bp, Artificial Sequence
  chemically synthesized
ggccagtaagaccatgagtaga

SEQ ID NO: 1207311 - DNA, 22 bp, Artificial Sequence
  chemically synthesized
aagtttggccagtaagaccatg

SEQ ID NO: 1207312 - DNA, 22 bp, Artificial Sequence
  chemically synthesized
taaagtttggccagtaagacca

SEQ ID NO: 1207313 - DNA, 22 bp, Artificial Sequence
  chemically synthesized
tctaaagtttggccagtaagac

SEQ ID NO: 1207314 - DNA, 22 bp, Artificial Sequence
  chemically synthesized
ctctaaagtttggccagtaaga

SEQ ID NO: 1207315 - DNA, 22 bp, Artificial Sequence
  chemically synthesized
tctactcatggtcttactggcc

SEQ ID NO: 1207316 - DNA, 22 bp, Artificial Sequence
  chemically synthesized
ctcatggtcttactggccaaac

SEQ ID NO: 1207317 - DNA, 22 bp, Artificial Sequence
  chemically synthesized
atggtcttactggccaaacttt

SEQ ID NO: 1207318 - DNA, 22 bp, Artificial Sequence
  chemically synthesized
atcagaaatttctctaaagttt

SEQ ID NO: 1207319 - DNA, 22 bp, Artificial Sequence
  chemically synthesized
actggccaaactttagagaaat

SEQ ID NO: 1207320 - DNA, 22 bp, Artificial Sequence
  chemically synthesized
ctggccaaactttagagaaatt

SEQ ID NO: 1207321 - DNA, 22 bp, Artificial Sequence
  chemically synthesized
gccaaactttagagaaatttct

SEQ ID NO: 1207322 - DNA, 22 bp, Artificial Sequence
  chemically synthesized
tagagaaatttctgatcaactc

SEQ ID NO: 1207323 - DNA, 22 bp, Artificial Sequence
  chemically synthesized
agagaaatttctgatcaactca

SEQ ID NO: 1207324 - DNA, 22 bp, Artificial Sequence
  chemically synthesized
gagaaatttctgatcaactcat

SEQ ID NO: 1207325 - DNA, 22 bp, Artificial Sequence
  chemically synthesized
aaaaaatgaataaatgagttga

SEQ ID NO: 1207326 - DNA, 22 bp, Artificial Sequence
  chemically synthesized
ctgatcaactcatttattcatt

SEQ ID NO: 1207327 - DNA, 22 bp, Artificial Sequence
  chemically synthesized
tgatcaactcatttattcattt

SEQ ID NO: 1207328 - DNA, 22 bp, Artificial Sequence
  chemically synthesized
atcaactcatttattcattttt

SEQ ID NO: 1207329 - DNA, 22 bp, Artificial Sequence
  chemically synthesized
atttattcatttttttaattgc

SEQ ID NO: 1207330 - DNA, 22 bp, Artificial Sequence
  chemically synthesized
aacaacagaaaaacagcaatta

SEQ ID NO: 1207331 - DNA, 22 bp, Artificial Sequence
  chemically synthesized
attcatttttttaattgctgtt

SEQ ID NO: 1207332 - DNA, 22 bp, Artificial Sequence
  chemically synthesized
ttcatttttttaattgctgttt

SEQ ID NO: 1207333 - DNA, 22 bp, Artificial Sequence
  chemically synthesized
atttttttaattgctgtttttc

SEQ ID NO: 1207334 - DNA, 22 bp, Artificial Sequence
  chemically synthesized
ttttaattgctgtttttctgtt

SEQ ID NO: 1207335 - DNA, 22 bp, Artificial Sequence
  chemically synthesized
tttaattgctgtttttctgttg

SEQ ID NO: 1207336 - DNA, 22 bp, Artificial Sequence
  chemically synthesized
ttaattgctgtttttctgttgt

SEQ ID NO: 1207337 - DNA, 22 bp, Artificial Sequence
  chemically synthesized
taattgctgtttttctgttgtt

SEQ ID NO: 1207338 - DNA, 22 bp, Artificial Sequence
  chemically synthesized
aattgctgtttttctgttgttg

SEQ ID NO: 1207339 - DNA, 22 bp, Artificial Sequence
  chemically synthesized
attgctgtttttctgttgttga

SEQ ID NO: 1207340 - DNA, 22 bp, Artificial Sequence
  chemically synthesized
tatcatcgtagaattcaacaac

SEQ ID NO: 1207341 - DNA, 22 bp, Artificial Sequence
  chemically synthesized
ctgtttttctgttgttgaattc

SEQ ID NO: 1207342 - DNA, 22 bp, Artificial Sequence
  chemically synthesized
tttttctgttgttgaattctac

SEQ ID NO: 1207343 - DNA, 22 bp, Artificial Sequence
  chemically synthesized
aattatatcatcgtagaattca

SEQ ID NO: 1207344 - DNA, 22 bp, Artificial Sequence
  chemically synthesized
ttctgttgttgaattctacgat

SEQ ID NO: 1207345 - DNA, 22 bp, Artificial Sequence
  chemically synthesized
tctgttgttgaattctacgatg

SEQ ID NO: 1207346 - DNA, 22 bp, Artificial Sequence
  chemically synthesized
ctgttgttgaattctacgatga

SEQ ID NO: 1207347 - DNA, 22 bp, Artificial Sequence
  chemically synthesized
tgttgttgaattctacgatgat

SEQ ID NO: 1207348 - DNA, 22 bp, Artificial Sequence
  chemically synthesized
ttgttgaattctacgatgatat

SEQ ID NO: 1207349 - DNA, 22 bp, Artificial Sequence
  chemically synthesized
ttgaattctacgatgatataat

SEQ ID NO: 1207350 - DNA, 22 bp, Artificial Sequence
  chemically synthesized
aattctacgatgatataattta

SEQ ID NO: 1207351 - DNA, 22 bp, Artificial Sequence
  chemically synthesized
agtggggacacagttaaattat

SEQ ID NO: 1207352 - DNA, 22 bp, Artificial Sequence
  chemically synthesized
gagtggggacacagttaaatta

SEQ ID NO: 1207353 - DNA, 22 bp, Artificial Sequence
  chemically synthesized
tacgatgatataatttaactgt

SEQ ID NO: 1207354 - DNA, 22 bp, Artificial Sequence
  chemically synthesized
cgatgatataatttaactgtgt

SEQ ID NO: 1207355 - DNA, 22 bp, Artificial Sequence
  chemically synthesized
aacatgagatttgagtggggac

SEQ ID NO: 1207356 - DNA, 22 bp, Artificial Sequence
  chemically synthesized
aactgtgtccccactcaaatct

SEQ ID NO: 1207357 - DNA, 22 bp, Artificial Sequence
  chemically synthesized
caattcaacatgagatttgagt

SEQ ID NO: 1207358 - DNA, 22 bp, Artificial Sequence
  chemically synthesized
actgtgtccccactcaaatctc

SEQ ID NO: 1207359 - DNA, 22 bp, Artificial Sequence
  chemically synthesized
tgtccccactcaaatctcatgt

SEQ ID NO: 1207360 - DNA, 22 bp, Artificial Sequence
  chemically synthesized
gggattacaattcaacatgaga

SEQ ID NO: 1207361 - DNA, 22 bp, Artificial Sequence
  chemically synthesized
caacattggggattacaattca

SEQ ID NO: 1207362 - DNA, 22 bp, Artificial Sequence
  chemically synthesized
aaatctcatgttgaattgtaat

SEQ ID NO: 1207363 - DNA, 22 bp, Artificial Sequence
  chemically synthesized
atgttgaattgtaatccccaat

SEQ ID NO: 1207364 - DNA, 22 bp, Artificial Sequence
  chemically synthesized
aattgtaatccccaatgttgga

SEQ ID NO: 1207365 - DNA, 22 bp, Artificial Sequence
  chemically synthesized
ccaccagacaccaactccaaca

SEQ ID NO: 1207366 - DNA, 22 bp, Artificial Sequence
  chemically synthesized
taatccccaatgttggagttgg

SEQ ID NO: 1207367 - DNA, 22 bp, Artificial Sequence
  chemically synthesized
gagttggtgtctggtgggaggt

SEQ ID NO: 1207368 - DNA, 22 bp, Artificial Sequence
  chemically synthesized
ccccagtgatccaatcacctcc

SEQ ID NO: 1207369 - DNA, 22 bp, Artificial Sequence
  chemically synthesized
gccccagtgatccaatcacctc

SEQ ID NO: 1207370 - DNA, 22 bp, Artificial Sequence
  chemically synthesized
gtgtctggtgggaggtgattgg

SEQ ID NO: 1207371 - DNA, 22 bp, Artificial Sequence
  chemically synthesized
gtgggaggtgattggatcactg

SEQ ID NO: 1207372 - DNA, 22 bp, Artificial Sequence
  chemically synthesized
atcagaaatttgccccagtgat

SEQ ID NO: 1207373 - DNA, 22 bp, Artificial Sequence
  chemically synthesized
aaccattcatcagaaatttgcc

SEQ ID NO: 1207374 - DNA, 22 bp, Artificial Sequence
  chemically synthesized
gatcactggggcaaatttctga

SEQ ID NO: 1207375 - DNA, 22 bp, Artificial Sequence
  chemically synthesized
gggcaaatttctgatgaatggt

SEQ ID NO: 1207376 - DNA, 22 bp, Artificial Sequence
  chemically synthesized
ctgatgaatggtttagtactgt

SEQ ID NO: 1207377 - DNA, 22 bp, Artificial Sequence
  chemically synthesized
tgatgaatggtttagtactgtc

SEQ ID NO: 1207378 - DNA, 22 bp, Artificial Sequence
  chemically synthesized
atgaatggtttagtactgtccg

SEQ ID NO: 1207379 - DNA, 22 bp, Artificial Sequence
  chemically synthesized
tcacgagaatagtaccaagcgg

SEQ ID NO: 1207380 - DNA, 22 bp, Artificial Sequence
  chemically synthesized
tatcacgagaatagtaccaagc

SEQ ID NO: 1207381 - DNA, 22 bp, Artificial Sequence
  chemically synthesized
agtactgtccgcttggtactat

SEQ ID NO: 1207382 - DNA, 22 bp, Artificial Sequence
  chemically synthesized
tctatcacgagaatagtaccaa

SEQ ID NO: 1207383 - DNA, 22 bp, Artificial Sequence
  chemically synthesized
gtactgtccgcttggtactatt

SEQ ID NO: 1207384 - DNA, 22 bp, Artificial Sequence
  chemically synthesized
tccgcttggtactattctcgtg

SEQ ID NO: 1207385 - DNA, 22 bp, Artificial Sequence
  chemically synthesized
ataagaactctctatcacgaga

SEQ ID NO: 1207386 - DNA, 22 bp, Artificial Sequence
  chemically synthesized
cataagaactctctatcacgag

SEQ ID NO: 1207387 - DNA, 22 bp, Artificial Sequence
  chemically synthesized
ggtactattctcgtgatagaga

SEQ ID NO: 1207388 - DNA, 22 bp, Artificial Sequence
  chemically synthesized
gtactattctcgtgatagagag

SEQ ID NO: 1207389 - DNA, 22 bp, Artificial Sequence
  chemically synthesized
ttctcgtgatagagagttctta

SEQ ID NO: 1207390 - DNA, 22 bp, Artificial Sequence
  chemically synthesized
tcgtgatagagagttcttatga

SEQ ID NO: 1207391 - DNA, 22 bp, Artificial Sequence
  chemically synthesized
aacgaccagatttcataagaac

SEQ ID NO: 1207392 - DNA, 22 bp, Artificial Sequence
  chemically synthesized
aaacgaccagatttcataagaa

SEQ ID NO: 1207393 - DNA, 22 bp, Artificial Sequence
  chemically synthesized
gtgatagagagttcttatgaaa

SEQ ID NO: 1207394 - DNA, 22 bp, Artificial Sequence
  chemically synthesized
taaacgaccagatttcataaga

SEQ ID NO: 1207395 - DNA, 22 bp, Artificial Sequence
  chemically synthesized
ttaaacgaccagatttcataag

SEQ ID NO: 1207396 - DNA, 22 bp, Artificial Sequence
  chemically synthesized
ttatgaaatctggtcgtttaaa

SEQ ID NO: 1207397 - DNA, 22 bp, Artificial Sequence
  chemically synthesized
atgaaatctggtcgtttaaaag

SEQ ID NO: 1207398 - DNA, 22 bp, Artificial Sequence
  chemically synthesized
tgaaatctggtcgtttaaaagt

SEQ ID NO: 1207399 - DNA, 22 bp, Artificial Sequence
  chemically synthesized
gtcgtttaaaagtgtatgacat

SEQ ID NO: 1207400 - DNA, 22 bp, Artificial Sequence
  chemically synthesized
aaaagtgtatgacatctccctc

SEQ ID NO: 1207401 - DNA, 22 bp, Artificial Sequence
  chemically synthesized
aaagtgtatgacatctccctcc

SEQ ID NO: 1207402 - DNA, 22 bp, Artificial Sequence
  chemically synthesized
cctccacccctcttgctcctgt

SEQ ID NO: 1207403 - DNA, 22 bp, Artificial Sequence
  chemically synthesized
cacccctcttgctcctgttctg

SEQ ID NO: 1207404 - DNA, 22 bp, Artificial Sequence
  chemically synthesized
gcaggtcatatggtcagaacag

SEQ ID NO: 1207405 - DNA, 22 bp, Artificial Sequence
  chemically synthesized
ttgctcctgttctgaccatatg

SEQ ID NO: 1207406 - DNA, 22 bp, Artificial Sequence
  chemically synthesized
gctcctgttctgaccatatgac

SEQ ID NO: 1207407 - DNA, 22 bp, Artificial Sequence
  chemically synthesized
ctcctgttctgaccatatgacc

SEQ ID NO: 1207408 - DNA, 22 bp, Artificial Sequence
  chemically synthesized
ctgttctgaccatatgacctgc

SEQ ID NO: 1207409 - DNA, 22 bp, Artificial Sequence
  chemically synthesized
ttctgaccatatgacctgccag

SEQ ID NO: 1207410 - DNA, 22 bp, Artificial Sequence
  chemically synthesized
tgaccatatgacctgccaggtc

SEQ ID NO: 1207411 - DNA, 22 bp, Artificial Sequence
  chemically synthesized
accatatgacctgccaggtcac

SEQ ID NO: 1207412 - DNA, 22 bp, Artificial Sequence
  chemically synthesized
ccaggtcacccttccctttctg

SEQ ID NO: 1207413 - DNA, 22 bp, Artificial Sequence
  chemically synthesized
aggaaacataaagcagaaaggg

SEQ ID NO: 1207414 - DNA, 22 bp, Artificial Sequence
  chemically synthesized
gggaggcctcaggaaacataaa

SEQ ID NO: 1207415 - DNA, 22 bp, Artificial Sequence
  chemically synthesized
ccctttctgctttatgtttcct

SEQ ID NO: 1207416 - DNA, 22 bp, Artificial Sequence
  chemically synthesized
tggggaggcctcaggaaacata

SEQ ID NO: 1207417 - DNA, 22 bp, Artificial Sequence
  chemically synthesized
cctttctgctttatgtttcctg

SEQ ID NO: 1207418 - DNA, 22 bp, Artificial Sequence
  chemically synthesized
ctggggaggcctcaggaaacat

SEQ ID NO: 1207419 - DNA, 22 bp, Artificial Sequence
  chemically synthesized
tctgctttatgtttcctgaggc

SEQ ID NO: 1207420 - DNA, 22 bp, Artificial Sequence
  chemically synthesized
ctgctttatgtttcctgaggcc

SEQ ID NO: 1207421 - DNA, 22 bp, Artificial Sequence
  chemically synthesized
ggcttctggggaggcctcagga

SEQ ID NO: 1207422 - DNA, 22 bp, Artificial Sequence
  chemically synthesized
tgctttatgtttcctgaggcct

SEQ ID NO: 1207423 - DNA, 22 bp, Artificial Sequence
  chemically synthesized
ctttatgtttcctgaggcctcc

SEQ ID NO: 1207424 - DNA, 22 bp, Artificial Sequence
  chemically synthesized
ctcggcttctggggaggcctca

SEQ ID NO: 1207425 - DNA, 22 bp, Artificial Sequence
  chemically synthesized
tatgtttcctgaggcctcccca

SEQ ID NO: 1207426 - DNA, 22 bp, Artificial Sequence
  chemically synthesized
atgtttcctgaggcctccccag

SEQ ID NO: 1207427 - DNA, 22 bp, Artificial Sequence
  chemically synthesized
tgtttcctgaggcctccccaga

SEQ ID NO: 1207428 - DNA, 22 bp, Artificial Sequence
  chemically synthesized
gcatctgctcggcttctgggga

SEQ ID NO: 1207429 - DNA, 22 bp, Artificial Sequence
  chemically synthesized
cctgaggcctccccagaagccg

SEQ ID NO: 1207430 - DNA, 22 bp, Artificial Sequence
  chemically synthesized
ctgaggcctccccagaagccga

SEQ ID NO: 1207431 - DNA, 22 bp, Artificial Sequence
  chemically synthesized
aggcctccccagaagccgagca

SEQ ID NO: 1207432 - DNA, 22 bp, Artificial Sequence
  chemically synthesized
cccagaagccgagcagatgcca

SEQ ID NO: 1207433 - DNA, 22 bp, Artificial Sequence
  chemically synthesized
tacaggaagcatgatgctggca

SEQ ID NO: 1207434 - DNA, 22 bp, Artificial Sequence
  chemically synthesized
taggctgtacaggaagcatgat

SEQ ID NO: 1207435 - DNA, 22 bp, Artificial Sequence
  chemically synthesized
tgtaggctgtacaggaagcatg

SEQ ID NO: 1207436 - DNA, 22 bp, Artificial Sequence
  chemically synthesized
ctgtaggctgtacaggaagcat

SEQ ID NO: 1207437 - DNA, 22 bp, Artificial Sequence
  chemically synthesized
acatttctgtaggctgtacagg

SEQ ID NO: 1207438 - DNA, 22 bp, Artificial Sequence
  chemically synthesized
gctcacatttctgtaggctgta

SEQ ID NO: 1207439 - DNA, 22 bp, Artificial Sequence
  chemically synthesized
attggctcacatttctgtaggc

SEQ ID NO: 1207440 - DNA, 22 bp, Artificial Sequence
  chemically synthesized
aattggctcacatttctgtagg

SEQ ID NO: 1207441 - DNA, 22 bp, Artificial Sequence
  chemically synthesized
cctgtacagcctacagaaatgt

SEQ ID NO: 1207442 - DNA, 22 bp, Artificial Sequence
  chemically synthesized
ctgtacagcctacagaaatgtg

SEQ ID NO: 1207443 - DNA, 22 bp, Artificial Sequence
  chemically synthesized
tacagcctacagaaatgtgagc

SEQ ID NO: 1207444 - DNA, 22 bp, Artificial Sequence
  chemically synthesized
cagaaatgtgagccaattaaac

SEQ ID NO: 1207445 - DNA, 22 bp, Artificial Sequence
  chemically synthesized
taaagaaaagaggtttaattgg

SEQ ID NO: 1207446 - DNA, 22 bp, Artificial Sequence
  chemically synthesized
ggtaaattataaagaaaagagg

SEQ ID NO: 1207447 - DNA, 22 bp, Artificial Sequence
  chemically synthesized
aaactgggtaaattataaagaa

SEQ ID NO: 1207448 - DNA, 22 bp, Artificial Sequence
  chemically synthesized
aacctcttttctttataattta

SEQ ID NO: 1207449 - DNA, 22 bp, Artificial Sequence
  chemically synthesized
ttttctttataatttacccagt

SEQ ID NO: 1207450 - DNA, 22 bp, Artificial Sequence
  chemically synthesized
ttctttataatttacccagttt

SEQ ID NO: 1207451 - DNA, 22 bp, Artificial Sequence
  chemically synthesized
aagaaatatctgaaactgggta

SEQ ID NO: 1207452 - DNA, 22 bp, Artificial Sequence
  chemically synthesized
tctttataatttacccagtttc

SEQ ID NO: 1207453 - DNA, 22 bp, Artificial Sequence
  chemically synthesized
ctttataatttacccagtttca

SEQ ID NO: 1207454 - DNA, 22 bp, Artificial Sequence
  chemically synthesized
taaagaaatatctgaaactggg

SEQ ID NO: 1207455 - DNA, 22 bp, Artificial Sequence
  chemically synthesized
tttataatttacccagtttcag

SEQ ID NO: 1207456 - DNA, 22 bp, Artificial Sequence
  chemically synthesized
tataatttacccagtttcagat

SEQ ID NO: 1207457 - DNA, 22 bp, Artificial Sequence
  chemically synthesized
ctctaaagaaatatctgaaact

SEQ ID NO: 1207458 - DNA, 22 bp, Artificial Sequence
  chemically synthesized
ataatttacccagtttcagata

SEQ ID NO: 1207459 - DNA, 22 bp, Artificial Sequence
  chemically synthesized
taatttacccagtttcagatat

SEQ ID NO: 1207460 - DNA, 22 bp, Artificial Sequence
  chemically synthesized
cattgctctaaagaaatatctg

SEQ ID NO: 1207461 - DNA, 22 bp, Artificial Sequence
  chemically synthesized
gcattgctctaaagaaatatct

SEQ ID NO: 1207462 - DNA, 22 bp, Artificial Sequence
  chemically synthesized
acccagtttcagatatttcttt

SEQ ID NO: 1207463 - DNA, 22 bp, Artificial Sequence
  chemically synthesized
ttgcattgctctaaagaaatat

SEQ ID NO: 1207464 - DNA, 22 bp, Artificial Sequence
  chemically synthesized
cccagtttcagatatttcttta

SEQ ID NO: 1207465 - DNA, 22 bp, Artificial Sequence
  chemically synthesized
gtccattcttgcattgctctaa

SEQ ID NO: 1207466 - DNA, 22 bp, Artificial Sequence
  chemically synthesized
cagatatttctttagagcaatg

SEQ ID NO: 1207467 - DNA, 22 bp, Artificial Sequence
  chemically synthesized
agatatttctttagagcaatgc

SEQ ID NO: 1207468 - DNA, 22 bp, Artificial Sequence
  chemically synthesized
tatgttagtccattcttgcatt

SEQ ID NO: 1207469 - DNA, 22 bp, Artificial Sequence
  chemically synthesized
ctttagagcaatgcaagaatgg

SEQ ID NO: 1207470 - DNA, 22 bp, Artificial Sequence
  chemically synthesized
ctatatgttagtccattcttgc

SEQ ID NO: 1207471 - DNA, 22 bp, Artificial Sequence
  chemically synthesized
tttagagcaatgcaagaatgga

SEQ ID NO: 1207472 - DNA, 22 bp, Artificial Sequence
  chemically synthesized
tagagcaatgcaagaatggact

SEQ ID NO: 1207473 - DNA, 22 bp, Artificial Sequence
  chemically synthesized
agagcaatgcaagaatggacta

SEQ ID NO: 1207474 - DNA, 22 bp, Artificial Sequence
  chemically synthesized
gagcaatgcaagaatggactaa

SEQ ID NO: 1207475 - DNA, 22 bp, Artificial Sequence
  chemically synthesized
tgccaagaactcctatatgtta

SEQ ID NO: 1207476 - DNA, 22 bp, Artificial Sequence
  chemically synthesized
atatccagactgtgccaagaac

SEQ ID NO: 1207477 - DNA, 22 bp, Artificial Sequence
  chemically synthesized
acatataggagttcttggcaca

SEQ ID NO: 1207478 - DNA, 22 bp, Artificial Sequence
  chemically synthesized
aatagggaattaatatccagac

SEQ ID NO: 1207479 - DNA, 22 bp, Artificial Sequence
  chemically synthesized
ttggcacagtctggatattaat

SEQ ID NO: 1207480 - DNA, 22 bp, Artificial Sequence
  chemically synthesized
ggcacagtctggatattaattc

SEQ ID NO: 1207481 - DNA, 22 bp, Artificial Sequence
  chemically synthesized
gcacagtctggatattaattcc

SEQ ID NO: 1207482 - DNA, 22 bp, Artificial Sequence
  chemically synthesized
cgaatcatatattcaataggga

SEQ ID NO: 1207483 - DNA, 22 bp, Artificial Sequence
  chemically synthesized
gcgaatcatatattcaataggg

SEQ ID NO: 1207484 - DNA, 22 bp, Artificial Sequence
  chemically synthesized
gatattaattccctattgaata

SEQ ID NO: 1207485 - DNA, 22 bp, Artificial Sequence
  chemically synthesized
attccctattgaatatatgatt

SEQ ID NO: 1207486 - DNA, 22 bp, Artificial Sequence
  chemically synthesized
cctattgaatatatgattcgca

SEQ ID NO: 1207487 - DNA, 22 bp, Artificial Sequence
  chemically synthesized
ttgaatatatgattcgcaaaca

SEQ ID NO: 1207488 - DNA, 22 bp, Artificial Sequence
  chemically synthesized
aatatatgattcgcaaacatct

SEQ ID NO: 1207489 - DNA, 22 bp, Artificial Sequence
  chemically synthesized
cggaatgggagaagatgtttgc

SEQ ID NO: 1207490 - DNA, 22 bp, Artificial Sequence
  chemically synthesized
acggaatgggagaagatgtttg

SEQ ID NO: 1207491 - DNA, 22 bp, Artificial Sequence
  chemically synthesized
gcaaacatcttctcccattccg

SEQ ID NO: 1207492 - DNA, 22 bp, Artificial Sequence
  chemically synthesized
ctcccattccgtaagttgcctt

SEQ ID NO: 1207493 - DNA, 22 bp, Artificial Sequence
  chemically synthesized
tcccattccgtaagttgccttt

SEQ ID NO: 1207494 - DNA, 22 bp, Artificial Sequence
  chemically synthesized
ccattccgtaagttgccttttc

SEQ ID NO: 1207495 - DNA, 22 bp, Artificial Sequence
  chemically synthesized
cgtaagttgccttttcactctg

SEQ ID NO: 1207496 - DNA, 22 bp, Artificial Sequence
  chemically synthesized
tgcatgaatgaacaccatcaga

SEQ ID NO: 1207497 - DNA, 22 bp, Artificial Sequence
  chemically synthesized
tgtgcatgaatgaacaccatca

SEQ ID NO: 1207498 - DNA, 22 bp, Artificial Sequence
  chemically synthesized
ccttttcactctgatggtgttc

SEQ ID NO: 1207499 - DNA, 22 bp, Artificial Sequence
  chemically synthesized
ctgtgcatgaatgaacaccatc

SEQ ID NO: 1207500 - DNA, 22 bp, Artificial Sequence
  chemically synthesized
ttcactctgatggtgttcattc

SEQ ID NO: 1207501 - DNA, 22 bp, Artificial Sequence
  chemically synthesized
tcactctgatggtgttcattca

SEQ ID NO: 1207502 - DNA, 22 bp, Artificial Sequence
  chemically synthesized
cactctgatggtgttcattcat

SEQ ID NO: 1207503 - DNA, 22 bp, Artificial Sequence
  chemically synthesized
actctgatggtgttcattcatg

SEQ ID NO: 1207504 - DNA, 22 bp, Artificial Sequence
  chemically synthesized
aaaacttctgtgcatgaatgaa

SEQ ID NO: 1207505 - DNA, 22 bp, Artificial Sequence
  chemically synthesized
tgatggtgttcattcatgcaca

SEQ ID NO: 1207506 - DNA, 22 bp, Artificial Sequence
  chemically synthesized
atggtgttcattcatgcacaga

SEQ ID NO: 1207507 - DNA, 22 bp, Artificial Sequence
  chemically synthesized
attcatgcacagaagtttttaa

SEQ ID NO: 1207508 - DNA, 22 bp, Artificial Sequence
  chemically synthesized
aaatgcatcaacattaaaaact

SEQ ID NO: 1207509 - DNA, 22 bp, Artificial Sequence
  chemically synthesized
atgcacagaagtttttaatgtt

SEQ ID NO: 1207510 - DNA, 22 bp, Artificial Sequence
  chemically synthesized
ggtaaattgaaatgcatcaaca

SEQ ID NO: 1207511 - DNA, 22 bp, Artificial Sequence
  chemically synthesized
ttaatgttgatgcatttcaatt

SEQ ID NO: 1207512 - DNA, 22 bp, Artificial Sequence
  chemically synthesized
taatgttgatgcatttcaattt

SEQ ID NO: 1207513 - DNA, 22 bp, Artificial Sequence
  chemically synthesized
aatgttgatgcatttcaattta

SEQ ID NO: 1207514 - DNA, 22 bp, Artificial Sequence
  chemically synthesized
atgttgatgcatttcaatttac

SEQ ID NO: 1207515 - DNA, 22 bp, Artificial Sequence
  chemically synthesized
caacagaaaaattaggtaaatt

SEQ ID NO: 1207516 - DNA, 22 bp, Artificial Sequence
  chemically synthesized
atgcatttcaatttacctaatt

SEQ ID NO: 1207517 - DNA, 22 bp, Artificial Sequence
  chemically synthesized
aggctacaacagaaaaattagg

SEQ ID NO: 1207518 - DNA, 22 bp, Artificial Sequence
  chemically synthesized
caatttacctaatttttctgtt

SEQ ID NO: 1207519 - DNA, 22 bp, Artificial Sequence
  chemically synthesized
aatttacctaatttttctgttg

SEQ ID NO: 1207520 - DNA, 22 bp, Artificial Sequence
  chemically synthesized
aaagctcaggctacaacagaaa

SEQ ID NO: 1207521 - DNA, 22 bp, Artificial Sequence
  chemically synthesized
acctaatttttctgttgtagcc

SEQ ID NO: 1207522 - DNA, 22 bp, Artificial Sequence
  chemically synthesized
cctaatttttctgttgtagcct

SEQ ID NO: 1207523 - DNA, 22 bp, Artificial Sequence
  chemically synthesized
atttttctgttgtagcctgagc

SEQ ID NO: 1207524 - DNA, 22 bp, Artificial Sequence
  chemically synthesized
gatatgacactaaaagctcagg

SEQ ID NO: 1207525 - DNA, 22 bp, Artificial Sequence
  chemically synthesized
ttctgttgtagcctgagctttt

SEQ ID NO: 1207526 - DNA, 22 bp, Artificial Sequence
  chemically synthesized
ggatatgacactaaaagctcag

SEQ ID NO: 1207527 - DNA, 22 bp, Artificial Sequence
  chemically synthesized
tctgttgtagcctgagctttta

SEQ ID NO: 1207528 - DNA, 22 bp, Artificial Sequence
  chemically synthesized
ctgttgtagcctgagcttttag

SEQ ID NO: 1207529 - DNA, 22 bp, Artificial Sequence
  chemically synthesized
tgttgtagcctgagcttttagt

SEQ ID NO: 1207530 - DNA, 22 bp, Artificial Sequence
  chemically synthesized
ttgtagcctgagcttttagtgt

SEQ ID NO: 1207531 - DNA, 22 bp, Artificial Sequence
  chemically synthesized
tagcctgagcttttagtgtcat

SEQ ID NO: 1207532 - DNA, 22 bp, Artificial Sequence
  chemically synthesized
aatatcttggatatgacactaa

SEQ ID NO: 1207533 - DNA, 22 bp, Artificial Sequence
  chemically synthesized
agcttttagtgtcatatccaag

SEQ ID NO: 1207534 - DNA, 22 bp, Artificial Sequence
  chemically synthesized
ggcaattaaatatcttggatat

SEQ ID NO: 1207535 - DNA, 22 bp, Artificial Sequence
  chemically synthesized
ttagtgtcatatccaagatatt

SEQ ID NO: 1207536 - DNA, 22 bp, Artificial Sequence
  chemically synthesized
tagtgtcatatccaagatattt

SEQ ID NO: 1207537 - DNA, 22 bp, Artificial Sequence
  chemically synthesized
gattgggcaattaaatatcttg

SEQ ID NO: 1207538 - DNA, 22 bp, Artificial Sequence
  chemically synthesized
agtgtcatatccaagatattta

SEQ ID NO: 1207539 - DNA, 22 bp, Artificial Sequence
  chemically synthesized
gtgtcatatccaagatatttaa

SEQ ID NO: 1207540 - DNA, 22 bp, Artificial Sequence
  chemically synthesized
gaagaaaacataaacattagat

SEQ ID NO: 1207541 - DNA, 22 bp, Artificial Sequence
  chemically synthesized
ggaagaaaacataaacattaga

SEQ ID NO: 1207542 - DNA, 22 bp, Artificial Sequence
  chemically synthesized
aattgcccaatctaatgtttat

SEQ ID NO: 1207543 - DNA, 22 bp, Artificial Sequence
  chemically synthesized
attgcccaatctaatgtttatg

SEQ ID NO: 1207544 - DNA, 22 bp, Artificial Sequence
  chemically synthesized
cccaatctaatgtttatgtttt

SEQ ID NO: 1207545 - DNA, 22 bp, Artificial Sequence
  chemically synthesized
atgtttatgttttcttccaaat

SEQ ID NO: 1207546 - DNA, 22 bp, Artificial Sequence
  chemically synthesized
gaagaaagcgtagacatttgga

SEQ ID NO: 1207547 - DNA, 22 bp, Artificial Sequence
  chemically synthesized
agaagaaagcgtagacatttgg

SEQ ID NO: 1207548 - DNA, 22 bp, Artificial Sequence
  chemically synthesized
tagaagaaagcgtagacatttg

SEQ ID NO: 1207549 - DNA, 22 bp, Artificial Sequence
  chemically synthesized
atgttttcttccaaatgtctac

SEQ ID NO: 1207550 - DNA, 22 bp, Artificial Sequence
  chemically synthesized
ttagaagaaagcgtagacattt

SEQ ID NO: 1207551 - DNA, 22 bp, Artificial Sequence
  chemically synthesized
tgttttcttccaaatgtctacg

SEQ ID NO: 1207552 - DNA, 22 bp, Artificial Sequence
  chemically synthesized
tcttccaaatgtctacgctttc

SEQ ID NO: 1207553 - DNA, 22 bp, Artificial Sequence
  chemically synthesized
cttccaaatgtctacgctttct

SEQ ID NO: 1207554 - DNA, 22 bp, Artificial Sequence
  chemically synthesized
ttccaaatgtctacgctttctt

SEQ ID NO: 1207555 - DNA, 22 bp, Artificial Sequence
  chemically synthesized
ccaaatgtctacgctttcttct

SEQ ID NO: 1207556 - DNA, 22 bp, Artificial Sequence
  chemically synthesized
caaatgtctacgctttcttcta

SEQ ID NO: 1207557 - DNA, 22 bp, Artificial Sequence
  chemically synthesized
cgctttcttctaaaagttctgt

SEQ ID NO: 1207558 - DNA, 22 bp, Artificial Sequence
  chemically synthesized
tcttctaaaagttctgtacttt

SEQ ID NO: 1207559 - DNA, 22 bp, Artificial Sequence
  chemically synthesized
cttctaaaagttctgtactttt

SEQ ID NO: 1207560 - DNA, 22 bp, Artificial Sequence
  chemically synthesized
ttctaaaagttctgtacttttg

SEQ ID NO: 1207561 - DNA, 22 bp, Artificial Sequence
  chemically synthesized
ctaaaagttctgtacttttggc

SEQ ID NO: 1207562 - DNA, 22 bp, Artificial Sequence
  chemically synthesized
taaaagttctgtacttttggcc

SEQ ID NO: 1207563 - DNA, 22 bp, Artificial Sequence
  chemically synthesized
aaagttctgtacttttggccac

SEQ ID NO: 1207564 - DNA, 22 bp, Artificial Sequence
  chemically synthesized
tgtacttttggccacgtttact

SEQ ID NO: 1207565 - DNA, 22 bp, Artificial Sequence
  chemically synthesized
tacttttggccacgtttacttc

SEQ ID NO: 1207566 - DNA, 22 bp, Artificial Sequence
  chemically synthesized
agtcaaaatggatcaggaagta

SEQ ID NO: 1207567 - DNA, 22 bp, Artificial Sequence
  chemically synthesized
ttggccacgtttacttcctgat

SEQ ID NO: 1207568 - DNA, 22 bp, Artificial Sequence
  chemically synthesized
tggccacgtttacttcctgatc

SEQ ID NO: 1207569 - DNA, 22 bp, Artificial Sequence
  chemically synthesized
ggccacgtttacttcctgatcc

SEQ ID NO: 1207570 - DNA, 22 bp, Artificial Sequence
  chemically synthesized
gccacgtttacttcctgatcca

SEQ ID NO: 1207571 - DNA, 22 bp, Artificial Sequence
  chemically synthesized
acttcctgatccattttgactt

SEQ ID NO: 1207572 - DNA, 22 bp, Artificial Sequence
  chemically synthesized
cttcctgatccattttgactta

SEQ ID NO: 1207573 - DNA, 22 bp, Artificial Sequence
  chemically synthesized
cctgatccattttgacttaatt

SEQ ID NO: 1207574 - DNA, 22 bp, Artificial Sequence
  chemically synthesized
ctgatccattttgacttaattt

SEQ ID NO: 1207575 - DNA, 22 bp, Artificial Sequence
  chemically synthesized
taaaatacacaaaaattaagtc

SEQ ID NO: 1207576 - DNA, 22 bp, Artificial Sequence
  chemically synthesized
ataaaatacacaaaaattaagt

SEQ ID NO: 1207577 - DNA, 22 bp, Artificial Sequence
  chemically synthesized
atccattttgacttaatttttg

SEQ ID NO: 1207578 - DNA, 22 bp, Artificial Sequence
  chemically synthesized
ttataaaatacacaaaaattaa

SEQ ID NO: 1207579 - DNA, 22 bp, Artificial Sequence
  chemically synthesized
gactcttataaaatacacaaaa

SEQ ID NO: 1207580 - DNA, 22 bp, Artificial Sequence
  chemically synthesized
tgacttaatttttgtgtatttt

SEQ ID NO: 1207581 - DNA, 22 bp, Artificial Sequence
  chemically synthesized
gacttaatttttgtgtatttta

SEQ ID NO: 1207582 - DNA, 22 bp, Artificial Sequence
  chemically synthesized
acttaatttttgtgtattttat

SEQ ID NO: 1207583 - DNA, 22 bp, Artificial Sequence
  chemically synthesized
aatttttgtgtattttataaga

SEQ ID NO: 1207584 - DNA, 22 bp, Artificial Sequence
  chemically synthesized
atttttgtgtattttataagag

SEQ ID NO: 1207585 - DNA, 22 bp, Artificial Sequence
  chemically synthesized
ttgtgtattttataagagtcca

SEQ ID NO: 1207586 - DNA, 22 bp, Artificial Sequence
  chemically synthesized
tgtgtattttataagagtccaa

SEQ ID NO: 1207587 - DNA, 22 bp, Artificial Sequence
  chemically synthesized
aaataaatgaagttggactctt

SEQ ID NO: 1207588 - DNA, 22 bp, Artificial Sequence
  chemically synthesized
gtgtattttataagagtccaac

SEQ ID NO: 1207589 - DNA, 22 bp, Artificial Sequence
  chemically synthesized
aaaataaatgaagttggactct

SEQ ID NO: 1207590 - DNA, 22 bp, Artificial Sequence
  chemically synthesized
tgtattttataagagtccaact

SEQ ID NO: 1207591 - DNA, 22 bp, Artificial Sequence
  chemically synthesized
tataagagtccaacttcattta

SEQ ID NO: 1207592 - DNA, 22 bp, Artificial Sequence
  chemically synthesized
ataagagtccaacttcatttat

SEQ ID NO: 1207593 - DNA, 22 bp, Artificial Sequence
  chemically synthesized
taagagtccaacttcatttatt

SEQ ID NO: 1207594 - DNA, 22 bp, Artificial Sequence
  chemically synthesized
aatatatacatttaaaataaat

SEQ ID NO: 1207595 - DNA, 22 bp, Artificial Sequence
  chemically synthesized
agaaactgaatatatacattta

SEQ ID NO: 1207596 - DNA, 22 bp, Artificial Sequence
  chemically synthesized
catttattttaaatgtatatat

SEQ ID NO: 1207597 - DNA, 22 bp, Artificial Sequence
  chemically synthesized
ctaagaaactgaatatatacat

SEQ ID NO: 1207598 - DNA, 22 bp, Artificial Sequence
  chemically synthesized
atttattttaaatgtatatatt

SEQ ID NO: 1207599 - DNA, 22 bp, Artificial Sequence
  chemically synthesized
attttaaatgtatatattcagt

SEQ ID NO: 1207600 - DNA, 22 bp, Artificial Sequence
  chemically synthesized
ttttaaatgtatatattcagtt

SEQ ID NO: 1207601 - DNA, 22 bp, Artificial Sequence
  chemically synthesized
taaatgtatatattcagtttct

SEQ ID NO: 1207602 - DNA, 22 bp, Artificial Sequence
  chemically synthesized
aaatgtatatattcagtttctt

SEQ ID NO: 1207603 - DNA, 22 bp, Artificial Sequence
  chemically synthesized
aatgtatatattcagtttctta

SEQ ID NO: 1207604 - DNA, 22 bp, Artificial Sequence
  chemically synthesized
atgaagccacaaatgttgctaa

SEQ ID NO: 1207605 - DNA, 22 bp, Artificial Sequence
  chemically synthesized
aatgaagccacaaatgttgcta

SEQ ID NO: 1207606 - DNA, 22 bp, Artificial Sequence
  chemically synthesized
taatgaagccacaaatgttgct

SEQ ID NO: 1207607 - DNA, 22 bp, Artificial Sequence
  chemically synthesized
ttaatgaagccacaaatgttgc

SEQ ID NO: 1207608 - DNA, 22 bp, Artificial Sequence
  chemically synthesized
tttaatgaagccacaaatgttg

SEQ ID NO: 1207609 - DNA, 22 bp, Artificial Sequence
  chemically synthesized
agtttcttagcaacatttgtgg

SEQ ID NO: 1207610 - DNA, 22 bp, Artificial Sequence
  chemically synthesized
cttagcaacatttgtggcttca

SEQ ID NO: 1207611 - DNA, 22 bp, Artificial Sequence
  chemically synthesized
atgattttttaatgaagccaca

SEQ ID NO: 1207612 - DNA, 22 bp, Artificial Sequence
  chemically synthesized
ttagcaacatttgtggcttcat

SEQ ID NO: 1207613 - DNA, 22 bp, Artificial Sequence
  chemically synthesized
aatgattttttaatgaagccac

SEQ ID NO: 1207614 - DNA, 22 bp, Artificial Sequence
  chemically synthesized
taatgattttttaatgaagcca

SEQ ID NO: 1207615 - DNA, 22 bp, Artificial Sequence
  chemically synthesized
agcaacatttgtggcttcatta

SEQ ID NO: 1207616 - DNA, 22 bp, Artificial Sequence
  chemically synthesized
ttaatgattttttaatgaagcc

SEQ ID NO: 1207617 - DNA, 22 bp, Artificial Sequence
  chemically synthesized
gcaacatttgtggcttcattaa

SEQ ID NO: 1207618 - DNA, 22 bp, Artificial Sequence
  chemically synthesized
tttaatgattttttaatgaagc

SEQ ID NO: 1207619 - DNA, 22 bp, Artificial Sequence
  chemically synthesized
gtggcttcattaaaaaatcatt

SEQ ID NO: 1207620 - DNA, 22 bp, Artificial Sequence
  chemically synthesized
ccaaggttttttaatgattttt

SEQ ID NO: 1207621 - DNA, 22 bp, Artificial Sequence
  chemically synthesized
tggcttcattaaaaaatcatta

SEQ ID NO: 1207622 - DNA, 22 bp, Artificial Sequence
  chemically synthesized
cattaaaaaatcattaaaaaac

SEQ ID NO: 1207623 - DNA, 22 bp, Artificial Sequence
  chemically synthesized
attaaaaaatcattaaaaaacc

SEQ ID NO: 1207624 - DNA, 22 bp, Artificial Sequence
  chemically synthesized
cataaggttgccaaggtttttt

SEQ ID NO: 1207625 - DNA, 22 bp, Artificial Sequence
  chemically synthesized
ccataaggttgccaaggttttt

SEQ ID NO: 1207626 - DNA, 22 bp, Artificial Sequence
  chemically synthesized
aaaaatcattaaaaaaccttgg

SEQ ID NO: 1207627 - DNA, 22 bp, Artificial Sequence
  chemically synthesized
tccataaggttgccaaggtttt

SEQ ID NO: 1207628 - DNA, 22 bp, Artificial Sequence
  chemically synthesized
aaaaaccttggcaaccttatgg

SEQ ID NO: 1207629 - DNA, 22 bp, Artificial Sequence
  chemically synthesized
tcaaacaattttccataaggtt

SEQ ID NO: 1207630 - DNA, 22 bp, Artificial Sequence
  chemically synthesized
tatattgtcaaacaattttcca

SEQ ID NO: 1207631 - DNA, 22 bp, Artificial Sequence
  chemically synthesized
ggcaaccttatggaaaattgtt

SEQ ID NO: 1207632 - DNA, 22 bp, Artificial Sequence
  chemically synthesized
gcaaccttatggaaaattgttt

SEQ ID NO: 1207633 - DNA, 22 bp, Artificial Sequence
  chemically synthesized
ctatatattgtcaaacaatttt

SEQ ID NO: 1207634 - DNA, 22 bp, Artificial Sequence
  chemically synthesized
tactatatattgtcaaacaatt

SEQ ID NO: 1207635 - DNA, 22 bp, Artificial Sequence
  chemically synthesized
atggaaaattgtttgacaatat

SEQ ID NO: 1207636 - DNA, 22 bp, Artificial Sequence
  chemically synthesized
tggaaaattgtttgacaatata

SEQ ID NO: 1207637 - DNA, 22 bp, Artificial Sequence
  chemically synthesized
aagtaaactctactatatattg

SEQ ID NO: 1207638 - DNA, 22 bp, Artificial Sequence
  chemically synthesized
tttgacaatatatagtagagtt

SEQ ID NO: 1207639 - DNA, 22 bp, Artificial Sequence
  chemically synthesized
gacaatatatagtagagtttac

SEQ ID NO: 1207640 - DNA, 22 bp, Artificial Sequence
  chemically synthesized
acaatatatagtagagtttact

SEQ ID NO: 1207641 - DNA, 22 bp, Artificial Sequence
  chemically synthesized
acttcagggctattatattcta

SEQ ID NO: 1207642 - DNA, 22 bp, Artificial Sequence
  chemically synthesized
cttcagggctattatattctat

SEQ ID NO: 1207643 - DNA, 22 bp, Artificial Sequence
  chemically synthesized
cagggctattatattctattgt

SEQ ID NO: 1207644 - DNA, 22 bp, Artificial Sequence
  chemically synthesized
agggctattatattctattgtt

SEQ ID NO: 1207645 - DNA, 22 bp, Artificial Sequence
  chemically synthesized
aaaaaagggaatgtagaacaat

SEQ ID NO: 1207646 - DNA, 22 bp, Artificial Sequence
  chemically synthesized
aaaaaaagggaatgtagaacaa

SEQ ID NO: 1207647 - DNA, 22 bp, Artificial Sequence
  chemically synthesized
ttatattctattgttctacatt

SEQ ID NO: 1207648 - DNA, 22 bp, Artificial Sequence
  chemically synthesized
gcttaaaaaaagggaatgtaga

SEQ ID NO: 1207649 - DNA, 22 bp, Artificial Sequence
  chemically synthesized
tattctattgttctacattccc

SEQ ID NO: 1207650 - DNA, 22 bp, Artificial Sequence
  chemically synthesized
tattgttctacattcccttttt

SEQ ID NO: 1207651 - DNA, 22 bp, Artificial Sequence
  chemically synthesized
ttgttctacattcccttttttt

SEQ ID NO: 1207652 - DNA, 22 bp, Artificial Sequence
  chemically synthesized
tggtattggcttaaaaaaaggg

SEQ ID NO: 1207653 - DNA, 22 bp, Artificial Sequence
  chemically synthesized
ttctacattccctttttttaag

SEQ ID NO: 1207654 - DNA, 22 bp, Artificial Sequence
  chemically synthesized
tacattccctttttttaagcca

SEQ ID NO: 1207655 - DNA, 22 bp, Artificial Sequence
  chemically synthesized
cattccctttttttaagccaat

SEQ ID NO: 1207656 - DNA, 22 bp, Artificial Sequence
  chemically synthesized
cctttttttaagccaataccac

SEQ ID NO: 1207657 - DNA, 22 bp, Artificial Sequence
  chemically synthesized
tttttaagccaataccacagtg

SEQ ID NO: 1207658 - DNA, 22 bp, Artificial Sequence
  chemically synthesized
ccataatcaaaacactgtggta

SEQ ID NO: 1207659 - DNA, 22 bp, Artificial Sequence
  chemically synthesized
ttttaagccaataccacagtgt

SEQ ID NO: 1207660 - DNA, 22 bp, Artificial Sequence
  chemically synthesized
tttaagccaataccacagtgtt

SEQ ID NO: 1207661 - DNA, 22 bp, Artificial Sequence
  chemically synthesized
ttaagccaataccacagtgttt

SEQ ID NO: 1207662 - DNA, 22 bp, Artificial Sequence
  chemically synthesized
taagccaataccacagtgtttt

SEQ ID NO: 1207663 - DNA, 22 bp, Artificial Sequence
  chemically synthesized
aagccaataccacagtgttttg

SEQ ID NO: 1207664 - DNA, 22 bp, Artificial Sequence
  chemically synthesized
agccaataccacagtgttttga

SEQ ID NO: 1207665 - DNA, 22 bp, Artificial Sequence
  chemically synthesized
caaagctaccataatcaaaaca

SEQ ID NO: 1207666 - DNA, 22 bp, Artificial Sequence
  chemically synthesized
ctacaaagctaccataatcaaa

SEQ ID NO: 1207667 - DNA, 22 bp, Artificial Sequence
  chemically synthesized
actacaaagctaccataatcaa

SEQ ID NO: 1207668 - DNA, 22 bp, Artificial Sequence
  chemically synthesized
aaaacttactacaaagctacca

SEQ ID NO: 1207669 - DNA, 22 bp, Artificial Sequence
  chemically synthesized
caaaacttactacaaagctacc

SEQ ID NO: 1207670 - DNA, 22 bp, Artificial Sequence
  chemically synthesized
atttcaaaacttactacaaagc

SEQ ID NO: 1207671 - DNA, 22 bp, Artificial Sequence
  chemically synthesized
tgattatggtagctttgtagta

SEQ ID NO: 1207672 - DNA, 22 bp, Artificial Sequence
  chemically synthesized
gattatggtagctttgtagtaa

SEQ ID NO: 1207673 - DNA, 22 bp, Artificial Sequence
  chemically synthesized
attatggtagctttgtagtaag

SEQ ID NO: 1207674 - DNA, 22 bp, Artificial Sequence
  chemically synthesized
tggtagctttgtagtaagtttt

SEQ ID NO: 1207675 - DNA, 22 bp, Artificial Sequence
  chemically synthesized
tgtagtaagttttgaaatcagg

SEQ ID NO: 1207676 - DNA, 22 bp, Artificial Sequence
  chemically synthesized
gtagtaagttttgaaatcagga

SEQ ID NO: 1207677 - DNA, 22 bp, Artificial Sequence
  chemically synthesized
aagggtcatacgtcctgatttc

SEQ ID NO: 1207678 - DNA, 22 bp, Artificial Sequence
  chemically synthesized
tagtaagttttgaaatcaggac

SEQ ID NO: 1207679 - DNA, 22 bp, Artificial Sequence
  chemically synthesized
tgaaatcaggacgtatgaccct

SEQ ID NO: 1207680 - DNA, 22 bp, Artificial Sequence
  chemically synthesized
gaaatcaggacgtatgaccctt

SEQ ID NO: 1207681 - DNA, 22 bp, Artificial Sequence
  chemically synthesized
aaatcaggacgtatgacccttc

SEQ ID NO: 1207682 - DNA, 22 bp, Artificial Sequence
  chemically synthesized
aaaaaagaatgaagttgaaggg

SEQ ID NO: 1207683 - DNA, 22 bp, Artificial Sequence
  chemically synthesized
gaaaaaagaatgaagttgaagg

SEQ ID NO: 1207684 - DNA, 22 bp, Artificial Sequence
  chemically synthesized
aaacgatcttgaaaaaagaatg

SEQ ID NO: 1207685 - DNA, 22 bp, Artificial Sequence
  chemically synthesized
caacttcattcttttttcaaga

SEQ ID NO: 1207686 - DNA, 22 bp, Artificial Sequence
  chemically synthesized
aacttcattcttttttcaagat

SEQ ID NO: 1207687 - DNA, 22 bp, Artificial Sequence
  chemically synthesized
cattcttttttcaagatcgttt

SEQ ID NO: 1207688 - DNA, 22 bp, Artificial Sequence
  chemically synthesized
attcttttttcaagatcgtttc

SEQ ID NO: 1207689 - DNA, 22 bp, Artificial Sequence
  chemically synthesized
ttttttcaagatcgtttcaact

SEQ ID NO: 1207690 - DNA, 22 bp, Artificial Sequence
  chemically synthesized
ttttcaagatcgtttcaactat

SEQ ID NO: 1207691 - DNA, 22 bp, Artificial Sequence
  chemically synthesized
atggatccaggaatagttgaaa

SEQ ID NO: 1207692 - DNA, 22 bp, Artificial Sequence
  chemically synthesized
tttcaagatcgtttcaactatt

SEQ ID NO: 1207693 - DNA, 22 bp, Artificial Sequence
  chemically synthesized
ttcaagatcgtttcaactattc

SEQ ID NO: 1207694 - DNA, 22 bp, Artificial Sequence
  chemically synthesized
tcaagatcgtttcaactattcc

SEQ ID NO: 1207695 - DNA, 22 bp, Artificial Sequence
  chemically synthesized
caagatcgtttcaactattcct

SEQ ID NO: 1207696 - DNA, 22 bp, Artificial Sequence
  chemically synthesized
aagatcgtttcaactattcctg

SEQ ID NO: 1207697 - DNA, 22 bp, Artificial Sequence
  chemically synthesized
ccatgtaatctcatggatccag

SEQ ID NO: 1207698 - DNA, 22 bp, Artificial Sequence
  chemically synthesized
caactattcctggatccatgag

SEQ ID NO: 1207699 - DNA, 22 bp, Artificial Sequence
  chemically synthesized
aactattcctggatccatgaga

SEQ ID NO: 1207700 - DNA, 22 bp, Artificial Sequence
  chemically synthesized
ttcctggatccatgagattaca

SEQ ID NO: 1207701 - DNA, 22 bp, Artificial Sequence
  chemically synthesized
tcaaaaattcccatgtaatctc

SEQ ID NO: 1207702 - DNA, 22 bp, Artificial Sequence
  chemically synthesized
ctggatccatgagattacatgg

SEQ ID NO: 1207703 - DNA, 22 bp, Artificial Sequence
  chemically synthesized
tatcaaaaattcccatgtaatc

SEQ ID NO: 1207704 - DNA, 22 bp, Artificial Sequence
  chemically synthesized
gatccatgagattacatgggaa

SEQ ID NO: 1207705 - DNA, 22 bp, Artificial Sequence
  chemically synthesized
cagaaatagacaactctatcaa

SEQ ID NO: 1207706 - DNA, 22 bp, Artificial Sequence
  chemically synthesized
catgggaatttttgatagagtt

SEQ ID NO: 1207707 - DNA, 22 bp, Artificial Sequence
  chemically synthesized
tgcagaaatagacaactctatc

SEQ ID NO: 1207708 - DNA, 22 bp, Artificial Sequence
  chemically synthesized
ctgcagaaatagacaactctat

SEQ ID NO: 1207709 - DNA, 22 bp, Artificial Sequence
  chemically synthesized
tctgcagaaatagacaactcta

SEQ ID NO: 1207710 - DNA, 22 bp, Artificial Sequence
  chemically synthesized
ttctgcagaaatagacaactct

SEQ ID NO: 1207711 - DNA, 22 bp, Artificial Sequence
  chemically synthesized
gtttttctgcagaaatagacaa

SEQ ID NO: 1207712 - DNA, 22 bp, Artificial Sequence
  chemically synthesized
ttgatagagttgtctatttctg

SEQ ID NO: 1207713 - DNA, 22 bp, Artificial Sequence
  chemically synthesized
tgatagagttgtctatttctgc

SEQ ID NO: 1207714 - DNA, 22 bp, Artificial Sequence
  chemically synthesized
gatagagttgtctatttctgca

SEQ ID NO: 1207715 - DNA, 22 bp, Artificial Sequence
  chemically synthesized
atagagttgtctatttctgcag

SEQ ID NO: 1207716 - DNA, 22 bp, Artificial Sequence
  chemically synthesized
tctatttctgcagaaaaactaa

SEQ ID NO: 1207717 - DNA, 22 bp, Artificial Sequence
  chemically synthesized
agaaaatcccaattagtttttc

SEQ ID NO: 1207718 - DNA, 22 bp, Artificial Sequence
  chemically synthesized
taagaaaatcccaattagtttt

SEQ ID NO: 1207719 - DNA, 22 bp, Artificial Sequence
  chemically synthesized
tttctgcagaaaaactaattgg

SEQ ID NO: 1207720 - DNA, 22 bp, Artificial Sequence
  chemically synthesized
ctgcagaaaaactaattgggat

SEQ ID NO: 1207721 - DNA, 22 bp, Artificial Sequence
  chemically synthesized
tgcagaaaaactaattgggatt

SEQ ID NO: 1207722 - DNA, 22 bp, Artificial Sequence
  chemically synthesized
cagaaaaactaattgggatttt

SEQ ID NO: 1207723 - DNA, 22 bp, Artificial Sequence
  chemically synthesized
agtgccatctctaagaaaatcc

SEQ ID NO: 1207724 - DNA, 22 bp, Artificial Sequence
  chemically synthesized
cacattcagtgccatctctaag

SEQ ID NO: 1207725 - DNA, 22 bp, Artificial Sequence
  chemically synthesized
attgggattttcttagagatgg

SEQ ID NO: 1207726 - DNA, 22 bp, Artificial Sequence
  chemically synthesized
ggattttcttagagatggcact

SEQ ID NO: 1207727 - DNA, 22 bp, Artificial Sequence
  chemically synthesized
tcttagagatggcactgaatgt

SEQ ID NO: 1207728 - DNA, 22 bp, Artificial Sequence
  chemically synthesized
aaaacaaactacacattcagtg

SEQ ID NO: 1207729 - DNA, 22 bp, Artificial Sequence
  chemically synthesized
cttagagatggcactgaatgtg

SEQ ID NO: 1207730 - DNA, 22 bp, Artificial Sequence
  chemically synthesized
ttagagatggcactgaatgtgt

SEQ ID NO: 1207731 - DNA, 22 bp, Artificial Sequence
  chemically synthesized
ctcaaaacaaactacacattca

SEQ ID NO: 1207732 - DNA, 22 bp, Artificial Sequence
  chemically synthesized
agagatggcactgaatgtgtag

SEQ ID NO: 1207733 - DNA, 22 bp, Artificial Sequence
  chemically synthesized
gagatggcactgaatgtgtagt

SEQ ID NO: 1207734 - DNA, 22 bp, Artificial Sequence
  chemically synthesized
aatgtgtagtttgttttgagta

SEQ ID NO: 1207735 - DNA, 22 bp, Artificial Sequence
  chemically synthesized
aggtatccgagttactcaaaac

SEQ ID NO: 1207736 - DNA, 22 bp, Artificial Sequence
  chemically synthesized
ttgaggtatccgagttactcaa

SEQ ID NO: 1207737 - DNA, 22 bp, Artificial Sequence
  chemically synthesized
ttgttgaggtatccgagttact

SEQ ID NO: 1207738 - DNA, 22 bp, Artificial Sequence
  chemically synthesized
gttttgagtaactcggatacct

SEQ ID NO: 1207739 - DNA, 22 bp, Artificial Sequence
  chemically synthesized
ttttgagtaactcggatacctc

SEQ ID NO: 1207740 - DNA, 22 bp, Artificial Sequence
  chemically synthesized
aatattgttgttgaggtatccg

SEQ ID NO: 1207741 - DNA, 22 bp, Artificial Sequence
  chemically synthesized
tgagtaactcggatacctcaac

SEQ ID NO: 1207742 - DNA, 22 bp, Artificial Sequence
  chemically synthesized
gagtaactcggatacctcaaca

SEQ ID NO: 1207743 - DNA, 22 bp, Artificial Sequence
  chemically synthesized
agtaactcggatacctcaacaa

SEQ ID NO: 1207744 - DNA, 22 bp, Artificial Sequence
  chemically synthesized
ggatacctcaacaacaatattg

SEQ ID NO: 1207745 - DNA, 22 bp, Artificial Sequence
  chemically synthesized
tgaaatggaacactcaatattg

SEQ ID NO: 1207746 - DNA, 22 bp, Artificial Sequence
  chemically synthesized
atgaaatggaacactcaatatt

SEQ ID NO: 1207747 - DNA, 22 bp, Artificial Sequence
  chemically synthesized
aacaacaatattgagtgttcca

SEQ ID NO: 1207748 - DNA, 22 bp, Artificial Sequence
  chemically synthesized
agtgttccatttcataaacctg

SEQ ID NO: 1207749 - DNA, 22 bp, Artificial Sequence
  chemically synthesized
catttcataaacctggggttcc

SEQ ID NO: 1207750 - DNA, 22 bp, Artificial Sequence
  chemically synthesized
taaataaatgaaaaggaacccc

SEQ ID NO: 1207751 - DNA, 22 bp, Artificial Sequence
  chemically synthesized
ataaataaatgaaaaggaaccc

SEQ ID NO: 1207752 - DNA, 22 bp, Artificial Sequence
  chemically synthesized
tataaataaatgaaaaggaacc

SEQ ID NO: 1207753 - DNA, 22 bp, Artificial Sequence
  chemically synthesized
cataaacctggggttccttttc

SEQ ID NO: 1207754 - DNA, 22 bp, Artificial Sequence
  chemically synthesized
ttataaataaatgaaaaggaac

SEQ ID NO: 1207755 - DNA, 22 bp, Artificial Sequence
  chemically synthesized
ataaacctggggttccttttca

SEQ ID NO: 1207756 - DNA, 22 bp, Artificial Sequence
  chemically synthesized
tttttataaataaatgaaaagg

SEQ ID NO: 1207757 - DNA, 22 bp, Artificial Sequence
  chemically synthesized
atttttataaataaatgaaaag

SEQ ID NO: 1207758 - DNA, 22 bp, Artificial Sequence
  chemically synthesized
gggttccttttcatttatttat

SEQ ID NO: 1207759 - DNA, 22 bp, Artificial Sequence
  chemically synthesized
aacatttatttttataaataaa

SEQ ID NO: 1207760 - DNA, 22 bp, Artificial Sequence
  chemically synthesized
cttttcatttatttataaaaat

SEQ ID NO: 1207761 - DNA, 22 bp, Artificial Sequence
  chemically synthesized
ttcatttatttataaaaataaa

SEQ ID NO: 1207762 - DNA, 22 bp, Artificial Sequence
  chemically synthesized
tcatttatttataaaaataaat

SEQ ID NO: 1207763 - DNA, 22 bp, Artificial Sequence
  chemically synthesized
catttatttataaaaataaatg

SEQ ID NO: 1207764 - DNA, 22 bp, Artificial Sequence
  chemically synthesized
aaagaaattaaacatttatttt

SEQ ID NO: 1207765 - DNA, 22 bp, Artificial Sequence
  chemically synthesized
atttatttataaaaataaatgt

SEQ ID NO: 1207766 - DNA, 22 bp, Artificial Sequence
  chemically synthesized
atttataaaaataaatgtttaa

SEQ ID NO: 1207767 - DNA, 22 bp, Artificial Sequence
  chemically synthesized
tttataaaaataaatgtttaat

SEQ ID NO: 1207768 - DNA, 22 bp, Artificial Sequence
  chemically synthesized
ataaaaataaatgtttaatttc

SEQ ID NO: 1207769 - DNA, 22 bp, Artificial Sequence
  chemically synthesized
taaaaataaatgtttaatttct

SEQ ID NO: 1207770 - DNA, 22 bp, Artificial Sequence
  chemically synthesized
caaaacaatcctgaaagaaatt

SEQ ID NO: 1207771 - DNA, 22 bp, Artificial Sequence
  chemically synthesized
acaactacaaaacaatcctgaa

SEQ ID NO: 1207772 - DNA, 22 bp, Artificial Sequence
  chemically synthesized
aatttctttcaggattgttttg

SEQ ID NO: 1207773 - DNA, 22 bp, Artificial Sequence
  chemically synthesized
atttctttcaggattgttttgt

SEQ ID NO: 1207774 - DNA, 22 bp, Artificial Sequence
  chemically synthesized
tacactgacaactacaaaacaa

SEQ ID NO: 1207775 - DNA, 22 bp, Artificial Sequence
  chemically synthesized
atacactgacaactacaaaaca

SEQ ID NO: 1207776 - DNA, 22 bp, Artificial Sequence
  chemically synthesized
ctttcaggattgttttgtagtt

SEQ ID NO: 1207777 - DNA, 22 bp, Artificial Sequence
  chemically synthesized
tttcaggattgttttgtagttg

SEQ ID NO: 1207778 - DNA, 22 bp, Artificial Sequence
  chemically synthesized
tcaggattgttttgtagttgtc

SEQ ID NO: 1207779 - DNA, 22 bp, Artificial Sequence
  chemically synthesized
caggattgttttgtagttgtca

SEQ ID NO: 1207780 - DNA, 22 bp, Artificial Sequence
  chemically synthesized
aggattgttttgtagttgtcag

SEQ ID NO: 1207781 - DNA, 22 bp, Artificial Sequence
  chemically synthesized
ttttgtagttgtcagtgtataa

SEQ ID NO: 1207782 - DNA, 22 bp, Artificial Sequence
  chemically synthesized
tgtagttgtcagtgtataagtc

SEQ ID NO: 1207783 - DNA, 22 bp, Artificial Sequence
  chemically synthesized
gtagttgtcagtgtataagtct

SEQ ID NO: 1207784 - DNA, 22 bp, Artificial Sequence
  chemically synthesized
tagttgtcagtgtataagtctt

SEQ ID NO: 1207785 - DNA, 22 bp, Artificial Sequence
  chemically synthesized
accaagaaggtggaagacttat

SEQ ID NO: 1207786 - DNA, 22 bp, Artificial Sequence
  chemically synthesized
tcagtgtataagtcttccacct

SEQ ID NO: 1207787 - DNA, 22 bp, Artificial Sequence
  chemically synthesized
ggaattaaccaagaaggtggaa

SEQ ID NO: 1207788 - DNA, 22 bp, Artificial Sequence
  chemically synthesized
aggaattaaccaagaaggtgga

SEQ ID NO: 1207789 - DNA, 22 bp, Artificial Sequence
  chemically synthesized
ccaccttcttggttaattccta

SEQ ID NO: 1207790 - DNA, 22 bp, Artificial Sequence
  chemically synthesized
caccttcttggttaattcctaa

SEQ ID NO: 1207791 - DNA, 22 bp, Artificial Sequence
  chemically synthesized
cttggttaattcctaagtattt

SEQ ID NO: 1207792 - DNA, 22 bp, Artificial Sequence
  chemically synthesized
ttggttaattcctaagtatttt

SEQ ID NO: 1207793 - DNA, 22 bp, Artificial Sequence
  chemically synthesized
ggttaattcctaagtattttac

SEQ ID NO: 1207794 - DNA, 22 bp, Artificial Sequence
  chemically synthesized
gttaattcctaagtattttact

SEQ ID NO: 1207795 - DNA, 22 bp, Artificial Sequence
  chemically synthesized
attcctaagtattttactcttt

SEQ ID NO: 1207796 - DNA, 22 bp, Artificial Sequence
  chemically synthesized
aaatagtaacaaaaagagtaaa

SEQ ID NO: 1207797 - DNA, 22 bp, Artificial Sequence
  chemically synthesized
aaaatagtaacaaaaagagtaa

SEQ ID NO: 1207798 - DNA, 22 bp, Artificial Sequence
  chemically synthesized
ctaagtattttactctttttgt

SEQ ID NO: 1207799 - DNA, 22 bp, Artificial Sequence
  chemically synthesized
tttaaaatagtaacaaaaagag

SEQ ID NO: 1207800 - DNA, 22 bp, Artificial Sequence
  chemically synthesized
atttaaaatagtaacaaaaaga

SEQ ID NO: 1207801 - DNA, 22 bp, Artificial Sequence
  chemically synthesized
tatttaaaatagtaacaaaaag

SEQ ID NO: 1207802 - DNA, 22 bp, Artificial Sequence
  chemically synthesized
agtattttactctttttgttac

SEQ ID NO: 1207803 - DNA, 22 bp, Artificial Sequence
  chemically synthesized
tactctttttgttactatttta

SEQ ID NO: 1207804 - DNA, 22 bp, Artificial Sequence
  chemically synthesized
actctttttgttactattttaa

SEQ ID NO: 1207805 - DNA, 22 bp, Artificial Sequence
  chemically synthesized
ctctttttgttactattttaaa

SEQ ID NO: 1207806 - DNA, 22 bp, Artificial Sequence
  chemically synthesized
aggaaacaattttatttaaaat

SEQ ID NO: 1207807 - DNA, 22 bp, Artificial Sequence
  chemically synthesized
tttttgttactattttaaataa

SEQ ID NO: 1207808 - DNA, 22 bp, Artificial Sequence
  chemically synthesized
tttgttactattttaaataaaa

SEQ ID NO: 1207809 - DNA, 22 bp, Artificial Sequence
  chemically synthesized
ttgttactattttaaataaaat

SEQ ID NO: 1207810 - DNA, 22 bp, Artificial Sequence
  chemically synthesized
tgttactattttaaataaaatt

SEQ ID NO: 1207811 - DNA, 22 bp, Artificial Sequence
  chemically synthesized
gttactattttaaataaaattg

SEQ ID NO: 1207812 - DNA, 22 bp, Artificial Sequence
  chemically synthesized
ttactattttaaataaaattgt

SEQ ID NO: 1207813 - DNA, 22 bp, Artificial Sequence
  chemically synthesized
ctattttaaataaaattgtttc

SEQ ID NO: 1207814 - DNA, 22 bp, Artificial Sequence
  chemically synthesized
ttttaaataaaattgtttcctt

SEQ ID NO: 1207815 - DNA, 22 bp, Artificial Sequence
  chemically synthesized
taaataaaattgtttccttaat

SEQ ID NO: 1207816 - DNA, 22 bp, Artificial Sequence
  chemically synthesized
aaataaaattgtttccttaatc

SEQ ID NO: 1207817 - DNA, 22 bp, Artificial Sequence
  chemically synthesized
aataaaattgtttccttaatct

SEQ ID NO: 1207818 - DNA, 22 bp, Artificial Sequence
  chemically synthesized
tttccttaatctcctttttgga

SEQ ID NO: 1207819 - DNA, 22 bp, Artificial Sequence
  chemically synthesized
acagtgatgcagtccaaaaagg

SEQ ID NO: 1207820 - DNA, 22 bp, Artificial Sequence
  chemically synthesized
ccttaatctcctttttggactg

SEQ ID NO: 1207821 - DNA, 22 bp, Artificial Sequence
  chemically synthesized
cttaatctcctttttggactgc

SEQ ID NO: 1207822 - DNA, 22 bp, Artificial Sequence
  chemically synthesized
aatctcctttttggactgcatc

SEQ ID NO: 1207823 - DNA, 22 bp, Artificial Sequence
  chemically synthesized
tgcactaacagtgatgcagtcc

SEQ ID NO: 1207824 - DNA, 22 bp, Artificial Sequence
  chemically synthesized
atctcctttttggactgcatca

SEQ ID NO: 1207825 - DNA, 22 bp, Artificial Sequence
  chemically synthesized
atgcactaacagtgatgcagtc

SEQ ID NO: 1207826 - DNA, 22 bp, Artificial Sequence
  chemically synthesized
tatgcactaacagtgatgcagt

SEQ ID NO: 1207827 - DNA, 22 bp, Artificial Sequence
  chemically synthesized
ctttttggactgcatcactgtt

SEQ ID NO: 1207828 - DNA, 22 bp, Artificial Sequence
  chemically synthesized
tattttatgcactaacagtgat

SEQ ID NO: 1207829 - DNA, 22 bp, Artificial Sequence
  chemically synthesized
tttggactgcatcactgttagt

SEQ ID NO: 1207830 - DNA, 22 bp, Artificial Sequence
  chemically synthesized
ttggactgcatcactgttagtg

SEQ ID NO: 1207831 - DNA, 22 bp, Artificial Sequence
  chemically synthesized
tggactgcatcactgttagtgc

SEQ ID NO: 1207832 - DNA, 22 bp, Artificial Sequence
  chemically synthesized
ggactgcatcactgttagtgca

SEQ ID NO: 1207833 - DNA, 22 bp, Artificial Sequence
  chemically synthesized
gactgcatcactgttagtgcat

SEQ ID NO: 1207834 - DNA, 22 bp, Artificial Sequence
  chemically synthesized
catcactgttagtgcataaaat

SEQ ID NO: 1207835 - DNA, 22 bp, Artificial Sequence
  chemically synthesized
ttagtgcataaaatataactta

SEQ ID NO: 1207836 - DNA, 22 bp, Artificial Sequence
  chemically synthesized
gtgcataaaatataacttattt

SEQ ID NO: 1207837 - DNA, 22 bp, Artificial Sequence
  chemically synthesized
cagtaaataaaatcaatataca

SEQ ID NO: 1207838 - DNA, 22 bp, Artificial Sequence
  chemically synthesized
atttctgtatattgattttatt

SEQ ID NO: 1207839 - DNA, 22 bp, Artificial Sequence
  chemically synthesized
tttctgtatattgattttattt

SEQ ID NO: 1207840 - DNA, 22 bp, Artificial Sequence
  chemically synthesized
agcacaattgcagtaaataaaa

SEQ ID NO: 1207841 - DNA, 22 bp, Artificial Sequence
  chemically synthesized
ctgtatattgattttatttact

SEQ ID NO: 1207842 - DNA, 22 bp, Artificial Sequence
  chemically synthesized
tgtatattgattttatttactg

SEQ ID NO: 1207843 - DNA, 22 bp, Artificial Sequence
  chemically synthesized
tatattgattttatttactgca

SEQ ID NO: 1207844 - DNA, 22 bp, Artificial Sequence
  chemically synthesized
ataaattaagcacaattgcagt

SEQ ID NO: 1207845 - DNA, 22 bp, Artificial Sequence
  chemically synthesized
attttatttactgcaattgtgc

SEQ ID NO: 1207846 - DNA, 22 bp, Artificial Sequence
  chemically synthesized
gaactaataaattaagcacaat

SEQ ID NO: 1207847 - DNA, 22 bp, Artificial Sequence
  chemically synthesized
tatttactgcaattgtgcttaa

SEQ ID NO: 1207848 - DNA, 22 bp, Artificial Sequence
  chemically synthesized
atttactgcaattgtgcttaat

SEQ ID NO: 1207849 - DNA, 22 bp, Artificial Sequence
  chemically synthesized
tttactgcaattgtgcttaatt

SEQ ID NO: 1207850 - DNA, 22 bp, Artificial Sequence
  chemically synthesized
ctagaactaataaattaagcac

SEQ ID NO: 1207851 - DNA, 22 bp, Artificial Sequence
  chemically synthesized
actgcaattgtgcttaatttat

SEQ ID NO: 1207852 - DNA, 22 bp, Artificial Sequence
  chemically synthesized
ctgcaattgtgcttaatttatt

SEQ ID NO: 1207853 - DNA, 22 bp, Artificial Sequence
  chemically synthesized
caattgtgcttaatttattagt

SEQ ID NO: 1207854 - DNA, 22 bp, Artificial Sequence
  chemically synthesized
tgcttaatttattagttctagc

SEQ ID NO: 1207855 - DNA, 22 bp, Artificial Sequence
  chemically synthesized
cacacaaaaaacctgctagaac

SEQ ID NO: 1207856 - DNA, 22 bp, Artificial Sequence
  chemically synthesized
ccacacaaaaaacctgctagaa

SEQ ID NO: 1207857 - DNA, 22 bp, Artificial Sequence
  chemically synthesized
aatttattagttctagcaggtt

SEQ ID NO: 1207858 - DNA, 22 bp, Artificial Sequence
  chemically synthesized
atttattagttctagcaggttt

SEQ ID NO: 1207859 - DNA, 22 bp, Artificial Sequence
  chemically synthesized
attagttctagcaggttttttg

SEQ ID NO: 1207860 - DNA, 22 bp, Artificial Sequence
  chemically synthesized
gagatttccacacaaaaaacct

SEQ ID NO: 1207861 - DNA, 22 bp, Artificial Sequence
  chemically synthesized
ttagttctagcaggttttttgt

SEQ ID NO: 1207862 - DNA, 22 bp, Artificial Sequence
  chemically synthesized
tagagatttccacacaaaaaac

SEQ ID NO: 1207863 - DNA, 22 bp, Artificial Sequence
  chemically synthesized
gttctagcaggttttttgtgtg

SEQ ID NO: 1207864 - DNA, 22 bp, Artificial Sequence
  chemically synthesized
tagcaggttttttgtgtggaaa

SEQ ID NO: 1207865 - DNA, 22 bp, Artificial Sequence
  chemically synthesized
gcaggttttttgtgtggaaatc

SEQ ID NO: 1207866 - DNA, 22 bp, Artificial Sequence
  chemically synthesized
tatgtagaaaattctagagatt

SEQ ID NO: 1207867 - DNA, 22 bp, Artificial Sequence
  chemically synthesized
atatgtagaaaattctagagat

SEQ ID NO: 1207868 - DNA, 22 bp, Artificial Sequence
  chemically synthesized
tttgtgtggaaatctctagaat

SEQ ID NO: 1207869 - DNA, 22 bp, Artificial Sequence
  chemically synthesized
ttgtgtggaaatctctagaatt

SEQ ID NO: 1207870 - DNA, 22 bp, Artificial Sequence
  chemically synthesized
tgtgtggaaatctctagaattt

SEQ ID NO: 1207871 - DNA, 22 bp, Artificial Sequence
  chemically synthesized
gtgtggaaatctctagaatttt

SEQ ID NO: 1207872 - DNA, 22 bp, Artificial Sequence
  chemically synthesized
tgtggaaatctctagaattttc

SEQ ID NO: 1207873 - DNA, 22 bp, Artificial Sequence
  chemically synthesized
agatgatatgatcttatatgta

SEQ ID NO: 1207874 - DNA, 22 bp, Artificial Sequence
  chemically synthesized
tagaattttctacatataagat

SEQ ID NO: 1207875 - DNA, 22 bp, Artificial Sequence
  chemically synthesized
tcagatgatatgatcttatatg

SEQ ID NO: 1207876 - DNA, 22 bp, Artificial Sequence
  chemically synthesized
ctcagatgatatgatcttatat

SEQ ID NO: 1207877 - DNA, 22 bp, Artificial Sequence
  chemically synthesized
gaattttctacatataagatca

SEQ ID NO: 1207878 - DNA, 22 bp, Artificial Sequence
  chemically synthesized
tctacatataagatcatatcat

SEQ ID NO: 1207879 - DNA, 22 bp, Artificial Sequence
  chemically synthesized
taagcttctcagatgatatgat

SEQ ID NO: 1207880 - DNA, 22 bp, Artificial Sequence
  chemically synthesized
ctacatataagatcatatcatc

SEQ ID NO: 1207881 - DNA, 22 bp, Artificial Sequence
  chemically synthesized
ataagcttctcagatgatatga

SEQ ID NO: 1207882 - DNA, 22 bp, Artificial Sequence
  chemically synthesized
tacatataagatcatatcatct

SEQ ID NO: 1207883 - DNA, 22 bp, Artificial Sequence
  chemically synthesized
tataagcttctcagatgatatg

SEQ ID NO: 1207884 - DNA, 22 bp, Artificial Sequence
  chemically synthesized
catataagatcatatcatctga

SEQ ID NO: 1207885 - DNA, 22 bp, Artificial Sequence
  chemically synthesized
aaagagtgtatgcaaaaatttt

SEQ ID NO: 1207886 - DNA, 22 bp, Artificial Sequence
  chemically synthesized
gaaagagtgtatgcaaaaattt

SEQ ID NO: 1207887 - DNA, 22 bp, Artificial Sequence
  chemically synthesized
agaagcttataaaatttttgca

SEQ ID NO: 1207888 - DNA, 22 bp, Artificial Sequence
  chemically synthesized
tgaaagagtgtatgcaaaaatt

SEQ ID NO: 1207889 - DNA, 22 bp, Artificial Sequence
  chemically synthesized
ataaaatttttgcatacactct

SEQ ID NO: 1207890 - DNA, 22 bp, Artificial Sequence
  chemically synthesized
taaaatttttgcatacactctt

SEQ ID NO: 1207891 - DNA, 22 bp, Artificial Sequence
  chemically synthesized
ttgcatacactctttcaaagct

SEQ ID NO: 1207892 - DNA, 22 bp, Artificial Sequence
  chemically synthesized
atcagaaaaatcagctttgaaa

SEQ ID NO: 1207893 - DNA, 22 bp, Artificial Sequence
  chemically synthesized
tgcatacactctttcaaagctg

SEQ ID NO: 1207894 - DNA, 22 bp, Artificial Sequence
  chemically synthesized
catcagaaaaatcagctttgaa

SEQ ID NO: 1207895 - DNA, 22 bp, Artificial Sequence
  chemically synthesized
gcatacactctttcaaagctga

SEQ ID NO: 1207896 - DNA, 22 bp, Artificial Sequence
  chemically synthesized
tcatcagaaaaatcagctttga

SEQ ID NO: 1207897 - DNA, 22 bp, Artificial Sequence
  chemically synthesized
catacactctttcaaagctgat

SEQ ID NO: 1207898 - DNA, 22 bp, Artificial Sequence
  chemically synthesized
aaattttcatcagaaaaatcag

SEQ ID NO: 1207899 - DNA, 22 bp, Artificial Sequence
  chemically synthesized
caaattttcatcagaaaaatca

SEQ ID NO: 1207900 - DNA, 22 bp, Artificial Sequence
  chemically synthesized
tttcaaagctgatttttctgat

SEQ ID NO: 1207901 - DNA, 22 bp, Artificial Sequence
  chemically synthesized
tcaaagctgatttttctgatga

SEQ ID NO: 1207902 - DNA, 22 bp, Artificial Sequence
  chemically synthesized
caaagctgatttttctgatgaa

SEQ ID NO: 1207903 - DNA, 22 bp, Artificial Sequence
  chemically synthesized
aaagctgatttttctgatgaaa

SEQ ID NO: 1207904 - DNA, 22 bp, Artificial Sequence
  chemically synthesized
tgcaatgcatttcaaattttca

SEQ ID NO: 1207905 - DNA, 22 bp, Artificial Sequence
  chemically synthesized
atttttctgatgaaaatttgaa

SEQ ID NO: 1207906 - DNA, 22 bp, Artificial Sequence
  chemically synthesized
ttctgatgaaaatttgaaatgc

SEQ ID NO: 1207907 - DNA, 22 bp, Artificial Sequence
  chemically synthesized
atgctgtgcaatgcatttcaaa

SEQ ID NO: 1207908 - DNA, 22 bp, Artificial Sequence
  chemically synthesized
tctgatgaaaatttgaaatgca

SEQ ID NO: 1207909 - DNA, 22 bp, Artificial Sequence
  chemically synthesized
ctgatgaaaatttgaaatgcat

SEQ ID NO: 1207910 - DNA, 22 bp, Artificial Sequence
  chemically synthesized
tgatgaaaatttgaaatgcatt

SEQ ID NO: 1207911 - DNA, 22 bp, Artificial Sequence
  chemically synthesized
atgaaaatttgaaatgcattgc

SEQ ID NO: 1207912 - DNA, 22 bp, Artificial Sequence
  chemically synthesized
tattcatgctgtgcaatgcatt

SEQ ID NO: 1207913 - DNA, 22 bp, Artificial Sequence
  chemically synthesized
actatattcatgctgtgcaatg

SEQ ID NO: 1207914 - DNA, 22 bp, Artificial Sequence
  chemically synthesized
ttaactatattcatgctgtgca

SEQ ID NO: 1207915 - DNA, 22 bp, Artificial Sequence
  chemically synthesized
tattaactatattcatgctgtg

SEQ ID NO: 1207916 - DNA, 22 bp, Artificial Sequence
  chemically synthesized
gaaatgcattgcacagcatgaa

SEQ ID NO: 1207917 - DNA, 22 bp, Artificial Sequence
  chemically synthesized
aaatgcattgcacagcatgaat

SEQ ID NO: 1207918 - DNA, 22 bp, Artificial Sequence
  chemically synthesized
cacagcatgaatatagttaata

SEQ ID NO: 1207919 - DNA, 22 bp, Artificial Sequence
  chemically synthesized
gaaatgagcaatactctattaa

SEQ ID NO: 1207920 - DNA, 22 bp, Artificial Sequence
  chemically synthesized
cgaaatgagcaatactctatta

SEQ ID NO: 1207921 - DNA, 22 bp, Artificial Sequence
  chemically synthesized
gcagcttcgaaatgagcaatac

SEQ ID NO: 1207922 - DNA, 22 bp, Artificial Sequence
  chemically synthesized
agcagcttcgaaatgagcaata

SEQ ID NO: 1207923 - DNA, 22 bp, Artificial Sequence
  chemically synthesized
ttagcagcttcgaaatgagcaa

SEQ ID NO: 1207924 - DNA, 22 bp, Artificial Sequence
  chemically synthesized
tcttagcagcttcgaaatgagc

SEQ ID NO: 1207925 - DNA, 22 bp, Artificial Sequence
  chemically synthesized
atagagtattgctcatttcgaa

SEQ ID NO: 1207926 - DNA, 22 bp, Artificial Sequence
  chemically synthesized
aagtgtactctcttagcagctt

SEQ ID NO: 1207927 - DNA, 22 bp, Artificial Sequence
  chemically synthesized
gaagtgtactctcttagcagct

SEQ ID NO: 1207928 - DNA, 22 bp, Artificial Sequence
  chemically synthesized
ctcatttcgaagctgctaagag

SEQ ID NO: 1207929 - DNA, 22 bp, Artificial Sequence
  chemically synthesized
atttcgaagctgctaagagagt

SEQ ID NO: 1207930 - DNA, 22 bp, Artificial Sequence
  chemically synthesized
cgaagctgctaagagagtacac

SEQ ID NO: 1207931 - DNA, 22 bp, Artificial Sequence
  chemically synthesized
gaagctgctaagagagtacact

SEQ ID NO: 1207932 - DNA, 22 bp, Artificial Sequence
  chemically synthesized
tggagagaacatttgaagtgta

SEQ ID NO: 1207933 - DNA, 22 bp, Artificial Sequence
  chemically synthesized
gtggagagaacatttgaagtgt

SEQ ID NO: 1207934 - DNA, 22 bp, Artificial Sequence
  chemically synthesized
tgtggagagaacatttgaagtg

SEQ ID NO: 1207935 - DNA, 22 bp, Artificial Sequence
  chemically synthesized
ctaagagagtacacttcaaatg

SEQ ID NO: 1207936 - DNA, 22 bp, Artificial Sequence
  chemically synthesized
ttgtggagagaacatttgaagt

SEQ ID NO: 1207937 - DNA, 22 bp, Artificial Sequence
  chemically synthesized
agagagtacacttcaaatgttc

SEQ ID NO: 1207938 - DNA, 22 bp, Artificial Sequence
  chemically synthesized
aaagacttttgtggagagaaca

SEQ ID NO: 1207939 - DNA, 22 bp, Artificial Sequence
  chemically synthesized
tcacctcaaagacttttgtgga

SEQ ID NO: 1207940 - DNA, 22 bp, Artificial Sequence
  chemically synthesized
caaatgttctctccacaaaagt

SEQ ID NO: 1207941 - DNA, 22 bp, Artificial Sequence
  chemically synthesized
aaatgttctctccacaaaagtc

SEQ ID NO: 1207942 - DNA, 22 bp, Artificial Sequence
  chemically synthesized
acatatctatcacctcaaagac

SEQ ID NO: 1207943 - DNA, 22 bp, Artificial Sequence
  chemically synthesized
tctccacaaaagtctttgaggt

SEQ ID NO: 1207944 - DNA, 22 bp, Artificial Sequence
  chemically synthesized
tccacaaaagtctttgaggtga

SEQ ID NO: 1207945 - DNA, 22 bp, Artificial Sequence
  chemically synthesized
gttaacatatctatcacctcaa

SEQ ID NO: 1207946 - DNA, 22 bp, Artificial Sequence
  chemically synthesized
cacaaaagtctttgaggtgata

SEQ ID NO: 1207947 - DNA, 22 bp, Artificial Sequence
  chemically synthesized
aatcaagctagttaacatatct

SEQ ID NO: 1207948 - DNA, 22 bp, Artificial Sequence
  chemically synthesized
tgaggtgatagatatgttaact

SEQ ID NO: 1207949 - DNA, 22 bp, Artificial Sequence
  chemically synthesized
gaggtgatagatatgttaacta

SEQ ID NO: 1207950 - DNA, 22 bp, Artificial Sequence
  chemically synthesized
aggtgatagatatgttaactag

SEQ ID NO: 1207951 - DNA, 22 bp, Artificial Sequence
  chemically synthesized
actagcttgatttaattactcc

SEQ ID NO: 1207952 - DNA, 22 bp, Artificial Sequence
  chemically synthesized
tgaatacaatgtggagtaatta

SEQ ID NO: 1207953 - DNA, 22 bp, Artificial Sequence
  chemically synthesized
atgaatacaatgtggagtaatt

SEQ ID NO: 1207954 - DNA, 22 bp, Artificial Sequence
  chemically synthesized
gcttgatttaattactccacat

SEQ ID NO: 1207955 - DNA, 22 bp, Artificial Sequence
  chemically synthesized
gatttaattactccacattgta

SEQ ID NO: 1207956 - DNA, 22 bp, Artificial Sequence
  chemically synthesized
atttaattactccacattgtat

SEQ ID NO: 1207957 - DNA, 22 bp, Artificial Sequence
  chemically synthesized
aattactccacattgtattcat

SEQ ID NO: 1207958 - DNA, 22 bp, Artificial Sequence
  chemically synthesized
attactccacattgtattcata

SEQ ID NO: 1207959 - DNA, 22 bp, Artificial Sequence
  chemically synthesized
ctccacattgtattcataaatt

SEQ ID NO: 1207960 - DNA, 22 bp, Artificial Sequence
  chemically synthesized
cacattgtattcataaattcta

SEQ ID NO: 1207961 - DNA, 22 bp, Artificial Sequence
  chemically synthesized
tattcataaattctaccatcac

SEQ ID NO: 1207962 - DNA, 22 bp, Artificial Sequence
  chemically synthesized
ataaattctaccatcactttgt

SEQ ID NO: 1207963 - DNA, 22 bp, Artificial Sequence
  chemically synthesized
tataaatatatggcatacaaag

SEQ ID NO: 1207964 - DNA, 22 bp, Artificial Sequence
  chemically synthesized
taccatcactttgtatgccata

SEQ ID NO: 1207965 - DNA, 22 bp, Artificial Sequence
  chemically synthesized
ccatcactttgtatgccatata

SEQ ID NO: 1207966 - DNA, 22 bp, Artificial Sequence
  chemically synthesized
acaatatataattgtataaata

SEQ ID NO: 1207967 - DNA, 22 bp, Artificial Sequence
  chemically synthesized
tgtatgccatatatttatacaa

SEQ ID NO: 1207968 - DNA, 22 bp, Artificial Sequence
  chemically synthesized
gtatgccatatatttatacaat

SEQ ID NO: 1207969 - DNA, 22 bp, Artificial Sequence
  chemically synthesized
tatgccatatatttatacaatt

SEQ ID NO: 1207970 - DNA, 22 bp, Artificial Sequence
  chemically synthesized
taaattgacaatatataattgt

SEQ ID NO: 1207971 - DNA, 22 bp, Artificial Sequence
  chemically synthesized
ttgtaaattgacaatatataat

SEQ ID NO: 1207972 - DNA, 22 bp, Artificial Sequence
  chemically synthesized
attgtaaattgacaatatataa

SEQ ID NO: 1207973 - DNA, 22 bp, Artificial Sequence
  chemically synthesized
tattgtaaattgacaatatata

SEQ ID NO: 1207974 - DNA, 22 bp, Artificial Sequence
  chemically synthesized
ttattgtaaattgacaatatat

SEQ ID NO: 1207975 - DNA, 22 bp, Artificial Sequence
  chemically synthesized
tttattgtaaattgacaatata

SEQ ID NO: 1207976 - DNA, 22 bp, Artificial Sequence
  chemically synthesized
tttttattgtaaattgacaata

SEQ ID NO: 1207977 - DNA, 22 bp, Artificial Sequence
  chemically synthesized
atacaattatatattgtcaatt

SEQ ID NO: 1207978 - DNA, 22 bp, Artificial Sequence
  chemically synthesized
tacaattatatattgtcaattt

SEQ ID NO: 1207979 - DNA, 22 bp, Artificial Sequence
  chemically synthesized
tatgcctctttttattgtaaat

SEQ ID NO: 1207980 - DNA, 22 bp, Artificial Sequence
  chemically synthesized
atatgcctctttttattgtaaa

SEQ ID NO: 1207981 - DNA, 22 bp, Artificial Sequence
  chemically synthesized
tatattgtcaatttacaataaa

SEQ ID NO: 1207982 - DNA, 22 bp, Artificial Sequence
  chemically synthesized
tatatgcctctttttattgtaa

SEQ ID NO: 1207983 - DNA, 22 bp, Artificial Sequence
  chemically synthesized
tcaatttacaataaaaagaggc

SEQ ID NO: 1207984 - DNA, 22 bp, Artificial Sequence
  chemically synthesized
acaataaaaagaggcatataaa

SEQ ID NO: 1207985 - DNA, 22 bp, Artificial Sequence
  chemically synthesized
caataaaaagaggcatataaaa

SEQ ID NO: 1207986 - DNA, 22 bp, Artificial Sequence
  chemically synthesized
agagaatgcaaattttatatgc

SEQ ID NO: 1207987 - DNA, 22 bp, Artificial Sequence
  chemically synthesized
aagagaatgcaaattttatatg

SEQ ID NO: 1207988 - DNA, 22 bp, Artificial Sequence
  chemically synthesized
taagagaatgcaaattttatat

SEQ ID NO: 1207989 - DNA, 22 bp, Artificial Sequence
  chemically synthesized
aagactttaagagaatgcaaat

SEQ ID NO: 1207990 - DNA, 22 bp, Artificial Sequence
  chemically synthesized
gcaagcattaaagactttaaga

SEQ ID NO: 1207991 - DNA, 22 bp, Artificial Sequence
  chemically synthesized
gcattctcttaaagtctttaat

SEQ ID NO: 1207992 - DNA, 22 bp, Artificial Sequence
  chemically synthesized
cattctcttaaagtctttaatg

SEQ ID NO: 1207993 - DNA, 22 bp, Artificial Sequence
  chemically synthesized
tcttaaagtctttaatgcttgc

SEQ ID NO: 1207994 - DNA, 22 bp, Artificial Sequence
  chemically synthesized
ttaaagtctttaatgcttgcca

SEQ ID NO: 1207995 - DNA, 22 bp, Artificial Sequence
  chemically synthesized
aaagtctttaatgcttgccaac

SEQ ID NO: 1207996 - DNA, 22 bp, Artificial Sequence
  chemically synthesized
aagtctttaatgcttgccaaca

SEQ ID NO: 1207997 - DNA, 22 bp, Artificial Sequence
  chemically synthesized
aatcagagaaatggtgttggca

SEQ ID NO: 1207998 - DNA, 22 bp, Artificial Sequence
  chemically synthesized
taatgcttgccaacaccatttc

SEQ ID NO: 1207999 - DNA, 22 bp, Artificial Sequence
  chemically synthesized
aattgaatcagagaaatggtgt

SEQ ID NO: 1208000 - DNA, 22 bp, Artificial Sequence
  chemically synthesized
aatgcttgccaacaccatttct

SEQ ID NO: 1208001 - DNA, 22 bp, Artificial Sequence
  chemically synthesized
gaattgaatcagagaaatggtg

SEQ ID NO: 1208002 - DNA, 22 bp, Artificial Sequence
  chemically synthesized
atgcttgccaacaccatttctc

SEQ ID NO: 1208003 - DNA, 22 bp, Artificial Sequence
  chemically synthesized
gccaacaccatttctctgattc

SEQ ID NO: 1208004 - DNA, 22 bp, Artificial Sequence
  chemically synthesized
ccaacaccatttctctgattca

SEQ ID NO: 1208005 - DNA, 22 bp, Artificial Sequence
  chemically synthesized
gacagcttgaattgaatcagag

SEQ ID NO: 1208006 - DNA, 22 bp, Artificial Sequence
  chemically synthesized
atgcggcattggacagcttgaa

SEQ ID NO: 1208007 - DNA, 22 bp, Artificial Sequence
  chemically synthesized
ctctgattcaattcaagctgtc

SEQ ID NO: 1208008 - DNA, 22 bp, Artificial Sequence
  chemically synthesized
tctgattcaattcaagctgtcc

SEQ ID NO: 1208009 - DNA, 22 bp, Artificial Sequence
  chemically synthesized
tgattcaattcaagctgtccaa

SEQ ID NO: 1208010 - DNA, 22 bp, Artificial Sequence
  chemically synthesized
attcaattcaagctgtccaatg

SEQ ID NO: 1208011 - DNA, 22 bp, Artificial Sequence
  chemically synthesized
aattcaagctgtccaatgccgc

SEQ ID NO: 1208012 - DNA, 22 bp, Artificial Sequence
  chemically synthesized
atggtatgtattaatgcggcat

SEQ ID NO: 1208013 - DNA, 22 bp, Artificial Sequence
  chemically synthesized
aatggtatgtattaatgcggca

SEQ ID NO: 1208014 - DNA, 22 bp, Artificial Sequence
  chemically synthesized
aagctgtccaatgccgcattaa

SEQ ID NO: 1208015 - DNA, 22 bp, Artificial Sequence
  chemically synthesized
tttaatggtatgtattaatgcg

SEQ ID NO: 1208016 - DNA, 22 bp, Artificial Sequence
  chemically synthesized
gtttaatggtatgtattaatgc

SEQ ID NO: 1208017 - DNA, 22 bp, Artificial Sequence
  chemically synthesized
tgtttaatggtatgtattaatg

SEQ ID NO: 1208018 - DNA, 22 bp, Artificial Sequence
  chemically synthesized
tccaatgccgcattaatacata

SEQ ID NO: 1208019 - DNA, 22 bp, Artificial Sequence
  chemically synthesized
taatgcggagtagttttgttta

SEQ ID NO: 1208020 - DNA, 22 bp, Artificial Sequence
  chemically synthesized
atacataccattaaacaaaact

SEQ ID NO: 1208021 - DNA, 22 bp, Artificial Sequence
  chemically synthesized
tgcctataatgcggagtagttt

SEQ ID NO: 1208022 - DNA, 22 bp, Artificial Sequence
  chemically synthesized
ctatgcctataatgcggagtag

SEQ ID NO: 1208023 - DNA, 22 bp, Artificial Sequence
  chemically synthesized
ttactatgcctataatgcggag

SEQ ID NO: 1208024 - DNA, 22 bp, Artificial Sequence
  chemically synthesized
aacaaaactactccgcattata

SEQ ID NO: 1208025 - DNA, 22 bp, Artificial Sequence
  chemically synthesized
ctccgcattataggcatagtaa

SEQ ID NO: 1208026 - DNA, 22 bp, Artificial Sequence
  chemically synthesized
cgcattataggcatagtaatag

SEQ ID NO: 1208027 - DNA, 22 bp, Artificial Sequence
  chemically synthesized
taggcatagtaataggattaca

SEQ ID NO: 1208028 - DNA, 22 bp, Artificial Sequence
  chemically synthesized
gaagccaggtaaatgtaatcct

SEQ ID NO: 1208029 - DNA, 22 bp, Artificial Sequence
  chemically synthesized
gttggaagccaggtaaatgtaa

SEQ ID NO: 1208030 - DNA, 22 bp, Artificial Sequence
  chemically synthesized
ggttggaagccaggtaaatgta

SEQ ID NO: 1208031 - DNA, 22 bp, Artificial Sequence
  chemically synthesized
tggttggaagccaggtaaatgt

SEQ ID NO: 1208032 - DNA, 22 bp, Artificial Sequence
  chemically synthesized
ttggttggaagccaggtaaatg

SEQ ID NO: 1208033 - DNA, 22 bp, Artificial Sequence
  chemically synthesized
cttttggttggaagccaggtaa

SEQ ID NO: 1208034 - DNA, 22 bp, Artificial Sequence
  chemically synthesized
catttacctggcttccaaccaa

SEQ ID NO: 1208035 - DNA, 22 bp, Artificial Sequence
  chemically synthesized
gcggtgttgcttttggttggaa

SEQ ID NO: 1208036 - DNA, 22 bp, Artificial Sequence
  chemically synthesized
acctggcttccaaccaaaagca

SEQ ID NO: 1208037 - DNA, 22 bp, Artificial Sequence
  chemically synthesized
cctggcttccaaccaaaagcaa

SEQ ID NO: 1208038 - DNA, 22 bp, Artificial Sequence
  chemically synthesized
atgttagcggtgttgcttttgg

SEQ ID NO: 1208039 - DNA, 22 bp, Artificial Sequence
  chemically synthesized
aatgttagcggtgttgcttttg

SEQ ID NO: 1208040 - DNA, 22 bp, Artificial Sequence
  chemically synthesized
taatgttagcggtgttgctttt

SEQ ID NO: 1208041 - DNA, 22 bp, Artificial Sequence
  chemically synthesized
gcttccaaccaaaagcaacacc

SEQ ID NO: 1208042 - DNA, 22 bp, Artificial Sequence
  chemically synthesized
ttttaatgttagcggtgttgct

SEQ ID NO: 1208043 - DNA, 22 bp, Artificial Sequence
  chemically synthesized
attttaatgttagcggtgttgc

SEQ ID NO: 1208044 - DNA, 22 bp, Artificial Sequence
  chemically synthesized
tattttaatgttagcggtgttg

SEQ ID NO: 1208045 - DNA, 22 bp, Artificial Sequence
  chemically synthesized
ccaaccaaaagcaacaccgcta

SEQ ID NO: 1208046 - DNA, 22 bp, Artificial Sequence
  chemically synthesized
caaccaaaagcaacaccgctaa

SEQ ID NO: 1208047 - DNA, 22 bp, Artificial Sequence
  chemically synthesized
atgatgagaatattttatttta

SEQ ID NO: 1208048 - DNA, 22 bp, Artificial Sequence
  chemically synthesized
attcatgatgagaatattttat

SEQ ID NO: 1208049 - DNA, 22 bp, Artificial Sequence
  chemically synthesized
ctaattcatgatgagaatattt

SEQ ID NO: 1208050 - DNA, 22 bp, Artificial Sequence
  chemically synthesized
acattaaaataaaatattctca

SEQ ID NO: 1208051 - DNA, 22 bp, Artificial Sequence
  chemically synthesized
aaataaaatattctcatcatga

SEQ ID NO: 1208052 - DNA, 22 bp, Artificial Sequence
  chemically synthesized
atatgaaattactaattcatga

SEQ ID NO: 1208053 - DNA, 22 bp, Artificial Sequence
  chemically synthesized
ttaatatgaaattactaattca

SEQ ID NO: 1208054 - DNA, 22 bp, Artificial Sequence
  chemically synthesized
tgttaatatgaaattactaatt

SEQ ID NO: 1208055 - DNA, 22 bp, Artificial Sequence
  chemically synthesized
ctgttaatatgaaattactaat

SEQ ID NO: 1208056 - DNA, 22 bp, Artificial Sequence
  chemically synthesized
tcatcatgaattagtaatttca

SEQ ID NO: 1208057 - DNA, 22 bp, Artificial Sequence
  chemically synthesized
gcttctgttaatatgaaattac

SEQ ID NO: 1208058 - DNA, 22 bp, Artificial Sequence
  chemically synthesized
atcatgaattagtaatttcata

SEQ ID NO: 1208059 - DNA, 22 bp, Artificial Sequence
  chemically synthesized
agcttctgttaatatgaaatta

SEQ ID NO: 1208060 - DNA, 22 bp, Artificial Sequence
  chemically synthesized
tagcttctgttaatatgaaatt

SEQ ID NO: 1208061 - DNA, 22 bp, Artificial Sequence
  chemically synthesized
ggtgcctttagcttctgttaat

SEQ ID NO: 1208062 - DNA, 22 bp, Artificial Sequence
  chemically synthesized
gtaatttcatattaacagaagc

SEQ ID NO: 1208063 - DNA, 22 bp, Artificial Sequence
  chemically synthesized
catattaacagaagctaaaggc

SEQ ID NO: 1208064 - DNA, 22 bp, Artificial Sequence
  chemically synthesized
atattaacagaagctaaaggca

SEQ ID NO: 1208065 - DNA, 22 bp, Artificial Sequence
  chemically synthesized
aaaaaatactaggtgcctttag

SEQ ID NO: 1208066 - DNA, 22 bp, Artificial Sequence
  chemically synthesized
acagaagctaaaggcacctagt

SEQ ID NO: 1208067 - DNA, 22 bp, Artificial Sequence
  chemically synthesized
aaggcacctagtattttttgag

SEQ ID NO: 1208068 - DNA, 22 bp, Artificial Sequence
  chemically synthesized
gtattttttgaggctcatttgc

SEQ ID NO: 1208069 - DNA, 22 bp, Artificial Sequence
  chemically synthesized
agtatatacccatatgcaaatg

SEQ ID NO: 1208070 - DNA, 22 bp, Artificial Sequence
  chemically synthesized
tttgaggctcatttgcatatgg

SEQ ID NO: 1208071 - DNA, 22 bp, Artificial Sequence
  chemically synthesized
ttgaggctcatttgcatatggg

SEQ ID NO: 1208072 - DNA, 22 bp, Artificial Sequence
  chemically synthesized
tgaggctcatttgcatatgggt

SEQ ID NO: 1208073 - DNA, 22 bp, Artificial Sequence
  chemically synthesized
gaggctcatttgcatatgggta

SEQ ID NO: 1208074 - DNA, 22 bp, Artificial Sequence
  chemically synthesized
aggctcatttgcatatgggtat

SEQ ID NO: 1208075 - DNA, 22 bp, Artificial Sequence
  chemically synthesized
atttgcatatgggtatatactc

SEQ ID NO: 1208076 - DNA, 22 bp, Artificial Sequence
  chemically synthesized
gaaaagaaatctgagtatatac

SEQ ID NO: 1208077 - DNA, 22 bp, Artificial Sequence
  chemically synthesized
ggaaaagaaatctgagtatata

SEQ ID NO: 1208078 - DNA, 22 bp, Artificial Sequence
  chemically synthesized
tggaaaagaaatctgagtatat

SEQ ID NO: 1208079 - DNA, 22 bp, Artificial Sequence
  chemically synthesized
ttggaaaagaaatctgagtata

SEQ ID NO: 1208080 - DNA, 22 bp, Artificial Sequence
  chemically synthesized
gcatatgggtatatactcagat

SEQ ID NO: 1208081 - DNA, 22 bp, Artificial Sequence
  chemically synthesized
tttggaaaagaaatctgagtat

SEQ ID NO: 1208082 - DNA, 22 bp, Artificial Sequence
  chemically synthesized
catatgggtatatactcagatt

SEQ ID NO: 1208083 - DNA, 22 bp, Artificial Sequence
  chemically synthesized
ttttggaaaagaaatctgagta

SEQ ID NO: 1208084 - DNA, 22 bp, Artificial Sequence
  chemically synthesized
cttttttggaaaagaaatctga

SEQ ID NO: 1208085 - DNA, 22 bp, Artificial Sequence
  chemically synthesized
aatggctacttttttggaaaag

SEQ ID NO: 1208086 - DNA, 22 bp, Artificial Sequence
  chemically synthesized
aaatggctacttttttggaaaa

SEQ ID NO: 1208087 - DNA, 22 bp, Artificial Sequence
  chemically synthesized
taaatggctacttttttggaaa

SEQ ID NO: 1208088 - DNA, 22 bp, Artificial Sequence
  chemically synthesized
agatttcttttccaaaaaagta

SEQ ID NO: 1208089 - DNA, 22 bp, Artificial Sequence
  chemically synthesized
cctttaaatggctacttttttg

SEQ ID NO: 1208090 - DNA, 22 bp, Artificial Sequence
  chemically synthesized
cttttccaaaaaagtagccatt

SEQ ID NO: 1208091 - DNA, 22 bp, Artificial Sequence
  chemically synthesized
ttttccaaaaaagtagccattt

SEQ ID NO: 1208092 - DNA, 22 bp, Artificial Sequence
  chemically synthesized
ttccaaaaaagtagccatttaa

SEQ ID NO: 1208093 - DNA, 22 bp, Artificial Sequence
  chemically synthesized
tccaaaaaagtagccatttaaa

SEQ ID NO: 1208094 - DNA, 22 bp, Artificial Sequence
  chemically synthesized
ccaaaaaagtagccatttaaag

SEQ ID NO: 1208095 - DNA, 22 bp, Artificial Sequence
  chemically synthesized
caccagggttccctttaaatgg

SEQ ID NO: 1208096 - DNA, 22 bp, Artificial Sequence
  chemically synthesized
caaaaaagtagccatttaaagg

SEQ ID NO: 1208097 - DNA, 22 bp, Artificial Sequence
  chemically synthesized
acaccagggttccctttaaatg

SEQ ID NO: 1208098 - DNA, 22 bp, Artificial Sequence
  chemically synthesized
tacaccagggttccctttaaat

SEQ ID NO: 1208099 - DNA, 22 bp, Artificial Sequence
  chemically synthesized
aattttacaccagggttccctt

SEQ ID NO: 1208100 - DNA, 22 bp, Artificial Sequence
  chemically synthesized
taaattttacaccagggttccc

SEQ ID NO: 1208101 - DNA, 22 bp, Artificial Sequence
  chemically synthesized
ctaaattttacaccagggttcc

SEQ ID NO: 1208102 - DNA, 22 bp, Artificial Sequence
  chemically synthesized
tctaaattttacaccagggttc

SEQ ID NO: 1208103 - DNA, 22 bp, Artificial Sequence
  chemically synthesized
ttttctaaattttacaccaggg

SEQ ID NO: 1208104 - DNA, 22 bp, Artificial Sequence
  chemically synthesized
aaagggaaccctggtgtaaaat

SEQ ID NO: 1208105 - DNA, 22 bp, Artificial Sequence
  chemically synthesized
aagggaaccctggtgtaaaatt

SEQ ID NO: 1208106 - DNA, 22 bp, Artificial Sequence
  chemically synthesized
catctgttttctaaattttaca

SEQ ID NO: 1208107 - DNA, 22 bp, Artificial Sequence
  chemically synthesized
tacatctgttttctaaatttta

SEQ ID NO: 1208108 - DNA, 22 bp, Artificial Sequence
  chemically synthesized
ctacatctgttttctaaatttt

SEQ ID NO: 1208109 - DNA, 22 bp, Artificial Sequence
  chemically synthesized
tctacatctgttttctaaattt

SEQ ID NO: 1208110 - DNA, 22 bp, Artificial Sequence
  chemically synthesized
ttctacatctgttttctaaatt

SEQ ID NO: 1208111 - DNA, 22 bp, Artificial Sequence
  chemically synthesized
gtgtaaaatttagaaaacagat

SEQ ID NO: 1208112 - DNA, 22 bp, Artificial Sequence
  chemically synthesized
tgatttttctacatctgttttc

SEQ ID NO: 1208113 - DNA, 22 bp, Artificial Sequence
  chemically synthesized
atgatttttctacatctgtttt

SEQ ID NO: 1208114 - DNA, 22 bp, Artificial Sequence
  chemically synthesized
tatgatttttctacatctgttt

SEQ ID NO: 1208115 - DNA, 22 bp, Artificial Sequence
  chemically synthesized
gatattttatgatttttctaca

SEQ ID NO: 1208116 - DNA, 22 bp, Artificial Sequence
  chemically synthesized
ggatattttatgatttttctac

SEQ ID NO: 1208117 - DNA, 22 bp, Artificial Sequence
  chemically synthesized
agaaaacagatgtagaaaaatc

SEQ ID NO: 1208118 - DNA, 22 bp, Artificial Sequence
  chemically synthesized
gaaaacagatgtagaaaaatca

SEQ ID NO: 1208119 - DNA, 22 bp, Artificial Sequence
  chemically synthesized
tttggatattttatgatttttc

SEQ ID NO: 1208120 - DNA, 22 bp, Artificial Sequence
  chemically synthesized
atttggatattttatgattttt

SEQ ID NO: 1208121 - DNA, 22 bp, Artificial Sequence
  chemically synthesized
taaaaacttatttggatatttt

SEQ ID NO: 1208122 - DNA, 22 bp, Artificial Sequence
  chemically synthesized
gtaaaaacttatttggatattt

SEQ ID NO: 1208123 - DNA, 22 bp, Artificial Sequence
  chemically synthesized
tgtaaaaacttatttggatatt

SEQ ID NO: 1208124 - DNA, 22 bp, Artificial Sequence
  chemically synthesized
ttacaaaattttcctatgctat

SEQ ID NO: 1208125 - DNA, 22 bp, Artificial Sequence
  chemically synthesized
tacaaaattttcctatgctatt

SEQ ID NO: 1208126 - DNA, 22 bp, Artificial Sequence
  chemically synthesized
acaaaattttcctatgctattt

SEQ ID NO: 1208127 - DNA, 22 bp, Artificial Sequence
  chemically synthesized
caaaattttcctatgctatttc

SEQ ID NO: 1208128 - DNA, 22 bp, Artificial Sequence
  chemically synthesized
aagaaaatataaaggaaatagc

SEQ ID NO: 1208129 - DNA, 22 bp, Artificial Sequence
  chemically synthesized
tcctatgctatttcctttatat

SEQ ID NO: 1208130 - DNA, 22 bp, Artificial Sequence
  chemically synthesized
cctatgctatttcctttatatt

SEQ ID NO: 1208131 - DNA, 22 bp, Artificial Sequence
  chemically synthesized
ctatgctatttcctttatattt

SEQ ID NO: 1208132 - DNA, 22 bp, Artificial Sequence
  chemically synthesized
tgctatttcctttatattttct

SEQ ID NO: 1208133 - DNA, 22 bp, Artificial Sequence
  chemically synthesized
tttcctttatattttctttagt

SEQ ID NO: 1208134 - DNA, 22 bp, Artificial Sequence
  chemically synthesized
ataaatggagatggactaaaga

SEQ ID NO: 1208135 - DNA, 22 bp, Artificial Sequence
  chemically synthesized
cctttatattttctttagtcca

SEQ ID NO: 1208136 - DNA, 22 bp, Artificial Sequence
  chemically synthesized
ctttatattttctttagtccat

SEQ ID NO: 1208137 - DNA, 22 bp, Artificial Sequence
  chemically synthesized
tatattttctttagtccatctc

SEQ ID NO: 1208138 - DNA, 22 bp, Artificial Sequence
  chemically synthesized
atattttctttagtccatctcc

SEQ ID NO: 1208139 - DNA, 22 bp, Artificial Sequence
  chemically synthesized
tattttctttagtccatctcca

SEQ ID NO: 1208140 - DNA, 22 bp, Artificial Sequence
  chemically synthesized
aataattcataaatggagatgg

SEQ ID NO: 1208141 - DNA, 22 bp, Artificial Sequence
  chemically synthesized
ctgaataattcataaatggaga

SEQ ID NO: 1208142 - DNA, 22 bp, Artificial Sequence
  chemically synthesized
tctttagtccatctccatttat

SEQ ID NO: 1208143 - DNA, 22 bp, Artificial Sequence
  chemically synthesized
cctgaataattcataaatggag

SEQ ID NO: 1208144 - DNA, 22 bp, Artificial Sequence
  chemically synthesized
ctttagtccatctccatttatg

SEQ ID NO: 1208145 - DNA, 22 bp, Artificial Sequence
  chemically synthesized
tcctgaataattcataaatgga

SEQ ID NO: 1208146 - DNA, 22 bp, Artificial Sequence
  chemically synthesized
tttagtccatctccatttatga

SEQ ID NO: 1208147 - DNA, 22 bp, Artificial Sequence
  chemically synthesized
ttcctgaataattcataaatgg

SEQ ID NO: 1208148 - DNA, 22 bp, Artificial Sequence
  chemically synthesized
tttcctgaataattcataaatg

SEQ ID NO: 1208149 - DNA, 22 bp, Artificial Sequence
  chemically synthesized
tagtccatctccatttatgaat

SEQ ID NO: 1208150 - DNA, 22 bp, Artificial Sequence
  chemically synthesized
ttttcctgaataattcataaat

SEQ ID NO: 1208151 - DNA, 22 bp, Artificial Sequence
  chemically synthesized
agtccatctccatttatgaatt

SEQ ID NO: 1208152 - DNA, 22 bp, Artificial Sequence
  chemically synthesized
tttttcctgaataattcataaa

SEQ ID NO: 1208153 - DNA, 22 bp, Artificial Sequence
  chemically synthesized
gtccatctccatttatgaatta

SEQ ID NO: 1208154 - DNA, 22 bp, Artificial Sequence
  chemically synthesized
gggttttttttcctgaataatt

SEQ ID NO: 1208155 - DNA, 22 bp, Artificial Sequence
  chemically synthesized
ggggttttttttcctgaataat

SEQ ID NO: 1208156 - DNA, 22 bp, Artificial Sequence
  chemically synthesized
tggggttttttttcctgaataa

SEQ ID NO: 1208157 - DNA, 22 bp, Artificial Sequence
  chemically synthesized
catttatgaattattcaggaaa

SEQ ID NO: 1208158 - DNA, 22 bp, Artificial Sequence
  chemically synthesized
atgaattattcaggaaaaaaaa

SEQ ID NO: 1208159 - DNA, 22 bp, Artificial Sequence
  chemically synthesized
tgaattattcaggaaaaaaaac

SEQ ID NO: 1208160 - DNA, 22 bp, Artificial Sequence
  chemically synthesized
ttcaggaaaaaaaaccccaaaa

SEQ ID NO: 1208161 - DNA, 22 bp, Artificial Sequence
  chemically synthesized
aggaaaaaaaaccccaaaatga

SEQ ID NO: 1208162 - DNA, 22 bp, Artificial Sequence
  chemically synthesized
taacacggaaaatcattttggg

SEQ ID NO: 1208163 - DNA, 22 bp, Artificial Sequence
  chemically synthesized
tataacacggaaaatcattttg

SEQ ID NO: 1208164 - DNA, 22 bp, Artificial Sequence
  chemically synthesized
ctataacacggaaaatcatttt

SEQ ID NO: 1208165 - DNA, 22 bp, Artificial Sequence
  chemically synthesized
gagtatgatcttctataacacg

SEQ ID NO: 1208166 - DNA, 22 bp, Artificial Sequence
  chemically synthesized
ggagtatgatcttctataacac

SEQ ID NO: 1208167 - DNA, 22 bp, Artificial Sequence
  chemically synthesized
tggagtatgatcttctataaca

SEQ ID NO: 1208168 - DNA, 22 bp, Artificial Sequence
  chemically synthesized
tccgtgttatagaagatcatac

SEQ ID NO: 1208169 - DNA, 22 bp, Artificial Sequence
  chemically synthesized
gtcaattttggagtatgatctt

SEQ ID NO: 1208170 - DNA, 22 bp, Artificial Sequence
  chemically synthesized
ccgtgttatagaagatcatact

SEQ ID NO: 1208171 - DNA, 22 bp, Artificial Sequence
  chemically synthesized
ggtcaattttggagtatgatct

SEQ ID NO: 1208172 - DNA, 22 bp, Artificial Sequence
  chemically synthesized
cgtgttatagaagatcatactc

SEQ ID NO: 1208173 - DNA, 22 bp, Artificial Sequence
  chemically synthesized
tggtcaattttggagtatgatc

SEQ ID NO: 1208174 - DNA, 22 bp, Artificial Sequence
  chemically synthesized
ttggtcaattttggagtatgat

SEQ ID NO: 1208175 - DNA, 22 bp, Artificial Sequence
  chemically synthesized
tttggtcaattttggagtatga

SEQ ID NO: 1208176 - DNA, 22 bp, Artificial Sequence
  chemically synthesized
tagaagatcatactccaaaatt

SEQ ID NO: 1208177 - DNA, 22 bp, Artificial Sequence
  chemically synthesized
acaaatgaagctttttggtcaa

SEQ ID NO: 1208178 - DNA, 22 bp, Artificial Sequence
  chemically synthesized
aacaaatgaagctttttggtca

SEQ ID NO: 1208179 - DNA, 22 bp, Artificial Sequence
  chemically synthesized
caaaattgaccaaaaagcttca

SEQ ID NO: 1208180 - DNA, 22 bp, Artificial Sequence
  chemically synthesized
cagtcttaacaaatgaagcttt

SEQ ID NO: 1208181 - DNA, 22 bp, Artificial Sequence
  chemically synthesized
acagtcttaacaaatgaagctt

SEQ ID NO: 1208182 - DNA, 22 bp, Artificial Sequence
  chemically synthesized
accaaaaagcttcatttgttaa

SEQ ID NO: 1208183 - DNA, 22 bp, Artificial Sequence
  chemically synthesized
catttgttaagactgtaagttc

SEQ ID NO: 1208184 - DNA, 22 bp, Artificial Sequence
  chemically synthesized
atggcacatatagaacttacag

SEQ ID NO: 1208185 - DNA, 22 bp, Artificial Sequence
  chemically synthesized
atttgttaagactgtaagttct

SEQ ID NO: 1208186 - DNA, 22 bp, Artificial Sequence
  chemically synthesized
aatggcacatatagaacttaca

SEQ ID NO: 1208187 - DNA, 22 bp, Artificial Sequence
  chemically synthesized
gttaagactgtaagttctatat

SEQ ID NO: 1208188 - DNA, 22 bp, Artificial Sequence
  chemically synthesized
ttaagactgtaagttctatatg

SEQ ID NO: 1208189 - DNA, 22 bp, Artificial Sequence
  chemically synthesized
agactgtaagttctatatgtgc

SEQ ID NO: 1208190 - DNA, 22 bp, Artificial Sequence
  chemically synthesized
taagttctatatgtgccattaa

SEQ ID NO: 1208191 - DNA, 22 bp, Artificial Sequence
  chemically synthesized
gaaaaagtaagtatgtttaatg

SEQ ID NO: 1208192 - DNA, 22 bp, Artificial Sequence
  chemically synthesized
tatatgtgccattaaacatact

SEQ ID NO: 1208193 - DNA, 22 bp, Artificial Sequence
  chemically synthesized
tatgtgccattaaacatactta

SEQ ID NO: 1208194 - DNA, 22 bp, Artificial Sequence
  chemically synthesized
taagtctagaaaaagtaagtat

SEQ ID NO: 1208195 - DNA, 22 bp, Artificial Sequence
  chemically synthesized
ggactataagtctagaaaaagt

SEQ ID NO: 1208196 - DNA, 22 bp, Artificial Sequence
  chemically synthesized
aacatacttactttttctagac

SEQ ID NO: 1208197 - DNA, 22 bp, Artificial Sequence
  chemically synthesized
actttttctagacttatagtcc

SEQ ID NO: 1208198 - DNA, 22 bp, Artificial Sequence
  chemically synthesized
ctttttctagacttatagtccc

SEQ ID NO: 1208199 - DNA, 22 bp, Artificial Sequence
  chemically synthesized
tttctagacttatagtcccaat

SEQ ID NO: 1208200 - DNA, 22 bp, Artificial Sequence
  chemically synthesized
ttctagacttatagtcccaatt

SEQ ID NO: 1208201 - DNA, 22 bp, Artificial Sequence
  chemically synthesized
tctagacttatagtcccaattc

SEQ ID NO: 1208202 - DNA, 22 bp, Artificial Sequence
  chemically synthesized
ctagacttatagtcccaattct

SEQ ID NO: 1208203 - DNA, 22 bp, Artificial Sequence
  chemically synthesized
gatataaacgtcagaattggga

SEQ ID NO: 1208204 - DNA, 22 bp, Artificial Sequence
  chemically synthesized
tagacttatagtcccaattctg

SEQ ID NO: 1208205 - DNA, 22 bp, Artificial Sequence
  chemically synthesized
gacttatagtcccaattctgac

SEQ ID NO: 1208206 - DNA, 22 bp, Artificial Sequence
  chemically synthesized
aattggatataaacgtcagaat

SEQ ID NO: 1208207 - DNA, 22 bp, Artificial Sequence
  chemically synthesized
taaattggatataaacgtcaga

SEQ ID NO: 1208208 - DNA, 22 bp, Artificial Sequence
  chemically synthesized
atagtcccaattctgacgttta

SEQ ID NO: 1208209 - DNA, 22 bp, Artificial Sequence
  chemically synthesized
tagtcccaattctgacgtttat

SEQ ID NO: 1208210 - DNA, 22 bp, Artificial Sequence
  chemically synthesized
acactctaaattggatataaac

SEQ ID NO: 1208211 - DNA, 22 bp, Artificial Sequence
  chemically synthesized
tgacgtttatatccaatttaga

SEQ ID NO: 1208212 - DNA, 22 bp, Artificial Sequence
  chemically synthesized
acgtttatatccaatttagagt

SEQ ID NO: 1208213 - DNA, 22 bp, Artificial Sequence
  chemically synthesized
atatccaatttagagtgtcaga

SEQ ID NO: 1208214 - DNA, 22 bp, Artificial Sequence
  chemically synthesized
tatccaatttagagtgtcagac

SEQ ID NO: 1208215 - DNA, 22 bp, Artificial Sequence
  chemically synthesized
aaatagaggagagaagaaatag

SEQ ID NO: 1208216 - DNA, 22 bp, Artificial Sequence
  chemically synthesized
agagtgtcagactatttcttct

SEQ ID NO: 1208217 - DNA, 22 bp, Artificial Sequence
  chemically synthesized
gagtgtcagactatttcttctc

SEQ ID NO: 1208218 - DNA, 22 bp, Artificial Sequence
  chemically synthesized
taaaatagaggagagaagaaat

SEQ ID NO: 1208219 - DNA, 22 bp, Artificial Sequence
  chemically synthesized
cctctaaaatagaggagagaag

SEQ ID NO: 1208220 - DNA, 22 bp, Artificial Sequence
  chemically synthesized
agactgcctctaaaatagagga

SEQ ID NO: 1208221 - DNA, 22 bp, Artificial Sequence
  chemically synthesized
cagactgcctctaaaatagagg

SEQ ID NO: 1208222 - DNA, 22 bp, Artificial Sequence
  chemically synthesized
tttcttctctcctctattttag

SEQ ID NO: 1208223 - DNA, 22 bp, Artificial Sequence
  chemically synthesized
cttctctcctctattttagagg

SEQ ID NO: 1208224 - DNA, 22 bp, Artificial Sequence
  chemically synthesized
ttctctcctctattttagaggc

SEQ ID NO: 1208225 - DNA, 22 bp, Artificial Sequence
  chemically synthesized
ctctcctctattttagaggcag

SEQ ID NO: 1208226 - DNA, 22 bp, Artificial Sequence
  chemically synthesized
aaagacttcagactgcctctaa

SEQ ID NO: 1208227 - DNA, 22 bp, Artificial Sequence
  chemically synthesized
tctcctctattttagaggcagt

SEQ ID NO: 1208228 - DNA, 22 bp, Artificial Sequence
  chemically synthesized
tcctctattttagaggcagtct

SEQ ID NO: 1208229 - DNA, 22 bp, Artificial Sequence
  chemically synthesized
ttgaaagacttcagactgcctc

SEQ ID NO: 1208230 - DNA, 22 bp, Artificial Sequence
  chemically synthesized
gttgaaagacttcagactgcct

SEQ ID NO: 1208231 - DNA, 22 bp, Artificial Sequence
  chemically synthesized
ctctattttagaggcagtctga

SEQ ID NO: 1208232 - DNA, 22 bp, Artificial Sequence
  chemically synthesized
ttgttgaaagacttcagactgc

SEQ ID NO: 1208233 - DNA, 22 bp, Artificial Sequence
  chemically synthesized
cttgttgaaagacttcagactg

SEQ ID NO: 1208234 - DNA, 22 bp, Artificial Sequence
  chemically synthesized
tattttagaggcagtctgaagt

SEQ ID NO: 1208235 - DNA, 22 bp, Artificial Sequence
  chemically synthesized
tcttgttgaaagacttcagact

SEQ ID NO: 1208236 - DNA, 22 bp, Artificial Sequence
  chemically synthesized
ttttagaggcagtctgaagtct

SEQ ID NO: 1208237 - DNA, 22 bp, Artificial Sequence
  chemically synthesized
tagaggcagtctgaagtctttc

SEQ ID NO: 1208238 - DNA, 22 bp, Artificial Sequence
  chemically synthesized
agaggcagtctgaagtctttca

SEQ ID NO: 1208239 - DNA, 22 bp, Artificial Sequence
  chemically synthesized
gaggcagtctgaagtctttcaa

SEQ ID NO: 1208240 - DNA, 22 bp, Artificial Sequence
  chemically synthesized
caaaattttcttgttgaaagac

SEQ ID NO: 1208241 - DNA, 22 bp, Artificial Sequence
  chemically synthesized
attacaaaattttcttgttgaa

SEQ ID NO: 1208242 - DNA, 22 bp, Artificial Sequence
  chemically synthesized
aagtctttcaacaagaaaattt

SEQ ID NO: 1208243 - DNA, 22 bp, Artificial Sequence
  chemically synthesized
tcaacaagaaaattttgtaatg

SEQ ID NO: 1208244 - DNA, 22 bp, Artificial Sequence
  chemically synthesized
caacaagaaaattttgtaatga

SEQ ID NO: 1208245 - DNA, 22 bp, Artificial Sequence
  chemically synthesized
aacaagaaaattttgtaatgag

SEQ ID NO: 1208246 - DNA, 22 bp, Artificial Sequence
  chemically synthesized
agtggaaaaaaacccacctcat

SEQ ID NO: 1208247 - DNA, 22 bp, Artificial Sequence
  chemically synthesized
tgtaatgaggtgggtttttttc

SEQ ID NO: 1208248 - DNA, 22 bp, Artificial Sequence
  chemically synthesized
gtaatgaggtgggtttttttcc

SEQ ID NO: 1208249 - DNA, 22 bp, Artificial Sequence
  chemically synthesized
taatgaggtgggtttttttcca

SEQ ID NO: 1208250 - DNA, 22 bp, Artificial Sequence
  chemically synthesized
atcaaacactaagtggaaaaaa

SEQ ID NO: 1208251 - DNA, 22 bp, Artificial Sequence
  chemically synthesized
ctgatcaaacactaagtggaaa

SEQ ID NO: 1208252 - DNA, 22 bp, Artificial Sequence
  chemically synthesized
ttcctgatcaaacactaagtgg

SEQ ID NO: 1208253 - DNA, 22 bp, Artificial Sequence
  chemically synthesized
gttcctgatcaaacactaagtg

SEQ ID NO: 1208254 - DNA, 22 bp, Artificial Sequence
  chemically synthesized
tgttcctgatcaaacactaagt

SEQ ID NO: 1208255 - DNA, 22 bp, Artificial Sequence
  chemically synthesized
ttttccacttagtgtttgatca

SEQ ID NO: 1208256 - DNA, 22 bp, Artificial Sequence
  chemically synthesized
tttccacttagtgtttgatcag

SEQ ID NO: 1208257 - DNA, 22 bp, Artificial Sequence
  chemically synthesized
gatgctttgttcctgatcaaac

SEQ ID NO: 1208258 - DNA, 22 bp, Artificial Sequence
  chemically synthesized
ttccacttagtgtttgatcagg

SEQ ID NO: 1208259 - DNA, 22 bp, Artificial Sequence
  chemically synthesized
tccacttagtgtttgatcagga

SEQ ID NO: 1208260 - DNA, 22 bp, Artificial Sequence
  chemically synthesized
ccacttagtgtttgatcaggaa

SEQ ID NO: 1208261 - DNA, 22 bp, Artificial Sequence
  chemically synthesized
cacttagtgtttgatcaggaac

SEQ ID NO: 1208262 - DNA, 22 bp, Artificial Sequence
  chemically synthesized
agtgtttgatcaggaacaaagc

SEQ ID NO: 1208263 - DNA, 22 bp, Artificial Sequence
  chemically synthesized
gtgtttgatcaggaacaaagca

SEQ ID NO: 1208264 - DNA, 22 bp, Artificial Sequence
  chemically synthesized
caagtaattagatgctttgttc

SEQ ID NO: 1208265 - DNA, 22 bp, Artificial Sequence
  chemically synthesized
gatcaggaacaaagcatctaat

SEQ ID NO: 1208266 - DNA, 22 bp, Artificial Sequence
  chemically synthesized
atcaggaacaaagcatctaatt

SEQ ID NO: 1208267 - DNA, 22 bp, Artificial Sequence
  chemically synthesized
cagatgagaaaatgggctccaa

SEQ ID NO: 1208268 - DNA, 22 bp, Artificial Sequence
  chemically synthesized
atattccagatgagaaaatggg

SEQ ID NO: 1208269 - DNA, 22 bp, Artificial Sequence
  chemically synthesized
attacttggagcccattttctc

SEQ ID NO: 1208270 - DNA, 22 bp, Artificial Sequence
  chemically synthesized
aatattccagatgagaaaatgg

SEQ ID NO: 1208271 - DNA, 22 bp, Artificial Sequence
  chemically synthesized
cttggagcccattttctcatct

SEQ ID NO: 1208272 - DNA, 22 bp, Artificial Sequence
  chemically synthesized
gcttaatattccagatgagaaa

SEQ ID NO: 1208273 - DNA, 22 bp, Artificial Sequence
  chemically synthesized
ggagcccattttctcatctgga

SEQ ID NO: 1208274 - DNA, 22 bp, Artificial Sequence
  chemically synthesized
gagcccattttctcatctggaa

SEQ ID NO: 1208275 - DNA, 22 bp, Artificial Sequence
  chemically synthesized
tctcatctggaatattaagcta

SEQ ID NO: 1208276 - DNA, 22 bp, Artificial Sequence
  chemically synthesized
acaaaatagcattagcttaata

SEQ ID NO: 1208277 - DNA, 22 bp, Artificial Sequence
  chemically synthesized
ctcatctggaatattaagctaa

SEQ ID NO: 1208278 - DNA, 22 bp, Artificial Sequence
  chemically synthesized
tcatctggaatattaagctaat

SEQ ID NO: 1208279 - DNA, 22 bp, Artificial Sequence
  chemically synthesized
ttgacaaaatagcattagctta

SEQ ID NO: 1208280 - DNA, 22 bp, Artificial Sequence
  chemically synthesized
atctggaatattaagctaatgc

SEQ ID NO: 1208281 - DNA, 22 bp, Artificial Sequence
  chemically synthesized
gaatattaagctaatgctattt

SEQ ID NO: 1208282 - DNA, 22 bp, Artificial Sequence
  chemically synthesized
caaaaatcctattgacaaaata

SEQ ID NO: 1208283 - DNA, 22 bp, Artificial Sequence
  chemically synthesized
acaaaaatcctattgacaaaat

SEQ ID NO: 1208284 - DNA, 22 bp, Artificial Sequence
  chemically synthesized
agctaatgctattttgtcaata

SEQ ID NO: 1208285 - DNA, 22 bp, Artificial Sequence
  chemically synthesized
atgctattttgtcaataggatt

SEQ ID NO: 1208286 - DNA, 22 bp, Artificial Sequence
  chemically synthesized
taatccttacaaaaatcctatt

SEQ ID NO: 1208287 - DNA, 22 bp, Artificial Sequence
  chemically synthesized
gttataatccttacaaaaatcc

SEQ ID NO: 1208288 - DNA, 22 bp, Artificial Sequence
  chemically synthesized
ttttgtcaataggatttttgta

SEQ ID NO: 1208289 - DNA, 22 bp, Artificial Sequence
  chemically synthesized
tgtcaataggatttttgtaagg

SEQ ID NO: 1208290 - DNA, 22 bp, Artificial Sequence
  chemically synthesized
gtcaataggatttttgtaagga

SEQ ID NO: 1208291 - DNA, 22 bp, Artificial Sequence
  chemically synthesized
tcaataggatttttgtaaggat

SEQ ID NO: 1208292 - DNA, 22 bp, Artificial Sequence
  chemically synthesized
tagactagttataatccttaca

SEQ ID NO: 1208293 - DNA, 22 bp, Artificial Sequence
  chemically synthesized
atagactagttataatccttac

SEQ ID NO: 1208294 - DNA, 22 bp, Artificial Sequence
  chemically synthesized
tatagactagttataatcctta

SEQ ID NO: 1208295 - DNA, 22 bp, Artificial Sequence
  chemically synthesized
ttgtaaggattataactagtct

SEQ ID NO: 1208296 - DNA, 22 bp, Artificial Sequence
  chemically synthesized
tgtaaggattataactagtcta

SEQ ID NO: 1208297 - DNA, 22 bp, Artificial Sequence
  chemically synthesized
cataatgttttatagactagtt

SEQ ID NO: 1208298 - DNA, 22 bp, Artificial Sequence
  chemically synthesized
gtaaggattataactagtctat

SEQ ID NO: 1208299 - DNA, 22 bp, Artificial Sequence
  chemically synthesized
gcataatgttttatagactagt

SEQ ID NO: 1208300 - DNA, 22 bp, Artificial Sequence
  chemically synthesized
taaggattataactagtctata

SEQ ID NO: 1208301 - DNA, 22 bp, Artificial Sequence
  chemically synthesized
taactagtctataaaacattat

SEQ ID NO: 1208302 - DNA, 22 bp, Artificial Sequence
  chemically synthesized
gtctataaaacattatgcaagt

SEQ ID NO: 1208303 - DNA, 22 bp, Artificial Sequence
  chemically synthesized
taaaacattatgcaagtatttg

SEQ ID NO: 1208304 - DNA, 22 bp, Artificial Sequence
  chemically synthesized
tgacagtagaatcaaatacttg

SEQ ID NO: 1208305 - DNA, 22 bp, Artificial Sequence
  chemically synthesized
gtgacagtagaatcaaatactt

SEQ ID NO: 1208306 - DNA, 22 bp, Artificial Sequence
  chemically synthesized
ttgtgacagtagaatcaaatac

SEQ ID NO: 1208307 - DNA, 22 bp, Artificial Sequence
  chemically synthesized
tgcaagtatttgattctactgt

SEQ ID NO: 1208308 - DNA, 22 bp, Artificial Sequence
  chemically synthesized
aaagcatcggttcttgtgacag

SEQ ID NO: 1208309 - DNA, 22 bp, Artificial Sequence
  chemically synthesized
gaaagcatcggttcttgtgaca

SEQ ID NO: 1208310 - DNA, 22 bp, Artificial Sequence
  chemically synthesized
tgaaagcatcggttcttgtgac

SEQ ID NO: 1208311 - DNA, 22 bp, Artificial Sequence
  chemically synthesized
ttgaaagcatcggttcttgtga

SEQ ID NO: 1208312 - DNA, 22 bp, Artificial Sequence
  chemically synthesized
gattctactgtcacaagaaccg

SEQ ID NO: 1208313 - DNA, 22 bp, Artificial Sequence
  chemically synthesized
attctactgtcacaagaaccga

SEQ ID NO: 1208314 - DNA, 22 bp, Artificial Sequence
  chemically synthesized
tactgtcacaagaaccgatgct

SEQ ID NO: 1208315 - DNA, 22 bp, Artificial Sequence
  chemically synthesized
atgtatttttgaaagcatcggt

SEQ ID NO: 1208316 - DNA, 22 bp, Artificial Sequence
  chemically synthesized
ctgtcacaagaaccgatgcttt

SEQ ID NO: 1208317 - DNA, 22 bp, Artificial Sequence
  chemically synthesized
tcacaagaaccgatgctttcaa

SEQ ID NO: 1208318 - DNA, 22 bp, Artificial Sequence
  chemically synthesized
aattaatgtatttttgaaagca

SEQ ID NO: 1208319 - DNA, 22 bp, Artificial Sequence
  chemically synthesized
aggtctgaattaatgtattttt

SEQ ID NO: 1208320 - DNA, 22 bp, Artificial Sequence
  chemically synthesized
gtgttgaggtctgaattaatgt

SEQ ID NO: 1208321 - DNA, 22 bp, Artificial Sequence
  chemically synthesized
tcaaaaatacattaattcagac

SEQ ID NO: 1208322 - DNA, 22 bp, Artificial Sequence
  chemically synthesized
attggtgttgaggtctgaatta

SEQ ID NO: 1208323 - DNA, 22 bp, Artificial Sequence
  chemically synthesized
caaaaatacattaattcagacc

SEQ ID NO: 1208324 - DNA, 22 bp, Artificial Sequence
  chemically synthesized
aaaaatacattaattcagacct

SEQ ID NO: 1208325 - DNA, 22 bp, Artificial Sequence
  chemically synthesized
tatatctaattggtgttgaggt

SEQ ID NO: 1208326 - DNA, 22 bp, Artificial Sequence
  chemically synthesized
atatatctaattggtgttgagg

SEQ ID NO: 1208327 - DNA, 22 bp, Artificial Sequence
  chemically synthesized
attcagacctcaacaccaatta

SEQ ID NO: 1208328 - DNA, 22 bp, Artificial Sequence
  chemically synthesized
agacctcaacaccaattagata

SEQ ID NO: 1208329 - DNA, 22 bp, Artificial Sequence
  chemically synthesized
aacaccaattagatatataagc

SEQ ID NO: 1208330 - DNA, 22 bp, Artificial Sequence
  chemically synthesized
gatatataagcatttatgtgtt

SEQ ID NO: 1208331 - DNA, 22 bp, Artificial Sequence
  chemically synthesized
atgtgttatacctgatgctcat

SEQ ID NO: 1208332 - DNA, 22 bp, Artificial Sequence
  chemically synthesized
tgtgttatacctgatgctcatc

SEQ ID NO: 1208333 - DNA, 22 bp, Artificial Sequence
  chemically synthesized
tacctgatgctcatctatatat

SEQ ID NO: 1208334 - DNA, 22 bp, Artificial Sequence
  chemically synthesized
atgctcatctatatatatacac

SEQ ID NO: 1208335 - DNA, 22 bp, Artificial Sequence
  chemically synthesized
cagacacatagtagggtgtgta

SEQ ID NO: 1208336 - DNA, 22 bp, Artificial Sequence
  chemically synthesized
atctatatatatacacacccta

SEQ ID NO: 1208337 - DNA, 22 bp, Artificial Sequence
  chemically synthesized
acagacacatagtagggtgtgt

SEQ ID NO: 1208338 - DNA, 22 bp, Artificial Sequence
  chemically synthesized
tatatatacacaccctactatg

SEQ ID NO: 1208339 - DNA, 22 bp, Artificial Sequence
  chemically synthesized
ccaaacagagatttacagacac

SEQ ID NO: 1208340 - DNA, 22 bp, Artificial Sequence
  chemically synthesized
tcccaaacagagatttacagac

SEQ ID NO: 1208341 - DNA, 22 bp, Artificial Sequence
  chemically synthesized
ctcccaaacagagatttacaga

SEQ ID NO: 1208342 - DNA, 22 bp, Artificial Sequence
  chemically synthesized
tctcccaaacagagatttacag

SEQ ID NO: 1208343 - DNA, 22 bp, Artificial Sequence
  chemically synthesized
ctatgtgtctgtaaatctctgt

SEQ ID NO: 1208344 - DNA, 22 bp, Artificial Sequence
  chemically synthesized
cacctttctcccaaacagagat

SEQ ID NO: 1208345 - DNA, 22 bp, Artificial Sequence
  chemically synthesized
tgtgtctgtaaatctctgtttg

SEQ ID NO: 1208346 - DNA, 22 bp, Artificial Sequence
  chemically synthesized
taaatctctgtttgggagaaag

SEQ ID NO: 1208347 - DNA, 22 bp, Artificial Sequence
  chemically synthesized
gcatggtgtattgcacctttct

SEQ ID NO: 1208348 - DNA, 22 bp, Artificial Sequence
  chemically synthesized
agcatggtgtattgcacctttc

SEQ ID NO: 1208349 - DNA, 22 bp, Artificial Sequence
  chemically synthesized
tagcatggtgtattgcaccttt

SEQ ID NO: 1208350 - DNA, 22 bp, Artificial Sequence
  chemically synthesized
tgtttgggagaaaggtgcaata

SEQ ID NO: 1208351 - DNA, 22 bp, Artificial Sequence
  chemically synthesized
tttagcatggtgtattgcacct

SEQ ID NO: 1208352 - DNA, 22 bp, Artificial Sequence
  chemically synthesized
tttgggagaaaggtgcaataca

SEQ ID NO: 1208353 - DNA, 22 bp, Artificial Sequence
  chemically synthesized
attctttagcatggtgtattgc

SEQ ID NO: 1208354 - DNA, 22 bp, Artificial Sequence
  chemically synthesized
gggagaaaggtgcaatacacca

SEQ ID NO: 1208355 - DNA, 22 bp, Artificial Sequence
  chemically synthesized
ggagaaaggtgcaatacaccat

SEQ ID NO: 1208356 - DNA, 22 bp, Artificial Sequence
  chemically synthesized
tgaaaataattgattctttagc

SEQ ID NO: 1208357 - DNA, 22 bp, Artificial Sequence
  chemically synthesized
atgaaaataattgattctttag

SEQ ID NO: 1208358 - DNA, 22 bp, Artificial Sequence
  chemically synthesized
tatgaaaataattgattcttta

SEQ ID NO: 1208359 - DNA, 22 bp, Artificial Sequence
  chemically synthesized
agcctttatgaaaataattgat

SEQ ID NO: 1208360 - DNA, 22 bp, Artificial Sequence
  chemically synthesized
aagaatcaattattttcataaa

SEQ ID NO: 1208361 - DNA, 22 bp, Artificial Sequence
  chemically synthesized
tcaatagttaagcctttatgaa

SEQ ID NO: 1208362 - DNA, 22 bp, Artificial Sequence
  chemically synthesized
atcaatagttaagcctttatga

SEQ ID NO: 1208363 - DNA, 22 bp, Artificial Sequence
  chemically synthesized
ttatcaatagttaagcctttat

SEQ ID NO: 1208364 - DNA, 22 bp, Artificial Sequence
  chemically synthesized
tatctcttatcaatagttaagc

SEQ ID NO: 1208365 - DNA, 22 bp, Artificial Sequence
  chemically synthesized
ttttcataaaggcttaactatt

SEQ ID NO: 1208366 - DNA, 22 bp, Artificial Sequence
  chemically synthesized
tcataaaggcttaactattgat

SEQ ID NO: 1208367 - DNA, 22 bp, Artificial Sequence
  chemically synthesized
cataaaggcttaactattgata

SEQ ID NO: 1208368 - DNA, 22 bp, Artificial Sequence
  chemically synthesized
ataaaggcttaactattgataa

SEQ ID NO: 1208369 - DNA, 22 bp, Artificial Sequence
  chemically synthesized
tatctatatctcttatcaatag

SEQ ID NO: 1208370 - DNA, 22 bp, Artificial Sequence
  chemically synthesized
aatgttatatctatatctctta

SEQ ID NO: 1208371 - DNA, 22 bp, Artificial Sequence
  chemically synthesized
aactattgataagagatataga

SEQ ID NO: 1208372 - DNA, 22 bp, Artificial Sequence
  chemically synthesized
actattgataagagatatagat

SEQ ID NO: 1208373 - DNA, 22 bp, Artificial Sequence
  chemically synthesized
ttgataagagatatagatataa

SEQ ID NO: 1208374 - DNA, 22 bp, Artificial Sequence
  chemically synthesized
tgaaacactcaatgttatatct

SEQ ID NO: 1208375 - DNA, 22 bp, Artificial Sequence
  chemically synthesized
ataagagatatagatataacat

SEQ ID NO: 1208376 - DNA, 22 bp, Artificial Sequence
  chemically synthesized
ctgtgaaacactcaatgttata

SEQ ID NO: 1208377 - DNA, 22 bp, Artificial Sequence
  chemically synthesized
tgtgtgtgtgtaactcctgtga

SEQ ID NO: 1208378 - DNA, 22 bp, Artificial Sequence
  chemically synthesized
agtgtttcacaggagttacaca

SEQ ID NO: 1208379 - DNA, 22 bp, Artificial Sequence
  chemically synthesized
aataaagttatgtgtgtgtgta

SEQ ID NO: 1208380 - DNA, 22 bp, Artificial Sequence
  chemically synthesized
cacaggagttacacacacacat

SEQ ID NO: 1208381 - DNA, 22 bp, Artificial Sequence
  chemically synthesized
acaggagttacacacacacata

SEQ ID NO: 1208382 - DNA, 22 bp, Artificial Sequence
  chemically synthesized
gaaattgaataaagttatgtgt

SEQ ID NO: 1208383 - DNA, 22 bp, Artificial Sequence
  chemically synthesized
ctggaaattgaataaagttatg

SEQ ID NO: 1208384 - DNA, 22 bp, Artificial Sequence
  chemically synthesized
cacacacacataactttattca

SEQ ID NO: 1208385 - DNA, 22 bp, Artificial Sequence
  chemically synthesized
aaacattgctggaaattgaata

SEQ ID NO: 1208386 - DNA, 22 bp, Artificial Sequence
  chemically synthesized
gttgaaacattgctggaaattg

SEQ ID NO: 1208387 - DNA, 22 bp, Artificial Sequence
  chemically synthesized
agttgaaacattgctggaaatt

SEQ ID NO: 1208388 - DNA, 22 bp, Artificial Sequence
  chemically synthesized
tagttgaaacattgctggaaat

SEQ ID NO: 1208389 - DNA, 22 bp, Artificial Sequence
  chemically synthesized
ttagttgaaacattgctggaaa

SEQ ID NO: 1208390 - DNA, 22 bp, Artificial Sequence
  chemically synthesized
tattcaatttccagcaatgttt

SEQ ID NO: 1208391 - DNA, 22 bp, Artificial Sequence
  chemically synthesized
attcaatttccagcaatgtttc

SEQ ID NO: 1208392 - DNA, 22 bp, Artificial Sequence
  chemically synthesized
ttcaatttccagcaatgtttca

SEQ ID NO: 1208393 - DNA, 22 bp, Artificial Sequence
  chemically synthesized
aatttccagcaatgtttcaact

SEQ ID NO: 1208394 - DNA, 22 bp, Artificial Sequence
  chemically synthesized
acagaatatttttagttgaaac

SEQ ID NO: 1208395 - DNA, 22 bp, Artificial Sequence
  chemically synthesized
gacagaatatttttagttgaaa

SEQ ID NO: 1208396 - DNA, 22 bp, Artificial Sequence
  chemically synthesized
tgacagaatatttttagttgaa

SEQ ID NO: 1208397 - DNA, 22 bp, Artificial Sequence
  chemically synthesized
ccagcaatgtttcaactaaaaa

SEQ ID NO: 1208398 - DNA, 22 bp, Artificial Sequence
  chemically synthesized
cagcaatgtttcaactaaaaat

SEQ ID NO: 1208399 - DNA, 22 bp, Artificial Sequence
  chemically synthesized
actttgacagaatatttttagt

SEQ ID NO: 1208400 - DNA, 22 bp, Artificial Sequence
  chemically synthesized
tgtaaattgactttgacagaat

SEQ ID NO: 1208401 - DNA, 22 bp, Artificial Sequence
  chemically synthesized
caactaaaaatattctgtcaaa

SEQ ID NO: 1208402 - DNA, 22 bp, Artificial Sequence
  chemically synthesized
aactaaaaatattctgtcaaag

SEQ ID NO: 1208403 - DNA, 22 bp, Artificial Sequence
  chemically synthesized
aaaatattctgtcaaagtcaat

SEQ ID NO: 1208404 - DNA, 22 bp, Artificial Sequence
  chemically synthesized
accattatgtaaattgactttg

SEQ ID NO: 1208405 - DNA, 22 bp, Artificial Sequence
  chemically synthesized
atctcaccattatgtaaattga

SEQ ID NO: 1208406 - DNA, 22 bp, Artificial Sequence
  chemically synthesized
aatctcaccattatgtaaattg

SEQ ID NO: 1208407 - DNA, 22 bp, Artificial Sequence
  chemically synthesized
taatctcaccattatgtaaatt

SEQ ID NO: 1208408 - DNA, 22 bp, Artificial Sequence
  chemically synthesized
tgtcaaagtcaatttacataat

SEQ ID NO: 1208409 - DNA, 22 bp, Artificial Sequence
  chemically synthesized
ctttaatctcaccattatgtaa

SEQ ID NO: 1208410 - DNA, 22 bp, Artificial Sequence
  chemically synthesized
tcaaagtcaatttacataatgg

SEQ ID NO: 1208411 - DNA, 22 bp, Artificial Sequence
  chemically synthesized
actttaatctcaccattatgta

SEQ ID NO: 1208412 - DNA, 22 bp, Artificial Sequence
  chemically synthesized
tactttaatctcaccattatgt

SEQ ID NO: 1208413 - DNA, 22 bp, Artificial Sequence
  chemically synthesized
gttttactttaatctcaccatt

SEQ ID NO: 1208414 - DNA, 22 bp, Artificial Sequence
  chemically synthesized
agttttactttaatctcaccat

SEQ ID NO: 1208415 - DNA, 22 bp, Artificial Sequence
  chemically synthesized
ttagttttactttaatctcacc

SEQ ID NO: 1208416 - DNA, 22 bp, Artificial Sequence
  chemically synthesized
cttagttttactttaatctcac

SEQ ID NO: 1208417 - DNA, 22 bp, Artificial Sequence
  chemically synthesized
acataatggtgagattaaagta

SEQ ID NO: 1208418 - DNA, 22 bp, Artificial Sequence
  chemically synthesized
cataatggtgagattaaagtaa

SEQ ID NO: 1208419 - DNA, 22 bp, Artificial Sequence
  chemically synthesized
acgtttcttagttttactttaa

SEQ ID NO: 1208420 - DNA, 22 bp, Artificial Sequence
  chemically synthesized
gtatccactgacgtttcttagt

SEQ ID NO: 1208421 - DNA, 22 bp, Artificial Sequence
  chemically synthesized
ctggtatccactgacgtttctt

SEQ ID NO: 1208422 - DNA, 22 bp, Artificial Sequence
  chemically synthesized
aagtaaaactaagaaacgtcag

SEQ ID NO: 1208423 - DNA, 22 bp, Artificial Sequence
  chemically synthesized
tactggtatccactgacgtttc

SEQ ID NO: 1208424 - DNA, 22 bp, Artificial Sequence
  chemically synthesized
tcatattctactggtatccact

SEQ ID NO: 1208425 - DNA, 22 bp, Artificial Sequence
  chemically synthesized
agaaacgtcagtggataccagt

SEQ ID NO: 1208426 - DNA, 22 bp, Artificial Sequence
  chemically synthesized
ataaactgtcatattctactgg

SEQ ID NO: 1208427 - DNA, 22 bp, Artificial Sequence
  chemically synthesized
taaataaaattaataaactgtc

SEQ ID NO: 1208428 - DNA, 22 bp, Artificial Sequence
  chemically synthesized
tgtgttataaataaaattaata

SEQ ID NO: 1208429 - DNA, 22 bp, Artificial Sequence
  chemically synthesized
gtgtgttataaataaaattaat

SEQ ID NO: 1208430 - DNA, 22 bp, Artificial Sequence
  chemically synthesized
tgtgtgttataaataaaattaa

SEQ ID NO: 1208431 - DNA, 22 bp, Artificial Sequence
  chemically synthesized
ttgtgtgttataaataaaatta

SEQ ID NO: 1208432 - DNA, 22 bp, Artificial Sequence
  chemically synthesized
ttttgtgtgttataaataaaat

SEQ ID NO: 1208433 - DNA, 22 bp, Artificial Sequence
  chemically synthesized
cttttgtgtgttataaataaaa

SEQ ID NO: 1208434 - DNA, 22 bp, Artificial Sequence
  chemically synthesized
tcttttgtgtgttataaataaa

SEQ ID NO: 1208435 - DNA, 22 bp, Artificial Sequence
  chemically synthesized
ttcttttgtgtgttataaataa

SEQ ID NO: 1208436 - DNA, 22 bp, Artificial Sequence
  chemically synthesized
attaattttatttataacacac

SEQ ID NO: 1208437 - DNA, 22 bp, Artificial Sequence
  chemically synthesized
ttaattttatttataacacaca

SEQ ID NO: 1208438 - DNA, 22 bp, Artificial Sequence
  chemically synthesized
acatatttttcttttgtgtgtt

SEQ ID NO: 1208439 - DNA, 22 bp, Artificial Sequence
  chemically synthesized
attttatttataacacacaaaa

SEQ ID NO: 1208440 - DNA, 22 bp, Artificial Sequence
  chemically synthesized
aacatatttttcttttgtgtgt

SEQ ID NO: 1208441 - DNA, 22 bp, Artificial Sequence
  chemically synthesized
taacatatttttcttttgtgtg

SEQ ID NO: 1208442 - DNA, 22 bp, Artificial Sequence
  chemically synthesized
ttaacatatttttcttttgtgt

SEQ ID NO: 1208443 - DNA, 22 bp, Artificial Sequence
  chemically synthesized
tttaacatatttttcttttgtg

SEQ ID NO: 1208444 - DNA, 22 bp, Artificial Sequence
  chemically synthesized
tatttataacacacaaaagaaa

SEQ ID NO: 1208445 - DNA, 22 bp, Artificial Sequence
  chemically synthesized
atttataacacacaaaagaaaa

SEQ ID NO: 1208446 - DNA, 22 bp, Artificial Sequence
  chemically synthesized
tttataacacacaaaagaaaaa

SEQ ID NO: 1208447 - DNA, 22 bp, Artificial Sequence
  chemically synthesized
attttttaacatatttttcttt

SEQ ID NO: 1208448 - DNA, 22 bp, Artificial Sequence
  chemically synthesized
ataacacacaaaagaaaaatat

SEQ ID NO: 1208449 - DNA, 22 bp, Artificial Sequence
  chemically synthesized
taacacacaaaagaaaaatatg

SEQ ID NO: 1208450 - DNA, 22 bp, Artificial Sequence
  chemically synthesized
caagatagcatattcatttttt

SEQ ID NO: 1208451 - DNA, 22 bp, Artificial Sequence
  chemically synthesized
gcaagatagcatattcattttt

SEQ ID NO: 1208452 - DNA, 22 bp, Artificial Sequence
  chemically synthesized
aaaaatgaatatgctatcttgc

SEQ ID NO: 1208453 - DNA, 22 bp, Artificial Sequence
  chemically synthesized
ccatagtagacagtgtttgcaa

SEQ ID NO: 1208454 - DNA, 22 bp, Artificial Sequence
  chemically synthesized
gtgtctgccatagtagacagtg

SEQ ID NO: 1208455 - DNA, 22 bp, Artificial Sequence
  chemically synthesized
agtgtctgccatagtagacagt

SEQ ID NO: 1208456 - DNA, 22 bp, Artificial Sequence
  chemically synthesized
tcttgcaaacactgtctactat

SEQ ID NO: 1208457 - DNA, 22 bp, Artificial Sequence
  chemically synthesized
ttagtgtctgccatagtagaca

SEQ ID NO: 1208458 - DNA, 22 bp, Artificial Sequence
  chemically synthesized
cttagtgtctgccatagtagac

SEQ ID NO: 1208459 - DNA, 22 bp, Artificial Sequence
  chemically synthesized
tcttagtgtctgccatagtaga

SEQ ID NO: 1208460 - DNA, 22 bp, Artificial Sequence
  chemically synthesized
gcaaacactgtctactatggca

SEQ ID NO: 1208461 - DNA, 22 bp, Artificial Sequence
  chemically synthesized
caaacactgtctactatggcag

SEQ ID NO: 1208462 - DNA, 22 bp, Artificial Sequence
  chemically synthesized
aataagttttcttagtgtctgc

SEQ ID NO: 1208463 - DNA, 22 bp, Artificial Sequence
  chemically synthesized
tctactatggcagacactaaga

SEQ ID NO: 1208464 - DNA, 22 bp, Artificial Sequence
  chemically synthesized
ttaaataagttttcttagtgtc

SEQ ID NO: 1208465 - DNA, 22 bp, Artificial Sequence
  chemically synthesized
ttattaaataagttttcttagt

SEQ ID NO: 1208466 - DNA, 22 bp, Artificial Sequence
  chemically synthesized
ctatggcagacactaagaaaac

SEQ ID NO: 1208467 - DNA, 22 bp, Artificial Sequence
  chemically synthesized
gttattaaataagttttcttag

SEQ ID NO: 1208468 - DNA, 22 bp, Artificial Sequence
  chemically synthesized
tggcagacactaagaaaactta

SEQ ID NO: 1208469 - DNA, 22 bp, Artificial Sequence
  chemically synthesized
agtcttgttattaaataagttt

SEQ ID NO: 1208470 - DNA, 22 bp, Artificial Sequence
  chemically synthesized
cagtcttgttattaaataagtt

SEQ ID NO: 1208471 - DNA, 22 bp, Artificial Sequence
  chemically synthesized
atttcagtcttgttattaaata

SEQ ID NO: 1208472 - DNA, 22 bp, Artificial Sequence
  chemically synthesized
agaaaacttatttaataacaag

SEQ ID NO: 1208473 - DNA, 22 bp, Artificial Sequence
  chemically synthesized
acggaaatctaatttcagtctt

SEQ ID NO: 1208474 - DNA, 22 bp, Artificial Sequence
  chemically synthesized
atttaataacaagactgaaatt

SEQ ID NO: 1208475 - DNA, 22 bp, Artificial Sequence
  chemically synthesized
tttaataacaagactgaaatta

SEQ ID NO: 1208476 - DNA, 22 bp, Artificial Sequence
  chemically synthesized
aataacaagactgaaattagat

SEQ ID NO: 1208477 - DNA, 22 bp, Artificial Sequence
  chemically synthesized
ataacaagactgaaattagatt

SEQ ID NO: 1208478 - DNA, 22 bp, Artificial Sequence
  chemically synthesized
aagacagcatctgacggaaatc

SEQ ID NO: 1208479 - DNA, 22 bp, Artificial Sequence
  chemically synthesized
taaagacagcatctgacggaaa

SEQ ID NO: 1208480 - DNA, 22 bp, Artificial Sequence
  chemically synthesized
aaattagatttccgtcagatgc

SEQ ID NO: 1208481 - DNA, 22 bp, Artificial Sequence
  chemically synthesized
cccaaattctaaagacagcatc

SEQ ID NO: 1208482 - DNA, 22 bp, Artificial Sequence
  chemically synthesized
gatttccgtcagatgctgtctt

SEQ ID NO: 1208483 - DNA, 22 bp, Artificial Sequence
  chemically synthesized
ttccccaaattctaaagacagc

SEQ ID NO: 1208484 - DNA, 22 bp, Artificial Sequence
  chemically synthesized
tattccccaaattctaaagaca

SEQ ID NO: 1208485 - DNA, 22 bp, Artificial Sequence
  chemically synthesized
ccgtcagatgctgtctttagaa

SEQ ID NO: 1208486 - DNA, 22 bp, Artificial Sequence
  chemically synthesized
cgtcagatgctgtctttagaat

SEQ ID NO: 1208487 - DNA, 22 bp, Artificial Sequence
  chemically synthesized
tctttagaatttggggaataga

SEQ ID NO: 1208488 - DNA, 22 bp, Artificial Sequence
  chemically synthesized
tagaatttggggaatagagcta

SEQ ID NO: 1208489 - DNA, 22 bp, Artificial Sequence
  chemically synthesized
agaatttggggaatagagctat

SEQ ID NO: 1208490 - DNA, 22 bp, Artificial Sequence
  chemically synthesized
gaatttggggaatagagctatt

SEQ ID NO: 1208491 - DNA, 22 bp, Artificial Sequence
  chemically synthesized
ggggaatagagctattcatccc

SEQ ID NO: 1208492 - DNA, 22 bp, Artificial Sequence
  chemically synthesized
gggaatagagctattcatccct

SEQ ID NO: 1208493 - DNA, 22 bp, Artificial Sequence
  chemically synthesized
caagaaacacatccagggatga

SEQ ID NO: 1208494 - DNA, 22 bp, Artificial Sequence
  chemically synthesized
acacatctccaagaaacacatc

SEQ ID NO: 1208495 - DNA, 22 bp, Artificial Sequence
  chemically synthesized
ttcatccctggatgtgtttctt

SEQ ID NO: 1208496 - DNA, 22 bp, Artificial Sequence
  chemically synthesized
atccctggatgtgtttcttgga

SEQ ID NO: 1208497 - DNA, 22 bp, Artificial Sequence
  chemically synthesized
cgatattgacacatctccaaga

SEQ ID NO: 1208498 - DNA, 22 bp, Artificial Sequence
  chemically synthesized
ttacgatattgacacatctcca

SEQ ID NO: 1208499 - DNA, 22 bp, Artificial Sequence
  chemically synthesized
gatgtgtttcttggagatgtgt

SEQ ID NO: 1208500 - DNA, 22 bp, Artificial Sequence
  chemically synthesized
attgttacgatattgacacatc

SEQ ID NO: 1208501 - DNA, 22 bp, Artificial Sequence
  chemically synthesized
cattgttacgatattgacacat

SEQ ID NO: 1208502 - DNA, 22 bp, Artificial Sequence
  chemically synthesized
tcattgttacgatattgacaca

SEQ ID NO: 1208503 - DNA, 22 bp, Artificial Sequence
  chemically synthesized
ttcattgttacgatattgacac

SEQ ID NO: 1208504 - DNA, 22 bp, Artificial Sequence
  chemically synthesized
cttggagatgtgtcaatatcgt

SEQ ID NO: 1208505 - DNA, 22 bp, Artificial Sequence
  chemically synthesized
tttttcattgttacgatattga

SEQ ID NO: 1208506 - DNA, 22 bp, Artificial Sequence
  chemically synthesized
ttggagatgtgtcaatatcgta

SEQ ID NO: 1208507 - DNA, 22 bp, Artificial Sequence
  chemically synthesized
gtttttcattgttacgatattg

SEQ ID NO: 1208508 - DNA, 22 bp, Artificial Sequence
  chemically synthesized
tgtttttcattgttacgatatt

SEQ ID NO: 1208509 - DNA, 22 bp, Artificial Sequence
  chemically synthesized
ggagatgtgtcaatatcgtaac

SEQ ID NO: 1208510 - DNA, 22 bp, Artificial Sequence
  chemically synthesized
gagatgtgtcaatatcgtaaca

SEQ ID NO: 1208511 - DNA, 22 bp, Artificial Sequence
  chemically synthesized
acggtataaagcaattttgttt

SEQ ID NO: 1208512 - DNA, 22 bp, Artificial Sequence
  chemically synthesized
tatcagaaatatctaacggtat

SEQ ID NO: 1208513 - DNA, 22 bp, Artificial Sequence
  chemically synthesized
ctttataccgttagatatttct

SEQ ID NO: 1208514 - DNA, 22 bp, Artificial Sequence
  chemically synthesized
tataccgttagatatttctgat

SEQ ID NO: 1208515 - DNA, 22 bp, Artificial Sequence
  chemically synthesized
ataccgttagatatttctgata

SEQ ID NO: 1208516 - DNA, 22 bp, Artificial Sequence
  chemically synthesized
taccgttagatatttctgatac

SEQ ID NO: 1208517 - DNA, 22 bp, Artificial Sequence
  chemically synthesized
gatatttctgatacaatctttg

SEQ ID NO: 1208518 - DNA, 22 bp, Artificial Sequence
  chemically synthesized
tgaaacccacgagtgggcaaag

SEQ ID NO: 1208519 - DNA, 22 bp, Artificial Sequence
  chemically synthesized
atgaaacccacgagtgggcaaa

SEQ ID NO: 1208520 - DNA, 22 bp, Artificial Sequence
  chemically synthesized
ctgatacaatctttgcccactc

SEQ ID NO: 1208521 - DNA, 22 bp, Artificial Sequence
  chemically synthesized
tatgaaacccacgagtgggcaa

SEQ ID NO: 1208522 - DNA, 22 bp, Artificial Sequence
  chemically synthesized
tgatacaatctttgcccactcg

SEQ ID NO: 1208523 - DNA, 22 bp, Artificial Sequence
  chemically synthesized
atacaatctttgcccactcgtg

SEQ ID NO: 1208524 - DNA, 22 bp, Artificial Sequence
  chemically synthesized
gcacaaagctttatgaaaccca

SEQ ID NO: 1208525 - DNA, 22 bp, Artificial Sequence
  chemically synthesized
tgcccactcgtgggtttcataa

SEQ ID NO: 1208526 - DNA, 22 bp, Artificial Sequence
  chemically synthesized
gcccactcgtgggtttcataaa

SEQ ID NO: 1208527 - DNA, 22 bp, Artificial Sequence
  chemically synthesized
cccactcgtgggtttcataaag

SEQ ID NO: 1208528 - DNA, 22 bp, Artificial Sequence
  chemically synthesized
gtgggtttcataaagctttgtg

SEQ ID NO: 1208529 - DNA, 22 bp, Artificial Sequence
  chemically synthesized
gtgacaaaattggcacaaagct

SEQ ID NO: 1208530 - DNA, 22 bp, Artificial Sequence
  chemically synthesized
ggtgacaaaattggcacaaagc

SEQ ID NO: 1208531 - DNA, 22 bp, Artificial Sequence
  chemically synthesized
tcttggtgacaaaattggcaca

SEQ ID NO: 1208532 - DNA, 22 bp, Artificial Sequence
  chemically synthesized
gtcttggtgacaaaattggcac

SEQ ID NO: 1208533 - DNA, 22 bp, Artificial Sequence
  chemically synthesized
cataaagctttgtgccaatttt

SEQ ID NO: 1208534 - DNA, 22 bp, Artificial Sequence
  chemically synthesized
ataaagctttgtgccaattttg

SEQ ID NO: 1208535 - DNA, 22 bp, Artificial Sequence
  chemically synthesized
tgtgccaattttgtcaccaaga

SEQ ID NO: 1208536 - DNA, 22 bp, Artificial Sequence
  chemically synthesized
gtgccaattttgtcaccaagac

SEQ ID NO: 1208537 - DNA, 22 bp, Artificial Sequence
  chemically synthesized
tgccaattttgtcaccaagaca

SEQ ID NO: 1208538 - DNA, 22 bp, Artificial Sequence
  chemically synthesized
gatcagatacacttgtcttggt

SEQ ID NO: 1208539 - DNA, 22 bp, Artificial Sequence
  chemically synthesized
tgttagatcagatacacttgtc

SEQ ID NO: 1208540 - DNA, 22 bp, Artificial Sequence
  chemically synthesized
gtgttagatcagatacacttgt

SEQ ID NO: 1208541 - DNA, 22 bp, Artificial Sequence
  chemically synthesized
tgtcaccaagacaagtgtatct

SEQ ID NO: 1208542 - DNA, 22 bp, Artificial Sequence
  chemically synthesized
gtcaccaagacaagtgtatctg

SEQ ID NO: 1208543 - DNA, 22 bp, Artificial Sequence
  chemically synthesized
tcaccaagacaagtgtatctga

SEQ ID NO: 1208544 - DNA, 22 bp, Artificial Sequence
  chemically synthesized
aatttgtgttagatcagataca

SEQ ID NO: 1208545 - DNA, 22 bp, Artificial Sequence
  chemically synthesized
aaaagtgttcaatttgtgttag

SEQ ID NO: 1208546 - DNA, 22 bp, Artificial Sequence
  chemically synthesized
ctgaaaagtgttcaatttgtgt

SEQ ID NO: 1208547 - DNA, 22 bp, Artificial Sequence
  chemically synthesized
gctgaaaagtgttcaatttgtg

SEQ ID NO: 1208548 - DNA, 22 bp, Artificial Sequence
  chemically synthesized
tgctgaaaagtgttcaatttgt

SEQ ID NO: 1208549 - DNA, 22 bp, Artificial Sequence
  chemically synthesized
atctaacacaaattgaacactt

SEQ ID NO: 1208550 - DNA, 22 bp, Artificial Sequence
  chemically synthesized
acacaaattgaacacttttcag

SEQ ID NO: 1208551 - DNA, 22 bp, Artificial Sequence
  chemically synthesized
aataatatacacaatgctttgc

SEQ ID NO: 1208552 - DNA, 22 bp, Artificial Sequence
  chemically synthesized
aacacttttcagcaaagcattg

SEQ ID NO: 1208553 - DNA, 22 bp, Artificial Sequence
  chemically synthesized
ttcagcaaagcattgtgtatat

SEQ ID NO: 1208554 - DNA, 22 bp, Artificial Sequence
  chemically synthesized
tcagcaaagcattgtgtatatt

SEQ ID NO: 1208555 - DNA, 22 bp, Artificial Sequence
  chemically synthesized
cagcaaagcattgtgtatatta

SEQ ID NO: 1208556 - DNA, 22 bp, Artificial Sequence
  chemically synthesized
agcaaagcattgtgtatattat

SEQ ID NO: 1208557 - DNA, 22 bp, Artificial Sequence
  chemically synthesized
atgacatatgaatggggaatta

SEQ ID NO: 1208558 - DNA, 22 bp, Artificial Sequence
  chemically synthesized
tgtatattatttaattccccat

SEQ ID NO: 1208559 - DNA, 22 bp, Artificial Sequence
  chemically synthesized
catgacatatgaatggggaatt

SEQ ID NO: 1208560 - DNA, 22 bp, Artificial Sequence
  chemically synthesized
ccttcatgacatatgaatgggg

SEQ ID NO: 1208561 - DNA, 22 bp, Artificial Sequence
  chemically synthesized
gttcccttcatgacatatgaat

SEQ ID NO: 1208562 - DNA, 22 bp, Artificial Sequence
  chemically synthesized
tttaattccccattcatatgtc

SEQ ID NO: 1208563 - DNA, 22 bp, Artificial Sequence
  chemically synthesized
aattccccattcatatgtcatg

SEQ ID NO: 1208564 - DNA, 22 bp, Artificial Sequence
  chemically synthesized
attccccattcatatgtcatga

SEQ ID NO: 1208565 - DNA, 22 bp, Artificial Sequence
  chemically synthesized
cccattcatatgtcatgaaggg

SEQ ID NO: 1208566 - DNA, 22 bp, Artificial Sequence
  chemically synthesized
tggtaaccatgctggttccctt

SEQ ID NO: 1208567 - DNA, 22 bp, Artificial Sequence
  chemically synthesized
atatgtcatgaagggaaccagc

SEQ ID NO: 1208568 - DNA, 22 bp, Artificial Sequence
  chemically synthesized
ttgtggtaaccatgctggttcc

SEQ ID NO: 1208569 - DNA, 22 bp, Artificial Sequence
  chemically synthesized
attgtggtaaccatgctggttc

SEQ ID NO: 1208570 - DNA, 22 bp, Artificial Sequence
  chemically synthesized
aataaatttattgtggtaacca

SEQ ID NO: 1208571 - DNA, 22 bp, Artificial Sequence
  chemically synthesized
aaataaatttattgtggtaacc

SEQ ID NO: 1208572 - DNA, 22 bp, Artificial Sequence
  chemically synthesized
atttaaataaatttattgtggt

SEQ ID NO: 1208573 - DNA, 22 bp, Artificial Sequence
  chemically synthesized
ttgatttaaataaatttattgt

SEQ ID NO: 1208574 - DNA, 22 bp, Artificial Sequence
  chemically synthesized
gttgatttaaataaatttattg

SEQ ID NO: 1208575 - DNA, 22 bp, Artificial Sequence
  chemically synthesized
tgttgatttaaataaatttatt

SEQ ID NO: 1208576 - DNA, 22 bp, Artificial Sequence
  chemically synthesized
aattttgttgatttaaataaat

SEQ ID NO: 1208577 - DNA, 22 bp, Artificial Sequence
  chemically synthesized
ccacaataaatttatttaaatc

SEQ ID NO: 1208578 - DNA, 22 bp, Artificial Sequence
  chemically synthesized
acattgaattttgttgatttaa

SEQ ID NO: 1208579 - DNA, 22 bp, Artificial Sequence
  chemically synthesized
tgacattgaattttgttgattt

SEQ ID NO: 1208580 - DNA, 22 bp, Artificial Sequence
  chemically synthesized
atttaaatcaacaaaattcaat

SEQ ID NO: 1208581 - DNA, 22 bp, Artificial Sequence
  chemically synthesized
tttaaatcaacaaaattcaatg

SEQ ID NO: 1208582 - DNA, 22 bp, Artificial Sequence
  chemically synthesized
aaatcaacaaaattcaatgtca

SEQ ID NO: 1208583 - DNA, 22 bp, Artificial Sequence
  chemically synthesized
aatcaacaaaattcaatgtcag

SEQ ID NO: 1208584 - DNA, 22 bp, Artificial Sequence
  chemically synthesized
aatgtcagaatgtatcattttt

SEQ ID NO: 1208585 - DNA, 22 bp, Artificial Sequence
  chemically synthesized
agtataccatagaaaaaaatga

SEQ ID NO: 1208586 - DNA, 22 bp, Artificial Sequence
  chemically synthesized
aagtataccatagaaaaaaatg

SEQ ID NO: 1208587 - DNA, 22 bp, Artificial Sequence
  chemically synthesized
atggaaccttaagtataccata

SEQ ID NO: 1208588 - DNA, 22 bp, Artificial Sequence
  chemically synthesized
aatggaaccttaagtataccat

SEQ ID NO: 1208589 - DNA, 22 bp, Artificial Sequence
  chemically synthesized
ttttctatggtatacttaaggt

SEQ ID NO: 1208590 - DNA, 22 bp, Artificial Sequence
  chemically synthesized
tttctatggtatacttaaggtt

SEQ ID NO: 1208591 - DNA, 22 bp, Artificial Sequence
  chemically synthesized
ttctatggtatacttaaggttc

SEQ ID NO: 1208592 - DNA, 22 bp, Artificial Sequence
  chemically synthesized
tctatggtatacttaaggttcc

SEQ ID NO: 1208593 - DNA, 22 bp, Artificial Sequence
  chemically synthesized
ctatggtatacttaaggttcca

SEQ ID NO: 1208594 - DNA, 22 bp, Artificial Sequence
  chemically synthesized
tatggtatacttaaggttccat

SEQ ID NO: 1208595 - DNA, 22 bp, Artificial Sequence
  chemically synthesized
tggtatacttaaggttccatta

SEQ ID NO: 1208596 - DNA, 22 bp, Artificial Sequence
  chemically synthesized
aaggttccattaaatttactga

SEQ ID NO: 1208597 - DNA, 22 bp, Artificial Sequence
  chemically synthesized
aggttccattaaatttactgac

SEQ ID NO: 1208598 - DNA, 22 bp, Artificial Sequence
  chemically synthesized
aaatgaaggaatgtcagtaaat

SEQ ID NO: 1208599 - DNA, 22 bp, Artificial Sequence
  chemically synthesized
taaaatgaaggaatgtcagtaa

SEQ ID NO: 1208600 - DNA, 22 bp, Artificial Sequence
  chemically synthesized
ctaaaatgaaggaatgtcagta

SEQ ID NO: 1208601 - DNA, 22 bp, Artificial Sequence
  chemically synthesized
cattaaatttactgacattcct

SEQ ID NO: 1208602 - DNA, 22 bp, Artificial Sequence
  chemically synthesized
taatttctaaaatgaaggaatg

SEQ ID NO: 1208603 - DNA, 22 bp, Artificial Sequence
  chemically synthesized
aatttactgacattccttcatt

SEQ ID NO: 1208604 - DNA, 22 bp, Artificial Sequence
  chemically synthesized
actgacattccttcattttaga

SEQ ID NO: 1208605 - DNA, 22 bp, Artificial Sequence
  chemically synthesized
ctgacattccttcattttagaa

SEQ ID NO: 1208606 - DNA, 22 bp, Artificial Sequence
  chemically synthesized
acattccttcattttagaaatt

SEQ ID NO: 1208607 - DNA, 22 bp, Artificial Sequence
  chemically synthesized
cttcattttagaaattataatc

SEQ ID NO: 1208608 - DNA, 22 bp, Artificial Sequence
  chemically synthesized
cattttagaaattataatccca

SEQ ID NO: 1208609 - DNA, 22 bp, Artificial Sequence
  chemically synthesized
attttagaaattataatcccac

SEQ ID NO: 1208610 - DNA, 22 bp, Artificial Sequence
  chemically synthesized
tagaaattataatcccactggg

SEQ ID NO: 1208611 - DNA, 22 bp, Artificial Sequence
  chemically synthesized
agaaattataatcccactggga

SEQ ID NO: 1208612 - DNA, 22 bp, Artificial Sequence
  chemically synthesized
agaaaatcgtggtcccagtggg

SEQ ID NO: 1208613 - DNA, 22 bp, Artificial Sequence
  chemically synthesized
gaaattataatcccactgggac

SEQ ID NO: 1208614 - DNA, 22 bp, Artificial Sequence
  chemically synthesized
tgttaagaaaatcgtggtccca

SEQ ID NO: 1208615 - DNA, 22 bp, Artificial Sequence
  chemically synthesized
tatgttaagaaaatcgtggtcc

SEQ ID NO: 1208616 - DNA, 22 bp, Artificial Sequence
  chemically synthesized
taatcccactgggaccacgatt

SEQ ID NO: 1208617 - DNA, 22 bp, Artificial Sequence
  chemically synthesized
aattctatgttaagaaaatcgt

SEQ ID NO: 1208618 - DNA, 22 bp, Artificial Sequence
  chemically synthesized
gattcaattctatgttaagaaa

SEQ ID NO: 1208619 - DNA, 22 bp, Artificial Sequence
  chemically synthesized
ggaccacgattttcttaacata

SEQ ID NO: 1208620 - DNA, 22 bp, Artificial Sequence
  chemically synthesized
tcttaacatagaattgaatcta

SEQ ID NO: 1208621 - DNA, 22 bp, Artificial Sequence
  chemically synthesized
cttaacatagaattgaatctaa

SEQ ID NO: 1208622 - DNA, 22 bp, Artificial Sequence
  chemically synthesized
ttaacatagaattgaatctaat

SEQ ID NO: 1208623 - DNA, 22 bp, Artificial Sequence
  chemically synthesized
aacatagaattgaatctaatgg

SEQ ID NO: 1208624 - DNA, 22 bp, Artificial Sequence
  chemically synthesized
acatagaattgaatctaatgga

SEQ ID NO: 1208625 - DNA, 22 bp, Artificial Sequence
  chemically synthesized
aagtcaataagaggaaaatatc

SEQ ID NO: 1208626 - DNA, 22 bp, Artificial Sequence
  chemically synthesized
aatctaatggatattttcctct

SEQ ID NO: 1208627 - DNA, 22 bp, Artificial Sequence
  chemically synthesized
cctcaagtcaataagaggaaaa

SEQ ID NO: 1208628 - DNA, 22 bp, Artificial Sequence
  chemically synthesized
attacctcaagtcaataagagg

SEQ ID NO: 1208629 - DNA, 22 bp, Artificial Sequence
  chemically synthesized
atggatattttcctcttattga

SEQ ID NO: 1208630 - DNA, 22 bp, Artificial Sequence
  chemically synthesized
aattacctcaagtcaataagag

SEQ ID NO: 1208631 - DNA, 22 bp, Artificial Sequence
  chemically synthesized
tcctcttattgacttgaggtaa

SEQ ID NO: 1208632 - DNA, 22 bp, Artificial Sequence
  chemically synthesized
cctcttattgacttgaggtaat

SEQ ID NO: 1208633 - DNA, 22 bp, Artificial Sequence
  chemically synthesized
ctcttattgacttgaggtaatt

SEQ ID NO: 1208634 - DNA, 22 bp, Artificial Sequence
  chemically synthesized
aatggggagcttaattacctca

SEQ ID NO: 1208635 - DNA, 22 bp, Artificial Sequence
  chemically synthesized
tcaatggggagcttaattacct

SEQ ID NO: 1208636 - DNA, 22 bp, Artificial Sequence
  chemically synthesized
ttattgacttgaggtaattaag

SEQ ID NO: 1208637 - DNA, 22 bp, Artificial Sequence
  chemically synthesized
ctcaatggggagcttaattacc

SEQ ID NO: 1208638 - DNA, 22 bp, Artificial Sequence
  chemically synthesized
attgacttgaggtaattaagct

SEQ ID NO: 1208639 - DNA, 22 bp, Artificial Sequence
  chemically synthesized
ttgacttgaggtaattaagctc

SEQ ID NO: 1208640 - DNA, 22 bp, Artificial Sequence
  chemically synthesized
acttgaggtaattaagctcccc

SEQ ID NO: 1208641 - DNA, 22 bp, Artificial Sequence
  chemically synthesized
gtggtcttctcaatggggagct

SEQ ID NO: 1208642 - DNA, 22 bp, Artificial Sequence
  chemically synthesized
gaggtaattaagctccccattg

SEQ ID NO: 1208643 - DNA, 22 bp, Artificial Sequence
  chemically synthesized
aggtaattaagctccccattga

SEQ ID NO: 1208644 - DNA, 22 bp, Artificial Sequence
  chemically synthesized
tctggtggtcttctcaatgggg

SEQ ID NO: 1208645 - DNA, 22 bp, Artificial Sequence
  chemically synthesized
agctccccattgagaagaccac

SEQ ID NO: 1208646 - DNA, 22 bp, Artificial Sequence
  chemically synthesized
cccattgagaagaccaccagat

SEQ ID NO: 1208647 - DNA, 22 bp, Artificial Sequence
  chemically synthesized
ataaataaaactatctggtggt

SEQ ID NO: 1208648 - DNA, 22 bp, Artificial Sequence
  chemically synthesized
cataaataaaactatctggtgg

SEQ ID NO: 1208649 - DNA, 22 bp, Artificial Sequence
  chemically synthesized
agaagaccaccagatagtttta

SEQ ID NO: 1208650 - DNA, 22 bp, Artificial Sequence
  chemically synthesized
tcagcttcataaataaaactat

SEQ ID NO: 1208651 - DNA, 22 bp, Artificial Sequence
  chemically synthesized
ggaactatcagcttcataaata

SEQ ID NO: 1208652 - DNA, 22 bp, Artificial Sequence
  chemically synthesized
ccatagttaggaactatcagct

SEQ ID NO: 1208653 - DNA, 22 bp, Artificial Sequence
  chemically synthesized
tgccatagttaggaactatcag

SEQ ID NO: 1208654 - DNA, 22 bp, Artificial Sequence
  chemically synthesized
tatttatgaagctgatagttcc

SEQ ID NO: 1208655 - DNA, 22 bp, Artificial Sequence
  chemically synthesized
atttatgaagctgatagttcct

SEQ ID NO: 1208656 - DNA, 22 bp, Artificial Sequence
  chemically synthesized
tttatgaagctgatagttccta

SEQ ID NO: 1208657 - DNA, 22 bp, Artificial Sequence
  chemically synthesized
tctctgccatagttaggaacta

SEQ ID NO: 1208658 - DNA, 22 bp, Artificial Sequence
  chemically synthesized
atgaagctgatagttcctaact

SEQ ID NO: 1208659 - DNA, 22 bp, Artificial Sequence
  chemically synthesized
tgaagctgatagttcctaacta

SEQ ID NO: 1208660 - DNA, 22 bp, Artificial Sequence
  chemically synthesized
acagcctgtctctgccatagtt

SEQ ID NO: 1208661 - DNA, 22 bp, Artificial Sequence
  chemically synthesized
gacagcctgtctctgccatagt

SEQ ID NO: 1208662 - DNA, 22 bp, Artificial Sequence
  chemically synthesized
atagttcctaactatggcagag

SEQ ID NO: 1208663 - DNA, 22 bp, Artificial Sequence
  chemically synthesized
tttgacagcctgtctctgccat

SEQ ID NO: 1208664 - DNA, 22 bp, Artificial Sequence
  chemically synthesized
ctaactatggcagagacaggct

SEQ ID NO: 1208665 - DNA, 22 bp, Artificial Sequence
  chemically synthesized
actatggcagagacaggctgtc

SEQ ID NO: 1208666 - DNA, 22 bp, Artificial Sequence
  chemically synthesized
tggcagagacaggctgtcaaac

SEQ ID NO: 1208667 - DNA, 22 bp, Artificial Sequence
  chemically synthesized
gagaaaggacatggttgtttga

SEQ ID NO: 1208668 - DNA, 22 bp, Artificial Sequence
  chemically synthesized
aaagctggagaaaggacatggt

SEQ ID NO: 1208669 - DNA, 22 bp, Artificial Sequence
  chemically synthesized
aaaagctggagaaaggacatgg

SEQ ID NO: 1208670 - DNA, 22 bp, Artificial Sequence
  chemically synthesized
taaaagctggagaaaggacatg

SEQ ID NO: 1208671 - DNA, 22 bp, Artificial Sequence
  chemically synthesized
tcaaacaaccatgtcctttctc

SEQ ID NO: 1208672 - DNA, 22 bp, Artificial Sequence
  chemically synthesized
tactttaaaagctggagaaagg

SEQ ID NO: 1208673 - DNA, 22 bp, Artificial Sequence
  chemically synthesized
agtgaaaaatctatactttaaa

SEQ ID NO: 1208674 - DNA, 22 bp, Artificial Sequence
  chemically synthesized
taagtgaaaaatctatacttta

SEQ ID NO: 1208675 - DNA, 22 bp, Artificial Sequence
  chemically synthesized
tctccagcttttaaagtataga

SEQ ID NO: 1208676 - DNA, 22 bp, Artificial Sequence
  chemically synthesized
ctaagtgaaaaatctatacttt

SEQ ID NO: 1208677 - DNA, 22 bp, Artificial Sequence
  chemically synthesized
ctccagcttttaaagtatagat

SEQ ID NO: 1208678 - DNA, 22 bp, Artificial Sequence
  chemically synthesized
tccagcttttaaagtatagatt

SEQ ID NO: 1208679 - DNA, 22 bp, Artificial Sequence
  chemically synthesized
cttctaagtgaaaaatctatac

SEQ ID NO: 1208680 - DNA, 22 bp, Artificial Sequence
  chemically synthesized
cagcttttaaagtatagatttt

SEQ ID NO: 1208681 - DNA, 22 bp, Artificial Sequence
  chemically synthesized
ttaaagtatagatttttcactt

SEQ ID NO: 1208682 - DNA, 22 bp, Artificial Sequence
  chemically synthesized
taaagtatagatttttcactta

SEQ ID NO: 1208683 - DNA, 22 bp, Artificial Sequence
  chemically synthesized
agtggctgcttctaagtgaaaa

SEQ ID NO: 1208684 - DNA, 22 bp, Artificial Sequence
  chemically synthesized
aaagtatagatttttcacttag

SEQ ID NO: 1208685 - DNA, 22 bp, Artificial Sequence
  chemically synthesized
aagtatagatttttcacttaga

SEQ ID NO: 1208686 - DNA, 22 bp, Artificial Sequence
  chemically synthesized
gctgagtggctgcttctaagtg

SEQ ID NO: 1208687 - DNA, 22 bp, Artificial Sequence
  chemically synthesized
ttcacttagaagcagccactca

SEQ ID NO: 1208688 - DNA, 22 bp, Artificial Sequence
  chemically synthesized
tcacttagaagcagccactcag

SEQ ID NO: 1208689 - DNA, 22 bp, Artificial Sequence
  chemically synthesized
cacttagaagcagccactcagc

SEQ ID NO: 1208690 - DNA, 22 bp, Artificial Sequence
  chemically synthesized
acttagaagcagccactcagcc

SEQ ID NO: 1208691 - DNA, 22 bp, Artificial Sequence
  chemically synthesized
agaagcagccactcagccagcc

SEQ ID NO: 1208692 - DNA, 22 bp, Artificial Sequence
  chemically synthesized
gaagcagccactcagccagcca

SEQ ID NO: 1208693 - DNA, 22 bp, Artificial Sequence
  chemically synthesized
caaggataatgcagtggctggc

SEQ ID NO: 1208694 - DNA, 22 bp, Artificial Sequence
  chemically synthesized
tctacaaggataatgcagtggc

SEQ ID NO: 1208695 - DNA, 22 bp, Artificial Sequence
  chemically synthesized
agccagccactgcattatcctt

SEQ ID NO: 1208696 - DNA, 22 bp, Artificial Sequence
  chemically synthesized
cattatccttgtagacaggcat

SEQ ID NO: 1208697 - DNA, 22 bp, Artificial Sequence
  chemically synthesized
tccttgtagacaggcatggcta

SEQ ID NO: 1208698 - DNA, 22 bp, Artificial Sequence
  chemically synthesized
atgaaacatgtatatagccatg

SEQ ID NO: 1208699 - DNA, 22 bp, Artificial Sequence
  chemically synthesized
gtagacaggcatggctatatac

SEQ ID NO: 1208700 - DNA, 22 bp, Artificial Sequence
  chemically synthesized
tagacaggcatggctatataca

SEQ ID NO: 1208701 - DNA, 22 bp, Artificial Sequence
  chemically synthesized
tatacatgtttcatgagcacac

SEQ ID NO: 1208702 - DNA, 22 bp, Artificial Sequence
  chemically synthesized
cacatgaaggggatgtgtgctc

SEQ ID NO: 1208703 - DNA, 22 bp, Artificial Sequence
  chemically synthesized
ccacatgaaggggatgtgtgct

SEQ ID NO: 1208704 - DNA, 22 bp, Artificial Sequence
  chemically synthesized
tccacatgaaggggatgtgtgc

SEQ ID NO: 1208705 - DNA, 22 bp, Artificial Sequence
  chemically synthesized
actttccacatgaaggggatgt

SEQ ID NO: 1208706 - DNA, 22 bp, Artificial Sequence
  chemically synthesized
cactttccacatgaaggggatg

SEQ ID NO: 1208707 - DNA, 22 bp, Artificial Sequence
  chemically synthesized
catgagcacacatccccttcat

SEQ ID NO: 1208708 - DNA, 22 bp, Artificial Sequence
  chemically synthesized
atgagcacacatccccttcatg

SEQ ID NO: 1208709 - DNA, 22 bp, Artificial Sequence
  chemically synthesized
ccttcactttccacatgaaggg

SEQ ID NO: 1208710 - DNA, 22 bp, Artificial Sequence
  chemically synthesized
catgtggaaagtgaagggagca

SEQ ID NO: 1208711 - DNA, 22 bp, Artificial Sequence
  chemically synthesized
atgtggaaagtgaagggagcac

SEQ ID NO: 1208712 - DNA, 22 bp, Artificial Sequence
  chemically synthesized
tggtagaggtgatgcatatgtg

SEQ ID NO: 1208713 - DNA, 22 bp, Artificial Sequence
  chemically synthesized
gtggtagaggtgatgcatatgt

SEQ ID NO: 1208714 - DNA, 22 bp, Artificial Sequence
  chemically synthesized
gaagccttgtggtagaggtgat

SEQ ID NO: 1208715 - DNA, 22 bp, Artificial Sequence
  chemically synthesized
agaagccttgtggtagaggtga

SEQ ID NO: 1208716 - DNA, 22 bp, Artificial Sequence
  chemically synthesized
ttagaagccttgtggtagaggt

SEQ ID NO: 1208717 - DNA, 22 bp, Artificial Sequence
  chemically synthesized
cttagaagccttgtggtagagg

SEQ ID NO: 1208718 - DNA, 22 bp, Artificial Sequence
  chemically synthesized
taccacaaggcttctaagaagt

SEQ ID NO: 1208719 - DNA, 22 bp, Artificial Sequence
  chemically synthesized
ccacaaggcttctaagaagtca

SEQ ID NO: 1208720 - DNA, 22 bp, Artificial Sequence
  chemically synthesized
ctaagaagtcactgtggctttt

SEQ ID NO: 1208721 - DNA, 22 bp, Artificial Sequence
  chemically synthesized
taagaagtcactgtggcttttc

SEQ ID NO: 1208722 - DNA, 22 bp, Artificial Sequence
  chemically synthesized
agaagtcactgtggcttttctg

SEQ ID NO: 1208723 - DNA, 22 bp, Artificial Sequence
  chemically synthesized
aagagggggaagcaaatacaga

SEQ ID NO: 1208724 - DNA, 22 bp, Artificial Sequence
  chemically synthesized
tggcttttctgtatttgcttcc

SEQ ID NO: 1208725 - DNA, 22 bp, Artificial Sequence
  chemically synthesized
ttctgtatttgcttccccctct

SEQ ID NO: 1208726 - DNA, 22 bp, Artificial Sequence
  chemically synthesized
tctgtatttgcttccccctctt

SEQ ID NO: 1208727 - DNA, 22 bp, Artificial Sequence
  chemically synthesized
atatagccattgaagaggggga

SEQ ID NO: 1208728 - DNA, 22 bp, Artificial Sequence
  chemically synthesized
ctgtatttgcttccccctcttc

SEQ ID NO: 1208729 - DNA, 22 bp, Artificial Sequence
  chemically synthesized
catatagccattgaagaggggg

SEQ ID NO: 1208730 - DNA, 22 bp, Artificial Sequence
  chemically synthesized
tgtatttgcttccccctcttca

SEQ ID NO: 1208731 - DNA, 22 bp, Artificial Sequence
  chemically synthesized
tcatatagccattgaagagggg

SEQ ID NO: 1208732 - DNA, 22 bp, Artificial Sequence
  chemically synthesized
ttcatatagccattgaagaggg

SEQ ID NO: 1208733 - DNA, 22 bp, Artificial Sequence
  chemically synthesized
tatttgcttccccctcttcaat

SEQ ID NO: 1208734 - DNA, 22 bp, Artificial Sequence
  chemically synthesized
tttcatatagccattgaagagg

SEQ ID NO: 1208735 - DNA, 22 bp, Artificial Sequence
  chemically synthesized
ttttttcatatagccattgaag

SEQ ID NO: 1208736 - DNA, 22 bp, Artificial Sequence
  chemically synthesized
gttttttcatatagccattgaa

SEQ ID NO: 1208737 - DNA, 22 bp, Artificial Sequence
  chemically synthesized
gcttccccctcttcaatggcta

SEQ ID NO: 1208738 - DNA, 22 bp, Artificial Sequence
  chemically synthesized
tgttttttcatatagccattga

SEQ ID NO: 1208739 - DNA, 22 bp, Artificial Sequence
  chemically synthesized
cttccccctcttcaatggctat

SEQ ID NO: 1208740 - DNA, 22 bp, Artificial Sequence
  chemically synthesized
ttgttttttcatatagccattg

SEQ ID NO: 1208741 - DNA, 22 bp, Artificial Sequence
  chemically synthesized
tttgttttttcatatagccatt

SEQ ID NO: 1208742 - DNA, 22 bp, Artificial Sequence
  chemically synthesized
ttttgttttttcatatagccat

SEQ ID NO: 1208743 - DNA, 22 bp, Artificial Sequence
  chemically synthesized
ccccctcttcaatggctatatg

SEQ ID NO: 1208744 - DNA, 22 bp, Artificial Sequence
  chemically synthesized
cccctcttcaatggctatatga

SEQ ID NO: 1208745 - DNA, 22 bp, Artificial Sequence
  chemically synthesized
tttttttgttttttcatatagc

SEQ ID NO: 1208746 - DNA, 22 bp, Artificial Sequence
  chemically synthesized
gtttttttgttttttcatatag

SEQ ID NO: 1208747 - DNA, 22 bp, Artificial Sequence
  chemically synthesized
tgtttttttgttttttcatata

SEQ ID NO: 1208748 - DNA, 22 bp, Artificial Sequence
  chemically synthesized
ttgtttttttgttttttcatat

SEQ ID NO: 1208749 - DNA, 22 bp, Artificial Sequence
  chemically synthesized
tttgtttttttgttttttcata

SEQ ID NO: 1208750 - DNA, 22 bp, Artificial Sequence
  chemically synthesized
ttcaatggctatatgaaaaaac

SEQ ID NO: 1208751 - DNA, 22 bp, Artificial Sequence
  chemically synthesized
caatggctatatgaaaaaacaa

SEQ ID NO: 1208752 - DNA, 22 bp, Artificial Sequence
  chemically synthesized
aatggctatatgaaaaaacaaa

SEQ ID NO: 1208753 - DNA, 22 bp, Artificial Sequence
  chemically synthesized
tatgaaaaaacaaaaaaacaaa

SEQ ID NO: 1208754 - DNA, 22 bp, Artificial Sequence
  chemically synthesized
acagatgatgatgttttttgtt

SEQ ID NO: 1208755 - DNA, 22 bp, Artificial Sequence
  chemically synthesized
cacagatgatgatgttttttgt

SEQ ID NO: 1208756 - DNA, 22 bp, Artificial Sequence
  chemically synthesized
ttcacagatgatgatgtttttt

SEQ ID NO: 1208757 - DNA, 22 bp, Artificial Sequence
  chemically synthesized
cttcacagatgatgatgttttt

SEQ ID NO: 1208758 - DNA, 22 bp, Artificial Sequence
  chemically synthesized
ccttcttcacagatgatgatgt

SEQ ID NO: 1208759 - DNA, 22 bp, Artificial Sequence
  chemically synthesized
taccttcttcacagatgatgat

SEQ ID NO: 1208760 - DNA, 22 bp, Artificial Sequence
  chemically synthesized
tggctctaccttcttcacagat

SEQ ID NO: 1208761 - DNA, 22 bp, Artificial Sequence
  chemically synthesized
ttgtggctctaccttcttcaca

SEQ ID NO: 1208762 - DNA, 22 bp, Artificial Sequence
  chemically synthesized
gttgtggctctaccttcttcac

SEQ ID NO: 1208763 - DNA, 22 bp, Artificial Sequence
  chemically synthesized
tgttgtggctctaccttcttca

SEQ ID NO: 1208764 - DNA, 22 bp, Artificial Sequence
  chemically synthesized
cctttgttgtggctctaccttc

SEQ ID NO: 1208765 - DNA, 22 bp, Artificial Sequence
  chemically synthesized
tgcctttgttgtggctctacct

SEQ ID NO: 1208766 - DNA, 22 bp, Artificial Sequence
  chemically synthesized
ctgcctttgttgtggctctacc

SEQ ID NO: 1208767 - DNA, 22 bp, Artificial Sequence
  chemically synthesized
tctgcctttgttgtggctctac

SEQ ID NO: 1208768 - DNA, 22 bp, Artificial Sequence
  chemically synthesized
ttctgcctttgttgtggctcta

SEQ ID NO: 1208769 - DNA, 22 bp, Artificial Sequence
  chemically synthesized
tgaagaaggtagagccacaaca

SEQ ID NO: 1208770 - DNA, 22 bp, Artificial Sequence
  chemically synthesized
tatttttctgcctttgttgtgg

SEQ ID NO: 1208771 - DNA, 22 bp, Artificial Sequence
  chemically synthesized
tatatttttctgcctttgttgt

SEQ ID NO: 1208772 - DNA, 22 bp, Artificial Sequence
  chemically synthesized
ctatatttttctgcctttgttg

SEQ ID NO: 1208773 - DNA, 22 bp, Artificial Sequence
  chemically synthesized
tctatatttttctgcctttgtt

SEQ ID NO: 1208774 - DNA, 22 bp, Artificial Sequence
  chemically synthesized
ttctatatttttctgcctttgt

SEQ ID NO: 1208775 - DNA, 22 bp, Artificial Sequence
  chemically synthesized
atatttttctatatttttctgc

SEQ ID NO: 1208776 - DNA, 22 bp, Artificial Sequence
  chemically synthesized
cagtgactaatatttttctata

SEQ ID NO: 1208777 - DNA, 22 bp, Artificial Sequence
  chemically synthesized
attacagtgactaatatttttc

SEQ ID NO: 1208778 - DNA, 22 bp, Artificial Sequence
  chemically synthesized
tcagcagtgtgaaaatggacta

SEQ ID NO: 1208779 - DNA, 22 bp, Artificial Sequence
  chemically synthesized
gtcactgtaattagtccatttt

SEQ ID NO: 1208780 - DNA, 22 bp, Artificial Sequence
  chemically synthesized
atcagcagtgtgaaaatggact

SEQ ID NO: 1208781 - DNA, 22 bp, Artificial Sequence
  chemically synthesized
taattagtccattttcacactg

SEQ ID NO: 1208782 - DNA, 22 bp, Artificial Sequence
  chemically synthesized
ggcaggtatttatcagcagtgt

SEQ ID NO: 1208783 - DNA, 22 bp, Artificial Sequence
  chemically synthesized
gtccattttcacactgctgata

SEQ ID NO: 1208784 - DNA, 22 bp, Artificial Sequence
  chemically synthesized
tcacactgctgataaatacctg

SEQ ID NO: 1208785 - DNA, 22 bp, Artificial Sequence
  chemically synthesized
cacactgctgataaatacctgc

SEQ ID NO: 1208786 - DNA, 22 bp, Artificial Sequence
  chemically synthesized
acactgctgataaatacctgcc

SEQ ID NO: 1208787 - DNA, 22 bp, Artificial Sequence
  chemically synthesized
taaatcgtccagtctcggcagg

SEQ ID NO: 1208788 - DNA, 22 bp, Artificial Sequence
  chemically synthesized
gtaaatcgtccagtctcggcag

SEQ ID NO: 1208789 - DNA, 22 bp, Artificial Sequence
  chemically synthesized
ctgataaatacctgccgagact

SEQ ID NO: 1208790 - DNA, 22 bp, Artificial Sequence
  chemically synthesized
tgtaaatcgtccagtctcggca

SEQ ID NO: 1208791 - DNA, 22 bp, Artificial Sequence
  chemically synthesized
ttgtaaatcgtccagtctcggc

SEQ ID NO: 1208792 - DNA, 22 bp, Artificial Sequence
  chemically synthesized
ataaatacctgccgagactgga

SEQ ID NO: 1208793 - DNA, 22 bp, Artificial Sequence
  chemically synthesized
ttttgtaaatcgtccagtctcg

SEQ ID NO: 1208794 - DNA, 22 bp, Artificial Sequence
  chemically synthesized
cttttgtaaatcgtccagtctc

SEQ ID NO: 1208795 - DNA, 22 bp, Artificial Sequence
  chemically synthesized
tcttttgtaaatcgtccagtct

SEQ ID NO: 1208796 - DNA, 22 bp, Artificial Sequence
  chemically synthesized
aacgtctttcttttgtaaatcg

SEQ ID NO: 1208797 - DNA, 22 bp, Artificial Sequence
  chemically synthesized
ccgagactggacgatttacaaa

SEQ ID NO: 1208798 - DNA, 22 bp, Artificial Sequence
  chemically synthesized
gacgatttacaaaagaaagacg

SEQ ID NO: 1208799 - DNA, 22 bp, Artificial Sequence
  chemically synthesized
acaaaagaaagacgtttaattc

SEQ ID NO: 1208800 - DNA, 22 bp, Artificial Sequence
  chemically synthesized
caaaagaaagacgtttaattca

SEQ ID NO: 1208801 - DNA, 22 bp, Artificial Sequence
  chemically synthesized
aattcatttacggttccacgtg

SEQ ID NO: 1208802 - DNA, 22 bp, Artificial Sequence
  chemically synthesized
attcatttacggttccacgtgg

SEQ ID NO: 1208803 - DNA, 22 bp, Artificial Sequence
  chemically synthesized
tgaggccaccccagccacgtgg

SEQ ID NO: 1208804 - DNA, 22 bp, Artificial Sequence
  chemically synthesized
atttacggttccacgtggctgg

SEQ ID NO: 1208805 - DNA, 22 bp, Artificial Sequence
  chemically synthesized
acggttccacgtggctggggtg

SEQ ID NO: 1208806 - DNA, 22 bp, Artificial Sequence
  chemically synthesized
cggttccacgtggctggggtgg

SEQ ID NO: 1208807 - DNA, 22 bp, Artificial Sequence
  chemically synthesized
ccatgattgtgaggccacccca

SEQ ID NO: 1208808 - DNA, 22 bp, Artificial Sequence
  chemically synthesized
tgccatgattgtgaggccaccc

SEQ ID NO: 1208809 - DNA, 22 bp, Artificial Sequence
  chemically synthesized
cacgtggctggggtggcctcac

SEQ ID NO: 1208810 - DNA, 22 bp, Artificial Sequence
  chemically synthesized
gcattctgccatgattgtgagg

SEQ ID NO: 1208811 - DNA, 22 bp, Artificial Sequence
  chemically synthesized
cgcattctgccatgattgtgag

SEQ ID NO: 1208812 - DNA, 22 bp, Artificial Sequence
  chemically synthesized
tcgcattctgccatgattgtga

SEQ ID NO: 1208813 - DNA, 22 bp, Artificial Sequence
  chemically synthesized
gggtggcctcacaatcatggca

SEQ ID NO: 1208814 - DNA, 22 bp, Artificial Sequence
  chemically synthesized
acaatcatggcagaatgcgaaa

SEQ ID NO: 1208815 - DNA, 22 bp, Artificial Sequence
  chemically synthesized
ccaccatgtgagacatgccttt

SEQ ID NO: 1208816 - DNA, 22 bp, Artificial Sequence
  chemically synthesized
gtctgccaccatgtgagacatg

SEQ ID NO: 1208817 - DNA, 22 bp, Artificial Sequence
  chemically synthesized
tcgtctgccaccatgtgagaca

SEQ ID NO: 1208818 - DNA, 22 bp, Artificial Sequence
  chemically synthesized
ctcgtctgccaccatgtgagac

SEQ ID NO: 1208819 - DNA, 22 bp, Artificial Sequence
  chemically synthesized
ccttctcgtctgccaccatgtg

SEQ ID NO: 1208820 - DNA, 22 bp, Artificial Sequence
  chemically synthesized
cacaagttaccttctcgtctgc

SEQ ID NO: 1208821 - DNA, 22 bp, Artificial Sequence
  chemically synthesized
gcacaagttaccttctcgtctg

SEQ ID NO: 1208822 - DNA, 22 bp, Artificial Sequence
  chemically synthesized
acatggtggcagacgagaaggt

SEQ ID NO: 1208823 - DNA, 22 bp, Artificial Sequence
  chemically synthesized
cttgcacaagttaccttctcgt

SEQ ID NO: 1208824 - DNA, 22 bp, Artificial Sequence
  chemically synthesized
ataagggggagactccttgcac

SEQ ID NO: 1208825 - DNA, 22 bp, Artificial Sequence
  chemically synthesized
cataagggggagactccttgca

SEQ ID NO: 1208826 - DNA, 22 bp, Artificial Sequence
  chemically synthesized
atggcttcataagggggagact

SEQ ID NO: 1208827 - DNA, 22 bp, Artificial Sequence
  chemically synthesized
gtgcaaggagtctcccccttat

SEQ ID NO: 1208828 - DNA, 22 bp, Artificial Sequence
  chemically synthesized
tgcaaggagtctcccccttatg

SEQ ID NO: 1208829 - DNA, 22 bp, Artificial Sequence
  chemically synthesized
gtgagatctgatggcttcataa

SEQ ID NO: 1208830 - DNA, 22 bp, Artificial Sequence
  chemically synthesized
ccccttatgaagccatcagatc

SEQ ID NO: 1208831 - DNA, 22 bp, Artificial Sequence
  chemically synthesized
atgaagccatcagatctcacga

SEQ ID NO: 1208832 - DNA, 22 bp, Artificial Sequence
  chemically synthesized
tgaagccatcagatctcacgag

SEQ ID NO: 1208833 - DNA, 22 bp, Artificial Sequence
  chemically synthesized
atagtggtaagtctcgtgagat

SEQ ID NO: 1208834 - DNA, 22 bp, Artificial Sequence
  chemically synthesized
gatagtggtaagtctcgtgaga

SEQ ID NO: 1208835 - DNA, 22 bp, Artificial Sequence
  chemically synthesized
ttgatagtggtaagtctcgtga

SEQ ID NO: 1208836 - DNA, 22 bp, Artificial Sequence
  chemically synthesized
cttgatagtggtaagtctcgtg

SEQ ID NO: 1208837 - DNA, 22 bp, Artificial Sequence
  chemically synthesized
tcttgatagtggtaagtctcgt

SEQ ID NO: 1208838 - DNA, 22 bp, Artificial Sequence
  chemically synthesized
ttttcttgatagtggtaagtct

SEQ ID NO: 1208839 - DNA, 22 bp, Artificial Sequence
  chemically synthesized
ccgtgctgttttcttgatagtg

SEQ ID NO: 1208840 - DNA, 22 bp, Artificial Sequence
  chemically synthesized
acgagacttaccactatcaaga

SEQ ID NO: 1208841 - DNA, 22 bp, Artificial Sequence
  chemically synthesized
cccgtgctgttttcttgatagt

SEQ ID NO: 1208842 - DNA, 22 bp, Artificial Sequence
  chemically synthesized
tcccgtgctgttttcttgatag

SEQ ID NO: 1208843 - DNA, 22 bp, Artificial Sequence
  chemically synthesized
accactatcaagaaaacagcac

SEQ ID NO: 1208844 - DNA, 22 bp, Artificial Sequence
  chemically synthesized
ccactatcaagaaaacagcacg

SEQ ID NO: 1208845 - DNA, 22 bp, Artificial Sequence
  chemically synthesized
tcaagaaaacagcacgggaaag

SEQ ID NO: 1208846 - DNA, 22 bp, Artificial Sequence
  chemically synthesized
aatcatgggggcaggtctttcc

SEQ ID NO: 1208847 - DNA, 22 bp, Artificial Sequence
  chemically synthesized
cccccatgattcaattacctcc

SEQ ID NO: 1208848 - DNA, 22 bp, Artificial Sequence
  chemically synthesized
ggagtggcccagtgggaggtaa

SEQ ID NO: 1208849 - DNA, 22 bp, Artificial Sequence
  chemically synthesized
tgggagtggcccagtgggaggt

SEQ ID NO: 1208850 - DNA, 22 bp, Artificial Sequence
  chemically synthesized
aattacctcccactgggccact

SEQ ID NO: 1208851 - DNA, 22 bp, Artificial Sequence
  chemically synthesized
ccacgtgttctgggagtggccc

SEQ ID NO: 1208852 - DNA, 22 bp, Artificial Sequence
  chemically synthesized
cctcccactgggccactcccag

SEQ ID NO: 1208853 - DNA, 22 bp, Artificial Sequence
  chemically synthesized
aattcccacgtgttctgggagt

SEQ ID NO: 1208854 - DNA, 22 bp, Artificial Sequence
  chemically synthesized
gaattcccacgtgttctgggag

SEQ ID NO: 1208855 - DNA, 22 bp, Artificial Sequence
  chemically synthesized
ccactgggccactcccagaaca

SEQ ID NO: 1208856 - DNA, 22 bp, Artificial Sequence
  chemically synthesized
catcttgaattcccacgtgttc

SEQ ID NO: 1208857 - DNA, 22 bp, Artificial Sequence
  chemically synthesized
ggccactcccagaacacgtggg

SEQ ID NO: 1208858 - DNA, 22 bp, Artificial Sequence
  chemically synthesized
ccagaacacgtgggaattcaag

SEQ ID NO: 1208859 - DNA, 22 bp, Artificial Sequence
  chemically synthesized
tgtccccacccaaattgcatct

SEQ ID NO: 1208860 - DNA, 22 bp, Artificial Sequence
  chemically synthesized
gctgtgtccccacccaaattgc

SEQ ID NO: 1208861 - DNA, 22 bp, Artificial Sequence
  chemically synthesized
ggctgtgtccccacccaaattg

SEQ ID NO: 1208862 - DNA, 22 bp, Artificial Sequence
  chemically synthesized
aagatgcaatttgggtggggac

SEQ ID NO: 1208863 - DNA, 22 bp, Artificial Sequence
  chemically synthesized
atatggtttggctgtgtcccca

SEQ ID NO: 1208864 - DNA, 22 bp, Artificial Sequence
  chemically synthesized
gtgactgatatggtttggctgt

SEQ ID NO: 1208865 - DNA, 22 bp, Artificial Sequence
  chemically synthesized
gggtggggacacagccaaacca

SEQ ID NO: 1208866 - DNA, 22 bp, Artificial Sequence
  chemically synthesized
ggtggggacacagccaaaccat

SEQ ID NO: 1208867 - DNA, 22 bp, Artificial Sequence
  chemically synthesized
ttggtgactgatatggtttggc

SEQ ID NO: 1208868 - DNA, 22 bp, Artificial Sequence
  chemically synthesized
attggtgactgatatggtttgg

SEQ ID NO: 1208869 - DNA, 22 bp, Artificial Sequence
  chemically synthesized
cttattggtgactgatatggtt

SEQ ID NO: 1208870 - DNA, 22 bp, Artificial Sequence
  chemically synthesized
tatgtagcccaggtataagtcc

SEQ ID NO: 1208871 - DNA, 22 bp, Artificial Sequence
  chemically synthesized
atatgtagcccaggtataagtc

SEQ ID NO: 1208872 - DNA, 22 bp, Artificial Sequence
  chemically synthesized
cattggacttatacctgggcta

SEQ ID NO: 1208873 - DNA, 22 bp, Artificial Sequence
  chemically synthesized
gacttatacctgggctacatat

SEQ ID NO: 1208874 - DNA, 22 bp, Artificial Sequence
  chemically synthesized
aaacaatagtttatatgtagcc

SEQ ID NO: 1208875 - DNA, 22 bp, Artificial Sequence
  chemically synthesized
aaaacaatagtttatatgtagc

SEQ ID NO: 1208876 - DNA, 22 bp, Artificial Sequence
  chemically synthesized
atacctgggctacatataaact

SEQ ID NO: 1208877 - DNA, 22 bp, Artificial Sequence
  chemically synthesized
tacctgggctacatataaacta

SEQ ID NO: 1208878 - DNA, 22 bp, Artificial Sequence
  chemically synthesized
ggctacatataaactattgttt

SEQ ID NO: 1208879 - DNA, 22 bp, Artificial Sequence
  chemically synthesized
catataaactattgttttaagc

SEQ ID NO: 1208880 - DNA, 22 bp, Artificial Sequence
  chemically synthesized
ttgttttaagctcctttctatt

SEQ ID NO: 1208881 - DNA, 22 bp, Artificial Sequence
  chemically synthesized
ttttaagctcctttctattttg

SEQ ID NO: 1208882 - DNA, 22 bp, Artificial Sequence
  chemically synthesized
acacataagtgccaaaatagaa

SEQ ID NO: 1208883 - DNA, 22 bp, Artificial Sequence
  chemically synthesized
aacacataagtgccaaaataga

SEQ ID NO: 1208884 - DNA, 22 bp, Artificial Sequence
  chemically synthesized
taacacataagtgccaaaatag

SEQ ID NO: 1208885 - DNA, 22 bp, Artificial Sequence
  chemically synthesized
taagctcctttctattttggca

SEQ ID NO: 1208886 - DNA, 22 bp, Artificial Sequence
  chemically synthesized
aagctcctttctattttggcac

SEQ ID NO: 1208887 - DNA, 22 bp, Artificial Sequence
  chemically synthesized
agctcctttctattttggcact

SEQ ID NO: 1208888 - DNA, 22 bp, Artificial Sequence
  chemically synthesized
ctttaacacataagtgccaaaa

SEQ ID NO: 1208889 - DNA, 22 bp, Artificial Sequence
  chemically synthesized
ctgctttaacacataagtgcca

SEQ ID NO: 1208890 - DNA, 22 bp, Artificial Sequence
  chemically synthesized
gctgctttaacacataagtgcc

SEQ ID NO: 1208891 - DNA, 22 bp, Artificial Sequence
  chemically synthesized
ctttctattttggcacttatgt

SEQ ID NO: 1208892 - DNA, 22 bp, Artificial Sequence
  chemically synthesized
tctattttggcacttatgtgtt

SEQ ID NO: 1208893 - DNA, 22 bp, Artificial Sequence
  chemically synthesized
ctattttggcacttatgtgtta

SEQ ID NO: 1208894 - DNA, 22 bp, Artificial Sequence
  chemically synthesized
tattttggcacttatgtgttaa

SEQ ID NO: 1208895 - DNA, 22 bp, Artificial Sequence
  chemically synthesized
ttttggcacttatgtgttaaag

SEQ ID NO: 1208896 - DNA, 22 bp, Artificial Sequence
  chemically synthesized
aacaaccttgctgctttaacac

SEQ ID NO: 1208897 - DNA, 22 bp, Artificial Sequence
  chemically synthesized
tggcacttatgtgttaaagcag

SEQ ID NO: 1208898 - DNA, 22 bp, Artificial Sequence
  chemically synthesized
ggcacttatgtgttaaagcagc

SEQ ID NO: 1208899 - DNA, 22 bp, Artificial Sequence
  chemically synthesized
gcacttatgtgttaaagcagca

SEQ ID NO: 1208900 - DNA, 22 bp, Artificial Sequence
  chemically synthesized
gctaaacaaccttgctgcttta

SEQ ID NO: 1208901 - DNA, 22 bp, Artificial Sequence
  chemically synthesized
aattagctaaacaaccttgctg

SEQ ID NO: 1208902 - DNA, 22 bp, Artificial Sequence
  chemically synthesized
atgtgttaaagcagcaaggttg

SEQ ID NO: 1208903 - DNA, 22 bp, Artificial Sequence
  chemically synthesized
tgtgttaaagcagcaaggttgt

SEQ ID NO: 1208904 - DNA, 22 bp, Artificial Sequence
  chemically synthesized
aagcagcaaggttgtttagcta

SEQ ID NO: 1208905 - DNA, 22 bp, Artificial Sequence
  chemically synthesized
gtgtcactgaattagctaaaca

SEQ ID NO: 1208906 - DNA, 22 bp, Artificial Sequence
  chemically synthesized
tttagctaattcagtgacacga

SEQ ID NO: 1208907 - DNA, 22 bp, Artificial Sequence
  chemically synthesized
agctaattcagtgacacgagat

SEQ ID NO: 1208908 - DNA, 22 bp, Artificial Sequence
  chemically synthesized
gctaattcagtgacacgagatc

SEQ ID NO: 1208909 - DNA, 22 bp, Artificial Sequence
  chemically synthesized
attcagtgacacgagatcacac

SEQ ID NO: 1208910 - DNA, 22 bp, Artificial Sequence
  chemically synthesized
agtgacacgagatcacactttg

SEQ ID NO: 1208911 - DNA, 22 bp, Artificial Sequence
  chemically synthesized
aatcatcagaaacaaagtgtga

SEQ ID NO: 1208912 - DNA, 22 bp, Artificial Sequence
  chemically synthesized
aaatcatcagaaacaaagtgtg

SEQ ID NO: 1208913 - DNA, 22 bp, Artificial Sequence
  chemically synthesized
tttaaatcatcagaaacaaagt

SEQ ID NO: 1208914 - DNA, 22 bp, Artificial Sequence
  chemically synthesized
atttaaatcatcagaaacaaag

SEQ ID NO: 1208915 - DNA, 22 bp, Artificial Sequence
  chemically synthesized
ttatttaaatcatcagaaacaa

SEQ ID NO: 1208916 - DNA, 22 bp, Artificial Sequence
  chemically synthesized
attcttatttaaatcatcagaa

SEQ ID NO: 1208917 - DNA, 22 bp, Artificial Sequence
  chemically synthesized
ttaattcttatttaaatcatca

SEQ ID NO: 1208918 - DNA, 22 bp, Artificial Sequence
  chemically synthesized
tattaattcttatttaaatcat

SEQ ID NO: 1208919 - DNA, 22 bp, Artificial Sequence
  chemically synthesized
tgtttctgatgatttaaataag

SEQ ID NO: 1208920 - DNA, 22 bp, Artificial Sequence
  chemically synthesized
gtttctgatgatttaaataaga

SEQ ID NO: 1208921 - DNA, 22 bp, Artificial Sequence
  chemically synthesized
aattctattaattcttatttaa

SEQ ID NO: 1208922 - DNA, 22 bp, Artificial Sequence
  chemically synthesized
tttctgatgatttaaataagaa

SEQ ID NO: 1208923 - DNA, 22 bp, Artificial Sequence
  chemically synthesized
ctgatgatttaaataagaatta

SEQ ID NO: 1208924 - DNA, 22 bp, Artificial Sequence
  chemically synthesized
tgatgatttaaataagaattaa

SEQ ID NO: 1208925 - DNA, 22 bp, Artificial Sequence
  chemically synthesized
atgatttaaataagaattaata

SEQ ID NO: 1208926 - DNA, 22 bp, Artificial Sequence
  chemically synthesized
gtgcaactgaattctattaatt

SEQ ID NO: 1208927 - DNA, 22 bp, Artificial Sequence
  chemically synthesized
aaataagaattaatagaattca

SEQ ID NO: 1208928 - DNA, 22 bp, Artificial Sequence
  chemically synthesized
aataagaattaatagaattcag

SEQ ID NO: 1208929 - DNA, 22 bp, Artificial Sequence
  chemically synthesized
atggcctggtgcaactgaattc

SEQ ID NO: 1208930 - DNA, 22 bp, Artificial Sequence
  chemically synthesized
gatggcctggtgcaactgaatt

SEQ ID NO: 1208931 - DNA, 22 bp, Artificial Sequence
  chemically synthesized
gtcttgatggcctggtgcaact

SEQ ID NO: 1208932 - DNA, 22 bp, Artificial Sequence
  chemically synthesized
atagaattcagttgcaccaggc

SEQ ID NO: 1208933 - DNA, 22 bp, Artificial Sequence
  chemically synthesized
agttgcaccaggccatcaagac

SEQ ID NO: 1208934 - DNA, 22 bp, Artificial Sequence
  chemically synthesized
caagggcatgattagtcttgat

SEQ ID NO: 1208935 - DNA, 22 bp, Artificial Sequence
  chemically synthesized
ccaagggcatgattagtcttga

SEQ ID NO: 1208936 - DNA, 22 bp, Artificial Sequence
  chemically synthesized
tccaagggcatgattagtcttg

SEQ ID NO: 1208937 - DNA, 22 bp, Artificial Sequence
  chemically synthesized
caccaggccatcaagactaatc

SEQ ID NO: 1208938 - DNA, 22 bp, Artificial Sequence
  chemically synthesized
tatctttccaagggcatgatta

SEQ ID NO: 1208939 - DNA, 22 bp, Artificial Sequence
  chemically synthesized
atatctttccaagggcatgatt

SEQ ID NO: 1208940 - DNA, 22 bp, Artificial Sequence
  chemically synthesized
ttatatctttccaagggcatga

SEQ ID NO: 1208941 - DNA, 22 bp, Artificial Sequence
  chemically synthesized
ctcttatatctttccaagggca

SEQ ID NO: 1208942 - DNA, 22 bp, Artificial Sequence
  chemically synthesized
atctgctcttatatctttccaa

SEQ ID NO: 1208943 - DNA, 22 bp, Artificial Sequence
  chemically synthesized
atcatgcccttggaaagatata

SEQ ID NO: 1208944 - DNA, 22 bp, Artificial Sequence
  chemically synthesized
ttcatctgctcttatatctttc

SEQ ID NO: 1208945 - DNA, 22 bp, Artificial Sequence
  chemically synthesized
ggaaagatataagagcagatga

SEQ ID NO: 1208946 - DNA, 22 bp, Artificial Sequence
  chemically synthesized
gaaagatataagagcagatgaa

SEQ ID NO: 1208947 - DNA, 22 bp, Artificial Sequence
  chemically synthesized
aggtgacacagaaaaattattc

SEQ ID NO: 1208948 - DNA, 22 bp, Artificial Sequence
  chemically synthesized
gaggtgacacagaaaaattatt

SEQ ID NO: 1208949 - DNA, 22 bp, Artificial Sequence
  chemically synthesized
tagtaccacagaatttgaggtg

SEQ ID NO: 1208950 - DNA, 22 bp, Artificial Sequence
  chemically synthesized
ttctgtgtcacctcaaattctg

SEQ ID NO: 1208951 - DNA, 22 bp, Artificial Sequence
  chemically synthesized
tctgtgtcacctcaaattctgt

SEQ ID NO: 1208952 - DNA, 22 bp, Artificial Sequence
  chemically synthesized
ctgtgtcacctcaaattctgtg

SEQ ID NO: 1208953 - DNA, 22 bp, Artificial Sequence
  chemically synthesized
tgtgtcacctcaaattctgtgg

SEQ ID NO: 1208954 - DNA, 22 bp, Artificial Sequence
  chemically synthesized
taagctgtagtaccacagaatt

SEQ ID NO: 1208955 - DNA, 22 bp, Artificial Sequence
  chemically synthesized
tgtcacctcaaattctgtggta

SEQ ID NO: 1208956 - DNA, 22 bp, Artificial Sequence
  chemically synthesized
gctataagctgtagtaccacag

SEQ ID NO: 1208957 - DNA, 22 bp, Artificial Sequence
  chemically synthesized
ggctataagctgtagtaccaca

SEQ ID NO: 1208958 - DNA, 22 bp, Artificial Sequence
  chemically synthesized
aaattctgtggtactacagctt

SEQ ID NO: 1208959 - DNA, 22 bp, Artificial Sequence
  chemically synthesized
tgtggtactacagcttatagcc

SEQ ID NO: 1208960 - DNA, 22 bp, Artificial Sequence
  chemically synthesized
gaatatatcacttggctataag

SEQ ID NO: 1208961 - DNA, 22 bp, Artificial Sequence
  chemically synthesized
tggtactacagcttatagccaa

SEQ ID NO: 1208962 - DNA, 22 bp, Artificial Sequence
  chemically synthesized
cagcttatagccaagtgatata

SEQ ID NO: 1208963 - DNA, 22 bp, Artificial Sequence
  chemically synthesized
ataaaactagaatatatcactt

SEQ ID NO: 1208964 - DNA, 22 bp, Artificial Sequence
  chemically synthesized
ctaataaaactagaatatatca

SEQ ID NO: 1208965 - DNA, 22 bp, Artificial Sequence
  chemically synthesized
actaataaaactagaatatatc

SEQ ID NO: 1208966 - DNA, 22 bp, Artificial Sequence
  chemically synthesized
atagccaagtgatatattctag

SEQ ID NO: 1208967 - DNA, 22 bp, Artificial Sequence
  chemically synthesized
tagccaagtgatatattctagt

SEQ ID NO: 1208968 - DNA, 22 bp, Artificial Sequence
  chemically synthesized
aatttactaataaaactagaat

SEQ ID NO: 1208969 - DNA, 22 bp, Artificial Sequence
  chemically synthesized
ctcaatttactaataaaactag

SEQ ID NO: 1208970 - DNA, 22 bp, Artificial Sequence
  chemically synthesized
actcaatttactaataaaacta

SEQ ID NO: 1208971 - DNA, 22 bp, Artificial Sequence
  chemically synthesized
tagttttattagtaaattgagt

SEQ ID NO: 1208972 - DNA, 22 bp, Artificial Sequence
  chemically synthesized
gatagtaatgtttactcaattt

SEQ ID NO: 1208973 - DNA, 22 bp, Artificial Sequence
  chemically synthesized
gttttattagtaaattgagtaa

SEQ ID NO: 1208974 - DNA, 22 bp, Artificial Sequence
  chemically synthesized
ctggatagtaatgtttactcaa

SEQ ID NO: 1208975 - DNA, 22 bp, Artificial Sequence
  chemically synthesized
cctggatagtaatgtttactca

SEQ ID NO: 1208976 - DNA, 22 bp, Artificial Sequence
  chemically synthesized
tattagtaaattgagtaaacat

SEQ ID NO: 1208977 - DNA, 22 bp, Artificial Sequence
  chemically synthesized
tcctggatagtaatgtttactc

SEQ ID NO: 1208978 - DNA, 22 bp, Artificial Sequence
  chemically synthesized
attagtaaattgagtaaacatt

SEQ ID NO: 1208979 - DNA, 22 bp, Artificial Sequence
  chemically synthesized
ttcctggatagtaatgtttact

SEQ ID NO: 1208980 - DNA, 22 bp, Artificial Sequence
  chemically synthesized
ttagtaaattgagtaaacatta

SEQ ID NO: 1208981 - DNA, 22 bp, Artificial Sequence
  chemically synthesized
gtaaattgagtaaacattacta

SEQ ID NO: 1208982 - DNA, 22 bp, Artificial Sequence
  chemically synthesized
gtttttcctggatagtaatgtt

SEQ ID NO: 1208983 - DNA, 22 bp, Artificial Sequence
  chemically synthesized
tggtttttcctggatagtaatg

SEQ ID NO: 1208984 - DNA, 22 bp, Artificial Sequence
  chemically synthesized
ctggtttttcctggatagtaat

SEQ ID NO: 1208985 - DNA, 22 bp, Artificial Sequence
  chemically synthesized
tctggtttttcctggatagtaa

SEQ ID NO: 1208986 - DNA, 22 bp, Artificial Sequence
  chemically synthesized
ttctggtttttcctggatagta

SEQ ID NO: 1208987 - DNA, 22 bp, Artificial Sequence
  chemically synthesized
tttctggtttttcctggatagt

SEQ ID NO: 1208988 - DNA, 22 bp, Artificial Sequence
  chemically synthesized
ttttctggtttttcctggatag

SEQ ID NO: 1208989 - DNA, 22 bp, Artificial Sequence
  chemically synthesized
agtaaacattactatccaggaa

SEQ ID NO: 1208990 - DNA, 22 bp, Artificial Sequence
  chemically synthesized
tttttctggtttttcctggata

SEQ ID NO: 1208991 - DNA, 22 bp, Artificial Sequence
  chemically synthesized
ttttttctggtttttcctggat

SEQ ID NO: 1208992 - DNA, 22 bp, Artificial Sequence
  chemically synthesized
tttttttctggtttttcctgga

SEQ ID NO: 1208993 - DNA, 22 bp, Artificial Sequence
  chemically synthesized
ttttttttctggtttttcctgg

SEQ ID NO: 1208994 - DNA, 22 bp, Artificial Sequence
  chemically synthesized
tttttttttctggtttttcctg

SEQ ID NO: 1208995 - DNA, 22 bp, Artificial Sequence
  chemically synthesized
ttttttttttctggtttttcct

SEQ ID NO: 1208996 - DNA, 22 bp, Artificial Sequence
  chemically synthesized
tttttttttttttctggttttt

SEQ ID NO: 1208997 - DNA, 22 bp, Artificial Sequence
  chemically synthesized
ctatccaggaaaaaccagaaaa

SEQ ID NO: 1208998 - DNA, 22 bp, Artificial Sequence
  chemically synthesized
ctgtttttttttttttctggtt

SEQ ID NO: 1208999 - DNA, 22 bp, Artificial Sequence
  chemically synthesized
tccaggaaaaaccagaaaaaaa

SEQ ID NO: 1209000 - DNA, 22 bp, Artificial Sequence
  chemically synthesized
taagcctcctgttttttttttt

SEQ ID NO: 1209001 - DNA, 22 bp, Artificial Sequence
  chemically synthesized
ttataagcctcctgtttttttt

SEQ ID NO: 1209002 - DNA, 22 bp, Artificial Sequence
  chemically synthesized
attataagcctcctgttttttt

SEQ ID NO: 1209003 - DNA, 22 bp, Artificial Sequence
  chemically synthesized
aaagataaaatgtcatatttat

SEQ ID NO: 1209004 - DNA, 22 bp, Artificial Sequence
  chemically synthesized
caaagataaaatgtcatattta

SEQ ID NO: 1209005 - DNA, 22 bp, Artificial Sequence
  chemically synthesized
tatttcaaagataaaatgtcat

SEQ ID NO: 1209006 - DNA, 22 bp, Artificial Sequence
  chemically synthesized
atatttcaaagataaaatgtca

SEQ ID NO: 1209007 - DNA, 22 bp, Artificial Sequence
  chemically synthesized
ataataaatatgacattttatc

SEQ ID NO: 1209008 - DNA, 22 bp, Artificial Sequence
  chemically synthesized
taataaatatgacattttatct

SEQ ID NO: 1209009 - DNA, 22 bp, Artificial Sequence
  chemically synthesized
gtttatatttcaaagataaaat

SEQ ID NO: 1209010 - DNA, 22 bp, Artificial Sequence
  chemically synthesized
catgaagctggtttatatttca

SEQ ID NO: 1209011 - DNA, 22 bp, Artificial Sequence
  chemically synthesized
ttccatgaagctggtttatatt

SEQ ID NO: 1209012 - DNA, 22 bp, Artificial Sequence
  chemically synthesized
tatctttgaaatataaaccagc

SEQ ID NO: 1209013 - DNA, 22 bp, Artificial Sequence
  chemically synthesized
atctttgaaatataaaccagct

SEQ ID NO: 1209014 - DNA, 22 bp, Artificial Sequence
  chemically synthesized
tctttgaaatataaaccagctt

SEQ ID NO: 1209015 - DNA, 22 bp, Artificial Sequence
  chemically synthesized
tgaaatataaaccagcttcatg

SEQ ID NO: 1209016 - DNA, 22 bp, Artificial Sequence
  chemically synthesized
gaaatataaaccagcttcatgg

SEQ ID NO: 1209017 - DNA, 22 bp, Artificial Sequence
  chemically synthesized
aagatgactattccatgaagct

SEQ ID NO: 1209018 - DNA, 22 bp, Artificial Sequence
  chemically synthesized
aaatataaaccagcttcatgga

SEQ ID NO: 1209019 - DNA, 22 bp, Artificial Sequence
  chemically synthesized
aaagatgactattccatgaagc

SEQ ID NO: 1209020 - DNA, 22 bp, Artificial Sequence
  chemically synthesized
gaacttaaagatgactattcca

SEQ ID NO: 1209021 - DNA, 22 bp, Artificial Sequence
  chemically synthesized
tcctagaacttaaagatgacta

SEQ ID NO: 1209022 - DNA, 22 bp, Artificial Sequence
  chemically synthesized
catggaatagtcatctttaagt

SEQ ID NO: 1209023 - DNA, 22 bp, Artificial Sequence
  chemically synthesized
atggaatagtcatctttaagtt

SEQ ID NO: 1209024 - DNA, 22 bp, Artificial Sequence
  chemically synthesized
ccactgtcctagaacttaaaga

SEQ ID NO: 1209025 - DNA, 22 bp, Artificial Sequence
  chemically synthesized
gccactgtcctagaacttaaag

SEQ ID NO: 1209026 - DNA, 22 bp, Artificial Sequence
  chemically synthesized
tgccactgtcctagaacttaaa

SEQ ID NO: 1209027 - DNA, 22 bp, Artificial Sequence
  chemically synthesized
aaaactttgccactgtcctaga

SEQ ID NO: 1209028 - DNA, 22 bp, Artificial Sequence
  chemically synthesized
aaaaactttgccactgtcctag

SEQ ID NO: 1209029 - DNA, 22 bp, Artificial Sequence
  chemically synthesized
taaaaactttgccactgtccta

SEQ ID NO: 1209030 - DNA, 22 bp, Artificial Sequence
  chemically synthesized
ttaaaaactttgccactgtcct

SEQ ID NO: 1209031 - DNA, 22 bp, Artificial Sequence
  chemically synthesized
taagttctaggacagtggcaaa

SEQ ID NO: 1209032 - DNA, 22 bp, Artificial Sequence
  chemically synthesized
aagttctaggacagtggcaaag

SEQ ID NO: 1209033 - DNA, 22 bp, Artificial Sequence
  chemically synthesized
agttctaggacagtggcaaagt

SEQ ID NO: 1209034 - DNA, 22 bp, Artificial Sequence
  chemically synthesized
aatcttttaaaaactttgccac

SEQ ID NO: 1209035 - DNA, 22 bp, Artificial Sequence
  chemically synthesized
taggacagtggcaaagttttta

SEQ ID NO: 1209036 - DNA, 22 bp, Artificial Sequence
  chemically synthesized
ggacagtggcaaagtttttaaa

SEQ ID NO: 1209037 - DNA, 22 bp, Artificial Sequence
  chemically synthesized
tgtgttcaatcttttaaaaact

SEQ ID NO: 1209038 - DNA, 22 bp, Artificial Sequence
  chemically synthesized
gtgatgactatgtgttcaatct

SEQ ID NO: 1209039 - DNA, 22 bp, Artificial Sequence
  chemically synthesized
ttggtgatgactatgtgttcaa

SEQ ID NO: 1209040 - DNA, 22 bp, Artificial Sequence
  chemically synthesized
attggtgatgactatgtgttca

SEQ ID NO: 1209041 - DNA, 22 bp, Artificial Sequence
  chemically synthesized
ttaaaagattgaacacatagtc

SEQ ID NO: 1209042 - DNA, 22 bp, Artificial Sequence
  chemically synthesized
taaaagattgaacacatagtca

SEQ ID NO: 1209043 - DNA, 22 bp, Artificial Sequence
  chemically synthesized
aaaagattgaacacatagtcat

SEQ ID NO: 1209044 - DNA, 22 bp, Artificial Sequence
  chemically synthesized
aaagattgaacacatagtcatc

SEQ ID NO: 1209045 - DNA, 22 bp, Artificial Sequence
  chemically synthesized
agtaagggtttattggtgatga

SEQ ID NO: 1209046 - DNA, 22 bp, Artificial Sequence
  chemically synthesized
aacacatagtcatcaccaataa

SEQ ID NO: 1209047 - DNA, 22 bp, Artificial Sequence
  chemically synthesized
tactaagtaagggtttattggt

SEQ ID NO: 1209048 - DNA, 22 bp, Artificial Sequence
  chemically synthesized
atgcatagtctgtactaagtaa

SEQ ID NO: 1209049 - DNA, 22 bp, Artificial Sequence
  chemically synthesized
catgcatagtctgtactaagta

SEQ ID NO: 1209050 - DNA, 22 bp, Artificial Sequence
  chemically synthesized
gtacttcatgcatagtctgtac

SEQ ID NO: 1209051 - DNA, 22 bp, Artificial Sequence
  chemically synthesized
agtacttcatgcatagtctgta

SEQ ID NO: 1209052 - DNA, 22 bp, Artificial Sequence
  chemically synthesized
ccttagtacttcatgcatagtc

SEQ ID NO: 1209053 - DNA, 22 bp, Artificial Sequence
  chemically synthesized
accttagtacttcatgcatagt

SEQ ID NO: 1209054 - DNA, 22 bp, Artificial Sequence
  chemically synthesized
acttagtacagactatgcatga

SEQ ID NO: 1209055 - DNA, 22 bp, Artificial Sequence
  chemically synthesized
cttagtacagactatgcatgaa

SEQ ID NO: 1209056 - DNA, 22 bp, Artificial Sequence
  chemically synthesized
agtacagactatgcatgaagta

SEQ ID NO: 1209057 - DNA, 22 bp, Artificial Sequence
  chemically synthesized
gtacagactatgcatgaagtac

SEQ ID NO: 1209058 - DNA, 22 bp, Artificial Sequence
  chemically synthesized
cagaagtcacttaccttagtac

SEQ ID NO: 1209059 - DNA, 22 bp, Artificial Sequence
  chemically synthesized
acagaagtcacttaccttagta

SEQ ID NO: 1209060 - DNA, 22 bp, Artificial Sequence
  chemically synthesized
tgcatgaagtactaaggtaagt

SEQ ID NO: 1209061 - DNA, 22 bp, Artificial Sequence
  chemically synthesized
tcttacagaagtcacttacctt

SEQ ID NO: 1209062 - DNA, 22 bp, Artificial Sequence
  chemically synthesized
atcttacagaagtcacttacct

SEQ ID NO: 1209063 - DNA, 22 bp, Artificial Sequence
  chemically synthesized
tatcttacagaagtcacttacc

SEQ ID NO: 1209064 - DNA, 22 bp, Artificial Sequence
  chemically synthesized
ttatcttacagaagtcacttac

SEQ ID NO: 1209065 - DNA, 22 bp, Artificial Sequence
  chemically synthesized
catgtttttatcttacagaagt

SEQ ID NO: 1209066 - DNA, 22 bp, Artificial Sequence
  chemically synthesized
aggtaagtgacttctgtaagat

SEQ ID NO: 1209067 - DNA, 22 bp, Artificial Sequence
  chemically synthesized
ctccatgtttttatcttacaga

SEQ ID NO: 1209068 - DNA, 22 bp, Artificial Sequence
  chemically synthesized
cctccatgtttttatcttacag

SEQ ID NO: 1209069 - DNA, 22 bp, Artificial Sequence
  chemically synthesized
ctgtaagataaaaacatggagg

SEQ ID NO: 1209070 - DNA, 22 bp, Artificial Sequence
  chemically synthesized
tgtaagataaaaacatggagga

SEQ ID NO: 1209071 - DNA, 22 bp, Artificial Sequence
  chemically synthesized
taagataaaaacatggaggaaa

SEQ ID NO: 1209072 - DNA, 22 bp, Artificial Sequence
  chemically synthesized
aaccacaaaagggtttcctcca

SEQ ID NO: 1209073 - DNA, 22 bp, Artificial Sequence
  chemically synthesized
ctgaaccacaaaagggtttcct

SEQ ID NO: 1209074 - DNA, 22 bp, Artificial Sequence
  chemically synthesized
ggaatacatgttcctgaaccac

SEQ ID NO: 1209075 - DNA, 22 bp, Artificial Sequence
  chemically synthesized
gggaatacatgttcctgaacca

SEQ ID NO: 1209076 - DNA, 22 bp, Artificial Sequence
  chemically synthesized
ttgtggttcaggaacatgtatt

SEQ ID NO: 1209077 - DNA, 22 bp, Artificial Sequence
  chemically synthesized
tgtggttcaggaacatgtattc

SEQ ID NO: 1209078 - DNA, 22 bp, Artificial Sequence
  chemically synthesized
caccaaccttgggaatacatgt

SEQ ID NO: 1209079 - DNA, 22 bp, Artificial Sequence
  chemically synthesized
gtggttcaggaacatgtattcc

SEQ ID NO: 1209080 - DNA, 22 bp, Artificial Sequence
  chemically synthesized
tggttcaggaacatgtattccc

SEQ ID NO: 1209081 - DNA, 22 bp, Artificial Sequence
  chemically synthesized
agttacaccaaccttgggaata

SEQ ID NO: 1209082 - DNA, 22 bp, Artificial Sequence
  chemically synthesized
cagttacaccaaccttgggaat

SEQ ID NO: 1209083 - DNA, 22 bp, Artificial Sequence
  chemically synthesized
aggaacatgtattcccaaggtt

SEQ ID NO: 1209084 - DNA, 22 bp, Artificial Sequence
  chemically synthesized
accttcagttacaccaaccttg

SEQ ID NO: 1209085 - DNA, 22 bp, Artificial Sequence
  chemically synthesized
aactaaccttcagttacaccaa

SEQ ID NO: 1209086 - DNA, 22 bp, Artificial Sequence
  chemically synthesized
aaactaaccttcagttacacca

SEQ ID NO: 1209087 - DNA, 22 bp, Artificial Sequence
  chemically synthesized
ttaaactaaccttcagttacac

SEQ ID NO: 1209088 - DNA, 22 bp, Artificial Sequence
  chemically synthesized
ccaaggttggtgtaactgaagg

SEQ ID NO: 1209089 - DNA, 22 bp, Artificial Sequence
  chemically synthesized
tacccattcttaaactaacctt

SEQ ID NO: 1209090 - DNA, 22 bp, Artificial Sequence
  chemically synthesized
tgtacccattcttaaactaacc

SEQ ID NO: 1209091 - DNA, 22 bp, Artificial Sequence
  chemically synthesized
gtgtaactgaaggttagtttaa

SEQ ID NO: 1209092 - DNA, 22 bp, Artificial Sequence
  chemically synthesized
aaggttagtttaagaatgggta

SEQ ID NO: 1209093 - DNA, 22 bp, Artificial Sequence
  chemically synthesized
ccaccatgtgttctgtacccat

SEQ ID NO: 1209094 - DNA, 22 bp, Artificial Sequence
  chemically synthesized
cccaccatgtgttctgtaccca

SEQ ID NO: 1209095 - DNA, 22 bp, Artificial Sequence
  chemically synthesized
gtttaagaatgggtacagaaca

SEQ ID NO: 1209096 - DNA, 22 bp, Artificial Sequence
  chemically synthesized
cttcccaccatgtgttctgtac

SEQ ID NO: 1209097 - DNA, 22 bp, Artificial Sequence
  chemically synthesized
ttgcttcccaccatgtgttctg

SEQ ID NO: 1209098 - DNA, 22 bp, Artificial Sequence
  chemically synthesized
aagaatgggtacagaacacatg

SEQ ID NO: 1209099 - DNA, 22 bp, Artificial Sequence
  chemically synthesized
attgcttcccaccatgtgttct

SEQ ID NO: 1209100 - DNA, 22 bp, Artificial Sequence
  chemically synthesized
agaatgggtacagaacacatgg

SEQ ID NO: 1209101 - DNA, 22 bp, Artificial Sequence
  chemically synthesized
tattgcttcccaccatgtgttc

SEQ ID NO: 1209102 - DNA, 22 bp, Artificial Sequence
  chemically synthesized
ttattgcttcccaccatgtgtt

SEQ ID NO: 1209103 - DNA, 22 bp, Artificial Sequence
  chemically synthesized
ccttttattgcttcccaccatg

SEQ ID NO: 1209104 - DNA, 22 bp, Artificial Sequence
  chemically synthesized
tgcctgccttttattgcttccc

SEQ ID NO: 1209105 - DNA, 22 bp, Artificial Sequence
  chemically synthesized
tatgcctgccttttattgcttc

SEQ ID NO: 1209106 - DNA, 22 bp, Artificial Sequence
  chemically synthesized
ctatgcctgccttttattgctt

SEQ ID NO: 1209107 - DNA, 22 bp, Artificial Sequence
  chemically synthesized
tctatgcctgccttttattgct

SEQ ID NO: 1209108 - DNA, 22 bp, Artificial Sequence
  chemically synthesized
aacaaaatccggctttctatgc

SEQ ID NO: 1209109 - DNA, 22 bp, Artificial Sequence
  chemically synthesized
taaacaaaatccggctttctat

SEQ ID NO: 1209110 - DNA, 22 bp, Artificial Sequence
  chemically synthesized
ctaaacaaaatccggctttcta

SEQ ID NO: 1209111 - DNA, 22 bp, Artificial Sequence
  chemically synthesized
tctaaacaaaatccggctttct

SEQ ID NO: 1209112 - DNA, 22 bp, Artificial Sequence
  chemically synthesized
tttctaaacaaaatccggcttt

SEQ ID NO: 1209113 - DNA, 22 bp, Artificial Sequence
  chemically synthesized
atacaaccccatgttctttcta

SEQ ID NO: 1209114 - DNA, 22 bp, Artificial Sequence
  chemically synthesized
ttaatacaaccccatgttcttt

SEQ ID NO: 1209115 - DNA, 22 bp, Artificial Sequence
  chemically synthesized
gttaatacaaccccatgttctt

SEQ ID NO: 1209116 - DNA, 22 bp, Artificial Sequence
  chemically synthesized
ttgttaatacaaccccatgttc

SEQ ID NO: 1209117 - DNA, 22 bp, Artificial Sequence
  chemically synthesized
tgtttagaaagaacatggggtt

SEQ ID NO: 1209118 - DNA, 22 bp, Artificial Sequence
  chemically synthesized
tcttgttaatacaaccccatgt

SEQ ID NO: 1209119 - DNA, 22 bp, Artificial Sequence
  chemically synthesized
gtttagaaagaacatggggttg

SEQ ID NO: 1209120 - DNA, 22 bp, Artificial Sequence
  chemically synthesized
tttagaaagaacatggggttgt

SEQ ID NO: 1209121 - DNA, 22 bp, Artificial Sequence
  chemically synthesized
agaaagaacatggggttgtatt

SEQ ID NO: 1209122 - DNA, 22 bp, Artificial Sequence
  chemically synthesized
gaaagaacatggggttgtatta

SEQ ID NO: 1209123 - DNA, 22 bp, Artificial Sequence
  chemically synthesized
agcatgtcattctcttgttaat

SEQ ID NO: 1209124 - DNA, 22 bp, Artificial Sequence
  chemically synthesized
tattaacaagagaatgacatgc

SEQ ID NO: 1209125 - DNA, 22 bp, Artificial Sequence
  chemically synthesized
aagatgacaggtctaagcatgt

SEQ ID NO: 1209126 - DNA, 22 bp, Artificial Sequence
  chemically synthesized
acaagagaatgacatgcttaga

SEQ ID NO: 1209127 - DNA, 22 bp, Artificial Sequence
  chemically synthesized
gaagatgacaggtctaagcatg

SEQ ID NO: 1209128 - DNA, 22 bp, Artificial Sequence
  chemically synthesized
gtgtttgaagatgacaggtcta

SEQ ID NO: 1209129 - DNA, 22 bp, Artificial Sequence
  chemically synthesized
agacctgtcatcttcaaacact

SEQ ID NO: 1209130 - DNA, 22 bp, Artificial Sequence
  chemically synthesized
gacctgtcatcttcaaacacta

SEQ ID NO: 1209131 - DNA, 22 bp, Artificial Sequence
  chemically synthesized
acatgccaccacaattagtgtt

SEQ ID NO: 1209132 - DNA, 22 bp, Artificial Sequence
  chemically synthesized
tcatcttcaaacactaattgtg

SEQ ID NO: 1209133 - DNA, 22 bp, Artificial Sequence
  chemically synthesized
ttcacatgccaccacaattagt

SEQ ID NO: 1209134 - DNA, 22 bp, Artificial Sequence
  chemically synthesized
caaacactaattgtggtggcat

SEQ ID NO: 1209135 - DNA, 22 bp, Artificial Sequence
  chemically synthesized
aaacactaattgtggtggcatg

SEQ ID NO: 1209136 - DNA, 22 bp, Artificial Sequence
  chemically synthesized
aatcattgttcacatgccacca

SEQ ID NO: 1209137 - DNA, 22 bp, Artificial Sequence
  chemically synthesized
aaatcattgttcacatgccacc

SEQ ID NO: 1209138 - DNA, 22 bp, Artificial Sequence
  chemically synthesized
taaatcattgttcacatgccac

SEQ ID NO: 1209139 - DNA, 22 bp, Artificial Sequence
  chemically synthesized
ctttaaatcattgttcacatgc

SEQ ID NO: 1209140 - DNA, 22 bp, Artificial Sequence
  chemically synthesized
attgtggtggcatgtgaacaat

SEQ ID NO: 1209141 - DNA, 22 bp, Artificial Sequence
  chemically synthesized
ctactttaaatcattgttcaca

SEQ ID NO: 1209142 - DNA, 22 bp, Artificial Sequence
  chemically synthesized
ctcctactttaaatcattgttc

SEQ ID NO: 1209143 - DNA, 22 bp, Artificial Sequence
  chemically synthesized
tggtggcatgtgaacaatgatt

SEQ ID NO: 1209144 - DNA, 22 bp, Artificial Sequence
  chemically synthesized
cctcctactttaaatcattgtt

SEQ ID NO: 1209145 - DNA, 22 bp, Artificial Sequence
  chemically synthesized
atttcctcctactttaaatcat

SEQ ID NO: 1209146 - DNA, 22 bp, Artificial Sequence
  chemically synthesized
taatttcctcctactttaaatc

SEQ ID NO: 1209147 - DNA, 22 bp, Artificial Sequence
  chemically synthesized
cagtctctaatttcctcctact

SEQ ID NO: 1209148 - DNA, 22 bp, Artificial Sequence
  chemically synthesized
ccagtctctaatttcctcctac

SEQ ID NO: 1209149 - DNA, 22 bp, Artificial Sequence
  chemically synthesized
tcttccagtctctaatttcctc

SEQ ID NO: 1209150 - DNA, 22 bp, Artificial Sequence
  chemically synthesized
gtcttccagtctctaatttcct

SEQ ID NO: 1209151 - DNA, 22 bp, Artificial Sequence
  chemically synthesized
aaagtaggaggaaattagagac

SEQ ID NO: 1209152 - DNA, 22 bp, Artificial Sequence
  chemically synthesized
gcttgtcttccagtctctaatt

SEQ ID NO: 1209153 - DNA, 22 bp, Artificial Sequence
  chemically synthesized
aagtaggaggaaattagagact

SEQ ID NO: 1209154 - DNA, 22 bp, Artificial Sequence
  chemically synthesized
agcttgtcttccagtctctaat

SEQ ID NO: 1209155 - DNA, 22 bp, Artificial Sequence
  chemically synthesized
ttagcttgtcttccagtctcta

SEQ ID NO: 1209156 - DNA, 22 bp, Artificial Sequence
  chemically synthesized
tcttagcttgtcttccagtctc

SEQ ID NO: 1209157 - DNA, 22 bp, Artificial Sequence
  chemically synthesized
cctctcttagcttgtcttccag

SEQ ID NO: 1209158 - DNA, 22 bp, Artificial Sequence
  chemically synthesized
cagttccctctcttagcttgtc

SEQ ID NO: 1209159 - DNA, 22 bp, Artificial Sequence
  chemically synthesized
gagactggaagacaagctaaga

SEQ ID NO: 1209160 - DNA, 22 bp, Artificial Sequence
  chemically synthesized
gaagacaagctaagagagggaa

SEQ ID NO: 1209161 - DNA, 22 bp, Artificial Sequence
  chemically synthesized
cccagataattacagttccctc

SEQ ID NO: 1209162 - DNA, 22 bp, Artificial Sequence
  chemically synthesized
ctgcccagataattacagttcc

SEQ ID NO: 1209163 - DNA, 22 bp, Artificial Sequence
  chemically synthesized
agagagggaactgtaattatct

SEQ ID NO: 1209164 - DNA, 22 bp, Artificial Sequence
  chemically synthesized
gatgatcccccaaaactgctgc

SEQ ID NO: 1209165 - DNA, 22 bp, Artificial Sequence
  chemically synthesized
taattatctgggcagcagtttt

SEQ ID NO: 1209166 - DNA, 22 bp, Artificial Sequence
  chemically synthesized
ctggatgatcccccaaaactgc

SEQ ID NO: 1209167 - DNA, 22 bp, Artificial Sequence
  chemically synthesized
tgctggatgatcccccaaaact

SEQ ID NO: 1209168 - DNA, 22 bp, Artificial Sequence
  chemically synthesized
tctgggcagcagttttggggga

SEQ ID NO: 1209169 - DNA, 22 bp, Artificial Sequence
  chemically synthesized
tctgctggatgatcccccaaaa

SEQ ID NO: 1209170 - DNA, 22 bp, Artificial Sequence
  chemically synthesized
ggcagcagttttgggggatcat

SEQ ID NO: 1209171 - DNA, 22 bp, Artificial Sequence
  chemically synthesized
cattctctgctggatgatcccc

SEQ ID NO: 1209172 - DNA, 22 bp, Artificial Sequence
  chemically synthesized
tacattctctgctggatgatcc

SEQ ID NO: 1209173 - DNA, 22 bp, Artificial Sequence
  chemically synthesized
aattctacattctctgctggat

SEQ ID NO: 1209174 - DNA, 22 bp, Artificial Sequence
  chemically synthesized
aaattctacattctctgctgga

SEQ ID NO: 1209175 - DNA, 22 bp, Artificial Sequence
  chemically synthesized
taaattctacattctctgctgg

SEQ ID NO: 1209176 - DNA, 22 bp, Artificial Sequence
  chemically synthesized
tgggggatcatccagcagagaa

SEQ ID NO: 1209177 - DNA, 22 bp, Artificial Sequence
  chemically synthesized
gggggatcatccagcagagaat

SEQ ID NO: 1209178 - DNA, 22 bp, Artificial Sequence
  chemically synthesized
ggggatcatccagcagagaatg

SEQ ID NO: 1209179 - DNA, 22 bp, Artificial Sequence
  chemically synthesized
ctttaaattctacattctctgc

SEQ ID NO: 1209180 - DNA, 22 bp, Artificial Sequence
  chemically synthesized
actttaaattctacattctctg

SEQ ID NO: 1209181 - DNA, 22 bp, Artificial Sequence
  chemically synthesized
gaggaatttactttaaattcta

SEQ ID NO: 1209182 - DNA, 22 bp, Artificial Sequence
  chemically synthesized
cgaatagcaatactagaggaat

SEQ ID NO: 1209183 - DNA, 22 bp, Artificial Sequence
  chemically synthesized
ttccgaatagcaatactagagg

SEQ ID NO: 1209184 - DNA, 22 bp, Artificial Sequence
  chemically synthesized
aaagtaaattcctctagtattg

SEQ ID NO: 1209185 - DNA, 22 bp, Artificial Sequence
  chemically synthesized
tattccgaatagcaatactaga

SEQ ID NO: 1209186 - DNA, 22 bp, Artificial Sequence
  chemically synthesized
aagtaaattcctctagtattgc

SEQ ID NO: 1209187 - DNA, 22 bp, Artificial Sequence
  chemically synthesized
ctattccgaatagcaatactag

SEQ ID NO: 1209188 - DNA, 22 bp, Artificial Sequence
  chemically synthesized
tctattccgaatagcaatacta

SEQ ID NO: 1209189 - DNA, 22 bp, Artificial Sequence
  chemically synthesized
ctctagtattgctattcggaat

SEQ ID NO: 1209190 - DNA, 22 bp, Artificial Sequence
  chemically synthesized
tagtattgctattcggaataga

SEQ ID NO: 1209191 - DNA, 22 bp, Artificial Sequence
  chemically synthesized
taaatgtagttttctattccga

SEQ ID NO: 1209192 - DNA, 22 bp, Artificial Sequence
  chemically synthesized
gtattgctattcggaatagaaa

SEQ ID NO: 1209193 - DNA, 22 bp, Artificial Sequence
  chemically synthesized
ctattcggaatagaaaactaca

SEQ ID NO: 1209194 - DNA, 22 bp, Artificial Sequence
  chemically synthesized
aatcattgtaaatgtagttttc

SEQ ID NO: 1209195 - DNA, 22 bp, Artificial Sequence
  chemically synthesized
ttcggaatagaaaactacattt

SEQ ID NO: 1209196 - DNA, 22 bp, Artificial Sequence
  chemically synthesized
tattaaatcattgtaaatgtag

SEQ ID NO: 1209197 - DNA, 22 bp, Artificial Sequence
  chemically synthesized
ggaatagaaaactacatttaca

SEQ ID NO: 1209198 - DNA, 22 bp, Artificial Sequence
  chemically synthesized
atgtatattgtattaaatcatt

SEQ ID NO: 1209199 - DNA, 22 bp, Artificial Sequence
  chemically synthesized
catttacaatgatttaatacaa

SEQ ID NO: 1209200 - DNA, 22 bp, Artificial Sequence
  chemically synthesized
gtattaatgtatattgtattaa

SEQ ID NO: 1209201 - DNA, 22 bp, Artificial Sequence
  chemically synthesized
ggtattaatgtatattgtatta

SEQ ID NO: 1209202 - DNA, 22 bp, Artificial Sequence
  chemically synthesized
tggtattaatgtatattgtatt

SEQ ID NO: 1209203 - DNA, 22 bp, Artificial Sequence
  chemically synthesized
ttggtattaatgtatattgtat

SEQ ID NO: 1209204 - DNA, 22 bp, Artificial Sequence
  chemically synthesized
acaatgatttaatacaatatac

SEQ ID NO: 1209205 - DNA, 22 bp, Artificial Sequence
  chemically synthesized
caatgatttaatacaatataca

SEQ ID NO: 1209206 - DNA, 22 bp, Artificial Sequence
  chemically synthesized
tacttttggtattaatgtatat

SEQ ID NO: 1209207 - DNA, 22 bp, Artificial Sequence
  chemically synthesized
ctatacttttggtattaatgta

SEQ ID NO: 1209208 - DNA, 22 bp, Artificial Sequence
  chemically synthesized
actatacttttggtattaatgt

SEQ ID NO: 1209209 - DNA, 22 bp, Artificial Sequence
  chemically synthesized
aatacaatatacattaatacca

SEQ ID NO: 1209210 - DNA, 22 bp, Artificial Sequence
  chemically synthesized
atacaatatacattaataccaa

SEQ ID NO: 1209211 - DNA, 22 bp, Artificial Sequence
  chemically synthesized
aggtcttactatacttttggta

SEQ ID NO: 1209212 - DNA, 22 bp, Artificial Sequence
  chemically synthesized
catctaaggtcttactatactt

SEQ ID NO: 1209213 - DNA, 22 bp, Artificial Sequence
  chemically synthesized
acatctaaggtcttactatact

SEQ ID NO: 1209214 - DNA, 22 bp, Artificial Sequence
  chemically synthesized
tacatctaaggtcttactatac

SEQ ID NO: 1209215 - DNA, 22 bp, Artificial Sequence
  chemically synthesized
ataccaaaagtatagtaagacc

SEQ ID NO: 1209216 - DNA, 22 bp, Artificial Sequence
  chemically synthesized
caagaacacgtaaacattttac

SEQ ID NO: 1209217 - DNA, 22 bp, Artificial Sequence
  chemically synthesized
agatgtaaaatgtttacgtgtt

SEQ ID NO: 1209218 - DNA, 22 bp, Artificial Sequence
  chemically synthesized
gatgtaaaatgtttacgtgttc

SEQ ID NO: 1209219 - DNA, 22 bp, Artificial Sequence
  chemically synthesized
acgtgttcttggagttcctttt

SEQ ID NO: 1209220 - DNA, 22 bp, Artificial Sequence
  chemically synthesized
cgtgttcttggagttccttttc

SEQ ID NO: 1209221 - DNA, 22 bp, Artificial Sequence
  chemically synthesized
atcatcaagcatagaaaaggaa

SEQ ID NO: 1209222 - DNA, 22 bp, Artificial Sequence
  chemically synthesized
ttggagttccttttctatgctt

SEQ ID NO: 1209223 - DNA, 22 bp, Artificial Sequence
  chemically synthesized
ggagttccttttctatgcttga

SEQ ID NO: 1209224 - DNA, 22 bp, Artificial Sequence
  chemically synthesized
gagttccttttctatgcttgat

SEQ ID NO: 1209225 - DNA, 22 bp, Artificial Sequence
  chemically synthesized
atacatcaattgatcatcaagc

SEQ ID NO: 1209226 - DNA, 22 bp, Artificial Sequence
  chemically synthesized
cttttctatgcttgatgatcaa

SEQ ID NO: 1209227 - DNA, 22 bp, Artificial Sequence
  chemically synthesized
ttctatgcttgatgatcaattg

SEQ ID NO: 1209228 - DNA, 22 bp, Artificial Sequence
  chemically synthesized
aaattaatacatcaattgatca

SEQ ID NO: 1209229 - DNA, 22 bp, Artificial Sequence
  chemically synthesized
tctatgcttgatgatcaattga

SEQ ID NO: 1209230 - DNA, 22 bp, Artificial Sequence
  chemically synthesized
ctatgcttgatgatcaattgat

SEQ ID NO: 1209231 - DNA, 22 bp, Artificial Sequence
  chemically synthesized
tatgcttgatgatcaattgatg

SEQ ID NO: 1209232 - DNA, 22 bp, Artificial Sequence
  chemically synthesized
tgcttgatgatcaattgatgta

SEQ ID NO: 1209233 - DNA, 22 bp, Artificial Sequence
  chemically synthesized
gaaaaactaaaattaatacatc

SEQ ID NO: 1209234 - DNA, 22 bp, Artificial Sequence
  chemically synthesized
gatgatcaattgatgtattaat

SEQ ID NO: 1209235 - DNA, 22 bp, Artificial Sequence
  chemically synthesized
atgatcaattgatgtattaatt

SEQ ID NO: 1209236 - DNA, 22 bp, Artificial Sequence
  chemically synthesized
ggttagaaaaactaaaattaat

SEQ ID NO: 1209237 - DNA, 22 bp, Artificial Sequence
  chemically synthesized
aggttagaaaaactaaaattaa

SEQ ID NO: 1209238 - DNA, 22 bp, Artificial Sequence
  chemically synthesized
atgtattaattttagtttttct

SEQ ID NO: 1209239 - DNA, 22 bp, Artificial Sequence
  chemically synthesized
aaatacatttaggttagaaaaa

SEQ ID NO: 1209240 - DNA, 22 bp, Artificial Sequence
  chemically synthesized
attttagtttttctaacctaaa

SEQ ID NO: 1209241 - DNA, 22 bp, Artificial Sequence
  chemically synthesized
gcgccctcaaatacatttaggt

SEQ ID NO: 1209242 - DNA, 22 bp, Artificial Sequence
  chemically synthesized
tagtttttctaacctaaatgta

SEQ ID NO: 1209243 - DNA, 22 bp, Artificial Sequence
  chemically synthesized
agtttttctaacctaaatgtat

SEQ ID NO: 1209244 - DNA, 22 bp, Artificial Sequence
  chemically synthesized
gtttttctaacctaaatgtatt

SEQ ID NO: 1209245 - DNA, 22 bp, Artificial Sequence
  chemically synthesized
ttctaacctaaatgtatttgag

SEQ ID NO: 1209246 - DNA, 22 bp, Artificial Sequence
  chemically synthesized
aaaattagcgccctcaaataca

SEQ ID NO: 1209247 - DNA, 22 bp, Artificial Sequence
  chemically synthesized
tctaacctaaatgtatttgagg

SEQ ID NO: 1209248 - DNA, 22 bp, Artificial Sequence
  chemically synthesized
caaaattagcgccctcaaatac

SEQ ID NO: 1209249 - DNA, 22 bp, Artificial Sequence
  chemically synthesized
ctaacctaaatgtatttgaggg

SEQ ID NO: 1209250 - DNA, 22 bp, Artificial Sequence
  chemically synthesized
tcaaaattagcgccctcaaata

SEQ ID NO: 1209251 - DNA, 22 bp, Artificial Sequence
  chemically synthesized
taacctaaatgtatttgagggc

SEQ ID NO: 1209252 - DNA, 22 bp, Artificial Sequence
  chemically synthesized
acctaaatgtatttgagggcgc

SEQ ID NO: 1209253 - DNA, 22 bp, Artificial Sequence
  chemically synthesized
ctttcaaaattagcgccctcaa

SEQ ID NO: 1209254 - DNA, 22 bp, Artificial Sequence
  chemically synthesized
aatgtatttgagggcgctaatt

SEQ ID NO: 1209255 - DNA, 22 bp, Artificial Sequence
  chemically synthesized
tattgctttcaaaattagcgcc

SEQ ID NO: 1209256 - DNA, 22 bp, Artificial Sequence
  chemically synthesized
atattgctttcaaaattagcgc

SEQ ID NO: 1209257 - DNA, 22 bp, Artificial Sequence
  chemically synthesized
gagggcgctaattttgaaagca

SEQ ID NO: 1209258 - DNA, 22 bp, Artificial Sequence
  chemically synthesized
agggcgctaattttgaaagcaa

SEQ ID NO: 1209259 - DNA, 22 bp, Artificial Sequence
  chemically synthesized
attttgaaagcaatataaatat

SEQ ID NO: 1209260 - DNA, 22 bp, Artificial Sequence
  chemically synthesized
ataaagtaatcgacatatttat

SEQ ID NO: 1209261 - DNA, 22 bp, Artificial Sequence
  chemically synthesized
tgaaagcaatataaatatgtcg

SEQ ID NO: 1209262 - DNA, 22 bp, Artificial Sequence
  chemically synthesized
gaaagcaatataaatatgtcga

SEQ ID NO: 1209263 - DNA, 22 bp, Artificial Sequence
  chemically synthesized
aaagcaatataaatatgtcgat

SEQ ID NO: 1209264 - DNA, 22 bp, Artificial Sequence
  chemically synthesized
tgcaactcataaagtaatcgac

SEQ ID NO: 1209265 - DNA, 22 bp, Artificial Sequence
  chemically synthesized
atgcaactcataaagtaatcga

SEQ ID NO: 1209266 - DNA, 22 bp, Artificial Sequence
  chemically synthesized
tatgcaactcataaagtaatcg

SEQ ID NO: 1209267 - DNA, 22 bp, Artificial Sequence
  chemically synthesized
atgtatataattttatgcaact

SEQ ID NO: 1209268 - DNA, 22 bp, Artificial Sequence
  chemically synthesized
ctttatgagttgcataaaatta

SEQ ID NO: 1209269 - DNA, 22 bp, Artificial Sequence
  chemically synthesized
tactaatgtatataattttatg

SEQ ID NO: 1209270 - DNA, 22 bp, Artificial Sequence
  chemically synthesized
tatgagttgcataaaattatat

SEQ ID NO: 1209271 - DNA, 22 bp, Artificial Sequence
  chemically synthesized
atgagttgcataaaattatata

SEQ ID NO: 1209272 - DNA, 22 bp, Artificial Sequence
  chemically synthesized
tgagttgcataaaattatatac

SEQ ID NO: 1209273 - DNA, 22 bp, Artificial Sequence
  chemically synthesized
gtattgtactaatgtatataat

SEQ ID NO: 1209274 - DNA, 22 bp, Artificial Sequence
  chemically synthesized
ggtattgtactaatgtatataa

SEQ ID NO: 1209275 - DNA, 22 bp, Artificial Sequence
  chemically synthesized
cataaaattatatacattagta

SEQ ID NO: 1209276 - DNA, 22 bp, Artificial Sequence
  chemically synthesized
caaatgtacatttggtattgta

SEQ ID NO: 1209277 - DNA, 22 bp, Artificial Sequence
  chemically synthesized
tatacattagtacaataccaaa

SEQ ID NO: 1209278 - DNA, 22 bp, Artificial Sequence
  chemically synthesized
tccaaatgtacatttggtattg

SEQ ID NO: 1209279 - DNA, 22 bp, Artificial Sequence
  chemically synthesized
cctctccaaatgtacatttggt

SEQ ID NO: 1209280 - DNA, 22 bp, Artificial Sequence
  chemically synthesized
gtacaataccaaatgtacattt

SEQ ID NO: 1209281 - DNA, 22 bp, Artificial Sequence
  chemically synthesized
tattccctctccaaatgtacat

SEQ ID NO: 1209282 - DNA, 22 bp, Artificial Sequence
  chemically synthesized
atagaatctgtattccctctcc

SEQ ID NO: 1209283 - DNA, 22 bp, Artificial Sequence
  chemically synthesized
ctaatagaatctgtattccctc

SEQ ID NO: 1209284 - DNA, 22 bp, Artificial Sequence
  chemically synthesized
aattactaatagaatctgtatt

SEQ ID NO: 1209285 - DNA, 22 bp, Artificial Sequence
  chemically synthesized
ggagagggaatacagattctat

SEQ ID NO: 1209286 - DNA, 22 bp, Artificial Sequence
  chemically synthesized
gagagggaatacagattctatt

SEQ ID NO: 1209287 - DNA, 22 bp, Artificial Sequence
  chemically synthesized
tattagtaatttaatcattcat

SEQ ID NO: 1209288 - DNA, 22 bp, Artificial Sequence
  chemically synthesized
atgaaaaacataaatgaatgat

SEQ ID NO: 1209289 - DNA, 22 bp, Artificial Sequence
  chemically synthesized
ttagtaatttaatcattcattt

SEQ ID NO: 1209290 - DNA, 22 bp, Artificial Sequence
  chemically synthesized
aatgaaaaacataaatgaatga

SEQ ID NO: 1209291 - DNA, 22 bp, Artificial Sequence
  chemically synthesized
gtaatttaatcattcatttatg

SEQ ID NO: 1209292 - DNA, 22 bp, Artificial Sequence
  chemically synthesized
aatgtttaatgaaaaacataaa

SEQ ID NO: 1209293 - DNA, 22 bp, Artificial Sequence
  chemically synthesized
aaatgtttaatgaaaaacataa

SEQ ID NO: 1209294 - DNA, 22 bp, Artificial Sequence
  chemically synthesized
aatcattcatttatgtttttca

SEQ ID NO: 1209295 - DNA, 22 bp, Artificial Sequence
  chemically synthesized
atcattcatttatgtttttcat

SEQ ID NO: 1209296 - DNA, 22 bp, Artificial Sequence
  chemically synthesized
atttatgtttttcattaaacat

SEQ ID NO: 1209297 - DNA, 22 bp, Artificial Sequence
  chemically synthesized
atgtttttcattaaacatttaa

SEQ ID NO: 1209298 - DNA, 22 bp, Artificial Sequence
  chemically synthesized
tgtttttcattaaacatttaag

SEQ ID NO: 1209299 - DNA, 22 bp, Artificial Sequence
  chemically synthesized
aaacagtaggaacttaaatgtt

SEQ ID NO: 1209300 - DNA, 22 bp, Artificial Sequence
  chemically synthesized
ttcattaaacatttaagttcct

SEQ ID NO: 1209301 - DNA, 22 bp, Artificial Sequence
  chemically synthesized
tcattaaacatttaagttccta

SEQ ID NO: 1209302 - DNA, 22 bp, Artificial Sequence
  chemically synthesized
gtcctaaaacagtaggaactta

SEQ ID NO: 1209303 - DNA, 22 bp, Artificial Sequence
  chemically synthesized
cattaaacatttaagttcctac

SEQ ID NO: 1209304 - DNA, 22 bp, Artificial Sequence
  chemically synthesized
attaaacatttaagttcctact

SEQ ID NO: 1209305 - DNA, 22 bp, Artificial Sequence
  chemically synthesized
ctggtcctaaaacagtaggaac

SEQ ID NO: 1209306 - DNA, 22 bp, Artificial Sequence
  chemically synthesized
aacatttaagttcctactgttt

SEQ ID NO: 1209307 - DNA, 22 bp, Artificial Sequence
  chemically synthesized
tatctcctggtcctaaaacagt

SEQ ID NO: 1209308 - DNA, 22 bp, Artificial Sequence
  chemically synthesized
ctatatctcctggtcctaaaac

SEQ ID NO: 1209309 - DNA, 22 bp, Artificial Sequence
  chemically synthesized
aagttcctactgttttaggacc

SEQ ID NO: 1209310 - DNA, 22 bp, Artificial Sequence
  chemically synthesized
agttcctactgttttaggacca

SEQ ID NO: 1209311 - DNA, 22 bp, Artificial Sequence
  chemically synthesized
actgctatatctcctggtccta

SEQ ID NO: 1209312 - DNA, 22 bp, Artificial Sequence
  chemically synthesized
ctactgttttaggaccaggaga

SEQ ID NO: 1209313 - DNA, 22 bp, Artificial Sequence
  chemically synthesized
ttcactgctatatctcctggtc

SEQ ID NO: 1209314 - DNA, 22 bp, Artificial Sequence
  chemically synthesized
attcactgctatatctcctggt

SEQ ID NO: 1209315 - DNA, 22 bp, Artificial Sequence
  chemically synthesized
tattcactgctatatctcctgg

SEQ ID NO: 1209316 - DNA, 22 bp, Artificial Sequence
  chemically synthesized
ctgttttaggaccaggagatat

SEQ ID NO: 1209317 - DNA, 22 bp, Artificial Sequence
  chemically synthesized
ttttaggaccaggagatatagc

SEQ ID NO: 1209318 - DNA, 22 bp, Artificial Sequence
  chemically synthesized
taggaccaggagatatagcagt

SEQ ID NO: 1209319 - DNA, 22 bp, Artificial Sequence
  chemically synthesized
tacattttattcactgctatat

SEQ ID NO: 1209320 - DNA, 22 bp, Artificial Sequence
  chemically synthesized
aggaccaggagatatagcagtg

SEQ ID NO: 1209321 - DNA, 22 bp, Artificial Sequence
  chemically synthesized
gtacattttattcactgctata

SEQ ID NO: 1209322 - DNA, 22 bp, Artificial Sequence
  chemically synthesized
ggaccaggagatatagcagtga

SEQ ID NO: 1209323 - DNA, 22 bp, Artificial Sequence
  chemically synthesized
tgtacattttattcactgctat

SEQ ID NO: 1209324 - DNA, 22 bp, Artificial Sequence
  chemically synthesized
aggactttgtacattttattca

SEQ ID NO: 1209325 - DNA, 22 bp, Artificial Sequence
  chemically synthesized
ataagttaaggactttgtacat

SEQ ID NO: 1209326 - DNA, 22 bp, Artificial Sequence
  chemically synthesized
cataagttaaggactttgtaca

SEQ ID NO: 1209327 - DNA, 22 bp, Artificial Sequence
  chemically synthesized
agcttcataagttaaggacttt

SEQ ID NO: 1209328 - DNA, 22 bp, Artificial Sequence
  chemically synthesized
aagcttcataagttaaggactt

SEQ ID NO: 1209329 - DNA, 22 bp, Artificial Sequence
  chemically synthesized
gaatttaagcttcataagttaa

SEQ ID NO: 1209330 - DNA, 22 bp, Artificial Sequence
  chemically synthesized
gtcctagaatttaagcttcata

SEQ ID NO: 1209331 - DNA, 22 bp, Artificial Sequence
  chemically synthesized
tagtcctagaatttaagcttca

SEQ ID NO: 1209332 - DNA, 22 bp, Artificial Sequence
  chemically synthesized
ctagtcctagaatttaagcttc

SEQ ID NO: 1209333 - DNA, 22 bp, Artificial Sequence
  chemically synthesized
tttctagtcctagaatttaagc

SEQ ID NO: 1209334 - DNA, 22 bp, Artificial Sequence
  chemically synthesized
atttctagtcctagaatttaag

SEQ ID NO: 1209335 - DNA, 22 bp, Artificial Sequence
  chemically synthesized
aacttatgaagcttaaattcta

SEQ ID NO: 1209336 - DNA, 22 bp, Artificial Sequence
  chemically synthesized
tatttctagtcctagaatttaa

SEQ ID NO: 1209337 - DNA, 22 bp, Artificial Sequence
  chemically synthesized
acttatgaagcttaaattctag

SEQ ID NO: 1209338 - DNA, 22 bp, Artificial Sequence
  chemically synthesized
ttatttctagtcctagaattta

SEQ ID NO: 1209339 - DNA, 22 bp, Artificial Sequence
  chemically synthesized
tttttatttctagtcctagaat

SEQ ID NO: 1209340 - DNA, 22 bp, Artificial Sequence
  chemically synthesized
atgaagcttaaattctaggact

SEQ ID NO: 1209341 - DNA, 22 bp, Artificial Sequence
  chemically synthesized
atttttatttctagtcctagaa

SEQ ID NO: 1209342 - DNA, 22 bp, Artificial Sequence
  chemically synthesized
tgaagcttaaattctaggacta

SEQ ID NO: 1209343 - DNA, 22 bp, Artificial Sequence
  chemically synthesized
tccttatttttatttctagtcc

SEQ ID NO: 1209344 - DNA, 22 bp, Artificial Sequence
  chemically synthesized
gtccttatttttatttctagtc

SEQ ID NO: 1209345 - DNA, 22 bp, Artificial Sequence
  chemically synthesized
aaattctaggactagaaataaa

SEQ ID NO: 1209346 - DNA, 22 bp, Artificial Sequence
  chemically synthesized
tttgtccttatttttatttcta

SEQ ID NO: 1209347 - DNA, 22 bp, Artificial Sequence
  chemically synthesized
aattctaggactagaaataaaa

SEQ ID NO: 1209348 - DNA, 22 bp, Artificial Sequence
  chemically synthesized
atttgtccttatttttatttct

SEQ ID NO: 1209349 - DNA, 22 bp, Artificial Sequence
  chemically synthesized
taggactagaaataaaaataag

SEQ ID NO: 1209350 - DNA, 22 bp, Artificial Sequence
  chemically synthesized
ggactagaaataaaaataagga

SEQ ID NO: 1209351 - DNA, 22 bp, Artificial Sequence
  chemically synthesized
tgtagcatatttatttgtcctt

SEQ ID NO: 1209352 - DNA, 22 bp, Artificial Sequence
  chemically synthesized
gaaataaaaataaggacaaata

SEQ ID NO: 1209353 - DNA, 22 bp, Artificial Sequence
  chemically synthesized
gtgtagcatatttatttgtcct

SEQ ID NO: 1209354 - DNA, 22 bp, Artificial Sequence
  chemically synthesized
tgtgtagcatatttatttgtcc

SEQ ID NO: 1209355 - DNA, 22 bp, Artificial Sequence
  chemically synthesized
attttgtgtagcatatttattt

SEQ ID NO: 1209356 - DNA, 22 bp, Artificial Sequence
  chemically synthesized
ccatgacctgattttgtgtagc

SEQ ID NO: 1209357 - DNA, 22 bp, Artificial Sequence
  chemically synthesized
gccatgacctgattttgtgtag

SEQ ID NO: 1209358 - DNA, 22 bp, Artificial Sequence
  chemically synthesized
taggacttgccatgacctgatt

SEQ ID NO: 1209359 - DNA, 22 bp, Artificial Sequence
  chemically synthesized
ataggacttgccatgacctgat

SEQ ID NO: 1209360 - DNA, 22 bp, Artificial Sequence
  chemically synthesized
tataggacttgccatgacctga

SEQ ID NO: 1209361 - DNA, 22 bp, Artificial Sequence
  chemically synthesized
tttataggacttgccatgacct

SEQ ID NO: 1209362 - DNA, 22 bp, Artificial Sequence
  chemically synthesized
ctttataggacttgccatgacc

SEQ ID NO: 1209363 - DNA, 22 bp, Artificial Sequence
  chemically synthesized
tctttataggacttgccatgac

SEQ ID NO: 1209364 - DNA, 22 bp, Artificial Sequence
  chemically synthesized
cacaaaatcaggtcatggcaag

SEQ ID NO: 1209365 - DNA, 22 bp, Artificial Sequence
  chemically synthesized
ttctttataggacttgccatga

SEQ ID NO: 1209366 - DNA, 22 bp, Artificial Sequence
  chemically synthesized
tttttctttataggacttgcca

SEQ ID NO: 1209367 - DNA, 22 bp, Artificial Sequence
  chemically synthesized
tatttttctttataggacttgc

SEQ ID NO: 1209368 - DNA, 22 bp, Artificial Sequence
  chemically synthesized
ctctatttttctttataggact

SEQ ID NO: 1209369 - DNA, 22 bp, Artificial Sequence
  chemically synthesized
gctctatttttctttataggac

SEQ ID NO: 1209370 - DNA, 22 bp, Artificial Sequence
  chemically synthesized
ccttgctctatttttctttata

SEQ ID NO: 1209371 - DNA, 22 bp, Artificial Sequence
  chemically synthesized
accttgctctatttttctttat

SEQ ID NO: 1209372 - DNA, 22 bp, Artificial Sequence
  chemically synthesized
taccttgctctatttttcttta

SEQ ID NO: 1209373 - DNA, 22 bp, Artificial Sequence
  chemically synthesized
tttaccttgctctatttttctt

SEQ ID NO: 1209374 - DNA, 22 bp, Artificial Sequence
  chemically synthesized
tctttaccttgctctatttttc

SEQ ID NO: 1209375 - DNA, 22 bp, Artificial Sequence
  chemically synthesized
cctctctttaccttgctctatt

SEQ ID NO: 1209376 - DNA, 22 bp, Artificial Sequence
  chemically synthesized
ttccctctctttaccttgctct

SEQ ID NO: 1209377 - DNA, 22 bp, Artificial Sequence
  chemically synthesized
taaagaaaaatagagcaaggta

SEQ ID NO: 1209378 - DNA, 22 bp, Artificial Sequence
  chemically synthesized
gttccctctctttaccttgctc

SEQ ID NO: 1209379 - DNA, 22 bp, Artificial Sequence
  chemically synthesized
tgttccctctctttaccttgct

SEQ ID NO: 1209380 - DNA, 22 bp, Artificial Sequence
  chemically synthesized
ttgttccctctctttaccttgc

SEQ ID NO: 1209381 - DNA, 22 bp, Artificial Sequence
  chemically synthesized
catgccttttgttccctctctt

SEQ ID NO: 1209382 - DNA, 22 bp, Artificial Sequence
  chemically synthesized
tccatgccttttgttccctctc

SEQ ID NO: 1209383 - DNA, 22 bp, Artificial Sequence
  chemically synthesized
agtagagccaacctctccatgc

SEQ ID NO: 1209384 - DNA, 22 bp, Artificial Sequence
  chemically synthesized
aagtagagccaacctctccatg

SEQ ID NO: 1209385 - DNA, 22 bp, Artificial Sequence
  chemically synthesized
ttaagtagagccaacctctcca

SEQ ID NO: 1209386 - DNA, 22 bp, Artificial Sequence
  chemically synthesized
tcttaagtagagccaacctctc

SEQ ID NO: 1209387 - DNA, 22 bp, Artificial Sequence
  chemically synthesized
aatcctctcttaagtagagcca

SEQ ID NO: 1209388 - DNA, 22 bp, Artificial Sequence
  chemically synthesized
taaatcctctcttaagtagagc

SEQ ID NO: 1209389 - DNA, 22 bp, Artificial Sequence
  chemically synthesized
tctaaatcctctcttaagtaga

SEQ ID NO: 1209390 - DNA, 22 bp, Artificial Sequence
  chemically synthesized
cctctctaaatcctctcttaag

SEQ ID NO: 1209391 - DNA, 22 bp, Artificial Sequence
  chemically synthesized
ccctctctaaatcctctcttaa

SEQ ID NO: 1209392 - DNA, 22 bp, Artificial Sequence
  chemically synthesized
tccctctctaaatcctctctta

SEQ ID NO: 1209393 - DNA, 22 bp, Artificial Sequence
  chemically synthesized
gctctacttaagagaggattta

SEQ ID NO: 1209394 - DNA, 22 bp, Artificial Sequence
  chemically synthesized
tacttaagagaggatttagaga

SEQ ID NO: 1209395 - DNA, 22 bp, Artificial Sequence
  chemically synthesized
aaaggctttccctctctaaatc

SEQ ID NO: 1209396 - DNA, 22 bp, Artificial Sequence
  chemically synthesized
cttaagagaggatttagagagg

SEQ ID NO: 1209397 - DNA, 22 bp, Artificial Sequence
  chemically synthesized
aagagaggatttagagagggaa

SEQ ID NO: 1209398 - DNA, 22 bp, Artificial Sequence
  chemically synthesized
agagaggatttagagagggaaa

SEQ ID NO: 1209399 - DNA, 22 bp, Artificial Sequence
  chemically synthesized
tagttgaaaggctttccctctc

SEQ ID NO: 1209400 - DNA, 22 bp, Artificial Sequence
  chemically synthesized
ctgtagttgaaaggctttccct

SEQ ID NO: 1209401 - DNA, 22 bp, Artificial Sequence
  chemically synthesized
aatgttcctgtagttgaaaggc

SEQ ID NO: 1209402 - DNA, 22 bp, Artificial Sequence
  chemically synthesized
agagagggaaagcctttcaact

SEQ ID NO: 1209403 - DNA, 22 bp, Artificial Sequence
  chemically synthesized
aaatgttcctgtagttgaaagg

SEQ ID NO: 1209404 - DNA, 22 bp, Artificial Sequence
  chemically synthesized
gagagggaaagcctttcaacta

SEQ ID NO: 1209405 - DNA, 22 bp, Artificial Sequence
  chemically synthesized
taaatgttcctgtagttgaaag

SEQ ID NO: 1209406 - DNA, 22 bp, Artificial Sequence
  chemically synthesized
ttaaatgttcctgtagttgaaa

SEQ ID NO: 1209407 - DNA, 22 bp, Artificial Sequence
  chemically synthesized
tttttaaatgttcctgtagttg

SEQ ID NO: 1209408 - DNA, 22 bp, Artificial Sequence
  chemically synthesized
tatttttaaatgttcctgtagt

SEQ ID NO: 1209409 - DNA, 22 bp, Artificial Sequence
  chemically synthesized
aactctatttttaaatgttcct

SEQ ID NO: 1209410 - DNA, 22 bp, Artificial Sequence
  chemically synthesized
tcaactacaggaacatttaaaa

SEQ ID NO: 1209411 - DNA, 22 bp, Artificial Sequence
  chemically synthesized
attcaactctatttttaaatgt

SEQ ID NO: 1209412 - DNA, 22 bp, Artificial Sequence
  chemically synthesized
caactacaggaacatttaaaaa

SEQ ID NO: 1209413 - DNA, 22 bp, Artificial Sequence
  chemically synthesized
cattcaactctatttttaaatg

SEQ ID NO: 1209414 - DNA, 22 bp, Artificial Sequence
  chemically synthesized
aactacaggaacatttaaaaat

SEQ ID NO: 1209415 - DNA, 22 bp, Artificial Sequence
  chemically synthesized
tttcattcaactctatttttaa

SEQ ID NO: 1209416 - DNA, 22 bp, Artificial Sequence
  chemically synthesized
atttcattcaactctattttta

SEQ ID NO: 1209417 - DNA, 22 bp, Artificial Sequence
  chemically synthesized
caggaacatttaaaaatagagt

SEQ ID NO: 1209418 - DNA, 22 bp, Artificial Sequence
  chemically synthesized
cttatttcattcaactctattt

SEQ ID NO: 1209419 - DNA, 22 bp, Artificial Sequence
  chemically synthesized
aactgcttatttcattcaactc

SEQ ID NO: 1209420 - DNA, 22 bp, Artificial Sequence
  chemically synthesized
aaaaatagagttgaatgaaata

SEQ ID NO: 1209421 - DNA, 22 bp, Artificial Sequence
  chemically synthesized
aaaatagagttgaatgaaataa

SEQ ID NO: 1209422 - DNA, 22 bp, Artificial Sequence
  chemically synthesized
aatgaaataagcagttgaatcc

SEQ ID NO: 1209423 - DNA, 22 bp, Artificial Sequence
  chemically synthesized
cagagagtcatcacaggattca

SEQ ID NO: 1209424 - DNA, 22 bp, Artificial Sequence
  chemically synthesized
tccagagagtcatcacaggatt

SEQ ID NO: 1209425 - DNA, 22 bp, Artificial Sequence
  chemically synthesized
ctccagagagtcatcacaggat

SEQ ID NO: 1209426 - DNA, 22 bp, Artificial Sequence
  chemically synthesized
tctccagagagtcatcacagga

SEQ ID NO: 1209427 - DNA, 22 bp, Artificial Sequence
  chemically synthesized
aatcctgtgatgactctctgga

SEQ ID NO: 1209428 - DNA, 22 bp, Artificial Sequence
  chemically synthesized
atatggaaatgtgttttctcca

SEQ ID NO: 1209429 - DNA, 22 bp, Artificial Sequence
  chemically synthesized
tgatgactctctggagaaaaca

SEQ ID NO: 1209430 - DNA, 22 bp, Artificial Sequence
  chemically synthesized
aatatggaaatgtgttttctcc

SEQ ID NO: 1209431 - DNA, 22 bp, Artificial Sequence
  chemically synthesized
taatatggaaatgtgttttctc

SEQ ID NO: 1209432 - DNA, 22 bp, Artificial Sequence
  chemically synthesized
atcctttaatatggaaatgtgt

SEQ ID NO: 1209433 - DNA, 22 bp, Artificial Sequence
  chemically synthesized
tctggagaaaacacatttccat

SEQ ID NO: 1209434 - DNA, 22 bp, Artificial Sequence
  chemically synthesized
ctgatcctttaatatggaaatg

SEQ ID NO: 1209435 - DNA, 22 bp, Artificial Sequence
  chemically synthesized
tggagaaaacacatttccatat

SEQ ID NO: 1209436 - DNA, 22 bp, Artificial Sequence
  chemically synthesized
gctgatcctttaatatggaaat

SEQ ID NO: 1209437 - DNA, 22 bp, Artificial Sequence
  chemically synthesized
gagaaaacacatttccatatta

SEQ ID NO: 1209438 - DNA, 22 bp, Artificial Sequence
  chemically synthesized
tacttgctgatcctttaatatg

SEQ ID NO: 1209439 - DNA, 22 bp, Artificial Sequence
  chemically synthesized
gtacttgctgatcctttaatat

SEQ ID NO: 1209440 - DNA, 22 bp, Artificial Sequence
  chemically synthesized
tgtacttgctgatcctttaata

SEQ ID NO: 1209441 - DNA, 22 bp, Artificial Sequence
  chemically synthesized
aggacctttgtacttgctgatc

SEQ ID NO: 1209442 - DNA, 22 bp, Artificial Sequence
  chemically synthesized
ccatattaaaggatcagcaagt

SEQ ID NO: 1209443 - DNA, 22 bp, Artificial Sequence
  chemically synthesized
catattaaaggatcagcaagta

SEQ ID NO: 1209444 - DNA, 22 bp, Artificial Sequence
  chemically synthesized
cctcaggacctttgtacttgct

SEQ ID NO: 1209445 - DNA, 22 bp, Artificial Sequence
  chemically synthesized
aaggatcagcaagtacaaaggt

SEQ ID NO: 1209446 - DNA, 22 bp, Artificial Sequence
  chemically synthesized
ggagtcaagtgccagagaggtc

SEQ ID NO: 1209447 - DNA, 22 bp, Artificial Sequence
  chemically synthesized
attgggagtcaagtgccagaga

SEQ ID NO: 1209448 - DNA, 22 bp, Artificial Sequence
  chemically synthesized
aggcaggacctctctggcactt

SEQ ID NO: 1209449 - DNA, 22 bp, Artificial Sequence
  chemically synthesized
tctggcacttgactcccaatga

SEQ ID NO: 1209450 - DNA, 22 bp, Artificial Sequence
  chemically synthesized
gtcagatccaggctcattggga

SEQ ID NO: 1209451 - DNA, 22 bp, Artificial Sequence
  chemically synthesized
tggcacttgactcccaatgagc

SEQ ID NO: 1209452 - DNA, 22 bp, Artificial Sequence
  chemically synthesized
tagtcagatccaggctcattgg

SEQ ID NO: 1209453 - DNA, 22 bp, Artificial Sequence
  chemically synthesized
gcacttgactcccaatgagcct

SEQ ID NO: 1209454 - DNA, 22 bp, Artificial Sequence
  chemically synthesized
ctagtcagatccaggctcattg

SEQ ID NO: 1209455 - DNA, 22 bp, Artificial Sequence
  chemically synthesized
acttctagtcagatccaggctc

SEQ ID NO: 1209456 - DNA, 22 bp, Artificial Sequence
  chemically synthesized
cacttctagtcagatccaggct

SEQ ID NO: 1209457 - DNA, 22 bp, Artificial Sequence
  chemically synthesized
gactcccaatgagcctggatct

SEQ ID NO: 1209458 - DNA, 22 bp, Artificial Sequence
  chemically synthesized
actcccaatgagcctggatctg

SEQ ID NO: 1209459 - DNA, 22 bp, Artificial Sequence
  chemically synthesized
ccaatgagcctggatctgacta

SEQ ID NO: 1209460 - DNA, 22 bp, Artificial Sequence
  chemically synthesized
catgccttcacttctagtcaga

SEQ ID NO: 1209461 - DNA, 22 bp, Artificial Sequence
  chemically synthesized
tccatgccttcacttctagtca

SEQ ID NO: 1209462 - DNA, 22 bp, Artificial Sequence
  chemically synthesized
gatctgactagaagtgaaggca

SEQ ID NO: 1209463 - DNA, 22 bp, Artificial Sequence
  chemically synthesized
atcataggctctccatgccttc

SEQ ID NO: 1209464 - DNA, 22 bp, Artificial Sequence
  chemically synthesized
actagaagtgaaggcatggaga

SEQ ID NO: 1209465 - DNA, 22 bp, Artificial Sequence
  chemically synthesized
gaagtgaaggcatggagagcct

SEQ ID NO: 1209466 - DNA, 22 bp, Artificial Sequence
  chemically synthesized
catgcgctaatcataggctctc

SEQ ID NO: 1209467 - DNA, 22 bp, Artificial Sequence
  chemically synthesized
atattgcatgcgctaatcatag

SEQ ID NO: 1209468 - DNA, 22 bp, Artificial Sequence
  chemically synthesized
taatcaaaattaatattgcatg

SEQ ID NO: 1209469 - DNA, 22 bp, Artificial Sequence
  chemically synthesized
gtaatcaaaattaatattgcat

SEQ ID NO: 1209470 - DNA, 22 bp, Artificial Sequence
  chemically synthesized
tgtaatcaaaattaatattgca

SEQ ID NO: 1209471 - DNA, 22 bp, Artificial Sequence
  chemically synthesized
tgattagcgcatgcaatattaa

SEQ ID NO: 1209472 - DNA, 22 bp, Artificial Sequence
  chemically synthesized
gcgcatgcaatattaattttga

SEQ ID NO: 1209473 - DNA, 22 bp, Artificial Sequence
  chemically synthesized
aagtaactttgtaatcaaaatt

SEQ ID NO: 1209474 - DNA, 22 bp, Artificial Sequence
  chemically synthesized
aaagtaactttgtaatcaaaat

SEQ ID NO: 1209475 - DNA, 22 bp, Artificial Sequence
  chemically synthesized
atccagtttaaagtaactttgt

SEQ ID NO: 1209476 - DNA, 22 bp, Artificial Sequence
  chemically synthesized
attttgattacaaagttacttt

SEQ ID NO: 1209477 - DNA, 22 bp, Artificial Sequence
  chemically synthesized
tgattacaaagttactttaaac

SEQ ID NO: 1209478 - DNA, 22 bp, Artificial Sequence
  chemically synthesized
gattacaaagttactttaaact

SEQ ID NO: 1209479 - DNA, 22 bp, Artificial Sequence
  chemically synthesized
attacaaagttactttaaactg

SEQ ID NO: 1209480 - DNA, 22 bp, Artificial Sequence
  chemically synthesized
gagataaagctaatccagttta

SEQ ID NO: 1209481 - DNA, 22 bp, Artificial Sequence
  chemically synthesized
caaagttactttaaactggatt

SEQ ID NO: 1209482 - DNA, 22 bp, Artificial Sequence
  chemically synthesized
actggagataaagctaatccag

SEQ ID NO: 1209483 - DNA, 22 bp, Artificial Sequence
  chemically synthesized
cactggagataaagctaatcca

SEQ ID NO: 1209484 - DNA, 22 bp, Artificial Sequence
  chemically synthesized
ctttaaactggattagctttat

SEQ ID NO: 1209485 - DNA, 22 bp, Artificial Sequence
  chemically synthesized
taaactggattagctttatctc

SEQ ID NO: 1209486 - DNA, 22 bp, Artificial Sequence
  chemically synthesized
aaactggattagctttatctcc

SEQ ID NO: 1209487 - DNA, 22 bp, Artificial Sequence
  chemically synthesized
aactggattagctttatctcca

SEQ ID NO: 1209488 - DNA, 22 bp, Artificial Sequence
  chemically synthesized
aaaagtgtttcactggagataa

SEQ ID NO: 1209489 - DNA, 22 bp, Artificial Sequence
  chemically synthesized
tgaaaagtgtttcactggagat

SEQ ID NO: 1209490 - DNA, 22 bp, Artificial Sequence
  chemically synthesized
gattagctttatctccagtgaa

SEQ ID NO: 1209491 - DNA, 22 bp, Artificial Sequence
  chemically synthesized
gctttatctccagtgaaacact

SEQ ID NO: 1209492 - DNA, 22 bp, Artificial Sequence
  chemically synthesized
tggtctctgaaaagtgtttcac

SEQ ID NO: 1209493 - DNA, 22 bp, Artificial Sequence
  chemically synthesized
tatctccagtgaaacacttttc

SEQ ID NO: 1209494 - DNA, 22 bp, Artificial Sequence
  chemically synthesized
tctgtggtctctgaaaagtgtt

SEQ ID NO: 1209495 - DNA, 22 bp, Artificial Sequence
  chemically synthesized
atctccagtgaaacacttttca

SEQ ID NO: 1209496 - DNA, 22 bp, Artificial Sequence
  chemically synthesized
gtctgtggtctctgaaaagtgt

SEQ ID NO: 1209497 - DNA, 22 bp, Artificial Sequence
  chemically synthesized
tctccagtgaaacacttttcag

SEQ ID NO: 1209498 - DNA, 22 bp, Artificial Sequence
  chemically synthesized
cagtgaaacacttttcagagac

SEQ ID NO: 1209499 - DNA, 22 bp, Artificial Sequence
  chemically synthesized
ttcagagaccacagacaaatct

SEQ ID NO: 1209500 - DNA, 22 bp, Artificial Sequence
  chemically synthesized
tcagagaccacagacaaatctt

SEQ ID NO: 1209501 - DNA, 22 bp, Artificial Sequence
  chemically synthesized
gatgtagtccaaaagatttgtc

SEQ ID NO: 1209502 - DNA, 22 bp, Artificial Sequence
  chemically synthesized
cagagaccacagacaaatcttt

SEQ ID NO: 1209503 - DNA, 22 bp, Artificial Sequence
  chemically synthesized
agatgtagtccaaaagatttgt

SEQ ID NO: 1209504 - DNA, 22 bp, Artificial Sequence
  chemically synthesized
agagaccacagacaaatctttt

SEQ ID NO: 1209505 - DNA, 22 bp, Artificial Sequence
  chemically synthesized
caaaaaatgtttagatgtagtc

SEQ ID NO: 1209506 - DNA, 22 bp, Artificial Sequence
  chemically synthesized
ccaaaaaatgtttagatgtagt

SEQ ID NO: 1209507 - DNA, 22 bp, Artificial Sequence
  chemically synthesized
atccttccaaaaaatgtttaga

SEQ ID NO: 1209508 - DNA, 22 bp, Artificial Sequence
  chemically synthesized
ttggactacatctaaacatttt

SEQ ID NO: 1209509 - DNA, 22 bp, Artificial Sequence
  chemically synthesized
tggactacatctaaacattttt

SEQ ID NO: 1209510 - DNA, 22 bp, Artificial Sequence
  chemically synthesized
ggactacatctaaacatttttt

SEQ ID NO: 1209511 - DNA, 22 bp, Artificial Sequence
  chemically synthesized
gactacatctaaacattttttg

SEQ ID NO: 1209512 - DNA, 22 bp, Artificial Sequence
  chemically synthesized
catctaaacattttttggaagg

SEQ ID NO: 1209513 - DNA, 22 bp, Artificial Sequence
  chemically synthesized
tagaaatattaatccttccaaa

SEQ ID NO: 1209514 - DNA, 22 bp, Artificial Sequence
  chemically synthesized
aacattttttggaaggattaat

SEQ ID NO: 1209515 - DNA, 22 bp, Artificial Sequence
  chemically synthesized
aaaattatagaaatattaatcc

SEQ ID NO: 1209516 - DNA, 22 bp, Artificial Sequence
  chemically synthesized
caaaattatagaaatattaatc

SEQ ID NO: 1209517 - DNA, 22 bp, Artificial Sequence
  chemically synthesized
tttggaaggattaatatttcta

SEQ ID NO: 1209518 - DNA, 22 bp, Artificial Sequence
  chemically synthesized
ttggaaggattaatatttctat

SEQ ID NO: 1209519 - DNA, 22 bp, Artificial Sequence
  chemically synthesized
tggaaggattaatatttctata

SEQ ID NO: 1209520 - DNA, 22 bp, Artificial Sequence
  chemically synthesized
ggaaggattaatatttctataa

SEQ ID NO: 1209521 - DNA, 22 bp, Artificial Sequence
  chemically synthesized
gaaggattaatatttctataat

SEQ ID NO: 1209522 - DNA, 22 bp, Artificial Sequence
  chemically synthesized
acatggcttcaaaattatagaa

SEQ ID NO: 1209523 - DNA, 22 bp, Artificial Sequence
  chemically synthesized
cacatggcttcaaaattataga

SEQ ID NO: 1209524 - DNA, 22 bp, Artificial Sequence
  chemically synthesized
tcacatggcttcaaaattatag

SEQ ID NO: 1209525 - DNA, 22 bp, Artificial Sequence
  chemically synthesized
attttcacatggcttcaaaatt

SEQ ID NO: 1209526 - DNA, 22 bp, Artificial Sequence
  chemically synthesized
aattttcacatggcttcaaaat

SEQ ID NO: 1209527 - DNA, 22 bp, Artificial Sequence
  chemically synthesized
atatttctataattttgaagcc

SEQ ID NO: 1209528 - DNA, 22 bp, Artificial Sequence
  chemically synthesized
atcttaattttcacatggcttc

SEQ ID NO: 1209529 - DNA, 22 bp, Artificial Sequence
  chemically synthesized
ctataattttgaagccatgtga

SEQ ID NO: 1209530 - DNA, 22 bp, Artificial Sequence
  chemically synthesized
tataattttgaagccatgtgaa

SEQ ID NO: 1209531 - DNA, 22 bp, Artificial Sequence
  chemically synthesized
taattttgaagccatgtgaaaa

SEQ ID NO: 1209532 - DNA, 22 bp, Artificial Sequence
  chemically synthesized
tgaagccatgtgaaaattaaga

SEQ ID NO: 1209533 - DNA, 22 bp, Artificial Sequence
  chemically synthesized
gaagccatgtgaaaattaagat

SEQ ID NO: 1209534 - DNA, 22 bp, Artificial Sequence
  chemically synthesized
aagccatgtgaaaattaagatg

SEQ ID NO: 1209535 - DNA, 22 bp, Artificial Sequence
  chemically synthesized
aatgagaatagactcatcttaa

SEQ ID NO: 1209536 - DNA, 22 bp, Artificial Sequence
  chemically synthesized
gcatgatcactaaatgagaata

SEQ ID NO: 1209537 - DNA, 22 bp, Artificial Sequence
  chemically synthesized
agatgagtctattctcatttag

SEQ ID NO: 1209538 - DNA, 22 bp, Artificial Sequence
  chemically synthesized
aggctggcatgatcactaaatg

SEQ ID NO: 1209539 - DNA, 22 bp, Artificial Sequence
  chemically synthesized
taaggctggcatgatcactaaa

SEQ ID NO: 1209540 - DNA, 22 bp, Artificial Sequence
  chemically synthesized
ctaaggctggcatgatcactaa

SEQ ID NO: 1209541 - DNA, 22 bp, Artificial Sequence
  chemically synthesized
tctaaggctggcatgatcacta

SEQ ID NO: 1209542 - DNA, 22 bp, Artificial Sequence
  chemically synthesized
ttctcatttagtgatcatgcca

SEQ ID NO: 1209543 - DNA, 22 bp, Artificial Sequence
  chemically synthesized
agtctttctaaggctggcatga

SEQ ID NO: 1209544 - DNA, 22 bp, Artificial Sequence
  chemically synthesized
tcatttagtgatcatgccagcc

SEQ ID NO: 1209545 - DNA, 22 bp, Artificial Sequence
  chemically synthesized
cagtctttctaaggctggcatg

SEQ ID NO: 1209546 - DNA, 22 bp, Artificial Sequence
  chemically synthesized
atttagtgatcatgccagcctt

SEQ ID NO: 1209547 - DNA, 22 bp, Artificial Sequence
  chemically synthesized
agtgatcatgccagccttagaa

SEQ ID NO: 1209548 - DNA, 22 bp, Artificial Sequence
  chemically synthesized
gtgatcatgccagccttagaaa

SEQ ID NO: 1209549 - DNA, 22 bp, Artificial Sequence
  chemically synthesized
atcagtttcagtctttctaagg

SEQ ID NO: 1209550 - DNA, 22 bp, Artificial Sequence
  chemically synthesized
aatcagtttcagtctttctaag

SEQ ID NO: 1209551 - DNA, 22 bp, Artificial Sequence
  chemically synthesized
cttaatcagtttcagtctttct

SEQ ID NO: 1209552 - DNA, 22 bp, Artificial Sequence
  chemically synthesized
acttaatcagtttcagtctttc

SEQ ID NO: 1209553 - DNA, 22 bp, Artificial Sequence
  chemically synthesized
atttacttaatcagtttcagtc

SEQ ID NO: 1209554 - DNA, 22 bp, Artificial Sequence
  chemically synthesized
catttacttaatcagtttcagt

SEQ ID NO: 1209555 - DNA, 22 bp, Artificial Sequence
  chemically synthesized
tcatttacttaatcagtttcag

SEQ ID NO: 1209556 - DNA, 22 bp, Artificial Sequence
  chemically synthesized
agaaagactgaaactgattaag

SEQ ID NO: 1209557 - DNA, 22 bp, Artificial Sequence
  chemically synthesized
gaaagactgaaactgattaagt

SEQ ID NO: 1209558 - DNA, 22 bp, Artificial Sequence
  chemically synthesized
agtgtgacaaactttcatttac

SEQ ID NO: 1209559 - DNA, 22 bp, Artificial Sequence
  chemically synthesized
aaactgattaagtaaatgaaag

SEQ ID NO: 1209560 - DNA, 22 bp, Artificial Sequence
  chemically synthesized
aagtgtgacaaactttcattta

SEQ ID NO: 1209561 - DNA, 22 bp, Artificial Sequence
  chemically synthesized
attaagtaaatgaaagtttgtc

SEQ ID NO: 1209562 - DNA, 22 bp, Artificial Sequence
  chemically synthesized
caccttaagtgtgacaaacttt

SEQ ID NO: 1209563 - DNA, 22 bp, Artificial Sequence
  chemically synthesized
agtaaatgaaagtttgtcacac

SEQ ID NO: 1209564 - DNA, 22 bp, Artificial Sequence
  chemically synthesized
tagtagttacaccttaagtgtg

SEQ ID NO: 1209565 - DNA, 22 bp, Artificial Sequence
  chemically synthesized
atctgtagtagttacaccttaa

SEQ ID NO: 1209566 - DNA, 22 bp, Artificial Sequence
  chemically synthesized
catctgtagtagttacacctta

SEQ ID NO: 1209567 - DNA, 22 bp, Artificial Sequence
  chemically synthesized
tcatctgtagtagttacacctt

SEQ ID NO: 1209568 - DNA, 22 bp, Artificial Sequence
  chemically synthesized
gtcacacttaaggtgtaactac

SEQ ID NO: 1209569 - DNA, 22 bp, Artificial Sequence
  chemically synthesized
ttttcatctgtagtagttacac

SEQ ID NO: 1209570 - DNA, 22 bp, Artificial Sequence
  chemically synthesized
tcacacttaaggtgtaactact

SEQ ID NO: 1209571 - DNA, 22 bp, Artificial Sequence
  chemically synthesized
tgttttcatctgtagtagttac

SEQ ID NO: 1209572 - DNA, 22 bp, Artificial Sequence
  chemically synthesized
ctgttttcatctgtagtagtta

SEQ ID NO: 1209573 - DNA, 22 bp, Artificial Sequence
  chemically synthesized
aaggtgtaactactacagatga

SEQ ID NO: 1209574 - DNA, 22 bp, Artificial Sequence
  chemically synthesized
aggtgtaactactacagatgaa

SEQ ID NO: 1209575 - DNA, 22 bp, Artificial Sequence
  chemically synthesized
tagtggcttctgttttcatctg

SEQ ID NO: 1209576 - DNA, 22 bp, Artificial Sequence
  chemically synthesized
gtagtggcttctgttttcatct

SEQ ID NO: 1209577 - DNA, 22 bp, Artificial Sequence
  chemically synthesized
ggtttgtagtggcttctgtttt

SEQ ID NO: 1209578 - DNA, 22 bp, Artificial Sequence
  chemically synthesized
ctacagatgaaaacagaagcca

SEQ ID NO: 1209579 - DNA, 22 bp, Artificial Sequence
  chemically synthesized
ctaggtttgtagtggcttctgt

SEQ ID NO: 1209580 - DNA, 22 bp, Artificial Sequence
  chemically synthesized
gctaggtttgtagtggcttctg

SEQ ID NO: 1209581 - DNA, 22 bp, Artificial Sequence
  chemically synthesized
cagatgaaaacagaagccacta

SEQ ID NO: 1209582 - DNA, 22 bp, Artificial Sequence
  chemically synthesized
gtttgctaggtttgtagtggct

SEQ ID NO: 1209583 - DNA, 22 bp, Artificial Sequence
  chemically synthesized
agtttgctaggtttgtagtggc

SEQ ID NO: 1209584 - DNA, 22 bp, Artificial Sequence
  chemically synthesized
cttagtttgctaggtttgtagt

SEQ ID NO: 1209585 - DNA, 22 bp, Artificial Sequence
  chemically synthesized
gaaatctacttagtttgctagg

SEQ ID NO: 1209586 - DNA, 22 bp, Artificial Sequence
  chemically synthesized
agaaatctacttagtttgctag

SEQ ID NO: 1209587 - DNA, 22 bp, Artificial Sequence
  chemically synthesized
tagaaatctacttagtttgcta

SEQ ID NO: 1209588 - DNA, 22 bp, Artificial Sequence
  chemically synthesized
caaacctagcaaactaagtaga

SEQ ID NO: 1209589 - DNA, 22 bp, Artificial Sequence
  chemically synthesized
aaaactttagaaatctacttag

SEQ ID NO: 1209590 - DNA, 22 bp, Artificial Sequence
  chemically synthesized
ctgaaaactttagaaatctact

SEQ ID NO: 1209591 - DNA, 22 bp, Artificial Sequence
  chemically synthesized
gctgaaaactttagaaatctac

SEQ ID NO: 1209592 - DNA, 22 bp, Artificial Sequence
  chemically synthesized
gcaaactaagtagatttctaaa

SEQ ID NO: 1209593 - DNA, 22 bp, Artificial Sequence
  chemically synthesized
acttgctgaaaactttagaaat

SEQ ID NO: 1209594 - DNA, 22 bp, Artificial Sequence
  chemically synthesized
cacttgctgaaaactttagaaa

SEQ ID NO: 1209595 - DNA, 22 bp, Artificial Sequence
  chemically synthesized
tcacttgctgaaaactttagaa

SEQ ID NO: 1209596 - DNA, 22 bp, Artificial Sequence
  chemically synthesized
agtagatttctaaagttttcag

SEQ ID NO: 1209597 - DNA, 22 bp, Artificial Sequence
  chemically synthesized
tgttttcacttgctgaaaactt

SEQ ID NO: 1209598 - DNA, 22 bp, Artificial Sequence
  chemically synthesized
atgttttcacttgctgaaaact

SEQ ID NO: 1209599 - DNA, 22 bp, Artificial Sequence
  chemically synthesized
ctaaagttttcagcaagtgaaa

SEQ ID NO: 1209600 - DNA, 22 bp, Artificial Sequence
  chemically synthesized
taaagttttcagcaagtgaaaa

SEQ ID NO: 1209601 - DNA, 22 bp, Artificial Sequence
  chemically synthesized
aagttttcagcaagtgaaaaca

SEQ ID NO: 1209602 - DNA, 22 bp, Artificial Sequence
  chemically synthesized
tcagcaagtgaaaacataaatg

SEQ ID NO: 1209603 - DNA, 22 bp, Artificial Sequence
  chemically synthesized
cagcaagtgaaaacataaatgt

SEQ ID NO: 1209604 - DNA, 22 bp, Artificial Sequence
  chemically synthesized
agcaagtgaaaacataaatgtc

SEQ ID NO: 1209605 - DNA, 22 bp, Artificial Sequence
  chemically synthesized
tcaatgatgagatgacatttat

SEQ ID NO: 1209606 - DNA, 22 bp, Artificial Sequence
  chemically synthesized
gtcaatgatgagatgacattta

SEQ ID NO: 1209607 - DNA, 22 bp, Artificial Sequence
  chemically synthesized
gggaatttgtcaatgatgagat

SEQ ID NO: 1209608 - DNA, 22 bp, Artificial Sequence
  chemically synthesized
acaaaatgggattagggaattt

SEQ ID NO: 1209609 - DNA, 22 bp, Artificial Sequence
  chemically synthesized
atcattgacaaattccctaatc

SEQ ID NO: 1209610 - DNA, 22 bp, Artificial Sequence
  chemically synthesized
acaaattccctaatcccatttt

SEQ ID NO: 1209611 - DNA, 22 bp, Artificial Sequence
  chemically synthesized
cctaatcccattttgttaatac

SEQ ID NO: 1209612 - DNA, 22 bp, Artificial Sequence
  chemically synthesized
atcccattttgttaatacacac

SEQ ID NO: 1209613 - DNA, 22 bp, Artificial Sequence
  chemically synthesized
tgttaatacacacacacacaca

SEQ ID NO: 1209614 - DNA, 22 bp, Artificial Sequence
  chemically synthesized
gttaatacacacacacacacac

SEQ ID NO: 1209615 - DNA, 22 bp, Artificial Sequence
  chemically synthesized
ttaatacacacacacacacaca

SEQ ID NO: 1209616 - DNA, 22 bp, Artificial Sequence
  chemically synthesized
atacacacacacacacacacac

SEQ ID NO: 1209617 - DNA, 22 bp, Artificial Sequence
  chemically synthesized
gggcacagaaggagtagtggca

SEQ ID NO: 1209618 - DNA, 22 bp, Artificial Sequence
  chemically synthesized
tgccactactccttctgtgccc

SEQ ID NO: 1209619 - DNA, 22 bp, Artificial Sequence
  chemically synthesized
ccactactccttctgtgcccca

SEQ ID NO: 1209620 - DNA, 22 bp, Artificial Sequence
  chemically synthesized
aaaaaagccgtattggggcaca

SEQ ID NO: 1209621 - DNA, 22 bp, Artificial Sequence
  chemically synthesized
gaaaaaagccgtattggggcac

SEQ ID NO: 1209622 - DNA, 22 bp, Artificial Sequence
  chemically synthesized
ctccttctgtgccccaatacgg

SEQ ID NO: 1209623 - DNA, 22 bp, Artificial Sequence
  chemically synthesized
cttctgtgccccaatacggctt

SEQ ID NO: 1209624 - DNA, 22 bp, Artificial Sequence
  chemically synthesized
ctgtgccccaatacggcttttt

SEQ ID NO: 1209625 - DNA, 22 bp, Artificial Sequence
  chemically synthesized
tgtgccccaatacggctttttt

SEQ ID NO: 1209626 - DNA, 22 bp, Artificial Sequence
  chemically synthesized
tgccccaatacggcttttttca

SEQ ID NO: 1209627 - DNA, 22 bp, Artificial Sequence
  chemically synthesized
atataatagtagtttgaaaaaa

SEQ ID NO: 1209628 - DNA, 22 bp, Artificial Sequence
  chemically synthesized
gatataatagtagtttgaaaaa

SEQ ID NO: 1209629 - DNA, 22 bp, Artificial Sequence
  chemically synthesized
ttttcaaactactattatatca

SEQ ID NO: 1209630 - DNA, 22 bp, Artificial Sequence
  chemically synthesized
tttcaaactactattatatcaa

SEQ ID NO: 1209631 - DNA, 22 bp, Artificial Sequence
  chemically synthesized
ttcaaactactattatatcaag

SEQ ID NO: 1209632 - DNA, 22 bp, Artificial Sequence
  chemically synthesized
tcaaactactattatatcaagg

SEQ ID NO: 1209633 - DNA, 22 bp, Artificial Sequence
  chemically synthesized
caaactactattatatcaaggg

SEQ ID NO: 1209634 - DNA, 22 bp, Artificial Sequence
  chemically synthesized
aaactactattatatcaagggc

SEQ ID NO: 1209635 - DNA, 22 bp, Artificial Sequence
  chemically synthesized
caaagacataatcacagccctt

SEQ ID NO: 1209636 - DNA, 22 bp, Artificial Sequence
  chemically synthesized
ctattatatcaagggctgtgat

SEQ ID NO: 1209637 - DNA, 22 bp, Artificial Sequence
  chemically synthesized
ttatatcaagggctgtgattat

SEQ ID NO: 1209638 - DNA, 22 bp, Artificial Sequence
  chemically synthesized
tatcaagggctgtgattatgtc

SEQ ID NO: 1209639 - DNA, 22 bp, Artificial Sequence
  chemically synthesized
aaaatattgcaaagacataatc

SEQ ID NO: 1209640 - DNA, 22 bp, Artificial Sequence
  chemically synthesized
tgattatgtctttgcaatattt

SEQ ID NO: 1209641 - DNA, 22 bp, Artificial Sequence
  chemically synthesized
aggggtgagacactgaaaatat

SEQ ID NO: 1209642 - DNA, 22 bp, Artificial Sequence
  chemically synthesized
caggggtgagacactgaaaata

SEQ ID NO: 1209643 - DNA, 22 bp, Artificial Sequence
  chemically synthesized
tgtctttgcaatattttcagtg

SEQ ID NO: 1209644 - DNA, 22 bp, Artificial Sequence
  chemically synthesized
tcaggggtgagacactgaaaat

SEQ ID NO: 1209645 - DNA, 22 bp, Artificial Sequence
  chemically synthesized
tgcaatattttcagtgtctcac

SEQ ID NO: 1209646 - DNA, 22 bp, Artificial Sequence
  chemically synthesized
gcaatattttcagtgtctcacc

SEQ ID NO: 1209647 - DNA, 22 bp, Artificial Sequence
  chemically synthesized
caatattttcagtgtctcaccc

SEQ ID NO: 1209648 - DNA, 22 bp, Artificial Sequence
  chemically synthesized
tgcatctttcaggggtgagaca

SEQ ID NO: 1209649 - DNA, 22 bp, Artificial Sequence
  chemically synthesized
ttatgcatctttcaggggtgag

SEQ ID NO: 1209650 - DNA, 22 bp, Artificial Sequence
  chemically synthesized
ttgttatgcatctttcaggggt

SEQ ID NO: 1209651 - DNA, 22 bp, Artificial Sequence
  chemically synthesized
tcagtgtctcacccctgaaaga

SEQ ID NO: 1209652 - DNA, 22 bp, Artificial Sequence
  chemically synthesized
cagtgtctcacccctgaaagat

SEQ ID NO: 1209653 - DNA, 22 bp, Artificial Sequence
  chemically synthesized
agtgtctcacccctgaaagatg

SEQ ID NO: 1209654 - DNA, 22 bp, Artificial Sequence
  chemically synthesized
accaattgttgttatgcatctt

SEQ ID NO: 1209655 - DNA, 22 bp, Artificial Sequence
  chemically synthesized
aaccaattgttgttatgcatct

SEQ ID NO: 1209656 - DNA, 22 bp, Artificial Sequence
  chemically synthesized
acccctgaaagatgcataacaa

SEQ ID NO: 1209657 - DNA, 22 bp, Artificial Sequence
  chemically synthesized
tatttaaccaattgttgttatg

SEQ ID NO: 1209658 - DNA, 22 bp, Artificial Sequence
  chemically synthesized
gttatatttaaccaattgttgt

SEQ ID NO: 1209659 - DNA, 22 bp, Artificial Sequence
  chemically synthesized
aaagatgcataacaacaattgg

SEQ ID NO: 1209660 - DNA, 22 bp, Artificial Sequence
  chemically synthesized
agttatatttaaccaattgttg

SEQ ID NO: 1209661 - DNA, 22 bp, Artificial Sequence
  chemically synthesized
tttagttatatttaaccaattg

SEQ ID NO: 1209662 - DNA, 22 bp, Artificial Sequence
  chemically synthesized
gttaaatataactaaatagtat

SEQ ID NO: 1209663 - DNA, 22 bp, Artificial Sequence
  chemically synthesized
aatataactaaatagtattccc

SEQ ID NO: 1209664 - DNA, 22 bp, Artificial Sequence
  chemically synthesized
gagagtcatcacagggaatact

SEQ ID NO: 1209665 - DNA, 22 bp, Artificial Sequence
  chemically synthesized
ggagagtcatcacagggaatac

SEQ ID NO: 1209666 - DNA, 22 bp, Artificial Sequence
  chemically synthesized
tggagagtcatcacagggaata

SEQ ID NO: 1209667 - DNA, 22 bp, Artificial Sequence
  chemically synthesized
aatagtattccctgtgatgact

SEQ ID NO: 1209668 - DNA, 22 bp, Artificial Sequence
  chemically synthesized
gtatattttggagagtcatcac

SEQ ID NO: 1209669 - DNA, 22 bp, Artificial Sequence
  chemically synthesized
cctgtgatgactctccaaaata

SEQ ID NO: 1209670 - DNA, 22 bp, Artificial Sequence
  chemically synthesized
tgatgactctccaaaatatacg

SEQ ID NO: 1209671 - DNA, 22 bp, Artificial Sequence
  chemically synthesized
tccaaaatatacgagtttctgt

SEQ ID NO: 1209672 - DNA, 22 bp, Artificial Sequence
  chemically synthesized
caaaatatacgagtttctgtac

SEQ ID NO: 1209673 - DNA, 22 bp, Artificial Sequence
  chemically synthesized
aaatagcaaaagtggtacagaa

SEQ ID NO: 1209674 - DNA, 22 bp, Artificial Sequence
  chemically synthesized
tgaaatagcaaaagtggtacag

SEQ ID NO: 1209675 - DNA, 22 bp, Artificial Sequence
  chemically synthesized
ctgtaccacttttgctatttca

SEQ ID NO: 1209676 - DNA, 22 bp, Artificial Sequence
  chemically synthesized
tgtaccacttttgctatttcag

SEQ ID NO: 1209677 - DNA, 22 bp, Artificial Sequence
  chemically synthesized
aaatagtcaacctctgaaatag

SEQ ID NO: 1209678 - DNA, 22 bp, Artificial Sequence
  chemically synthesized
taccacttttgctatttcagag

SEQ ID NO: 1209679 - DNA, 22 bp, Artificial Sequence
  chemically synthesized
gcattaaaatagtcaacctctg

SEQ ID NO: 1209680 - DNA, 22 bp, Artificial Sequence
  chemically synthesized
tagcattaaaatagtcaacctc

SEQ ID NO: 1209681 - DNA, 22 bp, Artificial Sequence
  chemically synthesized
ttgctatttcagaggttgacta

SEQ ID NO: 1209682 - DNA, 22 bp, Artificial Sequence
  chemically synthesized
tgctatttcagaggttgactat

SEQ ID NO: 1209683 - DNA, 22 bp, Artificial Sequence
  chemically synthesized
gctatttcagaggttgactatt

SEQ ID NO: 1209684 - DNA, 22 bp, Artificial Sequence
  chemically synthesized
ctatttcagaggttgactattt

SEQ ID NO: 1209685 - DNA, 22 bp, Artificial Sequence
  chemically synthesized
gctctagcattaaaatagtcaa

SEQ ID NO: 1209686 - DNA, 22 bp, Artificial Sequence
  chemically synthesized
tggctctagcattaaaatagtc

SEQ ID NO: 1209687 - DNA, 22 bp, Artificial Sequence
  chemically synthesized
tttcagaggttgactattttaa

SEQ ID NO: 1209688 - DNA, 22 bp, Artificial Sequence
  chemically synthesized
cagaggttgactattttaatgc

SEQ ID NO: 1209689 - DNA, 22 bp, Artificial Sequence
  chemically synthesized
agaggttgactattttaatgct

SEQ ID NO: 1209690 - DNA, 22 bp, Artificial Sequence
  chemically synthesized
tgtctctggctctagcattaaa

SEQ ID NO: 1209691 - DNA, 22 bp, Artificial Sequence
  chemically synthesized
ctgtgtctctggctctagcatt

SEQ ID NO: 1209692 - DNA, 22 bp, Artificial Sequence
  chemically synthesized
actattttaatgctagagccag

SEQ ID NO: 1209693 - DNA, 22 bp, Artificial Sequence
  chemically synthesized
gattactgtgtctctggctcta

SEQ ID NO: 1209694 - DNA, 22 bp, Artificial Sequence
  chemically synthesized
ggattactgtgtctctggctct

SEQ ID NO: 1209695 - DNA, 22 bp, Artificial Sequence
  chemically synthesized
ttttaatgctagagccagagac

SEQ ID NO: 1209696 - DNA, 22 bp, Artificial Sequence
  chemically synthesized
taatgctagagccagagacaca

SEQ ID NO: 1209697 - DNA, 22 bp, Artificial Sequence
  chemically synthesized
aatgctagagccagagacacag

SEQ ID NO: 1209698 - DNA, 22 bp, Artificial Sequence
  chemically synthesized
atgctagagccagagacacagt

SEQ ID NO: 1209699 - DNA, 22 bp, Artificial Sequence
  chemically synthesized
agcatgtcacttggattactgt

SEQ ID NO: 1209700 - DNA, 22 bp, Artificial Sequence
  chemically synthesized
gagccagagacacagtaatcca

SEQ ID NO: 1209701 - DNA, 22 bp, Artificial Sequence
  chemically synthesized
gagcatgtcacttggattactg

SEQ ID NO: 1209702 - DNA, 22 bp, Artificial Sequence
  chemically synthesized
gtttgagcatgtcacttggatt

SEQ ID NO: 1209703 - DNA, 22 bp, Artificial Sequence
  chemically synthesized
agtttgagcatgtcacttggat

SEQ ID NO: 1209704 - DNA, 22 bp, Artificial Sequence
  chemically synthesized
tagtttgagcatgtcacttgga

SEQ ID NO: 1209705 - DNA, 22 bp, Artificial Sequence
  chemically synthesized
ttagtttgagcatgtcacttgg

SEQ ID NO: 1209706 - DNA, 22 bp, Artificial Sequence
  chemically synthesized
atcagtgcttttagtttgagca

SEQ ID NO: 1209707 - DNA, 22 bp, Artificial Sequence
  chemically synthesized
gatcagtgcttttagtttgagc

SEQ ID NO: 1209708 - DNA, 22 bp, Artificial Sequence
  chemically synthesized
ttgatcagtgcttttagtttga

SEQ ID NO: 1209709 - DNA, 22 bp, Artificial Sequence
  chemically synthesized
attcttgatcagtgcttttagt

SEQ ID NO: 1209710 - DNA, 22 bp, Artificial Sequence
  chemically synthesized
tcattcttgatcagtgctttta

SEQ ID NO: 1209711 - DNA, 22 bp, Artificial Sequence
  chemically synthesized
aaactaaaagcactgatcaaga

SEQ ID NO: 1209712 - DNA, 22 bp, Artificial Sequence
  chemically synthesized
aaagcactgatcaagaatgaga

SEQ ID NO: 1209713 - DNA, 22 bp, Artificial Sequence
  chemically synthesized
aaagataaaacaaaatcctctc

SEQ ID NO: 1209714 - DNA, 22 bp, Artificial Sequence
  chemically synthesized
atcaagaatgagaggattttgt

SEQ ID NO: 1209715 - DNA, 22 bp, Artificial Sequence
  chemically synthesized
tgttttatctttgaggtttata

SEQ ID NO: 1209716 - DNA, 22 bp, Artificial Sequence
  chemically synthesized
agaagaataatgtataaacctc

SEQ ID NO: 1209717 - DNA, 22 bp, Artificial Sequence
  chemically synthesized
gttttatctttgaggtttatac

SEQ ID NO: 1209718 - DNA, 22 bp, Artificial Sequence
  chemically synthesized
gagaagaataatgtataaacct

SEQ ID NO: 1209719 - DNA, 22 bp, Artificial Sequence
  chemically synthesized
ttttatctttgaggtttataca

SEQ ID NO: 1209720 - DNA, 22 bp, Artificial Sequence
  chemically synthesized
tatctttgaggtttatacatta

SEQ ID NO: 1209721 - DNA, 22 bp, Artificial Sequence
  chemically synthesized
atctttgaggtttatacattat

SEQ ID NO: 1209722 - DNA, 22 bp, Artificial Sequence
  chemically synthesized
tctttgaggtttatacattatt

SEQ ID NO: 1209723 - DNA, 22 bp, Artificial Sequence
  chemically synthesized
tgaggtttatacattattcttc

SEQ ID NO: 1209724 - DNA, 22 bp, Artificial Sequence
  chemically synthesized
gaggtttatacattattcttct

SEQ ID NO: 1209725 - DNA, 22 bp, Artificial Sequence
  chemically synthesized
agcccatccttgagaagaataa

SEQ ID NO: 1209726 - DNA, 22 bp, Artificial Sequence
  chemically synthesized
aggtttatacattattcttctc

SEQ ID NO: 1209727 - DNA, 22 bp, Artificial Sequence
  chemically synthesized
atacattattcttctcaaggat

SEQ ID NO: 1209728 - DNA, 22 bp, Artificial Sequence
  chemically synthesized
gatgttgagcccatccttgaga

SEQ ID NO: 1209729 - DNA, 22 bp, Artificial Sequence
  chemically synthesized
tacattattcttctcaaggatg

SEQ ID NO: 1209730 - DNA, 22 bp, Artificial Sequence
  chemically synthesized
agatgttgagcccatccttgag

SEQ ID NO: 1209731 - DNA, 22 bp, Artificial Sequence
  chemically synthesized
ttcttctcaaggatgggctcaa

SEQ ID NO: 1209732 - DNA, 22 bp, Artificial Sequence
  chemically synthesized
ttctcaaggatgggctcaacat

SEQ ID NO: 1209733 - DNA, 22 bp, Artificial Sequence
  chemically synthesized
ctcaaggatgggctcaacatct

SEQ ID NO: 1209734 - DNA, 22 bp, Artificial Sequence
  chemically synthesized
tcaaggatgggctcaacatcta

SEQ ID NO: 1209735 - DNA, 22 bp, Artificial Sequence
  chemically synthesized
aaggatgggctcaacatctaag

SEQ ID NO: 1209736 - DNA, 22 bp, Artificial Sequence
  chemically synthesized
acatgtaagatacttagatgtt

SEQ ID NO: 1209737 - DNA, 22 bp, Artificial Sequence
  chemically synthesized
aacatgtaagatacttagatgt

SEQ ID NO: 1209738 - DNA, 22 bp, Artificial Sequence
  chemically synthesized
atttaacatgtaagatacttag

SEQ ID NO: 1209739 - DNA, 22 bp, Artificial Sequence
  chemically synthesized
catttaacatgtaagatactta

SEQ ID NO: 1209740 - DNA, 22 bp, Artificial Sequence
  chemically synthesized
aacatctaagtatcttacatgt

SEQ ID NO: 1209741 - DNA, 22 bp, Artificial Sequence
  chemically synthesized
gaatggtttcatttaacatgta

SEQ ID NO: 1209742 - DNA, 22 bp, Artificial Sequence
  chemically synthesized
ggaatggtttcatttaacatgt

SEQ ID NO: 1209743 - DNA, 22 bp, Artificial Sequence
  chemically synthesized
agtatcttacatgttaaatgaa

SEQ ID NO: 1209744 - DNA, 22 bp, Artificial Sequence
  chemically synthesized
acttggaatggtttcatttaac

SEQ ID NO: 1209745 - DNA, 22 bp, Artificial Sequence
  chemically synthesized
gacttggaatggtttcatttaa

SEQ ID NO: 1209746 - DNA, 22 bp, Artificial Sequence
  chemically synthesized
tgacttggaatggtttcattta

SEQ ID NO: 1209747 - DNA, 22 bp, Artificial Sequence
  chemically synthesized
ttgacttggaatggtttcattt

SEQ ID NO: 1209748 - DNA, 22 bp, Artificial Sequence
  chemically synthesized
tttgacttggaatggtttcatt

SEQ ID NO: 1209749 - DNA, 22 bp, Artificial Sequence
  chemically synthesized
acatgttaaatgaaaccattcc

SEQ ID NO: 1209750 - DNA, 22 bp, Artificial Sequence
  chemically synthesized
tctttttgacttggaatggttt

SEQ ID NO: 1209751 - DNA, 22 bp, Artificial Sequence
  chemically synthesized
catgttaaatgaaaccattcca

SEQ ID NO: 1209752 - DNA, 22 bp, Artificial Sequence
  chemically synthesized
atctttttgacttggaatggtt

SEQ ID NO: 1209753 - DNA, 22 bp, Artificial Sequence
  chemically synthesized
tatctttttgacttggaatggt

SEQ ID NO: 1209754 - DNA, 22 bp, Artificial Sequence
  chemically synthesized
ttatctttttgacttggaatgg

SEQ ID NO: 1209755 - DNA, 22 bp, Artificial Sequence
  chemically synthesized
aatgaaaccattccaagtcaaa

SEQ ID NO: 1209756 - DNA, 22 bp, Artificial Sequence
  chemically synthesized
gtatttttatctttttgacttg

SEQ ID NO: 1209757 - DNA, 22 bp, Artificial Sequence
  chemically synthesized
caagtcaaaaagataaaaatac

SEQ ID NO: 1209758 - DNA, 22 bp, Artificial Sequence
  chemically synthesized
tataaatatattggtattttta

SEQ ID NO: 1209759 - DNA, 22 bp, Artificial Sequence
  chemically synthesized
tatataaatatattggtatttt

SEQ ID NO: 1209760 - DNA, 22 bp, Artificial Sequence
  chemically synthesized
gtgctctatataaatatattgg

SEQ ID NO: 1209761 - DNA, 22 bp, Artificial Sequence
  chemically synthesized
ctagtgctctatataaatatat

SEQ ID NO: 1209762 - DNA, 22 bp, Artificial Sequence
  chemically synthesized
ggacctcctagtgctctatata

SEQ ID NO: 1209763 - DNA, 22 bp, Artificial Sequence
  chemically synthesized
gttaggacctcctagtgctcta

SEQ ID NO: 1209764 - DNA, 22 bp, Artificial Sequence
  chemically synthesized
agttaggacctcctagtgctct

SEQ ID NO: 1209765 - DNA, 22 bp, Artificial Sequence
  chemically synthesized
gcttagttaggacctcctagtg

SEQ ID NO: 1209766 - DNA, 22 bp, Artificial Sequence
  chemically synthesized
atatagagcactaggaggtcct

SEQ ID NO: 1209767 - DNA, 22 bp, Artificial Sequence
  chemically synthesized
tatagagcactaggaggtccta

SEQ ID NO: 1209768 - DNA, 22 bp, Artificial Sequence
  chemically synthesized
ggaggtcctaactaagccagtg

SEQ ID NO: 1209769 - DNA, 22 bp, Artificial Sequence
  chemically synthesized
actaagccagtgattttgatac

SEQ ID NO: 1209770 - DNA, 22 bp, Artificial Sequence
  chemically synthesized
tggcatagtcagagtatcaaaa

SEQ ID NO: 1209771 - DNA, 22 bp, Artificial Sequence
  chemically synthesized
agccagtgattttgatactctg

SEQ ID NO: 1209772 - DNA, 22 bp, Artificial Sequence
  chemically synthesized
gctatggcatagtcagagtatc

SEQ ID NO: 1209773 - DNA, 22 bp, Artificial Sequence
  chemically synthesized
aattggctatggcatagtcaga

SEQ ID NO: 1209774 - DNA, 22 bp, Artificial Sequence
  chemically synthesized
gaattggctatggcatagtcag

SEQ ID NO: 1209775 - DNA, 22 bp, Artificial Sequence
  chemically synthesized
cttgaattggctatggcatagt

SEQ ID NO: 1209776 - DNA, 22 bp, Artificial Sequence
  chemically synthesized
tgatactctgactatgccatag

SEQ ID NO: 1209777 - DNA, 22 bp, Artificial Sequence
  chemically synthesized
gatactctgactatgccatagc

SEQ ID NO: 1209778 - DNA, 22 bp, Artificial Sequence
  chemically synthesized
ctccttgaattggctatggcat

SEQ ID NO: 1209779 - DNA, 22 bp, Artificial Sequence
  chemically synthesized
atactctgactatgccatagcc

SEQ ID NO: 1209780 - DNA, 22 bp, Artificial Sequence
  chemically synthesized
ttactccttgaattggctatgg

SEQ ID NO: 1209781 - DNA, 22 bp, Artificial Sequence
  chemically synthesized
tattactccttgaattggctat

SEQ ID NO: 1209782 - DNA, 22 bp, Artificial Sequence
  chemically synthesized
ctattactccttgaattggcta

SEQ ID NO: 1209783 - DNA, 22 bp, Artificial Sequence
  chemically synthesized
tgactatgccatagccaattca

SEQ ID NO: 1209784 - DNA, 22 bp, Artificial Sequence
  chemically synthesized
actatgccatagccaattcaag

SEQ ID NO: 1209785 - DNA, 22 bp, Artificial Sequence
  chemically synthesized
cttctattactccttgaattgg

SEQ ID NO: 1209786 - DNA, 22 bp, Artificial Sequence
  chemically synthesized
ccttctattactccttgaattg

SEQ ID NO: 1209787 - DNA, 22 bp, Artificial Sequence
  chemically synthesized
tgccatagccaattcaaggagt

SEQ ID NO: 1209788 - DNA, 22 bp, Artificial Sequence
  chemically synthesized
aggtgtttccttctattactcc

SEQ ID NO: 1209789 - DNA, 22 bp, Artificial Sequence
  chemically synthesized
caggtgtttccttctattactc

SEQ ID NO: 1209790 - DNA, 22 bp, Artificial Sequence
  chemically synthesized
aaggagtaatagaaggaaacac

SEQ ID NO: 1209791 - DNA, 22 bp, Artificial Sequence
  chemically synthesized
taccggtttcaggtgtttcctt

SEQ ID NO: 1209792 - DNA, 22 bp, Artificial Sequence
  chemically synthesized
tgtaccggtttcaggtgtttcc

SEQ ID NO: 1209793 - DNA, 22 bp, Artificial Sequence
  chemically synthesized
ctgtaccggtttcaggtgtttc

SEQ ID NO: 1209794 - DNA, 22 bp, Artificial Sequence
  chemically synthesized
ttctgtaccggtttcaggtgtt

SEQ ID NO: 1209795 - DNA, 22 bp, Artificial Sequence
  chemically synthesized
cttctgtaccggtttcaggtgt

SEQ ID NO: 1209796 - DNA, 22 bp, Artificial Sequence
  chemically synthesized
tcttcttctgtaccggtttcag

SEQ ID NO: 1209797 - DNA, 22 bp, Artificial Sequence
  chemically synthesized
tatcttcttctgtaccggtttc

SEQ ID NO: 1209798 - DNA, 22 bp, Artificial Sequence
  chemically synthesized
gttctatcttcttctgtaccgg

SEQ ID NO: 1209799 - DNA, 22 bp, Artificial Sequence
  chemically synthesized
tagttctatcttcttctgtacc

SEQ ID NO: 1209800 - DNA, 22 bp, Artificial Sequence
  chemically synthesized
ctagttctatcttcttctgtac

SEQ ID NO: 1209801 - DNA, 22 bp, Artificial Sequence
  chemically synthesized
ttctagttctatcttcttctgt

SEQ ID NO: 1209802 - DNA, 22 bp, Artificial Sequence
  chemically synthesized
aaaccggtacagaagaagatag

SEQ ID NO: 1209803 - DNA, 22 bp, Artificial Sequence
  chemically synthesized
acagcccattcttctagttcta

SEQ ID NO: 1209804 - DNA, 22 bp, Artificial Sequence
  chemically synthesized
ggcattgacagcccattcttct

SEQ ID NO: 1209805 - DNA, 22 bp, Artificial Sequence
  chemically synthesized
atcagttaggcattgacagccc

SEQ ID NO: 1209806 - DNA, 22 bp, Artificial Sequence
  chemically synthesized
gaagaatgggctgtcaatgcct

SEQ ID NO: 1209807 - DNA, 22 bp, Artificial Sequence
  chemically synthesized
tcaatgcctaactgatgagggc

SEQ ID NO: 1209808 - DNA, 22 bp, Artificial Sequence
  chemically synthesized
tgaatggccaaccaatgccctc

SEQ ID NO: 1209809 - DNA, 22 bp, Artificial Sequence
  chemically synthesized
actgatgagggcattggttggc

SEQ ID NO: 1209810 - DNA, 22 bp, Artificial Sequence
  chemically synthesized
aaattatgaatggccaaccaat

SEQ ID NO: 1209811 - DNA, 22 bp, Artificial Sequence
  chemically synthesized
caaattatgaatggccaaccaa

SEQ ID NO: 1209812 - DNA, 22 bp, Artificial Sequence
  chemically synthesized
atgagggcattggttggccatt

SEQ ID NO: 1209813 - DNA, 22 bp, Artificial Sequence
  chemically synthesized
ccatttcaaattatgaatggcc

SEQ ID NO: 1209814 - DNA, 22 bp, Artificial Sequence
  chemically synthesized
accatttcaaattatgaatggc

SEQ ID NO: 1209815 - DNA, 22 bp, Artificial Sequence
  chemically synthesized
gtgatttaccatttcaaattat

SEQ ID NO: 1209816 - DNA, 22 bp, Artificial Sequence
  chemically synthesized
gttggccattcataatttgaaa

SEQ ID NO: 1209817 - DNA, 22 bp, Artificial Sequence
  chemically synthesized
gccattcataatttgaaatggt

SEQ ID NO: 1209818 - DNA, 22 bp, Artificial Sequence
  chemically synthesized
ggaaatagctagtgatttacca

SEQ ID NO: 1209819 - DNA, 22 bp, Artificial Sequence
  chemically synthesized
ataatttgaaatggtaaatcac

SEQ ID NO: 1209820 - DNA, 22 bp, Artificial Sequence
  chemically synthesized
aggaaatagctagtgatttacc

SEQ ID NO: 1209821 - DNA, 22 bp, Artificial Sequence
  chemically synthesized
taggaaatagctagtgatttac

SEQ ID NO: 1209822 - DNA, 22 bp, Artificial Sequence
  chemically synthesized
ctttaggaaatagctagtgatt

SEQ ID NO: 1209823 - DNA, 22 bp, Artificial Sequence
  chemically synthesized
gaaatggtaaatcactagctat

SEQ ID NO: 1209824 - DNA, 22 bp, Artificial Sequence
  chemically synthesized
aaatggtaaatcactagctatt

SEQ ID NO: 1209825 - DNA, 22 bp, Artificial Sequence
  chemically synthesized
cagcagtatctgctttaggaaa

SEQ ID NO: 1209826 - DNA, 22 bp, Artificial Sequence
  chemically synthesized
acagcagtatctgctttaggaa

SEQ ID NO: 1209827 - DNA, 22 bp, Artificial Sequence
  chemically synthesized
tacagcagtatctgctttagga

SEQ ID NO: 1209828 - DNA, 22 bp, Artificial Sequence
  chemically synthesized
ttacagcagtatctgctttagg

SEQ ID NO: 1209829 - DNA, 22 bp, Artificial Sequence
  chemically synthesized
gctatttcctaaagcagatact

SEQ ID NO: 1209830 - DNA, 22 bp, Artificial Sequence
  chemically synthesized
tttcctaaagcagatactgctg

SEQ ID NO: 1209831 - DNA, 22 bp, Artificial Sequence
  chemically synthesized
cctaaagcagatactgctgtaa

SEQ ID NO: 1209832 - DNA, 22 bp, Artificial Sequence
  chemically synthesized
ctaaagcagatactgctgtaaa

SEQ ID NO: 1209833 - DNA, 22 bp, Artificial Sequence
  chemically synthesized
aagcagatactgctgtaaaagt

SEQ ID NO: 1209834 - DNA, 22 bp, Artificial Sequence
  chemically synthesized
agggagaaatcagaaactttta

SEQ ID NO: 1209835 - DNA, 22 bp, Artificial Sequence
  chemically synthesized
ctgtaaaagtttctgatttctc

SEQ ID NO: 1209836 - DNA, 22 bp, Artificial Sequence
  chemically synthesized
aatgacctcagggagaaatcag

SEQ ID NO: 1209837 - DNA, 22 bp, Artificial Sequence
  chemically synthesized
aaatgacctcagggagaaatca

SEQ ID NO: 1209838 - DNA, 22 bp, Artificial Sequence
  chemically synthesized
taaaagtttctgatttctccct

SEQ ID NO: 1209839 - DNA, 22 bp, Artificial Sequence
  chemically synthesized
tttaaatgacctcagggagaaa

SEQ ID NO: 1209840 - DNA, 22 bp, Artificial Sequence
  chemically synthesized
ctgatttctccctgaggtcatt

SEQ ID NO: 1209841 - DNA, 22 bp, Artificial Sequence
  chemically synthesized
tgatttctccctgaggtcattt

SEQ ID NO: 1209842 - DNA, 22 bp, Artificial Sequence
  chemically synthesized
atttctccctgaggtcatttaa

SEQ ID NO: 1209843 - DNA, 22 bp, Artificial Sequence
  chemically synthesized
ctccctgaggtcatttaaacag

SEQ ID NO: 1209844 - DNA, 22 bp, Artificial Sequence
  chemically synthesized
tccctgaggtcatttaaacagg

SEQ ID NO: 1209845 - DNA, 22 bp, Artificial Sequence
  chemically synthesized
cctgaggtcatttaaacaggtc

SEQ ID NO: 1209846 - DNA, 22 bp, Artificial Sequence
  chemically synthesized
aaaaatgaagcaaagacctgtt

SEQ ID NO: 1209847 - DNA, 22 bp, Artificial Sequence
  chemically synthesized
aggtcatttaaacaggtctttg

SEQ ID NO: 1209848 - DNA, 22 bp, Artificial Sequence
  chemically synthesized
aaacaggtctttgcttcatttt

SEQ ID NO: 1209849 - DNA, 22 bp, Artificial Sequence
  chemically synthesized
aacaggtctttgcttcattttt

SEQ ID NO: 1209850 - DNA, 22 bp, Artificial Sequence
  chemically synthesized
ataacggcattcaaaaatgaag

SEQ ID NO: 1209851 - DNA, 22 bp, Artificial Sequence
  chemically synthesized
tgcttcatttttgaatgccgtt

SEQ ID NO: 1209852 - DNA, 22 bp, Artificial Sequence
  chemically synthesized
gcttcatttttgaatgccgtta

SEQ ID NO: 1209853 - DNA, 22 bp, Artificial Sequence
  chemically synthesized
cttcatttttgaatgccgttat

SEQ ID NO: 1209854 - DNA, 22 bp, Artificial Sequence
  chemically synthesized
catttttgaatgccgttattaa

SEQ ID NO: 1209855 - DNA, 22 bp, Artificial Sequence
  chemically synthesized
atttttgaatgccgttattaat

SEQ ID NO: 1209856 - DNA, 22 bp, Artificial Sequence
  chemically synthesized
ttgaatgccgttattaattcat

SEQ ID NO: 1209857 - DNA, 22 bp, Artificial Sequence
  chemically synthesized
tgaatgccgttattaattcatg

SEQ ID NO: 1209858 - DNA, 22 bp, Artificial Sequence
  chemically synthesized
gaatgccgttattaattcatga

SEQ ID NO: 1209859 - DNA, 22 bp, Artificial Sequence
  chemically synthesized
aatgccgttattaattcatgac

SEQ ID NO: 1209860 - DNA, 22 bp, Artificial Sequence
  chemically synthesized
ttaattcatgacatattctact

SEQ ID NO: 1209861 - DNA, 22 bp, Artificial Sequence
  chemically synthesized
attcatgacatattctactata

SEQ ID NO: 1209862 - DNA, 22 bp, Artificial Sequence
  chemically synthesized
tgggatgtaagtgcatatagta

SEQ ID NO: 1209863 - DNA, 22 bp, Artificial Sequence
  chemically synthesized
atgacatattctactatatgca

SEQ ID NO: 1209864 - DNA, 22 bp, Artificial Sequence
  chemically synthesized
gtgggatgtaagtgcatatagt

SEQ ID NO: 1209865 - DNA, 22 bp, Artificial Sequence
  chemically synthesized
atcttgtgggatgtaagtgcat

SEQ ID NO: 1209866 - DNA, 22 bp, Artificial Sequence
  chemically synthesized
tactatatgcacttacatccca

SEQ ID NO: 1209867 - DNA, 22 bp, Artificial Sequence
  chemically synthesized
ctatatgcacttacatcccaca

SEQ ID NO: 1209868 - DNA, 22 bp, Artificial Sequence
  chemically synthesized
tatgcacttacatcccacaaga

SEQ ID NO: 1209869 - DNA, 22 bp, Artificial Sequence
  chemically synthesized
caaaggagattcatcttgtggg

SEQ ID NO: 1209870 - DNA, 22 bp, Artificial Sequence
  chemically synthesized
acatcccacaagatgaatctcc

SEQ ID NO: 1209871 - DNA, 22 bp, Artificial Sequence
  chemically synthesized
catcccacaagatgaatctcct

SEQ ID NO: 1209872 - DNA, 22 bp, Artificial Sequence
  chemically synthesized
ggccaataggccctccaaagga

SEQ ID NO: 1209873 - DNA, 22 bp, Artificial Sequence
  chemically synthesized
gtagttgggccaataggccctc

SEQ ID NO: 1209874 - DNA, 22 bp, Artificial Sequence
  chemically synthesized
tattagtagttgggccaatagg

SEQ ID NO: 1209875 - DNA, 22 bp, Artificial Sequence
  chemically synthesized
atattagtagttgggccaatag

SEQ ID NO: 1209876 - DNA, 22 bp, Artificial Sequence
  chemically synthesized
ctttggagggcctattggccca

SEQ ID NO: 1209877 - DNA, 22 bp, Artificial Sequence
  chemically synthesized
tggagggcctattggcccaact

SEQ ID NO: 1209878 - DNA, 22 bp, Artificial Sequence
  chemically synthesized
ggagggcctattggcccaacta

SEQ ID NO: 1209879 - DNA, 22 bp, Artificial Sequence
  chemically synthesized
gagggcctattggcccaactac

SEQ ID NO: 1209880 - DNA, 22 bp, Artificial Sequence
  chemically synthesized
acaatgacttatattagtagtt

SEQ ID NO: 1209881 - DNA, 22 bp, Artificial Sequence
  chemically synthesized
ctaacaatgacttatattagta

SEQ ID NO: 1209882 - DNA, 22 bp, Artificial Sequence
  chemically synthesized
ttggcccaactactaatataag

SEQ ID NO: 1209883 - DNA, 22 bp, Artificial Sequence
  chemically synthesized
tactaacaatgacttatattag

SEQ ID NO: 1209884 - DNA, 22 bp, Artificial Sequence
  chemically synthesized
gcccaactactaatataagtca

SEQ ID NO: 1209885 - DNA, 22 bp, Artificial Sequence
  chemically synthesized
ctaatataagtcattgttagta

SEQ ID NO: 1209886 - DNA, 22 bp, Artificial Sequence
  chemically synthesized
atataagtcattgttagtagaa

SEQ ID NO: 1209887 - DNA, 22 bp, Artificial Sequence
  chemically synthesized
ggaaagggagatgtagaattct

SEQ ID NO: 1209888 - DNA, 22 bp, Artificial Sequence
  chemically synthesized
ttagtagaattctacatctccc

SEQ ID NO: 1209889 - DNA, 22 bp, Artificial Sequence
  chemically synthesized
gtagaattctacatctcccttt

SEQ ID NO: 1209890 - DNA, 22 bp, Artificial Sequence
  chemically synthesized
tacatctccctttcctaacctt

SEQ ID NO: 1209891 - DNA, 22 bp, Artificial Sequence
  chemically synthesized
catctccctttcctaacctttt

SEQ ID NO: 1209892 - DNA, 22 bp, Artificial Sequence
  chemically synthesized
taaacgtagaaagaaaaggtta

SEQ ID NO: 1209893 - DNA, 22 bp, Artificial Sequence
  chemically synthesized
gtaaacgtagaaagaaaaggtt

SEQ ID NO: 1209894 - DNA, 22 bp, Artificial Sequence
  chemically synthesized
cctttcctaaccttttctttct

SEQ ID NO: 1209895 - DNA, 22 bp, Artificial Sequence
  chemically synthesized
ccccttgtaaacgtagaaagaa

SEQ ID NO: 1209896 - DNA, 22 bp, Artificial Sequence
  chemically synthesized
tcctaaccttttctttctacgt

SEQ ID NO: 1209897 - DNA, 22 bp, Artificial Sequence
  chemically synthesized
cctaaccttttctttctacgtt

SEQ ID NO: 1209898 - DNA, 22 bp, Artificial Sequence
  chemically synthesized
ttcccccttgtaaacgtagaaa

SEQ ID NO: 1209899 - DNA, 22 bp, Artificial Sequence
  chemically synthesized
ctaaccttttctttctacgttt

SEQ ID NO: 1209900 - DNA, 22 bp, Artificial Sequence
  chemically synthesized
ctgttcccccttgtaaacgtag

SEQ ID NO: 1209901 - DNA, 22 bp, Artificial Sequence
  chemically synthesized
accttttctttctacgtttaca

SEQ ID NO: 1209902 - DNA, 22 bp, Artificial Sequence
  chemically synthesized
aattgctgttcccccttgtaaa

SEQ ID NO: 1209903 - DNA, 22 bp, Artificial Sequence
  chemically synthesized
ttctttctacgtttacaagggg

SEQ ID NO: 1209904 - DNA, 22 bp, Artificial Sequence
  chemically synthesized
tctttctacgtttacaaggggg

SEQ ID NO: 1209905 - DNA, 22 bp, Artificial Sequence
  chemically synthesized
ctttctacgtttacaaggggga

SEQ ID NO: 1209906 - DNA, 22 bp, Artificial Sequence
  chemically synthesized
tttctacgtttacaagggggaa

SEQ ID NO: 1209907 - DNA, 22 bp, Artificial Sequence
  chemically synthesized
attcaattgctgttcccccttg

SEQ ID NO: 1209908 - DNA, 22 bp, Artificial Sequence
  chemically synthesized
aattcaattgctgttccccctt

SEQ ID NO: 1209909 - DNA, 22 bp, Artificial Sequence
  chemically synthesized
tctacgtttacaagggggaaca

SEQ ID NO: 1209910 - DNA, 22 bp, Artificial Sequence
  chemically synthesized
taattcaattgctgttccccct

SEQ ID NO: 1209911 - DNA, 22 bp, Artificial Sequence
  chemically synthesized
ctacgtttacaagggggaacag

SEQ ID NO: 1209912 - DNA, 22 bp, Artificial Sequence
  chemically synthesized
tacgtttacaagggggaacagc

SEQ ID NO: 1209913 - DNA, 22 bp, Artificial Sequence
  chemically synthesized
ttttaattcaattgctgttccc

SEQ ID NO: 1209914 - DNA, 22 bp, Artificial Sequence
  chemically synthesized
cgtttacaagggggaacagcaa

SEQ ID NO: 1209915 - DNA, 22 bp, Artificial Sequence
  chemically synthesized
attttaattcaattgctgttcc

SEQ ID NO: 1209916 - DNA, 22 bp, Artificial Sequence
  chemically synthesized
acaagggggaacagcaattgaa

SEQ ID NO: 1209917 - DNA, 22 bp, Artificial Sequence
  chemically synthesized
caagggggaacagcaattgaat

SEQ ID NO: 1209918 - DNA, 22 bp, Artificial Sequence
  chemically synthesized
aatgatgtttattttaattcaa

SEQ ID NO: 1209919 - DNA, 22 bp, Artificial Sequence
  chemically synthesized
aaatgatgtttattttaattca

SEQ ID NO: 1209920 - DNA, 22 bp, Artificial Sequence
  chemically synthesized
taaatgatgtttattttaattc

SEQ ID NO: 1209921 - DNA, 22 bp, Artificial Sequence
  chemically synthesized
ttaaatgatgtttattttaatt

SEQ ID NO: 1209922 - DNA, 22 bp, Artificial Sequence
  chemically synthesized
atttttaaatgatgtttatttt

SEQ ID NO: 1209923 - DNA, 22 bp, Artificial Sequence
  chemically synthesized
ctgatttttaaatgatgtttat

SEQ ID NO: 1209924 - DNA, 22 bp, Artificial Sequence
  chemically synthesized
ttgctgatttttaaatgatgtt

SEQ ID NO: 1209925 - DNA, 22 bp, Artificial Sequence
  chemically synthesized
aattaaaataaacatcatttaa

SEQ ID NO: 1209926 - DNA, 22 bp, Artificial Sequence
  chemically synthesized
atgctattgctgatttttaaat

SEQ ID NO: 1209927 - DNA, 22 bp, Artificial Sequence
  chemically synthesized
aaataaacatcatttaaaaatc

SEQ ID NO: 1209928 - DNA, 22 bp, Artificial Sequence
  chemically synthesized
taactcatgctattgctgattt

SEQ ID NO: 1209929 - DNA, 22 bp, Artificial Sequence
  chemically synthesized
ttgtaactcatgctattgctga

SEQ ID NO: 1209930 - DNA, 22 bp, Artificial Sequence
  chemically synthesized
gttattgtaactcatgctattg

SEQ ID NO: 1209931 - DNA, 22 bp, Artificial Sequence
  chemically synthesized
aaaaatcagcaatagcatgagt

SEQ ID NO: 1209932 - DNA, 22 bp, Artificial Sequence
  chemically synthesized
aaaatcagcaatagcatgagtt

SEQ ID NO: 1209933 - DNA, 22 bp, Artificial Sequence
  chemically synthesized
atatagtacagagtaaagacta

SEQ ID NO: 1209934 - DNA, 22 bp, Artificial Sequence
  chemically synthesized
catatagtacagagtaaagact

SEQ ID NO: 1209935 - DNA, 22 bp, Artificial Sequence
  chemically synthesized
caataactagtctttactctgt

SEQ ID NO: 1209936 - DNA, 22 bp, Artificial Sequence
  chemically synthesized
aatacttcatatagtacagagt

SEQ ID NO: 1209937 - DNA, 22 bp, Artificial Sequence
  chemically synthesized
gtctttactctgtactatatga

SEQ ID NO: 1209938 - DNA, 22 bp, Artificial Sequence
  chemically synthesized
atgtatgttaaatacttcatat

SEQ ID NO: 1209939 - DNA, 22 bp, Artificial Sequence
  chemically synthesized
tactctgtactatatgaagtat

SEQ ID NO: 1209940 - DNA, 22 bp, Artificial Sequence
  chemically synthesized
actctgtactatatgaagtatt

SEQ ID NO: 1209941 - DNA, 22 bp, Artificial Sequence
  chemically synthesized
ctctgtactatatgaagtattt

SEQ ID NO: 1209942 - DNA, 22 bp, Artificial Sequence
  chemically synthesized
tgtactatatgaagtatttaac

SEQ ID NO: 1209943 - DNA, 22 bp, Artificial Sequence
  chemically synthesized
tactatatgaagtatttaacat

SEQ ID NO: 1209944 - DNA, 22 bp, Artificial Sequence
  chemically synthesized
tatgaagtatttaacatacatt

SEQ ID NO: 1209945 - DNA, 22 bp, Artificial Sequence
  chemically synthesized
ataataaatgggttaatgtatg

SEQ ID NO: 1209946 - DNA, 22 bp, Artificial Sequence
  chemically synthesized
aacatacattaacccatttatt

SEQ ID NO: 1209947 - DNA, 22 bp, Artificial Sequence
  chemically synthesized
acatacattaacccatttatta

SEQ ID NO: 1209948 - DNA, 22 bp, Artificial Sequence
  chemically synthesized
tgcaatgtggttaataataaat

SEQ ID NO: 1209949 - DNA, 22 bp, Artificial Sequence
  chemically synthesized
gtgcaatgtggttaataataaa

SEQ ID NO: 1209950 - DNA, 22 bp, Artificial Sequence
  chemically synthesized
atttgtgcaatgtggttaataa

SEQ ID NO: 1209951 - DNA, 22 bp, Artificial Sequence
  chemically synthesized
acccatttattattaaccacat

SEQ ID NO: 1209952 - DNA, 22 bp, Artificial Sequence
  chemically synthesized
ctcatttgtgcaatgtggttaa

SEQ ID NO: 1209953 - DNA, 22 bp, Artificial Sequence
  chemically synthesized
cctcatttgtgcaatgtggtta

SEQ ID NO: 1209954 - DNA, 22 bp, Artificial Sequence
  chemically synthesized
attattaaccacattgcacaaa

SEQ ID NO: 1209955 - DNA, 22 bp, Artificial Sequence
  chemically synthesized
ttattaaccacattgcacaaat

SEQ ID NO: 1209956 - DNA, 22 bp, Artificial Sequence
  chemically synthesized
gtcagtttcctcatttgtgcaa

SEQ ID NO: 1209957 - DNA, 22 bp, Artificial Sequence
  chemically synthesized
ttaaccacattgcacaaatgag

SEQ ID NO: 1209958 - DNA, 22 bp, Artificial Sequence
  chemically synthesized
gttcgtcagtttcctcatttgt

SEQ ID NO: 1209959 - DNA, 22 bp, Artificial Sequence
  chemically synthesized
accacattgcacaaatgaggaa

SEQ ID NO: 1209960 - DNA, 22 bp, Artificial Sequence
  chemically synthesized
cacaaatgaggaaactgacgaa

SEQ ID NO: 1209961 - DNA, 22 bp, Artificial Sequence
  chemically synthesized
cacaagcaattagttcgtcagt

SEQ ID NO: 1209962 - DNA, 22 bp, Artificial Sequence
  chemically synthesized
acacaagcaattagttcgtcag

SEQ ID NO: 1209963 - DNA, 22 bp, Artificial Sequence
  chemically synthesized
tacacaagcaattagttcgtca

SEQ ID NO: 1209964 - DNA, 22 bp, Artificial Sequence
  chemically synthesized
aaaactttacacaagcaattag

SEQ ID NO: 1209965 - DNA, 22 bp, Artificial Sequence
  chemically synthesized
aaaaactttacacaagcaatta

SEQ ID NO: 1209966 - DNA, 22 bp, Artificial Sequence
  chemically synthesized
acgaactaattgcttgtgtaaa

SEQ ID NO: 1209967 - DNA, 22 bp, Artificial Sequence
  chemically synthesized
attgcttgtgtaaagtttttaa

SEQ ID NO: 1209968 - DNA, 22 bp, Artificial Sequence
  chemically synthesized
ccagatgtgtgaccttaaaaac

SEQ ID NO: 1209969 - DNA, 22 bp, Artificial Sequence
  chemically synthesized
cttgtgtaaagtttttaaggtc

SEQ ID NO: 1209970 - DNA, 22 bp, Artificial Sequence
  chemically synthesized
cctaccagatgtgtgaccttaa

SEQ ID NO: 1209971 - DNA, 22 bp, Artificial Sequence
  chemically synthesized
gtgtaaagtttttaaggtcaca

SEQ ID NO: 1209972 - DNA, 22 bp, Artificial Sequence
  chemically synthesized
tgtaaagtttttaaggtcacac

SEQ ID NO: 1209973 - DNA, 22 bp, Artificial Sequence
  chemically synthesized
ctacctaccagatgtgtgacct

SEQ ID NO: 1209974 - DNA, 22 bp, Artificial Sequence
  chemically synthesized
tgctacctaccagatgtgtgac

SEQ ID NO: 1209975 - DNA, 22 bp, Artificial Sequence
  chemically synthesized
gctctgctacctaccagatgtg

SEQ ID NO: 1209976 - DNA, 22 bp, Artificial Sequence
  chemically synthesized
ttaaggtcacacatctggtagg

SEQ ID NO: 1209977 - DNA, 22 bp, Artificial Sequence
  chemically synthesized
taaggtcacacatctggtaggt

SEQ ID NO: 1209978 - DNA, 22 bp, Artificial Sequence
  chemically synthesized
aaggtcacacatctggtaggta

SEQ ID NO: 1209979 - DNA, 22 bp, Artificial Sequence
  chemically synthesized
aggtcacacatctggtaggtag

SEQ ID NO: 1209980 - DNA, 22 bp, Artificial Sequence
  chemically synthesized
aatcctagctctgctacctacc

SEQ ID NO: 1209981 - DNA, 22 bp, Artificial Sequence
  chemically synthesized
gaatcctagctctgctacctac

SEQ ID NO: 1209982 - DNA, 22 bp, Artificial Sequence
  chemically synthesized
tgaatcctagctctgctaccta

SEQ ID NO: 1209983 - DNA, 22 bp, Artificial Sequence
  chemically synthesized
tctttgaatcctagctctgcta

SEQ ID NO: 1209984 - DNA, 22 bp, Artificial Sequence
  chemically synthesized
cactgtctttgaatcctagctc

SEQ ID NO: 1209985 - DNA, 22 bp, Artificial Sequence
  chemically synthesized
gtaggtagcagagctaggattc

SEQ ID NO: 1209986 - DNA, 22 bp, Artificial Sequence
  chemically synthesized
agctgcactgtctttgaatcct

SEQ ID NO: 1209987 - DNA, 22 bp, Artificial Sequence
  chemically synthesized
gagctgcactgtctttgaatcc

SEQ ID NO: 1209988 - DNA, 22 bp, Artificial Sequence
  chemically synthesized
ttgagctgcactgtctttgaat

SEQ ID NO: 1209989 - DNA, 22 bp, Artificial Sequence
  chemically synthesized
ggattcaaagacagtgcagctc

SEQ ID NO: 1209990 - DNA, 22 bp, Artificial Sequence
  chemically synthesized
aaagacagtgcagctcaagagc

SEQ ID NO: 1209991 - DNA, 22 bp, Artificial Sequence
  chemically synthesized
tgtaagagtaaagagcataggc

SEQ ID NO: 1209992 - DNA, 22 bp, Artificial Sequence
  chemically synthesized
tatgtaagagtaaagagcatag

SEQ ID NO: 1209993 - DNA, 22 bp, Artificial Sequence
  chemically synthesized
cctctatgtaagagtaaagagc

SEQ ID NO: 1209994 - DNA, 22 bp, Artificial Sequence
  chemically synthesized
aagagcctatgctctttactct

SEQ ID NO: 1209995 - DNA, 22 bp, Artificial Sequence
  chemically synthesized
aaacgtctacctctatgtaaga

SEQ ID NO: 1209996 - DNA, 22 bp, Artificial Sequence
  chemically synthesized
aaaacgtctacctctatgtaag

SEQ ID NO: 1209997 - DNA, 22 bp, Artificial Sequence
  chemically synthesized
tgctctttactcttacatagag

SEQ ID NO: 1209998 - DNA, 22 bp, Artificial Sequence
  chemically synthesized
taaaacgtctacctctatgtaa

SEQ ID NO: 1209999 - DNA, 22 bp, Artificial Sequence
  chemically synthesized
tttactcttacatagaggtaga

SEQ ID NO: 1210000 - DNA, 22 bp, Artificial Sequence
  chemically synthesized
tccctttaaaacgtctacctct

SEQ ID NO: 1210001 - DNA, 22 bp, Artificial Sequence
  chemically synthesized
tactcttacatagaggtagacg

SEQ ID NO: 1210002 - DNA, 22 bp, Artificial Sequence
  chemically synthesized
gtccctttaaaacgtctacctc

SEQ ID NO: 1210003 - DNA, 22 bp, Artificial Sequence
  chemically synthesized
actcttacatagaggtagacgt

SEQ ID NO: 1210004 - DNA, 22 bp, Artificial Sequence
  chemically synthesized
tgtccctttaaaacgtctacct

SEQ ID NO: 1210005 - DNA, 22 bp, Artificial Sequence
  chemically synthesized
ctcttacatagaggtagacgtt

SEQ ID NO: 1210006 - DNA, 22 bp, Artificial Sequence
  chemically synthesized
ttgtccctttaaaacgtctacc

SEQ ID NO: 1210007 - DNA, 22 bp, Artificial Sequence
  chemically synthesized
ttacatagaggtagacgtttta

SEQ ID NO: 1210008 - DNA, 22 bp, Artificial Sequence
  chemically synthesized
acatagaggtagacgttttaaa

SEQ ID NO: 1210009 - DNA, 22 bp, Artificial Sequence
  chemically synthesized
catagaggtagacgttttaaag

SEQ ID NO: 1210010 - DNA, 22 bp, Artificial Sequence
  chemically synthesized
agaatatttttgtccctttaaa

SEQ ID NO: 1210011 - DNA, 22 bp, Artificial Sequence
  chemically synthesized
taaagggacaaaaatattctga

SEQ ID NO: 1210012 - DNA, 22 bp, Artificial Sequence
  chemically synthesized
aaagggacaaaaatattctgag

SEQ ID NO: 1210013 - DNA, 22 bp, Artificial Sequence
  chemically synthesized
aagggacaaaaatattctgagt

SEQ ID NO: 1210014 - DNA, 22 bp, Artificial Sequence
  chemically synthesized
catagggagaaatgatcaactc

SEQ ID NO: 1210015 - DNA, 22 bp, Artificial Sequence
  chemically synthesized
acatagggagaaatgatcaact

SEQ ID NO: 1210016 - DNA, 22 bp, Artificial Sequence
  chemically synthesized
acttacatagggagaaatgatc

SEQ ID NO: 1210017 - DNA, 22 bp, Artificial Sequence
  chemically synthesized
gttcacttacatagggagaaat

SEQ ID NO: 1210018 - DNA, 22 bp, Artificial Sequence
  chemically synthesized
tgagttgatcatttctccctat

SEQ ID NO: 1210019 - DNA, 22 bp, Artificial Sequence
  chemically synthesized
agttgatcatttctccctatgt

SEQ ID NO: 1210020 - DNA, 22 bp, Artificial Sequence
  chemically synthesized
atcatttctccctatgtaagtg

SEQ ID NO: 1210021 - DNA, 22 bp, Artificial Sequence
  chemically synthesized
gggagtgatatattagttcact

SEQ ID NO: 1210022 - DNA, 22 bp, Artificial Sequence
  chemically synthesized
ctccctatgtaagtgaactaat

SEQ ID NO: 1210023 - DNA, 22 bp, Artificial Sequence
  chemically synthesized
tccctatgtaagtgaactaata

SEQ ID NO: 1210024 - DNA, 22 bp, Artificial Sequence
  chemically synthesized
cctatgtaagtgaactaatata

SEQ ID NO: 1210025 - DNA, 22 bp, Artificial Sequence
  chemically synthesized
attagggagtgatatattagtt

SEQ ID NO: 1210026 - DNA, 22 bp, Artificial Sequence
  chemically synthesized
tgtaagtgaactaatatatcac

SEQ ID NO: 1210027 - DNA, 22 bp, Artificial Sequence
  chemically synthesized
ggatacagggattgattaggga

SEQ ID NO: 1210028 - DNA, 22 bp, Artificial Sequence
  chemically synthesized
aggatacagggattgattaggg

SEQ ID NO: 1210029 - DNA, 22 bp, Artificial Sequence
  chemically synthesized
taggatacagggattgattagg

SEQ ID NO: 1210030 - DNA, 22 bp, Artificial Sequence
  chemically synthesized
atatatcactccctaatcaatc

SEQ ID NO: 1210031 - DNA, 22 bp, Artificial Sequence
  chemically synthesized
tttaggatacagggattgatta

SEQ ID NO: 1210032 - DNA, 22 bp, Artificial Sequence
  chemically synthesized
actctttaggatacagggattg

SEQ ID NO: 1210033 - DNA, 22 bp, Artificial Sequence
  chemically synthesized
tattaactctttaggatacagg

SEQ ID NO: 1210034 - DNA, 22 bp, Artificial Sequence
  chemically synthesized
cctaatcaatccctgtatccta

SEQ ID NO: 1210035 - DNA, 22 bp, Artificial Sequence
  chemically synthesized
atcaatccctgtatcctaaaga

SEQ ID NO: 1210036 - DNA, 22 bp, Artificial Sequence
  chemically synthesized
catcctatattaactctttagg

SEQ ID NO: 1210037 - DNA, 22 bp, Artificial Sequence
  chemically synthesized
tattacatcctatattaactct

SEQ ID NO: 1210038 - DNA, 22 bp, Artificial Sequence
  chemically synthesized
tatcctaaagagttaatatagg

SEQ ID NO: 1210039 - DNA, 22 bp, Artificial Sequence
  chemically synthesized
gatcatcctatattacatccta

SEQ ID NO: 1210040 - DNA, 22 bp, Artificial Sequence
  chemically synthesized
aagagttaatataggatgtaat

SEQ ID NO: 1210041 - DNA, 22 bp, Artificial Sequence
  chemically synthesized
agatcatcctatattacatcct

SEQ ID NO: 1210042 - DNA, 22 bp, Artificial Sequence
  chemically synthesized
ttagatcatcctatattacatc

SEQ ID NO: 1210043 - DNA, 22 bp, Artificial Sequence
  chemically synthesized
atataggatgtaatataggatg

SEQ ID NO: 1210044 - DNA, 22 bp, Artificial Sequence
  chemically synthesized
tatccgagttcttagatcatcc

SEQ ID NO: 1210045 - DNA, 22 bp, Artificial Sequence
  chemically synthesized
ttgtatccgagttcttagatca

SEQ ID NO: 1210046 - DNA, 22 bp, Artificial Sequence
  chemically synthesized
atataggggggagtctgttgta

SEQ ID NO: 1210047 - DNA, 22 bp, Artificial Sequence
  chemically synthesized
gatataggggggagtctgttgt

SEQ ID NO: 1210048 - DNA, 22 bp, Artificial Sequence
  chemically synthesized
agaactcggatacaacagactc

SEQ ID NO: 1210049 - DNA, 22 bp, Artificial Sequence
  chemically synthesized
cttgatataggggggagtctgt

SEQ ID NO: 1210050 - DNA, 22 bp, Artificial Sequence
  chemically synthesized
gcttgatataggggggagtctg

SEQ ID NO: 1210051 - DNA, 22 bp, Artificial Sequence
  chemically synthesized
ttgcttgatataggggggagtc

SEQ ID NO: 1210052 - DNA, 22 bp, Artificial Sequence
  chemically synthesized
ggatacaacagactccccccta

SEQ ID NO: 1210053 - DNA, 22 bp, Artificial Sequence
  chemically synthesized
gcataagggactcttgcttgat

SEQ ID NO: 1210054 - DNA, 22 bp, Artificial Sequence
  chemically synthesized
ggcataagggactcttgcttga

SEQ ID NO: 1210055 - DNA, 22 bp, Artificial Sequence
  chemically synthesized
ccccctatatcaagcaagagtc

SEQ ID NO: 1210056 - DNA, 22 bp, Artificial Sequence
  chemically synthesized
tgcttggcataagggactcttg

SEQ ID NO: 1210057 - DNA, 22 bp, Artificial Sequence
  chemically synthesized
tatcaagcaagagtcccttatg

SEQ ID NO: 1210058 - DNA, 22 bp, Artificial Sequence
  chemically synthesized
gccatcacgggtaattatgctt

SEQ ID NO: 1210059 - DNA, 22 bp, Artificial Sequence
  chemically synthesized
tgttagccatcacgggtaatta

SEQ ID NO: 1210060 - DNA, 22 bp, Artificial Sequence
  chemically synthesized
atgttagccatcacgggtaatt

SEQ ID NO: 1210061 - DNA, 22 bp, Artificial Sequence
  chemically synthesized
atgccaagcataattacccgtg

SEQ ID NO: 1210062 - DNA, 22 bp, Artificial Sequence
  chemically synthesized
tatgttagccatcacgggtaat

SEQ ID NO: 1210063 - DNA, 22 bp, Artificial Sequence
  chemically synthesized
tgccaagcataattacccgtga

SEQ ID NO: 1210064 - DNA, 22 bp, Artificial Sequence
  chemically synthesized
cccaaacgattttatgttagcc

SEQ ID NO: 1210065 - DNA, 22 bp, Artificial Sequence
  chemically synthesized
ccccaaacgattttatgttagc

SEQ ID NO: 1210066 - DNA, 22 bp, Artificial Sequence
  chemically synthesized
tccccaaacgattttatgttag

SEQ ID NO: 1210067 - DNA, 22 bp, Artificial Sequence
  chemically synthesized
cccgtgatggctaacataaaat

SEQ ID NO: 1210068 - DNA, 22 bp, Artificial Sequence
  chemically synthesized
ttttccccaaacgattttatgt

SEQ ID NO: 1210069 - DNA, 22 bp, Artificial Sequence
  chemically synthesized
attttccccaaacgattttatg

SEQ ID NO: 1210070 - DNA, 22 bp, Artificial Sequence
  chemically synthesized
atatgtttattttccccaaacg

SEQ ID NO: 1210071 - DNA, 22 bp, Artificial Sequence
  chemically synthesized
gatatgtttattttccccaaac

SEQ ID NO: 1210072 - DNA, 22 bp, Artificial Sequence
  chemically synthesized
acataaaatcgtttggggaaaa

SEQ ID NO: 1210073 - DNA, 22 bp, Artificial Sequence
  chemically synthesized
aacaatttgatatgtttatttt

SEQ ID NO: 1210074 - DNA, 22 bp, Artificial Sequence
  chemically synthesized
aaacaatttgatatgtttattt

SEQ ID NO: 1210075 - DNA, 22 bp, Artificial Sequence
  chemically synthesized
agcttaaacaatttgatatgtt

SEQ ID NO: 1210076 - DNA, 22 bp, Artificial Sequence
  chemically synthesized
gagcttaaacaatttgatatgt

SEQ ID NO: 1210077 - DNA, 22 bp, Artificial Sequence
  chemically synthesized
ggggaaaataaacatatcaaat

SEQ ID NO: 1210078 - DNA, 22 bp, Artificial Sequence
  chemically synthesized
gggaaaataaacatatcaaatt

SEQ ID NO: 1210079 - DNA, 22 bp, Artificial Sequence
  chemically synthesized
cttgagcttaaacaatttgata

SEQ ID NO: 1210080 - DNA, 22 bp, Artificial Sequence
  chemically synthesized
taaatctacttgagcttaaaca

SEQ ID NO: 1210081 - DNA, 22 bp, Artificial Sequence
  chemically synthesized
tgtaaatctacttgagcttaaa

SEQ ID NO: 1210082 - DNA, 22 bp, Artificial Sequence
  chemically synthesized
ctgtaaatctacttgagcttaa

SEQ ID NO: 1210083 - DNA, 22 bp, Artificial Sequence
  chemically synthesized
cccgagtttctgtaaatctact

SEQ ID NO: 1210084 - DNA, 22 bp, Artificial Sequence
  chemically synthesized
gcccgagtttctgtaaatctac

SEQ ID NO: 1210085 - DNA, 22 bp, Artificial Sequence
  chemically synthesized
tttaagctcaagtagatttaca

SEQ ID NO: 1210086 - DNA, 22 bp, Artificial Sequence
  chemically synthesized
aagctcaagtagatttacagaa

SEQ ID NO: 1210087 - DNA, 22 bp, Artificial Sequence
  chemically synthesized
agctcaagtagatttacagaaa

SEQ ID NO: 1210088 - DNA, 22 bp, Artificial Sequence
  chemically synthesized
aagtagatttacagaaactcgg

SEQ ID NO: 1210089 - DNA, 22 bp, Artificial Sequence
  chemically synthesized
gaacacatgagtttgcccgagt

SEQ ID NO: 1210090 - DNA, 22 bp, Artificial Sequence
  chemically synthesized
ggaacacatgagtttgcccgag

SEQ ID NO: 1210091 - DNA, 22 bp, Artificial Sequence
  chemically synthesized
tcttggaacacatgagtttgcc

SEQ ID NO: 1210092 - DNA, 22 bp, Artificial Sequence
  chemically synthesized
acagaaactcgggcaaactcat

SEQ ID NO: 1210093 - DNA, 22 bp, Artificial Sequence
  chemically synthesized
cagaaactcgggcaaactcatg

SEQ ID NO: 1210094 - DNA, 22 bp, Artificial Sequence
  chemically synthesized
tggtgttatcttggaacacatg

SEQ ID NO: 1210095 - DNA, 22 bp, Artificial Sequence
  chemically synthesized
gggcaaactcatgtgttccaag

SEQ ID NO: 1210096 - DNA, 22 bp, Artificial Sequence
  chemically synthesized
tgacagtctgtggtgttatctt

SEQ ID NO: 1210097 - DNA, 22 bp, Artificial Sequence
  chemically synthesized
atgtgttccaagataacaccac

SEQ ID NO: 1210098 - DNA, 22 bp, Artificial Sequence
  chemically synthesized
ctgtgacagtctgtggtgttat

SEQ ID NO: 1210099 - DNA, 22 bp, Artificial Sequence
  chemically synthesized
caagataacaccacagactgtc

SEQ ID NO: 1210100 - DNA, 22 bp, Artificial Sequence
  chemically synthesized
ccagatgagttgctgtgacagt

SEQ ID NO: 1210101 - DNA, 22 bp, Artificial Sequence
  chemically synthesized
accagatgagttgctgtgacag

SEQ ID NO: 1210102 - DNA, 22 bp, Artificial Sequence
  chemically synthesized
gcttaccagatgagttgctgtg

SEQ ID NO: 1210103 - DNA, 22 bp, Artificial Sequence
  chemically synthesized
gtcagaattagcttaccagatg

SEQ ID NO: 1210104 - DNA, 22 bp, Artificial Sequence
  chemically synthesized
tcacagcaactcatctggtaag

SEQ ID NO: 1210105 - DNA, 22 bp, Artificial Sequence
  chemically synthesized
gacagattggtcagaattagct

SEQ ID NO: 1210106 - DNA, 22 bp, Artificial Sequence
  chemically synthesized
tcgacagattggtcagaattag

SEQ ID NO: 1210107 - DNA, 22 bp, Artificial Sequence
  chemically synthesized
atctggtaagctaattctgacc

SEQ ID NO: 1210108 - DNA, 22 bp, Artificial Sequence
  chemically synthesized
gtaagctaattctgaccaatct

SEQ ID NO: 1210109 - DNA, 22 bp, Artificial Sequence
  chemically synthesized
agtatgctctcgacagattggt

SEQ ID NO: 1210110 - DNA, 22 bp, Artificial Sequence
  chemically synthesized
taagtatgctctcgacagattg

SEQ ID NO: 1210111 - DNA, 22 bp, Artificial Sequence
  chemically synthesized
attctgaccaatctgtcgagag

SEQ ID NO: 1210112 - DNA, 22 bp, Artificial Sequence
  chemically synthesized
tgaccaatctgtcgagagcata

SEQ ID NO: 1210113 - DNA, 22 bp, Artificial Sequence
  chemically synthesized
gatggttctaagtatgctctcg

SEQ ID NO: 1210114 - DNA, 22 bp, Artificial Sequence
  chemically synthesized
accaatctgtcgagagcatact

SEQ ID NO: 1210115 - DNA, 22 bp, Artificial Sequence
  chemically synthesized
agctggatggttctaagtatgc

SEQ ID NO: 1210116 - DNA, 22 bp, Artificial Sequence
  chemically synthesized
tcgagagcatacttagaaccat

SEQ ID NO: 1210117 - DNA, 22 bp, Artificial Sequence
  chemically synthesized
cacgctgagctggatggttcta

SEQ ID NO: 1210118 - DNA, 22 bp, Artificial Sequence
  chemically synthesized
acacgctgagctggatggttct

SEQ ID NO: 1210119 - DNA, 22 bp, Artificial Sequence
  chemically synthesized
tacacgctgagctggatggttc

SEQ ID NO: 1210120 - DNA, 22 bp, Artificial Sequence
  chemically synthesized
agagttttacacgctgagctgg

SEQ ID NO: 1210121 - DNA, 22 bp, Artificial Sequence
  chemically synthesized
aagagttttacacgctgagctg

SEQ ID NO: 1210122 - DNA, 22 bp, Artificial Sequence
  chemically synthesized
agaaccatccagctcagcgtgt

SEQ ID NO: 1210123 - DNA, 22 bp, Artificial Sequence
  chemically synthesized
gaaccatccagctcagcgtgta

SEQ ID NO: 1210124 - DNA, 22 bp, Artificial Sequence
  chemically synthesized
agcgtgtaaaactcttaagtat

SEQ ID NO: 1210125 - DNA, 22 bp, Artificial Sequence
  chemically synthesized
agaagaggagcatgacggaagg

SEQ ID NO: 1210126 - DNA, 22 bp, Artificial Sequence
  chemically synthesized
tcagaagaggagcatgacggaa

SEQ ID NO: 1210127 - DNA, 22 bp, Artificial Sequence
  chemically synthesized
ttaagtatccttccgtcatgct

SEQ ID NO: 1210128 - DNA, 22 bp, Artificial Sequence
  chemically synthesized
aagtatccttccgtcatgctcc

SEQ ID NO: 1210129 - DNA, 22 bp, Artificial Sequence
  chemically synthesized
agtatccttccgtcatgctcct

SEQ ID NO: 1210130 - DNA, 22 bp, Artificial Sequence
  chemically synthesized
ccgtcatgctcctcttctgaga

SEQ ID NO: 1210131 - DNA, 22 bp, Artificial Sequence
  chemically synthesized
cgtcatgctcctcttctgagag

SEQ ID NO: 1210132 - DNA, 22 bp, Artificial Sequence
  chemically synthesized
agggaatagtcatagcctctca

SEQ ID NO: 1210133 - DNA, 22 bp, Artificial Sequence
  chemically synthesized
cagggaatagtcatagcctctc

SEQ ID NO: 1210134 - DNA, 22 bp, Artificial Sequence
  chemically synthesized
ctcttctgagaggctatgacta

SEQ ID NO: 1210135 - DNA, 22 bp, Artificial Sequence
  chemically synthesized
ttctgagaggctatgactattc

SEQ ID NO: 1210136 - DNA, 22 bp, Artificial Sequence
  chemically synthesized
ctgagaggctatgactattccc

SEQ ID NO: 1210137 - DNA, 22 bp, Artificial Sequence
  chemically synthesized
tgagaggctatgactattccct

SEQ ID NO: 1210138 - DNA, 22 bp, Artificial Sequence
  chemically synthesized
agaggctatgactattccctga

SEQ ID NO: 1210139 - DNA, 22 bp, Artificial Sequence
  chemically synthesized
tgactattccctgaaggtggtg

SEQ ID NO: 1210140 - DNA, 22 bp, Artificial Sequence
  chemically synthesized
cagggaaagggtaagcaccacc

SEQ ID NO: 1210141 - DNA, 22 bp, Artificial Sequence
  chemically synthesized
acagggaaagggtaagcaccac

SEQ ID NO: 1210142 - DNA, 22 bp, Artificial Sequence
  chemically synthesized
ttccctgaaggtggtgcttacc

SEQ ID NO: 1210143 - DNA, 22 bp, Artificial Sequence
  chemically synthesized
cctgaaggtggtgcttaccctt

SEQ ID NO: 1210144 - DNA, 22 bp, Artificial Sequence
  chemically synthesized
aatttacagggaaagggtaagc

SEQ ID NO: 1210145 - DNA, 22 bp, Artificial Sequence
  chemically synthesized
ttaaatttacagggaaagggta

SEQ ID NO: 1210146 - DNA, 22 bp, Artificial Sequence
  chemically synthesized
aaggtggtgcttaccctttccc

SEQ ID NO: 1210147 - DNA, 22 bp, Artificial Sequence
  chemically synthesized
gttaaatttacagggaaagggt

SEQ ID NO: 1210148 - DNA, 22 bp, Artificial Sequence
  chemically synthesized
agcttgttaaatttacagggaa

SEQ ID NO: 1210149 - DNA, 22 bp, Artificial Sequence
  chemically synthesized
accctttccctgtaaatttaac

SEQ ID NO: 1210150 - DNA, 22 bp, Artificial Sequence
  chemically synthesized
ccctttccctgtaaatttaaca

SEQ ID NO: 1210151 - DNA, 22 bp, Artificial Sequence
  chemically synthesized
tccctgtaaatttaacaagctc

SEQ ID NO: 1210152 - DNA, 22 bp, Artificial Sequence
  chemically synthesized
ccctgtaaatttaacaagctca

SEQ ID NO: 1210153 - DNA, 22 bp, Artificial Sequence
  chemically synthesized
atcacccaaagctgagcttgtt

SEQ ID NO: 1210154 - DNA, 22 bp, Artificial Sequence
  chemically synthesized
cctgtaaatttaacaagctcag

SEQ ID NO: 1210155 - DNA, 22 bp, Artificial Sequence
  chemically synthesized
taaatttaacaagctcagcttt

SEQ ID NO: 1210156 - DNA, 22 bp, Artificial Sequence
  chemically synthesized
aacaagctcagctttgggtgat

SEQ ID NO: 1210157 - DNA, 22 bp, Artificial Sequence
  chemically synthesized
acaagctcagctttgggtgatc

SEQ ID NO: 1210158 - DNA, 22 bp, Artificial Sequence
  chemically synthesized
cagtcaaaggtgttgatcaccc

SEQ ID NO: 1210159 - DNA, 22 bp, Artificial Sequence
  chemically synthesized
agctttgggtgatcaacacctt

SEQ ID NO: 1210160 - DNA, 22 bp, Artificial Sequence
  chemically synthesized
taatgtcctccagtcaaaggtg

SEQ ID NO: 1210161 - DNA, 22 bp, Artificial Sequence
  chemically synthesized
tgggtgatcaacacctttgact

SEQ ID NO: 1210162 - DNA, 22 bp, Artificial Sequence
  chemically synthesized
gggtgatcaacacctttgactg

SEQ ID NO: 1210163 - DNA, 22 bp, Artificial Sequence
  chemically synthesized
ggtgatcaacacctttgactgg

SEQ ID NO: 1210164 - DNA, 22 bp, Artificial Sequence
  chemically synthesized
tgactggaggacattacaggtg

SEQ ID NO: 1210165 - DNA, 22 bp, Artificial Sequence
  chemically synthesized
gactggaggacattacaggtgt

SEQ ID NO: 1210166 - DNA, 22 bp, Artificial Sequence
  chemically synthesized
actggaggacattacaggtgtt

SEQ ID NO: 1210167 - DNA, 22 bp, Artificial Sequence
  chemically synthesized
gaggacattacaggtgtttcta

SEQ ID NO: 1210168 - DNA, 22 bp, Artificial Sequence
  chemically synthesized
tgaatgaataccatagaaacac

SEQ ID NO: 1210169 - DNA, 22 bp, Artificial Sequence
  chemically synthesized
atgaatgaataccatagaaaca

SEQ ID NO: 1210170 - DNA, 22 bp, Artificial Sequence
  chemically synthesized
gtttatgaatgaataccataga

SEQ ID NO: 1210171 - DNA, 22 bp, Artificial Sequence
  chemically synthesized
agtttatgaatgaataccatag

SEQ ID NO: 1210172 - DNA, 22 bp, Artificial Sequence
  chemically synthesized
tagtttatgaatgaataccata

SEQ ID NO: 1210173 - DNA, 22 bp, Artificial Sequence
  chemically synthesized
ttagtttatgaatgaataccat

SEQ ID NO: 1210174 - DNA, 22 bp, Artificial Sequence
  chemically synthesized
caggtgtttctatggtattcat

SEQ ID NO: 1210175 - DNA, 22 bp, Artificial Sequence
  chemically synthesized
cttttagtttatgaatgaatac

SEQ ID NO: 1210176 - DNA, 22 bp, Artificial Sequence
  chemically synthesized
tacttttagtttatgaatgaat

SEQ ID NO: 1210177 - DNA, 22 bp, Artificial Sequence
  chemically synthesized
ctatggtattcattcataaact

SEQ ID NO: 1210178 - DNA, 22 bp, Artificial Sequence
  chemically synthesized
tatggtattcattcataaacta

SEQ ID NO: 1210179 - DNA, 22 bp, Artificial Sequence
  chemically synthesized
tggtattcattcataaactaaa

SEQ ID NO: 1210180 - DNA, 22 bp, Artificial Sequence
  chemically synthesized
agtcagctctacttttagttta

SEQ ID NO: 1210181 - DNA, 22 bp, Artificial Sequence
  chemically synthesized
cagtcagctctacttttagttt

SEQ ID NO: 1210182 - DNA, 22 bp, Artificial Sequence
  chemically synthesized
tcagtcagctctacttttagtt

SEQ ID NO: 1210183 - DNA, 22 bp, Artificial Sequence
  chemically synthesized
attcataaactaaaagtagagc

SEQ ID NO: 1210184 - DNA, 22 bp, Artificial Sequence
  chemically synthesized
ataaactaaaagtagagctgac

SEQ ID NO: 1210185 - DNA, 22 bp, Artificial Sequence
  chemically synthesized
taaataccaggctttcagtcag

SEQ ID NO: 1210186 - DNA, 22 bp, Artificial Sequence
  chemically synthesized
aaagtagagctgactgaaagcc

SEQ ID NO: 1210187 - DNA, 22 bp, Artificial Sequence
  chemically synthesized
gctataaataccaggctttcag

SEQ ID NO: 1210188 - DNA, 22 bp, Artificial Sequence
  chemically synthesized
gctagctataaataccaggctt

SEQ ID NO: 1210189 - DNA, 22 bp, Artificial Sequence
  chemically synthesized
tcgctagctataaataccaggc

SEQ ID NO: 1210190 - DNA, 22 bp, Artificial Sequence
  chemically synthesized
tctcgctagctataaataccag

SEQ ID NO: 1210191 - DNA, 22 bp, Artificial Sequence
  chemically synthesized
ctctcgctagctataaatacca

SEQ ID NO: 1210192 - DNA, 22 bp, Artificial Sequence
  chemically synthesized
actgaaagcctggtatttatag

SEQ ID NO: 1210193 - DNA, 22 bp, Artificial Sequence
  chemically synthesized
aaagcctggtatttatagctag

SEQ ID NO: 1210194 - DNA, 22 bp, Artificial Sequence
  chemically synthesized
gacatttctctcgctagctata

SEQ ID NO: 1210195 - DNA, 22 bp, Artificial Sequence
  chemically synthesized
gtatttatagctagcgagagaa

SEQ ID NO: 1210196 - DNA, 22 bp, Artificial Sequence
  chemically synthesized
ataattggacatttctctcgct

SEQ ID NO: 1210197 - DNA, 22 bp, Artificial Sequence
  chemically synthesized
atctaataattggacatttctc

SEQ ID NO: 1210198 - DNA, 22 bp, Artificial Sequence
  chemically synthesized
atagctagcgagagaaatgtcc

SEQ ID NO: 1210199 - DNA, 22 bp, Artificial Sequence
  chemically synthesized
tagctagcgagagaaatgtcca

SEQ ID NO: 1210200 - DNA, 22 bp, Artificial Sequence
  chemically synthesized
gcgagagaaatgtccaattatt

SEQ ID NO: 1210201 - DNA, 22 bp, Artificial Sequence
  chemically synthesized
acgaaaatgaacctcatctaat

SEQ ID NO: 1210202 - DNA, 22 bp, Artificial Sequence
  chemically synthesized
aaataattaacgaaaatgaacc

SEQ ID NO: 1210203 - DNA, 22 bp, Artificial Sequence
  chemically synthesized
ttagatgaggttcattttcgtt

SEQ ID NO: 1210204 - DNA, 22 bp, Artificial Sequence
  chemically synthesized
gatgaggttcattttcgttaat

SEQ ID NO: 1210205 - DNA, 22 bp, Artificial Sequence
  chemically synthesized
attttcgttaattattttagtt

SEQ ID NO: 1210206 - DNA, 22 bp, Artificial Sequence
  chemically synthesized
tgtagtcataataactaaaata

SEQ ID NO: 1210207 - DNA, 22 bp, Artificial Sequence
  chemically synthesized
ttatgtagtcataataactaaa

SEQ ID NO: 1210208 - DNA, 22 bp, Artificial Sequence
  chemically synthesized
tcgttaattattttagttatta

SEQ ID NO: 1210209 - DNA, 22 bp, Artificial Sequence
  chemically synthesized
cgttaattattttagttattat

SEQ ID NO: 1210210 - DNA, 22 bp, Artificial Sequence
  chemically synthesized
gttaattattttagttattatg

SEQ ID NO: 1210211 - DNA, 22 bp, Artificial Sequence
  chemically synthesized
attattttagttattatgacta

SEQ ID NO: 1210212 - DNA, 22 bp, Artificial Sequence
  chemically synthesized
ttttagttattatgactacata

SEQ ID NO: 1210213 - DNA, 22 bp, Artificial Sequence
  chemically synthesized
tagttattatgactacataata

SEQ ID NO: 1210214 - DNA, 22 bp, Artificial Sequence
  chemically synthesized
agttattatgactacataatag

SEQ ID NO: 1210215 - DNA, 22 bp, Artificial Sequence
  chemically synthesized
gttattatgactacataatagt

SEQ ID NO: 1210216 - DNA, 22 bp, Artificial Sequence
  chemically synthesized
ttatgactacataatagttgta

SEQ ID NO: 1210217 - DNA, 22 bp, Artificial Sequence
  chemically synthesized
tgactacataatagttgtacat

SEQ ID NO: 1210218 - DNA, 22 bp, Artificial Sequence
  chemically synthesized
cataatagttgtacatttgggg

SEQ ID NO: 1210219 - DNA, 22 bp, Artificial Sequence
  chemically synthesized
atgtatcaaaatatcccatgca

SEQ ID NO: 1210220 - DNA, 22 bp, Artificial Sequence
  chemically synthesized
tacatttggggtgcatgggata

SEQ ID NO: 1210221 - DNA, 22 bp, Artificial Sequence
  chemically synthesized
tattcatgtatcaaaatatccc

SEQ ID NO: 1210222 - DNA, 22 bp, Artificial Sequence
  chemically synthesized
ggggtgcatgggatattttgat

SEQ ID NO: 1210223 - DNA, 22 bp, Artificial Sequence
  chemically synthesized
gggtgcatgggatattttgata

SEQ ID NO: 1210224 - DNA, 22 bp, Artificial Sequence
  chemically synthesized
catgttgtattcatgtatcaaa

SEQ ID NO: 1210225 - DNA, 22 bp, Artificial Sequence
  chemically synthesized
tcattacatgttgtattcatgt

SEQ ID NO: 1210226 - DNA, 22 bp, Artificial Sequence
  chemically synthesized
atcattacatgttgtattcatg

SEQ ID NO: 1210227 - DNA, 22 bp, Artificial Sequence
  chemically synthesized
atttatcattacatgttgtatt

SEQ ID NO: 1210228 - DNA, 22 bp, Artificial Sequence
  chemically synthesized
tgatacatgaatacaacatgta

SEQ ID NO: 1210229 - DNA, 22 bp, Artificial Sequence
  chemically synthesized
gatacatgaatacaacatgtaa

SEQ ID NO: 1210230 - DNA, 22 bp, Artificial Sequence
  chemically synthesized
cctgatttatcattacatgttg

SEQ ID NO: 1210231 - DNA, 22 bp, Artificial Sequence
  chemically synthesized
atacatgaatacaacatgtaat

SEQ ID NO: 1210232 - DNA, 22 bp, Artificial Sequence
  chemically synthesized
ccctgatttatcattacatgtt

SEQ ID NO: 1210233 - DNA, 22 bp, Artificial Sequence
  chemically synthesized
atttccctgatttatcattaca

SEQ ID NO: 1210234 - DNA, 22 bp, Artificial Sequence
  chemically synthesized
aggtgatggatgccctaatttc

SEQ ID NO: 1210235 - DNA, 22 bp, Artificial Sequence
  chemically synthesized
gaggtgatggatgccctaattt

SEQ ID NO: 1210236 - DNA, 22 bp, Artificial Sequence
  chemically synthesized
gggcatccatcacctcaagcat

SEQ ID NO: 1210237 - DNA, 22 bp, Artificial Sequence
  chemically synthesized
acataaatgataaatgcttgag

SEQ ID NO: 1210238 - DNA, 22 bp, Artificial Sequence
  chemically synthesized
gctaacataaatgataaatgct

SEQ ID NO: 1210239 - DNA, 22 bp, Artificial Sequence
  chemically synthesized
agctaacataaatgataaatgc

SEQ ID NO: 1210240 - DNA, 22 bp, Artificial Sequence
  chemically synthesized
gaatttagctaacataaatgat

SEQ ID NO: 1210241 - DNA, 22 bp, Artificial Sequence
  chemically synthesized
aagcatttatcatttatgttag

SEQ ID NO: 1210242 - DNA, 22 bp, Artificial Sequence
  chemically synthesized
aattggaatttagctaacataa

SEQ ID NO: 1210243 - DNA, 22 bp, Artificial Sequence
  chemically synthesized
atcatttatgttagctaaattc

SEQ ID NO: 1210244 - DNA, 22 bp, Artificial Sequence
  chemically synthesized
tcatttatgttagctaaattcc

SEQ ID NO: 1210245 - DNA, 22 bp, Artificial Sequence
  chemically synthesized
aaaataatagttaaattggaat

SEQ ID NO: 1210246 - DNA, 22 bp, Artificial Sequence
  chemically synthesized
atgttagctaaattccaattta

SEQ ID NO: 1210247 - DNA, 22 bp, Artificial Sequence
  chemically synthesized
caaaataatagttaaattggaa

SEQ ID NO: 1210248 - DNA, 22 bp, Artificial Sequence
  chemically synthesized
tgttagctaaattccaatttaa

SEQ ID NO: 1210249 - DNA, 22 bp, Artificial Sequence
  chemically synthesized
tatttcaaaataatagttaaat

SEQ ID NO: 1210250 - DNA, 22 bp, Artificial Sequence
  chemically synthesized
gctaaattccaatttaactatt

SEQ ID NO: 1210251 - DNA, 22 bp, Artificial Sequence
  chemically synthesized
atatttcaaaataatagttaaa

SEQ ID NO: 1210252 - DNA, 22 bp, Artificial Sequence
  chemically synthesized
aattccaatttaactattattt

SEQ ID NO: 1210253 - DNA, 22 bp, Artificial Sequence
  chemically synthesized
caatttaactattattttgaaa

SEQ ID NO: 1210254 - DNA, 22 bp, Artificial Sequence
  chemically synthesized
ccaataatttatatttcaaaat

SEQ ID NO: 1210255 - DNA, 22 bp, Artificial Sequence
  chemically synthesized
aactattattttgaaatataaa

SEQ ID NO: 1210256 - DNA, 22 bp, Artificial Sequence
  chemically synthesized
actattattttgaaatataaat

SEQ ID NO: 1210257 - DNA, 22 bp, Artificial Sequence
  chemically synthesized
tagttaccaataatttatattt

SEQ ID NO: 1210258 - DNA, 22 bp, Artificial Sequence
  chemically synthesized
ttattttgaaatataaattatt

SEQ ID NO: 1210259 - DNA, 22 bp, Artificial Sequence
  chemically synthesized
ttttgaaatataaattattggt

SEQ ID NO: 1210260 - DNA, 22 bp, Artificial Sequence
  chemically synthesized
gagtgattatagttaccaataa

SEQ ID NO: 1210261 - DNA, 22 bp, Artificial Sequence
  chemically synthesized
tgaaatataaattattggtaac

SEQ ID NO: 1210262 - DNA, 22 bp, Artificial Sequence
  chemically synthesized
gaaatataaattattggtaact

SEQ ID NO: 1210263 - DNA, 22 bp, Artificial Sequence
  chemically synthesized
aaatataaattattggtaacta

SEQ ID NO: 1210264 - DNA, 22 bp, Artificial Sequence
  chemically synthesized
gtagcaccctagagtgattata

SEQ ID NO: 1210265 - DNA, 22 bp, Artificial Sequence
  chemically synthesized
ggtagcaccctagagtgattat

SEQ ID NO: 1210266 - DNA, 22 bp, Artificial Sequence
  chemically synthesized
ttggtaactataatcactctag

SEQ ID NO: 1210267 - DNA, 22 bp, Artificial Sequence
  chemically synthesized
gtaactataatcactctagggt

SEQ ID NO: 1210268 - DNA, 22 bp, Artificial Sequence
  chemically synthesized
gtgtttggtagcaccctagagt

SEQ ID NO: 1210269 - DNA, 22 bp, Artificial Sequence
  chemically synthesized
taatcactctagggtgctacca

SEQ ID NO: 1210270 - DNA, 22 bp, Artificial Sequence
  chemically synthesized
tagggtgctaccaaacactaga

SEQ ID NO: 1210271 - DNA, 22 bp, Artificial Sequence
  chemically synthesized
gggtgctaccaaacactagatc

SEQ ID NO: 1210272 - DNA, 22 bp, Artificial Sequence
  chemically synthesized
gatagaaggaatcagatctagt

SEQ ID NO: 1210273 - DNA, 22 bp, Artificial Sequence
  chemically synthesized
ccaaacactagatctgattcct

SEQ ID NO: 1210274 - DNA, 22 bp, Artificial Sequence
  chemically synthesized
gatctgattccttctatctaac

SEQ ID NO: 1210275 - DNA, 22 bp, Artificial Sequence
  chemically synthesized
attccttctatctaactatata

SEQ ID NO: 1210276 - DNA, 22 bp, Artificial Sequence
  chemically synthesized
cttctatctaactatatacttt

SEQ ID NO: 1210277 - DNA, 22 bp, Artificial Sequence
  chemically synthesized
ctatctaactatatacttttta

SEQ ID NO: 1210278 - DNA, 22 bp, Artificial Sequence
  chemically synthesized
tatctaactatatactttttat

SEQ ID NO: 1210279 - DNA, 22 bp, Artificial Sequence
  chemically synthesized
tctaactatatactttttattt

SEQ ID NO: 1210280 - DNA, 22 bp, Artificial Sequence
  chemically synthesized
actatatactttttattttttt

SEQ ID NO: 1210281 - DNA, 22 bp, Artificial Sequence
  chemically synthesized
tatactttttattttttttttt

SEQ ID NO: 1210282 - DNA, 22 bp, Artificial Sequence
  chemically synthesized
tttattttttttttttttttta

SEQ ID NO: 1210283 - DNA, 22 bp, Artificial Sequence
  chemically synthesized
ttatttttttttttttttttac

SEQ ID NO: 1210284 - DNA, 22 bp, Artificial Sequence
  chemically synthesized
tatttttttttttttttttacc

SEQ ID NO: 1210285 - DNA, 22 bp, Artificial Sequence
  chemically synthesized
atttttttttttttttttacct

SEQ ID NO: 1210286 - DNA, 22 bp, Artificial Sequence
  chemically synthesized
tttttttttttttttttaccta

SEQ ID NO: 1210287 - DNA, 22 bp, Artificial Sequence
  chemically synthesized
ttttttttttttttacctattt

SEQ ID NO: 1210288 - DNA, 22 bp, Artificial Sequence
  chemically synthesized
tttttttttttttacctattta

SEQ ID NO: 1210289 - DNA, 22 bp, Artificial Sequence
  chemically synthesized
ttttttttttttacctatttac

SEQ ID NO: 1210290 - DNA, 22 bp, Artificial Sequence
  chemically synthesized
tttttttttttacctatttacc

SEQ ID NO: 1210291 - DNA, 22 bp, Artificial Sequence
  chemically synthesized
ttttttttttacctatttacca

SEQ ID NO: 1210292 - DNA, 22 bp, Artificial Sequence
  chemically synthesized
tttttttttacctatttaccac

SEQ ID NO: 1210293 - DNA, 22 bp, Artificial Sequence
  chemically synthesized
ttttttttacctatttaccact

SEQ ID NO: 1210294 - DNA, 22 bp, Artificial Sequence
  chemically synthesized
tttttttacctatttaccactc

SEQ ID NO: 1210295 - DNA, 22 bp, Artificial Sequence
  chemically synthesized
ttttttacctatttaccactcc

SEQ ID NO: 1210296 - DNA, 22 bp, Artificial Sequence
  chemically synthesized
tttttacctatttaccactccc

SEQ ID NO: 1210297 - DNA, 22 bp, Artificial Sequence
  chemically synthesized
ttttacctatttaccactccct

SEQ ID NO: 1210298 - DNA, 22 bp, Artificial Sequence
  chemically synthesized
tttacctatttaccactccctc

SEQ ID NO: 1210299 - DNA, 22 bp, Artificial Sequence
  chemically synthesized
ttacctatttaccactccctcc

SEQ ID NO: 1210300 - DNA, 22 bp, Artificial Sequence
  chemically synthesized
tacctatttaccactccctcct

SEQ ID NO: 1210301 - DNA, 22 bp, Artificial Sequence
  chemically synthesized
acctatttaccactccctcctt

SEQ ID NO: 1210302 - DNA, 22 bp, Artificial Sequence
  chemically synthesized
cctatttaccactccctcctta

SEQ ID NO: 1210303 - DNA, 22 bp, Artificial Sequence
  chemically synthesized
tttaccactccctccttatcct

SEQ ID NO: 1210304 - DNA, 22 bp, Artificial Sequence
  chemically synthesized
accactccctccttatcctgtc

SEQ ID NO: 1210305 - DNA, 22 bp, Artificial Sequence
  chemically synthesized
ccactccctccttatcctgtcc

SEQ ID NO: 1210306 - DNA, 22 bp, Artificial Sequence
  chemically synthesized
agaagggtaagtggggaggaca

SEQ ID NO: 1210307 - DNA, 22 bp, Artificial Sequence
  chemically synthesized
cctccttatcctgtcctcccca

SEQ ID NO: 1210308 - DNA, 22 bp, Artificial Sequence
  chemically synthesized
cttatcctgtcctccccactta

SEQ ID NO: 1210309 - DNA, 22 bp, Artificial Sequence
  chemically synthesized
atcctgtcctccccacttaccc

SEQ ID NO: 1210310 - DNA, 22 bp, Artificial Sequence
  chemically synthesized
tcctgtcctccccacttaccct

SEQ ID NO: 1210311 - DNA, 22 bp, Artificial Sequence
  chemically synthesized
ccagatgctgagaagggtaagt

SEQ ID NO: 1210312 - DNA, 22 bp, Artificial Sequence
  chemically synthesized
tcctccccacttacccttctca

SEQ ID NO: 1210313 - DNA, 22 bp, Artificial Sequence
  chemically synthesized
cccacttacccttctcagcatc

SEQ ID NO: 1210314 - DNA, 22 bp, Artificial Sequence
  chemically synthesized
acccttctcagcatctggtaac

SEQ ID NO: 1210315 - DNA, 22 bp, Artificial Sequence
  chemically synthesized
cccttctcagcatctggtaacc

SEQ ID NO: 1210316 - DNA, 22 bp, Artificial Sequence
  chemically synthesized
ctcagcatctggtaaccatcat

SEQ ID NO: 1210317 - DNA, 22 bp, Artificial Sequence
  chemically synthesized
tcagcatctggtaaccatcatc

SEQ ID NO: 1210318 - DNA, 22 bp, Artificial Sequence
  chemically synthesized
agcatctggtaaccatcatccc

SEQ ID NO: 1210319 - DNA, 22 bp, Artificial Sequence
  chemically synthesized
atggagatagagagtgggatga

SEQ ID NO: 1210320 - DNA, 22 bp, Artificial Sequence
  chemically synthesized
gtaaccatcatcccactctcta

SEQ ID NO: 1210321 - DNA, 22 bp, Artificial Sequence
  chemically synthesized
aactcatggagatagagagtgg

SEQ ID NO: 1210322 - DNA, 22 bp, Artificial Sequence
  chemically synthesized
aagtaaattgaactcatggaga

SEQ ID NO: 1210323 - DNA, 22 bp, Artificial Sequence
  chemically synthesized
tctatctccatgagttcaattt

SEQ ID NO: 1210324 - DNA, 22 bp, Artificial Sequence
  chemically synthesized
tatctccatgagttcaatttac

SEQ ID NO: 1210325 - DNA, 22 bp, Artificial Sequence
  chemically synthesized
tctccatgagttcaatttactt

SEQ ID NO: 1210326 - DNA, 22 bp, Artificial Sequence
  chemically synthesized
atatgtgggagctaaagtaaat

SEQ ID NO: 1210327 - DNA, 22 bp, Artificial Sequence
  chemically synthesized
catgagttcaatttactttagc

SEQ ID NO: 1210328 - DNA, 22 bp, Artificial Sequence
  chemically synthesized
actcatatgtgggagctaaagt

SEQ ID NO: 1210329 - DNA, 22 bp, Artificial Sequence
  chemically synthesized
tcactcatatgtgggagctaaa

SEQ ID NO: 1210330 - DNA, 22 bp, Artificial Sequence
  chemically synthesized
aatttactttagctcccacata

SEQ ID NO: 1210331 - DNA, 22 bp, Artificial Sequence
  chemically synthesized
caagttctcactcatatgtggg

SEQ ID NO: 1210332 - DNA, 22 bp, Artificial Sequence
  chemically synthesized
actttagctcccacatatgagt

SEQ ID NO: 1210333 - DNA, 22 bp, Artificial Sequence
  chemically synthesized
ctttagctcccacatatgagtg

SEQ ID NO: 1210334 - DNA, 22 bp, Artificial Sequence
  chemically synthesized
tagctcccacatatgagtgaga

SEQ ID NO: 1210335 - DNA, 22 bp, Artificial Sequence
  chemically synthesized
agctcccacatatgagtgagaa

SEQ ID NO: 1210336 - DNA, 22 bp, Artificial Sequence
  chemically synthesized
gctcccacatatgagtgagaac

SEQ ID NO: 1210337 - DNA, 22 bp, Artificial Sequence
  chemically synthesized
ccacatatgagtgagaacttgc

SEQ ID NO: 1210338 - DNA, 22 bp, Artificial Sequence
  chemically synthesized
gcaatatttgtgtctctgtgcc

SEQ ID NO: 1210339 - DNA, 22 bp, Artificial Sequence
  chemically synthesized
caatatttgtgtctctgtgcct

SEQ ID NO: 1210340 - DNA, 22 bp, Artificial Sequence
  chemically synthesized
agtgaaatcaaccaggcacaga

SEQ ID NO: 1210341 - DNA, 22 bp, Artificial Sequence
  chemically synthesized
ttaagtgaaatcaaccaggcac

SEQ ID NO: 1210342 - DNA, 22 bp, Artificial Sequence
  chemically synthesized
gtgtctctgtgcctggttgatt

SEQ ID NO: 1210343 - DNA, 22 bp, Artificial Sequence
  chemically synthesized
tgtctctgtgcctggttgattt

SEQ ID NO: 1210344 - DNA, 22 bp, Artificial Sequence
  chemically synthesized
gaggacattgttaagtgaaatc

SEQ ID NO: 1210345 - DNA, 22 bp, Artificial Sequence
  chemically synthesized
tgtgcctggttgatttcactta

SEQ ID NO: 1210346 - DNA, 22 bp, Artificial Sequence
  chemically synthesized
tgcctggttgatttcacttaac

SEQ ID NO: 1210347 - DNA, 22 bp, Artificial Sequence
  chemically synthesized
gttgatttcacttaacaatgtc

SEQ ID NO: 1210348 - DNA, 22 bp, Artificial Sequence
  chemically synthesized
atttcacttaacaatgtcctcc

SEQ ID NO: 1210349 - DNA, 22 bp, Artificial Sequence
  chemically synthesized
cacttaacaatgtcctccagtt

SEQ ID NO: 1210350 - DNA, 22 bp, Artificial Sequence
  chemically synthesized
acttaacaatgtcctccagttt

SEQ ID NO: 1210351 - DNA, 22 bp, Artificial Sequence
  chemically synthesized
aacaatgtcctccagttttatt

SEQ ID NO: 1210352 - DNA, 22 bp, Artificial Sequence
  chemically synthesized
acaatgtcctccagttttattt

SEQ ID NO: 1210353 - DNA, 22 bp, Artificial Sequence
  chemically synthesized
cagttttattttctattatttt

SEQ ID NO: 1210354 - DNA, 22 bp, Artificial Sequence
  chemically synthesized
tattttctattatttttctttc

SEQ ID NO: 1210355 - DNA, 22 bp, Artificial Sequence
  chemically synthesized
attttctattatttttctttct

SEQ ID NO: 1210356 - DNA, 22 bp, Artificial Sequence
  chemically synthesized
ttttctattatttttctttctc

SEQ ID NO: 1210357 - DNA, 22 bp, Artificial Sequence
  chemically synthesized
aaaaaggagagcgagagaaaga

SEQ ID NO: 1210358 - DNA, 22 bp, Artificial Sequence
  chemically synthesized
tctattatttttctttctctcg

SEQ ID NO: 1210359 - DNA, 22 bp, Artificial Sequence
  chemically synthesized
aaaaaaggagagcgagagaaag

SEQ ID NO: 1210360 - DNA, 22 bp, Artificial Sequence
  chemically synthesized
ctattatttttctttctctcgc

SEQ ID NO: 1210361 - DNA, 22 bp, Artificial Sequence
  chemically synthesized
taaaaaaggagagcgagagaaa

SEQ ID NO: 1210362 - DNA, 22 bp, Artificial Sequence
  chemically synthesized
tattatttttctttctctcgct

SEQ ID NO: 1210363 - DNA, 22 bp, Artificial Sequence
  chemically synthesized
ttatttttctttctctcgctct

SEQ ID NO: 1210364 - DNA, 22 bp, Artificial Sequence
  chemically synthesized
tttttctttctctcgctctcct

SEQ ID NO: 1210365 - DNA, 22 bp, Artificial Sequence
  chemically synthesized
ttctttctctcgctctcctttt

SEQ ID NO: 1210366 - DNA, 22 bp, Artificial Sequence
  chemically synthesized
tctttctctcgctctccttttt

SEQ ID NO: 1210367 - DNA, 22 bp, Artificial Sequence
  chemically synthesized
ctttctctcgctctcctttttt

SEQ ID NO: 1210368 - DNA, 22 bp, Artificial Sequence
  chemically synthesized
cagaggagctttaaaaaaggag

SEQ ID NO: 1210369 - DNA, 22 bp, Artificial Sequence
  chemically synthesized
tttctctcgctctcctttttta

SEQ ID NO: 1210370 - DNA, 22 bp, Artificial Sequence
  chemically synthesized
tctctcgctctccttttttaaa

SEQ ID NO: 1210371 - DNA, 22 bp, Artificial Sequence
  chemically synthesized
ctctcgctctccttttttaaag

SEQ ID NO: 1210372 - DNA, 22 bp, Artificial Sequence
  chemically synthesized
tctcgctctccttttttaaagc

SEQ ID NO: 1210373 - DNA, 22 bp, Artificial Sequence
  chemically synthesized
tcgctctccttttttaaagctc

SEQ ID NO: 1210374 - DNA, 22 bp, Artificial Sequence
  chemically synthesized
gctctccttttttaaagctcct

SEQ ID NO: 1210375 - DNA, 22 bp, Artificial Sequence
  chemically synthesized
tccttttttaaagctcctctgg

SEQ ID NO: 1210376 - DNA, 22 bp, Artificial Sequence
  chemically synthesized
agaaagagcactccagaggagc

SEQ ID NO: 1210377 - DNA, 22 bp, Artificial Sequence
  chemically synthesized
cttttttaaagctcctctggag

SEQ ID NO: 1210378 - DNA, 22 bp, Artificial Sequence
  chemically synthesized
ttttaaagctcctctggagtgc

SEQ ID NO: 1210379 - DNA, 22 bp, Artificial Sequence
  chemically synthesized
tttaaagctcctctggagtgct

SEQ ID NO: 1210380 - DNA, 22 bp, Artificial Sequence
  chemically synthesized
ttaaagctcctctggagtgctc

SEQ ID NO: 1210381 - DNA, 22 bp, Artificial Sequence
  chemically synthesized
aaaactaagaaagagcactcca

SEQ ID NO: 1210382 - DNA, 22 bp, Artificial Sequence
  chemically synthesized
taaagctcctctggagtgctct

SEQ ID NO: 1210383 - DNA, 22 bp, Artificial Sequence
  chemically synthesized
aaagctcctctggagtgctctt

SEQ ID NO: 1210384 - DNA, 22 bp, Artificial Sequence
  chemically synthesized
aagctcctctggagtgctcttt

SEQ ID NO: 1210385 - DNA, 22 bp, Artificial Sequence
  chemically synthesized
ctctggagtgctctttcttagt

SEQ ID NO: 1210386 - DNA, 22 bp, Artificial Sequence
  chemically synthesized
tggagtgctctttcttagtttt

SEQ ID NO: 1210387 - DNA, 22 bp, Artificial Sequence
  chemically synthesized
gagtgctctttcttagttttca

SEQ ID NO: 1210388 - DNA, 22 bp, Artificial Sequence
  chemically synthesized
agaaaatatagtattgaaaact

SEQ ID NO: 1210389 - DNA, 22 bp, Artificial Sequence
  chemically synthesized
tttcttagttttcaatactata

SEQ ID NO: 1210390 - DNA, 22 bp, Artificial Sequence
  chemically synthesized
tcttagttttcaatactatatt

SEQ ID NO: 1210391 - DNA, 22 bp, Artificial Sequence
  chemically synthesized
cttagttttcaatactatattt

SEQ ID NO: 1210392 - DNA, 22 bp, Artificial Sequence
  chemically synthesized
ttagttttcaatactatatttt

SEQ ID NO: 1210393 - DNA, 22 bp, Artificial Sequence
  chemically synthesized
agttttcaatactatattttct

SEQ ID NO: 1210394 - DNA, 22 bp, Artificial Sequence
  chemically synthesized
aaaaacatgttcagaaaatata

SEQ ID NO: 1210395 - DNA, 22 bp, Artificial Sequence
  chemically synthesized
gttttcaatactatattttctg

SEQ ID NO: 1210396 - DNA, 22 bp, Artificial Sequence
  chemically synthesized
aaaaaacatgttcagaaaatat

SEQ ID NO: 1210397 - DNA, 22 bp, Artificial Sequence
  chemically synthesized
taaaaaacatgttcagaaaata

SEQ ID NO: 1210398 - DNA, 22 bp, Artificial Sequence
  chemically synthesized
tcaatactatattttctgaaca

SEQ ID NO: 1210399 - DNA, 22 bp, Artificial Sequence
  chemically synthesized
caatactatattttctgaacat

SEQ ID NO: 1210400 - DNA, 22 bp, Artificial Sequence
  chemically synthesized
aatactatattttctgaacatg

SEQ ID NO: 1210401 - DNA, 22 bp, Artificial Sequence
  chemically synthesized
tattttctgaacatgtttttta

SEQ ID NO: 1210402 - DNA, 22 bp, Artificial Sequence
  chemically synthesized
tctgaacatgttttttaaaatc

SEQ ID NO: 1210403 - DNA, 22 bp, Artificial Sequence
  chemically synthesized
ctgaacatgttttttaaaatct

SEQ ID NO: 1210404 - DNA, 22 bp, Artificial Sequence
  chemically synthesized
tgaacatgttttttaaaatcta

SEQ ID NO: 1210405 - DNA, 22 bp, Artificial Sequence
  chemically synthesized
aacatgttttttaaaatctaca

SEQ ID NO: 1210406 - DNA, 22 bp, Artificial Sequence
  chemically synthesized
tttaaaatctacatctggcatc

SEQ ID NO: 1210407 - DNA, 22 bp, Artificial Sequence
  chemically synthesized
ttaaaatctacatctggcatct

SEQ ID NO: 1210408 - DNA, 22 bp, Artificial Sequence
  chemically synthesized
taggaatagatcagatgccaga

SEQ ID NO: 1210409 - DNA, 22 bp, Artificial Sequence
  chemically synthesized
taaaatctacatctggcatctg

SEQ ID NO: 1210410 - DNA, 22 bp, Artificial Sequence
  chemically synthesized
aaaatctacatctggcatctga

SEQ ID NO: 1210411 - DNA, 22 bp, Artificial Sequence
  chemically synthesized
aaatctacatctggcatctgat

SEQ ID NO: 1210412 - DNA, 22 bp, Artificial Sequence
  chemically synthesized
catctggcatctgatctattcc

SEQ ID NO: 1210413 - DNA, 22 bp, Artificial Sequence
  chemically synthesized
gcatctgatctattcctacaac

SEQ ID NO: 1210414 - DNA, 22 bp, Artificial Sequence
  chemically synthesized
atctattcctacaacctatcca

SEQ ID NO: 1210415 - DNA, 22 bp, Artificial Sequence
  chemically synthesized
ttcctacaacctatccatattc

SEQ ID NO: 1210416 - DNA, 22 bp, Artificial Sequence
  chemically synthesized
ctacaacctatccatattctgt

SEQ ID NO: 1210417 - DNA, 22 bp, Artificial Sequence
  chemically synthesized
caacctatccatattctgtctg

SEQ ID NO: 1210418 - DNA, 22 bp, Artificial Sequence
  chemically synthesized
tccatattctgtctgacctata

SEQ ID NO: 1210419 - DNA, 22 bp, Artificial Sequence
  chemically synthesized
aagtataaataaaaatataggt

SEQ ID NO: 1210420 - DNA, 22 bp, Artificial Sequence
  chemically synthesized
tgtctgacctatatttttattt

SEQ ID NO: 1210421 - DNA, 22 bp, Artificial Sequence
  chemically synthesized
tctgacctatatttttatttat

SEQ ID NO: 1210422 - DNA, 22 bp, Artificial Sequence
  chemically synthesized
aaatggaattaaagtataaata

SEQ ID NO: 1210423 - DNA, 22 bp, Artificial Sequence
  chemically synthesized
acctatatttttatttatactt

SEQ ID NO: 1210424 - DNA, 22 bp, Artificial Sequence
  chemically synthesized
tatttttatttatactttaatt

SEQ ID NO: 1210425 - DNA, 22 bp, Artificial Sequence
  chemically synthesized
ttatttatactttaattccatt

SEQ ID NO: 1210426 - DNA, 22 bp, Artificial Sequence
  chemically synthesized
tatttatactttaattccattt

SEQ ID NO: 1210427 - DNA, 22 bp, Artificial Sequence
  chemically synthesized
atttatactttaattccatttg

SEQ ID NO: 1210428 - DNA, 22 bp, Artificial Sequence
  chemically synthesized
tttatactttaattccatttga

SEQ ID NO: 1210429 - DNA, 22 bp, Artificial Sequence
  chemically synthesized
atactttaattccatttgaatt

SEQ ID NO: 1210430 - DNA, 22 bp, Artificial Sequence
  chemically synthesized
tactttaattccatttgaattt

SEQ ID NO: 1210431 - DNA, 22 bp, Artificial Sequence
  chemically synthesized
aagcccagagcagaaattcaaa

SEQ ID NO: 1210432 - DNA, 22 bp, Artificial Sequence
  chemically synthesized
taattccatttgaatttctgct

SEQ ID NO: 1210433 - DNA, 22 bp, Artificial Sequence
  chemically synthesized
aattccatttgaatttctgctc

SEQ ID NO: 1210434 - DNA, 22 bp, Artificial Sequence
  chemically synthesized
attccatttgaatttctgctct

SEQ ID NO: 1210435 - DNA, 22 bp, Artificial Sequence
  chemically synthesized
catttgaatttctgctctgggc

SEQ ID NO: 1210436 - DNA, 22 bp, Artificial Sequence
  chemically synthesized
caagtgtaaactaaagcccaga

SEQ ID NO: 1210437 - DNA, 22 bp, Artificial Sequence
  chemically synthesized
gaatttctgctctgggctttag

SEQ ID NO: 1210438 - DNA, 22 bp, Artificial Sequence
  chemically synthesized
aatttctgctctgggctttagt

SEQ ID NO: 1210439 - DNA, 22 bp, Artificial Sequence
  chemically synthesized
ctgctctgggctttagtttaca

SEQ ID NO: 1210440 - DNA, 22 bp, Artificial Sequence
  chemically synthesized
tgctctgggctttagtttacac

SEQ ID NO: 1210441 - DNA, 22 bp, Artificial Sequence
  chemically synthesized
ctctgggctttagtttacactt

SEQ ID NO: 1210442 - DNA, 22 bp, Artificial Sequence
  chemically synthesized
tgggctttagtttacacttgca

SEQ ID NO: 1210443 - DNA, 22 bp, Artificial Sequence
  chemically synthesized
ggctttagtttacacttgcaat

SEQ ID NO: 1210444 - DNA, 22 bp, Artificial Sequence
  chemically synthesized
tagtttacacttgcaatgtgtg

SEQ ID NO: 1210445 - DNA, 22 bp, Artificial Sequence
  chemically synthesized
agtttacacttgcaatgtgtga

SEQ ID NO: 1210446 - DNA, 22 bp, Artificial Sequence
  chemically synthesized
gtttacacttgcaatgtgtgat

SEQ ID NO: 1210447 - DNA, 22 bp, Artificial Sequence
  chemically synthesized
acacttgcaatgtgtgatatct

SEQ ID NO: 1210448 - DNA, 22 bp, Artificial Sequence
  chemically synthesized
cacttgcaatgtgtgatatctg

SEQ ID NO: 1210449 - DNA, 22 bp, Artificial Sequence
  chemically synthesized
gcaatgtgtgatatctgatatc

SEQ ID NO: 1210450 - DNA, 22 bp, Artificial Sequence
  chemically synthesized
caggatgggccagatatcagat

SEQ ID NO: 1210451 - DNA, 22 bp, Artificial Sequence
  chemically synthesized
caatgtgtgatatctgatatct

SEQ ID NO: 1210452 - DNA, 22 bp, Artificial Sequence
  chemically synthesized
ttccaggatgggccagatatca

SEQ ID NO: 1210453 - DNA, 22 bp, Artificial Sequence
  chemically synthesized
tgttccaggatgggccagatat

SEQ ID NO: 1210454 - DNA, 22 bp, Artificial Sequence
  chemically synthesized
ctgttccaggatgggccagata

SEQ ID NO: 1210455 - DNA, 22 bp, Artificial Sequence
  chemically synthesized
ttctgttccaggatgggccaga

SEQ ID NO: 1210456 - DNA, 22 bp, Artificial Sequence
  chemically synthesized
cttctgttccaggatgggccag

SEQ ID NO: 1210457 - DNA, 22 bp, Artificial Sequence
  chemically synthesized
atatctggcccatcctggaaca

SEQ ID NO: 1210458 - DNA, 22 bp, Artificial Sequence
  chemically synthesized
gtaatgatatatttcttctgtt

SEQ ID NO: 1210459 - DNA, 22 bp, Artificial Sequence
  chemically synthesized
gcccatcctggaacagaagaaa

SEQ ID NO: 1210460 - DNA, 22 bp, Artificial Sequence
  chemically synthesized
cattggtaatgatatatttctt

SEQ ID NO: 1210461 - DNA, 22 bp, Artificial Sequence
  chemically synthesized
ccattggtaatgatatatttct

SEQ ID NO: 1210462 - DNA, 22 bp, Artificial Sequence
  chemically synthesized
tccattggtaatgatatatttc

SEQ ID NO: 1210463 - DNA, 22 bp, Artificial Sequence
  chemically synthesized
ttccattggtaatgatatattt

SEQ ID NO: 1210464 - DNA, 22 bp, Artificial Sequence
  chemically synthesized
gaacagaagaaatatatcatta

SEQ ID NO: 1210465 - DNA, 22 bp, Artificial Sequence
  chemically synthesized
atgtgtttttccattggtaatg

SEQ ID NO: 1210466 - DNA, 22 bp, Artificial Sequence
  chemically synthesized
aatgtgtttttccattggtaat

SEQ ID NO: 1210467 - DNA, 22 bp, Artificial Sequence
  chemically synthesized
tcatttaatgtgtttttccatt

SEQ ID NO: 1210468 - DNA, 22 bp, Artificial Sequence
  chemically synthesized
ctatcatttaatgtgtttttcc

SEQ ID NO: 1210469 - DNA, 22 bp, Artificial Sequence
  chemically synthesized
tgttcctatcatttaatgtgtt

SEQ ID NO: 1210470 - DNA, 22 bp, Artificial Sequence
  chemically synthesized
ccaatggaaaaacacattaaat

SEQ ID NO: 1210471 - DNA, 22 bp, Artificial Sequence
  chemically synthesized
ctatgttcctatcatttaatgt

SEQ ID NO: 1210472 - DNA, 22 bp, Artificial Sequence
  chemically synthesized
cctatgttcctatcatttaatg

SEQ ID NO: 1210473 - DNA, 22 bp, Artificial Sequence
  chemically synthesized
tcctatgttcctatcatttaat

SEQ ID NO: 1210474 - DNA, 22 bp, Artificial Sequence
  chemically synthesized
aaccgactttcctatgttccta

SEQ ID NO: 1210475 - DNA, 22 bp, Artificial Sequence
  chemically synthesized
aaaccgactttcctatgttcct

SEQ ID NO: 1210476 - DNA, 22 bp, Artificial Sequence
  chemically synthesized
tcttaaaccgactttcctatgt

SEQ ID NO: 1210477 - DNA, 22 bp, Artificial Sequence
  chemically synthesized
atcttaaaccgactttcctatg

SEQ ID NO: 1210478 - DNA, 22 bp, Artificial Sequence
  chemically synthesized
aatgataggaacataggaaagt

SEQ ID NO: 1210479 - DNA, 22 bp, Artificial Sequence
  chemically synthesized
ggggcccatttatcttaaaccg

SEQ ID NO: 1210480 - DNA, 22 bp, Artificial Sequence
  chemically synthesized
taggggcccatttatcttaaac

SEQ ID NO: 1210481 - DNA, 22 bp, Artificial Sequence
  chemically synthesized
ctaggggcccatttatcttaaa

SEQ ID NO: 1210482 - DNA, 22 bp, Artificial Sequence
  chemically synthesized
tctaggggcccatttatcttaa

SEQ ID NO: 1210483 - DNA, 22 bp, Artificial Sequence
  chemically synthesized
aagataaatgggcccctagaaa

SEQ ID NO: 1210484 - DNA, 22 bp, Artificial Sequence
  chemically synthesized
tgcgagtgtatctttctagggg

SEQ ID NO: 1210485 - DNA, 22 bp, Artificial Sequence
  chemically synthesized
agataaatgggcccctagaaag

SEQ ID NO: 1210486 - DNA, 22 bp, Artificial Sequence
  chemically synthesized
ttgtgcgagtgtatctttctag

SEQ ID NO: 1210487 - DNA, 22 bp, Artificial Sequence
  chemically synthesized
gaaagatacactcgcacaacag

SEQ ID NO: 1210488 - DNA, 22 bp, Artificial Sequence
  chemically synthesized
tataatgtacatactgttgtgc

SEQ ID NO: 1210489 - DNA, 22 bp, Artificial Sequence
  chemically synthesized
atataatgtacatactgttgtg

SEQ ID NO: 1210490 - DNA, 22 bp, Artificial Sequence
  chemically synthesized
tatataatgtacatactgttgt

SEQ ID NO: 1210491 - DNA, 22 bp, Artificial Sequence
  chemically synthesized
acatctttatataatgtacata

SEQ ID NO: 1210492 - DNA, 22 bp, Artificial Sequence
  chemically synthesized
aacatctttatataatgtacat

SEQ ID NO: 1210493 - DNA, 22 bp, Artificial Sequence
  chemically synthesized
gcacaacagtatgtacattata

SEQ ID NO: 1210494 - DNA, 22 bp, Artificial Sequence
  chemically synthesized
atcttaacatctttatataatg

SEQ ID NO: 1210495 - DNA, 22 bp, Artificial Sequence
  chemically synthesized
agacatccctaatcttaacatc

SEQ ID NO: 1210496 - DNA, 22 bp, Artificial Sequence
  chemically synthesized
cagacatccctaatcttaacat

SEQ ID NO: 1210497 - DNA, 22 bp, Artificial Sequence
  chemically synthesized
tataaagatgttaagattaggg

SEQ ID NO: 1210498 - DNA, 22 bp, Artificial Sequence
  chemically synthesized
aggaatttcagacatccctaat

SEQ ID NO: 1210499 - DNA, 22 bp, Artificial Sequence
  chemically synthesized
ctaaggaatttcagacatccct

SEQ ID NO: 1210500 - DNA, 22 bp, Artificial Sequence
  chemically synthesized
tcctaaggaatttcagacatcc

SEQ ID NO: 1210501 - DNA, 22 bp, Artificial Sequence
  chemically synthesized
ctcctaaggaatttcagacatc

SEQ ID NO: 1210502 - DNA, 22 bp, Artificial Sequence
  chemically synthesized
agattagggatgtctgaaattc

SEQ ID NO: 1210503 - DNA, 22 bp, Artificial Sequence
  chemically synthesized
gggatgtctgaaattccttagg

SEQ ID NO: 1210504 - DNA, 22 bp, Artificial Sequence
  chemically synthesized
gcaggccatttctcctaaggaa

SEQ ID NO: 1210505 - DNA, 22 bp, Artificial Sequence
  chemically synthesized
agcaggccatttctcctaagga

SEQ ID NO: 1210506 - DNA, 22 bp, Artificial Sequence
  chemically synthesized
tagcaggccatttctcctaagg

SEQ ID NO: 1210507 - DNA, 22 bp, Artificial Sequence
  chemically synthesized
ccctttagcaggccatttctcc

SEQ ID NO: 1210508 - DNA, 22 bp, Artificial Sequence
  chemically synthesized
gccctttagcaggccatttctc

SEQ ID NO: 1210509 - DNA, 22 bp, Artificial Sequence
  chemically synthesized
aaattccttaggagaaatggcc

SEQ ID NO: 1210510 - DNA, 22 bp, Artificial Sequence
  chemically synthesized
cttaggagaaatggcctgctaa

SEQ ID NO: 1210511 - DNA, 22 bp, Artificial Sequence
  chemically synthesized
aggagaaatggcctgctaaagg

SEQ ID NO: 1210512 - DNA, 22 bp, Artificial Sequence
  chemically synthesized
ggagaaatggcctgctaaaggg

SEQ ID NO: 1210513 - DNA, 22 bp, Artificial Sequence
  chemically synthesized
caatcgtggaacccttgccctt

SEQ ID NO: 1210514 - DNA, 22 bp, Artificial Sequence
  chemically synthesized
tattacaatcgtggaacccttg

SEQ ID NO: 1210515 - DNA, 22 bp, Artificial Sequence
  chemically synthesized
atattacaatcgtggaaccctt

SEQ ID NO: 1210516 - DNA, 22 bp, Artificial Sequence
  chemically synthesized
ttatattacaatcgtggaaccc

SEQ ID NO: 1210517 - DNA, 22 bp, Artificial Sequence
  chemically synthesized
ctaaagggcaagggttccacga

SEQ ID NO: 1210518 - DNA, 22 bp, Artificial Sequence
  chemically synthesized
tcttatattacaatcgtggaac

SEQ ID NO: 1210519 - DNA, 22 bp, Artificial Sequence
  chemically synthesized
aagggcaagggttccacgattg

SEQ ID NO: 1210520 - DNA, 22 bp, Artificial Sequence
  chemically synthesized
aataactctcttatattacaat

SEQ ID NO: 1210521 - DNA, 22 bp, Artificial Sequence
  chemically synthesized
cacgattgtaatataagagagt

SEQ ID NO: 1210522 - DNA, 22 bp, Artificial Sequence
  chemically synthesized
gtaaaattgaataactctctta

SEQ ID NO: 1210523 - DNA, 22 bp, Artificial Sequence
  chemically synthesized
agtaaaattgaataactctctt

SEQ ID NO: 1210524 - DNA, 22 bp, Artificial Sequence
  chemically synthesized
tagtaaaattgaataactctct

SEQ ID NO: 1210525 - DNA, 22 bp, Artificial Sequence
  chemically synthesized
ttagtaaaattgaataactctc

SEQ ID NO: 1210526 - DNA, 22 bp, Artificial Sequence
  chemically synthesized
tttttagtaaaattgaataact

SEQ ID NO: 1210527 - DNA, 22 bp, Artificial Sequence
  chemically synthesized
taatataagagagttattcaat

SEQ ID NO: 1210528 - DNA, 22 bp, Artificial Sequence
  chemically synthesized
atttttagtaaaattgaataac

SEQ ID NO: 1210529 - DNA, 22 bp, Artificial Sequence
  chemically synthesized
acttatttttagtaaaattgaa

SEQ ID NO: 1210530 - DNA, 22 bp, Artificial Sequence
  chemically synthesized
aacttatttttagtaaaattga

SEQ ID NO: 1210531 - DNA, 22 bp, Artificial Sequence
  chemically synthesized
taacttatttttagtaaaattg

SEQ ID NO: 1210532 - DNA, 22 bp, Artificial Sequence
  chemically synthesized
aaaatattttaacttattttta

SEQ ID NO: 1210533 - DNA, 22 bp, Artificial Sequence
  chemically synthesized
ttcaattttactaaaaataagt

SEQ ID NO: 1210534 - DNA, 22 bp, Artificial Sequence
  chemically synthesized
ttaaaaatattttaacttattt

SEQ ID NO: 1210535 - DNA, 22 bp, Artificial Sequence
  chemically synthesized
aattttactaaaaataagttaa

SEQ ID NO: 1210536 - DNA, 22 bp, Artificial Sequence
  chemically synthesized
cgttattaaaaatattttaact

SEQ ID NO: 1210537 - DNA, 22 bp, Artificial Sequence
  chemically synthesized
tactaaaaataagttaaaatat

SEQ ID NO: 1210538 - DNA, 22 bp, Artificial Sequence
  chemically synthesized
actaaaaataagttaaaatatt

SEQ ID NO: 1210539 - DNA, 22 bp, Artificial Sequence
  chemically synthesized
ctaaaaataagttaaaatattt

SEQ ID NO: 1210540 - DNA, 22 bp, Artificial Sequence
  chemically synthesized
attacgttattaaaaatatttt

SEQ ID NO: 1210541 - DNA, 22 bp, Artificial Sequence
  chemically synthesized
aaaataagttaaaatattttta

SEQ ID NO: 1210542 - DNA, 22 bp, Artificial Sequence
  chemically synthesized
gtaaatgttgattacgttatta

SEQ ID NO: 1210543 - DNA, 22 bp, Artificial Sequence
  chemically synthesized
ggtaaatgttgattacgttatt

SEQ ID NO: 1210544 - DNA, 22 bp, Artificial Sequence
  chemically synthesized
aaatatttttaataacgtaatc

SEQ ID NO: 1210545 - DNA, 22 bp, Artificial Sequence
  chemically synthesized
ttaataacgtaatcaacattta

SEQ ID NO: 1210546 - DNA, 22 bp, Artificial Sequence
  chemically synthesized
taataacgtaatcaacatttac

SEQ ID NO: 1210547 - DNA, 22 bp, Artificial Sequence
  chemically synthesized
aataacgtaatcaacatttacc

SEQ ID NO: 1210548 - DNA, 22 bp, Artificial Sequence
  chemically synthesized
ataacgtaatcaacatttacca

SEQ ID NO: 1210549 - DNA, 22 bp, Artificial Sequence
  chemically synthesized
aaagaaggggtacttggtaaat

SEQ ID NO: 1210550 - DNA, 22 bp, Artificial Sequence
  chemically synthesized
gaaagaaggggtacttggtaaa

SEQ ID NO: 1210551 - DNA, 22 bp, Artificial Sequence
  chemically synthesized
cttgaaagaaggggtacttggt

SEQ ID NO: 1210552 - DNA, 22 bp, Artificial Sequence
  chemically synthesized
gtcccattacttgaaagaaggg

SEQ ID NO: 1210553 - DNA, 22 bp, Artificial Sequence
  chemically synthesized
agtcccattacttgaaagaagg

SEQ ID NO: 1210554 - DNA, 22 bp, Artificial Sequence
  chemically synthesized
accaagtaccccttctttcaag

SEQ ID NO: 1210555 - DNA, 22 bp, Artificial Sequence
  chemically synthesized
ccaagtaccccttctttcaagt

SEQ ID NO: 1210556 - DNA, 22 bp, Artificial Sequence
  chemically synthesized
cggtcttagtcccattacttga

SEQ ID NO: 1210557 - DNA, 22 bp, Artificial Sequence
  chemically synthesized
cctccggtcttagtcccattac

SEQ ID NO: 1210558 - DNA, 22 bp, Artificial Sequence
  chemically synthesized
ccctccggtcttagtcccatta

SEQ ID NO: 1210559 - DNA, 22 bp, Artificial Sequence
  chemically synthesized
tccctccggtcttagtcccatt

SEQ ID NO: 1210560 - DNA, 22 bp, Artificial Sequence
  chemically synthesized
tttccctccggtcttagtccca

SEQ ID NO: 1210561 - DNA, 22 bp, Artificial Sequence
  chemically synthesized
ctttcaagtaatgggactaaga

SEQ ID NO: 1210562 - DNA, 22 bp, Artificial Sequence
  chemically synthesized
ctttccctccggtcttagtccc

SEQ ID NO: 1210563 - DNA, 22 bp, Artificial Sequence
  chemically synthesized
tttcaagtaatgggactaagac

SEQ ID NO: 1210564 - DNA, 22 bp, Artificial Sequence
  chemically synthesized
tcaagtaatgggactaagaccg

SEQ ID NO: 1210565 - DNA, 22 bp, Artificial Sequence
  chemically synthesized
tttctttccctccggtcttagt

SEQ ID NO: 1210566 - DNA, 22 bp, Artificial Sequence
  chemically synthesized
caagtaatgggactaagaccgg

SEQ ID NO: 1210567 - DNA, 22 bp, Artificial Sequence
  chemically synthesized
aagtaatgggactaagaccgga

SEQ ID NO: 1210568 - DNA, 22 bp, Artificial Sequence
  chemically synthesized
cgaattgtttctttccctccgg

SEQ ID NO: 1210569 - DNA, 22 bp, Artificial Sequence
  chemically synthesized
acgaattgtttctttccctccg

SEQ ID NO: 1210570 - DNA, 22 bp, Artificial Sequence
  chemically synthesized
catcttacgaattgtttctttc

SEQ ID NO: 1210571 - DNA, 22 bp, Artificial Sequence
  chemically synthesized
agaccggagggaaagaaacaat

SEQ ID NO: 1210572 - DNA, 22 bp, Artificial Sequence
  chemically synthesized
atggagaagttgcatcttacga

SEQ ID NO: 1210573 - DNA, 22 bp, Artificial Sequence
  chemically synthesized
aatggagaagttgcatcttacg

SEQ ID NO: 1210574 - DNA, 22 bp, Artificial Sequence
  chemically synthesized
taatggagaagttgcatcttac

SEQ ID NO: 1210575 - DNA, 22 bp, Artificial Sequence
  chemically synthesized
aacagctttaatggagaagttg

SEQ ID NO: 1210576 - DNA, 22 bp, Artificial Sequence
  chemically synthesized
aaacagctttaatggagaagtt

SEQ ID NO: 1210577 - DNA, 22 bp, Artificial Sequence
  chemically synthesized
gtaagatgcaacttctccatta

SEQ ID NO: 1210578 - DNA, 22 bp, Artificial Sequence
  chemically synthesized
tggacttaaacagctttaatgg

SEQ ID NO: 1210579 - DNA, 22 bp, Artificial Sequence
  chemically synthesized
actgtggacttaaacagcttta

SEQ ID NO: 1210580 - DNA, 22 bp, Artificial Sequence
  chemically synthesized
ctccattaaagctgtttaagtc

SEQ ID NO: 1210581 - DNA, 22 bp, Artificial Sequence
  chemically synthesized
tccattaaagctgtttaagtcc

SEQ ID NO: 1210582 - DNA, 22 bp, Artificial Sequence
  chemically synthesized
cattaaagctgtttaagtccac

SEQ ID NO: 1210583 - DNA, 22 bp, Artificial Sequence
  chemically synthesized
agtgtaattgactgtggactta

SEQ ID NO: 1210584 - DNA, 22 bp, Artificial Sequence
  chemically synthesized
cagtgtaattgactgtggactt

SEQ ID NO: 1210585 - DNA, 22 bp, Artificial Sequence
  chemically synthesized
aagctgtttaagtccacagtca

SEQ ID NO: 1210586 - DNA, 22 bp, Artificial Sequence
  chemically synthesized
tttaagtccacagtcaattaca

SEQ ID NO: 1210587 - DNA, 22 bp, Artificial Sequence
  chemically synthesized
aagtccacagtcaattacactg

SEQ ID NO: 1210588 - DNA, 22 bp, Artificial Sequence
  chemically synthesized
gaatcagtgtttcagtgtaatt

SEQ ID NO: 1210589 - DNA, 22 bp, Artificial Sequence
  chemically synthesized
agtccacagtcaattacactga

SEQ ID NO: 1210590 - DNA, 22 bp, Artificial Sequence
  chemically synthesized
ggaatcagtgtttcagtgtaat

SEQ ID NO: 1210591 - DNA, 22 bp, Artificial Sequence
  chemically synthesized
ttggaatcagtgtttcagtgta

SEQ ID NO: 1210592 - DNA, 22 bp, Artificial Sequence
  chemically synthesized
agatgctcttggaatcagtgtt

SEQ ID NO: 1210593 - DNA, 22 bp, Artificial Sequence
  chemically synthesized
aagatgctcttggaatcagtgt

SEQ ID NO: 1210594 - DNA, 22 bp, Artificial Sequence
  chemically synthesized
acttaagatgctcttggaatca

SEQ ID NO: 1210595 - DNA, 22 bp, Artificial Sequence
  chemically synthesized
cactgaaacactgattccaaga

SEQ ID NO: 1210596 - DNA, 22 bp, Artificial Sequence
  chemically synthesized
aaacactgattccaagagcatc

SEQ ID NO: 1210597 - DNA, 22 bp, Artificial Sequence
  chemically synthesized
attccaagagcatcttaagtta

SEQ ID NO: 1210598 - DNA, 22 bp, Artificial Sequence
  chemically synthesized
caagagcatcttaagttaatct

SEQ ID NO: 1210599 - DNA, 22 bp, Artificial Sequence
  chemically synthesized
gaaagaataaatccagattaac

SEQ ID NO: 1210600 - DNA, 22 bp, Artificial Sequence
  chemically synthesized
cctagaaagaataaatccagat

SEQ ID NO: 1210601 - DNA, 22 bp, Artificial Sequence
  chemically synthesized
aagttaatctggatttattctt

SEQ ID NO: 1210602 - DNA, 22 bp, Artificial Sequence
  chemically synthesized
agttaatctggatttattcttt

SEQ ID NO: 1210603 - DNA, 22 bp, Artificial Sequence
  chemically synthesized
atctggatttattctttctagg

SEQ ID NO: 1210604 - DNA, 22 bp, Artificial Sequence
  chemically synthesized
agtgatagaactacctagaaag

SEQ ID NO: 1210605 - DNA, 22 bp, Artificial Sequence
  chemically synthesized
gatttattctttctaggtagtt

SEQ ID NO: 1210606 - DNA, 22 bp, Artificial Sequence
  chemically synthesized
attctttctaggtagttctatc

SEQ ID NO: 1210607 - DNA, 22 bp, Artificial Sequence
  chemically synthesized
ttctttctaggtagttctatca

SEQ ID NO: 1210608 - DNA, 22 bp, Artificial Sequence
  chemically synthesized
tttctaggtagttctatcactt

SEQ ID NO: 1210609 - DNA, 22 bp, Artificial Sequence
  chemically synthesized
tctaggtagttctatcacttag

SEQ ID NO: 1210610 - DNA, 22 bp, Artificial Sequence
  chemically synthesized
ctaggtagttctatcacttagt

SEQ ID NO: 1210611 - DNA, 22 bp, Artificial Sequence
  chemically synthesized
atacataagtatactaagtgat

SEQ ID NO: 1210612 - DNA, 22 bp, Artificial Sequence
  chemically synthesized
taggtagttctatcacttagta

SEQ ID NO: 1210613 - DNA, 22 bp, Artificial Sequence
  chemically synthesized
ggtagttctatcacttagtata

SEQ ID NO: 1210614 - DNA, 22 bp, Artificial Sequence
  chemically synthesized
tatcacttagtatacttatgta

SEQ ID NO: 1210615 - DNA, 22 bp, Artificial Sequence
  chemically synthesized
tcacttagtatacttatgtatt

SEQ ID NO: 1210616 - DNA, 22 bp, Artificial Sequence
  chemically synthesized
agtatacttatgtattagtcca

SEQ ID NO: 1210617 - DNA, 22 bp, Artificial Sequence
  chemically synthesized
gtatacttatgtattagtccat

SEQ ID NO: 1210618 - DNA, 22 bp, Artificial Sequence
  chemically synthesized
tggcagtgtgaaaatggactaa

SEQ ID NO: 1210619 - DNA, 22 bp, Artificial Sequence
  chemically synthesized
atggcagtgtgaaaatggacta

SEQ ID NO: 1210620 - DNA, 22 bp, Artificial Sequence
  chemically synthesized
cttatggcagtgtgaaaatgga

SEQ ID NO: 1210621 - DNA, 22 bp, Artificial Sequence
  chemically synthesized
atgtattagtccattttcacac

SEQ ID NO: 1210622 - DNA, 22 bp, Artificial Sequence
  chemically synthesized
tgtattagtccattttcacact

SEQ ID NO: 1210623 - DNA, 22 bp, Artificial Sequence
  chemically synthesized
aggtattccttatggcagtgtg

SEQ ID NO: 1210624 - DNA, 22 bp, Artificial Sequence
  chemically synthesized
gtccattttcacactgccataa

SEQ ID NO: 1210625 - DNA, 22 bp, Artificial Sequence
  chemically synthesized
cccagtctcaggtattccttat

SEQ ID NO: 1210626 - DNA, 22 bp, Artificial Sequence
  chemically synthesized
tcacactgccataaggaatacc

SEQ ID NO: 1210627 - DNA, 22 bp, Artificial Sequence
  chemically synthesized
cacactgccataaggaatacct

SEQ ID NO: 1210628 - DNA, 22 bp, Artificial Sequence
  chemically synthesized
acactgccataaggaatacctg

SEQ ID NO: 1210629 - DNA, 22 bp, Artificial Sequence
  chemically synthesized
aattacccagtctcaggtattc

SEQ ID NO: 1210630 - DNA, 22 bp, Artificial Sequence
  chemically synthesized
taaattacccagtctcaggtat

SEQ ID NO: 1210631 - DNA, 22 bp, Artificial Sequence
  chemically synthesized
ctaaattacccagtctcaggta

SEQ ID NO: 1210632 - DNA, 22 bp, Artificial Sequence
  chemically synthesized
tctaaattacccagtctcaggt

SEQ ID NO: 1210633 - DNA, 22 bp, Artificial Sequence
  chemically synthesized
ccataaggaatacctgagactg

SEQ ID NO: 1210634 - DNA, 22 bp, Artificial Sequence
  chemically synthesized
tttctaaattacccagtctcag

SEQ ID NO: 1210635 - DNA, 22 bp, Artificial Sequence
  chemically synthesized
ctttctaaattacccagtctca

SEQ ID NO: 1210636 - DNA, 22 bp, Artificial Sequence
  chemically synthesized
tctttctaaattacccagtctc

SEQ ID NO: 1210637 - DNA, 22 bp, Artificial Sequence
  chemically synthesized
tttctttctaaattacccagtc

SEQ ID NO: 1210638 - DNA, 22 bp, Artificial Sequence
  chemically synthesized
aacctctttctttctaaattac

SEQ ID NO: 1210639 - DNA, 22 bp, Artificial Sequence
  chemically synthesized
agactgggtaatttagaaagaa

SEQ ID NO: 1210640 - DNA, 22 bp, Artificial Sequence
  chemically synthesized
ggtaatttagaaagaaagaggt

SEQ ID NO: 1210641 - DNA, 22 bp, Artificial Sequence
  chemically synthesized
tgaatcaattaaacctctttct

SEQ ID NO: 1210642 - DNA, 22 bp, Artificial Sequence
  chemically synthesized
agaaagaaagaggtttaattga

SEQ ID NO: 1210643 - DNA, 22 bp, Artificial Sequence
  chemically synthesized
gaaagaaagaggtttaattgat

SEQ ID NO: 1210644 - DNA, 22 bp, Artificial Sequence
  chemically synthesized
cccagccatgcggaactgtgaa

SEQ ID NO: 1210645 - DNA, 22 bp, Artificial Sequence
  chemically synthesized
ccccagccatgcggaactgtga

SEQ ID NO: 1210646 - DNA, 22 bp, Artificial Sequence
  chemically synthesized
aattgattcacagttccgcatg

SEQ ID NO: 1210647 - DNA, 22 bp, Artificial Sequence
  chemically synthesized
attgattcacagttccgcatgg

SEQ ID NO: 1210648 - DNA, 22 bp, Artificial Sequence
  chemically synthesized
aggcttccccagccatgcggaa

SEQ ID NO: 1210649 - DNA, 22 bp, Artificial Sequence
  chemically synthesized
ctgaggcttccccagccatgcg

SEQ ID NO: 1210650 - DNA, 22 bp, Artificial Sequence
  chemically synthesized
attcacagttccgcatggctgg

SEQ ID NO: 1210651 - DNA, 22 bp, Artificial Sequence
  chemically synthesized
cctgaggcttccccagccatgc

SEQ ID NO: 1210652 - DNA, 22 bp, Artificial Sequence
  chemically synthesized
tcctgaggcttccccagccatg

SEQ ID NO: 1210653 - DNA, 22 bp, Artificial Sequence
  chemically synthesized
acagttccgcatggctggggaa

SEQ ID NO: 1210654 - DNA, 22 bp, Artificial Sequence
  chemically synthesized
actttcctgaggcttccccagc

SEQ ID NO: 1210655 - DNA, 22 bp, Artificial Sequence
  chemically synthesized
aactttcctgaggcttccccag

SEQ ID NO: 1210656 - DNA, 22 bp, Artificial Sequence
  chemically synthesized
taactttcctgaggcttcccca

SEQ ID NO: 1210657 - DNA, 22 bp, Artificial Sequence
  chemically synthesized
cgcatggctggggaagcctcag

SEQ ID NO: 1210658 - DNA, 22 bp, Artificial Sequence
  chemically synthesized
accatgattttaactttcctga

SEQ ID NO: 1210659 - DNA, 22 bp, Artificial Sequence
  chemically synthesized
caccatgattttaactttcctg

SEQ ID NO: 1210660 - DNA, 22 bp, Artificial Sequence
  chemically synthesized
tcaccatgattttaactttcct

SEQ ID NO: 1210661 - DNA, 22 bp, Artificial Sequence
  chemically synthesized
gggaagcctcaggaaagttaaa

SEQ ID NO: 1210662 - DNA, 22 bp, Artificial Sequence
  chemically synthesized
cctttcaccatgattttaactt

SEQ ID NO: 1210663 - DNA, 22 bp, Artificial Sequence
  chemically synthesized
gcctttcaccatgattttaact

SEQ ID NO: 1210664 - DNA, 22 bp, Artificial Sequence
  chemically synthesized
tgcctttcaccatgattttaac

SEQ ID NO: 1210665 - DNA, 22 bp, Artificial Sequence
  chemically synthesized
ccctttgcctttcaccatgatt

SEQ ID NO: 1210666 - DNA, 22 bp, Artificial Sequence
  chemically synthesized
aggaaagttaaaatcatggtga

SEQ ID NO: 1210667 - DNA, 22 bp, Artificial Sequence
  chemically synthesized
cccctttgcctttcaccatgat

SEQ ID NO: 1210668 - DNA, 22 bp, Artificial Sequence
  chemically synthesized
cttcccctttgcctttcaccat

SEQ ID NO: 1210669 - DNA, 22 bp, Artificial Sequence
  chemically synthesized
gcttcccctttgcctttcacca

SEQ ID NO: 1210670 - DNA, 22 bp, Artificial Sequence
  chemically synthesized
aaatcatggtgaaaggcaaagg

SEQ ID NO: 1210671 - DNA, 22 bp, Artificial Sequence
  chemically synthesized
gtgaagagagtgcttgcttccc

SEQ ID NO: 1210672 - DNA, 22 bp, Artificial Sequence
  chemically synthesized
ccacctagtgaagagagtgctt

SEQ ID NO: 1210673 - DNA, 22 bp, Artificial Sequence
  chemically synthesized
ctgccacctagtgaagagagtg

SEQ ID NO: 1210674 - DNA, 22 bp, Artificial Sequence
  chemically synthesized
ccccctcctgccacctagtgaa

SEQ ID NO: 1210675 - DNA, 22 bp, Artificial Sequence
  chemically synthesized
cctgccccctcctgccacctag

SEQ ID NO: 1210676 - DNA, 22 bp, Artificial Sequence
  chemically synthesized
ttccctgccccctcctgccacc

SEQ ID NO: 1210677 - DNA, 22 bp, Artificial Sequence
  chemically synthesized
tcttcactaggtggcaggaggg

SEQ ID NO: 1210678 - DNA, 22 bp, Artificial Sequence
  chemically synthesized
gctgttccctgccccctcctgc

SEQ ID NO: 1210679 - DNA, 22 bp, Artificial Sequence
  chemically synthesized
ttcactaggtggcaggaggggg

SEQ ID NO: 1210680 - DNA, 22 bp, Artificial Sequence
  chemically synthesized
cactaggtggcaggagggggca

SEQ ID NO: 1210681 - DNA, 22 bp, Artificial Sequence
  chemically synthesized
actaggtggcaggagggggcag

SEQ ID NO: 1210682 - DNA, 22 bp, Artificial Sequence
  chemically synthesized
ggtggcaggagggggcagggaa

SEQ ID NO: 1210683 - DNA, 22 bp, Artificial Sequence
  chemically synthesized
agtgtctggctgttccctgccc

SEQ ID NO: 1210684 - DNA, 22 bp, Artificial Sequence
  chemically synthesized
aagtgtctggctgttccctgcc

SEQ ID NO: 1210685 - DNA, 22 bp, Artificial Sequence
  chemically synthesized
atggtttaagtgtctggctgtt

SEQ ID NO: 1210686 - DNA, 22 bp, Artificial Sequence
  chemically synthesized
tgatggtttaagtgtctggctg

SEQ ID NO: 1210687 - DNA, 22 bp, Artificial Sequence
  chemically synthesized
acaagttctgatggtttaagtg

SEQ ID NO: 1210688 - DNA, 22 bp, Artificial Sequence
  chemically synthesized
tcacaagttctgatggtttaag

SEQ ID NO: 1210689 - DNA, 22 bp, Artificial Sequence
  chemically synthesized
atgatagttctcacaagttctg

SEQ ID NO: 1210690 - DNA, 22 bp, Artificial Sequence
  chemically synthesized
aaaccatcagaacttgtgagaa

SEQ ID NO: 1210691 - DNA, 22 bp, Artificial Sequence
  chemically synthesized
cactcatgatagttctcacaag

SEQ ID NO: 1210692 - DNA, 22 bp, Artificial Sequence
  chemically synthesized
aaccatcagaacttgtgagaac

SEQ ID NO: 1210693 - DNA, 22 bp, Artificial Sequence
  chemically synthesized
tgctgcactcatgatagttctc

SEQ ID NO: 1210694 - DNA, 22 bp, Artificial Sequence
  chemically synthesized
ccctatgctgcactcatgatag

SEQ ID NO: 1210695 - DNA, 22 bp, Artificial Sequence
  chemically synthesized
gtgagaactatcatgagtgcag

SEQ ID NO: 1210696 - DNA, 22 bp, Artificial Sequence
  chemically synthesized
tgagaactatcatgagtgcagc

SEQ ID NO: 1210697 - DNA, 22 bp, Artificial Sequence
  chemically synthesized
tcatgagtgcagcataggggaa

SEQ ID NO: 1210698 - DNA, 22 bp, Artificial Sequence
  chemically synthesized
ggggatgggggatgggtggttc

SEQ ID NO: 1210699 - DNA, 22 bp, Artificial Sequence
  chemically synthesized
gggggatgggggatgggtggtt

SEQ ID NO: 1210700 - DNA, 22 bp, Artificial Sequence
  chemically synthesized
gatcatttgggggatgggggat

SEQ ID NO: 1210701 - DNA, 22 bp, Artificial Sequence
  chemically synthesized
gtgggatattggatcatttggg

SEQ ID NO: 1210702 - DNA, 22 bp, Artificial Sequence
  chemically synthesized
taatccccacgtgtcaagggag

SEQ ID NO: 1210703 - DNA, 22 bp, Artificial Sequence
  chemically synthesized
aaattgtaatccccacgtgtca

SEQ ID NO: 1210704 - DNA, 22 bp, Artificial Sequence
  chemically synthesized
tctcaaattgtaatccccacgt

SEQ ID NO: 1210705 - DNA, 22 bp, Artificial Sequence
  chemically synthesized
cctcccttgacacgtggggatt

SEQ ID NO: 1210706 - DNA, 22 bp, Artificial Sequence
  chemically synthesized
gtctcaaattgtaatccccacg

SEQ ID NO: 1210707 - DNA, 22 bp, Artificial Sequence
  chemically synthesized
tgtctcaaattgtaatccccac

SEQ ID NO: 1210708 - DNA, 22 bp, Artificial Sequence
  chemically synthesized
ccttgacacgtggggattacaa

SEQ ID NO: 1210709 - DNA, 22 bp, Artificial Sequence
  chemically synthesized
gacacgtggggattacaatttg

SEQ ID NO: 1210710 - DNA, 22 bp, Artificial Sequence
  chemically synthesized
acacgtggggattacaatttga

SEQ ID NO: 1210711 - DNA, 22 bp, Artificial Sequence
  chemically synthesized
tgtgtacccacccaaattttgt

SEQ ID NO: 1210712 - DNA, 22 bp, Artificial Sequence
  chemically synthesized
caatttgagacaaaatttgggt

SEQ ID NO: 1210713 - DNA, 22 bp, Artificial Sequence
  chemically synthesized
gctatgtgtacccacccaaatt

SEQ ID NO: 1210714 - DNA, 22 bp, Artificial Sequence
  chemically synthesized
ggctatgtgtacccacccaaat

SEQ ID NO: 1210715 - DNA, 22 bp, Artificial Sequence
  chemically synthesized
gagacaaaatttgggtgggtac

SEQ ID NO: 1210716 - DNA, 22 bp, Artificial Sequence
  chemically synthesized
agacaaaatttgggtgggtaca

SEQ ID NO: 1210717 - DNA, 22 bp, Artificial Sequence
  chemically synthesized
gggtgggtacacatagccaaac

SEQ ID NO: 1210718 - DNA, 22 bp, Artificial Sequence
  chemically synthesized
ggtgggtacacatagccaaacc

SEQ ID NO: 1210719 - DNA, 22 bp, Artificial Sequence
  chemically synthesized
ggaggggccgggagcagaatga

SEQ ID NO: 1210720 - DNA, 22 bp, Artificial Sequence
  chemically synthesized
gggaggggccgggagcagaatg

SEQ ID NO: 1210721 - DNA, 22 bp, Artificial Sequence
  chemically synthesized
tgctcccggcccctcccaagcc

SEQ ID NO: 1210722 - DNA, 22 bp, Artificial Sequence
  chemically synthesized
ctcccggcccctcccaagcctc

SEQ ID NO: 1210723 - DNA, 22 bp, Artificial Sequence
  chemically synthesized
aaatgtgatgacatgaggcttg

SEQ ID NO: 1210724 - DNA, 22 bp, Artificial Sequence
  chemically synthesized
ccggcccctcccaagcctcatg

SEQ ID NO: 1210725 - DNA, 22 bp, Artificial Sequence
  chemically synthesized
gaaatgtgatgacatgaggctt

SEQ ID NO: 1210726 - DNA, 22 bp, Artificial Sequence
  chemically synthesized
tgaaatgtgatgacatgaggct

SEQ ID NO: 1210727 - DNA, 22 bp, Artificial Sequence
  chemically synthesized
tgttttgaaatgtgatgacatg

SEQ ID NO: 1210728 - DNA, 22 bp, Artificial Sequence
  chemically synthesized
ccaagcctcatgtcatcacatt

SEQ ID NO: 1210729 - DNA, 22 bp, Artificial Sequence
  chemically synthesized
atgtcatcacatttcaaaacac

SEQ ID NO: 1210730 - DNA, 22 bp, Artificial Sequence
  chemically synthesized
ggaaggcatgactgtgttttga

SEQ ID NO: 1210731 - DNA, 22 bp, Artificial Sequence
  chemically synthesized
ttgggaaggcatgactgtgttt

SEQ ID NO: 1210732 - DNA, 22 bp, Artificial Sequence
  chemically synthesized
cgagactgttgggaaggcatga

SEQ ID NO: 1210733 - DNA, 22 bp, Artificial Sequence
  chemically synthesized
gcgagactgttgggaaggcatg

SEQ ID NO: 1210734 - DNA, 22 bp, Artificial Sequence
  chemically synthesized
caaaacacagtcatgccttccc

SEQ ID NO: 1210735 - DNA, 22 bp, Artificial Sequence
  chemically synthesized
tgcgagactgttgggaaggcat

SEQ ID NO: 1210736 - DNA, 22 bp, Artificial Sequence
  chemically synthesized
aaaacacagtcatgccttccca

SEQ ID NO: 1210737 - DNA, 22 bp, Artificial Sequence
  chemically synthesized
agactttgcgagactgttggga

SEQ ID NO: 1210738 - DNA, 22 bp, Artificial Sequence
  chemically synthesized
cccaacagtctcgcaaagtctt

SEQ ID NO: 1210739 - DNA, 22 bp, Artificial Sequence
  chemically synthesized
ccaacagtctcgcaaagtctta

SEQ ID NO: 1210740 - DNA, 22 bp, Artificial Sequence
  chemically synthesized
atgccgaaatgagttaagactt

SEQ ID NO: 1210741 - DNA, 22 bp, Artificial Sequence
  chemically synthesized
aatgccgaaatgagttaagact

SEQ ID NO: 1210742 - DNA, 22 bp, Artificial Sequence
  chemically synthesized
acttaatgccgaaatgagttaa

SEQ ID NO: 1210743 - DNA, 22 bp, Artificial Sequence
  chemically synthesized
gacttaatgccgaaatgagtta

SEQ ID NO: 1210744 - DNA, 22 bp, Artificial Sequence
  chemically synthesized
tgacttaatgccgaaatgagtt

SEQ ID NO: 1210745 - DNA, 22 bp, Artificial Sequence
  chemically synthesized
gcaaagtcttaactcatttcgg

SEQ ID NO: 1210746 - DNA, 22 bp, Artificial Sequence
  chemically synthesized
gaattttgacttaatgccgaaa

SEQ ID NO: 1210747 - DNA, 22 bp, Artificial Sequence
  chemically synthesized
ggaattttgacttaatgccgaa

SEQ ID NO: 1210748 - DNA, 22 bp, Artificial Sequence
  chemically synthesized
aactcatttcggcattaagtca

SEQ ID NO: 1210749 - DNA, 22 bp, Artificial Sequence
  chemically synthesized
gacttggaattttgacttaatg

SEQ ID NO: 1210750 - DNA, 22 bp, Artificial Sequence
  chemically synthesized
actcatttcggcattaagtcaa

SEQ ID NO: 1210751 - DNA, 22 bp, Artificial Sequence
  chemically synthesized
ggacttggaattttgacttaat

SEQ ID NO: 1210752 - DNA, 22 bp, Artificial Sequence
  chemically synthesized
tggacttggaattttgacttaa

SEQ ID NO: 1210753 - DNA, 22 bp, Artificial Sequence
  chemically synthesized
atttcggcattaagtcaaaatt

SEQ ID NO: 1210754 - DNA, 22 bp, Artificial Sequence
  chemically synthesized
cggcattaagtcaaaattccaa

SEQ ID NO: 1210755 - DNA, 22 bp, Artificial Sequence
  chemically synthesized
ggcattaagtcaaaattccaag

SEQ ID NO: 1210756 - DNA, 22 bp, Artificial Sequence
  chemically synthesized
agatgaaactttggacttggaa

SEQ ID NO: 1210757 - DNA, 22 bp, Artificial Sequence
  chemically synthesized
agtcaaaattccaagtccaaag

SEQ ID NO: 1210758 - DNA, 22 bp, Artificial Sequence
  chemically synthesized
tctcagatgaaactttggactt

SEQ ID NO: 1210759 - DNA, 22 bp, Artificial Sequence
  chemically synthesized
gtctcagatgaaactttggact

SEQ ID NO: 1210760 - DNA, 22 bp, Artificial Sequence
  chemically synthesized
ccttgtctcagatgaaactttg

SEQ ID NO: 1210761 - DNA, 22 bp, Artificial Sequence
  chemically synthesized
gccttgtctcagatgaaacttt

SEQ ID NO: 1210762 - DNA, 22 bp, Artificial Sequence
  chemically synthesized
caagtccaaagtttcatctgag

SEQ ID NO: 1210763 - DNA, 22 bp, Artificial Sequence
  chemically synthesized
taggcagagagaacttgccttg

SEQ ID NO: 1210764 - DNA, 22 bp, Artificial Sequence
  chemically synthesized
gtaggcagagagaacttgcctt

SEQ ID NO: 1210765 - DNA, 22 bp, Artificial Sequence
  chemically synthesized
catctgagacaaggcaagttct

SEQ ID NO: 1210766 - DNA, 22 bp, Artificial Sequence
  chemically synthesized
atctgagacaaggcaagttctc

SEQ ID NO: 1210767 - DNA, 22 bp, Artificial Sequence
  chemically synthesized
caggcttgtaggcagagagaac

SEQ ID NO: 1210768 - DNA, 22 bp, Artificial Sequence
  chemically synthesized
agacaaggcaagttctctctgc

SEQ ID NO: 1210769 - DNA, 22 bp, Artificial Sequence
  chemically synthesized
acaggcttgtaggcagagagaa

SEQ ID NO: 1210770 - DNA, 22 bp, Artificial Sequence
  chemically synthesized
tacaggcttgtaggcagagaga

SEQ ID NO: 1210771 - DNA, 22 bp, Artificial Sequence
  chemically synthesized
gttttacaggcttgtaggcaga

SEQ ID NO: 1210772 - DNA, 22 bp, Artificial Sequence
  chemically synthesized
ggttttacaggcttgtaggcag

SEQ ID NO: 1210773 - DNA, 22 bp, Artificial Sequence
  chemically synthesized
tggttttacaggcttgtaggca

SEQ ID NO: 1210774 - DNA, 22 bp, Artificial Sequence
  chemically synthesized
ttggttttacaggcttgtaggc

SEQ ID NO: 1210775 - DNA, 22 bp, Artificial Sequence
  chemically synthesized
cttttggttttacaggcttgta

SEQ ID NO: 1210776 - DNA, 22 bp, Artificial Sequence
  chemically synthesized
gcttttggttttacaggcttgt

SEQ ID NO: 1210777 - DNA, 22 bp, Artificial Sequence
  chemically synthesized
tctctgcctacaagcctgtaaa

SEQ ID NO: 1210778 - DNA, 22 bp, Artificial Sequence
  chemically synthesized
gcttgcttttggttttacaggc

SEQ ID NO: 1210779 - DNA, 22 bp, Artificial Sequence
  chemically synthesized
tctgcctacaagcctgtaaaac

SEQ ID NO: 1210780 - DNA, 22 bp, Artificial Sequence
  chemically synthesized
tgcctacaagcctgtaaaacca

SEQ ID NO: 1210781 - DNA, 22 bp, Artificial Sequence
  chemically synthesized
cctacaagcctgtaaaaccaaa

SEQ ID NO: 1210782 - DNA, 22 bp, Artificial Sequence
  chemically synthesized
caagcctgtaaaaccaaaagca

SEQ ID NO: 1210783 - DNA, 22 bp, Artificial Sequence
  chemically synthesized
gaagtaactagcttgcttttgg

SEQ ID NO: 1210784 - DNA, 22 bp, Artificial Sequence
  chemically synthesized
ggaagtaactagcttgcttttg

SEQ ID NO: 1210785 - DNA, 22 bp, Artificial Sequence
  chemically synthesized
taaaaccaaaagcaagctagtt

SEQ ID NO: 1210786 - DNA, 22 bp, Artificial Sequence
  chemically synthesized
taccttggaagtaactagcttg

SEQ ID NO: 1210787 - DNA, 22 bp, Artificial Sequence
  chemically synthesized
cattgtaccttggaagtaacta

SEQ ID NO: 1210788 - DNA, 22 bp, Artificial Sequence
  chemically synthesized
tacctgcattgtaccttggaag

SEQ ID NO: 1210789 - DNA, 22 bp, Artificial Sequence
  chemically synthesized
atacctgcattgtaccttggaa

SEQ ID NO: 1210790 - DNA, 22 bp, Artificial Sequence
  chemically synthesized
gttacttccaaggtacaatgca

SEQ ID NO: 1210791 - DNA, 22 bp, Artificial Sequence
  chemically synthesized
cccaatacttatacctgcattg

SEQ ID NO: 1210792 - DNA, 22 bp, Artificial Sequence
  chemically synthesized
cttccaaggtacaatgcaggta

SEQ ID NO: 1210793 - DNA, 22 bp, Artificial Sequence
  chemically synthesized
acccaatacttatacctgcatt

SEQ ID NO: 1210794 - DNA, 22 bp, Artificial Sequence
  chemically synthesized
ccaaggtacaatgcaggtataa

SEQ ID NO: 1210795 - DNA, 22 bp, Artificial Sequence
  chemically synthesized
caaggtacaatgcaggtataag

SEQ ID NO: 1210796 - DNA, 22 bp, Artificial Sequence
  chemically synthesized
gaatggaaacatttacccaata

SEQ ID NO: 1210797 - DNA, 22 bp, Artificial Sequence
  chemically synthesized
agaatggaaacatttacccaat

SEQ ID NO: 1210798 - DNA, 22 bp, Artificial Sequence
  chemically synthesized
ccccatttagaatggaaacatt

SEQ ID NO: 1210799 - DNA, 22 bp, Artificial Sequence
  chemically synthesized
cccccatttagaatggaaacat

SEQ ID NO: 1210800 - DNA, 22 bp, Artificial Sequence
  chemically synthesized
ggtaaatgtttccattctaaat

SEQ ID NO: 1210801 - DNA, 22 bp, Artificial Sequence
  chemically synthesized
accagtttcccccatttagaat

SEQ ID NO: 1210802 - DNA, 22 bp, Artificial Sequence
  chemically synthesized
gaccagtttcccccatttagaa

SEQ ID NO: 1210803 - DNA, 22 bp, Artificial Sequence
  chemically synthesized
tgaccagtttcccccatttaga

SEQ ID NO: 1210804 - DNA, 22 bp, Artificial Sequence
  chemically synthesized
ctttgaccagtttcccccattt

SEQ ID NO: 1210805 - DNA, 22 bp, Artificial Sequence
  chemically synthesized
gctttgaccagtttcccccatt

SEQ ID NO: 1210806 - DNA, 22 bp, Artificial Sequence
  chemically synthesized
tgctttgaccagtttcccccat

SEQ ID NO: 1210807 - DNA, 22 bp, Artificial Sequence
  chemically synthesized
ccattctaaatgggggaaactg

SEQ ID NO: 1210808 - DNA, 22 bp, Artificial Sequence
  chemically synthesized
ctttgctttgaccagtttcccc

SEQ ID NO: 1210809 - DNA, 22 bp, Artificial Sequence
  chemically synthesized
cattctaaatgggggaaactgg

SEQ ID NO: 1210810 - DNA, 22 bp, Artificial Sequence
  chemically synthesized
taaatgggggaaactggtcaaa

SEQ ID NO: 1210811 - DNA, 22 bp, Artificial Sequence
  chemically synthesized
tgtctactttgctttgaccagt

SEQ ID NO: 1210812 - DNA, 22 bp, Artificial Sequence
  chemically synthesized
aatgggggaaactggtcaaagc

SEQ ID NO: 1210813 - DNA, 22 bp, Artificial Sequence
  chemically synthesized
cgtgggacctgtgtctactttg

SEQ ID NO: 1210814 - DNA, 22 bp, Artificial Sequence
  chemically synthesized
gcgtgggacctgtgtctacttt

SEQ ID NO: 1210815 - DNA, 22 bp, Artificial Sequence
  chemically synthesized
gtcaaagcaaagtagacacagg

SEQ ID NO: 1210816 - DNA, 22 bp, Artificial Sequence
  chemically synthesized
aaacttgcgtgggacctgtgtc

SEQ ID NO: 1210817 - DNA, 22 bp, Artificial Sequence
  chemically synthesized
caaacttgcgtgggacctgtgt

SEQ ID NO: 1210818 - DNA, 22 bp, Artificial Sequence
  chemically synthesized
catttcaaacttgcgtgggacc

SEQ ID NO: 1210819 - DNA, 22 bp, Artificial Sequence
  chemically synthesized
gctgcatttcaaacttgcgtgg

SEQ ID NO: 1210820 - DNA, 22 bp, Artificial Sequence
  chemically synthesized
cctggctgcatttcaaacttgc

SEQ ID NO: 1210821 - DNA, 22 bp, Artificial Sequence
  chemically synthesized
acgattgcctggctgcatttca

SEQ ID NO: 1210822 - DNA, 22 bp, Artificial Sequence
  chemically synthesized
aacgattgcctggctgcatttc

SEQ ID NO: 1210823 - DNA, 22 bp, Artificial Sequence
  chemically synthesized
agatttaacgattgcctggctg

SEQ ID NO: 1210824 - DNA, 22 bp, Artificial Sequence
  chemically synthesized
aagatttaacgattgcctggct

SEQ ID NO: 1210825 - DNA, 22 bp, Artificial Sequence
  chemically synthesized
taagatttaacgattgcctggc

SEQ ID NO: 1210826 - DNA, 22 bp, Artificial Sequence
  chemically synthesized
gaaatgcagccaggcaatcgtt

SEQ ID NO: 1210827 - DNA, 22 bp, Artificial Sequence
  chemically synthesized
aaatgcagccaggcaatcgtta

SEQ ID NO: 1210828 - DNA, 22 bp, Artificial Sequence
  chemically synthesized
ggagctttaagatttaacgatt

SEQ ID NO: 1210829 - DNA, 22 bp, Artificial Sequence
  chemically synthesized
gggagctttaagatttaacgat

SEQ ID NO: 1210830 - DNA, 22 bp, Artificial Sequence
  chemically synthesized
aatcttaaagctcccaaatctg

SEQ ID NO: 1210831 - DNA, 22 bp, Artificial Sequence
  chemically synthesized
aaagctcccaaatctgccttga

SEQ ID NO: 1210832 - DNA, 22 bp, Artificial Sequence
  chemically synthesized
aagctcccaaatctgccttgac

SEQ ID NO: 1210833 - DNA, 22 bp, Artificial Sequence
  chemically synthesized
gatatgagacatggagtcaagg

SEQ ID NO: 1210834 - DNA, 22 bp, Artificial Sequence
  chemically synthesized
ccaaatctgccttgactccatg

SEQ ID NO: 1210835 - DNA, 22 bp, Artificial Sequence
  chemically synthesized
ccctggatatgagacatggagt

SEQ ID NO: 1210836 - DNA, 22 bp, Artificial Sequence
  chemically synthesized
ccttgactccatgtctcatatc

SEQ ID NO: 1210837 - DNA, 22 bp, Artificial Sequence
  chemically synthesized
catcagcctgccctggatatga

SEQ ID NO: 1210838 - DNA, 22 bp, Artificial Sequence
  chemically synthesized
gactccatgtctcatatccagg

SEQ ID NO: 1210839 - DNA, 22 bp, Artificial Sequence
  chemically synthesized
gcatcagcctgccctggatatg

SEQ ID NO: 1210840 - DNA, 22 bp, Artificial Sequence
  chemically synthesized
actccatgtctcatatccaggg

SEQ ID NO: 1210841 - DNA, 22 bp, Artificial Sequence
  chemically synthesized
catgtctcatatccagggcagg

SEQ ID NO: 1210842 - DNA, 22 bp, Artificial Sequence
  chemically synthesized
atatccagggcaggctgatgca

SEQ ID NO: 1210843 - DNA, 22 bp, Artificial Sequence
  chemically synthesized
tccaaggtcatgggagcccacc

SEQ ID NO: 1210844 - DNA, 22 bp, Artificial Sequence
  chemically synthesized
atgcaaggggtgggctcccatg

SEQ ID NO: 1210845 - DNA, 22 bp, Artificial Sequence
  chemically synthesized
ccatgaccttggacagctccac

SEQ ID NO: 1210846 - DNA, 22 bp, Artificial Sequence
  chemically synthesized
cagagccacaggcgtggagctg

SEQ ID NO: 1210847 - DNA, 22 bp, Artificial Sequence
  chemically synthesized
tgcagagccacaggcgtggagc

SEQ ID NO: 1210848 - DNA, 22 bp, Artificial Sequence
  chemically synthesized
tgctctgcagagccacaggcgt

SEQ ID NO: 1210849 - DNA, 22 bp, Artificial Sequence
  chemically synthesized
ggacagctccacgcctgtggct

SEQ ID NO: 1210850 - DNA, 22 bp, Artificial Sequence
  chemically synthesized
gacagctccacgcctgtggctc

SEQ ID NO: 1210851 - DNA, 22 bp, Artificial Sequence
  chemically synthesized
cacgcctgtggctctgcagagc

SEQ ID NO: 1210852 - DNA, 22 bp, Artificial Sequence
  chemically synthesized
tgaaagccatgggggctgtgct

SEQ ID NO: 1210853 - DNA, 22 bp, Artificial Sequence
  chemically synthesized
tggctctgcagagcacagcccc

SEQ ID NO: 1210854 - DNA, 22 bp, Artificial Sequence
  chemically synthesized
tgcagagcacagcccccatggc

SEQ ID NO: 1210855 - DNA, 22 bp, Artificial Sequence
  chemically synthesized
cagagcacagcccccatggctt

SEQ ID NO: 1210856 - DNA, 22 bp, Artificial Sequence
  chemically synthesized
caggcactgtgaaagccatggg

SEQ ID NO: 1210857 - DNA, 22 bp, Artificial Sequence
  chemically synthesized
gaaaagctgcaggcactgtgaa

SEQ ID NO: 1210858 - DNA, 22 bp, Artificial Sequence
  chemically synthesized
agaaaagctgcaggcactgtga

SEQ ID NO: 1210859 - DNA, 22 bp, Artificial Sequence
  chemically synthesized
tcacagtgcctgcagcttttct

SEQ ID NO: 1210860 - DNA, 22 bp, Artificial Sequence
  chemically synthesized
caccatgcacttagaaaagctg

SEQ ID NO: 1210861 - DNA, 22 bp, Artificial Sequence
  chemically synthesized
cacagtgcctgcagcttttcta

SEQ ID NO: 1210862 - DNA, 22 bp, Artificial Sequence
  chemically synthesized
gcaccatgcacttagaaaagct

SEQ ID NO: 1210863 - DNA, 22 bp, Artificial Sequence
  chemically synthesized
acagtgcctgcagcttttctaa

SEQ ID NO: 1210864 - DNA, 22 bp, Artificial Sequence
  chemically synthesized
acaacttgcaccatgcacttag

SEQ ID NO: 1210865 - DNA, 22 bp, Artificial Sequence
  chemically synthesized
cagcttttctaagtgcatggtg

SEQ ID NO: 1210866 - DNA, 22 bp, Artificial Sequence
  chemically synthesized
ttctaagtgcatggtgcaagtt

SEQ ID NO: 1210867 - DNA, 22 bp, Artificial Sequence
  chemically synthesized
tctaagtgcatggtgcaagttg

SEQ ID NO: 1210868 - DNA, 22 bp, Artificial Sequence
  chemically synthesized
ctaagtgcatggtgcaagttgt

SEQ ID NO: 1210869 - DNA, 22 bp, Artificial Sequence
  chemically synthesized
taagtgcatggtgcaagttgtc

SEQ ID NO: 1210870 - DNA, 22 bp, Artificial Sequence
  chemically synthesized
agtgcatggtgcaagttgtcag

SEQ ID NO: 1210871 - DNA, 22 bp, Artificial Sequence
  chemically synthesized
gaccccagaatggtagatccac

SEQ ID NO: 1210872 - DNA, 22 bp, Artificial Sequence
  chemically synthesized
tcagtggatctaccattctggg

SEQ ID NO: 1210873 - DNA, 22 bp, Artificial Sequence
  chemically synthesized
ccattctggggtctagatggtg

SEQ ID NO: 1210874 - DNA, 22 bp, Artificial Sequence
  chemically synthesized
tggggtctagatggtgggcctc

SEQ ID NO: 1210875 - DNA, 22 bp, Artificial Sequence
  chemically synthesized
gggtctagatggtgggcctctt

SEQ ID NO: 1210876 - DNA, 22 bp, Artificial Sequence
  chemically synthesized
gtggagccatgagaagaggccc

SEQ ID NO: 1210877 - DNA, 22 bp, Artificial Sequence
  chemically synthesized
cctagtggagccatgagaagag

SEQ ID NO: 1210878 - DNA, 22 bp, Artificial Sequence
  chemically synthesized
gatggtgggcctcttctcatgg

SEQ ID NO: 1210879 - DNA, 22 bp, Artificial Sequence
  chemically synthesized
gggcactgcctagtggagccat

SEQ ID NO: 1210880 - DNA, 22 bp, Artificial Sequence
  chemically synthesized
actggggcactgcctagtggag

SEQ ID NO: 1210881 - DNA, 22 bp, Artificial Sequence
  chemically synthesized
ttctcatggctccactaggcag

SEQ ID NO: 1210882 - DNA, 22 bp, Artificial Sequence
  chemically synthesized
ctcatggctccactaggcagtg

SEQ ID NO: 1210883 - DNA, 22 bp, Artificial Sequence
  chemically synthesized
tcatggctccactaggcagtgc

SEQ ID NO: 1210884 - DNA, 22 bp, Artificial Sequence
  chemically synthesized
atggctccactaggcagtgccc

SEQ ID NO: 1210885 - DNA, 22 bp, Artificial Sequence
  chemically synthesized
cactaggcagtgccccagtgag

SEQ ID NO: 1210886 - DNA, 22 bp, Artificial Sequence
  chemically synthesized
cccccaccacagagtcctcact

SEQ ID NO: 1210887 - DNA, 22 bp, Artificial Sequence
  chemically synthesized
ggcagtgccccagtgaggactc

SEQ ID NO: 1210888 - DNA, 22 bp, Artificial Sequence
  chemically synthesized
ccccccaccacagagtcctcac

SEQ ID NO: 1210889 - DNA, 22 bp, Artificial Sequence
  chemically synthesized
gagcccttccccccaccacaga

SEQ ID NO: 1210890 - DNA, 22 bp, Artificial Sequence
  chemically synthesized
tgtggtggggggaagggctcca

SEQ ID NO: 1210891 - DNA, 22 bp, Artificial Sequence
  chemically synthesized
tggtggggggaagggctccaac

SEQ ID NO: 1210892 - DNA, 22 bp, Artificial Sequence
  chemically synthesized
gggcaatgcaggggggaaatgt

SEQ ID NO: 1210893 - DNA, 22 bp, Artificial Sequence
  chemically synthesized
ctagggcaatgcaggggggaaa

SEQ ID NO: 1210894 - DNA, 22 bp, Artificial Sequence
  chemically synthesized
caaccccacatttcccccctgc

SEQ ID NO: 1210895 - DNA, 22 bp, Artificial Sequence
  chemically synthesized
tactagggcaatgcagggggga

SEQ ID NO: 1210896 - DNA, 22 bp, Artificial Sequence
  chemically synthesized
atggagaacctctactagggca

SEQ ID NO: 1210897 - DNA, 22 bp, Artificial Sequence
  chemically synthesized
cccccctgcattgccctagtag

SEQ ID NO: 1210898 - DNA, 22 bp, Artificial Sequence
  chemically synthesized
ccccctgcattgccctagtaga

SEQ ID NO: 1210899 - DNA, 22 bp, Artificial Sequence
  chemically synthesized
cattgccctagtagaggttctc

SEQ ID NO: 1210900 - DNA, 22 bp, Artificial Sequence
  chemically synthesized
ccctagtagaggttctccatga

SEQ ID NO: 1210901 - DNA, 22 bp, Artificial Sequence
  chemically synthesized
caggggcggagtcctcatggag

SEQ ID NO: 1210902 - DNA, 22 bp, Artificial Sequence
  chemically synthesized
gtagaggttctccatgaggact

SEQ ID NO: 1210903 - DNA, 22 bp, Artificial Sequence
  chemically synthesized
ctgcaggggcggagtcctcatg

SEQ ID NO: 1210904 - DNA, 22 bp, Artificial Sequence
  chemically synthesized
tccatgaggactccgcccctgc

SEQ ID NO: 1210905 - DNA, 22 bp, Artificial Sequence
  chemically synthesized
catgaggactccgcccctgcag

SEQ ID NO: 1210906 - DNA, 22 bp, Artificial Sequence
  chemically synthesized
aggtagaagtctgctgcagggg

SEQ ID NO: 1210907 - DNA, 22 bp, Artificial Sequence
  chemically synthesized
gatgttcaggtagaagtctgct

SEQ ID NO: 1210908 - DNA, 22 bp, Artificial Sequence
  chemically synthesized
cgcccctgcagcagacttctac

SEQ ID NO: 1210909 - DNA, 22 bp, Artificial Sequence
  chemically synthesized
cagcagacttctacctgaacat

SEQ ID NO: 1210910 - DNA, 22 bp, Artificial Sequence
  chemically synthesized
ctacctgaacatccaggtgttt

SEQ ID NO: 1210911 - DNA, 22 bp, Artificial Sequence
  chemically synthesized
gaggatgtatggaaacacctgg

SEQ ID NO: 1210912 - DNA, 22 bp, Artificial Sequence
  chemically synthesized
tacctgaacatccaggtgtttc

SEQ ID NO: 1210913 - DNA, 22 bp, Artificial Sequence
  chemically synthesized
cctgaacatccaggtgtttcca

SEQ ID NO: 1210914 - DNA, 22 bp, Artificial Sequence
  chemically synthesized
aacatccaggtgtttccataca

SEQ ID NO: 1210915 - DNA, 22 bp, Artificial Sequence
  chemically synthesized
gatgtctagaggatgtatggaa

SEQ ID NO: 1210916 - DNA, 22 bp, Artificial Sequence
  chemically synthesized
cctagatgtctagaggatgtat

SEQ ID NO: 1210917 - DNA, 22 bp, Artificial Sequence
  chemically synthesized
tgcctagatgtctagaggatgt

SEQ ID NO: 1210918 - DNA, 22 bp, Artificial Sequence
  chemically synthesized
ccatacatcctctagacatcta

SEQ ID NO: 1210919 - DNA, 22 bp, Artificial Sequence
  chemically synthesized
ggaacctctgcctagatgtcta

SEQ ID NO: 1210920 - DNA, 22 bp, Artificial Sequence
  chemically synthesized
catacatcctctagacatctag

SEQ ID NO: 1210921 - DNA, 22 bp, Artificial Sequence
  chemically synthesized
gggaacctctgcctagatgtct

SEQ ID NO: 1210922 - DNA, 22 bp, Artificial Sequence
  chemically synthesized
tagacatctaggcagaggttcc

SEQ ID NO: 1210923 - DNA, 22 bp, Artificial Sequence
  chemically synthesized
gacatctaggcagaggttccca

SEQ ID NO: 1210924 - DNA, 22 bp, Artificial Sequence
  chemically synthesized
ggcagaggttcccaaacctcat

SEQ ID NO: 1210925 - DNA, 22 bp, Artificial Sequence
  chemically synthesized
tgcagaaggcaagaaatgaggt

SEQ ID NO: 1210926 - DNA, 22 bp, Artificial Sequence
  chemically synthesized
cggctgtgcagaaggcaagaaa

SEQ ID NO: 1210927 - DNA, 22 bp, Artificial Sequence
  chemically synthesized
ccaaacctcatttcttgccttc

SEQ ID NO: 1210928 - DNA, 22 bp, Artificial Sequence
  chemically synthesized
cctacggctgtgcagaaggcaa

SEQ ID NO: 1210929 - DNA, 22 bp, Artificial Sequence
  chemically synthesized
tgcctacggctgtgcagaaggc

SEQ ID NO: 1210930 - DNA, 22 bp, Artificial Sequence
  chemically synthesized
atttcttgccttctgcacagcc

SEQ ID NO: 1210931 - DNA, 22 bp, Artificial Sequence
  chemically synthesized
cttgccttctgcacagccgtag

SEQ ID NO: 1210932 - DNA, 22 bp, Artificial Sequence
  chemically synthesized
ttgccttctgcacagccgtagg

SEQ ID NO: 1210933 - DNA, 22 bp, Artificial Sequence
  chemically synthesized
gccttctgcacagccgtaggca

SEQ ID NO: 1210934 - DNA, 22 bp, Artificial Sequence
  chemically synthesized
catgtggtgttctgcctacggc

SEQ ID NO: 1210935 - DNA, 22 bp, Artificial Sequence
  chemically synthesized
ccttctgcacagccgtaggcag

SEQ ID NO: 1210936 - DNA, 22 bp, Artificial Sequence
  chemically synthesized
ccatgtggtgttctgcctacgg

SEQ ID NO: 1210937 - DNA, 22 bp, Artificial Sequence
  chemically synthesized
ctgcacagccgtaggcagaaca

SEQ ID NO: 1210938 - DNA, 22 bp, Artificial Sequence
  chemically synthesized
tgcacagccgtaggcagaacac

SEQ ID NO: 1210939 - DNA, 22 bp, Artificial Sequence
  chemically synthesized
cacagccgtaggcagaacacca

SEQ ID NO: 1210940 - DNA, 22 bp, Artificial Sequence
  chemically synthesized
gcagcttccatgtggtgttctg

SEQ ID NO: 1210941 - DNA, 22 bp, Artificial Sequence
  chemically synthesized
ggcagcttccatgtggtgttct

SEQ ID NO: 1210942 - DNA, 22 bp, Artificial Sequence
  chemically synthesized
agagggtgcaagccccaagcct

SEQ ID NO: 1210943 - DNA, 22 bp, Artificial Sequence
  chemically synthesized
cagagggtgcaagccccaagcc

SEQ ID NO: 1210944 - DNA, 22 bp, Artificial Sequence
  chemically synthesized
cttcagagggtgcaagccccaa

SEQ ID NO: 1210945 - DNA, 22 bp, Artificial Sequence
  chemically synthesized
ccaaggcttggggcttgcaccc

SEQ ID NO: 1210946 - DNA, 22 bp, Artificial Sequence
  chemically synthesized
caccattgcttcagagggtgca

SEQ ID NO: 1210947 - DNA, 22 bp, Artificial Sequence
  chemically synthesized
gcaccattgcttcagagggtgc

SEQ ID NO: 1210948 - DNA, 22 bp, Artificial Sequence
  chemically synthesized
ggggcttgcaccctctgaagca

SEQ ID NO: 1210949 - DNA, 22 bp, Artificial Sequence
  chemically synthesized
gggcttgcaccctctgaagcaa

SEQ ID NO: 1210950 - DNA, 22 bp, Artificial Sequence
  chemically synthesized
gcaccctctgaagcaatggtgc

SEQ ID NO: 1210951 - DNA, 22 bp, Artificial Sequence
  chemically synthesized
caccctctgaagcaatggtgca

SEQ ID NO: 1210952 - DNA, 22 bp, Artificial Sequence
  chemically synthesized
tgaagcaatggtgcaagatgta

SEQ ID NO: 1210953 - DNA, 22 bp, Artificial Sequence
  chemically synthesized
aaaggggccaaggtacatcttg

SEQ ID NO: 1210954 - DNA, 22 bp, Artificial Sequence
  chemically synthesized
aagcaatggtgcaagatgtacc

SEQ ID NO: 1210955 - DNA, 22 bp, Artificial Sequence
  chemically synthesized
gctaaaaggggccaaggtacat

SEQ ID NO: 1210956 - DNA, 22 bp, Artificial Sequence
  chemically synthesized
ggctaaaaggggccaaggtaca

SEQ ID NO: 1210957 - DNA, 22 bp, Artificial Sequence
  chemically synthesized
cagccttggctaaaaggggcca

SEQ ID NO: 1210958 - DNA, 22 bp, Artificial Sequence
  chemically synthesized
agctccagccttggctaaaagg

SEQ ID NO: 1210959 - DNA, 22 bp, Artificial Sequence
  chemically synthesized
cagctccagccttggctaaaag

SEQ ID NO: 1210960 - DNA, 22 bp, Artificial Sequence
  chemically synthesized
cttcagctccagccttggctaa

SEQ ID NO: 1210961 - DNA, 22 bp, Artificial Sequence
  chemically synthesized
ggccccttttagccaaggctgg

SEQ ID NO: 1210962 - DNA, 22 bp, Artificial Sequence
  chemically synthesized
gctgcttcagctccagccttgg

SEQ ID NO: 1210963 - DNA, 22 bp, Artificial Sequence
  chemically synthesized
gccccttttagccaaggctgga

SEQ ID NO: 1210964 - DNA, 22 bp, Artificial Sequence
  chemically synthesized
tgtcctagctgcttcagctcca

SEQ ID NO: 1210965 - DNA, 22 bp, Artificial Sequence
  chemically synthesized
ttagccaaggctggagctgaag

SEQ ID NO: 1210966 - DNA, 22 bp, Artificial Sequence
  chemically synthesized
tagccaaggctggagctgaagc

SEQ ID NO: 1210967 - DNA, 22 bp, Artificial Sequence
  chemically synthesized
agccaaggctggagctgaagca

SEQ ID NO: 1210968 - DNA, 22 bp, Artificial Sequence
  chemically synthesized
ctgtgtcctagctgcttcagct

SEQ ID NO: 1210969 - DNA, 22 bp, Artificial Sequence
  chemically synthesized
gccaaggctggagctgaagcag

SEQ ID NO: 1210970 - DNA, 22 bp, Artificial Sequence
  chemically synthesized
cctgtgtcctagctgcttcagc

SEQ ID NO: 1210971 - DNA, 22 bp, Artificial Sequence
  chemically synthesized
gcttcctgtgtcctagctgctt

SEQ ID NO: 1210972 - DNA, 22 bp, Artificial Sequence
  chemically synthesized
gagctgaagcagctaggacaca

SEQ ID NO: 1210973 - DNA, 22 bp, Artificial Sequence
  chemically synthesized
ggacctggcttcctgtgtccta

SEQ ID NO: 1210974 - DNA, 22 bp, Artificial Sequence
  chemically synthesized
gggacctggcttcctgtgtcct

SEQ ID NO: 1210975 - DNA, 22 bp, Artificial Sequence
  chemically synthesized
aagcagctaggacacaggaagc

SEQ ID NO: 1210976 - DNA, 22 bp, Artificial Sequence
  chemically synthesized
tgcagccttgggacctggcttc

SEQ ID NO: 1210977 - DNA, 22 bp, Artificial Sequence
  chemically synthesized
tgtgcagccttgggacctggct

SEQ ID NO: 1210978 - DNA, 22 bp, Artificial Sequence
  chemically synthesized
ggacacaggaagccaggtccca

SEQ ID NO: 1210979 - DNA, 22 bp, Artificial Sequence
  chemically synthesized
ctctgtgcagccttgggacctg

SEQ ID NO: 1210980 - DNA, 22 bp, Artificial Sequence
  chemically synthesized
gtgggccaggcccaaggcccca

SEQ ID NO: 1210981 - DNA, 22 bp, Artificial Sequence
  chemically synthesized
ggtgggccaggcccaaggcccc

SEQ ID NO: 1210982 - DNA, 22 bp, Artificial Sequence
  chemically synthesized
cacagagcagtggggccttggg

SEQ ID NO: 1210983 - DNA, 22 bp, Artificial Sequence
  chemically synthesized
gaagggaaaaatggtttggtgg

SEQ ID NO: 1210984 - DNA, 22 bp, Artificial Sequence
  chemically synthesized
gggcctggcccaccaaaccatt

SEQ ID NO: 1210985 - DNA, 22 bp, Artificial Sequence
  chemically synthesized
ggcctggcccaccaaaccattt

SEQ ID NO: 1210986 - DNA, 22 bp, Artificial Sequence
  chemically synthesized
gcccaccaaaccatttttccct

SEQ ID NO: 1210987 - DNA, 22 bp, Artificial Sequence
  chemically synthesized
catcacaggcccagaggcctag

SEQ ID NO: 1210988 - DNA, 22 bp, Artificial Sequence
  chemically synthesized
ccatcacaggcccagaggccta

SEQ ID NO: 1210989 - DNA, 22 bp, Artificial Sequence
  chemically synthesized
ttcccttctaggcctctgggcc

SEQ ID NO: 1210990 - DNA, 22 bp, Artificial Sequence
  chemically synthesized
tcccttctaggcctctgggcct

SEQ ID NO: 1210991 - DNA, 22 bp, Artificial Sequence
  chemically synthesized
cccttctaggcctctgggcctg

SEQ ID NO: 1210992 - DNA, 22 bp, Artificial Sequence
  chemically synthesized
ccttctaggcctctgggcctgt

SEQ ID NO: 1210993 - DNA, 22 bp, Artificial Sequence
  chemically synthesized
ctaggcctctgggcctgtgatg

SEQ ID NO: 1210994 - DNA, 22 bp, Artificial Sequence
  chemically synthesized
taggcctctgggcctgtgatgg

SEQ ID NO: 1210995 - DNA, 22 bp, Artificial Sequence
  chemically synthesized
tgccagccccttccatcacagg

SEQ ID NO: 1210996 - DNA, 22 bp, Artificial Sequence
  chemically synthesized
gtgccagccccttccatcacag

SEQ ID NO: 1210997 - DNA, 22 bp, Artificial Sequence
  chemically synthesized
ggcctctgggcctgtgatggaa

SEQ ID NO: 1210998 - DNA, 22 bp, Artificial Sequence
  chemically synthesized
tgtgccagccccttccatcaca

SEQ ID NO: 1210999 - DNA, 22 bp, Artificial Sequence
  chemically synthesized
tgggcctgtgatggaaggggct

SEQ ID NO: 1211000 - DNA, 22 bp, Artificial Sequence
  chemically synthesized
ggcctgtgatggaaggggctgg

SEQ ID NO: 1211001 - DNA, 22 bp, Artificial Sequence
  chemically synthesized
tgatggaaggggctggcacaaa

SEQ ID NO: 1211002 - DNA, 22 bp, Artificial Sequence
  chemically synthesized
agggtatgtcagagacctttgt

SEQ ID NO: 1211003 - DNA, 22 bp, Artificial Sequence
  chemically synthesized
cagggtatgtcagagacctttg

SEQ ID NO: 1211004 - DNA, 22 bp, Artificial Sequence
  chemically synthesized
gcacaaaggtctctgacatacc

SEQ ID NO: 1211005 - DNA, 22 bp, Artificial Sequence
  chemically synthesized
tgacataccctgaagacgtttt

SEQ ID NO: 1211006 - DNA, 22 bp, Artificial Sequence
  chemically synthesized
acataccctgaagacgttttcc

SEQ ID NO: 1211007 - DNA, 22 bp, Artificial Sequence
  chemically synthesized
gtagccaagacaatggggaaaa

SEQ ID NO: 1211008 - DNA, 22 bp, Artificial Sequence
  chemically synthesized
aagacgttttccccattgtctt

SEQ ID NO: 1211009 - DNA, 22 bp, Artificial Sequence
  chemically synthesized
tccccattgtcttggctactaa

SEQ ID NO: 1211010 - DNA, 22 bp, Artificial Sequence
  chemically synthesized
ccccattgtcttggctactaac

SEQ ID NO: 1211011 - DNA, 22 bp, Artificial Sequence
  chemically synthesized
cccattgtcttggctactaaca

SEQ ID NO: 1211012 - DNA, 22 bp, Artificial Sequence
  chemically synthesized
tcttggctactaacattctgct

SEQ ID NO: 1211013 - DNA, 22 bp, Artificial Sequence
  chemically synthesized
cataagtaaagagaagcagaat

SEQ ID NO: 1211014 - DNA, 22 bp, Artificial Sequence
  chemically synthesized
gcataagtaaagagaagcagaa

SEQ ID NO: 1211015 - DNA, 22 bp, Artificial Sequence
  chemically synthesized
ggctactaacattctgcttctc

SEQ ID NO: 1211016 - DNA, 22 bp, Artificial Sequence
  chemically synthesized
gctactaacattctgcttctct

SEQ ID NO: 1211017 - DNA, 22 bp, Artificial Sequence
  chemically synthesized
ctaacattctgcttctctttac

SEQ ID NO: 1211018 - DNA, 22 bp, Artificial Sequence
  chemically synthesized
acattctgcttctctttactta

SEQ ID NO: 1211019 - DNA, 22 bp, Artificial Sequence
  chemically synthesized
cagaaatttgcataagtaaaga

SEQ ID NO: 1211020 - DNA, 22 bp, Artificial Sequence
  chemically synthesized
ctgcagaaatttgcataagtaa

SEQ ID NO: 1211021 - DNA, 22 bp, Artificial Sequence
  chemically synthesized
tgcttctctttacttatgcaaa

SEQ ID NO: 1211022 - DNA, 22 bp, Artificial Sequence
  chemically synthesized
cttctctttacttatgcaaatt

SEQ ID NO: 1211023 - DNA, 22 bp, Artificial Sequence
  chemically synthesized
ctctttacttatgcaaatttct

SEQ ID NO: 1211024 - DNA, 22 bp, Artificial Sequence
  chemically synthesized
tctttacttatgcaaatttctg

SEQ ID NO: 1211025 - DNA, 22 bp, Artificial Sequence
  chemically synthesized
tttacttatgcaaatttctgca

SEQ ID NO: 1211026 - DNA, 22 bp, Artificial Sequence
  chemically synthesized
tacttatgcaaatttctgcagc

SEQ ID NO: 1211027 - DNA, 22 bp, Artificial Sequence
  chemically synthesized
acttatgcaaatttctgcagca

SEQ ID NO: 1211028 - DNA, 22 bp, Artificial Sequence
  chemically synthesized
cttatgcaaatttctgcagcag

SEQ ID NO: 1211029 - DNA, 22 bp, Artificial Sequence
  chemically synthesized
atgcaaatttctgcagcaggct

SEQ ID NO: 1211030 - DNA, 22 bp, Artificial Sequence
  chemically synthesized
gggagtaagtcaagcctgctgc

SEQ ID NO: 1211031 - DNA, 22 bp, Artificial Sequence
  chemically synthesized
tgcaaatttctgcagcaggctt

SEQ ID NO: 1211032 - DNA, 22 bp, Artificial Sequence
  chemically synthesized
tagggagtaagtcaagcctgct

SEQ ID NO: 1211033 - DNA, 22 bp, Artificial Sequence
  chemically synthesized
ctagggagtaagtcaagcctgc

SEQ ID NO: 1211034 - DNA, 22 bp, Artificial Sequence
  chemically synthesized
tctagggagtaagtcaagcctg

SEQ ID NO: 1211035 - DNA, 22 bp, Artificial Sequence
  chemically synthesized
ctgcagcaggcttgacttactc

SEQ ID NO: 1211036 - DNA, 22 bp, Artificial Sequence
  chemically synthesized
tgcagcaggcttgacttactcc

SEQ ID NO: 1211037 - DNA, 22 bp, Artificial Sequence
  chemically synthesized
cagcaggcttgacttactccct

SEQ ID NO: 1211038 - DNA, 22 bp, Artificial Sequence
  chemically synthesized
gacttactccctagaaaatggg

SEQ ID NO: 1211039 - DNA, 22 bp, Artificial Sequence
  chemically synthesized
acttactccctagaaaatgggt

SEQ ID NO: 1211040 - DNA, 22 bp, Artificial Sequence
  chemically synthesized
actccctagaaaatgggttttt

SEQ ID NO: 1211041 - DNA, 22 bp, Artificial Sequence
  chemically synthesized
ctccctagaaaatgggtttttc

SEQ ID NO: 1211042 - DNA, 22 bp, Artificial Sequence
  chemically synthesized
cctagaaaatgggtttttcttt

SEQ ID NO: 1211043 - DNA, 22 bp, Artificial Sequence
  chemically synthesized
tccatgcggcagaaaagaaaaa

SEQ ID NO: 1211044 - DNA, 22 bp, Artificial Sequence
  chemically synthesized
gaaaatgggtttttcttttctg

SEQ ID NO: 1211045 - DNA, 22 bp, Artificial Sequence
  chemically synthesized
cagcctgtccatgcggcagaaa

SEQ ID NO: 1211046 - DNA, 22 bp, Artificial Sequence
  chemically synthesized
gcagcctgtccatgcggcagaa

SEQ ID NO: 1211047 - DNA, 22 bp, Artificial Sequence
  chemically synthesized
ttcttttctgccgcatggacag

SEQ ID NO: 1211048 - DNA, 22 bp, Artificial Sequence
  chemically synthesized
tcttttctgccgcatggacagg

SEQ ID NO: 1211049 - DNA, 22 bp, Artificial Sequence
  chemically synthesized
gaaaatttgcagcctgtccatg

SEQ ID NO: 1211050 - DNA, 22 bp, Artificial Sequence
  chemically synthesized
cttttctgccgcatggacaggc

SEQ ID NO: 1211051 - DNA, 22 bp, Artificial Sequence
  chemically synthesized
ggaaaatttgcagcctgtccat

SEQ ID NO: 1211052 - DNA, 22 bp, Artificial Sequence
  chemically synthesized
ttttctgccgcatggacaggct

SEQ ID NO: 1211053 - DNA, 22 bp, Artificial Sequence
  chemically synthesized
ttctgccgcatggacaggctgc

SEQ ID NO: 1211054 - DNA, 22 bp, Artificial Sequence
  chemically synthesized
tctgccgcatggacaggctgca

SEQ ID NO: 1211055 - DNA, 22 bp, Artificial Sequence
  chemically synthesized
ctgccgcatggacaggctgcaa

SEQ ID NO: 1211056 - DNA, 22 bp, Artificial Sequence
  chemically synthesized
tgccgcatggacaggctgcaaa

SEQ ID NO: 1211057 - DNA, 22 bp, Artificial Sequence
  chemically synthesized
ccgcatggacaggctgcaaatt

SEQ ID NO: 1211058 - DNA, 22 bp, Artificial Sequence
  chemically synthesized
caaattttccaaacttttatgc

SEQ ID NO: 1211059 - DNA, 22 bp, Artificial Sequence
  chemically synthesized
aaaggaaagcagagcataaaag

SEQ ID NO: 1211060 - DNA, 22 bp, Artificial Sequence
  chemically synthesized
aaaaggaaagcagagcataaaa

SEQ ID NO: 1211061 - DNA, 22 bp, Artificial Sequence
  chemically synthesized
taaaaggaaagcagagcataaa

SEQ ID NO: 1211062 - DNA, 22 bp, Artificial Sequence
  chemically synthesized
tttaaaaggaaagcagagcata

SEQ ID NO: 1211063 - DNA, 22 bp, Artificial Sequence
  chemically synthesized
ctttaaaaggaaagcagagcat

SEQ ID NO: 1211064 - DNA, 22 bp, Artificial Sequence
  chemically synthesized
tccaaacttttatgctctgctt

SEQ ID NO: 1211065 - DNA, 22 bp, Artificial Sequence
  chemically synthesized
tctttaaaaggaaagcagagca

SEQ ID NO: 1211066 - DNA, 22 bp, Artificial Sequence
  chemically synthesized
ccaaacttttatgctctgcttt

SEQ ID NO: 1211067 - DNA, 22 bp, Artificial Sequence
  chemically synthesized
ttctttaaaaggaaagcagagc

SEQ ID NO: 1211068 - DNA, 22 bp, Artificial Sequence
  chemically synthesized
caaacttttatgctctgctttc

SEQ ID NO: 1211069 - DNA, 22 bp, Artificial Sequence
  chemically synthesized
ttatgctctgctttccttttaa

SEQ ID NO: 1211070 - DNA, 22 bp, Artificial Sequence
  chemically synthesized
tatgctctgctttccttttaaa

SEQ ID NO: 1211071 - DNA, 22 bp, Artificial Sequence
  chemically synthesized
atgctctgctttccttttaaag

SEQ ID NO: 1211072 - DNA, 22 bp, Artificial Sequence
  chemically synthesized
tgctctgctttccttttaaaga

SEQ ID NO: 1211073 - DNA, 22 bp, Artificial Sequence
  chemically synthesized
aaatgggaacttttctttaaaa

SEQ ID NO: 1211074 - DNA, 22 bp, Artificial Sequence
  chemically synthesized
tgctttccttttaaagaaaagt

SEQ ID NO: 1211075 - DNA, 22 bp, Artificial Sequence
  chemically synthesized
tctgaaatgggaacttttcttt

SEQ ID NO: 1211076 - DNA, 22 bp, Artificial Sequence
  chemically synthesized
ctttccttttaaagaaaagttc

SEQ ID NO: 1211077 - DNA, 22 bp, Artificial Sequence
  chemically synthesized
tccttttaaagaaaagttccca

SEQ ID NO: 1211078 - DNA, 22 bp, Artificial Sequence
  chemically synthesized
ccttttaaagaaaagttcccat

SEQ ID NO: 1211079 - DNA, 22 bp, Artificial Sequence
  chemically synthesized
cttttaaagaaaagttcccatt

SEQ ID NO: 1211080 - DNA, 22 bp, Artificial Sequence
  chemically synthesized
ttaaagaaaagttcccatttca

SEQ ID NO: 1211081 - DNA, 22 bp, Artificial Sequence
  chemically synthesized
taaagaaaagttcccatttcag

SEQ ID NO: 1211082 - DNA, 22 bp, Artificial Sequence
  chemically synthesized
aaagaaaagttcccatttcaga

SEQ ID NO: 1211083 - DNA, 22 bp, Artificial Sequence
  chemically synthesized
acagagagattatctgaaatgg

SEQ ID NO: 1211084 - DNA, 22 bp, Artificial Sequence
  chemically synthesized
aagaaaagttcccatttcagat

SEQ ID NO: 1211085 - DNA, 22 bp, Artificial Sequence
  chemically synthesized
tatgcgttcacagagagattat

SEQ ID NO: 1211086 - DNA, 22 bp, Artificial Sequence
  chemically synthesized
ccatttcagataatctctctgt

SEQ ID NO: 1211087 - DNA, 22 bp, Artificial Sequence
  chemically synthesized
cagataatctctctgtgaacgc

SEQ ID NO: 1211088 - DNA, 22 bp, Artificial Sequence
  chemically synthesized
agataatctctctgtgaacgca

SEQ ID NO: 1211089 - DNA, 22 bp, Artificial Sequence
  chemically synthesized
aaaacatacggttatatgcgtt

SEQ ID NO: 1211090 - DNA, 22 bp, Artificial Sequence
  chemically synthesized
tgaaaacatacggttatatgcg

SEQ ID NO: 1211091 - DNA, 22 bp, Artificial Sequence
  chemically synthesized
ctgaaaacatacggttatatgc

SEQ ID NO: 1211092 - DNA, 22 bp, Artificial Sequence
  chemically synthesized
tctgaaaacatacggttatatg

SEQ ID NO: 1211093 - DNA, 22 bp, Artificial Sequence
  chemically synthesized
ttctgaaaacatacggttatat

SEQ ID NO: 1211094 - DNA, 22 bp, Artificial Sequence
  chemically synthesized
tctgtgaacgcatataaccgta

SEQ ID NO: 1211095 - DNA, 22 bp, Artificial Sequence
  chemically synthesized
tttctgaaaacatacggttata

SEQ ID NO: 1211096 - DNA, 22 bp, Artificial Sequence
  chemically synthesized
tgtgaacgcatataaccgtatg

SEQ ID NO: 1211097 - DNA, 22 bp, Artificial Sequence
  chemically synthesized
tgaacgcatataaccgtatgtt

SEQ ID NO: 1211098 - DNA, 22 bp, Artificial Sequence
  chemically synthesized
actttttctgaaaacatacggt

SEQ ID NO: 1211099 - DNA, 22 bp, Artificial Sequence
  chemically synthesized
gactttttctgaaaacatacgg

SEQ ID NO: 1211100 - DNA, 22 bp, Artificial Sequence
  chemically synthesized
aagatgtgacttgactttttct

SEQ ID NO: 1211101 - DNA, 22 bp, Artificial Sequence
  chemically synthesized
tcagaaaaagtcaagtcacatc

SEQ ID NO: 1211102 - DNA, 22 bp, Artificial Sequence
  chemically synthesized
cagaaaaagtcaagtcacatct

SEQ ID NO: 1211103 - DNA, 22 bp, Artificial Sequence
  chemically synthesized
agaaaaagtcaagtcacatctt

SEQ ID NO: 1211104 - DNA, 22 bp, Artificial Sequence
  chemically synthesized
taagcagcaaggcattcaagat

SEQ ID NO: 1211105 - DNA, 22 bp, Artificial Sequence
  chemically synthesized
gcagaaatctgtaagcagcaag

SEQ ID NO: 1211106 - DNA, 22 bp, Artificial Sequence
  chemically synthesized
gaatgccttgctgcttacagat

SEQ ID NO: 1211107 - DNA, 22 bp, Artificial Sequence
  chemically synthesized
aatgccttgctgcttacagatt

SEQ ID NO: 1211108 - DNA, 22 bp, Artificial Sequence
  chemically synthesized
gggtatctggcagaaatctgta

SEQ ID NO: 1211109 - DNA, 22 bp, Artificial Sequence
  chemically synthesized
agggtatctggcagaaatctgt

SEQ ID NO: 1211110 - DNA, 22 bp, Artificial Sequence
  chemically synthesized
gctgcttacagatttctgccag

SEQ ID NO: 1211111 - DNA, 22 bp, Artificial Sequence
  chemically synthesized
ctgcttacagatttctgccaga

SEQ ID NO: 1211112 - DNA, 22 bp, Artificial Sequence
  chemically synthesized
cttacagatttctgccagatac

SEQ ID NO: 1211113 - DNA, 22 bp, Artificial Sequence
  chemically synthesized
agagatgatttagggtatctgg

SEQ ID NO: 1211114 - DNA, 22 bp, Artificial Sequence
  chemically synthesized
acagatttctgccagataccct

SEQ ID NO: 1211115 - DNA, 22 bp, Artificial Sequence
  chemically synthesized
gagagatgatttagggtatctg

SEQ ID NO: 1211116 - DNA, 22 bp, Artificial Sequence
  chemically synthesized
cagatttctgccagatacccta

SEQ ID NO: 1211117 - DNA, 22 bp, Artificial Sequence
  chemically synthesized
aacttgagagatgatttagggt

SEQ ID NO: 1211118 - DNA, 22 bp, Artificial Sequence
  chemically synthesized
gaacttgagagatgatttaggg

SEQ ID NO: 1211119 - DNA, 22 bp, Artificial Sequence
  chemically synthesized
tgaacttgagagatgatttagg

SEQ ID NO: 1211120 - DNA, 22 bp, Artificial Sequence
  chemically synthesized
ctgccagataccctaaatcatc

SEQ ID NO: 1211121 - DNA, 22 bp, Artificial Sequence
  chemically synthesized
tgccagataccctaaatcatct

SEQ ID NO: 1211122 - DNA, 22 bp, Artificial Sequence
  chemically synthesized
ccagataccctaaatcatctct

SEQ ID NO: 1211123 - DNA, 22 bp, Artificial Sequence
  chemically synthesized
tggaactttgaacttgagagat

SEQ ID NO: 1211124 - DNA, 22 bp, Artificial Sequence
  chemically synthesized
aatcatctctcaagttcaaagt

SEQ ID NO: 1211125 - DNA, 22 bp, Artificial Sequence
  chemically synthesized
gacatctgtggaactttgaact

SEQ ID NO: 1211126 - DNA, 22 bp, Artificial Sequence
  chemically synthesized
cctagacatctgtggaactttg

SEQ ID NO: 1211127 - DNA, 22 bp, Artificial Sequence
  chemically synthesized
ccctagacatctgtggaacttt

SEQ ID NO: 1211128 - DNA, 22 bp, Artificial Sequence
  chemically synthesized
tcaagttcaaagttccacagat

SEQ ID NO: 1211129 - DNA, 22 bp, Artificial Sequence
  chemically synthesized
aagttcaaagttccacagatgt

SEQ ID NO: 1211130 - DNA, 22 bp, Artificial Sequence
  chemically synthesized
ccccttccctagacatctgtgg

SEQ ID NO: 1211131 - DNA, 22 bp, Artificial Sequence
  chemically synthesized
gccccttccctagacatctgtg

SEQ ID NO: 1211132 - DNA, 22 bp, Artificial Sequence
  chemically synthesized
tgccccttccctagacatctgt

SEQ ID NO: 1211133 - DNA, 22 bp, Artificial Sequence
  chemically synthesized
aaagttccacagatgtctaggg

SEQ ID NO: 1211134 - DNA, 22 bp, Artificial Sequence
  chemically synthesized
gtggcattttgccccttcccta

SEQ ID NO: 1211135 - DNA, 22 bp, Artificial Sequence
  chemically synthesized
cacagatgtctagggaaggggc

SEQ ID NO: 1211136 - DNA, 22 bp, Artificial Sequence
  chemically synthesized
gcaaagagattggtggcatttt

SEQ ID NO: 1211137 - DNA, 22 bp, Artificial Sequence
  chemically synthesized
agcaaagagattggtggcattt

SEQ ID NO: 1211138 - DNA, 22 bp, Artificial Sequence
  chemically synthesized
gggaaggggcaaaatgccacca

SEQ ID NO: 1211139 - DNA, 22 bp, Artificial Sequence
  chemically synthesized
tagcaaagagattggtggcatt

SEQ ID NO: 1211140 - DNA, 22 bp, Artificial Sequence
  chemically synthesized
tgctttagcaaagagattggtg

SEQ ID NO: 1211141 - DNA, 22 bp, Artificial Sequence
  chemically synthesized
ctatgctttagcaaagagattg

SEQ ID NO: 1211142 - DNA, 22 bp, Artificial Sequence
  chemically synthesized
gctatgctttagcaaagagatt

SEQ ID NO: 1211143 - DNA, 22 bp, Artificial Sequence
  chemically synthesized
ttgctatgctttagcaaagaga

SEQ ID NO: 1211144 - DNA, 22 bp, Artificial Sequence
  chemically synthesized
gagtaaaagtgactcttgctat

SEQ ID NO: 1211145 - DNA, 22 bp, Artificial Sequence
  chemically synthesized
tttgctaaagcatagcaagagt

SEQ ID NO: 1211146 - DNA, 22 bp, Artificial Sequence
  chemically synthesized
tgctaaagcatagcaagagtca

SEQ ID NO: 1211147 - DNA, 22 bp, Artificial Sequence
  chemically synthesized
gctaaagcatagcaagagtcac

SEQ ID NO: 1211148 - DNA, 22 bp, Artificial Sequence
  chemically synthesized
ctaaagcatagcaagagtcact

SEQ ID NO: 1211149 - DNA, 22 bp, Artificial Sequence
  chemically synthesized
ggaactggagtaaaagtgactc

SEQ ID NO: 1211150 - DNA, 22 bp, Artificial Sequence
  chemically synthesized
aagcatagcaagagtcactttt

SEQ ID NO: 1211151 - DNA, 22 bp, Artificial Sequence
  chemically synthesized
ttgggaactggagtaaaagtga

SEQ ID NO: 1211152 - DNA, 22 bp, Artificial Sequence
  chemically synthesized
gttgggaactggagtaaaagtg

SEQ ID NO: 1211153 - DNA, 22 bp, Artificial Sequence
  chemically synthesized
ttactccagttcccaacaagtt

SEQ ID NO: 1211154 - DNA, 22 bp, Artificial Sequence
  chemically synthesized
tactccagttcccaacaagttc

SEQ ID NO: 1211155 - DNA, 22 bp, Artificial Sequence
  chemically synthesized
actccagttcccaacaagttcc

SEQ ID NO: 1211156 - DNA, 22 bp, Artificial Sequence
  chemically synthesized
agatggagatgaggaacttgtt

SEQ ID NO: 1211157 - DNA, 22 bp, Artificial Sequence
  chemically synthesized
ctccagttcccaacaagttcct

SEQ ID NO: 1211158 - DNA, 22 bp, Artificial Sequence
  chemically synthesized
cagttcccaacaagttcctcat

SEQ ID NO: 1211159 - DNA, 22 bp, Artificial Sequence
  chemically synthesized
ccaacaagttcctcatctccat

SEQ ID NO: 1211160 - DNA, 22 bp, Artificial Sequence
  chemically synthesized
agatagtctcagatggagatga

SEQ ID NO: 1211161 - DNA, 22 bp, Artificial Sequence
  chemically synthesized
ctcatctccatctgagactatc

SEQ ID NO: 1211162 - DNA, 22 bp, Artificial Sequence
  chemically synthesized
atctccatctgagactatctca

SEQ ID NO: 1211163 - DNA, 22 bp, Artificial Sequence
  chemically synthesized
catctgagactatctcagcctg

SEQ ID NO: 1211164 - DNA, 22 bp, Artificial Sequence
  chemically synthesized
agactatctcagcctggacttc

SEQ ID NO: 1211165 - DNA, 22 bp, Artificial Sequence
  chemically synthesized
atagtgatacggacaatgaagt

SEQ ID NO: 1211166 - DNA, 22 bp, Artificial Sequence
  chemically synthesized
tctcagcctggacttcattgtc

SEQ ID NO: 1211167 - DNA, 22 bp, Artificial Sequence
  chemically synthesized
agcctggacttcattgtccgta

SEQ ID NO: 1211168 - DNA, 22 bp, Artificial Sequence
  chemically synthesized
gacttcattgtccgtatcacta

SEQ ID NO: 1211169 - DNA, 22 bp, Artificial Sequence
  chemically synthesized
accacaatgttgatagtgatac

SEQ ID NO: 1211170 - DNA, 22 bp, Artificial Sequence
  chemically synthesized
gaccacaatgttgatagtgata

SEQ ID NO: 1211171 - DNA, 22 bp, Artificial Sequence
  chemically synthesized
tgaccacaatgttgatagtgat

SEQ ID NO: 1211172 - DNA, 22 bp, Artificial Sequence
  chemically synthesized
cattgtccgtatcactatcaac

SEQ ID NO: 1211173 - DNA, 22 bp, Artificial Sequence
  chemically synthesized
attgtccgtatcactatcaaca

SEQ ID NO: 1211174 - DNA, 22 bp, Artificial Sequence
  chemically synthesized
tccgtatcactatcaacattgt

SEQ ID NO: 1211175 - DNA, 22 bp, Artificial Sequence
  chemically synthesized
aatggctttgaccacaatgttg

SEQ ID NO: 1211176 - DNA, 22 bp, Artificial Sequence
  chemically synthesized
ttgaatggctttgaccacaatg

SEQ ID NO: 1211177 - DNA, 22 bp, Artificial Sequence
  chemically synthesized
gttgaatggctttgaccacaat

SEQ ID NO: 1211178 - DNA, 22 bp, Artificial Sequence
  chemically synthesized
tcaacattgtggtcaaagccat

SEQ ID NO: 1211179 - DNA, 22 bp, Artificial Sequence
  chemically synthesized
ccagagacttgttgaatggctt

SEQ ID NO: 1211180 - DNA, 22 bp, Artificial Sequence
  chemically synthesized
cccagagacttgttgaatggct

SEQ ID NO: 1211181 - DNA, 22 bp, Artificial Sequence
  chemically synthesized
tggtcaaagccattcaacaagt

SEQ ID NO: 1211182 - DNA, 22 bp, Artificial Sequence
  chemically synthesized
gaatttcccagagacttgttga

SEQ ID NO: 1211183 - DNA, 22 bp, Artificial Sequence
  chemically synthesized
ggaatttcccagagacttgttg

SEQ ID NO: 1211184 - DNA, 22 bp, Artificial Sequence
  chemically synthesized
aacaagtctctgggaaattcca

SEQ ID NO: 1211185 - DNA, 22 bp, Artificial Sequence
  chemically synthesized
tgggaaattccaaactctccct

SEQ ID NO: 1211186 - DNA, 22 bp, Artificial Sequence
  chemically synthesized
ggaaattccaaactctccctca

SEQ ID NO: 1211187 - DNA, 22 bp, Artificial Sequence
  chemically synthesized
caaactctccctcatctttctg

SEQ ID NO: 1211188 - DNA, 22 bp, Artificial Sequence
  chemically synthesized
tccctcatctttctgtcttctt

SEQ ID NO: 1211189 - DNA, 22 bp, Artificial Sequence
  chemically synthesized
gggggggggtcagaagaagaca

SEQ ID NO: 1211190 - DNA, 22 bp, Artificial Sequence
  chemically synthesized
cctcatctttctgtcttcttct

SEQ ID NO: 1211191 - DNA, 22 bp, Artificial Sequence
  chemically synthesized
ggggggggggtcagaagaagac

SEQ ID NO: 1211192 - DNA, 22 bp, Artificial Sequence
  chemically synthesized
atctttctgtcttcttctgacc

SEQ ID NO: 1211193 - DNA, 22 bp, Artificial Sequence
  chemically synthesized
tctgtcttcttctgaccccccc

SEQ ID NO: 1211194 - DNA, 22 bp, Artificial Sequence
  chemically synthesized
gaacaatttggggggggggtca

SEQ ID NO: 1211195 - DNA, 22 bp, Artificial Sequence
  chemically synthesized
ctgtcttcttctgacccccccc

SEQ ID NO: 1211196 - DNA, 22 bp, Artificial Sequence
  chemically synthesized
tgtcttcttctgaccccccccc

SEQ ID NO: 1211197 - DNA, 22 bp, Artificial Sequence
  chemically synthesized
tcttcttctgacccccccccca

SEQ ID NO: 1211198 - DNA, 22 bp, Artificial Sequence
  chemically synthesized
cttctgaccccccccccaaatt

SEQ ID NO: 1211199 - DNA, 22 bp, Artificial Sequence
  chemically synthesized
ttctgaccccccccccaaattg

SEQ ID NO: 1211200 - DNA, 22 bp, Artificial Sequence
  chemically synthesized
gcagaggttggaacaatttggg

SEQ ID NO: 1211201 - DNA, 22 bp, Artificial Sequence
  chemically synthesized
ctgaccccccccccaaattgtt

SEQ ID NO: 1211202 - DNA, 22 bp, Artificial Sequence
  chemically synthesized
tgaccccccccccaaattgttc

SEQ ID NO: 1211203 - DNA, 22 bp, Artificial Sequence
  chemically synthesized
accccccccccaaattgttcca

SEQ ID NO: 1211204 - DNA, 22 bp, Artificial Sequence
  chemically synthesized
ggtaactggcagaggttggaac

SEQ ID NO: 1211205 - DNA, 22 bp, Artificial Sequence
  chemically synthesized
gaactgggtaactggcagaggt

SEQ ID NO: 1211206 - DNA, 22 bp, Artificial Sequence
  chemically synthesized
ggaactgggtaactggcagagg

SEQ ID NO: 1211207 - DNA, 22 bp, Artificial Sequence
  chemically synthesized
tggaactgggtaactggcagag

SEQ ID NO: 1211208 - DNA, 22 bp, Artificial Sequence
  chemically synthesized
ttccaacctctgccagttaccc

SEQ ID NO: 1211209 - DNA, 22 bp, Artificial Sequence
  chemically synthesized
caacctctgccagttacccagt

SEQ ID NO: 1211210 - DNA, 22 bp, Artificial Sequence
  chemically synthesized
tagaagtgactttggaactggg

SEQ ID NO: 1211211 - DNA, 22 bp, Artificial Sequence
  chemically synthesized
tgccagttacccagttccaaag

SEQ ID NO: 1211212 - DNA, 22 bp, Artificial Sequence
  chemically synthesized
ccagttacccagttccaaagtc

SEQ ID NO: 1211213 - DNA, 22 bp, Artificial Sequence
  chemically synthesized
cccagttccaaagtcacttcta

SEQ ID NO: 1211214 - DNA, 22 bp, Artificial Sequence
  chemically synthesized
taaatatagcaattatagaagt

SEQ ID NO: 1211215 - DNA, 22 bp, Artificial Sequence
  chemically synthesized
ctataaatatagcaattataga

SEQ ID NO: 1211216 - DNA, 22 bp, Artificial Sequence
  chemically synthesized
caaagtcacttctataattgct

SEQ ID NO: 1211217 - DNA, 22 bp, Artificial Sequence
  chemically synthesized
ctataattgctatatttatagc

SEQ ID NO: 1211218 - DNA, 22 bp, Artificial Sequence
  chemically synthesized
tataattgctatatttatagca

SEQ ID NO: 1211219 - DNA, 22 bp, Artificial Sequence
  chemically synthesized
taattgctatatttatagcaat

SEQ ID NO: 1211220 - DNA, 22 bp, Artificial Sequence
  chemically synthesized
ctatatttatagcaatgcccca

SEQ ID NO: 1211221 - DNA, 22 bp, Artificial Sequence
  chemically synthesized
gtgcccagatagtggggcattg

SEQ ID NO: 1211222 - DNA, 22 bp, Artificial Sequence
  chemically synthesized
tatttatagcaatgccccacta

SEQ ID NO: 1211223 - DNA, 22 bp, Artificial Sequence
  chemically synthesized
atagcaatgccccactatctgg

SEQ ID NO: 1211224 - DNA, 22 bp, Artificial Sequence
  chemically synthesized
tagcaatgccccactatctggg

SEQ ID NO: 1211225 - DNA, 22 bp, Artificial Sequence
  chemically synthesized
aaacagaaaattggtgcccaga

SEQ ID NO: 1211226 - DNA, 22 bp, Artificial Sequence
  chemically synthesized
tctgggcaccaattttctgttt

SEQ ID NO: 1211227 - DNA, 22 bp, Artificial Sequence
  chemically synthesized
ggcaccaattttctgttttagt

SEQ ID NO: 1211228 - DNA, 22 bp, Artificial Sequence
  chemically synthesized
taacagtgtgaaaacagactaa

SEQ ID NO: 1211229 - DNA, 22 bp, Artificial Sequence
  chemically synthesized
ataacagtgtgaaaacagacta

SEQ ID NO: 1211230 - DNA, 22 bp, Artificial Sequence
  chemically synthesized
tataacagtgtgaaaacagact

SEQ ID NO: 1211231 - DNA, 22 bp, Artificial Sequence
  chemically synthesized
tttataacagtgtgaaaacaga

SEQ ID NO: 1211232 - DNA, 22 bp, Artificial Sequence
  chemically synthesized
tctgttttagtctgttttcaca

SEQ ID NO: 1211233 - DNA, 22 bp, Artificial Sequence
  chemically synthesized
ctgttttagtctgttttcacac

SEQ ID NO: 1211234 - DNA, 22 bp, Artificial Sequence
  chemically synthesized
tgttttagtctgttttcacact

SEQ ID NO: 1211235 - DNA, 22 bp, Artificial Sequence
  chemically synthesized
ttttagtctgttttcacactgt

SEQ ID NO: 1211236 - DNA, 22 bp, Artificial Sequence
  chemically synthesized
tagtctgttttcacactgttat

SEQ ID NO: 1211237 - DNA, 22 bp, Artificial Sequence
  chemically synthesized
agtctgttttcacactgttata

SEQ ID NO: 1211238 - DNA, 22 bp, Artificial Sequence
  chemically synthesized
gtctgttttcacactgttataa

SEQ ID NO: 1211239 - DNA, 22 bp, Artificial Sequence
  chemically synthesized
ttttcacactgttataaagagt

SEQ ID NO: 1211240 - DNA, 22 bp, Artificial Sequence
  chemically synthesized
cccaaccacaggtactctttat

SEQ ID NO: 1211241 - DNA, 22 bp, Artificial Sequence
  chemically synthesized
tcacactgttataaagagtacc

SEQ ID NO: 1211242 - DNA, 22 bp, Artificial Sequence
  chemically synthesized
cacactgttataaagagtacct

SEQ ID NO: 1211243 - DNA, 22 bp, Artificial Sequence
  chemically synthesized
acactgttataaagagtacctg

SEQ ID NO: 1211244 - DNA, 22 bp, Artificial Sequence
  chemically synthesized
taaattacccaaccacaggtac

SEQ ID NO: 1211245 - DNA, 22 bp, Artificial Sequence
  chemically synthesized
ataaattacccaaccacaggta

SEQ ID NO: 1211246 - DNA, 22 bp, Artificial Sequence
  chemically synthesized
ttataaagagtacctgtggttg

SEQ ID NO: 1211247 - DNA, 22 bp, Artificial Sequence
  chemically synthesized
cttataaattacccaaccacag

SEQ ID NO: 1211248 - DNA, 22 bp, Artificial Sequence
  chemically synthesized
acttataaattacccaaccaca

SEQ ID NO: 1211249 - DNA, 22 bp, Artificial Sequence
  chemically synthesized
taaagagtacctgtggttgggt

SEQ ID NO: 1211250 - DNA, 22 bp, Artificial Sequence
  chemically synthesized
tacttataaattacccaaccac

SEQ ID NO: 1211251 - DNA, 22 bp, Artificial Sequence
  chemically synthesized
ttacttataaattacccaacca

SEQ ID NO: 1211252 - DNA, 22 bp, Artificial Sequence
  chemically synthesized
ttttacttataaattacccaac

SEQ ID NO: 1211253 - DNA, 22 bp, Artificial Sequence
  chemically synthesized
atcctcttttacttataaatta

SEQ ID NO: 1211254 - DNA, 22 bp, Artificial Sequence
  chemically synthesized
ttaatcctcttttacttataaa

SEQ ID NO: 1211255 - DNA, 22 bp, Artificial Sequence
  chemically synthesized
tggttgggtaatttataagtaa

SEQ ID NO: 1211256 - DNA, 22 bp, Artificial Sequence
  chemically synthesized
ggtaatttataagtaaaagagg

SEQ ID NO: 1211257 - DNA, 22 bp, Artificial Sequence
  chemically synthesized
tgagtctattaatcctctttta

SEQ ID NO: 1211258 - DNA, 22 bp, Artificial Sequence
  chemically synthesized
ataagtaaaagaggattaatag

SEQ ID NO: 1211259 - DNA, 22 bp, Artificial Sequence
  chemically synthesized
taagtaaaagaggattaataga

SEQ ID NO: 1211260 - DNA, 22 bp, Artificial Sequence
  chemically synthesized
cccacccatgtagaactgtgag

SEQ ID NO: 1211261 - DNA, 22 bp, Artificial Sequence
  chemically synthesized
atagactcacagttctacatgg

SEQ ID NO: 1211262 - DNA, 22 bp, Artificial Sequence
  chemically synthesized
ggggcctccccacccatgtaga

SEQ ID NO: 1211263 - DNA, 22 bp, Artificial Sequence
  chemically synthesized
ctgggggcctccccacccatgt

SEQ ID NO: 1211264 - DNA, 22 bp, Artificial Sequence
  chemically synthesized
cctgggggcctccccacccatg

SEQ ID NO: 1211265 - DNA, 22 bp, Artificial Sequence
  chemically synthesized
acagttctacatgggtggggag

SEQ ID NO: 1211266 - DNA, 22 bp, Artificial Sequence
  chemically synthesized
taagtttcctgggggcctcccc

SEQ ID NO: 1211267 - DNA, 22 bp, Artificial Sequence
  chemically synthesized
tacatgggtggggaggccccca

SEQ ID NO: 1211268 - DNA, 22 bp, Artificial Sequence
  chemically synthesized
catgggtggggaggcccccagg

SEQ ID NO: 1211269 - DNA, 22 bp, Artificial Sequence
  chemically synthesized
caccatgattgtaagtttcctg

SEQ ID NO: 1211270 - DNA, 22 bp, Artificial Sequence
  chemically synthesized
ccaccatgattgtaagtttcct

SEQ ID NO: 1211271 - DNA, 22 bp, Artificial Sequence
  chemically synthesized
accttccaccatgattgtaagt

SEQ ID NO: 1211272 - DNA, 22 bp, Artificial Sequence
  chemically synthesized
caccttccaccatgattgtaag

SEQ ID NO: 1211273 - DNA, 22 bp, Artificial Sequence
  chemically synthesized
cccttcaccttccaccatgatt

SEQ ID NO: 1211274 - DNA, 22 bp, Artificial Sequence
  chemically synthesized
ccccttcaccttccaccatgat

SEQ ID NO: 1211275 - DNA, 22 bp, Artificial Sequence
  chemically synthesized
cttccccttcaccttccaccat

SEQ ID NO: 1211276 - DNA, 22 bp, Artificial Sequence
  chemically synthesized
gcttccccttcaccttccacca

SEQ ID NO: 1211277 - DNA, 22 bp, Artificial Sequence
  chemically synthesized
acaatcatggtggaaggtgaag

SEQ ID NO: 1211278 - DNA, 22 bp, Artificial Sequence
  chemically synthesized
caatcatggtggaaggtgaagg

SEQ ID NO: 1211279 - DNA, 22 bp, Artificial Sequence
  chemically synthesized
tgaagaaggtacttgcttcccc

SEQ ID NO: 1211280 - DNA, 22 bp, Artificial Sequence
  chemically synthesized
ccctgtgaagaaggtacttgct

SEQ ID NO: 1211281 - DNA, 22 bp, Artificial Sequence
  chemically synthesized
cccccgaccccactgccctgtg

SEQ ID NO: 1211282 - DNA, 22 bp, Artificial Sequence
  chemically synthesized
ccccccgaccccactgccctgt

SEQ ID NO: 1211283 - DNA, 22 bp, Artificial Sequence
  chemically synthesized
cttcacagggcagtggggtcgg

SEQ ID NO: 1211284 - DNA, 22 bp, Artificial Sequence
  chemically synthesized
acagccttccccccgaccccac

SEQ ID NO: 1211285 - DNA, 22 bp, Artificial Sequence
  chemically synthesized
ttcacagggcagtggggtcggg

SEQ ID NO: 1211286 - DNA, 22 bp, Artificial Sequence
  chemically synthesized
gacagccttccccccgacccca

SEQ ID NO: 1211287 - DNA, 22 bp, Artificial Sequence
  chemically synthesized
cacagggcagtggggtcggggg

SEQ ID NO: 1211288 - DNA, 22 bp, Artificial Sequence
  chemically synthesized
acagggcagtggggtcgggggg

SEQ ID NO: 1211289 - DNA, 22 bp, Artificial Sequence
  chemically synthesized
aaagtatttgacagccttcccc

SEQ ID NO: 1211290 - DNA, 22 bp, Artificial Sequence
  chemically synthesized
aaaagtatttgacagccttccc

SEQ ID NO: 1211291 - DNA, 22 bp, Artificial Sequence
  chemically synthesized
atggtttaaaagtatttgacag

SEQ ID NO: 1211292 - DNA, 22 bp, Artificial Sequence
  chemically synthesized
atgtgatctgatggtttaaaag

SEQ ID NO: 1211293 - DNA, 22 bp, Artificial Sequence
  chemically synthesized
tcaaatacttttaaaccatcag

SEQ ID NO: 1211294 - DNA, 22 bp, Artificial Sequence
  chemically synthesized
ttaaaccatcagatcacatgag

SEQ ID NO: 1211295 - DNA, 22 bp, Artificial Sequence
  chemically synthesized
taaaccatcagatcacatgagc

SEQ ID NO: 1211296 - DNA, 22 bp, Artificial Sequence
  chemically synthesized
aaaccatcagatcacatgagca

SEQ ID NO: 1211297 - DNA, 22 bp, Artificial Sequence
  chemically synthesized
aaccatcagatcacatgagcat

SEQ ID NO: 1211298 - DNA, 22 bp, Artificial Sequence
  chemically synthesized
tgatagtgtgtgaatgctcatg

SEQ ID NO: 1211299 - DNA, 22 bp, Artificial Sequence
  chemically synthesized
gtgatagtgtgtgaatgctcat

SEQ ID NO: 1211300 - DNA, 22 bp, Artificial Sequence
  chemically synthesized
ttgtgatagtgtgtgaatgctc

SEQ ID NO: 1211301 - DNA, 22 bp, Artificial Sequence
  chemically synthesized
cttgtgatagtgtgtgaatgct

SEQ ID NO: 1211302 - DNA, 22 bp, Artificial Sequence
  chemically synthesized
ttcttgtgatagtgtgtgaatg

SEQ ID NO: 1211303 - DNA, 22 bp, Artificial Sequence
  chemically synthesized
tccccatgctcttcttgtgata

SEQ ID NO: 1211304 - DNA, 22 bp, Artificial Sequence
  chemically synthesized
acacactatcacaagaagagca

SEQ ID NO: 1211305 - DNA, 22 bp, Artificial Sequence
  chemically synthesized
tcacaagaagagcatggggaca

SEQ ID NO: 1211306 - DNA, 22 bp, Artificial Sequence
  chemically synthesized
gatcagggaggcggttgtcccc

SEQ ID NO: 1211307 - DNA, 22 bp, Artificial Sequence
  chemically synthesized
gtgggaggtgattggatcaggg

SEQ ID NO: 1211308 - DNA, 22 bp, Artificial Sequence
  chemically synthesized
cctgatccaatcacctcccacc

SEQ ID NO: 1211309 - DNA, 22 bp, Artificial Sequence
  chemically synthesized
atccaatcacctcccaccagga

SEQ ID NO: 1211310 - DNA, 22 bp, Artificial Sequence
  chemically synthesized
taatccccacgtgtagagggag

SEQ ID NO: 1211311 - DNA, 22 bp, Artificial Sequence
  chemically synthesized
ccaccaggaccctccctctaca

SEQ ID NO: 1211312 - DNA, 22 bp, Artificial Sequence
  chemically synthesized
aaattgtaatccccacgtgtag

SEQ ID NO: 1211313 - DNA, 22 bp, Artificial Sequence
  chemically synthesized
atctcaaattgtaatccccacg

SEQ ID NO: 1211314 - DNA, 22 bp, Artificial Sequence
  chemically synthesized
cctctacacgtggggattacaa

SEQ ID NO: 1211315 - DNA, 22 bp, Artificial Sequence
  chemically synthesized
tacacgtggggattacaatttg

SEQ ID NO: 1211316 - DNA, 22 bp, Artificial Sequence
  chemically synthesized
cacgtggggattacaatttgag

SEQ ID NO: 1211317 - DNA, 22 bp, Artificial Sequence
  chemically synthesized
cccaagtctcatctcaaattgt

SEQ ID NO: 1211318 - DNA, 22 bp, Artificial Sequence
  chemically synthesized
tgtcccctacccaagtctcatc

SEQ ID NO: 1211319 - DNA, 22 bp, Artificial Sequence
  chemically synthesized
tgtgtcccctacccaagtctca

SEQ ID NO: 1211320 - DNA, 22 bp, Artificial Sequence
  chemically synthesized
caatttgagatgagacttgggt

SEQ ID NO: 1211321 - DNA, 22 bp, Artificial Sequence
  chemically synthesized
gctctgtgtcccctacccaagt

SEQ ID NO: 1211322 - DNA, 22 bp, Artificial Sequence
  chemically synthesized
ggctctgtgtcccctacccaag

SEQ ID NO: 1211323 - DNA, 22 bp, Artificial Sequence
  chemically synthesized
gagatgagacttgggtagggga

SEQ ID NO: 1211324 - DNA, 22 bp, Artificial Sequence
  chemically synthesized
agatgagacttgggtaggggac

SEQ ID NO: 1211325 - DNA, 22 bp, Artificial Sequence
  chemically synthesized
atataatttggctctgtgtccc

SEQ ID NO: 1211326 - DNA, 22 bp, Artificial Sequence
  chemically synthesized
gggtaggggacacagagccaaa

SEQ ID NO: 1211327 - DNA, 22 bp, Artificial Sequence
  chemically synthesized
ggtaggggacacagagccaaat

SEQ ID NO: 1211328 - DNA, 22 bp, Artificial Sequence
  chemically synthesized
ataagttgatataatttggctc

SEQ ID NO: 1211329 - DNA, 22 bp, Artificial Sequence
  chemically synthesized
cattaataagttgatataattt

SEQ ID NO: 1211330 - DNA, 22 bp, Artificial Sequence
  chemically synthesized
tgcattaataagttgatataat

SEQ ID NO: 1211331 - DNA, 22 bp, Artificial Sequence
  chemically synthesized
ttctgcattaataagttgatat

SEQ ID NO: 1211332 - DNA, 22 bp, Artificial Sequence
  chemically synthesized
attctgcattaataagttgata

SEQ ID NO: 1211333 - DNA, 22 bp, Artificial Sequence
  chemically synthesized
gaaacaatttattctgcattaa

SEQ ID NO: 1211334 - DNA, 22 bp, Artificial Sequence
  chemically synthesized
tatcaacttattaatgcagaat

SEQ ID NO: 1211335 - DNA, 22 bp, Artificial Sequence
  chemically synthesized
tattggaaacaatttattctgc

SEQ ID NO: 1211336 - DNA, 22 bp, Artificial Sequence
  chemically synthesized
attgtattggaaacaatttatt

SEQ ID NO: 1211337 - DNA, 22 bp, Artificial Sequence
  chemically synthesized
attaatgcagaataaattgttt

SEQ ID NO: 1211338 - DNA, 22 bp, Artificial Sequence
  chemically synthesized
tcattgtattggaaacaattta

SEQ ID NO: 1211339 - DNA, 22 bp, Artificial Sequence
  chemically synthesized
ttaatgcagaataaattgtttc

SEQ ID NO: 1211340 - DNA, 22 bp, Artificial Sequence
  chemically synthesized
ctcattgtattggaaacaattt

SEQ ID NO: 1211341 - DNA, 22 bp, Artificial Sequence
  chemically synthesized
atgcagaataaattgtttccaa

SEQ ID NO: 1211342 - DNA, 22 bp, Artificial Sequence
  chemically synthesized
gggaaaatttctcattgtattg

SEQ ID NO: 1211343 - DNA, 22 bp, Artificial Sequence
  chemically synthesized
agggaaaatttctcattgtatt

SEQ ID NO: 1211344 - DNA, 22 bp, Artificial Sequence
  chemically synthesized
tttccaatacaatgagaaattt

SEQ ID NO: 1211345 - DNA, 22 bp, Artificial Sequence
  chemically synthesized
ccaatacaatgagaaattttcc

SEQ ID NO: 1211346 - DNA, 22 bp, Artificial Sequence
  chemically synthesized
caatacaatgagaaattttccc

SEQ ID NO: 1211347 - DNA, 22 bp, Artificial Sequence
  chemically synthesized
aggtgtcacaaatagaaaaact

SEQ ID NO: 1211348 - DNA, 22 bp, Artificial Sequence
  chemically synthesized
gaggtgtcacaaatagaaaaac

SEQ ID NO: 1211349 - DNA, 22 bp, Artificial Sequence
  chemically synthesized
tgaggtgtcacaaatagaaaaa

SEQ ID NO: 1211350 - DNA, 22 bp, Artificial Sequence
  chemically synthesized
tccctaagtttttctatttgtg

SEQ ID NO: 1211351 - DNA, 22 bp, Artificial Sequence
  chemically synthesized
gttttgaggtgtcacaaataga

SEQ ID NO: 1211352 - DNA, 22 bp, Artificial Sequence
  chemically synthesized
ccctaagtttttctatttgtga

SEQ ID NO: 1211353 - DNA, 22 bp, Artificial Sequence
  chemically synthesized
agttttgaggtgtcacaaatag

SEQ ID NO: 1211354 - DNA, 22 bp, Artificial Sequence
  chemically synthesized
cctaagtttttctatttgtgac

SEQ ID NO: 1211355 - DNA, 22 bp, Artificial Sequence
  chemically synthesized
agtttttctatttgtgacacct

SEQ ID NO: 1211356 - DNA, 22 bp, Artificial Sequence
  chemically synthesized
ttctatttgtgacacctcaaaa

SEQ ID NO: 1211357 - DNA, 22 bp, Artificial Sequence
  chemically synthesized
tctatttgtgacacctcaaaac

SEQ ID NO: 1211358 - DNA, 22 bp, Artificial Sequence
  chemically synthesized
ctatttgtgacacctcaaaact

SEQ ID NO: 1211359 - DNA, 22 bp, Artificial Sequence
  chemically synthesized
tatttgtgacacctcaaaacta

SEQ ID NO: 1211360 - DNA, 22 bp, Artificial Sequence
  chemically synthesized
tttgtgacacctcaaaactaaa

SEQ ID NO: 1211361 - DNA, 22 bp, Artificial Sequence
  chemically synthesized
agaacatcagtggtttagtttt

SEQ ID NO: 1211362 - DNA, 22 bp, Artificial Sequence
  chemically synthesized
gagaacatcagtggtttagttt

SEQ ID NO: 1211363 - DNA, 22 bp, Artificial Sequence
  chemically synthesized
gtgacacctcaaaactaaacca

SEQ ID NO: 1211364 - DNA, 22 bp, Artificial Sequence
  chemically synthesized
tgacacctcaaaactaaaccac

SEQ ID NO: 1211365 - DNA, 22 bp, Artificial Sequence
  chemically synthesized
agcatttgagaacatcagtggt

SEQ ID NO: 1211366 - DNA, 22 bp, Artificial Sequence
  chemically synthesized
aaaactaaaccactgatgttct

SEQ ID NO: 1211367 - DNA, 22 bp, Artificial Sequence
  chemically synthesized
attaagcatttgagaacatcag

SEQ ID NO: 1211368 - DNA, 22 bp, Artificial Sequence
  chemically synthesized
attaattaagcatttgagaaca

SEQ ID NO: 1211369 - DNA, 22 bp, Artificial Sequence
  chemically synthesized
aattaattaagcatttgagaac

SEQ ID NO: 1211370 - DNA, 22 bp, Artificial Sequence
  chemically synthesized
aaccactgatgttctcaaatgc

SEQ ID NO: 1211371 - DNA, 22 bp, Artificial Sequence
  chemically synthesized
tttaattaattaagcatttgag

SEQ ID NO: 1211372 - DNA, 22 bp, Artificial Sequence
  chemically synthesized
gtttaattaattaagcatttga

SEQ ID NO: 1211373 - DNA, 22 bp, Artificial Sequence
  chemically synthesized
atgttctcaaatgcttaattaa

SEQ ID NO: 1211374 - DNA, 22 bp, Artificial Sequence
  chemically synthesized
gatgagtttgtttaattaatta

SEQ ID NO: 1211375 - DNA, 22 bp, Artificial Sequence
  chemically synthesized
tcaaatgcttaattaattaaac

SEQ ID NO: 1211376 - DNA, 22 bp, Artificial Sequence
  chemically synthesized
gttggatgagtttgtttaatta

SEQ ID NO: 1211377 - DNA, 22 bp, Artificial Sequence
  chemically synthesized
aaatgcttaattaattaaacaa

SEQ ID NO: 1211378 - DNA, 22 bp, Artificial Sequence
  chemically synthesized
ggttggatgagtttgtttaatt

SEQ ID NO: 1211379 - DNA, 22 bp, Artificial Sequence
  chemically synthesized
tggttggatgagtttgtttaat

SEQ ID NO: 1211380 - DNA, 22 bp, Artificial Sequence
  chemically synthesized
ttggttggatgagtttgtttaa

SEQ ID NO: 1211381 - DNA, 22 bp, Artificial Sequence
  chemically synthesized
aattaattaaacaaactcatcc

SEQ ID NO: 1211382 - DNA, 22 bp, Artificial Sequence
  chemically synthesized
attaattaaacaaactcatcca

SEQ ID NO: 1211383 - DNA, 22 bp, Artificial Sequence
  chemically synthesized
attaaacaaactcatccaacca

SEQ ID NO: 1211384 - DNA, 22 bp, Artificial Sequence
  chemically synthesized
aacaaactcatccaaccaaaaa

SEQ ID NO: 1211385 - DNA, 22 bp, Artificial Sequence
  chemically synthesized
atgcacaagcatatttttggtt

SEQ ID NO: 1211386 - DNA, 22 bp, Artificial Sequence
  chemically synthesized
catgcacaagcatatttttggt

SEQ ID NO: 1211387 - DNA, 22 bp, Artificial Sequence
  chemically synthesized
tcatgcacaagcatatttttgg

SEQ ID NO: 1211388 - DNA, 22 bp, Artificial Sequence
  chemically synthesized
atccaaccaaaaatatgcttgt

SEQ ID NO: 1211389 - DNA, 22 bp, Artificial Sequence
  chemically synthesized
taaccataaaacatcagctttc

SEQ ID NO: 1211390 - DNA, 22 bp, Artificial Sequence
  chemically synthesized
gtaaccataaaacatcagcttt

SEQ ID NO: 1211391 - DNA, 22 bp, Artificial Sequence
  chemically synthesized
tgtaaccataaaacatcagctt

SEQ ID NO: 1211392 - DNA, 22 bp, Artificial Sequence
  chemically synthesized
ttgtaaccataaaacatcagct

SEQ ID NO: 1211393 - DNA, 22 bp, Artificial Sequence
  chemically synthesized
tttgtaaccataaaacatcagc

SEQ ID NO: 1211394 - DNA, 22 bp, Artificial Sequence
  chemically synthesized
gtgcatgaaagctgatgtttta

SEQ ID NO: 1211395 - DNA, 22 bp, Artificial Sequence
  chemically synthesized
tgcatgaaagctgatgttttat

SEQ ID NO: 1211396 - DNA, 22 bp, Artificial Sequence
  chemically synthesized
ctttttgtaaccataaaacatc

SEQ ID NO: 1211397 - DNA, 22 bp, Artificial Sequence
  chemically synthesized
actttttgtaaccataaaacat

SEQ ID NO: 1211398 - DNA, 22 bp, Artificial Sequence
  chemically synthesized
tactttttgtaaccataaaaca

SEQ ID NO: 1211399 - DNA, 22 bp, Artificial Sequence
  chemically synthesized
ttttactttttgtaaccataaa

SEQ ID NO: 1211400 - DNA, 22 bp, Artificial Sequence
  chemically synthesized
gttttactttttgtaaccataa

SEQ ID NO: 1211401 - DNA, 22 bp, Artificial Sequence
  chemically synthesized
tgttttactttttgtaaccata

SEQ ID NO: 1211402 - DNA, 22 bp, Artificial Sequence
  chemically synthesized
ttttgttttactttttgtaacc

SEQ ID NO: 1211403 - DNA, 22 bp, Artificial Sequence
  chemically synthesized
atgttttatggttacaaaaagt

SEQ ID NO: 1211404 - DNA, 22 bp, Artificial Sequence
  chemically synthesized
atactattttgttttacttttt

SEQ ID NO: 1211405 - DNA, 22 bp, Artificial Sequence
  chemically synthesized
catactattttgttttactttt

SEQ ID NO: 1211406 - DNA, 22 bp, Artificial Sequence
  chemically synthesized
tatggttacaaaaagtaaaaca

SEQ ID NO: 1211407 - DNA, 22 bp, Artificial Sequence
  chemically synthesized
atggttacaaaaagtaaaacaa

SEQ ID NO: 1211408 - DNA, 22 bp, Artificial Sequence
  chemically synthesized
tttcatactattttgttttact

SEQ ID NO: 1211409 - DNA, 22 bp, Artificial Sequence
  chemically synthesized
tggttacaaaaagtaaaacaaa

SEQ ID NO: 1211410 - DNA, 22 bp, Artificial Sequence
  chemically synthesized
atttcatactattttgttttac

SEQ ID NO: 1211411 - DNA, 22 bp, Artificial Sequence
  chemically synthesized
cttatttcatactattttgttt

SEQ ID NO: 1211412 - DNA, 22 bp, Artificial Sequence
  chemically synthesized
ccttatttcatactattttgtt

SEQ ID NO: 1211413 - DNA, 22 bp, Artificial Sequence
  chemically synthesized
tccttatttcatactattttgt

SEQ ID NO: 1211414 - DNA, 22 bp, Artificial Sequence
  chemically synthesized
caaaaagtaaaacaaaatagta

SEQ ID NO: 1211415 - DNA, 22 bp, Artificial Sequence
  chemically synthesized
tcagtgcatagaatgcagtatg

SEQ ID NO: 1211416 - DNA, 22 bp, Artificial Sequence
  chemically synthesized
atcagtgcatagaatgcagtat

SEQ ID NO: 1211417 - DNA, 22 bp, Artificial Sequence
  chemically synthesized
tatcagtgcatagaatgcagta

SEQ ID NO: 1211418 - DNA, 22 bp, Artificial Sequence
  chemically synthesized
attttatcagtgcatagaatgc

SEQ ID NO: 1211419 - DNA, 22 bp, Artificial Sequence
  chemically synthesized
attcattttatcagtgcataga

SEQ ID NO: 1211420 - DNA, 22 bp, Artificial Sequence
  chemically synthesized
cattcattttatcagtgcatag

SEQ ID NO: 1211421 - DNA, 22 bp, Artificial Sequence
  chemically synthesized
gcttcattcattttatcagtgc

SEQ ID NO: 1211422 - DNA, 22 bp, Artificial Sequence
  chemically synthesized
agcttcattcattttatcagtg

SEQ ID NO: 1211423 - DNA, 22 bp, Artificial Sequence
  chemically synthesized
cattctatgcactgataaaatg

SEQ ID NO: 1211424 - DNA, 22 bp, Artificial Sequence
  chemically synthesized
tatgcactgataaaatgaatga

SEQ ID NO: 1211425 - DNA, 22 bp, Artificial Sequence
  chemically synthesized
tgcactgataaaatgaatgaag

SEQ ID NO: 1211426 - DNA, 22 bp, Artificial Sequence
  chemically synthesized
tgacccatttagcttcattcat

SEQ ID NO: 1211427 - DNA, 22 bp, Artificial Sequence
  chemically synthesized
atgacccatttagcttcattca

SEQ ID NO: 1211428 - DNA, 22 bp, Artificial Sequence
  chemically synthesized
tatgacccatttagcttcattc

SEQ ID NO: 1211429 - DNA, 22 bp, Artificial Sequence
  chemically synthesized
ttatgacccatttagcttcatt

SEQ ID NO: 1211430 - DNA, 22 bp, Artificial Sequence
  chemically synthesized
tttatgacccatttagcttcat

SEQ ID NO: 1211431 - DNA, 22 bp, Artificial Sequence
  chemically synthesized
ttttatgacccatttagcttca

SEQ ID NO: 1211432 - DNA, 22 bp, Artificial Sequence
  chemically synthesized
ataaaatgaatgaagctaaatg

SEQ ID NO: 1211433 - DNA, 22 bp, Artificial Sequence
  chemically synthesized
gatatacttttttatgacccat

SEQ ID NO: 1211434 - DNA, 22 bp, Artificial Sequence
  chemically synthesized
taaaactggatatactttttta

SEQ ID NO: 1211435 - DNA, 22 bp, Artificial Sequence
  chemically synthesized
aatgggtcataaaaaagtatat

SEQ ID NO: 1211436 - DNA, 22 bp, Artificial Sequence
  chemically synthesized
acgccctataaaactggatata

SEQ ID NO: 1211437 - DNA, 22 bp, Artificial Sequence
  chemically synthesized
tataggcctcacgccctataaa

SEQ ID NO: 1211438 - DNA, 22 bp, Artificial Sequence
  chemically synthesized
ctatataggcctcacgccctat

SEQ ID NO: 1211439 - DNA, 22 bp, Artificial Sequence
  chemically synthesized
tgctgctatataggcctcacgc

SEQ ID NO: 1211440 - DNA, 22 bp, Artificial Sequence
  chemically synthesized
atgctgctatataggcctcacg

SEQ ID NO: 1211441 - DNA, 22 bp, Artificial Sequence
  chemically synthesized
tatagggcgtgaggcctatata

SEQ ID NO: 1211442 - DNA, 22 bp, Artificial Sequence
  chemically synthesized
atagggcgtgaggcctatatag

SEQ ID NO: 1211443 - DNA, 22 bp, Artificial Sequence
  chemically synthesized
tagggcgtgaggcctatatagc

SEQ ID NO: 1211444 - DNA, 22 bp, Artificial Sequence
  chemically synthesized
tatagcagcataaatttgtctt

SEQ ID NO: 1211445 - DNA, 22 bp, Artificial Sequence
  chemically synthesized
taaaaacaaaaaaaaaagacaa

SEQ ID NO: 1211446 - DNA, 22 bp, Artificial Sequence
  chemically synthesized
ctgtaaaaacaaaaaaaaaaga

SEQ ID NO: 1211447 - DNA, 22 bp, Artificial Sequence
  chemically synthesized
attactgtaaaaacaaaaaaaa

SEQ ID NO: 1211448 - DNA, 22 bp, Artificial Sequence
  chemically synthesized
aattactgtaaaaacaaaaaaa

SEQ ID NO: 1211449 - DNA, 22 bp, Artificial Sequence
  chemically synthesized
ttaattactgtaaaaacaaaaa

SEQ ID NO: 1211450 - DNA, 22 bp, Artificial Sequence
  chemically synthesized
gtcttttttttttgtttttaca

SEQ ID NO: 1211451 - DNA, 22 bp, Artificial Sequence
  chemically synthesized
tcttttttttttgtttttacag

SEQ ID NO: 1211452 - DNA, 22 bp, Artificial Sequence
  chemically synthesized
catactcttaattactgtaaaa

SEQ ID NO: 1211453 - DNA, 22 bp, Artificial Sequence
  chemically synthesized
ttttttttgtttttacagtaat

SEQ ID NO: 1211454 - DNA, 22 bp, Artificial Sequence
  chemically synthesized
tttttttgtttttacagtaatt

SEQ ID NO: 1211455 - DNA, 22 bp, Artificial Sequence
  chemically synthesized
ttttttgtttttacagtaatta

SEQ ID NO: 1211456 - DNA, 22 bp, Artificial Sequence
  chemically synthesized
tttttgtttttacagtaattaa

SEQ ID NO: 1211457 - DNA, 22 bp, Artificial Sequence
  chemically synthesized
ttttgtttttacagtaattaag

SEQ ID NO: 1211458 - DNA, 22 bp, Artificial Sequence
  chemically synthesized
tttgtttttacagtaattaaga

SEQ ID NO: 1211459 - DNA, 22 bp, Artificial Sequence
  chemically synthesized
ttgtttttacagtaattaagag

SEQ ID NO: 1211460 - DNA, 22 bp, Artificial Sequence
  chemically synthesized
tgtttttacagtaattaagagt

SEQ ID NO: 1211461 - DNA, 22 bp, Artificial Sequence
  chemically synthesized
gtttttacagtaattaagagta

SEQ ID NO: 1211462 - DNA, 22 bp, Artificial Sequence
  chemically synthesized
tttttacagtaattaagagtat

SEQ ID NO: 1211463 - DNA, 22 bp, Artificial Sequence
  chemically synthesized
tggagcgtgttgcatactctta

SEQ ID NO: 1211464 - DNA, 22 bp, Artificial Sequence
  chemically synthesized
ttacagtaattaagagtatgca

SEQ ID NO: 1211465 - DNA, 22 bp, Artificial Sequence
  chemically synthesized
tacagtaattaagagtatgcaa

SEQ ID NO: 1211466 - DNA, 22 bp, Artificial Sequence
  chemically synthesized
acagtaattaagagtatgcaac

SEQ ID NO: 1211467 - DNA, 22 bp, Artificial Sequence
  chemically synthesized
cagtaattaagagtatgcaaca

SEQ ID NO: 1211468 - DNA, 22 bp, Artificial Sequence
  chemically synthesized
agataattgtggagcgtgttgc

SEQ ID NO: 1211469 - DNA, 22 bp, Artificial Sequence
  chemically synthesized
ctcagataattgtggagcgtgt

SEQ ID NO: 1211470 - DNA, 22 bp, Artificial Sequence
  chemically synthesized
agagtatgcaacacgctccaca

SEQ ID NO: 1211471 - DNA, 22 bp, Artificial Sequence
  chemically synthesized
attactcagataattgtggagc

SEQ ID NO: 1211472 - DNA, 22 bp, Artificial Sequence
  chemically synthesized
agaaaatctaattactcagata

SEQ ID NO: 1211473 - DNA, 22 bp, Artificial Sequence
  chemically synthesized
attgagaaaatctaattactca

SEQ ID NO: 1211474 - DNA, 22 bp, Artificial Sequence
  chemically synthesized
aattgagaaaatctaattactc

SEQ ID NO: 1211475 - DNA, 22 bp, Artificial Sequence
  chemically synthesized
cacaattatctgagtaattaga

SEQ ID NO: 1211476 - DNA, 22 bp, Artificial Sequence
  chemically synthesized
taattgagaaaatctaattact

SEQ ID NO: 1211477 - DNA, 22 bp, Artificial Sequence
  chemically synthesized
ttaattgagaaaatctaattac

SEQ ID NO: 1211478 - DNA, 22 bp, Artificial Sequence
  chemically synthesized
gtttttaattgagaaaatctaa

SEQ ID NO: 1211479 - DNA, 22 bp, Artificial Sequence
  chemically synthesized
tctgagtaattagattttctca

SEQ ID NO: 1211480 - DNA, 22 bp, Artificial Sequence
  chemically synthesized
agtaattagattttctcaatta

SEQ ID NO: 1211481 - DNA, 22 bp, Artificial Sequence
  chemically synthesized
tcagtgctcgtttttaattgag

SEQ ID NO: 1211482 - DNA, 22 bp, Artificial Sequence
  chemically synthesized
atcagtgctcgtttttaattga

SEQ ID NO: 1211483 - DNA, 22 bp, Artificial Sequence
  chemically synthesized
gattttctcaattaaaaacgag

SEQ ID NO: 1211484 - DNA, 22 bp, Artificial Sequence
  chemically synthesized
atcttatcagtgctcgttttta

SEQ ID NO: 1211485 - DNA, 22 bp, Artificial Sequence
  chemically synthesized
tctcaattaaaaacgagcactg

SEQ ID NO: 1211486 - DNA, 22 bp, Artificial Sequence
  chemically synthesized
ctcaattaaaaacgagcactga

SEQ ID NO: 1211487 - DNA, 22 bp, Artificial Sequence
  chemically synthesized
tcaattaaaaacgagcactgat

SEQ ID NO: 1211488 - DNA, 22 bp, Artificial Sequence
  chemically synthesized
aattaaaaacgagcactgataa

SEQ ID NO: 1211489 - DNA, 22 bp, Artificial Sequence
  chemically synthesized
gaaatccagctaatcttatcag

SEQ ID NO: 1211490 - DNA, 22 bp, Artificial Sequence
  chemically synthesized
aaaacgagcactgataagatta

SEQ ID NO: 1211491 - DNA, 22 bp, Artificial Sequence
  chemically synthesized
ataagattagctggatttctag

SEQ ID NO: 1211492 - DNA, 22 bp, Artificial Sequence
  chemically synthesized
cgaaacaaagtgacctagaaat

SEQ ID NO: 1211493 - DNA, 22 bp, Artificial Sequence
  chemically synthesized
gctggatttctaggtcactttg

SEQ ID NO: 1211494 - DNA, 22 bp, Artificial Sequence
  chemically synthesized
ataatgctgcgaaacaaagtga

SEQ ID NO: 1211495 - DNA, 22 bp, Artificial Sequence
  chemically synthesized
gatttctaggtcactttgtttc

SEQ ID NO: 1211496 - DNA, 22 bp, Artificial Sequence
  chemically synthesized
ctaggtcactttgtttcgcagc

SEQ ID NO: 1211497 - DNA, 22 bp, Artificial Sequence
  chemically synthesized
taggtcactttgtttcgcagca

SEQ ID NO: 1211498 - DNA, 22 bp, Artificial Sequence
  chemically synthesized
gataaattgataatgctgcgaa

SEQ ID NO: 1211499 - DNA, 22 bp, Artificial Sequence
  chemically synthesized
ggtcactttgtttcgcagcatt

SEQ ID NO: 1211500 - DNA, 22 bp, Artificial Sequence
  chemically synthesized
acctggataaattgataatgct

SEQ ID NO: 1211501 - DNA, 22 bp, Artificial Sequence
  chemically synthesized
tgacctggataaattgataatg

SEQ ID NO: 1211502 - DNA, 22 bp, Artificial Sequence
  chemically synthesized
tgtttcgcagcattatcaattt

SEQ ID NO: 1211503 - DNA, 22 bp, Artificial Sequence
  chemically synthesized
gtttcgcagcattatcaattta

SEQ ID NO: 1211504 - DNA, 22 bp, Artificial Sequence
  chemically synthesized
tttcgcagcattatcaatttat

SEQ ID NO: 1211505 - DNA, 22 bp, Artificial Sequence
  chemically synthesized
cgcagcattatcaatttatcca

SEQ ID NO: 1211506 - DNA, 22 bp, Artificial Sequence
  chemically synthesized
gcagcattatcaatttatccag

SEQ ID NO: 1211507 - DNA, 22 bp, Artificial Sequence
  chemically synthesized
gatgtaagattctgacctggat

SEQ ID NO: 1211508 - DNA, 22 bp, Artificial Sequence
  chemically synthesized
tcaatttatccaggtcagaatc

SEQ ID NO: 1211509 - DNA, 22 bp, Artificial Sequence
  chemically synthesized
tatccctagatgtaagattctg

SEQ ID NO: 1211510 - DNA, 22 bp, Artificial Sequence
  chemically synthesized
atccaggtcagaatcttacatc

SEQ ID NO: 1211511 - DNA, 22 bp, Artificial Sequence
  chemically synthesized
tccaggtcagaatcttacatct

SEQ ID NO: 1211512 - DNA, 22 bp, Artificial Sequence
  chemically synthesized
cagtccagtctgtatccctaga

SEQ ID NO: 1211513 - DNA, 22 bp, Artificial Sequence
  chemically synthesized
ccagtccagtctgtatccctag

SEQ ID NO: 1211514 - DNA, 22 bp, Artificial Sequence
  chemically synthesized
ggaacttccagtccagtctgta

SEQ ID NO: 1211515 - DNA, 22 bp, Artificial Sequence
  chemically synthesized
acatctagggatacagactgga

SEQ ID NO: 1211516 - DNA, 22 bp, Artificial Sequence
  chemically synthesized
catctagggatacagactggac

SEQ ID NO: 1211517 - DNA, 22 bp, Artificial Sequence
  chemically synthesized
aaaactaggaacttccagtcca

SEQ ID NO: 1211518 - DNA, 22 bp, Artificial Sequence
  chemically synthesized
gggatacagactggactggaag

SEQ ID NO: 1211519 - DNA, 22 bp, Artificial Sequence
  chemically synthesized
aaaaactaggaacttccagtcc

SEQ ID NO: 1211520 - DNA, 22 bp, Artificial Sequence
  chemically synthesized
gactggaagttcctagttttta

SEQ ID NO: 1211521 - DNA, 22 bp, Artificial Sequence
  chemically synthesized
gaagttcctagtttttaagttt

SEQ ID NO: 1211522 - DNA, 22 bp, Artificial Sequence
  chemically synthesized
cccccccaaccagaaaccaaac

SEQ ID NO: 1211523 - DNA, 22 bp, Artificial Sequence
  chemically synthesized
ctagtttttaagtttggtttct

SEQ ID NO: 1211524 - DNA, 22 bp, Artificial Sequence
  chemically synthesized
gtttttaagtttggtttctggt

SEQ ID NO: 1211525 - DNA, 22 bp, Artificial Sequence
  chemically synthesized
ttaagtttggtttctggttggg

SEQ ID NO: 1211526 - DNA, 22 bp, Artificial Sequence
  chemically synthesized
taagtttggtttctggttgggg

SEQ ID NO: 1211527 - DNA, 22 bp, Artificial Sequence
  chemically synthesized
gtaggattccccccccaaccag

SEQ ID NO: 1211528 - DNA, 22 bp, Artificial Sequence
  chemically synthesized
aagtttggtttctggttggggg

SEQ ID NO: 1211529 - DNA, 22 bp, Artificial Sequence
  chemically synthesized
ggtaggattccccccccaacca

SEQ ID NO: 1211530 - DNA, 22 bp, Artificial Sequence
  chemically synthesized
agtttggtttctggttgggggg

SEQ ID NO: 1211531 - DNA, 22 bp, Artificial Sequence
  chemically synthesized
gcttggtaggattcccccccca

SEQ ID NO: 1211532 - DNA, 22 bp, Artificial Sequence
  chemically synthesized
ggtttctggttggggggggaat

SEQ ID NO: 1211533 - DNA, 22 bp, Artificial Sequence
  chemically synthesized
gtttctggttggggggggaatc

SEQ ID NO: 1211534 - DNA, 22 bp, Artificial Sequence
  chemically synthesized
ctagcttggtaggattcccccc

SEQ ID NO: 1211535 - DNA, 22 bp, Artificial Sequence
  chemically synthesized
cctagcttggtaggattccccc

SEQ ID NO: 1211536 - DNA, 22 bp, Artificial Sequence
  chemically synthesized
ctggttggggggggaatcctac

SEQ ID NO: 1211537 - DNA, 22 bp, Artificial Sequence
  chemically synthesized
tggttggggggggaatcctacc

SEQ ID NO: 1211538 - DNA, 22 bp, Artificial Sequence
  chemically synthesized
atttcctagcttggtaggattc

SEQ ID NO: 1211539 - DNA, 22 bp, Artificial Sequence
  chemically synthesized
gttggggggggaatcctaccaa

SEQ ID NO: 1211540 - DNA, 22 bp, Artificial Sequence
  chemically synthesized
gggggggaatcctaccaagcta

SEQ ID NO: 1211541 - DNA, 22 bp, Artificial Sequence
  chemically synthesized
ccattaatttcctagcttggta

SEQ ID NO: 1211542 - DNA, 22 bp, Artificial Sequence
  chemically synthesized
catcctcccattaatttcctag

SEQ ID NO: 1211543 - DNA, 22 bp, Artificial Sequence
  chemically synthesized
aattgcatcctcccattaattt

SEQ ID NO: 1211544 - DNA, 22 bp, Artificial Sequence
  chemically synthesized
caattgcatcctcccattaatt

SEQ ID NO: 1211545 - DNA, 22 bp, Artificial Sequence
  chemically synthesized
ccaagctaggaaattaatggga

SEQ ID NO: 1211546 - DNA, 22 bp, Artificial Sequence
  chemically synthesized
tttcaattgcatcctcccatta

SEQ ID NO: 1211547 - DNA, 22 bp, Artificial Sequence
  chemically synthesized
gttatttcaattgcatcctccc

SEQ ID NO: 1211548 - DNA, 22 bp, Artificial Sequence
  chemically synthesized
ggaaattaatgggaggatgcaa

SEQ ID NO: 1211549 - DNA, 22 bp, Artificial Sequence
  chemically synthesized
tcctagttatttcaattgcatc

SEQ ID NO: 1211550 - DNA, 22 bp, Artificial Sequence
  chemically synthesized
atgggaggatgcaattgaaata

SEQ ID NO: 1211551 - DNA, 22 bp, Artificial Sequence
  chemically synthesized
agtactatcctagttatttcaa

SEQ ID NO: 1211552 - DNA, 22 bp, Artificial Sequence
  chemically synthesized
caacacattaagtactatccta

SEQ ID NO: 1211553 - DNA, 22 bp, Artificial Sequence
  chemically synthesized
acaacacattaagtactatcct

SEQ ID NO: 1211554 - DNA, 22 bp, Artificial Sequence
  chemically synthesized
tttacaacacattaagtactat

SEQ ID NO: 1211555 - DNA, 22 bp, Artificial Sequence
  chemically synthesized
aaataactaggatagtacttaa

SEQ ID NO: 1211556 - DNA, 22 bp, Artificial Sequence
  chemically synthesized
ttatttacaacacattaagtac

SEQ ID NO: 1211557 - DNA, 22 bp, Artificial Sequence
  chemically synthesized
ccattattatttacaacacatt

SEQ ID NO: 1211558 - DNA, 22 bp, Artificial Sequence
  chemically synthesized
ggatagtacttaatgtgttgta

SEQ ID NO: 1211559 - DNA, 22 bp, Artificial Sequence
  chemically synthesized
aatgtgttgtaaataataatgg

SEQ ID NO: 1211560 - DNA, 22 bp, Artificial Sequence
  chemically synthesized
atgtgttgtaaataataatggc

SEQ ID NO: 1211561 - DNA, 22 bp, Artificial Sequence
  chemically synthesized
caaagtaataactgccattatt

SEQ ID NO: 1211562 - DNA, 22 bp, Artificial Sequence
  chemically synthesized
acaaagtaataactgccattat

SEQ ID NO: 1211563 - DNA, 22 bp, Artificial Sequence
  chemically synthesized
tacaaagtaataactgccatta

SEQ ID NO: 1211564 - DNA, 22 bp, Artificial Sequence
  chemically synthesized
ttacaaagtaataactgccatt

SEQ ID NO: 1211565 - DNA, 22 bp, Artificial Sequence
  chemically synthesized
taaataataatggcagttatta

SEQ ID NO: 1211566 - DNA, 22 bp, Artificial Sequence
  chemically synthesized
aaatatgtttttacaaagtaat

SEQ ID NO: 1211567 - DNA, 22 bp, Artificial Sequence
  chemically synthesized
aaaatatgtttttacaaagtaa

SEQ ID NO: 1211568 - DNA, 22 bp, Artificial Sequence
  chemically synthesized
cttaaaatatgtttttacaaag

SEQ ID NO: 1211569 - DNA, 22 bp, Artificial Sequence
  chemically synthesized
gcttaaaatatgtttttacaaa

SEQ ID NO: 1211570 - DNA, 22 bp, Artificial Sequence
  chemically synthesized
catacttgcttaaaatatgttt

SEQ ID NO: 1211571 - DNA, 22 bp, Artificial Sequence
  chemically synthesized
ttactttgtaaaaacatatttt

SEQ ID NO: 1211572 - DNA, 22 bp, Artificial Sequence
  chemically synthesized
ctttgtaaaaacatattttaag

SEQ ID NO: 1211573 - DNA, 22 bp, Artificial Sequence
  chemically synthesized
tgtaaaaacatattttaagcaa

SEQ ID NO: 1211574 - DNA, 22 bp, Artificial Sequence
  chemically synthesized
gtaaaaacatattttaagcaag

SEQ ID NO: 1211575 - DNA, 22 bp, Artificial Sequence
  chemically synthesized
agaaattccatacttgcttaaa

SEQ ID NO: 1211576 - DNA, 22 bp, Artificial Sequence
  chemically synthesized
taaaaacatattttaagcaagt

SEQ ID NO: 1211577 - DNA, 22 bp, Artificial Sequence
  chemically synthesized
tgagaaattccatacttgctta

SEQ ID NO: 1211578 - DNA, 22 bp, Artificial Sequence
  chemically synthesized
ctgagaaattccatacttgctt

SEQ ID NO: 1211579 - DNA, 22 bp, Artificial Sequence
  chemically synthesized
tctgagaaattccatacttgct

SEQ ID NO: 1211580 - DNA, 22 bp, Artificial Sequence
  chemically synthesized
agttttctgagaaattccatac

SEQ ID NO: 1211581 - DNA, 22 bp, Artificial Sequence
  chemically synthesized
taagcaagtatggaatttctca

SEQ ID NO: 1211582 - DNA, 22 bp, Artificial Sequence
  chemically synthesized
aagcaagtatggaatttctcag

SEQ ID NO: 1211583 - DNA, 22 bp, Artificial Sequence
  chemically synthesized
aggttaagttttctgagaaatt

SEQ ID NO: 1211584 - DNA, 22 bp, Artificial Sequence
  chemically synthesized
agcaagtatggaatttctcaga

SEQ ID NO: 1211585 - DNA, 22 bp, Artificial Sequence
  chemically synthesized
gaggttaagttttctgagaaat

SEQ ID NO: 1211586 - DNA, 22 bp, Artificial Sequence
  chemically synthesized
tgaggttaagttttctgagaaa

SEQ ID NO: 1211587 - DNA, 22 bp, Artificial Sequence
  chemically synthesized
ctttgaggttaagttttctgag

SEQ ID NO: 1211588 - DNA, 22 bp, Artificial Sequence
  chemically synthesized
gctttgaggttaagttttctga

SEQ ID NO: 1211589 - DNA, 22 bp, Artificial Sequence
  chemically synthesized
tgctttgaggttaagttttctg

SEQ ID NO: 1211590 - DNA, 22 bp, Artificial Sequence
  chemically synthesized
ttgctttgaggttaagttttct

SEQ ID NO: 1211591 - DNA, 22 bp, Artificial Sequence
  chemically synthesized
aaatttttgctttgaggttaag

SEQ ID NO: 1211592 - DNA, 22 bp, Artificial Sequence
  chemically synthesized
aaaatttttgctttgaggttaa

SEQ ID NO: 1211593 - DNA, 22 bp, Artificial Sequence
  chemically synthesized
ctcagaaaacttaacctcaaag

SEQ ID NO: 1211594 - DNA, 22 bp, Artificial Sequence
  chemically synthesized
tcagaaaacttaacctcaaagc

SEQ ID NO: 1211595 - DNA, 22 bp, Artificial Sequence
  chemically synthesized
agaaaacttaacctcaaagcaa

SEQ ID NO: 1211596 - DNA, 22 bp, Artificial Sequence
  chemically synthesized
aacctcaaagcaaaaattttaa

SEQ ID NO: 1211597 - DNA, 22 bp, Artificial Sequence
  chemically synthesized
ccataaacaatcttaaaatttt

SEQ ID NO: 1211598 - DNA, 22 bp, Artificial Sequence
  chemically synthesized
acctcaaagcaaaaattttaag

SEQ ID NO: 1211599 - DNA, 22 bp, Artificial Sequence
  chemically synthesized
accataaacaatcttaaaattt

SEQ ID NO: 1211600 - DNA, 22 bp, Artificial Sequence
  chemically synthesized
ttaccataaacaatcttaaaat

SEQ ID NO: 1211601 - DNA, 22 bp, Artificial Sequence
  chemically synthesized
aaagcaaaaattttaagattgt

SEQ ID NO: 1211602 - DNA, 22 bp, Artificial Sequence
  chemically synthesized
aattcttaccataaacaatctt

SEQ ID NO: 1211603 - DNA, 22 bp, Artificial Sequence
  chemically synthesized
taagattgtttatggtaagaat

SEQ ID NO: 1211604 - DNA, 22 bp, Artificial Sequence
  chemically synthesized
aagattgtttatggtaagaatt

SEQ ID NO: 1211605 - DNA, 22 bp, Artificial Sequence
  chemically synthesized
agattgtttatggtaagaattt

SEQ ID NO: 1211606 - DNA, 22 bp, Artificial Sequence
  chemically synthesized
tttatggtaagaatttaatatc

SEQ ID NO: 1211607 - DNA, 22 bp, Artificial Sequence
  chemically synthesized
atggtaagaatttaatatcatt

SEQ ID NO: 1211608 - DNA, 22 bp, Artificial Sequence
  chemically synthesized
tggtaagaatttaatatcattt

SEQ ID NO: 1211609 - DNA, 22 bp, Artificial Sequence
  chemically synthesized
aatatcattttccatgtattct

SEQ ID NO: 1211610 - DNA, 22 bp, Artificial Sequence
  chemically synthesized
atatcattttccatgtattctc

SEQ ID NO: 1211611 - DNA, 22 bp, Artificial Sequence
  chemically synthesized
aaataataacagtaagaatgag

SEQ ID NO: 1211612 - DNA, 22 bp, Artificial Sequence
  chemically synthesized
tccatgtattctcattcttact

SEQ ID NO: 1211613 - DNA, 22 bp, Artificial Sequence
  chemically synthesized
ccatgtattctcattcttactg

SEQ ID NO: 1211614 - DNA, 22 bp, Artificial Sequence
  chemically synthesized
catgtattctcattcttactgt

SEQ ID NO: 1211615 - DNA, 22 bp, Artificial Sequence
  chemically synthesized
cccaatgactgaaataataaca

SEQ ID NO: 1211616 - DNA, 22 bp, Artificial Sequence
  chemically synthesized
ccccaatgactgaaataataac

SEQ ID NO: 1211617 - DNA, 22 bp, Artificial Sequence
  chemically synthesized
tcattcttactgttattatttc

SEQ ID NO: 1211618 - DNA, 22 bp, Artificial Sequence
  chemically synthesized
tccccaatgactgaaataataa

SEQ ID NO: 1211619 - DNA, 22 bp, Artificial Sequence
  chemically synthesized
attcttactgttattatttcag

SEQ ID NO: 1211620 - DNA, 22 bp, Artificial Sequence
  chemically synthesized
ttactgttattatttcagtcat

SEQ ID NO: 1211621 - DNA, 22 bp, Artificial Sequence
  chemically synthesized
actgttattatttcagtcattg

SEQ ID NO: 1211622 - DNA, 22 bp, Artificial Sequence
  chemically synthesized
ctgttattatttcagtcattgg

SEQ ID NO: 1211623 - DNA, 22 bp, Artificial Sequence
  chemically synthesized
ttattatttcagtcattgggga

SEQ ID NO: 1211624 - DNA, 22 bp, Artificial Sequence
  chemically synthesized
ttatttcagtcattggggaaag

SEQ ID NO: 1211625 - DNA, 22 bp, Artificial Sequence
  chemically synthesized
aaggaagcataactttccccaa

SEQ ID NO: 1211626 - DNA, 22 bp, Artificial Sequence
  chemically synthesized
tttcagtcattggggaaagtta

SEQ ID NO: 1211627 - DNA, 22 bp, Artificial Sequence
  chemically synthesized
cagtcattggggaaagttatgc

SEQ ID NO: 1211628 - DNA, 22 bp, Artificial Sequence
  chemically synthesized
agtcattggggaaagttatgct

SEQ ID NO: 1211629 - DNA, 22 bp, Artificial Sequence
  chemically synthesized
atcaccccatctgaaggaagca

SEQ ID NO: 1211630 - DNA, 22 bp, Artificial Sequence
  chemically synthesized
gggaaagttatgcttccttcag

SEQ ID NO: 1211631 - DNA, 22 bp, Artificial Sequence
  chemically synthesized
taatcaccccatctgaaggaag

SEQ ID NO: 1211632 - DNA, 22 bp, Artificial Sequence
  chemically synthesized
ttctaatcaccccatctgaagg

SEQ ID NO: 1211633 - DNA, 22 bp, Artificial Sequence
  chemically synthesized
attctaatcaccccatctgaag

SEQ ID NO: 1211634 - DNA, 22 bp, Artificial Sequence
  chemically synthesized
tttattctaatcaccccatctg

SEQ ID NO: 1211635 - DNA, 22 bp, Artificial Sequence
  chemically synthesized
gtttattctaatcaccccatct

SEQ ID NO: 1211636 - DNA, 22 bp, Artificial Sequence
  chemically synthesized
tgcttccttcagatggggtgat

SEQ ID NO: 1211637 - DNA, 22 bp, Artificial Sequence
  chemically synthesized
ttgtttattctaatcaccccat

SEQ ID NO: 1211638 - DNA, 22 bp, Artificial Sequence
  chemically synthesized
ttcttgtttattctaatcaccc

SEQ ID NO: 1211639 - DNA, 22 bp, Artificial Sequence
  chemically synthesized
attcttgtttattctaatcacc

SEQ ID NO: 1211640 - DNA, 22 bp, Artificial Sequence
  chemically synthesized
ccttcagatggggtgattagaa

SEQ ID NO: 1211641 - DNA, 22 bp, Artificial Sequence
  chemically synthesized
cttcagatggggtgattagaat

SEQ ID NO: 1211642 - DNA, 22 bp, Artificial Sequence
  chemically synthesized
cagatggggtgattagaataaa

SEQ ID NO: 1211643 - DNA, 22 bp, Artificial Sequence
  chemically synthesized
agatggggtgattagaataaac

SEQ ID NO: 1211644 - DNA, 22 bp, Artificial Sequence
  chemically synthesized
agaggtcttattcttgtttatt

SEQ ID NO: 1211645 - DNA, 22 bp, Artificial Sequence
  chemically synthesized
aattcagaggtcttattcttgt

SEQ ID NO: 1211646 - DNA, 22 bp, Artificial Sequence
  chemically synthesized
gaataaacaagaataagacctc

SEQ ID NO: 1211647 - DNA, 22 bp, Artificial Sequence
  chemically synthesized
cgaagtcctgaattcagaggtc

SEQ ID NO: 1211648 - DNA, 22 bp, Artificial Sequence
  chemically synthesized
gaaaactgcgaagtcctgaatt

SEQ ID NO: 1211649 - DNA, 22 bp, Artificial Sequence
  chemically synthesized
ggaaaactgcgaagtcctgaat

SEQ ID NO: 1211650 - DNA, 22 bp, Artificial Sequence
  chemically synthesized
tggaaaactgcgaagtcctgaa

SEQ ID NO: 1211651 - DNA, 22 bp, Artificial Sequence
  chemically synthesized
ttggaaaactgcgaagtcctga

SEQ ID NO: 1211652 - DNA, 22 bp, Artificial Sequence
  chemically synthesized
ttttggaaaactgcgaagtcct

SEQ ID NO: 1211653 - DNA, 22 bp, Artificial Sequence
  chemically synthesized
cttttggaaaactgcgaagtcc

SEQ ID NO: 1211654 - DNA, 22 bp, Artificial Sequence
  chemically synthesized
tgaattcaggacttcgcagttt

SEQ ID NO: 1211655 - DNA, 22 bp, Artificial Sequence
  chemically synthesized
aattcaggacttcgcagttttc

SEQ ID NO: 1211656 - DNA, 22 bp, Artificial Sequence
  chemically synthesized
aggacttcgcagttttccaaaa

SEQ ID NO: 1211657 - DNA, 22 bp, Artificial Sequence
  chemically synthesized
aaaaataccgatttcttttgga

SEQ ID NO: 1211658 - DNA, 22 bp, Artificial Sequence
  chemically synthesized
aaaaaataccgatttcttttgg

SEQ ID NO: 1211659 - DNA, 22 bp, Artificial Sequence
  chemically synthesized
cgcagttttccaaaagaaatcg

SEQ ID NO: 1211660 - DNA, 22 bp, Artificial Sequence
  chemically synthesized
gcagttttccaaaagaaatcgg

SEQ ID NO: 1211661 - DNA, 22 bp, Artificial Sequence
  chemically synthesized
aaagtttaaaaaataccgattt

SEQ ID NO: 1211662 - DNA, 22 bp, Artificial Sequence
  chemically synthesized
ttaaaagtttaaaaaataccga

SEQ ID NO: 1211663 - DNA, 22 bp, Artificial Sequence
  chemically synthesized
tccaaaagaaatcggtattttt

SEQ ID NO: 1211664 - DNA, 22 bp, Artificial Sequence
  chemically synthesized
ccaaaagaaatcggtatttttt

SEQ ID NO: 1211665 - DNA, 22 bp, Artificial Sequence
  chemically synthesized
caaaagaaatcggtatttttta

SEQ ID NO: 1211666 - DNA, 22 bp, Artificial Sequence
  chemically synthesized
aatagaaaggagtaatctgtta

SEQ ID NO: 1211667 - DNA, 22 bp, Artificial Sequence
  chemically synthesized
tttaaacttttaacagattact

SEQ ID NO: 1211668 - DNA, 22 bp, Artificial Sequence
  chemically synthesized
ttaaacttttaacagattactc

SEQ ID NO: 1211669 - DNA, 22 bp, Artificial Sequence
  chemically synthesized
ctcaatagaaaggagtaatctg

SEQ ID NO: 1211670 - DNA, 22 bp, Artificial Sequence
  chemically synthesized
taaacttttaacagattactcc

SEQ ID NO: 1211671 - DNA, 22 bp, Artificial Sequence
  chemically synthesized
gctcaatagaaaggagtaatct

SEQ ID NO: 1211672 - DNA, 22 bp, Artificial Sequence
  chemically synthesized
aaacttttaacagattactcct

SEQ ID NO: 1211673 - DNA, 22 bp, Artificial Sequence
  chemically synthesized
aacttttaacagattactcctt

SEQ ID NO: 1211674 - DNA, 22 bp, Artificial Sequence
  chemically synthesized
ttaacagattactcctttctat

SEQ ID NO: 1211675 - DNA, 22 bp, Artificial Sequence
  chemically synthesized
taacagattactcctttctatt

SEQ ID NO: 1211676 - DNA, 22 bp, Artificial Sequence
  chemically synthesized
aacagattactcctttctattg

SEQ ID NO: 1211677 - DNA, 22 bp, Artificial Sequence
  chemically synthesized
acagattactcctttctattga

SEQ ID NO: 1211678 - DNA, 22 bp, Artificial Sequence
  chemically synthesized
gaaaggtaaagatttgctcaat

SEQ ID NO: 1211679 - DNA, 22 bp, Artificial Sequence
  chemically synthesized
ctcctttctattgagcaaatct

SEQ ID NO: 1211680 - DNA, 22 bp, Artificial Sequence
  chemically synthesized
ctttctattgagcaaatcttta

SEQ ID NO: 1211681 - DNA, 22 bp, Artificial Sequence
  chemically synthesized
tctattgagcaaatctttacct

SEQ ID NO: 1211682 - DNA, 22 bp, Artificial Sequence
  chemically synthesized
ctattgagcaaatctttacctt

SEQ ID NO: 1211683 - DNA, 22 bp, Artificial Sequence
  chemically synthesized
tattgagcaaatctttaccttt

SEQ ID NO: 1211684 - DNA, 22 bp, Artificial Sequence
  chemically synthesized
aataccaattggaaaggtaaag

SEQ ID NO: 1211685 - DNA, 22 bp, Artificial Sequence
  chemically synthesized
ttgagcaaatctttacctttcc

SEQ ID NO: 1211686 - DNA, 22 bp, Artificial Sequence
  chemically synthesized
agcaaatctttacctttccaat

SEQ ID NO: 1211687 - DNA, 22 bp, Artificial Sequence
  chemically synthesized
catgtctaaataccaattggaa

SEQ ID NO: 1211688 - DNA, 22 bp, Artificial Sequence
  chemically synthesized
acatgtctaaataccaattgga

SEQ ID NO: 1211689 - DNA, 22 bp, Artificial Sequence
  chemically synthesized
aatttacatgtctaaataccaa

SEQ ID NO: 1211690 - DNA, 22 bp, Artificial Sequence
  chemically synthesized
tacctttccaattggtatttag

SEQ ID NO: 1211691 - DNA, 22 bp, Artificial Sequence
  chemically synthesized
aaatttacatgtctaaatacca

SEQ ID NO: 1211692 - DNA, 22 bp, Artificial Sequence
  chemically synthesized
acctttccaattggtatttaga

SEQ ID NO: 1211693 - DNA, 22 bp, Artificial Sequence
  chemically synthesized
taaatttacatgtctaaatacc

SEQ ID NO: 1211694 - DNA, 22 bp, Artificial Sequence
  chemically synthesized
cctttccaattggtatttagac

SEQ ID NO: 1211695 - DNA, 22 bp, Artificial Sequence
  chemically synthesized
ttttaaatttacatgtctaaat

SEQ ID NO: 1211696 - DNA, 22 bp, Artificial Sequence
  chemically synthesized
gttttaaatttacatgtctaaa

SEQ ID NO: 1211697 - DNA, 22 bp, Artificial Sequence
  chemically synthesized
tccaattggtatttagacatgt

SEQ ID NO: 1211698 - DNA, 22 bp, Artificial Sequence
  chemically synthesized
tgttttaaatttacatgtctaa

SEQ ID NO: 1211699 - DNA, 22 bp, Artificial Sequence
  chemically synthesized
ccaattggtatttagacatgta

SEQ ID NO: 1211700 - DNA, 22 bp, Artificial Sequence
  chemically synthesized
caattggtatttagacatgtaa

SEQ ID NO: 1211701 - DNA, 22 bp, Artificial Sequence
  chemically synthesized
gtatttagacatgtaaatttaa

SEQ ID NO: 1211702 - DNA, 22 bp, Artificial Sequence
  chemically synthesized
agacatgtaaatttaaaacaaa

SEQ ID NO: 1211703 - DNA, 22 bp, Artificial Sequence
  chemically synthesized
cagaagaatgtctttgttttaa

SEQ ID NO: 1211704 - DNA, 22 bp, Artificial Sequence
  chemically synthesized
gacatgtaaatttaaaacaaag

SEQ ID NO: 1211705 - DNA, 22 bp, Artificial Sequence
  chemically synthesized
gcagaagaatgtctttgtttta

SEQ ID NO: 1211706 - DNA, 22 bp, Artificial Sequence
  chemically synthesized
cttgcagaagaatgtctttgtt

SEQ ID NO: 1211707 - DNA, 22 bp, Artificial Sequence
  chemically synthesized
ccttgcagaagaatgtctttgt

SEQ ID NO: 1211708 - DNA, 22 bp, Artificial Sequence
  chemically synthesized
aaatttccttgcagaagaatgt

SEQ ID NO: 1211709 - DNA, 22 bp, Artificial Sequence
  chemically synthesized
aaaacaaagacattcttctgca

SEQ ID NO: 1211710 - DNA, 22 bp, Artificial Sequence
  chemically synthesized
aaacaaagacattcttctgcaa

SEQ ID NO: 1211711 - DNA, 22 bp, Artificial Sequence
  chemically synthesized
tggaagcatctgaaatttcctt

SEQ ID NO: 1211712 - DNA, 22 bp, Artificial Sequence
  chemically synthesized
atggaagcatctgaaatttcct

SEQ ID NO: 1211713 - DNA, 22 bp, Artificial Sequence
  chemically synthesized
ttctgcaaggaaatttcagatg

SEQ ID NO: 1211714 - DNA, 22 bp, Artificial Sequence
  chemically synthesized
ctgcaaggaaatttcagatgct

SEQ ID NO: 1211715 - DNA, 22 bp, Artificial Sequence
  chemically synthesized
tgcaaggaaatttcagatgctt

SEQ ID NO: 1211716 - DNA, 22 bp, Artificial Sequence
  chemically synthesized
aaatgcttatggaagcatctga

SEQ ID NO: 1211717 - DNA, 22 bp, Artificial Sequence
  chemically synthesized
caaatgcttatggaagcatctg

SEQ ID NO: 1211718 - DNA, 22 bp, Artificial Sequence
  chemically synthesized
caaggaaatttcagatgcttcc

SEQ ID NO: 1211719 - DNA, 22 bp, Artificial Sequence
  chemically synthesized
tttcaaatgcttatggaagcat

SEQ ID NO: 1211720 - DNA, 22 bp, Artificial Sequence
  chemically synthesized
ggctgtttcaaatgcttatgga

SEQ ID NO: 1211721 - DNA, 22 bp, Artificial Sequence
  chemically synthesized
cagatgcttccataagcatttg

SEQ ID NO: 1211722 - DNA, 22 bp, Artificial Sequence
  chemically synthesized
agatgcttccataagcatttga

SEQ ID NO: 1211723 - DNA, 22 bp, Artificial Sequence
  chemically synthesized
ccataagcatttgaaacagccc

SEQ ID NO: 1211724 - DNA, 22 bp, Artificial Sequence
  chemically synthesized
cataagcatttgaaacagccca

SEQ ID NO: 1211725 - DNA, 22 bp, Artificial Sequence
  chemically synthesized
agtatgcaaaaacagttgggct

SEQ ID NO: 1211726 - DNA, 22 bp, Artificial Sequence
  chemically synthesized
aagtatgcaaaaacagttgggc

SEQ ID NO: 1211727 - DNA, 22 bp, Artificial Sequence
  chemically synthesized
cttaagtatgcaaaaacagttg

SEQ ID NO: 1211728 - DNA, 22 bp, Artificial Sequence
  chemically synthesized
ccttaagtatgcaaaaacagtt

SEQ ID NO: 1211729 - DNA, 22 bp, Artificial Sequence
  chemically synthesized
tccttaagtatgcaaaaacagt

SEQ ID NO: 1211730 - DNA, 22 bp, Artificial Sequence
  chemically synthesized
gaaacagcccaactgtttttgc

SEQ ID NO: 1211731 - DNA, 22 bp, Artificial Sequence
  chemically synthesized
aaacagcccaactgtttttgca

SEQ ID NO: 1211732 - DNA, 22 bp, Artificial Sequence
  chemically synthesized
tttccttaagtatgcaaaaaca

SEQ ID NO: 1211733 - DNA, 22 bp, Artificial Sequence
  chemically synthesized
agatagctctttccttaagtat

SEQ ID NO: 1211734 - DNA, 22 bp, Artificial Sequence
  chemically synthesized
aagatagctctttccttaagta

SEQ ID NO: 1211735 - DNA, 22 bp, Artificial Sequence
  chemically synthesized
tttttgcatacttaaggaaaga

SEQ ID NO: 1211736 - DNA, 22 bp, Artificial Sequence
  chemically synthesized
ttgcatacttaaggaaagagct

SEQ ID NO: 1211737 - DNA, 22 bp, Artificial Sequence
  chemically synthesized
tgcatacttaaggaaagagcta

SEQ ID NO: 1211738 - DNA, 22 bp, Artificial Sequence
  chemically synthesized
ccatccttaagatagctctttc

SEQ ID NO: 1211739 - DNA, 22 bp, Artificial Sequence
  chemically synthesized
gcatacttaaggaaagagctat

SEQ ID NO: 1211740 - DNA, 22 bp, Artificial Sequence
  chemically synthesized
catacttaaggaaagagctatc

SEQ ID NO: 1211741 - DNA, 22 bp, Artificial Sequence
  chemically synthesized
ttgccatccttaagatagctct

SEQ ID NO: 1211742 - DNA, 22 bp, Artificial Sequence
  chemically synthesized
aaggaaagagctatcttaagga

SEQ ID NO: 1211743 - DNA, 22 bp, Artificial Sequence
  chemically synthesized
aggaaagagctatcttaaggat

SEQ ID NO: 1211744 - DNA, 22 bp, Artificial Sequence
  chemically synthesized
cacagtaactgttgccatcctt

SEQ ID NO: 1211745 - DNA, 22 bp, Artificial Sequence
  chemically synthesized
acacagtaactgttgccatcct

SEQ ID NO: 1211746 - DNA, 22 bp, Artificial Sequence
  chemically synthesized
tacacagtaactgttgccatcc

SEQ ID NO: 1211747 - DNA, 22 bp, Artificial Sequence
  chemically synthesized
ttacacagtaactgttgccatc

SEQ ID NO: 1211748 - DNA, 22 bp, Artificial Sequence
  chemically synthesized
tcttaaggatggcaacagttac

SEQ ID NO: 1211749 - DNA, 22 bp, Artificial Sequence
  chemically synthesized
aaatttttacacagtaactgtt

SEQ ID NO: 1211750 - DNA, 22 bp, Artificial Sequence
  chemically synthesized
taaaatttttacacagtaactg

SEQ ID NO: 1211751 - DNA, 22 bp, Artificial Sequence
  chemically synthesized
aaggatggcaacagttactgtg

SEQ ID NO: 1211752 - DNA, 22 bp, Artificial Sequence
  chemically synthesized
ctaaaatttttacacagtaact

SEQ ID NO: 1211753 - DNA, 22 bp, Artificial Sequence
  chemically synthesized
aggatggcaacagttactgtgt

SEQ ID NO: 1211754 - DNA, 22 bp, Artificial Sequence
  chemically synthesized
aaaggatttctaaaatttttac

SEQ ID NO: 1211755 - DNA, 22 bp, Artificial Sequence
  chemically synthesized
aaaaggatttctaaaattttta

SEQ ID NO: 1211756 - DNA, 22 bp, Artificial Sequence
  chemically synthesized
atacttaaaaggatttctaaaa

SEQ ID NO: 1211757 - DNA, 22 bp, Artificial Sequence
  chemically synthesized
ctgtgtaaaaattttagaaatc

SEQ ID NO: 1211758 - DNA, 22 bp, Artificial Sequence
  chemically synthesized
gatacttaaaaggatttctaaa

SEQ ID NO: 1211759 - DNA, 22 bp, Artificial Sequence
  chemically synthesized
tgtaaaaattttagaaatcctt

SEQ ID NO: 1211760 - DNA, 22 bp, Artificial Sequence
  chemically synthesized
tagaaatccttttaagtatcaa

SEQ ID NO: 1211761 - DNA, 22 bp, Artificial Sequence
  chemically synthesized
agaaatccttttaagtatcaag

SEQ ID NO: 1211762 - DNA, 22 bp, Artificial Sequence
  chemically synthesized
gaaatccttttaagtatcaagt

SEQ ID NO: 1211763 - DNA, 22 bp, Artificial Sequence
  chemically synthesized
ttaagtatcaagtatacattct

SEQ ID NO: 1211764 - DNA, 22 bp, Artificial Sequence
  chemically synthesized
taagtatcaagtatacattctt

SEQ ID NO: 1211765 - DNA, 22 bp, Artificial Sequence
  chemically synthesized
aagtatcaagtatacattctta

SEQ ID NO: 1211766 - DNA, 22 bp, Artificial Sequence
  chemically synthesized
agtatcaagtatacattcttat

SEQ ID NO: 1211767 - DNA, 22 bp, Artificial Sequence
  chemically synthesized
agcagcgatgtgcacagggcat

SEQ ID NO: 1211768 - DNA, 22 bp, Artificial Sequence
  chemically synthesized
ttatgccctgtgcacatcgctg

SEQ ID NO: 1211769 - DNA, 22 bp, Artificial Sequence
  chemically synthesized
atgccctgtgcacatcgctgct

SEQ ID NO: 1211770 - DNA, 22 bp, Artificial Sequence
  chemically synthesized
tgccctgtgcacatcgctgctc

SEQ ID NO: 1211771 - DNA, 22 bp, Artificial Sequence
  chemically synthesized
gacatccaaaattgagcagcga

SEQ ID NO: 1211772 - DNA, 22 bp, Artificial Sequence
  chemically synthesized
ctggacatccaaaattgagcag

SEQ ID NO: 1211773 - DNA, 22 bp, Artificial Sequence
  chemically synthesized
tgcacatcgctgctcaattttg

SEQ ID NO: 1211774 - DNA, 22 bp, Artificial Sequence
  chemically synthesized
ctcaattttggatgtccagcag

SEQ ID NO: 1211775 - DNA, 22 bp, Artificial Sequence
  chemically synthesized
aattttggatgtccagcagtgt

SEQ ID NO: 1211776 - DNA, 22 bp, Artificial Sequence
  chemically synthesized
tggatgtccagcagtgtgcgca

SEQ ID NO: 1211777 - DNA, 22 bp, Artificial Sequence
  chemically synthesized
ggatgtccagcagtgtgcgcac

SEQ ID NO: 1211778 - DNA, 22 bp, Artificial Sequence
  chemically synthesized
gatgtccagcagtgtgcgcacg

SEQ ID NO: 1211779 - DNA, 22 bp, Artificial Sequence
  chemically synthesized
tgtgcatgcacacatggacgtg

SEQ ID NO: 1211780 - DNA, 22 bp, Artificial Sequence
  chemically synthesized
atgtgcatgggtatataattat

SEQ ID NO: 1211781 - DNA, 22 bp, Artificial Sequence
  chemically synthesized
aatgaatgtgctcatgtgcatg

SEQ ID NO: 1211782 - DNA, 22 bp, Artificial Sequence
  chemically synthesized
tatacccatgcacatgagcaca

SEQ ID NO: 1211783 - DNA, 22 bp, Artificial Sequence
  chemically synthesized
tatggttaaatgaatgtgctca

SEQ ID NO: 1211784 - DNA, 22 bp, Artificial Sequence
  chemically synthesized
gtatggttaaatgaatgtgctc

SEQ ID NO: 1211785 - DNA, 22 bp, Artificial Sequence
  chemically synthesized
ttgtatggttaaatgaatgtgc

SEQ ID NO: 1211786 - DNA, 22 bp, Artificial Sequence
  chemically synthesized
cttgtatggttaaatgaatgtg

SEQ ID NO: 1211787 - DNA, 22 bp, Artificial Sequence
  chemically synthesized
cttcttgtatggttaaatgaat

SEQ ID NO: 1211788 - DNA, 22 bp, Artificial Sequence
  chemically synthesized
ggattgcttcttgtatggttaa

SEQ ID NO: 1211789 - DNA, 22 bp, Artificial Sequence
  chemically synthesized
ctgggattgcttcttgtatggt

SEQ ID NO: 1211790 - DNA, 22 bp, Artificial Sequence
  chemically synthesized
gctgggattgcttcttgtatgg

SEQ ID NO: 1211791 - DNA, 22 bp, Artificial Sequence
  chemically synthesized
ttgctgggattgcttcttgtat

SEQ ID NO: 1211792 - DNA, 22 bp, Artificial Sequence
  chemically synthesized
atttaaccatacaagaagcaat

SEQ ID NO: 1211793 - DNA, 22 bp, Artificial Sequence
  chemically synthesized
gaattcttgctgggattgcttc

SEQ ID NO: 1211794 - DNA, 22 bp, Artificial Sequence
  chemically synthesized
agaattcttgctgggattgctt

SEQ ID NO: 1211795 - DNA, 22 bp, Artificial Sequence
  chemically synthesized
aaccatacaagaagcaatccca

SEQ ID NO: 1211796 - DNA, 22 bp, Artificial Sequence
  chemically synthesized
tagaattcttgctgggattgct

SEQ ID NO: 1211797 - DNA, 22 bp, Artificial Sequence
  chemically synthesized
accatacaagaagcaatcccag

SEQ ID NO: 1211798 - DNA, 22 bp, Artificial Sequence
  chemically synthesized
ttagaattcttgctgggattgc

SEQ ID NO: 1211799 - DNA, 22 bp, Artificial Sequence
  chemically synthesized
tttagaattcttgctgggattg

SEQ ID NO: 1211800 - DNA, 22 bp, Artificial Sequence
  chemically synthesized
agacatatatcagttttttaga

SEQ ID NO: 1211801 - DNA, 22 bp, Artificial Sequence
  chemically synthesized
cagtaatattcagacatatatc

SEQ ID NO: 1211802 - DNA, 22 bp, Artificial Sequence
  chemically synthesized
ccagtaatattcagacatatat

SEQ ID NO: 1211803 - DNA, 22 bp, Artificial Sequence
  chemically synthesized
tccagtaatattcagacatata

SEQ ID NO: 1211804 - DNA, 22 bp, Artificial Sequence
  chemically synthesized
taaaaaactgatatatgtctga

SEQ ID NO: 1211805 - DNA, 22 bp, Artificial Sequence
  chemically synthesized
ttccagtaatattcagacatat

SEQ ID NO: 1211806 - DNA, 22 bp, Artificial Sequence
  chemically synthesized
aaaaactgatatatgtctgaat

SEQ ID NO: 1211807 - DNA, 22 bp, Artificial Sequence
  chemically synthesized
ttttccagtaatattcagacat

SEQ ID NO: 1211808 - DNA, 22 bp, Artificial Sequence
  chemically synthesized
cagtctcttttccagtaatatt

SEQ ID NO: 1211809 - DNA, 22 bp, Artificial Sequence
  chemically synthesized
atatatgtctgaatattactgg

SEQ ID NO: 1211810 - DNA, 22 bp, Artificial Sequence
  chemically synthesized
acctacagtctcttttccagta

SEQ ID NO: 1211811 - DNA, 22 bp, Artificial Sequence
  chemically synthesized
aatattactggaaaagagactg

SEQ ID NO: 1211812 - DNA, 22 bp, Artificial Sequence
  chemically synthesized
ctggaaaagagactgtaggtga

SEQ ID NO: 1211813 - DNA, 22 bp, Artificial Sequence
  chemically synthesized
gaaaagagactgtaggtgagac

SEQ ID NO: 1211814 - DNA, 22 bp, Artificial Sequence
  chemically synthesized
aaccatatgaagcccaggtctc

SEQ ID NO: 1211815 - DNA, 22 bp, Artificial Sequence
  chemically synthesized
tgttgaaccatatgaagcccag

SEQ ID NO: 1211816 - DNA, 22 bp, Artificial Sequence
  chemically synthesized
taggtgagacctgggcttcata

SEQ ID NO: 1211817 - DNA, 22 bp, Artificial Sequence
  chemically synthesized
acaaatctatgttgaaccatat

SEQ ID NO: 1211818 - DNA, 22 bp, Artificial Sequence
  chemically synthesized
ggcttcatatggttcaacatag

SEQ ID NO: 1211819 - DNA, 22 bp, Artificial Sequence
  chemically synthesized
catatggttcaacatagatttg

SEQ ID NO: 1211820 - DNA, 22 bp, Artificial Sequence
  chemically synthesized
atatggttcaacatagatttgt

SEQ ID NO: 1211821 - DNA, 22 bp, Artificial Sequence
  chemically synthesized
acagcatcaactgacaaatcta

SEQ ID NO: 1211822 - DNA, 22 bp, Artificial Sequence
  chemically synthesized
attaacagcatcaactgacaaa

SEQ ID NO: 1211823 - DNA, 22 bp, Artificial Sequence
  chemically synthesized
aattaacagcatcaactgacaa

SEQ ID NO: 1211824 - DNA, 22 bp, Artificial Sequence
  chemically synthesized
taattaacagcatcaactgaca

SEQ ID NO: 1211825 - DNA, 22 bp, Artificial Sequence
  chemically synthesized
ttaattaacagcatcaactgac

SEQ ID NO: 1211826 - DNA, 22 bp, Artificial Sequence
  chemically synthesized
aacatagatttgtcagttgatg

SEQ ID NO: 1211827 - DNA, 22 bp, Artificial Sequence
  chemically synthesized
tttttaattaacagcatcaact

SEQ ID NO: 1211828 - DNA, 22 bp, Artificial Sequence
  chemically synthesized
tattatttttaattaacagcat

SEQ ID NO: 1211829 - DNA, 22 bp, Artificial Sequence
  chemically synthesized
tgtattatttttaattaacagc

SEQ ID NO: 1211830 - DNA, 22 bp, Artificial Sequence
  chemically synthesized
gtcagttgatgctgttaattaa

SEQ ID NO: 1211831 - DNA, 22 bp, Artificial Sequence
  chemically synthesized
tcagttgatgctgttaattaaa

SEQ ID NO: 1211832 - DNA, 22 bp, Artificial Sequence
  chemically synthesized
tatattctgtattatttttaat

SEQ ID NO: 1211833 - DNA, 22 bp, Artificial Sequence
  chemically synthesized
atgctgttaattaaaaataata

SEQ ID NO: 1211834 - DNA, 22 bp, Artificial Sequence
  chemically synthesized
tcctatatattctgtattattt

SEQ ID NO: 1211835 - DNA, 22 bp, Artificial Sequence
  chemically synthesized
gtcctatatattctgtattatt

SEQ ID NO: 1211836 - DNA, 22 bp, Artificial Sequence
  chemically synthesized
tgtcctatatattctgtattat

SEQ ID NO: 1211837 - DNA, 22 bp, Artificial Sequence
  chemically synthesized
ttaattaaaaataatacagaat

SEQ ID NO: 1211838 - DNA, 22 bp, Artificial Sequence
  chemically synthesized
attaaaaataatacagaatata

SEQ ID NO: 1211839 - DNA, 22 bp, Artificial Sequence
  chemically synthesized
aaaataatacagaatatatagg

SEQ ID NO: 1211840 - DNA, 22 bp, Artificial Sequence
  chemically synthesized
catcaacacacaatactttgtc

SEQ ID NO: 1211841 - DNA, 22 bp, Artificial Sequence
  chemically synthesized
gcacagtcatgggacaattaca

SEQ ID NO: 1211842 - DNA, 22 bp, Artificial Sequence
  chemically synthesized
tgtgttgatgtaattgtcccat

SEQ ID NO: 1211843 - DNA, 22 bp, Artificial Sequence
  chemically synthesized
cctggcacagtcatgggacaat

SEQ ID NO: 1211844 - DNA, 22 bp, Artificial Sequence
  chemically synthesized
acctggcacagtcatgggacaa

SEQ ID NO: 1211845 - DNA, 22 bp, Artificial Sequence
  chemically synthesized
ttacctggcacagtcatgggac

SEQ ID NO: 1211846 - DNA, 22 bp, Artificial Sequence
  chemically synthesized
cttacctggcacagtcatggga

SEQ ID NO: 1211847 - DNA, 22 bp, Artificial Sequence
  chemically synthesized
atgtaattgtcccatgactgtg

SEQ ID NO: 1211848 - DNA, 22 bp, Artificial Sequence
  chemically synthesized
cgcttcttacctggcacagtca

SEQ ID NO: 1211849 - DNA, 22 bp, Artificial Sequence
  chemically synthesized
tacgcttcttacctggcacagt

SEQ ID NO: 1211850 - DNA, 22 bp, Artificial Sequence
  chemically synthesized
tcccatgactgtgccaggtaag

SEQ ID NO: 1211851 - DNA, 22 bp, Artificial Sequence
  chemically synthesized
tcctctacgcttcttacctggc

SEQ ID NO: 1211852 - DNA, 22 bp, Artificial Sequence
  chemically synthesized
tgccaggtaagaagcgtagagg

SEQ ID NO: 1211853 - DNA, 22 bp, Artificial Sequence
  chemically synthesized
agggaatattatcctctacgct

SEQ ID NO: 1211854 - DNA, 22 bp, Artificial Sequence
  chemically synthesized
cagggaatattatcctctacgc

SEQ ID NO: 1211855 - DNA, 22 bp, Artificial Sequence
  chemically synthesized
tcagggaatattatcctctacg

SEQ ID NO: 1211856 - DNA, 22 bp, Artificial Sequence
  chemically synthesized
ttttcagggaatattatcctct

SEQ ID NO: 1211857 - DNA, 22 bp, Artificial Sequence
  chemically synthesized
ctgttttcagggaatattatcc

SEQ ID NO: 1211858 - DNA, 22 bp, Artificial Sequence
  chemically synthesized
gcagtagaaatccctactgttt

SEQ ID NO: 1211859 - DNA, 22 bp, Artificial Sequence
  chemically synthesized
agcagtagaaatccctactgtt

SEQ ID NO: 1211860 - DNA, 22 bp, Artificial Sequence
  chemically synthesized
cctgaaaacagtagggatttct

SEQ ID NO: 1211861 - DNA, 22 bp, Artificial Sequence
  chemically synthesized
aaaacagtagggatttctactg

SEQ ID NO: 1211862 - DNA, 22 bp, Artificial Sequence
  chemically synthesized
aaagatgtttagcagtagaaat

SEQ ID NO: 1211863 - DNA, 22 bp, Artificial Sequence
  chemically synthesized
aaaagatgtttagcagtagaaa

SEQ ID NO: 1211864 - DNA, 22 bp, Artificial Sequence
  chemically synthesized
taaaagatgtttagcagtagaa

SEQ ID NO: 1211865 - DNA, 22 bp, Artificial Sequence
  chemically synthesized
acattttaaaagatgtttagca

SEQ ID NO: 1211866 - DNA, 22 bp, Artificial Sequence
  chemically synthesized
ctactgctaaacatcttttaaa

SEQ ID NO: 1211867 - DNA, 22 bp, Artificial Sequence
  chemically synthesized
tactgctaaacatcttttaaaa

SEQ ID NO: 1211868 - DNA, 22 bp, Artificial Sequence
  chemically synthesized
cgaggatctgacattttaaaag

SEQ ID NO: 1211869 - DNA, 22 bp, Artificial Sequence
  chemically synthesized
ctgctaaacatcttttaaaatg

SEQ ID NO: 1211870 - DNA, 22 bp, Artificial Sequence
  chemically synthesized
gcgaggatctgacattttaaaa

SEQ ID NO: 1211871 - DNA, 22 bp, Artificial Sequence
  chemically synthesized
tgcgaggatctgacattttaaa

SEQ ID NO: 1211872 - DNA, 22 bp, Artificial Sequence
  chemically synthesized
ttgcgaggatctgacattttaa

SEQ ID NO: 1211873 - DNA, 22 bp, Artificial Sequence
  chemically synthesized
ctaaacatcttttaaaatgtca

SEQ ID NO: 1211874 - DNA, 22 bp, Artificial Sequence
  chemically synthesized
tttgcgaggatctgacatttta

SEQ ID NO: 1211875 - DNA, 22 bp, Artificial Sequence
  chemically synthesized
ttttgcgaggatctgacatttt

SEQ ID NO: 1211876 - DNA, 22 bp, Artificial Sequence
  chemically synthesized
tttttgcgaggatctgacattt

SEQ ID NO: 1211877 - DNA, 22 bp, Artificial Sequence
  chemically synthesized
aacatcttttaaaatgtcagat

SEQ ID NO: 1211878 - DNA, 22 bp, Artificial Sequence
  chemically synthesized
ttttttgcgaggatctgacatt

SEQ ID NO: 1211879 - DNA, 22 bp, Artificial Sequence
  chemically synthesized
tttttttgcgaggatctgacat

SEQ ID NO: 1211880 - DNA, 22 bp, Artificial Sequence
  chemically synthesized
ttttttttgcgaggatctgaca

SEQ ID NO: 1211881 - DNA, 22 bp, Artificial Sequence
  chemically synthesized
tttttttttgcgaggatctgac

SEQ ID NO: 1211882 - DNA, 22 bp, Artificial Sequence
  chemically synthesized
ttttttttttgcgaggatctga

SEQ ID NO: 1211883 - DNA, 22 bp, Artificial Sequence
  chemically synthesized
tttttttttttgcgaggatctg

SEQ ID NO: 1211884 - DNA, 22 bp, Artificial Sequence
  chemically synthesized
ttttttttttttgcgaggatct

SEQ ID NO: 1211885 - DNA, 22 bp, Artificial Sequence
  chemically synthesized
tttttttttttttgcgaggatc

SEQ ID NO: 1211886 - DNA, 22 bp, Artificial Sequence
  chemically synthesized
ttaaaatgtcagatcctcgcaa

SEQ ID NO: 1211887 - DNA, 22 bp, Artificial Sequence
  chemically synthesized
ttttttttttttttgcgaggat

SEQ ID NO: 1211888 - DNA, 22 bp, Artificial Sequence
  chemically synthesized
taaaatgtcagatcctcgcaaa

SEQ ID NO: 1211889 - DNA, 22 bp, Artificial Sequence
  chemically synthesized
tttttttttttttttgcgagga

SEQ ID NO: 1211890 - DNA, 22 bp, Artificial Sequence
  chemically synthesized
aaaatgtcagatcctcgcaaaa

SEQ ID NO: 1211891 - DNA, 22 bp, Artificial Sequence
  chemically synthesized
aaatgtcagatcctcgcaaaaa

SEQ ID NO: 1211892 - DNA, 22 bp, Artificial Sequence
  chemically synthesized
gcaaaaaaaaaaaaaaaaaata

SEQ ID NO: 1211893 - DNA, 22 bp, Artificial Sequence
  chemically synthesized
gacgaaagtccatatttttttt

SEQ ID NO: 1211894 - DNA, 22 bp, Artificial Sequence
  chemically synthesized
accctagacgaaagtccatatt

SEQ ID NO: 1211895 - DNA, 22 bp, Artificial Sequence
  chemically synthesized
cctcaccctagacgaaagtcca

SEQ ID NO: 1211896 - DNA, 22 bp, Artificial Sequence
  chemically synthesized
ccctcaccctagacgaaagtcc

SEQ ID NO: 1211897 - DNA, 22 bp, Artificial Sequence
  chemically synthesized
tccctcaccctagacgaaagtc

SEQ ID NO: 1211898 - DNA, 22 bp, Artificial Sequence
  chemically synthesized
ttccctcaccctagacgaaagt

SEQ ID NO: 1211899 - DNA, 22 bp, Artificial Sequence
  chemically synthesized
tttccctcaccctagacgaaag

SEQ ID NO: 1211900 - DNA, 22 bp, Artificial Sequence
  chemically synthesized
tcgtctagggtgagggaaaaag

SEQ ID NO: 1211901 - DNA, 22 bp, Artificial Sequence
  chemically synthesized
cgtctagggtgagggaaaaagt

SEQ ID NO: 1211902 - DNA, 22 bp, Artificial Sequence
  chemically synthesized
gtctagggtgagggaaaaagtt

SEQ ID NO: 1211903 - DNA, 22 bp, Artificial Sequence
  chemically synthesized
gggtgagggaaaaagtttttcc

SEQ ID NO: 1211904 - DNA, 22 bp, Artificial Sequence
  chemically synthesized
aatcacaaaaggcacgaaggga

SEQ ID NO: 1211905 - DNA, 22 bp, Artificial Sequence
  chemically synthesized
gaatcacaaaaggcacgaaggg

SEQ ID NO: 1211906 - DNA, 22 bp, Artificial Sequence
  chemically synthesized
gggacttgaatcacaaaaggca

SEQ ID NO: 1211907 - DNA, 22 bp, Artificial Sequence
  chemically synthesized
ttcccttcgtgccttttgtgat

SEQ ID NO: 1211908 - DNA, 22 bp, Artificial Sequence
  chemically synthesized
tcccttcgtgccttttgtgatt

SEQ ID NO: 1211909 - DNA, 22 bp, Artificial Sequence
  chemically synthesized
cccttcgtgccttttgtgattc

SEQ ID NO: 1211910 - DNA, 22 bp, Artificial Sequence
  chemically synthesized
ccttcgtgccttttgtgattca

SEQ ID NO: 1211911 - DNA, 22 bp, Artificial Sequence
  chemically synthesized
tagggttcgggacttgaatcac

SEQ ID NO: 1211912 - DNA, 22 bp, Artificial Sequence
  chemically synthesized
cgtgccttttgtgattcaagtc

SEQ ID NO: 1211913 - DNA, 22 bp, Artificial Sequence
  chemically synthesized
tatagggttcgggacttgaatc

SEQ ID NO: 1211914 - DNA, 22 bp, Artificial Sequence
  chemically synthesized
gtgccttttgtgattcaagtcc

SEQ ID NO: 1211915 - DNA, 22 bp, Artificial Sequence
  chemically synthesized
ctatagggttcgggacttgaat

SEQ ID NO: 1211916 - DNA, 22 bp, Artificial Sequence
  chemically synthesized
atttctatagggttcgggactt

SEQ ID NO: 1211917 - DNA, 22 bp, Artificial Sequence
  chemically synthesized
ttgtgattcaagtcccgaaccc

SEQ ID NO: 1211918 - DNA, 22 bp, Artificial Sequence
  chemically synthesized
tgtgattcaagtcccgaaccct

SEQ ID NO: 1211919 - DNA, 22 bp, Artificial Sequence
  chemically synthesized
gtgattcaagtcccgaacccta

SEQ ID NO: 1211920 - DNA, 22 bp, Artificial Sequence
  chemically synthesized
tgattcaagtcccgaaccctat

SEQ ID NO: 1211921 - DNA, 22 bp, Artificial Sequence
  chemically synthesized
aagtcccgaaccctatagaaat

SEQ ID NO: 1211922 - DNA, 22 bp, Artificial Sequence
  chemically synthesized
aatggtagaagtccagcagtgc

SEQ ID NO: 1211923 - DNA, 22 bp, Artificial Sequence
  chemically synthesized
tagaaatgagcactgctggact

SEQ ID NO: 1211924 - DNA, 22 bp, Artificial Sequence
  chemically synthesized
ccctcaatggtagaagtccagc

SEQ ID NO: 1211925 - DNA, 22 bp, Artificial Sequence
  chemically synthesized
acaaactgccctcaatggtaga

SEQ ID NO: 1211926 - DNA, 22 bp, Artificial Sequence
  chemically synthesized
ctggacttctaccattgagggc

SEQ ID NO: 1211927 - DNA, 22 bp, Artificial Sequence
  chemically synthesized
gggcctgacaaactgccctcaa

SEQ ID NO: 1211928 - DNA, 22 bp, Artificial Sequence
  chemically synthesized
gacttctaccattgagggcagt

SEQ ID NO: 1211929 - DNA, 22 bp, Artificial Sequence
  chemically synthesized
ggggcctgacaaactgccctca

SEQ ID NO: 1211930 - DNA, 22 bp, Artificial Sequence
  chemically synthesized
tggggcctgacaaactgccctc

SEQ ID NO: 1211931 - DNA, 22 bp, Artificial Sequence
  chemically synthesized
ctaccattgagggcagtttgtc

SEQ ID NO: 1211932 - DNA, 22 bp, Artificial Sequence
  chemically synthesized
taccattgagggcagtttgtca

SEQ ID NO: 1211933 - DNA, 22 bp, Artificial Sequence
  chemically synthesized
agctttggggcctgacaaactg

SEQ ID NO: 1211934 - DNA, 22 bp, Artificial Sequence
  chemically synthesized
ccattgagggcagtttgtcagg

SEQ ID NO: 1211935 - DNA, 22 bp, Artificial Sequence
  chemically synthesized
ttcagctttggggcctgacaaa

SEQ ID NO: 1211936 - DNA, 22 bp, Artificial Sequence
  chemically synthesized
gctgttcagctttggggcctga

SEQ ID NO: 1211937 - DNA, 22 bp, Artificial Sequence
  chemically synthesized
agggcagtttgtcaggccccaa

SEQ ID NO: 1211938 - DNA, 22 bp, Artificial Sequence
  chemically synthesized
ggctgttcagctttggggcctg

SEQ ID NO: 1211939 - DNA, 22 bp, Artificial Sequence
  chemically synthesized
tacttggctgttcagctttggg

SEQ ID NO: 1211940 - DNA, 22 bp, Artificial Sequence
  chemically synthesized
ttgtacttggctgttcagcttt

SEQ ID NO: 1211941 - DNA, 22 bp, Artificial Sequence
  chemically synthesized
gtcaggccccaaagctgaacag

SEQ ID NO: 1211942 - DNA, 22 bp, Artificial Sequence
  chemically synthesized
tcaggccccaaagctgaacagc

SEQ ID NO: 1211943 - DNA, 22 bp, Artificial Sequence
  chemically synthesized
gtctgttgtacttggctgttca

SEQ ID NO: 1211944 - DNA, 22 bp, Artificial Sequence
  chemically synthesized
tggtctgttgtacttggctgtt

SEQ ID NO: 1211945 - DNA, 22 bp, Artificial Sequence
  chemically synthesized
gctctggtctgttgtacttggc

SEQ ID NO: 1211946 - DNA, 22 bp, Artificial Sequence
  chemically synthesized
agctctggtctgttgtacttgg

SEQ ID NO: 1211947 - DNA, 22 bp, Artificial Sequence
  chemically synthesized
ttagctctggtctgttgtactt

SEQ ID NO: 1211948 - DNA, 22 bp, Artificial Sequence
  chemically synthesized
cttagctctggtctgttgtact

SEQ ID NO: 1211949 - DNA, 22 bp, Artificial Sequence
  chemically synthesized
aacagccaagtacaacagacca

SEQ ID NO: 1211950 - DNA, 22 bp, Artificial Sequence
  chemically synthesized
agtttcttagctctggtctgtt

SEQ ID NO: 1211951 - DNA, 22 bp, Artificial Sequence
  chemically synthesized
ttcagtttcttagctctggtct

SEQ ID NO: 1211952 - DNA, 22 bp, Artificial Sequence
  chemically synthesized
tgttcagtttcttagctctggt

SEQ ID NO: 1211953 - DNA, 22 bp, Artificial Sequence
  chemically synthesized
ctgttcagtttcttagctctgg

SEQ ID NO: 1211954 - DNA, 22 bp, Artificial Sequence
  chemically synthesized
tctgttcagtttcttagctctg

SEQ ID NO: 1211955 - DNA, 22 bp, Artificial Sequence
  chemically synthesized
ttctgttcagtttcttagctct

SEQ ID NO: 1211956 - DNA, 22 bp, Artificial Sequence
  chemically synthesized
tttctgttcagtttcttagctc

SEQ ID NO: 1211957 - DNA, 22 bp, Artificial Sequence
  chemically synthesized
ttttctgttcagtttcttagct

SEQ ID NO: 1211958 - DNA, 22 bp, Artificial Sequence
  chemically synthesized
tttttctgttcagtttcttagc

SEQ ID NO: 1211959 - DNA, 22 bp, Artificial Sequence
  chemically synthesized
tagttttttttctgttcagttt

SEQ ID NO: 1211960 - DNA, 22 bp, Artificial Sequence
  chemically synthesized
tgtagttttttttctgttcagt

SEQ ID NO: 1211961 - DNA, 22 bp, Artificial Sequence
  chemically synthesized
tctgtagttttttttctgttca

SEQ ID NO: 1211962 - DNA, 22 bp, Artificial Sequence
  chemically synthesized
cactctctgtagttttttttct

SEQ ID NO: 1211963 - DNA, 22 bp, Artificial Sequence
  chemically synthesized
agaaactgaacagaaaaaaaac

SEQ ID NO: 1211964 - DNA, 22 bp, Artificial Sequence
  chemically synthesized
ctgcactctctgtagttttttt

SEQ ID NO: 1211965 - DNA, 22 bp, Artificial Sequence
  chemically synthesized
aacagaaaaaaaactacagaga

SEQ ID NO: 1211966 - DNA, 22 bp, Artificial Sequence
  chemically synthesized
aatactactgcactctctgtag

SEQ ID NO: 1211967 - DNA, 22 bp, Artificial Sequence
  chemically synthesized
caacagtaattgaatactactg

SEQ ID NO: 1211968 - DNA, 22 bp, Artificial Sequence
  chemically synthesized
cagagagtgcagtagtattcaa

SEQ ID NO: 1211969 - DNA, 22 bp, Artificial Sequence
  chemically synthesized
ggaatatgttacaacagtaatt

SEQ ID NO: 1211970 - DNA, 22 bp, Artificial Sequence
  chemically synthesized
gggaatatgttacaacagtaat

SEQ ID NO: 1211971 - DNA, 22 bp, Artificial Sequence
  chemically synthesized
tgggaatatgttacaacagtaa

SEQ ID NO: 1211972 - DNA, 22 bp, Artificial Sequence
  chemically synthesized
agattttgggaatatgttacaa

SEQ ID NO: 1211973 - DNA, 22 bp, Artificial Sequence
  chemically synthesized
aattactgttgtaacatattcc

SEQ ID NO: 1211974 - DNA, 22 bp, Artificial Sequence
  chemically synthesized
agccattaagattttgggaata

SEQ ID NO: 1211975 - DNA, 22 bp, Artificial Sequence
  chemically synthesized
ctgttgtaacatattcccaaaa

SEQ ID NO: 1211976 - DNA, 22 bp, Artificial Sequence
  chemically synthesized
aagccattaagattttgggaat

SEQ ID NO: 1211977 - DNA, 22 bp, Artificial Sequence
  chemically synthesized
taagccattaagattttgggaa

SEQ ID NO: 1211978 - DNA, 22 bp, Artificial Sequence
  chemically synthesized
ttgtaacatattcccaaaatct

SEQ ID NO: 1211979 - DNA, 22 bp, Artificial Sequence
  chemically synthesized
ttttaagccattaagattttgg

SEQ ID NO: 1211980 - DNA, 22 bp, Artificial Sequence
  chemically synthesized
gttttaagccattaagattttg

SEQ ID NO: 1211981 - DNA, 22 bp, Artificial Sequence
  chemically synthesized
taacatattcccaaaatcttaa

SEQ ID NO: 1211982 - DNA, 22 bp, Artificial Sequence
  chemically synthesized
tcttgttttaagccattaagat

SEQ ID NO: 1211983 - DNA, 22 bp, Artificial Sequence
  chemically synthesized
gtcttgttttaagccattaaga

SEQ ID NO: 1211984 - DNA, 22 bp, Artificial Sequence
  chemically synthesized
ccaaaatcttaatggcttaaaa

SEQ ID NO: 1211985 - DNA, 22 bp, Artificial Sequence
  chemically synthesized
taagataaaacatttgtcttgt

SEQ ID NO: 1211986 - DNA, 22 bp, Artificial Sequence
  chemically synthesized
aatggcttaaaacaagacaaat

SEQ ID NO: 1211987 - DNA, 22 bp, Artificial Sequence
  chemically synthesized
atggcttaaaacaagacaaatg

SEQ ID NO: 1211988 - DNA, 22 bp, Artificial Sequence
  chemically synthesized
agctgtaagataaaacatttgt

SEQ ID NO: 1211989 - DNA, 22 bp, Artificial Sequence
  chemically synthesized
ctcagctgtaagataaaacatt

SEQ ID NO: 1211990 - DNA, 22 bp, Artificial Sequence
  chemically synthesized
aaaacaagacaaatgttttatc

SEQ ID NO: 1211991 - DNA, 22 bp, Artificial Sequence
  chemically synthesized
aaacaagacaaatgttttatct

SEQ ID NO: 1211992 - DNA, 22 bp, Artificial Sequence
  chemically synthesized
acctactcagctgtaagataaa

SEQ ID NO: 1211993 - DNA, 22 bp, Artificial Sequence
  chemically synthesized
tatcttacagctgagtaggtta

SEQ ID NO: 1211994 - DNA, 22 bp, Artificial Sequence
  chemically synthesized
atgtcagatgtctaacctactc

SEQ ID NO: 1211995 - DNA, 22 bp, Artificial Sequence
  chemically synthesized
atcttacagctgagtaggttag

SEQ ID NO: 1211996 - DNA, 22 bp, Artificial Sequence
  chemically synthesized
tcttacagctgagtaggttaga

SEQ ID NO: 1211997 - DNA, 22 bp, Artificial Sequence
  chemically synthesized
acagctgagtaggttagacatc

SEQ ID NO: 1211998 - DNA, 22 bp, Artificial Sequence
  chemically synthesized
cagctgagtaggttagacatct

SEQ ID NO: 1211999 - DNA, 22 bp, Artificial Sequence
  chemically synthesized
ataagactcatgtcagatgtct

SEQ ID NO: 1212000 - DNA, 22 bp, Artificial Sequence
  chemically synthesized
agtaggttagacatctgacatg

SEQ ID NO: 1212001 - DNA, 22 bp, Artificial Sequence
  chemically synthesized
gtctaataagactcatgtcaga

SEQ ID NO: 1212002 - DNA, 22 bp, Artificial Sequence
  chemically synthesized
agtctaataagactcatgtcag

SEQ ID NO: 1212003 - DNA, 22 bp, Artificial Sequence
  chemically synthesized
agtttagtctaataagactcat

SEQ ID NO: 1212004 - DNA, 22 bp, Artificial Sequence
  chemically synthesized
gagtttagtctaataagactca

SEQ ID NO: 1212005 - DNA, 22 bp, Artificial Sequence
  chemically synthesized
gacatctgacatgagtcttatt

SEQ ID NO: 1212006 - DNA, 22 bp, Artificial Sequence
  chemically synthesized
cttgagtttagtctaataagac

SEQ ID NO: 1212007 - DNA, 22 bp, Artificial Sequence
  chemically synthesized
ttgcttgagtttagtctaataa

SEQ ID NO: 1212008 - DNA, 22 bp, Artificial Sequence
  chemically synthesized
acatgagtcttattagactaaa

SEQ ID NO: 1212009 - DNA, 22 bp, Artificial Sequence
  chemically synthesized
ctgttgcttgagtttagtctaa

SEQ ID NO: 1212010 - DNA, 22 bp, Artificial Sequence
  chemically synthesized
attagactaaactcaagcaaca

SEQ ID NO: 1212011 - DNA, 22 bp, Artificial Sequence
  chemically synthesized
ttagactaaactcaagcaacag

SEQ ID NO: 1212012 - DNA, 22 bp, Artificial Sequence
  chemically synthesized
gactaaactcaagcaacagcag

SEQ ID NO: 1212013 - DNA, 22 bp, Artificial Sequence
  chemically synthesized
aactcaagcaacagcagggctt

SEQ ID NO: 1212014 - DNA, 22 bp, Artificial Sequence
  chemically synthesized
cagaaaggaacaaagccctgct

SEQ ID NO: 1212015 - DNA, 22 bp, Artificial Sequence
  chemically synthesized
ccagaaaggaacaaagccctgc

SEQ ID NO: 1212016 - DNA, 22 bp, Artificial Sequence
  chemically synthesized
aagcaacagcagggctttgttc

SEQ ID NO: 1212017 - DNA, 22 bp, Artificial Sequence
  chemically synthesized
gaatttccagaaaggaacaaag

SEQ ID NO: 1212018 - DNA, 22 bp, Artificial Sequence
  chemically synthesized
tagaatttccagaaaggaacaa

SEQ ID NO: 1212019 - DNA, 22 bp, Artificial Sequence
  chemically synthesized
ctagaatttccagaaaggaaca

SEQ ID NO: 1212020 - DNA, 22 bp, Artificial Sequence
  chemically synthesized
ttctagaatttccagaaaggaa

SEQ ID NO: 1212021 - DNA, 22 bp, Artificial Sequence
  chemically synthesized
tgttcctttctggaaattctag

SEQ ID NO: 1212022 - DNA, 22 bp, Artificial Sequence
  chemically synthesized
gttcctttctggaaattctaga

SEQ ID NO: 1212023 - DNA, 22 bp, Artificial Sequence
  chemically synthesized
ttcctttctggaaattctagaa

SEQ ID NO: 1212024 - DNA, 22 bp, Artificial Sequence
  chemically synthesized
ctttctggaaattctagaagag

SEQ ID NO: 1212025 - DNA, 22 bp, Artificial Sequence
  chemically synthesized
tctggaaattctagaagagatc

SEQ ID NO: 1212026 - DNA, 22 bp, Artificial Sequence
  chemically synthesized
ctggaaattctagaagagatca

SEQ ID NO: 1212027 - DNA, 22 bp, Artificial Sequence
  chemically synthesized
tggaaattctagaagagatcat

SEQ ID NO: 1212028 - DNA, 22 bp, Artificial Sequence
  chemically synthesized
gaaattctagaagagatcatgt

SEQ ID NO: 1212029 - DNA, 22 bp, Artificial Sequence
  chemically synthesized
gaaaagggaaagaaacatgatc

SEQ ID NO: 1212030 - DNA, 22 bp, Artificial Sequence
  chemically synthesized
tagaagagatcatgtttctttc

SEQ ID NO: 1212031 - DNA, 22 bp, Artificial Sequence
  chemically synthesized
gaagagatcatgtttctttccc

SEQ ID NO: 1212032 - DNA, 22 bp, Artificial Sequence
  chemically synthesized
taaaagctagaaaagggaaaga

SEQ ID NO: 1212033 - DNA, 22 bp, Artificial Sequence
  chemically synthesized
gaggtctataaaagctagaaaa

SEQ ID NO: 1212034 - DNA, 22 bp, Artificial Sequence
  chemically synthesized
ctttcccttttctagcttttat

SEQ ID NO: 1212035 - DNA, 22 bp, Artificial Sequence
  chemically synthesized
tttcccttttctagcttttata

SEQ ID NO: 1212036 - DNA, 22 bp, Artificial Sequence
  chemically synthesized
tcccttttctagcttttataga

SEQ ID NO: 1212037 - DNA, 22 bp, Artificial Sequence
  chemically synthesized
cccttttctagcttttatagac

SEQ ID NO: 1212038 - DNA, 22 bp, Artificial Sequence
  chemically synthesized
ccttttctagcttttatagacc

SEQ ID NO: 1212039 - DNA, 22 bp, Artificial Sequence
  chemically synthesized
aggaatattggaggtctataaa

SEQ ID NO: 1212040 - DNA, 22 bp, Artificial Sequence
  chemically synthesized
ttctagcttttatagacctcca

SEQ ID NO: 1212041 - DNA, 22 bp, Artificial Sequence
  chemically synthesized
tctagcttttatagacctccaa

SEQ ID NO: 1212042 - DNA, 22 bp, Artificial Sequence
  chemically synthesized
ctagcttttatagacctccaat

SEQ ID NO: 1212043 - DNA, 22 bp, Artificial Sequence
  chemically synthesized
tagcttttatagacctccaata

SEQ ID NO: 1212044 - DNA, 22 bp, Artificial Sequence
  chemically synthesized
gcttttatagacctccaatatt

SEQ ID NO: 1212045 - DNA, 22 bp, Artificial Sequence
  chemically synthesized
ttatagacctccaatattcctt

SEQ ID NO: 1212046 - DNA, 22 bp, Artificial Sequence
  chemically synthesized
tatagacctccaatattcctta

SEQ ID NO: 1212047 - DNA, 22 bp, Artificial Sequence
  chemically synthesized
atagacctccaatattccttaa

SEQ ID NO: 1212048 - DNA, 22 bp, Artificial Sequence
  chemically synthesized
tagacctccaatattccttaac

SEQ ID NO: 1212049 - DNA, 22 bp, Artificial Sequence
  chemically synthesized
caatattccttaacccctggtc

SEQ ID NO: 1212050 - DNA, 22 bp, Artificial Sequence
  chemically synthesized
aagaatggaggaagaccagggg

SEQ ID NO: 1212051 - DNA, 22 bp, Artificial Sequence
  chemically synthesized
gaagaatggaggaagaccaggg

SEQ ID NO: 1212052 - DNA, 22 bp, Artificial Sequence
  chemically synthesized
tgaagaatggaggaagaccagg

SEQ ID NO: 1212053 - DNA, 22 bp, Artificial Sequence
  chemically synthesized
gctttgaagaatggaggaagac

SEQ ID NO: 1212054 - DNA, 22 bp, Artificial Sequence
  chemically synthesized
cttaacccctggtcttcctcca

SEQ ID NO: 1212055 - DNA, 22 bp, Artificial Sequence
  chemically synthesized
ttcgctttgaagaatggaggaa

SEQ ID NO: 1212056 - DNA, 22 bp, Artificial Sequence
  chemically synthesized
aacccctggtcttcctccattc

SEQ ID NO: 1212057 - DNA, 22 bp, Artificial Sequence
  chemically synthesized
acccctggtcttcctccattct

SEQ ID NO: 1212058 - DNA, 22 bp, Artificial Sequence
  chemically synthesized
ttgttcgctttgaagaatggag

SEQ ID NO: 1212059 - DNA, 22 bp, Artificial Sequence
  chemically synthesized
ctgttgttcgctttgaagaatg

SEQ ID NO: 1212060 - DNA, 22 bp, Artificial Sequence
  chemically synthesized
gtcttcctccattcttcaaagc

SEQ ID NO: 1212061 - DNA, 22 bp, Artificial Sequence
  chemically synthesized
tacctactgttgttcgctttga

SEQ ID NO: 1212062 - DNA, 22 bp, Artificial Sequence
  chemically synthesized
cctccattcttcaaagcgaaca

SEQ ID NO: 1212063 - DNA, 22 bp, Artificial Sequence
  chemically synthesized
ctccattcttcaaagcgaacaa

SEQ ID NO: 1212064 - DNA, 22 bp, Artificial Sequence
  chemically synthesized
cattcttcaaagcgaacaacag

SEQ ID NO: 1212065 - DNA, 22 bp, Artificial Sequence
  chemically synthesized
agaaagactatacctactgttg

SEQ ID NO: 1212066 - DNA, 22 bp, Artificial Sequence
  chemically synthesized
ttcaaagcgaacaacagtaggt

SEQ ID NO: 1212067 - DNA, 22 bp, Artificial Sequence
  chemically synthesized
gagaaagactatacctactgtt

SEQ ID NO: 1212068 - DNA, 22 bp, Artificial Sequence
  chemically synthesized
caaagcgaacaacagtaggtat

SEQ ID NO: 1212069 - DNA, 22 bp, Artificial Sequence
  chemically synthesized
aaagcgaacaacagtaggtata

SEQ ID NO: 1212070 - DNA, 22 bp, Artificial Sequence
  chemically synthesized
agtgatataatttgagaaagac

SEQ ID NO: 1212071 - DNA, 22 bp, Artificial Sequence
  chemically synthesized
tctcaaattatatcactcaggc

SEQ ID NO: 1212072 - DNA, 22 bp, Artificial Sequence
  chemically synthesized
ctcaaattatatcactcaggcc

SEQ ID NO: 1212073 - DNA, 22 bp, Artificial Sequence
  chemically synthesized
tcaaattatatcactcaggcct

SEQ ID NO: 1212074 - DNA, 22 bp, Artificial Sequence
  chemically synthesized
aaattatatcactcaggcctac

SEQ ID NO: 1212075 - DNA, 22 bp, Artificial Sequence
  chemically synthesized
tatcactcaggcctactcttgt

SEQ ID NO: 1212076 - DNA, 22 bp, Artificial Sequence
  chemically synthesized
aaaatgaaagaggcacaagagt

SEQ ID NO: 1212077 - DNA, 22 bp, Artificial Sequence
  chemically synthesized
aaaaatgaaagaggcacaagag

SEQ ID NO: 1212078 - DNA, 22 bp, Artificial Sequence
  chemically synthesized
aggcctactcttgtgcctcttt

SEQ ID NO: 1212079 - DNA, 22 bp, Artificial Sequence
  chemically synthesized
ctcttgtgcctctttcattttt

SEQ ID NO: 1212080 - DNA, 22 bp, Artificial Sequence
  chemically synthesized
ttgtgcctctttcatttttaag

SEQ ID NO: 1212081 - DNA, 22 bp, Artificial Sequence
  chemically synthesized
gtgcctctttcatttttaagca

SEQ ID NO: 1212082 - DNA, 22 bp, Artificial Sequence
  chemically synthesized
tgcctctttcatttttaagcat

SEQ ID NO: 1212083 - DNA, 22 bp, Artificial Sequence
  chemically synthesized
tgtagtcaccggaatgcttaaa

SEQ ID NO: 1212084 - DNA, 22 bp, Artificial Sequence
  chemically synthesized
tttcatttttaagcattccggt

SEQ ID NO: 1212085 - DNA, 22 bp, Artificial Sequence
  chemically synthesized
tcatttttaagcattccggtga

SEQ ID NO: 1212086 - DNA, 22 bp, Artificial Sequence
  chemically synthesized
catttttaagcattccggtgac

SEQ ID NO: 1212087 - DNA, 22 bp, Artificial Sequence
  chemically synthesized
atttttaagcattccggtgact

SEQ ID NO: 1212088 - DNA, 22 bp, Artificial Sequence
  chemically synthesized
agtgcacactatgtagtcaccg

SEQ ID NO: 1212089 - DNA, 22 bp, Artificial Sequence
  chemically synthesized
ttaagcattccggtgactacat

SEQ ID NO: 1212090 - DNA, 22 bp, Artificial Sequence
  chemically synthesized
taagcattccggtgactacata

SEQ ID NO: 1212091 - DNA, 22 bp, Artificial Sequence
  chemically synthesized
aagcattccggtgactacatag

SEQ ID NO: 1212092 - DNA, 22 bp, Artificial Sequence
  chemically synthesized
cctgagtgcacactatgtagtc

SEQ ID NO: 1212093 - DNA, 22 bp, Artificial Sequence
  chemically synthesized
agcattccggtgactacatagt

SEQ ID NO: 1212094 - DNA, 22 bp, Artificial Sequence
  chemically synthesized
gattacctgagtgcacactatg

SEQ ID NO: 1212095 - DNA, 22 bp, Artificial Sequence
  chemically synthesized
cggtgactacatagtgtgcact

SEQ ID NO: 1212096 - DNA, 22 bp, Artificial Sequence
  chemically synthesized
acctggattacctgagtgcaca

SEQ ID NO: 1212097 - DNA, 22 bp, Artificial Sequence
  chemically synthesized
catagtgtgcactcaggtaatc

SEQ ID NO: 1212098 - DNA, 22 bp, Artificial Sequence
  chemically synthesized
aaatagggagggagattaacct

SEQ ID NO: 1212099 - DNA, 22 bp, Artificial Sequence
  chemically synthesized
aaaatagggagggagattaacc

SEQ ID NO: 1212100 - DNA, 22 bp, Artificial Sequence
  chemically synthesized
aggtaatccaggttaatctccc

SEQ ID NO: 1212101 - DNA, 22 bp, Artificial Sequence
  chemically synthesized
atcttaaaatagggagggagat

SEQ ID NO: 1212102 - DNA, 22 bp, Artificial Sequence
  chemically synthesized
gctgatcttaaaatagggaggg

SEQ ID NO: 1212103 - DNA, 22 bp, Artificial Sequence
  chemically synthesized
attagctgatcttaaaataggg

SEQ ID NO: 1212104 - DNA, 22 bp, Artificial Sequence
  chemically synthesized
ttaattagctgatcttaaaata

SEQ ID NO: 1212105 - DNA, 22 bp, Artificial Sequence
  chemically synthesized
atctccctccctattttaagat

SEQ ID NO: 1212106 - DNA, 22 bp, Artificial Sequence
  chemically synthesized
cctccctattttaagatcagct

SEQ ID NO: 1212107 - DNA, 22 bp, Artificial Sequence
  chemically synthesized
aggttgttaattagctgatctt

SEQ ID NO: 1212108 - DNA, 22 bp, Artificial Sequence
  chemically synthesized
cctattttaagatcagctaatt

SEQ ID NO: 1212109 - DNA, 22 bp, Artificial Sequence
  chemically synthesized
ttttaagatcagctaattaaca

SEQ ID NO: 1212110 - DNA, 22 bp, Artificial Sequence
  chemically synthesized
taagatcagctaattaacaacc

SEQ ID NO: 1212111 - DNA, 22 bp, Artificial Sequence
  chemically synthesized
aagatcagctaattaacaacct

SEQ ID NO: 1212112 - DNA, 22 bp, Artificial Sequence
  chemically synthesized
agatcagctaattaacaacctt

SEQ ID NO: 1212113 - DNA, 22 bp, Artificial Sequence
  chemically synthesized
attaacaaccttaattcccctg

SEQ ID NO: 1212114 - DNA, 22 bp, Artificial Sequence
  chemically synthesized
acaaccttaattcccctgtgtc

SEQ ID NO: 1212115 - DNA, 22 bp, Artificial Sequence
  chemically synthesized
aattcccctgtgtcatgtatca

SEQ ID NO: 1212116 - DNA, 22 bp, Artificial Sequence
  chemically synthesized
attcccctgtgtcatgtatcat

SEQ ID NO: 1212117 - DNA, 22 bp, Artificial Sequence
  chemically synthesized
tgagtatagtacatgatacatg

SEQ ID NO: 1212118 - DNA, 22 bp, Artificial Sequence
  chemically synthesized
ccctgtgtcatgtatcatgtac

SEQ ID NO: 1212119 - DNA, 22 bp, Artificial Sequence
  chemically synthesized
gaacctgtgagtatagtacatg

SEQ ID NO: 1212120 - DNA, 22 bp, Artificial Sequence
  chemically synthesized
tgtcatgtatcatgtactatac

SEQ ID NO: 1212121 - DNA, 22 bp, Artificial Sequence
  chemically synthesized
atgtcgaaatccctagaacctg

SEQ ID NO: 1212122 - DNA, 22 bp, Artificial Sequence
  chemically synthesized
tactcacaggttctagggattt

SEQ ID NO: 1212123 - DNA, 22 bp, Artificial Sequence
  chemically synthesized
acaggttctagggatttcgaca

SEQ ID NO: 1212124 - DNA, 22 bp, Artificial Sequence
  chemically synthesized
cccaaggatactcatgtcgaaa

SEQ ID NO: 1212125 - DNA, 22 bp, Artificial Sequence
  chemically synthesized
gctccccaaggatactcatgtc

SEQ ID NO: 1212126 - DNA, 22 bp, Artificial Sequence
  chemically synthesized
tagggatttcgacatgagtatc

SEQ ID NO: 1212127 - DNA, 22 bp, Artificial Sequence
  chemically synthesized
gggatttcgacatgagtatcct

SEQ ID NO: 1212128 - DNA, 22 bp, Artificial Sequence
  chemically synthesized
gatgctggctccccaaggatac

SEQ ID NO: 1212129 - DNA, 22 bp, Artificial Sequence
  chemically synthesized
cgacatgagtatccttggggag

SEQ ID NO: 1212130 - DNA, 22 bp, Artificial Sequence
  chemically synthesized
gacatgagtatccttggggagc

SEQ ID NO: 1212131 - DNA, 22 bp, Artificial Sequence
  chemically synthesized
gtagttggatgctggctcccca

SEQ ID NO: 1212132 - DNA, 22 bp, Artificial Sequence
  chemically synthesized
ggtagttggatgctggctcccc

SEQ ID NO: 1212133 - DNA, 22 bp, Artificial Sequence
  chemically synthesized
tggtagttggatgctggctccc

SEQ ID NO: 1212134 - DNA, 22 bp, Artificial Sequence
  chemically synthesized
ctttggtagttggatgctggct

SEQ ID NO: 1212135 - DNA, 22 bp, Artificial Sequence
  chemically synthesized
tcctttggtagttggatgctgg

SEQ ID NO: 1212136 - DNA, 22 bp, Artificial Sequence
  chemically synthesized
aactctcctttggtagttggat

SEQ ID NO: 1212137 - DNA, 22 bp, Artificial Sequence
  chemically synthesized
ggggagccagcatccaactacc

SEQ ID NO: 1212138 - DNA, 22 bp, Artificial Sequence
  chemically synthesized
aaactctcctttggtagttgga

SEQ ID NO: 1212139 - DNA, 22 bp, Artificial Sequence
  chemically synthesized
gggagccagcatccaactacca

SEQ ID NO: 1212140 - DNA, 22 bp, Artificial Sequence
  chemically synthesized
catatttaaactctcctttggt

SEQ ID NO: 1212141 - DNA, 22 bp, Artificial Sequence
  chemically synthesized
aacctgcatatttaaactctcc

SEQ ID NO: 1212142 - DNA, 22 bp, Artificial Sequence
  chemically synthesized
aaacctgcatatttaaactctc

SEQ ID NO: 1212143 - DNA, 22 bp, Artificial Sequence
  chemically synthesized
tttaaacctgcatatttaaact

SEQ ID NO: 1212144 - DNA, 22 bp, Artificial Sequence
  chemically synthesized
gtttaaacctgcatatttaaac

SEQ ID NO: 1212145 - DNA, 22 bp, Artificial Sequence
  chemically synthesized
tgtttaaacctgcatatttaaa

SEQ ID NO: 1212146 - DNA, 22 bp, Artificial Sequence
  chemically synthesized
ccaaaggagagtttaaatatgc

SEQ ID NO: 1212147 - DNA, 22 bp, Artificial Sequence
  chemically synthesized
ttgtttaaacctgcatatttaa

SEQ ID NO: 1212148 - DNA, 22 bp, Artificial Sequence
  chemically synthesized
tttgtttaaacctgcatattta

SEQ ID NO: 1212149 - DNA, 22 bp, Artificial Sequence
  chemically synthesized
ttttgtttaaacctgcatattt

SEQ ID NO: 1212150 - DNA, 22 bp, Artificial Sequence
  chemically synthesized
aaatatgcaggtttaaacaaaa

SEQ ID NO: 1212151 - DNA, 22 bp, Artificial Sequence
  chemically synthesized
aatatgcaggtttaaacaaaaa

SEQ ID NO: 1212152 - DNA, 22 bp, Artificial Sequence
  chemically synthesized
aatatgatacgacttttttgtt

SEQ ID NO: 1212153 - DNA, 22 bp, Artificial Sequence
  chemically synthesized
gatactcaatatgatacgactt

SEQ ID NO: 1212154 - DNA, 22 bp, Artificial Sequence
  chemically synthesized
aaacaaaaaagtcgtatcatat

SEQ ID NO: 1212155 - DNA, 22 bp, Artificial Sequence
  chemically synthesized
aacaaaaaagtcgtatcatatt

SEQ ID NO: 1212156 - DNA, 22 bp, Artificial Sequence
  chemically synthesized
agtatccagatttcactttgtc

SEQ ID NO: 1212157 - DNA, 22 bp, Artificial Sequence
  chemically synthesized
gagtatatcggagacaaagtga

SEQ ID NO: 1212158 - DNA, 22 bp, Artificial Sequence
  chemically synthesized
cactttgtctccgatatactct

SEQ ID NO: 1212159 - DNA, 22 bp, Artificial Sequence
  chemically synthesized
actttgtctccgatatactcta

SEQ ID NO: 1212160 - DNA, 22 bp, Artificial Sequence
  chemically synthesized
ggaataccagaattagagtata

SEQ ID NO: 1212161 - DNA, 22 bp, Artificial Sequence
  chemically synthesized
gggaataccagaattagagtat

SEQ ID NO: 1212162 - DNA, 22 bp, Artificial Sequence
  chemically synthesized
tgtctccgatatactctaattc

SEQ ID NO: 1212163 - DNA, 22 bp, Artificial Sequence
  chemically synthesized
gtctccgatatactctaattct

SEQ ID NO: 1212164 - DNA, 22 bp, Artificial Sequence
  chemically synthesized
tctccgatatactctaattctg

SEQ ID NO: 1212165 - DNA, 22 bp, Artificial Sequence
  chemically synthesized
atacttgggaataccagaatta

SEQ ID NO: 1212166 - DNA, 22 bp, Artificial Sequence
  chemically synthesized
aatacttgggaataccagaatt

SEQ ID NO: 1212167 - DNA, 22 bp, Artificial Sequence
  chemically synthesized
cgatatactctaattctggtat

SEQ ID NO: 1212168 - DNA, 22 bp, Artificial Sequence
  chemically synthesized
taattctggtattcccaagtat

SEQ ID NO: 1212169 - DNA, 22 bp, Artificial Sequence
  chemically synthesized
attctggtattcccaagtatta

SEQ ID NO: 1212170 - DNA, 22 bp, Artificial Sequence
  chemically synthesized
gtgcccaagatatttaatactt

SEQ ID NO: 1212171 - DNA, 22 bp, Artificial Sequence
  chemically synthesized
tggtattcccaagtattaaata

SEQ ID NO: 1212172 - DNA, 22 bp, Artificial Sequence
  chemically synthesized
gtattcccaagtattaaatatc

SEQ ID NO: 1212173 - DNA, 22 bp, Artificial Sequence
  chemically synthesized
ccaagtattaaatatcttgggc

SEQ ID NO: 1212174 - DNA, 22 bp, Artificial Sequence
  chemically synthesized
caaaaataattggtgcccaaga

SEQ ID NO: 1212175 - DNA, 22 bp, Artificial Sequence
  chemically synthesized
acaaaaataattggtgcccaag

SEQ ID NO: 1212176 - DNA, 22 bp, Artificial Sequence
  chemically synthesized
aatatcttgggcaccaattatt

SEQ ID NO: 1212177 - DNA, 22 bp, Artificial Sequence
  chemically synthesized
caggcaccagtttacaaaaata

SEQ ID NO: 1212178 - DNA, 22 bp, Artificial Sequence
  chemically synthesized
gggcaccaattatttttgtaaa

SEQ ID NO: 1212179 - DNA, 22 bp, Artificial Sequence
  chemically synthesized
ggcaccaattatttttgtaaac

SEQ ID NO: 1212180 - DNA, 22 bp, Artificial Sequence
  chemically synthesized
ttacaggcaccagtttacaaaa

SEQ ID NO: 1212181 - DNA, 22 bp, Artificial Sequence
  chemically synthesized
attacaggcaccagtttacaaa

SEQ ID NO: 1212182 - DNA, 22 bp, Artificial Sequence
  chemically synthesized
gtcaaatttattacaggcacca

SEQ ID NO: 1212183 - DNA, 22 bp, Artificial Sequence
  chemically synthesized
tttttgtaaactggtgcctgta

SEQ ID NO: 1212184 - DNA, 22 bp, Artificial Sequence
  chemically synthesized
agtcaaatttattacaggcacc

SEQ ID NO: 1212185 - DNA, 22 bp, Artificial Sequence
  chemically synthesized
ttgtaaactggtgcctgtaata

SEQ ID NO: 1212186 - DNA, 22 bp, Artificial Sequence
  chemically synthesized
tgtaaactggtgcctgtaataa

SEQ ID NO: 1212187 - DNA, 22 bp, Artificial Sequence
  chemically synthesized
atttagtcaaatttattacagg

SEQ ID NO: 1212188 - DNA, 22 bp, Artificial Sequence
  chemically synthesized
gtaaactggtgcctgtaataaa

SEQ ID NO: 1212189 - DNA, 22 bp, Artificial Sequence
  chemically synthesized
aatttagtcaaatttattacag

SEQ ID NO: 1212190 - DNA, 22 bp, Artificial Sequence
  chemically synthesized
taaactggtgcctgtaataaat

SEQ ID NO: 1212191 - DNA, 22 bp, Artificial Sequence
  chemically synthesized
gtgcctgtaataaatttgacta

SEQ ID NO: 1212192 - DNA, 22 bp, Artificial Sequence
  chemically synthesized
aataatcagcttaatttagtca

SEQ ID NO: 1212193 - DNA, 22 bp, Artificial Sequence
  chemically synthesized
aaataatcagcttaatttagtc

SEQ ID NO: 1212194 - DNA, 22 bp, Artificial Sequence
  chemically synthesized
taataaatttgactaaattaag

SEQ ID NO: 1212195 - DNA, 22 bp, Artificial Sequence
  chemically synthesized
gcttaaataatcagcttaattt

SEQ ID NO: 1212196 - DNA, 22 bp, Artificial Sequence
  chemically synthesized
gactaaattaagctgattattt

SEQ ID NO: 1212197 - DNA, 22 bp, Artificial Sequence
  chemically synthesized
actaaattaagctgattattta

SEQ ID NO: 1212198 - DNA, 22 bp, Artificial Sequence
  chemically synthesized
aattaagctgattatttaagct

SEQ ID NO: 1212199 - DNA, 22 bp, Artificial Sequence
  chemically synthesized
atacatgaacaattagcttaaa

SEQ ID NO: 1212200 - DNA, 22 bp, Artificial Sequence
  chemically synthesized
agctgattatttaagctaattg

SEQ ID NO: 1212201 - DNA, 22 bp, Artificial Sequence
  chemically synthesized
attatttaagctaattgttcat

SEQ ID NO: 1212202 - DNA, 22 bp, Artificial Sequence
  chemically synthesized
tttaagctaattgttcatgtat

SEQ ID NO: 1212203 - DNA, 22 bp, Artificial Sequence
  chemically synthesized
aagctaattgttcatgtatgaa

SEQ ID NO: 1212204 - DNA, 22 bp, Artificial Sequence
  chemically synthesized
agctaattgttcatgtatgaat

SEQ ID NO: 1212205 - DNA, 22 bp, Artificial Sequence
  chemically synthesized
attgttcatgtatgaattattt

SEQ ID NO: 1212206 - DNA, 22 bp, Artificial Sequence
  chemically synthesized
tcagtggaatgatgaaataatt

SEQ ID NO: 1212207 - DNA, 22 bp, Artificial Sequence
  chemically synthesized
ttcatgtatgaattatttcatc

SEQ ID NO: 1212208 - DNA, 22 bp, Artificial Sequence
  chemically synthesized
atgtatgaattatttcatcatt

SEQ ID NO: 1212209 - DNA, 22 bp, Artificial Sequence
  chemically synthesized
tgccacctatcagtggaatgat

SEQ ID NO: 1212210 - DNA, 22 bp, Artificial Sequence
  chemically synthesized
ctgtgccacctatcagtggaat

SEQ ID NO: 1212211 - DNA, 22 bp, Artificial Sequence
  chemically synthesized
tttcatcattccactgataggt

SEQ ID NO: 1212212 - DNA, 22 bp, Artificial Sequence
  chemically synthesized
catcattccactgataggtggc

SEQ ID NO: 1212213 - DNA, 22 bp, Artificial Sequence
  chemically synthesized
atcattccactgataggtggca

SEQ ID NO: 1212214 - DNA, 22 bp, Artificial Sequence
  chemically synthesized
tgtgagctactgtgccacctat

SEQ ID NO: 1212215 - DNA, 22 bp, Artificial Sequence
  chemically synthesized
gaattgtgtgagctactgtgcc

SEQ ID NO: 1212216 - DNA, 22 bp, Artificial Sequence
  chemically synthesized
cactgataggtggcacagtagc

SEQ ID NO: 1212217 - DNA, 22 bp, Artificial Sequence
  chemically synthesized
ggaattgtgtgagctactgtgc

SEQ ID NO: 1212218 - DNA, 22 bp, Artificial Sequence
  chemically synthesized
ttggaattgtgtgagctactgt

SEQ ID NO: 1212219 - DNA, 22 bp, Artificial Sequence
  chemically synthesized
ataggtggcacagtagctcaca

SEQ ID NO: 1212220 - DNA, 22 bp, Artificial Sequence
  chemically synthesized
aatctcttggaattgtgtgagc

SEQ ID NO: 1212221 - DNA, 22 bp, Artificial Sequence
  chemically synthesized
aaactaaatctcttggaattgt

SEQ ID NO: 1212222 - DNA, 22 bp, Artificial Sequence
  chemically synthesized
gaaactaaatctcttggaattg

SEQ ID NO: 1212223 - DNA, 22 bp, Artificial Sequence
  chemically synthesized
atttgaaactaaatctcttgga

SEQ ID NO: 1212224 - DNA, 22 bp, Artificial Sequence
  chemically synthesized
catttgaaactaaatctcttgg

SEQ ID NO: 1212225 - DNA, 22 bp, Artificial Sequence
  chemically synthesized
tcatttgaaactaaatctcttg

SEQ ID NO: 1212226 - DNA, 22 bp, Artificial Sequence
  chemically synthesized
acacaattccaagagatttagt

SEQ ID NO: 1212227 - DNA, 22 bp, Artificial Sequence
  chemically synthesized
caagagatttagtttcaaatga

SEQ ID NO: 1212228 - DNA, 22 bp, Artificial Sequence
  chemically synthesized
agtttcaaatgaaagtcgtcct

SEQ ID NO: 1212229 - DNA, 22 bp, Artificial Sequence
  chemically synthesized
gtttcaaatgaaagtcgtccta

SEQ ID NO: 1212230 - DNA, 22 bp, Artificial Sequence
  chemically synthesized
caaatgaaagtcgtcctattca

SEQ ID NO: 1212231 - DNA, 22 bp, Artificial Sequence
  chemically synthesized
aaatgaaagtcgtcctattcat

SEQ ID NO: 1212232 - DNA, 22 bp, Artificial Sequence
  chemically synthesized
ttcatcccctttattattgatt

SEQ ID NO: 1212233 - DNA, 22 bp, Artificial Sequence
  chemically synthesized
tgtgtgtgcagtaaaatcaata

SEQ ID NO: 1212234 - DNA, 22 bp, Artificial Sequence
  chemically synthesized
atcccctttattattgatttta

SEQ ID NO: 1212235 - DNA, 22 bp, Artificial Sequence
  chemically synthesized
tgtgtgtgtgcagtaaaatcaa

SEQ ID NO: 1212236 - DNA, 22 bp, Artificial Sequence
  chemically synthesized
tctgtgtgtgtgcagtaaaatc

SEQ ID NO: 1212237 - DNA, 22 bp, Artificial Sequence
  chemically synthesized
tattattgattttactgcacac

SEQ ID NO: 1212238 - DNA, 22 bp, Artificial Sequence
  chemically synthesized
attattgattttactgcacaca

SEQ ID NO: 1212239 - DNA, 22 bp, Artificial Sequence
  chemically synthesized
ttattgattttactgcacacac

SEQ ID NO: 1212240 - DNA, 22 bp, Artificial Sequence
  chemically synthesized
ttgattttactgcacacacaca

SEQ ID NO: 1212241 - DNA, 22 bp, Artificial Sequence
  chemically synthesized
gtaatgactctctgtgtgtgtg

SEQ ID NO: 1212242 - DNA, 22 bp, Artificial Sequence
  chemically synthesized
attttactgcacacacacagag

SEQ ID NO: 1212243 - DNA, 22 bp, Artificial Sequence
  chemically synthesized
tactgcacacacacagagagtc

SEQ ID NO: 1212244 - DNA, 22 bp, Artificial Sequence
  chemically synthesized
ccatctagtaatgactctctgt

SEQ ID NO: 1212245 - DNA, 22 bp, Artificial Sequence
  chemically synthesized
actgcacacacacagagagtca

SEQ ID NO: 1212246 - DNA, 22 bp, Artificial Sequence
  chemically synthesized
ctgcacacacacagagagtcat

SEQ ID NO: 1212247 - DNA, 22 bp, Artificial Sequence
  chemically synthesized
cacacacacagagagtcattac

SEQ ID NO: 1212248 - DNA, 22 bp, Artificial Sequence
  chemically synthesized
tcagttcccatctagtaatgac

SEQ ID NO: 1212249 - DNA, 22 bp, Artificial Sequence
  chemically synthesized
ttatcagttcccatctagtaat

SEQ ID NO: 1212250 - DNA, 22 bp, Artificial Sequence
  chemically synthesized
ctagatgggaactgataacaat

SEQ ID NO: 1212251 - DNA, 22 bp, Artificial Sequence
  chemically synthesized
tgtgtccgagcaacattgttat

SEQ ID NO: 1212252 - DNA, 22 bp, Artificial Sequence
  chemically synthesized
gatgggaactgataacaatgtt

SEQ ID NO: 1212253 - DNA, 22 bp, Artificial Sequence
  chemically synthesized
ggtgtcattgtgtgtccgagca

SEQ ID NO: 1212254 - DNA, 22 bp, Artificial Sequence
  chemically synthesized
ataacaatgttgctcggacaca

SEQ ID NO: 1212255 - DNA, 22 bp, Artificial Sequence
  chemically synthesized
atataaatattaggtgtcattg

SEQ ID NO: 1212256 - DNA, 22 bp, Artificial Sequence
  chemically synthesized
ctcggacacacaatgacaccta

SEQ ID NO: 1212257 - DNA, 22 bp, Artificial Sequence
  chemically synthesized
ggacacacaatgacacctaata

SEQ ID NO: 1212258 - DNA, 22 bp, Artificial Sequence
  chemically synthesized
gcatattaatataaatattagg

SEQ ID NO: 1212259 - DNA, 22 bp, Artificial Sequence
  chemically synthesized
atatttatattaatatgctagc

SEQ ID NO: 1212260 - DNA, 22 bp, Artificial Sequence
  chemically synthesized
atattaatatgctagcacattt

SEQ ID NO: 1212261 - DNA, 22 bp, Artificial Sequence
  chemically synthesized
tattaatatgctagcacatttt

SEQ ID NO: 1212262 - DNA, 22 bp, Artificial Sequence
  chemically synthesized
atatgctagcacattttttctg

SEQ ID NO: 1212263 - DNA, 22 bp, Artificial Sequence
  chemically synthesized
tcaaaaaataggaacagaaaaa

SEQ ID NO: 1212264 - DNA, 22 bp, Artificial Sequence
  chemically synthesized
gcacattttttctgttcctatt

SEQ ID NO: 1212265 - DNA, 22 bp, Artificial Sequence
  chemically synthesized
cagctatcaaaaaataggaaca

SEQ ID NO: 1212266 - DNA, 22 bp, Artificial Sequence
  chemically synthesized
gcagctatcaaaaaataggaac

SEQ ID NO: 1212267 - DNA, 22 bp, Artificial Sequence
  chemically synthesized
atttgcagctatcaaaaaatag

SEQ ID NO: 1212268 - DNA, 22 bp, Artificial Sequence
  chemically synthesized
tttctgttcctattttttgata

SEQ ID NO: 1212269 - DNA, 22 bp, Artificial Sequence
  chemically synthesized
ttctgttcctattttttgatag

SEQ ID NO: 1212270 - DNA, 22 bp, Artificial Sequence
  chemically synthesized
tctgttcctattttttgatagc

SEQ ID NO: 1212271 - DNA, 22 bp, Artificial Sequence
  chemically synthesized
ctgttcctattttttgatagct

SEQ ID NO: 1212272 - DNA, 22 bp, Artificial Sequence
  chemically synthesized
tgttcctattttttgatagctg

SEQ ID NO: 1212273 - DNA, 22 bp, Artificial Sequence
  chemically synthesized
ttcctattttttgatagctgca

SEQ ID NO: 1212274 - DNA, 22 bp, Artificial Sequence
  chemically synthesized
ctattttttgatagctgcaaat

SEQ ID NO: 1212275 - DNA, 22 bp, Artificial Sequence
  chemically synthesized
ttttttgatagctgcaaattag

SEQ ID NO: 1212276 - DNA, 22 bp, Artificial Sequence
  chemically synthesized
tttgatagctgcaaattagtct

SEQ ID NO: 1212277 - DNA, 22 bp, Artificial Sequence
  chemically synthesized
ttgatagctgcaaattagtctt

SEQ ID NO: 1212278 - DNA, 22 bp, Artificial Sequence
  chemically synthesized
tgatagctgcaaattagtcttt

SEQ ID NO: 1212279 - DNA, 22 bp, Artificial Sequence
  chemically synthesized
gatagctgcaaattagtctttt

SEQ ID NO: 1212280 - DNA, 22 bp, Artificial Sequence
  chemically synthesized
atagctgcaaattagtcttttg

SEQ ID NO: 1212281 - DNA, 22 bp, Artificial Sequence
  chemically synthesized
caaattagtcttttgtcgcaca

SEQ ID NO: 1212282 - DNA, 22 bp, Artificial Sequence
  chemically synthesized
atgaaaaagggaatgtgcgaca

SEQ ID NO: 1212283 - DNA, 22 bp, Artificial Sequence
  chemically synthesized
gtcttttgtcgcacattccctt

SEQ ID NO: 1212284 - DNA, 22 bp, Artificial Sequence
  chemically synthesized
aaaacctcatgaaaaagggaat

SEQ ID NO: 1212285 - DNA, 22 bp, Artificial Sequence
  chemically synthesized
aaaaacctcatgaaaaagggaa

SEQ ID NO: 1212286 - DNA, 22 bp, Artificial Sequence
  chemically synthesized
taaaaacctcatgaaaaaggga

SEQ ID NO: 1212287 - DNA, 22 bp, Artificial Sequence
  chemically synthesized
ttgtcgcacattccctttttca

SEQ ID NO: 1212288 - DNA, 22 bp, Artificial Sequence
  chemically synthesized
tgtcgcacattccctttttcat

SEQ ID NO: 1212289 - DNA, 22 bp, Artificial Sequence
  chemically synthesized
gtcgcacattccctttttcatg

SEQ ID NO: 1212290 - DNA, 22 bp, Artificial Sequence
  chemically synthesized
tcgcacattccctttttcatga

SEQ ID NO: 1212291 - DNA, 22 bp, Artificial Sequence
  chemically synthesized
aacattttaaaaacctcatgaa

SEQ ID NO: 1212292 - DNA, 22 bp, Artificial Sequence
  chemically synthesized
ttaaacattttaaaaacctcat

SEQ ID NO: 1212293 - DNA, 22 bp, Artificial Sequence
  chemically synthesized
attaaacattttaaaaacctca

SEQ ID NO: 1212294 - DNA, 22 bp, Artificial Sequence
  chemically synthesized
cctttttcatgaggtttttaaa

SEQ ID NO: 1212295 - DNA, 22 bp, Artificial Sequence
  chemically synthesized
tttcatgaggtttttaaaatgt

SEQ ID NO: 1212296 - DNA, 22 bp, Artificial Sequence
  chemically synthesized
ttcatgaggtttttaaaatgtt

SEQ ID NO: 1212297 - DNA, 22 bp, Artificial Sequence
  chemically synthesized
tcatgaggtttttaaaatgttt

SEQ ID NO: 1212298 - DNA, 22 bp, Artificial Sequence
  chemically synthesized
catgaggtttttaaaatgttta

SEQ ID NO: 1212299 - DNA, 22 bp, Artificial Sequence
  chemically synthesized
atgaggtttttaaaatgtttaa

SEQ ID NO: 1212300 - DNA, 22 bp, Artificial Sequence
  chemically synthesized
aatatgtagatgatttattaaa

SEQ ID NO: 1212301 - DNA, 22 bp, Artificial Sequence
  chemically synthesized
ttaaaatgtttaataaatcatc

SEQ ID NO: 1212302 - DNA, 22 bp, Artificial Sequence
  chemically synthesized
taaaatgtttaataaatcatct

SEQ ID NO: 1212303 - DNA, 22 bp, Artificial Sequence
  chemically synthesized
aaaatgtttaataaatcatcta

SEQ ID NO: 1212304 - DNA, 22 bp, Artificial Sequence
  chemically synthesized
aaatgtttaataaatcatctac

SEQ ID NO: 1212305 - DNA, 22 bp, Artificial Sequence
  chemically synthesized
gtggtaaaaattaaatatgtag

SEQ ID NO: 1212306 - DNA, 22 bp, Artificial Sequence
  chemically synthesized
aataaatcatctacatatttaa

SEQ ID NO: 1212307 - DNA, 22 bp, Artificial Sequence
  chemically synthesized
ataaatcatctacatatttaat

SEQ ID NO: 1212308 - DNA, 22 bp, Artificial Sequence
  chemically synthesized
aatgctagtggtaaaaattaaa

SEQ ID NO: 1212309 - DNA, 22 bp, Artificial Sequence
  chemically synthesized
catatttaatttttaccactag

SEQ ID NO: 1212310 - DNA, 22 bp, Artificial Sequence
  chemically synthesized
aaaatgtctaaatgctagtggt

SEQ ID NO: 1212311 - DNA, 22 bp, Artificial Sequence
  chemically synthesized
aaaaatgtctaaatgctagtgg

SEQ ID NO: 1212312 - DNA, 22 bp, Artificial Sequence
  chemically synthesized
taaaaatgtctaaatgctagtg

SEQ ID NO: 1212313 - DNA, 22 bp, Artificial Sequence
  chemically synthesized
aatttttaccactagcatttag

SEQ ID NO: 1212314 - DNA, 22 bp, Artificial Sequence
  chemically synthesized
atttttaccactagcatttaga

SEQ ID NO: 1212315 - DNA, 22 bp, Artificial Sequence
  chemically synthesized
ttaccactagcatttagacatt

SEQ ID NO: 1212316 - DNA, 22 bp, Artificial Sequence
  chemically synthesized
taccactagcatttagacattt

SEQ ID NO: 1212317 - DNA, 22 bp, Artificial Sequence
  chemically synthesized
accactagcatttagacatttt

SEQ ID NO: 1212318 - DNA, 22 bp, Artificial Sequence
  chemically synthesized
ccactagcatttagacattttt

SEQ ID NO: 1212319 - DNA, 22 bp, Artificial Sequence
  chemically synthesized
aaaagataactttaaaaatgtc

SEQ ID NO: 1212320 - DNA, 22 bp, Artificial Sequence
  chemically synthesized
caaaagataactttaaaaatgt

SEQ ID NO: 1212321 - DNA, 22 bp, Artificial Sequence
  chemically synthesized
gcatttagacatttttaaagtt

SEQ ID NO: 1212322 - DNA, 22 bp, Artificial Sequence
  chemically synthesized
gtttcaaaagataactttaaaa

SEQ ID NO: 1212323 - DNA, 22 bp, Artificial Sequence
  chemically synthesized
agtttcaaaagataactttaaa

SEQ ID NO: 1212324 - DNA, 22 bp, Artificial Sequence
  chemically synthesized
agacatttttaaagttatcttt

SEQ ID NO: 1212325 - DNA, 22 bp, Artificial Sequence
  chemically synthesized
gacatttttaaagttatctttt

SEQ ID NO: 1212326 - DNA, 22 bp, Artificial Sequence
  chemically synthesized
aaaataatttagtttcaaaaga

SEQ ID NO: 1212327 - DNA, 22 bp, Artificial Sequence
  chemically synthesized
ttaaagttatcttttgaaacta

SEQ ID NO: 1212328 - DNA, 22 bp, Artificial Sequence
  chemically synthesized
taaagttatcttttgaaactaa

SEQ ID NO: 1212329 - DNA, 22 bp, Artificial Sequence
  chemically synthesized
aaagttatcttttgaaactaaa

SEQ ID NO: 1212330 - DNA, 22 bp, Artificial Sequence
  chemically synthesized
aagttatcttttgaaactaaat

SEQ ID NO: 1212331 - DNA, 22 bp, Artificial Sequence
  chemically synthesized
taaaatctaaaaataatttagt

SEQ ID NO: 1212332 - DNA, 22 bp, Artificial Sequence
  chemically synthesized
tcttttgaaactaaattatttt

SEQ ID NO: 1212333 - DNA, 22 bp, Artificial Sequence
  chemically synthesized
ttgaaactaaattatttttaga

SEQ ID NO: 1212334 - DNA, 22 bp, Artificial Sequence
  chemically synthesized
tgaaactaaattatttttagat

SEQ ID NO: 1212335 - DNA, 22 bp, Artificial Sequence
  chemically synthesized
gaaactaaattatttttagatt

SEQ ID NO: 1212336 - DNA, 22 bp, Artificial Sequence
  chemically synthesized
aaactaaattatttttagattt

SEQ ID NO: 1212337 - DNA, 22 bp, Artificial Sequence
  chemically synthesized
aattatttttagattttacaga

SEQ ID NO: 1212338 - DNA, 22 bp, Artificial Sequence
  chemically synthesized
tttttagattttacagatgttc

SEQ ID NO: 1212339 - DNA, 22 bp, Artificial Sequence
  chemically synthesized
ttagattttacagatgttcccc

SEQ ID NO: 1212340 - DNA, 22 bp, Artificial Sequence
  chemically synthesized
tagattttacagatgttccccc

SEQ ID NO: 1212341 - DNA, 22 bp, Artificial Sequence
  chemically synthesized
agattttacagatgttccccct

SEQ ID NO: 1212342 - DNA, 22 bp, Artificial Sequence
  chemically synthesized
gattttacagatgttccccctt

SEQ ID NO: 1212343 - DNA, 22 bp, Artificial Sequence
  chemically synthesized
tacagatgttcccccttcctgt

SEQ ID NO: 1212344 - DNA, 22 bp, Artificial Sequence
  chemically synthesized
acagatgttcccccttcctgtg

SEQ ID NO: 1212345 - DNA, 22 bp, Artificial Sequence
  chemically synthesized
cagatgttcccccttcctgtgt

SEQ ID NO: 1212346 - DNA, 22 bp, Artificial Sequence
  chemically synthesized
aacaatgagaacacatggacac

SEQ ID NO: 1212347 - DNA, 22 bp, Artificial Sequence
  chemically synthesized
ccccttcctgtgtccatgtgtt

SEQ ID NO: 1212348 - DNA, 22 bp, Artificial Sequence
  chemically synthesized
cctgtgtccatgtgttctcatt

SEQ ID NO: 1212349 - DNA, 22 bp, Artificial Sequence
  chemically synthesized
ctgtgtccatgtgttctcattg

SEQ ID NO: 1212350 - DNA, 22 bp, Artificial Sequence
  chemically synthesized
tgtccatgtgttctcattgttc

SEQ ID NO: 1212351 - DNA, 22 bp, Artificial Sequence
  chemically synthesized
ataggtgggaattgaacaatga

SEQ ID NO: 1212352 - DNA, 22 bp, Artificial Sequence
  chemically synthesized
actcataggtgggaattgaaca

SEQ ID NO: 1212353 - DNA, 22 bp, Artificial Sequence
  chemically synthesized
tcactcataggtgggaattgaa

SEQ ID NO: 1212354 - DNA, 22 bp, Artificial Sequence
  chemically synthesized
tcattgttcaattcccacctat

SEQ ID NO: 1212355 - DNA, 22 bp, Artificial Sequence
  chemically synthesized
attgttcaattcccacctatga

SEQ ID NO: 1212356 - DNA, 22 bp, Artificial Sequence
  chemically synthesized
ttcaattcccacctatgagtga

SEQ ID NO: 1212357 - DNA, 22 bp, Artificial Sequence
  chemically synthesized
aattcccacctatgagtgagaa

SEQ ID NO: 1212358 - DNA, 22 bp, Artificial Sequence
  chemically synthesized
ccacctatgagtgagaacatgc

SEQ ID NO: 1212359 - DNA, 22 bp, Artificial Sequence
  chemically synthesized
tgagtgagaacatgcggtgttt

SEQ ID NO: 1212360 - DNA, 22 bp, Artificial Sequence
  chemically synthesized
tcgcaaggataaaaaaccaaac

SEQ ID NO: 1212361 - DNA, 22 bp, Artificial Sequence
  chemically synthesized
agcaaactatcgcaaggataaa

SEQ ID NO: 1212362 - DNA, 22 bp, Artificial Sequence
  chemically synthesized
tcagcaaactatcgcaaggata

SEQ ID NO: 1212363 - DNA, 22 bp, Artificial Sequence
  chemically synthesized
ggttttttatccttgcgatagt

SEQ ID NO: 1212364 - DNA, 22 bp, Artificial Sequence
  chemically synthesized
gttttttatccttgcgatagtt

SEQ ID NO: 1212365 - DNA, 22 bp, Artificial Sequence
  chemically synthesized
tttatccttgcgatagtttgct

SEQ ID NO: 1212366 - DNA, 22 bp, Artificial Sequence
  chemically synthesized
ttatccttgcgatagtttgctg

SEQ ID NO: 1212367 - DNA, 22 bp, Artificial Sequence
  chemically synthesized
tatccttgcgatagtttgctga

SEQ ID NO: 1212368 - DNA, 22 bp, Artificial Sequence
  chemically synthesized
atccttgcgatagtttgctgag

SEQ ID NO: 1212369 - DNA, 22 bp, Artificial Sequence
  chemically synthesized
gaaaccatcattctcagcaaac

SEQ ID NO: 1212370 - DNA, 22 bp, Artificial Sequence
  chemically synthesized
tccttgcgatagtttgctgaga

SEQ ID NO: 1212371 - DNA, 22 bp, Artificial Sequence
  chemically synthesized
gcgatagtttgctgagaatgat

SEQ ID NO: 1212372 - DNA, 22 bp, Artificial Sequence
  chemically synthesized
cgatagtttgctgagaatgatg

SEQ ID NO: 1212373 - DNA, 22 bp, Artificial Sequence
  chemically synthesized
gctgagaatgatggtttccagc

SEQ ID NO: 1212374 - DNA, 22 bp, Artificial Sequence
  chemically synthesized
ctgagaatgatggtttccagct

SEQ ID NO: 1212375 - DNA, 22 bp, Artificial Sequence
  chemically synthesized
agaatgatggtttccagcttca

SEQ ID NO: 1212376 - DNA, 22 bp, Artificial Sequence
  chemically synthesized
tagggacatggatgaagctgga

SEQ ID NO: 1212377 - DNA, 22 bp, Artificial Sequence
  chemically synthesized
gtagggacatggatgaagctgg

SEQ ID NO: 1212378 - DNA, 22 bp, Artificial Sequence
  chemically synthesized
tgtagggacatggatgaagctg

SEQ ID NO: 1212379 - DNA, 22 bp, Artificial Sequence
  chemically synthesized
atgtcctttgtagggacatgga

SEQ ID NO: 1212380 - DNA, 22 bp, Artificial Sequence
  chemically synthesized
ccagcttcatccatgtccctac

SEQ ID NO: 1212381 - DNA, 22 bp, Artificial Sequence
  chemically synthesized
cagcttcatccatgtccctaca

SEQ ID NO: 1212382 - DNA, 22 bp, Artificial Sequence
  chemically synthesized
catccatgtccctacaaaggac

SEQ ID NO: 1212383 - DNA, 22 bp, Artificial Sequence
  chemically synthesized
atccatgtccctacaaaggaca

SEQ ID NO: 1212384 - DNA, 22 bp, Artificial Sequence
  chemically synthesized
caaaggacatgaactcatcctt

SEQ ID NO: 1212385 - DNA, 22 bp, Artificial Sequence
  chemically synthesized
atccttttttatggctgcatac

SEQ ID NO: 1212386 - DNA, 22 bp, Artificial Sequence
  chemically synthesized
ttttatggctgcatacggcctg

SEQ ID NO: 1212387 - DNA, 22 bp, Artificial Sequence
  chemically synthesized
tttatggctgcatacggcctgt

SEQ ID NO: 1212388 - DNA, 22 bp, Artificial Sequence
  chemically synthesized
ttatggctgcatacggcctgtg

SEQ ID NO: 1212389 - DNA, 22 bp, Artificial Sequence
  chemically synthesized
tatggctgcatacggcctgtgg

SEQ ID NO: 1212390 - DNA, 22 bp, Artificial Sequence
  chemically synthesized
atggctgcatacggcctgtggt

SEQ ID NO: 1212391 - DNA, 22 bp, Artificial Sequence
  chemically synthesized
tggctgcatacggcctgtggtg

SEQ ID NO: 1212392 - DNA, 22 bp, Artificial Sequence
  chemically synthesized
catacggcctgtggtggggtgg

SEQ ID NO: 1212393 - DNA, 22 bp, Artificial Sequence
  chemically synthesized
tggtggggtggggtggggtggg

SEQ ID NO: 1212394 - DNA, 22 bp, Artificial Sequence
  chemically synthesized
ccccatacccccaccccacccc

SEQ ID NO: 1212395 - DNA, 22 bp, Artificial Sequence
  chemically synthesized
tccctcccccatacccccaccc

SEQ ID NO: 1212396 - DNA, 22 bp, Artificial Sequence
  chemically synthesized
atgctatccctcccccataccc

SEQ ID NO: 1212397 - DNA, 22 bp, Artificial Sequence
  chemically synthesized
ctaatgctatccctcccccata

SEQ ID NO: 1212398 - DNA, 22 bp, Artificial Sequence
  chemically synthesized
ggtatatctcctaatgctatcc

SEQ ID NO: 1212399 - DNA, 22 bp, Artificial Sequence
  chemically synthesized
acattaggtatatctcctaatg

SEQ ID NO: 1212400 - DNA, 22 bp, Artificial Sequence
  chemically synthesized
aacattaggtatatctcctaat

SEQ ID NO: 1212401 - DNA, 22 bp, Artificial Sequence
  chemically synthesized
gtcatttaacattaggtatatc

SEQ ID NO: 1212402 - DNA, 22 bp, Artificial Sequence
  chemically synthesized
gctcgtcatttaacattaggta

SEQ ID NO: 1212403 - DNA, 22 bp, Artificial Sequence
  chemically synthesized
ggagatatacctaatgttaaat

SEQ ID NO: 1212404 - DNA, 22 bp, Artificial Sequence
  chemically synthesized
cacccattagctcgtcatttaa

SEQ ID NO: 1212405 - DNA, 22 bp, Artificial Sequence
  chemically synthesized
gtgtgctgcacccattagctcg

SEQ ID NO: 1212406 - DNA, 22 bp, Artificial Sequence
  chemically synthesized
atgttaaatgacgagctaatgg

SEQ ID NO: 1212407 - DNA, 22 bp, Artificial Sequence
  chemically synthesized
aatgacgagctaatgggtgcag

SEQ ID NO: 1212408 - DNA, 22 bp, Artificial Sequence
  chemically synthesized
atgggtgcagcacaccaacatg

SEQ ID NO: 1212409 - DNA, 22 bp, Artificial Sequence
  chemically synthesized
catatgtatacatgtgccatgt

SEQ ID NO: 1212410 - DNA, 22 bp, Artificial Sequence
  chemically synthesized
ttacatatgtatacatgtgcca

SEQ ID NO: 1212411 - DNA, 22 bp, Artificial Sequence
  chemically synthesized
gttacatatgtatacatgtgcc

SEQ ID NO: 1212412 - DNA, 22 bp, Artificial Sequence
  chemically synthesized
gggtacatgtgcataacgtgca

SEQ ID NO: 1212413 - DNA, 22 bp, Artificial Sequence
  chemically synthesized
agggtacatgtgcataacgtgc

SEQ ID NO: 1212414 - DNA, 22 bp, Artificial Sequence
  chemically synthesized
tagggtacatgtgcataacgtg

SEQ ID NO: 1212415 - DNA, 22 bp, Artificial Sequence
  chemically synthesized
ttagggtacatgtgcataacgt

SEQ ID NO: 1212416 - DNA, 22 bp, Artificial Sequence
  chemically synthesized
tacttttagggtacatgtgcat

SEQ ID NO: 1212417 - DNA, 22 bp, Artificial Sequence
  chemically synthesized
ttatacttttagggtacatgtg

SEQ ID NO: 1212418 - DNA, 22 bp, Artificial Sequence
  chemically synthesized
attatacttttagggtacatgt

SEQ ID NO: 1212419 - DNA, 22 bp, Artificial Sequence
  chemically synthesized
tattatacttttagggtacatg

SEQ ID NO: 1212420 - DNA, 22 bp, Artificial Sequence
  chemically synthesized
cacgttatgcacatgtacccta

SEQ ID NO: 1212421 - DNA, 22 bp, Artificial Sequence
  chemically synthesized
ttattatacttttagggtacat

SEQ ID NO: 1212422 - DNA, 22 bp, Artificial Sequence
  chemically synthesized
tttattatacttttagggtaca

SEQ ID NO: 1212423 - DNA, 22 bp, Artificial Sequence
  chemically synthesized
ttttattatacttttagggtac

SEQ ID NO: 1212424 - DNA, 22 bp, Artificial Sequence
  chemically synthesized
atttttttattatacttttagg

SEQ ID NO: 1212425 - DNA, 22 bp, Artificial Sequence
  chemically synthesized
tgcacatgtaccctaaaagtat

SEQ ID NO: 1212426 - DNA, 22 bp, Artificial Sequence
  chemically synthesized
gatttttttattatacttttag

SEQ ID NO: 1212427 - DNA, 22 bp, Artificial Sequence
  chemically synthesized
tgatttttttattatactttta

SEQ ID NO: 1212428 - DNA, 22 bp, Artificial Sequence
  chemically synthesized
ttgatttttttattatactttt

SEQ ID NO: 1212429 - DNA, 22 bp, Artificial Sequence
  chemically synthesized
tttgatttttttattatacttt

SEQ ID NO: 1212430 - DNA, 22 bp, Artificial Sequence
  chemically synthesized
ttttgatttttttattatactt

SEQ ID NO: 1212431 - DNA, 22 bp, Artificial Sequence
  chemically synthesized
tttttgatttttttattatact

SEQ ID NO: 1212432 - DNA, 22 bp, Artificial Sequence
  chemically synthesized
tttttttgatttttttattata

SEQ ID NO: 1212433 - DNA, 22 bp, Artificial Sequence
  chemically synthesized
ctttttttgatttttttattat

SEQ ID NO: 1212434 - DNA, 22 bp, Artificial Sequence
  chemically synthesized
tctttttttgatttttttatta

SEQ ID NO: 1212435 - DNA, 22 bp, Artificial Sequence
  chemically synthesized
ttctttttttgatttttttatt

SEQ ID NO: 1212436 - DNA, 22 bp, Artificial Sequence
  chemically synthesized
aaagtataataaaaaaatcaaa

SEQ ID NO: 1212437 - DNA, 22 bp, Artificial Sequence
  chemically synthesized
aaatttttctttttttgatttt

SEQ ID NO: 1212438 - DNA, 22 bp, Artificial Sequence
  chemically synthesized
aaaatttttctttttttgattt

SEQ ID NO: 1212439 - DNA, 22 bp, Artificial Sequence
  chemically synthesized
taaaatttttctttttttgatt

SEQ ID NO: 1212440 - DNA, 22 bp, Artificial Sequence
  chemically synthesized
aatagtaatctttaaaattttt

SEQ ID NO: 1212441 - DNA, 22 bp, Artificial Sequence
  chemically synthesized
gaatagtaatctttaaaatttt

SEQ ID NO: 1212442 - DNA, 22 bp, Artificial Sequence
  chemically synthesized
ccaagaatatcttgaatagtaa

SEQ ID NO: 1212443 - DNA, 22 bp, Artificial Sequence
  chemically synthesized
cccaagaatatcttgaatagta

SEQ ID NO: 1212444 - DNA, 22 bp, Artificial Sequence
  chemically synthesized
tcccaagaatatcttgaatagt

SEQ ID NO: 1212445 - DNA, 22 bp, Artificial Sequence
  chemically synthesized
taaagattactattcaagatat

SEQ ID NO: 1212446 - DNA, 22 bp, Artificial Sequence
  chemically synthesized
aaagattactattcaagatatt

SEQ ID NO: 1212447 - DNA, 22 bp, Artificial Sequence
  chemically synthesized
aagattactattcaagatattc

SEQ ID NO: 1212448 - DNA, 22 bp, Artificial Sequence
  chemically synthesized
aatattttcccaagaatatctt

SEQ ID NO: 1212449 - DNA, 22 bp, Artificial Sequence
  chemically synthesized
aaatattttcccaagaatatct

SEQ ID NO: 1212450 - DNA, 22 bp, Artificial Sequence
  chemically synthesized
ctattcaagatattcttgggaa

SEQ ID NO: 1212451 - DNA, 22 bp, Artificial Sequence
  chemically synthesized
taatttaaatattttcccaaga

SEQ ID NO: 1212452 - DNA, 22 bp, Artificial Sequence
  chemically synthesized
ttcaagatattcttgggaaaat

SEQ ID NO: 1212453 - DNA, 22 bp, Artificial Sequence
  chemically synthesized
ttataatttaaatattttccca

SEQ ID NO: 1212454 - DNA, 22 bp, Artificial Sequence
  chemically synthesized
aagatattcttgggaaaatatt

SEQ ID NO: 1212455 - DNA, 22 bp, Artificial Sequence
  chemically synthesized
ggattattataatttaaatatt

SEQ ID NO: 1212456 - DNA, 22 bp, Artificial Sequence
  chemically synthesized
ttgggaaaatatttaaattata

SEQ ID NO: 1212457 - DNA, 22 bp, Artificial Sequence
  chemically synthesized
aattgggattattataatttaa

SEQ ID NO: 1212458 - DNA, 22 bp, Artificial Sequence
  chemically synthesized
aaattgggattattataattta

SEQ ID NO: 1212459 - DNA, 22 bp, Artificial Sequence
  chemically synthesized
gggaaaatatttaaattataat

SEQ ID NO: 1212460 - DNA, 22 bp, Artificial Sequence
  chemically synthesized
ggaaaatatttaaattataata

SEQ ID NO: 1212461 - DNA, 22 bp, Artificial Sequence
  chemically synthesized
aagtataatttaaattgggatt

SEQ ID NO: 1212462 - DNA, 22 bp, Artificial Sequence
  chemically synthesized
aaattataataatcccaattta

SEQ ID NO: 1212463 - DNA, 22 bp, Artificial Sequence
  chemically synthesized
aattataataatcccaatttaa

SEQ ID NO: 1212464 - DNA, 22 bp, Artificial Sequence
  chemically synthesized
taataatcccaatttaaattat

SEQ ID NO: 1212465 - DNA, 22 bp, Artificial Sequence
  chemically synthesized
aaattatactttaattatgtgg

SEQ ID NO: 1212466 - DNA, 22 bp, Artificial Sequence
  chemically synthesized
aattatactttaattatgtggt

SEQ ID NO: 1212467 - DNA, 22 bp, Artificial Sequence
  chemically synthesized
aaatataaaatgaccacataat

SEQ ID NO: 1212468 - DNA, 22 bp, Artificial Sequence
  chemically synthesized
tactttaattatgtggtcattt

SEQ ID NO: 1212469 - DNA, 22 bp, Artificial Sequence
  chemically synthesized
taattatgtggtcattttatat

SEQ ID NO: 1212470 - DNA, 22 bp, Artificial Sequence
  chemically synthesized
aattatgtggtcattttatatt

SEQ ID NO: 1212471 - DNA, 22 bp, Artificial Sequence
  chemically synthesized
attatgtggtcattttatattt

SEQ ID NO: 1212472 - DNA, 22 bp, Artificial Sequence
  chemically synthesized
tgtggtcattttatattttaac

SEQ ID NO: 1212473 - DNA, 22 bp, Artificial Sequence
  chemically synthesized
tatgggagaagatacatgacaa

SEQ ID NO: 1212474 - DNA, 22 bp, Artificial Sequence
  chemically synthesized
tatattttaacttgtcatgtat

SEQ ID NO: 1212475 - DNA, 22 bp, Artificial Sequence
  chemically synthesized
gtatgggagaagatacatgaca

SEQ ID NO: 1212476 - DNA, 22 bp, Artificial Sequence
  chemically synthesized
atattttaacttgtcatgtatc

SEQ ID NO: 1212477 - DNA, 22 bp, Artificial Sequence
  chemically synthesized
tattttaacttgtcatgtatct

SEQ ID NO: 1212478 - DNA, 22 bp, Artificial Sequence
  chemically synthesized
taacttgtcatgtatcttctcc

SEQ ID NO: 1212479 - DNA, 22 bp, Artificial Sequence
  chemically synthesized
aacttgtcatgtatcttctccc

SEQ ID NO: 1212480 - DNA, 22 bp, Artificial Sequence
  chemically synthesized
acttgtcatgtatcttctccca

SEQ ID NO: 1212481 - DNA, 22 bp, Artificial Sequence
  chemically synthesized
tatcaggcttgtatgggagaag

SEQ ID NO: 1212482 - DNA, 22 bp, Artificial Sequence
  chemically synthesized
atatcaggcttgtatgggagaa

SEQ ID NO: 1212483 - DNA, 22 bp, Artificial Sequence
  chemically synthesized
gtcatgtatcttctcccataca

SEQ ID NO: 1212484 - DNA, 22 bp, Artificial Sequence
  chemically synthesized
tcatgtatcttctcccatacaa

SEQ ID NO: 1212485 - DNA, 22 bp, Artificial Sequence
  chemically synthesized
tgtaaaatttatatcaggcttg

SEQ ID NO: 1212486 - DNA, 22 bp, Artificial Sequence
  chemically synthesized
tatgtaaaatttatatcaggct

SEQ ID NO: 1212487 - DNA, 22 bp, Artificial Sequence
  chemically synthesized
ctatgtaaaatttatatcaggc

SEQ ID NO: 1212488 - DNA, 22 bp, Artificial Sequence
  chemically synthesized
ctcccatacaagcctgatataa

SEQ ID NO: 1212489 - DNA, 22 bp, Artificial Sequence
  chemically synthesized
tcccatacaagcctgatataaa

SEQ ID NO: 1212490 - DNA, 22 bp, Artificial Sequence
  chemically synthesized
ccatacaagcctgatataaatt

SEQ ID NO: 1212491 - DNA, 22 bp, Artificial Sequence
  chemically synthesized
atataaattttacatagaaatc

SEQ ID NO: 1212492 - DNA, 22 bp, Artificial Sequence
  chemically synthesized
tacatagaaatcatgatctgtg

SEQ ID NO: 1212493 - DNA, 22 bp, Artificial Sequence
  chemically synthesized
acatagaaatcatgatctgtgt

SEQ ID NO: 1212494 - DNA, 22 bp, Artificial Sequence
  chemically synthesized
catagaaatcatgatctgtgta

SEQ ID NO: 1212495 - DNA, 22 bp, Artificial Sequence
  chemically synthesized
tgaggggagaagtatatggata

SEQ ID NO: 1212496 - DNA, 22 bp, Artificial Sequence
  chemically synthesized
tgtatccatatacttctcccct

SEQ ID NO: 1212497 - DNA, 22 bp, Artificial Sequence
  chemically synthesized
catatcgggtaagtgtgtgtac

SEQ ID NO: 1212498 - DNA, 22 bp, Artificial Sequence
  chemically synthesized
ctcccctcatagtacacacact

SEQ ID NO: 1212499 - DNA, 22 bp, Artificial Sequence
  chemically synthesized
tcccctcatagtacacacactt

SEQ ID NO: 1212500 - DNA, 22 bp, Artificial Sequence
  chemically synthesized
ccctcatagtacacacacttac

SEQ ID NO: 1212501 - DNA, 22 bp, Artificial Sequence
  chemically synthesized
atagtacacacacttacccgat

SEQ ID NO: 1212502 - DNA, 22 bp, Artificial Sequence
  chemically synthesized
aagcaatacacactacatatcg

SEQ ID NO: 1212503 - DNA, 22 bp, Artificial Sequence
  chemically synthesized
acccgatatgtagtgtgtattg

SEQ ID NO: 1212504 - DNA, 22 bp, Artificial Sequence
  chemically synthesized
agtatgctaaagcaatacacac

SEQ ID NO: 1212505 - DNA, 22 bp, Artificial Sequence
  chemically synthesized
cccgatatgtagtgtgtattgc

SEQ ID NO: 1212506 - DNA, 22 bp, Artificial Sequence
  chemically synthesized
ttgagtatgctaaagcaataca

SEQ ID NO: 1212507 - DNA, 22 bp, Artificial Sequence
  chemically synthesized
attgagtatgctaaagcaatac

SEQ ID NO: 1212508 - DNA, 22 bp, Artificial Sequence
  chemically synthesized
tattgagtatgctaaagcaata

SEQ ID NO: 1212509 - DNA, 22 bp, Artificial Sequence
  chemically synthesized
aatggattttattgagtatgct

SEQ ID NO: 1212510 - DNA, 22 bp, Artificial Sequence
  chemically synthesized
tctcaatggattttattgagta

SEQ ID NO: 1212511 - DNA, 22 bp, Artificial Sequence
  chemically synthesized
gtctcaatggattttattgagt

SEQ ID NO: 1212512 - DNA, 22 bp, Artificial Sequence
  chemically synthesized
tgtctcaatggattttattgag

SEQ ID NO: 1212513 - DNA, 22 bp, Artificial Sequence
  chemically synthesized
ctttagcatactcaataaaatc

SEQ ID NO: 1212514 - DNA, 22 bp, Artificial Sequence
  chemically synthesized
tagcatactcaataaaatccat

SEQ ID NO: 1212515 - DNA, 22 bp, Artificial Sequence
  chemically synthesized
agcatactcaataaaatccatt

SEQ ID NO: 1212516 - DNA, 22 bp, Artificial Sequence
  chemically synthesized
gcatactcaataaaatccattg

SEQ ID NO: 1212517 - DNA, 22 bp, Artificial Sequence
  chemically synthesized
aataaaatccattgagacaaaa

SEQ ID NO: 1212518 - DNA, 22 bp, Artificial Sequence
  chemically synthesized
gaaacataaggcatattttgtc

SEQ ID NO: 1212519 - DNA, 22 bp, Artificial Sequence
  chemically synthesized
caattagaaacataaggcatat

SEQ ID NO: 1212520 - DNA, 22 bp, Artificial Sequence
  chemically synthesized
ttacaattagaaacataaggca

SEQ ID NO: 1212521 - DNA, 22 bp, Artificial Sequence
  chemically synthesized
agacaaaatatgccttatgttt

SEQ ID NO: 1212522 - DNA, 22 bp, Artificial Sequence
  chemically synthesized
actgttacaattagaaacataa

SEQ ID NO: 1212523 - DNA, 22 bp, Artificial Sequence
  chemically synthesized
atgtttctaattgtaacagtca

SEQ ID NO: 1212524 - DNA, 22 bp, Artificial Sequence
  chemically synthesized
tatggtaaaaattgactgttac

SEQ ID NO: 1212525 - DNA, 22 bp, Artificial Sequence
  chemically synthesized
tgtttctaattgtaacagtcaa

SEQ ID NO: 1212526 - DNA, 22 bp, Artificial Sequence
  chemically synthesized
atatggtaaaaattgactgtta

SEQ ID NO: 1212527 - DNA, 22 bp, Artificial Sequence
  chemically synthesized
ctaattgtaacagtcaattttt

SEQ ID NO: 1212528 - DNA, 22 bp, Artificial Sequence
  chemically synthesized
taattgtaacagtcaattttta

SEQ ID NO: 1212529 - DNA, 22 bp, Artificial Sequence
  chemically synthesized
gtaatttatatggtaaaaattg

SEQ ID NO: 1212530 - DNA, 22 bp, Artificial Sequence
  chemically synthesized
attgtaacagtcaatttttacc

SEQ ID NO: 1212531 - DNA, 22 bp, Artificial Sequence
  chemically synthesized
ggtaatttatatggtaaaaatt

SEQ ID NO: 1212532 - DNA, 22 bp, Artificial Sequence
  chemically synthesized
ttggtaatttatatggtaaaaa

SEQ ID NO: 1212533 - DNA, 22 bp, Artificial Sequence
  chemically synthesized
taacagtcaatttttaccatat

SEQ ID NO: 1212534 - DNA, 22 bp, Artificial Sequence
  chemically synthesized
gaaaaatcctcttggtaattta

SEQ ID NO: 1212535 - DNA, 22 bp, Artificial Sequence
  chemically synthesized
agaaaaatcctcttggtaattt

SEQ ID NO: 1212536 - DNA, 22 bp, Artificial Sequence
  chemically synthesized
tagaaaaatcctcttggtaatt

SEQ ID NO: 1212537 - DNA, 22 bp, Artificial Sequence
  chemically synthesized
ttaccatataaattaccaagag

SEQ ID NO: 1212538 - DNA, 22 bp, Artificial Sequence
  chemically synthesized
taccatataaattaccaagagg

SEQ ID NO: 1212539 - DNA, 22 bp, Artificial Sequence
  chemically synthesized
accatataaattaccaagagga

SEQ ID NO: 1212540 - DNA, 22 bp, Artificial Sequence
  chemically synthesized
ccatataaattaccaagaggat

SEQ ID NO: 1212541 - DNA, 22 bp, Artificial Sequence
  chemically synthesized
atcgtataattttagaaaaatc

SEQ ID NO: 1212542 - DNA, 22 bp, Artificial Sequence
  chemically synthesized
ccaagaggatttttctaaaatt

SEQ ID NO: 1212543 - DNA, 22 bp, Artificial Sequence
  chemically synthesized
cattcatcgtataattttagaa

SEQ ID NO: 1212544 - DNA, 22 bp, Artificial Sequence
  chemically synthesized
ctacattcatcgtataatttta

SEQ ID NO: 1212545 - DNA, 22 bp, Artificial Sequence
  chemically synthesized
tgtaattgctacattcatcgta

SEQ ID NO: 1212546 - DNA, 22 bp, Artificial Sequence
  chemically synthesized
ttctaaaattatacgatgaatg

SEQ ID NO: 1212547 - DNA, 22 bp, Artificial Sequence
  chemically synthesized
tctaaaattatacgatgaatgt

SEQ ID NO: 1212548 - DNA, 22 bp, Artificial Sequence
  chemically synthesized
ctaaaattatacgatgaatgta

SEQ ID NO: 1212549 - DNA, 22 bp, Artificial Sequence
  chemically synthesized
taaaattatacgatgaatgtag

SEQ ID NO: 1212550 - DNA, 22 bp, Artificial Sequence
  chemically synthesized
aaattatacgatgaatgtagca

SEQ ID NO: 1212551 - DNA, 22 bp, Artificial Sequence
  chemically synthesized
tagagagattgtgtaattgcta

SEQ ID NO: 1212552 - DNA, 22 bp, Artificial Sequence
  chemically synthesized
tacgatgaatgtagcaattaca

SEQ ID NO: 1212553 - DNA, 22 bp, Artificial Sequence
  chemically synthesized
catgtatggtacaaaagttgta

SEQ ID NO: 1212554 - DNA, 22 bp, Artificial Sequence
  chemically synthesized
cacaatctctctacaacttttg

SEQ ID NO: 1212555 - DNA, 22 bp, Artificial Sequence
  chemically synthesized
tctacaacttttgtaccataca

SEQ ID NO: 1212556 - DNA, 22 bp, Artificial Sequence
  chemically synthesized
gtatagaattccatgtatggta

SEQ ID NO: 1212557 - DNA, 22 bp, Artificial Sequence
  chemically synthesized
tacaacttttgtaccatacatg

SEQ ID NO: 1212558 - DNA, 22 bp, Artificial Sequence
  chemically synthesized
tagtatagaattccatgtatgg

SEQ ID NO: 1212559 - DNA, 22 bp, Artificial Sequence
  chemically synthesized
caacttttgtaccatacatgga

SEQ ID NO: 1212560 - DNA, 22 bp, Artificial Sequence
  chemically synthesized
ctagtatagaattccatgtatg

SEQ ID NO: 1212561 - DNA, 22 bp, Artificial Sequence
  chemically synthesized
ttgtaccatacatggaattcta

SEQ ID NO: 1212562 - DNA, 22 bp, Artificial Sequence
  chemically synthesized
tgtaccatacatggaattctat

SEQ ID NO: 1212563 - DNA, 22 bp, Artificial Sequence
  chemically synthesized
gtaccatacatggaattctata

SEQ ID NO: 1212564 - DNA, 22 bp, Artificial Sequence
  chemically synthesized
taccatacatggaattctatac

SEQ ID NO: 1212565 - DNA, 22 bp, Artificial Sequence
  chemically synthesized
tcgggcataagaatgtcggctt

SEQ ID NO: 1212566 - DNA, 22 bp, Artificial Sequence
  chemically synthesized
tgtcgggcataagaatgtcggc

SEQ ID NO: 1212567 - DNA, 22 bp, Artificial Sequence
  chemically synthesized
tatactagaagccgacattctt

SEQ ID NO: 1212568 - DNA, 22 bp, Artificial Sequence
  chemically synthesized
tactagaagccgacattcttat

SEQ ID NO: 1212569 - DNA, 22 bp, Artificial Sequence
  chemically synthesized
aatagttctgtcgggcataaga

SEQ ID NO: 1212570 - DNA, 22 bp, Artificial Sequence
  chemically synthesized
gaagccgacattcttatgcccg

SEQ ID NO: 1212571 - DNA, 22 bp, Artificial Sequence
  chemically synthesized
ataaaatgaactaaatagttct

SEQ ID NO: 1212572 - DNA, 22 bp, Artificial Sequence
  chemically synthesized
ttatgcccgacagaactattta

SEQ ID NO: 1212573 - DNA, 22 bp, Artificial Sequence
  chemically synthesized
atgcccgacagaactatttagt

SEQ ID NO: 1212574 - DNA, 22 bp, Artificial Sequence
  chemically synthesized
tgcccgacagaactatttagtt

SEQ ID NO: 1212575 - DNA, 22 bp, Artificial Sequence
  chemically synthesized
aatagcacgtctcataaaatga

SEQ ID NO: 1212576 - DNA, 22 bp, Artificial Sequence
  chemically synthesized
tttagttcattttatgagacgt

SEQ ID NO: 1212577 - DNA, 22 bp, Artificial Sequence
  chemically synthesized
aaactcaatagcacgtctcata

SEQ ID NO: 1212578 - DNA, 22 bp, Artificial Sequence
  chemically synthesized
agttcattttatgagacgtgct

SEQ ID NO: 1212579 - DNA, 22 bp, Artificial Sequence
  chemically synthesized
gttcattttatgagacgtgcta

SEQ ID NO: 1212580 - DNA, 22 bp, Artificial Sequence
  chemically synthesized
tctaaaactcaatagcacgtct

SEQ ID NO: 1212581 - DNA, 22 bp, Artificial Sequence
  chemically synthesized
atctaaaactcaatagcacgtc

SEQ ID NO: 1212582 - DNA, 22 bp, Artificial Sequence
  chemically synthesized
tatctaaaactcaatagcacgt

SEQ ID NO: 1212583 - DNA, 22 bp, Artificial Sequence
  chemically synthesized
attttatgagacgtgctattga

SEQ ID NO: 1212584 - DNA, 22 bp, Artificial Sequence
  chemically synthesized
tatgagacgtgctattgagttt

SEQ ID NO: 1212585 - DNA, 22 bp, Artificial Sequence
  chemically synthesized
aaactttatctaaaactcaata

SEQ ID NO: 1212586 - DNA, 22 bp, Artificial Sequence
  chemically synthesized
atgagacgtgctattgagtttt

SEQ ID NO: 1212587 - DNA, 22 bp, Artificial Sequence
  chemically synthesized
caaactttatctaaaactcaat

SEQ ID NO: 1212588 - DNA, 22 bp, Artificial Sequence
  chemically synthesized
tgagacgtgctattgagtttta

SEQ ID NO: 1212589 - DNA, 22 bp, Artificial Sequence
  chemically synthesized
taaaatttcaaactttatctaa

SEQ ID NO: 1212590 - DNA, 22 bp, Artificial Sequence
  chemically synthesized
ttataaaatttcaaactttatc

SEQ ID NO: 1212591 - DNA, 22 bp, Artificial Sequence
  chemically synthesized
ttgagttttagataaagtttga

SEQ ID NO: 1212592 - DNA, 22 bp, Artificial Sequence
  chemically synthesized
agttttagataaagtttgaaat

SEQ ID NO: 1212593 - DNA, 22 bp, Artificial Sequence
  chemically synthesized
tagataaagtttgaaattttat

SEQ ID NO: 1212594 - DNA, 22 bp, Artificial Sequence
  chemically synthesized
agataaagtttgaaattttata

SEQ ID NO: 1212595 - DNA, 22 bp, Artificial Sequence
  chemically synthesized
gataaagtttgaaattttataa

SEQ ID NO: 1212596 - DNA, 22 bp, Artificial Sequence
  chemically synthesized
cagaataagctgttataaaatt

SEQ ID NO: 1212597 - DNA, 22 bp, Artificial Sequence
  chemically synthesized
acagaataagctgttataaaat

SEQ ID NO: 1212598 - DNA, 22 bp, Artificial Sequence
  chemically synthesized
ttacagaataagctgttataaa

SEQ ID NO: 1212599 - DNA, 22 bp, Artificial Sequence
  chemically synthesized
gaaattttataacagcttattc

SEQ ID NO: 1212600 - DNA, 22 bp, Artificial Sequence
  chemically synthesized
aaattttataacagcttattct

SEQ ID NO: 1212601 - DNA, 22 bp, Artificial Sequence
  chemically synthesized
tatgcattcttacagaataagc

SEQ ID NO: 1212602 - DNA, 22 bp, Artificial Sequence
  chemically synthesized
tataacagcttattctgtaaga

SEQ ID NO: 1212603 - DNA, 22 bp, Artificial Sequence
  chemically synthesized
ataacagcttattctgtaagaa

SEQ ID NO: 1212604 - DNA, 22 bp, Artificial Sequence
  chemically synthesized
taacagcttattctgtaagaat

SEQ ID NO: 1212605 - DNA, 22 bp, Artificial Sequence
  chemically synthesized
ataattgtatgcattcttacag

SEQ ID NO: 1212606 - DNA, 22 bp, Artificial Sequence
  chemically synthesized
attctgtaagaatgcatacaat

SEQ ID NO: 1212607 - DNA, 22 bp, Artificial Sequence
  chemically synthesized
ttctgtaagaatgcatacaatt

SEQ ID NO: 1212608 - DNA, 22 bp, Artificial Sequence
  chemically synthesized
ccaaggtaattgataattgtat

SEQ ID NO: 1212609 - DNA, 22 bp, Artificial Sequence
  chemically synthesized
tgtaagaatgcatacaattatc

SEQ ID NO: 1212610 - DNA, 22 bp, Artificial Sequence
  chemically synthesized
taagaatgcatacaattatcaa

SEQ ID NO: 1212611 - DNA, 22 bp, Artificial Sequence
  chemically synthesized
ttcccaaggtaattgataattg

SEQ ID NO: 1212612 - DNA, 22 bp, Artificial Sequence
  chemically synthesized
attcccaaggtaattgataatt

SEQ ID NO: 1212613 - DNA, 22 bp, Artificial Sequence
  chemically synthesized
tcaattaccttgggaataaatt

SEQ ID NO: 1212614 - DNA, 22 bp, Artificial Sequence
  chemically synthesized
agaaatatgtaaaacaatttat

SEQ ID NO: 1212615 - DNA, 22 bp, Artificial Sequence
  chemically synthesized
tcagaaatatgtaaaacaattt

SEQ ID NO: 1212616 - DNA, 22 bp, Artificial Sequence
  chemically synthesized
ccttgggaataaattgttttac

SEQ ID NO: 1212617 - DNA, 22 bp, Artificial Sequence
  chemically synthesized
gggaataaattgttttacatat

SEQ ID NO: 1212618 - DNA, 22 bp, Artificial Sequence
  chemically synthesized
ggaataaattgttttacatatt

SEQ ID NO: 1212619 - DNA, 22 bp, Artificial Sequence
  chemically synthesized
cagaaggttctcagaaatatgt

SEQ ID NO: 1212620 - DNA, 22 bp, Artificial Sequence
  chemically synthesized
ttttacatatttctgagaacct

SEQ ID NO: 1212621 - DNA, 22 bp, Artificial Sequence
  chemically synthesized
tacatatttctgagaaccttct

SEQ ID NO: 1212622 - DNA, 22 bp, Artificial Sequence
  chemically synthesized
acatatttctgagaaccttctg

SEQ ID NO: 1212623 - DNA, 22 bp, Artificial Sequence
  chemically synthesized
catatttctgagaaccttctgc

SEQ ID NO: 1212624 - DNA, 22 bp, Artificial Sequence
  chemically synthesized
atatacaagaagctgcagaagg

SEQ ID NO: 1212625 - DNA, 22 bp, Artificial Sequence
  chemically synthesized
gatatacaagaagctgcagaag

SEQ ID NO: 1212626 - DNA, 22 bp, Artificial Sequence
  chemically synthesized
ctgagaaccttctgcagcttct

SEQ ID NO: 1212627 - DNA, 22 bp, Artificial Sequence
  chemically synthesized
tgagaaccttctgcagcttctt

SEQ ID NO: 1212628 - DNA, 22 bp, Artificial Sequence
  chemically synthesized
tggtttgatatacaagaagctg

SEQ ID NO: 1212629 - DNA, 22 bp, Artificial Sequence
  chemically synthesized
agaaccttctgcagcttcttgt

SEQ ID NO: 1212630 - DNA, 22 bp, Artificial Sequence
  chemically synthesized
ctgcagcttcttgtatatcaaa

SEQ ID NO: 1212631 - DNA, 22 bp, Artificial Sequence
  chemically synthesized
tgcagcttcttgtatatcaaac

SEQ ID NO: 1212632 - DNA, 22 bp, Artificial Sequence
  chemically synthesized
cagcttcttgtatatcaaacca

SEQ ID NO: 1212633 - DNA, 22 bp, Artificial Sequence
  chemically synthesized
aaacatatacctgtggtttgat

SEQ ID NO: 1212634 - DNA, 22 bp, Artificial Sequence
  chemically synthesized
cttgtatatcaaaccacaggta

SEQ ID NO: 1212635 - DNA, 22 bp, Artificial Sequence
  chemically synthesized
tgctaaaacatatacctgtggt

SEQ ID NO: 1212636 - DNA, 22 bp, Artificial Sequence
  chemically synthesized
ttgtatatcaaaccacaggtat

SEQ ID NO: 1212637 - DNA, 22 bp, Artificial Sequence
  chemically synthesized
gtatatcaaaccacaggtatat

SEQ ID NO: 1212638 - DNA, 22 bp, Artificial Sequence
  chemically synthesized
tatatcaaaccacaggtatatg

SEQ ID NO: 1212639 - DNA, 22 bp, Artificial Sequence
  chemically synthesized
actatgctaaaacatatacctg

SEQ ID NO: 1212640 - DNA, 22 bp, Artificial Sequence
  chemically synthesized
aaaaaatattaactatgctaaa

SEQ ID NO: 1212641 - DNA, 22 bp, Artificial Sequence
  chemically synthesized
caaaaaatattaactatgctaa

SEQ ID NO: 1212642 - DNA, 22 bp, Artificial Sequence
  chemically synthesized
tagcatagttaatattttttga

SEQ ID NO: 1212643 - DNA, 22 bp, Artificial Sequence
  chemically synthesized
agcatagttaatattttttgaa

SEQ ID NO: 1212644 - DNA, 22 bp, Artificial Sequence
  chemically synthesized
gcatagttaatattttttgaaa

SEQ ID NO: 1212645 - DNA, 22 bp, Artificial Sequence
  chemically synthesized
atattttttgaaattaccttca

SEQ ID NO: 1212646 - DNA, 22 bp, Artificial Sequence
  chemically synthesized
aataaaataacagtggtgaagg

SEQ ID NO: 1212647 - DNA, 22 bp, Artificial Sequence
  chemically synthesized
aaataaaataacagtggtgaag

SEQ ID NO: 1212648 - DNA, 22 bp, Artificial Sequence
  chemically synthesized
tttgaaattaccttcaccactg

SEQ ID NO: 1212649 - DNA, 22 bp, Artificial Sequence
  chemically synthesized
ttgaaattaccttcaccactgt

SEQ ID NO: 1212650 - DNA, 22 bp, Artificial Sequence
  chemically synthesized
tgaaattaccttcaccactgtt

SEQ ID NO: 1212651 - DNA, 22 bp, Artificial Sequence
  chemically synthesized
tttaaataaaataacagtggtg

SEQ ID NO: 1212652 - DNA, 22 bp, Artificial Sequence
  chemically synthesized
gaaattaccttcaccactgtta

SEQ ID NO: 1212653 - DNA, 22 bp, Artificial Sequence
  chemically synthesized
atttaaataaaataacagtggt

SEQ ID NO: 1212654 - DNA, 22 bp, Artificial Sequence
  chemically synthesized
aaattaccttcaccactgttat

SEQ ID NO: 1212655 - DNA, 22 bp, Artificial Sequence
  chemically synthesized
tatttaaataaaataacagtgg

SEQ ID NO: 1212656 - DNA, 22 bp, Artificial Sequence
  chemically synthesized
cctttatttaaataaaataaca

SEQ ID NO: 1212657 - DNA, 22 bp, Artificial Sequence
  chemically synthesized
ccttcaccactgttattttatt

SEQ ID NO: 1212658 - DNA, 22 bp, Artificial Sequence
  chemically synthesized
attacctttatttaaataaaat

SEQ ID NO: 1212659 - DNA, 22 bp, Artificial Sequence
  chemically synthesized
caccactgttattttatttaaa

SEQ ID NO: 1212660 - DNA, 22 bp, Artificial Sequence
  chemically synthesized
accactgttattttatttaaat

SEQ ID NO: 1212661 - DNA, 22 bp, Artificial Sequence
  chemically synthesized
ctgattacctttatttaaataa

SEQ ID NO: 1212662 - DNA, 22 bp, Artificial Sequence
  chemically synthesized
cctgattacctttatttaaata

SEQ ID NO: 1212663 - DNA, 22 bp, Artificial Sequence
  chemically synthesized
ttattttatttaaataaaggta

SEQ ID NO: 1212664 - DNA, 22 bp, Artificial Sequence
  chemically synthesized
ttttatttaaataaaggtaatc

SEQ ID NO: 1212665 - DNA, 22 bp, Artificial Sequence
  chemically synthesized
tatttaaataaaggtaatcagg

SEQ ID NO: 1212666 - DNA, 22 bp, Artificial Sequence
  chemically synthesized
aagaaaggccttcctgattacc

SEQ ID NO: 1212667 - DNA, 22 bp, Artificial Sequence
  chemically synthesized
atttaaataaaggtaatcagga

SEQ ID NO: 1212668 - DNA, 22 bp, Artificial Sequence
  chemically synthesized
tttaaataaaggtaatcaggaa

SEQ ID NO: 1212669 - DNA, 22 bp, Artificial Sequence
  chemically synthesized
aaataaaggtaatcaggaaggc

SEQ ID NO: 1212670 - DNA, 22 bp, Artificial Sequence
  chemically synthesized
agctgaagaaaggccttcctga

SEQ ID NO: 1212671 - DNA, 22 bp, Artificial Sequence
  chemically synthesized
aataaaggtaatcaggaaggcc

SEQ ID NO: 1212672 - DNA, 22 bp, Artificial Sequence
  chemically synthesized
tctaagctgaagaaaggccttc

SEQ ID NO: 1212673 - DNA, 22 bp, Artificial Sequence
  chemically synthesized
ttgtctaagctgaagaaaggcc

SEQ ID NO: 1212674 - DNA, 22 bp, Artificial Sequence
  chemically synthesized
gttgtctaagctgaagaaaggc

SEQ ID NO: 1212675 - DNA, 22 bp, Artificial Sequence
  chemically synthesized
tgttgtctaagctgaagaaagg

SEQ ID NO: 1212676 - DNA, 22 bp, Artificial Sequence
  chemically synthesized
ctttgttgtctaagctgaagaa

SEQ ID NO: 1212677 - DNA, 22 bp, Artificial Sequence
  chemically synthesized
gctactttgttgtctaagctga

SEQ ID NO: 1212678 - DNA, 22 bp, Artificial Sequence
  chemically synthesized
ctggctactttgttgtctaagc

SEQ ID NO: 1212679 - DNA, 22 bp, Artificial Sequence
  chemically synthesized
actggctactttgttgtctaag

SEQ ID NO: 1212680 - DNA, 22 bp, Artificial Sequence
  chemically synthesized
tcttcagcttagacaacaaagt

SEQ ID NO: 1212681 - DNA, 22 bp, Artificial Sequence
  chemically synthesized
atcttactggctactttgttgt

SEQ ID NO: 1212682 - DNA, 22 bp, Artificial Sequence
  chemically synthesized
cttcagcttagacaacaaagta

SEQ ID NO: 1212683 - DNA, 22 bp, Artificial Sequence
  chemically synthesized
gatcttactggctactttgttg

SEQ ID NO: 1212684 - DNA, 22 bp, Artificial Sequence
  chemically synthesized
ttcagcttagacaacaaagtag

SEQ ID NO: 1212685 - DNA, 22 bp, Artificial Sequence
  chemically synthesized
cagcttagacaacaaagtagcc

SEQ ID NO: 1212686 - DNA, 22 bp, Artificial Sequence
  chemically synthesized
cttgatcttactggctactttg

SEQ ID NO: 1212687 - DNA, 22 bp, Artificial Sequence
  chemically synthesized
agcttagacaacaaagtagcca

SEQ ID NO: 1212688 - DNA, 22 bp, Artificial Sequence
  chemically synthesized
ccttgatcttactggctacttt

SEQ ID NO: 1212689 - DNA, 22 bp, Artificial Sequence
  chemically synthesized
tccttgatcttactggctactt

SEQ ID NO: 1212690 - DNA, 22 bp, Artificial Sequence
  chemically synthesized
agacaacaaagtagccagtaag

SEQ ID NO: 1212691 - DNA, 22 bp, Artificial Sequence
  chemically synthesized
gacaacaaagtagccagtaaga

SEQ ID NO: 1212692 - DNA, 22 bp, Artificial Sequence
  chemically synthesized
atattttccttgatcttactgg

SEQ ID NO: 1212693 - DNA, 22 bp, Artificial Sequence
  chemically synthesized
cctaatattttccttgatctta

SEQ ID NO: 1212694 - DNA, 22 bp, Artificial Sequence
  chemically synthesized
acctaatattttccttgatctt

SEQ ID NO: 1212695 - DNA, 22 bp, Artificial Sequence
  chemically synthesized
tacctaatattttccttgatct

SEQ ID NO: 1212696 - DNA, 22 bp, Artificial Sequence
  chemically synthesized
ggttttacctaatattttcctt

SEQ ID NO: 1212697 - DNA, 22 bp, Artificial Sequence
  chemically synthesized
gggttttacctaatattttcct

SEQ ID NO: 1212698 - DNA, 22 bp, Artificial Sequence
  chemically synthesized
tatttgggttttacctaatatt

SEQ ID NO: 1212699 - DNA, 22 bp, Artificial Sequence
  chemically synthesized
aagttgtatttgggttttacct

SEQ ID NO: 1212700 - DNA, 22 bp, Artificial Sequence
  chemically synthesized
ggtaaaacccaaatacaacttc

SEQ ID NO: 1212701 - DNA, 22 bp, Artificial Sequence
  chemically synthesized
acaagcaatgaaatggtcagta

SEQ ID NO: 1212702 - DNA, 22 bp, Artificial Sequence
  chemically synthesized
caatacttggatactgaccatt

SEQ ID NO: 1212703 - DNA, 22 bp, Artificial Sequence
  chemically synthesized
aatacttggatactgaccattt

SEQ ID NO: 1212704 - DNA, 22 bp, Artificial Sequence
  chemically synthesized
acattaacaagcaatgaaatgg

SEQ ID NO: 1212705 - DNA, 22 bp, Artificial Sequence
  chemically synthesized
ggatactgaccatttcattgct

SEQ ID NO: 1212706 - DNA, 22 bp, Artificial Sequence
  chemically synthesized
gatactgaccatttcattgctt

SEQ ID NO: 1212707 - DNA, 22 bp, Artificial Sequence
  chemically synthesized
accatttcattgcttgttaatg

SEQ ID NO: 1212708 - DNA, 22 bp, Artificial Sequence
  chemically synthesized
atccaaggaattaacattaaca

SEQ ID NO: 1212709 - DNA, 22 bp, Artificial Sequence
  chemically synthesized
attaatccaaggaattaacatt

SEQ ID NO: 1212710 - DNA, 22 bp, Artificial Sequence
  chemically synthesized
cattgcttgttaatgttaattc

SEQ ID NO: 1212711 - DNA, 22 bp, Artificial Sequence
  chemically synthesized
attgcttgttaatgttaattcc

SEQ ID NO: 1212712 - DNA, 22 bp, Artificial Sequence
  chemically synthesized
actgattaatccaaggaattaa

SEQ ID NO: 1212713 - DNA, 22 bp, Artificial Sequence
  chemically synthesized
cttgttaatgttaattccttgg

SEQ ID NO: 1212714 - DNA, 22 bp, Artificial Sequence
  chemically synthesized
gttaatgttaattccttggatt

SEQ ID NO: 1212715 - DNA, 22 bp, Artificial Sequence
  chemically synthesized
aattaactgattaatccaagga

SEQ ID NO: 1212716 - DNA, 22 bp, Artificial Sequence
  chemically synthesized
ttaatgttaattccttggatta

SEQ ID NO: 1212717 - DNA, 22 bp, Artificial Sequence
  chemically synthesized
atgttaattccttggattaatc

SEQ ID NO: 1212718 - DNA, 22 bp, Artificial Sequence
  chemically synthesized
atagattaaattaactgattaa

SEQ ID NO: 1212719 - DNA, 22 bp, Artificial Sequence
  chemically synthesized
attccttggattaatcagttaa

SEQ ID NO: 1212720 - DNA, 22 bp, Artificial Sequence
  chemically synthesized
cttggattaatcagttaattta

SEQ ID NO: 1212721 - DNA, 22 bp, Artificial Sequence
  chemically synthesized
tcaagctgatagattaaattaa

SEQ ID NO: 1212722 - DNA, 22 bp, Artificial Sequence
  chemically synthesized
ggattaatcagttaatttaatc

SEQ ID NO: 1212723 - DNA, 22 bp, Artificial Sequence
  chemically synthesized
gattaatcagttaatttaatct

SEQ ID NO: 1212724 - DNA, 22 bp, Artificial Sequence
  chemically synthesized
atcagttaatttaatctatcag

SEQ ID NO: 1212725 - DNA, 22 bp, Artificial Sequence
  chemically synthesized
atcagatacgttatcaagctga

SEQ ID NO: 1212726 - DNA, 22 bp, Artificial Sequence
  chemically synthesized
atttaatctatcagcttgataa

SEQ ID NO: 1212727 - DNA, 22 bp, Artificial Sequence
  chemically synthesized
tgatcagatacgttatcaagct

SEQ ID NO: 1212728 - DNA, 22 bp, Artificial Sequence
  chemically synthesized
aatctatcagcttgataacgta

SEQ ID NO: 1212729 - DNA, 22 bp, Artificial Sequence
  chemically synthesized
atctatcagcttgataacgtat

SEQ ID NO: 1212730 - DNA, 22 bp, Artificial Sequence
  chemically synthesized
aagttctgatcagatacgttat

SEQ ID NO: 1212731 - DNA, 22 bp, Artificial Sequence
  chemically synthesized
aaagttctgatcagatacgtta

SEQ ID NO: 1212732 - DNA, 22 bp, Artificial Sequence
  chemically synthesized
taaagttctgatcagatacgtt

SEQ ID NO: 1212733 - DNA, 22 bp, Artificial Sequence
  chemically synthesized
tcagcttgataacgtatctgat

SEQ ID NO: 1212734 - DNA, 22 bp, Artificial Sequence
  chemically synthesized
ggattttaaagttctgatcaga

SEQ ID NO: 1212735 - DNA, 22 bp, Artificial Sequence
  chemically synthesized
gataacgtatctgatcagaact

SEQ ID NO: 1212736 - DNA, 22 bp, Artificial Sequence
  chemically synthesized
ataacgtatctgatcagaactt

SEQ ID NO: 1212737 - DNA, 22 bp, Artificial Sequence
  chemically synthesized
atcagaactttaaaatcctaac

SEQ ID NO: 1212738 - DNA, 22 bp, Artificial Sequence
  chemically synthesized
atatgtgtgaagaccagttagg

SEQ ID NO: 1212739 - DNA, 22 bp, Artificial Sequence
  chemically synthesized
taaaatcctaactggtcttcac

SEQ ID NO: 1212740 - DNA, 22 bp, Artificial Sequence
  chemically synthesized
aaaatcctaactggtcttcaca

SEQ ID NO: 1212741 - DNA, 22 bp, Artificial Sequence
  chemically synthesized
aaatcctaactggtcttcacac

SEQ ID NO: 1212742 - DNA, 22 bp, Artificial Sequence
  chemically synthesized
actggtcttcacacatattaat

SEQ ID NO: 1212743 - DNA, 22 bp, Artificial Sequence
  chemically synthesized
gtcttcacacatattaatgacc

SEQ ID NO: 1212744 - DNA, 22 bp, Artificial Sequence
  chemically synthesized
catgaaagtgtgagggtcatta

SEQ ID NO: 1212745 - DNA, 22 bp, Artificial Sequence
  chemically synthesized
cacacatattaatgaccctcac

SEQ ID NO: 1212746 - DNA, 22 bp, Artificial Sequence
  chemically synthesized
acacatattaatgaccctcaca

SEQ ID NO: 1212747 - DNA, 22 bp, Artificial Sequence
  chemically synthesized
gcatattacatgaaagtgtgag

SEQ ID NO: 1212748 - DNA, 22 bp, Artificial Sequence
  chemically synthesized
cattagcatattacatgaaagt

SEQ ID NO: 1212749 - DNA, 22 bp, Artificial Sequence
  chemically synthesized
atgaccctcacactttcatgta

SEQ ID NO: 1212750 - DNA, 22 bp, Artificial Sequence
  chemically synthesized
acattagcatattacatgaaag

SEQ ID NO: 1212751 - DNA, 22 bp, Artificial Sequence
  chemically synthesized
tacattagcatattacatgaaa

SEQ ID NO: 1212752 - DNA, 22 bp, Artificial Sequence
  chemically synthesized
ttacattagcatattacatgaa

SEQ ID NO: 1212753 - DNA, 22 bp, Artificial Sequence
  chemically synthesized
acactttcatgtaatatgctaa

SEQ ID NO: 1212754 - DNA, 22 bp, Artificial Sequence
  chemically synthesized
aagacacggcttttacattagc

SEQ ID NO: 1212755 - DNA, 22 bp, Artificial Sequence
  chemically synthesized
tcatgtaatatgctaatgtaaa

SEQ ID NO: 1212756 - DNA, 22 bp, Artificial Sequence
  chemically synthesized
gaagacacggcttttacattag

SEQ ID NO: 1212757 - DNA, 22 bp, Artificial Sequence
  chemically synthesized
catgtaatatgctaatgtaaaa

SEQ ID NO: 1212758 - DNA, 22 bp, Artificial Sequence
  chemically synthesized
atgtaatatgctaatgtaaaag

SEQ ID NO: 1212759 - DNA, 22 bp, Artificial Sequence
  chemically synthesized
ttgaagacacggcttttacatt

SEQ ID NO: 1212760 - DNA, 22 bp, Artificial Sequence
  chemically synthesized
cttgaagacacggcttttacat

SEQ ID NO: 1212761 - DNA, 22 bp, Artificial Sequence
  chemically synthesized
atgtaaaagccgtgtcttcaag

SEQ ID NO: 1212762 - DNA, 22 bp, Artificial Sequence
  chemically synthesized
atgtacaacaaatgtttcttga

SEQ ID NO: 1212763 - DNA, 22 bp, Artificial Sequence
  chemically synthesized
aatgtacaacaaatgtttcttg

SEQ ID NO: 1212764 - DNA, 22 bp, Artificial Sequence
  chemically synthesized
taatgtacaacaaatgtttctt

SEQ ID NO: 1212765 - DNA, 22 bp, Artificial Sequence
  chemically synthesized
ttaatgtacaacaaatgtttct

SEQ ID NO: 1212766 - DNA, 22 bp, Artificial Sequence
  chemically synthesized
tttaatgtacaacaaatgtttc

SEQ ID NO: 1212767 - DNA, 22 bp, Artificial Sequence
  chemically synthesized
ttttttaatgtacaacaaatgt

SEQ ID NO: 1212768 - DNA, 22 bp, Artificial Sequence
  chemically synthesized
caagaaacatttgttgtacatt

SEQ ID NO: 1212769 - DNA, 22 bp, Artificial Sequence
  chemically synthesized
aagaaacatttgttgtacatta

SEQ ID NO: 1212770 - DNA, 22 bp, Artificial Sequence
  chemically synthesized
aaagtgcgagtgcctgtttttt

SEQ ID NO: 1212771 - DNA, 22 bp, Artificial Sequence
  chemically synthesized
gttgtacattaaaaaacaggca

SEQ ID NO: 1212772 - DNA, 22 bp, Artificial Sequence
  chemically synthesized
tgaaagtgcgagtgcctgtttt

SEQ ID NO: 1212773 - DNA, 22 bp, Artificial Sequence
  chemically synthesized
ttgtacattaaaaaacaggcac

SEQ ID NO: 1212774 - DNA, 22 bp, Artificial Sequence
  chemically synthesized
tacattaaaaaacaggcactcg

SEQ ID NO: 1212775 - DNA, 22 bp, Artificial Sequence
  chemically synthesized
ggcctctgaaagtgcgagtgcc

SEQ ID NO: 1212776 - DNA, 22 bp, Artificial Sequence
  chemically synthesized
aaaaacaggcactcgcactttc

SEQ ID NO: 1212777 - DNA, 22 bp, Artificial Sequence
  chemically synthesized
cccgcctcggcctctgaaagtg

SEQ ID NO: 1212778 - DNA, 22 bp, Artificial Sequence
  chemically synthesized
gtgatctgcccgcctcggcctc

SEQ ID NO: 1212779 - DNA, 22 bp, Artificial Sequence
  chemically synthesized
gcactttcagaggccgaggcgg

SEQ ID NO: 1212780 - DNA, 22 bp, Artificial Sequence
  chemically synthesized
acctcgtgatctgcccgcctcg

SEQ ID NO: 1212781 - DNA, 22 bp, Artificial Sequence
  chemically synthesized
ctgacctcgtgatctgcccgcc

SEQ ID NO: 1212782 - DNA, 22 bp, Artificial Sequence
  chemically synthesized
tcagaggccgaggcgggcagat

SEQ ID NO: 1212783 - DNA, 22 bp, Artificial Sequence
  chemically synthesized
cagaggccgaggcgggcagatc

SEQ ID NO: 1212784 - DNA, 22 bp, Artificial Sequence
  chemically synthesized
agaggccgaggcgggcagatca

SEQ ID NO: 1212785 - DNA, 22 bp, Artificial Sequence
  chemically synthesized
gatctcctgacctcgtgatctg

SEQ ID NO: 1212786 - DNA, 22 bp, Artificial Sequence
  chemically synthesized
gccaggatggtctcgatctcct

SEQ ID NO: 1212787 - DNA, 22 bp, Artificial Sequence
  chemically synthesized
tgttagccaggatggtctcgat

SEQ ID NO: 1212788 - DNA, 22 bp, Artificial Sequence
  chemically synthesized
actgtgttagccaggatggtct

SEQ ID NO: 1212789 - DNA, 22 bp, Artificial Sequence
  chemically synthesized
cactgtgttagccaggatggtc

SEQ ID NO: 1212790 - DNA, 22 bp, Artificial Sequence
  chemically synthesized
gtagagacggggtttcactgtg

SEQ ID NO: 1212791 - DNA, 22 bp, Artificial Sequence
  chemically synthesized
agtagagacggggtttcactgt

SEQ ID NO: 1212792 - DNA, 22 bp, Artificial Sequence
  chemically synthesized
tagtagagacggggtttcactg

SEQ ID NO: 1212793 - DNA, 22 bp, Artificial Sequence
  chemically synthesized
ttagtagagacggggtttcact

SEQ ID NO: 1212794 - DNA, 22 bp, Artificial Sequence
  chemically synthesized
tttttagtagagacggggtttc

SEQ ID NO: 1212795 - DNA, 22 bp, Artificial Sequence
  chemically synthesized
gctaacacagtgaaaccccgtc

SEQ ID NO: 1212796 - DNA, 22 bp, Artificial Sequence
  chemically synthesized
atttttagtagagacggggttt

SEQ ID NO: 1212797 - DNA, 22 bp, Artificial Sequence
  chemically synthesized
tatttttagtagagacggggtt

SEQ ID NO: 1212798 - DNA, 22 bp, Artificial Sequence
  chemically synthesized
ttatttttagtagagacggggt

SEQ ID NO: 1212799 - DNA, 22 bp, Artificial Sequence
  chemically synthesized
tttatttttagtagagacgggg

SEQ ID NO: 1212800 - DNA, 22 bp, Artificial Sequence
  chemically synthesized
acacagtgaaaccccgtctcta

SEQ ID NO: 1212801 - DNA, 22 bp, Artificial Sequence
  chemically synthesized
ttttatttttagtagagacggg

SEQ ID NO: 1212802 - DNA, 22 bp, Artificial Sequence
  chemically synthesized
tttttatttttagtagagacgg

SEQ ID NO: 1212803 - DNA, 22 bp, Artificial Sequence
  chemically synthesized
ttttttatttttagtagagacg

SEQ ID NO: 1212804 - DNA, 22 bp, Artificial Sequence
  chemically synthesized
tttttttatttttagtagagac

SEQ ID NO: 1212805 - DNA, 22 bp, Artificial Sequence
  chemically synthesized
ttttttttttatttttagtaga

SEQ ID NO: 1212806 - DNA, 22 bp, Artificial Sequence
  chemically synthesized
attttttttttatttttagtag

SEQ ID NO: 1212807 - DNA, 22 bp, Artificial Sequence
  chemically synthesized
tattttttttttatttttagta

SEQ ID NO: 1212808 - DNA, 22 bp, Artificial Sequence
  chemically synthesized
ttattttttttttatttttagt

SEQ ID NO: 1212809 - DNA, 22 bp, Artificial Sequence
  chemically synthesized
tttattttttttttatttttag

SEQ ID NO: 1212810 - DNA, 22 bp, Artificial Sequence
  chemically synthesized
ttttattttttttttattttta

SEQ ID NO: 1212811 - DNA, 22 bp, Artificial Sequence
  chemically synthesized
tttttattttttttttattttt

SEQ ID NO: 1212812 - DNA, 22 bp, Artificial Sequence
  chemically synthesized
ttttttattttttttttatttt

SEQ ID NO: 1212813 - DNA, 22 bp, Artificial Sequence
  chemically synthesized
tttttttttattttttttttat

SEQ ID NO: 1212814 - DNA, 22 bp, Artificial Sequence
  chemically synthesized
atttttttttatttttttttta

SEQ ID NO: 1212815 - DNA, 22 bp, Artificial Sequence
  chemically synthesized
tatttttttttatttttttttt

SEQ ID NO: 1212816 - DNA, 22 bp, Artificial Sequence
  chemically synthesized
ttatttttttttattttttttt

SEQ ID NO: 1212817 - DNA, 22 bp, Artificial Sequence
  chemically synthesized
tactaaaaataaaaaaaaaata

SEQ ID NO: 1212818 - DNA, 22 bp, Artificial Sequence
  chemically synthesized
tttatttttttttatttttttt

SEQ ID NO: 1212819 - DNA, 22 bp, Artificial Sequence
  chemically synthesized
ctaaaaataaaaaaaaaataaa

SEQ ID NO: 1212820 - DNA, 22 bp, Artificial Sequence
  chemically synthesized
ttttttatttttttttattttt

SEQ ID NO: 1212821 - DNA, 22 bp, Artificial Sequence
  chemically synthesized
attttttatttttttttatttt

SEQ ID NO: 1212822 - DNA, 22 bp, Artificial Sequence
  chemically synthesized
aaaataaaaaaaaaataaaaaa

SEQ ID NO: 1212823 - DNA, 22 bp, Artificial Sequence
  chemically synthesized
tattttttatttttttttattt

SEQ ID NO: 1212824 - DNA, 22 bp, Artificial Sequence
  chemically synthesized
ttattttttatttttttttatt

SEQ ID NO: 1212825 - DNA, 22 bp, Artificial Sequence
  chemically synthesized
tttattttttatttttttttat

SEQ ID NO: 1212826 - DNA, 22 bp, Artificial Sequence
  chemically synthesized
ttttattttttattttttttta

SEQ ID NO: 1212827 - DNA, 22 bp, Artificial Sequence
  chemically synthesized
atttttttattttttatttttt

SEQ ID NO: 1212828 - DNA, 22 bp, Artificial Sequence
  chemically synthesized
ccaccatgcccggctaattttt

SEQ ID NO: 1212829 - DNA, 22 bp, Artificial Sequence
  chemically synthesized
caggcgcctgccaccatgcccg

SEQ ID NO: 1212830 - DNA, 22 bp, Artificial Sequence
  chemically synthesized
ggactacaggcgcctgccacca

SEQ ID NO: 1212831 - DNA, 22 bp, Artificial Sequence
  chemically synthesized
gccgggcatggtggcaggcgcc

SEQ ID NO: 1212832 - DNA, 22 bp, Artificial Sequence
  chemically synthesized
ccgagtagctgggactacaggc

SEQ ID NO: 1212833 - DNA, 22 bp, Artificial Sequence
  chemically synthesized
agcctcccgagtagctgggact

SEQ ID NO: 1212834 - DNA, 22 bp, Artificial Sequence
  chemically synthesized
cctcagcctcccgagtagctgg

SEQ ID NO: 1212835 - DNA, 22 bp, Artificial Sequence
  chemically synthesized
ctgcctcagcctcccgagtagc

SEQ ID NO: 1212836 - DNA, 22 bp, Artificial Sequence
  chemically synthesized
tcctgcctcagcctcccgagta

SEQ ID NO: 1212837 - DNA, 22 bp, Artificial Sequence
  chemically synthesized
tagtcccagctactcgggaggc

SEQ ID NO: 1212838 - DNA, 22 bp, Artificial Sequence
  chemically synthesized
ttctcctgcctcagcctcccga

SEQ ID NO: 1212839 - DNA, 22 bp, Artificial Sequence
  chemically synthesized
acgctattctcctgcctcagcc

SEQ ID NO: 1212840 - DNA, 22 bp, Artificial Sequence
  chemically synthesized
ctcgggaggctgaggcaggaga

SEQ ID NO: 1212841 - DNA, 22 bp, Artificial Sequence
  chemically synthesized
gggaggctgaggcaggagaata

SEQ ID NO: 1212842 - DNA, 22 bp, Artificial Sequence
  chemically synthesized
ccgggttcacgctattctcctg

SEQ ID NO: 1212843 - DNA, 22 bp, Artificial Sequence
  chemically synthesized
cgcctcccgggttcacgctatt

SEQ ID NO: 1212844 - DNA, 22 bp, Artificial Sequence
  chemically synthesized
aggcaggagaatagcgtgaacc

SEQ ID NO: 1212845 - DNA, 22 bp, Artificial Sequence
  chemically synthesized
caagctccgcctcccgggttca

SEQ ID NO: 1212846 - DNA, 22 bp, Artificial Sequence
  chemically synthesized
actgcaagctccgcctcccggg

SEQ ID NO: 1212847 - DNA, 22 bp, Artificial Sequence
  chemically synthesized
ggctcactgcaagctccgcctc

SEQ ID NO: 1212848 - DNA, 22 bp, Artificial Sequence
  chemically synthesized
gagtgcagtggcgcgatctcgg

SEQ ID NO: 1212849 - DNA, 22 bp, Artificial Sequence
  chemically synthesized
gcagtgagccgagatcgcgcca

SEQ ID NO: 1212850 - DNA, 22 bp, Artificial Sequence
  chemically synthesized
cagtgagccgagatcgcgccac

SEQ ID NO: 1212851 - DNA, 22 bp, Artificial Sequence
  chemically synthesized
cgtcgcccaggctggagtgcag

SEQ ID NO: 1212852 - DNA, 22 bp, Artificial Sequence
  chemically synthesized
gctccgtcgcccaggctggagt

SEQ ID NO: 1212853 - DNA, 22 bp, Artificial Sequence
  chemically synthesized
cactccagcctgggcgacggag

SEQ ID NO: 1212854 - DNA, 22 bp, Artificial Sequence
  chemically synthesized
agacagaggctcgctccgtcgc

SEQ ID NO: 1212855 - DNA, 22 bp, Artificial Sequence
  chemically synthesized
gagacagaggctcgctccgtcg

SEQ ID NO: 1212856 - DNA, 22 bp, Artificial Sequence
  chemically synthesized
tgagacagaggctcgctccgtc

SEQ ID NO: 1212857 - DNA, 22 bp, Artificial Sequence
  chemically synthesized
ttgagacagaggctcgctccgt

SEQ ID NO: 1212858 - DNA, 22 bp, Artificial Sequence
  chemically synthesized
cagcctgggcgacggagcgagc

SEQ ID NO: 1212859 - DNA, 22 bp, Artificial Sequence
  chemically synthesized
tttgagacagaggctcgctccg

SEQ ID NO: 1212860 - DNA, 22 bp, Artificial Sequence
  chemically synthesized
ttttgagacagaggctcgctcc

SEQ ID NO: 1212861 - DNA, 22 bp, Artificial Sequence
  chemically synthesized
tttttgagacagaggctcgctc

SEQ ID NO: 1212862 - DNA, 22 bp, Artificial Sequence
  chemically synthesized
tttttttgagacagaggctcgc

SEQ ID NO: 1212863 - DNA, 22 bp, Artificial Sequence
  chemically synthesized
ctttttttgagacagaggctcg

SEQ ID NO: 1212864 - DNA, 22 bp, Artificial Sequence
  chemically synthesized
tctttttttgagacagaggctc

SEQ ID NO: 1212865 - DNA, 22 bp, Artificial Sequence
  chemically synthesized
ggcgacggagcgagcctctgtc

SEQ ID NO: 1212866 - DNA, 22 bp, Artificial Sequence
  chemically synthesized
ttctttttttgagacagaggct

SEQ ID NO: 1212867 - DNA, 22 bp, Artificial Sequence
  chemically synthesized
tttctttttttgagacagaggc

SEQ ID NO: 1212868 - DNA, 22 bp, Artificial Sequence
  chemically synthesized
ttttctttttttgagacagagg

SEQ ID NO: 1212869 - DNA, 22 bp, Artificial Sequence
  chemically synthesized
tttttctttttttgagacagag

SEQ ID NO: 1212870 - DNA, 22 bp, Artificial Sequence
  chemically synthesized
ttttttctttttttgagacaga

SEQ ID NO: 1212871 - DNA, 22 bp, Artificial Sequence
  chemically synthesized
tttttttctttttttgagacag

SEQ ID NO: 1212872 - DNA, 22 bp, Artificial Sequence
  chemically synthesized
ttttttttctttttttgagaca

SEQ ID NO: 1212873 - DNA, 22 bp, Artificial Sequence
  chemically synthesized
tttttttttctttttttgagac

SEQ ID NO: 1212874 - DNA, 22 bp, Artificial Sequence
  chemically synthesized
ttttttttttctttttttgaga

SEQ ID NO: 1212875 - DNA, 22 bp, Artificial Sequence
  chemically synthesized
tttttttttttctttttttgag

SEQ ID NO: 1212876 - DNA, 22 bp, Artificial Sequence
  chemically synthesized
ttttttttttttctttttttga

SEQ ID NO: 1212877 - DNA, 22 bp, Artificial Sequence
  chemically synthesized
tttttttttttttctttttttg

SEQ ID NO: 1212878 - DNA, 22 bp, Artificial Sequence
  chemically synthesized
ttttttttttttttcttttttt

SEQ ID NO: 1212879 - DNA, 22 bp, Artificial Sequence
  chemically synthesized
tttttttttttttttctttttt

SEQ ID NO: 1212880 - DNA, 22 bp, Artificial Sequence
  chemically synthesized
ttttttttttttttttcttttt

SEQ ID NO: 1212881 - DNA, 22 bp, Artificial Sequence
  chemically synthesized
tgtctcaaaaaaagaaaaaaaa

SEQ ID NO: 1212882 - DNA, 22 bp, Artificial Sequence
  chemically synthesized
tctcaaaaaaagaaaaaaaaaa

SEQ ID NO: 1212883 - DNA, 22 bp, Artificial Sequence
  chemically synthesized
aaaaaaagaaaaaaaaaaaaaa

SEQ ID NO: 1212884 - DNA, 22 bp, Artificial Sequence
  chemically synthesized
ccagagcataagagtgcctttt

SEQ ID NO: 1212885 - DNA, 22 bp, Artificial Sequence
  chemically synthesized
aattcccagagcataagagtgc

SEQ ID NO: 1212886 - DNA, 22 bp, Artificial Sequence
  chemically synthesized
acagctgaattcccagagcata

SEQ ID NO: 1212887 - DNA, 22 bp, Artificial Sequence
  chemically synthesized
ttcacagctgaattcccagagc

SEQ ID NO: 1212888 - DNA, 22 bp, Artificial Sequence
  chemically synthesized
ttattcacagctgaattcccag

SEQ ID NO: 1212889 - DNA, 22 bp, Artificial Sequence
  chemically synthesized
attattcacagctgaattccca

SEQ ID NO: 1212890 - DNA, 22 bp, Artificial Sequence
  chemically synthesized
tattattcacagctgaattccc

SEQ ID NO: 1212891 - DNA, 22 bp, Artificial Sequence
  chemically synthesized
ttatgctctgggaattcagctg

SEQ ID NO: 1212892 - DNA, 22 bp, Artificial Sequence
  chemically synthesized
atgctctgggaattcagctgtg

SEQ ID NO: 1212893 - DNA, 22 bp, Artificial Sequence
  chemically synthesized
tgctctgggaattcagctgtga

SEQ ID NO: 1212894 - DNA, 22 bp, Artificial Sequence
  chemically synthesized
ggacctttattattcacagctg

SEQ ID NO: 1212895 - DNA, 22 bp, Artificial Sequence
  chemically synthesized
tgggaattcagctgtgaataat

SEQ ID NO: 1212896 - DNA, 22 bp, Artificial Sequence
  chemically synthesized
ggaattcagctgtgaataataa

SEQ ID NO: 1212897 - DNA, 22 bp, Artificial Sequence
  chemically synthesized
atgtgctgggacctttattatt

SEQ ID NO: 1212898 - DNA, 22 bp, Artificial Sequence
  chemically synthesized
ctcatgtgctgggacctttatt

SEQ ID NO: 1212899 - DNA, 22 bp, Artificial Sequence
  chemically synthesized
cctcatgtgctgggacctttat

SEQ ID NO: 1212900 - DNA, 22 bp, Artificial Sequence
  chemically synthesized
agctgtgaataataaaggtccc

SEQ ID NO: 1212901 - DNA, 22 bp, Artificial Sequence
  chemically synthesized
tgaataataaaggtcccagcac

SEQ ID NO: 1212902 - DNA, 22 bp, Artificial Sequence
  chemically synthesized
gtggtgacttcctcatgtgctg

SEQ ID NO: 1212903 - DNA, 22 bp, Artificial Sequence
  chemically synthesized
ttggtggtgacttcctcatgtg

SEQ ID NO: 1212904 - DNA, 22 bp, Artificial Sequence
  chemically synthesized
ttattggtggtgacttcctcat

SEQ ID NO: 1212905 - DNA, 22 bp, Artificial Sequence
  chemically synthesized
agtcctgttattggtggtgact

SEQ ID NO: 1212906 - DNA, 22 bp, Artificial Sequence
  chemically synthesized
ttcagtcctgttattggtggtg

SEQ ID NO: 1212907 - DNA, 22 bp, Artificial Sequence
  chemically synthesized
gttcagtcctgttattggtggt

SEQ ID NO: 1212908 - DNA, 22 bp, Artificial Sequence
  chemically synthesized
tagacttgttcagtcctgttat

SEQ ID NO: 1212909 - DNA, 22 bp, Artificial Sequence
  chemically synthesized
taggtagttgtagacttgttca

SEQ ID NO: 1212910 - DNA, 22 bp, Artificial Sequence
  chemically synthesized
tcacaatgctgtaggtagttgt

SEQ ID NO: 1212911 - DNA, 22 bp, Artificial Sequence
  chemically synthesized
aacaagtctacaactacctaca

SEQ ID NO: 1212912 - DNA, 22 bp, Artificial Sequence
  chemically synthesized
gcctatcacaatgctgtaggta

SEQ ID NO: 1212913 - DNA, 22 bp, Artificial Sequence
  chemically synthesized
ctggcctatcacaatgctgtag

SEQ ID NO: 1212914 - DNA, 22 bp, Artificial Sequence
  chemically synthesized
caactacctacagcattgtgat

SEQ ID NO: 1212915 - DNA, 22 bp, Artificial Sequence
  chemically synthesized
cctacagcattgtgataggcca

SEQ ID NO: 1212916 - DNA, 22 bp, Artificial Sequence
  chemically synthesized
ccaccatagtactgctggccta

SEQ ID NO: 1212917 - DNA, 22 bp, Artificial Sequence
  chemically synthesized
cagcattgtgataggccagcag

SEQ ID NO: 1212918 - DNA, 22 bp, Artificial Sequence
  chemically synthesized
ttcccaccatagtactgctggc

SEQ ID NO: 1212919 - DNA, 22 bp, Artificial Sequence
  chemically synthesized
gttcccaccatagtactgctgg

SEQ ID NO: 1212920 - DNA, 22 bp, Artificial Sequence
  chemically synthesized
tgataggccagcagtactatgg

SEQ ID NO: 1212921 - DNA, 22 bp, Artificial Sequence
  chemically synthesized
cagtggagtttgttcccaccat

SEQ ID NO: 1212922 - DNA, 22 bp, Artificial Sequence
  chemically synthesized
atgttccagtggagtttgttcc

SEQ ID NO: 1212923 - DNA, 22 bp, Artificial Sequence
  chemically synthesized
aatgttccagtggagtttgttc

SEQ ID NO: 1212924 - DNA, 22 bp, Artificial Sequence
  chemically synthesized
acttaatgttccagtggagttt

SEQ ID NO: 1212925 - DNA, 22 bp, Artificial Sequence
  chemically synthesized
tggtgggaacaaactccactgg

SEQ ID NO: 1212926 - DNA, 22 bp, Artificial Sequence
  chemically synthesized
tcacttaatgttccagtggagt

SEQ ID NO: 1212927 - DNA, 22 bp, Artificial Sequence
  chemically synthesized
aaaaaataattctcacttaatg

SEQ ID NO: 1212928 - DNA, 22 bp, Artificial Sequence
  chemically synthesized
caaaaaataattctcacttaat

SEQ ID NO: 1212929 - DNA, 22 bp, Artificial Sequence
  chemically synthesized
cactggaacattaagtgagaat

SEQ ID NO: 1212930 - DNA, 22 bp, Artificial Sequence
  chemically synthesized
accttcaaaaaataattctcac

SEQ ID NO: 1212931 - DNA, 22 bp, Artificial Sequence
  chemically synthesized
gaacattaagtgagaattattt

SEQ ID NO: 1212932 - DNA, 22 bp, Artificial Sequence
  chemically synthesized
ctaaccttcaaaaaataattct

SEQ ID NO: 1212933 - DNA, 22 bp, Artificial Sequence
  chemically synthesized
agtgagaattattttttgaagg

SEQ ID NO: 1212934 - DNA, 22 bp, Artificial Sequence
  chemically synthesized
atccaacgtaaaattcctaacc

SEQ ID NO: 1212935 - DNA, 22 bp, Artificial Sequence
  chemically synthesized
aatccaacgtaaaattcctaac

SEQ ID NO: 1212936 - DNA, 22 bp, Artificial Sequence
  chemically synthesized
ttttttgaaggttaggaatttt

SEQ ID NO: 1212937 - DNA, 22 bp, Artificial Sequence
  chemically synthesized
tttgaaggttaggaattttacg

SEQ ID NO: 1212938 - DNA, 22 bp, Artificial Sequence
  chemically synthesized
ttgaaggttaggaattttacgt

SEQ ID NO: 1212939 - DNA, 22 bp, Artificial Sequence
  chemically synthesized
atatttaatccaacgtaaaatt

SEQ ID NO: 1212940 - DNA, 22 bp, Artificial Sequence
  chemically synthesized
tgaaggttaggaattttacgtt

SEQ ID NO: 1212941 - DNA, 22 bp, Artificial Sequence
  chemically synthesized
gaaggttaggaattttacgttg

SEQ ID NO: 1212942 - DNA, 22 bp, Artificial Sequence
  chemically synthesized
aaggttaggaattttacgttgg

SEQ ID NO: 1212943 - DNA, 22 bp, Artificial Sequence
  chemically synthesized
tatcattgatatttaatccaac

SEQ ID NO: 1212944 - DNA, 22 bp, Artificial Sequence
  chemically synthesized
ggaattttacgttggattaaat

SEQ ID NO: 1212945 - DNA, 22 bp, Artificial Sequence
  chemically synthesized
attgtatcattgatatttaatc

SEQ ID NO: 1212946 - DNA, 22 bp, Artificial Sequence
  chemically synthesized
gattgtatcattgatatttaat

SEQ ID NO: 1212947 - DNA, 22 bp, Artificial Sequence
  chemically synthesized
tgattgtatcattgatatttaa

SEQ ID NO: 1212948 - DNA, 22 bp, Artificial Sequence
  chemically synthesized
tacgttggattaaatatcaatg

SEQ ID NO: 1212949 - DNA, 22 bp, Artificial Sequence
  chemically synthesized
acgttggattaaatatcaatga

SEQ ID NO: 1212950 - DNA, 22 bp, Artificial Sequence
  chemically synthesized
actttgattgtatcattgatat

SEQ ID NO: 1212951 - DNA, 22 bp, Artificial Sequence
  chemically synthesized
cgttggattaaatatcaatgat

SEQ ID NO: 1212952 - DNA, 22 bp, Artificial Sequence
  chemically synthesized
cactttgattgtatcattgata

SEQ ID NO: 1212953 - DNA, 22 bp, Artificial Sequence
  chemically synthesized
gattaaatatcaatgatacaat

SEQ ID NO: 1212954 - DNA, 22 bp, Artificial Sequence
  chemically synthesized
atgtttcactttgattgtatca

SEQ ID NO: 1212955 - DNA, 22 bp, Artificial Sequence
  chemically synthesized
tcatgtttcactttgattgtat

SEQ ID NO: 1212956 - DNA, 22 bp, Artificial Sequence
  chemically synthesized
ctcatgtttcactttgattgta

SEQ ID NO: 1212957 - DNA, 22 bp, Artificial Sequence
  chemically synthesized
aatatcaatgatacaatcaaag

SEQ ID NO: 1212958 - DNA, 22 bp, Artificial Sequence
  chemically synthesized
acagagtaaacaacagtatgag

SEQ ID NO: 1212959 - DNA, 22 bp, Artificial Sequence
  chemically synthesized
gtacaatattaacagagtaaac

SEQ ID NO: 1212960 - DNA, 22 bp, Artificial Sequence
  chemically synthesized
agtacaatattaacagagtaaa

SEQ ID NO: 1212961 - DNA, 22 bp, Artificial Sequence
  chemically synthesized
atactgttgtttactctgttaa

SEQ ID NO: 1212962 - DNA, 22 bp, Artificial Sequence
  chemically synthesized
tttagtacaatattaacagagt

SEQ ID NO: 1212963 - DNA, 22 bp, Artificial Sequence
  chemically synthesized
ttgtttactctgttaatattgt

SEQ ID NO: 1212964 - DNA, 22 bp, Artificial Sequence
  chemically synthesized
aatactgtttagtacaatatta

SEQ ID NO: 1212965 - DNA, 22 bp, Artificial Sequence
  chemically synthesized
tttactctgttaatattgtact

SEQ ID NO: 1212966 - DNA, 22 bp, Artificial Sequence
  chemically synthesized
ttcaatactgtttagtacaata

SEQ ID NO: 1212967 - DNA, 22 bp, Artificial Sequence
  chemically synthesized
attcaatactgtttagtacaat

SEQ ID NO: 1212968 - DNA, 22 bp, Artificial Sequence
  chemically synthesized
actctgttaatattgtactaaa

SEQ ID NO: 1212969 - DNA, 22 bp, Artificial Sequence
  chemically synthesized
tattcaatactgtttagtacaa

SEQ ID NO: 1212970 - DNA, 22 bp, Artificial Sequence
  chemically synthesized
ctctgttaatattgtactaaac

SEQ ID NO: 1212971 - DNA, 22 bp, Artificial Sequence
  chemically synthesized
ttttattcaatactgtttagta

SEQ ID NO: 1212972 - DNA, 22 bp, Artificial Sequence
  chemically synthesized
tgttaatattgtactaaacagt

SEQ ID NO: 1212973 - DNA, 22 bp, Artificial Sequence
  chemically synthesized
gttttattcaatactgtttagt

SEQ ID NO: 1212974 - DNA, 22 bp, Artificial Sequence
  chemically synthesized
tgttttattcaatactgtttag

SEQ ID NO: 1212975 - DNA, 22 bp, Artificial Sequence
  chemically synthesized
ttaatattgtactaaacagtat

SEQ ID NO: 1212976 - DNA, 22 bp, Artificial Sequence
  chemically synthesized
atattgtactaaacagtattga

SEQ ID NO: 1212977 - DNA, 22 bp, Artificial Sequence
  chemically synthesized
attttgttttattcaatactgt

SEQ ID NO: 1212978 - DNA, 22 bp, Artificial Sequence
  chemically synthesized
gttgattttgttttattcaata

SEQ ID NO: 1212979 - DNA, 22 bp, Artificial Sequence
  chemically synthesized
cgttgattttgttttattcaat

SEQ ID NO: 1212980 - DNA, 22 bp, Artificial Sequence
  chemically synthesized
tactaaacagtattgaataaaa

SEQ ID NO: 1212981 - DNA, 22 bp, Artificial Sequence
  chemically synthesized
aacagtattgaataaaacaaaa

SEQ ID NO: 1212982 - DNA, 22 bp, Artificial Sequence
  chemically synthesized
aaatgtttcgttgattttgttt

SEQ ID NO: 1212983 - DNA, 22 bp, Artificial Sequence
  chemically synthesized
caaatgtttcgttgattttgtt

SEQ ID NO: 1212984 - DNA, 22 bp, Artificial Sequence
  chemically synthesized
tcaaatgtttcgttgattttgt

SEQ ID NO: 1212985 - DNA, 22 bp, Artificial Sequence
  chemically synthesized
ttcaaatgtttcgttgattttg

SEQ ID NO: 1212986 - DNA, 22 bp, Artificial Sequence
  chemically synthesized
tttttcaaatgtttcgttgatt

SEQ ID NO: 1212987 - DNA, 22 bp, Artificial Sequence
  chemically synthesized
aataaaacaaaatcaacgaaac

SEQ ID NO: 1212988 - DNA, 22 bp, Artificial Sequence
  chemically synthesized
tgtttttcaaatgtttcgttga

SEQ ID NO: 1212989 - DNA, 22 bp, Artificial Sequence
  chemically synthesized
ctgtttttcaaatgtttcgttg

SEQ ID NO: 1212990 - DNA, 22 bp, Artificial Sequence
  chemically synthesized
aagatacaatgtcttctgtttt

SEQ ID NO: 1212991 - DNA, 22 bp, Artificial Sequence
  chemically synthesized
aaagatacaatgtcttctgttt

SEQ ID NO: 1212992 - DNA, 22 bp, Artificial Sequence
  chemically synthesized
gtttaaagatacaatgtcttct

SEQ ID NO: 1212993 - DNA, 22 bp, Artificial Sequence
  chemically synthesized
gaaaaacagaagacattgtatc

SEQ ID NO: 1212994 - DNA, 22 bp, Artificial Sequence
  chemically synthesized
aaaaacagaagacattgtatct

SEQ ID NO: 1212995 - DNA, 22 bp, Artificial Sequence
  chemically synthesized
tatctttaaactagtgatgtca

SEQ ID NO: 1212996 - DNA, 22 bp, Artificial Sequence
  chemically synthesized
taaactagtgatgtcattttct

SEQ ID NO: 1212997 - DNA, 22 bp, Artificial Sequence
  chemically synthesized
aaactagtgatgtcattttctt

SEQ ID NO: 1212998 - DNA, 22 bp, Artificial Sequence
  chemically synthesized
aactagtgatgtcattttcttg

SEQ ID NO: 1212999 - DNA, 22 bp, Artificial Sequence
  chemically synthesized
tatatgagaatgcaagaaaatg

SEQ ID NO: 1213000 - DNA, 22 bp, Artificial Sequence
  chemically synthesized
gtgatgtcattttcttgcattc

SEQ ID NO: 1213001 - DNA, 22 bp, Artificial Sequence
  chemically synthesized
agttatatatgagaatgcaaga

SEQ ID NO: 1213002 - DNA, 22 bp, Artificial Sequence
  chemically synthesized
ccggtatattgagttatatatg

SEQ ID NO: 1213003 - DNA, 22 bp, Artificial Sequence
  chemically synthesized
tcttgcattctcatatataact

SEQ ID NO: 1213004 - DNA, 22 bp, Artificial Sequence
  chemically synthesized
cttgcattctcatatataactc

SEQ ID NO: 1213005 - DNA, 22 bp, Artificial Sequence
  chemically synthesized
ttgcattctcatatataactca

SEQ ID NO: 1213006 - DNA, 22 bp, Artificial Sequence
  chemically synthesized
gcattctcatatataactcaat

SEQ ID NO: 1213007 - DNA, 22 bp, Artificial Sequence
  chemically synthesized
cattctcatatataactcaata

SEQ ID NO: 1213008 - DNA, 22 bp, Artificial Sequence
  chemically synthesized
cagtgttcccggtatattgagt

SEQ ID NO: 1213009 - DNA, 22 bp, Artificial Sequence
  chemically synthesized
tcatatataactcaatataccg

SEQ ID NO: 1213010 - DNA, 22 bp, Artificial Sequence
  chemically synthesized
atatataactcaatataccggg

SEQ ID NO: 1213011 - DNA, 22 bp, Artificial Sequence
  chemically synthesized
gaatctacagtgttcccggtat

SEQ ID NO: 1213012 - DNA, 22 bp, Artificial Sequence
  chemically synthesized
agaatctacagtgttcccggta

SEQ ID NO: 1213013 - DNA, 22 bp, Artificial Sequence
  chemically synthesized
tttagaatctacagtgttcccg

SEQ ID NO: 1213014 - DNA, 22 bp, Artificial Sequence
  chemically synthesized
atttagaatctacagtgttccc

SEQ ID NO: 1213015 - DNA, 22 bp, Artificial Sequence
  chemically synthesized
aatataccgggaacactgtaga

SEQ ID NO: 1213016 - DNA, 22 bp, Artificial Sequence
  chemically synthesized
cataatacttatttagaatcta

SEQ ID NO: 1213017 - DNA, 22 bp, Artificial Sequence
  chemically synthesized
attacataatacttatttagaa

SEQ ID NO: 1213018 - DNA, 22 bp, Artificial Sequence
  chemically synthesized
aattacataatacttatttaga

SEQ ID NO: 1213019 - DNA, 22 bp, Artificial Sequence
  chemically synthesized
cttaattacataatacttattt

SEQ ID NO: 1213020 - DNA, 22 bp, Artificial Sequence
  chemically synthesized
acttaattacataatacttatt

SEQ ID NO: 1213021 - DNA, 22 bp, Artificial Sequence
  chemically synthesized
tagattctaaataagtattatg

SEQ ID NO: 1213022 - DNA, 22 bp, Artificial Sequence
  chemically synthesized
tttacttaattacataatactt

SEQ ID NO: 1213023 - DNA, 22 bp, Artificial Sequence
  chemically synthesized
atttacttaattacataatact

SEQ ID NO: 1213024 - DNA, 22 bp, Artificial Sequence
  chemically synthesized
taaataagtattatgtaattaa

SEQ ID NO: 1213025 - DNA, 22 bp, Artificial Sequence
  chemically synthesized
aataagtattatgtaattaagt

SEQ ID NO: 1213026 - DNA, 22 bp, Artificial Sequence
  chemically synthesized
tgtaattaagtaaataaattct

SEQ ID NO: 1213027 - DNA, 22 bp, Artificial Sequence
  chemically synthesized
gagtagaggcaagggagaattt

SEQ ID NO: 1213028 - DNA, 22 bp, Artificial Sequence
  chemically synthesized
ctggagtagaggcaagggagaa

SEQ ID NO: 1213029 - DNA, 22 bp, Artificial Sequence
  chemically synthesized
agtaaataaattctcccttgcc

SEQ ID NO: 1213030 - DNA, 22 bp, Artificial Sequence
  chemically synthesized
tcccttgcctctactccagtaa

SEQ ID NO: 1213031 - DNA, 22 bp, Artificial Sequence
  chemically synthesized
ccttgcctctactccagtaatc

SEQ ID NO: 1213032 - DNA, 22 bp, Artificial Sequence
  chemically synthesized
gcctctactccagtaatccctc

SEQ ID NO: 1213033 - DNA, 22 bp, Artificial Sequence
  chemically synthesized
cctctactccagtaatccctct

SEQ ID NO: 1213034 - DNA, 22 bp, Artificial Sequence
  chemically synthesized
tactccagtaatccctcttccc

SEQ ID NO: 1213035 - DNA, 22 bp, Artificial Sequence
  chemically synthesized
ctccagtaatccctcttccctt

SEQ ID NO: 1213036 - DNA, 22 bp, Artificial Sequence
  chemically synthesized
acaagcagcagcaagggaagag

SEQ ID NO: 1213037 - DNA, 22 bp, Artificial Sequence
  chemically synthesized
cagtaatccctcttcccttgct

SEQ ID NO: 1213038 - DNA, 22 bp, Artificial Sequence
  chemically synthesized
acacattcacaagcagcagcaa

SEQ ID NO: 1213039 - DNA, 22 bp, Artificial Sequence
  chemically synthesized
ttcccttgctgctgcttgtgaa

SEQ ID NO: 1213040 - DNA, 22 bp, Artificial Sequence
  chemically synthesized
cccttgctgctgcttgtgaatg

SEQ ID NO: 1213041 - DNA, 22 bp, Artificial Sequence
  chemically synthesized
ccttgctgctgcttgtgaatgt

SEQ ID NO: 1213042 - DNA, 22 bp, Artificial Sequence
  chemically synthesized
gctgctgcttgtgaatgtgtca

SEQ ID NO: 1213043 - DNA, 22 bp, Artificial Sequence
  chemically synthesized
caggagagaggctgacacattc

SEQ ID NO: 1213044 - DNA, 22 bp, Artificial Sequence
  chemically synthesized
ctgctgcttgtgaatgtgtcag

SEQ ID NO: 1213045 - DNA, 22 bp, Artificial Sequence
  chemically synthesized
ctgcttgtgaatgtgtcagcct

SEQ ID NO: 1213046 - DNA, 22 bp, Artificial Sequence
  chemically synthesized
gttgcaggagagaggctgacac

SEQ ID NO: 1213047 - DNA, 22 bp, Artificial Sequence
  chemically synthesized
ggttgcaggagagaggctgaca

SEQ ID NO: 1213048 - DNA, 22 bp, Artificial Sequence
  chemically synthesized
cttgtgaatgtgtcagcctctc

SEQ ID NO: 1213049 - DNA, 22 bp, Artificial Sequence
  chemically synthesized
gtgaatgtgtcagcctctctcc

SEQ ID NO: 1213050 - DNA, 22 bp, Artificial Sequence
  chemically synthesized
tgaatgtgtcagcctctctcct

SEQ ID NO: 1213051 - DNA, 22 bp, Artificial Sequence
  chemically synthesized
gggtagaaatttggttgcagga

SEQ ID NO: 1213052 - DNA, 22 bp, Artificial Sequence
  chemically synthesized
tctcctgcaaccaaatttctac

SEQ ID NO: 1213053 - DNA, 22 bp, Artificial Sequence
  chemically synthesized
tcctgcaaccaaatttctaccc

SEQ ID NO: 1213054 - DNA, 22 bp, Artificial Sequence
  chemically synthesized
ctgcaaccaaatttctacccca

SEQ ID NO: 1213055 - DNA, 22 bp, Artificial Sequence
  chemically synthesized
caaccaaatttctaccccagac

SEQ ID NO: 1213056 - DNA, 22 bp, Artificial Sequence
  chemically synthesized
ctaccccagacatactacattc

SEQ ID NO: 1213057 - DNA, 22 bp, Artificial Sequence
  chemically synthesized
taccccagacatactacattcg

SEQ ID NO: 1213058 - DNA, 22 bp, Artificial Sequence
  chemically synthesized
ccccagacatactacattcgtc

SEQ ID NO: 1213059 - DNA, 22 bp, Artificial Sequence
  chemically synthesized
tcaatacatggagagatggaat

SEQ ID NO: 1213060 - DNA, 22 bp, Artificial Sequence
  chemically synthesized
gtcaatacatggagagatggaa

SEQ ID NO: 1213061 - DNA, 22 bp, Artificial Sequence
  chemically synthesized
cattcgtcttattccatctctc

SEQ ID NO: 1213062 - DNA, 22 bp, Artificial Sequence
  chemically synthesized
gtcttattccatctctccatgt

SEQ ID NO: 1213063 - DNA, 22 bp, Artificial Sequence
  chemically synthesized
attccatctctccatgtattga

SEQ ID NO: 1213064 - DNA, 22 bp, Artificial Sequence
  chemically synthesized
ttccatctctccatgtattgac

SEQ ID NO: 1213065 - DNA, 22 bp, Artificial Sequence
  chemically synthesized
atgtgcccatcttgtcaataca

SEQ ID NO: 1213066 - DNA, 22 bp, Artificial Sequence
  chemically synthesized
catctctccatgtattgacaag

SEQ ID NO: 1213067 - DNA, 22 bp, Artificial Sequence
  chemically synthesized
tccatgtattgacaagatgggc

SEQ ID NO: 1213068 - DNA, 22 bp, Artificial Sequence
  chemically synthesized
catgtattgacaagatgggcac

SEQ ID NO: 1213069 - DNA, 22 bp, Artificial Sequence
  chemically synthesized
acaagatgggcacatgagtacg

SEQ ID NO: 1213070 - DNA, 22 bp, Artificial Sequence
  chemically synthesized
gtatgcggatgtatgtgtgtgc

SEQ ID NO: 1213071 - DNA, 22 bp, Artificial Sequence
  chemically synthesized
agtatgcggatgtatgtgtgtg

SEQ ID NO: 1213072 - DNA, 22 bp, Artificial Sequence
  chemically synthesized
ccttagtatgcggatgtatgtg

SEQ ID NO: 1213073 - DNA, 22 bp, Artificial Sequence
  chemically synthesized
gccttagtatgcggatgtatgt

SEQ ID NO: 1213074 - DNA, 22 bp, Artificial Sequence
  chemically synthesized
tgccttagtatgcggatgtatg

SEQ ID NO: 1213075 - DNA, 22 bp, Artificial Sequence
  chemically synthesized
ctttgccttagtatgcggatgt

SEQ ID NO: 1213076 - DNA, 22 bp, Artificial Sequence
  chemically synthesized
agataggtaaagtaagctactt

SEQ ID NO: 1213077 - DNA, 22 bp, Artificial Sequence
  chemically synthesized
tgagataggtaaagtaagctac

SEQ ID NO: 1213078 - DNA, 22 bp, Artificial Sequence
  chemically synthesized
tctgagataggtaaagtaagct

SEQ ID NO: 1213079 - DNA, 22 bp, Artificial Sequence
  chemically synthesized
tctctgagataggtaaagtaag

SEQ ID NO: 1213080 - DNA, 22 bp, Artificial Sequence
  chemically synthesized
aggcaaagtagcttactttacc

SEQ ID NO: 1213081 - DNA, 22 bp, Artificial Sequence
  chemically synthesized
ctctctgagataggtaaagtaa

SEQ ID NO: 1213082 - DNA, 22 bp, Artificial Sequence
  chemically synthesized
tctctctgagataggtaaagta

SEQ ID NO: 1213083 - DNA, 22 bp, Artificial Sequence
  chemically synthesized
gttttctctctgagataggtaa

SEQ ID NO: 1213084 - DNA, 22 bp, Artificial Sequence
  chemically synthesized
ggctagttttctctctgagata

SEQ ID NO: 1213085 - DNA, 22 bp, Artificial Sequence
  chemically synthesized
aggctagttttctctctgagat

SEQ ID NO: 1213086 - DNA, 22 bp, Artificial Sequence
  chemically synthesized
actttacctatctcagagagaa

SEQ ID NO: 1213087 - DNA, 22 bp, Artificial Sequence
  chemically synthesized
ctttacctatctcagagagaaa

SEQ ID NO: 1213088 - DNA, 22 bp, Artificial Sequence
  chemically synthesized
tgtttaggctagttttctctct

SEQ ID NO: 1213089 - DNA, 22 bp, Artificial Sequence
  chemically synthesized
atgtttaggctagttttctctc

SEQ ID NO: 1213090 - DNA, 22 bp, Artificial Sequence
  chemically synthesized
tacctatctcagagagaaaact

SEQ ID NO: 1213091 - DNA, 22 bp, Artificial Sequence
  chemically synthesized
acctatctcagagagaaaacta

SEQ ID NO: 1213092 - DNA, 22 bp, Artificial Sequence
  chemically synthesized
cctatctcagagagaaaactag

SEQ ID NO: 1213093 - DNA, 22 bp, Artificial Sequence
  chemically synthesized
cttatgtttaggctagttttct

SEQ ID NO: 1213094 - DNA, 22 bp, Artificial Sequence
  chemically synthesized
ccttatgtttaggctagttttc

SEQ ID NO: 1213095 - DNA, 22 bp, Artificial Sequence
  chemically synthesized
ttccttatgtttaggctagttt

SEQ ID NO: 1213096 - DNA, 22 bp, Artificial Sequence
  chemically synthesized
tctcagagagaaaactagccta

SEQ ID NO: 1213097 - DNA, 22 bp, Artificial Sequence
  chemically synthesized
agagagaaaactagcctaaaca

SEQ ID NO: 1213098 - DNA, 22 bp, Artificial Sequence
  chemically synthesized
gtgagcattcttccttatgttt

SEQ ID NO: 1213099 - DNA, 22 bp, Artificial Sequence
  chemically synthesized
agtgagcattcttccttatgtt

SEQ ID NO: 1213100 - DNA, 22 bp, Artificial Sequence
  chemically synthesized
tagtgagcattcttccttatgt

SEQ ID NO: 1213101 - DNA, 22 bp, Artificial Sequence
  chemically synthesized
gcctaaacataaggaagaatgc

SEQ ID NO: 1213102 - DNA, 22 bp, Artificial Sequence
  chemically synthesized
aaatctttagtgagcattcttc

SEQ ID NO: 1213103 - DNA, 22 bp, Artificial Sequence
  chemically synthesized
aaaatctttagtgagcattctt

SEQ ID NO: 1213104 - DNA, 22 bp, Artificial Sequence
  chemically synthesized
aacataaggaagaatgctcact

SEQ ID NO: 1213105 - DNA, 22 bp, Artificial Sequence
  chemically synthesized
tatcttaaaatctttagtgagc

SEQ ID NO: 1213106 - DNA, 22 bp, Artificial Sequence
  chemically synthesized
tctgtatcttaaaatctttagt

SEQ ID NO: 1213107 - DNA, 22 bp, Artificial Sequence
  chemically synthesized
atctgtatcttaaaatctttag

SEQ ID NO: 1213108 - DNA, 22 bp, Artificial Sequence
  chemically synthesized
tatctgtatcttaaaatcttta

SEQ ID NO: 1213109 - DNA, 22 bp, Artificial Sequence
  chemically synthesized
tttatctgtatcttaaaatctt

SEQ ID NO: 1213110 - DNA, 22 bp, Artificial Sequence
  chemically synthesized
actaaagattttaagatacaga

SEQ ID NO: 1213111 - DNA, 22 bp, Artificial Sequence
  chemically synthesized
aaatgttctttatctgtatctt

SEQ ID NO: 1213112 - DNA, 22 bp, Artificial Sequence
  chemically synthesized
aagattttaagatacagataaa

SEQ ID NO: 1213113 - DNA, 22 bp, Artificial Sequence
  chemically synthesized
aaggtgactcaaatgttcttta

SEQ ID NO: 1213114 - DNA, 22 bp, Artificial Sequence
  chemically synthesized
taagatacagataaagaacatt

SEQ ID NO: 1213115 - DNA, 22 bp, Artificial Sequence
  chemically synthesized
aaaggtgactcaaatgttcttt

SEQ ID NO: 1213116 - DNA, 22 bp, Artificial Sequence
  chemically synthesized
aagatacagataaagaacattt

SEQ ID NO: 1213117 - DNA, 22 bp, Artificial Sequence
  chemically synthesized
agatacagataaagaacatttg

SEQ ID NO: 1213118 - DNA, 22 bp, Artificial Sequence
  chemically synthesized
ttaaaggtgactcaaatgttct

SEQ ID NO: 1213119 - DNA, 22 bp, Artificial Sequence
  chemically synthesized
tgtctcttaaaggtgactcaaa

SEQ ID NO: 1213120 - DNA, 22 bp, Artificial Sequence
  chemically synthesized
atgtctcttaaaggtgactcaa

SEQ ID NO: 1213121 - DNA, 22 bp, Artificial Sequence
  chemically synthesized
gagtcacctttaagagacataa

SEQ ID NO: 1213122 - DNA, 22 bp, Artificial Sequence
  chemically synthesized
agtcacctttaagagacataaa

SEQ ID NO: 1213123 - DNA, 22 bp, Artificial Sequence
  chemically synthesized
taagagacataaattacatgtt

SEQ ID NO: 1213124 - DNA, 22 bp, Artificial Sequence
  chemically synthesized
aagagacataaattacatgttc

SEQ ID NO: 1213125 - DNA, 22 bp, Artificial Sequence
  chemically synthesized
agagacataaattacatgttca

SEQ ID NO: 1213126 - DNA, 22 bp, Artificial Sequence
  chemically synthesized
gggaaatagagagaaagtggag

SEQ ID NO: 1213127 - DNA, 22 bp, Artificial Sequence
  chemically synthesized
ggggaaatagagagaaagtgga

SEQ ID NO: 1213128 - DNA, 22 bp, Artificial Sequence
  chemically synthesized
catgttcactccactttctctc

SEQ ID NO: 1213129 - DNA, 22 bp, Artificial Sequence
  chemically synthesized
actccactttctctctatttcc

SEQ ID NO: 1213130 - DNA, 22 bp, Artificial Sequence
  chemically synthesized
cactttctctctatttccccaa

SEQ ID NO: 1213131 - DNA, 22 bp, Artificial Sequence
  chemically synthesized
tctctctatttccccaaatata

SEQ ID NO: 1213132 - DNA, 22 bp, Artificial Sequence
  chemically synthesized
aggagaataccatatatttggg

SEQ ID NO: 1213133 - DNA, 22 bp, Artificial Sequence
  chemically synthesized
ctctctatttccccaaatatat

SEQ ID NO: 1213134 - DNA, 22 bp, Artificial Sequence
  chemically synthesized
gaggagaataccatatatttgg

SEQ ID NO: 1213135 - DNA, 22 bp, Artificial Sequence
  chemically synthesized
tctctatttccccaaatatatg

SEQ ID NO: 1213136 - DNA, 22 bp, Artificial Sequence
  chemically synthesized
tctatttccccaaatatatggt

SEQ ID NO: 1213137 - DNA, 22 bp, Artificial Sequence
  chemically synthesized
gtttgaggagaataccatatat

SEQ ID NO: 1213138 - DNA, 22 bp, Artificial Sequence
  chemically synthesized
tatttccccaaatatatggtat

SEQ ID NO: 1213139 - DNA, 22 bp, Artificial Sequence
  chemically synthesized
agtttgaggagaataccatata

SEQ ID NO: 1213140 - DNA, 22 bp, Artificial Sequence
  chemically synthesized
tttccccaaatatatggtattc

SEQ ID NO: 1213141 - DNA, 22 bp, Artificial Sequence
  chemically synthesized
tcttagtttgaggagaatacca

SEQ ID NO: 1213142 - DNA, 22 bp, Artificial Sequence
  chemically synthesized
ccccaaatatatggtattctcc

SEQ ID NO: 1213143 - DNA, 22 bp, Artificial Sequence
  chemically synthesized
cccaaatatatggtattctcct

SEQ ID NO: 1213144 - DNA, 22 bp, Artificial Sequence
  chemically synthesized
ctatcttagtttgaggagaata

SEQ ID NO: 1213145 - DNA, 22 bp, Artificial Sequence
  chemically synthesized
gctatcttagtttgaggagaat

SEQ ID NO: 1213146 - DNA, 22 bp, Artificial Sequence
  chemically synthesized
agatatcttgctatcttagttt

SEQ ID NO: 1213147 - DNA, 22 bp, Artificial Sequence
  chemically synthesized
tcctcaaactaagatagcaaga

SEQ ID NO: 1213148 - DNA, 22 bp, Artificial Sequence
  chemically synthesized
ctcaaactaagatagcaagata

SEQ ID NO: 1213149 - DNA, 22 bp, Artificial Sequence
  chemically synthesized
aaactaagatagcaagatatct

SEQ ID NO: 1213150 - DNA, 22 bp, Artificial Sequence
  chemically synthesized
agatatcaactgagatatcttg

SEQ ID NO: 1213151 - DNA, 22 bp, Artificial Sequence
  chemically synthesized
agatagcaagatatctcagttg

SEQ ID NO: 1213152 - DNA, 22 bp, Artificial Sequence
  chemically synthesized
agtgtattaagatatcaactga

SEQ ID NO: 1213153 - DNA, 22 bp, Artificial Sequence
  chemically synthesized
catgaatactgagtgtattaag

SEQ ID NO: 1213154 - DNA, 22 bp, Artificial Sequence
  chemically synthesized
agttgatatcttaatacactca

SEQ ID NO: 1213155 - DNA, 22 bp, Artificial Sequence
  chemically synthesized
atatcttaatacactcagtatt

SEQ ID NO: 1213156 - DNA, 22 bp, Artificial Sequence
  chemically synthesized
ggagcctacatgaatactgagt

SEQ ID NO: 1213157 - DNA, 22 bp, Artificial Sequence
  chemically synthesized
cctgggagcctacatgaatact

SEQ ID NO: 1213158 - DNA, 22 bp, Artificial Sequence
  chemically synthesized
acctgggagcctacatgaatac

SEQ ID NO: 1213159 - DNA, 22 bp, Artificial Sequence
  chemically synthesized
aatacactcagtattcatgtag

SEQ ID NO: 1213160 - DNA, 22 bp, Artificial Sequence
  chemically synthesized
ttacctgggagcctacatgaat

SEQ ID NO: 1213161 - DNA, 22 bp, Artificial Sequence
  chemically synthesized
atacactcagtattcatgtagg

SEQ ID NO: 1213162 - DNA, 22 bp, Artificial Sequence
  chemically synthesized
cttacctgggagcctacatgaa

SEQ ID NO: 1213163 - DNA, 22 bp, Artificial Sequence
  chemically synthesized
tcttacctgggagcctacatga

SEQ ID NO: 1213164 - DNA, 22 bp, Artificial Sequence
  chemically synthesized
ttcttacctgggagcctacatg

SEQ ID NO: 1213165 - DNA, 22 bp, Artificial Sequence
  chemically synthesized
tttcttacctgggagcctacat

SEQ ID NO: 1213166 - DNA, 22 bp, Artificial Sequence
  chemically synthesized
ttttcttacctgggagcctaca

SEQ ID NO: 1213167 - DNA, 22 bp, Artificial Sequence
  chemically synthesized
agtattcatgtaggctcccagg

SEQ ID NO: 1213168 - DNA, 22 bp, Artificial Sequence
  chemically synthesized
atgtaggctcccaggtaagaaa

SEQ ID NO: 1213169 - DNA, 22 bp, Artificial Sequence
  chemically synthesized
ccaggtaagaaaaaaattatta

SEQ ID NO: 1213170 - DNA, 22 bp, Artificial Sequence
  chemically synthesized
gacaagcaacaataataatttt

SEQ ID NO: 1213171 - DNA, 22 bp, Artificial Sequence
  chemically synthesized
ggattagacaagcaacaataat

SEQ ID NO: 1213172 - DNA, 22 bp, Artificial Sequence
  chemically synthesized
aatgcaactaggattagacaag

SEQ ID NO: 1213173 - DNA, 22 bp, Artificial Sequence
  chemically synthesized
aaatgcaactaggattagacaa

SEQ ID NO: 1213174 - DNA, 22 bp, Artificial Sequence
  chemically synthesized
ttattgttgcttgtctaatcct

SEQ ID NO: 1213175 - DNA, 22 bp, Artificial Sequence
  chemically synthesized
ttgttgcttgtctaatcctagt

SEQ ID NO: 1213176 - DNA, 22 bp, Artificial Sequence
  chemically synthesized
atatttaaatgcaactaggatt

SEQ ID NO: 1213177 - DNA, 22 bp, Artificial Sequence
  chemically synthesized
catatttaaatgcaactaggat

SEQ ID NO: 1213178 - DNA, 22 bp, Artificial Sequence
  chemically synthesized
ttgcttgtctaatcctagttgc

SEQ ID NO: 1213179 - DNA, 22 bp, Artificial Sequence
  chemically synthesized
tttcatatttaaatgcaactag

SEQ ID NO: 1213180 - DNA, 22 bp, Artificial Sequence
  chemically synthesized
cttgtctaatcctagttgcatt

SEQ ID NO: 1213181 - DNA, 22 bp, Artificial Sequence
  chemically synthesized
ctatttcatatttaaatgcaac

SEQ ID NO: 1213182 - DNA, 22 bp, Artificial Sequence
  chemically synthesized
gtctaatcctagttgcatttaa

SEQ ID NO: 1213183 - DNA, 22 bp, Artificial Sequence
  chemically synthesized
tctaatcctagttgcatttaaa

SEQ ID NO: 1213184 - DNA, 22 bp, Artificial Sequence
  chemically synthesized
atcctagttgcatttaaatatg

SEQ ID NO: 1213185 - DNA, 22 bp, Artificial Sequence
  chemically synthesized
ccatgttactatttcatattta

SEQ ID NO: 1213186 - DNA, 22 bp, Artificial Sequence
  chemically synthesized
gttgcatttaaatatgaaatag

SEQ ID NO: 1213187 - DNA, 22 bp, Artificial Sequence
  chemically synthesized
catttaaatatgaaatagtaac

SEQ ID NO: 1213188 - DNA, 22 bp, Artificial Sequence
  chemically synthesized
aaaaattaccatgttactattt

SEQ ID NO: 1213189 - DNA, 22 bp, Artificial Sequence
  chemically synthesized
taaaaaattaccatgttactat

SEQ ID NO: 1213190 - DNA, 22 bp, Artificial Sequence
  chemically synthesized
aaatatgaaatagtaacatggt

SEQ ID NO: 1213191 - DNA, 22 bp, Artificial Sequence
  chemically synthesized
ttctaaaaaattaccatgttac

SEQ ID NO: 1213192 - DNA, 22 bp, Artificial Sequence
  chemically synthesized
aatatgaaatagtaacatggta

SEQ ID NO: 1213193 - DNA, 22 bp, Artificial Sequence
  chemically synthesized
attctaaaaaattaccatgtta

SEQ ID NO: 1213194 - DNA, 22 bp, Artificial Sequence
  chemically synthesized
tattctaaaaaattaccatgtt

SEQ ID NO: 1213195 - DNA, 22 bp, Artificial Sequence
  chemically synthesized
ttattctaaaaaattaccatgt

SEQ ID NO: 1213196 - DNA, 22 bp, Artificial Sequence
  chemically synthesized
gtttttattctaaaaaattacc

SEQ ID NO: 1213197 - DNA, 22 bp, Artificial Sequence
  chemically synthesized
aaaattggtttttattctaaaa

SEQ ID NO: 1213198 - DNA, 22 bp, Artificial Sequence
  chemically synthesized
tattcaaaattggtttttattc

SEQ ID NO: 1213199 - DNA, 22 bp, Artificial Sequence
  chemically synthesized
gattgtattcaaaattggtttt

SEQ ID NO: 1213200 - DNA, 22 bp, Artificial Sequence
  chemically synthesized
tttagaataaaaaccaattttg

SEQ ID NO: 1213201 - DNA, 22 bp, Artificial Sequence
  chemically synthesized
ttagaataaaaaccaattttga

SEQ ID NO: 1213202 - DNA, 22 bp, Artificial Sequence
  chemically synthesized
attagattgtattcaaaattgg

SEQ ID NO: 1213203 - DNA, 22 bp, Artificial Sequence
  chemically synthesized
tagaataaaaaccaattttgaa

SEQ ID NO: 1213204 - DNA, 22 bp, Artificial Sequence
  chemically synthesized
cattagattgtattcaaaattg

SEQ ID NO: 1213205 - DNA, 22 bp, Artificial Sequence
  chemically synthesized
agaataaaaaccaattttgaat

SEQ ID NO: 1213206 - DNA, 22 bp, Artificial Sequence
  chemically synthesized
tcattagattgtattcaaaatt

SEQ ID NO: 1213207 - DNA, 22 bp, Artificial Sequence
  chemically synthesized
gaataaaaaccaattttgaata

SEQ ID NO: 1213208 - DNA, 22 bp, Artificial Sequence
  chemically synthesized
aaagttttcattagattgtatt

SEQ ID NO: 1213209 - DNA, 22 bp, Artificial Sequence
  chemically synthesized
caaagttttcattagattgtat

SEQ ID NO: 1213210 - DNA, 22 bp, Artificial Sequence
  chemically synthesized
tcaaagttttcattagattgta

SEQ ID NO: 1213211 - DNA, 22 bp, Artificial Sequence
  chemically synthesized
ttcaaagttttcattagattgt

SEQ ID NO: 1213212 - DNA, 22 bp, Artificial Sequence
  chemically synthesized
tgaatacaatctaatgaaaact

SEQ ID NO: 1213213 - DNA, 22 bp, Artificial Sequence
  chemically synthesized
gaatacaatctaatgaaaactt

SEQ ID NO: 1213214 - DNA, 22 bp, Artificial Sequence
  chemically synthesized
aatacaatctaatgaaaacttt

SEQ ID NO: 1213215 - DNA, 22 bp, Artificial Sequence
  chemically synthesized
gaaatgaacatttttcaaagtt

SEQ ID NO: 1213216 - DNA, 22 bp, Artificial Sequence
  chemically synthesized
ggaaatgaacatttttcaaagt

SEQ ID NO: 1213217 - DNA, 22 bp, Artificial Sequence
  chemically synthesized
tggaaatgaacatttttcaaag

SEQ ID NO: 1213218 - DNA, 22 bp, Artificial Sequence
  chemically synthesized
tctttggaaatgaacatttttc

SEQ ID NO: 1213219 - DNA, 22 bp, Artificial Sequence
  chemically synthesized
atgaaaactttgaaaaatgttc

SEQ ID NO: 1213220 - DNA, 22 bp, Artificial Sequence
  chemically synthesized
atctttggaaatgaacattttt

SEQ ID NO: 1213221 - DNA, 22 bp, Artificial Sequence
  chemically synthesized
atttatctttggaaatgaacat

SEQ ID NO: 1213222 - DNA, 22 bp, Artificial Sequence
  chemically synthesized
aatttatctttggaaatgaaca

SEQ ID NO: 1213223 - DNA, 22 bp, Artificial Sequence
  chemically synthesized
taatttatctttggaaatgaac

SEQ ID NO: 1213224 - DNA, 22 bp, Artificial Sequence
  chemically synthesized
tgaaaaatgttcatttccaaag

SEQ ID NO: 1213225 - DNA, 22 bp, Artificial Sequence
  chemically synthesized
tctttaatttatctttggaaat

SEQ ID NO: 1213226 - DNA, 22 bp, Artificial Sequence
  chemically synthesized
gaaaaatgttcatttccaaaga

SEQ ID NO: 1213227 - DNA, 22 bp, Artificial Sequence
  chemically synthesized
aaaaatgttcatttccaaagat

SEQ ID NO: 1213228 - DNA, 22 bp, Artificial Sequence
  chemically synthesized
tctgtctttaatttatctttgg

SEQ ID NO: 1213229 - DNA, 22 bp, Artificial Sequence
  chemically synthesized
atttccaaagataaattaaaga

SEQ ID NO: 1213230 - DNA, 22 bp, Artificial Sequence
  chemically synthesized
tgaaattatctgtctttaattt

SEQ ID NO: 1213231 - DNA, 22 bp, Artificial Sequence
  chemically synthesized
ccaaagataaattaaagacaga

SEQ ID NO: 1213232 - DNA, 22 bp, Artificial Sequence
  chemically synthesized
caaagataaattaaagacagat

SEQ ID NO: 1213233 - DNA, 22 bp, Artificial Sequence
  chemically synthesized
agggagagcatgatctgtgaaa

SEQ ID NO: 1213234 - DNA, 22 bp, Artificial Sequence
  chemically synthesized
aagacagataatttcacagatc

SEQ ID NO: 1213235 - DNA, 22 bp, Artificial Sequence
  chemically synthesized
atgttaagggagagcatgatct

SEQ ID NO: 1213236 - DNA, 22 bp, Artificial Sequence
  chemically synthesized
aatgttaagggagagcatgatc

SEQ ID NO: 1213237 - DNA, 22 bp, Artificial Sequence
  chemically synthesized
taatgttaagggagagcatgat

SEQ ID NO: 1213238 - DNA, 22 bp, Artificial Sequence
  chemically synthesized
ttaatgttaagggagagcatga

SEQ ID NO: 1213239 - DNA, 22 bp, Artificial Sequence
  chemically synthesized
tttaatgttaagggagagcatg

SEQ ID NO: 1213240 - DNA, 22 bp, Artificial Sequence
  chemically synthesized
cacagatcatgctctcccttaa

SEQ ID NO: 1213241 - DNA, 22 bp, Artificial Sequence
  chemically synthesized
acagatcatgctctcccttaac

SEQ ID NO: 1213242 - DNA, 22 bp, Artificial Sequence
  chemically synthesized
tcccttaacattaaaaaggttc

SEQ ID NO: 1213243 - DNA, 22 bp, Artificial Sequence
  chemically synthesized
ccttaacattaaaaaggttctt

SEQ ID NO: 1213244 - DNA, 22 bp, Artificial Sequence
  chemically synthesized
atacatatatgagaaaagaacc

SEQ ID NO: 1213245 - DNA, 22 bp, Artificial Sequence
  chemically synthesized
aacattaaaaaggttcttttct

SEQ ID NO: 1213246 - DNA, 22 bp, Artificial Sequence
  chemically synthesized
aatacatatatgagaaaagaac

SEQ ID NO: 1213247 - DNA, 22 bp, Artificial Sequence
  chemically synthesized
acattaaaaaggttcttttctc

SEQ ID NO: 1213248 - DNA, 22 bp, Artificial Sequence
  chemically synthesized
aaaaggttcttttctcatatat

SEQ ID NO: 1213249 - DNA, 22 bp, Artificial Sequence
  chemically synthesized
atgataatatttaatacatata

SEQ ID NO: 1213250 - DNA, 22 bp, Artificial Sequence
  chemically synthesized
aatgataatatttaatacatat

SEQ ID NO: 1213251 - DNA, 22 bp, Artificial Sequence
  chemically synthesized
taatgataatatttaatacata

SEQ ID NO: 1213252 - DNA, 22 bp, Artificial Sequence
  chemically synthesized
ttaatgataatatttaatacat

SEQ ID NO: 1213253 - DNA, 22 bp, Artificial Sequence
  chemically synthesized
ttttctcatatatgtattaaat

SEQ ID NO: 1213254 - DNA, 22 bp, Artificial Sequence
  chemically synthesized
ttctcatatatgtattaaatat

SEQ ID NO: 1213255 - DNA, 22 bp, Artificial Sequence
  chemically synthesized
tctcatatatgtattaaatatt

SEQ ID NO: 1213256 - DNA, 22 bp, Artificial Sequence
  chemically synthesized
ctcatatatgtattaaatatta

SEQ ID NO: 1213257 - DNA, 22 bp, Artificial Sequence
  chemically synthesized
tcatatatgtattaaatattat

SEQ ID NO: 1213258 - DNA, 22 bp, Artificial Sequence
  chemically synthesized
gtgatttttaatgataatattt

SEQ ID NO: 1213259 - DNA, 22 bp, Artificial Sequence
  chemically synthesized
atatatgtattaaatattatca

SEQ ID NO: 1213260 - DNA, 22 bp, Artificial Sequence
  chemically synthesized
tagtgatttttaatgataatat

SEQ ID NO: 1213261 - DNA, 22 bp, Artificial Sequence
  chemically synthesized
atattctagtgatttttaatga

SEQ ID NO: 1213262 - DNA, 22 bp, Artificial Sequence
  chemically synthesized
gatattctagtgatttttaatg

SEQ ID NO: 1213263 - DNA, 22 bp, Artificial Sequence
  chemically synthesized
tgatattctagtgatttttaat

SEQ ID NO: 1213264 - DNA, 22 bp, Artificial Sequence
  chemically synthesized
ttgatattctagtgatttttaa

SEQ ID NO: 1213265 - DNA, 22 bp, Artificial Sequence
  chemically synthesized
tttgatattctagtgattttta

SEQ ID NO: 1213266 - DNA, 22 bp, Artificial Sequence
  chemically synthesized
aatattatcattaaaaatcact

SEQ ID NO: 1213267 - DNA, 22 bp, Artificial Sequence
  chemically synthesized
ttttgatattctagtgattttt

SEQ ID NO: 1213268 - DNA, 22 bp, Artificial Sequence
  chemically synthesized
tttttttgatattctagtgatt

SEQ ID NO: 1213269 - DNA, 22 bp, Artificial Sequence
  chemically synthesized
tcattaaaaatcactagaatat

SEQ ID NO: 1213270 - DNA, 22 bp, Artificial Sequence
  chemically synthesized
taggctgtttttttgatattct

SEQ ID NO: 1213271 - DNA, 22 bp, Artificial Sequence
  chemically synthesized
aaaatcactagaatatcaaaaa

SEQ ID NO: 1213272 - DNA, 22 bp, Artificial Sequence
  chemically synthesized
gaatatcaaaaaaacagcctac

SEQ ID NO: 1213273 - DNA, 22 bp, Artificial Sequence
  chemically synthesized
tacacaccaagtctgtaggctg

SEQ ID NO: 1213274 - DNA, 22 bp, Artificial Sequence
  chemically synthesized
tcacatactatacacaccaagt

SEQ ID NO: 1213275 - DNA, 22 bp, Artificial Sequence
  chemically synthesized
tgttatcacatactatacacac

SEQ ID NO: 1213276 - DNA, 22 bp, Artificial Sequence
  chemically synthesized
atgttatcacatactatacaca

SEQ ID NO: 1213277 - DNA, 22 bp, Artificial Sequence
  chemically synthesized
cagacttggtgtgtatagtatg

SEQ ID NO: 1213278 - DNA, 22 bp, Artificial Sequence
  chemically synthesized
tgcttatgttatcacatactat

SEQ ID NO: 1213279 - DNA, 22 bp, Artificial Sequence
  chemically synthesized
gtgcttatgttatcacatacta

SEQ ID NO: 1213280 - DNA, 22 bp, Artificial Sequence
  chemically synthesized
tgtgcttatgttatcacatact

SEQ ID NO: 1213281 - DNA, 22 bp, Artificial Sequence
  chemically synthesized
ggtgtgtatagtatgtgataac

SEQ ID NO: 1213282 - DNA, 22 bp, Artificial Sequence
  chemically synthesized
ttttgtgcttatgttatcacat

SEQ ID NO: 1213283 - DNA, 22 bp, Artificial Sequence
  chemically synthesized
gtgtgtatagtatgtgataaca

SEQ ID NO: 1213284 - DNA, 22 bp, Artificial Sequence
  chemically synthesized
gttttgtgcttatgttatcaca

SEQ ID NO: 1213285 - DNA, 22 bp, Artificial Sequence
  chemically synthesized
tgttttgtgcttatgttatcac

SEQ ID NO: 1213286 - DNA, 22 bp, Artificial Sequence
  chemically synthesized
ttttgttttgtgcttatgttat

SEQ ID NO: 1213287 - DNA, 22 bp, Artificial Sequence
  chemically synthesized
gttttgttttgtgcttatgtta

SEQ ID NO: 1213288 - DNA, 22 bp, Artificial Sequence
  chemically synthesized
tgttttgttttgtgcttatgtt

SEQ ID NO: 1213289 - DNA, 22 bp, Artificial Sequence
  chemically synthesized
ttgttttgttttgtgcttatgt

SEQ ID NO: 1213290 - DNA, 22 bp, Artificial Sequence
  chemically synthesized
tttgttttgttttgtgcttatg

SEQ ID NO: 1213291 - DNA, 22 bp, Artificial Sequence
  chemically synthesized
gttttttgttttgttttgtgct

SEQ ID NO: 1213292 - DNA, 22 bp, Artificial Sequence
  chemically synthesized
agttttttgttttgttttgtgc

SEQ ID NO: 1213293 - DNA, 22 bp, Artificial Sequence
  chemically synthesized
ttagttttttgttttgttttgt

SEQ ID NO: 1213294 - DNA, 22 bp, Artificial Sequence
  chemically synthesized
ttcttagttttttgttttgttt

SEQ ID NO: 1213295 - DNA, 22 bp, Artificial Sequence
  chemically synthesized
aaactattcttagttttttgtt

SEQ ID NO: 1213296 - DNA, 22 bp, Artificial Sequence
  chemically synthesized
catacatattgaaactattctt

SEQ ID NO: 1213297 - DNA, 22 bp, Artificial Sequence
  chemically synthesized
ctgcatacatattgaaactatt

SEQ ID NO: 1213298 - DNA, 22 bp, Artificial Sequence
  chemically synthesized
ttactgcatacatattgaaact

SEQ ID NO: 1213299 - DNA, 22 bp, Artificial Sequence
  chemically synthesized
tgttactgcatacatattgaaa

SEQ ID NO: 1213300 - DNA, 22 bp, Artificial Sequence
  chemically synthesized
agaatagtttcaatatgtatgc

SEQ ID NO: 1213301 - DNA, 22 bp, Artificial Sequence
  chemically synthesized
caatatgtatgcagtaacagag

SEQ ID NO: 1213302 - DNA, 22 bp, Artificial Sequence
  chemically synthesized
aatatgtatgcagtaacagaga

SEQ ID NO: 1213303 - DNA, 22 bp, Artificial Sequence
  chemically synthesized
agaatagcatgtgtctctgtta

SEQ ID NO: 1213304 - DNA, 22 bp, Artificial Sequence
  chemically synthesized
tcagaatagcatgtgtctctgt

SEQ ID NO: 1213305 - DNA, 22 bp, Artificial Sequence
  chemically synthesized
ctcagaatagcatgtgtctctg

SEQ ID NO: 1213306 - DNA, 22 bp, Artificial Sequence
  chemically synthesized
acccttctcagaatagcatgtg

SEQ ID NO: 1213307 - DNA, 22 bp, Artificial Sequence
  chemically synthesized
aacccttctcagaatagcatgt

SEQ ID NO: 1213308 - DNA, 22 bp, Artificial Sequence
  chemically synthesized
atttaacccttctcagaatagc

SEQ ID NO: 1213309 - DNA, 22 bp, Artificial Sequence
  chemically synthesized
ttgatttaacccttctcagaat

SEQ ID NO: 1213310 - DNA, 22 bp, Artificial Sequence
  chemically synthesized
gttgatttaacccttctcagaa

SEQ ID NO: 1213311 - DNA, 22 bp, Artificial Sequence
  chemically synthesized
tgttgatttaacccttctcaga

SEQ ID NO: 1213312 - DNA, 22 bp, Artificial Sequence
  chemically synthesized
tgtcctttgttgatttaaccct

SEQ ID NO: 1213313 - DNA, 22 bp, Artificial Sequence
  chemically synthesized
ttctgagaagggttaaatcaac

SEQ ID NO: 1213314 - DNA, 22 bp, Artificial Sequence
  chemically synthesized
tgagaagggttaaatcaacaaa

SEQ ID NO: 1213315 - DNA, 22 bp, Artificial Sequence
  chemically synthesized
agaagggttaaatcaacaaagg

SEQ ID NO: 1213316 - DNA, 22 bp, Artificial Sequence
  chemically synthesized
aaccccagaaagattatgtcct

SEQ ID NO: 1213317 - DNA, 22 bp, Artificial Sequence
  chemically synthesized
aatcaacaaaggacataatctt

SEQ ID NO: 1213318 - DNA, 22 bp, Artificial Sequence
  chemically synthesized
acagctgaaccccagaaagatt

SEQ ID NO: 1213319 - DNA, 22 bp, Artificial Sequence
  chemically synthesized
cacagctgaaccccagaaagat

SEQ ID NO: 1213320 - DNA, 22 bp, Artificial Sequence
  chemically synthesized
catttcacagctgaaccccaga

SEQ ID NO: 1213321 - DNA, 22 bp, Artificial Sequence
  chemically synthesized
tgcatttcacagctgaacccca

SEQ ID NO: 1213322 - DNA, 22 bp, Artificial Sequence
  chemically synthesized
cactctgcatttcacagctgaa

SEQ ID NO: 1213323 - DNA, 22 bp, Artificial Sequence
  chemically synthesized
ccactctgcatttcacagctga

SEQ ID NO: 1213324 - DNA, 22 bp, Artificial Sequence
  chemically synthesized
ttccactctgcatttcacagct

SEQ ID NO: 1213325 - DNA, 22 bp, Artificial Sequence
  chemically synthesized
tctggggttcagctgtgaaatg

SEQ ID NO: 1213326 - DNA, 22 bp, Artificial Sequence
  chemically synthesized
ctggggttcagctgtgaaatgc

SEQ ID NO: 1213327 - DNA, 22 bp, Artificial Sequence
  chemically synthesized
ttcttccactctgcatttcaca

SEQ ID NO: 1213328 - DNA, 22 bp, Artificial Sequence
  chemically synthesized
tggggttcagctgtgaaatgca

SEQ ID NO: 1213329 - DNA, 22 bp, Artificial Sequence
  chemically synthesized
gggttcagctgtgaaatgcaga

SEQ ID NO: 1213330 - DNA, 22 bp, Artificial Sequence
  chemically synthesized
ggatgttgttcttccactctgc

SEQ ID NO: 1213331 - DNA, 22 bp, Artificial Sequence
  chemically synthesized
agctgtgaaatgcagagtggaa

SEQ ID NO: 1213332 - DNA, 22 bp, Artificial Sequence
  chemically synthesized
cctgggatgttgttcttccact

SEQ ID NO: 1213333 - DNA, 22 bp, Artificial Sequence
  chemically synthesized
tgaaatgcagagtggaagaaca

SEQ ID NO: 1213334 - DNA, 22 bp, Artificial Sequence
  chemically synthesized
caactccctgggatgttgttct

SEQ ID NO: 1213335 - DNA, 22 bp, Artificial Sequence
  chemically synthesized
ttccaactccctgggatgttgt

SEQ ID NO: 1213336 - DNA, 22 bp, Artificial Sequence
  chemically synthesized
ctgttccaactccctgggatgt

SEQ ID NO: 1213337 - DNA, 22 bp, Artificial Sequence
  chemically synthesized
gctgttccaactccctgggatg

SEQ ID NO: 1213338 - DNA, 22 bp, Artificial Sequence
  chemically synthesized
gcacttgctgttccaactccct

SEQ ID NO: 1213339 - DNA, 22 bp, Artificial Sequence
  chemically synthesized
agcacttgctgttccaactccc

SEQ ID NO: 1213340 - DNA, 22 bp, Artificial Sequence
  chemically synthesized
aggccttagcacttgctgttcc

SEQ ID NO: 1213341 - DNA, 22 bp, Artificial Sequence
  chemically synthesized
aaggccttagcacttgctgttc

SEQ ID NO: 1213342 - DNA, 22 bp, Artificial Sequence
  chemically synthesized
catagtttaaggccttagcact

SEQ ID NO: 1213343 - DNA, 22 bp, Artificial Sequence
  chemically synthesized
acatagtttaaggccttagcac

SEQ ID NO: 1213344 - DNA, 22 bp, Artificial Sequence
  chemically synthesized
gaacagcaagtgctaaggcctt

SEQ ID NO: 1213345 - DNA, 22 bp, Artificial Sequence
  chemically synthesized
gcatgatatttacatagtttaa

SEQ ID NO: 1213346 - DNA, 22 bp, Artificial Sequence
  chemically synthesized
aggccttaaactatgtaaatat

SEQ ID NO: 1213347 - DNA, 22 bp, Artificial Sequence
  chemically synthesized
aaactatgtaaatatcatgcta

SEQ ID NO: 1213348 - DNA, 22 bp, Artificial Sequence
  chemically synthesized
cacacaatcatctagcatgata

SEQ ID NO: 1213349 - DNA, 22 bp, Artificial Sequence
  chemically synthesized
aactatgtaaatatcatgctag

SEQ ID NO: 1213350 - DNA, 22 bp, Artificial Sequence
  chemically synthesized
acacacaatcatctagcatgat

SEQ ID NO: 1213351 - DNA, 22 bp, Artificial Sequence
  chemically synthesized
tacacacaatcatctagcatga

SEQ ID NO: 1213352 - DNA, 22 bp, Artificial Sequence
  chemically synthesized
ttacacacaatcatctagcatg

SEQ ID NO: 1213353 - DNA, 22 bp, Artificial Sequence
  chemically synthesized
ttttacacacaatcatctagca

SEQ ID NO: 1213354 - DNA, 22 bp, Artificial Sequence
  chemically synthesized
tgtaaatatcatgctagatgat

SEQ ID NO: 1213355 - DNA, 22 bp, Artificial Sequence
  chemically synthesized
tcttttacacacaatcatctag

SEQ ID NO: 1213356 - DNA, 22 bp, Artificial Sequence
  chemically synthesized
attctcttttacacacaatcat

SEQ ID NO: 1213357 - DNA, 22 bp, Artificial Sequence
  chemically synthesized
aattctcttttacacacaatca

SEQ ID NO: 1213358 - DNA, 22 bp, Artificial Sequence
  chemically synthesized
acttaattctcttttacacaca

SEQ ID NO: 1213359 - DNA, 22 bp, Artificial Sequence
  chemically synthesized
aacttaattctcttttacacac

SEQ ID NO: 1213360 - DNA, 22 bp, Artificial Sequence
  chemically synthesized
gatgattgtgtgtaaaagagaa

SEQ ID NO: 1213361 - DNA, 22 bp, Artificial Sequence
  chemically synthesized
gatttaacttaattctctttta

SEQ ID NO: 1213362 - DNA, 22 bp, Artificial Sequence
  chemically synthesized
tggatttaacttaattctcttt

SEQ ID NO: 1213363 - DNA, 22 bp, Artificial Sequence
  chemically synthesized
ctggatttaacttaattctctt

SEQ ID NO: 1213364 - DNA, 22 bp, Artificial Sequence
  chemically synthesized
tctggatttaacttaattctct

SEQ ID NO: 1213365 - DNA, 22 bp, Artificial Sequence
  chemically synthesized
tttctggatttaacttaattct

SEQ ID NO: 1213366 - DNA, 22 bp, Artificial Sequence
  chemically synthesized
ctttctggatttaacttaattc

SEQ ID NO: 1213367 - DNA, 22 bp, Artificial Sequence
  chemically synthesized
tgtgtaaaagagaattaagtta

SEQ ID NO: 1213368 - DNA, 22 bp, Artificial Sequence
  chemically synthesized
tctttctggatttaacttaatt

SEQ ID NO: 1213369 - DNA, 22 bp, Artificial Sequence
  chemically synthesized
ttttctttctggatttaactta

SEQ ID NO: 1213370 - DNA, 22 bp, Artificial Sequence
  chemically synthesized
gccctattttctttctggattt

SEQ ID NO: 1213371 - DNA, 22 bp, Artificial Sequence
  chemically synthesized
agttaaatccagaaagaaaata

SEQ ID NO: 1213372 - DNA, 22 bp, Artificial Sequence
  chemically synthesized
acaatgactggccctattttct

SEQ ID NO: 1213373 - DNA, 22 bp, Artificial Sequence
  chemically synthesized
gacaatgactggccctattttc

SEQ ID NO: 1213374 - DNA, 22 bp, Artificial Sequence
  chemically synthesized
aatccagaaagaaaatagggcc

SEQ ID NO: 1213375 - DNA, 22 bp, Artificial Sequence
  chemically synthesized
caggaagaacttgacaatgact

SEQ ID NO: 1213376 - DNA, 22 bp, Artificial Sequence
  chemically synthesized
tgactgcaggaagaacttgaca

SEQ ID NO: 1213377 - DNA, 22 bp, Artificial Sequence
  chemically synthesized
tgtgactgcaggaagaacttga

SEQ ID NO: 1213378 - DNA, 22 bp, Artificial Sequence
  chemically synthesized
ctgtgactgcaggaagaacttg

SEQ ID NO: 1213379 - DNA, 22 bp, Artificial Sequence
  chemically synthesized
tctgtgactgcaggaagaactt

SEQ ID NO: 1213380 - DNA, 22 bp, Artificial Sequence
  chemically synthesized
ttctgtgactgcaggaagaact

SEQ ID NO: 1213381 - DNA, 22 bp, Artificial Sequence
  chemically synthesized
tttctgtgactgcaggaagaac

SEQ ID NO: 1213382 - DNA, 22 bp, Artificial Sequence
  chemically synthesized
atctttttctgtgactgcagga

SEQ ID NO: 1213383 - DNA, 22 bp, Artificial Sequence
  chemically synthesized
tcatctttttctgtgactgcag

SEQ ID NO: 1213384 - DNA, 22 bp, Artificial Sequence
  chemically synthesized
tcaagttcttcctgcagtcaca

SEQ ID NO: 1213385 - DNA, 22 bp, Artificial Sequence
  chemically synthesized
ttctcatctttttctgtgactg

SEQ ID NO: 1213386 - DNA, 22 bp, Artificial Sequence
  chemically synthesized
ttcctgcagtcacagaaaaaga

SEQ ID NO: 1213387 - DNA, 22 bp, Artificial Sequence
  chemically synthesized
aagttattctcatctttttctg

SEQ ID NO: 1213388 - DNA, 22 bp, Artificial Sequence
  chemically synthesized
cctgcagtcacagaaaaagatg

SEQ ID NO: 1213389 - DNA, 22 bp, Artificial Sequence
  chemically synthesized
ctgcagtcacagaaaaagatga

SEQ ID NO: 1213390 - DNA, 22 bp, Artificial Sequence
  chemically synthesized
cagtcacagaaaaagatgagaa

SEQ ID NO: 1213391 - DNA, 22 bp, Artificial Sequence
  chemically synthesized
tacaaccaccaccatagttcaa

SEQ ID NO: 1213392 - DNA, 22 bp, Artificial Sequence
  chemically synthesized
cacctgtacaaccaccaccata

SEQ ID NO: 1213393 - DNA, 22 bp, Artificial Sequence
  chemically synthesized
tccacctgtacaaccaccacca

SEQ ID NO: 1213394 - DNA, 22 bp, Artificial Sequence
  chemically synthesized
gaactatggtggtggttgtaca

SEQ ID NO: 1213395 - DNA, 22 bp, Artificial Sequence
  chemically synthesized
aactatggtggtggttgtacag

SEQ ID NO: 1213396 - DNA, 22 bp, Artificial Sequence
  chemically synthesized
atacctctccacctgtacaacc

SEQ ID NO: 1213397 - DNA, 22 bp, Artificial Sequence
  chemically synthesized
tggtggtggttgtacaggtgga

SEQ ID NO: 1213398 - DNA, 22 bp, Artificial Sequence
  chemically synthesized
aatcattcatacctctccacct

SEQ ID NO: 1213399 - DNA, 22 bp, Artificial Sequence
  chemically synthesized
tacaggtggagaggtatgaatg

SEQ ID NO: 1213400 - DNA, 22 bp, Artificial Sequence
  chemically synthesized
tatatcactaaatcattcatac

SEQ ID NO: 1213401 - DNA, 22 bp, Artificial Sequence
  chemically synthesized
agtgatatacagtgggccctcc

SEQ ID NO: 1213402 - DNA, 22 bp, Artificial Sequence
  chemically synthesized
gtgatatacagtgggccctccg

SEQ ID NO: 1213403 - DNA, 22 bp, Artificial Sequence
  chemically synthesized
cagatacagaacccgcagatac

SEQ ID NO: 1213404 - DNA, 22 bp, Artificial Sequence
  chemically synthesized
gcagatacagaacccgcagata

SEQ ID NO: 1213405 - DNA, 22 bp, Artificial Sequence
  chemically synthesized
aatttgcagatacagaacccgc

SEQ ID NO: 1213406 - DNA, 22 bp, Artificial Sequence
  chemically synthesized
gaatttgcagatacagaacccg

SEQ ID NO: 1213407 - DNA, 22 bp, Artificial Sequence
  chemically synthesized
tttgaatttgcagatacagaac

SEQ ID NO: 1213408 - DNA, 22 bp, Artificial Sequence
  chemically synthesized
cgtatctgcgggttctgtatct

SEQ ID NO: 1213409 - DNA, 22 bp, Artificial Sequence
  chemically synthesized
cgggttctgtatctgcaaattc

SEQ ID NO: 1213410 - DNA, 22 bp, Artificial Sequence
  chemically synthesized
tgtatctgcaaattcaaataac

SEQ ID NO: 1213411 - DNA, 22 bp, Artificial Sequence
  chemically synthesized
tatcaaatcagaggttatttga

SEQ ID NO: 1213412 - DNA, 22 bp, Artificial Sequence
  chemically synthesized
tatctgcaaattcaaataacct

SEQ ID NO: 1213413 - DNA, 22 bp, Artificial Sequence
  chemically synthesized
ttgtatcaaatcagaggttatt

SEQ ID NO: 1213414 - DNA, 22 bp, Artificial Sequence
  chemically synthesized
caaattcaaataacctctgatt

SEQ ID NO: 1213415 - DNA, 22 bp, Artificial Sequence
  chemically synthesized
accctattgtatcaaatcagag

SEQ ID NO: 1213416 - DNA, 22 bp, Artificial Sequence
  chemically synthesized
aaataacctctgatttgataca

SEQ ID NO: 1213417 - DNA, 22 bp, Artificial Sequence
  chemically synthesized
tattcaccctattgtatcaaat

SEQ ID NO: 1213418 - DNA, 22 bp, Artificial Sequence
  chemically synthesized
actatattcaccctattgtatc

SEQ ID NO: 1213419 - DNA, 22 bp, Artificial Sequence
  chemically synthesized
ttgactatattcaccctattgt

SEQ ID NO: 1213420 - DNA, 22 bp, Artificial Sequence
  chemically synthesized
tgatttgatacaatagggtgaa

SEQ ID NO: 1213421 - DNA, 22 bp, Artificial Sequence
  chemically synthesized
atttgatacaatagggtgaata

SEQ ID NO: 1213422 - DNA, 22 bp, Artificial Sequence
  chemically synthesized
gatacaatagggtgaatatagt

SEQ ID NO: 1213423 - DNA, 22 bp, Artificial Sequence
  chemically synthesized
atacaatagggtgaatatagtc

SEQ ID NO: 1213424 - DNA, 22 bp, Artificial Sequence
  chemically synthesized
aaatgcacaattattgactata

SEQ ID NO: 1213425 - DNA, 22 bp, Artificial Sequence
  chemically synthesized
caaatgcacaattattgactat

SEQ ID NO: 1213426 - DNA, 22 bp, Artificial Sequence
  chemically synthesized
tcaaatgcacaattattgacta

SEQ ID NO: 1213427 - DNA, 22 bp, Artificial Sequence
  chemically synthesized
ttttcaaatgcacaattattga

SEQ ID NO: 1213428 - DNA, 22 bp, Artificial Sequence
  chemically synthesized
aagttattttcaaatgcacaat

SEQ ID NO: 1213429 - DNA, 22 bp, Artificial Sequence
  chemically synthesized
gaagttattttcaaatgcacaa

SEQ ID NO: 1213430 - DNA, 22 bp, Artificial Sequence
  chemically synthesized
ttgaagttattttcaaatgcac

SEQ ID NO: 1213431 - DNA, 22 bp, Artificial Sequence
  chemically synthesized
cactcttgaagttattttcaaa

SEQ ID NO: 1213432 - DNA, 22 bp, Artificial Sequence
  chemically synthesized
attacactcttgaagttatttt

SEQ ID NO: 1213433 - DNA, 22 bp, Artificial Sequence
  chemically synthesized
tgcatttgaaaataacttcaag

SEQ ID NO: 1213434 - DNA, 22 bp, Artificial Sequence
  chemically synthesized
taaactaattacactcttgaag

SEQ ID NO: 1213435 - DNA, 22 bp, Artificial Sequence
  chemically synthesized
gaaaataacttcaagagtgtaa

SEQ ID NO: 1213436 - DNA, 22 bp, Artificial Sequence
  chemically synthesized
aaaataacttcaagagtgtaat

SEQ ID NO: 1213437 - DNA, 22 bp, Artificial Sequence
  chemically synthesized
agttataaactaattacactct

SEQ ID NO: 1213438 - DNA, 22 bp, Artificial Sequence
  chemically synthesized
gagttataaactaattacactc

SEQ ID NO: 1213439 - DNA, 22 bp, Artificial Sequence
  chemically synthesized
tgagttataaactaattacact

SEQ ID NO: 1213440 - DNA, 22 bp, Artificial Sequence
  chemically synthesized
tcctttgagttataaactaatt

SEQ ID NO: 1213441 - DNA, 22 bp, Artificial Sequence
  chemically synthesized
atcctttgagttataaactaat

SEQ ID NO: 1213442 - DNA, 22 bp, Artificial Sequence
  chemically synthesized
caagagtgtaattagtttataa

SEQ ID NO: 1213443 - DNA, 22 bp, Artificial Sequence
  chemically synthesized
aagagtgtaattagtttataac

SEQ ID NO: 1213444 - DNA, 22 bp, Artificial Sequence
  chemically synthesized
aagcatttatcctttgagttat

SEQ ID NO: 1213445 - DNA, 22 bp, Artificial Sequence
  chemically synthesized
gtttataactcaaaggataaat

SEQ ID NO: 1213446 - DNA, 22 bp, Artificial Sequence
  chemically synthesized
ataactcaaaggataaatgctt

SEQ ID NO: 1213447 - DNA, 22 bp, Artificial Sequence
  chemically synthesized
taactcaaaggataaatgcttg

SEQ ID NO: 1213448 - DNA, 22 bp, Artificial Sequence
  chemically synthesized
aaaggataaatgcttgaggtga

SEQ ID NO: 1213449 - DNA, 22 bp, Artificial Sequence
  chemically synthesized
gaggtgacatgctattctcatg

SEQ ID NO: 1213450 - DNA, 22 bp, Artificial Sequence
  chemically synthesized
aggtgacatgctattctcatga

SEQ ID NO: 1213451 - DNA, 22 bp, Artificial Sequence
  chemically synthesized
ttctcatgacgtgcttattcca

SEQ ID NO: 1213452 - DNA, 22 bp, Artificial Sequence
  chemically synthesized
tcatgacgtgcttattccatat

SEQ ID NO: 1213453 - DNA, 22 bp, Artificial Sequence
  chemically synthesized
atagaggcatacaatatggaat

SEQ ID NO: 1213454 - DNA, 22 bp, Artificial Sequence
  chemically synthesized
atgacgtgcttattccatattg

SEQ ID NO: 1213455 - DNA, 22 bp, Artificial Sequence
  chemically synthesized
gatagaggcatacaatatggaa

SEQ ID NO: 1213456 - DNA, 22 bp, Artificial Sequence
  chemically synthesized
tgatagaggcatacaatatgga

SEQ ID NO: 1213457 - DNA, 22 bp, Artificial Sequence
  chemically synthesized
attccatattgtatgcctctat

SEQ ID NO: 1213458 - DNA, 22 bp, Artificial Sequence
  chemically synthesized
ttccatattgtatgcctctatc

SEQ ID NO: 1213459 - DNA, 22 bp, Artificial Sequence
  chemically synthesized
catattgtatgcctctatcaaa

SEQ ID NO: 1213460 - DNA, 22 bp, Artificial Sequence
  chemically synthesized
tatgcctctatcaaaacatctc

SEQ ID NO: 1213461 - DNA, 22 bp, Artificial Sequence
  chemically synthesized
tatcaaaacatctcacgtacca

SEQ ID NO: 1213462 - DNA, 22 bp, Artificial Sequence
  chemically synthesized
tcaaaacatctcacgtaccata

SEQ ID NO: 1213463 - DNA, 22 bp, Artificial Sequence
  chemically synthesized
acgtaccatatatatatacaca

SEQ ID NO: 1213464 - DNA, 22 bp, Artificial Sequence
  chemically synthesized
tgtatatatgatatatatgtgt

SEQ ID NO: 1213465 - DNA, 22 bp, Artificial Sequence
  chemically synthesized
gtgtatatatgatatatatgtg

SEQ ID NO: 1213466 - DNA, 22 bp, Artificial Sequence
  chemically synthesized
tgggtacatggggtgtttgtgt

SEQ ID NO: 1213467 - DNA, 22 bp, Artificial Sequence
  chemically synthesized
gtgggtacatggggtgtttgtg

SEQ ID NO: 1213468 - DNA, 22 bp, Artificial Sequence
  chemically synthesized
tgtgggtacatggggtgtttgt

SEQ ID NO: 1213469 - DNA, 22 bp, Artificial Sequence
  chemically synthesized
ttgtgggtacatggggtgtttg

SEQ ID NO: 1213470 - DNA, 22 bp, Artificial Sequence
  chemically synthesized
tatacacacacacatacacaca

SEQ ID NO: 1213471 - DNA, 22 bp, Artificial Sequence
  chemically synthesized
tatggtgtgtgtatatatacac

SEQ ID NO: 1213472 - DNA, 22 bp, Artificial Sequence
  chemically synthesized
atatatatacacacacatatac

SEQ ID NO: 1213473 - DNA, 22 bp, Artificial Sequence
  chemically synthesized
tatatatacacacacatataca

SEQ ID NO: 1213474 - DNA, 22 bp, Artificial Sequence
  chemically synthesized
tatatatggtatatatatatac

SEQ ID NO: 1213475 - DNA, 22 bp, Artificial Sequence
  chemically synthesized
ggggtgtgtgtgtatatatatg

SEQ ID NO: 1213476 - DNA, 22 bp, Artificial Sequence
  chemically synthesized
tgggtacatactaggggtgtgt

SEQ ID NO: 1213477 - DNA, 22 bp, Artificial Sequence
  chemically synthesized
gtgggtacatactaggggtgtg

SEQ ID NO: 1213478 - DNA, 22 bp, Artificial Sequence
  chemically synthesized
tgtgggtacatactaggggtgt

SEQ ID NO: 1213479 - DNA, 22 bp, Artificial Sequence
  chemically synthesized
ttgtgggtacatactaggggtg

SEQ ID NO: 1213480 - DNA, 22 bp, Artificial Sequence
  chemically synthesized
gaaatttttgtgggtacatact

SEQ ID NO: 1213481 - DNA, 22 bp, Artificial Sequence
  chemically synthesized
ggaaatttttgtgggtacatac

SEQ ID NO: 1213482 - DNA, 22 bp, Artificial Sequence
  chemically synthesized
tggaaatttttgtgggtacata

SEQ ID NO: 1213483 - DNA, 22 bp, Artificial Sequence
  chemically synthesized
ttggaaatttttgtgggtacat

SEQ ID NO: 1213484 - DNA, 22 bp, Artificial Sequence
  chemically synthesized
tttggaaatttttgtgggtaca

SEQ ID NO: 1213485 - DNA, 22 bp, Artificial Sequence
  chemically synthesized
ttttggaaatttttgtgggtac

SEQ ID NO: 1213486 - DNA, 22 bp, Artificial Sequence
  chemically synthesized
tttttggaaatttttgtgggta

SEQ ID NO: 1213487 - DNA, 22 bp, Artificial Sequence
  chemically synthesized
ttttttttggaaatttttgtgg

SEQ ID NO: 1213488 - DNA, 22 bp, Artificial Sequence
  chemically synthesized
attttttttggaaatttttgtg

SEQ ID NO: 1213489 - DNA, 22 bp, Artificial Sequence
  chemically synthesized
gtatgtacccacaaaaatttcc

SEQ ID NO: 1213490 - DNA, 22 bp, Artificial Sequence
  chemically synthesized
ggaaacaatttattttttttgg

SEQ ID NO: 1213491 - DNA, 22 bp, Artificial Sequence
  chemically synthesized
gggaaacaatttattttttttg

SEQ ID NO: 1213492 - DNA, 22 bp, Artificial Sequence
  chemically synthesized
tttgggaaacaatttatttttt

SEQ ID NO: 1213493 - DNA, 22 bp, Artificial Sequence
  chemically synthesized
atttgggaaacaatttattttt

SEQ ID NO: 1213494 - DNA, 22 bp, Artificial Sequence
  chemically synthesized
tatttgggaaacaatttatttt

SEQ ID NO: 1213495 - DNA, 22 bp, Artificial Sequence
  chemically synthesized
ttatttgggaaacaatttattt

SEQ ID NO: 1213496 - DNA, 22 bp, Artificial Sequence
  chemically synthesized
tttatttgggaaacaatttatt

SEQ ID NO: 1213497 - DNA, 22 bp, Artificial Sequence
  chemically synthesized
ttttatttgggaaacaatttat

SEQ ID NO: 1213498 - DNA, 22 bp, Artificial Sequence
  chemically synthesized
ccaaaaaaaataaattgtttcc

SEQ ID NO: 1213499 - DNA, 22 bp, Artificial Sequence
  chemically synthesized
caaaaaaaataaattgtttccc

SEQ ID NO: 1213500 - DNA, 22 bp, Artificial Sequence
  chemically synthesized
aatatttttttatttgggaaac

SEQ ID NO: 1213501 - DNA, 22 bp, Artificial Sequence
  chemically synthesized
ctgaatatttttttatttggga

SEQ ID NO: 1213502 - DNA, 22 bp, Artificial Sequence
  chemically synthesized
cctgaatatttttttatttggg

SEQ ID NO: 1213503 - DNA, 22 bp, Artificial Sequence
  chemically synthesized
tatttcctgaatatttttttat

SEQ ID NO: 1213504 - DNA, 22 bp, Artificial Sequence
  chemically synthesized
ttgtatttcctgaatatttttt

SEQ ID NO: 1213505 - DNA, 22 bp, Artificial Sequence
  chemically synthesized
tttcccaaataaaaaaatattc

SEQ ID NO: 1213506 - DNA, 22 bp, Artificial Sequence
  chemically synthesized
attgtatttcctgaatattttt

SEQ ID NO: 1213507 - DNA, 22 bp, Artificial Sequence
  chemically synthesized
tattgtatttcctgaatatttt

SEQ ID NO: 1213508 - DNA, 22 bp, Artificial Sequence
  chemically synthesized
ttattgtatttcctgaatattt

SEQ ID NO: 1213509 - DNA, 22 bp, Artificial Sequence
  chemically synthesized
cccaaataaaaaaatattcagg

SEQ ID NO: 1213510 - DNA, 22 bp, Artificial Sequence
  chemically synthesized
ccaaataaaaaaatattcagga

SEQ ID NO: 1213511 - DNA, 22 bp, Artificial Sequence
  chemically synthesized
atttttattgtatttcctgaat

SEQ ID NO: 1213512 - DNA, 22 bp, Artificial Sequence
  chemically synthesized
ttaatttttattgtatttcctg

SEQ ID NO: 1213513 - DNA, 22 bp, Artificial Sequence
  chemically synthesized
tcctgttaatttttattgtatt

SEQ ID NO: 1213514 - DNA, 22 bp, Artificial Sequence
  chemically synthesized
tatcctgttaatttttattgta

SEQ ID NO: 1213515 - DNA, 22 bp, Artificial Sequence
  chemically synthesized
ctatcctgttaatttttattgt

SEQ ID NO: 1213516 - DNA, 22 bp, Artificial Sequence
  chemically synthesized
aggaaatacaataaaaattaac

SEQ ID NO: 1213517 - DNA, 22 bp, Artificial Sequence
  chemically synthesized
acaggatagaaatctccctgtt

SEQ ID NO: 1213518 - DNA, 22 bp, Artificial Sequence
  chemically synthesized
tcacccaggtaataagcatagt

SEQ ID NO: 1213519 - DNA, 22 bp, Artificial Sequence
  chemically synthesized
gtcacccaggtaataagcatag

SEQ ID NO: 1213520 - DNA, 22 bp, Artificial Sequence
  chemically synthesized
cctgttgggtactatgcttatt

SEQ ID NO: 1213521 - DNA, 22 bp, Artificial Sequence
  chemically synthesized
tgtcacccaggtaataagcata

SEQ ID NO: 1213522 - DNA, 22 bp, Artificial Sequence
  chemically synthesized
ctttgtcacccaggtaataagc

SEQ ID NO: 1213523 - DNA, 22 bp, Artificial Sequence
  chemically synthesized
ttgggtactatgcttattacct

SEQ ID NO: 1213524 - DNA, 22 bp, Artificial Sequence
  chemically synthesized
ggtactatgcttattacctggg

SEQ ID NO: 1213525 - DNA, 22 bp, Artificial Sequence
  chemically synthesized
tgcttattacctgggtgacaaa

SEQ ID NO: 1213526 - DNA, 22 bp, Artificial Sequence
  chemically synthesized
agtacagattactttgtcaccc

SEQ ID NO: 1213527 - DNA, 22 bp, Artificial Sequence
  chemically synthesized
tgagtacagattactttgtcac

SEQ ID NO: 1213528 - DNA, 22 bp, Artificial Sequence
  chemically synthesized
attacctgggtgacaaagtaat

SEQ ID NO: 1213529 - DNA, 22 bp, Artificial Sequence
  chemically synthesized
ttacctgggtgacaaagtaatc

SEQ ID NO: 1213530 - DNA, 22 bp, Artificial Sequence
  chemically synthesized
cctgggtgacaaagtaatctgt

SEQ ID NO: 1213531 - DNA, 22 bp, Artificial Sequence
  chemically synthesized
caggggctctgagtacagatta

SEQ ID NO: 1213532 - DNA, 22 bp, Artificial Sequence
  chemically synthesized
ggtgacaaagtaatctgtactc

SEQ ID NO: 1213533 - DNA, 22 bp, Artificial Sequence
  chemically synthesized
tgtgttacaggggctctgagta

SEQ ID NO: 1213534 - DNA, 22 bp, Artificial Sequence
  chemically synthesized
tactcagagcccctgtaacaca

SEQ ID NO: 1213535 - DNA, 22 bp, Artificial Sequence
  chemically synthesized
tatagataaattatgtgttaca

SEQ ID NO: 1213536 - DNA, 22 bp, Artificial Sequence
  chemically synthesized
ttatatagataaattatgtgtt

SEQ ID NO: 1213537 - DNA, 22 bp, Artificial Sequence
  chemically synthesized
agagcccctgtaacacataatt

SEQ ID NO: 1213538 - DNA, 22 bp, Artificial Sequence
  chemically synthesized
gttatatagataaattatgtgt

SEQ ID NO: 1213539 - DNA, 22 bp, Artificial Sequence
  chemically synthesized
tgttatatagataaattatgtg

SEQ ID NO: 1213540 - DNA, 22 bp, Artificial Sequence
  chemically synthesized
ttgttatatagataaattatgt

SEQ ID NO: 1213541 - DNA, 22 bp, Artificial Sequence
  chemically synthesized
taacacataatttatctatata

SEQ ID NO: 1213542 - DNA, 22 bp, Artificial Sequence
  chemically synthesized
cacatgcatttttgttatatag

SEQ ID NO: 1213543 - DNA, 22 bp, Artificial Sequence
  chemically synthesized
agggttacacatgcatttttgt

SEQ ID NO: 1213544 - DNA, 22 bp, Artificial Sequence
  chemically synthesized
atctatataacaaaaatgcatg

SEQ ID NO: 1213545 - DNA, 22 bp, Artificial Sequence
  chemically synthesized
tctatataacaaaaatgcatgt

SEQ ID NO: 1213546 - DNA, 22 bp, Artificial Sequence
  chemically synthesized
ggttcagggttacacatgcatt

SEQ ID NO: 1213547 - DNA, 22 bp, Artificial Sequence
  chemically synthesized
taggttcagggttacacatgca

SEQ ID NO: 1213548 - DNA, 22 bp, Artificial Sequence
  chemically synthesized
tataacaaaaatgcatgtgtaa

SEQ ID NO: 1213549 - DNA, 22 bp, Artificial Sequence
  chemically synthesized
ctaggttcagggttacacatgc

SEQ ID NO: 1213550 - DNA, 22 bp, Artificial Sequence
  chemically synthesized
atttctaggttcagggttacac

SEQ ID NO: 1213551 - DNA, 22 bp, Artificial Sequence
  chemically synthesized
aatttctaggttcagggttaca

SEQ ID NO: 1213552 - DNA, 22 bp, Artificial Sequence
  chemically synthesized
tgtttaatttctaggttcaggg

SEQ ID NO: 1213553 - DNA, 22 bp, Artificial Sequence
  chemically synthesized
gtgtttaatttctaggttcagg

SEQ ID NO: 1213554 - DNA, 22 bp, Artificial Sequence
  chemically synthesized
tgtgtttaatttctaggttcag

SEQ ID NO: 1213555 - DNA, 22 bp, Artificial Sequence
  chemically synthesized
tttgtgtttaatttctaggttc

SEQ ID NO: 1213556 - DNA, 22 bp, Artificial Sequence
  chemically synthesized
ttctttgtgtttaatttctagg

SEQ ID NO: 1213557 - DNA, 22 bp, Artificial Sequence
  chemically synthesized
attctttgtgtttaatttctag

SEQ ID NO: 1213558 - DNA, 22 bp, Artificial Sequence
  chemically synthesized
tattctttgtgtttaatttcta

SEQ ID NO: 1213559 - DNA, 22 bp, Artificial Sequence
  chemically synthesized
cattttattctttgtgtttaat

SEQ ID NO: 1213560 - DNA, 22 bp, Artificial Sequence
  chemically synthesized
aacctagaaattaaacacaaag

SEQ ID NO: 1213561 - DNA, 22 bp, Artificial Sequence
  chemically synthesized
ttacattttattctttgtgttt

SEQ ID NO: 1213562 - DNA, 22 bp, Artificial Sequence
  chemically synthesized
gaaattaaacacaaagaataaa

SEQ ID NO: 1213563 - DNA, 22 bp, Artificial Sequence
  chemically synthesized
aacacaaagaataaaatgtaac

SEQ ID NO: 1213564 - DNA, 22 bp, Artificial Sequence
  chemically synthesized
atacaatataaatagtacgtaa

SEQ ID NO: 1213565 - DNA, 22 bp, Artificial Sequence
  chemically synthesized
taatacctaatacaatataaat

SEQ ID NO: 1213566 - DNA, 22 bp, Artificial Sequence
  chemically synthesized
ataatacctaatacaatataaa

SEQ ID NO: 1213567 - DNA, 22 bp, Artificial Sequence
  chemically synthesized
tttacgtactatttatattgta

SEQ ID NO: 1213568 - DNA, 22 bp, Artificial Sequence
  chemically synthesized
cttataatacctaatacaatat

SEQ ID NO: 1213569 - DNA, 22 bp, Artificial Sequence
  chemically synthesized
acgtactatttatattgtatta

SEQ ID NO: 1213570 - DNA, 22 bp, Artificial Sequence
  chemically synthesized
cgtactatttatattgtattag

SEQ ID NO: 1213571 - DNA, 22 bp, Artificial Sequence
  chemically synthesized
gattacttataatacctaatac

SEQ ID NO: 1213572 - DNA, 22 bp, Artificial Sequence
  chemically synthesized
tagattacttataatacctaat

SEQ ID NO: 1213573 - DNA, 22 bp, Artificial Sequence
  chemically synthesized
tttatattgtattaggtattat

SEQ ID NO: 1213574 - DNA, 22 bp, Artificial Sequence
  chemically synthesized
tctctagattacttataatacc

SEQ ID NO: 1213575 - DNA, 22 bp, Artificial Sequence
  chemically synthesized
atattgtattaggtattataag

SEQ ID NO: 1213576 - DNA, 22 bp, Artificial Sequence
  chemically synthesized
tattgtattaggtattataagt

SEQ ID NO: 1213577 - DNA, 22 bp, Artificial Sequence
  chemically synthesized
aattatctctagattacttata

SEQ ID NO: 1213578 - DNA, 22 bp, Artificial Sequence
  chemically synthesized
tattaggtattataagtaatct

SEQ ID NO: 1213579 - DNA, 22 bp, Artificial Sequence
  chemically synthesized
cattaaattatctctagattac

SEQ ID NO: 1213580 - DNA, 22 bp, Artificial Sequence
  chemically synthesized
acattaaattatctctagatta

SEQ ID NO: 1213581 - DNA, 22 bp, Artificial Sequence
  chemically synthesized
ggtattataagtaatctagaga

SEQ ID NO: 1213582 - DNA, 22 bp, Artificial Sequence
  chemically synthesized
tttacattaaattatctctaga

SEQ ID NO: 1213583 - DNA, 22 bp, Artificial Sequence
  chemically synthesized
ctgtttacattaaattatctct

SEQ ID NO: 1213584 - DNA, 22 bp, Artificial Sequence
  chemically synthesized
taagtaatctagagataattta

SEQ ID NO: 1213585 - DNA, 22 bp, Artificial Sequence
  chemically synthesized
tgcacatcctcctgtttacatt

SEQ ID NO: 1213586 - DNA, 22 bp, Artificial Sequence
  chemically synthesized
gagataatttaatgtaaacagg

SEQ ID NO: 1213587 - DNA, 22 bp, Artificial Sequence
  chemically synthesized
catataacctatgcacatcctc

SEQ ID NO: 1213588 - DNA, 22 bp, Artificial Sequence
  chemically synthesized
aatgtaaacaggaggatgtgca

SEQ ID NO: 1213589 - DNA, 22 bp, Artificial Sequence
  chemically synthesized
gcatataacctatgcacatcct

SEQ ID NO: 1213590 - DNA, 22 bp, Artificial Sequence
  chemically synthesized
atgtaaacaggaggatgtgcat

SEQ ID NO: 1213591 - DNA, 22 bp, Artificial Sequence
  chemically synthesized
tataaatgatgtcatatttgca

SEQ ID NO: 1213592 - DNA, 22 bp, Artificial Sequence
  chemically synthesized
atataaatgatgtcatatttgc

SEQ ID NO: 1213593 - DNA, 22 bp, Artificial Sequence
  chemically synthesized
cttatataaatgatgtcatatt

SEQ ID NO: 1213594 - DNA, 22 bp, Artificial Sequence
  chemically synthesized
agttccttatataaatgatgtc

SEQ ID NO: 1213595 - DNA, 22 bp, Artificial Sequence
  chemically synthesized
tatgcaaatatgacatcattta

SEQ ID NO: 1213596 - DNA, 22 bp, Artificial Sequence
  chemically synthesized
aagttccttatataaatgatgt

SEQ ID NO: 1213597 - DNA, 22 bp, Artificial Sequence
  chemically synthesized
tggatgcttaagttccttatat

SEQ ID NO: 1213598 - DNA, 22 bp, Artificial Sequence
  chemically synthesized
aaatctgtggatgcttaagttc

SEQ ID NO: 1213599 - DNA, 22 bp, Artificial Sequence
  chemically synthesized
atataaggaacttaagcatcca

SEQ ID NO: 1213600 - DNA, 22 bp, Artificial Sequence
  chemically synthesized
tataaggaacttaagcatccac

SEQ ID NO: 1213601 - DNA, 22 bp, Artificial Sequence
  chemically synthesized
cagatactaaaatctgtggatg

SEQ ID NO: 1213602 - DNA, 22 bp, Artificial Sequence
  chemically synthesized
ggaactccagatactaaaatct

SEQ ID NO: 1213603 - DNA, 22 bp, Artificial Sequence
  chemically synthesized
aagcatccacagattttagtat

SEQ ID NO: 1213604 - DNA, 22 bp, Artificial Sequence
  chemically synthesized
taggaactccagatactaaaat

SEQ ID NO: 1213605 - DNA, 22 bp, Artificial Sequence
  chemically synthesized
agcatccacagattttagtatc

SEQ ID NO: 1213606 - DNA, 22 bp, Artificial Sequence
  chemically synthesized
gttctaggaactccagatacta

SEQ ID NO: 1213607 - DNA, 22 bp, Artificial Sequence
  chemically synthesized
agaactggttctaggaactcca

SEQ ID NO: 1213608 - DNA, 22 bp, Artificial Sequence
  chemically synthesized
tctgagaactggttctaggaac

SEQ ID NO: 1213609 - DNA, 22 bp, Artificial Sequence
  chemically synthesized
tagtatctggagttcctagaac

SEQ ID NO: 1213610 - DNA, 22 bp, Artificial Sequence
  chemically synthesized
agtatctggagttcctagaacc

SEQ ID NO: 1213611 - DNA, 22 bp, Artificial Sequence
  chemically synthesized
gtatctggagttcctagaacca

SEQ ID NO: 1213612 - DNA, 22 bp, Artificial Sequence
  chemically synthesized
actatctgagaactggttctag

SEQ ID NO: 1213613 - DNA, 22 bp, Artificial Sequence
  chemically synthesized
gagttcctagaaccagttctca

SEQ ID NO: 1213614 - DNA, 22 bp, Artificial Sequence
  chemically synthesized
tgcctcactatctgagaactgg

SEQ ID NO: 1213615 - DNA, 22 bp, Artificial Sequence
  chemically synthesized
ctagaaccagttctcagatagt

SEQ ID NO: 1213616 - DNA, 22 bp, Artificial Sequence
  chemically synthesized
gaaccagttctcagatagtgag

SEQ ID NO: 1213617 - DNA, 22 bp, Artificial Sequence
  chemically synthesized
agaatacgactgtgcctcacta

SEQ ID NO: 1213618 - DNA, 22 bp, Artificial Sequence
  chemically synthesized
aagaatacgactgtgcctcact

SEQ ID NO: 1213619 - DNA, 22 bp, Artificial Sequence
  chemically synthesized
taagaatacgactgtgcctcac

SEQ ID NO: 1213620 - DNA, 22 bp, Artificial Sequence
  chemically synthesized
tcagatagtgaggcacagtcgt

SEQ ID NO: 1213621 - DNA, 22 bp, Artificial Sequence
  chemically synthesized
tactttaagaatacgactgtgc

SEQ ID NO: 1213622 - DNA, 22 bp, Artificial Sequence
  chemically synthesized
agatagtgaggcacagtcgtat

SEQ ID NO: 1213623 - DNA, 22 bp, Artificial Sequence
  chemically synthesized
tagattatactttaagaatacg

SEQ ID NO: 1213624 - DNA, 22 bp, Artificial Sequence
  chemically synthesized
atagattatactttaagaatac

SEQ ID NO: 1213625 - DNA, 22 bp, Artificial Sequence
  chemically synthesized
aatccatgatgccttatagatt

SEQ ID NO: 1213626 - DNA, 22 bp, Artificial Sequence
  chemically synthesized
caatccatgatgccttatagat

SEQ ID NO: 1213627 - DNA, 22 bp, Artificial Sequence
  chemically synthesized
ttaaagtataatctataaggca

SEQ ID NO: 1213628 - DNA, 22 bp, Artificial Sequence
  chemically synthesized
tttcaatccatgatgccttata

SEQ ID NO: 1213629 - DNA, 22 bp, Artificial Sequence
  chemically synthesized
aaagtataatctataaggcatc

SEQ ID NO: 1213630 - DNA, 22 bp, Artificial Sequence
  chemically synthesized
aagtataatctataaggcatca

SEQ ID NO: 1213631 - DNA, 22 bp, Artificial Sequence
  chemically synthesized
gaactatttcaatccatgatgc

SEQ ID NO: 1213632 - DNA, 22 bp, Artificial Sequence
  chemically synthesized
taaggcatcatggattgaaata

SEQ ID NO: 1213633 - DNA, 22 bp, Artificial Sequence
  chemically synthesized
agtatgaaaaaagtgaagtatt

SEQ ID NO: 1213634 - DNA, 22 bp, Artificial Sequence
  chemically synthesized
aagtatgaaaaaagtgaagtat

SEQ ID NO: 1213635 - DNA, 22 bp, Artificial Sequence
  chemically synthesized
aaatagttctaatacttcactt

SEQ ID NO: 1213636 - DNA, 22 bp, Artificial Sequence
  chemically synthesized
taagtatgaaaaaagtgaagta

SEQ ID NO: 1213637 - DNA, 22 bp, Artificial Sequence
  chemically synthesized
agcagctttaagtatgaaaaaa

SEQ ID NO: 1213638 - DNA, 22 bp, Artificial Sequence
  chemically synthesized
taatacttcacttttttcatac

SEQ ID NO: 1213639 - DNA, 22 bp, Artificial Sequence
  chemically synthesized
aagcagctttaagtatgaaaaa

SEQ ID NO: 1213640 - DNA, 22 bp, Artificial Sequence
  chemically synthesized
atacttcacttttttcatactt

SEQ ID NO: 1213641 - DNA, 22 bp, Artificial Sequence
  chemically synthesized
gtcatttaagcagctttaagta

SEQ ID NO: 1213642 - DNA, 22 bp, Artificial Sequence
  chemically synthesized
cacttttttcatacttaaagct

SEQ ID NO: 1213643 - DNA, 22 bp, Artificial Sequence
  chemically synthesized
acttttttcatacttaaagctg

SEQ ID NO: 1213644 - DNA, 22 bp, Artificial Sequence
  chemically synthesized
agttggtcatttaagcagcttt

SEQ ID NO: 1213645 - DNA, 22 bp, Artificial Sequence
  chemically synthesized
ttttcatacttaaagctgctta

SEQ ID NO: 1213646 - DNA, 22 bp, Artificial Sequence
  chemically synthesized
aagttggtcatttaagcagctt

SEQ ID NO: 1213647 - DNA, 22 bp, Artificial Sequence
  chemically synthesized
tttcatacttaaagctgcttaa

SEQ ID NO: 1213648 - DNA, 22 bp, Artificial Sequence
  chemically synthesized
taagttggtcatttaagcagct

SEQ ID NO: 1213649 - DNA, 22 bp, Artificial Sequence
  chemically synthesized
ttcatacttaaagctgcttaaa

SEQ ID NO: 1213650 - DNA, 22 bp, Artificial Sequence
  chemically synthesized
ttaagttggtcatttaagcagc

SEQ ID NO: 1213651 - DNA, 22 bp, Artificial Sequence
  chemically synthesized
tcatacttaaagctgcttaaat

SEQ ID NO: 1213652 - DNA, 22 bp, Artificial Sequence
  chemically synthesized
catacttaaagctgcttaaatg

SEQ ID NO: 1213653 - DNA, 22 bp, Artificial Sequence
  chemically synthesized
atacttaaagctgcttaaatga

SEQ ID NO: 1213654 - DNA, 22 bp, Artificial Sequence
  chemically synthesized
tcttttaagttggtcatttaag

SEQ ID NO: 1213655 - DNA, 22 bp, Artificial Sequence
  chemically synthesized
aaagctgcttaaatgaccaact

SEQ ID NO: 1213656 - DNA, 22 bp, Artificial Sequence
  chemically synthesized
aagctgcttaaatgaccaactt

SEQ ID NO: 1213657 - DNA, 22 bp, Artificial Sequence
  chemically synthesized
cttaaatgaccaacttaaaaga

SEQ ID NO: 1213658 - DNA, 22 bp, Artificial Sequence
  chemically synthesized
taataataaatctatcttttaa

SEQ ID NO: 1213659 - DNA, 22 bp, Artificial Sequence
  chemically synthesized
aaatgaccaacttaaaagatag

SEQ ID NO: 1213660 - DNA, 22 bp, Artificial Sequence
  chemically synthesized
aatgaccaacttaaaagataga

SEQ ID NO: 1213661 - DNA, 22 bp, Artificial Sequence
  chemically synthesized
tgtaataataaatctatctttt

SEQ ID NO: 1213662 - DNA, 22 bp, Artificial Sequence
  chemically synthesized
aaaagatagatttattattaca

SEQ ID NO: 1213663 - DNA, 22 bp, Artificial Sequence
  chemically synthesized
aaagatagatttattattacag

SEQ ID NO: 1213664 - DNA, 22 bp, Artificial Sequence
  chemically synthesized
gatcgggaaatctctgtaataa

SEQ ID NO: 1213665 - DNA, 22 bp, Artificial Sequence
  chemically synthesized
ggatcgggaaatctctgtaata

SEQ ID NO: 1213666 - DNA, 22 bp, Artificial Sequence
  chemically synthesized
atagcttggatcgggaaatctc

SEQ ID NO: 1213667 - DNA, 22 bp, Artificial Sequence
  chemically synthesized
attattacagagatttcccgat

SEQ ID NO: 1213668 - DNA, 22 bp, Artificial Sequence
  chemically synthesized
ttattacagagatttcccgatc

SEQ ID NO: 1213669 - DNA, 22 bp, Artificial Sequence
  chemically synthesized
acattaatagcttggatcggga

SEQ ID NO: 1213670 - DNA, 22 bp, Artificial Sequence
  chemically synthesized
ttacagagatttcccgatccaa

SEQ ID NO: 1213671 - DNA, 22 bp, Artificial Sequence
  chemically synthesized
cagagatttcccgatccaagct

SEQ ID NO: 1213672 - DNA, 22 bp, Artificial Sequence
  chemically synthesized
cactgacattaatagcttggat

SEQ ID NO: 1213673 - DNA, 22 bp, Artificial Sequence
  chemically synthesized
cccgatccaagctattaatgtc

SEQ ID NO: 1213674 - DNA, 22 bp, Artificial Sequence
  chemically synthesized
ccgatccaagctattaatgtca

SEQ ID NO: 1213675 - DNA, 22 bp, Artificial Sequence
  chemically synthesized
catgaatcaaccatgtctgcac

SEQ ID NO: 1213676 - DNA, 22 bp, Artificial Sequence
  chemically synthesized
ttaatgtcagtgcagacatggt

SEQ ID NO: 1213677 - DNA, 22 bp, Artificial Sequence
  chemically synthesized
atgtcagtgcagacatggttga

SEQ ID NO: 1213678 - DNA, 22 bp, Artificial Sequence
  chemically synthesized
ccccccccacccccgctccatg

SEQ ID NO: 1213679 - DNA, 22 bp, Artificial Sequence
  chemically synthesized
cccccccccacccccgctccat

SEQ ID NO: 1213680 - DNA, 22 bp, Artificial Sequence
  chemically synthesized
attcatggagcgggggtggggg

SEQ ID NO: 1213681 - DNA, 22 bp, Artificial Sequence
  chemically synthesized
atggagcgggggtggggggggg

SEQ ID NO: 1213682 - DNA, 22 bp, Artificial Sequence
  chemically synthesized
caggtgtgtatttccccccccc

SEQ ID NO: 1213683 - DNA, 22 bp, Artificial Sequence
  chemically synthesized
aacacacagatgagttccaggt

SEQ ID NO: 1213684 - DNA, 22 bp, Artificial Sequence
  chemically synthesized
taaacacacagatgagttccag

SEQ ID NO: 1213685 - DNA, 22 bp, Artificial Sequence
  chemically synthesized
tcctctaaacacacagatgagt

SEQ ID NO: 1213686 - DNA, 22 bp, Artificial Sequence
  chemically synthesized
gtcctctaaacacacagatgag

SEQ ID NO: 1213687 - DNA, 22 bp, Artificial Sequence
  chemically synthesized
atttgtcctctaaacacacaga

SEQ ID NO: 1213688 - DNA, 22 bp, Artificial Sequence
  chemically synthesized
aatttgtcctctaaacacacag

SEQ ID NO: 1213689 - DNA, 22 bp, Artificial Sequence
  chemically synthesized
gaactcatctgtgtgtttagag

SEQ ID NO: 1213690 - DNA, 22 bp, Artificial Sequence
  chemically synthesized
atctgtgtgtttagaggacaaa

SEQ ID NO: 1213691 - DNA, 22 bp, Artificial Sequence
  chemically synthesized
aaaatgatttaatttgtcctct

SEQ ID NO: 1213692 - DNA, 22 bp, Artificial Sequence
  chemically synthesized
aaaaatgatttaatttgtcctc

SEQ ID NO: 1213693 - DNA, 22 bp, Artificial Sequence
  chemically synthesized
tttaaaaatgatttaatttgtc

SEQ ID NO: 1213694 - DNA, 22 bp, Artificial Sequence
  chemically synthesized
tgtgtttagaggacaaattaaa

SEQ ID NO: 1213695 - DNA, 22 bp, Artificial Sequence
  chemically synthesized
gggctatttaaaaatgatttaa

SEQ ID NO: 1213696 - DNA, 22 bp, Artificial Sequence
  chemically synthesized
agaggacaaattaaatcatttt

SEQ ID NO: 1213697 - DNA, 22 bp, Artificial Sequence
  chemically synthesized
gaggacaaattaaatcattttt

SEQ ID NO: 1213698 - DNA, 22 bp, Artificial Sequence
  chemically synthesized
agatcatcctggggctatttaa

SEQ ID NO: 1213699 - DNA, 22 bp, Artificial Sequence
  chemically synthesized
aatcatttttaaatagccccag

SEQ ID NO: 1213700 - DNA, 22 bp, Artificial Sequence
  chemically synthesized
atggctgagatcatcctggggc

SEQ ID NO: 1213701 - DNA, 22 bp, Artificial Sequence
  chemically synthesized
aatggctgagatcatcctgggg

SEQ ID NO: 1213702 - DNA, 22 bp, Artificial Sequence
  chemically synthesized
taatggctgagatcatcctggg

SEQ ID NO: 1213703 - DNA, 22 bp, Artificial Sequence
  chemically synthesized
tttaatggctgagatcatcctg

SEQ ID NO: 1213704 - DNA, 22 bp, Artificial Sequence
  chemically synthesized
ttaaatagccccaggatgatct

SEQ ID NO: 1213705 - DNA, 22 bp, Artificial Sequence
  chemically synthesized
taaatagccccaggatgatctc

SEQ ID NO: 1213706 - DNA, 22 bp, Artificial Sequence
  chemically synthesized
aaatagccccaggatgatctca

SEQ ID NO: 1213707 - DNA, 22 bp, Artificial Sequence
  chemically synthesized
ctctttaatggctgagatcatc

SEQ ID NO: 1213708 - DNA, 22 bp, Artificial Sequence
  chemically synthesized
aatagccccaggatgatctcag

SEQ ID NO: 1213709 - DNA, 22 bp, Artificial Sequence
  chemically synthesized
tgctctttaatggctgagatca

SEQ ID NO: 1213710 - DNA, 22 bp, Artificial Sequence
  chemically synthesized
ctgctctttaatggctgagatc

SEQ ID NO: 1213711 - DNA, 22 bp, Artificial Sequence
  chemically synthesized
gccttctgctctttaatggctg

SEQ ID NO: 1213712 - DNA, 22 bp, Artificial Sequence
  chemically synthesized
ttagccttctgctctttaatgg

SEQ ID NO: 1213713 - DNA, 22 bp, Artificial Sequence
  chemically synthesized
attagccttctgctctttaatg

SEQ ID NO: 1213714 - DNA, 22 bp, Artificial Sequence
  chemically synthesized
tattagccttctgctctttaat

SEQ ID NO: 1213715 - DNA, 22 bp, Artificial Sequence
  chemically synthesized
ttttattagccttctgctcttt

SEQ ID NO: 1213716 - DNA, 22 bp, Artificial Sequence
  chemically synthesized
agccattaaagagcagaaggct

SEQ ID NO: 1213717 - DNA, 22 bp, Artificial Sequence
  chemically synthesized
aagagcagaaggctaataaaac

SEQ ID NO: 1213718 - DNA, 22 bp, Artificial Sequence
  chemically synthesized
ataggaacagttgttttattag

SEQ ID NO: 1213719 - DNA, 22 bp, Artificial Sequence
  chemically synthesized
aataggaacagttgttttatta

SEQ ID NO: 1213720 - DNA, 22 bp, Artificial Sequence
  chemically synthesized
agaaaacgatttaataggaaca

SEQ ID NO: 1213721 - DNA, 22 bp, Artificial Sequence
  chemically synthesized
ataaaacaactgttcctattaa

SEQ ID NO: 1213722 - DNA, 22 bp, Artificial Sequence
  chemically synthesized
taaaactcagaaaacgatttaa

SEQ ID NO: 1213723 - DNA, 22 bp, Artificial Sequence
  chemically synthesized
ataaaactcagaaaacgattta

SEQ ID NO: 1213724 - DNA, 22 bp, Artificial Sequence
  chemically synthesized
cttataaaactcagaaaacgat

SEQ ID NO: 1213725 - DNA, 22 bp, Artificial Sequence
  chemically synthesized
ttcctattaaatcgttttctga

SEQ ID NO: 1213726 - DNA, 22 bp, Artificial Sequence
  chemically synthesized
ctattaaatcgttttctgagtt

SEQ ID NO: 1213727 - DNA, 22 bp, Artificial Sequence
  chemically synthesized
ttaaatcgttttctgagtttta

SEQ ID NO: 1213728 - DNA, 22 bp, Artificial Sequence
  chemically synthesized
aatcgttttctgagttttataa

SEQ ID NO: 1213729 - DNA, 22 bp, Artificial Sequence
  chemically synthesized
tctgagttttataagtagatgt

SEQ ID NO: 1213730 - DNA, 22 bp, Artificial Sequence
  chemically synthesized
ctgagttttataagtagatgtc

SEQ ID NO: 1213731 - DNA, 22 bp, Artificial Sequence
  chemically synthesized
tgagttttataagtagatgtcc

SEQ ID NO: 1213732 - DNA, 22 bp, Artificial Sequence
  chemically synthesized
agttttataagtagatgtcctc

SEQ ID NO: 1213733 - DNA, 22 bp, Artificial Sequence
  chemically synthesized
tataagtagatgtcctccctta

SEQ ID NO: 1213734 - DNA, 22 bp, Artificial Sequence
  chemically synthesized
ataagtagatgtcctcccttat

SEQ ID NO: 1213735 - DNA, 22 bp, Artificial Sequence
  chemically synthesized
ccaataaaatacataagggagg

SEQ ID NO: 1213736 - DNA, 22 bp, Artificial Sequence
  chemically synthesized
taagtagatgtcctcccttatg

SEQ ID NO: 1213737 - DNA, 22 bp, Artificial Sequence
  chemically synthesized
ccttatgtattttattggcaat

SEQ ID NO: 1213738 - DNA, 22 bp, Artificial Sequence
  chemically synthesized
taaaggtaacatatattgccaa

SEQ ID NO: 1213739 - DNA, 22 bp, Artificial Sequence
  chemically synthesized
atgtattttattggcaatatat

SEQ ID NO: 1213740 - DNA, 22 bp, Artificial Sequence
  chemically synthesized
tataaaggtaacatatattgcc

SEQ ID NO: 1213741 - DNA, 22 bp, Artificial Sequence
  chemically synthesized
tgtattttattggcaatatatg

SEQ ID NO: 1213742 - DNA, 22 bp, Artificial Sequence
  chemically synthesized
tctataaaggtaacatatattg

SEQ ID NO: 1213743 - DNA, 22 bp, Artificial Sequence
  chemically synthesized
ctctataaaggtaacatatatt

SEQ ID NO: 1213744 - DNA, 22 bp, Artificial Sequence
  chemically synthesized
cttctctataaaggtaacatat

SEQ ID NO: 1213745 - DNA, 22 bp, Artificial Sequence
  chemically synthesized
tattggcaatatatgttacctt

SEQ ID NO: 1213746 - DNA, 22 bp, Artificial Sequence
  chemically synthesized
attggcaatatatgttaccttt

SEQ ID NO: 1213747 - DNA, 22 bp, Artificial Sequence
  chemically synthesized
ttggcaatatatgttaccttta

SEQ ID NO: 1213748 - DNA, 22 bp, Artificial Sequence
  chemically synthesized
gcaatatatgttacctttatag

SEQ ID NO: 1213749 - DNA, 22 bp, Artificial Sequence
  chemically synthesized
tagaaacgctgcttctctataa

SEQ ID NO: 1213750 - DNA, 22 bp, Artificial Sequence
  chemically synthesized
agagctatagaaacgctgcttc

SEQ ID NO: 1213751 - DNA, 22 bp, Artificial Sequence
  chemically synthesized
gagagctatagaaacgctgctt

SEQ ID NO: 1213752 - DNA, 22 bp, Artificial Sequence
  chemically synthesized
cctttatagagaagcagcgttt

SEQ ID NO: 1213753 - DNA, 22 bp, Artificial Sequence
  chemically synthesized
tgagagctatagaaacgctgct

SEQ ID NO: 1213754 - DNA, 22 bp, Artificial Sequence
  chemically synthesized
ttgagagctatagaaacgctgc

SEQ ID NO: 1213755 - DNA, 22 bp, Artificial Sequence
  chemically synthesized
tttgagagctatagaaacgctg

SEQ ID NO: 1213756 - DNA, 22 bp, Artificial Sequence
  chemically synthesized
tatagagaagcagcgtttctat

SEQ ID NO: 1213757 - DNA, 22 bp, Artificial Sequence
  chemically synthesized
atagagaagcagcgtttctata

SEQ ID NO: 1213758 - DNA, 22 bp, Artificial Sequence
  chemically synthesized
tagagaagcagcgtttctatag

SEQ ID NO: 1213759 - DNA, 22 bp, Artificial Sequence
  chemically synthesized
acctttttgagagctatagaaa

SEQ ID NO: 1213760 - DNA, 22 bp, Artificial Sequence
  chemically synthesized
aacctttttgagagctatagaa

SEQ ID NO: 1213761 - DNA, 22 bp, Artificial Sequence
  chemically synthesized
ttaacctttttgagagctatag

SEQ ID NO: 1213762 - DNA, 22 bp, Artificial Sequence
  chemically synthesized
gggttcttaacctttttgagag

SEQ ID NO: 1213763 - DNA, 22 bp, Artificial Sequence
  chemically synthesized
ctatagctctcaaaaaggttaa

SEQ ID NO: 1213764 - DNA, 22 bp, Artificial Sequence
  chemically synthesized
tatagctctcaaaaaggttaag

SEQ ID NO: 1213765 - DNA, 22 bp, Artificial Sequence
  chemically synthesized
tagctctcaaaaaggttaagaa

SEQ ID NO: 1213766 - DNA, 22 bp, Artificial Sequence
  chemically synthesized
taatacacctcgggttcttaac

SEQ ID NO: 1213767 - DNA, 22 bp, Artificial Sequence
  chemically synthesized
tcaaaaaggttaagaacccgag

SEQ ID NO: 1213768 - DNA, 22 bp, Artificial Sequence
  chemically synthesized
gcctataatacacctcgggttc

SEQ ID NO: 1213769 - DNA, 22 bp, Artificial Sequence
  chemically synthesized
aaaaaggttaagaacccgaggt

SEQ ID NO: 1213770 - DNA, 22 bp, Artificial Sequence
  chemically synthesized
agaacccgaggtgtattatagg

SEQ ID NO: 1213771 - DNA, 22 bp, Artificial Sequence
  chemically synthesized
caagagaaattggcctataata

SEQ ID NO: 1213772 - DNA, 22 bp, Artificial Sequence
  chemically synthesized
acaagagaaattggcctataat

SEQ ID NO: 1213773 - DNA, 22 bp, Artificial Sequence
  chemically synthesized
agtcaacatttacaagagaaat

SEQ ID NO: 1213774 - DNA, 22 bp, Artificial Sequence
  chemically synthesized
aagtcaacatttacaagagaaa

SEQ ID NO: 1213775 - DNA, 22 bp, Artificial Sequence
  chemically synthesized
taagtcaacatttacaagagaa

SEQ ID NO: 1213776 - DNA, 22 bp, Artificial Sequence
  chemically synthesized
taggccaatttctcttgtaaat

SEQ ID NO: 1213777 - DNA, 22 bp, Artificial Sequence
  chemically synthesized
ttttaagtcaacatttacaaga

SEQ ID NO: 1213778 - DNA, 22 bp, Artificial Sequence
  chemically synthesized
aactattttaagtcaacattta

SEQ ID NO: 1213779 - DNA, 22 bp, Artificial Sequence
  chemically synthesized
aaactattttaagtcaacattt

SEQ ID NO: 1213780 - DNA, 22 bp, Artificial Sequence
  chemically synthesized
taaactattttaagtcaacatt

SEQ ID NO: 1213781 - DNA, 22 bp, Artificial Sequence
  chemically synthesized
tttaaactattttaagtcaaca

SEQ ID NO: 1213782 - DNA, 22 bp, Artificial Sequence
  chemically synthesized
ctcttgtaaatgttgacttaaa

SEQ ID NO: 1213783 - DNA, 22 bp, Artificial Sequence
  chemically synthesized
tcttgtaaatgttgacttaaaa

SEQ ID NO: 1213784 - DNA, 22 bp, Artificial Sequence
  chemically synthesized
ttgtaaatgttgacttaaaata

SEQ ID NO: 1213785 - DNA, 22 bp, Artificial Sequence
  chemically synthesized
gtaaatgttgacttaaaatagt

SEQ ID NO: 1213786 - DNA, 22 bp, Artificial Sequence
  chemically synthesized
taaatgttgacttaaaatagtt

SEQ ID NO: 1213787 - DNA, 22 bp, Artificial Sequence
  chemically synthesized
acttaaaatagtttaaagagca

SEQ ID NO: 1213788 - DNA, 22 bp, Artificial Sequence
  chemically synthesized
caacatgagaaaatgctcttta

SEQ ID NO: 1213789 - DNA, 22 bp, Artificial Sequence
  chemically synthesized
aaaatagtttaaagagcatttt

SEQ ID NO: 1213790 - DNA, 22 bp, Artificial Sequence
  chemically synthesized
aaatagtttaaagagcattttc

SEQ ID NO: 1213791 - DNA, 22 bp, Artificial Sequence
  chemically synthesized
atcacctccaacatgagaaaat

SEQ ID NO: 1213792 - DNA, 22 bp, Artificial Sequence
  chemically synthesized
aaagagcattttctcatgttgg

SEQ ID NO: 1213793 - DNA, 22 bp, Artificial Sequence
  chemically synthesized
aagagcattttctcatgttgga

SEQ ID NO: 1213794 - DNA, 22 bp, Artificial Sequence
  chemically synthesized
agtgcaattaatcacctccaac

SEQ ID NO: 1213795 - DNA, 22 bp, Artificial Sequence
  chemically synthesized
tctcatgttggaggtgattaat

SEQ ID NO: 1213796 - DNA, 22 bp, Artificial Sequence
  chemically synthesized
ctcatgttggaggtgattaatt

SEQ ID NO: 1213797 - DNA, 22 bp, Artificial Sequence
  chemically synthesized
tcatgttggaggtgattaattg

SEQ ID NO: 1213798 - DNA, 22 bp, Artificial Sequence
  chemically synthesized
atgttggaggtgattaattgca

SEQ ID NO: 1213799 - DNA, 22 bp, Artificial Sequence
  chemically synthesized
caagtgaaactcagtgcaatta

SEQ ID NO: 1213800 - DNA, 22 bp, Artificial Sequence
  chemically synthesized
acaagtgaaactcagtgcaatt

SEQ ID NO: 1213801 - DNA, 22 bp, Artificial Sequence
  chemically synthesized
tacaagtgaaactcagtgcaat

SEQ ID NO: 1213802 - DNA, 22 bp, Artificial Sequence
  chemically synthesized
ttacaagtgaaactcagtgcaa

SEQ ID NO: 1213803 - DNA, 22 bp, Artificial Sequence
  chemically synthesized
gaggtgattaattgcactgagt

SEQ ID NO: 1213804 - DNA, 22 bp, Artificial Sequence
  chemically synthesized
attgcactgagtttcacttgta

SEQ ID NO: 1213805 - DNA, 22 bp, Artificial Sequence
  chemically synthesized
agcaatggatttttacaagtga

SEQ ID NO: 1213806 - DNA, 22 bp, Artificial Sequence
  chemically synthesized
gagcaatggatttttacaagtg

SEQ ID NO: 1213807 - DNA, 22 bp, Artificial Sequence
  chemically synthesized
cactgagtttcacttgtaaaaa

SEQ ID NO: 1213808 - DNA, 22 bp, Artificial Sequence
  chemically synthesized
ggtttgagcaatggatttttac

SEQ ID NO: 1213809 - DNA, 22 bp, Artificial Sequence
  chemically synthesized
aggtttgagcaatggattttta

SEQ ID NO: 1213810 - DNA, 22 bp, Artificial Sequence
  chemically synthesized
agtttcacttgtaaaaatccat

SEQ ID NO: 1213811 - DNA, 22 bp, Artificial Sequence
  chemically synthesized
cacttgtaaaaatccattgctc

SEQ ID NO: 1213812 - DNA, 22 bp, Artificial Sequence
  chemically synthesized
acttgtaaaaatccattgctca

SEQ ID NO: 1213813 - DNA, 22 bp, Artificial Sequence
  chemically synthesized
gtaaaaatccattgctcaaacc

SEQ ID NO: 1213814 - DNA, 22 bp, Artificial Sequence
  chemically synthesized
taaaaatccattgctcaaacct

SEQ ID NO: 1213815 - DNA, 22 bp, Artificial Sequence
  chemically synthesized
ctcaaacctaaggatggtgggg

SEQ ID NO: 1213816 - DNA, 22 bp, Artificial Sequence
  chemically synthesized
aaacctaaggatggtgggggga

SEQ ID NO: 1213817 - DNA, 22 bp, Artificial Sequence
  chemically synthesized
cacagatgggtgtccccccacc

SEQ ID NO: 1213818 - DNA, 22 bp, Artificial Sequence
  chemically synthesized
gcacagatgggtgtccccccac

SEQ ID NO: 1213819 - DNA, 22 bp, Artificial Sequence
  chemically synthesized
aggatggtggggggacacccat

SEQ ID NO: 1213820 - DNA, 22 bp, Artificial Sequence
  chemically synthesized
taagtccacacgtttgcacaga

SEQ ID NO: 1213821 - DNA, 22 bp, Artificial Sequence
  chemically synthesized
tgcaaacgtgtggacttacaat

SEQ ID NO: 1213822 - DNA, 22 bp, Artificial Sequence
  chemically synthesized
acataagcaaaagtcattgtaa

SEQ ID NO: 1213823 - DNA, 22 bp, Artificial Sequence
  chemically synthesized
agctaacataagcaaaagtcat

SEQ ID NO: 1213824 - DNA, 22 bp, Artificial Sequence
  chemically synthesized
acacctgagctaacataagcaa

SEQ ID NO: 1213825 - DNA, 22 bp, Artificial Sequence
  chemically synthesized
acaatgacttttgcttatgtta

SEQ ID NO: 1213826 - DNA, 22 bp, Artificial Sequence
  chemically synthesized
caatgacttttgcttatgttag

SEQ ID NO: 1213827 - DNA, 22 bp, Artificial Sequence
  chemically synthesized
gaactgacacctgagctaacat

SEQ ID NO: 1213828 - DNA, 22 bp, Artificial Sequence
  chemically synthesized
attagaactgacacctgagcta

SEQ ID NO: 1213829 - DNA, 22 bp, Artificial Sequence
  chemically synthesized
ttgcttatgttagctcaggtgt

SEQ ID NO: 1213830 - DNA, 22 bp, Artificial Sequence
  chemically synthesized
tgcttatgttagctcaggtgtc

SEQ ID NO: 1213831 - DNA, 22 bp, Artificial Sequence
  chemically synthesized
ttcattagaactgacacctgag

SEQ ID NO: 1213832 - DNA, 22 bp, Artificial Sequence
  chemically synthesized
gcttatgttagctcaggtgtca

SEQ ID NO: 1213833 - DNA, 22 bp, Artificial Sequence
  chemically synthesized
cttatgttagctcaggtgtcag

SEQ ID NO: 1213834 - DNA, 22 bp, Artificial Sequence
  chemically synthesized
atgttagctcaggtgtcagttc

SEQ ID NO: 1213835 - DNA, 22 bp, Artificial Sequence
  chemically synthesized
tgttagctcaggtgtcagttct

SEQ ID NO: 1213836 - DNA, 22 bp, Artificial Sequence
  chemically synthesized
aaagttgttcattagaactgac

SEQ ID NO: 1213837 - DNA, 22 bp, Artificial Sequence
  chemically synthesized
ttgaaagttgttcattagaact

SEQ ID NO: 1213838 - DNA, 22 bp, Artificial Sequence
  chemically synthesized
gctcaggtgtcagttctaatga

SEQ ID NO: 1213839 - DNA, 22 bp, Artificial Sequence
  chemically synthesized
gttgaaagttgttcattagaac

SEQ ID NO: 1213840 - DNA, 22 bp, Artificial Sequence
  chemically synthesized
ttgttgaaagttgttcattaga

SEQ ID NO: 1213841 - DNA, 22 bp, Artificial Sequence
  chemically synthesized
aggtgtcagttctaatgaacaa

SEQ ID NO: 1213842 - DNA, 22 bp, Artificial Sequence
  chemically synthesized
tcttgttgaaagttgttcatta

SEQ ID NO: 1213843 - DNA, 22 bp, Artificial Sequence
  chemically synthesized
ctcttgttgaaagttgttcatt

SEQ ID NO: 1213844 - DNA, 22 bp, Artificial Sequence
  chemically synthesized
tctcttgttgaaagttgttcat

SEQ ID NO: 1213845 - DNA, 22 bp, Artificial Sequence
  chemically synthesized
ttttctcttgttgaaagttgtt

SEQ ID NO: 1213846 - DNA, 22 bp, Artificial Sequence
  chemically synthesized
attttctcttgttgaaagttgt

SEQ ID NO: 1213847 - DNA, 22 bp, Artificial Sequence
  chemically synthesized
gatttattttctcttgttgaaa

SEQ ID NO: 1213848 - DNA, 22 bp, Artificial Sequence
  chemically synthesized
taatgaacaactttcaacaaga

SEQ ID NO: 1213849 - DNA, 22 bp, Artificial Sequence
  chemically synthesized
tggatttattttctcttgttga

SEQ ID NO: 1213850 - DNA, 22 bp, Artificial Sequence
  chemically synthesized
atgaacaactttcaacaagaga

SEQ ID NO: 1213851 - DNA, 22 bp, Artificial Sequence
  chemically synthesized
ataaaaagttctggatttattt

SEQ ID NO: 1213852 - DNA, 22 bp, Artificial Sequence
  chemically synthesized
tcaacaagagaaaataaatcca

SEQ ID NO: 1213853 - DNA, 22 bp, Artificial Sequence
  chemically synthesized
caacaagagaaaataaatccag

SEQ ID NO: 1213854 - DNA, 22 bp, Artificial Sequence
  chemically synthesized
taataaaaagttctggatttat

SEQ ID NO: 1213855 - DNA, 22 bp, Artificial Sequence
  chemically synthesized
aacaagagaaaataaatccaga

SEQ ID NO: 1213856 - DNA, 22 bp, Artificial Sequence
  chemically synthesized
ctaataaaaagttctggattta

SEQ ID NO: 1213857 - DNA, 22 bp, Artificial Sequence
  chemically synthesized
acatgtgtgatttctaataaaa

SEQ ID NO: 1213858 - DNA, 22 bp, Artificial Sequence
  chemically synthesized
aacatgtgtgatttctaataaa

SEQ ID NO: 1213859 - DNA, 22 bp, Artificial Sequence
  chemically synthesized
tttaacatgtgtgatttctaat

SEQ ID NO: 1213860 - DNA, 22 bp, Artificial Sequence
  chemically synthesized
tgtttaacatgtgtgatttcta

SEQ ID NO: 1213861 - DNA, 22 bp, Artificial Sequence
  chemically synthesized
ctgtttaacatgtgtgatttct

SEQ ID NO: 1213862 - DNA, 22 bp, Artificial Sequence
  chemically synthesized
tttattagaaatcacacatgtt

SEQ ID NO: 1213863 - DNA, 22 bp, Artificial Sequence
  chemically synthesized
ttattagaaatcacacatgtta

SEQ ID NO: 1213864 - DNA, 22 bp, Artificial Sequence
  chemically synthesized
atgatttctgtttaacatgtgt

SEQ ID NO: 1213865 - DNA, 22 bp, Artificial Sequence
  chemically synthesized
tattagaaatcacacatgttaa

SEQ ID NO: 1213866 - DNA, 22 bp, Artificial Sequence
  chemically synthesized
attagaaatcacacatgttaaa

SEQ ID NO: 1213867 - DNA, 22 bp, Artificial Sequence
  chemically synthesized
ttagaaatcacacatgttaaac

SEQ ID NO: 1213868 - DNA, 22 bp, Artificial Sequence
  chemically synthesized
gttaatgatttctgtttaacat

SEQ ID NO: 1213869 - DNA, 22 bp, Artificial Sequence
  chemically synthesized
agttaatgatttctgtttaaca

SEQ ID NO: 1213870 - DNA, 22 bp, Artificial Sequence
  chemically synthesized
gaaatcacacatgttaaacaga

SEQ ID NO: 1213871 - DNA, 22 bp, Artificial Sequence
  chemically synthesized
agtaaggtttagttaatgattt

SEQ ID NO: 1213872 - DNA, 22 bp, Artificial Sequence
  chemically synthesized
gagtaaggtttagttaatgatt

SEQ ID NO: 1213873 - DNA, 22 bp, Artificial Sequence
  chemically synthesized
tgagtaaggtttagttaatgat

SEQ ID NO: 1213874 - DNA, 22 bp, Artificial Sequence
  chemically synthesized
ttttgagtaaggtttagttaat

SEQ ID NO: 1213875 - DNA, 22 bp, Artificial Sequence
  chemically synthesized
aacagaaatcattaactaaacc

SEQ ID NO: 1213876 - DNA, 22 bp, Artificial Sequence
  chemically synthesized
actaaaccttactcaaaatagt

SEQ ID NO: 1213877 - DNA, 22 bp, Artificial Sequence
  chemically synthesized
aaccttactcaaaatagtggtg

SEQ ID NO: 1213878 - DNA, 22 bp, Artificial Sequence
  chemically synthesized
agtgataaagtccaccactatt

SEQ ID NO: 1213879 - DNA, 22 bp, Artificial Sequence
  chemically synthesized
aagtgataaagtccaccactat

SEQ ID NO: 1213880 - DNA, 22 bp, Artificial Sequence
  chemically synthesized
ttaagtgataaagtccaccact

SEQ ID NO: 1213881 - DNA, 22 bp, Artificial Sequence
  chemically synthesized
cttaagtgataaagtccaccac

SEQ ID NO: 1213882 - DNA, 22 bp, Artificial Sequence
  chemically synthesized
actcaaaatagtggtggacttt

SEQ ID NO: 1213883 - DNA, 22 bp, Artificial Sequence
  chemically synthesized
ctcaaaatagtggtggacttta

SEQ ID NO: 1213884 - DNA, 22 bp, Artificial Sequence
  chemically synthesized
atttcttaagtgataaagtcca

SEQ ID NO: 1213885 - DNA, 22 bp, Artificial Sequence
  chemically synthesized
aaaatagtggtggactttatca

SEQ ID NO: 1213886 - DNA, 22 bp, Artificial Sequence
  chemically synthesized
attgatttcttaagtgataaag

SEQ ID NO: 1213887 - DNA, 22 bp, Artificial Sequence
  chemically synthesized
gaagttaattgatttcttaagt

SEQ ID NO: 1213888 - DNA, 22 bp, Artificial Sequence
  chemically synthesized
ggaagttaattgatttcttaag

SEQ ID NO: 1213889 - DNA, 22 bp, Artificial Sequence
  chemically synthesized
cttggaagttaattgatttctt

SEQ ID NO: 1213890 - DNA, 22 bp, Artificial Sequence
  chemically synthesized
tatcacttaagaaatcaattaa

SEQ ID NO: 1213891 - DNA, 22 bp, Artificial Sequence
  chemically synthesized
atcacttaagaaatcaattaac

SEQ ID NO: 1213892 - DNA, 22 bp, Artificial Sequence
  chemically synthesized
tcacttaagaaatcaattaact

SEQ ID NO: 1213893 - DNA, 22 bp, Artificial Sequence
  chemically synthesized
tagttccttggaagttaattga

SEQ ID NO: 1213894 - DNA, 22 bp, Artificial Sequence
  chemically synthesized
tatagttccttggaagttaatt

SEQ ID NO: 1213895 - DNA, 22 bp, Artificial Sequence
  chemically synthesized
ctatagttccttggaagttaat

SEQ ID NO: 1213896 - DNA, 22 bp, Artificial Sequence
  chemically synthesized
tctatagttccttggaagttaa

SEQ ID NO: 1213897 - DNA, 22 bp, Artificial Sequence
  chemically synthesized
ttctatagttccttggaagtta

SEQ ID NO: 1213898 - DNA, 22 bp, Artificial Sequence
  chemically synthesized
aagaaatcaattaacttccaag

SEQ ID NO: 1213899 - DNA, 22 bp, Artificial Sequence
  chemically synthesized
tttctatagttccttggaagtt

SEQ ID NO: 1213900 - DNA, 22 bp, Artificial Sequence
  chemically synthesized
agaaatcaattaacttccaagg

SEQ ID NO: 1213901 - DNA, 22 bp, Artificial Sequence
  chemically synthesized
actttttctatagttccttgga

SEQ ID NO: 1213902 - DNA, 22 bp, Artificial Sequence
  chemically synthesized
acttccaaggaactatagaaaa

SEQ ID NO: 1213903 - DNA, 22 bp, Artificial Sequence
  chemically synthesized
ccaaggaactatagaaaaagtt

SEQ ID NO: 1213904 - DNA, 22 bp, Artificial Sequence
  chemically synthesized
gagcgggaacctaactttttct

SEQ ID NO: 1213905 - DNA, 22 bp, Artificial Sequence
  chemically synthesized
caaggaactatagaaaaagtta

SEQ ID NO: 1213906 - DNA, 22 bp, Artificial Sequence
  chemically synthesized
ggagcgggaacctaactttttc

SEQ ID NO: 1213907 - DNA, 22 bp, Artificial Sequence
  chemically synthesized
tggagcgggaacctaacttttt

SEQ ID NO: 1213908 - DNA, 22 bp, Artificial Sequence
  chemically synthesized
tagaaaaagttaggttcccgct

SEQ ID NO: 1213909 - DNA, 22 bp, Artificial Sequence
  chemically synthesized
ggttcccgctccaaaatcatct

SEQ ID NO: 1213910 - DNA, 22 bp, Artificial Sequence
  chemically synthesized
ccgctccaaaatcatcttatcg

SEQ ID NO: 1213911 - DNA, 22 bp, Artificial Sequence
  chemically synthesized
gacataaatgcataaatcgata

SEQ ID NO: 1213912 - DNA, 22 bp, Artificial Sequence
  chemically synthesized
caaaatcatcttatcgatttat

SEQ ID NO: 1213913 - DNA, 22 bp, Artificial Sequence
  chemically synthesized
gttggacataaatgcataaatc

SEQ ID NO: 1213914 - DNA, 22 bp, Artificial Sequence
  chemically synthesized
ttagttggacataaatgcataa

SEQ ID NO: 1213915 - DNA, 22 bp, Artificial Sequence
  chemically synthesized
attagttggacataaatgcata

SEQ ID NO: 1213916 - DNA, 22 bp, Artificial Sequence
  chemically synthesized
tattagttggacataaatgcat

SEQ ID NO: 1213917 - DNA, 22 bp, Artificial Sequence
  chemically synthesized
atcgatttatgcatttatgtcc

SEQ ID NO: 1213918 - DNA, 22 bp, Artificial Sequence
  chemically synthesized
attttattagttggacataaat

SEQ ID NO: 1213919 - DNA, 22 bp, Artificial Sequence
  chemically synthesized
tcgatttatgcatttatgtcca

SEQ ID NO: 1213920 - DNA, 22 bp, Artificial Sequence
  chemically synthesized
cctaattttattagttggacat

SEQ ID NO: 1213921 - DNA, 22 bp, Artificial Sequence
  chemically synthesized
ccctaattttattagttggaca

SEQ ID NO: 1213922 - DNA, 22 bp, Artificial Sequence
  chemically synthesized
atgcatttatgtccaactaata

SEQ ID NO: 1213923 - DNA, 22 bp, Artificial Sequence
  chemically synthesized
cttccctaattttattagttgg

SEQ ID NO: 1213924 - DNA, 22 bp, Artificial Sequence
  chemically synthesized
tgcatttatgtccaactaataa

SEQ ID NO: 1213925 - DNA, 22 bp, Artificial Sequence
  chemically synthesized
tgcttccctaattttattagtt

SEQ ID NO: 1213926 - DNA, 22 bp, Artificial Sequence
  chemically synthesized
ctctgcttccctaattttatta

SEQ ID NO: 1213927 - DNA, 22 bp, Artificial Sequence
  chemically synthesized
actctgcttccctaattttatt

SEQ ID NO: 1213928 - DNA, 22 bp, Artificial Sequence
  chemically synthesized
atgtccaactaataaaattagg

SEQ ID NO: 1213929 - DNA, 22 bp, Artificial Sequence
  chemically synthesized
ttactctgcttccctaatttta

SEQ ID NO: 1213930 - DNA, 22 bp, Artificial Sequence
  chemically synthesized
tgtccaactaataaaattaggg

SEQ ID NO: 1213931 - DNA, 22 bp, Artificial Sequence
  chemically synthesized
ataaaattagggaagcagagta

SEQ ID NO: 1213932 - DNA, 22 bp, Artificial Sequence
  chemically synthesized
gggaagcagagtaagaactact

SEQ ID NO: 1213933 - DNA, 22 bp, Artificial Sequence
  chemically synthesized
aatataccaaaatccacggatc

SEQ ID NO: 1213934 - DNA, 22 bp, Artificial Sequence
  chemically synthesized
aaatataccaaaatccacggat

SEQ ID NO: 1213935 - DNA, 22 bp, Artificial Sequence
  chemically synthesized
taaatataccaaaatccacgga

SEQ ID NO: 1213936 - DNA, 22 bp, Artificial Sequence
  chemically synthesized
ctgtatggatccgtggattttg

SEQ ID NO: 1213937 - DNA, 22 bp, Artificial Sequence
  chemically synthesized
tatggatccgtggattttggta

SEQ ID NO: 1213938 - DNA, 22 bp, Artificial Sequence
  chemically synthesized
tatgggattttaaatataccaa

SEQ ID NO: 1213939 - DNA, 22 bp, Artificial Sequence
  chemically synthesized
atatgggattttaaatatacca

SEQ ID NO: 1213940 - DNA, 22 bp, Artificial Sequence
  chemically synthesized
ttatatgggattttaaatatac

SEQ ID NO: 1213941 - DNA, 22 bp, Artificial Sequence
  chemically synthesized
tggtatatttaaaatcccatat

SEQ ID NO: 1213942 - DNA, 22 bp, Artificial Sequence
  chemically synthesized
ggtatatttaaaatcccatata

SEQ ID NO: 1213943 - DNA, 22 bp, Artificial Sequence
  chemically synthesized
catcataattcttatatgggat

SEQ ID NO: 1213944 - DNA, 22 bp, Artificial Sequence
  chemically synthesized
gtatatttaaaatcccatataa

SEQ ID NO: 1213945 - DNA, 22 bp, Artificial Sequence
  chemically synthesized
aaaatcccatataagaattatg

SEQ ID NO: 1213946 - DNA, 22 bp, Artificial Sequence
  chemically synthesized
aaatcccatataagaattatga

SEQ ID NO: 1213947 - DNA, 22 bp, Artificial Sequence
  chemically synthesized
tgtcaaatgaaaatgtggctgc

SEQ ID NO: 1213948 - DNA, 22 bp, Artificial Sequence
  chemically synthesized
atgtcaaatgaaaatgtggctg

SEQ ID NO: 1213949 - DNA, 22 bp, Artificial Sequence
  chemically synthesized
tgatgcagccacattttcattt

SEQ ID NO: 1213950 - DNA, 22 bp, Artificial Sequence
  chemically synthesized
ataaatgtacaaatatttatgt

SEQ ID NO: 1213951 - DNA, 22 bp, Artificial Sequence
  chemically synthesized
taataaatgtacaaatatttat

SEQ ID NO: 1213952 - DNA, 22 bp, Artificial Sequence
  chemically synthesized
tcatttgacataaatatttgta

SEQ ID NO: 1213953 - DNA, 22 bp, Artificial Sequence
  chemically synthesized
catttgacataaatatttgtac

SEQ ID NO: 1213954 - DNA, 22 bp, Artificial Sequence
  chemically synthesized
attctaataaatgtacaaatat

SEQ ID NO: 1213955 - DNA, 22 bp, Artificial Sequence
  chemically synthesized
atttgacataaatatttgtaca

SEQ ID NO: 1213956 - DNA, 22 bp, Artificial Sequence
  chemically synthesized
cattctaataaatgtacaaata

SEQ ID NO: 1213957 - DNA, 22 bp, Artificial Sequence
  chemically synthesized
tcattctaataaatgtacaaat

SEQ ID NO: 1213958 - DNA, 22 bp, Artificial Sequence
  chemically synthesized
ttcattctaataaatgtacaaa

SEQ ID NO: 1213959 - DNA, 22 bp, Artificial Sequence
  chemically synthesized
gacataaatatttgtacattta

SEQ ID NO: 1213960 - DNA, 22 bp, Artificial Sequence
  chemically synthesized
acataaatatttgtacatttat

SEQ ID NO: 1213961 - DNA, 22 bp, Artificial Sequence
  chemically synthesized
gtacatttattagaatgaaaaa

SEQ ID NO: 1213962 - DNA, 22 bp, Artificial Sequence
  chemically synthesized
tacatttattagaatgaaaaac

SEQ ID NO: 1213963 - DNA, 22 bp, Artificial Sequence
  chemically synthesized
aagtacagagcatgtttttcat

SEQ ID NO: 1213964 - DNA, 22 bp, Artificial Sequence
  chemically synthesized
aaagtacagagcatgtttttca

SEQ ID NO: 1213965 - DNA, 22 bp, Artificial Sequence
  chemically synthesized
taaagtacagagcatgtttttc

SEQ ID NO: 1213966 - DNA, 22 bp, Artificial Sequence
  chemically synthesized
ttaaagtacagagcatgttttt

SEQ ID NO: 1213967 - DNA, 22 bp, Artificial Sequence
  chemically synthesized
tttaaagtacagagcatgtttt

SEQ ID NO: 1213968 - DNA, 22 bp, Artificial Sequence
  chemically synthesized
attagaatgaaaaacatgctct

SEQ ID NO: 1213969 - DNA, 22 bp, Artificial Sequence
  chemically synthesized
ttagaatgaaaaacatgctctg

SEQ ID NO: 1213970 - DNA, 22 bp, Artificial Sequence
  chemically synthesized
gaatgaaaaacatgctctgtac

SEQ ID NO: 1213971 - DNA, 22 bp, Artificial Sequence
  chemically synthesized
agagaatattttttaaagtaca

SEQ ID NO: 1213972 - DNA, 22 bp, Artificial Sequence
  chemically synthesized
attcagagaatattttttaaag

SEQ ID NO: 1213973 - DNA, 22 bp, Artificial Sequence
  chemically synthesized
tgtactttaaaaaatattctct

SEQ ID NO: 1213974 - DNA, 22 bp, Artificial Sequence
  chemically synthesized
tactttaaaaaatattctctga

SEQ ID NO: 1213975 - DNA, 22 bp, Artificial Sequence
  chemically synthesized
taaaaaatattctctgaattag

SEQ ID NO: 1213976 - DNA, 22 bp, Artificial Sequence
  chemically synthesized
aaaaaatattctctgaattagt

SEQ ID NO: 1213977 - DNA, 22 bp, Artificial Sequence
  chemically synthesized
aaaaatattctctgaattagtt

SEQ ID NO: 1213978 - DNA, 22 bp, Artificial Sequence
  chemically synthesized
tataagacagaatgtgaactaa

SEQ ID NO: 1213979 - DNA, 22 bp, Artificial Sequence
  chemically synthesized
ttatataagacagaatgtgaac

SEQ ID NO: 1213980 - DNA, 22 bp, Artificial Sequence
  chemically synthesized
tctgaattagttcacattctgt

SEQ ID NO: 1213981 - DNA, 22 bp, Artificial Sequence
  chemically synthesized
tgaattagttcacattctgtct

SEQ ID NO: 1213982 - DNA, 22 bp, Artificial Sequence
  chemically synthesized
aattagttcacattctgtctta

SEQ ID NO: 1213983 - DNA, 22 bp, Artificial Sequence
  chemically synthesized
gttcacattctgtcttatataa

SEQ ID NO: 1213984 - DNA, 22 bp, Artificial Sequence
  chemically synthesized
acattctgtcttatataacagt

SEQ ID NO: 1213985 - DNA, 22 bp, Artificial Sequence
  chemically synthesized
tgtcttatataacagttaccta

SEQ ID NO: 1213986 - DNA, 22 bp, Artificial Sequence
  chemically synthesized
tcttatataacagttacctata

SEQ ID NO: 1213987 - DNA, 22 bp, Artificial Sequence
  chemically synthesized
atataacagttacctatatatt

SEQ ID NO: 1213988 - DNA, 22 bp, Artificial Sequence
  chemically synthesized
tataacagttacctatatattg

SEQ ID NO: 1213989 - DNA, 22 bp, Artificial Sequence
  chemically synthesized
catataggccaacaaacaatat

SEQ ID NO: 1213990 - DNA, 22 bp, Artificial Sequence
  chemically synthesized
cctatatattgtttgttggcct

SEQ ID NO: 1213991 - DNA, 22 bp, Artificial Sequence
  chemically synthesized
aaaattgcatataggccaacaa

SEQ ID NO: 1213992 - DNA, 22 bp, Artificial Sequence
  chemically synthesized
tatattgtttgttggcctatat

SEQ ID NO: 1213993 - DNA, 22 bp, Artificial Sequence
  chemically synthesized
tttgttggcctatatgcaattt

SEQ ID NO: 1213994 - DNA, 22 bp, Artificial Sequence
  chemically synthesized
ccaaggtattgaaaattgcata

SEQ ID NO: 1213995 - DNA, 22 bp, Artificial Sequence
  chemically synthesized
gttggcctatatgcaattttca

SEQ ID NO: 1213996 - DNA, 22 bp, Artificial Sequence
  chemically synthesized
ttggcctatatgcaattttcaa

SEQ ID NO: 1213997 - DNA, 22 bp, Artificial Sequence
  chemically synthesized
gcctatatgcaattttcaatac

SEQ ID NO: 1213998 - DNA, 22 bp, Artificial Sequence
  chemically synthesized
tatgcaattttcaataccttgg

SEQ ID NO: 1213999 - DNA, 22 bp, Artificial Sequence
  chemically synthesized
tcaataccttggcagactgtat

SEQ ID NO: 1214000 - DNA, 22 bp, Artificial Sequence
  chemically synthesized
caataccttggcagactgtata

SEQ ID NO: 1214001 - DNA, 22 bp, Artificial Sequence
  chemically synthesized
aataccttggcagactgtatat

SEQ ID NO: 1214002 - DNA, 22 bp, Artificial Sequence
  chemically synthesized
ggcagactgtatatcttttact

SEQ ID NO: 1214003 - DNA, 22 bp, Artificial Sequence
  chemically synthesized
gcagactgtatatcttttactt

SEQ ID NO: 1214004 - DNA, 22 bp, Artificial Sequence
  chemically synthesized
caagtgtgtcaggaagtaaaag

SEQ ID NO: 1214005 - DNA, 22 bp, Artificial Sequence
  chemically synthesized
tatatcttttacttcctgacac

SEQ ID NO: 1214006 - DNA, 22 bp, Artificial Sequence
  chemically synthesized
tatactccaagtgtgtcaggaa

SEQ ID NO: 1214007 - DNA, 22 bp, Artificial Sequence
  chemically synthesized
ttacttcctgacacacttggag

SEQ ID NO: 1214008 - DNA, 22 bp, Artificial Sequence
  chemically synthesized
tacttcctgacacacttggagt

SEQ ID NO: 1214009 - DNA, 22 bp, Artificial Sequence
  chemically synthesized
acttcctgacacacttggagta

SEQ ID NO: 1214010 - DNA, 22 bp, Artificial Sequence
  chemically synthesized
cttcctgacacacttggagtat

SEQ ID NO: 1214011 - DNA, 22 bp, Artificial Sequence
  chemically synthesized
cctgacacacttggagtatata

SEQ ID NO: 1214012 - DNA, 22 bp, Artificial Sequence
  chemically synthesized
ctgacacacttggagtatatag

SEQ ID NO: 1214013 - DNA, 22 bp, Artificial Sequence
  chemically synthesized
cataaggaatagtgctatatac

SEQ ID NO: 1214014 - DNA, 22 bp, Artificial Sequence
  chemically synthesized
acacacttggagtatatagcac

SEQ ID NO: 1214015 - DNA, 22 bp, Artificial Sequence
  chemically synthesized
acataaggaatagtgctatata

SEQ ID NO: 1214016 - DNA, 22 bp, Artificial Sequence
  chemically synthesized
tacataaggaatagtgctatat

SEQ ID NO: 1214017 - DNA, 22 bp, Artificial Sequence
  chemically synthesized
ggagtatatagcactattcctt

SEQ ID NO: 1214018 - DNA, 22 bp, Artificial Sequence
  chemically synthesized
ataactttacataaggaatagt

SEQ ID NO: 1214019 - DNA, 22 bp, Artificial Sequence
  chemically synthesized
gagtatatagcactattcctta

SEQ ID NO: 1214020 - DNA, 22 bp, Artificial Sequence
  chemically synthesized
ttgataactttacataaggaat

SEQ ID NO: 1214021 - DNA, 22 bp, Artificial Sequence
  chemically synthesized
atcaaatgtctattgataactt

SEQ ID NO: 1214022 - DNA, 22 bp, Artificial Sequence
  chemically synthesized
ttccttatgtaaagttatcaat

SEQ ID NO: 1214023 - DNA, 22 bp, Artificial Sequence
  chemically synthesized
cttatgtaaagttatcaataga

SEQ ID NO: 1214024 - DNA, 22 bp, Artificial Sequence
  chemically synthesized
attcatcaaatgtctattgata

SEQ ID NO: 1214025 - DNA, 22 bp, Artificial Sequence
  chemically synthesized
atgtaaagttatcaatagacat

SEQ ID NO: 1214026 - DNA, 22 bp, Artificial Sequence
  chemically synthesized
tgtaaagttatcaatagacatt

SEQ ID NO: 1214027 - DNA, 22 bp, Artificial Sequence
  chemically synthesized
tcaatagacatttgatgaatta

SEQ ID NO: 1214028 - DNA, 22 bp, Artificial Sequence
  chemically synthesized
agtagaaatgcatgttaattca

SEQ ID NO: 1214029 - DNA, 22 bp, Artificial Sequence
  chemically synthesized
ttcagtagaaatgcatgttaat

SEQ ID NO: 1214030 - DNA, 22 bp, Artificial Sequence
  chemically synthesized
gttcagtagaaatgcatgttaa

SEQ ID NO: 1214031 - DNA, 22 bp, Artificial Sequence
  chemically synthesized
tgttcagtagaaatgcatgtta

SEQ ID NO: 1214032 - DNA, 22 bp, Artificial Sequence
  chemically synthesized
ctttgttcagtagaaatgcatg

SEQ ID NO: 1214033 - DNA, 22 bp, Artificial Sequence
  chemically synthesized
actttgttcagtagaaatgcat

SEQ ID NO: 1214034 - DNA, 22 bp, Artificial Sequence
  chemically synthesized
gatgaattaacatgcatttcta

SEQ ID NO: 1214035 - DNA, 22 bp, Artificial Sequence
  chemically synthesized
atgaattaacatgcatttctac

SEQ ID NO: 1214036 - DNA, 22 bp, Artificial Sequence
  chemically synthesized
acatgcatttctactgaacaaa

SEQ ID NO: 1214037 - DNA, 22 bp, Artificial Sequence
  chemically synthesized
tgtgccccaggcttactttgtt

SEQ ID NO: 1214038 - DNA, 22 bp, Artificial Sequence
  chemically synthesized
ctactgaacaaagtaagcctgg

SEQ ID NO: 1214039 - DNA, 22 bp, Artificial Sequence
  chemically synthesized
aagttatgtgccccaggcttac

SEQ ID NO: 1214040 - DNA, 22 bp, Artificial Sequence
  chemically synthesized
tactgaacaaagtaagcctggg

SEQ ID NO: 1214041 - DNA, 22 bp, Artificial Sequence
  chemically synthesized
aaagttatgtgccccaggctta

SEQ ID NO: 1214042 - DNA, 22 bp, Artificial Sequence
  chemically synthesized
taaagttatgtgccccaggctt

SEQ ID NO: 1214043 - DNA, 22 bp, Artificial Sequence
  chemically synthesized
ctgaacaaagtaagcctggggc

SEQ ID NO: 1214044 - DNA, 22 bp, Artificial Sequence
  chemically synthesized
aacaaagtaagcctggggcaca

SEQ ID NO: 1214045 - DNA, 22 bp, Artificial Sequence
  chemically synthesized
cataagcattttaaagttatgt

SEQ ID NO: 1214046 - DNA, 22 bp, Artificial Sequence
  chemically synthesized
gggcacataactttaaaatgct

SEQ ID NO: 1214047 - DNA, 22 bp, Artificial Sequence
  chemically synthesized
agatgctacataagcattttaa

SEQ ID NO: 1214048 - DNA, 22 bp, Artificial Sequence
  chemically synthesized
cagatgctacataagcatttta

SEQ ID NO: 1214049 - DNA, 22 bp, Artificial Sequence
  chemically synthesized
tcagatgctacataagcatttt

SEQ ID NO: 1214050 - DNA, 22 bp, Artificial Sequence
  chemically synthesized
tttcagatgctacataagcatt

SEQ ID NO: 1214051 - DNA, 22 bp, Artificial Sequence
  chemically synthesized
taaattctttcagatgctacat

SEQ ID NO: 1214052 - DNA, 22 bp, Artificial Sequence
  chemically synthesized
taaaatgcttatgtagcatctg

SEQ ID NO: 1214053 - DNA, 22 bp, Artificial Sequence
  chemically synthesized
aaaatgcttatgtagcatctga

SEQ ID NO: 1214054 - DNA, 22 bp, Artificial Sequence
  chemically synthesized
aaatgcttatgtagcatctgaa

SEQ ID NO: 1214055 - DNA, 22 bp, Artificial Sequence
  chemically synthesized
acattgtaaattctttcagatg

SEQ ID NO: 1214056 - DNA, 22 bp, Artificial Sequence
  chemically synthesized
gtctgacattgtaaattctttc

SEQ ID NO: 1214057 - DNA, 22 bp, Artificial Sequence
  chemically synthesized
atgtagcatctgaaagaattta

SEQ ID NO: 1214058 - DNA, 22 bp, Artificial Sequence
  chemically synthesized
agtctgacattgtaaattcttt

SEQ ID NO: 1214059 - DNA, 22 bp, Artificial Sequence
  chemically synthesized
tgtagcatctgaaagaatttac

SEQ ID NO: 1214060 - DNA, 22 bp, Artificial Sequence
  chemically synthesized
ttagtctgacattgtaaattct

SEQ ID NO: 1214061 - DNA, 22 bp, Artificial Sequence
  chemically synthesized
ttcttagtctgacattgtaaat

SEQ ID NO: 1214062 - DNA, 22 bp, Artificial Sequence
  chemically synthesized
attcttagtctgacattgtaaa

SEQ ID NO: 1214063 - DNA, 22 bp, Artificial Sequence
  chemically synthesized
tattcttagtctgacattgtaa

SEQ ID NO: 1214064 - DNA, 22 bp, Artificial Sequence
  chemically synthesized
ttattcttagtctgacattgta

SEQ ID NO: 1214065 - DNA, 22 bp, Artificial Sequence
  chemically synthesized
tttattcttagtctgacattgt

SEQ ID NO: 1214066 - DNA, 22 bp, Artificial Sequence
  chemically synthesized
aaagaatttacaatgtcagact

SEQ ID NO: 1214067 - DNA, 22 bp, Artificial Sequence
  chemically synthesized
ctttttattcttagtctgacat

SEQ ID NO: 1214068 - DNA, 22 bp, Artificial Sequence
  chemically synthesized
acaatgtcagactaagaataaa

SEQ ID NO: 1214069 - DNA, 22 bp, Artificial Sequence
  chemically synthesized
gagcccctactttttattctta

SEQ ID NO: 1214070 - DNA, 22 bp, Artificial Sequence
  chemically synthesized
caatgtcagactaagaataaaa

SEQ ID NO: 1214071 - DNA, 22 bp, Artificial Sequence
  chemically synthesized
tggagcccctactttttattct

SEQ ID NO: 1214072 - DNA, 22 bp, Artificial Sequence
  chemically synthesized
agaataaaaagtaggggctcca

SEQ ID NO: 1214073 - DNA, 22 bp, Artificial Sequence
  chemically synthesized
ataaagtagaaattctggagcc

SEQ ID NO: 1214074 - DNA, 22 bp, Artificial Sequence
  chemically synthesized
accacatcattaataaagtaga

SEQ ID NO: 1214075 - DNA, 22 bp, Artificial Sequence
  chemically synthesized
gaccacatcattaataaagtag

SEQ ID NO: 1214076 - DNA, 22 bp, Artificial Sequence
  chemically synthesized
cagaatttctactttattaatg

SEQ ID NO: 1214077 - DNA, 22 bp, Artificial Sequence
  chemically synthesized
atttgaccacatcattaataaa

SEQ ID NO: 1214078 - DNA, 22 bp, Artificial Sequence
  chemically synthesized
ctactttattaatgatgtggtc

SEQ ID NO: 1214079 - DNA, 22 bp, Artificial Sequence
  chemically synthesized
tactttattaatgatgtggtca

SEQ ID NO: 1214080 - DNA, 22 bp, Artificial Sequence
  chemically synthesized
caatgggttgatttgaccacat

SEQ ID NO: 1214081 - DNA, 22 bp, Artificial Sequence
  chemically synthesized
ctttattaatgatgtggtcaaa

SEQ ID NO: 1214082 - DNA, 22 bp, Artificial Sequence
  chemically synthesized
ccaatgggttgatttgaccaca

SEQ ID NO: 1214083 - DNA, 22 bp, Artificial Sequence
  chemically synthesized
tccaatgggttgatttgaccac

SEQ ID NO: 1214084 - DNA, 22 bp, Artificial Sequence
  chemically synthesized
ttccaatgggttgatttgacca

SEQ ID NO: 1214085 - DNA, 22 bp, Artificial Sequence
  chemically synthesized
tattaatgatgtggtcaaatca

SEQ ID NO: 1214086 - DNA, 22 bp, Artificial Sequence
  chemically synthesized
tttccaatgggttgatttgacc

SEQ ID NO: 1214087 - DNA, 22 bp, Artificial Sequence
  chemically synthesized
attaatgatgtggtcaaatcaa

SEQ ID NO: 1214088 - DNA, 22 bp, Artificial Sequence
  chemically synthesized
ttaatgatgtggtcaaatcaac

SEQ ID NO: 1214089 - DNA, 22 bp, Artificial Sequence
  chemically synthesized
atgatgtggtcaaatcaaccca

SEQ ID NO: 1214090 - DNA, 22 bp, Artificial Sequence
  chemically synthesized
agattttttccaatgggttgat

SEQ ID NO: 1214091 - DNA, 22 bp, Artificial Sequence
  chemically synthesized
agtagactaagattttttccaa

SEQ ID NO: 1214092 - DNA, 22 bp, Artificial Sequence
  chemically synthesized
tgcaggtggctgagtagactaa

SEQ ID NO: 1214093 - DNA, 22 bp, Artificial Sequence
  chemically synthesized
gtgcaggtggctgagtagacta

SEQ ID NO: 1214094 - DNA, 22 bp, Artificial Sequence
  chemically synthesized
gaaaaaatcttagtctactcag

SEQ ID NO: 1214095 - DNA, 22 bp, Artificial Sequence
  chemically synthesized
agtctactcagccacctgcaca

SEQ ID NO: 1214096 - DNA, 22 bp, Artificial Sequence
  chemically synthesized
gtctactcagccacctgcacaa

SEQ ID NO: 1214097 - DNA, 22 bp, Artificial Sequence
  chemically synthesized
tagagcacgagcatttgtgcag

SEQ ID NO: 1214098 - DNA, 22 bp, Artificial Sequence
  chemically synthesized
atagagcacgagcatttgtgca

SEQ ID NO: 1214099 - DNA, 22 bp, Artificial Sequence
  chemically synthesized
tatagagcacgagcatttgtgc

SEQ ID NO: 1214100 - DNA, 22 bp, Artificial Sequence
  chemically synthesized
ctcagccacctgcacaaatgct

SEQ ID NO: 1214101 - DNA, 22 bp, Artificial Sequence
  chemically synthesized
ttatagagcacgagcatttgtg

SEQ ID NO: 1214102 - DNA, 22 bp, Artificial Sequence
  chemically synthesized
agccacctgcacaaatgctcgt

SEQ ID NO: 1214103 - DNA, 22 bp, Artificial Sequence
  chemically synthesized
atgcttttatagagcacgagca

SEQ ID NO: 1214104 - DNA, 22 bp, Artificial Sequence
  chemically synthesized
aatgcttttatagagcacgagc

SEQ ID NO: 1214105 - DNA, 22 bp, Artificial Sequence
  chemically synthesized
taatgcttttatagagcacgag

SEQ ID NO: 1214106 - DNA, 22 bp, Artificial Sequence
  chemically synthesized
ttaatgcttttatagagcacga

SEQ ID NO: 1214107 - DNA, 22 bp, Artificial Sequence
  chemically synthesized
tttaatgcttttatagagcacg

SEQ ID NO: 1214108 - DNA, 22 bp, Artificial Sequence
  chemically synthesized
ttttaatgcttttatagagcac

SEQ ID NO: 1214109 - DNA, 22 bp, Artificial Sequence
  chemically synthesized
cacaaatgctcgtgctctataa

SEQ ID NO: 1214110 - DNA, 22 bp, Artificial Sequence
  chemically synthesized
tttttaatgcttttatagagca

SEQ ID NO: 1214111 - DNA, 22 bp, Artificial Sequence
  chemically synthesized
ttttttaatgcttttatagagc

SEQ ID NO: 1214112 - DNA, 22 bp, Artificial Sequence
  chemically synthesized
tttttttaatgcttttatagag

SEQ ID NO: 1214113 - DNA, 22 bp, Artificial Sequence
  chemically synthesized
ttttttttaatgcttttataga

SEQ ID NO: 1214114 - DNA, 22 bp, Artificial Sequence
  chemically synthesized
tttttttttaatgcttttatag

SEQ ID NO: 1214115 - DNA, 22 bp, Artificial Sequence
  chemically synthesized
gtgctctataaaagcattaaaa

SEQ ID NO: 1214116 - DNA, 22 bp, Artificial Sequence
  chemically synthesized
aaaggttttttttttttaatgc

SEQ ID NO: 1214117 - DNA, 22 bp, Artificial Sequence
  chemically synthesized
tataaaagcattaaaaaaaaaa

SEQ ID NO: 1214118 - DNA, 22 bp, Artificial Sequence
  chemically synthesized
gtctaaaaggtttttttttttt

SEQ ID NO: 1214119 - DNA, 22 bp, Artificial Sequence
  chemically synthesized
taaaagcattaaaaaaaaaaaa

SEQ ID NO: 1214120 - DNA, 22 bp, Artificial Sequence
  chemically synthesized
aaaaaaaaaaaccttttagact

SEQ ID NO: 1214121 - DNA, 22 bp, Artificial Sequence
  chemically synthesized
cagagtacatatagactagtct

SEQ ID NO: 1214122 - DNA, 22 bp, Artificial Sequence
  chemically synthesized
tgcagagtacatatagactagt

SEQ ID NO: 1214123 - DNA, 22 bp, Artificial Sequence
  chemically synthesized
ctctgcagagtacatatagact

SEQ ID NO: 1214124 - DNA, 22 bp, Artificial Sequence
  chemically synthesized
actctgcagagtacatatagac

SEQ ID NO: 1214125 - DNA, 22 bp, Artificial Sequence
  chemically synthesized
tactctgcagagtacatataga

SEQ ID NO: 1214126 - DNA, 22 bp, Artificial Sequence
  chemically synthesized
ttactctgcagagtacatatag

SEQ ID NO: 1214127 - DNA, 22 bp, Artificial Sequence
  chemically synthesized
ttagactagtctatatgtactc

SEQ ID NO: 1214128 - DNA, 22 bp, Artificial Sequence
  chemically synthesized
tagactagtctatatgtactct

SEQ ID NO: 1214129 - DNA, 22 bp, Artificial Sequence
  chemically synthesized
agactagtctatatgtactctg

SEQ ID NO: 1214130 - DNA, 22 bp, Artificial Sequence
  chemically synthesized
gactagtctatatgtactctgc

SEQ ID NO: 1214131 - DNA, 22 bp, Artificial Sequence
  chemically synthesized
atgtgtcttttactctgcagag

SEQ ID NO: 1214132 - DNA, 22 bp, Artificial Sequence
  chemically synthesized
gtctatatgtactctgcagagt

SEQ ID NO: 1214133 - DNA, 22 bp, Artificial Sequence
  chemically synthesized
gctaatgtgtcttttactctgc

SEQ ID NO: 1214134 - DNA, 22 bp, Artificial Sequence
  chemically synthesized
agctaatgtgtcttttactctg

SEQ ID NO: 1214135 - DNA, 22 bp, Artificial Sequence
  chemically synthesized
tatgtactctgcagagtaaaag

SEQ ID NO: 1214136 - DNA, 22 bp, Artificial Sequence
  chemically synthesized
tagctaatgtgtcttttactct

SEQ ID NO: 1214137 - DNA, 22 bp, Artificial Sequence
  chemically synthesized
ttttagctaatgtgtcttttac

SEQ ID NO: 1214138 - DNA, 22 bp, Artificial Sequence
  chemically synthesized
ttgttttagctaatgtgtcttt

SEQ ID NO: 1214139 - DNA, 22 bp, Artificial Sequence
  chemically synthesized
tgcagagtaaaagacacattag

SEQ ID NO: 1214140 - DNA, 22 bp, Artificial Sequence
  chemically synthesized
cagagtaaaagacacattagct

SEQ ID NO: 1214141 - DNA, 22 bp, Artificial Sequence
  chemically synthesized
tgagcactattgttttagctaa

SEQ ID NO: 1214142 - DNA, 22 bp, Artificial Sequence
  chemically synthesized
atattatgagcactattgtttt

SEQ ID NO: 1214143 - DNA, 22 bp, Artificial Sequence
  chemically synthesized
gctaaaacaatagtgctcataa

SEQ ID NO: 1214144 - DNA, 22 bp, Artificial Sequence
  chemically synthesized
aaacaatagtgctcataatatt

SEQ ID NO: 1214145 - DNA, 22 bp, Artificial Sequence
  chemically synthesized
cacaagccaaatacattaatat

SEQ ID NO: 1214146 - DNA, 22 bp, Artificial Sequence
  chemically synthesized
acacaagccaaatacattaata

SEQ ID NO: 1214147 - DNA, 22 bp, Artificial Sequence
  chemically synthesized
cttacacaagccaaatacatta

SEQ ID NO: 1214148 - DNA, 22 bp, Artificial Sequence
  chemically synthesized
ttacttacacaagccaaataca

SEQ ID NO: 1214149 - DNA, 22 bp, Artificial Sequence
  chemically synthesized
ataatattaatgtatttggctt

SEQ ID NO: 1214150 - DNA, 22 bp, Artificial Sequence
  chemically synthesized
aatattgttacttacacaagcc

SEQ ID NO: 1214151 - DNA, 22 bp, Artificial Sequence
  chemically synthesized
aaatattgttacttacacaagc

SEQ ID NO: 1214152 - DNA, 22 bp, Artificial Sequence
  chemically synthesized
atgtatttggcttgtgtaagta

SEQ ID NO: 1214153 - DNA, 22 bp, Artificial Sequence
  chemically synthesized
tcagagcttaaatattgttact

SEQ ID NO: 1214154 - DNA, 22 bp, Artificial Sequence
  chemically synthesized
ggcttgtgtaagtaacaatatt

SEQ ID NO: 1214155 - DNA, 22 bp, Artificial Sequence
  chemically synthesized
gcttgtgtaagtaacaatattt

SEQ ID NO: 1214156 - DNA, 22 bp, Artificial Sequence
  chemically synthesized
ttgtcagagcttaaatattgtt

SEQ ID NO: 1214157 - DNA, 22 bp, Artificial Sequence
  chemically synthesized
gtgtaagtaacaatatttaagc

SEQ ID NO: 1214158 - DNA, 22 bp, Artificial Sequence
  chemically synthesized
tgtaagtaacaatatttaagct

SEQ ID NO: 1214159 - DNA, 22 bp, Artificial Sequence
  chemically synthesized
gaattattgtcagagcttaaat

SEQ ID NO: 1214160 - DNA, 22 bp, Artificial Sequence
  chemically synthesized
aaattagaattattgtcagagc

SEQ ID NO: 1214161 - DNA, 22 bp, Artificial Sequence
  chemically synthesized
aaaattagaattattgtcagag

SEQ ID NO: 1214162 - DNA, 22 bp, Artificial Sequence
  chemically synthesized
aagctctgacaataattctaat

SEQ ID NO: 1214163 - DNA, 22 bp, Artificial Sequence
  chemically synthesized
agctctgacaataattctaatt

SEQ ID NO: 1214164 - DNA, 22 bp, Artificial Sequence
  chemically synthesized
tgacaataattctaattttaaa

SEQ ID NO: 1214165 - DNA, 22 bp, Artificial Sequence
  chemically synthesized
acaataattctaattttaaaca

SEQ ID NO: 1214166 - DNA, 22 bp, Artificial Sequence
  chemically synthesized
cagatggaatgaaaatgtttaa

SEQ ID NO: 1214167 - DNA, 22 bp, Artificial Sequence
  chemically synthesized
gcagatggaatgaaaatgttta

SEQ ID NO: 1214168 - DNA, 22 bp, Artificial Sequence
  chemically synthesized
atcttgcagatggaatgaaaat

SEQ ID NO: 1214169 - DNA, 22 bp, Artificial Sequence
  chemically synthesized
taattttaaacattttcattcc

SEQ ID NO: 1214170 - DNA, 22 bp, Artificial Sequence
  chemically synthesized
aatcttgcagatggaatgaaaa

SEQ ID NO: 1214171 - DNA, 22 bp, Artificial Sequence
  chemically synthesized
taatcttgcagatggaatgaaa

SEQ ID NO: 1214172 - DNA, 22 bp, Artificial Sequence
  chemically synthesized
attttaaacattttcattccat

SEQ ID NO: 1214173 - DNA, 22 bp, Artificial Sequence
  chemically synthesized
taaacattttcattccatctgc

SEQ ID NO: 1214174 - DNA, 22 bp, Artificial Sequence
  chemically synthesized
aaacattttcattccatctgca

SEQ ID NO: 1214175 - DNA, 22 bp, Artificial Sequence
  chemically synthesized
aaactttaatcttgcagatgga

SEQ ID NO: 1214176 - DNA, 22 bp, Artificial Sequence
  chemically synthesized
aacattttcattccatctgcaa

SEQ ID NO: 1214177 - DNA, 22 bp, Artificial Sequence
  chemically synthesized
tcattccatctgcaagattaaa

SEQ ID NO: 1214178 - DNA, 22 bp, Artificial Sequence
  chemically synthesized
cattccatctgcaagattaaag

SEQ ID NO: 1214179 - DNA, 22 bp, Artificial Sequence
  chemically synthesized
attccatctgcaagattaaagt

SEQ ID NO: 1214180 - DNA, 22 bp, Artificial Sequence
  chemically synthesized
catctgcaagattaaagtttga

SEQ ID NO: 1214181 - DNA, 22 bp, Artificial Sequence
  chemically synthesized
aataatcataataattcaaact

SEQ ID NO: 1214182 - DNA, 22 bp, Artificial Sequence
  chemically synthesized
caagattaaagtttgaattatt

SEQ ID NO: 1214183 - DNA, 22 bp, Artificial Sequence
  chemically synthesized
aagtttgaattattatgattat

SEQ ID NO: 1214184 - DNA, 22 bp, Artificial Sequence
  chemically synthesized
atcaagaggcattgaataatca

SEQ ID NO: 1214185 - DNA, 22 bp, Artificial Sequence
  chemically synthesized
gaattattatgattattcaatg

SEQ ID NO: 1214186 - DNA, 22 bp, Artificial Sequence
  chemically synthesized
aattattatgattattcaatgc

SEQ ID NO: 1214187 - DNA, 22 bp, Artificial Sequence
  chemically synthesized
agattgatcaagaggcattgaa

SEQ ID NO: 1214188 - DNA, 22 bp, Artificial Sequence
  chemically synthesized
ttatgattattcaatgcctctt

SEQ ID NO: 1214189 - DNA, 22 bp, Artificial Sequence
  chemically synthesized
ctcagattgatcaagaggcatt

SEQ ID NO: 1214190 - DNA, 22 bp, Artificial Sequence
  chemically synthesized
cctcagattgatcaagaggcat

SEQ ID NO: 1214191 - DNA, 22 bp, Artificial Sequence
  chemically synthesized
tcctcagattgatcaagaggca

SEQ ID NO: 1214192 - DNA, 22 bp, Artificial Sequence
  chemically synthesized
tgattattcaatgcctcttgat

SEQ ID NO: 1214193 - DNA, 22 bp, Artificial Sequence
  chemically synthesized
ttcaatgcctcttgatcaatct

SEQ ID NO: 1214194 - DNA, 22 bp, Artificial Sequence
  chemically synthesized
aatgcctcttgatcaatctgag

SEQ ID NO: 1214195 - DNA, 22 bp, Artificial Sequence
  chemically synthesized
aaagaaatctttcctcagattg

SEQ ID NO: 1214196 - DNA, 22 bp, Artificial Sequence
  chemically synthesized
ttgaaagaaatctttcctcaga

SEQ ID NO: 1214197 - DNA, 22 bp, Artificial Sequence
  chemically synthesized
attgaaagaaatctttcctcag

SEQ ID NO: 1214198 - DNA, 22 bp, Artificial Sequence
  chemically synthesized
ttattgaaagaaatctttcctc

SEQ ID NO: 1214199 - DNA, 22 bp, Artificial Sequence
  chemically synthesized
ttgatcaatctgaggaaagatt

SEQ ID NO: 1214200 - DNA, 22 bp, Artificial Sequence
  chemically synthesized
gatcaatctgaggaaagatttc

SEQ ID NO: 1214201 - DNA, 22 bp, Artificial Sequence
  chemically synthesized
atcaatctgaggaaagatttct

SEQ ID NO: 1214202 - DNA, 22 bp, Artificial Sequence
  chemically synthesized
aaggaatgttcttattgaaaga

SEQ ID NO: 1214203 - DNA, 22 bp, Artificial Sequence
  chemically synthesized
gaaggaatgttcttattgaaag

SEQ ID NO: 1214204 - DNA, 22 bp, Artificial Sequence
  chemically synthesized
aggaaagatttctttcaataag

SEQ ID NO: 1214205 - DNA, 22 bp, Artificial Sequence
  chemically synthesized
ctttcaataagaacattccttc

SEQ ID NO: 1214206 - DNA, 22 bp, Artificial Sequence
  chemically synthesized
tttcaataagaacattccttca

SEQ ID NO: 1214207 - DNA, 22 bp, Artificial Sequence
  chemically synthesized
tcaataagaacattccttcaag

SEQ ID NO: 1214208 - DNA, 22 bp, Artificial Sequence
  chemically synthesized
caataagaacattccttcaagc

SEQ ID NO: 1214209 - DNA, 22 bp, Artificial Sequence
  chemically synthesized
aataagaacattccttcaagca

SEQ ID NO: 1214210 - DNA, 22 bp, Artificial Sequence
  chemically synthesized
gtgaagaacatagcaaaggtag

SEQ ID NO: 1214211 - DNA, 22 bp, Artificial Sequence
  chemically synthesized
cttcaagcactacctttgctat

SEQ ID NO: 1214212 - DNA, 22 bp, Artificial Sequence
  chemically synthesized
caagcactacctttgctatgtt

SEQ ID NO: 1214213 - DNA, 22 bp, Artificial Sequence
  chemically synthesized
aagcactacctttgctatgttc

SEQ ID NO: 1214214 - DNA, 22 bp, Artificial Sequence
  chemically synthesized
acatagactagtgaagaacata

SEQ ID NO: 1214215 - DNA, 22 bp, Artificial Sequence
  chemically synthesized
aacatagactagtgaagaacat

SEQ ID NO: 1214216 - DNA, 22 bp, Artificial Sequence
  chemically synthesized
cctttgctatgttcttcactag

SEQ ID NO: 1214217 - DNA, 22 bp, Artificial Sequence
  chemically synthesized
atcttaacatagactagtgaag

SEQ ID NO: 1214218 - DNA, 22 bp, Artificial Sequence
  chemically synthesized
tgctatgttcttcactagtcta

SEQ ID NO: 1214219 - DNA, 22 bp, Artificial Sequence
  chemically synthesized
gctatgttcttcactagtctat

SEQ ID NO: 1214220 - DNA, 22 bp, Artificial Sequence
  chemically synthesized
ctatgttcttcactagtctatg

SEQ ID NO: 1214221 - DNA, 22 bp, Artificial Sequence
  chemically synthesized
acgttaatcttaacatagacta

SEQ ID NO: 1214222 - DNA, 22 bp, Artificial Sequence
  chemically synthesized
cacgttaatcttaacatagact

SEQ ID NO: 1214223 - DNA, 22 bp, Artificial Sequence
  chemically synthesized
tgttcttcactagtctatgtta

SEQ ID NO: 1214224 - DNA, 22 bp, Artificial Sequence
  chemically synthesized
ttcacgttaatcttaacataga

SEQ ID NO: 1214225 - DNA, 22 bp, Artificial Sequence
  chemically synthesized
cttcacgttaatcttaacatag

SEQ ID NO: 1214226 - DNA, 22 bp, Artificial Sequence
  chemically synthesized
ttcactagtctatgttaagatt

SEQ ID NO: 1214227 - DNA, 22 bp, Artificial Sequence
  chemically synthesized
cactagtctatgttaagattaa

SEQ ID NO: 1214228 - DNA, 22 bp, Artificial Sequence
  chemically synthesized
gccttcttcacgttaatcttaa

SEQ ID NO: 1214229 - DNA, 22 bp, Artificial Sequence
  chemically synthesized
actagtctatgttaagattaac

SEQ ID NO: 1214230 - DNA, 22 bp, Artificial Sequence
  chemically synthesized
cctagccttcttcacgttaatc

SEQ ID NO: 1214231 - DNA, 22 bp, Artificial Sequence
  chemically synthesized
gtctatgttaagattaacgtga

SEQ ID NO: 1214232 - DNA, 22 bp, Artificial Sequence
  chemically synthesized
acctagccttcttcacgttaat

SEQ ID NO: 1214233 - DNA, 22 bp, Artificial Sequence
  chemically synthesized
cttacctagccttcttcacgtt

SEQ ID NO: 1214234 - DNA, 22 bp, Artificial Sequence
  chemically synthesized
tgttaagattaacgtgaagaag

SEQ ID NO: 1214235 - DNA, 22 bp, Artificial Sequence
  chemically synthesized
agattaacgtgaagaaggctag

SEQ ID NO: 1214236 - DNA, 22 bp, Artificial Sequence
  chemically synthesized
acgtgaagaaggctaggtaagg

SEQ ID NO: 1214237 - DNA, 22 bp, Artificial Sequence
  chemically synthesized
taatagaaatgataatactcct

SEQ ID NO: 1214238 - DNA, 22 bp, Artificial Sequence
  chemically synthesized
ggtaaggagtattatcatttct

SEQ ID NO: 1214239 - DNA, 22 bp, Artificial Sequence
  chemically synthesized
agcaaaatcattataatagaaa

SEQ ID NO: 1214240 - DNA, 22 bp, Artificial Sequence
  chemically synthesized
aagcaaaatcattataatagaa

SEQ ID NO: 1214241 - DNA, 22 bp, Artificial Sequence
  chemically synthesized
taagcaaaatcattataataga

SEQ ID NO: 1214242 - DNA, 22 bp, Artificial Sequence
  chemically synthesized
tcatttctattataatgatttt

SEQ ID NO: 1214243 - DNA, 22 bp, Artificial Sequence
  chemically synthesized
ctattataatgattttgcttaa

SEQ ID NO: 1214244 - DNA, 22 bp, Artificial Sequence
  chemically synthesized
tattataatgattttgcttaaa

SEQ ID NO: 1214245 - DNA, 22 bp, Artificial Sequence
  chemically synthesized
ttataatgattttgcttaaaat

SEQ ID NO: 1214246 - DNA, 22 bp, Artificial Sequence
  chemically synthesized
taatgattttgcttaaaatgta

SEQ ID NO: 1214247 - DNA, 22 bp, Artificial Sequence
  chemically synthesized
atcataaacagaaatgtacatt

SEQ ID NO: 1214248 - DNA, 22 bp, Artificial Sequence
  chemically synthesized
tgcttaaaatgtacatttctgt

SEQ ID NO: 1214249 - DNA, 22 bp, Artificial Sequence
  chemically synthesized
cattcatcataaacagaaatgt

SEQ ID NO: 1214250 - DNA, 22 bp, Artificial Sequence
  chemically synthesized
gcttaaaatgtacatttctgtt

SEQ ID NO: 1214251 - DNA, 22 bp, Artificial Sequence
  chemically synthesized
gcattcatcataaacagaaatg

SEQ ID NO: 1214252 - DNA, 22 bp, Artificial Sequence
  chemically synthesized
cttaaaatgtacatttctgttt

SEQ ID NO: 1214253 - DNA, 22 bp, Artificial Sequence
  chemically synthesized
tgcattcatcataaacagaaat

SEQ ID NO: 1214254 - DNA, 22 bp, Artificial Sequence
  chemically synthesized
aaaatgtacatttctgtttatg

SEQ ID NO: 1214255 - DNA, 22 bp, Artificial Sequence
  chemically synthesized
aaatgtacatttctgtttatga

SEQ ID NO: 1214256 - DNA, 22 bp, Artificial Sequence
  chemically synthesized
aatgataatatctttgcattca

SEQ ID NO: 1214257 - DNA, 22 bp, Artificial Sequence
  chemically synthesized
ctgtttatgatgaatgcaaaga

SEQ ID NO: 1214258 - DNA, 22 bp, Artificial Sequence
  chemically synthesized
tgtttatgatgaatgcaaagat

SEQ ID NO: 1214259 - DNA, 22 bp, Artificial Sequence
  chemically synthesized
tttatgatgaatgcaaagatat

SEQ ID NO: 1214260 - DNA, 22 bp, Artificial Sequence
  chemically synthesized
cattaaatgataatatctttgc

SEQ ID NO: 1214261 - DNA, 22 bp, Artificial Sequence
  chemically synthesized
ccattaaatgataatatctttg

SEQ ID NO: 1214262 - DNA, 22 bp, Artificial Sequence
  chemically synthesized
tccattaaatgataatatcttt

SEQ ID NO: 1214263 - DNA, 22 bp, Artificial Sequence
  chemically synthesized
atgatgaatgcaaagatattat

SEQ ID NO: 1214264 - DNA, 22 bp, Artificial Sequence
  chemically synthesized
tgatgaatgcaaagatattatc

SEQ ID NO: 1214265 - DNA, 22 bp, Artificial Sequence
  chemically synthesized
cataaattttccattaaatgat

SEQ ID NO: 1214266 - DNA, 22 bp, Artificial Sequence
  chemically synthesized
acataaattttccattaaatga

SEQ ID NO: 1214267 - DNA, 22 bp, Artificial Sequence
  chemically synthesized
tcttacataaattttccattaa

SEQ ID NO: 1214268 - DNA, 22 bp, Artificial Sequence
  chemically synthesized
tcatttaatggaaaatttatgt

SEQ ID NO: 1214269 - DNA, 22 bp, Artificial Sequence
  chemically synthesized
tagcgagatctgtcttacataa

SEQ ID NO: 1214270 - DNA, 22 bp, Artificial Sequence
  chemically synthesized
aatggaaaatttatgtaagaca

SEQ ID NO: 1214271 - DNA, 22 bp, Artificial Sequence
  chemically synthesized
atggaaaatttatgtaagacag

SEQ ID NO: 1214272 - DNA, 22 bp, Artificial Sequence
  chemically synthesized
gttgtagcgagatctgtcttac

SEQ ID NO: 1214273 - DNA, 22 bp, Artificial Sequence
  chemically synthesized
aagctagttgtagcgagatctg

SEQ ID NO: 1214274 - DNA, 22 bp, Artificial Sequence
  chemically synthesized
ctaaagctagttgtagcgagat

SEQ ID NO: 1214275 - DNA, 22 bp, Artificial Sequence
  chemically synthesized
atgtaagacagatctcgctaca

SEQ ID NO: 1214276 - DNA, 22 bp, Artificial Sequence
  chemically synthesized
tgtaagacagatctcgctacaa

SEQ ID NO: 1214277 - DNA, 22 bp, Artificial Sequence
  chemically synthesized
agtaaaactgctaaagctagtt

SEQ ID NO: 1214278 - DNA, 22 bp, Artificial Sequence
  chemically synthesized
gctacaactagctttagcagtt

SEQ ID NO: 1214279 - DNA, 22 bp, Artificial Sequence
  chemically synthesized
taacctaagtaaaactgctaaa

SEQ ID NO: 1214280 - DNA, 22 bp, Artificial Sequence
  chemically synthesized
ttataacctaagtaaaactgct

SEQ ID NO: 1214281 - DNA, 22 bp, Artificial Sequence
  chemically synthesized
caactagctttagcagttttac

SEQ ID NO: 1214282 - DNA, 22 bp, Artificial Sequence
  chemically synthesized
aattgttataacctaagtaaaa

SEQ ID NO: 1214283 - DNA, 22 bp, Artificial Sequence
  chemically synthesized
aaattgttataacctaagtaaa

SEQ ID NO: 1214284 - DNA, 22 bp, Artificial Sequence
  chemically synthesized
gctttagcagttttacttaggt

SEQ ID NO: 1214285 - DNA, 22 bp, Artificial Sequence
  chemically synthesized
taaattgttataacctaagtaa

SEQ ID NO: 1214286 - DNA, 22 bp, Artificial Sequence
  chemically synthesized
ttaaattgttataacctaagta

SEQ ID NO: 1214287 - DNA, 22 bp, Artificial Sequence
  chemically synthesized
tagcagttttacttaggttata

SEQ ID NO: 1214288 - DNA, 22 bp, Artificial Sequence
  chemically synthesized
agcagttttacttaggttataa

SEQ ID NO: 1214289 - DNA, 22 bp, Artificial Sequence
  chemically synthesized
gcagttttacttaggttataac

SEQ ID NO: 1214290 - DNA, 22 bp, Artificial Sequence
  chemically synthesized
tacttaggttataacaatttaa

SEQ ID NO: 1214291 - DNA, 22 bp, Artificial Sequence
  chemically synthesized
acttaggttataacaatttaaa

SEQ ID NO: 1214292 - DNA, 22 bp, Artificial Sequence
  chemically synthesized
cttaggttataacaatttaaaa

SEQ ID NO: 1214293 - DNA, 22 bp, Artificial Sequence
  chemically synthesized
taagatgagaaatttttaaatt

SEQ ID NO: 1214294 - DNA, 22 bp, Artificial Sequence
  chemically synthesized
aggttataacaatttaaaaatt

SEQ ID NO: 1214295 - DNA, 22 bp, Artificial Sequence
  chemically synthesized
ggttataacaatttaaaaattt

SEQ ID NO: 1214296 - DNA, 22 bp, Artificial Sequence
  chemically synthesized
taacaatttaaaaatttctcat

SEQ ID NO: 1214297 - DNA, 22 bp, Artificial Sequence
  chemically synthesized
agggactataagatgagaaatt

SEQ ID NO: 1214298 - DNA, 22 bp, Artificial Sequence
  chemically synthesized
aaaaatttctcatcttatagtc

SEQ ID NO: 1214299 - DNA, 22 bp, Artificial Sequence
  chemically synthesized
aaaatttctcatcttatagtcc

SEQ ID NO: 1214300 - DNA, 22 bp, Artificial Sequence
  chemically synthesized
ctcatcttatagtcccttaata

SEQ ID NO: 1214301 - DNA, 22 bp, Artificial Sequence
  chemically synthesized
aaaaatatggaatattaaggga

SEQ ID NO: 1214302 - DNA, 22 bp, Artificial Sequence
  chemically synthesized
tcatcttatagtcccttaatat

SEQ ID NO: 1214303 - DNA, 22 bp, Artificial Sequence
  chemically synthesized
atcttatagtcccttaatattc

SEQ ID NO: 1214304 - DNA, 22 bp, Artificial Sequence
  chemically synthesized
atagtcccttaatattccatat

SEQ ID NO: 1214305 - DNA, 22 bp, Artificial Sequence
  chemically synthesized
tagtcccttaatattccatatt

SEQ ID NO: 1214306 - DNA, 22 bp, Artificial Sequence
  chemically synthesized
aatattccatattttttaactt

SEQ ID NO: 1214307 - DNA, 22 bp, Artificial Sequence
  chemically synthesized
atattccatattttttaacttt

SEQ ID NO: 1214308 - DNA, 22 bp, Artificial Sequence
  chemically synthesized
catgtgaaatacgaaaaaagtt

SEQ ID NO: 1214309 - DNA, 22 bp, Artificial Sequence
  chemically synthesized
catattttttaacttttttcgt

SEQ ID NO: 1214310 - DNA, 22 bp, Artificial Sequence
  chemically synthesized
tttaacttttttcgtatttcac

SEQ ID NO: 1214311 - DNA, 22 bp, Artificial Sequence
  chemically synthesized
ttaacttttttcgtatttcaca

SEQ ID NO: 1214312 - DNA, 22 bp, Artificial Sequence
  chemically synthesized
taacttttttcgtatttcacat

SEQ ID NO: 1214313 - DNA, 22 bp, Artificial Sequence
  chemically synthesized
aacttttttcgtatttcacatg

SEQ ID NO: 1214314 - DNA, 22 bp, Artificial Sequence
  chemically synthesized
accaacaaactgcatgtgaaat

SEQ ID NO: 1214315 - DNA, 22 bp, Artificial Sequence
  chemically synthesized
acttttttcgtatttcacatgc

SEQ ID NO: 1214316 - DNA, 22 bp, Artificial Sequence
  chemically synthesized
caccaacaaactgcatgtgaaa

SEQ ID NO: 1214317 - DNA, 22 bp, Artificial Sequence
  chemically synthesized
tcaccaacaaactgcatgtgaa

SEQ ID NO: 1214318 - DNA, 22 bp, Artificial Sequence
  chemically synthesized
ttttcgtatttcacatgcagtt

SEQ ID NO: 1214319 - DNA, 22 bp, Artificial Sequence
  chemically synthesized
ctttcaccaacaaactgcatgt

SEQ ID NO: 1214320 - DNA, 22 bp, Artificial Sequence
  chemically synthesized
tttcgtatttcacatgcagttt

SEQ ID NO: 1214321 - DNA, 22 bp, Artificial Sequence
  chemically synthesized
gctttcaccaacaaactgcatg

SEQ ID NO: 1214322 - DNA, 22 bp, Artificial Sequence
  chemically synthesized
ttcgtatttcacatgcagtttg

SEQ ID NO: 1214323 - DNA, 22 bp, Artificial Sequence
  chemically synthesized
tgctttcaccaacaaactgcat

SEQ ID NO: 1214324 - DNA, 22 bp, Artificial Sequence
  chemically synthesized
tcgtatttcacatgcagtttgt

SEQ ID NO: 1214325 - DNA, 22 bp, Artificial Sequence
  chemically synthesized
cgtatttcacatgcagtttgtt

SEQ ID NO: 1214326 - DNA, 22 bp, Artificial Sequence
  chemically synthesized
gtatttcacatgcagtttgttg

SEQ ID NO: 1214327 - DNA, 22 bp, Artificial Sequence
  chemically synthesized
gaattttgctttcaccaacaaa

SEQ ID NO: 1214328 - DNA, 22 bp, Artificial Sequence
  chemically synthesized
cacatgcagtttgttggtgaaa

SEQ ID NO: 1214329 - DNA, 22 bp, Artificial Sequence
  chemically synthesized
acatgcagtttgttggtgaaag

SEQ ID NO: 1214330 - DNA, 22 bp, Artificial Sequence
  chemically synthesized
tatctcgaattttgctttcacc

SEQ ID NO: 1214331 - DNA, 22 bp, Artificial Sequence
  chemically synthesized
ttatatctcgaattttgctttc

SEQ ID NO: 1214332 - DNA, 22 bp, Artificial Sequence
  chemically synthesized
tattatatctcgaattttgctt

SEQ ID NO: 1214333 - DNA, 22 bp, Artificial Sequence
  chemically synthesized
tctattatatctcgaattttgc

SEQ ID NO: 1214334 - DNA, 22 bp, Artificial Sequence
  chemically synthesized
gttggtgaaagcaaaattcgag

SEQ ID NO: 1214335 - DNA, 22 bp, Artificial Sequence
  chemically synthesized
tctctattatatctcgaatttt

SEQ ID NO: 1214336 - DNA, 22 bp, Artificial Sequence
  chemically synthesized
ttggtgaaagcaaaattcgaga

SEQ ID NO: 1214337 - DNA, 22 bp, Artificial Sequence
  chemically synthesized
ctctctattatatctcgaattt

SEQ ID NO: 1214338 - DNA, 22 bp, Artificial Sequence
  chemically synthesized
tctctctattatatctcgaatt

SEQ ID NO: 1214339 - DNA, 22 bp, Artificial Sequence
  chemically synthesized
ttctctctattatatctcgaat

SEQ ID NO: 1214340 - DNA, 22 bp, Artificial Sequence
  chemically synthesized
gtgaaagcaaaattcgagatat

SEQ ID NO: 1214341 - DNA, 22 bp, Artificial Sequence
  chemically synthesized
tttctctctattatatctcgaa

SEQ ID NO: 1214342 - DNA, 22 bp, Artificial Sequence
  chemically synthesized
ttttctctctattatatctcga

SEQ ID NO: 1214343 - DNA, 22 bp, Artificial Sequence
  chemically synthesized
gagatataatagagagaaaaaa

SEQ ID NO: 1214344 - DNA, 22 bp, Artificial Sequence
  chemically synthesized
gataaaaataaataatgtattt

SEQ ID NO: 1214345 - DNA, 22 bp, Artificial Sequence
  chemically synthesized
ctggataaaaataaataatgta

SEQ ID NO: 1214346 - DNA, 22 bp, Artificial Sequence
  chemically synthesized
tttatttttatccaggagctta

SEQ ID NO: 1214347 - DNA, 22 bp, Artificial Sequence
  chemically synthesized
atttttatccaggagcttatgt

SEQ ID NO: 1214348 - DNA, 22 bp, Artificial Sequence
  chemically synthesized
tttttatccaggagcttatgtc

SEQ ID NO: 1214349 - DNA, 22 bp, Artificial Sequence
  chemically synthesized
ttatccaggagcttatgtctca

SEQ ID NO: 1214350 - DNA, 22 bp, Artificial Sequence
  chemically synthesized
tatccaggagcttatgtctcat

SEQ ID NO: 1214351 - DNA, 22 bp, Artificial Sequence
  chemically synthesized
atccaggagcttatgtctcatt

SEQ ID NO: 1214352 - DNA, 22 bp, Artificial Sequence
  chemically synthesized
tccaggagcttatgtctcattt

SEQ ID NO: 1214353 - DNA, 22 bp, Artificial Sequence
  chemically synthesized
caaaatataacaacgatataaa

SEQ ID NO: 1214354 - DNA, 22 bp, Artificial Sequence
  chemically synthesized
atgtctcatttttatatcgttg

SEQ ID NO: 1214355 - DNA, 22 bp, Artificial Sequence
  chemically synthesized
tgtctcatttttatatcgttgt

SEQ ID NO: 1214356 - DNA, 22 bp, Artificial Sequence
  chemically synthesized
acccattgcaaaatataacaac

SEQ ID NO: 1214357 - DNA, 22 bp, Artificial Sequence
  chemically synthesized
atttttatatcgttgttatatt

SEQ ID NO: 1214358 - DNA, 22 bp, Artificial Sequence
  chemically synthesized
cacccattgcaaaatataacaa

SEQ ID NO: 1214359 - DNA, 22 bp, Artificial Sequence
  chemically synthesized
ttatatcgttgttatattttgc

SEQ ID NO: 1214360 - DNA, 22 bp, Artificial Sequence
  chemically synthesized
tatatcgttgttatattttgca

SEQ ID NO: 1214361 - DNA, 22 bp, Artificial Sequence
  chemically synthesized
atatcgttgttatattttgcaa

SEQ ID NO: 1214362 - DNA, 22 bp, Artificial Sequence
  chemically synthesized
tatcgttgttatattttgcaat

SEQ ID NO: 1214363 - DNA, 22 bp, Artificial Sequence
  chemically synthesized
ttatattttgcaatgggtgaaa

SEQ ID NO: 1214364 - DNA, 22 bp, Artificial Sequence
  chemically synthesized
aagagaaagacaaatttcaccc

SEQ ID NO: 1214365 - DNA, 22 bp, Artificial Sequence
  chemically synthesized
tattttgcaatgggtgaaattt

SEQ ID NO: 1214366 - DNA, 22 bp, Artificial Sequence
  chemically synthesized
tgcaatgggtgaaatttgtctt

SEQ ID NO: 1214367 - DNA, 22 bp, Artificial Sequence
  chemically synthesized
gcaatgggtgaaatttgtcttt

SEQ ID NO: 1214368 - DNA, 22 bp, Artificial Sequence
  chemically synthesized
caatgggtgaaatttgtctttc

SEQ ID NO: 1214369 - DNA, 22 bp, Artificial Sequence
  chemically synthesized
aaagactgaagagaaagacaaa

SEQ ID NO: 1214370 - DNA, 22 bp, Artificial Sequence
  chemically synthesized
aaaagactgaagagaaagacaa

SEQ ID NO: 1214371 - DNA, 22 bp, Artificial Sequence
  chemically synthesized
taaaagactgaagagaaagaca

SEQ ID NO: 1214372 - DNA, 22 bp, Artificial Sequence
  chemically synthesized
ggttttaaaagactgaagagaa

SEQ ID NO: 1214373 - DNA, 22 bp, Artificial Sequence
  chemically synthesized
gtctttctcttcagtcttttaa

SEQ ID NO: 1214374 - DNA, 22 bp, Artificial Sequence
  chemically synthesized
tctttctcttcagtcttttaaa

SEQ ID NO: 1214375 - DNA, 22 bp, Artificial Sequence
  chemically synthesized
gtgaagtaactaggttttaaaa

SEQ ID NO: 1214376 - DNA, 22 bp, Artificial Sequence
  chemically synthesized
tctcttcagtcttttaaaacct

SEQ ID NO: 1214377 - DNA, 22 bp, Artificial Sequence
  chemically synthesized
ctcttcagtcttttaaaaccta

SEQ ID NO: 1214378 - DNA, 22 bp, Artificial Sequence
  chemically synthesized
tcttcagtcttttaaaacctag

SEQ ID NO: 1214379 - DNA, 22 bp, Artificial Sequence
  chemically synthesized
ttcagtcttttaaaacctagtt

SEQ ID NO: 1214380 - DNA, 22 bp, Artificial Sequence
  chemically synthesized
cagtcttttaaaacctagttac

SEQ ID NO: 1214381 - DNA, 22 bp, Artificial Sequence
  chemically synthesized
agtcttttaaaacctagttact

SEQ ID NO: 1214382 - DNA, 22 bp, Artificial Sequence
  chemically synthesized
gaaaaaacctggtgaagtaact

SEQ ID NO: 1214383 - DNA, 22 bp, Artificial Sequence
  chemically synthesized
ggaaaaaacctggtgaagtaac

SEQ ID NO: 1214384 - DNA, 22 bp, Artificial Sequence
  chemically synthesized
ttaaaacctagttacttcacca

SEQ ID NO: 1214385 - DNA, 22 bp, Artificial Sequence
  chemically synthesized
taaaacctagttacttcaccag

SEQ ID NO: 1214386 - DNA, 22 bp, Artificial Sequence
  chemically synthesized
aaaacctagttacttcaccagg

SEQ ID NO: 1214387 - DNA, 22 bp, Artificial Sequence
  chemically synthesized
aaacctagttacttcaccaggt

SEQ ID NO: 1214388 - DNA, 22 bp, Artificial Sequence
  chemically synthesized
agtatttggaaaaaacctggtg

SEQ ID NO: 1214389 - DNA, 22 bp, Artificial Sequence
  chemically synthesized
gagtatttggaaaaaacctggt

SEQ ID NO: 1214390 - DNA, 22 bp, Artificial Sequence
  chemically synthesized
gttacttcaccaggttttttcc

SEQ ID NO: 1214391 - DNA, 22 bp, Artificial Sequence
  chemically synthesized
ggcatttgagtatttggaaaaa

SEQ ID NO: 1214392 - DNA, 22 bp, Artificial Sequence
  chemically synthesized
cttcaccaggttttttccaaat

SEQ ID NO: 1214393 - DNA, 22 bp, Artificial Sequence
  chemically synthesized
caccaggttttttccaaatact

SEQ ID NO: 1214394 - DNA, 22 bp, Artificial Sequence
  chemically synthesized
accaggttttttccaaatactc

SEQ ID NO: 1214395 - DNA, 22 bp, Artificial Sequence
  chemically synthesized
tttccaaatactcaaatgccca

SEQ ID NO: 1214396 - DNA, 22 bp, Artificial Sequence
  chemically synthesized
ttccaaatactcaaatgcccaa

SEQ ID NO: 1214397 - DNA, 22 bp, Artificial Sequence
  chemically synthesized
tccaaatactcaaatgcccaat

SEQ ID NO: 1214398 - DNA, 22 bp, Artificial Sequence
  chemically synthesized
ccaaatactcaaatgcccaatc

SEQ ID NO: 1214399 - DNA, 22 bp, Artificial Sequence
  chemically synthesized
caaatactcaaatgcccaatcg

SEQ ID NO: 1214400 - DNA, 22 bp, Artificial Sequence
  chemically synthesized
gtatagaaaaataacgattggg

SEQ ID NO: 1214401 - DNA, 22 bp, Artificial Sequence
  chemically synthesized
aaatgcccaatcgttatttttc

SEQ ID NO: 1214402 - DNA, 22 bp, Artificial Sequence
  chemically synthesized
tttttctatactagttttttcc

SEQ ID NO: 1214403 - DNA, 22 bp, Artificial Sequence
  chemically synthesized
ttctatactagttttttcccca

SEQ ID NO: 1214404 - DNA, 22 bp, Artificial Sequence
  chemically synthesized
tctatactagttttttccccac

SEQ ID NO: 1214405 - DNA, 22 bp, Artificial Sequence
  chemically synthesized
ctatactagttttttccccact

SEQ ID NO: 1214406 - DNA, 22 bp, Artificial Sequence
  chemically synthesized
tatactagttttttccccactt

SEQ ID NO: 1214407 - DNA, 22 bp, Artificial Sequence
  chemically synthesized
tactagttttttccccacttct

SEQ ID NO: 1214408 - DNA, 22 bp, Artificial Sequence
  chemically synthesized
aaaagagacagccagaagtggg

SEQ ID NO: 1214409 - DNA, 22 bp, Artificial Sequence
  chemically synthesized
tgaaaagagacagccagaagtg

SEQ ID NO: 1214410 - DNA, 22 bp, Artificial Sequence
  chemically synthesized
gttttttccccacttctggctg

SEQ ID NO: 1214411 - DNA, 22 bp, Artificial Sequence
  chemically synthesized
tttccccacttctggctgtctc

SEQ ID NO: 1214412 - DNA, 22 bp, Artificial Sequence
  chemically synthesized
ttccccacttctggctgtctct

SEQ ID NO: 1214413 - DNA, 22 bp, Artificial Sequence
  chemically synthesized
tccccacttctggctgtctctt

SEQ ID NO: 1214414 - DNA, 22 bp, Artificial Sequence
  chemically synthesized
ccccacttctggctgtctcttt

SEQ ID NO: 1214415 - DNA, 22 bp, Artificial Sequence
  chemically synthesized
cccacttctggctgtctctttt

SEQ ID NO: 1214416 - DNA, 22 bp, Artificial Sequence
  chemically synthesized
atcaaagggactctgaaaagag

SEQ ID NO: 1214417 - DNA, 22 bp, Artificial Sequence
  chemically synthesized
ttaatcaaagggactctgaaaa

SEQ ID NO: 1214418 - DNA, 22 bp, Artificial Sequence
  chemically synthesized
ctggctgtctcttttcagagtc

SEQ ID NO: 1214419 - DNA, 22 bp, Artificial Sequence
  chemically synthesized
tggctgtctcttttcagagtcc

SEQ ID NO: 1214420 - DNA, 22 bp, Artificial Sequence
  chemically synthesized
gctgtctcttttcagagtccct

SEQ ID NO: 1214421 - DNA, 22 bp, Artificial Sequence
  chemically synthesized
tagttgttaatcaaagggactc

SEQ ID NO: 1214422 - DNA, 22 bp, Artificial Sequence
  chemically synthesized
tctcttttcagagtccctttga

SEQ ID NO: 1214423 - DNA, 22 bp, Artificial Sequence
  chemically synthesized
ttgtagttgttaatcaaaggga

SEQ ID NO: 1214424 - DNA, 22 bp, Artificial Sequence
  chemically synthesized
ttttcagagtccctttgattaa

SEQ ID NO: 1214425 - DNA, 22 bp, Artificial Sequence
  chemically synthesized
ttcagagtccctttgattaaca

SEQ ID NO: 1214426 - DNA, 22 bp, Artificial Sequence
  chemically synthesized
tcagagtccctttgattaacaa

SEQ ID NO: 1214427 - DNA, 22 bp, Artificial Sequence
  chemically synthesized
cagagtccctttgattaacaac

SEQ ID NO: 1214428 - DNA, 22 bp, Artificial Sequence
  chemically synthesized
agagtccctttgattaacaact

SEQ ID NO: 1214429 - DNA, 22 bp, Artificial Sequence
  chemically synthesized
tgatattgttgtagttgttaat

SEQ ID NO: 1214430 - DNA, 22 bp, Artificial Sequence
  chemically synthesized
tgattaacaactacaacaatat

SEQ ID NO: 1214431 - DNA, 22 bp, Artificial Sequence
  chemically synthesized
gattaacaactacaacaatatc

SEQ ID NO: 1214432 - DNA, 22 bp, Artificial Sequence
  chemically synthesized
attaacaactacaacaatatca

SEQ ID NO: 1214433 - DNA, 22 bp, Artificial Sequence
  chemically synthesized
aacagcagactatgatattgtt

SEQ ID NO: 1214434 - DNA, 22 bp, Artificial Sequence
  chemically synthesized
acaactacaacaatatcatagt

SEQ ID NO: 1214435 - DNA, 22 bp, Artificial Sequence
  chemically synthesized
tagttaaacagcagactatgat

SEQ ID NO: 1214436 - DNA, 22 bp, Artificial Sequence
  chemically synthesized
actgtagttaaacagcagacta

SEQ ID NO: 1214437 - DNA, 22 bp, Artificial Sequence
  chemically synthesized
caacaatatcatagtctgctgt

SEQ ID NO: 1214438 - DNA, 22 bp, Artificial Sequence
  chemically synthesized
acctcactgtagttaaacagca

SEQ ID NO: 1214439 - DNA, 22 bp, Artificial Sequence
  chemically synthesized
ataaattcacctcactgtagtt

SEQ ID NO: 1214440 - DNA, 22 bp, Artificial Sequence
  chemically synthesized
aataaattcacctcactgtagt

SEQ ID NO: 1214441 - DNA, 22 bp, Artificial Sequence
  chemically synthesized
ctgtttaactacagtgaggtga

SEQ ID NO: 1214442 - DNA, 22 bp, Artificial Sequence
  chemically synthesized
tttaactacagtgaggtgaatt

SEQ ID NO: 1214443 - DNA, 22 bp, Artificial Sequence
  chemically synthesized
aactacagtgaggtgaatttat

SEQ ID NO: 1214444 - DNA, 22 bp, Artificial Sequence
  chemically synthesized
actacagtgaggtgaatttatt

SEQ ID NO: 1214445 - DNA, 22 bp, Artificial Sequence
  chemically synthesized
cagtgaggtgaatttattaagg

SEQ ID NO: 1214446 - DNA, 22 bp, Artificial Sequence
  chemically synthesized
aagaggcaagagtacatggtga

SEQ ID NO: 1214447 - DNA, 22 bp, Artificial Sequence
  chemically synthesized
attaagggcttcaccatgtact

SEQ ID NO: 1214448 - DNA, 22 bp, Artificial Sequence
  chemically synthesized
ttaagggcttcaccatgtactc

SEQ ID NO: 1214449 - DNA, 22 bp, Artificial Sequence
  chemically synthesized
ctcaagaggcaagagtacatgg

SEQ ID NO: 1214450 - DNA, 22 bp, Artificial Sequence
  chemically synthesized
agggcttcaccatgtactcttg

SEQ ID NO: 1214451 - DNA, 22 bp, Artificial Sequence
  chemically synthesized
ctcctcaagaggcaagagtaca

SEQ ID NO: 1214452 - DNA, 22 bp, Artificial Sequence
  chemically synthesized
ttcctcctcaagaggcaagagt

SEQ ID NO: 1214453 - DNA, 22 bp, Artificial Sequence
  chemically synthesized
attcctcctcaagaggcaagag

SEQ ID NO: 1214454 - DNA, 22 bp, Artificial Sequence
  chemically synthesized
ttattcctcctcaagaggcaag

SEQ ID NO: 1214455 - DNA, 22 bp, Artificial Sequence
  chemically synthesized
caccatgtactcttgcctcttg

SEQ ID NO: 1214456 - DNA, 22 bp, Artificial Sequence
  chemically synthesized
accatgtactcttgcctcttga

SEQ ID NO: 1214457 - DNA, 22 bp, Artificial Sequence
  chemically synthesized
ttgcctcttgaggaggaataag

SEQ ID NO: 1214458 - DNA, 22 bp, Artificial Sequence
  chemically synthesized
gcctcttgaggaggaataagag

SEQ ID NO: 1214459 - DNA, 22 bp, Artificial Sequence
  chemically synthesized
cctcttgaggaggaataagagt

SEQ ID NO: 1214460 - DNA, 22 bp, Artificial Sequence
  chemically synthesized
ttgaggaggaataagagtgtgt

SEQ ID NO: 1214461 - DNA, 22 bp, Artificial Sequence
  chemically synthesized
gaggaggaataagagtgtgtgt

SEQ ID NO: 1214462 - DNA, 22 bp, Artificial Sequence
  chemically synthesized
aggaggaataagagtgtgtgtg

SEQ ID NO: 1214463 - DNA, 22 bp, Artificial Sequence
  chemically synthesized
gaatacacacacacacacacac

SEQ ID NO: 1214464 - DNA, 22 bp, Artificial Sequence
  chemically synthesized
ataattggaatacacacacaca

SEQ ID NO: 1214465 - DNA, 22 bp, Artificial Sequence
  chemically synthesized
ttaataattggaatacacacac

SEQ ID NO: 1214466 - DNA, 22 bp, Artificial Sequence
  chemically synthesized
attaataattggaatacacaca

SEQ ID NO: 1214467 - DNA, 22 bp, Artificial Sequence
  chemically synthesized
tattaataattggaatacacac

SEQ ID NO: 1214468 - DNA, 22 bp, Artificial Sequence
  chemically synthesized
ttattaataattggaatacaca

SEQ ID NO: 1214469 - DNA, 22 bp, Artificial Sequence
  chemically synthesized
tttttattaataattggaatac

SEQ ID NO: 1214470 - DNA, 22 bp, Artificial Sequence
  chemically synthesized
aaaactgtttttattaataatt

SEQ ID NO: 1214471 - DNA, 22 bp, Artificial Sequence
  chemically synthesized
gaaaactgtttttattaataat

SEQ ID NO: 1214472 - DNA, 22 bp, Artificial Sequence
  chemically synthesized
caattattaataaaaacagttt

SEQ ID NO: 1214473 - DNA, 22 bp, Artificial Sequence
  chemically synthesized
gaaaagtgatttgaaaactgtt

SEQ ID NO: 1214474 - DNA, 22 bp, Artificial Sequence
  chemically synthesized
ggaaaagtgatttgaaaactgt

SEQ ID NO: 1214475 - DNA, 22 bp, Artificial Sequence
  chemically synthesized
ttggaaaagtgatttgaaaact

SEQ ID NO: 1214476 - DNA, 22 bp, Artificial Sequence
  chemically synthesized
ttaataaaaacagttttcaaat

SEQ ID NO: 1214477 - DNA, 22 bp, Artificial Sequence
  chemically synthesized
ataaaaacagttttcaaatcac

SEQ ID NO: 1214478 - DNA, 22 bp, Artificial Sequence
  chemically synthesized
ggcaagtgagtctcttggaaaa

SEQ ID NO: 1214479 - DNA, 22 bp, Artificial Sequence
  chemically synthesized
tcaaatcacttttccaagagac

SEQ ID NO: 1214480 - DNA, 22 bp, Artificial Sequence
  chemically synthesized
caaatcacttttccaagagact

SEQ ID NO: 1214481 - DNA, 22 bp, Artificial Sequence
  chemically synthesized
aaatcacttttccaagagactc

SEQ ID NO: 1214482 - DNA, 22 bp, Artificial Sequence
  chemically synthesized
ttccaagagactcacttgccca

SEQ ID NO: 1214483 - DNA, 22 bp, Artificial Sequence
  chemically synthesized
tatagaatcagttgggcaagtg

SEQ ID NO: 1214484 - DNA, 22 bp, Artificial Sequence
  chemically synthesized
tccaagagactcacttgcccaa

SEQ ID NO: 1214485 - DNA, 22 bp, Artificial Sequence
  chemically synthesized
ccaagagactcacttgcccaac

SEQ ID NO: 1214486 - DNA, 22 bp, Artificial Sequence
  chemically synthesized
tgtatagaatcagttgggcaag

SEQ ID NO: 1214487 - DNA, 22 bp, Artificial Sequence
  chemically synthesized
caagagactcacttgcccaact

SEQ ID NO: 1214488 - DNA, 22 bp, Artificial Sequence
  chemically synthesized
ctgtatagaatcagttgggcaa

SEQ ID NO: 1214489 - DNA, 22 bp, Artificial Sequence
  chemically synthesized
tctgtatagaatcagttgggca

SEQ ID NO: 1214490 - DNA, 22 bp, Artificial Sequence
  chemically synthesized
ttctgtatagaatcagttgggc

SEQ ID NO: 1214491 - DNA, 22 bp, Artificial Sequence
  chemically synthesized
agtttttctgtatagaatcagt

SEQ ID NO: 1214492 - DNA, 22 bp, Artificial Sequence
  chemically synthesized
acttgcccaactgattctatac

SEQ ID NO: 1214493 - DNA, 22 bp, Artificial Sequence
  chemically synthesized
gcccaactgattctatacagaa

SEQ ID NO: 1214494 - DNA, 22 bp, Artificial Sequence
  chemically synthesized
atatctaagtttttctgtatag

SEQ ID NO: 1214495 - DNA, 22 bp, Artificial Sequence
  chemically synthesized
cccaactgattctatacagaaa

SEQ ID NO: 1214496 - DNA, 22 bp, Artificial Sequence
  chemically synthesized
aatatctaagtttttctgtata

SEQ ID NO: 1214497 - DNA, 22 bp, Artificial Sequence
  chemically synthesized
taatatctaagtttttctgtat

SEQ ID NO: 1214498 - DNA, 22 bp, Artificial Sequence
  chemically synthesized
ggctttaatatctaagtttttc

SEQ ID NO: 1214499 - DNA, 22 bp, Artificial Sequence
  chemically synthesized
attctatacagaaaaacttaga

SEQ ID NO: 1214500 - DNA, 22 bp, Artificial Sequence
  chemically synthesized
cctaggctttaatatctaagtt

SEQ ID NO: 1214501 - DNA, 22 bp, Artificial Sequence
  chemically synthesized
acctaggctttaatatctaagt

SEQ ID NO: 1214502 - DNA, 22 bp, Artificial Sequence
  chemically synthesized
tatacagaaaaacttagatatt

SEQ ID NO: 1214503 - DNA, 22 bp, Artificial Sequence
  chemically synthesized
tacctaggctttaatatctaag

SEQ ID NO: 1214504 - DNA, 22 bp, Artificial Sequence
  chemically synthesized
tacagaaaaacttagatattaa

SEQ ID NO: 1214505 - DNA, 22 bp, Artificial Sequence
  chemically synthesized
agatattaaagcctaggtaaaa

SEQ ID NO: 1214506 - DNA, 22 bp, Artificial Sequence
  chemically synthesized
gatattaaagcctaggtaaaat

SEQ ID NO: 1214507 - DNA, 22 bp, Artificial Sequence
  chemically synthesized
aataaaaagatacattttacct

SEQ ID NO: 1214508 - DNA, 22 bp, Artificial Sequence
  chemically synthesized
aagcctaggtaaaatgtatctt

SEQ ID NO: 1214509 - DNA, 22 bp, Artificial Sequence
  chemically synthesized
agaaagtctaaataaaaagata

SEQ ID NO: 1214510 - DNA, 22 bp, Artificial Sequence
  chemically synthesized
ggtaaaatgtatctttttattt

SEQ ID NO: 1214511 - DNA, 22 bp, Artificial Sequence
  chemically synthesized
tctgagaaagtctaaataaaaa

SEQ ID NO: 1214512 - DNA, 22 bp, Artificial Sequence
  chemically synthesized
ttatctgagaaagtctaaataa

SEQ ID NO: 1214513 - DNA, 22 bp, Artificial Sequence
  chemically synthesized
tttatttagactttctcagata

SEQ ID NO: 1214514 - DNA, 22 bp, Artificial Sequence
  chemically synthesized
ttatttagactttctcagataa

SEQ ID NO: 1214515 - DNA, 22 bp, Artificial Sequence
  chemically synthesized
tatttagactttctcagataat

SEQ ID NO: 1214516 - DNA, 22 bp, Artificial Sequence
  chemically synthesized
aaaaaaaaagctattatctgag

SEQ ID NO: 1214517 - DNA, 22 bp, Artificial Sequence
  chemically synthesized
atttagactttctcagataata

SEQ ID NO: 1214518 - DNA, 22 bp, Artificial Sequence
  chemically synthesized
tttagactttctcagataatag

SEQ ID NO: 1214519 - DNA, 22 bp, Artificial Sequence
  chemically synthesized
agactttctcagataatagctt

SEQ ID NO: 1214520 - DNA, 22 bp, Artificial Sequence
  chemically synthesized
gactttctcagataatagcttt

SEQ ID NO: 1214521 - DNA, 22 bp, Artificial Sequence
  chemically synthesized
tctcagataatagctttttttt

SEQ ID NO: 1214522 - DNA, 22 bp, Artificial Sequence
  chemically synthesized
ctcagataatagcttttttttt

SEQ ID NO: 1214523 - DNA, 22 bp, Artificial Sequence
  chemically synthesized
tcagataatagctttttttttt

SEQ ID NO: 1214524 - DNA, 22 bp, Artificial Sequence
  chemically synthesized
agataatagcttttttttttaa

SEQ ID NO: 1214525 - DNA, 22 bp, Artificial Sequence
  chemically synthesized
agtcatatgtggattaaaaaaa

SEQ ID NO: 1214526 - DNA, 22 bp, Artificial Sequence
  chemically synthesized
gagtcatatgtggattaaaaaa

SEQ ID NO: 1214527 - DNA, 22 bp, Artificial Sequence
  chemically synthesized
ttttttttaatccacatatgac

SEQ ID NO: 1214528 - DNA, 22 bp, Artificial Sequence
  chemically synthesized
tttttttaatccacatatgact

SEQ ID NO: 1214529 - DNA, 22 bp, Artificial Sequence
  chemically synthesized
ttttttaatccacatatgactc

SEQ ID NO: 1214530 - DNA, 22 bp, Artificial Sequence
  chemically synthesized
aaatcccaccttgagtcatatg

SEQ ID NO: 1214531 - DNA, 22 bp, Artificial Sequence
  chemically synthesized
tttttaatccacatatgactca

SEQ ID NO: 1214532 - DNA, 22 bp, Artificial Sequence
  chemically synthesized
ttttaatccacatatgactcaa

SEQ ID NO: 1214533 - DNA, 22 bp, Artificial Sequence
  chemically synthesized
tttaatccacatatgactcaag

SEQ ID NO: 1214534 - DNA, 22 bp, Artificial Sequence
  chemically synthesized
ttaatccacatatgactcaagg

SEQ ID NO: 1214535 - DNA, 22 bp, Artificial Sequence
  chemically synthesized
taatccacatatgactcaaggt

SEQ ID NO: 1214536 - DNA, 22 bp, Artificial Sequence
  chemically synthesized
gattgaaatcccaccttgagtc

SEQ ID NO: 1214537 - DNA, 22 bp, Artificial Sequence
  chemically synthesized
aatccacatatgactcaaggtg

SEQ ID NO: 1214538 - DNA, 22 bp, Artificial Sequence
  chemically synthesized
atccacatatgactcaaggtgg

SEQ ID NO: 1214539 - DNA, 22 bp, Artificial Sequence
  chemically synthesized
tctagattgaaatcccaccttg

SEQ ID NO: 1214540 - DNA, 22 bp, Artificial Sequence
  chemically synthesized
atctagattgaaatcccacctt

SEQ ID NO: 1214541 - DNA, 22 bp, Artificial Sequence
  chemically synthesized
ttatctagattgaaatcccacc

SEQ ID NO: 1214542 - DNA, 22 bp, Artificial Sequence
  chemically synthesized
aaggtgggatttcaatctagat

SEQ ID NO: 1214543 - DNA, 22 bp, Artificial Sequence
  chemically synthesized
caatctagataagagatgttca

SEQ ID NO: 1214544 - DNA, 22 bp, Artificial Sequence
  chemically synthesized
aatctagataagagatgttcac

SEQ ID NO: 1214545 - DNA, 22 bp, Artificial Sequence
  chemically synthesized
agtgaggtcgtgatgtgaacat

SEQ ID NO: 1214546 - DNA, 22 bp, Artificial Sequence
  chemically synthesized
ctcagtgaggtcgtgatgtgaa

SEQ ID NO: 1214547 - DNA, 22 bp, Artificial Sequence
  chemically synthesized
gataagagatgttcacatcacg

SEQ ID NO: 1214548 - DNA, 22 bp, Artificial Sequence
  chemically synthesized
cctcagtgaggtcgtgatgtga

SEQ ID NO: 1214549 - DNA, 22 bp, Artificial Sequence
  chemically synthesized
aaatatttcctcagtgaggtcg

SEQ ID NO: 1214550 - DNA, 22 bp, Artificial Sequence
  chemically synthesized
tctcaaatatttcctcagtgag

SEQ ID NO: 1214551 - DNA, 22 bp, Artificial Sequence
  chemically synthesized
acatcacgacctcactgaggaa

SEQ ID NO: 1214552 - DNA, 22 bp, Artificial Sequence
  chemically synthesized
actatctcaaatatttcctcag

SEQ ID NO: 1214553 - DNA, 22 bp, Artificial Sequence
  chemically synthesized
actgaggaaatatttgagatag

SEQ ID NO: 1214554 - DNA, 22 bp, Artificial Sequence
  chemically synthesized
aggaaatatttgagatagtgag

SEQ ID NO: 1214555 - DNA, 22 bp, Artificial Sequence
  chemically synthesized
gatggcaaaggcatcaaaacat

SEQ ID NO: 1214556 - DNA, 22 bp, Artificial Sequence
  chemically synthesized
gagatagtgagatgttttgatg

SEQ ID NO: 1214557 - DNA, 22 bp, Artificial Sequence
  chemically synthesized
agatagtgagatgttttgatgc

SEQ ID NO: 1214558 - DNA, 22 bp, Artificial Sequence
  chemically synthesized
aaattagatggcaaaggcatca

SEQ ID NO: 1214559 - DNA, 22 bp, Artificial Sequence
  chemically synthesized
taaaattagatggcaaaggcat

SEQ ID NO: 1214560 - DNA, 22 bp, Artificial Sequence
  chemically synthesized
actctaaaattagatggcaaag

SEQ ID NO: 1214561 - DNA, 22 bp, Artificial Sequence
  chemically synthesized
agttaactctaaaattagatgg

SEQ ID NO: 1214562 - DNA, 22 bp, Artificial Sequence
  chemically synthesized
tgatgcctttgccatctaattt

SEQ ID NO: 1214563 - DNA, 22 bp, Artificial Sequence
  chemically synthesized
gatgcctttgccatctaatttt

SEQ ID NO: 1214564 - DNA, 22 bp, Artificial Sequence
  chemically synthesized
tcagttaactctaaaattagat

SEQ ID NO: 1214565 - DNA, 22 bp, Artificial Sequence
  chemically synthesized
atgcctttgccatctaatttta

SEQ ID NO: 1214566 - DNA, 22 bp, Artificial Sequence
  chemically synthesized
ctcagttaactctaaaattaga

SEQ ID NO: 1214567 - DNA, 22 bp, Artificial Sequence
  chemically synthesized
tctcagttaactctaaaattag

SEQ ID NO: 1214568 - DNA, 22 bp, Artificial Sequence
  chemically synthesized
tttctcagttaactctaaaatt

SEQ ID NO: 1214569 - DNA, 22 bp, Artificial Sequence
  chemically synthesized
ctctttctcagttaactctaaa

SEQ ID NO: 1214570 - DNA, 22 bp, Artificial Sequence
  chemically synthesized
tgccatctaattttagagttaa

SEQ ID NO: 1214571 - DNA, 22 bp, Artificial Sequence
  chemically synthesized
gccatctaattttagagttaac

SEQ ID NO: 1214572 - DNA, 22 bp, Artificial Sequence
  chemically synthesized
tactctttctcagttaactcta

SEQ ID NO: 1214573 - DNA, 22 bp, Artificial Sequence
  chemically synthesized
ccatctaattttagagttaact

SEQ ID NO: 1214574 - DNA, 22 bp, Artificial Sequence
  chemically synthesized
ccctctactctttctcagttaa

SEQ ID NO: 1214575 - DNA, 22 bp, Artificial Sequence
  chemically synthesized
attttagagttaactgagaaag

SEQ ID NO: 1214576 - DNA, 22 bp, Artificial Sequence
  chemically synthesized
tagagttaactgagaaagagta

SEQ ID NO: 1214577 - DNA, 22 bp, Artificial Sequence
  chemically synthesized
agagttaactgagaaagagtag

SEQ ID NO: 1214578 - DNA, 22 bp, Artificial Sequence
  chemically synthesized
gagttaactgagaaagagtaga

SEQ ID NO: 1214579 - DNA, 22 bp, Artificial Sequence
  chemically synthesized
tgaaaatattcccctctactct

SEQ ID NO: 1214580 - DNA, 22 bp, Artificial Sequence
  chemically synthesized
actgagaaagagtagaggggaa

SEQ ID NO: 1214581 - DNA, 22 bp, Artificial Sequence
  chemically synthesized
agaaagagtagaggggaatatt

SEQ ID NO: 1214582 - DNA, 22 bp, Artificial Sequence
  chemically synthesized
accagttatgaaaatattcccc

SEQ ID NO: 1214583 - DNA, 22 bp, Artificial Sequence
  chemically synthesized
tcaaagggagacactcaccagt

SEQ ID NO: 1214584 - DNA, 22 bp, Artificial Sequence
  chemically synthesized
aagttatcaaagggagacactc

SEQ ID NO: 1214585 - DNA, 22 bp, Artificial Sequence
  chemically synthesized
tcataactggtgagtgtctccc

SEQ ID NO: 1214586 - DNA, 22 bp, Artificial Sequence
  chemically synthesized
cataactggtgagtgtctccct

SEQ ID NO: 1214587 - DNA, 22 bp, Artificial Sequence
  chemically synthesized
ataactggtgagtgtctccctt

SEQ ID NO: 1214588 - DNA, 22 bp, Artificial Sequence
  chemically synthesized
gtgagtgtctccctttgataac

SEQ ID NO: 1214589 - DNA, 22 bp, Artificial Sequence
  chemically synthesized
tccaagccacactaaagttatc

SEQ ID NO: 1214590 - DNA, 22 bp, Artificial Sequence
  chemically synthesized
tatccaagccacactaaagtta

SEQ ID NO: 1214591 - DNA, 22 bp, Artificial Sequence
  chemically synthesized
cctttgataactttagtgtggc

SEQ ID NO: 1214592 - DNA, 22 bp, Artificial Sequence
  chemically synthesized
tgataactttagtgtggcttgg

SEQ ID NO: 1214593 - DNA, 22 bp, Artificial Sequence
  chemically synthesized
gataactttagtgtggcttgga

SEQ ID NO: 1214594 - DNA, 22 bp, Artificial Sequence
  chemically synthesized
ataactttagtgtggcttggat

SEQ ID NO: 1214595 - DNA, 22 bp, Artificial Sequence
  chemically synthesized
caagtatgacattctatccaag

SEQ ID NO: 1214596 - DNA, 22 bp, Artificial Sequence
  chemically synthesized
gcaagtatgacattctatccaa

SEQ ID NO: 1214597 - DNA, 22 bp, Artificial Sequence
  chemically synthesized
tagtgtggcttggatagaatgt

SEQ ID NO: 1214598 - DNA, 22 bp, Artificial Sequence
  chemically synthesized
agtgtggcttggatagaatgtc

SEQ ID NO: 1214599 - DNA, 22 bp, Artificial Sequence
  chemically synthesized
gtgtggcttggatagaatgtca

SEQ ID NO: 1214600 - DNA, 22 bp, Artificial Sequence
  chemically synthesized
caaatcttgcaagtatgacatt

SEQ ID NO: 1214601 - DNA, 22 bp, Artificial Sequence
  chemically synthesized
acaaatcttgcaagtatgacat

SEQ ID NO: 1214602 - DNA, 22 bp, Artificial Sequence
  chemically synthesized
ggatagaatgtcatacttgcaa

SEQ ID NO: 1214603 - DNA, 22 bp, Artificial Sequence
  chemically synthesized
gatagaatgtcatacttgcaag

SEQ ID NO: 1214604 - DNA, 22 bp, Artificial Sequence
  chemically synthesized
aagtagaaggatgtttacaaat

SEQ ID NO: 1214605 - DNA, 22 bp, Artificial Sequence
  chemically synthesized
gcaagatttgtaaacatccttc

SEQ ID NO: 1214606 - DNA, 22 bp, Artificial Sequence
  chemically synthesized
caagatttgtaaacatccttct

SEQ ID NO: 1214607 - DNA, 22 bp, Artificial Sequence
  chemically synthesized
aataattaaagtagaaggatgt

SEQ ID NO: 1214608 - DNA, 22 bp, Artificial Sequence
  chemically synthesized
gtaaacatccttctactttaat

SEQ ID NO: 1214609 - DNA, 22 bp, Artificial Sequence
  chemically synthesized
taaacatccttctactttaatt

SEQ ID NO: 1214610 - DNA, 22 bp, Artificial Sequence
  chemically synthesized
agagaatcattaaataattaaa

SEQ ID NO: 1214611 - DNA, 22 bp, Artificial Sequence
  chemically synthesized
gagagaatcattaaataattaa

SEQ ID NO: 1214612 - DNA, 22 bp, Artificial Sequence
  chemically synthesized
cttgagagaatcattaaataat

SEQ ID NO: 1214613 - DNA, 22 bp, Artificial Sequence
  chemically synthesized
ccttgagagaatcattaaataa

SEQ ID NO: 1214614 - DNA, 22 bp, Artificial Sequence
  chemically synthesized
ctactttaattatttaatgatt

SEQ ID NO: 1214615 - DNA, 22 bp, Artificial Sequence
  chemically synthesized
tactttaattatttaatgattc

SEQ ID NO: 1214616 - DNA, 22 bp, Artificial Sequence
  chemically synthesized
ctttaattatttaatgattctc

SEQ ID NO: 1214617 - DNA, 22 bp, Artificial Sequence
  chemically synthesized
tgatgtttccttgagagaatca

SEQ ID NO: 1214618 - DNA, 22 bp, Artificial Sequence
  chemically synthesized
taattatttaatgattctctca

SEQ ID NO: 1214619 - DNA, 22 bp, Artificial Sequence
  chemically synthesized
aattatttaatgattctctcaa

SEQ ID NO: 1214620 - DNA, 22 bp, Artificial Sequence
  chemically synthesized
attatttaatgattctctcaag

SEQ ID NO: 1214621 - DNA, 22 bp, Artificial Sequence
  chemically synthesized
ctatgatgtttccttgagagaa

SEQ ID NO: 1214622 - DNA, 22 bp, Artificial Sequence
  chemically synthesized
actatgatgtttccttgagaga

SEQ ID NO: 1214623 - DNA, 22 bp, Artificial Sequence
  chemically synthesized
tactatgatgtttccttgagag

SEQ ID NO: 1214624 - DNA, 22 bp, Artificial Sequence
  chemically synthesized
ttactatgatgtttccttgaga

SEQ ID NO: 1214625 - DNA, 22 bp, Artificial Sequence
  chemically synthesized
tttaatgattctctcaaggaaa

SEQ ID NO: 1214626 - DNA, 22 bp, Artificial Sequence
  chemically synthesized
tttactatgatgtttccttgag

SEQ ID NO: 1214627 - DNA, 22 bp, Artificial Sequence
  chemically synthesized
tttttactatgatgtttccttg

SEQ ID NO: 1214628 - DNA, 22 bp, Artificial Sequence
  chemically synthesized
aatgattctctcaaggaaacat

SEQ ID NO: 1214629 - DNA, 22 bp, Artificial Sequence
  chemically synthesized
atgattctctcaaggaaacatc

SEQ ID NO: 1214630 - DNA, 22 bp, Artificial Sequence
  chemically synthesized
aattctttttactatgatgttt

SEQ ID NO: 1214631 - DNA, 22 bp, Artificial Sequence
  chemically synthesized
tctcaaggaaacatcatagtaa

SEQ ID NO: 1214632 - DNA, 22 bp, Artificial Sequence
  chemically synthesized
tcaaggaaacatcatagtaaaa

SEQ ID NO: 1214633 - DNA, 22 bp, Artificial Sequence
  chemically synthesized
aaggaaacatcatagtaaaaag

SEQ ID NO: 1214634 - DNA, 22 bp, Artificial Sequence
  chemically synthesized
gagccagaataagagggatact

SEQ ID NO: 1214635 - DNA, 22 bp, Artificial Sequence
  chemically synthesized
taaactagagccagaataagag

SEQ ID NO: 1214636 - DNA, 22 bp, Artificial Sequence
  chemically synthesized
ataaactagagccagaataaga

SEQ ID NO: 1214637 - DNA, 22 bp, Artificial Sequence
  chemically synthesized
tataaactagagccagaataag

SEQ ID NO: 1214638 - DNA, 22 bp, Artificial Sequence
  chemically synthesized
agtatccctcttattctggctc

SEQ ID NO: 1214639 - DNA, 22 bp, Artificial Sequence
  chemically synthesized
ttattctggctctagtttataa

SEQ ID NO: 1214640 - DNA, 22 bp, Artificial Sequence
  chemically synthesized
attctggctctagtttataaaa

SEQ ID NO: 1214641 - DNA, 22 bp, Artificial Sequence
  chemically synthesized
ttctggctctagtttataaaac

SEQ ID NO: 1214642 - DNA, 22 bp, Artificial Sequence
  chemically synthesized
tggctctagtttataaaacttt

SEQ ID NO: 1214643 - DNA, 22 bp, Artificial Sequence
  chemically synthesized
aaaataaatggaaaagttttat

SEQ ID NO: 1214644 - DNA, 22 bp, Artificial Sequence
  chemically synthesized
gaaaataaatggaaaagtttta

SEQ ID NO: 1214645 - DNA, 22 bp, Artificial Sequence
  chemically synthesized
gctctagtttataaaacttttc

SEQ ID NO: 1214646 - DNA, 22 bp, Artificial Sequence
  chemically synthesized
tgaaaataaatggaaaagtttt

SEQ ID NO: 1214647 - DNA, 22 bp, Artificial Sequence
  chemically synthesized
tagtttataaaacttttccatt

SEQ ID NO: 1214648 - DNA, 22 bp, Artificial Sequence
  chemically synthesized
gtttataaaacttttccattta

SEQ ID NO: 1214649 - DNA, 22 bp, Artificial Sequence
  chemically synthesized
caaatgttttgaaaataaatgg

SEQ ID NO: 1214650 - DNA, 22 bp, Artificial Sequence
  chemically synthesized
ataaaacttttccatttatttt

SEQ ID NO: 1214651 - DNA, 22 bp, Artificial Sequence
  chemically synthesized
taaaacttttccatttattttc

SEQ ID NO: 1214652 - DNA, 22 bp, Artificial Sequence
  chemically synthesized
attccaaatgttttgaaaataa

SEQ ID NO: 1214653 - DNA, 22 bp, Artificial Sequence
  chemically synthesized
ttccatttattttcaaaacatt

SEQ ID NO: 1214654 - DNA, 22 bp, Artificial Sequence
  chemically synthesized
tccatttattttcaaaacattt

SEQ ID NO: 1214655 - DNA, 22 bp, Artificial Sequence
  chemically synthesized
ccatttattttcaaaacatttg

SEQ ID NO: 1214656 - DNA, 22 bp, Artificial Sequence
  chemically synthesized
catttattttcaaaacatttgg

SEQ ID NO: 1214657 - DNA, 22 bp, Artificial Sequence
  chemically synthesized
attttcaaaacatttggaatca

SEQ ID NO: 1214658 - DNA, 22 bp, Artificial Sequence
  chemically synthesized
ttttcaaaacatttggaatcaa

SEQ ID NO: 1214659 - DNA, 22 bp, Artificial Sequence
  chemically synthesized
tcaaaacatttggaatcaactg

SEQ ID NO: 1214660 - DNA, 22 bp, Artificial Sequence
  chemically synthesized
caaaacatttggaatcaactga

SEQ ID NO: 1214661 - DNA, 22 bp, Artificial Sequence
  chemically synthesized
gatgcacatccatcagttgatt

SEQ ID NO: 1214662 - DNA, 22 bp, Artificial Sequence
  chemically synthesized
aaaacatttggaatcaactgat

SEQ ID NO: 1214663 - DNA, 22 bp, Artificial Sequence
  chemically synthesized
attggatgcacatccatcagtt

SEQ ID NO: 1214664 - DNA, 22 bp, Artificial Sequence
  chemically synthesized
aattggatgcacatccatcagt

SEQ ID NO: 1214665 - DNA, 22 bp, Artificial Sequence
  chemically synthesized
taattggatgcacatccatcag

SEQ ID NO: 1214666 - DNA, 22 bp, Artificial Sequence
  chemically synthesized
ttaattggatgcacatccatca

SEQ ID NO: 1214667 - DNA, 22 bp, Artificial Sequence
  chemically synthesized
ggaatcaactgatggatgtgca

SEQ ID NO: 1214668 - DNA, 22 bp, Artificial Sequence
  chemically synthesized
tttttaattggatgcacatcca

SEQ ID NO: 1214669 - DNA, 22 bp, Artificial Sequence
  chemically synthesized
gaatcaactgatggatgtgcat

SEQ ID NO: 1214670 - DNA, 22 bp, Artificial Sequence
  chemically synthesized
gtttttaattggatgcacatcc

SEQ ID NO: 1214671 - DNA, 22 bp, Artificial Sequence
  chemically synthesized
ggtttgtttttaattggatgca

SEQ ID NO: 1214672 - DNA, 22 bp, Artificial Sequence
  chemically synthesized
attgggtttgtttttaattgga

SEQ ID NO: 1214673 - DNA, 22 bp, Artificial Sequence
  chemically synthesized
atggatgtgcatccaattaaaa

SEQ ID NO: 1214674 - DNA, 22 bp, Artificial Sequence
  chemically synthesized
cagggctaattgggtttgtttt

SEQ ID NO: 1214675 - DNA, 22 bp, Artificial Sequence
  chemically synthesized
ttacagggctaattgggtttgt

SEQ ID NO: 1214676 - DNA, 22 bp, Artificial Sequence
  chemically synthesized
attacagggctaattgggtttg

SEQ ID NO: 1214677 - DNA, 22 bp, Artificial Sequence
  chemically synthesized
tattacagggctaattgggttt

SEQ ID NO: 1214678 - DNA, 22 bp, Artificial Sequence
  chemically synthesized
attttattacagggctaattgg

SEQ ID NO: 1214679 - DNA, 22 bp, Artificial Sequence
  chemically synthesized
aaaacaaacccaattagccctg

SEQ ID NO: 1214680 - DNA, 22 bp, Artificial Sequence
  chemically synthesized
ctcattttattacagggctaat

SEQ ID NO: 1214681 - DNA, 22 bp, Artificial Sequence
  chemically synthesized
aaaggttactcattttattaca

SEQ ID NO: 1214682 - DNA, 22 bp, Artificial Sequence
  chemically synthesized
actaaaaggttactcattttat

SEQ ID NO: 1214683 - DNA, 22 bp, Artificial Sequence
  chemically synthesized
gccctgtaataaaatgagtaac

SEQ ID NO: 1214684 - DNA, 22 bp, Artificial Sequence
  chemically synthesized
cattaactaaaaggttactcat

SEQ ID NO: 1214685 - DNA, 22 bp, Artificial Sequence
  chemically synthesized
gcattaactaaaaggttactca

SEQ ID NO: 1214686 - DNA, 22 bp, Artificial Sequence
  chemically synthesized
tgcattaactaaaaggttactc

SEQ ID NO: 1214687 - DNA, 22 bp, Artificial Sequence
  chemically synthesized
tttgcattaactaaaaggttac

SEQ ID NO: 1214688 - DNA, 22 bp, Artificial Sequence
  chemically synthesized
taataaaatgagtaacctttta

SEQ ID NO: 1214689 - DNA, 22 bp, Artificial Sequence
  chemically synthesized
ctttgcattaactaaaaggtta

SEQ ID NO: 1214690 - DNA, 22 bp, Artificial Sequence
  chemically synthesized
tctttgcattaactaaaaggtt

SEQ ID NO: 1214691 - DNA, 22 bp, Artificial Sequence
  chemically synthesized
catgaatattttctttgcatta

SEQ ID NO: 1214692 - DNA, 22 bp, Artificial Sequence
  chemically synthesized
ccatgaatattttctttgcatt

SEQ ID NO: 1214693 - DNA, 22 bp, Artificial Sequence
  chemically synthesized
ttccatgaatattttctttgca

SEQ ID NO: 1214694 - DNA, 22 bp, Artificial Sequence
  chemically synthesized
cttccatgaatattttctttgc

SEQ ID NO: 1214695 - DNA, 22 bp, Artificial Sequence
  chemically synthesized
ttcttccatgaatattttcttt

SEQ ID NO: 1214696 - DNA, 22 bp, Artificial Sequence
  chemically synthesized
ttagttaatgcaaagaaaatat

SEQ ID NO: 1214697 - DNA, 22 bp, Artificial Sequence
  chemically synthesized
tagttaatgcaaagaaaatatt

SEQ ID NO: 1214698 - DNA, 22 bp, Artificial Sequence
  chemically synthesized
tcttcttccatgaatattttct

SEQ ID NO: 1214699 - DNA, 22 bp, Artificial Sequence
  chemically synthesized
agttaatgcaaagaaaatattc

SEQ ID NO: 1214700 - DNA, 22 bp, Artificial Sequence
  chemically synthesized
gttaatgcaaagaaaatattca

SEQ ID NO: 1214701 - DNA, 22 bp, Artificial Sequence
  chemically synthesized
ctctcttcttccatgaatattt

SEQ ID NO: 1214702 - DNA, 22 bp, Artificial Sequence
  chemically synthesized
atgcaaagaaaatattcatgga

SEQ ID NO: 1214703 - DNA, 22 bp, Artificial Sequence
  chemically synthesized
tggcagaatattcctctcttct

SEQ ID NO: 1214704 - DNA, 22 bp, Artificial Sequence
  chemically synthesized
atggcagaatattcctctcttc

SEQ ID NO: 1214705 - DNA, 22 bp, Artificial Sequence
  chemically synthesized
atggaagaagagaggaatattc

SEQ ID NO: 1214706 - DNA, 22 bp, Artificial Sequence
  chemically synthesized
cagaatataatcttatggcaga

SEQ ID NO: 1214707 - DNA, 22 bp, Artificial Sequence
  chemically synthesized
ctacagaatataatcttatggc

SEQ ID NO: 1214708 - DNA, 22 bp, Artificial Sequence
  chemically synthesized
taactactacagaatataatct

SEQ ID NO: 1214709 - DNA, 22 bp, Artificial Sequence
  chemically synthesized
gtaactactacagaatataatc

SEQ ID NO: 1214710 - DNA, 22 bp, Artificial Sequence
  chemically synthesized
cttgtaactactacagaatata

SEQ ID NO: 1214711 - DNA, 22 bp, Artificial Sequence
  chemically synthesized
tgccataagattatattctgta

SEQ ID NO: 1214712 - DNA, 22 bp, Artificial Sequence
  chemically synthesized
ccataagattatattctgtagt

SEQ ID NO: 1214713 - DNA, 22 bp, Artificial Sequence
  chemically synthesized
cctacttgtaactactacagaa

SEQ ID NO: 1214714 - DNA, 22 bp, Artificial Sequence
  chemically synthesized
agattccctacttgtaactact

SEQ ID NO: 1214715 - DNA, 22 bp, Artificial Sequence
  chemically synthesized
tattctgtagtagttacaagta

SEQ ID NO: 1214716 - DNA, 22 bp, Artificial Sequence
  chemically synthesized
gagttaagattccctacttgta

SEQ ID NO: 1214717 - DNA, 22 bp, Artificial Sequence
  chemically synthesized
tgtagtagttacaagtagggaa

SEQ ID NO: 1214718 - DNA, 22 bp, Artificial Sequence
  chemically synthesized
tagtagttacaagtagggaatc

SEQ ID NO: 1214719 - DNA, 22 bp, Artificial Sequence
  chemically synthesized
gtgagttggagttaagattccc

SEQ ID NO: 1214720 - DNA, 22 bp, Artificial Sequence
  chemically synthesized
agctagtgagttggagttaaga

SEQ ID NO: 1214721 - DNA, 22 bp, Artificial Sequence
  chemically synthesized
caagtagggaatcttaactcca

SEQ ID NO: 1214722 - DNA, 22 bp, Artificial Sequence
  chemically synthesized
cccacatcactcagctagtgag

SEQ ID NO: 1214723 - DNA, 22 bp, Artificial Sequence
  chemically synthesized
aactccaactcactagctgagt

SEQ ID NO: 1214724 - DNA, 22 bp, Artificial Sequence
  chemically synthesized
actccaactcactagctgagtg

SEQ ID NO: 1214725 - DNA, 22 bp, Artificial Sequence
  chemically synthesized
caactcactagctgagtgatgt

SEQ ID NO: 1214726 - DNA, 22 bp, Artificial Sequence
  chemically synthesized
tgtaaattgcccacatcactca

SEQ ID NO: 1214727 - DNA, 22 bp, Artificial Sequence
  chemically synthesized
atgtaaattgcccacatcactc

SEQ ID NO: 1214728 - DNA, 22 bp, Artificial Sequence
  chemically synthesized
actagctgagtgatgtgggcaa

SEQ ID NO: 1214729 - DNA, 22 bp, Artificial Sequence
  chemically synthesized
aagagtttatgtaaattgccca

SEQ ID NO: 1214730 - DNA, 22 bp, Artificial Sequence
  chemically synthesized
gctgagtgatgtgggcaattta

SEQ ID NO: 1214731 - DNA, 22 bp, Artificial Sequence
  chemically synthesized
agtgatgtgggcaatttacata

SEQ ID NO: 1214732 - DNA, 22 bp, Artificial Sequence
  chemically synthesized
caactgaagagtttatgtaaat

SEQ ID NO: 1214733 - DNA, 22 bp, Artificial Sequence
  chemically synthesized
gcaactgaagagtttatgtaaa

SEQ ID NO: 1214734 - DNA, 22 bp, Artificial Sequence
  chemically synthesized
gtcatttgcaactgaagagttt

SEQ ID NO: 1214735 - DNA, 22 bp, Artificial Sequence
  chemically synthesized
ggtcatttgcaactgaagagtt

SEQ ID NO: 1214736 - DNA, 22 bp, Artificial Sequence
  chemically synthesized
tggtcatttgcaactgaagagt

SEQ ID NO: 1214737 - DNA, 22 bp, Artificial Sequence
  chemically synthesized
ttttggtcatttgcaactgaag

SEQ ID NO: 1214738 - DNA, 22 bp, Artificial Sequence
  chemically synthesized
acataaactcttcagttgcaaa

SEQ ID NO: 1214739 - DNA, 22 bp, Artificial Sequence
  chemically synthesized
ttattttggtcatttgcaactg

SEQ ID NO: 1214740 - DNA, 22 bp, Artificial Sequence
  chemically synthesized
cataaactcttcagttgcaaat

SEQ ID NO: 1214741 - DNA, 22 bp, Artificial Sequence
  chemically synthesized
ttcagttgcaaatgaccaaaat

SEQ ID NO: 1214742 - DNA, 22 bp, Artificial Sequence
  chemically synthesized
cagttgcaaatgaccaaaataa

SEQ ID NO: 1214743 - DNA, 22 bp, Artificial Sequence
  chemically synthesized
agttgcaaatgaccaaaataat

SEQ ID NO: 1214744 - DNA, 22 bp, Artificial Sequence
  chemically synthesized
ggaggtagagactattattttg

SEQ ID NO: 1214745 - DNA, 22 bp, Artificial Sequence
  chemically synthesized
taggaggtagagactattattt

SEQ ID NO: 1214746 - DNA, 22 bp, Artificial Sequence
  chemically synthesized
caaatgaccaaaataatagtct

SEQ ID NO: 1214747 - DNA, 22 bp, Artificial Sequence
  chemically synthesized
caaaaactctaggaggtagaga

SEQ ID NO: 1214748 - DNA, 22 bp, Artificial Sequence
  chemically synthesized
tgcaaaaactctaggaggtaga

SEQ ID NO: 1214749 - DNA, 22 bp, Artificial Sequence
  chemically synthesized
ctgcaaaaactctaggaggtag

SEQ ID NO: 1214750 - DNA, 22 bp, Artificial Sequence
  chemically synthesized
tttctgcaaaaactctaggagg

SEQ ID NO: 1214751 - DNA, 22 bp, Artificial Sequence
  chemically synthesized
atttctgcaaaaactctaggag

SEQ ID NO: 1214752 - DNA, 22 bp, Artificial Sequence
  chemically synthesized
tatttctgcaaaaactctagga

SEQ ID NO: 1214753 - DNA, 22 bp, Artificial Sequence
  chemically synthesized
gttttatttctgcaaaaactct

SEQ ID NO: 1214754 - DNA, 22 bp, Artificial Sequence
  chemically synthesized
cgttttatttctgcaaaaactc

SEQ ID NO: 1214755 - DNA, 22 bp, Artificial Sequence
  chemically synthesized
tacctcctagagtttttgcaga

SEQ ID NO: 1214756 - DNA, 22 bp, Artificial Sequence
  chemically synthesized
cctcctagagtttttgcagaaa

SEQ ID NO: 1214757 - DNA, 22 bp, Artificial Sequence
  chemically synthesized
tataatttcgttttatttctgc

SEQ ID NO: 1214758 - DNA, 22 bp, Artificial Sequence
  chemically synthesized
ctagagtttttgcagaaataaa

SEQ ID NO: 1214759 - DNA, 22 bp, Artificial Sequence
  chemically synthesized
gagtttttgcagaaataaaacg

SEQ ID NO: 1214760 - DNA, 22 bp, Artificial Sequence
  chemically synthesized
atattgtataatttcgttttat

SEQ ID NO: 1214761 - DNA, 22 bp, Artificial Sequence
  chemically synthesized
gatattgtataatttcgtttta

SEQ ID NO: 1214762 - DNA, 22 bp, Artificial Sequence
  chemically synthesized
ttgcagaaataaaacgaaatta

SEQ ID NO: 1214763 - DNA, 22 bp, Artificial Sequence
  chemically synthesized
cttgatattgtataatttcgtt

SEQ ID NO: 1214764 - DNA, 22 bp, Artificial Sequence
  chemically synthesized
tgcagaaataaaacgaaattat

SEQ ID NO: 1214765 - DNA, 22 bp, Artificial Sequence
  chemically synthesized
gcagaaataaaacgaaattata

SEQ ID NO: 1214766 - DNA, 22 bp, Artificial Sequence
  chemically synthesized
cagaaataaaacgaaattatac

SEQ ID NO: 1214767 - DNA, 22 bp, Artificial Sequence
  chemically synthesized
ggcacattgcttgatattgtat

SEQ ID NO: 1214768 - DNA, 22 bp, Artificial Sequence
  chemically synthesized
agtgctgggcacattgcttgat

SEQ ID NO: 1214769 - DNA, 22 bp, Artificial Sequence
  chemically synthesized
tacaatatcaagcaatgtgccc

SEQ ID NO: 1214770 - DNA, 22 bp, Artificial Sequence
  chemically synthesized
aacattaagtgctgggcacatt

SEQ ID NO: 1214771 - DNA, 22 bp, Artificial Sequence
  chemically synthesized
ttaaacattaagtgctgggcac

SEQ ID NO: 1214772 - DNA, 22 bp, Artificial Sequence
  chemically synthesized
attaaacattaagtgctgggca

SEQ ID NO: 1214773 - DNA, 22 bp, Artificial Sequence
  chemically synthesized
gtgtgatatttattaaacatta

SEQ ID NO: 1214774 - DNA, 22 bp, Artificial Sequence
  chemically synthesized
atgtaatctggtgtgatattta

SEQ ID NO: 1214775 - DNA, 22 bp, Artificial Sequence
  chemically synthesized
aatgtttaataaatatcacacc

SEQ ID NO: 1214776 - DNA, 22 bp, Artificial Sequence
  chemically synthesized
atgtttaataaatatcacacca

SEQ ID NO: 1214777 - DNA, 22 bp, Artificial Sequence
  chemically synthesized
aataaatatcacaccagattac

SEQ ID NO: 1214778 - DNA, 22 bp, Artificial Sequence
  chemically synthesized
ataaatatcacaccagattaca

SEQ ID NO: 1214779 - DNA, 22 bp, Artificial Sequence
  chemically synthesized
ggagtaatacatacatagtaat

SEQ ID NO: 1214780 - DNA, 22 bp, Artificial Sequence
  chemically synthesized
catcaatattactatgtatgta

SEQ ID NO: 1214781 - DNA, 22 bp, Artificial Sequence
  chemically synthesized
aagctgggagtaatacatacat

SEQ ID NO: 1214782 - DNA, 22 bp, Artificial Sequence
  chemically synthesized
tgaagctgggagtaatacatac

SEQ ID NO: 1214783 - DNA, 22 bp, Artificial Sequence
  chemically synthesized
ctgaagctgggagtaatacata

SEQ ID NO: 1214784 - DNA, 22 bp, Artificial Sequence
  chemically synthesized
aacttctgaagctgggagtaat

SEQ ID NO: 1214785 - DNA, 22 bp, Artificial Sequence
  chemically synthesized
ctatgtatgtattactcccagc

SEQ ID NO: 1214786 - DNA, 22 bp, Artificial Sequence
  chemically synthesized
tgtatgtattactcccagcttc

SEQ ID NO: 1214787 - DNA, 22 bp, Artificial Sequence
  chemically synthesized
agaaaaactcaacttctgaagc

SEQ ID NO: 1214788 - DNA, 22 bp, Artificial Sequence
  chemically synthesized
tcagaaaaactcaacttctgaa

SEQ ID NO: 1214789 - DNA, 22 bp, Artificial Sequence
  chemically synthesized
ctcccagcttcagaagttgagt

SEQ ID NO: 1214790 - DNA, 22 bp, Artificial Sequence
  chemically synthesized
ccagcttcagaagttgagtttt

SEQ ID NO: 1214791 - DNA, 22 bp, Artificial Sequence
  chemically synthesized
ccagactctcagaaaaactcaa

SEQ ID NO: 1214792 - DNA, 22 bp, Artificial Sequence
  chemically synthesized
gttcccagactctcagaaaaac

SEQ ID NO: 1214793 - DNA, 22 bp, Artificial Sequence
  chemically synthesized
cagaagttgagtttttctgaga

SEQ ID NO: 1214794 - DNA, 22 bp, Artificial Sequence
  chemically synthesized
agaagttgagtttttctgagag

SEQ ID NO: 1214795 - DNA, 22 bp, Artificial Sequence
  chemically synthesized
aattggttcccagactctcaga

SEQ ID NO: 1214796 - DNA, 22 bp, Artificial Sequence
  chemically synthesized
agtttttctgagagtctgggaa

SEQ ID NO: 1214797 - DNA, 22 bp, Artificial Sequence
  chemically synthesized
ttctgagagtctgggaaccaat

SEQ ID NO: 1214798 - DNA, 22 bp, Artificial Sequence
  chemically synthesized
tctgagagtctgggaaccaatt

SEQ ID NO: 1214799 - DNA, 22 bp, Artificial Sequence
  chemically synthesized
ctgagagtctgggaaccaattc

SEQ ID NO: 1214800 - DNA, 22 bp, Artificial Sequence
  chemically synthesized
tgagagtctgggaaccaattca

SEQ ID NO: 1214801 - DNA, 22 bp, Artificial Sequence
  chemically synthesized
agagtctgggaaccaattcaac

SEQ ID NO: 1214802 - DNA, 22 bp, Artificial Sequence
  chemically synthesized
ggaaccaattcaaccactttta

SEQ ID NO: 1214803 - DNA, 22 bp, Artificial Sequence
  chemically synthesized
cgtcatatgacatcgtaaaagt

SEQ ID NO: 1214804 - DNA, 22 bp, Artificial Sequence
  chemically synthesized
aaccacttttacgatgtcatat

SEQ ID NO: 1214805 - DNA, 22 bp, Artificial Sequence
  chemically synthesized
tagtcattacgtcatatgacat

SEQ ID NO: 1214806 - DNA, 22 bp, Artificial Sequence
  chemically synthesized
gtagtcattacgtcatatgaca

SEQ ID NO: 1214807 - DNA, 22 bp, Artificial Sequence
  chemically synthesized
ttgtagtcattacgtcatatga

SEQ ID NO: 1214808 - DNA, 22 bp, Artificial Sequence
  chemically synthesized
tcttgtagtcattacgtcatat

SEQ ID NO: 1214809 - DNA, 22 bp, Artificial Sequence
  chemically synthesized
ctcttgtagtcattacgtcata

SEQ ID NO: 1214810 - DNA, 22 bp, Artificial Sequence
  chemically synthesized
ttacgatgtcatatgacgtaat

SEQ ID NO: 1214811 - DNA, 22 bp, Artificial Sequence
  chemically synthesized
tctcttgtagtcattacgtcat

SEQ ID NO: 1214812 - DNA, 22 bp, Artificial Sequence
  chemically synthesized
tacgatgtcatatgacgtaatg

SEQ ID NO: 1214813 - DNA, 22 bp, Artificial Sequence
  chemically synthesized
acgatgtcatatgacgtaatga

SEQ ID NO: 1214814 - DNA, 22 bp, Artificial Sequence
  chemically synthesized
cgatgtcatatgacgtaatgac

SEQ ID NO: 1214815 - DNA, 22 bp, Artificial Sequence
  chemically synthesized
ggttttctcttgtagtcattac

SEQ ID NO: 1214816 - DNA, 22 bp, Artificial Sequence
  chemically synthesized
caaaagtataactaggttttct

SEQ ID NO: 1214817 - DNA, 22 bp, Artificial Sequence
  chemically synthesized
gcaaaagtataactaggttttc

SEQ ID NO: 1214818 - DNA, 22 bp, Artificial Sequence
  chemically synthesized
caagagaaaacctagttatact

SEQ ID NO: 1214819 - DNA, 22 bp, Artificial Sequence
  chemically synthesized
gcacacttgcaaaagtataact

SEQ ID NO: 1214820 - DNA, 22 bp, Artificial Sequence
  chemically synthesized
gttagcacacttgcaaaagtat

SEQ ID NO: 1214821 - DNA, 22 bp, Artificial Sequence
  chemically synthesized
gttatacttttgcaagtgtgct

SEQ ID NO: 1214822 - DNA, 22 bp, Artificial Sequence
  chemically synthesized
taagacattagttagcacactt

SEQ ID NO: 1214823 - DNA, 22 bp, Artificial Sequence
  chemically synthesized
gtaagacattagttagcacact

SEQ ID NO: 1214824 - DNA, 22 bp, Artificial Sequence
  chemically synthesized
tacttttgcaagtgtgctaact

SEQ ID NO: 1214825 - DNA, 22 bp, Artificial Sequence
  chemically synthesized
ttgcaagtgtgctaactaatgt

SEQ ID NO: 1214826 - DNA, 22 bp, Artificial Sequence
  chemically synthesized
tgcaagtgtgctaactaatgtc

SEQ ID NO: 1214827 - DNA, 22 bp, Artificial Sequence
  chemically synthesized
gcaagtgtgctaactaatgtct

SEQ ID NO: 1214828 - DNA, 22 bp, Artificial Sequence
  chemically synthesized
caagtgtgctaactaatgtctt

SEQ ID NO: 1214829 - DNA, 22 bp, Artificial Sequence
  chemically synthesized
tcatagtatttgtaagacatta

SEQ ID NO: 1214830 - DNA, 22 bp, Artificial Sequence
  chemically synthesized
taattgtcatagtatttgtaag

SEQ ID NO: 1214831 - DNA, 22 bp, Artificial Sequence
  chemically synthesized
ataattgtcatagtatttgtaa

SEQ ID NO: 1214832 - DNA, 22 bp, Artificial Sequence
  chemically synthesized
actaatgtcttacaaatactat

SEQ ID NO: 1214833 - DNA, 22 bp, Artificial Sequence
  chemically synthesized
atgtcttacaaatactatgaca

SEQ ID NO: 1214834 - DNA, 22 bp, Artificial Sequence
  chemically synthesized
atgatagtaccttataattgtc

SEQ ID NO: 1214835 - DNA, 22 bp, Artificial Sequence
  chemically synthesized
acaaatactatgacaattataa

SEQ ID NO: 1214836 - DNA, 22 bp, Artificial Sequence
  chemically synthesized
caaatactatgacaattataag

SEQ ID NO: 1214837 - DNA, 22 bp, Artificial Sequence
  chemically synthesized
gttcatgatagtaccttataat

SEQ ID NO: 1214838 - DNA, 22 bp, Artificial Sequence
  chemically synthesized
tgacaattataaggtactatca

SEQ ID NO: 1214839 - DNA, 22 bp, Artificial Sequence
  chemically synthesized
aaggctggttcatgatagtacc

SEQ ID NO: 1214840 - DNA, 22 bp, Artificial Sequence
  chemically synthesized
ctgaaggctggttcatgatagt

SEQ ID NO: 1214841 - DNA, 22 bp, Artificial Sequence
  chemically synthesized
taaggtactatcatgaaccagc

SEQ ID NO: 1214842 - DNA, 22 bp, Artificial Sequence
  chemically synthesized
gcaagtctcctgaaggctggtt

SEQ ID NO: 1214843 - DNA, 22 bp, Artificial Sequence
  chemically synthesized
tagcaagtctcctgaaggctgg

SEQ ID NO: 1214844 - DNA, 22 bp, Artificial Sequence
  chemically synthesized
ctagcaagtctcctgaaggctg

SEQ ID NO: 1214845 - DNA, 22 bp, Artificial Sequence
  chemically synthesized
tcatgaaccagccttcaggaga

SEQ ID NO: 1214846 - DNA, 22 bp, Artificial Sequence
  chemically synthesized
caggagacttgctagaaatcta

SEQ ID NO: 1214847 - DNA, 22 bp, Artificial Sequence
  chemically synthesized
aggagacttgctagaaatctac

SEQ ID NO: 1214848 - DNA, 22 bp, Artificial Sequence
  chemically synthesized
tcatggatacatggtagatttc

SEQ ID NO: 1214849 - DNA, 22 bp, Artificial Sequence
  chemically synthesized
acagttgtcatggatacatggt

SEQ ID NO: 1214850 - DNA, 22 bp, Artificial Sequence
  chemically synthesized
gctagaaatctaccatgtatcc

SEQ ID NO: 1214851 - DNA, 22 bp, Artificial Sequence
  chemically synthesized
ctagaaatctaccatgtatcca

SEQ ID NO: 1214852 - DNA, 22 bp, Artificial Sequence
  chemically synthesized
attcacagttgtcatggataca

SEQ ID NO: 1214853 - DNA, 22 bp, Artificial Sequence
  chemically synthesized
gaaatctaccatgtatccatga

SEQ ID NO: 1214854 - DNA, 22 bp, Artificial Sequence
  chemically synthesized
ccatgtatccatgacaactgtg

SEQ ID NO: 1214855 - DNA, 22 bp, Artificial Sequence
  chemically synthesized
acagagagattgattcacagtt

SEQ ID NO: 1214856 - DNA, 22 bp, Artificial Sequence
  chemically synthesized
gacagagagattgattcacagt

SEQ ID NO: 1214857 - DNA, 22 bp, Artificial Sequence
  chemically synthesized
tgaatcaatctctctgtcaagt

SEQ ID NO: 1214858 - DNA, 22 bp, Artificial Sequence
  chemically synthesized
tctgtcaagtgtgtgtgtgtgt

SEQ ID NO: 1214859 - DNA, 22 bp, Artificial Sequence
  chemically synthesized
tgtcaagtgtgtgtgtgtgtgt

SEQ ID NO: 1214860 - DNA, 22 bp, Artificial Sequence
  chemically synthesized
tcaagtgtgtgtgtgtgtgtgt

SEQ ID NO: 1214861 - DNA, 22 bp, Artificial Sequence
  chemically synthesized
acacacacacacacacacacac

SEQ ID NO: 1214862 - DNA, 22 bp, Artificial Sequence
  chemically synthesized
tcacacacacacacacacacac

SEQ ID NO: 1214863 - DNA, 22 bp, Artificial Sequence
  chemically synthesized
tctcacacacacacacacacac

SEQ ID NO: 1214864 - DNA, 22 bp, Artificial Sequence
  chemically synthesized
tctctcacacacacacacacac

SEQ ID NO: 1214865 - DNA, 22 bp, Artificial Sequence
  chemically synthesized
tctctctcacacacacacacac

SEQ ID NO: 1214866 - DNA, 22 bp, Artificial Sequence
  chemically synthesized
tctctctctcacacacacacac

SEQ ID NO: 1214867 - DNA, 22 bp, Artificial Sequence
  chemically synthesized
tctctctctctcacacacacac

SEQ ID NO: 1214868 - DNA, 22 bp, Artificial Sequence
  chemically synthesized
tctctctctctctcacacacac

SEQ ID NO: 1214869 - DNA, 22 bp, Artificial Sequence
  chemically synthesized
tctctctctctctctcacacac

SEQ ID NO: 1214870 - DNA, 22 bp, Artificial Sequence
  chemically synthesized
tctctctctctctctctcacac

SEQ ID NO: 1214871 - DNA, 22 bp, Artificial Sequence
  chemically synthesized
tctctctctctctctctctcac

SEQ ID NO: 1214872 - DNA, 22 bp, Artificial Sequence
  chemically synthesized
tctctctctctctctctctctc

SEQ ID NO: 1214873 - DNA, 22 bp, Artificial Sequence
  chemically synthesized
tctctctctctctctctctctc

SEQ ID NO: 1214874 - DNA, 22 bp, Artificial Sequence
  chemically synthesized
ctctctctctctctctctctct

SEQ ID NO: 1214875 - DNA, 22 bp, Artificial Sequence
  chemically synthesized
tctctctctctctctctctctc

SEQ ID NO: 1214876 - DNA, 22 bp, Artificial Sequence
  chemically synthesized
tttctctctctctctctctctc

SEQ ID NO: 1214877 - DNA, 22 bp, Artificial Sequence
  chemically synthesized
tctttctctctctctctctctc

SEQ ID NO: 1214878 - DNA, 22 bp, Artificial Sequence
  chemically synthesized
tctctttctctctctctctctc

SEQ ID NO: 1214879 - DNA, 22 bp, Artificial Sequence
  chemically synthesized
tctctctttctctctctctctc

SEQ ID NO: 1214880 - DNA, 22 bp, Artificial Sequence
  chemically synthesized
tctctctctttctctctctctc

SEQ ID NO: 1214881 - DNA, 22 bp, Artificial Sequence
  chemically synthesized
agagtggttctctctctctttc

SEQ ID NO: 1214882 - DNA, 22 bp, Artificial Sequence
  chemically synthesized
ctcagagtggttctctctctct

SEQ ID NO: 1214883 - DNA, 22 bp, Artificial Sequence
  chemically synthesized
aattcctcagagtggttctctc

SEQ ID NO: 1214884 - DNA, 22 bp, Artificial Sequence
  chemically synthesized
aaattcctcagagtggttctct

SEQ ID NO: 1214885 - DNA, 22 bp, Artificial Sequence
  chemically synthesized
tatcttaaattcctcagagtgg

SEQ ID NO: 1214886 - DNA, 22 bp, Artificial Sequence
  chemically synthesized
tactatatcttaaattcctcag

SEQ ID NO: 1214887 - DNA, 22 bp, Artificial Sequence
  chemically synthesized
atactatatcttaaattcctca

SEQ ID NO: 1214888 - DNA, 22 bp, Artificial Sequence
  chemically synthesized
ataaaagatttatactatatct

SEQ ID NO: 1214889 - DNA, 22 bp, Artificial Sequence
  chemically synthesized
tgaggaatttaagatatagtat

SEQ ID NO: 1214890 - DNA, 22 bp, Artificial Sequence
  chemically synthesized
cataaaagatttatactatatc

SEQ ID NO: 1214891 - DNA, 22 bp, Artificial Sequence
  chemically synthesized
tcataaaagatttatactatat

SEQ ID NO: 1214892 - DNA, 22 bp, Artificial Sequence
  chemically synthesized
aggaatttaagatatagtataa

SEQ ID NO: 1214893 - DNA, 22 bp, Artificial Sequence
  chemically synthesized
gttttcataaaagatttatact

SEQ ID NO: 1214894 - DNA, 22 bp, Artificial Sequence
  chemically synthesized
aagatatagtataaatctttta

SEQ ID NO: 1214895 - DNA, 22 bp, Artificial Sequence
  chemically synthesized
atctagttttcataaaagattt

SEQ ID NO: 1214896 - DNA, 22 bp, Artificial Sequence
  chemically synthesized
agatatagtataaatcttttat

SEQ ID NO: 1214897 - DNA, 22 bp, Artificial Sequence
  chemically synthesized
cagagtctaatctagttttcat

SEQ ID NO: 1214898 - DNA, 22 bp, Artificial Sequence
  chemically synthesized
agctccagagtctaatctagtt

SEQ ID NO: 1214899 - DNA, 22 bp, Artificial Sequence
  chemically synthesized
gagctccagagtctaatctagt

SEQ ID NO: 1214900 - DNA, 22 bp, Artificial Sequence
  chemically synthesized
ttatgaaaactagattagactc

SEQ ID NO: 1214901 - DNA, 22 bp, Artificial Sequence
  chemically synthesized
tatgaaaactagattagactct

SEQ ID NO: 1214902 - DNA, 22 bp, Artificial Sequence
  chemically synthesized
atgaaaactagattagactctg

SEQ ID NO: 1214903 - DNA, 22 bp, Artificial Sequence
  chemically synthesized
tgaaaactagattagactctgg

SEQ ID NO: 1214904 - DNA, 22 bp, Artificial Sequence
  chemically synthesized
atatccttgagctccagagtct

SEQ ID NO: 1214905 - DNA, 22 bp, Artificial Sequence
  chemically synthesized
gatatccttgagctccagagtc

SEQ ID NO: 1214906 - DNA, 22 bp, Artificial Sequence
  chemically synthesized
tgatatccttgagctccagagt

SEQ ID NO: 1214907 - DNA, 22 bp, Artificial Sequence
  chemically synthesized
gattagactctggagctcaagg

SEQ ID NO: 1214908 - DNA, 22 bp, Artificial Sequence
  chemically synthesized
gactctggagctcaaggatatc

SEQ ID NO: 1214909 - DNA, 22 bp, Artificial Sequence
  chemically synthesized
ggtggtaatctttgatatcctt

SEQ ID NO: 1214910 - DNA, 22 bp, Artificial Sequence
  chemically synthesized
tggagctcaaggatatcaaaga

SEQ ID NO: 1214911 - DNA, 22 bp, Artificial Sequence
  chemically synthesized
gagctcaaggatatcaaagatt

SEQ ID NO: 1214912 - DNA, 22 bp, Artificial Sequence
  chemically synthesized
gtgtactgggtggtaatctttg

SEQ ID NO: 1214913 - DNA, 22 bp, Artificial Sequence
  chemically synthesized
aaggatatcaaagattaccacc

SEQ ID NO: 1214914 - DNA, 22 bp, Artificial Sequence
  chemically synthesized
acagctggtgtactgggtggta

SEQ ID NO: 1214915 - DNA, 22 bp, Artificial Sequence
  chemically synthesized
gctcacagctggtgtactgggt

SEQ ID NO: 1214916 - DNA, 22 bp, Artificial Sequence
  chemically synthesized
ctggctcacagctggtgtactg

SEQ ID NO: 1214917 - DNA, 22 bp, Artificial Sequence
  chemically synthesized
ccacccagtacaccagctgtga

SEQ ID NO: 1214918 - DNA, 22 bp, Artificial Sequence
  chemically synthesized
aggaatactgctggctcacagc

SEQ ID NO: 1214919 - DNA, 22 bp, Artificial Sequence
  chemically synthesized
gtctgaggaatactgctggctc

SEQ ID NO: 1214920 - DNA, 22 bp, Artificial Sequence
  chemically synthesized
tggtctgaggaatactgctggc

SEQ ID NO: 1214921 - DNA, 22 bp, Artificial Sequence
  chemically synthesized
ctggtctgaggaatactgctgg

SEQ ID NO: 1214922 - DNA, 22 bp, Artificial Sequence
  chemically synthesized
tctggtctgaggaatactgctg

SEQ ID NO: 1214923 - DNA, 22 bp, Artificial Sequence
  chemically synthesized
gttttctggtctgaggaatact

SEQ ID NO: 1214924 - DNA, 22 bp, Artificial Sequence
  chemically synthesized
tggttttctggtctgaggaata

SEQ ID NO: 1214925 - DNA, 22 bp, Artificial Sequence
  chemically synthesized
tgagccagcagtattcctcaga

SEQ ID NO: 1214926 - DNA, 22 bp, Artificial Sequence
  chemically synthesized
attctggttttctggtctgagg

SEQ ID NO: 1214927 - DNA, 22 bp, Artificial Sequence
  chemically synthesized
ccactcattctggttttctggt

SEQ ID NO: 1214928 - DNA, 22 bp, Artificial Sequence
  chemically synthesized
cccactcattctggttttctgg

SEQ ID NO: 1214929 - DNA, 22 bp, Artificial Sequence
  chemically synthesized
ctcagaccagaaaaccagaatg

SEQ ID NO: 1214930 - DNA, 22 bp, Artificial Sequence
  chemically synthesized
tgaccttcccactcattctggt

SEQ ID NO: 1214931 - DNA, 22 bp, Artificial Sequence
  chemically synthesized
agaccagaaaaccagaatgagt

SEQ ID NO: 1214932 - DNA, 22 bp, Artificial Sequence
  chemically synthesized
ctgtgaccttcccactcattct

SEQ ID NO: 1214933 - DNA, 22 bp, Artificial Sequence
  chemically synthesized
cctgtgaccttcccactcattc

SEQ ID NO: 1214934 - DNA, 22 bp, Artificial Sequence
  chemically synthesized
gtcttcctgtgaccttcccact

SEQ ID NO: 1214935 - DNA, 22 bp, Artificial Sequence
  chemically synthesized
ctggtcttcctgtgaccttccc

SEQ ID NO: 1214936 - DNA, 22 bp, Artificial Sequence
  chemically synthesized
gctggtcttcctgtgaccttcc

SEQ ID NO: 1214937 - DNA, 22 bp, Artificial Sequence
  chemically synthesized
aaatcttgctggtcttcctgtg

SEQ ID NO: 1214938 - DNA, 22 bp, Artificial Sequence
  chemically synthesized
gaaatcttgctggtcttcctgt

SEQ ID NO: 1214939 - DNA, 22 bp, Artificial Sequence
  chemically synthesized
ccatttgaaatcttgctggtct

SEQ ID NO: 1214940 - DNA, 22 bp, Artificial Sequence
  chemically synthesized
cccatttgaaatcttgctggtc

SEQ ID NO: 1214941 - DNA, 22 bp, Artificial Sequence
  chemically synthesized
tcatttcccatttgaaatcttg

SEQ ID NO: 1214942 - DNA, 22 bp, Artificial Sequence
  chemically synthesized
ctgtcatttcccatttgaaatc

SEQ ID NO: 1214943 - DNA, 22 bp, Artificial Sequence
  chemically synthesized
caaatgggaaatgacagtagat

SEQ ID NO: 1214944 - DNA, 22 bp, Artificial Sequence
  chemically synthesized
aaatgggaaatgacagtagatc

SEQ ID NO: 1214945 - DNA, 22 bp, Artificial Sequence
  chemically synthesized
gaacatatcccccgtggaaaag

SEQ ID NO: 1214946 - DNA, 22 bp, Artificial Sequence
  chemically synthesized
ggaacatatcccccgtggaaaa

SEQ ID NO: 1214947 - DNA, 22 bp, Artificial Sequence
  chemically synthesized
taggtcttggaacatatccccc

SEQ ID NO: 1214948 - DNA, 22 bp, Artificial Sequence
  chemically synthesized
ctgtaggtcttggaacatatcc

SEQ ID NO: 1214949 - DNA, 22 bp, Artificial Sequence
  chemically synthesized
ttccacgggggatatgttccaa

SEQ ID NO: 1214950 - DNA, 22 bp, Artificial Sequence
  chemically synthesized
tccacgggggatatgttccaag

SEQ ID NO: 1214951 - DNA, 22 bp, Artificial Sequence
  chemically synthesized
ccacgggggatatgttccaaga

SEQ ID NO: 1214952 - DNA, 22 bp, Artificial Sequence
  chemically synthesized
cacgggggatatgttccaagac

SEQ ID NO: 1214953 - DNA, 22 bp, Artificial Sequence
  chemically synthesized
agacatctgctgtaggtcttgg

SEQ ID NO: 1214954 - DNA, 22 bp, Artificial Sequence
  chemically synthesized
cagacatctgctgtaggtcttg

SEQ ID NO: 1214955 - DNA, 22 bp, Artificial Sequence
  chemically synthesized
tggtttcagacatctgctgtag

SEQ ID NO: 1214956 - DNA, 22 bp, Artificial Sequence
  chemically synthesized
gtggtttcagacatctgctgta

SEQ ID NO: 1214957 - DNA, 22 bp, Artificial Sequence
  chemically synthesized
tttgtggtttcagacatctgct

SEQ ID NO: 1214958 - DNA, 22 bp, Artificial Sequence
  chemically synthesized
caagacctacagcagatgtctg

SEQ ID NO: 1214959 - DNA, 22 bp, Artificial Sequence
  chemically synthesized
cagcagatgtctgaaaccacaa

SEQ ID NO: 1214960 - DNA, 22 bp, Artificial Sequence
  chemically synthesized
aaaccacaaataggccctatat

SEQ ID NO: 1214961 - DNA, 22 bp, Artificial Sequence
  chemically synthesized
tatatactgtttttcccataca

SEQ ID NO: 1214962 - DNA, 22 bp, Artificial Sequence
  chemically synthesized
tcataggtatgtatatgtatgg

SEQ ID NO: 1214963 - DNA, 22 bp, Artificial Sequence
  chemically synthesized
atcataggtatgtatatgtatg

SEQ ID NO: 1214964 - DNA, 22 bp, Artificial Sequence
  chemically synthesized
tatcataggtatgtatatgtat

SEQ ID NO: 1214965 - DNA, 22 bp, Artificial Sequence
  chemically synthesized
tttttcccatacatatacatac

SEQ ID NO: 1214966 - DNA, 22 bp, Artificial Sequence
  chemically synthesized
aattttatcataggtatgtata

SEQ ID NO: 1214967 - DNA, 22 bp, Artificial Sequence
  chemically synthesized
ttcccatacatatacataccta

SEQ ID NO: 1214968 - DNA, 22 bp, Artificial Sequence
  chemically synthesized
tcccatacatatacatacctat

SEQ ID NO: 1214969 - DNA, 22 bp, Artificial Sequence
  chemically synthesized
cccatacatatacatacctatg

SEQ ID NO: 1214970 - DNA, 22 bp, Artificial Sequence
  chemically synthesized
ccatacatatacatacctatga

SEQ ID NO: 1214971 - DNA, 22 bp, Artificial Sequence
  chemically synthesized
taagttaaattttatcataggt

SEQ ID NO: 1214972 - DNA, 22 bp, Artificial Sequence
  chemically synthesized
ataagttaaattttatcatagg

SEQ ID NO: 1214973 - DNA, 22 bp, Artificial Sequence
  chemically synthesized
atttataagttaaattttatca

SEQ ID NO: 1214974 - DNA, 22 bp, Artificial Sequence
  chemically synthesized
tgcctaatttataagttaaatt

SEQ ID NO: 1214975 - DNA, 22 bp, Artificial Sequence
  chemically synthesized
tgtgcctaatttataagttaaa

SEQ ID NO: 1214976 - DNA, 22 bp, Artificial Sequence
  chemically synthesized
ctgtgcctaatttataagttaa

SEQ ID NO: 1214977 - DNA, 22 bp, Artificial Sequence
  chemically synthesized
tctgtgcctaatttataagtta

SEQ ID NO: 1214978 - DNA, 22 bp, Artificial Sequence
  chemically synthesized
ttctgtgcctaatttataagtt

SEQ ID NO: 1214979 - DNA, 22 bp, Artificial Sequence
  chemically synthesized
tgataaaatttaacttataaat

SEQ ID NO: 1214980 - DNA, 22 bp, Artificial Sequence
  chemically synthesized
tttctgtgcctaatttataagt

SEQ ID NO: 1214981 - DNA, 22 bp, Artificial Sequence
  chemically synthesized
atctttttctgtgcctaattta

SEQ ID NO: 1214982 - DNA, 22 bp, Artificial Sequence
  chemically synthesized
ttaatctttttctgtgcctaat

SEQ ID NO: 1214983 - DNA, 22 bp, Artificial Sequence
  chemically synthesized
aacttataaattaggcacagaa

SEQ ID NO: 1214984 - DNA, 22 bp, Artificial Sequence
  chemically synthesized
acttataaattaggcacagaaa

SEQ ID NO: 1214985 - DNA, 22 bp, Artificial Sequence
  chemically synthesized
gttattaatctttttctgtgcc

SEQ ID NO: 1214986 - DNA, 22 bp, Artificial Sequence
  chemically synthesized
ttagttattaatctttttctgt

SEQ ID NO: 1214987 - DNA, 22 bp, Artificial Sequence
  chemically synthesized
ataaattaggcacagaaaaaga

SEQ ID NO: 1214988 - DNA, 22 bp, Artificial Sequence
  chemically synthesized
taaattaggcacagaaaaagat

SEQ ID NO: 1214989 - DNA, 22 bp, Artificial Sequence
  chemically synthesized
tattagttattaatctttttct

SEQ ID NO: 1214990 - DNA, 22 bp, Artificial Sequence
  chemically synthesized
ttctattagttattaatctttt

SEQ ID NO: 1214991 - DNA, 22 bp, Artificial Sequence
  chemically synthesized
ggcacagaaaaagattaataac

SEQ ID NO: 1214992 - DNA, 22 bp, Artificial Sequence
  chemically synthesized
taattgttctattagttattaa

SEQ ID NO: 1214993 - DNA, 22 bp, Artificial Sequence
  chemically synthesized
ctataattgttctattagttat

SEQ ID NO: 1214994 - DNA, 22 bp, Artificial Sequence
  chemically synthesized
catattgctataattgttctat

SEQ ID NO: 1214995 - DNA, 22 bp, Artificial Sequence
  chemically synthesized
ctgcatattgctataattgttc

SEQ ID NO: 1214996 - DNA, 22 bp, Artificial Sequence
  chemically synthesized
ataactaatagaacaattatag

SEQ ID NO: 1214997 - DNA, 22 bp, Artificial Sequence
  chemically synthesized
ttactgcatattgctataattg

SEQ ID NO: 1214998 - DNA, 22 bp, Artificial Sequence
  chemically synthesized
attactgcatattgctataatt

SEQ ID NO: 1214999 - DNA, 22 bp, Artificial Sequence
  chemically synthesized
tattactgcatattgctataat

SEQ ID NO: 1215000 - DNA, 22 bp, Artificial Sequence
  chemically synthesized
ttattactgcatattgctataa

SEQ ID NO: 1215001 - DNA, 22 bp, Artificial Sequence
  chemically synthesized
atagaacaattatagcaatatg

SEQ ID NO: 1215002 - DNA, 22 bp, Artificial Sequence
  chemically synthesized
acgtaacttttattactgcata

SEQ ID NO: 1215003 - DNA, 22 bp, Artificial Sequence
  chemically synthesized
tagcaatatgcagtaataaaag

SEQ ID NO: 1215004 - DNA, 22 bp, Artificial Sequence
  chemically synthesized
cgtgaatgtggactctcacctc

SEQ ID NO: 1215005 - DNA, 22 bp, Artificial Sequence
  chemically synthesized
tcacctctccctgcccaccctc

SEQ ID NO: 1215006 - DNA, 22 bp, Artificial Sequence
  chemically synthesized
gatgatggtggggagggtgggc

SEQ ID NO: 1215007 - DNA, 22 bp, Artificial Sequence
  chemically synthesized
acctctccctgcccaccctccc

SEQ ID NO: 1215008 - DNA, 22 bp, Artificial Sequence
  chemically synthesized
tccctgcccaccctccccacca

SEQ ID NO: 1215009 - DNA, 22 bp, Artificial Sequence
  chemically synthesized
cctgcccaccctccccaccatc

SEQ ID NO: 1215010 - DNA, 22 bp, Artificial Sequence
  chemically synthesized
cccaccctccccaccatcatct

SEQ ID NO: 1215011 - DNA, 22 bp, Artificial Sequence
  chemically synthesized
atgagtacagtacaattagatg

SEQ ID NO: 1215012 - DNA, 22 bp, Artificial Sequence
  chemically synthesized
cccaccatcatctaattgtact

SEQ ID NO: 1215013 - DNA, 22 bp, Artificial Sequence
  chemically synthesized
aattgatgagtacagtacaatt

SEQ ID NO: 1215014 - DNA, 22 bp, Artificial Sequence
  chemically synthesized
aaattgatgagtacagtacaat

SEQ ID NO: 1215015 - DNA, 22 bp, Artificial Sequence
  chemically synthesized
attgtactgtactcatcaattt

SEQ ID NO: 1215016 - DNA, 22 bp, Artificial Sequence
  chemically synthesized
tactgtactcatcaatttaagg

SEQ ID NO: 1215017 - DNA, 22 bp, Artificial Sequence
  chemically synthesized
tactcatcaatttaaggaccac

SEQ ID NO: 1215018 - DNA, 22 bp, Artificial Sequence
  chemically synthesized
cccatggtcaaccgtggtcctt

SEQ ID NO: 1215019 - DNA, 22 bp, Artificial Sequence
  chemically synthesized
ctacccatggtcaaccgtggtc

SEQ ID NO: 1215020 - DNA, 22 bp, Artificial Sequence
  chemically synthesized
atcaatttaaggaccacggttg

SEQ ID NO: 1215021 - DNA, 22 bp, Artificial Sequence
  chemically synthesized
tgctacccatggtcaaccgtgg

SEQ ID NO: 1215022 - DNA, 22 bp, Artificial Sequence
  chemically synthesized
ctgctacccatggtcaaccgtg

SEQ ID NO: 1215023 - DNA, 22 bp, Artificial Sequence
  chemically synthesized
aaggaccacggttgaccatggg

SEQ ID NO: 1215024 - DNA, 22 bp, Artificial Sequence
  chemically synthesized
cagtttctgctacccatggtca

SEQ ID NO: 1215025 - DNA, 22 bp, Artificial Sequence
  chemically synthesized
aggaccacggttgaccatgggt

SEQ ID NO: 1215026 - DNA, 22 bp, Artificial Sequence
  chemically synthesized
attacagtttctgctacccatg

SEQ ID NO: 1215027 - DNA, 22 bp, Artificial Sequence
  chemically synthesized
ttcattacagtttctgctaccc

SEQ ID NO: 1215028 - DNA, 22 bp, Artificial Sequence
  chemically synthesized
attcattacagtttctgctacc

SEQ ID NO: 1215029 - DNA, 22 bp, Artificial Sequence
  chemically synthesized
ccttattcattacagtttctgc

SEQ ID NO: 1215030 - DNA, 22 bp, Artificial Sequence
  chemically synthesized
accatgggtagcagaaactgta

SEQ ID NO: 1215031 - DNA, 22 bp, Artificial Sequence
  chemically synthesized
aatacaggagtcctcccttatt

SEQ ID NO: 1215032 - DNA, 22 bp, Artificial Sequence
  chemically synthesized
taatgaataagggaggactcct

SEQ ID NO: 1215033 - DNA, 22 bp, Artificial Sequence
  chemically synthesized
cccaaattaaatacaggagtcc

SEQ ID NO: 1215034 - DNA, 22 bp, Artificial Sequence
  chemically synthesized
tccccaaattaaatacaggagt

SEQ ID NO: 1215035 - DNA, 22 bp, Artificial Sequence
  chemically synthesized
actctccccaaattaaatacag

SEQ ID NO: 1215036 - DNA, 22 bp, Artificial Sequence
  chemically synthesized
ctgtatttaatttggggagagt

SEQ ID NO: 1215037 - DNA, 22 bp, Artificial Sequence
  chemically synthesized
gaataaatgctgactctcccca

SEQ ID NO: 1215038 - DNA, 22 bp, Artificial Sequence
  chemically synthesized
tagaataaatgctgactctccc

SEQ ID NO: 1215039 - DNA, 22 bp, Artificial Sequence
  chemically synthesized
tatttaatttggggagagtcag

SEQ ID NO: 1215040 - DNA, 22 bp, Artificial Sequence
  chemically synthesized
cctctagaataaatgctgactc

SEQ ID NO: 1215041 - DNA, 22 bp, Artificial Sequence
  chemically synthesized
aatttggggagagtcagcattt

SEQ ID NO: 1215042 - DNA, 22 bp, Artificial Sequence
  chemically synthesized
atttggggagagtcagcattta

SEQ ID NO: 1215043 - DNA, 22 bp, Artificial Sequence
  chemically synthesized
cctgcctctagaataaatgctg

SEQ ID NO: 1215044 - DNA, 22 bp, Artificial Sequence
  chemically synthesized
gcctgcctctagaataaatgct

SEQ ID NO: 1215045 - DNA, 22 bp, Artificial Sequence
  chemically synthesized
tgcctgcctctagaataaatgc

SEQ ID NO: 1215046 - DNA, 22 bp, Artificial Sequence
  chemically synthesized
ggggagagtcagcatttattct

SEQ ID NO: 1215047 - DNA, 22 bp, Artificial Sequence
  chemically synthesized
gggagagtcagcatttattcta

SEQ ID NO: 1215048 - DNA, 22 bp, Artificial Sequence
  chemically synthesized
ttttgcctgcctctagaataaa

SEQ ID NO: 1215049 - DNA, 22 bp, Artificial Sequence
  chemically synthesized
cagttattttgcctgcctctag

SEQ ID NO: 1215050 - DNA, 22 bp, Artificial Sequence
  chemically synthesized
ccagttattttgcctgcctcta

SEQ ID NO: 1215051 - DNA, 22 bp, Artificial Sequence
  chemically synthesized
tccagttattttgcctgcctct

SEQ ID NO: 1215052 - DNA, 22 bp, Artificial Sequence
  chemically synthesized
atctttccagttattttgcctg

SEQ ID NO: 1215053 - DNA, 22 bp, Artificial Sequence
  chemically synthesized
attctagaggcaggcaaaataa

SEQ ID NO: 1215054 - DNA, 22 bp, Artificial Sequence
  chemically synthesized
ttctagaggcaggcaaaataac

SEQ ID NO: 1215055 - DNA, 22 bp, Artificial Sequence
  chemically synthesized
tagaggcaggcaaaataactgg

SEQ ID NO: 1215056 - DNA, 22 bp, Artificial Sequence
  chemically synthesized
gaggcaggcaaaataactggaa

SEQ ID NO: 1215057 - DNA, 22 bp, Artificial Sequence
  chemically synthesized
tagggaaaactgatctttccag

SEQ ID NO: 1215058 - DNA, 22 bp, Artificial Sequence
  chemically synthesized
ctgtagggaaaactgatctttc

SEQ ID NO: 1215059 - DNA, 22 bp, Artificial Sequence
  chemically synthesized
tactcctgtagggaaaactgat

SEQ ID NO: 1215060 - DNA, 22 bp, Artificial Sequence
  chemically synthesized
atactcctgtagggaaaactga

SEQ ID NO: 1215061 - DNA, 22 bp, Artificial Sequence
  chemically synthesized
tatactcctgtagggaaaactg

SEQ ID NO: 1215062 - DNA, 22 bp, Artificial Sequence
  chemically synthesized
gaaagatcagttttccctacag

SEQ ID NO: 1215063 - DNA, 22 bp, Artificial Sequence
  chemically synthesized
aatggtccctttatactcctgt

SEQ ID NO: 1215064 - DNA, 22 bp, Artificial Sequence
  chemically synthesized
tccctacaggagtataaaggga

SEQ ID NO: 1215065 - DNA, 22 bp, Artificial Sequence
  chemically synthesized
ccctacaggagtataaagggac

SEQ ID NO: 1215066 - DNA, 22 bp, Artificial Sequence
  chemically synthesized
cctacaggagtataaagggacc

SEQ ID NO: 1215067 - DNA, 22 bp, Artificial Sequence
  chemically synthesized
taaaaattaaatggtcccttta

SEQ ID NO: 1215068 - DNA, 22 bp, Artificial Sequence
  chemically synthesized
caggagtataaagggaccattt

SEQ ID NO: 1215069 - DNA, 22 bp, Artificial Sequence
  chemically synthesized
gaatgttgtaaaaattaaatgg

SEQ ID NO: 1215070 - DNA, 22 bp, Artificial Sequence
  chemically synthesized
tgtcaaataactggaatgttgt

SEQ ID NO: 1215071 - DNA, 22 bp, Artificial Sequence
  chemically synthesized
aatttttacaacattccagtta

SEQ ID NO: 1215072 - DNA, 22 bp, Artificial Sequence
  chemically synthesized
atttttacaacattccagttat

SEQ ID NO: 1215073 - DNA, 22 bp, Artificial Sequence
  chemically synthesized
aagttatgtcaaataactggaa

SEQ ID NO: 1215074 - DNA, 22 bp, Artificial Sequence
  chemically synthesized
ttacaacattccagttatttga

SEQ ID NO: 1215075 - DNA, 22 bp, Artificial Sequence
  chemically synthesized
tacaacattccagttatttgac

SEQ ID NO: 1215076 - DNA, 22 bp, Artificial Sequence
  chemically synthesized
acaacattccagttatttgaca

SEQ ID NO: 1215077 - DNA, 22 bp, Artificial Sequence
  chemically synthesized
caacattccagttatttgacat

SEQ ID NO: 1215078 - DNA, 22 bp, Artificial Sequence
  chemically synthesized
cagttatttgacataactttag

SEQ ID NO: 1215079 - DNA, 22 bp, Artificial Sequence
  chemically synthesized
tttgacataactttagctactg

SEQ ID NO: 1215080 - DNA, 22 bp, Artificial Sequence
  chemically synthesized
gacataactttagctactgttt

SEQ ID NO: 1215081 - DNA, 22 bp, Artificial Sequence
  chemically synthesized
acataactttagctactgtttc

SEQ ID NO: 1215082 - DNA, 22 bp, Artificial Sequence
  chemically synthesized
gcccgtaatatgagcccagaaa

SEQ ID NO: 1215083 - DNA, 22 bp, Artificial Sequence
  chemically synthesized
ggcccgtaatatgagcccagaa

SEQ ID NO: 1215084 - DNA, 22 bp, Artificial Sequence
  chemically synthesized
tagctactgtttctgggctcat

SEQ ID NO: 1215085 - DNA, 22 bp, Artificial Sequence
  chemically synthesized
agctactgtttctgggctcata

SEQ ID NO: 1215086 - DNA, 22 bp, Artificial Sequence
  chemically synthesized
gctactgtttctgggctcatat

SEQ ID NO: 1215087 - DNA, 22 bp, Artificial Sequence
  chemically synthesized
ctgtttctgggctcatattacg

SEQ ID NO: 1215088 - DNA, 22 bp, Artificial Sequence
  chemically synthesized
tatgtatttggcccgtaatatg

SEQ ID NO: 1215089 - DNA, 22 bp, Artificial Sequence
  chemically synthesized
tttctgggctcatattacgggc

SEQ ID NO: 1215090 - DNA, 22 bp, Artificial Sequence
  chemically synthesized
ctgggctcatattacgggccaa

SEQ ID NO: 1215091 - DNA, 22 bp, Artificial Sequence
  chemically synthesized
tgggctcatattacgggccaaa

SEQ ID NO: 1215092 - DNA, 22 bp, Artificial Sequence
  chemically synthesized
ggctcatattacgggccaaata

SEQ ID NO: 1215093 - DNA, 22 bp, Artificial Sequence
  chemically synthesized
atattacgggccaaatacatac

SEQ ID NO: 1215094 - DNA, 22 bp, Artificial Sequence
  chemically synthesized
cgggccaaatacatacaggttt

SEQ ID NO: 1215095 - DNA, 22 bp, Artificial Sequence
  chemically synthesized
aaggagtaagtaaaacctgtat

SEQ ID NO: 1215096 - DNA, 22 bp, Artificial Sequence
  chemically synthesized
caaggagtaagtaaaacctgta

SEQ ID NO: 1215097 - DNA, 22 bp, Artificial Sequence
  chemically synthesized
cttcaaggagtaagtaaaacct

SEQ ID NO: 1215098 - DNA, 22 bp, Artificial Sequence
  chemically synthesized
ctacttcaaggagtaagtaaaa

SEQ ID NO: 1215099 - DNA, 22 bp, Artificial Sequence
  chemically synthesized
ccactgctacttcaaggagtaa

SEQ ID NO: 1215100 - DNA, 22 bp, Artificial Sequence
  chemically synthesized
cctcccactgctacttcaagga

SEQ ID NO: 1215101 - DNA, 22 bp, Artificial Sequence
  chemically synthesized
acctcccactgctacttcaagg

SEQ ID NO: 1215102 - DNA, 22 bp, Artificial Sequence
  chemically synthesized
tacttactccttgaagtagcag

SEQ ID NO: 1215103 - DNA, 22 bp, Artificial Sequence
  chemically synthesized
acttactccttgaagtagcagt

SEQ ID NO: 1215104 - DNA, 22 bp, Artificial Sequence
  chemically synthesized
cttactccttgaagtagcagtg

SEQ ID NO: 1215105 - DNA, 22 bp, Artificial Sequence
  chemically synthesized
actccttgaagtagcagtggga

SEQ ID NO: 1215106 - DNA, 22 bp, Artificial Sequence
  chemically synthesized
ctccttgaagtagcagtgggag

SEQ ID NO: 1215107 - DNA, 22 bp, Artificial Sequence
  chemically synthesized
cttgaagtagcagtgggaggta

SEQ ID NO: 1215108 - DNA, 22 bp, Artificial Sequence
  chemically synthesized
gaagtagcagtgggaggtaaat

SEQ ID NO: 1215109 - DNA, 22 bp, Artificial Sequence
  chemically synthesized
aagtagcagtgggaggtaaata

SEQ ID NO: 1215110 - DNA, 22 bp, Artificial Sequence
  chemically synthesized
acgtgtaaagtaaaaatattta

SEQ ID NO: 1215111 - DNA, 22 bp, Artificial Sequence
  chemically synthesized
ctcacgtgtaaagtaaaaatat

SEQ ID NO: 1215112 - DNA, 22 bp, Artificial Sequence
  chemically synthesized
agtattgctcacgtgtaaagta

SEQ ID NO: 1215113 - DNA, 22 bp, Artificial Sequence
  chemically synthesized
aggctcagtattgctcacgtgt

SEQ ID NO: 1215114 - DNA, 22 bp, Artificial Sequence
  chemically synthesized
ttgaggctcagtattgctcacg

SEQ ID NO: 1215115 - DNA, 22 bp, Artificial Sequence
  chemically synthesized
ttactttacacgtgagcaatac

SEQ ID NO: 1215116 - DNA, 22 bp, Artificial Sequence
  chemically synthesized
tactttacacgtgagcaatact

SEQ ID NO: 1215117 - DNA, 22 bp, Artificial Sequence
  chemically synthesized
actttacacgtgagcaatactg

SEQ ID NO: 1215118 - DNA, 22 bp, Artificial Sequence
  chemically synthesized
ctttacacgtgagcaatactga

SEQ ID NO: 1215119 - DNA, 22 bp, Artificial Sequence
  chemically synthesized
tacacgtgagcaatactgagcc

SEQ ID NO: 1215120 - DNA, 22 bp, Artificial Sequence
  chemically synthesized
gaaaattattgaggctcagtat

SEQ ID NO: 1215121 - DNA, 22 bp, Artificial Sequence
  chemically synthesized
acacgtgagcaatactgagcct

SEQ ID NO: 1215122 - DNA, 22 bp, Artificial Sequence
  chemically synthesized
cacgtgagcaatactgagcctc

SEQ ID NO: 1215123 - DNA, 22 bp, Artificial Sequence
  chemically synthesized
ggccactggaaaattattgagg

SEQ ID NO: 1215124 - DNA, 22 bp, Artificial Sequence
  chemically synthesized
aggccactggaaaattattgag

SEQ ID NO: 1215125 - DNA, 22 bp, Artificial Sequence
  chemically synthesized
taggccactggaaaattattga

SEQ ID NO: 1215126 - DNA, 22 bp, Artificial Sequence
  chemically synthesized
gttttaggccactggaaaatta

SEQ ID NO: 1215127 - DNA, 22 bp, Artificial Sequence
  chemically synthesized
ttagttttaggccactggaaaa

SEQ ID NO: 1215128 - DNA, 22 bp, Artificial Sequence
  chemically synthesized
agcctcaataattttccagtgg

SEQ ID NO: 1215129 - DNA, 22 bp, Artificial Sequence
  chemically synthesized
attagttttaggccactggaaa

SEQ ID NO: 1215130 - DNA, 22 bp, Artificial Sequence
  chemically synthesized
tattagttttaggccactggaa

SEQ ID NO: 1215131 - DNA, 22 bp, Artificial Sequence
  chemically synthesized
cctttattagttttaggccact

SEQ ID NO: 1215132 - DNA, 22 bp, Artificial Sequence
  chemically synthesized
aataattttccagtggcctaaa

SEQ ID NO: 1215133 - DNA, 22 bp, Artificial Sequence
  chemically synthesized
gcctttattagttttaggccac

SEQ ID NO: 1215134 - DNA, 22 bp, Artificial Sequence
  chemically synthesized
tgcctttattagttttaggcca

SEQ ID NO: 1215135 - DNA, 22 bp, Artificial Sequence
  chemically synthesized
ttgcctttattagttttaggcc

SEQ ID NO: 1215136 - DNA, 22 bp, Artificial Sequence
  chemically synthesized
atttttgcctttattagtttta

SEQ ID NO: 1215137 - DNA, 22 bp, Artificial Sequence
  chemically synthesized
tccagtggcctaaaactaataa

SEQ ID NO: 1215138 - DNA, 22 bp, Artificial Sequence
  chemically synthesized
ccagtggcctaaaactaataaa

SEQ ID NO: 1215139 - DNA, 22 bp, Artificial Sequence
  chemically synthesized
cagtggcctaaaactaataaag

SEQ ID NO: 1215140 - DNA, 22 bp, Artificial Sequence
  chemically synthesized
aaatctgatttttgcctttatt

SEQ ID NO: 1215141 - DNA, 22 bp, Artificial Sequence
  chemically synthesized
ggttaaaatctgatttttgcct

SEQ ID NO: 1215142 - DNA, 22 bp, Artificial Sequence
  chemically synthesized
gggttaaaatctgatttttgcc

SEQ ID NO: 1215143 - DNA, 22 bp, Artificial Sequence
  chemically synthesized
aaactaataaaggcaaaaatca

SEQ ID NO: 1215144 - DNA, 22 bp, Artificial Sequence
  chemically synthesized
tgggttaaaatctgatttttgc

SEQ ID NO: 1215145 - DNA, 22 bp, Artificial Sequence
  chemically synthesized
gttttgggttaaaatctgattt

SEQ ID NO: 1215146 - DNA, 22 bp, Artificial Sequence
  chemically synthesized
ataaaggcaaaaatcagatttt

SEQ ID NO: 1215147 - DNA, 22 bp, Artificial Sequence
  chemically synthesized
cacagagccaactagttttggg

SEQ ID NO: 1215148 - DNA, 22 bp, Artificial Sequence
  chemically synthesized
tacacagagccaactagttttg

SEQ ID NO: 1215149 - DNA, 22 bp, Artificial Sequence
  chemically synthesized
ctacacagagccaactagtttt

SEQ ID NO: 1215150 - DNA, 22 bp, Artificial Sequence
  chemically synthesized
tctacacagagccaactagttt

SEQ ID NO: 1215151 - DNA, 22 bp, Artificial Sequence
  chemically synthesized
ttctacacagagccaactagtt

SEQ ID NO: 1215152 - DNA, 22 bp, Artificial Sequence
  chemically synthesized
tttctacacagagccaactagt

SEQ ID NO: 1215153 - DNA, 22 bp, Artificial Sequence
  chemically synthesized
taacccaaaactagttggctct

SEQ ID NO: 1215154 - DNA, 22 bp, Artificial Sequence
  chemically synthesized
aacccaaaactagttggctctg

SEQ ID NO: 1215155 - DNA, 22 bp, Artificial Sequence
  chemically synthesized
actttttctacacagagccaac

SEQ ID NO: 1215156 - DNA, 22 bp, Artificial Sequence
  chemically synthesized
acccaaaactagttggctctgt

SEQ ID NO: 1215157 - DNA, 22 bp, Artificial Sequence
  chemically synthesized
aactttttctacacagagccaa

SEQ ID NO: 1215158 - DNA, 22 bp, Artificial Sequence
  chemically synthesized
atttaactttttctacacagag

SEQ ID NO: 1215159 - DNA, 22 bp, Artificial Sequence
  chemically synthesized
gggttgatttaactttttctac

SEQ ID NO: 1215160 - DNA, 22 bp, Artificial Sequence
  chemically synthesized
gttggctctgtgtagaaaaagt

SEQ ID NO: 1215161 - DNA, 22 bp, Artificial Sequence
  chemically synthesized
gctctgtgtagaaaaagttaaa

SEQ ID NO: 1215162 - DNA, 22 bp, Artificial Sequence
  chemically synthesized
acctagggttgatttaactttt

SEQ ID NO: 1215163 - DNA, 22 bp, Artificial Sequence
  chemically synthesized
tgtgtagaaaaagttaaatcaa

SEQ ID NO: 1215164 - DNA, 22 bp, Artificial Sequence
  chemically synthesized
tgtagaaaaagttaaatcaacc

SEQ ID NO: 1215165 - DNA, 22 bp, Artificial Sequence
  chemically synthesized
ggcagcatcagattaacctagg

SEQ ID NO: 1215166 - DNA, 22 bp, Artificial Sequence
  chemically synthesized
ctaggcagcatcagattaacct

SEQ ID NO: 1215167 - DNA, 22 bp, Artificial Sequence
  chemically synthesized
cctaggcagcatcagattaacc

SEQ ID NO: 1215168 - DNA, 22 bp, Artificial Sequence
  chemically synthesized
aatcaaccctaggttaatctga

SEQ ID NO: 1215169 - DNA, 22 bp, Artificial Sequence
  chemically synthesized
tcctaggcagcatcagattaac

SEQ ID NO: 1215170 - DNA, 22 bp, Artificial Sequence
  chemically synthesized
attttcctaggcagcatcagat

SEQ ID NO: 1215171 - DNA, 22 bp, Artificial Sequence
  chemically synthesized
tgttcattttcctaggcagcat

SEQ ID NO: 1215172 - DNA, 22 bp, Artificial Sequence
  chemically synthesized
ggttaatctgatgctgcctagg

SEQ ID NO: 1215173 - DNA, 22 bp, Artificial Sequence
  chemically synthesized
tatgttcattttcctaggcagc

SEQ ID NO: 1215174 - DNA, 22 bp, Artificial Sequence
  chemically synthesized
ctatgttcattttcctaggcag

SEQ ID NO: 1215175 - DNA, 22 bp, Artificial Sequence
  chemically synthesized
atctgatgctgcctaggaaaat

SEQ ID NO: 1215176 - DNA, 22 bp, Artificial Sequence
  chemically synthesized
atgctgcctaggaaaatgaaca

SEQ ID NO: 1215177 - DNA, 22 bp, Artificial Sequence
  chemically synthesized
agaaaataagtttctatgttca

SEQ ID NO: 1215178 - DNA, 22 bp, Artificial Sequence
  chemically synthesized
cctaggaaaatgaacatagaaa

SEQ ID NO: 1215179 - DNA, 22 bp, Artificial Sequence
  chemically synthesized
ggaaaatgaacatagaaactta

SEQ ID NO: 1215180 - DNA, 22 bp, Artificial Sequence
  chemically synthesized
atcctaagaaaataagtttcta

SEQ ID NO: 1215181 - DNA, 22 bp, Artificial Sequence
  chemically synthesized
aatcctaagaaaataagtttct

SEQ ID NO: 1215182 - DNA, 22 bp, Artificial Sequence
  chemically synthesized
ttaatcctaagaaaataagttt

SEQ ID NO: 1215183 - DNA, 22 bp, Artificial Sequence
  chemically synthesized
actcttaatcctaagaaaataa

SEQ ID NO: 1215184 - DNA, 22 bp, Artificial Sequence
  chemically synthesized
aactcttaatcctaagaaaata

SEQ ID NO: 1215185 - DNA, 22 bp, Artificial Sequence
  chemically synthesized
tcttaactcttaatcctaagaa

SEQ ID NO: 1215186 - DNA, 22 bp, Artificial Sequence
  chemically synthesized
ttatcttaactcttaatcctaa

SEQ ID NO: 1215187 - DNA, 22 bp, Artificial Sequence
  chemically synthesized
ctattatcttaactcttaatcc

SEQ ID NO: 1215188 - DNA, 22 bp, Artificial Sequence
  chemically synthesized
tactattatcttaactcttaat

SEQ ID NO: 1215189 - DNA, 22 bp, Artificial Sequence
  chemically synthesized
attttcttaggattaagagtta

SEQ ID NO: 1215190 - DNA, 22 bp, Artificial Sequence
  chemically synthesized
ttttcttaggattaagagttaa

SEQ ID NO: 1215191 - DNA, 22 bp, Artificial Sequence
  chemically synthesized
tcttaggattaagagttaagat

SEQ ID NO: 1215192 - DNA, 22 bp, Artificial Sequence
  chemically synthesized
cttaggattaagagttaagata

SEQ ID NO: 1215193 - DNA, 22 bp, Artificial Sequence
  chemically synthesized
ttaggattaagagttaagataa

SEQ ID NO: 1215194 - DNA, 22 bp, Artificial Sequence
  chemically synthesized
aggattaagagttaagataata

SEQ ID NO: 1215195 - DNA, 22 bp, Artificial Sequence
  chemically synthesized
ggattaagagttaagataatag

SEQ ID NO: 1215196 - DNA, 22 bp, Artificial Sequence
  chemically synthesized
agagttaagataatagtagaat

SEQ ID NO: 1215197 - DNA, 22 bp, Artificial Sequence
  chemically synthesized
agataatagtagaatttcttgt

SEQ ID NO: 1215198 - DNA, 22 bp, Artificial Sequence
  chemically synthesized
gcaaacaagagtgacaagaaat

SEQ ID NO: 1215199 - DNA, 22 bp, Artificial Sequence
  chemically synthesized
cctagcaaacaagagtgacaag

SEQ ID NO: 1215200 - DNA, 22 bp, Artificial Sequence
  chemically synthesized
cttgtcactcttgtttgctagg

SEQ ID NO: 1215201 - DNA, 22 bp, Artificial Sequence
  chemically synthesized
atagtagtcctacctagcaaac

SEQ ID NO: 1215202 - DNA, 22 bp, Artificial Sequence
  chemically synthesized
ttgtcactcttgtttgctaggt

SEQ ID NO: 1215203 - DNA, 22 bp, Artificial Sequence
  chemically synthesized
aatagtagtcctacctagcaaa

SEQ ID NO: 1215204 - DNA, 22 bp, Artificial Sequence
  chemically synthesized
gtcactcttgtttgctaggtag

SEQ ID NO: 1215205 - DNA, 22 bp, Artificial Sequence
  chemically synthesized
tcactcttgtttgctaggtagg

SEQ ID NO: 1215206 - DNA, 22 bp, Artificial Sequence
  chemically synthesized
atttaatagtagtcctacctag

SEQ ID NO: 1215207 - DNA, 22 bp, Artificial Sequence
  chemically synthesized
ttgtttgctaggtaggactact

SEQ ID NO: 1215208 - DNA, 22 bp, Artificial Sequence
  chemically synthesized
gtttgctaggtaggactactat

SEQ ID NO: 1215209 - DNA, 22 bp, Artificial Sequence
  chemically synthesized
tttgctaggtaggactactatt

SEQ ID NO: 1215210 - DNA, 22 bp, Artificial Sequence
  chemically synthesized
cccagttaatttaatagtagtc

SEQ ID NO: 1215211 - DNA, 22 bp, Artificial Sequence
  chemically synthesized
gctaggtaggactactattaaa

SEQ ID NO: 1215212 - DNA, 22 bp, Artificial Sequence
  chemically synthesized
ctaggtaggactactattaaat

SEQ ID NO: 1215213 - DNA, 22 bp, Artificial Sequence
  chemically synthesized
ggtaggactactattaaattaa

SEQ ID NO: 1215214 - DNA, 22 bp, Artificial Sequence
  chemically synthesized
ccccactccccagttaatttaa

SEQ ID NO: 1215215 - DNA, 22 bp, Artificial Sequence
  chemically synthesized
tgccccactccccagttaattt

SEQ ID NO: 1215216 - DNA, 22 bp, Artificial Sequence
  chemically synthesized
tctgccccactccccagttaat

SEQ ID NO: 1215217 - DNA, 22 bp, Artificial Sequence
  chemically synthesized
cctctctgccccactccccagt

SEQ ID NO: 1215218 - DNA, 22 bp, Artificial Sequence
  chemically synthesized
ctattaaattaactggggagtg

SEQ ID NO: 1215219 - DNA, 22 bp, Artificial Sequence
  chemically synthesized
ttaaattaactggggagtgggg

SEQ ID NO: 1215220 - DNA, 22 bp, Artificial Sequence
  chemically synthesized
aattaactggggagtggggcag

SEQ ID NO: 1215221 - DNA, 22 bp, Artificial Sequence
  chemically synthesized
tatattgcctctctgccccact

SEQ ID NO: 1215222 - DNA, 22 bp, Artificial Sequence
  chemically synthesized
actggggagtggggcagagagg

SEQ ID NO: 1215223 - DNA, 22 bp, Artificial Sequence
  chemically synthesized
gggagtggggcagagaggcaat

SEQ ID NO: 1215224 - DNA, 22 bp, Artificial Sequence
  chemically synthesized
tcacataggacaaaagactata

SEQ ID NO: 1215225 - DNA, 22 bp, Artificial Sequence
  chemically synthesized
ttgtcacataggacaaaagact

SEQ ID NO: 1215226 - DNA, 22 bp, Artificial Sequence
  chemically synthesized
ataccattgttgtcacatagga

SEQ ID NO: 1215227 - DNA, 22 bp, Artificial Sequence
  chemically synthesized
aataccattgttgtcacatagg

SEQ ID NO: 1215228 - DNA, 22 bp, Artificial Sequence
  chemically synthesized
ttgtcctatgtgacaacaatgg

SEQ ID NO: 1215229 - DNA, 22 bp, Artificial Sequence
  chemically synthesized
tgtcctatgtgacaacaatggt

SEQ ID NO: 1215230 - DNA, 22 bp, Artificial Sequence
  chemically synthesized
gtcctatgtgacaacaatggta

SEQ ID NO: 1215231 - DNA, 22 bp, Artificial Sequence
  chemically synthesized
tcctatgtgacaacaatggtat

SEQ ID NO: 1215232 - DNA, 22 bp, Artificial Sequence
  chemically synthesized
ccaccaatatttaataccattg

SEQ ID NO: 1215233 - DNA, 22 bp, Artificial Sequence
  chemically synthesized
cccaccaatatttaataccatt

SEQ ID NO: 1215234 - DNA, 22 bp, Artificial Sequence
  chemically synthesized
tgtgacaacaatggtattaaat

SEQ ID NO: 1215235 - DNA, 22 bp, Artificial Sequence
  chemically synthesized
atttcccaccaatatttaatac

SEQ ID NO: 1215236 - DNA, 22 bp, Artificial Sequence
  chemically synthesized
cagcattaatttcccaccaata

SEQ ID NO: 1215237 - DNA, 22 bp, Artificial Sequence
  chemically synthesized
aatattggtgggaaattaatgc

SEQ ID NO: 1215238 - DNA, 22 bp, Artificial Sequence
  chemically synthesized
acatgaagaaattgcagcatta

SEQ ID NO: 1215239 - DNA, 22 bp, Artificial Sequence
  chemically synthesized
gacatgaagaaattgcagcatt

SEQ ID NO: 1215240 - DNA, 22 bp, Artificial Sequence
  chemically synthesized
gtgggaaattaatgctgcaatt

SEQ ID NO: 1215241 - DNA, 22 bp, Artificial Sequence
  chemically synthesized
cttgacatgaagaaattgcagc

SEQ ID NO: 1215242 - DNA, 22 bp, Artificial Sequence
  chemically synthesized
acttgacatgaagaaattgcag

SEQ ID NO: 1215243 - DNA, 22 bp, Artificial Sequence
  chemically synthesized
atgctgcaatttcttcatgtca

SEQ ID NO: 1215244 - DNA, 22 bp, Artificial Sequence
  chemically synthesized
caatttcttcatgtcaagtaaa

SEQ ID NO: 1215245 - DNA, 22 bp, Artificial Sequence
  chemically synthesized
cttcatgtcaagtaaaccacac

SEQ ID NO: 1215246 - DNA, 22 bp, Artificial Sequence
  chemically synthesized
ttcatgtcaagtaaaccacact

SEQ ID NO: 1215247 - DNA, 22 bp, Artificial Sequence
  chemically synthesized
catgtcaagtaaaccacactga

SEQ ID NO: 1215248 - DNA, 22 bp, Artificial Sequence
  chemically synthesized
atgtcaagtaaaccacactgat

SEQ ID NO: 1215249 - DNA, 22 bp, Artificial Sequence
  chemically synthesized
ggacaacggccaaaatcagtgt

SEQ ID NO: 1215250 - DNA, 22 bp, Artificial Sequence
  chemically synthesized
ctaggacaacggccaaaatcag

SEQ ID NO: 1215251 - DNA, 22 bp, Artificial Sequence
  chemically synthesized
catatagctgctaggacaacgg

SEQ ID NO: 1215252 - DNA, 22 bp, Artificial Sequence
  chemically synthesized
attttggccgttgtcctagcag

SEQ ID NO: 1215253 - DNA, 22 bp, Artificial Sequence
  chemically synthesized
tggccgttgtcctagcagctat

SEQ ID NO: 1215254 - DNA, 22 bp, Artificial Sequence
  chemically synthesized
ggccgttgtcctagcagctata

SEQ ID NO: 1215255 - DNA, 22 bp, Artificial Sequence
  chemically synthesized
gccgttgtcctagcagctatat

SEQ ID NO: 1215256 - DNA, 22 bp, Artificial Sequence
  chemically synthesized
acccaaatgtgctccatatagc

SEQ ID NO: 1215257 - DNA, 22 bp, Artificial Sequence
  chemically synthesized
tcacccaaatgtgctccatata

SEQ ID NO: 1215258 - DNA, 22 bp, Artificial Sequence
  chemically synthesized
tcctagcagctatatggagcac

SEQ ID NO: 1215259 - DNA, 22 bp, Artificial Sequence
  chemically synthesized
gcagctatatggagcacatttg

SEQ ID NO: 1215260 - DNA, 22 bp, Artificial Sequence
  chemically synthesized
cacatgcctctcacccaaatgt

SEQ ID NO: 1215261 - DNA, 22 bp, Artificial Sequence
  chemically synthesized
ccacatgcctctcacccaaatg

SEQ ID NO: 1215262 - DNA, 22 bp, Artificial Sequence
  chemically synthesized
tatggagcacatttgggtgaga

SEQ ID NO: 1215263 - DNA, 22 bp, Artificial Sequence
  chemically synthesized
gggtgagaggcatgtggaaatc

SEQ ID NO: 1215264 - DNA, 22 bp, Artificial Sequence
  chemically synthesized
ggtgagaggcatgtggaaatct

SEQ ID NO: 1215265 - DNA, 22 bp, Artificial Sequence
  chemically synthesized
gatggcccagaagcaaccaaca

SEQ ID NO: 1215266 - DNA, 22 bp, Artificial Sequence
  chemically synthesized
tatcattggatggcccagaagc

SEQ ID NO: 1215267 - DNA, 22 bp, Artificial Sequence
  chemically synthesized
gtatcattggatggcccagaag

SEQ ID NO: 1215268 - DNA, 22 bp, Artificial Sequence
  chemically synthesized
tatgttggttgcttctgggcca

SEQ ID NO: 1215269 - DNA, 22 bp, Artificial Sequence
  chemically synthesized
tgtatcattggatggcccagaa

SEQ ID NO: 1215270 - DNA, 22 bp, Artificial Sequence
  chemically synthesized
gttgcttctgggccatccaatg

SEQ ID NO: 1215271 - DNA, 22 bp, Artificial Sequence
  chemically synthesized
cttctgggccatccaatgatac

SEQ ID NO: 1215272 - DNA, 22 bp, Artificial Sequence
  chemically synthesized
tcatagaatctttgtatcattg

SEQ ID NO: 1215273 - DNA, 22 bp, Artificial Sequence
  chemically synthesized
ctgggccatccaatgatacaaa

SEQ ID NO: 1215274 - DNA, 22 bp, Artificial Sequence
  chemically synthesized
tgggccatccaatgatacaaag

SEQ ID NO: 1215275 - DNA, 22 bp, Artificial Sequence
  chemically synthesized
ggccatccaatgatacaaagat

SEQ ID NO: 1215276 - DNA, 22 bp, Artificial Sequence
  chemically synthesized
tatgacagtgtatctcctgcct

SEQ ID NO: 1215277 - DNA, 22 bp, Artificial Sequence
  chemically synthesized
tgacagtgtatctcctgccttg

SEQ ID NO: 1215278 - DNA, 22 bp, Artificial Sequence
  chemically synthesized
tacagaaggatacaaggcagga

SEQ ID NO: 1215279 - DNA, 22 bp, Artificial Sequence
  chemically synthesized
gctgtacagaaggatacaaggc

SEQ ID NO: 1215280 - DNA, 22 bp, Artificial Sequence
  chemically synthesized
agctgtacagaaggatacaagg

SEQ ID NO: 1215281 - DNA, 22 bp, Artificial Sequence
  chemically synthesized
cttagctgtacagaaggataca

SEQ ID NO: 1215282 - DNA, 22 bp, Artificial Sequence
  chemically synthesized
acttagctgtacagaaggatac

SEQ ID NO: 1215283 - DNA, 22 bp, Artificial Sequence
  chemically synthesized
ctgccttgtatccttctgtaca

SEQ ID NO: 1215284 - DNA, 22 bp, Artificial Sequence
  chemically synthesized
ccttgtatccttctgtacagct

SEQ ID NO: 1215285 - DNA, 22 bp, Artificial Sequence
  chemically synthesized
tgacatttacttagctgtacag

SEQ ID NO: 1215286 - DNA, 22 bp, Artificial Sequence
  chemically synthesized
gtatccttctgtacagctaagt

SEQ ID NO: 1215287 - DNA, 22 bp, Artificial Sequence
  chemically synthesized
tatccttctgtacagctaagta

SEQ ID NO: 1215288 - DNA, 22 bp, Artificial Sequence
  chemically synthesized
atctatgacatttacttagctg

SEQ ID NO: 1215289 - DNA, 22 bp, Artificial Sequence
  chemically synthesized
aatctatgacatttacttagct

SEQ ID NO: 1215290 - DNA, 22 bp, Artificial Sequence
  chemically synthesized
ctgtacagctaagtaaatgtca

SEQ ID NO: 1215291 - DNA, 22 bp, Artificial Sequence
  chemically synthesized
tgtacagctaagtaaatgtcat

SEQ ID NO: 1215292 - DNA, 22 bp, Artificial Sequence
  chemically synthesized
tacagctaagtaaatgtcatag

SEQ ID NO: 1215293 - DNA, 22 bp, Artificial Sequence
  chemically synthesized
agtaaatgtcatagattaaatt

SEQ ID NO: 1215294 - DNA, 22 bp, Artificial Sequence
  chemically synthesized
acagatggaatagaatttaatc

SEQ ID NO: 1215295 - DNA, 22 bp, Artificial Sequence
  chemically synthesized
tactcacagatggaatagaatt

SEQ ID NO: 1215296 - DNA, 22 bp, Artificial Sequence
  chemically synthesized
gcaattatactcacagatggaa

SEQ ID NO: 1215297 - DNA, 22 bp, Artificial Sequence
  chemically synthesized
aattctattccatctgtgagta

SEQ ID NO: 1215298 - DNA, 22 bp, Artificial Sequence
  chemically synthesized
tattccatctgtgagtataatt

SEQ ID NO: 1215299 - DNA, 22 bp, Artificial Sequence
  chemically synthesized
ttccatctgtgagtataattgc

SEQ ID NO: 1215300 - DNA, 22 bp, Artificial Sequence
  chemically synthesized
catctgtgagtataattgccaa

SEQ ID NO: 1215301 - DNA, 22 bp, Artificial Sequence
  chemically synthesized
taaggagataaaattggcaatt

SEQ ID NO: 1215302 - DNA, 22 bp, Artificial Sequence
  chemically synthesized
tgagtataattgccaattttat

SEQ ID NO: 1215303 - DNA, 22 bp, Artificial Sequence
  chemically synthesized
gtgtagttgtaaggagataaaa

SEQ ID NO: 1215304 - DNA, 22 bp, Artificial Sequence
  chemically synthesized
ttagtgtagttgtaaggagata

SEQ ID NO: 1215305 - DNA, 22 bp, Artificial Sequence
  chemically synthesized
ccaattttatctccttacaact

SEQ ID NO: 1215306 - DNA, 22 bp, Artificial Sequence
  chemically synthesized
cactgttagtgtagttgtaagg

SEQ ID NO: 1215307 - DNA, 22 bp, Artificial Sequence
  chemically synthesized
tatctccttacaactacactaa

SEQ ID NO: 1215308 - DNA, 22 bp, Artificial Sequence
  chemically synthesized
gagcctgcactgttagtgtagt

SEQ ID NO: 1215309 - DNA, 22 bp, Artificial Sequence
  chemically synthesized
atctccttacaactacactaac

SEQ ID NO: 1215310 - DNA, 22 bp, Artificial Sequence
  chemically synthesized
ggagcctgcactgttagtgtag

SEQ ID NO: 1215311 - DNA, 22 bp, Artificial Sequence
  chemically synthesized
tctccttacaactacactaaca

SEQ ID NO: 1215312 - DNA, 22 bp, Artificial Sequence
  chemically synthesized
tggagcctgcactgttagtgta

SEQ ID NO: 1215313 - DNA, 22 bp, Artificial Sequence
  chemically synthesized
cttacaactacactaacagtgc

SEQ ID NO: 1215314 - DNA, 22 bp, Artificial Sequence
  chemically synthesized
acaactacactaacagtgcagg

SEQ ID NO: 1215315 - DNA, 22 bp, Artificial Sequence
  chemically synthesized
caactacactaacagtgcaggc

SEQ ID NO: 1215316 - DNA, 22 bp, Artificial Sequence
  chemically synthesized
cactaacagtgcaggctccaaa

SEQ ID NO: 1215317 - DNA, 22 bp, Artificial Sequence
  chemically synthesized
acaggacataatgaactttgga

SEQ ID NO: 1215318 - DNA, 22 bp, Artificial Sequence
  chemically synthesized
acagtgcaggctccaaagttca

SEQ ID NO: 1215319 - DNA, 22 bp, Artificial Sequence
  chemically synthesized
ctgacaggacataatgaacttt

SEQ ID NO: 1215320 - DNA, 22 bp, Artificial Sequence
  chemically synthesized
actgacaggacataatgaactt

SEQ ID NO: 1215321 - DNA, 22 bp, Artificial Sequence
  chemically synthesized
tactgacaggacataatgaact

SEQ ID NO: 1215322 - DNA, 22 bp, Artificial Sequence
  chemically synthesized
ttactgacaggacataatgaac

SEQ ID NO: 1215323 - DNA, 22 bp, Artificial Sequence
  chemically synthesized
caaagttcattatgtcctgtca

SEQ ID NO: 1215324 - DNA, 22 bp, Artificial Sequence
  chemically synthesized
attatgtcctgtcagtaaaagt

SEQ ID NO: 1215325 - DNA, 22 bp, Artificial Sequence
  chemically synthesized
gccagatatgcaacttttactg

SEQ ID NO: 1215326 - DNA, 22 bp, Artificial Sequence
  chemically synthesized
agccagatatgcaacttttact

SEQ ID NO: 1215327 - DNA, 22 bp, Artificial Sequence
  chemically synthesized
tagccagatatgcaacttttac

SEQ ID NO: 1215328 - DNA, 22 bp, Artificial Sequence
  chemically synthesized
tgtcctgtcagtaaaagttgca

SEQ ID NO: 1215329 - DNA, 22 bp, Artificial Sequence
  chemically synthesized
tattttagccagatatgcaact

SEQ ID NO: 1215330 - DNA, 22 bp, Artificial Sequence
  chemically synthesized
gtattttagccagatatgcaac

SEQ ID NO: 1215331 - DNA, 22 bp, Artificial Sequence
  chemically synthesized
tcagtaaaagttgcatatctgg

SEQ ID NO: 1215332 - DNA, 22 bp, Artificial Sequence
  chemically synthesized
aacagtttgtattttagccaga

SEQ ID NO: 1215333 - DNA, 22 bp, Artificial Sequence
  chemically synthesized
ctaaacagtttgtattttagcc

SEQ ID NO: 1215334 - DNA, 22 bp, Artificial Sequence
  chemically synthesized
gctaaacagtttgtattttagc

SEQ ID NO: 1215335 - DNA, 22 bp, Artificial Sequence
  chemically synthesized
tgctaaacagtttgtattttag

SEQ ID NO: 1215336 - DNA, 22 bp, Artificial Sequence
  chemically synthesized
catatctggctaaaatacaaac

SEQ ID NO: 1215337 - DNA, 22 bp, Artificial Sequence
  chemically synthesized
gttttgctaaacagtttgtatt

SEQ ID NO: 1215338 - DNA, 22 bp, Artificial Sequence
  chemically synthesized
gctaaaatacaaactgtttagc

SEQ ID NO: 1215339 - DNA, 22 bp, Artificial Sequence
  chemically synthesized
tccagggttagttttgctaaac

SEQ ID NO: 1215340 - DNA, 22 bp, Artificial Sequence
  chemically synthesized
aaatacaaactgtttagcaaaa

SEQ ID NO: 1215341 - DNA, 22 bp, Artificial Sequence
  chemically synthesized
atccagggttagttttgctaaa

SEQ ID NO: 1215342 - DNA, 22 bp, Artificial Sequence
  chemically synthesized
ccatttatccagggttagtttt

SEQ ID NO: 1215343 - DNA, 22 bp, Artificial Sequence
  chemically synthesized
accatttatccagggttagttt

SEQ ID NO: 1215344 - DNA, 22 bp, Artificial Sequence
  chemically synthesized
tttaccatttatccagggttag

SEQ ID NO: 1215345 - DNA, 22 bp, Artificial Sequence
  chemically synthesized
atttaccatttatccagggtta

SEQ ID NO: 1215346 - DNA, 22 bp, Artificial Sequence
  chemically synthesized
tttagcaaaactaaccctggat

SEQ ID NO: 1215347 - DNA, 22 bp, Artificial Sequence
  chemically synthesized
agcaaaactaaccctggataaa

SEQ ID NO: 1215348 - DNA, 22 bp, Artificial Sequence
  chemically synthesized
gcaaaactaaccctggataaat

SEQ ID NO: 1215349 - DNA, 22 bp, Artificial Sequence
  chemically synthesized
aatttatttaccatttatccag

SEQ ID NO: 1215350 - DNA, 22 bp, Artificial Sequence
  chemically synthesized
accctggataaatggtaaataa

SEQ ID NO: 1215351 - DNA, 22 bp, Artificial Sequence
  chemically synthesized
gataaatggtaaataaattcaa

SEQ ID NO: 1215352 - DNA, 22 bp, Artificial Sequence
  chemically synthesized
atgccataaataggttgaattt

SEQ ID NO: 1215353 - DNA, 22 bp, Artificial Sequence
  chemically synthesized
atattaatgccataaataggtt

SEQ ID NO: 1215354 - DNA, 22 bp, Artificial Sequence
  chemically synthesized
tgatattaatgccataaatagg

SEQ ID NO: 1215355 - DNA, 22 bp, Artificial Sequence
  chemically synthesized
tgatctctgatattaatgccat

SEQ ID NO: 1215356 - DNA, 22 bp, Artificial Sequence
  chemically synthesized
atgatctctgatattaatgcca

SEQ ID NO: 1215357 - DNA, 22 bp, Artificial Sequence
  chemically synthesized
tatgatctctgatattaatgcc

SEQ ID NO: 1215358 - DNA, 22 bp, Artificial Sequence
  chemically synthesized
aacctatttatggcattaatat

SEQ ID NO: 1215359 - DNA, 22 bp, Artificial Sequence
  chemically synthesized
attttatgatctctgatattaa

SEQ ID NO: 1215360 - DNA, 22 bp, Artificial Sequence
  chemically synthesized
aattttatgatctctgatatta

SEQ ID NO: 1215361 - DNA, 22 bp, Artificial Sequence
  chemically synthesized
tttatggcattaatatcagaga

SEQ ID NO: 1215362 - DNA, 22 bp, Artificial Sequence
  chemically synthesized
atggcattaatatcagagatca

SEQ ID NO: 1215363 - DNA, 22 bp, Artificial Sequence
  chemically synthesized
tggcattaatatcagagatcat

SEQ ID NO: 1215364 - DNA, 22 bp, Artificial Sequence
  chemically synthesized
atatcagagatcataaaattaa

SEQ ID NO: 1215365 - DNA, 22 bp, Artificial Sequence
  chemically synthesized
aaataagcaaatggcttaattt

SEQ ID NO: 1215366 - DNA, 22 bp, Artificial Sequence
  chemically synthesized
gaaataagcaaatggcttaatt

SEQ ID NO: 1215367 - DNA, 22 bp, Artificial Sequence
  chemically synthesized
agccatttgcttatttcaagtg

SEQ ID NO: 1215368 - DNA, 22 bp, Artificial Sequence
  chemically synthesized
atcccataaatccacttgaaat

SEQ ID NO: 1215369 - DNA, 22 bp, Artificial Sequence
  chemically synthesized
gcttatttcaagtggatttatg

SEQ ID NO: 1215370 - DNA, 22 bp, Artificial Sequence
  chemically synthesized
gaagtctgatcccataaatcca

SEQ ID NO: 1215371 - DNA, 22 bp, Artificial Sequence
  chemically synthesized
cttatttcaagtggatttatgg

SEQ ID NO: 1215372 - DNA, 22 bp, Artificial Sequence
  chemically synthesized
atttcaagtggatttatgggat

SEQ ID NO: 1215373 - DNA, 22 bp, Artificial Sequence
  chemically synthesized
tttcaagtggatttatgggatc

SEQ ID NO: 1215374 - DNA, 22 bp, Artificial Sequence
  chemically synthesized
aaattagaagtctgatcccata

SEQ ID NO: 1215375 - DNA, 22 bp, Artificial Sequence
  chemically synthesized
caaattagaagtctgatcccat

SEQ ID NO: 1215376 - DNA, 22 bp, Artificial Sequence
  chemically synthesized
caagtggatttatgggatcaga

SEQ ID NO: 1215377 - DNA, 22 bp, Artificial Sequence
  chemically synthesized
tcaaattagaagtctgatccca

SEQ ID NO: 1215378 - DNA, 22 bp, Artificial Sequence
  chemically synthesized
aagtggatttatgggatcagac

SEQ ID NO: 1215379 - DNA, 22 bp, Artificial Sequence
  chemically synthesized
atgggatcagacttctaatttg

SEQ ID NO: 1215380 - DNA, 22 bp, Artificial Sequence
  chemically synthesized
tgggatcagacttctaatttga

SEQ ID NO: 1215381 - DNA, 22 bp, Artificial Sequence
  chemically synthesized
aaatgatggtaaaataatagtt

SEQ ID NO: 1215382 - DNA, 22 bp, Artificial Sequence
  chemically synthesized
ctaatttgaaaactattatttt

SEQ ID NO: 1215383 - DNA, 22 bp, Artificial Sequence
  chemically synthesized
taatttgaaaactattatttta

SEQ ID NO: 1215384 - DNA, 22 bp, Artificial Sequence
  chemically synthesized
atttgaaaactattattttacc

SEQ ID NO: 1215385 - DNA, 22 bp, Artificial Sequence
  chemically synthesized
gaaaactattattttaccatca

SEQ ID NO: 1215386 - DNA, 22 bp, Artificial Sequence
  chemically synthesized
aaaactattattttaccatcat

SEQ ID NO: 1215387 - DNA, 22 bp, Artificial Sequence
  chemically synthesized
ttattttaccatcattttaatt

SEQ ID NO: 1215388 - DNA, 22 bp, Artificial Sequence
  chemically synthesized
ataagggaaaacaattaaaatg

SEQ ID NO: 1215389 - DNA, 22 bp, Artificial Sequence
  chemically synthesized
ttttaccatcattttaattgtt

SEQ ID NO: 1215390 - DNA, 22 bp, Artificial Sequence
  chemically synthesized
taccatcattttaattgttttc

SEQ ID NO: 1215391 - DNA, 22 bp, Artificial Sequence
  chemically synthesized
accatcattttaattgttttcc

SEQ ID NO: 1215392 - DNA, 22 bp, Artificial Sequence
  chemically synthesized
agggctaataagggaaaacaat

SEQ ID NO: 1215393 - DNA, 22 bp, Artificial Sequence
  chemically synthesized
ccatcattttaattgttttccc

SEQ ID NO: 1215394 - DNA, 22 bp, Artificial Sequence
  chemically synthesized
taattgttttcccttattagcc

SEQ ID NO: 1215395 - DNA, 22 bp, Artificial Sequence
  chemically synthesized
ataataactaagggctaataag

SEQ ID NO: 1215396 - DNA, 22 bp, Artificial Sequence
  chemically synthesized
aattgttttcccttattagccc

SEQ ID NO: 1215397 - DNA, 22 bp, Artificial Sequence
  chemically synthesized
aataataactaagggctaataa

SEQ ID NO: 1215398 - DNA, 22 bp, Artificial Sequence
  chemically synthesized
attgttttcccttattagccct

SEQ ID NO: 1215399 - DNA, 22 bp, Artificial Sequence
  chemically synthesized
taataataactaagggctaata

SEQ ID NO: 1215400 - DNA, 22 bp, Artificial Sequence
  chemically synthesized
ttaataataactaagggctaat

SEQ ID NO: 1215401 - DNA, 22 bp, Artificial Sequence
  chemically synthesized
ttttcccttattagcccttagt

SEQ ID NO: 1215402 - DNA, 22 bp, Artificial Sequence
  chemically synthesized
tcccttattagcccttagttat

SEQ ID NO: 1215403 - DNA, 22 bp, Artificial Sequence
  chemically synthesized
cccttattagcccttagttatt

SEQ ID NO: 1215404 - DNA, 22 bp, Artificial Sequence
  chemically synthesized
ccttattagcccttagttatta

SEQ ID NO: 1215405 - DNA, 22 bp, Artificial Sequence
  chemically synthesized
gaagaatttttaataataacta

SEQ ID NO: 1215406 - DNA, 22 bp, Artificial Sequence
  chemically synthesized
attagcccttagttattattaa

SEQ ID NO: 1215407 - DNA, 22 bp, Artificial Sequence
  chemically synthesized
ttagcccttagttattattaaa

SEQ ID NO: 1215408 - DNA, 22 bp, Artificial Sequence
  chemically synthesized
gcccttagttattattaaaaat

SEQ ID NO: 1215409 - DNA, 22 bp, Artificial Sequence
  chemically synthesized
ataaagaactagaagaattttt

SEQ ID NO: 1215410 - DNA, 22 bp, Artificial Sequence
  chemically synthesized
agttattattaaaaattcttct

SEQ ID NO: 1215411 - DNA, 22 bp, Artificial Sequence
  chemically synthesized
gttattattaaaaattcttcta

SEQ ID NO: 1215412 - DNA, 22 bp, Artificial Sequence
  chemically synthesized
ttattaaaaattcttctagttc

SEQ ID NO: 1215413 - DNA, 22 bp, Artificial Sequence
  chemically synthesized
gcagagctgataaagaactaga

SEQ ID NO: 1215414 - DNA, 22 bp, Artificial Sequence
  chemically synthesized
ttaaaaattcttctagttcttt

SEQ ID NO: 1215415 - DNA, 22 bp, Artificial Sequence
  chemically synthesized
aaaattcttctagttctttatc

SEQ ID NO: 1215416 - DNA, 22 bp, Artificial Sequence
  chemically synthesized
attggcagagctgataaagaac

SEQ ID NO: 1215417 - DNA, 22 bp, Artificial Sequence
  chemically synthesized
cattggcagagctgataaagaa

SEQ ID NO: 1215418 - DNA, 22 bp, Artificial Sequence
  chemically synthesized
tcattggcagagctgataaaga

SEQ ID NO: 1215419 - DNA, 22 bp, Artificial Sequence
  chemically synthesized
ttctagttctttatcagctctg

SEQ ID NO: 1215420 - DNA, 22 bp, Artificial Sequence
  chemically synthesized
ctagttctttatcagctctgcc

SEQ ID NO: 1215421 - DNA, 22 bp, Artificial Sequence
  chemically synthesized
tagttctttatcagctctgcca

SEQ ID NO: 1215422 - DNA, 22 bp, Artificial Sequence
  chemically synthesized
gttctttatcagctctgccaat

SEQ ID NO: 1215423 - DNA, 22 bp, Artificial Sequence
  chemically synthesized
tttatcagctctgccaatgaaa

SEQ ID NO: 1215424 - DNA, 22 bp, Artificial Sequence
  chemically synthesized
tatcagctctgccaatgaaaga

SEQ ID NO: 1215425 - DNA, 22 bp, Artificial Sequence
  chemically synthesized
atcagctctgccaatgaaagac

SEQ ID NO: 1215426 - DNA, 22 bp, Artificial Sequence
  chemically synthesized
tcagctctgccaatgaaagaca

SEQ ID NO: 1215427 - DNA, 22 bp, Artificial Sequence
  chemically synthesized
cagccaataaaaatgtctttca

SEQ ID NO: 1215428 - DNA, 22 bp, Artificial Sequence
  chemically synthesized
gcagccaataaaaatgtctttc

SEQ ID NO: 1215429 - DNA, 22 bp, Artificial Sequence
  chemically synthesized
tgcagccaataaaaatgtcttt

SEQ ID NO: 1215430 - DNA, 22 bp, Artificial Sequence
  chemically synthesized
ttgcagccaataaaaatgtctt

SEQ ID NO: 1215431 - DNA, 22 bp, Artificial Sequence
  chemically synthesized
tgccaatgaaagacatttttat

SEQ ID NO: 1215432 - DNA, 22 bp, Artificial Sequence
  chemically synthesized
ccaatgaaagacatttttattg

SEQ ID NO: 1215433 - DNA, 22 bp, Artificial Sequence
  chemically synthesized
atgccttttgcagccaataaaa

SEQ ID NO: 1215434 - DNA, 22 bp, Artificial Sequence
  chemically synthesized
ttgatgccttttgcagccaata

SEQ ID NO: 1215435 - DNA, 22 bp, Artificial Sequence
  chemically synthesized
gttgatgccttttgcagccaat

SEQ ID NO: 1215436 - DNA, 22 bp, Artificial Sequence
  chemically synthesized
aggtttgttgatgccttttgca

SEQ ID NO: 1215437 - DNA, 22 bp, Artificial Sequence
  chemically synthesized
ttattggctgcaaaaggcatca

SEQ ID NO: 1215438 - DNA, 22 bp, Artificial Sequence
  chemically synthesized
tctgaggtttgttgatgccttt

SEQ ID NO: 1215439 - DNA, 22 bp, Artificial Sequence
  chemically synthesized
tattggctgcaaaaggcatcaa

SEQ ID NO: 1215440 - DNA, 22 bp, Artificial Sequence
  chemically synthesized
attggctgcaaaaggcatcaac

SEQ ID NO: 1215441 - DNA, 22 bp, Artificial Sequence
  chemically synthesized
ttggctgcaaaaggcatcaaca

SEQ ID NO: 1215442 - DNA, 22 bp, Artificial Sequence
  chemically synthesized
ctatctgaggtttgttgatgcc

SEQ ID NO: 1215443 - DNA, 22 bp, Artificial Sequence
  chemically synthesized
tgctatctgaggtttgttgatg

SEQ ID NO: 1215444 - DNA, 22 bp, Artificial Sequence
  chemically synthesized
gctgcaaaaggcatcaacaaac

SEQ ID NO: 1215445 - DNA, 22 bp, Artificial Sequence
  chemically synthesized
caaaaggcatcaacaaacctca

SEQ ID NO: 1215446 - DNA, 22 bp, Artificial Sequence
  chemically synthesized
tgttctgctatctgaggtttgt

SEQ ID NO: 1215447 - DNA, 22 bp, Artificial Sequence
  chemically synthesized
acatcactgtgttctgctatct

SEQ ID NO: 1215448 - DNA, 22 bp, Artificial Sequence
  chemically synthesized
attgacatcactgtgttctgct

SEQ ID NO: 1215449 - DNA, 22 bp, Artificial Sequence
  chemically synthesized
ctaattgacatcactgtgttct

SEQ ID NO: 1215450 - DNA, 22 bp, Artificial Sequence
  chemically synthesized
ttactaattgacatcactgtgt

SEQ ID NO: 1215451 - DNA, 22 bp, Artificial Sequence
  chemically synthesized
gttactaattgacatcactgtg

SEQ ID NO: 1215452 - DNA, 22 bp, Artificial Sequence
  chemically synthesized
agatagcagaacacagtgatgt

SEQ ID NO: 1215453 - DNA, 22 bp, Artificial Sequence
  chemically synthesized
atcttgttactaattgacatca

SEQ ID NO: 1215454 - DNA, 22 bp, Artificial Sequence
  chemically synthesized
tcatcttgttactaattgacat

SEQ ID NO: 1215455 - DNA, 22 bp, Artificial Sequence
  chemically synthesized
tctcatcttgttactaattgac

SEQ ID NO: 1215456 - DNA, 22 bp, Artificial Sequence
  chemically synthesized
cctctctcatcttgttactaat

SEQ ID NO: 1215457 - DNA, 22 bp, Artificial Sequence
  chemically synthesized
cctgcctctctcatcttgttac

SEQ ID NO: 1215458 - DNA, 22 bp, Artificial Sequence
  chemically synthesized
gcctgcctctctcatcttgtta

SEQ ID NO: 1215459 - DNA, 22 bp, Artificial Sequence
  chemically synthesized
tgcctgcctctctcatcttgtt

SEQ ID NO: 1215460 - DNA, 22 bp, Artificial Sequence
  chemically synthesized
ttgcctgcctctctcatcttgt

SEQ ID NO: 1215461 - DNA, 22 bp, Artificial Sequence
  chemically synthesized
ttttgcctgcctctctcatctt

SEQ ID NO: 1215462 - DNA, 22 bp, Artificial Sequence
  chemically synthesized
cttttgcctgcctctctcatct

SEQ ID NO: 1215463 - DNA, 22 bp, Artificial Sequence
  chemically synthesized
ttcttttgcctgcctctctcat

SEQ ID NO: 1215464 - DNA, 22 bp, Artificial Sequence
  chemically synthesized
cttcttttgcctgcctctctca

SEQ ID NO: 1215465 - DNA, 22 bp, Artificial Sequence
  chemically synthesized
gtaacaagatgagagaggcagg

SEQ ID NO: 1215466 - DNA, 22 bp, Artificial Sequence
  chemically synthesized
tttcttcttttgcctgcctctc

SEQ ID NO: 1215467 - DNA, 22 bp, Artificial Sequence
  chemically synthesized
atttcttcttttgcctgcctct

SEQ ID NO: 1215468 - DNA, 22 bp, Artificial Sequence
  chemically synthesized
atttatttcttcttttgcctgc

SEQ ID NO: 1215469 - DNA, 22 bp, Artificial Sequence
  chemically synthesized
aatttatttcttcttttgcctg

SEQ ID NO: 1215470 - DNA, 22 bp, Artificial Sequence
  chemically synthesized
taatttatttcttcttttgcct

SEQ ID NO: 1215471 - DNA, 22 bp, Artificial Sequence
  chemically synthesized
tttaatttatttcttcttttgc

SEQ ID NO: 1215472 - DNA, 22 bp, Artificial Sequence
  chemically synthesized
ttctttaatttatttcttcttt

SEQ ID NO: 1215473 - DNA, 22 bp, Artificial Sequence
  chemically synthesized
gttctttaatttatttcttctt

SEQ ID NO: 1215474 - DNA, 22 bp, Artificial Sequence
  chemically synthesized
tgttctttaatttatttcttct

SEQ ID NO: 1215475 - DNA, 22 bp, Artificial Sequence
  chemically synthesized
tttgttctttaatttatttctt

SEQ ID NO: 1215476 - DNA, 22 bp, Artificial Sequence
  chemically synthesized
actctttgttctttaatttatt

SEQ ID NO: 1215477 - DNA, 22 bp, Artificial Sequence
  chemically synthesized
cagaggtgatccctgactcttt

SEQ ID NO: 1215478 - DNA, 22 bp, Artificial Sequence
  chemically synthesized
gcagaggtgatccctgactctt

SEQ ID NO: 1215479 - DNA, 22 bp, Artificial Sequence
  chemically synthesized
tttgcagaggtgatccctgact

SEQ ID NO: 1215480 - DNA, 22 bp, Artificial Sequence
  chemically synthesized
aagaacaaagagtcagggatca

SEQ ID NO: 1215481 - DNA, 22 bp, Artificial Sequence
  chemically synthesized
cccaggtgagaggagctgtttg

SEQ ID NO: 1215482 - DNA, 22 bp, Artificial Sequence
  chemically synthesized
tgcaaacagctcctctcacctg

SEQ ID NO: 1215483 - DNA, 22 bp, Artificial Sequence
  chemically synthesized
caaacagctcctctcacctggg

SEQ ID NO: 1215484 - DNA, 22 bp, Artificial Sequence
  chemically synthesized
cagcaagggttgcccaggtgag

SEQ ID NO: 1215485 - DNA, 22 bp, Artificial Sequence
  chemically synthesized
ccagcaagggttgcccaggtga

SEQ ID NO: 1215486 - DNA, 22 bp, Artificial Sequence
  chemically synthesized
ctctcacctgggcaacccttgc

SEQ ID NO: 1215487 - DNA, 22 bp, Artificial Sequence
  chemically synthesized
aaacagtttccagcaagggttg

SEQ ID NO: 1215488 - DNA, 22 bp, Artificial Sequence
  chemically synthesized
tcacctgggcaacccttgctgg

SEQ ID NO: 1215489 - DNA, 22 bp, Artificial Sequence
  chemically synthesized
actcaaacagtttccagcaagg

SEQ ID NO: 1215490 - DNA, 22 bp, Artificial Sequence
  chemically synthesized
acctgggcaacccttgctggaa

SEQ ID NO: 1215491 - DNA, 22 bp, Artificial Sequence
  chemically synthesized
tgactcaaacagtttccagcaa

SEQ ID NO: 1215492 - DNA, 22 bp, Artificial Sequence
  chemically synthesized
ggcaacccttgctggaaactgt

SEQ ID NO: 1215493 - DNA, 22 bp, Artificial Sequence
  chemically synthesized
gctggaaactgtttgagtcaga

SEQ ID NO: 1215494 - DNA, 22 bp, Artificial Sequence
  chemically synthesized
ctggaaactgtttgagtcagag

SEQ ID NO: 1215495 - DNA, 22 bp, Artificial Sequence
  chemically synthesized
tgatagaatggtactctgactc

SEQ ID NO: 1215496 - DNA, 22 bp, Artificial Sequence
  chemically synthesized
gtgatagaatggtactctgact

SEQ ID NO: 1215497 - DNA, 22 bp, Artificial Sequence
  chemically synthesized
gaaactgtttgagtcagagtac

SEQ ID NO: 1215498 - DNA, 22 bp, Artificial Sequence
  chemically synthesized
tttgagtcagagtaccattcta

SEQ ID NO: 1215499 - DNA, 22 bp, Artificial Sequence
  chemically synthesized
gagtcagagtaccattctatca

SEQ ID NO: 1215500 - DNA, 22 bp, Artificial Sequence
  chemically synthesized
agtcagagtaccattctatcac

SEQ ID NO: 1215501 - DNA, 22 bp, Artificial Sequence
  chemically synthesized
acggacatgtttgtgatagaat

SEQ ID NO: 1215502 - DNA, 22 bp, Artificial Sequence
  chemically synthesized
cacggacatgtttgtgatagaa

SEQ ID NO: 1215503 - DNA, 22 bp, Artificial Sequence
  chemically synthesized
cttcacggacatgtttgtgata

SEQ ID NO: 1215504 - DNA, 22 bp, Artificial Sequence
  chemically synthesized
ttgcttcacggacatgtttgtg

SEQ ID NO: 1215505 - DNA, 22 bp, Artificial Sequence
  chemically synthesized
attgcttcacggacatgtttgt

SEQ ID NO: 1215506 - DNA, 22 bp, Artificial Sequence
  chemically synthesized
tttattgcttcacggacatgtt

SEQ ID NO: 1215507 - DNA, 22 bp, Artificial Sequence
  chemically synthesized
tatttattgcttcacggacatg

SEQ ID NO: 1215508 - DNA, 22 bp, Artificial Sequence
  chemically synthesized
ctatttattgcttcacggacat

SEQ ID NO: 1215509 - DNA, 22 bp, Artificial Sequence
  chemically synthesized
tatcacaaacatgtccgtgaag

SEQ ID NO: 1215510 - DNA, 22 bp, Artificial Sequence
  chemically synthesized
ttctatttattgcttcacggac

SEQ ID NO: 1215511 - DNA, 22 bp, Artificial Sequence
  chemically synthesized
cttctatttattgcttcacgga

SEQ ID NO: 1215512 - DNA, 22 bp, Artificial Sequence
  chemically synthesized
tcacaaacatgtccgtgaagca

SEQ ID NO: 1215513 - DNA, 22 bp, Artificial Sequence
  chemically synthesized
cttcttctatttattgcttcac

SEQ ID NO: 1215514 - DNA, 22 bp, Artificial Sequence
  chemically synthesized
attccttcttctatttattgct

SEQ ID NO: 1215515 - DNA, 22 bp, Artificial Sequence
  chemically synthesized
cattccttcttctatttattgc

SEQ ID NO: 1215516 - DNA, 22 bp, Artificial Sequence
  chemically synthesized
ttcattccttcttctatttatt

SEQ ID NO: 1215517 - DNA, 22 bp, Artificial Sequence
  chemically synthesized
tcttcattccttcttctattta

SEQ ID NO: 1215518 - DNA, 22 bp, Artificial Sequence
  chemically synthesized
tctctcttcattccttcttcta

SEQ ID NO: 1215519 - DNA, 22 bp, Artificial Sequence
  chemically synthesized
cacagttgtctctcttcattcc

SEQ ID NO: 1215520 - DNA, 22 bp, Artificial Sequence
  chemically synthesized
tctgcacagttgtctctcttca

SEQ ID NO: 1215521 - DNA, 22 bp, Artificial Sequence
  chemically synthesized
ctgtctgcacagttgtctctct

SEQ ID NO: 1215522 - DNA, 22 bp, Artificial Sequence
  chemically synthesized
tctcctgtctgcacagttgtct

SEQ ID NO: 1215523 - DNA, 22 bp, Artificial Sequence
  chemically synthesized
atctcctgtctgcacagttgtc

SEQ ID NO: 1215524 - DNA, 22 bp, Artificial Sequence
  chemically synthesized
ccttatctcctgtctgcacagt

SEQ ID NO: 1215525 - DNA, 22 bp, Artificial Sequence
  chemically synthesized
gccttatctcctgtctgcacag

SEQ ID NO: 1215526 - DNA, 22 bp, Artificial Sequence
  chemically synthesized
agaaacttgccttatctcctgt

SEQ ID NO: 1215527 - DNA, 22 bp, Artificial Sequence
  chemically synthesized
ggattaagaaacttgccttatc

SEQ ID NO: 1215528 - DNA, 22 bp, Artificial Sequence
  chemically synthesized
tgcagacaggagataaggcaag

SEQ ID NO: 1215529 - DNA, 22 bp, Artificial Sequence
  chemically synthesized
aggattaagaaacttgccttat

SEQ ID NO: 1215530 - DNA, 22 bp, Artificial Sequence
  chemically synthesized
taggattaagaaacttgcctta

SEQ ID NO: 1215531 - DNA, 22 bp, Artificial Sequence
  chemically synthesized
tttaggattaagaaacttgcct

SEQ ID NO: 1215532 - DNA, 22 bp, Artificial Sequence
  chemically synthesized
tctttaggattaagaaacttgc

SEQ ID NO: 1215533 - DNA, 22 bp, Artificial Sequence
  chemically synthesized
gccatcaaaacattctctttag

SEQ ID NO: 1215534 - DNA, 22 bp, Artificial Sequence
  chemically synthesized
cttaatcctaaagagaatgttt

SEQ ID NO: 1215535 - DNA, 22 bp, Artificial Sequence
  chemically synthesized
ttaatcctaaagagaatgtttt

SEQ ID NO: 1215536 - DNA, 22 bp, Artificial Sequence
  chemically synthesized
aatcctaaagagaatgttttga

SEQ ID NO: 1215537 - DNA, 22 bp, Artificial Sequence
  chemically synthesized
atcctaaagagaatgttttgat

SEQ ID NO: 1215538 - DNA, 22 bp, Artificial Sequence
  chemically synthesized
tcacataagactggccatcaaa

SEQ ID NO: 1215539 - DNA, 22 bp, Artificial Sequence
  chemically synthesized
aagagaatgttttgatggccag

SEQ ID NO: 1215540 - DNA, 22 bp, Artificial Sequence
  chemically synthesized
gctgtcacataagactggccat

SEQ ID NO: 1215541 - DNA, 22 bp, Artificial Sequence
  chemically synthesized
tgatggccagtcttatgtgaca

SEQ ID NO: 1215542 - DNA, 22 bp, Artificial Sequence
  chemically synthesized
gatggccagtcttatgtgacag

SEQ ID NO: 1215543 - DNA, 22 bp, Artificial Sequence
  chemically synthesized
atggccagtcttatgtgacagc

SEQ ID NO: 1215544 - DNA, 22 bp, Artificial Sequence
  chemically synthesized
atgtgacagctagtctattttt

SEQ ID NO: 1215545 - DNA, 22 bp, Artificial Sequence
  chemically synthesized
tgtgacagctagtctattttta

SEQ ID NO: 1215546 - DNA, 22 bp, Artificial Sequence
  chemically synthesized
atccacagacaaagtaaaaata

SEQ ID NO: 1215547 - DNA, 22 bp, Artificial Sequence
  chemically synthesized
ttcatccacagacaaagtaaaa

SEQ ID NO: 1215548 - DNA, 22 bp, Artificial Sequence
  chemically synthesized
gtctatttttactttgtctgtg

SEQ ID NO: 1215549 - DNA, 22 bp, Artificial Sequence
  chemically synthesized
tttttactttgtctgtggatga

SEQ ID NO: 1215550 - DNA, 22 bp, Artificial Sequence
  chemically synthesized
atgagaaattgttcatccacag

SEQ ID NO: 1215551 - DNA, 22 bp, Artificial Sequence
  chemically synthesized
ttactttgtctgtggatgaaca

SEQ ID NO: 1215552 - DNA, 22 bp, Artificial Sequence
  chemically synthesized
ttaatgagaaattgttcatcca

SEQ ID NO: 1215553 - DNA, 22 bp, Artificial Sequence
  chemically synthesized
tactttgtctgtggatgaacaa

SEQ ID NO: 1215554 - DNA, 22 bp, Artificial Sequence
  chemically synthesized
actttgtctgtggatgaacaat

SEQ ID NO: 1215555 - DNA, 22 bp, Artificial Sequence
  chemically synthesized
tgttaatgagaaattgttcatc

SEQ ID NO: 1215556 - DNA, 22 bp, Artificial Sequence
  chemically synthesized
ctttgtctgtggatgaacaatt

SEQ ID NO: 1215557 - DNA, 22 bp, Artificial Sequence
  chemically synthesized
tgtctgtggatgaacaatttct

SEQ ID NO: 1215558 - DNA, 22 bp, Artificial Sequence
  chemically synthesized
gtctgtggatgaacaatttctc

SEQ ID NO: 1215559 - DNA, 22 bp, Artificial Sequence
  chemically synthesized
tctgtggatgaacaatttctca

SEQ ID NO: 1215560 - DNA, 22 bp, Artificial Sequence
  chemically synthesized
acagttctgttaatgagaaatt

SEQ ID NO: 1215561 - DNA, 22 bp, Artificial Sequence
  chemically synthesized
tggatgaacaatttctcattaa

SEQ ID NO: 1215562 - DNA, 22 bp, Artificial Sequence
  chemically synthesized
ctaacagttctgttaatgagaa

SEQ ID NO: 1215563 - DNA, 22 bp, Artificial Sequence
  chemically synthesized
ttgctaacagttctgttaatga

SEQ ID NO: 1215564 - DNA, 22 bp, Artificial Sequence
  chemically synthesized
attgctaacagttctgttaatg

SEQ ID NO: 1215565 - DNA, 22 bp, Artificial Sequence
  chemically synthesized
cttattgctaacagttctgtta

SEQ ID NO: 1215566 - DNA, 22 bp, Artificial Sequence
  chemically synthesized
ctcattaacagaactgttagca

SEQ ID NO: 1215567 - DNA, 22 bp, Artificial Sequence
  chemically synthesized
tcattaacagaactgttagcaa

SEQ ID NO: 1215568 - DNA, 22 bp, Artificial Sequence
  chemically synthesized
gagtactgcttattgctaacag

SEQ ID NO: 1215569 - DNA, 22 bp, Artificial Sequence
  chemically synthesized
attaacagaactgttagcaata

SEQ ID NO: 1215570 - DNA, 22 bp, Artificial Sequence
  chemically synthesized
ctggagtactgcttattgctaa

SEQ ID NO: 1215571 - DNA, 22 bp, Artificial Sequence
  chemically synthesized
acagaactgttagcaataagca

SEQ ID NO: 1215572 - DNA, 22 bp, Artificial Sequence
  chemically synthesized
aattactggagtactgcttatt

SEQ ID NO: 1215573 - DNA, 22 bp, Artificial Sequence
  chemically synthesized
caattactggagtactgcttat

SEQ ID NO: 1215574 - DNA, 22 bp, Artificial Sequence
  chemically synthesized
ttagcaataagcagtactccag

SEQ ID NO: 1215575 - DNA, 22 bp, Artificial Sequence
  chemically synthesized
acatcttcaattactggagtac

SEQ ID NO: 1215576 - DNA, 22 bp, Artificial Sequence
  chemically synthesized
gcaataagcagtactccagtaa

SEQ ID NO: 1215577 - DNA, 22 bp, Artificial Sequence
  chemically synthesized
ttcacatcttcaattactggag

SEQ ID NO: 1215578 - DNA, 22 bp, Artificial Sequence
  chemically synthesized
ctgttcacatcttcaattactg

SEQ ID NO: 1215579 - DNA, 22 bp, Artificial Sequence
  chemically synthesized
agcctgctgttcacatcttcaa

SEQ ID NO: 1215580 - DNA, 22 bp, Artificial Sequence
  chemically synthesized
cagtaattgaagatgtgaacag

SEQ ID NO: 1215581 - DNA, 22 bp, Artificial Sequence
  chemically synthesized
aaaaatgactaagcctgctgtt

SEQ ID NO: 1215582 - DNA, 22 bp, Artificial Sequence
  chemically synthesized
aaaaaatgactaagcctgctgt

SEQ ID NO: 1215583 - DNA, 22 bp, Artificial Sequence
  chemically synthesized
aagatgtgaacagcaggcttag

SEQ ID NO: 1215584 - DNA, 22 bp, Artificial Sequence
  chemically synthesized
cttaaaaaatgactaagcctgc

SEQ ID NO: 1215585 - DNA, 22 bp, Artificial Sequence
  chemically synthesized
ccttaaaaaatgactaagcctg

SEQ ID NO: 1215586 - DNA, 22 bp, Artificial Sequence
  chemically synthesized
ttccttaaaaaatgactaagcc

SEQ ID NO: 1215587 - DNA, 22 bp, Artificial Sequence
  chemically synthesized
cttccttaaaaaatgactaagc

SEQ ID NO: 1215588 - DNA, 22 bp, Artificial Sequence
  chemically synthesized
tcttccttaaaaaatgactaag

SEQ ID NO: 1215589 - DNA, 22 bp, Artificial Sequence
  chemically synthesized
gcattttcttccttaaaaaatg

SEQ ID NO: 1215590 - DNA, 22 bp, Artificial Sequence
  chemically synthesized
tagcattttcttccttaaaaaa

SEQ ID NO: 1215591 - DNA, 22 bp, Artificial Sequence
  chemically synthesized
ctagcattttcttccttaaaaa

SEQ ID NO: 1215592 - DNA, 22 bp, Artificial Sequence
  chemically synthesized
gacttctagcattttcttcctt

SEQ ID NO: 1215593 - DNA, 22 bp, Artificial Sequence
  chemically synthesized
agtcattttttaaggaagaaaa

SEQ ID NO: 1215594 - DNA, 22 bp, Artificial Sequence
  chemically synthesized
agacttctagcattttcttcct

SEQ ID NO: 1215595 - DNA, 22 bp, Artificial Sequence
  chemically synthesized
gtcattttttaaggaagaaaat

SEQ ID NO: 1215596 - DNA, 22 bp, Artificial Sequence
  chemically synthesized
tttagacttctagcattttctt

SEQ ID NO: 1215597 - DNA, 22 bp, Artificial Sequence
  chemically synthesized
gtttagacttctagcattttct

SEQ ID NO: 1215598 - DNA, 22 bp, Artificial Sequence
  chemically synthesized
tttaaggaagaaaatgctagaa

SEQ ID NO: 1215599 - DNA, 22 bp, Artificial Sequence
  chemically synthesized
ttaaggaagaaaatgctagaag

SEQ ID NO: 1215600 - DNA, 22 bp, Artificial Sequence
  chemically synthesized
taaggaagaaaatgctagaagt

SEQ ID NO: 1215601 - DNA, 22 bp, Artificial Sequence
  chemically synthesized
aaggaagaaaatgctagaagtc

SEQ ID NO: 1215602 - DNA, 22 bp, Artificial Sequence
  chemically synthesized
aggaagaaaatgctagaagtct

SEQ ID NO: 1215603 - DNA, 22 bp, Artificial Sequence
  chemically synthesized
tcccagcatttgtttagacttc

SEQ ID NO: 1215604 - DNA, 22 bp, Artificial Sequence
  chemically synthesized
ttgtcccagcatttgtttagac

SEQ ID NO: 1215605 - DNA, 22 bp, Artificial Sequence
  chemically synthesized
gaagtctaaacaaatgctggga

SEQ ID NO: 1215606 - DNA, 22 bp, Artificial Sequence
  chemically synthesized
aacaaatgctgggacaacagat

SEQ ID NO: 1215607 - DNA, 22 bp, Artificial Sequence
  chemically synthesized
taggataagatccagaatctgt

SEQ ID NO: 1215608 - DNA, 22 bp, Artificial Sequence
  chemically synthesized
ataggataagatccagaatctg

SEQ ID NO: 1215609 - DNA, 22 bp, Artificial Sequence
  chemically synthesized
tataggataagatccagaatct

SEQ ID NO: 1215610 - DNA, 22 bp, Artificial Sequence
  chemically synthesized
ttataggataagatccagaatc

SEQ ID NO: 1215611 - DNA, 22 bp, Artificial Sequence
  chemically synthesized
ggacaacagattctggatctta

SEQ ID NO: 1215612 - DNA, 22 bp, Artificial Sequence
  chemically synthesized
tgagatatgcccttttatagga

SEQ ID NO: 1215613 - DNA, 22 bp, Artificial Sequence
  chemically synthesized
tgtgagatatgcccttttatag

SEQ ID NO: 1215614 - DNA, 22 bp, Artificial Sequence
  chemically synthesized
tggatcttatcctataaaaggg

SEQ ID NO: 1215615 - DNA, 22 bp, Artificial Sequence
  chemically synthesized
ctgtgagatatgcccttttata

SEQ ID NO: 1215616 - DNA, 22 bp, Artificial Sequence
  chemically synthesized
gatcttatcctataaaagggca

SEQ ID NO: 1215617 - DNA, 22 bp, Artificial Sequence
  chemically synthesized
tttctgtgagatatgccctttt

SEQ ID NO: 1215618 - DNA, 22 bp, Artificial Sequence
  chemically synthesized
atcctataaaagggcatatctc

SEQ ID NO: 1215619 - DNA, 22 bp, Artificial Sequence
  chemically synthesized
tcctataaaagggcatatctca

SEQ ID NO: 1215620 - DNA, 22 bp, Artificial Sequence
  chemically synthesized
taaaagggcatatctcacagaa

SEQ ID NO: 1215621 - DNA, 22 bp, Artificial Sequence
  chemically synthesized
caatggaacaattgtttctgtg

SEQ ID NO: 1215622 - DNA, 22 bp, Artificial Sequence
  chemically synthesized
acagaaacaattgttccattgt

SEQ ID NO: 1215623 - DNA, 22 bp, Artificial Sequence
  chemically synthesized
agatagaaacaactacaatgga

SEQ ID NO: 1215624 - DNA, 22 bp, Artificial Sequence
  chemically synthesized
cagctaagatagaaacaactac

SEQ ID NO: 1215625 - DNA, 22 bp, Artificial Sequence
  chemically synthesized
ttccattgtagttgtttctatc

SEQ ID NO: 1215626 - DNA, 22 bp, Artificial Sequence
  chemically synthesized
cattgtagttgtttctatctta

SEQ ID NO: 1215627 - DNA, 22 bp, Artificial Sequence
  chemically synthesized
tagttgtttctatcttagctgc

SEQ ID NO: 1215628 - DNA, 22 bp, Artificial Sequence
  chemically synthesized
tttctatcttagctgcaggata

SEQ ID NO: 1215629 - DNA, 22 bp, Artificial Sequence
  chemically synthesized
agtaagtgagagtatcctgcag

SEQ ID NO: 1215630 - DNA, 22 bp, Artificial Sequence
  chemically synthesized
ctatcttagctgcaggatactc

SEQ ID NO: 1215631 - DNA, 22 bp, Artificial Sequence
  chemically synthesized
tatcttagctgcaggatactct

SEQ ID NO: 1215632 - DNA, 22 bp, Artificial Sequence
  chemically synthesized
tcttagctgcaggatactctca

SEQ ID NO: 1215633 - DNA, 22 bp, Artificial Sequence
  chemically synthesized
gaagctcagtaagtgagagtat

SEQ ID NO: 1215634 - DNA, 22 bp, Artificial Sequence
  chemically synthesized
agaagctcagtaagtgagagta

SEQ ID NO: 1215635 - DNA, 22 bp, Artificial Sequence
  chemically synthesized
tagaagctcagtaagtgagagt

SEQ ID NO: 1215636 - DNA, 22 bp, Artificial Sequence
  chemically synthesized
agctgcaggatactctcactta

SEQ ID NO: 1215637 - DNA, 22 bp, Artificial Sequence
  chemically synthesized
ttagaagctcagtaagtgagag

SEQ ID NO: 1215638 - DNA, 22 bp, Artificial Sequence
  chemically synthesized
gctgcaggatactctcacttac

SEQ ID NO: 1215639 - DNA, 22 bp, Artificial Sequence
  chemically synthesized
caggatactctcacttactgag

SEQ ID NO: 1215640 - DNA, 22 bp, Artificial Sequence
  chemically synthesized
tcacttactgagcttctaaaaa

SEQ ID NO: 1215641 - DNA, 22 bp, Artificial Sequence
  chemically synthesized
tgacatcagcaatttttagaag

SEQ ID NO: 1215642 - DNA, 22 bp, Artificial Sequence
  chemically synthesized
acttactgagcttctaaaaatt

SEQ ID NO: 1215643 - DNA, 22 bp, Artificial Sequence
  chemically synthesized
actgagcttctaaaaattgctg

SEQ ID NO: 1215644 - DNA, 22 bp, Artificial Sequence
  chemically synthesized
ctgagcttctaaaaattgctga

SEQ ID NO: 1215645 - DNA, 22 bp, Artificial Sequence
  chemically synthesized
agcttctaaaaattgctgatgt

SEQ ID NO: 1215646 - DNA, 22 bp, Artificial Sequence
  chemically synthesized
aggacgggctgtgacatcagca

SEQ ID NO: 1215647 - DNA, 22 bp, Artificial Sequence
  chemically synthesized
ctaaaaattgctgatgtcacag

SEQ ID NO: 1215648 - DNA, 22 bp, Artificial Sequence
  chemically synthesized
actgaggacgggctgtgacatc

SEQ ID NO: 1215649 - DNA, 22 bp, Artificial Sequence
  chemically synthesized
taaaaattgctgatgtcacagc

SEQ ID NO: 1215650 - DNA, 22 bp, Artificial Sequence
  chemically synthesized
cactgaggacgggctgtgacat

SEQ ID NO: 1215651 - DNA, 22 bp, Artificial Sequence
  chemically synthesized
aaaattgctgatgtcacagccc

SEQ ID NO: 1215652 - DNA, 22 bp, Artificial Sequence
  chemically synthesized
tttcactgaggacgggctgtga

SEQ ID NO: 1215653 - DNA, 22 bp, Artificial Sequence
  chemically synthesized
atttcactgaggacgggctgtg

SEQ ID NO: 1215654 - DNA, 22 bp, Artificial Sequence
  chemically synthesized
tatttcactgaggacgggctgt

SEQ ID NO: 1215655 - DNA, 22 bp, Artificial Sequence
  chemically synthesized
ctgatgtcacagcccgtcctca

SEQ ID NO: 1215656 - DNA, 22 bp, Artificial Sequence
  chemically synthesized
gtattttatttcactgaggacg

SEQ ID NO: 1215657 - DNA, 22 bp, Artificial Sequence
  chemically synthesized
atgtcacagcccgtcctcagtg

SEQ ID NO: 1215658 - DNA, 22 bp, Artificial Sequence
  chemically synthesized
aaactagtattttatttcactg

SEQ ID NO: 1215659 - DNA, 22 bp, Artificial Sequence
  chemically synthesized
ggattgaaactagtattttatt

SEQ ID NO: 1215660 - DNA, 22 bp, Artificial Sequence
  chemically synthesized
agtgaaataaaatactagtttc

SEQ ID NO: 1215661 - DNA, 22 bp, Artificial Sequence
  chemically synthesized
tggcaacactgggattgaaact

SEQ ID NO: 1215662 - DNA, 22 bp, Artificial Sequence
  chemically synthesized
atggcaacactgggattgaaac

SEQ ID NO: 1215663 - DNA, 22 bp, Artificial Sequence
  chemically synthesized
tatggcaacactgggattgaaa

SEQ ID NO: 1215664 - DNA, 22 bp, Artificial Sequence
  chemically synthesized
gggaagctttatggcaacactg

SEQ ID NO: 1215665 - DNA, 22 bp, Artificial Sequence
  chemically synthesized
gtttcaatcccagtgttgccat

SEQ ID NO: 1215666 - DNA, 22 bp, Artificial Sequence
  chemically synthesized
caatcccagtgttgccataaag

SEQ ID NO: 1215667 - DNA, 22 bp, Artificial Sequence
  chemically synthesized
aatcccagtgttgccataaagc

SEQ ID NO: 1215668 - DNA, 22 bp, Artificial Sequence
  chemically synthesized
tccaataaaatcggttggggaa

SEQ ID NO: 1215669 - DNA, 22 bp, Artificial Sequence
  chemically synthesized
ccataaagcttccccaaccgat

SEQ ID NO: 1215670 - DNA, 22 bp, Artificial Sequence
  chemically synthesized
acaagactgtccaataaaatcg

SEQ ID NO: 1215671 - DNA, 22 bp, Artificial Sequence
  chemically synthesized
tcacaagactgtccaataaaat

SEQ ID NO: 1215672 - DNA, 22 bp, Artificial Sequence
  chemically synthesized
ctcacaagactgtccaataaaa

SEQ ID NO: 1215673 - DNA, 22 bp, Artificial Sequence
  chemically synthesized
ccccaaccgattttattggaca

SEQ ID NO: 1215674 - DNA, 22 bp, Artificial Sequence
  chemically synthesized
cccaaccgattttattggacag

SEQ ID NO: 1215675 - DNA, 22 bp, Artificial Sequence
  chemically synthesized
tttctcacaagactgtccaata

SEQ ID NO: 1215676 - DNA, 22 bp, Artificial Sequence
  chemically synthesized
tattggacagtcttgtgagaaa

SEQ ID NO: 1215677 - DNA, 22 bp, Artificial Sequence
  chemically synthesized
aagtccgtgttatttctcacaa

SEQ ID NO: 1215678 - DNA, 22 bp, Artificial Sequence
  chemically synthesized
attggacagtcttgtgagaaat

SEQ ID NO: 1215679 - DNA, 22 bp, Artificial Sequence
  chemically synthesized
aaagtccgtgttatttctcaca

SEQ ID NO: 1215680 - DNA, 22 bp, Artificial Sequence
  chemically synthesized
ttggacagtcttgtgagaaata

SEQ ID NO: 1215681 - DNA, 22 bp, Artificial Sequence
  chemically synthesized
ttaaagtccgtgttatttctca

SEQ ID NO: 1215682 - DNA, 22 bp, Artificial Sequence
  chemically synthesized
cttaaagtccgtgttatttctc

SEQ ID NO: 1215683 - DNA, 22 bp, Artificial Sequence
  chemically synthesized
gacagtcttgtgagaaataaca

SEQ ID NO: 1215684 - DNA, 22 bp, Artificial Sequence
  chemically synthesized
ttcttaaagtccgtgttatttc

SEQ ID NO: 1215685 - DNA, 22 bp, Artificial Sequence
  chemically synthesized
tctcttcttaaagtccgtgtta

SEQ ID NO: 1215686 - DNA, 22 bp, Artificial Sequence
  chemically synthesized
atctcttcttaaagtccgtgtt

SEQ ID NO: 1215687 - DNA, 22 bp, Artificial Sequence
  chemically synthesized
gtgagaaataacacggacttta

SEQ ID NO: 1215688 - DNA, 22 bp, Artificial Sequence
  chemically synthesized
tgagaaataacacggactttaa

SEQ ID NO: 1215689 - DNA, 22 bp, Artificial Sequence
  chemically synthesized
taatcaaatccagggtttatct

SEQ ID NO: 1215690 - DNA, 22 bp, Artificial Sequence
  chemically synthesized
taagaagagataaaccctggat

SEQ ID NO: 1215691 - DNA, 22 bp, Artificial Sequence
  chemically synthesized
agctataatcaaatccagggtt

SEQ ID NO: 1215692 - DNA, 22 bp, Artificial Sequence
  chemically synthesized
aagaagagataaaccctggatt

SEQ ID NO: 1215693 - DNA, 22 bp, Artificial Sequence
  chemically synthesized
agaagagataaaccctggattt

SEQ ID NO: 1215694 - DNA, 22 bp, Artificial Sequence
  chemically synthesized
gatttgattatagctcagttat

SEQ ID NO: 1215695 - DNA, 22 bp, Artificial Sequence
  chemically synthesized
gattatagctcagttatctatt

SEQ ID NO: 1215696 - DNA, 22 bp, Artificial Sequence
  chemically synthesized
attatagctcagttatctattg

SEQ ID NO: 1215697 - DNA, 22 bp, Artificial Sequence
  chemically synthesized
tagctcagttatctattggctg

SEQ ID NO: 1215698 - DNA, 22 bp, Artificial Sequence
  chemically synthesized
aaatcaagatcacacagccaat

SEQ ID NO: 1215699 - DNA, 22 bp, Artificial Sequence
  chemically synthesized
ttaaaatcaagatcacacagcc

SEQ ID NO: 1215700 - DNA, 22 bp, Artificial Sequence
  chemically synthesized
agttatctattggctgtgtgat

SEQ ID NO: 1215701 - DNA, 22 bp, Artificial Sequence
  chemically synthesized
attaaaatcaagatcacacagc

SEQ ID NO: 1215702 - DNA, 22 bp, Artificial Sequence
  chemically synthesized
tattaaaatcaagatcacacag

SEQ ID NO: 1215703 - DNA, 22 bp, Artificial Sequence
  chemically synthesized
tctattggctgtgtgatcttga

SEQ ID NO: 1215704 - DNA, 22 bp, Artificial Sequence
  chemically synthesized
ttggctgtgtgatcttgatttt

SEQ ID NO: 1215705 - DNA, 22 bp, Artificial Sequence
  chemically synthesized
gagagctttattaaaatcaaga

SEQ ID NO: 1215706 - DNA, 22 bp, Artificial Sequence
  chemically synthesized
agagagctttattaaaatcaag

SEQ ID NO: 1215707 - DNA, 22 bp, Artificial Sequence
  chemically synthesized
gctgtgtgatcttgattttaat

SEQ ID NO: 1215708 - DNA, 22 bp, Artificial Sequence
  chemically synthesized
tgtgatcttgattttaataaag

SEQ ID NO: 1215709 - DNA, 22 bp, Artificial Sequence
  chemically synthesized
aggcttagagagctttattaaa

SEQ ID NO: 1215710 - DNA, 22 bp, Artificial Sequence
  chemically synthesized
gattttaataaagctctctaag

SEQ ID NO: 1215711 - DNA, 22 bp, Artificial Sequence
  chemically synthesized
attttaataaagctctctaagc

SEQ ID NO: 1215712 - DNA, 22 bp, Artificial Sequence
  chemically synthesized
taataaagctctctaagcctca

SEQ ID NO: 1215713 - DNA, 22 bp, Artificial Sequence
  chemically synthesized
aataaagctctctaagcctcag

SEQ ID NO: 1215714 - DNA, 22 bp, Artificial Sequence
  chemically synthesized
taaatggaaaaactgaggctta

SEQ ID NO: 1215715 - DNA, 22 bp, Artificial Sequence
  chemically synthesized
ataaagctctctaagcctcagt

SEQ ID NO: 1215716 - DNA, 22 bp, Artificial Sequence
  chemically synthesized
ataaatggaaaaactgaggctt

SEQ ID NO: 1215717 - DNA, 22 bp, Artificial Sequence
  chemically synthesized
tataaatggaaaaactgaggct

SEQ ID NO: 1215718 - DNA, 22 bp, Artificial Sequence
  chemically synthesized
ttataaatggaaaaactgaggc

SEQ ID NO: 1215719 - DNA, 22 bp, Artificial Sequence
  chemically synthesized
ttttataaatggaaaaactgag

SEQ ID NO: 1215720 - DNA, 22 bp, Artificial Sequence
  chemically synthesized
cttttataaatggaaaaactga

SEQ ID NO: 1215721 - DNA, 22 bp, Artificial Sequence
  chemically synthesized
tctaagcctcagtttttccatt

SEQ ID NO: 1215722 - DNA, 22 bp, Artificial Sequence
  chemically synthesized
tccttcttttataaatggaaaa

SEQ ID NO: 1215723 - DNA, 22 bp, Artificial Sequence
  chemically synthesized
taagcctcagtttttccattta

SEQ ID NO: 1215724 - DNA, 22 bp, Artificial Sequence
  chemically synthesized
atccttcttttataaatggaaa

SEQ ID NO: 1215725 - DNA, 22 bp, Artificial Sequence
  chemically synthesized
agcctcagtttttccatttata

SEQ ID NO: 1215726 - DNA, 22 bp, Artificial Sequence
  chemically synthesized
agtttttccatttataaaagaa

SEQ ID NO: 1215727 - DNA, 22 bp, Artificial Sequence
  chemically synthesized
caggtaagtttatccttctttt

SEQ ID NO: 1215728 - DNA, 22 bp, Artificial Sequence
  chemically synthesized
ttccatttataaaagaaggata

SEQ ID NO: 1215729 - DNA, 22 bp, Artificial Sequence
  chemically synthesized
tccatttataaaagaaggataa

SEQ ID NO: 1215730 - DNA, 22 bp, Artificial Sequence
  chemically synthesized
ccatttataaaagaaggataaa

SEQ ID NO: 1215731 - DNA, 22 bp, Artificial Sequence
  chemically synthesized
catttataaaagaaggataaac

SEQ ID NO: 1215732 - DNA, 22 bp, Artificial Sequence
  chemically synthesized
ataaaagaaggataaacttacc

SEQ ID NO: 1215733 - DNA, 22 bp, Artificial Sequence
  chemically synthesized
taaaagaaggataaacttacct

SEQ ID NO: 1215734 - DNA, 22 bp, Artificial Sequence
  chemically synthesized
tacacaacaattccaggtaagt

SEQ ID NO: 1215735 - DNA, 22 bp, Artificial Sequence
  chemically synthesized
gtacacaacaattccaggtaag

SEQ ID NO: 1215736 - DNA, 22 bp, Artificial Sequence
  chemically synthesized
tgtcttgtacacaacaattcca

SEQ ID NO: 1215737 - DNA, 22 bp, Artificial Sequence
  chemically synthesized
atgtcttgtacacaacaattcc

SEQ ID NO: 1215738 - DNA, 22 bp, Artificial Sequence
  chemically synthesized
tcttatgtcttgtacacaacaa

SEQ ID NO: 1215739 - DNA, 22 bp, Artificial Sequence
  chemically synthesized
atcttatgtcttgtacacaaca

SEQ ID NO: 1215740 - DNA, 22 bp, Artificial Sequence
  chemically synthesized
tatcttatgtcttgtacacaac

SEQ ID NO: 1215741 - DNA, 22 bp, Artificial Sequence
  chemically synthesized
acctggaattgttgtgtacaag

SEQ ID NO: 1215742 - DNA, 22 bp, Artificial Sequence
  chemically synthesized
cctggaattgttgtgtacaaga

SEQ ID NO: 1215743 - DNA, 22 bp, Artificial Sequence
  chemically synthesized
gaattgttgtgtacaagacata

SEQ ID NO: 1215744 - DNA, 22 bp, Artificial Sequence
  chemically synthesized
catactttatcttatgtcttgt

SEQ ID NO: 1215745 - DNA, 22 bp, Artificial Sequence
  chemically synthesized
ccatactttatcttatgtcttg

SEQ ID NO: 1215746 - DNA, 22 bp, Artificial Sequence
  chemically synthesized
ttgtgtacaagacataagataa

SEQ ID NO: 1215747 - DNA, 22 bp, Artificial Sequence
  chemically synthesized
tgtacaagacataagataaagt

SEQ ID NO: 1215748 - DNA, 22 bp, Artificial Sequence
  chemically synthesized
gataatttccatactttatctt

SEQ ID NO: 1215749 - DNA, 22 bp, Artificial Sequence
  chemically synthesized
tagataatttccatactttatc

SEQ ID NO: 1215750 - DNA, 22 bp, Artificial Sequence
  chemically synthesized
agtagggcagtcatgttctaga

SEQ ID NO: 1215751 - DNA, 22 bp, Artificial Sequence
  chemically synthesized
aagtagggcagtcatgttctag

SEQ ID NO: 1215752 - DNA, 22 bp, Artificial Sequence
  chemically synthesized
tctagaacatgactgccctact

SEQ ID NO: 1215753 - DNA, 22 bp, Artificial Sequence
  chemically synthesized
gaacatgactgccctacttaaa

SEQ ID NO: 1215754 - DNA, 22 bp, Artificial Sequence
  chemically synthesized
gtagaagagtgcaaatgtttaa

SEQ ID NO: 1215755 - DNA, 22 bp, Artificial Sequence
  chemically synthesized
ggtagaagagtgcaaatgttta

SEQ ID NO: 1215756 - DNA, 22 bp, Artificial Sequence
  chemically synthesized
tggtagaagagtgcaaatgttt

SEQ ID NO: 1215757 - DNA, 22 bp, Artificial Sequence
  chemically synthesized
ttggtagaagagtgcaaatgtt

SEQ ID NO: 1215758 - DNA, 22 bp, Artificial Sequence
  chemically synthesized
ccctacttaaacatttgcactc

SEQ ID NO: 1215759 - DNA, 22 bp, Artificial Sequence
  chemically synthesized
cttttggtagaagagtgcaaat

SEQ ID NO: 1215760 - DNA, 22 bp, Artificial Sequence
  chemically synthesized
cttaaacatttgcactcttcta

SEQ ID NO: 1215761 - DNA, 22 bp, Artificial Sequence
  chemically synthesized
caagttccttttggtagaagag

SEQ ID NO: 1215762 - DNA, 22 bp, Artificial Sequence
  chemically synthesized
aaacatttgcactcttctacca

SEQ ID NO: 1215763 - DNA, 22 bp, Artificial Sequence
  chemically synthesized
gcaagttccttttggtagaaga

SEQ ID NO: 1215764 - DNA, 22 bp, Artificial Sequence
  chemically synthesized
aacatttgcactcttctaccaa

SEQ ID NO: 1215765 - DNA, 22 bp, Artificial Sequence
  chemically synthesized
aaatttgcaagttccttttggt

SEQ ID NO: 1215766 - DNA, 22 bp, Artificial Sequence
  chemically synthesized
gcactcttctaccaaaaggaac

SEQ ID NO: 1215767 - DNA, 22 bp, Artificial Sequence
  chemically synthesized
cactcttctaccaaaaggaact

SEQ ID NO: 1215768 - DNA, 22 bp, Artificial Sequence
  chemically synthesized
ttctaccaaaaggaacttgcaa

SEQ ID NO: 1215769 - DNA, 22 bp, Artificial Sequence
  chemically synthesized
ctaccaaaaggaacttgcaaat

SEQ ID NO: 1215770 - DNA, 22 bp, Artificial Sequence
  chemically synthesized
taccaaaaggaacttgcaaatt

SEQ ID NO: 1215771 - DNA, 22 bp, Artificial Sequence
  chemically synthesized
ccaaaaggaacttgcaaatttg

SEQ ID NO: 1215772 - DNA, 22 bp, Artificial Sequence
  chemically synthesized
tcatcagtgatataaactcaaa

SEQ ID NO: 1215773 - DNA, 22 bp, Artificial Sequence
  chemically synthesized
atcatcagtgatataaactcaa

SEQ ID NO: 1215774 - DNA, 22 bp, Artificial Sequence
  chemically synthesized
atttatcatcagtgatataaac

SEQ ID NO: 1215775 - DNA, 22 bp, Artificial Sequence
  chemically synthesized
gcaaatttgagtttatatcact

SEQ ID NO: 1215776 - DNA, 22 bp, Artificial Sequence
  chemically synthesized
taatttatcatcagtgatataa

SEQ ID NO: 1215777 - DNA, 22 bp, Artificial Sequence
  chemically synthesized
caaatttgagtttatatcactg

SEQ ID NO: 1215778 - DNA, 22 bp, Artificial Sequence
  chemically synthesized
ctaatttatcatcagtgatata

SEQ ID NO: 1215779 - DNA, 22 bp, Artificial Sequence
  chemically synthesized
tctaatttatcatcagtgatat

SEQ ID NO: 1215780 - DNA, 22 bp, Artificial Sequence
  chemically synthesized
ttctaatttatcatcagtgata

SEQ ID NO: 1215781 - DNA, 22 bp, Artificial Sequence
  chemically synthesized
gagtttatatcactgatgataa

SEQ ID NO: 1215782 - DNA, 22 bp, Artificial Sequence
  chemically synthesized
agtttatatcactgatgataaa

SEQ ID NO: 1215783 - DNA, 22 bp, Artificial Sequence
  chemically synthesized
caaagatttttctaatttatca

SEQ ID NO: 1215784 - DNA, 22 bp, Artificial Sequence
  chemically synthesized
atatcactgatgataaattaga

SEQ ID NO: 1215785 - DNA, 22 bp, Artificial Sequence
  chemically synthesized
tatcactgatgataaattagaa

SEQ ID NO: 1215786 - DNA, 22 bp, Artificial Sequence
  chemically synthesized
ccctgcaaagatttttctaatt

SEQ ID NO: 1215787 - DNA, 22 bp, Artificial Sequence
  chemically synthesized
cccctgcaaagatttttctaat

SEQ ID NO: 1215788 - DNA, 22 bp, Artificial Sequence
  chemically synthesized
tcccctgcaaagatttttctaa

SEQ ID NO: 1215789 - DNA, 22 bp, Artificial Sequence
  chemically synthesized
ttcccctgcaaagatttttcta

SEQ ID NO: 1215790 - DNA, 22 bp, Artificial Sequence
  chemically synthesized
atgataaattagaaaaatcttt

SEQ ID NO: 1215791 - DNA, 22 bp, Artificial Sequence
  chemically synthesized
gaaaaatctttgcaggggaaaa

SEQ ID NO: 1215792 - DNA, 22 bp, Artificial Sequence
  chemically synthesized
aaatcaaagcacatttttcccc

SEQ ID NO: 1215793 - DNA, 22 bp, Artificial Sequence
  chemically synthesized
caaatcaaagcacatttttccc

SEQ ID NO: 1215794 - DNA, 22 bp, Artificial Sequence
  chemically synthesized
cttcaaatcaaagcacattttt

SEQ ID NO: 1215795 - DNA, 22 bp, Artificial Sequence
  chemically synthesized
gcttcaaatcaaagcacatttt

SEQ ID NO: 1215796 - DNA, 22 bp, Artificial Sequence
  chemically synthesized
tgcttcaaatcaaagcacattt

SEQ ID NO: 1215797 - DNA, 22 bp, Artificial Sequence
  chemically synthesized
ttgcttcaaatcaaagcacatt

SEQ ID NO: 1215798 - DNA, 22 bp, Artificial Sequence
  chemically synthesized
tgcaggggaaaaatgtgctttg

SEQ ID NO: 1215799 - DNA, 22 bp, Artificial Sequence
  chemically synthesized
gcaggggaaaaatgtgctttga

SEQ ID NO: 1215800 - DNA, 22 bp, Artificial Sequence
  chemically synthesized
caggggaaaaatgtgctttgat

SEQ ID NO: 1215801 - DNA, 22 bp, Artificial Sequence
  chemically synthesized
aataaacttttgcttcaaatca

SEQ ID NO: 1215802 - DNA, 22 bp, Artificial Sequence
  chemically synthesized
ctgaataaacttttgcttcaaa

SEQ ID NO: 1215803 - DNA, 22 bp, Artificial Sequence
  chemically synthesized
atattgctgaataaacttttgc

SEQ ID NO: 1215804 - DNA, 22 bp, Artificial Sequence
  chemically synthesized
tgatttgaagcaaaagtttatt

SEQ ID NO: 1215805 - DNA, 22 bp, Artificial Sequence
  chemically synthesized
gatttgaagcaaaagtttattc

SEQ ID NO: 1215806 - DNA, 22 bp, Artificial Sequence
  chemically synthesized
atttgaagcaaaagtttattca

SEQ ID NO: 1215807 - DNA, 22 bp, Artificial Sequence
  chemically synthesized
gaagcaaaagtttattcagcaa

SEQ ID NO: 1215808 - DNA, 22 bp, Artificial Sequence
  chemically synthesized
aagcaaaagtttattcagcaat

SEQ ID NO: 1215809 - DNA, 22 bp, Artificial Sequence
  chemically synthesized
tgagatgttaatattgctgaat

SEQ ID NO: 1215810 - DNA, 22 bp, Artificial Sequence
  chemically synthesized
gtgagatgttaatattgctgaa

SEQ ID NO: 1215811 - DNA, 22 bp, Artificial Sequence
  chemically synthesized
ttgtgagatgttaatattgctg

SEQ ID NO: 1215812 - DNA, 22 bp, Artificial Sequence
  chemically synthesized
attcagcaatattaacatctca

SEQ ID NO: 1215813 - DNA, 22 bp, Artificial Sequence
  chemically synthesized
ttcagcaatattaacatctcac

SEQ ID NO: 1215814 - DNA, 22 bp, Artificial Sequence
  chemically synthesized
taatatcattcttgtgagatgt

SEQ ID NO: 1215815 - DNA, 22 bp, Artificial Sequence
  chemically synthesized
agcaatattaacatctcacaag

SEQ ID NO: 1215816 - DNA, 22 bp, Artificial Sequence
  chemically synthesized
acatctcacaagaatgatatta

SEQ ID NO: 1215817 - DNA, 22 bp, Artificial Sequence
  chemically synthesized
ggaaatatcctgtaatatcatt

SEQ ID NO: 1215818 - DNA, 22 bp, Artificial Sequence
  chemically synthesized
aggaaatatcctgtaatatcat

SEQ ID NO: 1215819 - DNA, 22 bp, Artificial Sequence
  chemically synthesized
taggaaatatcctgtaatatca

SEQ ID NO: 1215820 - DNA, 22 bp, Artificial Sequence
  chemically synthesized
ttaggaaatatcctgtaatatc

SEQ ID NO: 1215821 - DNA, 22 bp, Artificial Sequence
  chemically synthesized
cttttaggaaatatcctgtaat

SEQ ID NO: 1215822 - DNA, 22 bp, Artificial Sequence
  chemically synthesized
acaagaatgatattacaggata

SEQ ID NO: 1215823 - DNA, 22 bp, Artificial Sequence
  chemically synthesized
acttttaggaaatatcctgtaa

SEQ ID NO: 1215824 - DNA, 22 bp, Artificial Sequence
  chemically synthesized
tacttttaggaaatatcctgta

SEQ ID NO: 1215825 - DNA, 22 bp, Artificial Sequence
  chemically synthesized
ttacttttaggaaatatcctgt

SEQ ID NO: 1215826 - DNA, 22 bp, Artificial Sequence
  chemically synthesized
aaaccagtgtttttacttttag

SEQ ID NO: 1215827 - DNA, 22 bp, Artificial Sequence
  chemically synthesized
caggatatttcctaaaagtaaa

SEQ ID NO: 1215828 - DNA, 22 bp, Artificial Sequence
  chemically synthesized
cctaaaagtaaaaacactggtt

SEQ ID NO: 1215829 - DNA, 22 bp, Artificial Sequence
  chemically synthesized
ctaaaagtaaaaacactggttt

SEQ ID NO: 1215830 - DNA, 22 bp, Artificial Sequence
  chemically synthesized
ataaggtggttgaaaccagtgt

SEQ ID NO: 1215831 - DNA, 22 bp, Artificial Sequence
  chemically synthesized
aataaggtggttgaaaccagtg

SEQ ID NO: 1215832 - DNA, 22 bp, Artificial Sequence
  chemically synthesized
aaagtaaaaacactggtttcaa

SEQ ID NO: 1215833 - DNA, 22 bp, Artificial Sequence
  chemically synthesized
caatttaataaggtggttgaaa

SEQ ID NO: 1215834 - DNA, 22 bp, Artificial Sequence
  chemically synthesized
ttacaatttaataaggtggttg

SEQ ID NO: 1215835 - DNA, 22 bp, Artificial Sequence
  chemically synthesized
tatattattacaatttaataag

SEQ ID NO: 1215836 - DNA, 22 bp, Artificial Sequence
  chemically synthesized
gtttcaaccaccttattaaatt

SEQ ID NO: 1215837 - DNA, 22 bp, Artificial Sequence
  chemically synthesized
atatattattacaatttaataa

SEQ ID NO: 1215838 - DNA, 22 bp, Artificial Sequence
  chemically synthesized
tatatattattacaatttaata

SEQ ID NO: 1215839 - DNA, 22 bp, Artificial Sequence
  chemically synthesized
caaccaccttattaaattgtaa

SEQ ID NO: 1215840 - DNA, 22 bp, Artificial Sequence
  chemically synthesized
aaccaccttattaaattgtaat

SEQ ID NO: 1215841 - DNA, 22 bp, Artificial Sequence
  chemically synthesized
ggaattttatatattattacaa

SEQ ID NO: 1215842 - DNA, 22 bp, Artificial Sequence
  chemically synthesized
ttaggaattttatatattatta

SEQ ID NO: 1215843 - DNA, 22 bp, Artificial Sequence
  chemically synthesized
attaaattgtaataatatataa

SEQ ID NO: 1215844 - DNA, 22 bp, Artificial Sequence
  chemically synthesized
ttaaattgtaataatatataaa

SEQ ID NO: 1215845 - DNA, 22 bp, Artificial Sequence
  chemically synthesized
aattattaggaattttatatat

SEQ ID NO: 1215846 - DNA, 22 bp, Artificial Sequence
  chemically synthesized
aattgtaataatatataaaatt

SEQ ID NO: 1215847 - DNA, 22 bp, Artificial Sequence
  chemically synthesized
ttaaattattaggaattttata

SEQ ID NO: 1215848 - DNA, 22 bp, Artificial Sequence
  chemically synthesized
taataatatataaaattcctaa

SEQ ID NO: 1215849 - DNA, 22 bp, Artificial Sequence
  chemically synthesized
caactattaaattattaggaat

SEQ ID NO: 1215850 - DNA, 22 bp, Artificial Sequence
  chemically synthesized
ttacaactattaaattattagg

SEQ ID NO: 1215851 - DNA, 22 bp, Artificial Sequence
  chemically synthesized
ctaataatttaatagttgtaac

SEQ ID NO: 1215852 - DNA, 22 bp, Artificial Sequence
  chemically synthesized
ataatttaatagttgtaacagt

SEQ ID NO: 1215853 - DNA, 22 bp, Artificial Sequence
  chemically synthesized
aaaagtgagaaaactgttacaa

SEQ ID NO: 1215854 - DNA, 22 bp, Artificial Sequence
  chemically synthesized
aatagttgtaacagttttctca

SEQ ID NO: 1215855 - DNA, 22 bp, Artificial Sequence
  chemically synthesized
atagttgtaacagttttctcac

SEQ ID NO: 1215856 - DNA, 22 bp, Artificial Sequence
  chemically synthesized
taacagttttctcacttttcaa

SEQ ID NO: 1215857 - DNA, 22 bp, Artificial Sequence
  chemically synthesized
gtggatcatatgatatccagtt

SEQ ID NO: 1215858 - DNA, 22 bp, Artificial Sequence
  chemically synthesized
tctcacttttcaactggatatc

SEQ ID NO: 1215859 - DNA, 22 bp, Artificial Sequence
  chemically synthesized
ctcacttttcaactggatatca

SEQ ID NO: 1215860 - DNA, 22 bp, Artificial Sequence
  chemically synthesized
tcacttttcaactggatatcat

SEQ ID NO: 1215861 - DNA, 22 bp, Artificial Sequence
  chemically synthesized
acttttcaactggatatcatat

SEQ ID NO: 1215862 - DNA, 22 bp, Artificial Sequence
  chemically synthesized
ttcaactggatatcatatgatc

SEQ ID NO: 1215863 - DNA, 22 bp, Artificial Sequence
  chemically synthesized
tcaactggatatcatatgatcc

SEQ ID NO: 1215864 - DNA, 22 bp, Artificial Sequence
  chemically synthesized
caactggatatcatatgatcca

SEQ ID NO: 1215865 - DNA, 22 bp, Artificial Sequence
  chemically synthesized
aactggatatcatatgatccac

SEQ ID NO: 1215866 - DNA, 22 bp, Artificial Sequence
  chemically synthesized
gatatcatatgatccactaact

SEQ ID NO: 1215867 - DNA, 22 bp, Artificial Sequence
  chemically synthesized
tggcaatcgtgtggagttagtg

SEQ ID NO: 1215868 - DNA, 22 bp, Artificial Sequence
  chemically synthesized
atggcaatcgtgtggagttagt

SEQ ID NO: 1215869 - DNA, 22 bp, Artificial Sequence
  chemically synthesized
tcttatggcaatcgtgtggagt

SEQ ID NO: 1215870 - DNA, 22 bp, Artificial Sequence
  chemically synthesized
gtcttatggcaatcgtgtggag

SEQ ID NO: 1215871 - DNA, 22 bp, Artificial Sequence
  chemically synthesized
tgtcttatggcaatcgtgtgga

SEQ ID NO: 1215872 - DNA, 22 bp, Artificial Sequence
  chemically synthesized
ttgtcttatggcaatcgtgtgg

SEQ ID NO: 1215873 - DNA, 22 bp, Artificial Sequence
  chemically synthesized
tttgtcttatggcaatcgtgtg

SEQ ID NO: 1215874 - DNA, 22 bp, Artificial Sequence
  chemically synthesized
actccacacgattgccataaga

SEQ ID NO: 1215875 - DNA, 22 bp, Artificial Sequence
  chemically synthesized
cacacgattgccataagacaaa

SEQ ID NO: 1215876 - DNA, 22 bp, Artificial Sequence
  chemically synthesized
aagccccagattttttgtctta

SEQ ID NO: 1215877 - DNA, 22 bp, Artificial Sequence
  chemically synthesized
gaagccccagattttttgtctt

SEQ ID NO: 1215878 - DNA, 22 bp, Artificial Sequence
  chemically synthesized
tgaagccccagattttttgtct

SEQ ID NO: 1215879 - DNA, 22 bp, Artificial Sequence
  chemically synthesized
ccataagacaaaaaatctgggg

SEQ ID NO: 1215880 - DNA, 22 bp, Artificial Sequence
  chemically synthesized
agccattttgaagccccagatt

SEQ ID NO: 1215881 - DNA, 22 bp, Artificial Sequence
  chemically synthesized
gggcttcaaaatggctgaattg

SEQ ID NO: 1215882 - DNA, 22 bp, Artificial Sequence
  chemically synthesized
caaaatggctgaattgatggat

SEQ ID NO: 1215883 - DNA, 22 bp, Artificial Sequence
  chemically synthesized
aaaatggctgaattgatggatc

SEQ ID NO: 1215884 - DNA, 22 bp, Artificial Sequence
  chemically synthesized
catggaagaggtgagtaacaga

SEQ ID NO: 1215885 - DNA, 22 bp, Artificial Sequence
  chemically synthesized
aattgatggatctgttactcac

SEQ ID NO: 1215886 - DNA, 22 bp, Artificial Sequence
  chemically synthesized
tccatggaagaggtgagtaaca

SEQ ID NO: 1215887 - DNA, 22 bp, Artificial Sequence
  chemically synthesized
ctctccatggaagaggtgagta

SEQ ID NO: 1215888 - DNA, 22 bp, Artificial Sequence
  chemically synthesized
atggatctgttactcacctctt

SEQ ID NO: 1215889 - DNA, 22 bp, Artificial Sequence
  chemically synthesized
gttcctctccatggaagaggtg

SEQ ID NO: 1215890 - DNA, 22 bp, Artificial Sequence
  chemically synthesized
ggttcctctccatggaagaggt

SEQ ID NO: 1215891 - DNA, 22 bp, Artificial Sequence
  chemically synthesized
tggttcctctccatggaagagg

SEQ ID NO: 1215892 - DNA, 22 bp, Artificial Sequence
  chemically synthesized
ttactcacctcttccatggaga

SEQ ID NO: 1215893 - DNA, 22 bp, Artificial Sequence
  chemically synthesized
gtactttggttcctctccatgg

SEQ ID NO: 1215894 - DNA, 22 bp, Artificial Sequence
  chemically synthesized
ggtactttggttcctctccatg

SEQ ID NO: 1215895 - DNA, 22 bp, Artificial Sequence
  chemically synthesized
ctcacctcttccatggagagga

SEQ ID NO: 1215896 - DNA, 22 bp, Artificial Sequence
  chemically synthesized
cttggtactttggttcctctcc

SEQ ID NO: 1215897 - DNA, 22 bp, Artificial Sequence
  chemically synthesized
acctcttccatggagaggaacc

SEQ ID NO: 1215898 - DNA, 22 bp, Artificial Sequence
  chemically synthesized
tctacttggtactttggttcct

SEQ ID NO: 1215899 - DNA, 22 bp, Artificial Sequence
  chemically synthesized
ttccatggagaggaaccaaagt

SEQ ID NO: 1215900 - DNA, 22 bp, Artificial Sequence
  chemically synthesized
ccatggagaggaaccaaagtac

SEQ ID NO: 1215901 - DNA, 22 bp, Artificial Sequence
  chemically synthesized
catggagaggaaccaaagtacc

SEQ ID NO: 1215902 - DNA, 22 bp, Artificial Sequence
  chemically synthesized
aaagtatgattatctacttggt

SEQ ID NO: 1215903 - DNA, 22 bp, Artificial Sequence
  chemically synthesized
atgtattcaaagtatgattatc

SEQ ID NO: 1215904 - DNA, 22 bp, Artificial Sequence
  chemically synthesized
gttaatgtattcaaagtatgat

SEQ ID NO: 1215905 - DNA, 22 bp, Artificial Sequence
  chemically synthesized
agttaatgtattcaaagtatga

SEQ ID NO: 1215906 - DNA, 22 bp, Artificial Sequence
  chemically synthesized
ttagttaatgtattcaaagtat

SEQ ID NO: 1215907 - DNA, 22 bp, Artificial Sequence
  chemically synthesized
tcttagttaatgtattcaaagt

SEQ ID NO: 1215908 - DNA, 22 bp, Artificial Sequence
  chemically synthesized
ctcttagttaatgtattcaaag

SEQ ID NO: 1215909 - DNA, 22 bp, Artificial Sequence
  chemically synthesized
tctcttagttaatgtattcaaa

SEQ ID NO: 1215910 - DNA, 22 bp, Artificial Sequence
  chemically synthesized
agtgttttctcttagttaatgt

SEQ ID NO: 1215911 - DNA, 22 bp, Artificial Sequence
  chemically synthesized
cagtgttttctcttagttaatg

SEQ ID NO: 1215912 - DNA, 22 bp, Artificial Sequence
  chemically synthesized
aatttcagtgttttctcttagt

SEQ ID NO: 1215913 - DNA, 22 bp, Artificial Sequence
  chemically synthesized
tgaatacattaactaagagaaa

SEQ ID NO: 1215914 - DNA, 22 bp, Artificial Sequence
  chemically synthesized
gaatacattaactaagagaaaa

SEQ ID NO: 1215915 - DNA, 22 bp, Artificial Sequence
  chemically synthesized
aatacattaactaagagaaaac

SEQ ID NO: 1215916 - DNA, 22 bp, Artificial Sequence
  chemically synthesized
ttgaatttcagtgttttctctt

SEQ ID NO: 1215917 - DNA, 22 bp, Artificial Sequence
  chemically synthesized
tgttgaatttcagtgttttctc

SEQ ID NO: 1215918 - DNA, 22 bp, Artificial Sequence
  chemically synthesized
tctgttgaatttcagtgttttc

SEQ ID NO: 1215919 - DNA, 22 bp, Artificial Sequence
  chemically synthesized
ctctgttgaatttcagtgtttt

SEQ ID NO: 1215920 - DNA, 22 bp, Artificial Sequence
  chemically synthesized
cttctctgttgaatttcagtgt

SEQ ID NO: 1215921 - DNA, 22 bp, Artificial Sequence
  chemically synthesized
actaagagaaaacactgaaatt

SEQ ID NO: 1215922 - DNA, 22 bp, Artificial Sequence
  chemically synthesized
attgcttctctgttgaatttca

SEQ ID NO: 1215923 - DNA, 22 bp, Artificial Sequence
  chemically synthesized
agagaaaacactgaaattcaac

SEQ ID NO: 1215924 - DNA, 22 bp, Artificial Sequence
  chemically synthesized
cattgcttctctgttgaatttc

SEQ ID NO: 1215925 - DNA, 22 bp, Artificial Sequence
  chemically synthesized
tcattgcttctctgttgaattt

SEQ ID NO: 1215926 - DNA, 22 bp, Artificial Sequence
  chemically synthesized
gtggttttcattgcttctctgt

SEQ ID NO: 1215927 - DNA, 22 bp, Artificial Sequence
  chemically synthesized
agtggttttcattgcttctctg

SEQ ID NO: 1215928 - DNA, 22 bp, Artificial Sequence
  chemically synthesized
tagtggttttcattgcttctct

SEQ ID NO: 1215929 - DNA, 22 bp, Artificial Sequence
  chemically synthesized
ttagtggttttcattgcttctc

SEQ ID NO: 1215930 - DNA, 22 bp, Artificial Sequence
  chemically synthesized
aaattcaacagagaagcaatga

SEQ ID NO: 1215931 - DNA, 22 bp, Artificial Sequence
  chemically synthesized
cttttagtggttttcattgctt

SEQ ID NO: 1215932 - DNA, 22 bp, Artificial Sequence
  chemically synthesized
ccttttagtggttttcattgct

SEQ ID NO: 1215933 - DNA, 22 bp, Artificial Sequence
  chemically synthesized
tccttttagtggttttcattgc

SEQ ID NO: 1215934 - DNA, 22 bp, Artificial Sequence
  chemically synthesized
ttccttttagtggttttcattg

SEQ ID NO: 1215935 - DNA, 22 bp, Artificial Sequence
  chemically synthesized
tttccttttagtggttttcatt

SEQ ID NO: 1215936 - DNA, 22 bp, Artificial Sequence
  chemically synthesized
aacagagaagcaatgaaaacca

SEQ ID NO: 1215937 - DNA, 22 bp, Artificial Sequence
  chemically synthesized
tttttccttttagtggttttca

SEQ ID NO: 1215938 - DNA, 22 bp, Artificial Sequence
  chemically synthesized
ctttttccttttagtggttttc

SEQ ID NO: 1215939 - DNA, 22 bp, Artificial Sequence
  chemically synthesized
cttctttttccttttagtggtt

SEQ ID NO: 1215940 - DNA, 22 bp, Artificial Sequence
  chemically synthesized
ccttctttttccttttagtggt

SEQ ID NO: 1215941 - DNA, 22 bp, Artificial Sequence
  chemically synthesized
atttccttctttttccttttag

SEQ ID NO: 1215942 - DNA, 22 bp, Artificial Sequence
  chemically synthesized
gatagagtgcctcatttccttc

SEQ ID NO: 1215943 - DNA, 22 bp, Artificial Sequence
  chemically synthesized
aaaggaaaaagaaggaaatgag

SEQ ID NO: 1215944 - DNA, 22 bp, Artificial Sequence
  chemically synthesized
agctggatagagtgcctcattt

SEQ ID NO: 1215945 - DNA, 22 bp, Artificial Sequence
  chemically synthesized
gccaatctcagctggatagagt

SEQ ID NO: 1215946 - DNA, 22 bp, Artificial Sequence
  chemically synthesized
ctagccaatctcagctggatag

SEQ ID NO: 1215947 - DNA, 22 bp, Artificial Sequence
  chemically synthesized
cagactcctagccaatctcagc

SEQ ID NO: 1215948 - DNA, 22 bp, Artificial Sequence
  chemically synthesized
tccagactcctagccaatctca

SEQ ID NO: 1215949 - DNA, 22 bp, Artificial Sequence
  chemically synthesized
tatccagctgagattggctagg

SEQ ID NO: 1215950 - DNA, 22 bp, Artificial Sequence
  chemically synthesized
tccagctgagattggctaggag

SEQ ID NO: 1215951 - DNA, 22 bp, Artificial Sequence
  chemically synthesized
gggagcctctccagactcctag

SEQ ID NO: 1215952 - DNA, 22 bp, Artificial Sequence
  chemically synthesized
agattggctaggagtctggaga

SEQ ID NO: 1215953 - DNA, 22 bp, Artificial Sequence
  chemically synthesized
cccatgttagggagcctctcca

SEQ ID NO: 1215954 - DNA, 22 bp, Artificial Sequence
  chemically synthesized
gctaggagtctggagaggctcc

SEQ ID NO: 1215955 - DNA, 22 bp, Artificial Sequence
  chemically synthesized
tccccatgttagggagcctctc

SEQ ID NO: 1215956 - DNA, 22 bp, Artificial Sequence
  chemically synthesized
tctccccatgttagggagcctc

SEQ ID NO: 1215957 - DNA, 22 bp, Artificial Sequence
  chemically synthesized
ggagtctggagaggctccctaa

SEQ ID NO: 1215958 - DNA, 22 bp, Artificial Sequence
  chemically synthesized
attctctccccatgttagggag

SEQ ID NO: 1215959 - DNA, 22 bp, Artificial Sequence
  chemically synthesized
taattctctccccatgttaggg

SEQ ID NO: 1215960 - DNA, 22 bp, Artificial Sequence
  chemically synthesized
gagaggctccctaacatgggga

SEQ ID NO: 1215961 - DNA, 22 bp, Artificial Sequence
  chemically synthesized
tgcatctctaattctctcccca

SEQ ID NO: 1215962 - DNA, 22 bp, Artificial Sequence
  chemically synthesized
gtgcatctctaattctctcccc

SEQ ID NO: 1215963 - DNA, 22 bp, Artificial Sequence
  chemically synthesized
tgtgcatctctaattctctccc

SEQ ID NO: 1215964 - DNA, 22 bp, Artificial Sequence
  chemically synthesized
cctaacatggggagagaattag

SEQ ID NO: 1215965 - DNA, 22 bp, Artificial Sequence
  chemically synthesized
acatggggagagaattagagat

SEQ ID NO: 1215966 - DNA, 22 bp, Artificial Sequence
  chemically synthesized
tacaagaatgtgtacctttgtg

SEQ ID NO: 1215967 - DNA, 22 bp, Artificial Sequence
  chemically synthesized
gtacaagaatgtgtacctttgt

SEQ ID NO: 1215968 - DNA, 22 bp, Artificial Sequence
  chemically synthesized
gagatgcacaaaggtacacatt

SEQ ID NO: 1215969 - DNA, 22 bp, Artificial Sequence
  chemically synthesized
taggaatcttgtacaagaatgt

SEQ ID NO: 1215970 - DNA, 22 bp, Artificial Sequence
  chemically synthesized
ggattgtaggaatcttgtacaa

SEQ ID NO: 1215971 - DNA, 22 bp, Artificial Sequence
  chemically synthesized
gctaggattgtaggaatcttgt

SEQ ID NO: 1215972 - DNA, 22 bp, Artificial Sequence
  chemically synthesized
aattggctaggattgtaggaat

SEQ ID NO: 1215973 - DNA, 22 bp, Artificial Sequence
  chemically synthesized
tcaattggctaggattgtagga

SEQ ID NO: 1215974 - DNA, 22 bp, Artificial Sequence
  chemically synthesized
ttgtacaagattcctacaatcc

SEQ ID NO: 1215975 - DNA, 22 bp, Artificial Sequence
  chemically synthesized
gtacaagattcctacaatccta

SEQ ID NO: 1215976 - DNA, 22 bp, Artificial Sequence
  chemically synthesized
tacaagattcctacaatcctag

SEQ ID NO: 1215977 - DNA, 22 bp, Artificial Sequence
  chemically synthesized
aagggctctcaattggctagga

SEQ ID NO: 1215978 - DNA, 22 bp, Artificial Sequence
  chemically synthesized
ctacaatcctagccaattgaga

SEQ ID NO: 1215979 - DNA, 22 bp, Artificial Sequence
  chemically synthesized
caatcctagccaattgagagcc

SEQ ID NO: 1215980 - DNA, 22 bp, Artificial Sequence
  chemically synthesized
gccaattgagagcccttcaacc

SEQ ID NO: 1215981 - DNA, 22 bp, Artificial Sequence
  chemically synthesized
ggggcccacacgggttgaaggg

SEQ ID NO: 1215982 - DNA, 22 bp, Artificial Sequence
  chemically synthesized
gggggcccacacgggttgaagg

SEQ ID NO: 1215983 - DNA, 22 bp, Artificial Sequence
  chemically synthesized
gtttgggggcccacacgggttg

SEQ ID NO: 1215984 - DNA, 22 bp, Artificial Sequence
  chemically synthesized
agagcccttcaacccgtgtggg

SEQ ID NO: 1215985 - DNA, 22 bp, Artificial Sequence
  chemically synthesized
tgtgttggtttgggggcccaca

SEQ ID NO: 1215986 - DNA, 22 bp, Artificial Sequence
  chemically synthesized
caacccgtgtgggcccccaaac

SEQ ID NO: 1215987 - DNA, 22 bp, Artificial Sequence
  chemically synthesized
aacccgtgtgggcccccaaacc

SEQ ID NO: 1215988 - DNA, 22 bp, Artificial Sequence
  chemically synthesized
gacagctgtgtgttggtttggg

SEQ ID NO: 1215989 - DNA, 22 bp, Artificial Sequence
  chemically synthesized
cacagtatctagacagctgtgt

SEQ ID NO: 1215990 - DNA, 22 bp, Artificial Sequence
  chemically synthesized
gcacagtatctagacagctgtg

SEQ ID NO: 1215991 - DNA, 22 bp, Artificial Sequence
  chemically synthesized
tgcacagtatctagacagctgt

SEQ ID NO: 1215992 - DNA, 22 bp, Artificial Sequence
  chemically synthesized
cgtgaagcaatgcctttgcaca

SEQ ID NO: 1215993 - DNA, 22 bp, Artificial Sequence
  chemically synthesized
ccgtgaagcaatgcctttgcac

SEQ ID NO: 1215994 - DNA, 22 bp, Artificial Sequence
  chemically synthesized
tctagatactgtgcaaaggcat

SEQ ID NO: 1215995 - DNA, 22 bp, Artificial Sequence
  chemically synthesized
ttccgtgaagcaatgcctttgc

SEQ ID NO: 1215996 - DNA, 22 bp, Artificial Sequence
  chemically synthesized
cttccgtgaagcaatgcctttg

SEQ ID NO: 1215997 - DNA, 22 bp, Artificial Sequence
  chemically synthesized
gatactgtgcaaaggcattgct

SEQ ID NO: 1215998 - DNA, 22 bp, Artificial Sequence
  chemically synthesized
tgcaaaggcattgcttcacgga

SEQ ID NO: 1215999 - DNA, 22 bp, Artificial Sequence
  chemically synthesized
tggaacccagcatgggcttctt

SEQ ID NO: 1216000 - DNA, 22 bp, Artificial Sequence
  chemically synthesized
gtggaacccagcatgggcttct

SEQ ID NO: 1216001 - DNA, 22 bp, Artificial Sequence
  chemically synthesized
cttcacggaagaagcccatgct

SEQ ID NO: 1216002 - DNA, 22 bp, Artificial Sequence
  chemically synthesized
cacggaagaagcccatgctggg

SEQ ID NO: 1216003 - DNA, 22 bp, Artificial Sequence
  chemically synthesized
gagtttgtggaacccagcatgg

SEQ ID NO: 1216004 - DNA, 22 bp, Artificial Sequence
  chemically synthesized
acggaagaagcccatgctgggt

SEQ ID NO: 1216005 - DNA, 22 bp, Artificial Sequence
  chemically synthesized
tagagtttgtggaacccagcat

SEQ ID NO: 1216006 - DNA, 22 bp, Artificial Sequence
  chemically synthesized
ggactctagagtttgtggaacc

SEQ ID NO: 1216007 - DNA, 22 bp, Artificial Sequence
  chemically synthesized
aggactctagagtttgtggaac

SEQ ID NO: 1216008 - DNA, 22 bp, Artificial Sequence
  chemically synthesized
cttaggactctagagtttgtgg

SEQ ID NO: 1216009 - DNA, 22 bp, Artificial Sequence
  chemically synthesized
cagctgcttaggactctagagt

SEQ ID NO: 1216010 - DNA, 22 bp, Artificial Sequence
  chemically synthesized
ggttccacaaactctagagtcc

SEQ ID NO: 1216011 - DNA, 22 bp, Artificial Sequence
  chemically synthesized
cacaaactctagagtcctaagc

SEQ ID NO: 1216012 - DNA, 22 bp, Artificial Sequence
  chemically synthesized
tagagtcctaagcagctgcaac

SEQ ID NO: 1216013 - DNA, 22 bp, Artificial Sequence
  chemically synthesized
aaaaccaggccatgttgcagct

SEQ ID NO: 1216014 - DNA, 22 bp, Artificial Sequence
  chemically synthesized
gagtcctaagcagctgcaacat

SEQ ID NO: 1216015 - DNA, 22 bp, Artificial Sequence
  chemically synthesized
tcaaaaccaggccatgttgcag

SEQ ID NO: 1216016 - DNA, 22 bp, Artificial Sequence
  chemically synthesized
ggctctcaaaaccaggccatgt

SEQ ID NO: 1216017 - DNA, 22 bp, Artificial Sequence
  chemically synthesized
agcagctgcaacatggcctggt

SEQ ID NO: 1216018 - DNA, 22 bp, Artificial Sequence
  chemically synthesized
caacatggcctggttttgagag

SEQ ID NO: 1216019 - DNA, 22 bp, Artificial Sequence
  chemically synthesized
gtgggggctgggctctcaaaac

SEQ ID NO: 1216020 - DNA, 22 bp, Artificial Sequence
  chemically synthesized
gttttgagagcccagcccccac

SEQ ID NO: 1216021 - DNA, 22 bp, Artificial Sequence
  chemically synthesized
tgagagcccagcccccaccagt

SEQ ID NO: 1216022 - DNA, 22 bp, Artificial Sequence
  chemically synthesized
gagagcccagcccccaccagtc

SEQ ID NO: 1216023 - DNA, 22 bp, Artificial Sequence
  chemically synthesized
ggtcaggacatagactggtggg

SEQ ID NO: 1216024 - DNA, 22 bp, Artificial Sequence
  chemically synthesized
agagcccagcccccaccagtct

SEQ ID NO: 1216025 - DNA, 22 bp, Artificial Sequence
  chemically synthesized
gtcctaggtcaggacatagact

SEQ ID NO: 1216026 - DNA, 22 bp, Artificial Sequence
  chemically synthesized
agtcctaggtcaggacatagac

SEQ ID NO: 1216027 - DNA, 22 bp, Artificial Sequence
  chemically synthesized
tagtcctaggtcaggacataga

SEQ ID NO: 1216028 - DNA, 22 bp, Artificial Sequence
  chemically synthesized
ttagtcctaggtcaggacatag

SEQ ID NO: 1216029 - DNA, 22 bp, Artificial Sequence
  chemically synthesized
tgtcctgacctaggactaaaaa

SEQ ID NO: 1216030 - DNA, 22 bp, Artificial Sequence
  chemically synthesized
acctaggactaaaaatcttccc

SEQ ID NO: 1216031 - DNA, 22 bp, Artificial Sequence
  chemically synthesized
caggaatgtggagatagggaag

SEQ ID NO: 1216032 - DNA, 22 bp, Artificial Sequence
  chemically synthesized
ggactaaaaatcttccctatct

SEQ ID NO: 1216033 - DNA, 22 bp, Artificial Sequence
  chemically synthesized
agactccaggaatgtggagata

SEQ ID NO: 1216034 - DNA, 22 bp, Artificial Sequence
  chemically synthesized
aaaatcttccctatctccacat

SEQ ID NO: 1216035 - DNA, 22 bp, Artificial Sequence
  chemically synthesized
ccctatctccacattcctggag

SEQ ID NO: 1216036 - DNA, 22 bp, Artificial Sequence
  chemically synthesized
cctatctccacattcctggagt

SEQ ID NO: 1216037 - DNA, 22 bp, Artificial Sequence
  chemically synthesized
tctccacattcctggagtctca

SEQ ID NO: 1216038 - DNA, 22 bp, Artificial Sequence
  chemically synthesized
cacattcctggagtctcagtga

SEQ ID NO: 1216039 - DNA, 22 bp, Artificial Sequence
  chemically synthesized
ctggagtctcagtgatatttcc

SEQ ID NO: 1216040 - DNA, 22 bp, Artificial Sequence
  chemically synthesized
cagccatgggtgggaaatatca

SEQ ID NO: 1216041 - DNA, 22 bp, Artificial Sequence
  chemically synthesized
gagtctcagtgatatttcccac

SEQ ID NO: 1216042 - DNA, 22 bp, Artificial Sequence
  chemically synthesized
agtgatatttcccacccatggc

SEQ ID NO: 1216043 - DNA, 22 bp, Artificial Sequence
  chemically synthesized
gccccagcagttgcagccatgg

SEQ ID NO: 1216044 - DNA, 22 bp, Artificial Sequence
  chemically synthesized
ggccccagcagttgcagccatg

SEQ ID NO: 1216045 - DNA, 22 bp, Artificial Sequence
  chemically synthesized
ccttggccccagcagttgcagc

SEQ ID NO: 1216046 - DNA, 22 bp, Artificial Sequence
  chemically synthesized
cccacccatggctgcaactgct

SEQ ID NO: 1216047 - DNA, 22 bp, Artificial Sequence
  chemically synthesized
ccacccatggctgcaactgctg

SEQ ID NO: 1216048 - DNA, 22 bp, Artificial Sequence
  chemically synthesized
ctgccttggccccagcagttgc

SEQ ID NO: 1216049 - DNA, 22 bp, Artificial Sequence
  chemically synthesized
ccagtggttcctgccttggccc

SEQ ID NO: 1216050 - DNA, 22 bp, Artificial Sequence
  chemically synthesized
caactgctggggccaaggcagg

SEQ ID NO: 1216051 - DNA, 22 bp, Artificial Sequence
  chemically synthesized
ctgccagtggttcctgccttgg

SEQ ID NO: 1216052 - DNA, 22 bp, Artificial Sequence
  chemically synthesized
gctgccagtggttcctgccttg

SEQ ID NO: 1216053 - DNA, 22 bp, Artificial Sequence
  chemically synthesized
ctggggccaaggcaggaaccac

SEQ ID NO: 1216054 - DNA, 22 bp, Artificial Sequence
  chemically synthesized
gggccaaggcaggaaccactgg

SEQ ID NO: 1216055 - DNA, 22 bp, Artificial Sequence
  chemically synthesized
ggcaggggagggtttgctgcca

SEQ ID NO: 1216056 - DNA, 22 bp, Artificial Sequence
  chemically synthesized
ttgggcaggggagggtttgctg

SEQ ID NO: 1216057 - DNA, 22 bp, Artificial Sequence
  chemically synthesized
tgttgggcaggggagggtttgc

SEQ ID NO: 1216058 - DNA, 22 bp, Artificial Sequence
  chemically synthesized
gcagcaaaccctcccctgccca

SEQ ID NO: 1216059 - DNA, 22 bp, Artificial Sequence
  chemically synthesized
agtggccacccctctgttgggc

SEQ ID NO: 1216060 - DNA, 22 bp, Artificial Sequence
  chemically synthesized
ccctgcccaacagaggggtggc

SEQ ID NO: 1216061 - DNA, 22 bp, Artificial Sequence
  chemically synthesized
cccaacagaggggtggccactc

SEQ ID NO: 1216062 - DNA, 22 bp, Artificial Sequence
  chemically synthesized
agtgtgcatgaagttgagtggc

SEQ ID NO: 1216063 - DNA, 22 bp, Artificial Sequence
  chemically synthesized
cagtgtgcatgaagttgagtgg

SEQ ID NO: 1216064 - DNA, 22 bp, Artificial Sequence
  chemically synthesized
gtcttcagtgtgcatgaagttg

SEQ ID NO: 1216065 - DNA, 22 bp, Artificial Sequence
  chemically synthesized
aacttcatgcacactgaagact

SEQ ID NO: 1216066 - DNA, 22 bp, Artificial Sequence
  chemically synthesized
caggcagtggaattagtcttca

SEQ ID NO: 1216067 - DNA, 22 bp, Artificial Sequence
  chemically synthesized
gcaggcagtggaattagtcttc

SEQ ID NO: 1216068 - DNA, 22 bp, Artificial Sequence
  chemically synthesized
catgcacactgaagactaattc

SEQ ID NO: 1216069 - DNA, 22 bp, Artificial Sequence
  chemically synthesized
atgcacactgaagactaattcc

SEQ ID NO: 1216070 - DNA, 22 bp, Artificial Sequence
  chemically synthesized
aagactaattccactgcctgca

SEQ ID NO: 1216071 - DNA, 22 bp, Artificial Sequence
  chemically synthesized
acagtgacagcatttgcaggca

SEQ ID NO: 1216072 - DNA, 22 bp, Artificial Sequence
  chemically synthesized
attccactgcctgcaaatgctg

SEQ ID NO: 1216073 - DNA, 22 bp, Artificial Sequence
  chemically synthesized
cactgcctgcaaatgctgtcac

SEQ ID NO: 1216074 - DNA, 22 bp, Artificial Sequence
  chemically synthesized
cacagcagttcacagtgacagc

SEQ ID NO: 1216075 - DNA, 22 bp, Artificial Sequence
  chemically synthesized
cctgcaaatgctgtcactgtga

SEQ ID NO: 1216076 - DNA, 22 bp, Artificial Sequence
  chemically synthesized
aactccacagcagttcacagtg

SEQ ID NO: 1216077 - DNA, 22 bp, Artificial Sequence
  chemically synthesized
caaatgctgtcactgtgaactg

SEQ ID NO: 1216078 - DNA, 22 bp, Artificial Sequence
  chemically synthesized
tgtctcaactccacagcagttc

SEQ ID NO: 1216079 - DNA, 22 bp, Artificial Sequence
  chemically synthesized
gtgtctcaactccacagcagtt

SEQ ID NO: 1216080 - DNA, 22 bp, Artificial Sequence
  chemically synthesized
tcactgtgaactgctgtggagt

SEQ ID NO: 1216081 - DNA, 22 bp, Artificial Sequence
  chemically synthesized
tgaactgctgtggagttgagac

SEQ ID NO: 1216082 - DNA, 22 bp, Artificial Sequence
  chemically synthesized
tgcgtcgcttgtgtctcaactc

SEQ ID NO: 1216083 - DNA, 22 bp, Artificial Sequence
  chemically synthesized
ctgtggagttgagacacaagcg

SEQ ID NO: 1216084 - DNA, 22 bp, Artificial Sequence
  chemically synthesized
ggtagcctgtgcgtcgcttgtg

SEQ ID NO: 1216085 - DNA, 22 bp, Artificial Sequence
  chemically synthesized
tggagttgagacacaagcgacg

SEQ ID NO: 1216086 - DNA, 22 bp, Artificial Sequence
  chemically synthesized
cctgggtagcctgtgcgtcgct

SEQ ID NO: 1216087 - DNA, 22 bp, Artificial Sequence
  chemically synthesized
agacacaagcgacgcacaggct

SEQ ID NO: 1216088 - DNA, 22 bp, Artificial Sequence
  chemically synthesized
ggagcagccataagcagttgcc

SEQ ID NO: 1216089 - DNA, 22 bp, Artificial Sequence
  chemically synthesized
gggagcagccataagcagttgc

SEQ ID NO: 1216090 - DNA, 22 bp, Artificial Sequence
  chemically synthesized
cttgggagcagccataagcagt

SEQ ID NO: 1216091 - DNA, 22 bp, Artificial Sequence
  chemically synthesized
ccttgggagcagccataagcag

SEQ ID NO: 1216092 - DNA, 22 bp, Artificial Sequence
  chemically synthesized
tccttgggagcagccataagca

SEQ ID NO: 1216093 - DNA, 22 bp, Artificial Sequence
  chemically synthesized
cccaggcaactgcttatggctg

SEQ ID NO: 1216094 - DNA, 22 bp, Artificial Sequence
  chemically synthesized
ctttccttgggagcagccataa

SEQ ID NO: 1216095 - DNA, 22 bp, Artificial Sequence
  chemically synthesized
cttatggctgctcccaaggaaa

SEQ ID NO: 1216096 - DNA, 22 bp, Artificial Sequence
  chemically synthesized
atggctgctcccaaggaaagca

SEQ ID NO: 1216097 - DNA, 22 bp, Artificial Sequence
  chemically synthesized
tggctgctcccaaggaaagcaa

SEQ ID NO: 1216098 - DNA, 22 bp, Artificial Sequence
  chemically synthesized
gagagggtaaggttgctttcct

SEQ ID NO: 1216099 - DNA, 22 bp, Artificial Sequence
  chemically synthesized
ctggagagggtaaggttgcttt

SEQ ID NO: 1216100 - DNA, 22 bp, Artificial Sequence
  chemically synthesized
ctcccaaggaaagcaaccttac

SEQ ID NO: 1216101 - DNA, 22 bp, Artificial Sequence
  chemically synthesized
ctactggagagggtaaggttgc

SEQ ID NO: 1216102 - DNA, 22 bp, Artificial Sequence
  chemically synthesized
ccaaggaaagcaaccttaccct

SEQ ID NO: 1216103 - DNA, 22 bp, Artificial Sequence
  chemically synthesized
tggccctgctactggagagggt

SEQ ID NO: 1216104 - DNA, 22 bp, Artificial Sequence
  chemically synthesized
cactgtggccctgctactggag

SEQ ID NO: 1216105 - DNA, 22 bp, Artificial Sequence
  chemically synthesized
gctacactgtggccctgctact

SEQ ID NO: 1216106 - DNA, 22 bp, Artificial Sequence
  chemically synthesized
accctctccagtagcagggcca

SEQ ID NO: 1216107 - DNA, 22 bp, Artificial Sequence
  chemically synthesized
ccctctccagtagcagggccac

SEQ ID NO: 1216108 - DNA, 22 bp, Artificial Sequence
  chemically synthesized
tccagtagcagggccacagtgt

SEQ ID NO: 1216109 - DNA, 22 bp, Artificial Sequence
  chemically synthesized
cagtagcagggccacagtgtag

SEQ ID NO: 1216110 - DNA, 22 bp, Artificial Sequence
  chemically synthesized
aggtggaaggcagtgttggcta

SEQ ID NO: 1216111 - DNA, 22 bp, Artificial Sequence
  chemically synthesized
tgcaatgctcaggtggaaggca

SEQ ID NO: 1216112 - DNA, 22 bp, Artificial Sequence
  chemically synthesized
gtgcaatgctcaggtggaaggc

SEQ ID NO: 1216113 - DNA, 22 bp, Artificial Sequence
  chemically synthesized
cccaggtcccttgtgcaatgct

SEQ ID NO: 1216114 - DNA, 22 bp, Artificial Sequence
  chemically synthesized
ccttccacctgagcattgcaca

SEQ ID NO: 1216115 - DNA, 22 bp, Artificial Sequence
  chemically synthesized
ccacctgagcattgcacaaggg

SEQ ID NO: 1216116 - DNA, 22 bp, Artificial Sequence
  chemically synthesized
cacctgagcattgcacaaggga

SEQ ID NO: 1216117 - DNA, 22 bp, Artificial Sequence
  chemically synthesized
agcattgcacaagggacctggg

SEQ ID NO: 1216118 - DNA, 22 bp, Artificial Sequence
  chemically synthesized
cacaagggacctggggagcacc

SEQ ID NO: 1216119 - DNA, 22 bp, Artificial Sequence
  chemically synthesized
tagtcgaggggcaaggtgctcc

SEQ ID NO: 1216120 - DNA, 22 bp, Artificial Sequence
  chemically synthesized
ttgtagtcgaggggcaaggtgc

SEQ ID NO: 1216121 - DNA, 22 bp, Artificial Sequence
  chemically synthesized
gttattgtagtcgaggggcaag

SEQ ID NO: 1216122 - DNA, 22 bp, Artificial Sequence
  chemically synthesized
gggagcaccttgcccctcgact

SEQ ID NO: 1216123 - DNA, 22 bp, Artificial Sequence
  chemically synthesized
gcccctcgactacaataaccag

SEQ ID NO: 1216124 - DNA, 22 bp, Artificial Sequence
  chemically synthesized
cccctcgactacaataaccagt

SEQ ID NO: 1216125 - DNA, 22 bp, Artificial Sequence
  chemically synthesized
gtggtgcatgcaaccactggtt

SEQ ID NO: 1216126 - DNA, 22 bp, Artificial Sequence
  chemically synthesized
gactacaataaccagtggttgc

SEQ ID NO: 1216127 - DNA, 22 bp, Artificial Sequence
  chemically synthesized
ctggtggtgcatgcaaccactg

SEQ ID NO: 1216128 - DNA, 22 bp, Artificial Sequence
  chemically synthesized
caataaccagtggttgcatgca

SEQ ID NO: 1216129 - DNA, 22 bp, Artificial Sequence
  chemically synthesized
aggactcctggtggtgcatgca

SEQ ID NO: 1216130 - DNA, 22 bp, Artificial Sequence
  chemically synthesized
tcctcaggactcctggtggtgc

SEQ ID NO: 1216131 - DNA, 22 bp, Artificial Sequence
  chemically synthesized
catgcaccaccaggagtcctga

SEQ ID NO: 1216132 - DNA, 22 bp, Artificial Sequence
  chemically synthesized
ggaagacctgtcctcaggactc

SEQ ID NO: 1216133 - DNA, 22 bp, Artificial Sequence
  chemically synthesized
gaagagcagagctgggaagacc

SEQ ID NO: 1216134 - DNA, 22 bp, Artificial Sequence
  chemically synthesized
ggaagagcagagctgggaagac

SEQ ID NO: 1216135 - DNA, 22 bp, Artificial Sequence
  chemically synthesized
aggacaggtcttcccagctctg

SEQ ID NO: 1216136 - DNA, 22 bp, Artificial Sequence
  chemically synthesized
ggggatttggaagagcagagct

SEQ ID NO: 1216137 - DNA, 22 bp, Artificial Sequence
  chemically synthesized
tgtactgggggatttggaagag

SEQ ID NO: 1216138 - DNA, 22 bp, Artificial Sequence
  chemically synthesized
atgtactgggggatttggaaga

SEQ ID NO: 1216139 - DNA, 22 bp, Artificial Sequence
  chemically synthesized
cccagctctgctcttccaaatc

SEQ ID NO: 1216140 - DNA, 22 bp, Artificial Sequence
  chemically synthesized
tatgtactgggggatttggaag

SEQ ID NO: 1216141 - DNA, 22 bp, Artificial Sequence
  chemically synthesized
ccagctctgctcttccaaatcc

SEQ ID NO: 1216142 - DNA, 22 bp, Artificial Sequence
  chemically synthesized
ttatgtactgggggatttggaa

SEQ ID NO: 1216143 - DNA, 22 bp, Artificial Sequence
  chemically synthesized
tgctcttccaaatcccccagta

SEQ ID NO: 1216144 - DNA, 22 bp, Artificial Sequence
  chemically synthesized
ctcttccaaatcccccagtaca

SEQ ID NO: 1216145 - DNA, 22 bp, Artificial Sequence
  chemically synthesized
tacaaatttttatgtactgggg

SEQ ID NO: 1216146 - DNA, 22 bp, Artificial Sequence
  chemically synthesized
tatacaaatttttatgtactgg

SEQ ID NO: 1216147 - DNA, 22 bp, Artificial Sequence
  chemically synthesized
ttccaaatcccccagtacataa

SEQ ID NO: 1216148 - DNA, 22 bp, Artificial Sequence
  chemically synthesized
ccaaatcccccagtacataaaa

SEQ ID NO: 1216149 - DNA, 22 bp, Artificial Sequence
  chemically synthesized
caaatcccccagtacataaaaa

SEQ ID NO: 1216150 - DNA, 22 bp, Artificial Sequence
  chemically synthesized
gggtgggagagccccaggtctc

SEQ ID NO: 1216151 - DNA, 22 bp, Artificial Sequence
  chemically synthesized
gtatagagacctggggctctcc

SEQ ID NO: 1216152 - DNA, 22 bp, Artificial Sequence
  chemically synthesized
tatagagacctggggctctccc

SEQ ID NO: 1216153 - DNA, 22 bp, Artificial Sequence
  chemically synthesized
gggctctcccaccccagtttac

SEQ ID NO: 1216154 - DNA, 22 bp, Artificial Sequence
  chemically synthesized
gtcagatgccaatggtggtaaa

SEQ ID NO: 1216155 - DNA, 22 bp, Artificial Sequence
  chemically synthesized
tcccaccccagtttaccaccat

SEQ ID NO: 1216156 - DNA, 22 bp, Artificial Sequence
  chemically synthesized
ccaccccagtttaccaccattg

SEQ ID NO: 1216157 - DNA, 22 bp, Artificial Sequence
  chemically synthesized
accaccattggcatctgactag

SEQ ID NO: 1216158 - DNA, 22 bp, Artificial Sequence
  chemically synthesized
ccaccattggcatctgactagt

SEQ ID NO: 1216159 - DNA, 22 bp, Artificial Sequence
  chemically synthesized
aggccccaggaagactagtcag

SEQ ID NO: 1216160 - DNA, 22 bp, Artificial Sequence
  chemically synthesized
gcatctgactagtcttcctggg

SEQ ID NO: 1216161 - DNA, 22 bp, Artificial Sequence
  chemically synthesized
actagtcttcctggggcctgaa

SEQ ID NO: 1216162 - DNA, 22 bp, Artificial Sequence
  chemically synthesized
agtgggcccaaattcaggcccc

SEQ ID NO: 1216163 - DNA, 22 bp, Artificial Sequence
  chemically synthesized
gagtgggcccaaattcaggccc

SEQ ID NO: 1216164 - DNA, 22 bp, Artificial Sequence
  chemically synthesized
gtcttcctggggcctgaatttg

SEQ ID NO: 1216165 - DNA, 22 bp, Artificial Sequence
  chemically synthesized
cctggggcctgaatttgggccc

SEQ ID NO: 1216166 - DNA, 22 bp, Artificial Sequence
  chemically synthesized
ctggggcctgaatttgggccca

SEQ ID NO: 1216167 - DNA, 22 bp, Artificial Sequence
  chemically synthesized
gggcctgaatttgggcccactc

SEQ ID NO: 1216168 - DNA, 22 bp, Artificial Sequence
  chemically synthesized
gtggtagtggaagcttgagtgg

SEQ ID NO: 1216169 - DNA, 22 bp, Artificial Sequence
  chemically synthesized
ggtggtagtggaagcttgagtg

SEQ ID NO: 1216170 - DNA, 22 bp, Artificial Sequence
  chemically synthesized
tggtggtagtggaagcttgagt

SEQ ID NO: 1216171 - DNA, 22 bp, Artificial Sequence
  chemically synthesized
aatttgggcccactcaagcttc

SEQ ID NO: 1216172 - DNA, 22 bp, Artificial Sequence
  chemically synthesized
gggcccactcaagcttccacta

SEQ ID NO: 1216173 - DNA, 22 bp, Artificial Sequence
  chemically synthesized
ggcccactcaagcttccactac

SEQ ID NO: 1216174 - DNA, 22 bp, Artificial Sequence
  chemically synthesized
acgccagctttggtggtagtgg

SEQ ID NO: 1216175 - DNA, 22 bp, Artificial Sequence
  chemically synthesized
aagcttccactaccaccaaagc

SEQ ID NO: 1216176 - DNA, 22 bp, Artificial Sequence
  chemically synthesized
ccactaccaccaaagctggcgt

SEQ ID NO: 1216177 - DNA, 22 bp, Artificial Sequence
  chemically synthesized
cactaccaccaaagctggcgtc

SEQ ID NO: 1216178 - DNA, 22 bp, Artificial Sequence
  chemically synthesized
ccaccaaagctggcgtcaacct

SEQ ID NO: 1216179 - DNA, 22 bp, Artificial Sequence
  chemically synthesized
cagatggtgcatgtaggttgac

SEQ ID NO: 1216180 - DNA, 22 bp, Artificial Sequence
  chemically synthesized
ggcctgcagatggtgcatgtag

SEQ ID NO: 1216181 - DNA, 22 bp, Artificial Sequence
  chemically synthesized
ctaggcctgcagatggtgcatg

SEQ ID NO: 1216182 - DNA, 22 bp, Artificial Sequence
  chemically synthesized
gcgtcaacctacatgcaccatc

SEQ ID NO: 1216183 - DNA, 22 bp, Artificial Sequence
  chemically synthesized
catgcaccatctgcaggcctag

SEQ ID NO: 1216184 - DNA, 22 bp, Artificial Sequence
  chemically synthesized
ggcaagccagttcctaggcctg

SEQ ID NO: 1216185 - DNA, 22 bp, Artificial Sequence
  chemically synthesized
caggcctaggaactggcttgcc

SEQ ID NO: 1216186 - DNA, 22 bp, Artificial Sequence
  chemically synthesized
ggaactggcttgcccaatctgt

SEQ ID NO: 1216187 - DNA, 22 bp, Artificial Sequence
  chemically synthesized
gtggtggatgcaacagattggg

SEQ ID NO: 1216188 - DNA, 22 bp, Artificial Sequence
  chemically synthesized
gcttgcccaatctgttgcatcc

SEQ ID NO: 1216189 - DNA, 22 bp, Artificial Sequence
  chemically synthesized
gcccaatctgttgcatccacca

SEQ ID NO: 1216190 - DNA, 22 bp, Artificial Sequence
  chemically synthesized
cccaatctgttgcatccaccac

SEQ ID NO: 1216191 - DNA, 22 bp, Artificial Sequence
  chemically synthesized
ttgcatccaccaccaacaccat

SEQ ID NO: 1216192 - DNA, 22 bp, Artificial Sequence
  chemically synthesized
catccaccaccaacaccatcat

SEQ ID NO: 1216193 - DNA, 22 bp, Artificial Sequence
  chemically synthesized
gaatgcaagcaatccatgatgg

SEQ ID NO: 1216194 - DNA, 22 bp, Artificial Sequence
  chemically synthesized
tggaatgcaagcaatccatgat

SEQ ID NO: 1216195 - DNA, 22 bp, Artificial Sequence
  chemically synthesized
cttgcattccagagggttgccc

SEQ ID NO: 1216196 - DNA, 22 bp, Artificial Sequence
  chemically synthesized
gcattccagagggttgcccccc

SEQ ID NO: 1216197 - DNA, 22 bp, Artificial Sequence
  chemically synthesized
cattccagagggttgcccccct

SEQ ID NO: 1216198 - DNA, 22 bp, Artificial Sequence
  chemically synthesized
cagagggttgcccccctcccac

SEQ ID NO: 1216199 - DNA, 22 bp, Artificial Sequence
  chemically synthesized
cccccctcccactattgccatt

SEQ ID NO: 1216200 - DNA, 22 bp, Artificial Sequence
  chemically synthesized
ccactattgccattacccgcac

SEQ ID NO: 1216201 - DNA, 22 bp, Artificial Sequence
  chemically synthesized
ttgccattacccgcaccatgct

SEQ ID NO: 1216202 - DNA, 22 bp, Artificial Sequence
  chemically synthesized
ccattacccgcaccatgcttgc

SEQ ID NO: 1216203 - DNA, 22 bp, Artificial Sequence
  chemically synthesized
ccagcccaggggcagcaagcat

SEQ ID NO: 1216204 - DNA, 22 bp, Artificial Sequence
  chemically synthesized
cccgcaccatgcttgctgcccc

SEQ ID NO: 1216205 - DNA, 22 bp, Artificial Sequence
  chemically synthesized
ggtgggtacacaggttcccagc

SEQ ID NO: 1216206 - DNA, 22 bp, Artificial Sequence
  chemically synthesized
gctgcccctgggctgggaacct

SEQ ID NO: 1216207 - DNA, 22 bp, Artificial Sequence
  chemically synthesized
ctgcccctgggctgggaacctg

SEQ ID NO: 1216208 - DNA, 22 bp, Artificial Sequence
  chemically synthesized
cccctgggctgggaacctgtgt

SEQ ID NO: 1216209 - DNA, 22 bp, Artificial Sequence
  chemically synthesized
ggctgggaacctgtgtacccac

SEQ ID NO: 1216210 - DNA, 22 bp, Artificial Sequence
  chemically synthesized
ggaacctgtgtacccacccagc

SEQ ID NO: 1216211 - DNA, 22 bp, Artificial Sequence
  chemically synthesized
tcaggaaaagcataggtgggct

SEQ ID NO: 1216212 - DNA, 22 bp, Artificial Sequence
  chemically synthesized
tgtacccacccagcccacctat

SEQ ID NO: 1216213 - DNA, 22 bp, Artificial Sequence
  chemically synthesized
gttgtcaggaaaagcataggtg

SEQ ID NO: 1216214 - DNA, 22 bp, Artificial Sequence
  chemically synthesized
ggttgtcaggaaaagcataggt

SEQ ID NO: 1216215 - DNA, 22 bp, Artificial Sequence
  chemically synthesized
cttggttgtcaggaaaagcata

SEQ ID NO: 1216216 - DNA, 22 bp, Artificial Sequence
  chemically synthesized
gcttggttgtcaggaaaagcat

SEQ ID NO: 1216217 - DNA, 22 bp, Artificial Sequence
  chemically synthesized
taggtggcttgcttggttgtca

SEQ ID NO: 1216218 - DNA, 22 bp, Artificial Sequence
  chemically synthesized
ataggtggcttgcttggttgtc

SEQ ID NO: 1216219 - DNA, 22 bp, Artificial Sequence
  chemically synthesized
tgcttttcctgacaaccaagca

SEQ ID NO: 1216220 - DNA, 22 bp, Artificial Sequence
  chemically synthesized
gcttataggtggcttgcttggt

SEQ ID NO: 1216221 - DNA, 22 bp, Artificial Sequence
  chemically synthesized
ggcttataggtggcttgcttgg

SEQ ID NO: 1216222 - DNA, 22 bp, Artificial Sequence
  chemically synthesized
tggcttataggtggcttgcttg

SEQ ID NO: 1216223 - DNA, 22 bp, Artificial Sequence
  chemically synthesized
ttcctgacaaccaagcaagcca

SEQ ID NO: 1216224 - DNA, 22 bp, Artificial Sequence
  chemically synthesized
tcctgacaaccaagcaagccac

SEQ ID NO: 1216225 - DNA, 22 bp, Artificial Sequence
  chemically synthesized
cctgacaaccaagcaagccacc

SEQ ID NO: 1216226 - DNA, 22 bp, Artificial Sequence
  chemically synthesized
ctgacaaccaagcaagccacct

SEQ ID NO: 1216227 - DNA, 22 bp, Artificial Sequence
  chemically synthesized
accctttggcttataggtggct

SEQ ID NO: 1216228 - DNA, 22 bp, Artificial Sequence
  chemically synthesized
acaaccaagcaagccacctata

SEQ ID NO: 1216229 - DNA, 22 bp, Artificial Sequence
  chemically synthesized
gtgtgtccaggcaggctaaccc

SEQ ID NO: 1216230 - DNA, 22 bp, Artificial Sequence
  chemically synthesized
taagccaaagggttagcctgcc

SEQ ID NO: 1216231 - DNA, 22 bp, Artificial Sequence
  chemically synthesized
atgttagtgtgtccaggcaggc

SEQ ID NO: 1216232 - DNA, 22 bp, Artificial Sequence
  chemically synthesized
gcattgatgttagtgtgtccag

SEQ ID NO: 1216233 - DNA, 22 bp, Artificial Sequence
  chemically synthesized
gcctgcctggacacactaacat

SEQ ID NO: 1216234 - DNA, 22 bp, Artificial Sequence
  chemically synthesized
tgtacattggcattgatgttag

SEQ ID NO: 1216235 - DNA, 22 bp, Artificial Sequence
  chemically synthesized
cctggacacactaacatcaatg

SEQ ID NO: 1216236 - DNA, 22 bp, Artificial Sequence
  chemically synthesized
gacacactaacatcaatgccaa

SEQ ID NO: 1216237 - DNA, 22 bp, Artificial Sequence
  chemically synthesized
agagctgtgtacattggcattg

SEQ ID NO: 1216238 - DNA, 22 bp, Artificial Sequence
  chemically synthesized
aggcctcagagctgtgtacatt

SEQ ID NO: 1216239 - DNA, 22 bp, Artificial Sequence
  chemically synthesized
acatcaatgccaatgtacacag

SEQ ID NO: 1216240 - DNA, 22 bp, Artificial Sequence
  chemically synthesized
tcctcaggcctcagagctgtgt

SEQ ID NO: 1216241 - DNA, 22 bp, Artificial Sequence
  chemically synthesized
agcgtgcctgtcctcaggcctc

SEQ ID NO: 1216242 - DNA, 22 bp, Artificial Sequence
  chemically synthesized
gttgagcgtgcctgtcctcagg

SEQ ID NO: 1216243 - DNA, 22 bp, Artificial Sequence
  chemically synthesized
tgaggcctgaggacaggcacgc

SEQ ID NO: 1216244 - DNA, 22 bp, Artificial Sequence
  chemically synthesized
aggcctgaggacaggcacgctc

SEQ ID NO: 1216245 - DNA, 22 bp, Artificial Sequence
  chemically synthesized
aggacaggcacgctcaaccaac

SEQ ID NO: 1216246 - DNA, 22 bp, Artificial Sequence
  chemically synthesized
aggccccagtggtggcatcagt

SEQ ID NO: 1216247 - DNA, 22 bp, Artificial Sequence
  chemically synthesized
caggccccagtggtggcatcag

SEQ ID NO: 1216248 - DNA, 22 bp, Artificial Sequence
  chemically synthesized
aaccaactgatgccaccactgg

SEQ ID NO: 1216249 - DNA, 22 bp, Artificial Sequence
  chemically synthesized
atgccaccactggggcctgaag

SEQ ID NO: 1216250 - DNA, 22 bp, Artificial Sequence
  chemically synthesized
ggacaccaagtggtccagtctt

SEQ ID NO: 1216251 - DNA, 22 bp, Artificial Sequence
  chemically synthesized
gggcctgaagactggaccactt

SEQ ID NO: 1216252 - DNA, 22 bp, Artificial Sequence
  chemically synthesized
ccggtgactgggacaccaagtg

SEQ ID NO: 1216253 - DNA, 22 bp, Artificial Sequence
  chemically synthesized
gccggtgactgggacaccaagt

SEQ ID NO: 1216254 - DNA, 22 bp, Artificial Sequence
  chemically synthesized
aagactggaccacttggtgtcc

SEQ ID NO: 1216255 - DNA, 22 bp, Artificial Sequence
  chemically synthesized
tgccggtgactgggacaccaag

SEQ ID NO: 1216256 - DNA, 22 bp, Artificial Sequence
  chemically synthesized
gaccacttggtgtcccagtcac

SEQ ID NO: 1216257 - DNA, 22 bp, Artificial Sequence
  chemically synthesized
tggtgaagttttgccggtgact

SEQ ID NO: 1216258 - DNA, 22 bp, Artificial Sequence
  chemically synthesized
ggtgtcccagtcaccggcaaaa

SEQ ID NO: 1216259 - DNA, 22 bp, Artificial Sequence
  chemically synthesized
gtgtcccagtcaccggcaaaac

SEQ ID NO: 1216260 - DNA, 22 bp, Artificial Sequence
  chemically synthesized
gcagaagctgtggtgaagtttt

SEQ ID NO: 1216261 - DNA, 22 bp, Artificial Sequence
  chemically synthesized
ttagcagaagctgtggtgaagt

SEQ ID NO: 1216262 - DNA, 22 bp, Artificial Sequence
  chemically synthesized
gggtgcagttgttagcagaagc

SEQ ID NO: 1216263 - DNA, 22 bp, Artificial Sequence
  chemically synthesized
agggtgcagttgttagcagaag

SEQ ID NO: 1216264 - DNA, 22 bp, Artificial Sequence
  chemically synthesized
caccacagcttctgctaacaac

SEQ ID NO: 1216265 - DNA, 22 bp, Artificial Sequence
  chemically synthesized
accacagcttctgctaacaact

SEQ ID NO: 1216266 - DNA, 22 bp, Artificial Sequence
  chemically synthesized
agtagcttagggtgcagttgtt

SEQ ID NO: 1216267 - DNA, 22 bp, Artificial Sequence
  chemically synthesized
ctcagtagcttagggtgcagtt

SEQ ID NO: 1216268 - DNA, 22 bp, Artificial Sequence
  chemically synthesized
cctcagtagcttagggtgcagt

SEQ ID NO: 1216269 - DNA, 22 bp, Artificial Sequence
  chemically synthesized
ctgctaacaactgcaccctaag

SEQ ID NO: 1216270 - DNA, 22 bp, Artificial Sequence
  chemically synthesized
tgctaacaactgcaccctaagc

SEQ ID NO: 1216271 - DNA, 22 bp, Artificial Sequence
  chemically synthesized
ctaacaactgcaccctaagcta

SEQ ID NO: 1216272 - DNA, 22 bp, Artificial Sequence
  chemically synthesized
taacttcctcagtagcttaggg

SEQ ID NO: 1216273 - DNA, 22 bp, Artificial Sequence
  chemically synthesized
acaactgcaccctaagctactg

SEQ ID NO: 1216274 - DNA, 22 bp, Artificial Sequence
  chemically synthesized
caccctaagctactgaggaagt

SEQ ID NO: 1216275 - DNA, 22 bp, Artificial Sequence
  chemically synthesized
agctactgaggaagttacagac

SEQ ID NO: 1216276 - DNA, 22 bp, Artificial Sequence
  chemically synthesized
ctgaggaagttacagacaccat

SEQ ID NO: 1216277 - DNA, 22 bp, Artificial Sequence
  chemically synthesized
aggaagttacagacaccattca

SEQ ID NO: 1216278 - DNA, 22 bp, Artificial Sequence
  chemically synthesized
gatgtaaacagtatgaatggtg

SEQ ID NO: 1216279 - DNA, 22 bp, Artificial Sequence
  chemically synthesized
ggatgtaaacagtatgaatggt

SEQ ID NO: 1216280 - DNA, 22 bp, Artificial Sequence
  chemically synthesized
tggatgtaaacagtatgaatgg

SEQ ID NO: 1216281 - DNA, 22 bp, Artificial Sequence
  chemically synthesized
tttggatgtaaacagtatgaat

SEQ ID NO: 1216282 - DNA, 22 bp, Artificial Sequence
  chemically synthesized
ctttggatgtaaacagtatgaa

SEQ ID NO: 1216283 - DNA, 22 bp, Artificial Sequence
  chemically synthesized
cagacaccattcatactgttta

SEQ ID NO: 1216284 - DNA, 22 bp, Artificial Sequence
  chemically synthesized
tatgatttctttggatgtaaac

SEQ ID NO: 1216285 - DNA, 22 bp, Artificial Sequence
  chemically synthesized
ctgtatgatttctttggatgta

SEQ ID NO: 1216286 - DNA, 22 bp, Artificial Sequence
  chemically synthesized
cctgtatgatttctttggatgt

SEQ ID NO: 1216287 - DNA, 22 bp, Artificial Sequence
  chemically synthesized
atactgtttacatccaaagaaa

SEQ ID NO: 1216288 - DNA, 22 bp, Artificial Sequence
  chemically synthesized
tttacatccaaagaaatcatac

SEQ ID NO: 1216289 - DNA, 22 bp, Artificial Sequence
  chemically synthesized
acatccaaagaaatcatacagg

SEQ ID NO: 1216290 - DNA, 22 bp, Artificial Sequence
  chemically synthesized
catccaaagaaatcatacagga

SEQ ID NO: 1216291 - DNA, 22 bp, Artificial Sequence
  chemically synthesized
aatgtatatagtagtatacttc

SEQ ID NO: 1216292 - DNA, 22 bp, Artificial Sequence
  chemically synthesized
tgaatgtatatagtagtatact

SEQ ID NO: 1216293 - DNA, 22 bp, Artificial Sequence
  chemically synthesized
attctgaatgtatatagtagta

SEQ ID NO: 1216294 - DNA, 22 bp, Artificial Sequence
  chemically synthesized
gattctgaatgtatatagtagt

SEQ ID NO: 1216295 - DNA, 22 bp, Artificial Sequence
  chemically synthesized
tgattctgaatgtatatagtag

SEQ ID NO: 1216296 - DNA, 22 bp, Artificial Sequence
  chemically synthesized
cctttgattctgaatgtatata

SEQ ID NO: 1216297 - DNA, 22 bp, Artificial Sequence
  chemically synthesized
gcctttgattctgaatgtatat

SEQ ID NO: 1216298 - DNA, 22 bp, Artificial Sequence
  chemically synthesized
tgcctttgattctgaatgtata

SEQ ID NO: 1216299 - DNA, 22 bp, Artificial Sequence
  chemically synthesized
agtctttgcctttgattctgaa

SEQ ID NO: 1216300 - DNA, 22 bp, Artificial Sequence
  chemically synthesized
gagtctttgcctttgattctga

SEQ ID NO: 1216301 - DNA, 22 bp, Artificial Sequence
  chemically synthesized
ctatatacattcagaatcaaag

SEQ ID NO: 1216302 - DNA, 22 bp, Artificial Sequence
  chemically synthesized
ttgagtctttgcctttgattct

SEQ ID NO: 1216303 - DNA, 22 bp, Artificial Sequence
  chemically synthesized
tatacattcagaatcaaaggca

SEQ ID NO: 1216304 - DNA, 22 bp, Artificial Sequence
  chemically synthesized
ctcttgagtctttgcctttgat

SEQ ID NO: 1216305 - DNA, 22 bp, Artificial Sequence
  chemically synthesized
gtctcctcttgagtctttgcct

SEQ ID NO: 1216306 - DNA, 22 bp, Artificial Sequence
  chemically synthesized
agaatcaaaggcaaagactcaa

SEQ ID NO: 1216307 - DNA, 22 bp, Artificial Sequence
  chemically synthesized
tctagtctcctcttgagtcttt

SEQ ID NO: 1216308 - DNA, 22 bp, Artificial Sequence
  chemically synthesized
atctagtctcctcttgagtctt

SEQ ID NO: 1216309 - DNA, 22 bp, Artificial Sequence
  chemically synthesized
tatctagtctcctcttgagtct

SEQ ID NO: 1216310 - DNA, 22 bp, Artificial Sequence
  chemically synthesized
ttttatctagtctcctcttgag

SEQ ID NO: 1216311 - DNA, 22 bp, Artificial Sequence
  chemically synthesized
tgttttatctagtctcctcttg

SEQ ID NO: 1216312 - DNA, 22 bp, Artificial Sequence
  chemically synthesized
ctgttttatctagtctcctctt

SEQ ID NO: 1216313 - DNA, 22 bp, Artificial Sequence
  chemically synthesized
ttctgttttatctagtctcctc

SEQ ID NO: 1216314 - DNA, 22 bp, Artificial Sequence
  chemically synthesized
agattcttctgttttatctagt

SEQ ID NO: 1216315 - DNA, 22 bp, Artificial Sequence
  chemically synthesized
tgagattcttctgttttatcta

SEQ ID NO: 1216316 - DNA, 22 bp, Artificial Sequence
  chemically synthesized
aagaggagactagataaaacag

SEQ ID NO: 1216317 - DNA, 22 bp, Artificial Sequence
  chemically synthesized
atgttctgagattcttctgttt

SEQ ID NO: 1216318 - DNA, 22 bp, Artificial Sequence
  chemically synthesized
catgttctgagattcttctgtt

SEQ ID NO: 1216319 - DNA, 22 bp, Artificial Sequence
  chemically synthesized
tcatgttctgagattcttctgt

SEQ ID NO: 1216320 - DNA, 22 bp, Artificial Sequence
  chemically synthesized
ttttcatgttctgagattcttc

SEQ ID NO: 1216321 - DNA, 22 bp, Artificial Sequence
  chemically synthesized
gataaaacagaagaatctcaga

SEQ ID NO: 1216322 - DNA, 22 bp, Artificial Sequence
  chemically synthesized
aaagacctgttttcatgttctg

SEQ ID NO: 1216323 - DNA, 22 bp, Artificial Sequence
  chemically synthesized
aaaagacctgttttcatgttct

SEQ ID NO: 1216324 - DNA, 22 bp, Artificial Sequence
  chemically synthesized
taaaagacctgttttcatgttc

SEQ ID NO: 1216325 - DNA, 22 bp, Artificial Sequence
  chemically synthesized
ttttaaaagacctgttttcatg

SEQ ID NO: 1216326 - DNA, 22 bp, Artificial Sequence
  chemically synthesized
agaacatgaaaacaggtctttt

SEQ ID NO: 1216327 - DNA, 22 bp, Artificial Sequence
  chemically synthesized
agtaggttattttaaaagacct

SEQ ID NO: 1216328 - DNA, 22 bp, Artificial Sequence
  chemically synthesized
gagtaggttattttaaaagacc

SEQ ID NO: 1216329 - DNA, 22 bp, Artificial Sequence
  chemically synthesized
tttgagtaggttattttaaaag

SEQ ID NO: 1216330 - DNA, 22 bp, Artificial Sequence
  chemically synthesized
gtttgagtaggttattttaaaa

SEQ ID NO: 1216331 - DNA, 22 bp, Artificial Sequence
  chemically synthesized
tgtttgagtaggttattttaaa

SEQ ID NO: 1216332 - DNA, 22 bp, Artificial Sequence
  chemically synthesized
ttgtttgagtaggttattttaa

SEQ ID NO: 1216333 - DNA, 22 bp, Artificial Sequence
  chemically synthesized
tttgtttgagtaggttatttta

SEQ ID NO: 1216334 - DNA, 22 bp, Artificial Sequence
  chemically synthesized
ttttttgtttgagtaggttatt

SEQ ID NO: 1216335 - DNA, 22 bp, Artificial Sequence
  chemically synthesized
ttattttttgtttgagtaggtt

SEQ ID NO: 1216336 - DNA, 22 bp, Artificial Sequence
  chemically synthesized
gttattttttgtttgagtaggt

SEQ ID NO: 1216337 - DNA, 22 bp, Artificial Sequence
  chemically synthesized
tgttattttttgtttgagtagg

SEQ ID NO: 1216338 - DNA, 22 bp, Artificial Sequence
  chemically synthesized
ttgttattttttgtttgagtag

SEQ ID NO: 1216339 - DNA, 22 bp, Artificial Sequence
  chemically synthesized
tttgttattttttgtttgagta

SEQ ID NO: 1216340 - DNA, 22 bp, Artificial Sequence
  chemically synthesized
ttaaaataacctactcaaacaa

SEQ ID NO: 1216341 - DNA, 22 bp, Artificial Sequence
  chemically synthesized
taaaataacctactcaaacaaa

SEQ ID NO: 1216342 - DNA, 22 bp, Artificial Sequence
  chemically synthesized
aaaataacctactcaaacaaaa

SEQ ID NO: 1216343 - DNA, 22 bp, Artificial Sequence
  chemically synthesized
aaataacctactcaaacaaaaa

SEQ ID NO: 1216344 - DNA, 22 bp, Artificial Sequence
  chemically synthesized
aaattttttgttattttttgtt

SEQ ID NO: 1216345 - DNA, 22 bp, Artificial Sequence
  chemically synthesized
aaaattttttgttattttttgt

SEQ ID NO: 1216346 - DNA, 22 bp, Artificial Sequence
  chemically synthesized
taaaattttttgttattttttg

SEQ ID NO: 1216347 - DNA, 22 bp, Artificial Sequence
  chemically synthesized
ttaaaattttttgttatttttt

SEQ ID NO: 1216348 - DNA, 22 bp, Artificial Sequence
  chemically synthesized
tttaaaattttttgttattttt

SEQ ID NO: 1216349 - DNA, 22 bp, Artificial Sequence
  chemically synthesized
ttttaaaattttttgttatttt

SEQ ID NO: 1216350 - DNA, 22 bp, Artificial Sequence
  chemically synthesized
ctcaaacaaaaaataacaaaaa

SEQ ID NO: 1216351 - DNA, 22 bp, Artificial Sequence
  chemically synthesized
atttttttaaaattttttgtta

SEQ ID NO: 1216352 - DNA, 22 bp, Artificial Sequence
  chemically synthesized
aaacaaaaaataacaaaaaatt

SEQ ID NO: 1216353 - DNA, 22 bp, Artificial Sequence
  chemically synthesized
ctcatttttttaaaattttttg

SEQ ID NO: 1216354 - DNA, 22 bp, Artificial Sequence
  chemically synthesized
gctcatttttttaaaatttttt

SEQ ID NO: 1216355 - DNA, 22 bp, Artificial Sequence
  chemically synthesized
tgctcatttttttaaaattttt

SEQ ID NO: 1216356 - DNA, 22 bp, Artificial Sequence
  chemically synthesized
tatatgtcacataggctttgct

SEQ ID NO: 1216357 - DNA, 22 bp, Artificial Sequence
  chemically synthesized
taaaaaaatgagcaaagcctat

SEQ ID NO: 1216358 - DNA, 22 bp, Artificial Sequence
  chemically synthesized
aaaaaaatgagcaaagcctatg

SEQ ID NO: 1216359 - DNA, 22 bp, Artificial Sequence
  chemically synthesized
aaaaaatgagcaaagcctatgt

SEQ ID NO: 1216360 - DNA, 22 bp, Artificial Sequence
  chemically synthesized
tggtgttgtatatgtcacatag

SEQ ID NO: 1216361 - DNA, 22 bp, Artificial Sequence
  chemically synthesized
atggtgttgtatatgtcacata

SEQ ID NO: 1216362 - DNA, 22 bp, Artificial Sequence
  chemically synthesized
tatggtgttgtatatgtcacat

SEQ ID NO: 1216363 - DNA, 22 bp, Artificial Sequence
  chemically synthesized
atggctttatggtgttgtatat

SEQ ID NO: 1216364 - DNA, 22 bp, Artificial Sequence
  chemically synthesized
catggctttatggtgttgtata

SEQ ID NO: 1216365 - DNA, 22 bp, Artificial Sequence
  chemically synthesized
tgtgacatatacaacaccataa

SEQ ID NO: 1216366 - DNA, 22 bp, Artificial Sequence
  chemically synthesized
ggacataaaaaatgcaagcatt

SEQ ID NO: 1216367 - DNA, 22 bp, Artificial Sequence
  chemically synthesized
taggacataaaaaatgcaagca

SEQ ID NO: 1216368 - DNA, 22 bp, Artificial Sequence
  chemically synthesized
ctaggacataaaaaatgcaagc

SEQ ID NO: 1216369 - DNA, 22 bp, Artificial Sequence
  chemically synthesized
ccttctaggacataaaaaatgc

SEQ ID NO: 1216370 - DNA, 22 bp, Artificial Sequence
  chemically synthesized
accttctaggacataaaaaatg

SEQ ID NO: 1216371 - DNA, 22 bp, Artificial Sequence
  chemically synthesized
taccttctaggacataaaaaat

SEQ ID NO: 1216372 - DNA, 22 bp, Artificial Sequence
  chemically synthesized
ctttaccttctaggacataaaa

SEQ ID NO: 1216373 - DNA, 22 bp, Artificial Sequence
  chemically synthesized
tcctttaccttctaggacataa

SEQ ID NO: 1216374 - DNA, 22 bp, Artificial Sequence
  chemically synthesized
ctcctttaccttctaggacata

SEQ ID NO: 1216375 - DNA, 22 bp, Artificial Sequence
  chemically synthesized
gcattttttatgtcctagaagg

SEQ ID NO: 1216376 - DNA, 22 bp, Artificial Sequence
  chemically synthesized
gtttctcctttaccttctagga

SEQ ID NO: 1216377 - DNA, 22 bp, Artificial Sequence
  chemically synthesized
cattttttatgtcctagaaggt

SEQ ID NO: 1216378 - DNA, 22 bp, Artificial Sequence
  chemically synthesized
agtttctcctttaccttctagg

SEQ ID NO: 1216379 - DNA, 22 bp, Artificial Sequence
  chemically synthesized
tagtttctcctttaccttctag

SEQ ID NO: 1216380 - DNA, 22 bp, Artificial Sequence
  chemically synthesized
tttatgtcctagaaggtaaagg

SEQ ID NO: 1216381 - DNA, 22 bp, Artificial Sequence
  chemically synthesized
ttatgtcctagaaggtaaagga

SEQ ID NO: 1216382 - DNA, 22 bp, Artificial Sequence
  chemically synthesized
tatgtcctagaaggtaaaggag

SEQ ID NO: 1216383 - DNA, 22 bp, Artificial Sequence
  chemically synthesized
aacctttagtttctcctttacc

SEQ ID NO: 1216384 - DNA, 22 bp, Artificial Sequence
  chemically synthesized
atgtcctagaaggtaaaggaga

SEQ ID NO: 1216385 - DNA, 22 bp, Artificial Sequence
  chemically synthesized
tgtcctagaaggtaaaggagaa

SEQ ID NO: 1216386 - DNA, 22 bp, Artificial Sequence
  chemically synthesized
taaacctttagtttctccttta

SEQ ID NO: 1216387 - DNA, 22 bp, Artificial Sequence
  chemically synthesized
ctaaacctttagtttctccttt

SEQ ID NO: 1216388 - DNA, 22 bp, Artificial Sequence
  chemically synthesized
gaaggtaaaggagaaactaaag

SEQ ID NO: 1216389 - DNA, 22 bp, Artificial Sequence
  chemically synthesized
aatagggtttctaaacctttag

SEQ ID NO: 1216390 - DNA, 22 bp, Artificial Sequence
  chemically synthesized
ttaaatagggtttctaaacctt

SEQ ID NO: 1216391 - DNA, 22 bp, Artificial Sequence
  chemically synthesized
gttaaatagggtttctaaacct

SEQ ID NO: 1216392 - DNA, 22 bp, Artificial Sequence
  chemically synthesized
tgttaaatagggtttctaaacc

SEQ ID NO: 1216393 - DNA, 22 bp, Artificial Sequence
  chemically synthesized
ttttgttaaatagggtttctaa

SEQ ID NO: 1216394 - DNA, 22 bp, Artificial Sequence
  chemically synthesized
ttattttgttaaatagggtttc

SEQ ID NO: 1216395 - DNA, 22 bp, Artificial Sequence
  chemically synthesized
aaggtttagaaaccctatttaa

SEQ ID NO: 1216396 - DNA, 22 bp, Artificial Sequence
  chemically synthesized
atctattattttgttaaatagg

SEQ ID NO: 1216397 - DNA, 22 bp, Artificial Sequence
  chemically synthesized
catctattattttgttaaatag

SEQ ID NO: 1216398 - DNA, 22 bp, Artificial Sequence
  chemically synthesized
agaaaccctatttaacaaaata

SEQ ID NO: 1216399 - DNA, 22 bp, Artificial Sequence
  chemically synthesized
gaaaccctatttaacaaaataa

SEQ ID NO: 1216400 - DNA, 22 bp, Artificial Sequence
  chemically synthesized
ggaagatttcatctattatttt

SEQ ID NO: 1216401 - DNA, 22 bp, Artificial Sequence
  chemically synthesized
gggaagatttcatctattattt

SEQ ID NO: 1216402 - DNA, 22 bp, Artificial Sequence
  chemically synthesized
tttaacaaaataatagatgaaa

SEQ ID NO: 1216403 - DNA, 22 bp, Artificial Sequence
  chemically synthesized
gacttgggaagatttcatctat

SEQ ID NO: 1216404 - DNA, 22 bp, Artificial Sequence
  chemically synthesized
aacaaaataatagatgaaatct

SEQ ID NO: 1216405 - DNA, 22 bp, Artificial Sequence
  chemically synthesized
ctagacttgggaagatttcatc

SEQ ID NO: 1216406 - DNA, 22 bp, Artificial Sequence
  chemically synthesized
acaaaataatagatgaaatctt

SEQ ID NO: 1216407 - DNA, 22 bp, Artificial Sequence
  chemically synthesized
gctagacttgggaagatttcat

SEQ ID NO: 1216408 - DNA, 22 bp, Artificial Sequence
  chemically synthesized
ttgctagacttgggaagatttc

SEQ ID NO: 1216409 - DNA, 22 bp, Artificial Sequence
  chemically synthesized
aatctcttgctagacttgggaa

SEQ ID NO: 1216410 - DNA, 22 bp, Artificial Sequence
  chemically synthesized
gatgtctaaatctcttgctaga

SEQ ID NO: 1216411 - DNA, 22 bp, Artificial Sequence
  chemically synthesized
cccaagtctagcaagagattta

SEQ ID NO: 1216412 - DNA, 22 bp, Artificial Sequence
  chemically synthesized
tatctggatgtctaaatctctt

SEQ ID NO: 1216413 - DNA, 22 bp, Artificial Sequence
  chemically synthesized
ccaagtctagcaagagatttag

SEQ ID NO: 1216414 - DNA, 22 bp, Artificial Sequence
  chemically synthesized
agcatcctgtatctggatgtct

SEQ ID NO: 1216415 - DNA, 22 bp, Artificial Sequence
  chemically synthesized
gcaagagatttagacatccaga

SEQ ID NO: 1216416 - DNA, 22 bp, Artificial Sequence
  chemically synthesized
cagcatcctgtatctggatgtc

SEQ ID NO: 1216417 - DNA, 22 bp, Artificial Sequence
  chemically synthesized
tcagcatcctgtatctggatgt

SEQ ID NO: 1216418 - DNA, 22 bp, Artificial Sequence
  chemically synthesized
agatctttcagcatcctgtatc

SEQ ID NO: 1216419 - DNA, 22 bp, Artificial Sequence
  chemically synthesized
gagatctttcagcatcctgtat

SEQ ID NO: 1216420 - DNA, 22 bp, Artificial Sequence
  chemically synthesized
tgagatctttcagcatcctgta

SEQ ID NO: 1216421 - DNA, 22 bp, Artificial Sequence
  chemically synthesized
agacatccagatacaggatgct

SEQ ID NO: 1216422 - DNA, 22 bp, Artificial Sequence
  chemically synthesized
ttgagatctttcagcatcctgt

SEQ ID NO: 1216423 - DNA, 22 bp, Artificial Sequence
  chemically synthesized
gacatccagatacaggatgctg

SEQ ID NO: 1216424 - DNA, 22 bp, Artificial Sequence
  chemically synthesized
tttgagatctttcagcatcctg

SEQ ID NO: 1216425 - DNA, 22 bp, Artificial Sequence
  chemically synthesized
tatccctttttgagatctttca

SEQ ID NO: 1216426 - DNA, 22 bp, Artificial Sequence
  chemically synthesized
aattgtatccctttttgagatc

SEQ ID NO: 1216427 - DNA, 22 bp, Artificial Sequence
  chemically synthesized
gaattgtatccctttttgagat

SEQ ID NO: 1216428 - DNA, 22 bp, Artificial Sequence
  chemically synthesized
tgaattgtatccctttttgaga

SEQ ID NO: 1216429 - DNA, 22 bp, Artificial Sequence
  chemically synthesized
ttgaattgtatccctttttgag

SEQ ID NO: 1216430 - DNA, 22 bp, Artificial Sequence
  chemically synthesized
aaagatctcaaaaagggataca

SEQ ID NO: 1216431 - DNA, 22 bp, Artificial Sequence
  chemically synthesized
aaaaagggatacaattcaaaaa

SEQ ID NO: 1216432 - DNA, 22 bp, Artificial Sequence
  chemically synthesized
taatgtgtcatggacaagacat

SEQ ID NO: 1216433 - DNA, 22 bp, Artificial Sequence
  chemically synthesized
gctataatgtgtcatggacaag

SEQ ID NO: 1216434 - DNA, 22 bp, Artificial Sequence
  chemically synthesized
ggctataatgtgtcatggacaa

SEQ ID NO: 1216435 - DNA, 22 bp, Artificial Sequence
  chemically synthesized
aaaaatgtcttgtccatgacac

SEQ ID NO: 1216436 - DNA, 22 bp, Artificial Sequence
  chemically synthesized
agagtttggctataatgtgtca

SEQ ID NO: 1216437 - DNA, 22 bp, Artificial Sequence
  chemically synthesized
gagagtttggctataatgtgtc

SEQ ID NO: 1216438 - DNA, 22 bp, Artificial Sequence
  chemically synthesized
tgagagtttggctataatgtgt

SEQ ID NO: 1216439 - DNA, 22 bp, Artificial Sequence
  chemically synthesized
ttgagagtttggctataatgtg

SEQ ID NO: 1216440 - DNA, 22 bp, Artificial Sequence
  chemically synthesized
gtccatgacacattatagccaa

SEQ ID NO: 1216441 - DNA, 22 bp, Artificial Sequence
  chemically synthesized
gcttttgagagtttggctataa

SEQ ID NO: 1216442 - DNA, 22 bp, Artificial Sequence
  chemically synthesized
tccatgacacattatagccaaa

SEQ ID NO: 1216443 - DNA, 22 bp, Artificial Sequence
  chemically synthesized
ggcttttgagagtttggctata

SEQ ID NO: 1216444 - DNA, 22 bp, Artificial Sequence
  chemically synthesized
tggcttttgagagtttggctat

SEQ ID NO: 1216445 - DNA, 22 bp, Artificial Sequence
  chemically synthesized
tctttggcttttgagagtttgg

SEQ ID NO: 1216446 - DNA, 22 bp, Artificial Sequence
  chemically synthesized
gtctttggcttttgagagtttg

SEQ ID NO: 1216447 - DNA, 22 bp, Artificial Sequence
  chemically synthesized
tgtctttggcttttgagagttt

SEQ ID NO: 1216448 - DNA, 22 bp, Artificial Sequence
  chemically synthesized
ttgtctttggcttttgagagtt

SEQ ID NO: 1216449 - DNA, 22 bp, Artificial Sequence
  chemically synthesized
tttgtctttggcttttgagagt

SEQ ID NO: 1216450 - DNA, 22 bp, Artificial Sequence
  chemically synthesized
tttttgtctttggcttttgaga

SEQ ID NO: 1216451 - DNA, 22 bp, Artificial Sequence
  chemically synthesized
tctttttgtctttggcttttga

SEQ ID NO: 1216452 - DNA, 22 bp, Artificial Sequence
  chemically synthesized
tagccaaactctcaaaagccaa

SEQ ID NO: 1216453 - DNA, 22 bp, Artificial Sequence
  chemically synthesized
gaattctctttttgtctttggc

SEQ ID NO: 1216454 - DNA, 22 bp, Artificial Sequence
  chemically synthesized
agaattctctttttgtctttgg

SEQ ID NO: 1216455 - DNA, 22 bp, Artificial Sequence
  chemically synthesized
tagaattctctttttgtctttg

SEQ ID NO: 1216456 - DNA, 22 bp, Artificial Sequence
  chemically synthesized
ttagaattctctttttgtcttt

SEQ ID NO: 1216457 - DNA, 22 bp, Artificial Sequence
  chemically synthesized
tcaaaagccaaagacaaaaaga

SEQ ID NO: 1216458 - DNA, 22 bp, Artificial Sequence
  chemically synthesized
tttttagaattctctttttgtc

SEQ ID NO: 1216459 - DNA, 22 bp, Artificial Sequence
  chemically synthesized
aaaagccaaagacaaaaagaga

SEQ ID NO: 1216460 - DNA, 22 bp, Artificial Sequence
  chemically synthesized
ctgtttttagaattctcttttt

SEQ ID NO: 1216461 - DNA, 22 bp, Artificial Sequence
  chemically synthesized
gctgtttttagaattctctttt

SEQ ID NO: 1216462 - DNA, 22 bp, Artificial Sequence
  chemically synthesized
ttgctgtttttagaattctctt

SEQ ID NO: 1216463 - DNA, 22 bp, Artificial Sequence
  chemically synthesized
tcttgctgtttttagaattctc

SEQ ID NO: 1216464 - DNA, 22 bp, Artificial Sequence
  chemically synthesized
ctcttgctgtttttagaattct

SEQ ID NO: 1216465 - DNA, 22 bp, Artificial Sequence
  chemically synthesized
tctcttgctgtttttagaattc

SEQ ID NO: 1216466 - DNA, 22 bp, Artificial Sequence
  chemically synthesized
ttctcttgctgtttttagaatt

SEQ ID NO: 1216467 - DNA, 22 bp, Artificial Sequence
  chemically synthesized
taaaaacagcaagagaaaagca

SEQ ID NO: 1216468 - DNA, 22 bp, Artificial Sequence
  chemically synthesized
taagtgacaaggtgcttttctc

SEQ ID NO: 1216469 - DNA, 22 bp, Artificial Sequence
  chemically synthesized
ataagtgacaaggtgcttttct

SEQ ID NO: 1216470 - DNA, 22 bp, Artificial Sequence
  chemically synthesized
aaaacagcaagagaaaagcacc

SEQ ID NO: 1216471 - DNA, 22 bp, Artificial Sequence
  chemically synthesized
tataagtgacaaggtgcttttc

SEQ ID NO: 1216472 - DNA, 22 bp, Artificial Sequence
  chemically synthesized
tttataagtgacaaggtgcttt

SEQ ID NO: 1216473 - DNA, 22 bp, Artificial Sequence
  chemically synthesized
ctttataagtgacaaggtgctt

SEQ ID NO: 1216474 - DNA, 22 bp, Artificial Sequence
  chemically synthesized
atggaggtttctttataagtga

SEQ ID NO: 1216475 - DNA, 22 bp, Artificial Sequence
  chemically synthesized
atctgatggaggtttctttata

SEQ ID NO: 1216476 - DNA, 22 bp, Artificial Sequence
  chemically synthesized
ttaatctgatggaggtttcttt

SEQ ID NO: 1216477 - DNA, 22 bp, Artificial Sequence
  chemically synthesized
gtcacttataaagaaacctcca

SEQ ID NO: 1216478 - DNA, 22 bp, Artificial Sequence
  chemically synthesized
tcacttataaagaaacctccat

SEQ ID NO: 1216479 - DNA, 22 bp, Artificial Sequence
  chemically synthesized
actgttaatctgatggaggttt

SEQ ID NO: 1216480 - DNA, 22 bp, Artificial Sequence
  chemically synthesized
ataaagaaacctccatcagatt

SEQ ID NO: 1216481 - DNA, 22 bp, Artificial Sequence
  chemically synthesized
taaagaaacctccatcagatta

SEQ ID NO: 1216482 - DNA, 22 bp, Artificial Sequence
  chemically synthesized
agaaattcactgttaatctgat

SEQ ID NO: 1216483 - DNA, 22 bp, Artificial Sequence
  chemically synthesized
tgagaaattcactgttaatctg

SEQ ID NO: 1216484 - DNA, 22 bp, Artificial Sequence
  chemically synthesized
ctgagaaattcactgttaatct

SEQ ID NO: 1216485 - DNA, 22 bp, Artificial Sequence
  chemically synthesized
ttctgagaaattcactgttaat

SEQ ID NO: 1216486 - DNA, 22 bp, Artificial Sequence
  chemically synthesized
cttctgagaaattcactgttaa

SEQ ID NO: 1216487 - DNA, 22 bp, Artificial Sequence
  chemically synthesized
catcagattaacagtgaatttc

SEQ ID NO: 1216488 - DNA, 22 bp, Artificial Sequence
  chemically synthesized
taaggtttcttctgagaaattc

SEQ ID NO: 1216489 - DNA, 22 bp, Artificial Sequence
  chemically synthesized
gcctgtaaggtttcttctgaga

SEQ ID NO: 1216490 - DNA, 22 bp, Artificial Sequence
  chemically synthesized
acagtgaatttctcagaagaaa

SEQ ID NO: 1216491 - DNA, 22 bp, Artificial Sequence
  chemically synthesized
tggcctgtaaggtttcttctga

SEQ ID NO: 1216492 - DNA, 22 bp, Artificial Sequence
  chemically synthesized
tctggcctgtaaggtttcttct

SEQ ID NO: 1216493 - DNA, 22 bp, Artificial Sequence
  chemically synthesized
ctctggcctgtaaggtttcttc

SEQ ID NO: 1216494 - DNA, 22 bp, Artificial Sequence
  chemically synthesized
ttctctggcctgtaaggtttct

SEQ ID NO: 1216495 - DNA, 22 bp, Artificial Sequence
  chemically synthesized
attcttctctggcctgtaaggt

SEQ ID NO: 1216496 - DNA, 22 bp, Artificial Sequence
  chemically synthesized
ctcagaagaaaccttacaggcc

SEQ ID NO: 1216497 - DNA, 22 bp, Artificial Sequence
  chemically synthesized
tcagaagaaaccttacaggcca

SEQ ID NO: 1216498 - DNA, 22 bp, Artificial Sequence
  chemically synthesized
agaagaaaccttacaggccaga

SEQ ID NO: 1216499 - DNA, 22 bp, Artificial Sequence
  chemically synthesized
atataacatctcattcttctct

SEQ ID NO: 1216500 - DNA, 22 bp, Artificial Sequence
  chemically synthesized
aatataacatctcattcttctc

SEQ ID NO: 1216501 - DNA, 22 bp, Artificial Sequence
  chemically synthesized
acaggccagagaagaatgagat

SEQ ID NO: 1216502 - DNA, 22 bp, Artificial Sequence
  chemically synthesized
caggccagagaagaatgagatg

SEQ ID NO: 1216503 - DNA, 22 bp, Artificial Sequence
  chemically synthesized
agcaagtttaatataacatctc

SEQ ID NO: 1216504 - DNA, 22 bp, Artificial Sequence
  chemically synthesized
cagcaagtttaatataacatct

SEQ ID NO: 1216505 - DNA, 22 bp, Artificial Sequence
  chemically synthesized
tcagcaagtttaatataacatc

SEQ ID NO: 1216506 - DNA, 22 bp, Artificial Sequence
  chemically synthesized
tttcagcaagtttaatataaca

SEQ ID NO: 1216507 - DNA, 22 bp, Artificial Sequence
  chemically synthesized
ctttcagcaagtttaatataac

SEQ ID NO: 1216508 - DNA, 22 bp, Artificial Sequence
  chemically synthesized
tctttcagcaagtttaatataa

SEQ ID NO: 1216509 - DNA, 22 bp, Artificial Sequence
  chemically synthesized
ttttctttcagcaagtttaata

SEQ ID NO: 1216510 - DNA, 22 bp, Artificial Sequence
  chemically synthesized
gtggttgttttctttcagcaag

SEQ ID NO: 1216511 - DNA, 22 bp, Artificial Sequence
  chemically synthesized
gctggtggttgttttctttcag

SEQ ID NO: 1216512 - DNA, 22 bp, Artificial Sequence
  chemically synthesized
tattaaacttgctgaaagaaaa

SEQ ID NO: 1216513 - DNA, 22 bp, Artificial Sequence
  chemically synthesized
ggctggtggttgttttctttca

SEQ ID NO: 1216514 - DNA, 22 bp, Artificial Sequence
  chemically synthesized
aacttgctgaaagaaaacaacc

SEQ ID NO: 1216515 - DNA, 22 bp, Artificial Sequence
  chemically synthesized
gctgaaagaaaacaaccaccag

SEQ ID NO: 1216516 - DNA, 22 bp, Artificial Sequence
  chemically synthesized
ctgaaagaaaacaaccaccagc

SEQ ID NO: 1216517 - DNA, 22 bp, Artificial Sequence
  chemically synthesized
aaagaaaacaaccaccagccaa

SEQ ID NO: 1216518 - DNA, 22 bp, Artificial Sequence
  chemically synthesized
ggtagagtatccttggctggtg

SEQ ID NO: 1216519 - DNA, 22 bp, Artificial Sequence
  chemically synthesized
gctgggtagagtatccttggct

SEQ ID NO: 1216520 - DNA, 22 bp, Artificial Sequence
  chemically synthesized
ggctgggtagagtatccttggc

SEQ ID NO: 1216521 - DNA, 22 bp, Artificial Sequence
  chemically synthesized
ccttggctgggtagagtatcct

SEQ ID NO: 1216522 - DNA, 22 bp, Artificial Sequence
  chemically synthesized
tgaaggctaccttggctgggta

SEQ ID NO: 1216523 - DNA, 22 bp, Artificial Sequence
  chemically synthesized
atgaaggctaccttggctgggt

SEQ ID NO: 1216524 - DNA, 22 bp, Artificial Sequence
  chemically synthesized
atttatgaaggctaccttggct

SEQ ID NO: 1216525 - DNA, 22 bp, Artificial Sequence
  chemically synthesized
gatttatgaaggctaccttggc

SEQ ID NO: 1216526 - DNA, 22 bp, Artificial Sequence
  chemically synthesized
cttgatttatgaaggctacctt

SEQ ID NO: 1216527 - DNA, 22 bp, Artificial Sequence
  chemically synthesized
tccttgatttatgaaggctacc

SEQ ID NO: 1216528 - DNA, 22 bp, Artificial Sequence
  chemically synthesized
tacccagccaaggtagccttca

SEQ ID NO: 1216529 - DNA, 22 bp, Artificial Sequence
  chemically synthesized
ctccttgatttatgaaggctac

SEQ ID NO: 1216530 - DNA, 22 bp, Artificial Sequence
  chemically synthesized
cccagccaaggtagccttcata

SEQ ID NO: 1216531 - DNA, 22 bp, Artificial Sequence
  chemically synthesized
tttctccttgatttatgaaggc

SEQ ID NO: 1216532 - DNA, 22 bp, Artificial Sequence
  chemically synthesized
atttctccttgatttatgaagg

SEQ ID NO: 1216533 - DNA, 22 bp, Artificial Sequence
  chemically synthesized
tatttctccttgatttatgaag

SEQ ID NO: 1216534 - DNA, 22 bp, Artificial Sequence
  chemically synthesized
ttttatttctccttgatttatg

SEQ ID NO: 1216535 - DNA, 22 bp, Artificial Sequence
  chemically synthesized
ggaactattttatttctccttg

SEQ ID NO: 1216536 - DNA, 22 bp, Artificial Sequence
  chemically synthesized
cataaatcaaggagaaataaaa

SEQ ID NO: 1216537 - DNA, 22 bp, Artificial Sequence
  chemically synthesized
gtctaggaactattttatttct

SEQ ID NO: 1216538 - DNA, 22 bp, Artificial Sequence
  chemically synthesized
ataaatcaaggagaaataaaat

SEQ ID NO: 1216539 - DNA, 22 bp, Artificial Sequence
  chemically synthesized
actcgtctaggaactattttat

SEQ ID NO: 1216540 - DNA, 22 bp, Artificial Sequence
  chemically synthesized
cactcgtctaggaactatttta

SEQ ID NO: 1216541 - DNA, 22 bp, Artificial Sequence
  chemically synthesized
tcactcgtctaggaactatttt

SEQ ID NO: 1216542 - DNA, 22 bp, Artificial Sequence
  chemically synthesized
cacagctttcactcgtctagga

SEQ ID NO: 1216543 - DNA, 22 bp, Artificial Sequence
  chemically synthesized
ccacagctttcactcgtctagg

SEQ ID NO: 1216544 - DNA, 22 bp, Artificial Sequence
  chemically synthesized
ctagacgagtgaaagctgtgga

SEQ ID NO: 1216545 - DNA, 22 bp, Artificial Sequence
  chemically synthesized
gacgagtgaaagctgtggaaat

SEQ ID NO: 1216546 - DNA, 22 bp, Artificial Sequence
  chemically synthesized
taaggccagtatcatggtgata

SEQ ID NO: 1216547 - DNA, 22 bp, Artificial Sequence
  chemically synthesized
gtaaggccagtatcatggtgat

SEQ ID NO: 1216548 - DNA, 22 bp, Artificial Sequence
  chemically synthesized
ttgtaaggccagtatcatggtg

SEQ ID NO: 1216549 - DNA, 22 bp, Artificial Sequence
  chemically synthesized
tggaaatttatcaccatgatac

SEQ ID NO: 1216550 - DNA, 22 bp, Artificial Sequence
  chemically synthesized
cttgtaaggccagtatcatggt

SEQ ID NO: 1216551 - DNA, 22 bp, Artificial Sequence
  chemically synthesized
tcttgtaaggccagtatcatgg

SEQ ID NO: 1216552 - DNA, 22 bp, Artificial Sequence
  chemically synthesized
aacctttcttgtaaggccagta

SEQ ID NO: 1216553 - DNA, 22 bp, Artificial Sequence
  chemically synthesized
aaacctttcttgtaaggccagt

SEQ ID NO: 1216554 - DNA, 22 bp, Artificial Sequence
  chemically synthesized
atcaccatgatactggccttac

SEQ ID NO: 1216555 - DNA, 22 bp, Artificial Sequence
  chemically synthesized
tcaccatgatactggccttaca

SEQ ID NO: 1216556 - DNA, 22 bp, Artificial Sequence
  chemically synthesized
ccttaaacctttcttgtaaggc

SEQ ID NO: 1216557 - DNA, 22 bp, Artificial Sequence
  chemically synthesized
gccttacaagaaaggtttaagg

SEQ ID NO: 1216558 - DNA, 22 bp, Artificial Sequence
  chemically synthesized
caggtataggactcccttaaac

SEQ ID NO: 1216559 - DNA, 22 bp, Artificial Sequence
  chemically synthesized
ccaggtataggactcccttaaa

SEQ ID NO: 1216560 - DNA, 22 bp, Artificial Sequence
  chemically synthesized
acaagaaaggtttaagggagtc

SEQ ID NO: 1216561 - DNA, 22 bp, Artificial Sequence
  chemically synthesized
caagaaaggtttaagggagtcc

SEQ ID NO: 1216562 - DNA, 22 bp, Artificial Sequence
  chemically synthesized
acttccaggtataggactccct

SEQ ID NO: 1216563 - DNA, 22 bp, Artificial Sequence
  chemically synthesized
cacttccaggtataggactccc

SEQ ID NO: 1216564 - DNA, 22 bp, Artificial Sequence
  chemically synthesized
tcacttccaggtataggactcc

SEQ ID NO: 1216565 - DNA, 22 bp, Artificial Sequence
  chemically synthesized
tttcacttccaggtataggact

SEQ ID NO: 1216566 - DNA, 22 bp, Artificial Sequence
  chemically synthesized
tcattctttcacttccaggtat

SEQ ID NO: 1216567 - DNA, 22 bp, Artificial Sequence
  chemically synthesized
aagggagtcctatacctggaag

SEQ ID NO: 1216568 - DNA, 22 bp, Artificial Sequence
  chemically synthesized
agggagtcctatacctggaagt

SEQ ID NO: 1216569 - DNA, 22 bp, Artificial Sequence
  chemically synthesized
tacctggaagtgaaagaatgac

SEQ ID NO: 1216570 - DNA, 22 bp, Artificial Sequence
  chemically synthesized
atgatggtagttgtcattcttt

SEQ ID NO: 1216571 - DNA, 22 bp, Artificial Sequence
  chemically synthesized
catgatggtagttgtcattctt

SEQ ID NO: 1216572 - DNA, 22 bp, Artificial Sequence
  chemically synthesized
tcatgatggtagttgtcattct

SEQ ID NO: 1216573 - DNA, 22 bp, Artificial Sequence
  chemically synthesized
gaagtgaaagaatgacaactac

SEQ ID NO: 1216574 - DNA, 22 bp, Artificial Sequence
  chemically synthesized
tgtgttttcatgatggtagttg

SEQ ID NO: 1216575 - DNA, 22 bp, Artificial Sequence
  chemically synthesized
atgtgttttcatgatggtagtt

SEQ ID NO: 1216576 - DNA, 22 bp, Artificial Sequence
  chemically synthesized
tatgtgttttcatgatggtagt

SEQ ID NO: 1216577 - DNA, 22 bp, Artificial Sequence
  chemically synthesized
ttatgtgttttcatgatggtag

SEQ ID NO: 1216578 - DNA, 22 bp, Artificial Sequence
  chemically synthesized
tatttttatgtgttttcatgat

SEQ ID NO: 1216579 - DNA, 22 bp, Artificial Sequence
  chemically synthesized
atatttttatgtgttttcatga

SEQ ID NO: 1216580 - DNA, 22 bp, Artificial Sequence
  chemically synthesized
tatatttttatgtgttttcatg

SEQ ID NO: 1216581 - DNA, 22 bp, Artificial Sequence
  chemically synthesized
ttatatttttatgtgttttcat

SEQ ID NO: 1216582 - DNA, 22 bp, Artificial Sequence
  chemically synthesized
tttttatatttttatgtgtttt

SEQ ID NO: 1216583 - DNA, 22 bp, Artificial Sequence
  chemically synthesized
ccatcatgaaaacacataaaaa

SEQ ID NO: 1216584 - DNA, 22 bp, Artificial Sequence
  chemically synthesized
gttgtttttatatttttatgtg

SEQ ID NO: 1216585 - DNA, 22 bp, Artificial Sequence
  chemically synthesized
ctagttgtttttatatttttat

SEQ ID NO: 1216586 - DNA, 22 bp, Artificial Sequence
  chemically synthesized
cactactagttgtttttatatt

SEQ ID NO: 1216587 - DNA, 22 bp, Artificial Sequence
  chemically synthesized
gcactactagttgtttttatat

SEQ ID NO: 1216588 - DNA, 22 bp, Artificial Sequence
  chemically synthesized
tgtgtttgcactactagttgtt

SEQ ID NO: 1216589 - DNA, 22 bp, Artificial Sequence
  chemically synthesized
gtgtgtttgcactactagttgt

SEQ ID NO: 1216590 - DNA, 22 bp, Artificial Sequence
  chemically synthesized
tgtgtgtttgcactactagttg

SEQ ID NO: 1216591 - DNA, 22 bp, Artificial Sequence
  chemically synthesized
ttgtgtgtttgcactactagtt

SEQ ID NO: 1216592 - DNA, 22 bp, Artificial Sequence
  chemically synthesized
tttgtgtgtttgcactactagt

SEQ ID NO: 1216593 - DNA, 22 bp, Artificial Sequence
  chemically synthesized
ttttgtgtgtttgcactactag

SEQ ID NO: 1216594 - DNA, 22 bp, Artificial Sequence
  chemically synthesized
tttttgtgtgtttgcactacta

SEQ ID NO: 1216595 - DNA, 22 bp, Artificial Sequence
  chemically synthesized
attttttttgtgtgtttgcact

SEQ ID NO: 1216596 - DNA, 22 bp, Artificial Sequence
  chemically synthesized
gattttttttgtgtgtttgcac

SEQ ID NO: 1216597 - DNA, 22 bp, Artificial Sequence
  chemically synthesized
ttgattttttttgtgtgtttgc

SEQ ID NO: 1216598 - DNA, 22 bp, Artificial Sequence
  chemically synthesized
cttgattttttttgtgtgtttg

SEQ ID NO: 1216599 - DNA, 22 bp, Artificial Sequence
  chemically synthesized
tcttgattttttttgtgtgttt

SEQ ID NO: 1216600 - DNA, 22 bp, Artificial Sequence
  chemically synthesized
ttcttgattttttttgtgtgtt

SEQ ID NO: 1216601 - DNA, 22 bp, Artificial Sequence
  chemically synthesized
gtagtgcaaacacacaaaaaaa

SEQ ID NO: 1216602 - DNA, 22 bp, Artificial Sequence
  chemically synthesized
agtaacttttcttgattttttt

SEQ ID NO: 1216603 - DNA, 22 bp, Artificial Sequence
  chemically synthesized
gagtaacttttcttgatttttt

SEQ ID NO: 1216604 - DNA, 22 bp, Artificial Sequence
  chemically synthesized
gtggtaacatttgagtaacttt

SEQ ID NO: 1216605 - DNA, 22 bp, Artificial Sequence
  chemically synthesized
agtggtaacatttgagtaactt

SEQ ID NO: 1216606 - DNA, 22 bp, Artificial Sequence
  chemically synthesized
tagtggtaacatttgagtaact

SEQ ID NO: 1216607 - DNA, 22 bp, Artificial Sequence
  chemically synthesized
tttagtggtaacatttgagtaa

SEQ ID NO: 1216608 - DNA, 22 bp, Artificial Sequence
  chemically synthesized
ctcaaatgttaccactaaagaa

SEQ ID NO: 1216609 - DNA, 22 bp, Artificial Sequence
  chemically synthesized
tagtgtgatggtattctttagt

SEQ ID NO: 1216610 - DNA, 22 bp, Artificial Sequence
  chemically synthesized
aaatgttaccactaaagaatac

SEQ ID NO: 1216611 - DNA, 22 bp, Artificial Sequence
  chemically synthesized
tcattatagtgtgatggtattc

SEQ ID NO: 1216612 - DNA, 22 bp, Artificial Sequence
  chemically synthesized
ccactaaagaataccatcacac

SEQ ID NO: 1216613 - DNA, 22 bp, Artificial Sequence
  chemically synthesized
attatcattatagtgtgatggt

SEQ ID NO: 1216614 - DNA, 22 bp, Artificial Sequence
  chemically synthesized
cctcattatcattatagtgtga

SEQ ID NO: 1216615 - DNA, 22 bp, Artificial Sequence
  chemically synthesized
ccctcattatcattatagtgtg

SEQ ID NO: 1216616 - DNA, 22 bp, Artificial Sequence
  chemically synthesized
aagaataccatcacactataat

SEQ ID NO: 1216617 - DNA, 22 bp, Artificial Sequence
  chemically synthesized
tccctcattatcattatagtgt

SEQ ID NO: 1216618 - DNA, 22 bp, Artificial Sequence
  chemically synthesized
ttccctcattatcattatagtg

SEQ ID NO: 1216619 - DNA, 22 bp, Artificial Sequence
  chemically synthesized
tttccctcattatcattatagt

SEQ ID NO: 1216620 - DNA, 22 bp, Artificial Sequence
  chemically synthesized
ttttccctcattatcattatag

SEQ ID NO: 1216621 - DNA, 22 bp, Artificial Sequence
  chemically synthesized
atttttttccctcattatcatt

SEQ ID NO: 1216622 - DNA, 22 bp, Artificial Sequence
  chemically synthesized
catttttttccctcattatcat

SEQ ID NO: 1216623 - DNA, 22 bp, Artificial Sequence
  chemically synthesized
ttcatttttttccctcattatc

SEQ ID NO: 1216624 - DNA, 22 bp, Artificial Sequence
  chemically synthesized
cttcatttttttccctcattat

SEQ ID NO: 1216625 - DNA, 22 bp, Artificial Sequence
  chemically synthesized
tcttcatttttttccctcatta

SEQ ID NO: 1216626 - DNA, 22 bp, Artificial Sequence
  chemically synthesized
ttcttcatttttttccctcatt

SEQ ID NO: 1216627 - DNA, 22 bp, Artificial Sequence
  chemically synthesized
tttcttcatttttttccctcat

SEQ ID NO: 1216628 - DNA, 22 bp, Artificial Sequence
  chemically synthesized
taatgataatgagggaaaaaaa

SEQ ID NO: 1216629 - DNA, 22 bp, Artificial Sequence
  chemically synthesized
aatattttttcttcattttttt

SEQ ID NO: 1216630 - DNA, 22 bp, Artificial Sequence
  chemically synthesized
gaatattttttcttcatttttt

SEQ ID NO: 1216631 - DNA, 22 bp, Artificial Sequence
  chemically synthesized
tgaatattttttcttcattttt

SEQ ID NO: 1216632 - DNA, 22 bp, Artificial Sequence
  chemically synthesized
ttttgaatattttttcttcatt

SEQ ID NO: 1216633 - DNA, 22 bp, Artificial Sequence
  chemically synthesized
tggttgttttgaatattttttc

SEQ ID NO: 1216634 - DNA, 22 bp, Artificial Sequence
  chemically synthesized
atggttgttttgaatatttttt

SEQ ID NO: 1216635 - DNA, 22 bp, Artificial Sequence
  chemically synthesized
atttatggttgttttgaatatt

SEQ ID NO: 1216636 - DNA, 22 bp, Artificial Sequence
  chemically synthesized
ttgatttatggttgttttgaat

SEQ ID NO: 1216637 - DNA, 22 bp, Artificial Sequence
  chemically synthesized
attgatttatggttgttttgaa

SEQ ID NO: 1216638 - DNA, 22 bp, Artificial Sequence
  chemically synthesized
tattgatttatggttgttttga

SEQ ID NO: 1216639 - DNA, 22 bp, Artificial Sequence
  chemically synthesized
attttattgatttatggttgtt

SEQ ID NO: 1216640 - DNA, 22 bp, Artificial Sequence
  chemically synthesized
cattttattgatttatggttgt

SEQ ID NO: 1216641 - DNA, 22 bp, Artificial Sequence
  chemically synthesized
tcattttattgatttatggttg

SEQ ID NO: 1216642 - DNA, 22 bp, Artificial Sequence
  chemically synthesized
tttcattttattgatttatggt

SEQ ID NO: 1216643 - DNA, 22 bp, Artificial Sequence
  chemically synthesized
ctttcattttattgatttatgg

SEQ ID NO: 1216644 - DNA, 22 bp, Artificial Sequence
  chemically synthesized
tttctttcattttattgattta

SEQ ID NO: 1216645 - DNA, 22 bp, Artificial Sequence
  chemically synthesized
atttctttcattttattgattt

SEQ ID NO: 1216646 - DNA, 22 bp, Artificial Sequence
  chemically synthesized
aaaacaaccataaatcaataaa

SEQ ID NO: 1216647 - DNA, 22 bp, Artificial Sequence
  chemically synthesized
atatgtgagggcttatttcttt

SEQ ID NO: 1216648 - DNA, 22 bp, Artificial Sequence
  chemically synthesized
ctgatatgtgagggcttatttc

SEQ ID NO: 1216649 - DNA, 22 bp, Artificial Sequence
  chemically synthesized
ttactgatatgtgagggcttat

SEQ ID NO: 1216650 - DNA, 22 bp, Artificial Sequence
  chemically synthesized
aacattattactgatatgtgag

SEQ ID NO: 1216651 - DNA, 22 bp, Artificial Sequence
  chemically synthesized
cattcaacattattactgatat

SEQ ID NO: 1216652 - DNA, 22 bp, Artificial Sequence
  chemically synthesized
acattcaacattattactgata

SEQ ID NO: 1216653 - DNA, 22 bp, Artificial Sequence
  chemically synthesized
atcaatttacattcaacattat

SEQ ID NO: 1216654 - DNA, 22 bp, Artificial Sequence
  chemically synthesized
acatatcagtaataatgttgaa

SEQ ID NO: 1216655 - DNA, 22 bp, Artificial Sequence
  chemically synthesized
aatcaatttacattcaacatta

SEQ ID NO: 1216656 - DNA, 22 bp, Artificial Sequence
  chemically synthesized
tgtggaatgtttaatcaattta

SEQ ID NO: 1216657 - DNA, 22 bp, Artificial Sequence
  chemically synthesized
atgtggaatgtttaatcaattt

SEQ ID NO: 1216658 - DNA, 22 bp, Artificial Sequence
  chemically synthesized
tatgtggaatgtttaatcaatt

SEQ ID NO: 1216659 - DNA, 22 bp, Artificial Sequence
  chemically synthesized
ttatgtggaatgtttaatcaat

SEQ ID NO: 1216660 - DNA, 22 bp, Artificial Sequence
  chemically synthesized
aatgtaaattgattaaacattc

SEQ ID NO: 1216661 - DNA, 22 bp, Artificial Sequence
  chemically synthesized
tgtcttttatgtggaatgttta

SEQ ID NO: 1216662 - DNA, 22 bp, Artificial Sequence
  chemically synthesized
atgtcttttatgtggaatgttt

SEQ ID NO: 1216663 - DNA, 22 bp, Artificial Sequence
  chemically synthesized
attaaacattccacataaaaga

SEQ ID NO: 1216664 - DNA, 22 bp, Artificial Sequence
  chemically synthesized
agccagtttatgtcttttatgt

SEQ ID NO: 1216665 - DNA, 22 bp, Artificial Sequence
  chemically synthesized
aacattccacataaaagacata

SEQ ID NO: 1216666 - DNA, 22 bp, Artificial Sequence
  chemically synthesized
atccattcagccagtttatgtc

SEQ ID NO: 1216667 - DNA, 22 bp, Artificial Sequence
  chemically synthesized
aatccattcagccagtttatgt

SEQ ID NO: 1216668 - DNA, 22 bp, Artificial Sequence
  chemically synthesized
taatccattcagccagtttatg

SEQ ID NO: 1216669 - DNA, 22 bp, Artificial Sequence
  chemically synthesized
cacataaaagacataaactggc

SEQ ID NO: 1216670 - DNA, 22 bp, Artificial Sequence
  chemically synthesized
ttaatccattcagccagtttat

SEQ ID NO: 1216671 - DNA, 22 bp, Artificial Sequence
  chemically synthesized
tttaatccattcagccagttta

SEQ ID NO: 1216672 - DNA, 22 bp, Artificial Sequence
  chemically synthesized
tatattttttaatccattcagc

SEQ ID NO: 1216673 - DNA, 22 bp, Artificial Sequence
  chemically synthesized
ggttatatattttttaatccat

SEQ ID NO: 1216674 - DNA, 22 bp, Artificial Sequence
  chemically synthesized
gggttatatattttttaatcca

SEQ ID NO: 1216675 - DNA, 22 bp, Artificial Sequence
  chemically synthesized
tgggttatatattttttaatcc

SEQ ID NO: 1216676 - DNA, 22 bp, Artificial Sequence
  chemically synthesized
ttgggttatatattttttaatc

SEQ ID NO: 1216677 - DNA, 22 bp, Artificial Sequence
  chemically synthesized
gctgaatggattaaaaaatata

SEQ ID NO: 1216678 - DNA, 22 bp, Artificial Sequence
  chemically synthesized
aatggattaaaaaatatataac

SEQ ID NO: 1216679 - DNA, 22 bp, Artificial Sequence
  chemically synthesized
ggcagaatatttttgggttata

SEQ ID NO: 1216680 - DNA, 22 bp, Artificial Sequence
  chemically synthesized
aggcagaatatttttgggttat

SEQ ID NO: 1216681 - DNA, 22 bp, Artificial Sequence
  chemically synthesized
taggcagaatatttttgggtta

SEQ ID NO: 1216682 - DNA, 22 bp, Artificial Sequence
  chemically synthesized
aaaaatatataacccaaaaata

SEQ ID NO: 1216683 - DNA, 22 bp, Artificial Sequence
  chemically synthesized
ttttaggcagaatatttttggg

SEQ ID NO: 1216684 - DNA, 22 bp, Artificial Sequence
  chemically synthesized
attttaggcagaatatttttgg

SEQ ID NO: 1216685 - DNA, 22 bp, Artificial Sequence
  chemically synthesized
caggtgaaatgagtttatttta

SEQ ID NO: 1216686 - DNA, 22 bp, Artificial Sequence
  chemically synthesized
acaggtgaaatgagtttatttt

SEQ ID NO: 1216687 - DNA, 22 bp, Artificial Sequence
  chemically synthesized
tacaggtgaaatgagtttattt

SEQ ID NO: 1216688 - DNA, 22 bp, Artificial Sequence
  chemically synthesized
tgcctaaaataaactcatttca

SEQ ID NO: 1216689 - DNA, 22 bp, Artificial Sequence
  chemically synthesized
cctaaaataaactcatttcacc

SEQ ID NO: 1216690 - DNA, 22 bp, Artificial Sequence
  chemically synthesized
tatgtgtctttacaggtgaaat

SEQ ID NO: 1216691 - DNA, 22 bp, Artificial Sequence
  chemically synthesized
aaataaactcatttcacctgta

SEQ ID NO: 1216692 - DNA, 22 bp, Artificial Sequence
  chemically synthesized
aaatctatatgtgtctttacag

SEQ ID NO: 1216693 - DNA, 22 bp, Artificial Sequence
  chemically synthesized
caaatctatatgtgtctttaca

SEQ ID NO: 1216694 - DNA, 22 bp, Artificial Sequence
  chemically synthesized
cttcaaatctatatgtgtcttt

SEQ ID NO: 1216695 - DNA, 22 bp, Artificial Sequence
  chemically synthesized
atttcacctgtaaagacacata

SEQ ID NO: 1216696 - DNA, 22 bp, Artificial Sequence
  chemically synthesized
acttcaaatctatatgtgtctt

SEQ ID NO: 1216697 - DNA, 22 bp, Artificial Sequence
  chemically synthesized
tacttcaaatctatatgtgtct

SEQ ID NO: 1216698 - DNA, 22 bp, Artificial Sequence
  chemically synthesized
cacctgtaaagacacatataga

SEQ ID NO: 1216699 - DNA, 22 bp, Artificial Sequence
  chemically synthesized
acctgtaaagacacatatagat

SEQ ID NO: 1216700 - DNA, 22 bp, Artificial Sequence
  chemically synthesized
catccctttacttcaaatctat

SEQ ID NO: 1216701 - DNA, 22 bp, Artificial Sequence
  chemically synthesized
taaagacacatatagatttgaa

SEQ ID NO: 1216702 - DNA, 22 bp, Artificial Sequence
  chemically synthesized
ccatccctttacttcaaatcta

SEQ ID NO: 1216703 - DNA, 22 bp, Artificial Sequence
  chemically synthesized
tccatccctttacttcaaatct

SEQ ID NO: 1216704 - DNA, 22 bp, Artificial Sequence
  chemically synthesized
ttccatccctttacttcaaatc

SEQ ID NO: 1216705 - DNA, 22 bp, Artificial Sequence
  chemically synthesized
cataaaatatacttttccatcc

SEQ ID NO: 1216706 - DNA, 22 bp, Artificial Sequence
  chemically synthesized
gcataaaatatacttttccatc

SEQ ID NO: 1216707 - DNA, 22 bp, Artificial Sequence
  chemically synthesized
gaagtaaagggatggaaaagta

SEQ ID NO: 1216708 - DNA, 22 bp, Artificial Sequence
  chemically synthesized
aagtaaagggatggaaaagtat

SEQ ID NO: 1216709 - DNA, 22 bp, Artificial Sequence
  chemically synthesized
ggtttgcataaaatatactttt

SEQ ID NO: 1216710 - DNA, 22 bp, Artificial Sequence
  chemically synthesized
cggtttgcataaaatatacttt

SEQ ID NO: 1216711 - DNA, 22 bp, Artificial Sequence
  chemically synthesized
gcttcggtttgcataaaatata

SEQ ID NO: 1216712 - DNA, 22 bp, Artificial Sequence
  chemically synthesized
ggcttcggtttgcataaaatat

SEQ ID NO: 1216713 - DNA, 22 bp, Artificial Sequence
  chemically synthesized
tggcttcggtttgcataaaata

SEQ ID NO: 1216714 - DNA, 22 bp, Artificial Sequence
  chemically synthesized
ccctttggcttcggtttgcata

SEQ ID NO: 1216715 - DNA, 22 bp, Artificial Sequence
  chemically synthesized
tcccctttggcttcggtttgca

SEQ ID NO: 1216716 - DNA, 22 bp, Artificial Sequence
  chemically synthesized
ctcccctttggcttcggtttgc

SEQ ID NO: 1216717 - DNA, 22 bp, Artificial Sequence
  chemically synthesized
cttctcccctttggcttcggtt

SEQ ID NO: 1216718 - DNA, 22 bp, Artificial Sequence
  chemically synthesized
ctgcttctcccctttggcttcg

SEQ ID NO: 1216719 - DNA, 22 bp, Artificial Sequence
  chemically synthesized
tatgcaaaccgaagccaaaggg

SEQ ID NO: 1216720 - DNA, 22 bp, Artificial Sequence
  chemically synthesized
atgcaaaccgaagccaaagggg

SEQ ID NO: 1216721 - DNA, 22 bp, Artificial Sequence
  chemically synthesized
tgcaaaccgaagccaaagggga

SEQ ID NO: 1216722 - DNA, 22 bp, Artificial Sequence
  chemically synthesized
tgtaagcatagctgctgcttct

SEQ ID NO: 1216723 - DNA, 22 bp, Artificial Sequence
  chemically synthesized
atgtaagcatagctgctgcttc

SEQ ID NO: 1216724 - DNA, 22 bp, Artificial Sequence
  chemically synthesized
tatgtaagcatagctgctgctt

SEQ ID NO: 1216725 - DNA, 22 bp, Artificial Sequence
  chemically synthesized
ttttatgtaagcatagctgctg

SEQ ID NO: 1216726 - DNA, 22 bp, Artificial Sequence
  chemically synthesized
aaagtctgttttatgtaagcat

SEQ ID NO: 1216727 - DNA, 22 bp, Artificial Sequence
  chemically synthesized
actgaaagtctgttttatgtaa

SEQ ID NO: 1216728 - DNA, 22 bp, Artificial Sequence
  chemically synthesized
gactgaaagtctgttttatgta

SEQ ID NO: 1216729 - DNA, 22 bp, Artificial Sequence
  chemically synthesized
tgactgaaagtctgttttatgt

SEQ ID NO: 1216730 - DNA, 22 bp, Artificial Sequence
  chemically synthesized
ttgactgaaagtctgttttatg

SEQ ID NO: 1216731 - DNA, 22 bp, Artificial Sequence
  chemically synthesized
tttttgactgaaagtctgtttt

SEQ ID NO: 1216732 - DNA, 22 bp, Artificial Sequence
  chemically synthesized
tgcttacataaaacagactttc

SEQ ID NO: 1216733 - DNA, 22 bp, Artificial Sequence
  chemically synthesized
ctgtttttgactgaaagtctgt

SEQ ID NO: 1216734 - DNA, 22 bp, Artificial Sequence
  chemically synthesized
actgtttttgactgaaagtctg

SEQ ID NO: 1216735 - DNA, 22 bp, Artificial Sequence
  chemically synthesized
tactgtttttgactgaaagtct

SEQ ID NO: 1216736 - DNA, 22 bp, Artificial Sequence
  chemically synthesized
ttactgtttttgactgaaagtc

SEQ ID NO: 1216737 - DNA, 22 bp, Artificial Sequence
  chemically synthesized
acataaaacagactttcagtca

SEQ ID NO: 1216738 - DNA, 22 bp, Artificial Sequence
  chemically synthesized
cataaaacagactttcagtcaa

SEQ ID NO: 1216739 - DNA, 22 bp, Artificial Sequence
  chemically synthesized
tttttactgtttttgactgaaa

SEQ ID NO: 1216740 - DNA, 22 bp, Artificial Sequence
  chemically synthesized
gtttttactgtttttgactgaa

SEQ ID NO: 1216741 - DNA, 22 bp, Artificial Sequence
  chemically synthesized
tttgtttttactgtttttgact

SEQ ID NO: 1216742 - DNA, 22 bp, Artificial Sequence
  chemically synthesized
ttgtttgtttttactgtttttg

SEQ ID NO: 1216743 - DNA, 22 bp, Artificial Sequence
  chemically synthesized
attgtttgtttttactgttttt

SEQ ID NO: 1216744 - DNA, 22 bp, Artificial Sequence
  chemically synthesized
tcagtcaaaaacagtaaaaaca

SEQ ID NO: 1216745 - DNA, 22 bp, Artificial Sequence
  chemically synthesized
cagtcaaaaacagtaaaaacaa

SEQ ID NO: 1216746 - DNA, 22 bp, Artificial Sequence
  chemically synthesized
agtcaaaaacagtaaaaacaaa

SEQ ID NO: 1216747 - DNA, 22 bp, Artificial Sequence
  chemically synthesized
tataatgaccttattgtttgtt

SEQ ID NO: 1216748 - DNA, 22 bp, Artificial Sequence
  chemically synthesized
tcattatataatgaccttattg

SEQ ID NO: 1216749 - DNA, 22 bp, Artificial Sequence
  chemically synthesized
atcattatataatgaccttatt

SEQ ID NO: 1216750 - DNA, 22 bp, Artificial Sequence
  chemically synthesized
tatcattatataatgaccttat

SEQ ID NO: 1216751 - DNA, 22 bp, Artificial Sequence
  chemically synthesized
tccctttatcattatataatga

SEQ ID NO: 1216752 - DNA, 22 bp, Artificial Sequence
  chemically synthesized
atccctttatcattatataatg

SEQ ID NO: 1216753 - DNA, 22 bp, Artificial Sequence
  chemically synthesized
aacttatccctttatcattata

SEQ ID NO: 1216754 - DNA, 22 bp, Artificial Sequence
  chemically synthesized
ctaaacttatccctttatcatt

SEQ ID NO: 1216755 - DNA, 22 bp, Artificial Sequence
  chemically synthesized
gctaaacttatccctttatcat

SEQ ID NO: 1216756 - DNA, 22 bp, Artificial Sequence
  chemically synthesized
ttgctaaacttatccctttatc

SEQ ID NO: 1216757 - DNA, 22 bp, Artificial Sequence
  chemically synthesized
tataatgataaagggataagtt

SEQ ID NO: 1216758 - DNA, 22 bp, Artificial Sequence
  chemically synthesized
tatactcttgctaaacttatcc

SEQ ID NO: 1216759 - DNA, 22 bp, Artificial Sequence
  chemically synthesized
atatactcttgctaaacttatc

SEQ ID NO: 1216760 - DNA, 22 bp, Artificial Sequence
  chemically synthesized
tatatactcttgctaaacttat

SEQ ID NO: 1216761 - DNA, 22 bp, Artificial Sequence
  chemically synthesized
ttatatactcttgctaaactta

SEQ ID NO: 1216762 - DNA, 22 bp, Artificial Sequence
  chemically synthesized
gaatttttatatactcttgcta

SEQ ID NO: 1216763 - DNA, 22 bp, Artificial Sequence
  chemically synthesized
agaatttttatatactcttgct

SEQ ID NO: 1216764 - DNA, 22 bp, Artificial Sequence
  chemically synthesized
agcaagagtatataaaaattct

SEQ ID NO: 1216765 - DNA, 22 bp, Artificial Sequence
  chemically synthesized
gcaagagtatataaaaattcta

SEQ ID NO: 1216766 - DNA, 22 bp, Artificial Sequence
  chemically synthesized
ggtgtatgtatgtttagaattt

SEQ ID NO: 1216767 - DNA, 22 bp, Artificial Sequence
  chemically synthesized
gtgttgggtgtatgtatgttta

SEQ ID NO: 1216768 - DNA, 22 bp, Artificial Sequence
  chemically synthesized
tcgtgttgggtgtatgtatgtt

SEQ ID NO: 1216769 - DNA, 22 bp, Artificial Sequence
  chemically synthesized
ggagctctcgtgttgggtgtat

SEQ ID NO: 1216770 - DNA, 22 bp, Artificial Sequence
  chemically synthesized
taaacatacatacacccaacac

SEQ ID NO: 1216771 - DNA, 22 bp, Artificial Sequence
  chemically synthesized
aacatacatacacccaacacga

SEQ ID NO: 1216772 - DNA, 22 bp, Artificial Sequence
  chemically synthesized
tatatctgggagctctcgtgtt

SEQ ID NO: 1216773 - DNA, 22 bp, Artificial Sequence
  chemically synthesized
atatatctgggagctctcgtgt

SEQ ID NO: 1216774 - DNA, 22 bp, Artificial Sequence
  chemically synthesized
tatatatctgggagctctcgtg

SEQ ID NO: 1216775 - DNA, 22 bp, Artificial Sequence
  chemically synthesized
ctttatatatctgggagctctc

SEQ ID NO: 1216776 - DNA, 22 bp, Artificial Sequence
  chemically synthesized
gctttatatatctgggagctct

SEQ ID NO: 1216777 - DNA, 22 bp, Artificial Sequence
  chemically synthesized
atacttgctttatatatctggg

SEQ ID NO: 1216778 - DNA, 22 bp, Artificial Sequence
  chemically synthesized
gatctaatacttgctttatata

SEQ ID NO: 1216779 - DNA, 22 bp, Artificial Sequence
  chemically synthesized
agatctaatacttgctttatat

SEQ ID NO: 1216780 - DNA, 22 bp, Artificial Sequence
  chemically synthesized
tagatctaatacttgctttata

SEQ ID NO: 1216781 - DNA, 22 bp, Artificial Sequence
  chemically synthesized
cctttagatctaatacttgctt

SEQ ID NO: 1216782 - DNA, 22 bp, Artificial Sequence
  chemically synthesized
ccagatatataaagcaagtatt

SEQ ID NO: 1216783 - DNA, 22 bp, Artificial Sequence
  chemically synthesized
tccctttagatctaatacttgc

SEQ ID NO: 1216784 - DNA, 22 bp, Artificial Sequence
  chemically synthesized
gctctccctttagatctaatac

SEQ ID NO: 1216785 - DNA, 22 bp, Artificial Sequence
  chemically synthesized
catctagctctccctttagatc

SEQ ID NO: 1216786 - DNA, 22 bp, Artificial Sequence
  chemically synthesized
gcatctagctctccctttagat

SEQ ID NO: 1216787 - DNA, 22 bp, Artificial Sequence
  chemically synthesized
tatttgcatctagctctccctt

SEQ ID NO: 1216788 - DNA, 22 bp, Artificial Sequence
  chemically synthesized
ctgtatttgcatctagctctcc

SEQ ID NO: 1216789 - DNA, 22 bp, Artificial Sequence
  chemically synthesized
gatctaaagggagagctagatg

SEQ ID NO: 1216790 - DNA, 22 bp, Artificial Sequence
  chemically synthesized
agatattactgtatttgcatct

SEQ ID NO: 1216791 - DNA, 22 bp, Artificial Sequence
  chemically synthesized
aagggagagctagatgcaaata

SEQ ID NO: 1216792 - DNA, 22 bp, Artificial Sequence
  chemically synthesized
aagtcctcagatattactgtat

SEQ ID NO: 1216793 - DNA, 22 bp, Artificial Sequence
  chemically synthesized
gatgcaaatacagtaatatctg

SEQ ID NO: 1216794 - DNA, 22 bp, Artificial Sequence
  chemically synthesized
agagtggggtgttgaagtcctc

SEQ ID NO: 1216795 - DNA, 22 bp, Artificial Sequence
  chemically synthesized
atgctgagagtggggtgttgaa

SEQ ID NO: 1216796 - DNA, 22 bp, Artificial Sequence
  chemically synthesized
aggacttcaacaccccactctc

SEQ ID NO: 1216797 - DNA, 22 bp, Artificial Sequence
  chemically synthesized
agtgatctaatgctgagagtgg

SEQ ID NO: 1216798 - DNA, 22 bp, Artificial Sequence
  chemically synthesized
tctaagtgatctaatgctgaga

SEQ ID NO: 1216799 - DNA, 22 bp, Artificial Sequence
  chemically synthesized
caacaccccactctcagcatta

SEQ ID NO: 1216800 - DNA, 22 bp, Artificial Sequence
  chemically synthesized
gtctaagtgatctaatgctgag

SEQ ID NO: 1216801 - DNA, 22 bp, Artificial Sequence
  chemically synthesized
aacaccccactctcagcattag

SEQ ID NO: 1216802 - DNA, 22 bp, Artificial Sequence
  chemically synthesized
tgtctaagtgatctaatgctga

SEQ ID NO: 1216803 - DNA, 22 bp, Artificial Sequence
  chemically synthesized
ttgtctaagtgatctaatgctg

SEQ ID NO: 1216804 - DNA, 22 bp, Artificial Sequence
  chemically synthesized
tttgtctaagtgatctaatgct

SEQ ID NO: 1216805 - DNA, 22 bp, Artificial Sequence
  chemically synthesized
attttttgtctaagtgatctaa

SEQ ID NO: 1216806 - DNA, 22 bp, Artificial Sequence
  chemically synthesized
ttaattttttgtctaagtgatc

SEQ ID NO: 1216807 - DNA, 22 bp, Artificial Sequence
  chemically synthesized
gttaattttttgtctaagtgat

SEQ ID NO: 1216808 - DNA, 22 bp, Artificial Sequence
  chemically synthesized
tgttaattttttgtctaagtga

SEQ ID NO: 1216809 - DNA, 22 bp, Artificial Sequence
  chemically synthesized
tcagcattagatcacttagaca

SEQ ID NO: 1216810 - DNA, 22 bp, Artificial Sequence
  chemically synthesized
tttgttaattttttgtctaagt

SEQ ID NO: 1216811 - DNA, 22 bp, Artificial Sequence
  chemically synthesized
agcattagatcacttagacaaa

SEQ ID NO: 1216812 - DNA, 22 bp, Artificial Sequence
  chemically synthesized
ctttgttaattttttgtctaag

SEQ ID NO: 1216813 - DNA, 22 bp, Artificial Sequence
  chemically synthesized
gatcacttagacaaaaaattaa

SEQ ID NO: 1216814 - DNA, 22 bp, Artificial Sequence
  chemically synthesized
aagccaatgtttctttgttaat

SEQ ID NO: 1216815 - DNA, 22 bp, Artificial Sequence
  chemically synthesized
caagccaatgtttctttgttaa

SEQ ID NO: 1216816 - DNA, 22 bp, Artificial Sequence
  chemically synthesized
agacaaaaaattaacaaagaaa

SEQ ID NO: 1216817 - DNA, 22 bp, Artificial Sequence
  chemically synthesized
gacaaaaaattaacaaagaaac

SEQ ID NO: 1216818 - DNA, 22 bp, Artificial Sequence
  chemically synthesized
aggagcagtttcaagccaatgt

SEQ ID NO: 1216819 - DNA, 22 bp, Artificial Sequence
  chemically synthesized
acaaagaaacattggcttgaaa

SEQ ID NO: 1216820 - DNA, 22 bp, Artificial Sequence
  chemically synthesized
gtctaaggagcagtttcaagcc

SEQ ID NO: 1216821 - DNA, 22 bp, Artificial Sequence
  chemically synthesized
ggtctaaggagcagtttcaagc

SEQ ID NO: 1216822 - DNA, 22 bp, Artificial Sequence
  chemically synthesized
tttggtctaaggagcagtttca

SEQ ID NO: 1216823 - DNA, 22 bp, Artificial Sequence
  chemically synthesized
ggactatttggtctaaggagca

SEQ ID NO: 1216824 - DNA, 22 bp, Artificial Sequence
  chemically synthesized
gcttgaaactgctccttagacc

SEQ ID NO: 1216825 - DNA, 22 bp, Artificial Sequence
  chemically synthesized
ttaggactatttggtctaagga

SEQ ID NO: 1216826 - DNA, 22 bp, Artificial Sequence
  chemically synthesized
gaaactgctccttagaccaaat

SEQ ID NO: 1216827 - DNA, 22 bp, Artificial Sequence
  chemically synthesized
aaactgctccttagaccaaata

SEQ ID NO: 1216828 - DNA, 22 bp, Artificial Sequence
  chemically synthesized
taagtgtctgttaggactattt

SEQ ID NO: 1216829 - DNA, 22 bp, Artificial Sequence
  chemically synthesized
ctccttagaccaaatagtccta

SEQ ID NO: 1216830 - DNA, 22 bp, Artificial Sequence
  chemically synthesized
cttagaccaaatagtcctaaca

SEQ ID NO: 1216831 - DNA, 22 bp, Artificial Sequence
  chemically synthesized
tcctataagtgtctgttaggac

SEQ ID NO: 1216832 - DNA, 22 bp, Artificial Sequence
  chemically synthesized
agaccaaatagtcctaacagac

SEQ ID NO: 1216833 - DNA, 22 bp, Artificial Sequence
  chemically synthesized
gaccaaatagtcctaacagaca

SEQ ID NO: 1216834 - DNA, 22 bp, Artificial Sequence
  chemically synthesized
aaggaattgtcctataagtgtc

SEQ ID NO: 1216835 - DNA, 22 bp, Artificial Sequence
  chemically synthesized
ttgaaggaattgtcctataagt

SEQ ID NO: 1216836 - DNA, 22 bp, Artificial Sequence
  chemically synthesized
acagacacttataggacaattc

SEQ ID NO: 1216837 - DNA, 22 bp, Artificial Sequence
  chemically synthesized
ataggacaattccttcaacagt

SEQ ID NO: 1216838 - DNA, 22 bp, Artificial Sequence
  chemically synthesized
taggacaattccttcaacagtc

SEQ ID NO: 1216839 - DNA, 22 bp, Artificial Sequence
  chemically synthesized
tgagaaaaaaatgtgtatgact

SEQ ID NO: 1216840 - DNA, 22 bp, Artificial Sequence
  chemically synthesized
atgagaaaaaaatgtgtatgac

SEQ ID NO: 1216841 - DNA, 22 bp, Artificial Sequence
  chemically synthesized
cttcaacagtcatacacatttt

SEQ ID NO: 1216842 - DNA, 22 bp, Artificial Sequence
  chemically synthesized
caacagtcatacacattttttt

SEQ ID NO: 1216843 - DNA, 22 bp, Artificial Sequence
  chemically synthesized
tgtgcttatgagaaaaaaatgt

SEQ ID NO: 1216844 - DNA, 22 bp, Artificial Sequence
  chemically synthesized
aacagtcatacacatttttttc

SEQ ID NO: 1216845 - DNA, 22 bp, Artificial Sequence
  chemically synthesized
tgtgtgcttatgagaaaaaaat

SEQ ID NO: 1216846 - DNA, 22 bp, Artificial Sequence
  chemically synthesized
gagaatgttctgtgtgcttatg

SEQ ID NO: 1216847 - DNA, 22 bp, Artificial Sequence
  chemically synthesized
tcctggagaatgttctgtgtgc

SEQ ID NO: 1216848 - DNA, 22 bp, Artificial Sequence
  chemically synthesized
ttttctcataagcacacagaac

SEQ ID NO: 1216849 - DNA, 22 bp, Artificial Sequence
  chemically synthesized
tttctcataagcacacagaaca

SEQ ID NO: 1216850 - DNA, 22 bp, Artificial Sequence
  chemically synthesized
ttctcataagcacacagaacat

SEQ ID NO: 1216851 - DNA, 22 bp, Artificial Sequence
  chemically synthesized
tctcataagcacacagaacatt

SEQ ID NO: 1216852 - DNA, 22 bp, Artificial Sequence
  chemically synthesized
ctcataagcacacagaacattc

SEQ ID NO: 1216853 - DNA, 22 bp, Artificial Sequence
  chemically synthesized
tcataagcacacagaacattct

SEQ ID NO: 1216854 - DNA, 22 bp, Artificial Sequence
  chemically synthesized
ataagcacacagaacattctcc

SEQ ID NO: 1216855 - DNA, 22 bp, Artificial Sequence
  chemically synthesized
tcataacatatggtctgtcctg

SEQ ID NO: 1216856 - DNA, 22 bp, Artificial Sequence
  chemically synthesized
tgtcataacatatggtctgtcc

SEQ ID NO: 1216857 - DNA, 22 bp, Artificial Sequence
  chemically synthesized
tccaggacagaccatatgttat

SEQ ID NO: 1216858 - DNA, 22 bp, Artificial Sequence
  chemically synthesized
caggacagaccatatgttatga

SEQ ID NO: 1216859 - DNA, 22 bp, Artificial Sequence
  chemically synthesized
agacatattctgtcataacata

SEQ ID NO: 1216860 - DNA, 22 bp, Artificial Sequence
  chemically synthesized
ttaagacatattctgtcataac

SEQ ID NO: 1216861 - DNA, 22 bp, Artificial Sequence
  chemically synthesized
gttaagacatattctgtcataa

SEQ ID NO: 1216862 - DNA, 22 bp, Artificial Sequence
  chemically synthesized
taaatttgttaagacatattct

SEQ ID NO: 1216863 - DNA, 22 bp, Artificial Sequence
  chemically synthesized
ataaatttgttaagacatattc

SEQ ID NO: 1216864 - DNA, 22 bp, Artificial Sequence
  chemically synthesized
tataaatttgttaagacatatt

SEQ ID NO: 1216865 - DNA, 22 bp, Artificial Sequence
  chemically synthesized
ttataaatttgttaagacatat

SEQ ID NO: 1216866 - DNA, 22 bp, Artificial Sequence
  chemically synthesized
tttataaatttgttaagacata

SEQ ID NO: 1216867 - DNA, 22 bp, Artificial Sequence
  chemically synthesized
tgacagaatatgtcttaacaaa

SEQ ID NO: 1216868 - DNA, 22 bp, Artificial Sequence
  chemically synthesized
attttttataaatttgttaaga

SEQ ID NO: 1216869 - DNA, 22 bp, Artificial Sequence
  chemically synthesized
gattttttataaatttgttaag

SEQ ID NO: 1216870 - DNA, 22 bp, Artificial Sequence
  chemically synthesized
tgattttttataaatttgttaa

SEQ ID NO: 1216871 - DNA, 22 bp, Artificial Sequence
  chemically synthesized
gatatgattttgattttttata

SEQ ID NO: 1216872 - DNA, 22 bp, Artificial Sequence
  chemically synthesized
aacaaatttataaaaaatcaaa

SEQ ID NO: 1216873 - DNA, 22 bp, Artificial Sequence
  chemically synthesized
acaaatttataaaaaatcaaaa

SEQ ID NO: 1216874 - DNA, 22 bp, Artificial Sequence
  chemically synthesized
agaagatattagatatgatttt

SEQ ID NO: 1216875 - DNA, 22 bp, Artificial Sequence
  chemically synthesized
aagaagatattagatatgattt

SEQ ID NO: 1216876 - DNA, 22 bp, Artificial Sequence
  chemically synthesized
ataaaaaatcaaaatcatatct

SEQ ID NO: 1216877 - DNA, 22 bp, Artificial Sequence
  chemically synthesized
taagaagatattagatatgatt

SEQ ID NO: 1216878 - DNA, 22 bp, Artificial Sequence
  chemically synthesized
taaaaaatcaaaatcatatcta

SEQ ID NO: 1216879 - DNA, 22 bp, Artificial Sequence
  chemically synthesized
tgttttaagaagatattagata

SEQ ID NO: 1216880 - DNA, 22 bp, Artificial Sequence
  chemically synthesized
gtgttttaagaagatattagat

SEQ ID NO: 1216881 - DNA, 22 bp, Artificial Sequence
  chemically synthesized
cttgtgttttaagaagatatta

SEQ ID NO: 1216882 - DNA, 22 bp, Artificial Sequence
  chemically synthesized
ccttgtgttttaagaagatatt

SEQ ID NO: 1216883 - DNA, 22 bp, Artificial Sequence
  chemically synthesized
tttccttgtgttttaagaagat

SEQ ID NO: 1216884 - DNA, 22 bp, Artificial Sequence
  chemically synthesized
ttatttccttgtgttttaagaa

SEQ ID NO: 1216885 - DNA, 22 bp, Artificial Sequence
  chemically synthesized
gttatttccttgtgttttaaga

SEQ ID NO: 1216886 - DNA, 22 bp, Artificial Sequence
  chemically synthesized
tgttatttccttgtgttttaag

SEQ ID NO: 1216887 - DNA, 22 bp, Artificial Sequence
  chemically synthesized
ttgttatttccttgtgttttaa

SEQ ID NO: 1216888 - DNA, 22 bp, Artificial Sequence
  chemically synthesized
tttgttatttccttgtgtttta

SEQ ID NO: 1216889 - DNA, 22 bp, Artificial Sequence
  chemically synthesized
tttttgttatttccttgtgttt

SEQ ID NO: 1216890 - DNA, 22 bp, Artificial Sequence
  chemically synthesized
atatcttcttaaaacacaagga

SEQ ID NO: 1216891 - DNA, 22 bp, Artificial Sequence
  chemically synthesized
tctttttgttatttccttgtgt

SEQ ID NO: 1216892 - DNA, 22 bp, Artificial Sequence
  chemically synthesized
ctctttttgttatttccttgtg

SEQ ID NO: 1216893 - DNA, 22 bp, Artificial Sequence
  chemically synthesized
cttaaaacacaaggaaataaca

SEQ ID NO: 1216894 - DNA, 22 bp, Artificial Sequence
  chemically synthesized
ttaaaacacaaggaaataacaa

SEQ ID NO: 1216895 - DNA, 22 bp, Artificial Sequence
  chemically synthesized
aaaacacaaggaaataacaaaa

SEQ ID NO: 1216896 - DNA, 22 bp, Artificial Sequence
  chemically synthesized
caaagtttctctttttgttatt

SEQ ID NO: 1216897 - DNA, 22 bp, Artificial Sequence
  chemically synthesized
aaacacaaggaaataacaaaaa

SEQ ID NO: 1216898 - DNA, 22 bp, Artificial Sequence
  chemically synthesized
tacaggttccaaagtttctctt

SEQ ID NO: 1216899 - DNA, 22 bp, Artificial Sequence
  chemically synthesized
gtacaggttccaaagtttctct

SEQ ID NO: 1216900 - DNA, 22 bp, Artificial Sequence
  chemically synthesized
tgtacaggttccaaagtttctc

SEQ ID NO: 1216901 - DNA, 22 bp, Artificial Sequence
  chemically synthesized
ttgtacaggttccaaagtttct

SEQ ID NO: 1216902 - DNA, 22 bp, Artificial Sequence
  chemically synthesized
catgtttttgtacaggttccaa

SEQ ID NO: 1216903 - DNA, 22 bp, Artificial Sequence
  chemically synthesized
ccatgtttttgtacaggttcca

SEQ ID NO: 1216904 - DNA, 22 bp, Artificial Sequence
  chemically synthesized
aatttccatgtttttgtacagg

SEQ ID NO: 1216905 - DNA, 22 bp, Artificial Sequence
  chemically synthesized
ttcaatttccatgtttttgtac

SEQ ID NO: 1216906 - DNA, 22 bp, Artificial Sequence
  chemically synthesized
tggaacctgtacaaaaacatgg

SEQ ID NO: 1216907 - DNA, 22 bp, Artificial Sequence
  chemically synthesized
ggaacctgtacaaaaacatgga

SEQ ID NO: 1216908 - DNA, 22 bp, Artificial Sequence
  chemically synthesized
gaacctgtacaaaaacatggaa

SEQ ID NO: 1216909 - DNA, 22 bp, Artificial Sequence
  chemically synthesized
aggagtatgttgttcaatttcc

SEQ ID NO: 1216910 - DNA, 22 bp, Artificial Sequence
  chemically synthesized
tacaaaaacatggaaattgaac

SEQ ID NO: 1216911 - DNA, 22 bp, Artificial Sequence
  chemically synthesized
acccaatggtcattcaggagta

SEQ ID NO: 1216912 - DNA, 22 bp, Artificial Sequence
  chemically synthesized
gacccaatggtcattcaggagt

SEQ ID NO: 1216913 - DNA, 22 bp, Artificial Sequence
  chemically synthesized
cttgacccaatggtcattcagg

SEQ ID NO: 1216914 - DNA, 22 bp, Artificial Sequence
  chemically synthesized
aacaacatactcctgaatgacc

SEQ ID NO: 1216915 - DNA, 22 bp, Artificial Sequence
  chemically synthesized
ccttgacccaatggtcattcag

SEQ ID NO: 1216916 - DNA, 22 bp, Artificial Sequence
  chemically synthesized
ttccttgacccaatggtcattc

SEQ ID NO: 1216917 - DNA, 22 bp, Artificial Sequence
  chemically synthesized
cttccttgacccaatggtcatt

SEQ ID NO: 1216918 - DNA, 22 bp, Artificial Sequence
  chemically synthesized
tcttccttgacccaatggtcat

SEQ ID NO: 1216919 - DNA, 22 bp, Artificial Sequence
  chemically synthesized
aattttcttccttgacccaatg

SEQ ID NO: 1216920 - DNA, 22 bp, Artificial Sequence
  chemically synthesized
ctgaatgaccattgggtcaagg

SEQ ID NO: 1216921 - DNA, 22 bp, Artificial Sequence
  chemically synthesized
ctcaattttcttccttgaccca

SEQ ID NO: 1216922 - DNA, 22 bp, Artificial Sequence
  chemically synthesized
cctcaattttcttccttgaccc

SEQ ID NO: 1216923 - DNA, 22 bp, Artificial Sequence
  chemically synthesized
aatgaccattgggtcaaggaag

SEQ ID NO: 1216924 - DNA, 22 bp, Artificial Sequence
  chemically synthesized
aaaacatttcctcaattttctt

SEQ ID NO: 1216925 - DNA, 22 bp, Artificial Sequence
  chemically synthesized
gaaaacatttcctcaattttct

SEQ ID NO: 1216926 - DNA, 22 bp, Artificial Sequence
  chemically synthesized
tgaaaacatttcctcaattttc

SEQ ID NO: 1216927 - DNA, 22 bp, Artificial Sequence
  chemically synthesized
ttgaaaacatttcctcaatttt

SEQ ID NO: 1216928 - DNA, 22 bp, Artificial Sequence
  chemically synthesized
ggtcaaggaagaaaattgagga

SEQ ID NO: 1216929 - DNA, 22 bp, Artificial Sequence
  chemically synthesized
tttgaaaacatttcctcaattt

SEQ ID NO: 1216930 - DNA, 22 bp, Artificial Sequence
  chemically synthesized
aataattttttgaaaacatttc

SEQ ID NO: 1216931 - DNA, 22 bp, Artificial Sequence
  chemically synthesized
caataattttttgaaaacattt

SEQ ID NO: 1216932 - DNA, 22 bp, Artificial Sequence
  chemically synthesized
tttcaataattttttgaaaaca

SEQ ID NO: 1216933 - DNA, 22 bp, Artificial Sequence
  chemically synthesized
gtttcaataattttttgaaaac

SEQ ID NO: 1216934 - DNA, 22 bp, Artificial Sequence
  chemically synthesized
atttgtttcaataattttttga

SEQ ID NO: 1216935 - DNA, 22 bp, Artificial Sequence
  chemically synthesized
aggaaatgttttcaaaaaatta

SEQ ID NO: 1216936 - DNA, 22 bp, Artificial Sequence
  chemically synthesized
atattcatttgtttcaataatt

SEQ ID NO: 1216937 - DNA, 22 bp, Artificial Sequence
  chemically synthesized
gatattcatttgtttcaataat

SEQ ID NO: 1216938 - DNA, 22 bp, Artificial Sequence
  chemically synthesized
tgatattcatttgtttcaataa

SEQ ID NO: 1216939 - DNA, 22 bp, Artificial Sequence
  chemically synthesized
tcaaaaaattattgaaacaaat

SEQ ID NO: 1216940 - DNA, 22 bp, Artificial Sequence
  chemically synthesized
caaaaaattattgaaacaaatg

SEQ ID NO: 1216941 - DNA, 22 bp, Artificial Sequence
  chemically synthesized
tattttgatattcatttgtttc

SEQ ID NO: 1216942 - DNA, 22 bp, Artificial Sequence
  chemically synthesized
aaaaaattattgaaacaaatga

SEQ ID NO: 1216943 - DNA, 22 bp, Artificial Sequence
  chemically synthesized
ttatattttgatattcatttgt

SEQ ID NO: 1216944 - DNA, 22 bp, Artificial Sequence
  chemically synthesized
ttgaaacaaatgaatatcaaaa

SEQ ID NO: 1216945 - DNA, 22 bp, Artificial Sequence
  chemically synthesized
aaacaaatgaatatcaaaatat

SEQ ID NO: 1216946 - DNA, 22 bp, Artificial Sequence
  chemically synthesized
ccatatcccgtaggtgttatta

SEQ ID NO: 1216947 - DNA, 22 bp, Artificial Sequence
  chemically synthesized
gccatatcccgtaggtgttatt

SEQ ID NO: 1216948 - DNA, 22 bp, Artificial Sequence
  chemically synthesized
tgccatatcccgtaggtgttat

SEQ ID NO: 1216949 - DNA, 22 bp, Artificial Sequence
  chemically synthesized
ttgccatatcccgtaggtgtta

SEQ ID NO: 1216950 - DNA, 22 bp, Artificial Sequence
  chemically synthesized
cttttgccatatcccgtaggtg

SEQ ID NO: 1216951 - DNA, 22 bp, Artificial Sequence
  chemically synthesized
gcactgcttttgccatatcccg

SEQ ID NO: 1216952 - DNA, 22 bp, Artificial Sequence
  chemically synthesized
agcactgcttttgccatatccc

SEQ ID NO: 1216953 - DNA, 22 bp, Artificial Sequence
  chemically synthesized
cgggatatggcaaaagcagtgc

SEQ ID NO: 1216954 - DNA, 22 bp, Artificial Sequence
  chemically synthesized
tatacatcccccttagcactgc

SEQ ID NO: 1216955 - DNA, 22 bp, Artificial Sequence
  chemically synthesized
ctatatacatcccccttagcac

SEQ ID NO: 1216956 - DNA, 22 bp, Artificial Sequence
  chemically synthesized
gctatatacatcccccttagca

SEQ ID NO: 1216957 - DNA, 22 bp, Artificial Sequence
  chemically synthesized
tgctatatacatcccccttagc

SEQ ID NO: 1216958 - DNA, 22 bp, Artificial Sequence
  chemically synthesized
ttgctatatacatcccccttag

SEQ ID NO: 1216959 - DNA, 22 bp, Artificial Sequence
  chemically synthesized
atgtgagcatttttgctatata

SEQ ID NO: 1216960 - DNA, 22 bp, Artificial Sequence
  chemically synthesized
gatgtgagcatttttgctatat

SEQ ID NO: 1216961 - DNA, 22 bp, Artificial Sequence
  chemically synthesized
tgatgtgagcatttttgctata

SEQ ID NO: 1216962 - DNA, 22 bp, Artificial Sequence
  chemically synthesized
agggggatgtatatagcaaaaa

SEQ ID NO: 1216963 - DNA, 22 bp, Artificial Sequence
  chemically synthesized
ttgatgtgagcatttttgctat

SEQ ID NO: 1216964 - DNA, 22 bp, Artificial Sequence
  chemically synthesized
aacatttttgatgtgagcattt

SEQ ID NO: 1216965 - DNA, 22 bp, Artificial Sequence
  chemically synthesized
caacatttttgatgtgagcatt

SEQ ID NO: 1216966 - DNA, 22 bp, Artificial Sequence
  chemically synthesized
aaatatttcaacatttttgatg

SEQ ID NO: 1216967 - DNA, 22 bp, Artificial Sequence
  chemically synthesized
gaaatatttcaacatttttgat

SEQ ID NO: 1216968 - DNA, 22 bp, Artificial Sequence
  chemically synthesized
tttgaaatatttcaacattttt

SEQ ID NO: 1216969 - DNA, 22 bp, Artificial Sequence
  chemically synthesized
gattgtttgaaatatttcaaca

SEQ ID NO: 1216970 - DNA, 22 bp, Artificial Sequence
  chemically synthesized
acatcaaaaatgttgaaatatt

SEQ ID NO: 1216971 - DNA, 22 bp, Artificial Sequence
  chemically synthesized
ttagattgtttgaaatatttca

SEQ ID NO: 1216972 - DNA, 22 bp, Artificial Sequence
  chemically synthesized
gttagattgtttgaaatatttc

SEQ ID NO: 1216973 - DNA, 22 bp, Artificial Sequence
  chemically synthesized
tgttagattgtttgaaatattt

SEQ ID NO: 1216974 - DNA, 22 bp, Artificial Sequence
  chemically synthesized
aagtactttgttagattgtttg

SEQ ID NO: 1216975 - DNA, 22 bp, Artificial Sequence
  chemically synthesized
gaagtactttgttagattgttt

SEQ ID NO: 1216976 - DNA, 22 bp, Artificial Sequence
  chemically synthesized
aaatatttcaaacaatctaaca

SEQ ID NO: 1216977 - DNA, 22 bp, Artificial Sequence
  chemically synthesized
cttgaagtactttgttagattg

SEQ ID NO: 1216978 - DNA, 22 bp, Artificial Sequence
  chemically synthesized
gctccttgaagtactttgttag

SEQ ID NO: 1216979 - DNA, 22 bp, Artificial Sequence
  chemically synthesized
caaacaatctaacaaagtactt

SEQ ID NO: 1216980 - DNA, 22 bp, Artificial Sequence
  chemically synthesized
actagctccttgaagtactttg

SEQ ID NO: 1216981 - DNA, 22 bp, Artificial Sequence
  chemically synthesized
aaacaatctaacaaagtacttc

SEQ ID NO: 1216982 - DNA, 22 bp, Artificial Sequence
  chemically synthesized
gactagctccttgaagtacttt

SEQ ID NO: 1216983 - DNA, 22 bp, Artificial Sequence
  chemically synthesized
tgactagctccttgaagtactt

SEQ ID NO: 1216984 - DNA, 22 bp, Artificial Sequence
  chemically synthesized
tttgactagctccttgaagtac

SEQ ID NO: 1216985 - DNA, 22 bp, Artificial Sequence
  chemically synthesized
ctttgactagctccttgaagta

SEQ ID NO: 1216986 - DNA, 22 bp, Artificial Sequence
  chemically synthesized
tctttgactagctccttgaagt

SEQ ID NO: 1216987 - DNA, 22 bp, Artificial Sequence
  chemically synthesized
ttctttgactagctccttgaag

SEQ ID NO: 1216988 - DNA, 22 bp, Artificial Sequence
  chemically synthesized
tttctttgactagctccttgaa

SEQ ID NO: 1216989 - DNA, 22 bp, Artificial Sequence
  chemically synthesized
ttttctttgactagctccttga

SEQ ID NO: 1216990 - DNA, 22 bp, Artificial Sequence
  chemically synthesized
tttttctttgactagctccttg

SEQ ID NO: 1216991 - DNA, 22 bp, Artificial Sequence
  chemically synthesized
acaaagtacttcaaggagctag

SEQ ID NO: 1216992 - DNA, 22 bp, Artificial Sequence
  chemically synthesized
ttttttctttgactagctcctt

SEQ ID NO: 1216993 - DNA, 22 bp, Artificial Sequence
  chemically synthesized
tttttttttctttgactagctc

SEQ ID NO: 1216994 - DNA, 22 bp, Artificial Sequence
  chemically synthesized
gtttttttttctttgactagct

SEQ ID NO: 1216995 - DNA, 22 bp, Artificial Sequence
  chemically synthesized
gtttgtttttttttctttgact

SEQ ID NO: 1216996 - DNA, 22 bp, Artificial Sequence
  chemically synthesized
ggtttgtttttttttctttgac

SEQ ID NO: 1216997 - DNA, 22 bp, Artificial Sequence
  chemically synthesized
caaggagctagtcaaagaaaaa

SEQ ID NO: 1216998 - DNA, 22 bp, Artificial Sequence
  chemically synthesized
aaggagctagtcaaagaaaaaa

SEQ ID NO: 1216999 - DNA, 22 bp, Artificial Sequence
  chemically synthesized
ggtttggtttgtttttttttct

SEQ ID NO: 1217000 - DNA, 22 bp, Artificial Sequence
  chemically synthesized
tgggtttggtttgttttttttt

SEQ ID NO: 1217001 - DNA, 22 bp, Artificial Sequence
  chemically synthesized
attctgggtttggtttgttttt

SEQ ID NO: 1217002 - DNA, 22 bp, Artificial Sequence
  chemically synthesized
gtcaaagaaaaaaaaacaaacc

SEQ ID NO: 1217003 - DNA, 22 bp, Artificial Sequence
  chemically synthesized
ctaattctgggtttggtttgtt

SEQ ID NO: 1217004 - DNA, 22 bp, Artificial Sequence
  chemically synthesized
tactaattctgggtttggtttg

SEQ ID NO: 1217005 - DNA, 22 bp, Artificial Sequence
  chemically synthesized
ctactaattctgggtttggttt

SEQ ID NO: 1217006 - DNA, 22 bp, Artificial Sequence
  chemically synthesized
atccttctactaattctgggtt

SEQ ID NO: 1217007 - DNA, 22 bp, Artificial Sequence
  chemically synthesized
catccttctactaattctgggt

SEQ ID NO: 1217008 - DNA, 22 bp, Artificial Sequence
  chemically synthesized
tcatccttctactaattctggg

SEQ ID NO: 1217009 - DNA, 22 bp, Artificial Sequence
  chemically synthesized
ggattttcatccttctactaat

SEQ ID NO: 1217010 - DNA, 22 bp, Artificial Sequence
  chemically synthesized
aggattttcatccttctactaa

SEQ ID NO: 1217011 - DNA, 22 bp, Artificial Sequence
  chemically synthesized
taggattttcatccttctacta

SEQ ID NO: 1217012 - DNA, 22 bp, Artificial Sequence
  chemically synthesized
ttaggattttcatccttctact

SEQ ID NO: 1217013 - DNA, 22 bp, Artificial Sequence
  chemically synthesized
aatttttaggattttcatcctt

SEQ ID NO: 1217014 - DNA, 22 bp, Artificial Sequence
  chemically synthesized
ctcaatttttaggattttcatc

SEQ ID NO: 1217015 - DNA, 22 bp, Artificial Sequence
  chemically synthesized
gctcaatttttaggattttcat

SEQ ID NO: 1217016 - DNA, 22 bp, Artificial Sequence
  chemically synthesized
tgctcaatttttaggattttca

SEQ ID NO: 1217017 - DNA, 22 bp, Artificial Sequence
  chemically synthesized
gtagaaggatgaaaatcctaaa

SEQ ID NO: 1217018 - DNA, 22 bp, Artificial Sequence
  chemically synthesized
agttttgctcaatttttaggat

SEQ ID NO: 1217019 - DNA, 22 bp, Artificial Sequence
  chemically synthesized
gagttttgctcaatttttagga

SEQ ID NO: 1217020 - DNA, 22 bp, Artificial Sequence
  chemically synthesized
ttgagttttgctcaatttttag

SEQ ID NO: 1217021 - DNA, 22 bp, Artificial Sequence
  chemically synthesized
cttgagttttgctcaattttta

SEQ ID NO: 1217022 - DNA, 22 bp, Artificial Sequence
  chemically synthesized
tcttgagttttgctcaattttt

SEQ ID NO: 1217023 - DNA, 22 bp, Artificial Sequence
  chemically synthesized
ttttcttgagttttgctcaatt

SEQ ID NO: 1217024 - DNA, 22 bp, Artificial Sequence
  chemically synthesized
tattttcttgagttttgctcaa

SEQ ID NO: 1217025 - DNA, 22 bp, Artificial Sequence
  chemically synthesized
tctattttcttgagttttgctc

SEQ ID NO: 1217026 - DNA, 22 bp, Artificial Sequence
  chemically synthesized
ctctctattttcttgagttttg

SEQ ID NO: 1217027 - DNA, 22 bp, Artificial Sequence
  chemically synthesized
gctctctattttcttgagtttt

SEQ ID NO: 1217028 - DNA, 22 bp, Artificial Sequence
  chemically synthesized
tgctctctattttcttgagttt

SEQ ID NO: 1217029 - DNA, 22 bp, Artificial Sequence
  chemically synthesized
aaaattgagcaaaactcaagaa

SEQ ID NO: 1217030 - DNA, 22 bp, Artificial Sequence
  chemically synthesized
ttgctctctattttcttgagtt

SEQ ID NO: 1217031 - DNA, 22 bp, Artificial Sequence
  chemically synthesized
tttgctctctattttcttgagt

SEQ ID NO: 1217032 - DNA, 22 bp, Artificial Sequence
  chemically synthesized
tattttttgctctctattttct

SEQ ID NO: 1217033 - DNA, 22 bp, Artificial Sequence
  chemically synthesized
agcaaaactcaagaaaatagag

SEQ ID NO: 1217034 - DNA, 22 bp, Artificial Sequence
  chemically synthesized
gtattttttgctctctattttc

SEQ ID NO: 1217035 - DNA, 22 bp, Artificial Sequence
  chemically synthesized
tgtattttttgctctctatttt

SEQ ID NO: 1217036 - DNA, 22 bp, Artificial Sequence
  chemically synthesized
atactttgtattttttgctctc

SEQ ID NO: 1217037 - DNA, 22 bp, Artificial Sequence
  chemically synthesized
aagaaaatagagagcaaaaaat

SEQ ID NO: 1217038 - DNA, 22 bp, Artificial Sequence
  chemically synthesized
attgatactttgtattttttgc

SEQ ID NO: 1217039 - DNA, 22 bp, Artificial Sequence
  chemically synthesized
cattgatactttgtattttttg

SEQ ID NO: 1217040 - DNA, 22 bp, Artificial Sequence
  chemically synthesized
atttcattgatactttgtattt

SEQ ID NO: 1217041 - DNA, 22 bp, Artificial Sequence
  chemically synthesized
tcatttcattgatactttgtat

SEQ ID NO: 1217042 - DNA, 22 bp, Artificial Sequence
  chemically synthesized
ctcatttcattgatactttgta

SEQ ID NO: 1217043 - DNA, 22 bp, Artificial Sequence
  chemically synthesized
aaaatcaaacttctcatttcat

SEQ ID NO: 1217044 - DNA, 22 bp, Artificial Sequence
  chemically synthesized
aaaaatcaaacttctcatttca

SEQ ID NO: 1217045 - DNA, 22 bp, Artificial Sequence
  chemically synthesized
taaaaatcaaacttctcatttc

SEQ ID NO: 1217046 - DNA, 22 bp, Artificial Sequence
  chemically synthesized
ttaaaaatcaaacttctcattt

SEQ ID NO: 1217047 - DNA, 22 bp, Artificial Sequence
  chemically synthesized
tttaaaaatcaaacttctcatt

SEQ ID NO: 1217048 - DNA, 22 bp, Artificial Sequence
  chemically synthesized
atctttttaaaaatcaaacttc

SEQ ID NO: 1217049 - DNA, 22 bp, Artificial Sequence
  chemically synthesized
catctttttaaaaatcaaactt

SEQ ID NO: 1217050 - DNA, 22 bp, Artificial Sequence
  chemically synthesized
tcatctttttaaaaatcaaact

SEQ ID NO: 1217051 - DNA, 22 bp, Artificial Sequence
  chemically synthesized
ttttcatctttttaaaaatcaa

SEQ ID NO: 1217052 - DNA, 22 bp, Artificial Sequence
  chemically synthesized
attttcatctttttaaaaatca

SEQ ID NO: 1217053 - DNA, 22 bp, Artificial Sequence
  chemically synthesized
tattttcatctttttaaaaatc

SEQ ID NO: 1217054 - DNA, 22 bp, Artificial Sequence
  chemically synthesized
gcaagtgctttattttcatctt

SEQ ID NO: 1217055 - DNA, 22 bp, Artificial Sequence
  chemically synthesized
gatttttaaaaagatgaaaata

SEQ ID NO: 1217056 - DNA, 22 bp, Artificial Sequence
  chemically synthesized
atttttaaaaagatgaaaataa

SEQ ID NO: 1217057 - DNA, 22 bp, Artificial Sequence
  chemically synthesized
gtctagcaagtgctttattttc

SEQ ID NO: 1217058 - DNA, 22 bp, Artificial Sequence
  chemically synthesized
ttaaaaagatgaaaataaagca

SEQ ID NO: 1217059 - DNA, 22 bp, Artificial Sequence
  chemically synthesized
taaaaagatgaaaataaagcac

SEQ ID NO: 1217060 - DNA, 22 bp, Artificial Sequence
  chemically synthesized
aaaaagatgaaaataaagcact

SEQ ID NO: 1217061 - DNA, 22 bp, Artificial Sequence
  chemically synthesized
gttagtctagcaagtgctttat

SEQ ID NO: 1217062 - DNA, 22 bp, Artificial Sequence
  chemically synthesized
aaaagatgaaaataaagcactt

SEQ ID NO: 1217063 - DNA, 22 bp, Artificial Sequence
  chemically synthesized
ggttagtctagcaagtgcttta

SEQ ID NO: 1217064 - DNA, 22 bp, Artificial Sequence
  chemically synthesized
ttggttagtctagcaagtgctt

SEQ ID NO: 1217065 - DNA, 22 bp, Artificial Sequence
  chemically synthesized
cttggttagtctagcaagtgct

SEQ ID NO: 1217066 - DNA, 22 bp, Artificial Sequence
  chemically synthesized
tcttggttagtctagcaagtgc

SEQ ID NO: 1217067 - DNA, 22 bp, Artificial Sequence
  chemically synthesized
ttcttggttagtctagcaagtg

SEQ ID NO: 1217068 - DNA, 22 bp, Artificial Sequence
  chemically synthesized
tttcttggttagtctagcaagt

SEQ ID NO: 1217069 - DNA, 22 bp, Artificial Sequence
  chemically synthesized
ttttcttggttagtctagcaag

SEQ ID NO: 1217070 - DNA, 22 bp, Artificial Sequence
  chemically synthesized
tttttcttggttagtctagcaa

SEQ ID NO: 1217071 - DNA, 22 bp, Artificial Sequence
  chemically synthesized
ttttttcttggttagtctagca

SEQ ID NO: 1217072 - DNA, 22 bp, Artificial Sequence
  chemically synthesized
tttttttcttggttagtctagc

SEQ ID NO: 1217073 - DNA, 22 bp, Artificial Sequence
  chemically synthesized
ttttttttcttggttagtctag

SEQ ID NO: 1217074 - DNA, 22 bp, Artificial Sequence
  chemically synthesized
agtcttttttttttcttggtta

SEQ ID NO: 1217075 - DNA, 22 bp, Artificial Sequence
  chemically synthesized
gagtcttttttttttcttggtt

SEQ ID NO: 1217076 - DNA, 22 bp, Artificial Sequence
  chemically synthesized
tgagtcttttttttttcttggt

SEQ ID NO: 1217077 - DNA, 22 bp, Artificial Sequence
  chemically synthesized
gctagactaaccaagaaaaaaa

SEQ ID NO: 1217078 - DNA, 22 bp, Artificial Sequence
  chemically synthesized
ctagactaaccaagaaaaaaaa

SEQ ID NO: 1217079 - DNA, 22 bp, Artificial Sequence
  chemically synthesized
tgattttgagtctttttttttt

SEQ ID NO: 1217080 - DNA, 22 bp, Artificial Sequence
  chemically synthesized
gactaaccaagaaaaaaaaaag

SEQ ID NO: 1217081 - DNA, 22 bp, Artificial Sequence
  chemically synthesized
atgattttgagtcttttttttt

SEQ ID NO: 1217082 - DNA, 22 bp, Artificial Sequence
  chemically synthesized
atttatgattttgagtcttttt

SEQ ID NO: 1217083 - DNA, 22 bp, Artificial Sequence
  chemically synthesized
accaagaaaaaaaaaagactca

SEQ ID NO: 1217084 - DNA, 22 bp, Artificial Sequence
  chemically synthesized
catttatgattttgagtctttt

SEQ ID NO: 1217085 - DNA, 22 bp, Artificial Sequence
  chemically synthesized
cgtcttcatttatgattttgag

SEQ ID NO: 1217086 - DNA, 22 bp, Artificial Sequence
  chemically synthesized
taatgtctccgtcttcatttat

SEQ ID NO: 1217087 - DNA, 22 bp, Artificial Sequence
  chemically synthesized
aaaatcataaatgaagacggag

SEQ ID NO: 1217088 - DNA, 22 bp, Artificial Sequence
  chemically synthesized
tggtatcagttgtaatgtctcc

SEQ ID NO: 1217089 - DNA, 22 bp, Artificial Sequence
  chemically synthesized
tatggtatcagttgtaatgtct

SEQ ID NO: 1217090 - DNA, 22 bp, Artificial Sequence
  chemically synthesized
ctatggtatcagttgtaatgtc

SEQ ID NO: 1217091 - DNA, 22 bp, Artificial Sequence
  chemically synthesized
tttctatggtatcagttgtaat

SEQ ID NO: 1217092 - DNA, 22 bp, Artificial Sequence
  chemically synthesized
atttctatggtatcagttgtaa

SEQ ID NO: 1217093 - DNA, 22 bp, Artificial Sequence
  chemically synthesized
tatttctatggtatcagttgta

SEQ ID NO: 1217094 - DNA, 22 bp, Artificial Sequence
  chemically synthesized
ttatttctatggtatcagttgt

SEQ ID NO: 1217095 - DNA, 22 bp, Artificial Sequence
  chemically synthesized
tttatttctatggtatcagttg

SEQ ID NO: 1217096 - DNA, 22 bp, Artificial Sequence
  chemically synthesized
aactttttatttctatggtatc

SEQ ID NO: 1217097 - DNA, 22 bp, Artificial Sequence
  chemically synthesized
tgaactttttatttctatggta

SEQ ID NO: 1217098 - DNA, 22 bp, Artificial Sequence
  chemically synthesized
caactgataccatagaaataaa

SEQ ID NO: 1217099 - DNA, 22 bp, Artificial Sequence
  chemically synthesized
ataccatagaaataaaaagttc

SEQ ID NO: 1217100 - DNA, 22 bp, Artificial Sequence
  chemically synthesized
agtatagtctctgaacttttta

SEQ ID NO: 1217101 - DNA, 22 bp, Artificial Sequence
  chemically synthesized
ttcagtatagtctctgaacttt

SEQ ID NO: 1217102 - DNA, 22 bp, Artificial Sequence
  chemically synthesized
atagttgttcagtatagtctct

SEQ ID NO: 1217103 - DNA, 22 bp, Artificial Sequence
  chemically synthesized
aatagttgttcagtatagtctc

SEQ ID NO: 1217104 - DNA, 22 bp, Artificial Sequence
  chemically synthesized
tttaatagttgttcagtatagt

SEQ ID NO: 1217105 - DNA, 22 bp, Artificial Sequence
  chemically synthesized
ttatttaatagttgttcagtat

SEQ ID NO: 1217106 - DNA, 22 bp, Artificial Sequence
  chemically synthesized
attatttaatagttgttcagta

SEQ ID NO: 1217107 - DNA, 22 bp, Artificial Sequence
  chemically synthesized
agagactatactgaacaactat

SEQ ID NO: 1217108 - DNA, 22 bp, Artificial Sequence
  chemically synthesized
gtttattatttaatagttgttc

SEQ ID NO: 1217109 - DNA, 22 bp, Artificial Sequence
  chemically synthesized
agtttattatttaatagttgtt

SEQ ID NO: 1217110 - DNA, 22 bp, Artificial Sequence
  chemically synthesized
tagtttattatttaatagttgt

SEQ ID NO: 1217111 - DNA, 22 bp, Artificial Sequence
  chemically synthesized
ttagtttattatttaatagttg

SEQ ID NO: 1217112 - DNA, 22 bp, Artificial Sequence
  chemically synthesized
tactgaacaactattaaataat

SEQ ID NO: 1217113 - DNA, 22 bp, Artificial Sequence
  chemically synthesized
gatttttagtttattatttaat

SEQ ID NO: 1217114 - DNA, 22 bp, Artificial Sequence
  chemically synthesized
tagatttttagtttattattta

SEQ ID NO: 1217115 - DNA, 22 bp, Artificial Sequence
  chemically synthesized
aacaactattaaataataaact

SEQ ID NO: 1217116 - DNA, 22 bp, Artificial Sequence
  chemically synthesized
ctctagatttttagtttattat

SEQ ID NO: 1217117 - DNA, 22 bp, Artificial Sequence
  chemically synthesized
tacattcctctagatttttagt

SEQ ID NO: 1217118 - DNA, 22 bp, Artificial Sequence
  chemically synthesized
ttaaataataaactaaaaatct

SEQ ID NO: 1217119 - DNA, 22 bp, Artificial Sequence
  chemically synthesized
atacattcctctagatttttag

SEQ ID NO: 1217120 - DNA, 22 bp, Artificial Sequence
  chemically synthesized
aataataaactaaaaatctaga

SEQ ID NO: 1217121 - DNA, 22 bp, Artificial Sequence
  chemically synthesized
aaaatctagaggaatgtataaa

SEQ ID NO: 1217122 - DNA, 22 bp, Artificial Sequence
  chemically synthesized
tatgtgtccgggaatttataca

SEQ ID NO: 1217123 - DNA, 22 bp, Artificial Sequence
  chemically synthesized
gttgtatgtgtccgggaattta

SEQ ID NO: 1217124 - DNA, 22 bp, Artificial Sequence
  chemically synthesized
gaggaatgtataaattcccgga

SEQ ID NO: 1217125 - DNA, 22 bp, Artificial Sequence
  chemically synthesized
atccacggttggttgtatgtgt

SEQ ID NO: 1217126 - DNA, 22 bp, Artificial Sequence
  chemically synthesized
gatccacggttggttgtatgtg

SEQ ID NO: 1217127 - DNA, 22 bp, Artificial Sequence
  chemically synthesized
ttgatccacggttggttgtatg

SEQ ID NO: 1217128 - DNA, 22 bp, Artificial Sequence
  chemically synthesized
cttgatccacggttggttgtat

SEQ ID NO: 1217129 - DNA, 22 bp, Artificial Sequence
  chemically synthesized
ttcttgatccacggttggttgt

SEQ ID NO: 1217130 - DNA, 22 bp, Artificial Sequence
  chemically synthesized
cttcttgatccacggttggttg

SEQ ID NO: 1217131 - DNA, 22 bp, Artificial Sequence
  chemically synthesized
ccggacacatacaaccaaccgt

SEQ ID NO: 1217132 - DNA, 22 bp, Artificial Sequence
  chemically synthesized
tttcttcttgatccacggttgg

SEQ ID NO: 1217133 - DNA, 22 bp, Artificial Sequence
  chemically synthesized
tatttcttcttgatccacggtt

SEQ ID NO: 1217134 - DNA, 22 bp, Artificial Sequence
  chemically synthesized
ctatttcttcttgatccacggt

SEQ ID NO: 1217135 - DNA, 22 bp, Artificial Sequence
  chemically synthesized
tctatttcttcttgatccacgg

SEQ ID NO: 1217136 - DNA, 22 bp, Artificial Sequence
  chemically synthesized
agattttctatttcttcttgat

SEQ ID NO: 1217137 - DNA, 22 bp, Artificial Sequence
  chemically synthesized
ttcagattttctatttcttctt

SEQ ID NO: 1217138 - DNA, 22 bp, Artificial Sequence
  chemically synthesized
tagatctgttcagattttctat

SEQ ID NO: 1217139 - DNA, 22 bp, Artificial Sequence
  chemically synthesized
attatagatctgttcagatttt

SEQ ID NO: 1217140 - DNA, 22 bp, Artificial Sequence
  chemically synthesized
ctaattatagatctgttcagat

SEQ ID NO: 1217141 - DNA, 22 bp, Artificial Sequence
  chemically synthesized
aagatcattactaattatagat

SEQ ID NO: 1217142 - DNA, 22 bp, Artificial Sequence
  chemically synthesized
attcaagatcattactaattat

SEQ ID NO: 1217143 - DNA, 22 bp, Artificial Sequence
  chemically synthesized
aacagatctataattagtaatg

SEQ ID NO: 1217144 - DNA, 22 bp, Artificial Sequence
  chemically synthesized
ctgattcaagatcattactaat

SEQ ID NO: 1217145 - DNA, 22 bp, Artificial Sequence
  chemically synthesized
agattactgattcaagatcatt

SEQ ID NO: 1217146 - DNA, 22 bp, Artificial Sequence
  chemically synthesized
aagattactgattcaagatcat

SEQ ID NO: 1217147 - DNA, 22 bp, Artificial Sequence
  chemically synthesized
taagattactgattcaagatca

SEQ ID NO: 1217148 - DNA, 22 bp, Artificial Sequence
  chemically synthesized
ttaagattactgattcaagatc

SEQ ID NO: 1217149 - DNA, 22 bp, Artificial Sequence
  chemically synthesized
taattagtaatgatcttgaatc

SEQ ID NO: 1217150 - DNA, 22 bp, Artificial Sequence
  chemically synthesized
tttaagattactgattcaagat

SEQ ID NO: 1217151 - DNA, 22 bp, Artificial Sequence
  chemically synthesized
gtaatgatcttgaatcagtaat

SEQ ID NO: 1217152 - DNA, 22 bp, Artificial Sequence
  chemically synthesized
ggaaattttttaagattactga

SEQ ID NO: 1217153 - DNA, 22 bp, Artificial Sequence
  chemically synthesized
gttgggaaattttttaagatta

SEQ ID NO: 1217154 - DNA, 22 bp, Artificial Sequence
  chemically synthesized
cgttgggaaattttttaagatt

SEQ ID NO: 1217155 - DNA, 22 bp, Artificial Sequence
  chemically synthesized
gaatcagtaatcttaaaaaatt

SEQ ID NO: 1217156 - DNA, 22 bp, Artificial Sequence
  chemically synthesized
tcttcgttgggaaattttttaa

SEQ ID NO: 1217157 - DNA, 22 bp, Artificial Sequence
  chemically synthesized
aatcagtaatcttaaaaaattt

SEQ ID NO: 1217158 - DNA, 22 bp, Artificial Sequence
  chemically synthesized
gactgtcttcgttgggaaattt

SEQ ID NO: 1217159 - DNA, 22 bp, Artificial Sequence
  chemically synthesized
gtcctggactgtcttcgttggg

SEQ ID NO: 1217160 - DNA, 22 bp, Artificial Sequence
  chemically synthesized
aaaaaatttcccaacgaagaca

SEQ ID NO: 1217161 - DNA, 22 bp, Artificial Sequence
  chemically synthesized
aaaaatttcccaacgaagacag

SEQ ID NO: 1217162 - DNA, 22 bp, Artificial Sequence
  chemically synthesized
cccaacgaagacagtccaggac

SEQ ID NO: 1217163 - DNA, 22 bp, Artificial Sequence
  chemically synthesized
ccaacgaagacagtccaggacc

SEQ ID NO: 1217164 - DNA, 22 bp, Artificial Sequence
  chemically synthesized
agcagtaaagacatctggtcct

SEQ ID NO: 1217165 - DNA, 22 bp, Artificial Sequence
  chemically synthesized
gtagaattcagcagtaaagaca

SEQ ID NO: 1217166 - DNA, 22 bp, Artificial Sequence
  chemically synthesized
ggtagaattcagcagtaaagac

SEQ ID NO: 1217167 - DNA, 22 bp, Artificial Sequence
  chemically synthesized
gtaaagtttggtagaattcagc

SEQ ID NO: 1217168 - DNA, 22 bp, Artificial Sequence
  chemically synthesized
tactgctgaattctaccaaact

SEQ ID NO: 1217169 - DNA, 22 bp, Artificial Sequence
  chemically synthesized
actgctgaattctaccaaactt

SEQ ID NO: 1217170 - DNA, 22 bp, Artificial Sequence
  chemically synthesized
ctgctgaattctaccaaacttt

SEQ ID NO: 1217171 - DNA, 22 bp, Artificial Sequence
  chemically synthesized
caggagaattggtaaagtttgg

SEQ ID NO: 1217172 - DNA, 22 bp, Artificial Sequence
  chemically synthesized
acaggagaattggtaaagtttg

SEQ ID NO: 1217173 - DNA, 22 bp, Artificial Sequence
  chemically synthesized
ctgaattctaccaaactttacc

SEQ ID NO: 1217174 - DNA, 22 bp, Artificial Sequence
  chemically synthesized
aattctaccaaactttaccaat

SEQ ID NO: 1217175 - DNA, 22 bp, Artificial Sequence
  chemically synthesized
gaacacttacaggagaattggt

SEQ ID NO: 1217176 - DNA, 22 bp, Artificial Sequence
  chemically synthesized
taccaaactttaccaattctcc

SEQ ID NO: 1217177 - DNA, 22 bp, Artificial Sequence
  chemically synthesized
ggaacacttacaggagaattgg

SEQ ID NO: 1217178 - DNA, 22 bp, Artificial Sequence
  chemically synthesized
ccaaactttaccaattctcctg

SEQ ID NO: 1217179 - DNA, 22 bp, Artificial Sequence
  chemically synthesized
ttggaacacttacaggagaatt

SEQ ID NO: 1217180 - DNA, 22 bp, Artificial Sequence
  chemically synthesized
cttggaacacttacaggagaat

SEQ ID NO: 1217181 - DNA, 22 bp, Artificial Sequence
  chemically synthesized
tcttggaacacttacaggagaa

SEQ ID NO: 1217182 - DNA, 22 bp, Artificial Sequence
  chemically synthesized
ttcttggaacacttacaggaga

SEQ ID NO: 1217183 - DNA, 22 bp, Artificial Sequence
  chemically synthesized
taccaattctcctgtaagtgtt

SEQ ID NO: 1217184 - DNA, 22 bp, Artificial Sequence
  chemically synthesized
aatttttcttggaacacttaca

SEQ ID NO: 1217185 - DNA, 22 bp, Artificial Sequence
  chemically synthesized
accaattctcctgtaagtgttc

SEQ ID NO: 1217186 - DNA, 22 bp, Artificial Sequence
  chemically synthesized
caatttttcttggaacacttac

SEQ ID NO: 1217187 - DNA, 22 bp, Artificial Sequence
  chemically synthesized
ccaattctcctgtaagtgttcc

SEQ ID NO: 1217188 - DNA, 22 bp, Artificial Sequence
  chemically synthesized
ttcaatttttcttggaacactt

SEQ ID NO: 1217189 - DNA, 22 bp, Artificial Sequence
  chemically synthesized
ctcttcaatttttcttggaaca

SEQ ID NO: 1217190 - DNA, 22 bp, Artificial Sequence
  chemically synthesized
cctcttcaatttttcttggaac

SEQ ID NO: 1217191 - DNA, 22 bp, Artificial Sequence
  chemically synthesized
tcctgtaagtgttccaagaaaa

SEQ ID NO: 1217192 - DNA, 22 bp, Artificial Sequence
  chemically synthesized
cttcctcttcaatttttcttgg

SEQ ID NO: 1217193 - DNA, 22 bp, Artificial Sequence
  chemically synthesized
ctgtaagtgttccaagaaaaat

SEQ ID NO: 1217194 - DNA, 22 bp, Artificial Sequence
  chemically synthesized
taagtgttccaagaaaaattga

SEQ ID NO: 1217195 - DNA, 22 bp, Artificial Sequence
  chemically synthesized
caagaaaaattgaagaggaagg

SEQ ID NO: 1217196 - DNA, 22 bp, Artificial Sequence
  chemically synthesized
atagaatgagatagggggaatt

SEQ ID NO: 1217197 - DNA, 22 bp, Artificial Sequence
  chemically synthesized
catagaatgagatagggggaat

SEQ ID NO: 1217198 - DNA, 22 bp, Artificial Sequence
  chemically synthesized
aagaggaaggaattccccctat

SEQ ID NO: 1217199 - DNA, 22 bp, Artificial Sequence
  chemically synthesized
gcttcatagaatgagatagggg

SEQ ID NO: 1217200 - DNA, 22 bp, Artificial Sequence
  chemically synthesized
cccctatctcattctatgaagc

SEQ ID NO: 1217201 - DNA, 22 bp, Artificial Sequence
  chemically synthesized
gcatcagggtaatgctggcttc

SEQ ID NO: 1217202 - DNA, 22 bp, Artificial Sequence
  chemically synthesized
tctcattctatgaagccagcat

SEQ ID NO: 1217203 - DNA, 22 bp, Artificial Sequence
  chemically synthesized
ggcatcagggtaatgctggctt

SEQ ID NO: 1217204 - DNA, 22 bp, Artificial Sequence
  chemically synthesized
attctatgaagccagcattacc

SEQ ID NO: 1217205 - DNA, 22 bp, Artificial Sequence
  chemically synthesized
ggtttggcatcagggtaatgct

SEQ ID NO: 1217206 - DNA, 22 bp, Artificial Sequence
  chemically synthesized
tatgaagccagcattaccctga

SEQ ID NO: 1217207 - DNA, 22 bp, Artificial Sequence
  chemically synthesized
tctgggtttggcatcagggtaa

SEQ ID NO: 1217208 - DNA, 22 bp, Artificial Sequence
  chemically synthesized
tgaagccagcattaccctgatg

SEQ ID NO: 1217209 - DNA, 22 bp, Artificial Sequence
  chemically synthesized
cataattgtctgggtttggcat

SEQ ID NO: 1217210 - DNA, 22 bp, Artificial Sequence
  chemically synthesized
ttgcataattgtctgggtttgg

SEQ ID NO: 1217211 - DNA, 22 bp, Artificial Sequence
  chemically synthesized
gttgcataattgtctgggtttg

SEQ ID NO: 1217212 - DNA, 22 bp, Artificial Sequence
  chemically synthesized
tgttgcataattgtctgggttt

SEQ ID NO: 1217213 - DNA, 22 bp, Artificial Sequence
  chemically synthesized
ttgttgcataattgtctgggtt

SEQ ID NO: 1217214 - DNA, 22 bp, Artificial Sequence
  chemically synthesized
ccctgatgccaaacccagacaa

SEQ ID NO: 1217215 - DNA, 22 bp, Artificial Sequence
  chemically synthesized
tttgttgcataattgtctgggt

SEQ ID NO: 1217216 - DNA, 22 bp, Artificial Sequence
  chemically synthesized
atgccaaacccagacaattatg

SEQ ID NO: 1217217 - DNA, 22 bp, Artificial Sequence
  chemically synthesized
tattttttgttgcataattgtc

SEQ ID NO: 1217218 - DNA, 22 bp, Artificial Sequence
  chemically synthesized
tcctgtattttttgttgcataa

SEQ ID NO: 1217219 - DNA, 22 bp, Artificial Sequence
  chemically synthesized
atcagggatgttgtcctgtatt

SEQ ID NO: 1217220 - DNA, 22 bp, Artificial Sequence
  chemically synthesized
tgcaacaaaaaatacaggacaa

SEQ ID NO: 1217221 - DNA, 22 bp, Artificial Sequence
  chemically synthesized
catcagtgttcatcagggatgt

SEQ ID NO: 1217222 - DNA, 22 bp, Artificial Sequence
  chemically synthesized
tacatcagtgttcatcagggat

SEQ ID NO: 1217223 - DNA, 22 bp, Artificial Sequence
  chemically synthesized
ctacatcagtgttcatcaggga

SEQ ID NO: 1217224 - DNA, 22 bp, Artificial Sequence
  chemically synthesized
tagagaatttctacatcagtgt

SEQ ID NO: 1217225 - DNA, 22 bp, Artificial Sequence
  chemically synthesized
gtagagaatttctacatcagtg

SEQ ID NO: 1217226 - DNA, 22 bp, Artificial Sequence
  chemically synthesized
tgtagagaatttctacatcagt

SEQ ID NO: 1217227 - DNA, 22 bp, Artificial Sequence
  chemically synthesized
atgaacactgatgtagaaattc

SEQ ID NO: 1217228 - DNA, 22 bp, Artificial Sequence
  chemically synthesized
gcattttgtagagaatttctac

SEQ ID NO: 1217229 - DNA, 22 bp, Artificial Sequence
  chemically synthesized
ctagcattttgtagagaatttc

SEQ ID NO: 1217230 - DNA, 22 bp, Artificial Sequence
  chemically synthesized
gattgctagcattttgtagaga

SEQ ID NO: 1217231 - DNA, 22 bp, Artificial Sequence
  chemically synthesized
atgtagaaattctctacaaaat

SEQ ID NO: 1217232 - DNA, 22 bp, Artificial Sequence
  chemically synthesized
ttggattgctagcattttgtag

SEQ ID NO: 1217233 - DNA, 22 bp, Artificial Sequence
  chemically synthesized
tattggattgctagcattttgt

SEQ ID NO: 1217234 - DNA, 22 bp, Artificial Sequence
  chemically synthesized
tgttctattggattgctagcat

SEQ ID NO: 1217235 - DNA, 22 bp, Artificial Sequence
  chemically synthesized
atgttctattggattgctagca

SEQ ID NO: 1217236 - DNA, 22 bp, Artificial Sequence
  chemically synthesized
tatgttctattggattgctagc

SEQ ID NO: 1217237 - DNA, 22 bp, Artificial Sequence
  chemically synthesized
ttatgttctattggattgctag

SEQ ID NO: 1217238 - DNA, 22 bp, Artificial Sequence
  chemically synthesized
tctacaaaatgctagcaatcca

SEQ ID NO: 1217239 - DNA, 22 bp, Artificial Sequence
  chemically synthesized
tttatgttctattggattgcta

SEQ ID NO: 1217240 - DNA, 22 bp, Artificial Sequence
  chemically synthesized
tacaaaatgctagcaatccaat

SEQ ID NO: 1217241 - DNA, 22 bp, Artificial Sequence
  chemically synthesized
caaaatgctagcaatccaatag

SEQ ID NO: 1217242 - DNA, 22 bp, Artificial Sequence
  chemically synthesized
cattttttatgttctattggat

SEQ ID NO: 1217243 - DNA, 22 bp, Artificial Sequence
  chemically synthesized
gcaatccaatagaacataaaaa

SEQ ID NO: 1217244 - DNA, 22 bp, Artificial Sequence
  chemically synthesized
ataatattacattttttatgtt

SEQ ID NO: 1217245 - DNA, 22 bp, Artificial Sequence
  chemically synthesized
gataatattacattttttatgt

SEQ ID NO: 1217246 - DNA, 22 bp, Artificial Sequence
  chemically synthesized
cacttgataatattacattttt

SEQ ID NO: 1217247 - DNA, 22 bp, Artificial Sequence
  chemically synthesized
ggataaattccacttgataata

SEQ ID NO: 1217248 - DNA, 22 bp, Artificial Sequence
  chemically synthesized
tatcattgggataaattccact

SEQ ID NO: 1217249 - DNA, 22 bp, Artificial Sequence
  chemically synthesized
gtatcattgggataaattccac

SEQ ID NO: 1217250 - DNA, 22 bp, Artificial Sequence
  chemically synthesized
tcaagtggaatttatcccaatg

SEQ ID NO: 1217251 - DNA, 22 bp, Artificial Sequence
  chemically synthesized
tgtatgatgtatccttgtatca

SEQ ID NO: 1217252 - DNA, 22 bp, Artificial Sequence
  chemically synthesized
gtgtatgatgtatccttgtatc

SEQ ID NO: 1217253 - DNA, 22 bp, Artificial Sequence
  chemically synthesized
atcccaatgatacaaggataca

SEQ ID NO: 1217254 - DNA, 22 bp, Artificial Sequence
  chemically synthesized
atttgtgtatgatgtatccttg

SEQ ID NO: 1217255 - DNA, 22 bp, Artificial Sequence
  chemically synthesized
tcccaatgatacaaggatacat

SEQ ID NO: 1217256 - DNA, 22 bp, Artificial Sequence
  chemically synthesized
ttgatttgtgtatgatgtatcc

SEQ ID NO: 1217257 - DNA, 22 bp, Artificial Sequence
  chemically synthesized
attgatttgtgtatgatgtatc

SEQ ID NO: 1217258 - DNA, 22 bp, Artificial Sequence
  chemically synthesized
atgtaatatgtcatatttattg

SEQ ID NO: 1217259 - DNA, 22 bp, Artificial Sequence
  chemically synthesized
gatgtaatatgtcatatttatt

SEQ ID NO: 1217260 - DNA, 22 bp, Artificial Sequence
  chemically synthesized
tttgatgtaatatgtcatattt

SEQ ID NO: 1217261 - DNA, 22 bp, Artificial Sequence
  chemically synthesized
tgtttgatgtaatatgtcatat

SEQ ID NO: 1217262 - DNA, 22 bp, Artificial Sequence
  chemically synthesized
attctgtttgatgtaatatgtc

SEQ ID NO: 1217263 - DNA, 22 bp, Artificial Sequence
  chemically synthesized
cattctgtttgatgtaatatgt

SEQ ID NO: 1217264 - DNA, 22 bp, Artificial Sequence
  chemically synthesized
tcattctgtttgatgtaatatg

SEQ ID NO: 1217265 - DNA, 22 bp, Artificial Sequence
  chemically synthesized
ttcattctgtttgatgtaatat

SEQ ID NO: 1217266 - DNA, 22 bp, Artificial Sequence
  chemically synthesized
tttttcattctgtttgatgtaa

SEQ ID NO: 1217267 - DNA, 22 bp, Artificial Sequence
  chemically synthesized
tgtttttcattctgtttgatgt

SEQ ID NO: 1217268 - DNA, 22 bp, Artificial Sequence
  chemically synthesized
ctgtttttcattctgtttgatg

SEQ ID NO: 1217269 - DNA, 22 bp, Artificial Sequence
  chemically synthesized
tctgtttttcattctgtttgat

SEQ ID NO: 1217270 - DNA, 22 bp, Artificial Sequence
  chemically synthesized
catcaaacagaatgaaaaacag

SEQ ID NO: 1217271 - DNA, 22 bp, Artificial Sequence
  chemically synthesized
aaaggatcatgttttctgtttt

SEQ ID NO: 1217272 - DNA, 22 bp, Artificial Sequence
  chemically synthesized
ttgaaaggatcatgttttctgt

SEQ ID NO: 1217273 - DNA, 22 bp, Artificial Sequence
  chemically synthesized
tgtctattgaaaggatcatgtt

SEQ ID NO: 1217274 - DNA, 22 bp, Artificial Sequence
  chemically synthesized
gtgtctattgaaaggatcatgt

SEQ ID NO: 1217275 - DNA, 22 bp, Artificial Sequence
  chemically synthesized
tgtgtctattgaaaggatcatg

SEQ ID NO: 1217276 - DNA, 22 bp, Artificial Sequence
  chemically synthesized
ttgtgtctattgaaaggatcat

SEQ ID NO: 1217277 - DNA, 22 bp, Artificial Sequence
  chemically synthesized
ttttgtgtctattgaaaggatc

SEQ ID NO: 1217278 - DNA, 22 bp, Artificial Sequence
  chemically synthesized
tgaaatgttcttttgtgtctat

SEQ ID NO: 1217279 - DNA, 22 bp, Artificial Sequence
  chemically synthesized
atgaaatgttcttttgtgtcta

SEQ ID NO: 1217280 - DNA, 22 bp, Artificial Sequence
  chemically synthesized
tatgaaatgttcttttgtgtct

SEQ ID NO: 1217281 - DNA, 22 bp, Artificial Sequence
  chemically synthesized
aattttatgaaatgttcttttg

SEQ ID NO: 1217282 - DNA, 22 bp, Artificial Sequence
  chemically synthesized
tcaatagacacaaaagaacatt

SEQ ID NO: 1217283 - DNA, 22 bp, Artificial Sequence
  chemically synthesized
caatagacacaaaagaacattt

SEQ ID NO: 1217284 - DNA, 22 bp, Artificial Sequence
  chemically synthesized
aatagacacaaaagaacatttc

SEQ ID NO: 1217285 - DNA, 22 bp, Artificial Sequence
  chemically synthesized
gaagggatgttaaattttatga

SEQ ID NO: 1217286 - DNA, 22 bp, Artificial Sequence
  chemically synthesized
tctcgaagggatgttaaatttt

SEQ ID NO: 1217287 - DNA, 22 bp, Artificial Sequence
  chemically synthesized
atctcgaagggatgttaaattt

SEQ ID NO: 1217288 - DNA, 22 bp, Artificial Sequence
  chemically synthesized
tatctcgaagggatgttaaatt

SEQ ID NO: 1217289 - DNA, 22 bp, Artificial Sequence
  chemically synthesized
ttatctcgaagggatgttaaat

SEQ ID NO: 1217290 - DNA, 22 bp, Artificial Sequence
  chemically synthesized
cataaaatttaacatcccttcg

SEQ ID NO: 1217291 - DNA, 22 bp, Artificial Sequence
  chemically synthesized
gagtttttatctcgaagggatg

SEQ ID NO: 1217292 - DNA, 22 bp, Artificial Sequence
  chemically synthesized
ataaaatttaacatcccttcga

SEQ ID NO: 1217293 - DNA, 22 bp, Artificial Sequence
  chemically synthesized
ttggagtttttatctcgaaggg

SEQ ID NO: 1217294 - DNA, 22 bp, Artificial Sequence
  chemically synthesized
gttggagtttttatctcgaagg

SEQ ID NO: 1217295 - DNA, 22 bp, Artificial Sequence
  chemically synthesized
gtttgttggagtttttatctcg

SEQ ID NO: 1217296 - DNA, 22 bp, Artificial Sequence
  chemically synthesized
aacatcccttcgagataaaaac

SEQ ID NO: 1217297 - DNA, 22 bp, Artificial Sequence
  chemically synthesized
acatcccttcgagataaaaact

SEQ ID NO: 1217298 - DNA, 22 bp, Artificial Sequence
  chemically synthesized
tatgcctagtttgttggagttt

SEQ ID NO: 1217299 - DNA, 22 bp, Artificial Sequence
  chemically synthesized
gtatgcctagtttgttggagtt

SEQ ID NO: 1217300 - DNA, 22 bp, Artificial Sequence
  chemically synthesized
tgtatgcctagtttgttggagt

SEQ ID NO: 1217301 - DNA, 22 bp, Artificial Sequence
  chemically synthesized
ttgtatgcctagtttgttggag

SEQ ID NO: 1217302 - DNA, 22 bp, Artificial Sequence
  chemically synthesized
cgagataaaaactccaacaaac

SEQ ID NO: 1217303 - DNA, 22 bp, Artificial Sequence
  chemically synthesized
tttgtatgcctagtttgttgga

SEQ ID NO: 1217304 - DNA, 22 bp, Artificial Sequence
  chemically synthesized
gagataaaaactccaacaaact

SEQ ID NO: 1217305 - DNA, 22 bp, Artificial Sequence
  chemically synthesized
ttttgtatgcctagtttgttgg

SEQ ID NO: 1217306 - DNA, 22 bp, Artificial Sequence
  chemically synthesized
tttttgtatgcctagtttgttg

SEQ ID NO: 1217307 - DNA, 22 bp, Artificial Sequence
  chemically synthesized
attttttttgtatgcctagttt

SEQ ID NO: 1217308 - DNA, 22 bp, Artificial Sequence
  chemically synthesized
ttaattttttttgtatgcctag

SEQ ID NO: 1217309 - DNA, 22 bp, Artificial Sequence
  chemically synthesized
gttaattttttttgtatgccta

SEQ ID NO: 1217310 - DNA, 22 bp, Artificial Sequence
  chemically synthesized
tgttaattttttttgtatgcct

SEQ ID NO: 1217311 - DNA, 22 bp, Artificial Sequence
  chemically synthesized
caacaaactaggcatacaaaaa

SEQ ID NO: 1217312 - DNA, 22 bp, Artificial Sequence
  chemically synthesized
ttttgttaattttttttgtatg

SEQ ID NO: 1217313 - DNA, 22 bp, Artificial Sequence
  chemically synthesized
attttgttaattttttttgtat

SEQ ID NO: 1217314 - DNA, 22 bp, Artificial Sequence
  chemically synthesized
tattttgttaattttttttgta

SEQ ID NO: 1217315 - DNA, 22 bp, Artificial Sequence
  chemically synthesized
ggcatacaaaaaaaattaacaa

SEQ ID NO: 1217316 - DNA, 22 bp, Artificial Sequence
  chemically synthesized
tcatatatggtctttattttgt

SEQ ID NO: 1217317 - DNA, 22 bp, Artificial Sequence
  chemically synthesized
gtcatatatggtctttattttg

SEQ ID NO: 1217318 - DNA, 22 bp, Artificial Sequence
  chemically synthesized
tagatttgtcatatatggtctt

SEQ ID NO: 1217319 - DNA, 22 bp, Artificial Sequence
  chemically synthesized
gtagatttgtcatatatggtct

SEQ ID NO: 1217320 - DNA, 22 bp, Artificial Sequence
  chemically synthesized
acaaaataaagaccatatatga

SEQ ID NO: 1217321 - DNA, 22 bp, Artificial Sequence
  chemically synthesized
cttgtagatttgtcatatatgg

SEQ ID NO: 1217322 - DNA, 22 bp, Artificial Sequence
  chemically synthesized
atactacttgtagatttgtcat

SEQ ID NO: 1217323 - DNA, 22 bp, Artificial Sequence
  chemically synthesized
gatactacttgtagatttgtca

SEQ ID NO: 1217324 - DNA, 22 bp, Artificial Sequence
  chemically synthesized
agtttgatactacttgtagatt

SEQ ID NO: 1217325 - DNA, 22 bp, Artificial Sequence
  chemically synthesized
cccattcagtttgatactactt

SEQ ID NO: 1217326 - DNA, 22 bp, Artificial Sequence
  chemically synthesized
ccccattcagtttgatactact

SEQ ID NO: 1217327 - DNA, 22 bp, Artificial Sequence
  chemically synthesized
tccccattcagtttgatactac

SEQ ID NO: 1217328 - DNA, 22 bp, Artificial Sequence
  chemically synthesized
ttccccattcagtttgatacta

SEQ ID NO: 1217329 - DNA, 22 bp, Artificial Sequence
  chemically synthesized
agcttttccccattcagtttga

SEQ ID NO: 1217330 - DNA, 22 bp, Artificial Sequence
  chemically synthesized
cagcttttccccattcagtttg

SEQ ID NO: 1217331 - DNA, 22 bp, Artificial Sequence
  chemically synthesized
tcagcttttccccattcagttt

SEQ ID NO: 1217332 - DNA, 22 bp, Artificial Sequence
  chemically synthesized
caagtagtatcaaactgaatgg

SEQ ID NO: 1217333 - DNA, 22 bp, Artificial Sequence
  chemically synthesized
ttcagcttttccccattcagtt

SEQ ID NO: 1217334 - DNA, 22 bp, Artificial Sequence
  chemically synthesized
tagggagaaatttttcagcttt

SEQ ID NO: 1217335 - DNA, 22 bp, Artificial Sequence
  chemically synthesized
atagggagaaatttttcagctt

SEQ ID NO: 1217336 - DNA, 22 bp, Artificial Sequence
  chemically synthesized
tatagggagaaatttttcagct

SEQ ID NO: 1217337 - DNA, 22 bp, Artificial Sequence
  chemically synthesized
aatggggaaaagctgaaaaatt

SEQ ID NO: 1217338 - DNA, 22 bp, Artificial Sequence
  chemically synthesized
cagttttatagggagaaatttt

SEQ ID NO: 1217339 - DNA, 22 bp, Artificial Sequence
  chemically synthesized
accattccagttttatagggag

SEQ ID NO: 1217340 - DNA, 22 bp, Artificial Sequence
  chemically synthesized
aaaaatttctccctataaaact

SEQ ID NO: 1217341 - DNA, 22 bp, Artificial Sequence
  chemically synthesized
ctccctataaaactggaatggt

SEQ ID NO: 1217342 - DNA, 22 bp, Artificial Sequence
  chemically synthesized
tccctataaaactggaatggtc

SEQ ID NO: 1217343 - DNA, 22 bp, Artificial Sequence
  chemically synthesized
cctataaaactggaatggtcag

SEQ ID NO: 1217344 - DNA, 22 bp, Artificial Sequence
  chemically synthesized
taaaactggaatggtcaggcgt

SEQ ID NO: 1217345 - DNA, 22 bp, Artificial Sequence
  chemically synthesized
caggcgtgagccaccacgcctg

SEQ ID NO: 1217346 - DNA, 22 bp, Artificial Sequence
  chemically synthesized
gaatggtcaggcgtggtggctc

SEQ ID NO: 1217347 - DNA, 22 bp, Artificial Sequence
  chemically synthesized
ggattacaggcgtgagccacca

SEQ ID NO: 1217348 - DNA, 22 bp, Artificial Sequence
  chemically synthesized
ccaaagtgctgggattacaggc

SEQ ID NO: 1217349 - DNA, 22 bp, Artificial Sequence
  chemically synthesized
cctcccaaagtgctgggattac

SEQ ID NO: 1217350 - DNA, 22 bp, Artificial Sequence
  chemically synthesized
tgcctcccaaagtgctgggatt

SEQ ID NO: 1217351 - DNA, 22 bp, Artificial Sequence
  chemically synthesized
acgcctgtaatcccagcacttt

SEQ ID NO: 1217352 - DNA, 22 bp, Artificial Sequence
  chemically synthesized
taatcccagcactttgggaggc

SEQ ID NO: 1217353 - DNA, 22 bp, Artificial Sequence
  chemically synthesized
atccacccacctctgcctccca

SEQ ID NO: 1217354 - DNA, 22 bp, Artificial Sequence
  chemically synthesized
ttgatccacccacctctgcctc

SEQ ID NO: 1217355 - DNA, 22 bp, Artificial Sequence
  chemically synthesized
atctattgatccacccacctct

SEQ ID NO: 1217356 - DNA, 22 bp, Artificial Sequence
  chemically synthesized
ctgatctattgatccacccacc

SEQ ID NO: 1217357 - DNA, 22 bp, Artificial Sequence
  chemically synthesized
tgggaggcagaggtgggtggat

SEQ ID NO: 1217358 - DNA, 22 bp, Artificial Sequence
  chemically synthesized
gggaggcagaggtgggtggatc

SEQ ID NO: 1217359 - DNA, 22 bp, Artificial Sequence
  chemically synthesized
ggaggcagaggtgggtggatca

SEQ ID NO: 1217360 - DNA, 22 bp, Artificial Sequence
  chemically synthesized
gatctcctgatctattgatcca

SEQ ID NO: 1217361 - DNA, 22 bp, Artificial Sequence
  chemically synthesized
gccaggatgatctcgatctcct

SEQ ID NO: 1217362 - DNA, 22 bp, Artificial Sequence
  chemically synthesized
accgtgttagccaggatgatct

SEQ ID NO: 1217363 - DNA, 22 bp, Artificial Sequence
  chemically synthesized
caccgtgttagccaggatgatc

SEQ ID NO: 1217364 - DNA, 22 bp, Artificial Sequence
  chemically synthesized
gtagagatggggtttcaccgtg

SEQ ID NO: 1217365 - DNA, 22 bp, Artificial Sequence
  chemically synthesized
agtagagatggggtttcaccgt

SEQ ID NO: 1217366 - DNA, 22 bp, Artificial Sequence
  chemically synthesized
tagtagagatggggtttcaccg

SEQ ID NO: 1217367 - DNA, 22 bp, Artificial Sequence
  chemically synthesized
ttagtagagatggggtttcacc

SEQ ID NO: 1217368 - DNA, 22 bp, Artificial Sequence
  chemically synthesized
gctaacacggtgaaaccccatc

SEQ ID NO: 1217369 - DNA, 22 bp, Artificial Sequence
  chemically synthesized
tatttttagtagagatggggtt

SEQ ID NO: 1217370 - DNA, 22 bp, Artificial Sequence
  chemically synthesized
gtatttttagtagagatggggt

SEQ ID NO: 1217371 - DNA, 22 bp, Artificial Sequence
  chemically synthesized
tgtatttttagtagagatgggg

SEQ ID NO: 1217372 - DNA, 22 bp, Artificial Sequence
  chemically synthesized
acacggtgaaaccccatctcta

SEQ ID NO: 1217373 - DNA, 22 bp, Artificial Sequence
  chemically synthesized
ttgtatttttagtagagatggg

SEQ ID NO: 1217374 - DNA, 22 bp, Artificial Sequence
  chemically synthesized
tttgtatttttagtagagatgg

SEQ ID NO: 1217375 - DNA, 22 bp, Artificial Sequence
  chemically synthesized
attttttgtatttttagtagag

SEQ ID NO: 1217376 - DNA, 22 bp, Artificial Sequence
  chemically synthesized
tactaaaaatacaaaaaattag

SEQ ID NO: 1217377 - DNA, 22 bp, Artificial Sequence
  chemically synthesized
ccaccatgcccggctaattttt

SEQ ID NO: 1217378 - DNA, 22 bp, Artificial Sequence
  chemically synthesized
ctaaaaatacaaaaaattagcc

SEQ ID NO: 1217379 - DNA, 22 bp, Artificial Sequence
  chemically synthesized
aaaatacaaaaaattagccggg

SEQ ID NO: 1217380 - DNA, 22 bp, Artificial Sequence
  chemically synthesized
ggaccacaggcatctgccacca

SEQ ID NO: 1217381 - DNA, 22 bp, Artificial Sequence
  chemically synthesized
gccgggcatggtggcagatgcc

SEQ ID NO: 1217382 - DNA, 22 bp, Artificial Sequence
  chemically synthesized
ccgagcagctgggaccacaggc

SEQ ID NO: 1217383 - DNA, 22 bp, Artificial Sequence
  chemically synthesized
agcctcccgagcagctgggacc

SEQ ID NO: 1217384 - DNA, 22 bp, Artificial Sequence
  chemically synthesized
cctcagcctcccgagcagctgg

SEQ ID NO: 1217385 - DNA, 22 bp, Artificial Sequence
  chemically synthesized
gcctcagcctcccgagcagctg

SEQ ID NO: 1217386 - DNA, 22 bp, Artificial Sequence
  chemically synthesized
ttgcctcagcctcccgagcagc

SEQ ID NO: 1217387 - DNA, 22 bp, Artificial Sequence
  chemically synthesized
tcttgcctcagcctcccgagca

SEQ ID NO: 1217388 - DNA, 22 bp, Artificial Sequence
  chemically synthesized
tggtcccagctgctcgggaggc

SEQ ID NO: 1217389 - DNA, 22 bp, Artificial Sequence
  chemically synthesized
atgccgttctcttgcctcagcc

SEQ ID NO: 1217390 - DNA, 22 bp, Artificial Sequence
  chemically synthesized
ctcgggaggctgaggcaagaga

SEQ ID NO: 1217391 - DNA, 22 bp, Artificial Sequence
  chemically synthesized
gggaggctgaggcaagagaacg

SEQ ID NO: 1217392 - DNA, 22 bp, Artificial Sequence
  chemically synthesized
cagggttcatgccgttctcttg

SEQ ID NO: 1217393 - DNA, 22 bp, Artificial Sequence
  chemically synthesized
agcctccagggttcatgccgtt

SEQ ID NO: 1217394 - DNA, 22 bp, Artificial Sequence
  chemically synthesized
aggcaagagaacggcatgaacc

SEQ ID NO: 1217395 - DNA, 22 bp, Artificial Sequence
  chemically synthesized
caagctcagcctccagggttca

SEQ ID NO: 1217396 - DNA, 22 bp, Artificial Sequence
  chemically synthesized
attgcaagctcagcctccaggg

SEQ ID NO: 1217397 - DNA, 22 bp, Artificial Sequence
  chemically synthesized
gctcattgcaagctcagcctcc

SEQ ID NO: 1217398 - DNA, 22 bp, Artificial Sequence
  chemically synthesized
ggctcattgcaagctcagcctc

SEQ ID NO: 1217399 - DNA, 22 bp, Artificial Sequence
  chemically synthesized
gaggctgagcttgcaatgagcc

SEQ ID NO: 1217400 - DNA, 22 bp, Artificial Sequence
  chemically synthesized
agcttgcaatgagccaagattg

SEQ ID NO: 1217401 - DNA, 22 bp, Artificial Sequence
  chemically synthesized
gagtacagtggcccaatcttgg

SEQ ID NO: 1217402 - DNA, 22 bp, Artificial Sequence
  chemically synthesized
gcaatgagccaagattgggcca

SEQ ID NO: 1217403 - DNA, 22 bp, Artificial Sequence
  chemically synthesized
caatgagccaagattgggccac

SEQ ID NO: 1217404 - DNA, 22 bp, Artificial Sequence
  chemically synthesized
cccaggctggagtacagtggcc

SEQ ID NO: 1217405 - DNA, 22 bp, Artificial Sequence
  chemically synthesized
ttgcccaggctggagtacagtg

SEQ ID NO: 1217406 - DNA, 22 bp, Artificial Sequence
  chemically synthesized
tgttgcccaggctggagtacag

SEQ ID NO: 1217407 - DNA, 22 bp, Artificial Sequence
  chemically synthesized
ctctgttgcccaggctggagta

SEQ ID NO: 1217408 - DNA, 22 bp, Artificial Sequence
  chemically synthesized
gctctgttgcccaggctggagt

SEQ ID NO: 1217409 - DNA, 22 bp, Artificial Sequence
  chemically synthesized
ggccactgtactccagcctggg

SEQ ID NO: 1217410 - DNA, 22 bp, Artificial Sequence
  chemically synthesized
tactccagcctgggcaacagag

SEQ ID NO: 1217411 - DNA, 22 bp, Artificial Sequence
  chemically synthesized
agatggagtcttgctctgttgc

SEQ ID NO: 1217412 - DNA, 22 bp, Artificial Sequence
  chemically synthesized
gagatggagtcttgctctgttg

SEQ ID NO: 1217413 - DNA, 22 bp, Artificial Sequence
  chemically synthesized
tgagatggagtcttgctctgtt

SEQ ID NO: 1217414 - DNA, 22 bp, Artificial Sequence
  chemically synthesized
ttgagatggagtcttgctctgt

SEQ ID NO: 1217415 - DNA, 22 bp, Artificial Sequence
  chemically synthesized
cagcctgggcaacagagcaaga

SEQ ID NO: 1217416 - DNA, 22 bp, Artificial Sequence
  chemically synthesized
tttttgagatggagtcttgctc

SEQ ID NO: 1217417 - DNA, 22 bp, Artificial Sequence
  chemically synthesized
gtttttgagatggagtcttgct

SEQ ID NO: 1217418 - DNA, 22 bp, Artificial Sequence
  chemically synthesized
tgtttttgagatggagtcttgc

SEQ ID NO: 1217419 - DNA, 22 bp, Artificial Sequence
  chemically synthesized
ttgtttttgagatggagtcttg

SEQ ID NO: 1217420 - DNA, 22 bp, Artificial Sequence
  chemically synthesized
tttgtttttgagatggagtctt

SEQ ID NO: 1217421 - DNA, 22 bp, Artificial Sequence
  chemically synthesized
ggcaacagagcaagactccatc

SEQ ID NO: 1217422 - DNA, 22 bp, Artificial Sequence
  chemically synthesized
gttttttgtttttgagatggag

SEQ ID NO: 1217423 - DNA, 22 bp, Artificial Sequence
  chemically synthesized
ggttttttgtttttgagatgga

SEQ ID NO: 1217424 - DNA, 22 bp, Artificial Sequence
  chemically synthesized
tggttttttgtttttgagatgg

SEQ ID NO: 1217425 - DNA, 22 bp, Artificial Sequence
  chemically synthesized
ttggttttttgtttttgagatg

SEQ ID NO: 1217426 - DNA, 22 bp, Artificial Sequence
  chemically synthesized
tttttggttttttgtttttgag

SEQ ID NO: 1217427 - DNA, 22 bp, Artificial Sequence
  chemically synthesized
gtttttggttttttgtttttga

SEQ ID NO: 1217428 - DNA, 22 bp, Artificial Sequence
  chemically synthesized
tgtttttggttttttgtttttg

SEQ ID NO: 1217429 - DNA, 22 bp, Artificial Sequence
  chemically synthesized
ttgtttttggttttttgttttt

SEQ ID NO: 1217430 - DNA, 22 bp, Artificial Sequence
  chemically synthesized
tttgtttttggttttttgtttt

SEQ ID NO: 1217431 - DNA, 22 bp, Artificial Sequence
  chemically synthesized
ttttgtttttggttttttgttt

SEQ ID NO: 1217432 - DNA, 22 bp, Artificial Sequence
  chemically synthesized
tttttgtttttggttttttgtt

SEQ ID NO: 1217433 - DNA, 22 bp, Artificial Sequence
  chemically synthesized
ttttttgtttttggttttttgt

SEQ ID NO: 1217434 - DNA, 22 bp, Artificial Sequence
  chemically synthesized
catctcaaaaacaaaaaaccaa

SEQ ID NO: 1217435 - DNA, 22 bp, Artificial Sequence
  chemically synthesized
ttttttttgtttttggtttttt

SEQ ID NO: 1217436 - DNA, 22 bp, Artificial Sequence
  chemically synthesized
ttcttttttttgtttttggttt

SEQ ID NO: 1217437 - DNA, 22 bp, Artificial Sequence
  chemically synthesized
gttcttttttttgtttttggtt

SEQ ID NO: 1217438 - DNA, 22 bp, Artificial Sequence
  chemically synthesized
aaaaacaaaaaaccaaaaacaa

SEQ ID NO: 1217439 - DNA, 22 bp, Artificial Sequence
  chemically synthesized
tcttgttcttttttttgttttt

SEQ ID NO: 1217440 - DNA, 22 bp, Artificial Sequence
  chemically synthesized
gtcttgttcttttttttgtttt

SEQ ID NO: 1217441 - DNA, 22 bp, Artificial Sequence
  chemically synthesized
aatgagtggtgaaagtgggcat

SEQ ID NO: 1217442 - DNA, 22 bp, Artificial Sequence
  chemically synthesized
tgttgaatgagtggtgaaagtg

SEQ ID NO: 1217443 - DNA, 22 bp, Artificial Sequence
  chemically synthesized
cagtactatgttgaatgagtgg

SEQ ID NO: 1217444 - DNA, 22 bp, Artificial Sequence
  chemically synthesized
ggacctccagtactatgttgaa

SEQ ID NO: 1217445 - DNA, 22 bp, Artificial Sequence
  chemically synthesized
tcaccactcattcaacatagta

SEQ ID NO: 1217446 - DNA, 22 bp, Artificial Sequence
  chemically synthesized
caccactcattcaacatagtac

SEQ ID NO: 1217447 - DNA, 22 bp, Artificial Sequence
  chemically synthesized
accactcattcaacatagtact

SEQ ID NO: 1217448 - DNA, 22 bp, Artificial Sequence
  chemically synthesized
gctaggacctccagtactatgt

SEQ ID NO: 1217449 - DNA, 22 bp, Artificial Sequence
  chemically synthesized
tggctaggacctccagtactat

SEQ ID NO: 1217450 - DNA, 22 bp, Artificial Sequence
  chemically synthesized
ctctggctaggacctccagtac

SEQ ID NO: 1217451 - DNA, 22 bp, Artificial Sequence
  chemically synthesized
attcaacatagtactggaggtc

SEQ ID NO: 1217452 - DNA, 22 bp, Artificial Sequence
  chemically synthesized
attgctctggctaggacctcca

SEQ ID NO: 1217453 - DNA, 22 bp, Artificial Sequence
  chemically synthesized
gattgctctggctaggacctcc

SEQ ID NO: 1217454 - DNA, 22 bp, Artificial Sequence
  chemically synthesized
aacatagtactggaggtcctag

SEQ ID NO: 1217455 - DNA, 22 bp, Artificial Sequence
  chemically synthesized
ttgattgctctggctaggacct

SEQ ID NO: 1217456 - DNA, 22 bp, Artificial Sequence
  chemically synthesized
tcttgattgctctggctaggac

SEQ ID NO: 1217457 - DNA, 22 bp, Artificial Sequence
  chemically synthesized
ctcttgattgctctggctagga

SEQ ID NO: 1217458 - DNA, 22 bp, Artificial Sequence
  chemically synthesized
tctcttgattgctctggctagg

SEQ ID NO: 1217459 - DNA, 22 bp, Artificial Sequence
  chemically synthesized
tttctcttgattgctctggcta

SEQ ID NO: 1217460 - DNA, 22 bp, Artificial Sequence
  chemically synthesized
ctttctcttgattgctctggct

SEQ ID NO: 1217461 - DNA, 22 bp, Artificial Sequence
  chemically synthesized
gaggtcctagccagagcaatca

SEQ ID NO: 1217462 - DNA, 22 bp, Artificial Sequence
  chemically synthesized
tatttctttctcttgattgctc

SEQ ID NO: 1217463 - DNA, 22 bp, Artificial Sequence
  chemically synthesized
gtatttctttctcttgattgct

SEQ ID NO: 1217464 - DNA, 22 bp, Artificial Sequence
  chemically synthesized
gccagagcaatcaagagaaaga

SEQ ID NO: 1217465 - DNA, 22 bp, Artificial Sequence
  chemically synthesized
ggacgccttgtatttctttctc

SEQ ID NO: 1217466 - DNA, 22 bp, Artificial Sequence
  chemically synthesized
ttaggacgccttgtatttcttt

SEQ ID NO: 1217467 - DNA, 22 bp, Artificial Sequence
  chemically synthesized
tattaggacgccttgtatttct

SEQ ID NO: 1217468 - DNA, 22 bp, Artificial Sequence
  chemically synthesized
ctattaggacgccttgtatttc

SEQ ID NO: 1217469 - DNA, 22 bp, Artificial Sequence
  chemically synthesized
ttctattaggacgccttgtatt

SEQ ID NO: 1217470 - DNA, 22 bp, Artificial Sequence
  chemically synthesized
cttctattaggacgccttgtat

SEQ ID NO: 1217471 - DNA, 22 bp, Artificial Sequence
  chemically synthesized
gacaacgatttcttctattagg

SEQ ID NO: 1217472 - DNA, 22 bp, Artificial Sequence
  chemically synthesized
ggacaacgatttcttctattag

SEQ ID NO: 1217473 - DNA, 22 bp, Artificial Sequence
  chemically synthesized
atagaagaaatcgttgtccaag

SEQ ID NO: 1217474 - DNA, 22 bp, Artificial Sequence
  chemically synthesized
acaaagagcagtacttggacaa

SEQ ID NO: 1217475 - DNA, 22 bp, Artificial Sequence
  chemically synthesized
ttaacaaagagcagtacttgga

SEQ ID NO: 1217476 - DNA, 22 bp, Artificial Sequence
  chemically synthesized
taagttattaacaaagagcagt

SEQ ID NO: 1217477 - DNA, 22 bp, Artificial Sequence
  chemically synthesized
gctataagttattaacaaagag

SEQ ID NO: 1217478 - DNA, 22 bp, Artificial Sequence
  chemically synthesized
tccaagtactgctctttgttaa

SEQ ID NO: 1217479 - DNA, 22 bp, Artificial Sequence
  chemically synthesized
tagctataagttattaacaaag

SEQ ID NO: 1217480 - DNA, 22 bp, Artificial Sequence
  chemically synthesized
ctagctataagttattaacaaa

SEQ ID NO: 1217481 - DNA, 22 bp, Artificial Sequence
  chemically synthesized
tctagctataagttattaacaa

SEQ ID NO: 1217482 - DNA, 22 bp, Artificial Sequence
  chemically synthesized
ttctagctataagttattaaca

SEQ ID NO: 1217483 - DNA, 22 bp, Artificial Sequence
  chemically synthesized
tttctagctataagttattaac

SEQ ID NO: 1217484 - DNA, 22 bp, Artificial Sequence
  chemically synthesized
gctttttctagctataagttat

SEQ ID NO: 1217485 - DNA, 22 bp, Artificial Sequence
  chemically synthesized
agctttttctagctataagtta

SEQ ID NO: 1217486 - DNA, 22 bp, Artificial Sequence
  chemically synthesized
ctctttgttaataacttatagc

SEQ ID NO: 1217487 - DNA, 22 bp, Artificial Sequence
  chemically synthesized
tttgttaataacttatagctag

SEQ ID NO: 1217488 - DNA, 22 bp, Artificial Sequence
  chemically synthesized
tgttaataacttatagctagaa

SEQ ID NO: 1217489 - DNA, 22 bp, Artificial Sequence
  chemically synthesized
gttaataacttatagctagaaa

SEQ ID NO: 1217490 - DNA, 22 bp, Artificial Sequence
  chemically synthesized
ttaataacttatagctagaaaa

SEQ ID NO: 1217491 - DNA, 22 bp, Artificial Sequence
  chemically synthesized
gtgagggtttagctttttctag

SEQ ID NO: 1217492 - DNA, 22 bp, Artificial Sequence
  chemically synthesized
ataacttatagctagaaaaagc

SEQ ID NO: 1217493 - DNA, 22 bp, Artificial Sequence
  chemically synthesized
tggtgagggtttagctttttct

SEQ ID NO: 1217494 - DNA, 22 bp, Artificial Sequence
  chemically synthesized
ctggtgagggtttagctttttc

SEQ ID NO: 1217495 - DNA, 22 bp, Artificial Sequence
  chemically synthesized
tctggtgagggtttagcttttt

SEQ ID NO: 1217496 - DNA, 22 bp, Artificial Sequence
  chemically synthesized
atagctagaaaaagctaaaccc

SEQ ID NO: 1217497 - DNA, 22 bp, Artificial Sequence
  chemically synthesized
tagctagaaaaagctaaaccct

SEQ ID NO: 1217498 - DNA, 22 bp, Artificial Sequence
  chemically synthesized
agagctttctggtgagggttta

SEQ ID NO: 1217499 - DNA, 22 bp, Artificial Sequence
  chemically synthesized
gaaaaagctaaaccctcaccag

SEQ ID NO: 1217500 - DNA, 22 bp, Artificial Sequence
  chemically synthesized
tcagatctgagagctttctggt

SEQ ID NO: 1217501 - DNA, 22 bp, Artificial Sequence
  chemically synthesized
atcagatctgagagctttctgg

SEQ ID NO: 1217502 - DNA, 22 bp, Artificial Sequence
  chemically synthesized
tttatcagatctgagagctttc

SEQ ID NO: 1217503 - DNA, 22 bp, Artificial Sequence
  chemically synthesized
aaccctcaccagaaagctctca

SEQ ID NO: 1217504 - DNA, 22 bp, Artificial Sequence
  chemically synthesized
atttatcagatctgagagcttt

SEQ ID NO: 1217505 - DNA, 22 bp, Artificial Sequence
  chemically synthesized
aatttatttatcagatctgaga

SEQ ID NO: 1217506 - DNA, 22 bp, Artificial Sequence
  chemically synthesized
accagaaagctctcagatctga

SEQ ID NO: 1217507 - DNA, 22 bp, Artificial Sequence
  chemically synthesized
ctaaatttatttatcagatctg

SEQ ID NO: 1217508 - DNA, 22 bp, Artificial Sequence
  chemically synthesized
actaaatttatttatcagatct

SEQ ID NO: 1217509 - DNA, 22 bp, Artificial Sequence
  chemically synthesized
tactaaatttatttatcagatc

SEQ ID NO: 1217510 - DNA, 22 bp, Artificial Sequence
  chemically synthesized
caactttactaaatttatttat

SEQ ID NO: 1217511 - DNA, 22 bp, Artificial Sequence
  chemically synthesized
tcagatctgataaataaattta

SEQ ID NO: 1217512 - DNA, 22 bp, Artificial Sequence
  chemically synthesized
agatctgataaataaatttagt

SEQ ID NO: 1217513 - DNA, 22 bp, Artificial Sequence
  chemically synthesized
tatcctgcaactttactaaatt

SEQ ID NO: 1217514 - DNA, 22 bp, Artificial Sequence
  chemically synthesized
gtatcctgcaactttactaaat

SEQ ID NO: 1217515 - DNA, 22 bp, Artificial Sequence
  chemically synthesized
tgtatcctgcaactttactaaa

SEQ ID NO: 1217516 - DNA, 22 bp, Artificial Sequence
  chemically synthesized
ttgtatcctgcaactttactaa

SEQ ID NO: 1217517 - DNA, 22 bp, Artificial Sequence
  chemically synthesized
ataaataaatttagtaaagttg

SEQ ID NO: 1217518 - DNA, 22 bp, Artificial Sequence
  chemically synthesized
atttttgtatcctgcaacttta

SEQ ID NO: 1217519 - DNA, 22 bp, Artificial Sequence
  chemically synthesized
tgtatgttgatttttgtatcct

SEQ ID NO: 1217520 - DNA, 22 bp, Artificial Sequence
  chemically synthesized
agtaaagttgcaggatacaaaa

SEQ ID NO: 1217521 - DNA, 22 bp, Artificial Sequence
  chemically synthesized
gtaaagttgcaggatacaaaaa

SEQ ID NO: 1217522 - DNA, 22 bp, Artificial Sequence
  chemically synthesized
aattgtgtatgttgatttttgt

SEQ ID NO: 1217523 - DNA, 22 bp, Artificial Sequence
  chemically synthesized
ctgaattgtgtatgttgatttt

SEQ ID NO: 1217524 - DNA, 22 bp, Artificial Sequence
  chemically synthesized
caggatacaaaaatcaacatac

SEQ ID NO: 1217525 - DNA, 22 bp, Artificial Sequence
  chemically synthesized
gtatatagaaatgctactgaat

SEQ ID NO: 1217526 - DNA, 22 bp, Artificial Sequence
  chemically synthesized
ttggtatatagaaatgctactg

SEQ ID NO: 1217527 - DNA, 22 bp, Artificial Sequence
  chemically synthesized
attattggtatatagaaatgct

SEQ ID NO: 1217528 - DNA, 22 bp, Artificial Sequence
  chemically synthesized
agtagcatttctatataccaat

SEQ ID NO: 1217529 - DNA, 22 bp, Artificial Sequence
  chemically synthesized
agccagttcattattggtatat

SEQ ID NO: 1217530 - DNA, 22 bp, Artificial Sequence
  chemically synthesized
tcagccagttcattattggtat

SEQ ID NO: 1217531 - DNA, 22 bp, Artificial Sequence
  chemically synthesized
ctcagccagttcattattggta

SEQ ID NO: 1217532 - DNA, 22 bp, Artificial Sequence
  chemically synthesized
tctcagccagttcattattggt

SEQ ID NO: 1217533 - DNA, 22 bp, Artificial Sequence
  chemically synthesized
tttctcagccagttcattattg

SEQ ID NO: 1217534 - DNA, 22 bp, Artificial Sequence
  chemically synthesized
ctttctcagccagttcattatt

SEQ ID NO: 1217535 - DNA, 22 bp, Artificial Sequence
  chemically synthesized
ctatataccaataatgaactgg

SEQ ID NO: 1217536 - DNA, 22 bp, Artificial Sequence
  chemically synthesized
tatataccaataatgaactggc

SEQ ID NO: 1217537 - DNA, 22 bp, Artificial Sequence
  chemically synthesized
atttctttctcagccagttcat

SEQ ID NO: 1217538 - DNA, 22 bp, Artificial Sequence
  chemically synthesized
gatttctttctcagccagttca

SEQ ID NO: 1217539 - DNA, 22 bp, Artificial Sequence
  chemically synthesized
tataccaataatgaactggctg

SEQ ID NO: 1217540 - DNA, 22 bp, Artificial Sequence
  chemically synthesized
ttgatttctttctcagccagtt

SEQ ID NO: 1217541 - DNA, 22 bp, Artificial Sequence
  chemically synthesized
cttgatttctttctcagccagt

SEQ ID NO: 1217542 - DNA, 22 bp, Artificial Sequence
  chemically synthesized
ccttcttgatttctttctcagc

SEQ ID NO: 1217543 - DNA, 22 bp, Artificial Sequence
  chemically synthesized
gccttcttgatttctttctcag

SEQ ID NO: 1217544 - DNA, 22 bp, Artificial Sequence
  chemically synthesized
gctgagaaagaaatcaagaagg

SEQ ID NO: 1217545 - DNA, 22 bp, Artificial Sequence
  chemically synthesized
taaataggtttgccttcttgat

SEQ ID NO: 1217546 - DNA, 22 bp, Artificial Sequence
  chemically synthesized
agaaagaaatcaagaaggcaaa

SEQ ID NO: 1217547 - DNA, 22 bp, Artificial Sequence
  chemically synthesized
cagccgttgtaaataggtttgc

SEQ ID NO: 1217548 - DNA, 22 bp, Artificial Sequence
  chemically synthesized
ccagccgttgtaaataggtttg

SEQ ID NO: 1217549 - DNA, 22 bp, Artificial Sequence
  chemically synthesized
tttccagccgttgtaaataggt

SEQ ID NO: 1217550 - DNA, 22 bp, Artificial Sequence
  chemically synthesized
ggtattatttccagccgttgta

SEQ ID NO: 1217551 - DNA, 22 bp, Artificial Sequence
  chemically synthesized
ctaggtattatttccagccgtt

SEQ ID NO: 1217552 - DNA, 22 bp, Artificial Sequence
  chemically synthesized
ctcctaggtattatttccagcc

SEQ ID NO: 1217553 - DNA, 22 bp, Artificial Sequence
  chemically synthesized
actcctaggtattatttccagc

SEQ ID NO: 1217554 - DNA, 22 bp, Artificial Sequence
  chemically synthesized
tttacaacggctggaaataata

SEQ ID NO: 1217555 - DNA, 22 bp, Artificial Sequence
  chemically synthesized
aacttactcctaggtattattt

SEQ ID NO: 1217556 - DNA, 22 bp, Artificial Sequence
  chemically synthesized
acaacggctggaaataatacct

SEQ ID NO: 1217557 - DNA, 22 bp, Artificial Sequence
  chemically synthesized
caacggctggaaataataccta

SEQ ID NO: 1217558 - DNA, 22 bp, Artificial Sequence
  chemically synthesized
ggctaaacttactcctaggtat

SEQ ID NO: 1217559 - DNA, 22 bp, Artificial Sequence
  chemically synthesized
ctgggctaaacttactcctagg

SEQ ID NO: 1217560 - DNA, 22 bp, Artificial Sequence
  chemically synthesized
gaaataatacctaggagtaagt

SEQ ID NO: 1217561 - DNA, 22 bp, Artificial Sequence
  chemically synthesized
cctcctgggctaaacttactcc

SEQ ID NO: 1217562 - DNA, 22 bp, Artificial Sequence
  chemically synthesized
ccctcctgggctaaacttactc

SEQ ID NO: 1217563 - DNA, 22 bp, Artificial Sequence
  chemically synthesized
tccctcctgggctaaacttact

SEQ ID NO: 1217564 - DNA, 22 bp, Artificial Sequence
  chemically synthesized
ggagtaagtttagcccaggagg

SEQ ID NO: 1217565 - DNA, 22 bp, Artificial Sequence
  chemically synthesized
tacggacctttccctcctgggc

SEQ ID NO: 1217566 - DNA, 22 bp, Artificial Sequence
  chemically synthesized
atacggacctttccctcctggg

SEQ ID NO: 1217567 - DNA, 22 bp, Artificial Sequence
  chemically synthesized
tatacggacctttccctcctgg

SEQ ID NO: 1217568 - DNA, 22 bp, Artificial Sequence
  chemically synthesized
tattttatacggacctttccct

SEQ ID NO: 1217569 - DNA, 22 bp, Artificial Sequence
  chemically synthesized
tgtattttatacggacctttcc

SEQ ID NO: 1217570 - DNA, 22 bp, Artificial Sequence
  chemically synthesized
agcccaggagggaaaggtccgt

SEQ ID NO: 1217571 - DNA, 22 bp, Artificial Sequence
  chemically synthesized
gcccaggagggaaaggtccgta

SEQ ID NO: 1217572 - DNA, 22 bp, Artificial Sequence
  chemically synthesized
tcagtgttctgtattttatacg

SEQ ID NO: 1217573 - DNA, 22 bp, Artificial Sequence
  chemically synthesized
gtcagtgttctgtattttatac

SEQ ID NO: 1217574 - DNA, 22 bp, Artificial Sequence
  chemically synthesized
tgtcagtgttctgtattttata

SEQ ID NO: 1217575 - DNA, 22 bp, Artificial Sequence
  chemically synthesized
ttttgtcagtgttctgtatttt

SEQ ID NO: 1217576 - DNA, 22 bp, Artificial Sequence
  chemically synthesized
gttttgtcagtgttctgtattt

SEQ ID NO: 1217577 - DNA, 22 bp, Artificial Sequence
  chemically synthesized
aatttgttttgtcagtgttctg

SEQ ID NO: 1217578 - DNA, 22 bp, Artificial Sequence
  chemically synthesized
caatttgttttgtcagtgttct

SEQ ID NO: 1217579 - DNA, 22 bp, Artificial Sequence
  chemically synthesized
ttcaatttgttttgtcagtgtt

SEQ ID NO: 1217580 - DNA, 22 bp, Artificial Sequence
  chemically synthesized
gtgtactcttcaatttgttttg

SEQ ID NO: 1217581 - DNA, 22 bp, Artificial Sequence
  chemically synthesized
ttggtgtactcttcaatttgtt

SEQ ID NO: 1217582 - DNA, 22 bp, Artificial Sequence
  chemically synthesized
gttggtgtactcttcaatttgt

SEQ ID NO: 1217583 - DNA, 22 bp, Artificial Sequence
  chemically synthesized
catttgttggtgtactcttcaa

SEQ ID NO: 1217584 - DNA, 22 bp, Artificial Sequence
  chemically synthesized
ccatttgttggtgtactcttca

SEQ ID NO: 1217585 - DNA, 22 bp, Artificial Sequence
  chemically synthesized
acaaaacaaattgaagagtaca

SEQ ID NO: 1217586 - DNA, 22 bp, Artificial Sequence
  chemically synthesized
tccatttgttggtgtactcttc

SEQ ID NO: 1217587 - DNA, 22 bp, Artificial Sequence
  chemically synthesized
aagagtacaccaacaaatggaa

SEQ ID NO: 1217588 - DNA, 22 bp, Artificial Sequence
  chemically synthesized
accgataaacatgggatgactt

SEQ ID NO: 1217589 - DNA, 22 bp, Artificial Sequence
  chemically synthesized
tgaccgataaacatgggatgac

SEQ ID NO: 1217590 - DNA, 22 bp, Artificial Sequence
  chemically synthesized
ctgaccgataaacatgggatga

SEQ ID NO: 1217591 - DNA, 22 bp, Artificial Sequence
  chemically synthesized
ttctgaccgataaacatgggat

SEQ ID NO: 1217592 - DNA, 22 bp, Artificial Sequence
  chemically synthesized
attcttctgaccgataaacatg

SEQ ID NO: 1217593 - DNA, 22 bp, Artificial Sequence
  chemically synthesized
ataacattaattcttctgaccg

SEQ ID NO: 1217594 - DNA, 22 bp, Artificial Sequence
  chemically synthesized
atcggtcagaagaattaatgtt

SEQ ID NO: 1217595 - DNA, 22 bp, Artificial Sequence
  chemically synthesized
tcggtcagaagaattaatgtta

SEQ ID NO: 1217596 - DNA, 22 bp, Artificial Sequence
  chemically synthesized
agtagaaagatcatgttaataa

SEQ ID NO: 1217597 - DNA, 22 bp, Artificial Sequence
  chemically synthesized
gagtagaaagatcatgttaata

SEQ ID NO: 1217598 - DNA, 22 bp, Artificial Sequence
  chemically synthesized
tgagtagaaagatcatgttaat

SEQ ID NO: 1217599 - DNA, 22 bp, Artificial Sequence
  chemically synthesized
atgttattaacatgatctttct

SEQ ID NO: 1217600 - DNA, 22 bp, Artificial Sequence
  chemically synthesized
ttaacatgatctttctactcaa

SEQ ID NO: 1217601 - DNA, 22 bp, Artificial Sequence
  chemically synthesized
aatgtagaatgctttgagtaga

SEQ ID NO: 1217602 - DNA, 22 bp, Artificial Sequence
  chemically synthesized
acatgatctttctactcaaagc

SEQ ID NO: 1217603 - DNA, 22 bp, Artificial Sequence
  chemically synthesized
ttcaatgtagaatgctttgagt

SEQ ID NO: 1217604 - DNA, 22 bp, Artificial Sequence
  chemically synthesized
cattattcaatgtagaatgctt

SEQ ID NO: 1217605 - DNA, 22 bp, Artificial Sequence
  chemically synthesized
tctactcaaagcattctacatt

SEQ ID NO: 1217606 - DNA, 22 bp, Artificial Sequence
  chemically synthesized
ctactcaaagcattctacattg

SEQ ID NO: 1217607 - DNA, 22 bp, Artificial Sequence
  chemically synthesized
tactcaaagcattctacattga

SEQ ID NO: 1217608 - DNA, 22 bp, Artificial Sequence
  chemically synthesized
ctcaaagcattctacattgaat

SEQ ID NO: 1217609 - DNA, 22 bp, Artificial Sequence
  chemically synthesized
atagggactgcattattcaatg

SEQ ID NO: 1217610 - DNA, 22 bp, Artificial Sequence
  chemically synthesized
aaagcattctacattgaataat

SEQ ID NO: 1217611 - DNA, 22 bp, Artificial Sequence
  chemically synthesized
tgatagggactgcattattcaa

SEQ ID NO: 1217612 - DNA, 22 bp, Artificial Sequence
  chemically synthesized
tattctgatagggactgcatta

SEQ ID NO: 1217613 - DNA, 22 bp, Artificial Sequence
  chemically synthesized
tgtattctgatagggactgcat

SEQ ID NO: 1217614 - DNA, 22 bp, Artificial Sequence
  chemically synthesized
tacattgaataatgcagtccct

SEQ ID NO: 1217615 - DNA, 22 bp, Artificial Sequence
  chemically synthesized
ctgtattctgatagggactgca

SEQ ID NO: 1217616 - DNA, 22 bp, Artificial Sequence
  chemically synthesized
cattgaataatgcagtccctat

SEQ ID NO: 1217617 - DNA, 22 bp, Artificial Sequence
  chemically synthesized
catttctgtattctgataggga

SEQ ID NO: 1217618 - DNA, 22 bp, Artificial Sequence
  chemically synthesized
aataatgcagtccctatcagaa

SEQ ID NO: 1217619 - DNA, 22 bp, Artificial Sequence
  chemically synthesized
ttccatttctgtattctgatag

SEQ ID NO: 1217620 - DNA, 22 bp, Artificial Sequence
  chemically synthesized
attccatttctgtattctgata

SEQ ID NO: 1217621 - DNA, 22 bp, Artificial Sequence
  chemically synthesized
tattccatttctgtattctgat

SEQ ID NO: 1217622 - DNA, 22 bp, Artificial Sequence
  chemically synthesized
ttattccatttctgtattctga

SEQ ID NO: 1217623 - DNA, 22 bp, Artificial Sequence
  chemically synthesized
tttattccatttctgtattctg

SEQ ID NO: 1217624 - DNA, 22 bp, Artificial Sequence
  chemically synthesized
tgatcactttttattccatttc

SEQ ID NO: 1217625 - DNA, 22 bp, Artificial Sequence
  chemically synthesized
atgatcactttttattccattt

SEQ ID NO: 1217626 - DNA, 22 bp, Artificial Sequence
  chemically synthesized
tcagaatacagaaatggaataa

SEQ ID NO: 1217627 - DNA, 22 bp, Artificial Sequence
  chemically synthesized
tatgatcactttttattccatt

SEQ ID NO: 1217628 - DNA, 22 bp, Artificial Sequence
  chemically synthesized
atcgtacaaattttatgatcac

SEQ ID NO: 1217629 - DNA, 22 bp, Artificial Sequence
  chemically synthesized
gatcgtacaaattttatgatca

SEQ ID NO: 1217630 - DNA, 22 bp, Artificial Sequence
  chemically synthesized
tgatcgtacaaattttatgatc

SEQ ID NO: 1217631 - DNA, 22 bp, Artificial Sequence
  chemically synthesized
gtctttgatcgtacaaatttta

SEQ ID NO: 1217632 - DNA, 22 bp, Artificial Sequence
  chemically synthesized
ctggtctttgatcgtacaaatt

SEQ ID NO: 1217633 - DNA, 22 bp, Artificial Sequence
  chemically synthesized
tgctggtctttgatcgtacaaa

SEQ ID NO: 1217634 - DNA, 22 bp, Artificial Sequence
  chemically synthesized
tctgctggtctttgatcgtaca

SEQ ID NO: 1217635 - DNA, 22 bp, Artificial Sequence
  chemically synthesized
aggctctctgctggtctttgat

SEQ ID NO: 1217636 - DNA, 22 bp, Artificial Sequence
  chemically synthesized
ttcaggctctctgctggtcttt

SEQ ID NO: 1217637 - DNA, 22 bp, Artificial Sequence
  chemically synthesized
gtacgatcaaagaccagcagag

SEQ ID NO: 1217638 - DNA, 22 bp, Artificial Sequence
  chemically synthesized
gctattcaggctctctgctggt

SEQ ID NO: 1217639 - DNA, 22 bp, Artificial Sequence
  chemically synthesized
tacgatcaaagaccagcagaga

SEQ ID NO: 1217640 - DNA, 22 bp, Artificial Sequence
  chemically synthesized
ggctattcaggctctctgctgg

SEQ ID NO: 1217641 - DNA, 22 bp, Artificial Sequence
  chemically synthesized
tggctattcaggctctctgctg

SEQ ID NO: 1217642 - DNA, 22 bp, Artificial Sequence
  chemically synthesized
ctttggctattcaggctctctg

SEQ ID NO: 1217643 - DNA, 22 bp, Artificial Sequence
  chemically synthesized
aggattgctttggctattcagg

SEQ ID NO: 1217644 - DNA, 22 bp, Artificial Sequence
  chemically synthesized
ctcaggattgctttggctattc

SEQ ID NO: 1217645 - DNA, 22 bp, Artificial Sequence
  chemically synthesized
gctcaggattgctttggctatt

SEQ ID NO: 1217646 - DNA, 22 bp, Artificial Sequence
  chemically synthesized
tgctcaggattgctttggctat

SEQ ID NO: 1217647 - DNA, 22 bp, Artificial Sequence
  chemically synthesized
ttgctcaggattgctttggcta

SEQ ID NO: 1217648 - DNA, 22 bp, Artificial Sequence
  chemically synthesized
tttgctcaggattgctttggct

SEQ ID NO: 1217649 - DNA, 22 bp, Artificial Sequence
  chemically synthesized
tttttgctcaggattgctttgg

SEQ ID NO: 1217650 - DNA, 22 bp, Artificial Sequence
  chemically synthesized
ttctttttgctcaggattgctt

SEQ ID NO: 1217651 - DNA, 22 bp, Artificial Sequence
  chemically synthesized
gttctttttgctcaggattgct

SEQ ID NO: 1217652 - DNA, 22 bp, Artificial Sequence
  chemically synthesized
tgttctttttgctcaggattgc

SEQ ID NO: 1217653 - DNA, 22 bp, Artificial Sequence
  chemically synthesized
aatagccaaagcaatcctgagc

SEQ ID NO: 1217654 - DNA, 22 bp, Artificial Sequence
  chemically synthesized
ataagtctttgttctttttgct

SEQ ID NO: 1217655 - DNA, 22 bp, Artificial Sequence
  chemically synthesized
agcaaaaagaacaaagacttat

SEQ ID NO: 1217656 - DNA, 22 bp, Artificial Sequence
  chemically synthesized
tcaagtagtgtgattcataagt

SEQ ID NO: 1217657 - DNA, 22 bp, Artificial Sequence
  chemically synthesized
gtcaagtagtgtgattcataag

SEQ ID NO: 1217658 - DNA, 22 bp, Artificial Sequence
  chemically synthesized
tgtcaagtagtgtgattcataa

SEQ ID NO: 1217659 - DNA, 22 bp, Artificial Sequence
  chemically synthesized
ttttgtcaagtagtgtgattca

SEQ ID NO: 1217660 - DNA, 22 bp, Artificial Sequence
  chemically synthesized
ctgttttgtcaagtagtgtgat

SEQ ID NO: 1217661 - DNA, 22 bp, Artificial Sequence
  chemically synthesized
gctgttttgtcaagtagtgtga

SEQ ID NO: 1217662 - DNA, 22 bp, Artificial Sequence
  chemically synthesized
atgaatcacactacttgacaaa

SEQ ID NO: 1217663 - DNA, 22 bp, Artificial Sequence
  chemically synthesized
acaccttgctgttttgtcaagt

SEQ ID NO: 1217664 - DNA, 22 bp, Artificial Sequence
  chemically synthesized
tgaatcacactacttgacaaaa

SEQ ID NO: 1217665 - DNA, 22 bp, Artificial Sequence
  chemically synthesized
taacaccttgctgttttgtcaa

SEQ ID NO: 1217666 - DNA, 22 bp, Artificial Sequence
  chemically synthesized
ttctaacaccttgctgttttgt

SEQ ID NO: 1217667 - DNA, 22 bp, Artificial Sequence
  chemically synthesized
attctaacaccttgctgttttg

SEQ ID NO: 1217668 - DNA, 22 bp, Artificial Sequence
  chemically synthesized
tattctaacaccttgctgtttt

SEQ ID NO: 1217669 - DNA, 22 bp, Artificial Sequence
  chemically synthesized
ttattctaacaccttgctgttt

SEQ ID NO: 1217670 - DNA, 22 bp, Artificial Sequence
  chemically synthesized
tttttattctaacaccttgctg

SEQ ID NO: 1217671 - DNA, 22 bp, Artificial Sequence
  chemically synthesized
cttgacaaaacagcaaggtgtt

SEQ ID NO: 1217672 - DNA, 22 bp, Artificial Sequence
  chemically synthesized
gacaaaacagcaaggtgttaga

SEQ ID NO: 1217673 - DNA, 22 bp, Artificial Sequence
  chemically synthesized
acaaaacagcaaggtgttagaa

SEQ ID NO: 1217674 - DNA, 22 bp, Artificial Sequence
  chemically synthesized
tatgtctgtttttattctaaca

SEQ ID NO: 1217675 - DNA, 22 bp, Artificial Sequence
  chemically synthesized
tatatgtctgtttttattctaa

SEQ ID NO: 1217676 - DNA, 22 bp, Artificial Sequence
  chemically synthesized
ttctatatgtctgtttttattc

SEQ ID NO: 1217677 - DNA, 22 bp, Artificial Sequence
  chemically synthesized
cattgttctatatgtctgtttt

SEQ ID NO: 1217678 - DNA, 22 bp, Artificial Sequence
  chemically synthesized
ttccattgttctatatgtctgt

SEQ ID NO: 1217679 - DNA, 22 bp, Artificial Sequence
  chemically synthesized
gaataaaaacagacatatagaa

SEQ ID NO: 1217680 - DNA, 22 bp, Artificial Sequence
  chemically synthesized
atctattccattgttctatatg

SEQ ID NO: 1217681 - DNA, 22 bp, Artificial Sequence
  chemically synthesized
taatctattccattgttctata

SEQ ID NO: 1217682 - DNA, 22 bp, Artificial Sequence
  chemically synthesized
tctaatctattccattgttcta

SEQ ID NO: 1217683 - DNA, 22 bp, Artificial Sequence
  chemically synthesized
agttctctaatctattccattg

SEQ ID NO: 1217684 - DNA, 22 bp, Artificial Sequence
  chemically synthesized
tgagttctctaatctattccat

SEQ ID NO: 1217685 - DNA, 22 bp, Artificial Sequence
  chemically synthesized
attctgagttctctaatctatt

SEQ ID NO: 1217686 - DNA, 22 bp, Artificial Sequence
  chemically synthesized
aattctgagttctctaatctat

SEQ ID NO: 1217687 - DNA, 22 bp, Artificial Sequence
  chemically synthesized
tatgtaaatacatggatttaat

SEQ ID NO: 1217688 - DNA, 22 bp, Artificial Sequence
  chemically synthesized
gagaactcagaattaaatccat

SEQ ID NO: 1217689 - DNA, 22 bp, Artificial Sequence
  chemically synthesized
agaattaaatccatgtatttac

SEQ ID NO: 1217690 - DNA, 22 bp, Artificial Sequence
  chemically synthesized
tcaaaaacaagttgtatgtaaa

SEQ ID NO: 1217691 - DNA, 22 bp, Artificial Sequence
  chemically synthesized
gtcaaaaacaagttgtatgtaa

SEQ ID NO: 1217692 - DNA, 22 bp, Artificial Sequence
  chemically synthesized
aatccatgtatttacatacaac

SEQ ID NO: 1217693 - DNA, 22 bp, Artificial Sequence
  chemically synthesized
tgtcaaaaacaagttgtatgta

SEQ ID NO: 1217694 - DNA, 22 bp, Artificial Sequence
  chemically synthesized
ttgtcaaaaacaagttgtatgt

SEQ ID NO: 1217695 - DNA, 22 bp, Artificial Sequence
  chemically synthesized
gtgcttttgtcaaaaacaagtt

SEQ ID NO: 1217696 - DNA, 22 bp, Artificial Sequence
  chemically synthesized
ggtgcttttgtcaaaaacaagt

SEQ ID NO: 1217697 - DNA, 22 bp, Artificial Sequence
  chemically synthesized
ttggtgcttttgtcaaaaacaa

SEQ ID NO: 1217698 - DNA, 22 bp, Artificial Sequence
  chemically synthesized
acatacaacttgtttttgacaa

SEQ ID NO: 1217699 - DNA, 22 bp, Artificial Sequence
  chemically synthesized
catacaacttgtttttgacaaa

SEQ ID NO: 1217700 - DNA, 22 bp, Artificial Sequence
  chemically synthesized
atgcatgttcttggtgcttttg

SEQ ID NO: 1217701 - DNA, 22 bp, Artificial Sequence
  chemically synthesized
gtttttgacaaaagcaccaaga

SEQ ID NO: 1217702 - DNA, 22 bp, Artificial Sequence
  chemically synthesized
tttttgacaaaagcaccaagaa

SEQ ID NO: 1217703 - DNA, 22 bp, Artificial Sequence
  chemically synthesized
cccctaatgcatgttcttggtg

SEQ ID NO: 1217704 - DNA, 22 bp, Artificial Sequence
  chemically synthesized
ccccctaatgcatgttcttggt

SEQ ID NO: 1217705 - DNA, 22 bp, Artificial Sequence
  chemically synthesized
ttgacaaaagcaccaagaacat

SEQ ID NO: 1217706 - DNA, 22 bp, Artificial Sequence
  chemically synthesized
tgacaaaagcaccaagaacatg

SEQ ID NO: 1217707 - DNA, 22 bp, Artificial Sequence
  chemically synthesized
gacaaaagcaccaagaacatgc

SEQ ID NO: 1217708 - DNA, 22 bp, Artificial Sequence
  chemically synthesized
acaaaagcaccaagaacatgca

SEQ ID NO: 1217709 - DNA, 22 bp, Artificial Sequence
  chemically synthesized
aagaaggtgtccttccccctaa

SEQ ID NO: 1217710 - DNA, 22 bp, Artificial Sequence
  chemically synthesized
gaagaaggtgtccttcccccta

SEQ ID NO: 1217711 - DNA, 22 bp, Artificial Sequence
  chemically synthesized
agcaccatttgaagaaggtgtc

SEQ ID NO: 1217712 - DNA, 22 bp, Artificial Sequence
  chemically synthesized
tcagcaccatttgaagaaggtg

SEQ ID NO: 1217713 - DNA, 22 bp, Artificial Sequence
  chemically synthesized
gggggaaggacaccttcttcaa

SEQ ID NO: 1217714 - DNA, 22 bp, Artificial Sequence
  chemically synthesized
acaatccaattctcagcaccat

SEQ ID NO: 1217715 - DNA, 22 bp, Artificial Sequence
  chemically synthesized
cttcaaatggtgctgagaattg

SEQ ID NO: 1217716 - DNA, 22 bp, Artificial Sequence
  chemically synthesized
catctgacaatccaattctcag

SEQ ID NO: 1217717 - DNA, 22 bp, Artificial Sequence
  chemically synthesized
ttcaaatggtgctgagaattgg

SEQ ID NO: 1217718 - DNA, 22 bp, Artificial Sequence
  chemically synthesized
tgcatctgacaatccaattctc

SEQ ID NO: 1217719 - DNA, 22 bp, Artificial Sequence
  chemically synthesized
caaatggtgctgagaattggat

SEQ ID NO: 1217720 - DNA, 22 bp, Artificial Sequence
  chemically synthesized
ctgcatctgacaatccaattct

SEQ ID NO: 1217721 - DNA, 22 bp, Artificial Sequence
  chemically synthesized
aaatggtgctgagaattggatt

SEQ ID NO: 1217722 - DNA, 22 bp, Artificial Sequence
  chemically synthesized
atacttctgcatctgacaatcc

SEQ ID NO: 1217723 - DNA, 22 bp, Artificial Sequence
  chemically synthesized
catacttctgcatctgacaatc

SEQ ID NO: 1217724 - DNA, 22 bp, Artificial Sequence
  chemically synthesized
agaattggattgtcagatgcag

SEQ ID NO: 1217725 - DNA, 22 bp, Artificial Sequence
  chemically synthesized
gattgtcagatgcagaagtatg

SEQ ID NO: 1217726 - DNA, 22 bp, Artificial Sequence
  chemically synthesized
tcagatgcagaagtatgaaact

SEQ ID NO: 1217727 - DNA, 22 bp, Artificial Sequence
  chemically synthesized
atatggtgagagacagggatcc

SEQ ID NO: 1217728 - DNA, 22 bp, Artificial Sequence
  chemically synthesized
taatatggtgagagacagggat

SEQ ID NO: 1217729 - DNA, 22 bp, Artificial Sequence
  chemically synthesized
ctaatatggtgagagacaggga

SEQ ID NO: 1217730 - DNA, 22 bp, Artificial Sequence
  chemically synthesized
tctaatatggtgagagacaggg

SEQ ID NO: 1217731 - DNA, 22 bp, Artificial Sequence
  chemically synthesized
aattttctaatatggtgagaga

SEQ ID NO: 1217732 - DNA, 22 bp, Artificial Sequence
  chemically synthesized
gatccctgtctctcaccatatt

SEQ ID NO: 1217733 - DNA, 22 bp, Artificial Sequence
  chemically synthesized
agctgaattttctaatatggtg

SEQ ID NO: 1217734 - DNA, 22 bp, Artificial Sequence
  chemically synthesized
gagctgaattttctaatatggt

SEQ ID NO: 1217735 - DNA, 22 bp, Artificial Sequence
  chemically synthesized
tctctcaccatattagaaaatt

SEQ ID NO: 1217736 - DNA, 22 bp, Artificial Sequence
  chemically synthesized
atccatcttgagctgaattttc

SEQ ID NO: 1217737 - DNA, 22 bp, Artificial Sequence
  chemically synthesized
tcaccatattagaaaattcagc

SEQ ID NO: 1217738 - DNA, 22 bp, Artificial Sequence
  chemically synthesized
aatccatcttgagctgaatttt

SEQ ID NO: 1217739 - DNA, 22 bp, Artificial Sequence
  chemically synthesized
accatattagaaaattcagctc

SEQ ID NO: 1217740 - DNA, 22 bp, Artificial Sequence
  chemically synthesized
aatccttaatccatcttgagct

SEQ ID NO: 1217741 - DNA, 22 bp, Artificial Sequence
  chemically synthesized
aaatccttaatccatcttgagc

SEQ ID NO: 1217742 - DNA, 22 bp, Artificial Sequence
  chemically synthesized
taaatccttaatccatcttgag

SEQ ID NO: 1217743 - DNA, 22 bp, Artificial Sequence
  chemically synthesized
gaaaattcagctcaagatggat

SEQ ID NO: 1217744 - DNA, 22 bp, Artificial Sequence
  chemically synthesized
cctttaaatccttaatccatct

SEQ ID NO: 1217745 - DNA, 22 bp, Artificial Sequence
  chemically synthesized
acctttaaatccttaatccatc

SEQ ID NO: 1217746 - DNA, 22 bp, Artificial Sequence
  chemically synthesized
agctcaagatggattaaggatt

SEQ ID NO: 1217747 - DNA, 22 bp, Artificial Sequence
  chemically synthesized
ggtcttacctttaaatccttaa

SEQ ID NO: 1217748 - DNA, 22 bp, Artificial Sequence
  chemically synthesized
aggtcttacctttaaatcctta

SEQ ID NO: 1217749 - DNA, 22 bp, Artificial Sequence
  chemically synthesized
taggtcttacctttaaatcctt

SEQ ID NO: 1217750 - DNA, 22 bp, Artificial Sequence
  chemically synthesized
aagatggattaaggatttaaag

SEQ ID NO: 1217751 - DNA, 22 bp, Artificial Sequence
  chemically synthesized
agttttaggtcttacctttaaa

SEQ ID NO: 1217752 - DNA, 22 bp, Artificial Sequence
  chemically synthesized
cagttttaggtcttacctttaa

SEQ ID NO: 1217753 - DNA, 22 bp, Artificial Sequence
  chemically synthesized
aggatttaaaggtaagacctaa

SEQ ID NO: 1217754 - DNA, 22 bp, Artificial Sequence
  chemically synthesized
atgtagtttcagttttaggtct

SEQ ID NO: 1217755 - DNA, 22 bp, Artificial Sequence
  chemically synthesized
catgtagtttcagttttaggtc

SEQ ID NO: 1217756 - DNA, 22 bp, Artificial Sequence
  chemically synthesized
cttcatgtagtttcagttttag

SEQ ID NO: 1217757 - DNA, 22 bp, Artificial Sequence
  chemically synthesized
aaaggtaagacctaaaactgaa

SEQ ID NO: 1217758 - DNA, 22 bp, Artificial Sequence
  chemically synthesized
gcttcatgtagtttcagtttta

SEQ ID NO: 1217759 - DNA, 22 bp, Artificial Sequence
  chemically synthesized
aaggtaagacctaaaactgaaa

SEQ ID NO: 1217760 - DNA, 22 bp, Artificial Sequence
  chemically synthesized
tgtttgcttcatgtagtttcag

SEQ ID NO: 1217761 - DNA, 22 bp, Artificial Sequence
  chemically synthesized
cctatgtttgcttcatgtagtt

SEQ ID NO: 1217762 - DNA, 22 bp, Artificial Sequence
  chemically synthesized
ccctatgtttgcttcatgtagt

SEQ ID NO: 1217763 - DNA, 22 bp, Artificial Sequence
  chemically synthesized
tccctatgtttgcttcatgtag

SEQ ID NO: 1217764 - DNA, 22 bp, Artificial Sequence
  chemically synthesized
aaactgaaactacatgaagcaa

SEQ ID NO: 1217765 - DNA, 22 bp, Artificial Sequence
  chemically synthesized
ttttccctatgtttgcttcatg

SEQ ID NO: 1217766 - DNA, 22 bp, Artificial Sequence
  chemically synthesized
tctgttttccctatgtttgctt

SEQ ID NO: 1217767 - DNA, 22 bp, Artificial Sequence
  chemically synthesized
aaactacatgaagcaaacatag

SEQ ID NO: 1217768 - DNA, 22 bp, Artificial Sequence
  chemically synthesized
catgaagcaaacatagggaaaa

SEQ ID NO: 1217769 - DNA, 22 bp, Artificial Sequence
  chemically synthesized
gaccaaggtcctgtctgttttc

SEQ ID NO: 1217770 - DNA, 22 bp, Artificial Sequence
  chemically synthesized
cctagaccaaggtcctgtctgt

SEQ ID NO: 1217771 - DNA, 22 bp, Artificial Sequence
  chemically synthesized
gcctagaccaaggtcctgtctg

SEQ ID NO: 1217772 - DNA, 22 bp, Artificial Sequence
  chemically synthesized
tgcctagaccaaggtcctgtct

SEQ ID NO: 1217773 - DNA, 22 bp, Artificial Sequence
  chemically synthesized
aggtcataaccataaaatcttt

SEQ ID NO: 1217774 - DNA, 22 bp, Artificial Sequence
  chemically synthesized
gaggtcataaccataaaatctt

SEQ ID NO: 1217775 - DNA, 22 bp, Artificial Sequence
  chemically synthesized
tgaggtcataaccataaaatct

SEQ ID NO: 1217776 - DNA, 22 bp, Artificial Sequence
  chemically synthesized
ggtctaggcaaagattttatgg

SEQ ID NO: 1217777 - DNA, 22 bp, Artificial Sequence
  chemically synthesized
ttgaggtcataaccataaaatc

SEQ ID NO: 1217778 - DNA, 22 bp, Artificial Sequence
  chemically synthesized
gtctaggcaaagattttatggt

SEQ ID NO: 1217779 - DNA, 22 bp, Artificial Sequence
  chemically synthesized
cgcttttgaggtcataaccata

SEQ ID NO: 1217780 - DNA, 22 bp, Artificial Sequence
  chemically synthesized
ggcaaagattttatggttatga

SEQ ID NO: 1217781 - DNA, 22 bp, Artificial Sequence
  chemically synthesized
cctgcgcttttgaggtcataac

SEQ ID NO: 1217782 - DNA, 22 bp, Artificial Sequence
  chemically synthesized
ttgcctgcgcttttgaggtcat

SEQ ID NO: 1217783 - DNA, 22 bp, Artificial Sequence
  chemically synthesized
gttgcctgcgcttttgaggtca

SEQ ID NO: 1217784 - DNA, 22 bp, Artificial Sequence
  chemically synthesized
tgttgcctgcgcttttgaggtc

SEQ ID NO: 1217785 - DNA, 22 bp, Artificial Sequence
  chemically synthesized
ttgttgcctgcgcttttgaggt

SEQ ID NO: 1217786 - DNA, 22 bp, Artificial Sequence
  chemically synthesized
tatggttatgacctcaaaagcg

SEQ ID NO: 1217787 - DNA, 22 bp, Artificial Sequence
  chemically synthesized
atggttatgacctcaaaagcgc

SEQ ID NO: 1217788 - DNA, 22 bp, Artificial Sequence
  chemically synthesized
tggttatgacctcaaaagcgca

SEQ ID NO: 1217789 - DNA, 22 bp, Artificial Sequence
  chemically synthesized
tgtttttgttgcctgcgctttt

SEQ ID NO: 1217790 - DNA, 22 bp, Artificial Sequence
  chemically synthesized
atgtttttgttgcctgcgcttt

SEQ ID NO: 1217791 - DNA, 22 bp, Artificial Sequence
  chemically synthesized
tttatgtttttgttgcctgcgc

SEQ ID NO: 1217792 - DNA, 22 bp, Artificial Sequence
  chemically synthesized
tgacctcaaaagcgcaggcaac

SEQ ID NO: 1217793 - DNA, 22 bp, Artificial Sequence
  chemically synthesized
tctatttatgtttttgttgcct

SEQ ID NO: 1217794 - DNA, 22 bp, Artificial Sequence
  chemically synthesized
aaaagcgcaggcaacaaaaaca

SEQ ID NO: 1217795 - DNA, 22 bp, Artificial Sequence
  chemically synthesized
cagtcccaattatctatttatg

SEQ ID NO: 1217796 - DNA, 22 bp, Artificial Sequence
  chemically synthesized
tacagtcccaattatctattta

SEQ ID NO: 1217797 - DNA, 22 bp, Artificial Sequence
  chemically synthesized
ctacagtcccaattatctattt

SEQ ID NO: 1217798 - DNA, 22 bp, Artificial Sequence
  chemically synthesized
tctacagtcccaattatctatt

SEQ ID NO: 1217799 - DNA, 22 bp, Artificial Sequence
  chemically synthesized
attttctacagtcccaattatc

SEQ ID NO: 1217800 - DNA, 22 bp, Artificial Sequence
  chemically synthesized
cattttctacagtcccaattat

SEQ ID NO: 1217801 - DNA, 22 bp, Artificial Sequence
  chemically synthesized
tcattttctacagtcccaatta

SEQ ID NO: 1217802 - DNA, 22 bp, Artificial Sequence
  chemically synthesized
tttcattttctacagtcccaat

SEQ ID NO: 1217803 - DNA, 22 bp, Artificial Sequence
  chemically synthesized
cagaagctctttcattttctac

SEQ ID NO: 1217804 - DNA, 22 bp, Artificial Sequence
  chemically synthesized
acagaagctctttcattttcta

SEQ ID NO: 1217805 - DNA, 22 bp, Artificial Sequence
  chemically synthesized
tacagaagctctttcattttct

SEQ ID NO: 1217806 - DNA, 22 bp, Artificial Sequence
  chemically synthesized
ttttacagaagctctttcattt

SEQ ID NO: 1217807 - DNA, 22 bp, Artificial Sequence
  chemically synthesized
gttttacagaagctctttcatt

SEQ ID NO: 1217808 - DNA, 22 bp, Artificial Sequence
  chemically synthesized
ggactgtagaaaatgaaagagc

SEQ ID NO: 1217809 - DNA, 22 bp, Artificial Sequence
  chemically synthesized
tgttttacagaagctctttcat

SEQ ID NO: 1217810 - DNA, 22 bp, Artificial Sequence
  chemically synthesized
ctttgttttacagaagctcttt

SEQ ID NO: 1217811 - DNA, 22 bp, Artificial Sequence
  chemically synthesized
cctttgttttacagaagctctt

SEQ ID NO: 1217812 - DNA, 22 bp, Artificial Sequence
  chemically synthesized
tagaaaatgaaagagcttctgt

SEQ ID NO: 1217813 - DNA, 22 bp, Artificial Sequence
  chemically synthesized
aatccttcctttgttttacaga

SEQ ID NO: 1217814 - DNA, 22 bp, Artificial Sequence
  chemically synthesized
ttgaatccttcctttgttttac

SEQ ID NO: 1217815 - DNA, 22 bp, Artificial Sequence
  chemically synthesized
tgttgaatccttcctttgtttt

SEQ ID NO: 1217816 - DNA, 22 bp, Artificial Sequence
  chemically synthesized
actctgttgaatccttcctttg

SEQ ID NO: 1217817 - DNA, 22 bp, Artificial Sequence
  chemically synthesized
cactctgttgaatccttccttt

SEQ ID NO: 1217818 - DNA, 22 bp, Artificial Sequence
  chemically synthesized
ttcactctgttgaatccttcct

SEQ ID NO: 1217819 - DNA, 22 bp, Artificial Sequence
  chemically synthesized
ctgtaaaacaaaggaaggattc

SEQ ID NO: 1217820 - DNA, 22 bp, Artificial Sequence
  chemically synthesized
tgtaaaacaaaggaaggattca

SEQ ID NO: 1217821 - DNA, 22 bp, Artificial Sequence
  chemically synthesized
taaaacaaaggaaggattcaac

SEQ ID NO: 1217822 - DNA, 22 bp, Artificial Sequence
  chemically synthesized
tctcttcactctgttgaatcct

SEQ ID NO: 1217823 - DNA, 22 bp, Artificial Sequence
  chemically synthesized
agcaggttgtctcttcactctg

SEQ ID NO: 1217824 - DNA, 22 bp, Artificial Sequence
  chemically synthesized
ccattcagcaggttgtctcttc

SEQ ID NO: 1217825 - DNA, 22 bp, Artificial Sequence
  chemically synthesized
tcccattcagcaggttgtctct

SEQ ID NO: 1217826 - DNA, 22 bp, Artificial Sequence
  chemically synthesized
ctcccattcagcaggttgtctc

SEQ ID NO: 1217827 - DNA, 22 bp, Artificial Sequence
  chemically synthesized
aacagagtgaagagacaacctg

SEQ ID NO: 1217828 - DNA, 22 bp, Artificial Sequence
  chemically synthesized
tctcccattcagcaggttgtct

SEQ ID NO: 1217829 - DNA, 22 bp, Artificial Sequence
  chemically synthesized
ttctcccattcagcaggttgtc

SEQ ID NO: 1217830 - DNA, 22 bp, Artificial Sequence
  chemically synthesized
caaatcttttctcccattcagc

SEQ ID NO: 1217831 - DNA, 22 bp, Artificial Sequence
  chemically synthesized
acaaatcttttctcccattcag

SEQ ID NO: 1217832 - DNA, 22 bp, Artificial Sequence
  chemically synthesized
aatagtttacaaatcttttctc

SEQ ID NO: 1217833 - DNA, 22 bp, Artificial Sequence
  chemically synthesized
ctgaatgggagaaaagatttgt

SEQ ID NO: 1217834 - DNA, 22 bp, Artificial Sequence
  chemically synthesized
tctgaatagtttacaaatcttt

SEQ ID NO: 1217835 - DNA, 22 bp, Artificial Sequence
  chemically synthesized
gtctgaatagtttacaaatctt

SEQ ID NO: 1217836 - DNA, 22 bp, Artificial Sequence
  chemically synthesized
aatgggagaaaagatttgtaaa

SEQ ID NO: 1217837 - DNA, 22 bp, Artificial Sequence
  chemically synthesized
ttgtctgaatagtttacaaatc

SEQ ID NO: 1217838 - DNA, 22 bp, Artificial Sequence
  chemically synthesized
gtctcttgtctgaatagtttac

SEQ ID NO: 1217839 - DNA, 22 bp, Artificial Sequence
  chemically synthesized
gatattagtctcttgtctgaat

SEQ ID NO: 1217840 - DNA, 22 bp, Artificial Sequence
  chemically synthesized
ctagatattagtctcttgtctg

SEQ ID NO: 1217841 - DNA, 22 bp, Artificial Sequence
  chemically synthesized
cctagatattagtctcttgtct

SEQ ID NO: 1217842 - DNA, 22 bp, Artificial Sequence
  chemically synthesized
gtaaactattcagacaagagac

SEQ ID NO: 1217843 - DNA, 22 bp, Artificial Sequence
  chemically synthesized
taaactattcagacaagagact

SEQ ID NO: 1217844 - DNA, 22 bp, Artificial Sequence
  chemically synthesized
gtatttcctagatattagtctc

SEQ ID NO: 1217845 - DNA, 22 bp, Artificial Sequence
  chemically synthesized
ttcagacaagagactaatatct

SEQ ID NO: 1217846 - DNA, 22 bp, Artificial Sequence
  chemically synthesized
agacaagagactaatatctagg

SEQ ID NO: 1217847 - DNA, 22 bp, Artificial Sequence
  chemically synthesized
ggatcctcgtatttcctagata

SEQ ID NO: 1217848 - DNA, 22 bp, Artificial Sequence
  chemically synthesized
gggatcctcgtatttcctagat

SEQ ID NO: 1217849 - DNA, 22 bp, Artificial Sequence
  chemically synthesized
tttgggatcctcgtatttccta

SEQ ID NO: 1217850 - DNA, 22 bp, Artificial Sequence
  chemically synthesized
aattgtttgggatcctcgtatt

SEQ ID NO: 1217851 - DNA, 22 bp, Artificial Sequence
  chemically synthesized
atatctaggaaatacgaggatc

SEQ ID NO: 1217852 - DNA, 22 bp, Artificial Sequence
  chemically synthesized
ttaaattgtttgggatcctcgt

SEQ ID NO: 1217853 - DNA, 22 bp, Artificial Sequence
  chemically synthesized
ctgttaaattgtttgggatcct

SEQ ID NO: 1217854 - DNA, 22 bp, Artificial Sequence
  chemically synthesized
actgttaaattgtttgggatcc

SEQ ID NO: 1217855 - DNA, 22 bp, Artificial Sequence
  chemically synthesized
tactgttaaattgtttgggatc

SEQ ID NO: 1217856 - DNA, 22 bp, Artificial Sequence
  chemically synthesized
ggaaatacgaggatcccaaaca

SEQ ID NO: 1217857 - DNA, 22 bp, Artificial Sequence
  chemically synthesized
ttactgttaaattgtttgggat

SEQ ID NO: 1217858 - DNA, 22 bp, Artificial Sequence
  chemically synthesized
tttactgttaaattgtttggga

SEQ ID NO: 1217859 - DNA, 22 bp, Artificial Sequence
  chemically synthesized
ttttactgttaaattgtttggg

SEQ ID NO: 1217860 - DNA, 22 bp, Artificial Sequence
  chemically synthesized
tttttttactgttaaattgttt

SEQ ID NO: 1217861 - DNA, 22 bp, Artificial Sequence
  chemically synthesized
atgtgattatttttttactgtt

SEQ ID NO: 1217862 - DNA, 22 bp, Artificial Sequence
  chemically synthesized
aatgtgattatttttttactgt

SEQ ID NO: 1217863 - DNA, 22 bp, Artificial Sequence
  chemically synthesized
taatgtgattatttttttactg

SEQ ID NO: 1217864 - DNA, 22 bp, Artificial Sequence
  chemically synthesized
ttaatgtgattatttttttact

SEQ ID NO: 1217865 - DNA, 22 bp, Artificial Sequence
  chemically synthesized
tccatttttaatgtgattattt

SEQ ID NO: 1217866 - DNA, 22 bp, Artificial Sequence
  chemically synthesized
gtccatttttaatgtgattatt

SEQ ID NO: 1217867 - DNA, 22 bp, Artificial Sequence
  chemically synthesized
aacagtaaaaaaataatcacat

SEQ ID NO: 1217868 - DNA, 22 bp, Artificial Sequence
  chemically synthesized
tgtccatttttaatgtgattat

SEQ ID NO: 1217869 - DNA, 22 bp, Artificial Sequence
  chemically synthesized
acagtaaaaaaataatcacatt

SEQ ID NO: 1217870 - DNA, 22 bp, Artificial Sequence
  chemically synthesized
tcctttgtccatttttaatgtg

SEQ ID NO: 1217871 - DNA, 22 bp, Artificial Sequence
  chemically synthesized
ttgtcctttgtccatttttaat

SEQ ID NO: 1217872 - DNA, 22 bp, Artificial Sequence
  chemically synthesized
ttattgtcctttgtccattttt

SEQ ID NO: 1217873 - DNA, 22 bp, Artificial Sequence
  chemically synthesized
attattgtcctttgtccatttt

SEQ ID NO: 1217874 - DNA, 22 bp, Artificial Sequence
  chemically synthesized
agaaatacttattattgtcctt

SEQ ID NO: 1217875 - DNA, 22 bp, Artificial Sequence
  chemically synthesized
gagaaatacttattattgtcct

SEQ ID NO: 1217876 - DNA, 22 bp, Artificial Sequence
  chemically synthesized
aaaatggacaaaggacaataat

SEQ ID NO: 1217877 - DNA, 22 bp, Artificial Sequence
  chemically synthesized
tgagaaatacttattattgtcc

SEQ ID NO: 1217878 - DNA, 22 bp, Artificial Sequence
  chemically synthesized
ttgagaaatacttattattgtc

SEQ ID NO: 1217879 - DNA, 22 bp, Artificial Sequence
  chemically synthesized
ttttgagaaatacttattattg

SEQ ID NO: 1217880 - DNA, 22 bp, Artificial Sequence
  chemically synthesized
cttttgagaaatacttattatt

SEQ ID NO: 1217881 - DNA, 22 bp, Artificial Sequence
  chemically synthesized
tcttcttttgagaaatacttat

SEQ ID NO: 1217882 - DNA, 22 bp, Artificial Sequence
  chemically synthesized
gtcttcttttgagaaatactta

SEQ ID NO: 1217883 - DNA, 22 bp, Artificial Sequence
  chemically synthesized
gtcatttgtcttcttttgagaa

SEQ ID NO: 1217884 - DNA, 22 bp, Artificial Sequence
  chemically synthesized
atatacccgttggtcatttgtc

SEQ ID NO: 1217885 - DNA, 22 bp, Artificial Sequence
  chemically synthesized
catatacccgttggtcatttgt

SEQ ID NO: 1217886 - DNA, 22 bp, Artificial Sequence
  chemically synthesized
ctcaaaagaagacaaatgacca

SEQ ID NO: 1217887 - DNA, 22 bp, Artificial Sequence
  chemically synthesized
tcatatacccgttggtcatttg

SEQ ID NO: 1217888 - DNA, 22 bp, Artificial Sequence
  chemically synthesized
tcaaaagaagacaaatgaccaa

SEQ ID NO: 1217889 - DNA, 22 bp, Artificial Sequence
  chemically synthesized
ttcatatacccgttggtcattt

SEQ ID NO: 1217890 - DNA, 22 bp, Artificial Sequence
  chemically synthesized
tttcatatacccgttggtcatt

SEQ ID NO: 1217891 - DNA, 22 bp, Artificial Sequence
  chemically synthesized
aaaagaagacaaatgaccaacg

SEQ ID NO: 1217892 - DNA, 22 bp, Artificial Sequence
  chemically synthesized
agcattttttcatatacccgtt

SEQ ID NO: 1217893 - DNA, 22 bp, Artificial Sequence
  chemically synthesized
gtgatgttgagcattttttcat

SEQ ID NO: 1217894 - DNA, 22 bp, Artificial Sequence
  chemically synthesized
atgattagtgatgttgagcatt

SEQ ID NO: 1217895 - DNA, 22 bp, Artificial Sequence
  chemically synthesized
cctaatgattagtgatgttgag

SEQ ID NO: 1217896 - DNA, 22 bp, Artificial Sequence
  chemically synthesized
ccctaatgattagtgatgttga

SEQ ID NO: 1217897 - DNA, 22 bp, Artificial Sequence
  chemically synthesized
catttccctaatgattagtgat

SEQ ID NO: 1217898 - DNA, 22 bp, Artificial Sequence
  chemically synthesized
gcatttccctaatgattagtga

SEQ ID NO: 1217899 - DNA, 22 bp, Artificial Sequence
  chemically synthesized
atttgcatttccctaatgatta

SEQ ID NO: 1217900 - DNA, 22 bp, Artificial Sequence
  chemically synthesized
gatttgcatttccctaatgatt

SEQ ID NO: 1217901 - DNA, 22 bp, Artificial Sequence
  chemically synthesized
aacatcactaatcattagggaa

SEQ ID NO: 1217902 - DNA, 22 bp, Artificial Sequence
  chemically synthesized
atcatgacttgatttgcatttc

SEQ ID NO: 1217903 - DNA, 22 bp, Artificial Sequence
  chemically synthesized
atcattagggaaatgcaaatca

SEQ ID NO: 1217904 - DNA, 22 bp, Artificial Sequence
  chemically synthesized
gggaaatgcaaatcaagtcatg

SEQ ID NO: 1217905 - DNA, 22 bp, Artificial Sequence
  chemically synthesized
gggcaagatgatggctcatcat

SEQ ID NO: 1217906 - DNA, 22 bp, Artificial Sequence
  chemically synthesized
actggggcaagatgatggctca

SEQ ID NO: 1217907 - DNA, 22 bp, Artificial Sequence
  chemically synthesized
taactggggcaagatgatggct

SEQ ID NO: 1217908 - DNA, 22 bp, Artificial Sequence
  chemically synthesized
ataatagccattctaactgggg

SEQ ID NO: 1217909 - DNA, 22 bp, Artificial Sequence
  chemically synthesized
aataatagccattctaactggg

SEQ ID NO: 1217910 - DNA, 22 bp, Artificial Sequence
  chemically synthesized
taataatagccattctaactgg

SEQ ID NO: 1217911 - DNA, 22 bp, Artificial Sequence
  chemically synthesized
ttaataatagccattctaactg

SEQ ID NO: 1217912 - DNA, 22 bp, Artificial Sequence
  chemically synthesized
tttaataatagccattctaact

SEQ ID NO: 1217913 - DNA, 22 bp, Artificial Sequence
  chemically synthesized
tctttttaataatagccattct

SEQ ID NO: 1217914 - DNA, 22 bp, Artificial Sequence
  chemically synthesized
gtctttttaataatagccattc

SEQ ID NO: 1217915 - DNA, 22 bp, Artificial Sequence
  chemically synthesized
gccccagttagaatggctatta

SEQ ID NO: 1217916 - DNA, 22 bp, Artificial Sequence
  chemically synthesized
ttgtctttttaataatagccat

SEQ ID NO: 1217917 - DNA, 22 bp, Artificial Sequence
  chemically synthesized
ccccagttagaatggctattat

SEQ ID NO: 1217918 - DNA, 22 bp, Artificial Sequence
  chemically synthesized
cttgtctttttaataatagcca

SEQ ID NO: 1217919 - DNA, 22 bp, Artificial Sequence
  chemically synthesized
tcttgtctttttaataatagcc

SEQ ID NO: 1217920 - DNA, 22 bp, Artificial Sequence
  chemically synthesized
ttttcttgtctttttaataata

SEQ ID NO: 1217921 - DNA, 22 bp, Artificial Sequence
  chemically synthesized
ttgttttcttgtctttttaata

SEQ ID NO: 1217922 - DNA, 22 bp, Artificial Sequence
  chemically synthesized
gaatggctattattaaaaagac

SEQ ID NO: 1217923 - DNA, 22 bp, Artificial Sequence
  chemically synthesized
ttattaaaaagacaagaaaaca

SEQ ID NO: 1217924 - DNA, 22 bp, Artificial Sequence
  chemically synthesized
gtcaacatctgttgttttcttg

SEQ ID NO: 1217925 - DNA, 22 bp, Artificial Sequence
  chemically synthesized
ttaaaaagacaagaaaacaaca

SEQ ID NO: 1217926 - DNA, 22 bp, Artificial Sequence
  chemically synthesized
aaaagacaagaaaacaacagat

SEQ ID NO: 1217927 - DNA, 22 bp, Artificial Sequence
  chemically synthesized
cacctcgtcaacatctgttgtt

SEQ ID NO: 1217928 - DNA, 22 bp, Artificial Sequence
  chemically synthesized
gttgcacctcgtcaacatctgt

SEQ ID NO: 1217929 - DNA, 22 bp, Artificial Sequence
  chemically synthesized
cgttgcacctcgtcaacatctg

SEQ ID NO: 1217930 - DNA, 22 bp, Artificial Sequence
  chemically synthesized
tcgttgcacctcgtcaacatct

SEQ ID NO: 1217931 - DNA, 22 bp, Artificial Sequence
  chemically synthesized
ttcgttgcacctcgtcaacatc

SEQ ID NO: 1217932 - DNA, 22 bp, Artificial Sequence
  chemically synthesized
ccttttcgttgcacctcgtcaa

SEQ ID NO: 1217933 - DNA, 22 bp, Artificial Sequence
  chemically synthesized
agagttcccttttcgttgcacc

SEQ ID NO: 1217934 - DNA, 22 bp, Artificial Sequence
  chemically synthesized
acgaggtgcaacgaaaagggaa

SEQ ID NO: 1217935 - DNA, 22 bp, Artificial Sequence
  chemically synthesized
caacaatgtattaagagttccc

SEQ ID NO: 1217936 - DNA, 22 bp, Artificial Sequence
  chemically synthesized
aactacaacaatgtattaagag

SEQ ID NO: 1217937 - DNA, 22 bp, Artificial Sequence
  chemically synthesized
tgaactacaacaatgtattaag

SEQ ID NO: 1217938 - DNA, 22 bp, Artificial Sequence
  chemically synthesized
tattctgaactacaacaatgta

SEQ ID NO: 1217939 - DNA, 22 bp, Artificial Sequence
  chemically synthesized
atattctgaactacaacaatgt

SEQ ID NO: 1217940 - DNA, 22 bp, Artificial Sequence
  chemically synthesized
acttatattctgaactacaaca

SEQ ID NO: 1217941 - DNA, 22 bp, Artificial Sequence
  chemically synthesized
ttaatacattgttgtagttcag

SEQ ID NO: 1217942 - DNA, 22 bp, Artificial Sequence
  chemically synthesized
aatacattgttgtagttcagaa

SEQ ID NO: 1217943 - DNA, 22 bp, Artificial Sequence
  chemically synthesized
tactgacttatattctgaacta

SEQ ID NO: 1217944 - DNA, 22 bp, Artificial Sequence
  chemically synthesized
atacattgttgtagttcagaat

SEQ ID NO: 1217945 - DNA, 22 bp, Artificial Sequence
  chemically synthesized
ttgtagttcagaatataagtca

SEQ ID NO: 1217946 - DNA, 22 bp, Artificial Sequence
  chemically synthesized
aatagtggctatactgacttat

SEQ ID NO: 1217947 - DNA, 22 bp, Artificial Sequence
  chemically synthesized
tagttcagaatataagtcagta

SEQ ID NO: 1217948 - DNA, 22 bp, Artificial Sequence
  chemically synthesized
caatagtggctatactgactta

SEQ ID NO: 1217949 - DNA, 22 bp, Artificial Sequence
  chemically synthesized
tcaatagtggctatactgactt

SEQ ID NO: 1217950 - DNA, 22 bp, Artificial Sequence
  chemically synthesized
ttttcaatagtggctatactga

SEQ ID NO: 1217951 - DNA, 22 bp, Artificial Sequence
  chemically synthesized
agaatataagtcagtatagcca

SEQ ID NO: 1217952 - DNA, 22 bp, Artificial Sequence
  chemically synthesized
catactgttttcaatagtggct

SEQ ID NO: 1217953 - DNA, 22 bp, Artificial Sequence
  chemically synthesized
tccatactgttttcaatagtgg

SEQ ID NO: 1217954 - DNA, 22 bp, Artificial Sequence
  chemically synthesized
ctccatactgttttcaatagtg

SEQ ID NO: 1217955 - DNA, 22 bp, Artificial Sequence
  chemically synthesized
agaaatcttctccatactgttt

SEQ ID NO: 1217956 - DNA, 22 bp, Artificial Sequence
  chemically synthesized
gagaaatcttctccatactgtt

SEQ ID NO: 1217957 - DNA, 22 bp, Artificial Sequence
  chemically synthesized
tgagaaatcttctccatactgt

SEQ ID NO: 1217958 - DNA, 22 bp, Artificial Sequence
  chemically synthesized
ttgagaaatcttctccatactg

SEQ ID NO: 1217959 - DNA, 22 bp, Artificial Sequence
  chemically synthesized
tttgagaaatcttctccatact

SEQ ID NO: 1217960 - DNA, 22 bp, Artificial Sequence
  chemically synthesized
ttgaaaacagtatggagaagat

SEQ ID NO: 1217961 - DNA, 22 bp, Artificial Sequence
  chemically synthesized
gttttttgagaaatcttctcca

SEQ ID NO: 1217962 - DNA, 22 bp, Artificial Sequence
  chemically synthesized
agttttttgagaaatcttctcc

SEQ ID NO: 1217963 - DNA, 22 bp, Artificial Sequence
  chemically synthesized
aaaacagtatggagaagatttc

SEQ ID NO: 1217964 - DNA, 22 bp, Artificial Sequence
  chemically synthesized
tgtttagttttttgagaaatct

SEQ ID NO: 1217965 - DNA, 22 bp, Artificial Sequence
  chemically synthesized
tatgtttagttttttgagaaat

SEQ ID NO: 1217966 - DNA, 22 bp, Artificial Sequence
  chemically synthesized
ctatgtttagttttttgagaaa

SEQ ID NO: 1217967 - DNA, 22 bp, Artificial Sequence
  chemically synthesized
tttctatgtttagttttttgag

SEQ ID NO: 1217968 - DNA, 22 bp, Artificial Sequence
  chemically synthesized
tatttctatgtttagttttttg

SEQ ID NO: 1217969 - DNA, 22 bp, Artificial Sequence
  chemically synthesized
ctcaaaaaactaaacatagaaa

SEQ ID NO: 1217970 - DNA, 22 bp, Artificial Sequence
  chemically synthesized
acacatactctatttctatgtt

SEQ ID NO: 1217971 - DNA, 22 bp, Artificial Sequence
  chemically synthesized
tcaaaaaactaaacatagaaat

SEQ ID NO: 1217972 - DNA, 22 bp, Artificial Sequence
  chemically synthesized
aaaaaactaaacatagaaatag

SEQ ID NO: 1217973 - DNA, 22 bp, Artificial Sequence
  chemically synthesized
ctgacacatactctatttctat

SEQ ID NO: 1217974 - DNA, 22 bp, Artificial Sequence
  chemically synthesized
aacatagaaatagagtatgtgt

SEQ ID NO: 1217975 - DNA, 22 bp, Artificial Sequence
  chemically synthesized
gtggcattgctgacacatactc

SEQ ID NO: 1217976 - DNA, 22 bp, Artificial Sequence
  chemically synthesized
ttagtggcattgctgacacata

SEQ ID NO: 1217977 - DNA, 22 bp, Artificial Sequence
  chemically synthesized
attagtggcattgctgacacat

SEQ ID NO: 1217978 - DNA, 22 bp, Artificial Sequence
  chemically synthesized
catatatacttattagtggcat

SEQ ID NO: 1217979 - DNA, 22 bp, Artificial Sequence
  chemically synthesized
acatatatacttattagtggca

SEQ ID NO: 1217980 - DNA, 22 bp, Artificial Sequence
  chemically synthesized
tacatatatacttattagtggc

SEQ ID NO: 1217981 - DNA, 22 bp, Artificial Sequence
  chemically synthesized
cctttacatatatacttattag

SEQ ID NO: 1217982 - DNA, 22 bp, Artificial Sequence
  chemically synthesized
ccctttacatatatacttatta

SEQ ID NO: 1217983 - DNA, 22 bp, Artificial Sequence
  chemically synthesized
tccctttacatatatacttatt

SEQ ID NO: 1217984 - DNA, 22 bp, Artificial Sequence
  chemically synthesized
ctttccctttacatatatactt

SEQ ID NO: 1217985 - DNA, 22 bp, Artificial Sequence
  chemically synthesized
ataagtatatatgtaaagggaa

SEQ ID NO: 1217986 - DNA, 22 bp, Artificial Sequence
  chemically synthesized
gaaaagtatatgattgctttcc

SEQ ID NO: 1217987 - DNA, 22 bp, Artificial Sequence
  chemically synthesized
atagttagaaaagtatatgatt

SEQ ID NO: 1217988 - DNA, 22 bp, Artificial Sequence
  chemically synthesized
ctgatagttagaaaagtatatg

SEQ ID NO: 1217989 - DNA, 22 bp, Artificial Sequence
  chemically synthesized
cctgatagttagaaaagtatat

SEQ ID NO: 1217990 - DNA, 22 bp, Artificial Sequence
  chemically synthesized
tcctgatagttagaaaagtata

SEQ ID NO: 1217991 - DNA, 22 bp, Artificial Sequence
  chemically synthesized
ttcctgatagttagaaaagtat

SEQ ID NO: 1217992 - DNA, 22 bp, Artificial Sequence
  chemically synthesized
ttctaactatcaggaaaagtat

SEQ ID NO: 1217993 - DNA, 22 bp, Artificial Sequence
  chemically synthesized
tctaactatcaggaaaagtata

SEQ ID NO: 1217994 - DNA, 22 bp, Artificial Sequence
  chemically synthesized
ctaactatcaggaaaagtatat

SEQ ID NO: 1217995 - DNA, 22 bp, Artificial Sequence
  chemically synthesized
taactatcaggaaaagtatatg

SEQ ID NO: 1217996 - DNA, 22 bp, Artificial Sequence
  chemically synthesized
actatcaggaaaagtatatgca

SEQ ID NO: 1217997 - DNA, 22 bp, Artificial Sequence
  chemically synthesized
tcaggaaaagtatatgcatggc

SEQ ID NO: 1217998 - DNA, 22 bp, Artificial Sequence
  chemically synthesized
aataagcatgcaagtacaggta

SEQ ID NO: 1217999 - DNA, 22 bp, Artificial Sequence
  chemically synthesized
taaatagtgcctcaataagcat

SEQ ID NO: 1218000 - DNA, 22 bp, Artificial Sequence
  chemically synthesized
ttataaatagtgcctcaataag

SEQ ID NO: 1218001 - DNA, 22 bp, Artificial Sequence
  chemically synthesized
tacttgcatgcttattgaggca

SEQ ID NO: 1218002 - DNA, 22 bp, Artificial Sequence
  chemically synthesized
ctattataaatagtgcctcaat

SEQ ID NO: 1218003 - DNA, 22 bp, Artificial Sequence
  chemically synthesized
gcatgcttattgaggcactatt

SEQ ID NO: 1218004 - DNA, 22 bp, Artificial Sequence
  chemically synthesized
catgcttattgaggcactattt

SEQ ID NO: 1218005 - DNA, 22 bp, Artificial Sequence
  chemically synthesized
agttgctattataaatagtgcc

SEQ ID NO: 1218006 - DNA, 22 bp, Artificial Sequence
  chemically synthesized
aagttgctattataaatagtgc

SEQ ID NO: 1218007 - DNA, 22 bp, Artificial Sequence
  chemically synthesized
attgaggcactatttataatag

SEQ ID NO: 1218008 - DNA, 22 bp, Artificial Sequence
  chemically synthesized
ttgaggcactatttataatagc

SEQ ID NO: 1218009 - DNA, 22 bp, Artificial Sequence
  chemically synthesized
aggcactatttataatagcaac

SEQ ID NO: 1218010 - DNA, 22 bp, Artificial Sequence
  chemically synthesized
atggacacttaagttgctatta

SEQ ID NO: 1218011 - DNA, 22 bp, Artificial Sequence
  chemically synthesized
actaatggacacttaagttgct

SEQ ID NO: 1218012 - DNA, 22 bp, Artificial Sequence
  chemically synthesized
ttcactaatggacacttaagtt

SEQ ID NO: 1218013 - DNA, 22 bp, Artificial Sequence
  chemically synthesized
tttataatagcaacttaagtgt

SEQ ID NO: 1218014 - DNA, 22 bp, Artificial Sequence
  chemically synthesized
gttcactaatggacacttaagt

SEQ ID NO: 1218015 - DNA, 22 bp, Artificial Sequence
  chemically synthesized
ataatagcaacttaagtgtcca

SEQ ID NO: 1218016 - DNA, 22 bp, Artificial Sequence
  chemically synthesized
taatagcaacttaagtgtccat

SEQ ID NO: 1218017 - DNA, 22 bp, Artificial Sequence
  chemically synthesized
tccatttgttcactaatggaca

SEQ ID NO: 1218018 - DNA, 22 bp, Artificial Sequence
  chemically synthesized
atccatttgttcactaatggac

SEQ ID NO: 1218019 - DNA, 22 bp, Artificial Sequence
  chemically synthesized
tatccatttgttcactaatgga

SEQ ID NO: 1218020 - DNA, 22 bp, Artificial Sequence
  chemically synthesized
tttatccatttgttcactaatg

SEQ ID NO: 1218021 - DNA, 22 bp, Artificial Sequence
  chemically synthesized
ctttatccatttgttcactaat

SEQ ID NO: 1218022 - DNA, 22 bp, Artificial Sequence
  chemically synthesized
tctttatccatttgttcactaa

SEQ ID NO: 1218023 - DNA, 22 bp, Artificial Sequence
  chemically synthesized
aagtgtccattagtgaacaaat

SEQ ID NO: 1218024 - DNA, 22 bp, Artificial Sequence
  chemically synthesized
agtgtccattagtgaacaaatg

SEQ ID NO: 1218025 - DNA, 22 bp, Artificial Sequence
  chemically synthesized
gtgaacaaatggataaagaaaa

SEQ ID NO: 1218026 - DNA, 22 bp, Artificial Sequence
  chemically synthesized
tatatatgtaccacattttctt

SEQ ID NO: 1218027 - DNA, 22 bp, Artificial Sequence
  chemically synthesized
cactgtatatatgtaccacatt

SEQ ID NO: 1218028 - DNA, 22 bp, Artificial Sequence
  chemically synthesized
tggatgaagagtattccactgt

SEQ ID NO: 1218029 - DNA, 22 bp, Artificial Sequence
  chemically synthesized
atggatgaagagtattccactg

SEQ ID NO: 1218030 - DNA, 22 bp, Artificial Sequence
  chemically synthesized
tatggatgaagagtattccact

SEQ ID NO: 1218031 - DNA, 22 bp, Artificial Sequence
  chemically synthesized
ttatggatgaagagtattccac

SEQ ID NO: 1218032 - DNA, 22 bp, Artificial Sequence
  chemically synthesized
tttatggatgaagagtattcca

SEQ ID NO: 1218033 - DNA, 22 bp, Artificial Sequence
  chemically synthesized
ttttatggatgaagagtattcc

SEQ ID NO: 1218034 - DNA, 22 bp, Artificial Sequence
  chemically synthesized
ttttttatggatgaagagtatt

SEQ ID NO: 1218035 - DNA, 22 bp, Artificial Sequence
  chemically synthesized
gtgcagaaaatgtaattctttt

SEQ ID NO: 1218036 - DNA, 22 bp, Artificial Sequence
  chemically synthesized
ttcatccataaaaaagaattac

SEQ ID NO: 1218037 - DNA, 22 bp, Artificial Sequence
  chemically synthesized
catccataaaaaagaattacat

SEQ ID NO: 1218038 - DNA, 22 bp, Artificial Sequence
  chemically synthesized
atccataaaaaagaattacatt

SEQ ID NO: 1218039 - DNA, 22 bp, Artificial Sequence
  chemically synthesized
atgttggtgcagaaaatgtaat

SEQ ID NO: 1218040 - DNA, 22 bp, Artificial Sequence
  chemically synthesized
attcatgttggtgcagaaaatg

SEQ ID NO: 1218041 - DNA, 22 bp, Artificial Sequence
  chemically synthesized
cattcatgttggtgcagaaaat

SEQ ID NO: 1218042 - DNA, 22 bp, Artificial Sequence
  chemically synthesized
cagtttcattcatgttggtgca

SEQ ID NO: 1218043 - DNA, 22 bp, Artificial Sequence
  chemically synthesized
cattttctgcaccaacatgaat

SEQ ID NO: 1218044 - DNA, 22 bp, Artificial Sequence
  chemically synthesized
ataacctgcagtttcattcatg

SEQ ID NO: 1218045 - DNA, 22 bp, Artificial Sequence
  chemically synthesized
aataacctgcagtttcattcat

SEQ ID NO: 1218046 - DNA, 22 bp, Artificial Sequence
  chemically synthesized
tctgcaccaacatgaatgaaac

SEQ ID NO: 1218047 - DNA, 22 bp, Artificial Sequence
  chemically synthesized
ctgcaccaacatgaatgaaact

SEQ ID NO: 1218048 - DNA, 22 bp, Artificial Sequence
  chemically synthesized
tgcaccaacatgaatgaaactg

SEQ ID NO: 1218049 - DNA, 22 bp, Artificial Sequence
  chemically synthesized
acttaataacctgcagtttcat

SEQ ID NO: 1218050 - DNA, 22 bp, Artificial Sequence
  chemically synthesized
caccaacatgaatgaaactgca

SEQ ID NO: 1218051 - DNA, 22 bp, Artificial Sequence
  chemically synthesized
tctcacttaataacctgcagtt

SEQ ID NO: 1218052 - DNA, 22 bp, Artificial Sequence
  chemically synthesized
gattgtctcacttaataacctg

SEQ ID NO: 1218053 - DNA, 22 bp, Artificial Sequence
  chemically synthesized
cctcgattgtctcacttaataa

SEQ ID NO: 1218054 - DNA, 22 bp, Artificial Sequence
  chemically synthesized
gcctcgattgtctcacttaata

SEQ ID NO: 1218055 - DNA, 22 bp, Artificial Sequence
  chemically synthesized
tgcctcgattgtctcacttaat

SEQ ID NO: 1218056 - DNA, 22 bp, Artificial Sequence
  chemically synthesized
tctttgcctcgattgtctcact

SEQ ID NO: 1218057 - DNA, 22 bp, Artificial Sequence
  chemically synthesized
atctttgcctcgattgtctcac

SEQ ID NO: 1218058 - DNA, 22 bp, Artificial Sequence
  chemically synthesized
caggttattaagtgagacaatc

SEQ ID NO: 1218059 - DNA, 22 bp, Artificial Sequence
  chemically synthesized
tttatctttgcctcgattgtct

SEQ ID NO: 1218060 - DNA, 22 bp, Artificial Sequence
  chemically synthesized
ttaagtgagacaatcgaggcaa

SEQ ID NO: 1218061 - DNA, 22 bp, Artificial Sequence
  chemically synthesized
agtgagacaatcgaggcaaaga

SEQ ID NO: 1218062 - DNA, 22 bp, Artificial Sequence
  chemically synthesized
tatatgagtaagaaaatgtaaa

SEQ ID NO: 1218063 - DNA, 22 bp, Artificial Sequence
  chemically synthesized
cacctatatatgagtaagaaaa

SEQ ID NO: 1218064 - DNA, 22 bp, Artificial Sequence
  chemically synthesized
acacctatatatgagtaagaaa

SEQ ID NO: 1218065 - DNA, 22 bp, Artificial Sequence
  chemically synthesized
tacacctatatatgagtaagaa

SEQ ID NO: 1218066 - DNA, 22 bp, Artificial Sequence
  chemically synthesized
ttacacctatatatgagtaaga

SEQ ID NO: 1218067 - DNA, 22 bp, Artificial Sequence
  chemically synthesized
tttacacctatatatgagtaag

SEQ ID NO: 1218068 - DNA, 22 bp, Artificial Sequence
  chemically synthesized
ttttacacctatatatgagtaa

SEQ ID NO: 1218069 - DNA, 22 bp, Artificial Sequence
  chemically synthesized
tttttacacctatatatgagta

SEQ ID NO: 1218070 - DNA, 22 bp, Artificial Sequence
  chemically synthesized
tacattttcttactcatatata

SEQ ID NO: 1218071 - DNA, 22 bp, Artificial Sequence
  chemically synthesized
acattttcttactcatatatag

SEQ ID NO: 1218072 - DNA, 22 bp, Artificial Sequence
  chemically synthesized
cattttcttactcatatatagg

SEQ ID NO: 1218073 - DNA, 22 bp, Artificial Sequence
  chemically synthesized
tcttactcatatataggtgtaa

SEQ ID NO: 1218074 - DNA, 22 bp, Artificial Sequence
  chemically synthesized
cttactcatatataggtgtaaa

SEQ ID NO: 1218075 - DNA, 22 bp, Artificial Sequence
  chemically synthesized
ttactcatatataggtgtaaaa

SEQ ID NO: 1218076 - DNA, 22 bp, Artificial Sequence
  chemically synthesized
actcatatataggtgtaaaaaa

SEQ ID NO: 1218077 - DNA, 22 bp, Artificial Sequence
  chemically synthesized
ctcatatataggtgtaaaaaaa

SEQ ID NO: 1218078 - DNA, 22 bp, Artificial Sequence
  chemically synthesized
catgagaacaactttttttaca

SEQ ID NO: 1218079 - DNA, 22 bp, Artificial Sequence
  chemically synthesized
ccatgagaacaactttttttac

SEQ ID NO: 1218080 - DNA, 22 bp, Artificial Sequence
  chemically synthesized
atatataggtgtaaaaaaagtt

SEQ ID NO: 1218081 - DNA, 22 bp, Artificial Sequence
  chemically synthesized
tttccatgagaacaactttttt

SEQ ID NO: 1218082 - DNA, 22 bp, Artificial Sequence
  chemically synthesized
tatttccatgagaacaactttt

SEQ ID NO: 1218083 - DNA, 22 bp, Artificial Sequence
  chemically synthesized
tctatttccatgagaacaactt

SEQ ID NO: 1218084 - DNA, 22 bp, Artificial Sequence
  chemically synthesized
tactctctatttccatgagaac

SEQ ID NO: 1218085 - DNA, 22 bp, Artificial Sequence
  chemically synthesized
ttatactctctatttccatgag

SEQ ID NO: 1218086 - DNA, 22 bp, Artificial Sequence
  chemically synthesized
attatactctctatttccatga

SEQ ID NO: 1218087 - DNA, 22 bp, Artificial Sequence
  chemically synthesized
gtatcttattatactctctatt

SEQ ID NO: 1218088 - DNA, 22 bp, Artificial Sequence
  chemically synthesized
ttctcatggaaatagagagtat

SEQ ID NO: 1218089 - DNA, 22 bp, Artificial Sequence
  chemically synthesized
tggtatcttattatactctcta

SEQ ID NO: 1218090 - DNA, 22 bp, Artificial Sequence
  chemically synthesized
tcatggaaatagagagtataat

SEQ ID NO: 1218091 - DNA, 22 bp, Artificial Sequence
  chemically synthesized
atggaaatagagagtataataa

SEQ ID NO: 1218092 - DNA, 22 bp, Artificial Sequence
  chemically synthesized
gcctctggtatcttattatact

SEQ ID NO: 1218093 - DNA, 22 bp, Artificial Sequence
  chemically synthesized
ctagcctctggtatcttattat

SEQ ID NO: 1218094 - DNA, 22 bp, Artificial Sequence
  chemically synthesized
cctagcctctggtatcttatta

SEQ ID NO: 1218095 - DNA, 22 bp, Artificial Sequence
  chemically synthesized
cccttcctagcctctggtatct

SEQ ID NO: 1218096 - DNA, 22 bp, Artificial Sequence
  chemically synthesized
ctacccttcctagcctctggta

SEQ ID NO: 1218097 - DNA, 22 bp, Artificial Sequence
  chemically synthesized
cctacccttcctagcctctggt

SEQ ID NO: 1218098 - DNA, 22 bp, Artificial Sequence
  chemically synthesized
ccttcctacccttcctagcctc

SEQ ID NO: 1218099 - DNA, 22 bp, Artificial Sequence
  chemically synthesized
tattcccttcctacccttccta

SEQ ID NO: 1218100 - DNA, 22 bp, Artificial Sequence
  chemically synthesized
atattcccttcctacccttcct

SEQ ID NO: 1218101 - DNA, 22 bp, Artificial Sequence
  chemically synthesized
tatattcccttcctacccttcc

SEQ ID NO: 1218102 - DNA, 22 bp, Artificial Sequence
  chemically synthesized
ttatattcccttcctacccttc

SEQ ID NO: 1218103 - DNA, 22 bp, Artificial Sequence
  chemically synthesized
tttatattcccttcctaccctt

SEQ ID NO: 1218104 - DNA, 22 bp, Artificial Sequence
  chemically synthesized
ggaagggtaggaagggaatata

SEQ ID NO: 1218105 - DNA, 22 bp, Artificial Sequence
  chemically synthesized
aataacccctttttatattccc

SEQ ID NO: 1218106 - DNA, 22 bp, Artificial Sequence
  chemically synthesized
tacccattaaataacccctttt

SEQ ID NO: 1218107 - DNA, 22 bp, Artificial Sequence
  chemically synthesized
gtacccattaaataaccccttt

SEQ ID NO: 1218108 - DNA, 22 bp, Artificial Sequence
  chemically synthesized
tatatttgtacccattaaataa

SEQ ID NO: 1218109 - DNA, 22 bp, Artificial Sequence
  chemically synthesized
caactatatatttgtacccatt

SEQ ID NO: 1218110 - DNA, 22 bp, Artificial Sequence
  chemically synthesized
ccaactatatatttgtacccat

SEQ ID NO: 1218111 - DNA, 22 bp, Artificial Sequence
  chemically synthesized
tttaatgggtacaaatatatag

SEQ ID NO: 1218112 - DNA, 22 bp, Artificial Sequence
  chemically synthesized
aatgggtacaaatatatagttg

SEQ ID NO: 1218113 - DNA, 22 bp, Artificial Sequence
  chemically synthesized
atgggtacaaatatatagttgg

SEQ ID NO: 1218114 - DNA, 22 bp, Artificial Sequence
  chemically synthesized
gaatatataccttccaactata

SEQ ID NO: 1218115 - DNA, 22 bp, Artificial Sequence
  chemically synthesized
aacattagaatatataccttcc

SEQ ID NO: 1218116 - DNA, 22 bp, Artificial Sequence
  chemically synthesized
ttgaacattagaatatatacct

SEQ ID NO: 1218117 - DNA, 22 bp, Artificial Sequence
  chemically synthesized
ctgttgaacattagaatatata

SEQ ID NO: 1218118 - DNA, 22 bp, Artificial Sequence
  chemically synthesized
tgctgttgaacattagaatata

SEQ ID NO: 1218119 - DNA, 22 bp, Artificial Sequence
  chemically synthesized
ctgctgttgaacattagaatat

SEQ ID NO: 1218120 - DNA, 22 bp, Artificial Sequence
  chemically synthesized
tctgctgttgaacattagaata

SEQ ID NO: 1218121 - DNA, 22 bp, Artificial Sequence
  chemically synthesized
gaaggtatatattctaatgttc

SEQ ID NO: 1218122 - DNA, 22 bp, Artificial Sequence
  chemically synthesized
gtcacccctttctgctgttgaa

SEQ ID NO: 1218123 - DNA, 22 bp, Artificial Sequence
  chemically synthesized
tagtcacccctttctgctgttg

SEQ ID NO: 1218124 - DNA, 22 bp, Artificial Sequence
  chemically synthesized
actctagtcacccctttctgct

SEQ ID NO: 1218125 - DNA, 22 bp, Artificial Sequence
  chemically synthesized
taatgttcaacagcagaaaggg

SEQ ID NO: 1218126 - DNA, 22 bp, Artificial Sequence
  chemically synthesized
atgttcaacagcagaaaggggt

SEQ ID NO: 1218127 - DNA, 22 bp, Artificial Sequence
  chemically synthesized
ctaactctagtcacccctttct

SEQ ID NO: 1218128 - DNA, 22 bp, Artificial Sequence
  chemically synthesized
ttgctaactctagtcacccctt

SEQ ID NO: 1218129 - DNA, 22 bp, Artificial Sequence
  chemically synthesized
aacagcagaaaggggtgactag

SEQ ID NO: 1218130 - DNA, 22 bp, Artificial Sequence
  chemically synthesized
aaatgtacatcatattgttgct

SEQ ID NO: 1218131 - DNA, 22 bp, Artificial Sequence
  chemically synthesized
gaaatgtacatcatattgttgc

SEQ ID NO: 1218132 - DNA, 22 bp, Artificial Sequence
  chemically synthesized
tgaaatgtacatcatattgttg

SEQ ID NO: 1218133 - DNA, 22 bp, Artificial Sequence
  chemically synthesized
ctttgaaatgtacatcatattg

SEQ ID NO: 1218134 - DNA, 22 bp, Artificial Sequence
  chemically synthesized
gagttagcaacaatatgatgta

SEQ ID NO: 1218135 - DNA, 22 bp, Artificial Sequence
  chemically synthesized
atctactttgaaatgtacatca

SEQ ID NO: 1218136 - DNA, 22 bp, Artificial Sequence
  chemically synthesized
tcatctactttgaaatgtacat

SEQ ID NO: 1218137 - DNA, 22 bp, Artificial Sequence
  chemically synthesized
gcaacaatatgatgtacatttc

SEQ ID NO: 1218138 - DNA, 22 bp, Artificial Sequence
  chemically synthesized
tctcatctactttgaaatgtac

SEQ ID NO: 1218139 - DNA, 22 bp, Artificial Sequence
  chemically synthesized
agttctctcatctactttgaaa

SEQ ID NO: 1218140 - DNA, 22 bp, Artificial Sequence
  chemically synthesized
gagttctctcatctactttgaa

SEQ ID NO: 1218141 - DNA, 22 bp, Artificial Sequence
  chemically synthesized
tgagttctctcatctactttga

SEQ ID NO: 1218142 - DNA, 22 bp, Artificial Sequence
  chemically synthesized
tgaacattttgagttctctcat

SEQ ID NO: 1218143 - DNA, 22 bp, Artificial Sequence
  chemically synthesized
tgtgaacattttgagttctctc

SEQ ID NO: 1218144 - DNA, 22 bp, Artificial Sequence
  chemically synthesized
caaagtagatgagagaactcaa

SEQ ID NO: 1218145 - DNA, 22 bp, Artificial Sequence
  chemically synthesized
aaagtagatgagagaactcaaa

SEQ ID NO: 1218146 - DNA, 22 bp, Artificial Sequence
  chemically synthesized
tgttctgtgaacattttgagtt

SEQ ID NO: 1218147 - DNA, 22 bp, Artificial Sequence
  chemically synthesized
atgttctgtgaacattttgagt

SEQ ID NO: 1218148 - DNA, 22 bp, Artificial Sequence
  chemically synthesized
tatgttctgtgaacattttgag

SEQ ID NO: 1218149 - DNA, 22 bp, Artificial Sequence
  chemically synthesized
ttatgttctgtgaacattttga

SEQ ID NO: 1218150 - DNA, 22 bp, Artificial Sequence
  chemically synthesized
tcatttttatgttctgtgaaca

SEQ ID NO: 1218151 - DNA, 22 bp, Artificial Sequence
  chemically synthesized
atcatttttatgttctgtgaac

SEQ ID NO: 1218152 - DNA, 22 bp, Artificial Sequence
  chemically synthesized
aaaatgttcacagaacataaaa

SEQ ID NO: 1218153 - DNA, 22 bp, Artificial Sequence
  chemically synthesized
agtatttatcatttttatgttc

SEQ ID NO: 1218154 - DNA, 22 bp, Artificial Sequence
  chemically synthesized
gagtatttatcatttttatgtt

SEQ ID NO: 1218155 - DNA, 22 bp, Artificial Sequence
  chemically synthesized
tgagtatttatcatttttatgt

SEQ ID NO: 1218156 - DNA, 22 bp, Artificial Sequence
  chemically synthesized
ctttgagtatttatcattttta

SEQ ID NO: 1218157 - DNA, 22 bp, Artificial Sequence
  chemically synthesized
acagaacataaaaatgataaat

SEQ ID NO: 1218158 - DNA, 22 bp, Artificial Sequence
  chemically synthesized
attactttgagtatttatcatt

SEQ ID NO: 1218159 - DNA, 22 bp, Artificial Sequence
  chemically synthesized
gggtattcattactttgagtat

SEQ ID NO: 1218160 - DNA, 22 bp, Artificial Sequence
  chemically synthesized
ggggtattcattactttgagta

SEQ ID NO: 1218161 - DNA, 22 bp, Artificial Sequence
  chemically synthesized
aaagtaatgaataccccaaata

SEQ ID NO: 1218162 - DNA, 22 bp, Artificial Sequence
  chemically synthesized
aatgtgtaatggtcaagtcagt

SEQ ID NO: 1218163 - DNA, 22 bp, Artificial Sequence
  chemically synthesized
aacgcactgaatgtgtaatggt

SEQ ID NO: 1218164 - DNA, 22 bp, Artificial Sequence
  chemically synthesized
ttaaacgcactgaatgtgtaat

SEQ ID NO: 1218165 - DNA, 22 bp, Artificial Sequence
  chemically synthesized
gttaaacgcactgaatgtgtaa

SEQ ID NO: 1218166 - DNA, 22 bp, Artificial Sequence
  chemically synthesized
tgttaaacgcactgaatgtgta

SEQ ID NO: 1218167 - DNA, 22 bp, Artificial Sequence
  chemically synthesized
acttgaccattacacattcagt

SEQ ID NO: 1218168 - DNA, 22 bp, Artificial Sequence
  chemically synthesized
gaccattacacattcagtgcgt

SEQ ID NO: 1218169 - DNA, 22 bp, Artificial Sequence
  chemically synthesized
accattacacattcagtgcgtt

SEQ ID NO: 1218170 - DNA, 22 bp, Artificial Sequence
  chemically synthesized
cacattcagtgcgtttaacaaa

SEQ ID NO: 1218171 - DNA, 22 bp, Artificial Sequence
  chemically synthesized
agtgcgtttaacaaaatatcac

SEQ ID NO: 1218172 - DNA, 22 bp, Artificial Sequence
  chemically synthesized
catatatgtacatacatgtgat

SEQ ID NO: 1218173 - DNA, 22 bp, Artificial Sequence
  chemically synthesized
acatatatgtacatacatgtga

SEQ ID NO: 1218174 - DNA, 22 bp, Artificial Sequence
  chemically synthesized
tacatatatgtacatacatgtg

SEQ ID NO: 1218175 - DNA, 22 bp, Artificial Sequence
  chemically synthesized
aacaaaatatcacatgtatgta

SEQ ID NO: 1218176 - DNA, 22 bp, Artificial Sequence
  chemically synthesized
acaaaatatcacatgtatgtac

SEQ ID NO: 1218177 - DNA, 22 bp, Artificial Sequence
  chemically synthesized
atgcataacgttttacatatat

SEQ ID NO: 1218178 - DNA, 22 bp, Artificial Sequence
  chemically synthesized
ttgatgcataacgttttacata

SEQ ID NO: 1218179 - DNA, 22 bp, Artificial Sequence
  chemically synthesized
attgatgcataacgttttacat

SEQ ID NO: 1218180 - DNA, 22 bp, Artificial Sequence
  chemically synthesized
tattgatgcataacgttttaca

SEQ ID NO: 1218181 - DNA, 22 bp, Artificial Sequence
  chemically synthesized
ttattgatgcataacgttttac

SEQ ID NO: 1218182 - DNA, 22 bp, Artificial Sequence
  chemically synthesized
tttttattgatgcataacgttt

SEQ ID NO: 1218183 - DNA, 22 bp, Artificial Sequence
  chemically synthesized
atttttattgatgcataacgtt

SEQ ID NO: 1218184 - DNA, 22 bp, Artificial Sequence
  chemically synthesized
tatttttattgatgcataacgt

SEQ ID NO: 1218185 - DNA, 22 bp, Artificial Sequence
  chemically synthesized
ttatttttattgatgcataacg

SEQ ID NO: 1218186 - DNA, 22 bp, Artificial Sequence
  chemically synthesized
gaacttttatttttattgatgc

SEQ ID NO: 1218187 - DNA, 22 bp, Artificial Sequence
  chemically synthesized
agaacttttatttttattgatg

SEQ ID NO: 1218188 - DNA, 22 bp, Artificial Sequence
  chemically synthesized
tagaacttttatttttattgat

SEQ ID NO: 1218189 - DNA, 22 bp, Artificial Sequence
  chemically synthesized
ttagaacttttatttttattga

SEQ ID NO: 1218190 - DNA, 22 bp, Artificial Sequence
  chemically synthesized
tttagaacttttatttttattg

SEQ ID NO: 1218191 - DNA, 22 bp, Artificial Sequence
  chemically synthesized
tttttagaacttttatttttat

SEQ ID NO: 1218192 - DNA, 22 bp, Artificial Sequence
  chemically synthesized
tctttttagaacttttattttt

SEQ ID NO: 1218193 - DNA, 22 bp, Artificial Sequence
  chemically synthesized
tgcatcaataaaaataaaagtt

SEQ ID NO: 1218194 - DNA, 22 bp, Artificial Sequence
  chemically synthesized
ttctctttttagaacttttatt

SEQ ID NO: 1218195 - DNA, 22 bp, Artificial Sequence
  chemically synthesized
attctctttttagaacttttat

SEQ ID NO: 1218196 - DNA, 22 bp, Artificial Sequence
  chemically synthesized
gatttattctctttttagaact

SEQ ID NO: 1218197 - DNA, 22 bp, Artificial Sequence
  chemically synthesized
agatttattctctttttagaac

SEQ ID NO: 1218198 - DNA, 22 bp, Artificial Sequence
  chemically synthesized
ttagatttattctctttttaga

SEQ ID NO: 1218199 - DNA, 22 bp, Artificial Sequence
  chemically synthesized
tcctcttagatttattctcttt

SEQ ID NO: 1218200 - DNA, 22 bp, Artificial Sequence
  chemically synthesized
taaaaagagaataaatctaaga

SEQ ID NO: 1218201 - DNA, 22 bp, Artificial Sequence
  chemically synthesized
aaaagagaataaatctaagagg

SEQ ID NO: 1218202 - DNA, 22 bp, Artificial Sequence
  chemically synthesized
aagcaataagctatcctcttag

SEQ ID NO: 1218203 - DNA, 22 bp, Artificial Sequence
  chemically synthesized
aaagcaataagctatcctctta

SEQ ID NO: 1218204 - DNA, 22 bp, Artificial Sequence
  chemically synthesized
taaagcaataagctatcctctt

SEQ ID NO: 1218205 - DNA, 22 bp, Artificial Sequence
  chemically synthesized
ttttaaagcaataagctatcct

SEQ ID NO: 1218206 - DNA, 22 bp, Artificial Sequence
  chemically synthesized
attttaaagcaataagctatcc

SEQ ID NO: 1218207 - DNA, 22 bp, Artificial Sequence
  chemically synthesized
tattttaaagcaataagctatc

SEQ ID NO: 1218208 - DNA, 22 bp, Artificial Sequence
  chemically synthesized
tcattttattttaaagcaataa

SEQ ID NO: 1218209 - DNA, 22 bp, Artificial Sequence
  chemically synthesized
gtcattttattttaaagcaata

SEQ ID NO: 1218210 - DNA, 22 bp, Artificial Sequence
  chemically synthesized
agaggatagcttattgctttaa

SEQ ID NO: 1218211 - DNA, 22 bp, Artificial Sequence
  chemically synthesized
tcttgtcattttattttaaagc

SEQ ID NO: 1218212 - DNA, 22 bp, Artificial Sequence
  chemically synthesized
tagttgtcttgtcattttattt

SEQ ID NO: 1218213 - DNA, 22 bp, Artificial Sequence
  chemically synthesized
atagttgtcttgtcattttatt

SEQ ID NO: 1218214 - DNA, 22 bp, Artificial Sequence
  chemically synthesized
attgctttaaaataaaatgaca

SEQ ID NO: 1218215 - DNA, 22 bp, Artificial Sequence
  chemically synthesized
ttgctttaaaataaaatgacaa

SEQ ID NO: 1218216 - DNA, 22 bp, Artificial Sequence
  chemically synthesized
ctttaaaataaaatgacaagac

SEQ ID NO: 1218217 - DNA, 22 bp, Artificial Sequence
  chemically synthesized
aagatttatagttgtcttgtca

SEQ ID NO: 1218218 - DNA, 22 bp, Artificial Sequence
  chemically synthesized
taaaataaaatgacaagacaac

SEQ ID NO: 1218219 - DNA, 22 bp, Artificial Sequence
  chemically synthesized
aaaataaaatgacaagacaact

SEQ ID NO: 1218220 - DNA, 22 bp, Artificial Sequence
  chemically synthesized
aaataaaatgacaagacaacta

SEQ ID NO: 1218221 - DNA, 22 bp, Artificial Sequence
  chemically synthesized
cagagggaaacctgaagattta

SEQ ID NO: 1218222 - DNA, 22 bp, Artificial Sequence
  chemically synthesized
gcagagggaaacctgaagattt

SEQ ID NO: 1218223 - DNA, 22 bp, Artificial Sequence
  chemically synthesized
cttgcagagggaaacctgaaga

SEQ ID NO: 1218224 - DNA, 22 bp, Artificial Sequence
  chemically synthesized
ttccttgcagagggaaacctga

SEQ ID NO: 1218225 - DNA, 22 bp, Artificial Sequence
  chemically synthesized
attccttgcagagggaaacctg

SEQ ID NO: 1218226 - DNA, 22 bp, Artificial Sequence
  chemically synthesized
taaatcttcaggtttccctctg

SEQ ID NO: 1218227 - DNA, 22 bp, Artificial Sequence
  chemically synthesized
caggtttccctctgcaaggaat

SEQ ID NO: 1218228 - DNA, 22 bp, Artificial Sequence
  chemically synthesized
aggtttccctctgcaaggaata

SEQ ID NO: 1218229 - DNA, 22 bp, Artificial Sequence
  chemically synthesized
tcatacaataggatttattcct

SEQ ID NO: 1218230 - DNA, 22 bp, Artificial Sequence
  chemically synthesized
ccctctgcaaggaataaatcct

SEQ ID NO: 1218231 - DNA, 22 bp, Artificial Sequence
  chemically synthesized
cctctgcaaggaataaatccta

SEQ ID NO: 1218232 - DNA, 22 bp, Artificial Sequence
  chemically synthesized
attgtcatacaataggatttat

SEQ ID NO: 1218233 - DNA, 22 bp, Artificial Sequence
  chemically synthesized
aattgtcatacaataggattta

SEQ ID NO: 1218234 - DNA, 22 bp, Artificial Sequence
  chemically synthesized
tgcaaggaataaatcctattgt

SEQ ID NO: 1218235 - DNA, 22 bp, Artificial Sequence
  chemically synthesized
caaggaataaatcctattgtat

SEQ ID NO: 1218236 - DNA, 22 bp, Artificial Sequence
  chemically synthesized
taagagggaaatttaattgtca

SEQ ID NO: 1218237 - DNA, 22 bp, Artificial Sequence
  chemically synthesized
ataagagggaaatttaattgtc

SEQ ID NO: 1218238 - DNA, 22 bp, Artificial Sequence
  chemically synthesized
ttgtatgacaattaaatttccc

SEQ ID NO: 1218239 - DNA, 22 bp, Artificial Sequence
  chemically synthesized
aatcttataagagggaaattta

SEQ ID NO: 1218240 - DNA, 22 bp, Artificial Sequence
  chemically synthesized
aaatcttataagagggaaattt

SEQ ID NO: 1218241 - DNA, 22 bp, Artificial Sequence
  chemically synthesized
tatgacaattaaatttccctct

SEQ ID NO: 1218242 - DNA, 22 bp, Artificial Sequence
  chemically synthesized
atgtcatttaaatcttataaga

SEQ ID NO: 1218243 - DNA, 22 bp, Artificial Sequence
  chemically synthesized
ttgatgtcatttaaatcttata

SEQ ID NO: 1218244 - DNA, 22 bp, Artificial Sequence
  chemically synthesized
aatttccctcttataagattta

SEQ ID NO: 1218245 - DNA, 22 bp, Artificial Sequence
  chemically synthesized
gttgatgtcatttaaatcttat

SEQ ID NO: 1218246 - DNA, 22 bp, Artificial Sequence
  chemically synthesized
tgttgatgtcatttaaatctta

SEQ ID NO: 1218247 - DNA, 22 bp, Artificial Sequence
  chemically synthesized
ccctcttataagatttaaatga

SEQ ID NO: 1218248 - DNA, 22 bp, Artificial Sequence
  chemically synthesized
cctcttataagatttaaatgac

SEQ ID NO: 1218249 - DNA, 22 bp, Artificial Sequence
  chemically synthesized
aagtctttgttgatgtcattta

SEQ ID NO: 1218250 - DNA, 22 bp, Artificial Sequence
  chemically synthesized
ttataagatttaaatgacatca

SEQ ID NO: 1218251 - DNA, 22 bp, Artificial Sequence
  chemically synthesized
ataagatttaaatgacatcaac

SEQ ID NO: 1218252 - DNA, 22 bp, Artificial Sequence
  chemically synthesized
taagatttaaatgacatcaaca

SEQ ID NO: 1218253 - DNA, 22 bp, Artificial Sequence
  chemically synthesized
aaatgacatcaacaaagacttt

SEQ ID NO: 1218254 - DNA, 22 bp, Artificial Sequence
  chemically synthesized
aatgacatcaacaaagacttta

SEQ ID NO: 1218255 - DNA, 22 bp, Artificial Sequence
  chemically synthesized
ggtaaaataatgatgaactaaa

SEQ ID NO: 1218256 - DNA, 22 bp, Artificial Sequence
  chemically synthesized
gggtaaaataatgatgaactaa

SEQ ID NO: 1218257 - DNA, 22 bp, Artificial Sequence
  chemically synthesized
caacaatatttgggtaaaataa

SEQ ID NO: 1218258 - DNA, 22 bp, Artificial Sequence
  chemically synthesized
acaacaatatttgggtaaaata

SEQ ID NO: 1218259 - DNA, 22 bp, Artificial Sequence
  chemically synthesized
tagttcatcattattttaccca

SEQ ID NO: 1218260 - DNA, 22 bp, Artificial Sequence
  chemically synthesized
tacaacaatatttgggtaaaat

SEQ ID NO: 1218261 - DNA, 22 bp, Artificial Sequence
  chemically synthesized
agttcatcattattttacccaa

SEQ ID NO: 1218262 - DNA, 22 bp, Artificial Sequence
  chemically synthesized
gttcatcattattttacccaaa

SEQ ID NO: 1218263 - DNA, 22 bp, Artificial Sequence
  chemically synthesized
ttttacaacaatatttgggtaa

SEQ ID NO: 1218264 - DNA, 22 bp, Artificial Sequence
  chemically synthesized
atcattattttacccaaatatt

SEQ ID NO: 1218265 - DNA, 22 bp, Artificial Sequence
  chemically synthesized
ttttacccaaatattgttgtaa

SEQ ID NO: 1218266 - DNA, 22 bp, Artificial Sequence
  chemically synthesized
tacccaaatattgttgtaaaat

SEQ ID NO: 1218267 - DNA, 22 bp, Artificial Sequence
  chemically synthesized
acccaaatattgttgtaaaata

SEQ ID NO: 1218268 - DNA, 22 bp, Artificial Sequence
  chemically synthesized
cccaaatattgttgtaaaatag

SEQ ID NO: 1218269 - DNA, 22 bp, Artificial Sequence
  chemically synthesized
ttgtaaaatagtatattttcat

SEQ ID NO: 1218270 - DNA, 22 bp, Artificial Sequence
  chemically synthesized
taaaatagtatattttcatctt

SEQ ID NO: 1218271 - DNA, 22 bp, Artificial Sequence
  chemically synthesized
gaacatgaaatataagatgaaa

SEQ ID NO: 1218272 - DNA, 22 bp, Artificial Sequence
  chemically synthesized
cagctggaacatgaaatataag

SEQ ID NO: 1218273 - DNA, 22 bp, Artificial Sequence
  chemically synthesized
acagctggaacatgaaatataa

SEQ ID NO: 1218274 - DNA, 22 bp, Artificial Sequence
  chemically synthesized
tacagctggaacatgaaatata

SEQ ID NO: 1218275 - DNA, 22 bp, Artificial Sequence
  chemically synthesized
tcatcttatatttcatgttcca

SEQ ID NO: 1218276 - DNA, 22 bp, Artificial Sequence
  chemically synthesized
catcttatatttcatgttccag

SEQ ID NO: 1218277 - DNA, 22 bp, Artificial Sequence
  chemically synthesized
atcttatatttcatgttccagc

SEQ ID NO: 1218278 - DNA, 22 bp, Artificial Sequence
  chemically synthesized
atatttcatgttccagctgtaa

SEQ ID NO: 1218279 - DNA, 22 bp, Artificial Sequence
  chemically synthesized
tatttcatgttccagctgtaaa

SEQ ID NO: 1218280 - DNA, 22 bp, Artificial Sequence
  chemically synthesized
catgttccagctgtaaaatgtc

SEQ ID NO: 1218281 - DNA, 22 bp, Artificial Sequence
  chemically synthesized
atgttccagctgtaaaatgtca

SEQ ID NO: 1218282 - DNA, 22 bp, Artificial Sequence
  chemically synthesized
tatataaaatgcatgtgacatt

SEQ ID NO: 1218283 - DNA, 22 bp, Artificial Sequence
  chemically synthesized
tatatataaaatgcatgtgaca

SEQ ID NO: 1218284 - DNA, 22 bp, Artificial Sequence
  chemically synthesized
cagctgtaaaatgtcacatgca

SEQ ID NO: 1218285 - DNA, 22 bp, Artificial Sequence
  chemically synthesized
ctatatataaaatgcatgtgac

SEQ ID NO: 1218286 - DNA, 22 bp, Artificial Sequence
  chemically synthesized
taaaatgtcacatgcattttat

SEQ ID NO: 1218287 - DNA, 22 bp, Artificial Sequence
  chemically synthesized
aataatttctatatataaaatg

SEQ ID NO: 1218288 - DNA, 22 bp, Artificial Sequence
  chemically synthesized
caattaaataatttctatatat

SEQ ID NO: 1218289 - DNA, 22 bp, Artificial Sequence
  chemically synthesized
ccaattaaataatttctatata

SEQ ID NO: 1218290 - DNA, 22 bp, Artificial Sequence
  chemically synthesized
tccaattaaataatttctatat

SEQ ID NO: 1218291 - DNA, 22 bp, Artificial Sequence
  chemically synthesized
tatatatagaaattatttaatt

SEQ ID NO: 1218292 - DNA, 22 bp, Artificial Sequence
  chemically synthesized
atatatagaaattatttaattg

SEQ ID NO: 1218293 - DNA, 22 bp, Artificial Sequence
  chemically synthesized
tatatagaaattatttaattgg

SEQ ID NO: 1218294 - DNA, 22 bp, Artificial Sequence
  chemically synthesized
gtacatatgttttccaattaaa

SEQ ID NO: 1218295 - DNA, 22 bp, Artificial Sequence
  chemically synthesized
ggttggtacatatgttttccaa

SEQ ID NO: 1218296 - DNA, 22 bp, Artificial Sequence
  chemically synthesized
tttaattggaaaacatatgtac

SEQ ID NO: 1218297 - DNA, 22 bp, Artificial Sequence
  chemically synthesized
aattggaaaacatatgtaccaa

SEQ ID NO: 1218298 - DNA, 22 bp, Artificial Sequence
  chemically synthesized
attggaaaacatatgtaccaac

SEQ ID NO: 1218299 - DNA, 22 bp, Artificial Sequence
  chemically synthesized
gaaaacatatgtaccaacctaa

SEQ ID NO: 1218300 - DNA, 22 bp, Artificial Sequence
  chemically synthesized
gaaaaatagatattaggttggt

SEQ ID NO: 1218301 - DNA, 22 bp, Artificial Sequence
  chemically synthesized
ggcactggaaaaatagatatta

SEQ ID NO: 1218302 - DNA, 22 bp, Artificial Sequence
  chemically synthesized
aagctgggcactggaaaaatag

SEQ ID NO: 1218303 - DNA, 22 bp, Artificial Sequence
  chemically synthesized
aaagctgggcactggaaaaata

SEQ ID NO: 1218304 - DNA, 22 bp, Artificial Sequence
  chemically synthesized
atatctatttttccagtgccca

SEQ ID NO: 1218305 - DNA, 22 bp, Artificial Sequence
  chemically synthesized
tttttccagtgcccagctttaa

SEQ ID NO: 1218306 - DNA, 22 bp, Artificial Sequence
  chemically synthesized
ttccagtgcccagctttaaggt

SEQ ID NO: 1218307 - DNA, 22 bp, Artificial Sequence
  chemically synthesized
tccagtgcccagctttaaggtt

SEQ ID NO: 1218308 - DNA, 22 bp, Artificial Sequence
  chemically synthesized
ccagtgcccagctttaaggttt

SEQ ID NO: 1218309 - DNA, 22 bp, Artificial Sequence
  chemically synthesized
cagtgcccagctttaaggtttt

SEQ ID NO: 1218310 - DNA, 22 bp, Artificial Sequence
  chemically synthesized
caaatgaatatccaaaaacctt

SEQ ID NO: 1218311 - DNA, 22 bp, Artificial Sequence
  chemically synthesized
taaggtttttggatattcattt

SEQ ID NO: 1218312 - DNA, 22 bp, Artificial Sequence
  chemically synthesized
aaggtttttggatattcatttg

SEQ ID NO: 1218313 - DNA, 22 bp, Artificial Sequence
  chemically synthesized
aggtttttggatattcatttgc

SEQ ID NO: 1218314 - DNA, 22 bp, Artificial Sequence
  chemically synthesized
ttggatattcatttgcaggttc

SEQ ID NO: 1218315 - DNA, 22 bp, Artificial Sequence
  chemically synthesized
tggatattcatttgcaggttct

SEQ ID NO: 1218316 - DNA, 22 bp, Artificial Sequence
  chemically synthesized
ggatattcatttgcaggttctg

SEQ ID NO: 1218317 - DNA, 22 bp, Artificial Sequence
  chemically synthesized
gatattcatttgcaggttctgt

SEQ ID NO: 1218318 - DNA, 22 bp, Artificial Sequence
  chemically synthesized
atttgcaggttctgtgatgtct

SEQ ID NO: 1218319 - DNA, 22 bp, Artificial Sequence
  chemically synthesized
gcaggttctgtgatgtcttttt

SEQ ID NO: 1218320 - DNA, 22 bp, Artificial Sequence
  chemically synthesized
caggttctgtgatgtctttttt

SEQ ID NO: 1218321 - DNA, 22 bp, Artificial Sequence
  chemically synthesized
tgtgatgtctttttttgtttgt

SEQ ID NO: 1218322 - DNA, 22 bp, Artificial Sequence
  chemically synthesized
tgatgtctttttttgtttgttt

SEQ ID NO: 1218323 - DNA, 22 bp, Artificial Sequence
  chemically synthesized
tccccccatcccacaaaaacaa

SEQ ID NO: 1218324 - DNA, 22 bp, Artificial Sequence
  chemically synthesized
tttttgtttgtttttgtgggat

SEQ ID NO: 1218325 - DNA, 22 bp, Artificial Sequence
  chemically synthesized
ttttgtttgtttttgtgggatg

SEQ ID NO: 1218326 - DNA, 22 bp, Artificial Sequence
  chemically synthesized
tttgtttgtttttgtgggatgg

SEQ ID NO: 1218327 - DNA, 22 bp, Artificial Sequence
  chemically synthesized
ttgtttgtttttgtgggatggg

SEQ ID NO: 1218328 - DNA, 22 bp, Artificial Sequence
  chemically synthesized
aggccctgtccccccatcccac

SEQ ID NO: 1218329 - DNA, 22 bp, Artificial Sequence
  chemically synthesized
tgtttgtttttgtgggatgggg

SEQ ID NO: 1218330 - DNA, 22 bp, Artificial Sequence
  chemically synthesized
gtttgtttttgtgggatggggg

SEQ ID NO: 1218331 - DNA, 22 bp, Artificial Sequence
  chemically synthesized
tttgtttttgtgggatgggggg

SEQ ID NO: 1218332 - DNA, 22 bp, Artificial Sequence
  chemically synthesized
gtttttgtgggatggggggaca

SEQ ID NO: 1218333 - DNA, 22 bp, Artificial Sequence
  chemically synthesized
tttttgtgggatggggggacag

SEQ ID NO: 1218334 - DNA, 22 bp, Artificial Sequence
  chemically synthesized
ttgtgggatggggggacagggc

SEQ ID NO: 1218335 - DNA, 22 bp, Artificial Sequence
  chemically synthesized
tgtgggatggggggacagggcc

SEQ ID NO: 1218336 - DNA, 22 bp, Artificial Sequence
  chemically synthesized
gtgggatggggggacagggcct

SEQ ID NO: 1218337 - DNA, 22 bp, Artificial Sequence
  chemically synthesized
tgggatggggggacagggcctc

SEQ ID NO: 1218338 - DNA, 22 bp, Artificial Sequence
  chemically synthesized
ggcaaaagaactgaggccctgt

SEQ ID NO: 1218339 - DNA, 22 bp, Artificial Sequence
  chemically synthesized
aagcctaggcaaaagaactgag

SEQ ID NO: 1218340 - DNA, 22 bp, Artificial Sequence
  chemically synthesized
tcaagcctaggcaaaagaactg

SEQ ID NO: 1218341 - DNA, 22 bp, Artificial Sequence
  chemically synthesized
ctctcaagcctaggcaaaagaa

SEQ ID NO: 1218342 - DNA, 22 bp, Artificial Sequence
  chemically synthesized
tgccactactctcaagcctagg

SEQ ID NO: 1218343 - DNA, 22 bp, Artificial Sequence
  chemically synthesized
agttcttttgcctaggcttgag

SEQ ID NO: 1218344 - DNA, 22 bp, Artificial Sequence
  chemically synthesized
tgattgtgccactactctcaag

SEQ ID NO: 1218345 - DNA, 22 bp, Artificial Sequence
  chemically synthesized
ttttgcctaggcttgagagtag

SEQ ID NO: 1218346 - DNA, 22 bp, Artificial Sequence
  chemically synthesized
ttgcctaggcttgagagtagtg

SEQ ID NO: 1218347 - DNA, 22 bp, Artificial Sequence
  chemically synthesized
tgcctaggcttgagagtagtgg

SEQ ID NO: 1218348 - DNA, 22 bp, Artificial Sequence
  chemically synthesized
gcctaggcttgagagtagtggc

SEQ ID NO: 1218349 - DNA, 22 bp, Artificial Sequence
  chemically synthesized
cctaggcttgagagtagtggca

SEQ ID NO: 1218350 - DNA, 22 bp, Artificial Sequence
  chemically synthesized
ggcttgagagtagtggcacaat

SEQ ID NO: 1218351 - DNA, 22 bp, Artificial Sequence
  chemically synthesized
cggtgagctatgattgtgccac

SEQ ID NO: 1218352 - DNA, 22 bp, Artificial Sequence
  chemically synthesized
gagagtagtggcacaatcatag

SEQ ID NO: 1218353 - DNA, 22 bp, Artificial Sequence
  chemically synthesized
agagtagtggcacaatcatagc

SEQ ID NO: 1218354 - DNA, 22 bp, Artificial Sequence
  chemically synthesized
aaggctgcggtgagctatgatt

SEQ ID NO: 1218355 - DNA, 22 bp, Artificial Sequence
  chemically synthesized
ggccaggagttcaaggctgcgg

SEQ ID NO: 1218356 - DNA, 22 bp, Artificial Sequence
  chemically synthesized
aggccaggagttcaaggctgcg

SEQ ID NO: 1218357 - DNA, 22 bp, Artificial Sequence
  chemically synthesized
taggccaggagttcaaggctgc

SEQ ID NO: 1218358 - DNA, 22 bp, Artificial Sequence
  chemically synthesized
ctttaggccaggagttcaaggc

SEQ ID NO: 1218359 - DNA, 22 bp, Artificial Sequence
  chemically synthesized
accgcagccttgaactcctggc

SEQ ID NO: 1218360 - DNA, 22 bp, Artificial Sequence
  chemically synthesized
gaactcctggcctaaagcaatt

SEQ ID NO: 1218361 - DNA, 22 bp, Artificial Sequence
  chemically synthesized
aactcctggcctaaagcaattc

SEQ ID NO: 1218362 - DNA, 22 bp, Artificial Sequence
  chemically synthesized
ggaggccaaggcaggagaattg

SEQ ID NO: 1218363 - DNA, 22 bp, Artificial Sequence
  chemically synthesized
ctggcctaaagcaattctcctg

SEQ ID NO: 1218364 - DNA, 22 bp, Artificial Sequence
  chemically synthesized
gcctaaagcaattctcctgcct

SEQ ID NO: 1218365 - DNA, 22 bp, Artificial Sequence
  chemically synthesized
aagcaattctcctgccttggcc

SEQ ID NO: 1218366 - DNA, 22 bp, Artificial Sequence
  chemically synthesized
taatcccagcacattgggaggc

SEQ ID NO: 1218367 - DNA, 22 bp, Artificial Sequence
  chemically synthesized
tcctgccttggcctcccaatgt

SEQ ID NO: 1218368 - DNA, 22 bp, Artificial Sequence
  chemically synthesized
ctgccttggcctcccaatgtgc

SEQ ID NO: 1218369 - DNA, 22 bp, Artificial Sequence
  chemically synthesized
ccttggcctcccaatgtgctgg

SEQ ID NO: 1218370 - DNA, 22 bp, Artificial Sequence
  chemically synthesized
acacctgtaatcccagcacatt

SEQ ID NO: 1218371 - DNA, 22 bp, Artificial Sequence
  chemically synthesized
ggcctcccaatgtgctgggatt

SEQ ID NO: 1218372 - DNA, 22 bp, Artificial Sequence
  chemically synthesized
gcctcccaatgtgctgggatta

SEQ ID NO: 1218373 - DNA, 22 bp, Artificial Sequence
  chemically synthesized
ccaatgtgctgggattacaggt

SEQ ID NO: 1218374 - DNA, 22 bp, Artificial Sequence
  chemically synthesized
ggtgtgatggctgacacctgta

SEQ ID NO: 1218375 - DNA, 22 bp, Artificial Sequence
  chemically synthesized
ggattacaggtgtcagccatca

SEQ ID NO: 1218376 - DNA, 22 bp, Artificial Sequence
  chemically synthesized
caggtgtcagccatcacaccca

SEQ ID NO: 1218377 - DNA, 22 bp, Artificial Sequence
  chemically synthesized
taagtgatatcacagggctggg

SEQ ID NO: 1218378 - DNA, 22 bp, Artificial Sequence
  chemically synthesized
tacataattataagtgatatca

SEQ ID NO: 1218379 - DNA, 22 bp, Artificial Sequence
  chemically synthesized
atacataattataagtgatatc

SEQ ID NO: 1218380 - DNA, 22 bp, Artificial Sequence
  chemically synthesized
tatacataattataagtgatat

SEQ ID NO: 1218381 - DNA, 22 bp, Artificial Sequence
  chemically synthesized
tgttttatacataattataagt

SEQ ID NO: 1218382 - DNA, 22 bp, Artificial Sequence
  chemically synthesized
actgtgttttatacataattat

SEQ ID NO: 1218383 - DNA, 22 bp, Artificial Sequence
  chemically synthesized
tgatatcacttataattatgta

SEQ ID NO: 1218384 - DNA, 22 bp, Artificial Sequence
  chemically synthesized
ataattatgtataaaacacagt

SEQ ID NO: 1218385 - DNA, 22 bp, Artificial Sequence
  chemically synthesized
aaaatggagttaactgtgtttt

SEQ ID NO: 1218386 - DNA, 22 bp, Artificial Sequence
  chemically synthesized
taattatgtataaaacacagtt

SEQ ID NO: 1218387 - DNA, 22 bp, Artificial Sequence
  chemically synthesized
caaaatggagttaactgtgttt

SEQ ID NO: 1218388 - DNA, 22 bp, Artificial Sequence
  chemically synthesized
tcttcaaaatggagttaactgt

SEQ ID NO: 1218389 - DNA, 22 bp, Artificial Sequence
  chemically synthesized
tgtataaaacacagttaactcc

SEQ ID NO: 1218390 - DNA, 22 bp, Artificial Sequence
  chemically synthesized
actgtcttcaaaatggagttaa

SEQ ID NO: 1218391 - DNA, 22 bp, Artificial Sequence
  chemically synthesized
cactgtcttcaaaatggagtta

SEQ ID NO: 1218392 - DNA, 22 bp, Artificial Sequence
  chemically synthesized
cttcactgtcttcaaaatggag

SEQ ID NO: 1218393 - DNA, 22 bp, Artificial Sequence
  chemically synthesized
acttcactgtcttcaaaatgga

SEQ ID NO: 1218394 - DNA, 22 bp, Artificial Sequence
  chemically synthesized
gaaaacttacttcactgtcttc

SEQ ID NO: 1218395 - DNA, 22 bp, Artificial Sequence
  chemically synthesized
actccattttgaagacagtgaa

SEQ ID NO: 1218396 - DNA, 22 bp, Artificial Sequence
  chemically synthesized
cattttgaagacagtgaagtaa

SEQ ID NO: 1218397 - DNA, 22 bp, Artificial Sequence
  chemically synthesized
atagttggaaaacttacttcac

SEQ ID NO: 1218398 - DNA, 22 bp, Artificial Sequence
  chemically synthesized
ctgatagttggaaaacttactt

SEQ ID NO: 1218399 - DNA, 22 bp, Artificial Sequence
  chemically synthesized
tgaagacagtgaagtaagtttt

SEQ ID NO: 1218400 - DNA, 22 bp, Artificial Sequence
  chemically synthesized
gctgatagttggaaaacttact

SEQ ID NO: 1218401 - DNA, 22 bp, Artificial Sequence
  chemically synthesized
gaagacagtgaagtaagttttc

SEQ ID NO: 1218402 - DNA, 22 bp, Artificial Sequence
  chemically synthesized
tgctgatagttggaaaacttac

SEQ ID NO: 1218403 - DNA, 22 bp, Artificial Sequence
  chemically synthesized
aagacagtgaagtaagttttcc

SEQ ID NO: 1218404 - DNA, 22 bp, Artificial Sequence
  chemically synthesized
aatgtaatgtatattttgctga

SEQ ID NO: 1218405 - DNA, 22 bp, Artificial Sequence
  chemically synthesized
gaatgtaatgtatattttgctg

SEQ ID NO: 1218406 - DNA, 22 bp, Artificial Sequence
  chemically synthesized
tccaactatcagcaaaatatac

SEQ ID NO: 1218407 - DNA, 22 bp, Artificial Sequence
  chemically synthesized
ccaactatcagcaaaatataca

SEQ ID NO: 1218408 - DNA, 22 bp, Artificial Sequence
  chemically synthesized
caactatcagcaaaatatacat

SEQ ID NO: 1218409 - DNA, 22 bp, Artificial Sequence
  chemically synthesized
tcagcaaaatatacattacatt

SEQ ID NO: 1218410 - DNA, 22 bp, Artificial Sequence
  chemically synthesized
agtcagtgataatatttgaatg

SEQ ID NO: 1218411 - DNA, 22 bp, Artificial Sequence
  chemically synthesized
aagtcagtgataatatttgaat

SEQ ID NO: 1218412 - DNA, 22 bp, Artificial Sequence
  chemically synthesized
taagtcagtgataatatttgaa

SEQ ID NO: 1218413 - DNA, 22 bp, Artificial Sequence
  chemically synthesized
tgtggttttaagtcagtgataa

SEQ ID NO: 1218414 - DNA, 22 bp, Artificial Sequence
  chemically synthesized
cattcaaatattatcactgact

SEQ ID NO: 1218415 - DNA, 22 bp, Artificial Sequence
  chemically synthesized
tatgtggttttaagtcagtgat

SEQ ID NO: 1218416 - DNA, 22 bp, Artificial Sequence
  chemically synthesized
ctatgtggttttaagtcagtga

SEQ ID NO: 1218417 - DNA, 22 bp, Artificial Sequence
  chemically synthesized
tctatgtggttttaagtcagtg

SEQ ID NO: 1218418 - DNA, 22 bp, Artificial Sequence
  chemically synthesized
aaatattatcactgacttaaaa

SEQ ID NO: 1218419 - DNA, 22 bp, Artificial Sequence
  chemically synthesized
aaattttctatgtggttttaag

SEQ ID NO: 1218420 - DNA, 22 bp, Artificial Sequence
  chemically synthesized
aaaattttctatgtggttttaa

SEQ ID NO: 1218421 - DNA, 22 bp, Artificial Sequence
  chemically synthesized
tcactgacttaaaaccacatag

SEQ ID NO: 1218422 - DNA, 22 bp, Artificial Sequence
  chemically synthesized
acttaaaaccacatagaaaatt

SEQ ID NO: 1218423 - DNA, 22 bp, Artificial Sequence
  chemically synthesized
aaaaccacatagaaaattttaa

SEQ ID NO: 1218424 - DNA, 22 bp, Artificial Sequence
  chemically synthesized
aaaccacatagaaaattttaaa

SEQ ID NO: 1218425 - DNA, 22 bp, Artificial Sequence
  chemically synthesized
taaactacttatgccattttat

SEQ ID NO: 1218426 - DNA, 22 bp, Artificial Sequence
  chemically synthesized
aaactacttatgccattttatt

SEQ ID NO: 1218427 - DNA, 22 bp, Artificial Sequence
  chemically synthesized
aactacttatgccattttattc

SEQ ID NO: 1218428 - DNA, 22 bp, Artificial Sequence
  chemically synthesized
atgatggtaaatgagaataaaa

SEQ ID NO: 1218429 - DNA, 22 bp, Artificial Sequence
  chemically synthesized
taatgatggtaaatgagaataa

SEQ ID NO: 1218430 - DNA, 22 bp, Artificial Sequence
  chemically synthesized
cttatgccattttattctcatt

SEQ ID NO: 1218431 - DNA, 22 bp, Artificial Sequence
  chemically synthesized
atgccattttattctcatttac

SEQ ID NO: 1218432 - DNA, 22 bp, Artificial Sequence
  chemically synthesized
tgccattttattctcatttacc

SEQ ID NO: 1218433 - DNA, 22 bp, Artificial Sequence
  chemically synthesized
accattctaatgatggtaaatg

SEQ ID NO: 1218434 - DNA, 22 bp, Artificial Sequence
  chemically synthesized
gaccattctaatgatggtaaat

SEQ ID NO: 1218435 - DNA, 22 bp, Artificial Sequence
  chemically synthesized
tgaccattctaatgatggtaaa

SEQ ID NO: 1218436 - DNA, 22 bp, Artificial Sequence
  chemically synthesized
tattctcatttaccatcattag

SEQ ID NO: 1218437 - DNA, 22 bp, Artificial Sequence
  chemically synthesized
attctcatttaccatcattaga

SEQ ID NO: 1218438 - DNA, 22 bp, Artificial Sequence
  chemically synthesized
ttctcatttaccatcattagaa

SEQ ID NO: 1218439 - DNA, 22 bp, Artificial Sequence
  chemically synthesized
tcatttaccatcattagaatgg

SEQ ID NO: 1218440 - DNA, 22 bp, Artificial Sequence
  chemically synthesized
atttaccatcattagaatggtc

SEQ ID NO: 1218441 - DNA, 22 bp, Artificial Sequence
  chemically synthesized
gcaaaaacattttgaccattct

SEQ ID NO: 1218442 - DNA, 22 bp, Artificial Sequence
  chemically synthesized
ggcaaaaacattttgaccattc

SEQ ID NO: 1218443 - DNA, 22 bp, Artificial Sequence
  chemically synthesized
accatcattagaatggtcaaaa

SEQ ID NO: 1218444 - DNA, 22 bp, Artificial Sequence
  chemically synthesized
ccatcattagaatggtcaaaat

SEQ ID NO: 1218445 - DNA, 22 bp, Artificial Sequence
  chemically synthesized
ccttggcaaaaacattttgacc

SEQ ID NO: 1218446 - DNA, 22 bp, Artificial Sequence
  chemically synthesized
gccttggcaaaaacattttgac

SEQ ID NO: 1218447 - DNA, 22 bp, Artificial Sequence
  chemically synthesized
tgccttggcaaaaacattttga

SEQ ID NO: 1218448 - DNA, 22 bp, Artificial Sequence
  chemically synthesized
gaatggtcaaaatgtttttgcc

SEQ ID NO: 1218449 - DNA, 22 bp, Artificial Sequence
  chemically synthesized
tcacagaattttgccttggcaa

SEQ ID NO: 1218450 - DNA, 22 bp, Artificial Sequence
  chemically synthesized
gtcacagaattttgccttggca

SEQ ID NO: 1218451 - DNA, 22 bp, Artificial Sequence
  chemically synthesized
ttgtcacagaattttgccttgg

SEQ ID NO: 1218452 - DNA, 22 bp, Artificial Sequence
  chemically synthesized
cttgtcacagaattttgccttg

SEQ ID NO: 1218453 - DNA, 22 bp, Artificial Sequence
  chemically synthesized
tgtttcttgtcacagaattttg

SEQ ID NO: 1218454 - DNA, 22 bp, Artificial Sequence
  chemically synthesized
ttgccaaggcaaaattctgtga

SEQ ID NO: 1218455 - DNA, 22 bp, Artificial Sequence
  chemically synthesized
tgccaaggcaaaattctgtgac

SEQ ID NO: 1218456 - DNA, 22 bp, Artificial Sequence
  chemically synthesized
gccaaggcaaaattctgtgaca

SEQ ID NO: 1218457 - DNA, 22 bp, Artificial Sequence
  chemically synthesized
ccaaggcaaaattctgtgacaa

SEQ ID NO: 1218458 - DNA, 22 bp, Artificial Sequence
  chemically synthesized
atatctgtgtttcttgtcacag

SEQ ID NO: 1218459 - DNA, 22 bp, Artificial Sequence
  chemically synthesized
tagttgatatctgtgtttcttg

SEQ ID NO: 1218460 - DNA, 22 bp, Artificial Sequence
  chemically synthesized
tatagttgatatctgtgtttct

SEQ ID NO: 1218461 - DNA, 22 bp, Artificial Sequence
  chemically synthesized
tgtgacaagaaacacagatatc

SEQ ID NO: 1218462 - DNA, 22 bp, Artificial Sequence
  chemically synthesized
tgacaagaaacacagatatcaa

SEQ ID NO: 1218463 - DNA, 22 bp, Artificial Sequence
  chemically synthesized
agaaaagtgttctatagttgat

SEQ ID NO: 1218464 - DNA, 22 bp, Artificial Sequence
  chemically synthesized
attcagaaaagtgttctatagt

SEQ ID NO: 1218465 - DNA, 22 bp, Artificial Sequence
  chemically synthesized
gattcagaaaagtgttctatag

SEQ ID NO: 1218466 - DNA, 22 bp, Artificial Sequence
  chemically synthesized
ggtttgattcagaaaagtgttc

SEQ ID NO: 1218467 - DNA, 22 bp, Artificial Sequence
  chemically synthesized
tagaacacttttctgaatcaaa

SEQ ID NO: 1218468 - DNA, 22 bp, Artificial Sequence
  chemically synthesized
ttctgaatcaaacctaatatct

SEQ ID NO: 1218469 - DNA, 22 bp, Artificial Sequence
  chemically synthesized
tctgaatcaaacctaatatctc

SEQ ID NO: 1218470 - DNA, 22 bp, Artificial Sequence
  chemically synthesized
ctgaatcaaacctaatatctca

SEQ ID NO: 1218471 - DNA, 22 bp, Artificial Sequence
  chemically synthesized
tgaaggaatacatgagatatta

SEQ ID NO: 1218472 - DNA, 22 bp, Artificial Sequence
  chemically synthesized
tgaatcaaacctaatatctcat

SEQ ID NO: 1218473 - DNA, 22 bp, Artificial Sequence
  chemically synthesized
aatcaaacctaatatctcatgt

SEQ ID NO: 1218474 - DNA, 22 bp, Artificial Sequence
  chemically synthesized
agctatgaaggaatacatgaga

SEQ ID NO: 1218475 - DNA, 22 bp, Artificial Sequence
  chemically synthesized
cagctatgaaggaatacatgag

SEQ ID NO: 1218476 - DNA, 22 bp, Artificial Sequence
  chemically synthesized
tttcagctatgaaggaatacat

SEQ ID NO: 1218477 - DNA, 22 bp, Artificial Sequence
  chemically synthesized
atttcagctatgaaggaataca

SEQ ID NO: 1218478 - DNA, 22 bp, Artificial Sequence
  chemically synthesized
tatttcagctatgaaggaatac

SEQ ID NO: 1218479 - DNA, 22 bp, Artificial Sequence
  chemically synthesized
atatctcatgtattccttcata

SEQ ID NO: 1218480 - DNA, 22 bp, Artificial Sequence
  chemically synthesized
attttatttcagctatgaagga

SEQ ID NO: 1218481 - DNA, 22 bp, Artificial Sequence
  chemically synthesized
ttaattttatttcagctatgaa

SEQ ID NO: 1218482 - DNA, 22 bp, Artificial Sequence
  chemically synthesized
gttaattttatttcagctatga

SEQ ID NO: 1218483 - DNA, 22 bp, Artificial Sequence
  chemically synthesized
atgtattccttcatagctgaaa

SEQ ID NO: 1218484 - DNA, 22 bp, Artificial Sequence
  chemically synthesized
gtatttgttaattttatttcag

SEQ ID NO: 1218485 - DNA, 22 bp, Artificial Sequence
  chemically synthesized
ttggtatttgttaattttattt

SEQ ID NO: 1218486 - DNA, 22 bp, Artificial Sequence
  chemically synthesized
cttcatagctgaaataaaatta

SEQ ID NO: 1218487 - DNA, 22 bp, Artificial Sequence
  chemically synthesized
catagctgaaataaaattaaca

SEQ ID NO: 1218488 - DNA, 22 bp, Artificial Sequence
  chemically synthesized
atagctgaaataaaattaacaa

SEQ ID NO: 1218489 - DNA, 22 bp, Artificial Sequence
  chemically synthesized
aaaacatctattggtatttgtt

SEQ ID NO: 1218490 - DNA, 22 bp, Artificial Sequence
  chemically synthesized
aaataaaattaacaaataccaa

SEQ ID NO: 1218491 - DNA, 22 bp, Artificial Sequence
  chemically synthesized
acaaataccaatagatgttttt

SEQ ID NO: 1218492 - DNA, 22 bp, Artificial Sequence
  chemically synthesized
aagaaatatattaaaaacatct

SEQ ID NO: 1218493 - DNA, 22 bp, Artificial Sequence
  chemically synthesized
atgagactaaagaaatatatta

SEQ ID NO: 1218494 - DNA, 22 bp, Artificial Sequence
  chemically synthesized
ttaatatatttctttagtctca

SEQ ID NO: 1218495 - DNA, 22 bp, Artificial Sequence
  chemically synthesized
taatatatttctttagtctcat

SEQ ID NO: 1218496 - DNA, 22 bp, Artificial Sequence
  chemically synthesized
aatatatttctttagtctcatg

SEQ ID NO: 1218497 - DNA, 22 bp, Artificial Sequence
  chemically synthesized
atatatttctttagtctcatga

SEQ ID NO: 1218498 - DNA, 22 bp, Artificial Sequence
  chemically synthesized
ctttagtctcatgaactcattg

SEQ ID NO: 1218499 - DNA, 22 bp, Artificial Sequence
  chemically synthesized
gtcatatcatcacaatgagttc

SEQ ID NO: 1218500 - DNA, 22 bp, Artificial Sequence
  chemically synthesized
tttagtctcatgaactcattgt

SEQ ID NO: 1218501 - DNA, 22 bp, Artificial Sequence
  chemically synthesized
tagtctcatgaactcattgtga

SEQ ID NO: 1218502 - DNA, 22 bp, Artificial Sequence
  chemically synthesized
ctagtcatatcatcacaatgag

SEQ ID NO: 1218503 - DNA, 22 bp, Artificial Sequence
  chemically synthesized
agtctcatgaactcattgtgat

SEQ ID NO: 1218504 - DNA, 22 bp, Artificial Sequence
  chemically synthesized
cctagtcatatcatcacaatga

SEQ ID NO: 1218505 - DNA, 22 bp, Artificial Sequence
  chemically synthesized
gtctcatgaactcattgtgatg

SEQ ID NO: 1218506 - DNA, 22 bp, Artificial Sequence
  chemically synthesized
tcctagtcatatcatcacaatg

SEQ ID NO: 1218507 - DNA, 22 bp, Artificial Sequence
  chemically synthesized
atgaactcattgtgatgatatg

SEQ ID NO: 1218508 - DNA, 22 bp, Artificial Sequence
  chemically synthesized
tggatggttttcctagtcatat

SEQ ID NO: 1218509 - DNA, 22 bp, Artificial Sequence
  chemically synthesized
gtggatggttttcctagtcata

SEQ ID NO: 1218510 - DNA, 22 bp, Artificial Sequence
  chemically synthesized
tgtggatggttttcctagtcat

SEQ ID NO: 1218511 - DNA, 22 bp, Artificial Sequence
  chemically synthesized
attgtgatgatatgactaggaa

SEQ ID NO: 1218512 - DNA, 22 bp, Artificial Sequence
  chemically synthesized
tgatgatatgactaggaaaacc

SEQ ID NO: 1218513 - DNA, 22 bp, Artificial Sequence
  chemically synthesized
ggaaaaccatccacaaagtgtc

SEQ ID NO: 1218514 - DNA, 22 bp, Artificial Sequence
  chemically synthesized
aataatatgtaatagacacttt

SEQ ID NO: 1218515 - DNA, 22 bp, Artificial Sequence
  chemically synthesized
atgctaaataatatgtaataga

SEQ ID NO: 1218516 - DNA, 22 bp, Artificial Sequence
  chemically synthesized
taatgctaaataatatgtaata

SEQ ID NO: 1218517 - DNA, 22 bp, Artificial Sequence
  chemically synthesized
ttacatattatttagcattaga

SEQ ID NO: 1218518 - DNA, 22 bp, Artificial Sequence
  chemically synthesized
catattatttagcattagaacc

SEQ ID NO: 1218519 - DNA, 22 bp, Artificial Sequence
  chemically synthesized
tttagcattagaacctcatggc

SEQ ID NO: 1218520 - DNA, 22 bp, Artificial Sequence
  chemically synthesized
agcattagaacctcatggctgc

SEQ ID NO: 1218521 - DNA, 22 bp, Artificial Sequence
  chemically synthesized
ataatgagaaatgcagccatga

SEQ ID NO: 1218522 - DNA, 22 bp, Artificial Sequence
  chemically synthesized
gcattagaacctcatggctgca

SEQ ID NO: 1218523 - DNA, 22 bp, Artificial Sequence
  chemically synthesized
gaacctcatggctgcatttctc

SEQ ID NO: 1218524 - DNA, 22 bp, Artificial Sequence
  chemically synthesized
ataaattaataatgagaaatgc

SEQ ID NO: 1218525 - DNA, 22 bp, Artificial Sequence
  chemically synthesized
atggctgcatttctcattatta

SEQ ID NO: 1218526 - DNA, 22 bp, Artificial Sequence
  chemically synthesized
acaagacattaataaattaata

SEQ ID NO: 1218527 - DNA, 22 bp, Artificial Sequence
  chemically synthesized
catttctcattattaatttatt

SEQ ID NO: 1218528 - DNA, 22 bp, Artificial Sequence
  chemically synthesized
ctcattattaatttattaatgt

SEQ ID NO: 1218529 - DNA, 22 bp, Artificial Sequence
  chemically synthesized
tcattattaatttattaatgtc

SEQ ID NO: 1218530 - DNA, 22 bp, Artificial Sequence
  chemically synthesized
aatgattgacaagacattaata

SEQ ID NO: 1218531 - DNA, 22 bp, Artificial Sequence
  chemically synthesized
gaatgattgacaagacattaat

SEQ ID NO: 1218532 - DNA, 22 bp, Artificial Sequence
  chemically synthesized
attattaatttattaatgtctt

SEQ ID NO: 1218533 - DNA, 22 bp, Artificial Sequence
  chemically synthesized
tgaatgattgacaagacattaa

SEQ ID NO: 1218534 - DNA, 22 bp, Artificial Sequence
  chemically synthesized
ttgaatgattgacaagacatta

SEQ ID NO: 1218535 - DNA, 22 bp, Artificial Sequence
  chemically synthesized
ttaatttattaatgtcttgtca

SEQ ID NO: 1218536 - DNA, 22 bp, Artificial Sequence
  chemically synthesized
atttattaatgtcttgtcaatc

SEQ ID NO: 1218537 - DNA, 22 bp, Artificial Sequence
  chemically synthesized
agtgatttttgaatgattgaca

SEQ ID NO: 1218538 - DNA, 22 bp, Artificial Sequence
  chemically synthesized
attaatgtcttgtcaatcattc

SEQ ID NO: 1218539 - DNA, 22 bp, Artificial Sequence
  chemically synthesized
ttaatgtcttgtcaatcattca

SEQ ID NO: 1218540 - DNA, 22 bp, Artificial Sequence
  chemically synthesized
atgtcttgtcaatcattcaaaa

SEQ ID NO: 1218541 - DNA, 22 bp, Artificial Sequence
  chemically synthesized
gtcaatcattcaaaaatcactt

SEQ ID NO: 1218542 - DNA, 22 bp, Artificial Sequence
  chemically synthesized
tacagtgacattaagtgatttt

SEQ ID NO: 1218543 - DNA, 22 bp, Artificial Sequence
  chemically synthesized
tcaatcattcaaaaatcactta

SEQ ID NO: 1218544 - DNA, 22 bp, Artificial Sequence
  chemically synthesized
gcctatacagtgacattaagtg

SEQ ID NO: 1218545 - DNA, 22 bp, Artificial Sequence
  chemically synthesized
ggcctatacagtgacattaagt

SEQ ID NO: 1218546 - DNA, 22 bp, Artificial Sequence
  chemically synthesized
aaaaatcacttaatgtcactgt

SEQ ID NO: 1218547 - DNA, 22 bp, Artificial Sequence
  chemically synthesized
aatgtcactgtataggccaagg

SEQ ID NO: 1218548 - DNA, 22 bp, Artificial Sequence
  chemically synthesized
atgtcactgtataggccaagga

SEQ ID NO: 1218549 - DNA, 22 bp, Artificial Sequence
  chemically synthesized
caggtgaaataacaatatcctt

SEQ ID NO: 1218550 - DNA, 22 bp, Artificial Sequence
  chemically synthesized
tataggccaaggatattgttat

SEQ ID NO: 1218551 - DNA, 22 bp, Artificial Sequence
  chemically synthesized
attacaggtgaaataacaatat

SEQ ID NO: 1218552 - DNA, 22 bp, Artificial Sequence
  chemically synthesized
aattacaggtgaaataacaata

SEQ ID NO: 1218553 - DNA, 22 bp, Artificial Sequence
  chemically synthesized
taattacaggtgaaataacaat

SEQ ID NO: 1218554 - DNA, 22 bp, Artificial Sequence
  chemically synthesized
ttaattacaggtgaaataacaa

SEQ ID NO: 1218555 - DNA, 22 bp, Artificial Sequence
  chemically synthesized
tttaattacaggtgaaataaca

SEQ ID NO: 1218556 - DNA, 22 bp, Artificial Sequence
  chemically synthesized
ttttaattacaggtgaaataac

SEQ ID NO: 1218557 - DNA, 22 bp, Artificial Sequence
  chemically synthesized
tttttaattacaggtgaaataa

SEQ ID NO: 1218558 - DNA, 22 bp, Artificial Sequence
  chemically synthesized
ttttttaattacaggtgaaata

SEQ ID NO: 1218559 - DNA, 22 bp, Artificial Sequence
  chemically synthesized
tttttttaattacaggtgaaat

SEQ ID NO: 1218560 - DNA, 22 bp, Artificial Sequence
  chemically synthesized
ttttttttaattacaggtgaaa

SEQ ID NO: 1218561 - DNA, 22 bp, Artificial Sequence
  chemically synthesized
tttttttttaattacaggtgaa

SEQ ID NO: 1218562 - DNA, 22 bp, Artificial Sequence
  chemically synthesized
acaactttttttttttaattac

SEQ ID NO: 1218563 - DNA, 22 bp, Artificial Sequence
  chemically synthesized
ttatttcacctgtaattaaaaa

SEQ ID NO: 1218564 - DNA, 22 bp, Artificial Sequence
  chemically synthesized
cacaactttttttttttaatta

SEQ ID NO: 1218565 - DNA, 22 bp, Artificial Sequence
  chemically synthesized
tcacaactttttttttttaatt

SEQ ID NO: 1218566 - DNA, 22 bp, Artificial Sequence
  chemically synthesized
tttcacctgtaattaaaaaaaa

SEQ ID NO: 1218567 - DNA, 22 bp, Artificial Sequence
  chemically synthesized
ttttcacaacttttttttttta

SEQ ID NO: 1218568 - DNA, 22 bp, Artificial Sequence
  chemically synthesized
cacctgtaattaaaaaaaaaaa

SEQ ID NO: 1218569 - DNA, 22 bp, Artificial Sequence
  chemically synthesized
acctgtaattaaaaaaaaaaag

SEQ ID NO: 1218570 - DNA, 22 bp, Artificial Sequence
  chemically synthesized
taattaaaaaaaaaaagttgtg

SEQ ID NO: 1218571 - DNA, 22 bp, Artificial Sequence
  chemically synthesized
ccaggattattttcacaacttt

SEQ ID NO: 1218572 - DNA, 22 bp, Artificial Sequence
  chemically synthesized
accaggattattttcacaactt

SEQ ID NO: 1218573 - DNA, 22 bp, Artificial Sequence
  chemically synthesized
aaaaaaaaaagttgtgaaaata

SEQ ID NO: 1218574 - DNA, 22 bp, Artificial Sequence
  chemically synthesized
gcttaccaggattattttcaca

SEQ ID NO: 1218575 - DNA, 22 bp, Artificial Sequence
  chemically synthesized
aattagcttaccaggattattt

SEQ ID NO: 1218576 - DNA, 22 bp, Artificial Sequence
  chemically synthesized
caattagcttaccaggattatt

SEQ ID NO: 1218577 - DNA, 22 bp, Artificial Sequence
  chemically synthesized
tcaattagcttaccaggattat

SEQ ID NO: 1218578 - DNA, 22 bp, Artificial Sequence
  chemically synthesized
ttcaattagcttaccaggatta

SEQ ID NO: 1218579 - DNA, 22 bp, Artificial Sequence
  chemically synthesized
ttttcaattagcttaccaggat

SEQ ID NO: 1218580 - DNA, 22 bp, Artificial Sequence
  chemically synthesized
tgaaaataatcctggtaagcta

SEQ ID NO: 1218581 - DNA, 22 bp, Artificial Sequence
  chemically synthesized
agaatctcttttcaattagctt

SEQ ID NO: 1218582 - DNA, 22 bp, Artificial Sequence
  chemically synthesized
gataactgagaatctcttttca

SEQ ID NO: 1218583 - DNA, 22 bp, Artificial Sequence
  chemically synthesized
gtaagctaattgaaaagagatt

SEQ ID NO: 1218584 - DNA, 22 bp, Artificial Sequence
  chemically synthesized
cctagataactgagaatctctt

SEQ ID NO: 1218585 - DNA, 22 bp, Artificial Sequence
  chemically synthesized
acctagataactgagaatctct

SEQ ID NO: 1218586 - DNA, 22 bp, Artificial Sequence
  chemically synthesized
ttacctagataactgagaatct

SEQ ID NO: 1218587 - DNA, 22 bp, Artificial Sequence
  chemically synthesized
attgaaaagagattctcagtta

SEQ ID NO: 1218588 - DNA, 22 bp, Artificial Sequence
  chemically synthesized
aaaagagattctcagttatcta

SEQ ID NO: 1218589 - DNA, 22 bp, Artificial Sequence
  chemically synthesized
aatataattcttacctagataa

SEQ ID NO: 1218590 - DNA, 22 bp, Artificial Sequence
  chemically synthesized
aaatataattcttacctagata

SEQ ID NO: 1218591 - DNA, 22 bp, Artificial Sequence
  chemically synthesized
tcagttatctaggtaagaatta

SEQ ID NO: 1218592 - DNA, 22 bp, Artificial Sequence
  chemically synthesized
agttatctaggtaagaattata

SEQ ID NO: 1218593 - DNA, 22 bp, Artificial Sequence
  chemically synthesized
agaaacatttaaatataattct

SEQ ID NO: 1218594 - DNA, 22 bp, Artificial Sequence
  chemically synthesized
ttcagaaacatttaaatataat

SEQ ID NO: 1218595 - DNA, 22 bp, Artificial Sequence
  chemically synthesized
tctaggtaagaattatatttaa

SEQ ID NO: 1218596 - DNA, 22 bp, Artificial Sequence
  chemically synthesized
gttcagaaacatttaaatataa

SEQ ID NO: 1218597 - DNA, 22 bp, Artificial Sequence
  chemically synthesized
ggtaagaattatatttaaatgt

SEQ ID NO: 1218598 - DNA, 22 bp, Artificial Sequence
  chemically synthesized
tgccaaatttgttcagaaacat

SEQ ID NO: 1218599 - DNA, 22 bp, Artificial Sequence
  chemically synthesized
tatgccaaatttgttcagaaac

SEQ ID NO: 1218600 - DNA, 22 bp, Artificial Sequence
  chemically synthesized
tatttaaatgtttctgaacaaa

SEQ ID NO: 1218601 - DNA, 22 bp, Artificial Sequence
  chemically synthesized
ggttctatgccaaatttgttca

SEQ ID NO: 1218602 - DNA, 22 bp, Artificial Sequence
  chemically synthesized
aaatgtttctgaacaaatttgg

SEQ ID NO: 1218603 - DNA, 22 bp, Artificial Sequence
  chemically synthesized
aatgtttctgaacaaatttggc

SEQ ID NO: 1218604 - DNA, 22 bp, Artificial Sequence
  chemically synthesized
tggattaggttctatgccaaat

SEQ ID NO: 1218605 - DNA, 22 bp, Artificial Sequence
  chemically synthesized
ctgaacaaatttggcatagaac

SEQ ID NO: 1218606 - DNA, 22 bp, Artificial Sequence
  chemically synthesized
tgaacaaatttggcatagaacc

SEQ ID NO: 1218607 - DNA, 22 bp, Artificial Sequence
  chemically synthesized
aacaaatttggcatagaaccta

SEQ ID NO: 1218608 - DNA, 22 bp, Artificial Sequence
  chemically synthesized
aagatgtgcattatggattagg

SEQ ID NO: 1218609 - DNA, 22 bp, Artificial Sequence
  chemically synthesized
ggcatagaacctaatccataat

SEQ ID NO: 1218610 - DNA, 22 bp, Artificial Sequence
  chemically synthesized
gcatagaacctaatccataatg

SEQ ID NO: 1218611 - DNA, 22 bp, Artificial Sequence
  chemically synthesized
atccataatgcacatcttcaat

SEQ ID NO: 1218612 - DNA, 22 bp, Artificial Sequence
  chemically synthesized
aataatgaagtataatcatgcg

SEQ ID NO: 1218613 - DNA, 22 bp, Artificial Sequence
  chemically synthesized
aaataatgaagtataatcatgc

SEQ ID NO: 1218614 - DNA, 22 bp, Artificial Sequence
  chemically synthesized
caatcgcatgattatacttcat

SEQ ID NO: 1218615 - DNA, 22 bp, Artificial Sequence
  chemically synthesized
aatcgcatgattatacttcatt

SEQ ID NO: 1218616 - DNA, 22 bp, Artificial Sequence
  chemically synthesized
gggaatttaaataatgaagtat

SEQ ID NO: 1218617 - DNA, 22 bp, Artificial Sequence
  chemically synthesized
agttggggaatttaaataatga

SEQ ID NO: 1218618 - DNA, 22 bp, Artificial Sequence
  chemically synthesized
ctcagttggggaatttaaataa

SEQ ID NO: 1218619 - DNA, 22 bp, Artificial Sequence
  chemically synthesized
actcagttggggaatttaaata

SEQ ID NO: 1218620 - DNA, 22 bp, Artificial Sequence
  chemically synthesized
ttactcagttggggaatttaaa

SEQ ID NO: 1218621 - DNA, 22 bp, Artificial Sequence
  chemically synthesized
cttactcagttggggaatttaa

SEQ ID NO: 1218622 - DNA, 22 bp, Artificial Sequence
  chemically synthesized
tacttcattatttaaattcccc

SEQ ID NO: 1218623 - DNA, 22 bp, Artificial Sequence
  chemically synthesized
cattatttaaattccccaactg

SEQ ID NO: 1218624 - DNA, 22 bp, Artificial Sequence
  chemically synthesized
attatttaaattccccaactga

SEQ ID NO: 1218625 - DNA, 22 bp, Artificial Sequence
  chemically synthesized
tttaaattccccaactgagtaa

SEQ ID NO: 1218626 - DNA, 22 bp, Artificial Sequence
  chemically synthesized
agtaagagtttcttactcagtt

SEQ ID NO: 1218627 - DNA, 22 bp, Artificial Sequence
  chemically synthesized
aaattccccaactgagtaagaa

SEQ ID NO: 1218628 - DNA, 22 bp, Artificial Sequence
  chemically synthesized
aattccccaactgagtaagaaa

SEQ ID NO: 1218629 - DNA, 22 bp, Artificial Sequence
  chemically synthesized
gttaagtaagagtttcttactc

SEQ ID NO: 1218630 - DNA, 22 bp, Artificial Sequence
  chemically synthesized
agttaagtaagagtttcttact

SEQ ID NO: 1218631 - DNA, 22 bp, Artificial Sequence
  chemically synthesized
tagttaagtaagagtttcttac

SEQ ID NO: 1218632 - DNA, 22 bp, Artificial Sequence
  chemically synthesized
cccaactgagtaagaaactctt

SEQ ID NO: 1218633 - DNA, 22 bp, Artificial Sequence
  chemically synthesized
aagtatgctttagttaagtaag

SEQ ID NO: 1218634 - DNA, 22 bp, Artificial Sequence
  chemically synthesized
agtaagaaactcttacttaact

SEQ ID NO: 1218635 - DNA, 22 bp, Artificial Sequence
  chemically synthesized
ttaaagtatgctttagttaagt

SEQ ID NO: 1218636 - DNA, 22 bp, Artificial Sequence
  chemically synthesized
gttaaagtatgctttagttaag

SEQ ID NO: 1218637 - DNA, 22 bp, Artificial Sequence
  chemically synthesized
atttgttaaagtatgctttagt

SEQ ID NO: 1218638 - DNA, 22 bp, Artificial Sequence
  chemically synthesized
ttacttaactaaagcatacttt

SEQ ID NO: 1218639 - DNA, 22 bp, Artificial Sequence
  chemically synthesized
acttaactaaagcatactttaa

SEQ ID NO: 1218640 - DNA, 22 bp, Artificial Sequence
  chemically synthesized
ggggctgatttgttaaagtatg

SEQ ID NO: 1218641 - DNA, 22 bp, Artificial Sequence
  chemically synthesized
cttaactaaagcatactttaac

SEQ ID NO: 1218642 - DNA, 22 bp, Artificial Sequence
  chemically synthesized
aactaaagcatactttaacaaa

SEQ ID NO: 1218643 - DNA, 22 bp, Artificial Sequence
  chemically synthesized
actaaagcatactttaacaaat

SEQ ID NO: 1218644 - DNA, 22 bp, Artificial Sequence
  chemically synthesized
ccctaggggctgatttgttaaa

SEQ ID NO: 1218645 - DNA, 22 bp, Artificial Sequence
  chemically synthesized
aagcatactttaacaaatcagc

SEQ ID NO: 1218646 - DNA, 22 bp, Artificial Sequence
  chemically synthesized
tctcccctaggggctgatttgt

SEQ ID NO: 1218647 - DNA, 22 bp, Artificial Sequence
  chemically synthesized
tatctcccctaggggctgattt

SEQ ID NO: 1218648 - DNA, 22 bp, Artificial Sequence
  chemically synthesized
ctatctcccctaggggctgatt

SEQ ID NO: 1218649 - DNA, 22 bp, Artificial Sequence
  chemically synthesized
taatttctatctcccctagggg

SEQ ID NO: 1218650 - DNA, 22 bp, Artificial Sequence
  chemically synthesized
taacaaatcagcccctagggga

SEQ ID NO: 1218651 - DNA, 22 bp, Artificial Sequence
  chemically synthesized
ataatttctatctcccctaggg

SEQ ID NO: 1218652 - DNA, 22 bp, Artificial Sequence
  chemically synthesized
aacaaatcagcccctaggggag

SEQ ID NO: 1218653 - DNA, 22 bp, Artificial Sequence
  chemically synthesized
acaaatcagcccctaggggaga

SEQ ID NO: 1218654 - DNA, 22 bp, Artificial Sequence
  chemically synthesized
ggggagatagaaattataaatt

SEQ ID NO: 1218655 - DNA, 22 bp, Artificial Sequence
  chemically synthesized
tggaaaatggtcaatttataat

SEQ ID NO: 1218656 - DNA, 22 bp, Artificial Sequence
  chemically synthesized
atggaaaatggtcaatttataa

SEQ ID NO: 1218657 - DNA, 22 bp, Artificial Sequence
  chemically synthesized
tatggaaaatggtcaatttata

SEQ ID NO: 1218658 - DNA, 22 bp, Artificial Sequence
  chemically synthesized
actttatggaaaatggtcaatt

SEQ ID NO: 1218659 - DNA, 22 bp, Artificial Sequence
  chemically synthesized
aactttatggaaaatggtcaat

SEQ ID NO: 1218660 - DNA, 22 bp, Artificial Sequence
  chemically synthesized
taactttatggaaaatggtcaa

SEQ ID NO: 1218661 - DNA, 22 bp, Artificial Sequence
  chemically synthesized
taaattgaccattttccataaa

SEQ ID NO: 1218662 - DNA, 22 bp, Artificial Sequence
  chemically synthesized
tcaccattttaactttatggaa

SEQ ID NO: 1218663 - DNA, 22 bp, Artificial Sequence
  chemically synthesized
gtcaccattttaactttatgga

SEQ ID NO: 1218664 - DNA, 22 bp, Artificial Sequence
  chemically synthesized
accattttccataaagttaaaa

SEQ ID NO: 1218665 - DNA, 22 bp, Artificial Sequence
  chemically synthesized
tgatttgtcaccattttaactt

SEQ ID NO: 1218666 - DNA, 22 bp, Artificial Sequence
  chemically synthesized
tatgatttgtcaccattttaac

SEQ ID NO: 1218667 - DNA, 22 bp, Artificial Sequence
  chemically synthesized
ctatgatttgtcaccattttaa

SEQ ID NO: 1218668 - DNA, 22 bp, Artificial Sequence
  chemically synthesized
ttctatgatttgtcaccatttt

SEQ ID NO: 1218669 - DNA, 22 bp, Artificial Sequence
  chemically synthesized
tccataaagttaaaatggtgac

SEQ ID NO: 1218670 - DNA, 22 bp, Artificial Sequence
  chemically synthesized
ccataaagttaaaatggtgaca

SEQ ID NO: 1218671 - DNA, 22 bp, Artificial Sequence
  chemically synthesized
cataaagttaaaatggtgacaa

SEQ ID NO: 1218672 - DNA, 22 bp, Artificial Sequence
  chemically synthesized
acattcttctatgatttgtcac

SEQ ID NO: 1218673 - DNA, 22 bp, Artificial Sequence
  chemically synthesized
cacattcttctatgatttgtca

SEQ ID NO: 1218674 - DNA, 22 bp, Artificial Sequence
  chemically synthesized
tcacattcttctatgatttgtc

SEQ ID NO: 1218675 - DNA, 22 bp, Artificial Sequence
  chemically synthesized
aaatggtgacaaatcatagaag

SEQ ID NO: 1218676 - DNA, 22 bp, Artificial Sequence
  chemically synthesized
atctttcacattcttctatgat

SEQ ID NO: 1218677 - DNA, 22 bp, Artificial Sequence
  chemically synthesized
ctaatctttcacattcttctat

SEQ ID NO: 1218678 - DNA, 22 bp, Artificial Sequence
  chemically synthesized
tactaatctttcacattcttct

SEQ ID NO: 1218679 - DNA, 22 bp, Artificial Sequence
  chemically synthesized
ctactaatctttcacattcttc

SEQ ID NO: 1218680 - DNA, 22 bp, Artificial Sequence
  chemically synthesized
tctactaatctttcacattctt

SEQ ID NO: 1218681 - DNA, 22 bp, Artificial Sequence
  chemically synthesized
gtattttctactaatctttcac

SEQ ID NO: 1218682 - DNA, 22 bp, Artificial Sequence
  chemically synthesized
ggtattttctactaatctttca

SEQ ID NO: 1218683 - DNA, 22 bp, Artificial Sequence
  chemically synthesized
tggtattttctactaatctttc

SEQ ID NO: 1218684 - DNA, 22 bp, Artificial Sequence
  chemically synthesized
taacaaattttggtattttcta

SEQ ID NO: 1218685 - DNA, 22 bp, Artificial Sequence
  chemically synthesized
ataacaaattttggtattttct

SEQ ID NO: 1218686 - DNA, 22 bp, Artificial Sequence
  chemically synthesized
tataacaaattttggtattttc

SEQ ID NO: 1218687 - DNA, 22 bp, Artificial Sequence
  chemically synthesized
ccctttataacaaattttggta

SEQ ID NO: 1218688 - DNA, 22 bp, Artificial Sequence
  chemically synthesized
accctttataacaaattttggt

SEQ ID NO: 1218689 - DNA, 22 bp, Artificial Sequence
  chemically synthesized
gtagaaaataccaaaatttgtt

SEQ ID NO: 1218690 - DNA, 22 bp, Artificial Sequence
  chemically synthesized
aatttaccctttataacaaatt

SEQ ID NO: 1218691 - DNA, 22 bp, Artificial Sequence
  chemically synthesized
gaatttaccctttataacaaat

SEQ ID NO: 1218692 - DNA, 22 bp, Artificial Sequence
  chemically synthesized
gcttgaatttaccctttataac

SEQ ID NO: 1218693 - DNA, 22 bp, Artificial Sequence
  chemically synthesized
gttataaagggtaaattcaagc

SEQ ID NO: 1218694 - DNA, 22 bp, Artificial Sequence
  chemically synthesized
ttataaagggtaaattcaagcc

SEQ ID NO: 1218695 - DNA, 22 bp, Artificial Sequence
  chemically synthesized
taaagggtaaattcaagccagg

SEQ ID NO: 1218696 - DNA, 22 bp, Artificial Sequence
  chemically synthesized
tgtgtgcgggagcctggcttga

SEQ ID NO: 1218697 - DNA, 22 bp, Artificial Sequence
  chemically synthesized
gtgtgtgcgggagcctggcttg

SEQ ID NO: 1218698 - DNA, 22 bp, Artificial Sequence
  chemically synthesized
aatatgatatttgtgtgtgcgg

SEQ ID NO: 1218699 - DNA, 22 bp, Artificial Sequence
  chemically synthesized
aagccaggctcccgcacacaca

SEQ ID NO: 1218700 - DNA, 22 bp, Artificial Sequence
  chemically synthesized
aaaaacattaaatatgatattt

SEQ ID NO: 1218701 - DNA, 22 bp, Artificial Sequence
  chemically synthesized
gaaaaacattaaatatgatatt

SEQ ID NO: 1218702 - DNA, 22 bp, Artificial Sequence
  chemically synthesized
ccgcacacacaaatatcatatt

SEQ ID NO: 1218703 - DNA, 22 bp, Artificial Sequence
  chemically synthesized
gacaacagagacttgaaaaaca

SEQ ID NO: 1218704 - DNA, 22 bp, Artificial Sequence
  chemically synthesized
agacaacagagacttgaaaaac

SEQ ID NO: 1218705 - DNA, 22 bp, Artificial Sequence
  chemically synthesized
cttagacaacagagacttgaaa

SEQ ID NO: 1218706 - DNA, 22 bp, Artificial Sequence
  chemically synthesized
acctacttagacaacagagact

SEQ ID NO: 1218707 - DNA, 22 bp, Artificial Sequence
  chemically synthesized
aatgtttttcaagtctctgttg

SEQ ID NO: 1218708 - DNA, 22 bp, Artificial Sequence
  chemically synthesized
atgtttttcaagtctctgttgt

SEQ ID NO: 1218709 - DNA, 22 bp, Artificial Sequence
  chemically synthesized
ttcaagtctctgttgtctaagt

SEQ ID NO: 1218710 - DNA, 22 bp, Artificial Sequence
  chemically synthesized
tcaagtctctgttgtctaagta

SEQ ID NO: 1218711 - DNA, 22 bp, Artificial Sequence
  chemically synthesized
caagtctctgttgtctaagtag

SEQ ID NO: 1218712 - DNA, 22 bp, Artificial Sequence
  chemically synthesized
tcccaaattcacctacttagac

SEQ ID NO: 1218713 - DNA, 22 bp, Artificial Sequence
  chemically synthesized
aagtctctgttgtctaagtagg

SEQ ID NO: 1218714 - DNA, 22 bp, Artificial Sequence
  chemically synthesized
tgttgtctaagtaggtgaattt

SEQ ID NO: 1218715 - DNA, 22 bp, Artificial Sequence
  chemically synthesized
ttgtctaagtaggtgaatttgg

SEQ ID NO: 1218716 - DNA, 22 bp, Artificial Sequence
  chemically synthesized
catgtaactgtcccaaattcac

SEQ ID NO: 1218717 - DNA, 22 bp, Artificial Sequence
  chemically synthesized
tctaagtaggtgaatttgggac

SEQ ID NO: 1218718 - DNA, 22 bp, Artificial Sequence
  chemically synthesized
agtaggtgaatttgggacagtt

SEQ ID NO: 1218719 - DNA, 22 bp, Artificial Sequence
  chemically synthesized
gatgacaaataattgcatgtaa

SEQ ID NO: 1218720 - DNA, 22 bp, Artificial Sequence
  chemically synthesized
ggatgacaaataattgcatgta

SEQ ID NO: 1218721 - DNA, 22 bp, Artificial Sequence
  chemically synthesized
tttggatgacaaataattgcat

SEQ ID NO: 1218722 - DNA, 22 bp, Artificial Sequence
  chemically synthesized
gggacagttacatgcaattatt

SEQ ID NO: 1218723 - DNA, 22 bp, Artificial Sequence
  chemically synthesized
ggacagttacatgcaattattt

SEQ ID NO: 1218724 - DNA, 22 bp, Artificial Sequence
  chemically synthesized
agttgtttggatgacaaataat

SEQ ID NO: 1218725 - DNA, 22 bp, Artificial Sequence
  chemically synthesized
cagttgtttggatgacaaataa

SEQ ID NO: 1218726 - DNA, 22 bp, Artificial Sequence
  chemically synthesized
catgcaattatttgtcatccaa

SEQ ID NO: 1218727 - DNA, 22 bp, Artificial Sequence
  chemically synthesized
tccatttcagttgtttggatga

SEQ ID NO: 1218728 - DNA, 22 bp, Artificial Sequence
  chemically synthesized
atccatttcagttgtttggatg

SEQ ID NO: 1218729 - DNA, 22 bp, Artificial Sequence
  chemically synthesized
cttatccatttcagttgtttgg

SEQ ID NO: 1218730 - DNA, 22 bp, Artificial Sequence
  chemically synthesized
tccttatccatttcagttgttt

SEQ ID NO: 1218731 - DNA, 22 bp, Artificial Sequence
  chemically synthesized
tttgtcatccaaacaactgaaa

SEQ ID NO: 1218732 - DNA, 22 bp, Artificial Sequence
  chemically synthesized
ttctccttatccatttcagttg

SEQ ID NO: 1218733 - DNA, 22 bp, Artificial Sequence
  chemically synthesized
gttctccttatccatttcagtt

SEQ ID NO: 1218734 - DNA, 22 bp, Artificial Sequence
  chemically synthesized
gtcatccaaacaactgaaatgg

SEQ ID NO: 1218735 - DNA, 22 bp, Artificial Sequence
  chemically synthesized
tgttctccttatccatttcagt

SEQ ID NO: 1218736 - DNA, 22 bp, Artificial Sequence
  chemically synthesized
tcatccaaacaactgaaatgga

SEQ ID NO: 1218737 - DNA, 22 bp, Artificial Sequence
  chemically synthesized
ttgttctccttatccatttcag

SEQ ID NO: 1218738 - DNA, 22 bp, Artificial Sequence
  chemically synthesized
aaatggataaggagaacaaaaa

SEQ ID NO: 1218739 - DNA, 22 bp, Artificial Sequence
  chemically synthesized
ataaatgaaagcaatttttgtt

SEQ ID NO: 1218740 - DNA, 22 bp, Artificial Sequence
  chemically synthesized
gaaccagtcactaataaatgaa

SEQ ID NO: 1218741 - DNA, 22 bp, Artificial Sequence
  chemically synthesized
ggcagttggaaccagtcactaa

SEQ ID NO: 1218742 - DNA, 22 bp, Artificial Sequence
  chemically synthesized
ctttcatttattagtgactggt

SEQ ID NO: 1218743 - DNA, 22 bp, Artificial Sequence
  chemically synthesized
tgggcagttggaaccagtcact

SEQ ID NO: 1218744 - DNA, 22 bp, Artificial Sequence
  chemically synthesized
ctgggcagttggaaccagtcac

SEQ ID NO: 1218745 - DNA, 22 bp, Artificial Sequence
  chemically synthesized
tctgggcagttggaaccagtca

SEQ ID NO: 1218746 - DNA, 22 bp, Artificial Sequence
  chemically synthesized
tcatttattagtgactggttcc

SEQ ID NO: 1218747 - DNA, 22 bp, Artificial Sequence
  chemically synthesized
catttattagtgactggttcca

SEQ ID NO: 1218748 - DNA, 22 bp, Artificial Sequence
  chemically synthesized
atttattagtgactggttccaa

SEQ ID NO: 1218749 - DNA, 22 bp, Artificial Sequence
  chemically synthesized
attagtgactggttccaactgc

SEQ ID NO: 1218750 - DNA, 22 bp, Artificial Sequence
  chemically synthesized
agtattttctgggcagttggaa

SEQ ID NO: 1218751 - DNA, 22 bp, Artificial Sequence
  chemically synthesized
ttagtgactggttccaactgcc

SEQ ID NO: 1218752 - DNA, 22 bp, Artificial Sequence
  chemically synthesized
gtgactggttccaactgcccag

SEQ ID NO: 1218753 - DNA, 22 bp, Artificial Sequence
  chemically synthesized
gttccaactgcccagaaaatac

SEQ ID NO: 1218754 - DNA, 22 bp, Artificial Sequence
  chemically synthesized
caactgcccagaaaatactcag

SEQ ID NO: 1218755 - DNA, 22 bp, Artificial Sequence
  chemically synthesized
agataccataaaaaaactgagt

SEQ ID NO: 1218756 - DNA, 22 bp, Artificial Sequence
  chemically synthesized
cccagaaaatactcagtttttt

SEQ ID NO: 1218757 - DNA, 22 bp, Artificial Sequence
  chemically synthesized
agttcagataccataaaaaaac

SEQ ID NO: 1218758 - DNA, 22 bp, Artificial Sequence
  chemically synthesized
tcagttcagataccataaaaaa

SEQ ID NO: 1218759 - DNA, 22 bp, Artificial Sequence
  chemically synthesized
ctcagttcagataccataaaaa

SEQ ID NO: 1218760 - DNA, 22 bp, Artificial Sequence
  chemically synthesized
tctcagttcagataccataaaa

SEQ ID NO: 1218761 - DNA, 22 bp, Artificial Sequence
  chemically synthesized
agtttttttatggtatctgaac

SEQ ID NO: 1218762 - DNA, 22 bp, Artificial Sequence
  chemically synthesized
tacatctttctcagttcagata

SEQ ID NO: 1218763 - DNA, 22 bp, Artificial Sequence
  chemically synthesized
ttttatggtatctgaactgaga

SEQ ID NO: 1218764 - DNA, 22 bp, Artificial Sequence
  chemically synthesized
tttatggtatctgaactgagaa

SEQ ID NO: 1218765 - DNA, 22 bp, Artificial Sequence
  chemically synthesized
ttatggtatctgaactgagaaa

SEQ ID NO: 1218766 - DNA, 22 bp, Artificial Sequence
  chemically synthesized
tatggtatctgaactgagaaag

SEQ ID NO: 1218767 - DNA, 22 bp, Artificial Sequence
  chemically synthesized
tgtgttgtacatctttctcagt

SEQ ID NO: 1218768 - DNA, 22 bp, Artificial Sequence
  chemically synthesized
atggtatctgaactgagaaaga

SEQ ID NO: 1218769 - DNA, 22 bp, Artificial Sequence
  chemically synthesized
tggtatctgaactgagaaagat

SEQ ID NO: 1218770 - DNA, 22 bp, Artificial Sequence
  chemically synthesized
atgttatgtgttgtacatcttt

SEQ ID NO: 1218771 - DNA, 22 bp, Artificial Sequence
  chemically synthesized
gatgttatgtgttgtacatctt

SEQ ID NO: 1218772 - DNA, 22 bp, Artificial Sequence
  chemically synthesized
ttgatgttatgtgttgtacatc

SEQ ID NO: 1218773 - DNA, 22 bp, Artificial Sequence
  chemically synthesized
aactgagaaagatgtacaacac

SEQ ID NO: 1218774 - DNA, 22 bp, Artificial Sequence
  chemically synthesized
tcttgatgttatgtgttgtaca

SEQ ID NO: 1218775 - DNA, 22 bp, Artificial Sequence
  chemically synthesized
agaaagatgtacaacacataac

SEQ ID NO: 1218776 - DNA, 22 bp, Artificial Sequence
  chemically synthesized
cagtgtgttctcttgatgttat

SEQ ID NO: 1218777 - DNA, 22 bp, Artificial Sequence
  chemically synthesized
gaagaggcatgagagtattcca

SEQ ID NO: 1218778 - DNA, 22 bp, Artificial Sequence
  chemically synthesized
aaagttagaagaggcatgagag

SEQ ID NO: 1218779 - DNA, 22 bp, Artificial Sequence
  chemically synthesized
gaatactctcatgcctcttcta

SEQ ID NO: 1218780 - DNA, 22 bp, Artificial Sequence
  chemically synthesized
ccagtggcctaaaagttagaag

SEQ ID NO: 1218781 - DNA, 22 bp, Artificial Sequence
  chemically synthesized
cccagtggcctaaaagttagaa

SEQ ID NO: 1218782 - DNA, 22 bp, Artificial Sequence
  chemically synthesized
tcatgcctcttctaacttttag

SEQ ID NO: 1218783 - DNA, 22 bp, Artificial Sequence
  chemically synthesized
tttcccagtggcctaaaagtta

SEQ ID NO: 1218784 - DNA, 22 bp, Artificial Sequence
  chemically synthesized
atgcctcttctaacttttaggc

SEQ ID NO: 1218785 - DNA, 22 bp, Artificial Sequence
  chemically synthesized
ttctaacttttaggccactggg

SEQ ID NO: 1218786 - DNA, 22 bp, Artificial Sequence
  chemically synthesized
ctaacttttaggccactgggaa

SEQ ID NO: 1218787 - DNA, 22 bp, Artificial Sequence
  chemically synthesized
taacttttaggccactgggaaa

SEQ ID NO: 1218788 - DNA, 22 bp, Artificial Sequence
  chemically synthesized
acttttaggccactgggaaata

SEQ ID NO: 1218789 - DNA, 22 bp, Artificial Sequence
  chemically synthesized
agacgtaaatgttatttcccag

SEQ ID NO: 1218790 - DNA, 22 bp, Artificial Sequence
  chemically synthesized
ttaggccactgggaaataacat

SEQ ID NO: 1218791 - DNA, 22 bp, Artificial Sequence
  chemically synthesized
taggccactgggaaataacatt

SEQ ID NO: 1218792 - DNA, 22 bp, Artificial Sequence
  chemically synthesized
aggccactgggaaataacattt

SEQ ID NO: 1218793 - DNA, 22 bp, Artificial Sequence
  chemically synthesized
ggccactgggaaataacattta

SEQ ID NO: 1218794 - DNA, 22 bp, Artificial Sequence
  chemically synthesized
atgacaaaaattaagacgtaaa

SEQ ID NO: 1218795 - DNA, 22 bp, Artificial Sequence
  chemically synthesized
catgacaaaaattaagacgtaa

SEQ ID NO: 1218796 - DNA, 22 bp, Artificial Sequence
  chemically synthesized
ggaaataacatttacgtcttaa

SEQ ID NO: 1218797 - DNA, 22 bp, Artificial Sequence
  chemically synthesized
ttcatgacaaaaattaagacgt

SEQ ID NO: 1218798 - DNA, 22 bp, Artificial Sequence
  chemically synthesized
ctcttcatgacaaaaattaaga

SEQ ID NO: 1218799 - DNA, 22 bp, Artificial Sequence
  chemically synthesized
aaattgctcttcatgacaaaaa

SEQ ID NO: 1218800 - DNA, 22 bp, Artificial Sequence
  chemically synthesized
gaaattgctcttcatgacaaaa

SEQ ID NO: 1218801 - DNA, 22 bp, Artificial Sequence
  chemically synthesized
acgtcttaatttttgtcatgaa

SEQ ID NO: 1218802 - DNA, 22 bp, Artificial Sequence
  chemically synthesized
cgtcttaatttttgtcatgaag

SEQ ID NO: 1218803 - DNA, 22 bp, Artificial Sequence
  chemically synthesized
aatttttgtcatgaagagcaat

SEQ ID NO: 1218804 - DNA, 22 bp, Artificial Sequence
  chemically synthesized
atttttgtcatgaagagcaatt

SEQ ID NO: 1218805 - DNA, 22 bp, Artificial Sequence
  chemically synthesized
atgggaaatcttgaaattgctc

SEQ ID NO: 1218806 - DNA, 22 bp, Artificial Sequence
  chemically synthesized
ttgtcatgaagagcaatttcaa

SEQ ID NO: 1218807 - DNA, 22 bp, Artificial Sequence
  chemically synthesized
tgtcatgaagagcaatttcaag

SEQ ID NO: 1218808 - DNA, 22 bp, Artificial Sequence
  chemically synthesized
gtcatgaagagcaatttcaaga

SEQ ID NO: 1218809 - DNA, 22 bp, Artificial Sequence
  chemically synthesized
cctgatgggaaatcttgaaatt

SEQ ID NO: 1218810 - DNA, 22 bp, Artificial Sequence
  chemically synthesized
tcatgaagagcaatttcaagat

SEQ ID NO: 1218811 - DNA, 22 bp, Artificial Sequence
  chemically synthesized
ccctgatgggaaatcttgaaat

SEQ ID NO: 1218812 - DNA, 22 bp, Artificial Sequence
  chemically synthesized
ttccctgatgggaaatcttgaa

SEQ ID NO: 1218813 - DNA, 22 bp, Artificial Sequence
  chemically synthesized
ctcttccctgatgggaaatctt

SEQ ID NO: 1218814 - DNA, 22 bp, Artificial Sequence
  chemically synthesized
cctcttccctgatgggaaatct

SEQ ID NO: 1218815 - DNA, 22 bp, Artificial Sequence
  chemically synthesized
tagcaatttcctcttccctgat

SEQ ID NO: 1218816 - DNA, 22 bp, Artificial Sequence
  chemically synthesized
caagatttcccatcagggaaga

SEQ ID NO: 1218817 - DNA, 22 bp, Artificial Sequence
  chemically synthesized
aagatttcccatcagggaagag

SEQ ID NO: 1218818 - DNA, 22 bp, Artificial Sequence
  chemically synthesized
ttgtagcaatttcctcttccct

SEQ ID NO: 1218819 - DNA, 22 bp, Artificial Sequence
  chemically synthesized
cccatcagggaagaggaaattg

SEQ ID NO: 1218820 - DNA, 22 bp, Artificial Sequence
  chemically synthesized
ccatcagggaagaggaaattgc

SEQ ID NO: 1218821 - DNA, 22 bp, Artificial Sequence
  chemically synthesized
agatattattgtagcaatttcc

SEQ ID NO: 1218822 - DNA, 22 bp, Artificial Sequence
  chemically synthesized
acattcagatattattgtagca

SEQ ID NO: 1218823 - DNA, 22 bp, Artificial Sequence
  chemically synthesized
tattaacattcagatattattg

SEQ ID NO: 1218824 - DNA, 22 bp, Artificial Sequence
  chemically synthesized
ctacaataatatctgaatgtta

SEQ ID NO: 1218825 - DNA, 22 bp, Artificial Sequence
  chemically synthesized
caataatatctgaatgttaata

SEQ ID NO: 1218826 - DNA, 22 bp, Artificial Sequence
  chemically synthesized
aatgttaatataatcatctgta

SEQ ID NO: 1218827 - DNA, 22 bp, Artificial Sequence
  chemically synthesized
atataatcatctgtatcatacc

SEQ ID NO: 1218828 - DNA, 22 bp, Artificial Sequence
  chemically synthesized
tatcatacctatttggtatata

SEQ ID NO: 1218829 - DNA, 22 bp, Artificial Sequence
  chemically synthesized
atgacaaagtaatatataccaa

SEQ ID NO: 1218830 - DNA, 22 bp, Artificial Sequence
  chemically synthesized
gatgacaaagtaatatatacca

SEQ ID NO: 1218831 - DNA, 22 bp, Artificial Sequence
  chemically synthesized
tgatgacaaagtaatatatacc

SEQ ID NO: 1218832 - DNA, 22 bp, Artificial Sequence
  chemically synthesized
ttgatgacaaagtaatatatac

SEQ ID NO: 1218833 - DNA, 22 bp, Artificial Sequence
  chemically synthesized
tttgatgacaaagtaatatata

SEQ ID NO: 1218834 - DNA, 22 bp, Artificial Sequence
  chemically synthesized
cctttttgatgacaaagtaata

SEQ ID NO: 1218835 - DNA, 22 bp, Artificial Sequence
  chemically synthesized
tttggtatatattactttgtca

SEQ ID NO: 1218836 - DNA, 22 bp, Artificial Sequence
  chemically synthesized
ggtatatattactttgtcatca

SEQ ID NO: 1218837 - DNA, 22 bp, Artificial Sequence
  chemically synthesized
gtatatattactttgtcatcaa

SEQ ID NO: 1218838 - DNA, 22 bp, Artificial Sequence
  chemically synthesized
ctttgtcatcaaaaaggcaatg

SEQ ID NO: 1218839 - DNA, 22 bp, Artificial Sequence
  chemically synthesized
tgtcatcaaaaaggcaatggcc

SEQ ID NO: 1218840 - DNA, 22 bp, Artificial Sequence
  chemically synthesized
gtcatcaaaaaggcaatggcca

SEQ ID NO: 1218841 - DNA, 22 bp, Artificial Sequence
  chemically synthesized
tcatcaaaaaggcaatggccat

SEQ ID NO: 1218842 - DNA, 22 bp, Artificial Sequence
  chemically synthesized
catgaatgaaaaatggccattg

SEQ ID NO: 1218843 - DNA, 22 bp, Artificial Sequence
  chemically synthesized
acatgaatgaaaaatggccatt

SEQ ID NO: 1218844 - DNA, 22 bp, Artificial Sequence
  chemically synthesized
gcacttacatgaatgaaaaatg

SEQ ID NO: 1218845 - DNA, 22 bp, Artificial Sequence
  chemically synthesized
actggcacttacatgaatgaaa

SEQ ID NO: 1218846 - DNA, 22 bp, Artificial Sequence
  chemically synthesized
cactggcacttacatgaatgaa

SEQ ID NO: 1218847 - DNA, 22 bp, Artificial Sequence
  chemically synthesized
agaaaatatttcactggcactt

SEQ ID NO: 1218848 - DNA, 22 bp, Artificial Sequence
  chemically synthesized
ttcattcatgtaagtgccagtg

SEQ ID NO: 1218849 - DNA, 22 bp, Artificial Sequence
  chemically synthesized
aagaaaatatttcactggcact

SEQ ID NO: 1218850 - DNA, 22 bp, Artificial Sequence
  chemically synthesized
tcattcatgtaagtgccagtga

SEQ ID NO: 1218851 - DNA, 22 bp, Artificial Sequence
  chemically synthesized
cattcatgtaagtgccagtgaa

SEQ ID NO: 1218852 - DNA, 22 bp, Artificial Sequence
  chemically synthesized
attcatgtaagtgccagtgaaa

SEQ ID NO: 1218853 - DNA, 22 bp, Artificial Sequence
  chemically synthesized
atgtaagtgccagtgaaatatt

SEQ ID NO: 1218854 - DNA, 22 bp, Artificial Sequence
  chemically synthesized
agaaaatatttaagaaaatatt

SEQ ID NO: 1218855 - DNA, 22 bp, Artificial Sequence
  chemically synthesized
aagaaaatatttaagaaaatat

SEQ ID NO: 1218856 - DNA, 22 bp, Artificial Sequence
  chemically synthesized
aaaatatatttaagaaaatatt

SEQ ID NO: 1218857 - DNA, 22 bp, Artificial Sequence
  chemically synthesized
cagttgaaaatatatttaagaa

SEQ ID NO: 1218858 - DNA, 22 bp, Artificial Sequence
  chemically synthesized
tcttaaatattttcttaaatat

SEQ ID NO: 1218859 - DNA, 22 bp, Artificial Sequence
  chemically synthesized
cttaaatattttcttaaatata

SEQ ID NO: 1218860 - DNA, 22 bp, Artificial Sequence
  chemically synthesized
tgcagttgaaaatatatttaag

SEQ ID NO: 1218861 - DNA, 22 bp, Artificial Sequence
  chemically synthesized
ttaaatattttcttaaatatat

SEQ ID NO: 1218862 - DNA, 22 bp, Artificial Sequence
  chemically synthesized
aaatattttcttaaatatattt

SEQ ID NO: 1218863 - DNA, 22 bp, Artificial Sequence
  chemically synthesized
aatattttcttaaatatatttt

SEQ ID NO: 1218864 - DNA, 22 bp, Artificial Sequence
  chemically synthesized
tcttaaatatattttcaactgc

SEQ ID NO: 1218865 - DNA, 22 bp, Artificial Sequence
  chemically synthesized
gagtcaaactctgcagttgaaa

SEQ ID NO: 1218866 - DNA, 22 bp, Artificial Sequence
  chemically synthesized
cttaaatatattttcaactgca

SEQ ID NO: 1218867 - DNA, 22 bp, Artificial Sequence
  chemically synthesized
agagtcaaactctgcagttgaa

SEQ ID NO: 1218868 - DNA, 22 bp, Artificial Sequence
  chemically synthesized
ttaaatatattttcaactgcag

SEQ ID NO: 1218869 - DNA, 22 bp, Artificial Sequence
  chemically synthesized
aaatatattttcaactgcagag

SEQ ID NO: 1218870 - DNA, 22 bp, Artificial Sequence
  chemically synthesized
aatatattttcaactgcagagt

SEQ ID NO: 1218871 - DNA, 22 bp, Artificial Sequence
  chemically synthesized
agacaatttagagtcaaactct

SEQ ID NO: 1218872 - DNA, 22 bp, Artificial Sequence
  chemically synthesized
cagacaatttagagtcaaactc

SEQ ID NO: 1218873 - DNA, 22 bp, Artificial Sequence
  chemically synthesized
tcaactgcagagtttgactcta

SEQ ID NO: 1218874 - DNA, 22 bp, Artificial Sequence
  chemically synthesized
caactgcagagtttgactctaa

SEQ ID NO: 1218875 - DNA, 22 bp, Artificial Sequence
  chemically synthesized
aactgcagagtttgactctaaa

SEQ ID NO: 1218876 - DNA, 22 bp, Artificial Sequence
  chemically synthesized
taaatatttcagacaatttaga

SEQ ID NO: 1218877 - DNA, 22 bp, Artificial Sequence
  chemically synthesized
cagagtttgactctaaattgtc

SEQ ID NO: 1218878 - DNA, 22 bp, Artificial Sequence
  chemically synthesized
ctgtaaatatttcagacaattt

SEQ ID NO: 1218879 - DNA, 22 bp, Artificial Sequence
  chemically synthesized
actgtaaatatttcagacaatt

SEQ ID NO: 1218880 - DNA, 22 bp, Artificial Sequence
  chemically synthesized
gactctaaattgtctgaaatat

SEQ ID NO: 1218881 - DNA, 22 bp, Artificial Sequence
  chemically synthesized
actctaaattgtctgaaatatt

SEQ ID NO: 1218882 - DNA, 22 bp, Artificial Sequence
  chemically synthesized
gaaatccttactgtaaatattt

SEQ ID NO: 1218883 - DNA, 22 bp, Artificial Sequence
  chemically synthesized
taaattgtctgaaatatttaca

SEQ ID NO: 1218884 - DNA, 22 bp, Artificial Sequence
  chemically synthesized
aattgtctgaaatatttacagt

SEQ ID NO: 1218885 - DNA, 22 bp, Artificial Sequence
  chemically synthesized
aactagaaatccttactgtaaa

SEQ ID NO: 1218886 - DNA, 22 bp, Artificial Sequence
  chemically synthesized
caactagaaatccttactgtaa

SEQ ID NO: 1218887 - DNA, 22 bp, Artificial Sequence
  chemically synthesized
tctgaaatatttacagtaagga

SEQ ID NO: 1218888 - DNA, 22 bp, Artificial Sequence
  chemically synthesized
aaatatttacagtaaggatttc

SEQ ID NO: 1218889 - DNA, 22 bp, Artificial Sequence
  chemically synthesized
tatacggtatttcaactagaaa

SEQ ID NO: 1218890 - DNA, 22 bp, Artificial Sequence
  chemically synthesized
acagtaaggatttctagttgaa

SEQ ID NO: 1218891 - DNA, 22 bp, Artificial Sequence
  chemically synthesized
tatatacggtatttcaactaga

SEQ ID NO: 1218892 - DNA, 22 bp, Artificial Sequence
  chemically synthesized
cagtaaggatttctagttgaaa

SEQ ID NO: 1218893 - DNA, 22 bp, Artificial Sequence
  chemically synthesized
tctatatacggtatttcaacta

SEQ ID NO: 1218894 - DNA, 22 bp, Artificial Sequence
  chemically synthesized
ctctatatacggtatttcaact

SEQ ID NO: 1218895 - DNA, 22 bp, Artificial Sequence
  chemically synthesized
cttctctatatacggtatttca

SEQ ID NO: 1218896 - DNA, 22 bp, Artificial Sequence
  chemically synthesized
ctagttgaaataccgtatatag

SEQ ID NO: 1218897 - DNA, 22 bp, Artificial Sequence
  chemically synthesized
tagttgaaataccgtatataga

SEQ ID NO: 1218898 - DNA, 22 bp, Artificial Sequence
  chemically synthesized
taggtgttccttctctatatac

SEQ ID NO: 1218899 - DNA, 22 bp, Artificial Sequence
  chemically synthesized
gttgaaataccgtatatagaga

SEQ ID NO: 1218900 - DNA, 22 bp, Artificial Sequence
  chemically synthesized
aaataccgtatatagagaagga

SEQ ID NO: 1218901 - DNA, 22 bp, Artificial Sequence
  chemically synthesized
caatattataggtgttccttct

SEQ ID NO: 1218902 - DNA, 22 bp, Artificial Sequence
  chemically synthesized
atgcgattgcaatattataggt

SEQ ID NO: 1218903 - DNA, 22 bp, Artificial Sequence
  chemically synthesized
agaaaatctaatgcgattgcaa

SEQ ID NO: 1218904 - DNA, 22 bp, Artificial Sequence
  chemically synthesized
cagaaaatctaatgcgattgca

SEQ ID NO: 1218905 - DNA, 22 bp, Artificial Sequence
  chemically synthesized
tcagaaaatctaatgcgattgc

SEQ ID NO: 1218906 - DNA, 22 bp, Artificial Sequence
  chemically synthesized
ttttcagaaaatctaatgcgat

SEQ ID NO: 1218907 - DNA, 22 bp, Artificial Sequence
  chemically synthesized
gttttcagaaaatctaatgcga

SEQ ID NO: 1218908 - DNA, 22 bp, Artificial Sequence
  chemically synthesized
taatattgcaatcgcattagat

SEQ ID NO: 1218909 - DNA, 22 bp, Artificial Sequence
  chemically synthesized
caatcgcattagattttctgaa

SEQ ID NO: 1218910 - DNA, 22 bp, Artificial Sequence
  chemically synthesized
tagagtaccttgttttcagaaa

SEQ ID NO: 1218911 - DNA, 22 bp, Artificial Sequence
  chemically synthesized
attatagagtaccttgttttca

SEQ ID NO: 1218912 - DNA, 22 bp, Artificial Sequence
  chemically synthesized
gattttctgaaaacaaggtact

SEQ ID NO: 1218913 - DNA, 22 bp, Artificial Sequence
  chemically synthesized
gaactcattatagagtaccttg

SEQ ID NO: 1218914 - DNA, 22 bp, Artificial Sequence
  chemically synthesized
tctgaaaacaaggtactctata

SEQ ID NO: 1218915 - DNA, 22 bp, Artificial Sequence
  chemically synthesized
tctagaactcattatagagtac

SEQ ID NO: 1218916 - DNA, 22 bp, Artificial Sequence
  chemically synthesized
ctgaaaacaaggtactctataa

SEQ ID NO: 1218917 - DNA, 22 bp, Artificial Sequence
  chemically synthesized
gtctagaactcattatagagta

SEQ ID NO: 1218918 - DNA, 22 bp, Artificial Sequence
  chemically synthesized
tgaaaacaaggtactctataat

SEQ ID NO: 1218919 - DNA, 22 bp, Artificial Sequence
  chemically synthesized
tgtctagaactcattatagagt

SEQ ID NO: 1218920 - DNA, 22 bp, Artificial Sequence
  chemically synthesized
ttgtctagaactcattatagag

SEQ ID NO: 1218921 - DNA, 22 bp, Artificial Sequence
  chemically synthesized
aaaacaaggtactctataatga

SEQ ID NO: 1218922 - DNA, 22 bp, Artificial Sequence
  chemically synthesized
atttttgtctagaactcattat

SEQ ID NO: 1218923 - DNA, 22 bp, Artificial Sequence
  chemically synthesized
gattgatttttgtctagaactc

SEQ ID NO: 1218924 - DNA, 22 bp, Artificial Sequence
  chemically synthesized
agattgatttttgtctagaact

SEQ ID NO: 1218925 - DNA, 22 bp, Artificial Sequence
  chemically synthesized
tataatgagttctagacaaaaa

SEQ ID NO: 1218926 - DNA, 22 bp, Artificial Sequence
  chemically synthesized
taatgagttctagacaaaaatc

SEQ ID NO: 1218927 - DNA, 22 bp, Artificial Sequence
  chemically synthesized
tatcatttagattgatttttgt

SEQ ID NO: 1218928 - DNA, 22 bp, Artificial Sequence
  chemically synthesized
atatcatttagattgatttttg

SEQ ID NO: 1218929 - DNA, 22 bp, Artificial Sequence
  chemically synthesized
tatatcatttagattgattttt

SEQ ID NO: 1218930 - DNA, 22 bp, Artificial Sequence
  chemically synthesized
attttatatcatttagattgat

SEQ ID NO: 1218931 - DNA, 22 bp, Artificial Sequence
  chemically synthesized
tagacaaaaatcaatctaaatg

SEQ ID NO: 1218932 - DNA, 22 bp, Artificial Sequence
  chemically synthesized
gacaaaaatcaatctaaatgat

SEQ ID NO: 1218933 - DNA, 22 bp, Artificial Sequence
  chemically synthesized
tgaacataaacactaattttat

SEQ ID NO: 1218934 - DNA, 22 bp, Artificial Sequence
  chemically synthesized
gtgaacataaacactaatttta

SEQ ID NO: 1218935 - DNA, 22 bp, Artificial Sequence
  chemically synthesized
tgtgaacataaacactaatttt

SEQ ID NO: 1218936 - DNA, 22 bp, Artificial Sequence
  chemically synthesized
ttgtgaacataaacactaattt

SEQ ID NO: 1218937 - DNA, 22 bp, Artificial Sequence
  chemically synthesized
aatgatataaaattagtgttta

SEQ ID NO: 1218938 - DNA, 22 bp, Artificial Sequence
  chemically synthesized
aataaataaatatttttgtgaa

SEQ ID NO: 1218939 - DNA, 22 bp, Artificial Sequence
  chemically synthesized
aaataaataaatatttttgtga

SEQ ID NO: 1218940 - DNA, 22 bp, Artificial Sequence
  chemically synthesized
gtgtttatgttcacaaaaatat

SEQ ID NO: 1218941 - DNA, 22 bp, Artificial Sequence
  chemically synthesized
atttaaataaataaatattttt

SEQ ID NO: 1218942 - DNA, 22 bp, Artificial Sequence
  chemically synthesized
atgttcacaaaaatatttattt

SEQ ID NO: 1218943 - DNA, 22 bp, Artificial Sequence
  chemically synthesized
tgttcacaaaaatatttattta

SEQ ID NO: 1218944 - DNA, 22 bp, Artificial Sequence
  chemically synthesized
gagttaatttaaataaataaat

SEQ ID NO: 1218945 - DNA, 22 bp, Artificial Sequence
  chemically synthesized
acaaaaatatttatttatttaa

SEQ ID NO: 1218946 - DNA, 22 bp, Artificial Sequence
  chemically synthesized
aggaggattagagttaatttaa

SEQ ID NO: 1218947 - DNA, 22 bp, Artificial Sequence
  chemically synthesized
tcaggaggattagagttaattt

SEQ ID NO: 1218948 - DNA, 22 bp, Artificial Sequence
  chemically synthesized
atttatttaaattaactctaat

SEQ ID NO: 1218949 - DNA, 22 bp, Artificial Sequence
  chemically synthesized
attctcaggaggattagagtta

SEQ ID NO: 1218950 - DNA, 22 bp, Artificial Sequence
  chemically synthesized
tttatttaaattaactctaatc

SEQ ID NO: 1218951 - DNA, 22 bp, Artificial Sequence
  chemically synthesized
atttaaattaactctaatcctc

SEQ ID NO: 1218952 - DNA, 22 bp, Artificial Sequence
  chemically synthesized
tttaaattaactctaatcctcc

SEQ ID NO: 1218953 - DNA, 22 bp, Artificial Sequence
  chemically synthesized
aaattaactctaatcctcctga

SEQ ID NO: 1218954 - DNA, 22 bp, Artificial Sequence
  chemically synthesized
aattaactctaatcctcctgag

SEQ ID NO: 1218955 - DNA, 22 bp, Artificial Sequence
  chemically synthesized
agagggttaattctcaggagga

SEQ ID NO: 1218956 - DNA, 22 bp, Artificial Sequence
  chemically synthesized
actctaatcctcctgagaatta

SEQ ID NO: 1218957 - DNA, 22 bp, Artificial Sequence
  chemically synthesized
aaattgagagggttaattctca

SEQ ID NO: 1218958 - DNA, 22 bp, Artificial Sequence
  chemically synthesized
taatcctcctgagaattaaccc

SEQ ID NO: 1218959 - DNA, 22 bp, Artificial Sequence
  chemically synthesized
atcctcctgagaattaaccctc

SEQ ID NO: 1218960 - DNA, 22 bp, Artificial Sequence
  chemically synthesized
cacaggttaaaattgagagggt

SEQ ID NO: 1218961 - DNA, 22 bp, Artificial Sequence
  chemically synthesized
acacaggttaaaattgagaggg

SEQ ID NO: 1218962 - DNA, 22 bp, Artificial Sequence
  chemically synthesized
ctgagaattaaccctctcaatt

SEQ ID NO: 1218963 - DNA, 22 bp, Artificial Sequence
  chemically synthesized
agaattaaccctctcaatttta

SEQ ID NO: 1218964 - DNA, 22 bp, Artificial Sequence
  chemically synthesized
taagtttacacaggttaaaatt

SEQ ID NO: 1218965 - DNA, 22 bp, Artificial Sequence
  chemically synthesized
ataagtttacacaggttaaaat

SEQ ID NO: 1218966 - DNA, 22 bp, Artificial Sequence
  chemically synthesized
accctctcaattttaacctgtg

SEQ ID NO: 1218967 - DNA, 22 bp, Artificial Sequence
  chemically synthesized
tcaattttaacctgtgtaaact

SEQ ID NO: 1218968 - DNA, 22 bp, Artificial Sequence
  chemically synthesized
aattttaacctgtgtaaactta

SEQ ID NO: 1218969 - DNA, 22 bp, Artificial Sequence
  chemically synthesized
taacctgtgtaaacttataaac

SEQ ID NO: 1218970 - DNA, 22 bp, Artificial Sequence
  chemically synthesized
aacctgtgtaaacttataaaca

SEQ ID NO: 1218971 - DNA, 22 bp, Artificial Sequence
  chemically synthesized
acctgtgtaaacttataaacat

SEQ ID NO: 1218972 - DNA, 22 bp, Artificial Sequence
  chemically synthesized
tgtaaacttataaacatttctt

SEQ ID NO: 1218973 - DNA, 22 bp, Artificial Sequence
  chemically synthesized
ataccataatggcaagaaatgt

SEQ ID NO: 1218974 - DNA, 22 bp, Artificial Sequence
  chemically synthesized
gataccataatggcaagaaatg

SEQ ID NO: 1218975 - DNA, 22 bp, Artificial Sequence
  chemically synthesized
tgataccataatggcaagaaat

SEQ ID NO: 1218976 - DNA, 22 bp, Artificial Sequence
  chemically synthesized
ataaacatttcttgccattatg

SEQ ID NO: 1218977 - DNA, 22 bp, Artificial Sequence
  chemically synthesized
taaacatttcttgccattatgg

SEQ ID NO: 1218978 - DNA, 22 bp, Artificial Sequence
  chemically synthesized
taatcatcacattttgatacca

SEQ ID NO: 1218979 - DNA, 22 bp, Artificial Sequence
  chemically synthesized
cttgccattatggtatcaaaat

SEQ ID NO: 1218980 - DNA, 22 bp, Artificial Sequence
  chemically synthesized
ttgccattatggtatcaaaatg

SEQ ID NO: 1218981 - DNA, 22 bp, Artificial Sequence
  chemically synthesized
ctgtaatcatcacattttgata

SEQ ID NO: 1218982 - DNA, 22 bp, Artificial Sequence
  chemically synthesized
gccattatggtatcaaaatgtg

SEQ ID NO: 1218983 - DNA, 22 bp, Artificial Sequence
  chemically synthesized
tgctgtaatcatcacattttga

SEQ ID NO: 1218984 - DNA, 22 bp, Artificial Sequence
  chemically synthesized
ccattatggtatcaaaatgtga

SEQ ID NO: 1218985 - DNA, 22 bp, Artificial Sequence
  chemically synthesized
cgcctctgctgtaatcatcaca

SEQ ID NO: 1218986 - DNA, 22 bp, Artificial Sequence
  chemically synthesized
tggtatcaaaatgtgatgatta

SEQ ID NO: 1218987 - DNA, 22 bp, Artificial Sequence
  chemically synthesized
ccgcctctgctgtaatcatcac

SEQ ID NO: 1218988 - DNA, 22 bp, Artificial Sequence
  chemically synthesized
tccgcctctgctgtaatcatca

SEQ ID NO: 1218989 - DNA, 22 bp, Artificial Sequence
  chemically synthesized
ttccgcctctgctgtaatcatc

SEQ ID NO: 1218990 - DNA, 22 bp, Artificial Sequence
  chemically synthesized
tttccgcctctgctgtaatcat

SEQ ID NO: 1218991 - DNA, 22 bp, Artificial Sequence
  chemically synthesized
ttttccgcctctgctgtaatca

SEQ ID NO: 1218992 - DNA, 22 bp, Artificial Sequence
  chemically synthesized
acttttttccgcctctgctgta

SEQ ID NO: 1218993 - DNA, 22 bp, Artificial Sequence
  chemically synthesized
aacttttttccgcctctgctgt

SEQ ID NO: 1218994 - DNA, 22 bp, Artificial Sequence
  chemically synthesized
taacttttttccgcctctgctg

SEQ ID NO: 1218995 - DNA, 22 bp, Artificial Sequence
  chemically synthesized
ttttaacttttttccgcctctg

SEQ ID NO: 1218996 - DNA, 22 bp, Artificial Sequence
  chemically synthesized
cagcagaggcggaaaaaagtta

SEQ ID NO: 1218997 - DNA, 22 bp, Artificial Sequence
  chemically synthesized
aacaagggctgttttaactttt

SEQ ID NO: 1218998 - DNA, 22 bp, Artificial Sequence
  chemically synthesized
gctgaacaagggctgttttaac

SEQ ID NO: 1218999 - DNA, 22 bp, Artificial Sequence
  chemically synthesized
atatcaattggctgaacaaggg

SEQ ID NO: 1219000 - DNA, 22 bp, Artificial Sequence
  chemically synthesized
gatatcaattggctgaacaagg

SEQ ID NO: 1219001 - DNA, 22 bp, Artificial Sequence
  chemically synthesized
aaacagcccttgttcagccaat

SEQ ID NO: 1219002 - DNA, 22 bp, Artificial Sequence
  chemically synthesized
ggtttgatatcaattggctgaa

SEQ ID NO: 1219003 - DNA, 22 bp, Artificial Sequence
  chemically synthesized
tgttgggtttgatatcaattgg

SEQ ID NO: 1219004 - DNA, 22 bp, Artificial Sequence
  chemically synthesized
atgttgggtttgatatcaattg

SEQ ID NO: 1219005 - DNA, 22 bp, Artificial Sequence
  chemically synthesized
ttatgttgggtttgatatcaat

SEQ ID NO: 1219006 - DNA, 22 bp, Artificial Sequence
  chemically synthesized
gttcagccaattgatatcaaac

SEQ ID NO: 1219007 - DNA, 22 bp, Artificial Sequence
  chemically synthesized
ttcagccaattgatatcaaacc

SEQ ID NO: 1219008 - DNA, 22 bp, Artificial Sequence
  chemically synthesized
agccaattgatatcaaacccaa

SEQ ID NO: 1219009 - DNA, 22 bp, Artificial Sequence
  chemically synthesized
aggcctcttatgttgggtttga

SEQ ID NO: 1219010 - DNA, 22 bp, Artificial Sequence
  chemically synthesized
aaggcctcttatgttgggtttg

SEQ ID NO: 1219011 - DNA, 22 bp, Artificial Sequence
  chemically synthesized
taaggcctcttatgttgggttt

SEQ ID NO: 1219012 - DNA, 22 bp, Artificial Sequence
  chemically synthesized
ttaaggcctcttatgttgggtt

SEQ ID NO: 1219013 - DNA, 22 bp, Artificial Sequence
  chemically synthesized
atatcaaacccaacataagagg

SEQ ID NO: 1219014 - DNA, 22 bp, Artificial Sequence
  chemically synthesized
taaaagagaagaatatttttaa

SEQ ID NO: 1219015 - DNA, 22 bp, Artificial Sequence
  chemically synthesized
ctataaaagagaagaatatttt

SEQ ID NO: 1219016 - DNA, 22 bp, Artificial Sequence
  chemically synthesized
gctataaaagagaagaatattt

SEQ ID NO: 1219017 - DNA, 22 bp, Artificial Sequence
  chemically synthesized
aaaaatattcttctcttttata

SEQ ID NO: 1219018 - DNA, 22 bp, Artificial Sequence
  chemically synthesized
aaaatattcttctcttttatag

SEQ ID NO: 1219019 - DNA, 22 bp, Artificial Sequence
  chemically synthesized
ttctcttttatagcaaattcta

SEQ ID NO: 1219020 - DNA, 22 bp, Artificial Sequence
  chemically synthesized
ctcttttatagcaaattctatg

SEQ ID NO: 1219021 - DNA, 22 bp, Artificial Sequence
  chemically synthesized
tcttttatagcaaattctatgt

SEQ ID NO: 1219022 - DNA, 22 bp, Artificial Sequence
  chemically synthesized
ttttatagcaaattctatgtat

SEQ ID NO: 1219023 - DNA, 22 bp, Artificial Sequence
  chemically synthesized
ttatagcaaattctatgtatct

SEQ ID NO: 1219024 - DNA, 22 bp, Artificial Sequence
  chemically synthesized
tatagcaaattctatgtatctt

SEQ ID NO: 1219025 - DNA, 22 bp, Artificial Sequence
  chemically synthesized
atagcaaattctatgtatcttt

SEQ ID NO: 1219026 - DNA, 22 bp, Artificial Sequence
  chemically synthesized
tagcaaattctatgtatctttc

SEQ ID NO: 1219027 - DNA, 22 bp, Artificial Sequence
  chemically synthesized
caaaaataatcatggaaagata

SEQ ID NO: 1219028 - DNA, 22 bp, Artificial Sequence
  chemically synthesized
acctacaaaaataatcatggaa

SEQ ID NO: 1219029 - DNA, 22 bp, Artificial Sequence
  chemically synthesized
aacctacaaaaataatcatgga

SEQ ID NO: 1219030 - DNA, 22 bp, Artificial Sequence
  chemically synthesized
taacctacaaaaataatcatgg

SEQ ID NO: 1219031 - DNA, 22 bp, Artificial Sequence
  chemically synthesized
tatgtatctttccatgattatt

SEQ ID NO: 1219032 - DNA, 22 bp, Artificial Sequence
  chemically synthesized
tgtatctttccatgattatttt

SEQ ID NO: 1219033 - DNA, 22 bp, Artificial Sequence
  chemically synthesized
tccatgattatttttgtaggtt

SEQ ID NO: 1219034 - DNA, 22 bp, Artificial Sequence
  chemically synthesized
ccatgattatttttgtaggtta

SEQ ID NO: 1219035 - DNA, 22 bp, Artificial Sequence
  chemically synthesized
catgattatttttgtaggttaa

SEQ ID NO: 1219036 - DNA, 22 bp, Artificial Sequence
  chemically synthesized
tatgcatgcaggattttaacct

SEQ ID NO: 1219037 - DNA, 22 bp, Artificial Sequence
  chemically synthesized
gtatgcatgcaggattttaacc

SEQ ID NO: 1219038 - DNA, 22 bp, Artificial Sequence
  chemically synthesized
tgtatgcatgcaggattttaac

SEQ ID NO: 1219039 - DNA, 22 bp, Artificial Sequence
  chemically synthesized
tttttgtaggttaaaatcctgc

SEQ ID NO: 1219040 - DNA, 22 bp, Artificial Sequence
  chemically synthesized
gctttgtatgcatgcaggattt

SEQ ID NO: 1219041 - DNA, 22 bp, Artificial Sequence
  chemically synthesized
ggctttgtatgcatgcaggatt

SEQ ID NO: 1219042 - DNA, 22 bp, Artificial Sequence
  chemically synthesized
ttgtaggttaaaatcctgcatg

SEQ ID NO: 1219043 - DNA, 22 bp, Artificial Sequence
  chemically synthesized
tgtaggttaaaatcctgcatgc

SEQ ID NO: 1219044 - DNA, 22 bp, Artificial Sequence
  chemically synthesized
gtaggttaaaatcctgcatgca

SEQ ID NO: 1219045 - DNA, 22 bp, Artificial Sequence
  chemically synthesized
taggttaaaatcctgcatgcat

SEQ ID NO: 1219046 - DNA, 22 bp, Artificial Sequence
  chemically synthesized
agacttggctttgtatgcatgc

SEQ ID NO: 1219047 - DNA, 22 bp, Artificial Sequence
  chemically synthesized
cagacttggctttgtatgcatg

SEQ ID NO: 1219048 - DNA, 22 bp, Artificial Sequence
  chemically synthesized
tcagacttggctttgtatgcat

SEQ ID NO: 1219049 - DNA, 22 bp, Artificial Sequence
  chemically synthesized
aaatcctgcatgcatacaaagc

SEQ ID NO: 1219050 - DNA, 22 bp, Artificial Sequence
  chemically synthesized
catgcatacaaagccaagtctg

SEQ ID NO: 1219051 - DNA, 22 bp, Artificial Sequence
  chemically synthesized
gagtgaatgctttcagacttgg

SEQ ID NO: 1219052 - DNA, 22 bp, Artificial Sequence
  chemically synthesized
ctggagtgaatgctttcagact

SEQ ID NO: 1219053 - DNA, 22 bp, Artificial Sequence
  chemically synthesized
ctcctggagtgaatgctttcag

SEQ ID NO: 1219054 - DNA, 22 bp, Artificial Sequence
  chemically synthesized
actcctggagtgaatgctttca

SEQ ID NO: 1219055 - DNA, 22 bp, Artificial Sequence
  chemically synthesized
tactcctggagtgaatgctttc

SEQ ID NO: 1219056 - DNA, 22 bp, Artificial Sequence
  chemically synthesized
gaaagttttactcctggagtga

SEQ ID NO: 1219057 - DNA, 22 bp, Artificial Sequence
  chemically synthesized
ttggaaagttttactcctggag

SEQ ID NO: 1219058 - DNA, 22 bp, Artificial Sequence
  chemically synthesized
aaagcattcactccaggagtaa

SEQ ID NO: 1219059 - DNA, 22 bp, Artificial Sequence
  chemically synthesized
cctgttggaaagttttactcct

SEQ ID NO: 1219060 - DNA, 22 bp, Artificial Sequence
  chemically synthesized
tgcctgttggaaagttttactc

SEQ ID NO: 1219061 - DNA, 22 bp, Artificial Sequence
  chemically synthesized
gctctgcctgttggaaagtttt

SEQ ID NO: 1219062 - DNA, 22 bp, Artificial Sequence
  chemically synthesized
actccaggagtaaaactttcca

SEQ ID NO: 1219063 - DNA, 22 bp, Artificial Sequence
  chemically synthesized
caggagtaaaactttccaacag

SEQ ID NO: 1219064 - DNA, 22 bp, Artificial Sequence
  chemically synthesized
caagaattagctctgcctgttg

SEQ ID NO: 1219065 - DNA, 22 bp, Artificial Sequence
  chemically synthesized
ccaagaattagctctgcctgtt

SEQ ID NO: 1219066 - DNA, 22 bp, Artificial Sequence
  chemically synthesized
tccaagaattagctctgcctgt

SEQ ID NO: 1219067 - DNA, 22 bp, Artificial Sequence
  chemically synthesized
ttccaagaattagctctgcctg

SEQ ID NO: 1219068 - DNA, 22 bp, Artificial Sequence
  chemically synthesized
ttttccaagaattagctctgcc

SEQ ID NO: 1219069 - DNA, 22 bp, Artificial Sequence
  chemically synthesized
cttttccaagaattagctctgc

SEQ ID NO: 1219070 - DNA, 22 bp, Artificial Sequence
  chemically synthesized
tccaacaggcagagctaattct

SEQ ID NO: 1219071 - DNA, 22 bp, Artificial Sequence
  chemically synthesized
ccaacaggcagagctaattctt

SEQ ID NO: 1219072 - DNA, 22 bp, Artificial Sequence
  chemically synthesized
caacaggcagagctaattcttg

SEQ ID NO: 1219073 - DNA, 22 bp, Artificial Sequence
  chemically synthesized
tagccttcttttccaagaatta

SEQ ID NO: 1219074 - DNA, 22 bp, Artificial Sequence
  chemically synthesized
atagccttcttttccaagaatt

SEQ ID NO: 1219075 - DNA, 22 bp, Artificial Sequence
  chemically synthesized
tatagccttcttttccaagaat

SEQ ID NO: 1219076 - DNA, 22 bp, Artificial Sequence
  chemically synthesized
ttatagccttcttttccaagaa

SEQ ID NO: 1219077 - DNA, 22 bp, Artificial Sequence
  chemically synthesized
tttttatagccttcttttccaa

SEQ ID NO: 1219078 - DNA, 22 bp, Artificial Sequence
  chemically synthesized
agttgtttttatagccttcttt

SEQ ID NO: 1219079 - DNA, 22 bp, Artificial Sequence
  chemically synthesized
gagttgtttttatagccttctt

SEQ ID NO: 1219080 - DNA, 22 bp, Artificial Sequence
  chemically synthesized
attcttggaaaagaaggctata

SEQ ID NO: 1219081 - DNA, 22 bp, Artificial Sequence
  chemically synthesized
ttgagttgtttttatagccttc

SEQ ID NO: 1219082 - DNA, 22 bp, Artificial Sequence
  chemically synthesized
ttggaaaagaaggctataaaaa

SEQ ID NO: 1219083 - DNA, 22 bp, Artificial Sequence
  chemically synthesized
ggaaaagaaggctataaaaaca

SEQ ID NO: 1219084 - DNA, 22 bp, Artificial Sequence
  chemically synthesized
gaaaagaaggctataaaaacaa

SEQ ID NO: 1219085 - DNA, 22 bp, Artificial Sequence
  chemically synthesized
catcactcttgagttgttttta

SEQ ID NO: 1219086 - DNA, 22 bp, Artificial Sequence
  chemically synthesized
atccctgcatcactcttgagtt

SEQ ID NO: 1219087 - DNA, 22 bp, Artificial Sequence
  chemically synthesized
gctaatccctgcatcactcttg

SEQ ID NO: 1219088 - DNA, 22 bp, Artificial Sequence
  chemically synthesized
taaaaacaactcaagagtgatg

SEQ ID NO: 1219089 - DNA, 22 bp, Artificial Sequence
  chemically synthesized
ggctaatccctgcatcactctt

SEQ ID NO: 1219090 - DNA, 22 bp, Artificial Sequence
  chemically synthesized
cttggctaatccctgcatcact

SEQ ID NO: 1219091 - DNA, 22 bp, Artificial Sequence
  chemically synthesized
tgcttggctaatccctgcatca

SEQ ID NO: 1219092 - DNA, 22 bp, Artificial Sequence
  chemically synthesized
ctgcttggctaatccctgcatc

SEQ ID NO: 1219093 - DNA, 22 bp, Artificial Sequence
  chemically synthesized
tctgcttggctaatccctgcat

SEQ ID NO: 1219094 - DNA, 22 bp, Artificial Sequence
  chemically synthesized
ttttctgcttggctaatccctg

SEQ ID NO: 1219095 - DNA, 22 bp, Artificial Sequence
  chemically synthesized
aagagtgatgcagggattagcc

SEQ ID NO: 1219096 - DNA, 22 bp, Artificial Sequence
  chemically synthesized
tattttctgcttggctaatccc

SEQ ID NO: 1219097 - DNA, 22 bp, Artificial Sequence
  chemically synthesized
gccaagcagaaaatagaatccg

SEQ ID NO: 1219098 - DNA, 22 bp, Artificial Sequence
  chemically synthesized
agaatggtgacacggattctat

SEQ ID NO: 1219099 - DNA, 22 bp, Artificial Sequence
  chemically synthesized
ctgagaatggtgacacggattc

SEQ ID NO: 1219100 - DNA, 22 bp, Artificial Sequence
  chemically synthesized
cctgagaatggtgacacggatt

SEQ ID NO: 1219101 - DNA, 22 bp, Artificial Sequence
  chemically synthesized
acttcctgagaatggtgacacg

SEQ ID NO: 1219102 - DNA, 22 bp, Artificial Sequence
  chemically synthesized
gacttcctgagaatggtgacac

SEQ ID NO: 1219103 - DNA, 22 bp, Artificial Sequence
  chemically synthesized
tgacttcctgagaatggtgaca

SEQ ID NO: 1219104 - DNA, 22 bp, Artificial Sequence
  chemically synthesized
ttttgacttcctgagaatggtg

SEQ ID NO: 1219105 - DNA, 22 bp, Artificial Sequence
  chemically synthesized
attttgacttcctgagaatggt

SEQ ID NO: 1219106 - DNA, 22 bp, Artificial Sequence
  chemically synthesized
tattttgacttcctgagaatgg

SEQ ID NO: 1219107 - DNA, 22 bp, Artificial Sequence
  chemically synthesized
atcccctttattttgacttcct

SEQ ID NO: 1219108 - DNA, 22 bp, Artificial Sequence
  chemically synthesized
aatcccctttattttgacttcc

SEQ ID NO: 1219109 - DNA, 22 bp, Artificial Sequence
  chemically synthesized
taatcccctttattttgacttc

SEQ ID NO: 1219110 - DNA, 22 bp, Artificial Sequence
  chemically synthesized
gttttaatcccctttattttga

SEQ ID NO: 1219111 - DNA, 22 bp, Artificial Sequence
  chemically synthesized
ggttttaatcccctttattttg

SEQ ID NO: 1219112 - DNA, 22 bp, Artificial Sequence
  chemically synthesized
tcaggaagtcaaaataaagggg

SEQ ID NO: 1219113 - DNA, 22 bp, Artificial Sequence
  chemically synthesized
aggaagtcaaaataaaggggat

SEQ ID NO: 1219114 - DNA, 22 bp, Artificial Sequence
  chemically synthesized
gggtttggttttaatccccttt

SEQ ID NO: 1219115 - DNA, 22 bp, Artificial Sequence
  chemically synthesized
caaacccgttagggtttggttt

SEQ ID NO: 1219116 - DNA, 22 bp, Artificial Sequence
  chemically synthesized
acaaacccgttagggtttggtt

SEQ ID NO: 1219117 - DNA, 22 bp, Artificial Sequence
  chemically synthesized
aaaccaaaccctaacgggtttg

SEQ ID NO: 1219118 - DNA, 22 bp, Artificial Sequence
  chemically synthesized
aaaatgacatttacaaacccgt

SEQ ID NO: 1219119 - DNA, 22 bp, Artificial Sequence
  chemically synthesized
tatcctcaaaatgacatttaca

SEQ ID NO: 1219120 - DNA, 22 bp, Artificial Sequence
  chemically synthesized
gtatcctcaaaatgacatttac

SEQ ID NO: 1219121 - DNA, 22 bp, Artificial Sequence
  chemically synthesized
tgtatcctcaaaatgacattta

SEQ ID NO: 1219122 - DNA, 22 bp, Artificial Sequence
  chemically synthesized
ttgtatcctcaaaatgacattt

SEQ ID NO: 1219123 - DNA, 22 bp, Artificial Sequence
  chemically synthesized
acgggtttgtaaatgtcatttt

SEQ ID NO: 1219124 - DNA, 22 bp, Artificial Sequence
  chemically synthesized
gtaaatgtcattttgaggatac

SEQ ID NO: 1219125 - DNA, 22 bp, Artificial Sequence
  chemically synthesized
taaatgtcattttgaggataca

SEQ ID NO: 1219126 - DNA, 22 bp, Artificial Sequence
  chemically synthesized
gagagaaatttttgtatcctca

SEQ ID NO: 1219127 - DNA, 22 bp, Artificial Sequence
  chemically synthesized
ggactcgagagaaatttttgta

SEQ ID NO: 1219128 - DNA, 22 bp, Artificial Sequence
  chemically synthesized
tgaggatacaaaaatttctctc

SEQ ID NO: 1219129 - DNA, 22 bp, Artificial Sequence
  chemically synthesized
gaggatacaaaaatttctctcg

SEQ ID NO: 1219130 - DNA, 22 bp, Artificial Sequence
  chemically synthesized
aggatacaaaaatttctctcga

SEQ ID NO: 1219131 - DNA, 22 bp, Artificial Sequence
  chemically synthesized
accaaaaaaggaaggacactag

SEQ ID NO: 1219132 - DNA, 22 bp, Artificial Sequence
  chemically synthesized
gaccaaaaaaggaaggacacta

SEQ ID NO: 1219133 - DNA, 22 bp, Artificial Sequence
  chemically synthesized
ctctcgagtcctagtgtccttc

SEQ ID NO: 1219134 - DNA, 22 bp, Artificial Sequence
  chemically synthesized
tctcgagtcctagtgtccttcc

SEQ ID NO: 1219135 - DNA, 22 bp, Artificial Sequence
  chemically synthesized
tcgagtcctagtgtccttcctt

SEQ ID NO: 1219136 - DNA, 22 bp, Artificial Sequence
  chemically synthesized
gagtcctagtgtccttcctttt

SEQ ID NO: 1219137 - DNA, 22 bp, Artificial Sequence
  chemically synthesized
gtgtccttccttttttggtcaa

SEQ ID NO: 1219138 - DNA, 22 bp, Artificial Sequence
  chemically synthesized
ccttttttggtcaaatttgact

SEQ ID NO: 1219139 - DNA, 22 bp, Artificial Sequence
  chemically synthesized
cttttttggtcaaatttgactg

SEQ ID NO: 1219140 - DNA, 22 bp, Artificial Sequence
  chemically synthesized
ttttggtcaaatttgactgtca

SEQ ID NO: 1219141 - DNA, 22 bp, Artificial Sequence
  chemically synthesized
tttggtcaaatttgactgtcat

SEQ ID NO: 1219142 - DNA, 22 bp, Artificial Sequence
  chemically synthesized
ttggtcaaatttgactgtcatt

SEQ ID NO: 1219143 - DNA, 22 bp, Artificial Sequence
  chemically synthesized
tggtcaaatttgactgtcatta

SEQ ID NO: 1219144 - DNA, 22 bp, Artificial Sequence
  chemically synthesized
ggtcaaatttgactgtcattat

SEQ ID NO: 1219145 - DNA, 22 bp, Artificial Sequence
  chemically synthesized
gaacaaaaatgaataatgacag

SEQ ID NO: 1219146 - DNA, 22 bp, Artificial Sequence
  chemically synthesized
gtcaaatttgactgtcattatt

SEQ ID NO: 1219147 - DNA, 22 bp, Artificial Sequence
  chemically synthesized
agaacaaaaatgaataatgaca

SEQ ID NO: 1219148 - DNA, 22 bp, Artificial Sequence
  chemically synthesized
tagaacaaaaatgaataatgac

SEQ ID NO: 1219149 - DNA, 22 bp, Artificial Sequence
  chemically synthesized
gactgtcattattcatttttgt

SEQ ID NO: 1219150 - DNA, 22 bp, Artificial Sequence
  chemically synthesized
actgtcattattcatttttgtt

SEQ ID NO: 1219151 - DNA, 22 bp, Artificial Sequence
  chemically synthesized
ccagggtaactttagaacaaaa

SEQ ID NO: 1219152 - DNA, 22 bp, Artificial Sequence
  chemically synthesized
tcattattcatttttgttctaa

SEQ ID NO: 1219153 - DNA, 22 bp, Artificial Sequence
  chemically synthesized
accagggtaactttagaacaaa

SEQ ID NO: 1219154 - DNA, 22 bp, Artificial Sequence
  chemically synthesized
tttaccagggtaactttagaac

SEQ ID NO: 1219155 - DNA, 22 bp, Artificial Sequence
  chemically synthesized
atttaccagggtaactttagaa

SEQ ID NO: 1219156 - DNA, 22 bp, Artificial Sequence
  chemically synthesized
ttcatttttgttctaaagttac

SEQ ID NO: 1219157 - DNA, 22 bp, Artificial Sequence
  chemically synthesized
cttatttaccagggtaacttta

SEQ ID NO: 1219158 - DNA, 22 bp, Artificial Sequence
  chemically synthesized
acttatttaccagggtaacttt

SEQ ID NO: 1219159 - DNA, 22 bp, Artificial Sequence
  chemically synthesized
atttttgttctaaagttaccct

SEQ ID NO: 1219160 - DNA, 22 bp, Artificial Sequence
  chemically synthesized
ttacttatttaccagggtaact

SEQ ID NO: 1219161 - DNA, 22 bp, Artificial Sequence
  chemically synthesized
ttgttctaaagttaccctggta

SEQ ID NO: 1219162 - DNA, 22 bp, Artificial Sequence
  chemically synthesized
tgttctaaagttaccctggtaa

SEQ ID NO: 1219163 - DNA, 22 bp, Artificial Sequence
  chemically synthesized
gttctaaagttaccctggtaaa

SEQ ID NO: 1219164 - DNA, 22 bp, Artificial Sequence
  chemically synthesized
ttctaaagttaccctggtaaat

SEQ ID NO: 1219165 - DNA, 22 bp, Artificial Sequence
  chemically synthesized
taaagttaccctggtaaataag

SEQ ID NO: 1219166 - DNA, 22 bp, Artificial Sequence
  chemically synthesized
aagttaccctggtaaataagta

SEQ ID NO: 1219167 - DNA, 22 bp, Artificial Sequence
  chemically synthesized
ccctggtaaataagtaagaaca

SEQ ID NO: 1219168 - DNA, 22 bp, Artificial Sequence
  chemically synthesized
gtaaataagtaagaacatttcc

SEQ ID NO: 1219169 - DNA, 22 bp, Artificial Sequence
  chemically synthesized
ggatatgaaatatgatatggaa

SEQ ID NO: 1219170 - DNA, 22 bp, Artificial Sequence
  chemically synthesized
aggatatgaaatatgatatgga

SEQ ID NO: 1219171 - DNA, 22 bp, Artificial Sequence
  chemically synthesized
catttaggatatgaaatatgat

SEQ ID NO: 1219172 - DNA, 22 bp, Artificial Sequence
  chemically synthesized
ccatttaggatatgaaatatga

SEQ ID NO: 1219173 - DNA, 22 bp, Artificial Sequence
  chemically synthesized
ccatatcatatttcatatccta

SEQ ID NO: 1219174 - DNA, 22 bp, Artificial Sequence
  chemically synthesized
catatcatatttcatatcctaa

SEQ ID NO: 1219175 - DNA, 22 bp, Artificial Sequence
  chemically synthesized
gtgtagaaagccatttccattt

SEQ ID NO: 1219176 - DNA, 22 bp, Artificial Sequence
  chemically synthesized
catatcctaaatggaaatggct

SEQ ID NO: 1219177 - DNA, 22 bp, Artificial Sequence
  chemically synthesized
atatcctaaatggaaatggctt

SEQ ID NO: 1219178 - DNA, 22 bp, Artificial Sequence
  chemically synthesized
aatattagtgtagaaagccatt

SEQ ID NO: 1219179 - DNA, 22 bp, Artificial Sequence
  chemically synthesized
gaatattagtgtagaaagccat

SEQ ID NO: 1219180 - DNA, 22 bp, Artificial Sequence
  chemically synthesized
tgaatattagtgtagaaagcca

SEQ ID NO: 1219181 - DNA, 22 bp, Artificial Sequence
  chemically synthesized
ttgaatattagtgtagaaagcc

SEQ ID NO: 1219182 - DNA, 22 bp, Artificial Sequence
  chemically synthesized
aatggaaatggctttctacact

SEQ ID NO: 1219183 - DNA, 22 bp, Artificial Sequence
  chemically synthesized
gatgtcttttgaatattagtgt

SEQ ID NO: 1219184 - DNA, 22 bp, Artificial Sequence
  chemically synthesized
tagatgtcttttgaatattagt

SEQ ID NO: 1219185 - DNA, 22 bp, Artificial Sequence
  chemically synthesized
ttctagatgtcttttgaatatt

SEQ ID NO: 1219186 - DNA, 22 bp, Artificial Sequence
  chemically synthesized
tctacactaatattcaaaagac

SEQ ID NO: 1219187 - DNA, 22 bp, Artificial Sequence
  chemically synthesized
ctacactaatattcaaaagaca

SEQ ID NO: 1219188 - DNA, 22 bp, Artificial Sequence
  chemically synthesized
tacactaatattcaaaagacat

SEQ ID NO: 1219189 - DNA, 22 bp, Artificial Sequence
  chemically synthesized
cgcctgttctagatgtcttttg

SEQ ID NO: 1219190 - DNA, 22 bp, Artificial Sequence
  chemically synthesized
cactaatattcaaaagacatct

SEQ ID NO: 1219191 - DNA, 22 bp, Artificial Sequence
  chemically synthesized
atattcaaaagacatctagaac

SEQ ID NO: 1219192 - DNA, 22 bp, Artificial Sequence
  chemically synthesized
aaaagacatctagaacaggcgc

SEQ ID NO: 1219193 - DNA, 22 bp, Artificial Sequence
  chemically synthesized
gaacaggcgcaatcttttatcc

SEQ ID NO: 1219194 - DNA, 22 bp, Artificial Sequence
  chemically synthesized
aaggaataaaacaaaaaatcag

SEQ ID NO: 1219195 - DNA, 22 bp, Artificial Sequence
  chemically synthesized
aaaggaataaaacaaaaaatca

SEQ ID NO: 1219196 - DNA, 22 bp, Artificial Sequence
  chemically synthesized
taaaggaataaaacaaaaaatc

SEQ ID NO: 1219197 - DNA, 22 bp, Artificial Sequence
  chemically synthesized
tttaaaggaataaaacaaaaaa

SEQ ID NO: 1219198 - DNA, 22 bp, Artificial Sequence
  chemically synthesized
ttatccctgattttttgtttta

SEQ ID NO: 1219199 - DNA, 22 bp, Artificial Sequence
  chemically synthesized
tctttaaaggaataaaacaaaa

SEQ ID NO: 1219200 - DNA, 22 bp, Artificial Sequence
  chemically synthesized
tatccctgattttttgttttat

SEQ ID NO: 1219201 - DNA, 22 bp, Artificial Sequence
  chemically synthesized
atccctgattttttgttttatt

SEQ ID NO: 1219202 - DNA, 22 bp, Artificial Sequence
  chemically synthesized
tccctgattttttgttttattc

SEQ ID NO: 1219203 - DNA, 22 bp, Artificial Sequence
  chemically synthesized
attttttgttttattcctttaa

SEQ ID NO: 1219204 - DNA, 22 bp, Artificial Sequence
  chemically synthesized
tttgttttattcctttaaagag

SEQ ID NO: 1219205 - DNA, 22 bp, Artificial Sequence
  chemically synthesized
ttgttttattcctttaaagaga

SEQ ID NO: 1219206 - DNA, 22 bp, Artificial Sequence
  chemically synthesized
tgttttattcctttaaagagaa

SEQ ID NO: 1219207 - DNA, 22 bp, Artificial Sequence
  chemically synthesized
gttttattcctttaaagagaac

SEQ ID NO: 1219208 - DNA, 22 bp, Artificial Sequence
  chemically synthesized
ttttattcctttaaagagaaca

SEQ ID NO: 1219209 - DNA, 22 bp, Artificial Sequence
  chemically synthesized
tattcctttaaagagaacatcc

SEQ ID NO: 1219210 - DNA, 22 bp, Artificial Sequence
  chemically synthesized
attcctttaaagagaacatcct

SEQ ID NO: 1219211 - DNA, 22 bp, Artificial Sequence
  chemically synthesized
ttcctttaaagagaacatcctc

SEQ ID NO: 1219212 - DNA, 22 bp, Artificial Sequence
  chemically synthesized
tgaataacaaagtgaggatgtt

SEQ ID NO: 1219213 - DNA, 22 bp, Artificial Sequence
  chemically synthesized
ctttaaagagaacatcctcact

SEQ ID NO: 1219214 - DNA, 22 bp, Artificial Sequence
  chemically synthesized
taaagagaacatcctcactttg

SEQ ID NO: 1219215 - DNA, 22 bp, Artificial Sequence
  chemically synthesized
ccctgtgaataacaaagtgagg

SEQ ID NO: 1219216 - DNA, 22 bp, Artificial Sequence
  chemically synthesized
aaagagaacatcctcactttgt

SEQ ID NO: 1219217 - DNA, 22 bp, Artificial Sequence
  chemically synthesized
cccctgtgaataacaaagtgag

SEQ ID NO: 1219218 - DNA, 22 bp, Artificial Sequence
  chemically synthesized
aagagaacatcctcactttgtt

SEQ ID NO: 1219219 - DNA, 22 bp, Artificial Sequence
  chemically synthesized
tcccctgtgaataacaaagtga

SEQ ID NO: 1219220 - DNA, 22 bp, Artificial Sequence
  chemically synthesized
tcagctttcccctgtgaataac

SEQ ID NO: 1219221 - DNA, 22 bp, Artificial Sequence
  chemically synthesized
gtcagctttcccctgtgaataa

SEQ ID NO: 1219222 - DNA, 22 bp, Artificial Sequence
  chemically synthesized
tgtcagctttcccctgtgaata

SEQ ID NO: 1219223 - DNA, 22 bp, Artificial Sequence
  chemically synthesized
actttgttattcacaggggaaa

SEQ ID NO: 1219224 - DNA, 22 bp, Artificial Sequence
  chemically synthesized
tgttattcacaggggaaagctg

SEQ ID NO: 1219225 - DNA, 22 bp, Artificial Sequence
  chemically synthesized
gttattcacaggggaaagctga

SEQ ID NO: 1219226 - DNA, 22 bp, Artificial Sequence
  chemically synthesized
ttattcacaggggaaagctgac

SEQ ID NO: 1219227 - DNA, 22 bp, Artificial Sequence
  chemically synthesized
agagagtgctttgtcagctttc

SEQ ID NO: 1219228 - DNA, 22 bp, Artificial Sequence
  chemically synthesized
ttcacaggggaaagctgacaaa

SEQ ID NO: 1219229 - DNA, 22 bp, Artificial Sequence
  chemically synthesized
tattaagagagtgctttgtcag

SEQ ID NO: 1219230 - DNA, 22 bp, Artificial Sequence
  chemically synthesized
acaggggaaagctgacaaagca

SEQ ID NO: 1219231 - DNA, 22 bp, Artificial Sequence
  chemically synthesized
cctatattaagagagtgctttg

SEQ ID NO: 1219232 - DNA, 22 bp, Artificial Sequence
  chemically synthesized
acaaagcactctcttaatatag

SEQ ID NO: 1219233 - DNA, 22 bp, Artificial Sequence
  chemically synthesized
tcttaatatagggaggattttt

SEQ ID NO: 1219234 - DNA, 22 bp, Artificial Sequence
  chemically synthesized
ttaatatagggaggattttttt

SEQ ID NO: 1219235 - DNA, 22 bp, Artificial Sequence
  chemically synthesized
aatatagggaggattttttttt

SEQ ID NO: 1219236 - DNA, 22 bp, Artificial Sequence
  chemically synthesized
atatagggaggatttttttttt

SEQ ID NO: 1219237 - DNA, 22 bp, Artificial Sequence
  chemically synthesized
ccagtccaaaaaaaaaaaaaaa

SEQ ID NO: 1219238 - DNA, 22 bp, Artificial Sequence
  chemically synthesized
gccagtccaaaaaaaaaaaaaa

SEQ ID NO: 1219239 - DNA, 22 bp, Artificial Sequence
  chemically synthesized
tttgccagtccaaaaaaaaaaa

SEQ ID NO: 1219240 - DNA, 22 bp, Artificial Sequence
  chemically synthesized
gtttgccagtccaaaaaaaaaa

SEQ ID NO: 1219241 - DNA, 22 bp, Artificial Sequence
  chemically synthesized
gtttgtttgccagtccaaaaaa

SEQ ID NO: 1219242 - DNA, 22 bp, Artificial Sequence
  chemically synthesized
tttttttttttttggactggca

SEQ ID NO: 1219243 - DNA, 22 bp, Artificial Sequence
  chemically synthesized
ttttttttttttggactggcaa

SEQ ID NO: 1219244 - DNA, 22 bp, Artificial Sequence
  chemically synthesized
tttttttttttggactggcaaa

SEQ ID NO: 1219245 - DNA, 22 bp, Artificial Sequence
  chemically synthesized
ttttttttttggactggcaaac

SEQ ID NO: 1219246 - DNA, 22 bp, Artificial Sequence
  chemically synthesized
tttttttttggactggcaaaca

SEQ ID NO: 1219247 - DNA, 22 bp, Artificial Sequence
  chemically synthesized
ttttttttggactggcaaacaa

SEQ ID NO: 1219248 - DNA, 22 bp, Artificial Sequence
  chemically synthesized
aaacagattggtttgtttgcca

SEQ ID NO: 1219249 - DNA, 22 bp, Artificial Sequence
  chemically synthesized
tttttttggactggcaaacaaa

SEQ ID NO: 1219250 - DNA, 22 bp, Artificial Sequence
  chemically synthesized
caaacagattggtttgtttgcc

SEQ ID NO: 1219251 - DNA, 22 bp, Artificial Sequence
  chemically synthesized
ttttttggactggcaaacaaac

SEQ ID NO: 1219252 - DNA, 22 bp, Artificial Sequence
  chemically synthesized
tttttggactggcaaacaaacc

SEQ ID NO: 1219253 - DNA, 22 bp, Artificial Sequence
  chemically synthesized
ttttggactggcaaacaaacca

SEQ ID NO: 1219254 - DNA, 22 bp, Artificial Sequence
  chemically synthesized
tttggactggcaaacaaaccaa

SEQ ID NO: 1219255 - DNA, 22 bp, Artificial Sequence
  chemically synthesized
ttggactggcaaacaaaccaat

SEQ ID NO: 1219256 - DNA, 22 bp, Artificial Sequence
  chemically synthesized
agtttcaaacagattggtttgt

SEQ ID NO: 1219257 - DNA, 22 bp, Artificial Sequence
  chemically synthesized
tggactggcaaacaaaccaatc

SEQ ID NO: 1219258 - DNA, 22 bp, Artificial Sequence
  chemically synthesized
ggactggcaaacaaaccaatct

SEQ ID NO: 1219259 - DNA, 22 bp, Artificial Sequence
  chemically synthesized
tgagtttcaaacagattggttt

SEQ ID NO: 1219260 - DNA, 22 bp, Artificial Sequence
  chemically synthesized
gactggcaaacaaaccaatctg

SEQ ID NO: 1219261 - DNA, 22 bp, Artificial Sequence
  chemically synthesized
tctgagtttcaaacagattggt

SEQ ID NO: 1219262 - DNA, 22 bp, Artificial Sequence
  chemically synthesized
ctctgagtttcaaacagattgg

SEQ ID NO: 1219263 - DNA, 22 bp, Artificial Sequence
  chemically synthesized
gcaaacaaaccaatctgtttga

SEQ ID NO: 1219264 - DNA, 22 bp, Artificial Sequence
  chemically synthesized
tttctctgagtttcaaacagat

SEQ ID NO: 1219265 - DNA, 22 bp, Artificial Sequence
  chemically synthesized
atatacattgtttctctgagtt

SEQ ID NO: 1219266 - DNA, 22 bp, Artificial Sequence
  chemically synthesized
catatacattgtttctctgagt

SEQ ID NO: 1219267 - DNA, 22 bp, Artificial Sequence
  chemically synthesized
tttgaaactcagagaaacaatg

SEQ ID NO: 1219268 - DNA, 22 bp, Artificial Sequence
  chemically synthesized
gaaactcagagaaacaatgtat

SEQ ID NO: 1219269 - DNA, 22 bp, Artificial Sequence
  chemically synthesized
aaactcagagaaacaatgtata

SEQ ID NO: 1219270 - DNA, 22 bp, Artificial Sequence
  chemically synthesized
gtcgtgggtttcatatacattg

SEQ ID NO: 1219271 - DNA, 22 bp, Artificial Sequence
  chemically synthesized
agagaaacaatgtatatgaaac

SEQ ID NO: 1219272 - DNA, 22 bp, Artificial Sequence
  chemically synthesized
catgcgttggtcgtgggtttca

SEQ ID NO: 1219273 - DNA, 22 bp, Artificial Sequence
  chemically synthesized
tacatgcgttggtcgtgggttt

SEQ ID NO: 1219274 - DNA, 22 bp, Artificial Sequence
  chemically synthesized
taagacagtacattctacatgc

SEQ ID NO: 1219275 - DNA, 22 bp, Artificial Sequence
  chemically synthesized
tgtaagacagtacattctacat

SEQ ID NO: 1219276 - DNA, 22 bp, Artificial Sequence
  chemically synthesized
tctgtaagacagtacattctac

SEQ ID NO: 1219277 - DNA, 22 bp, Artificial Sequence
  chemically synthesized
ctctgtaagacagtacattcta

SEQ ID NO: 1219278 - DNA, 22 bp, Artificial Sequence
  chemically synthesized
tgatttctctgtaagacagtac

SEQ ID NO: 1219279 - DNA, 22 bp, Artificial Sequence
  chemically synthesized
ccgttatgatttctctgtaaga

SEQ ID NO: 1219280 - DNA, 22 bp, Artificial Sequence
  chemically synthesized
cccgttatgatttctctgtaag

SEQ ID NO: 1219281 - DNA, 22 bp, Artificial Sequence
  chemically synthesized
ttcccgttatgatttctctgta

SEQ ID NO: 1219282 - DNA, 22 bp, Artificial Sequence
  chemically synthesized
tcttcccgttatgatttctctg

SEQ ID NO: 1219283 - DNA, 22 bp, Artificial Sequence
  chemically synthesized
tcttacagagaaatcataacgg

SEQ ID NO: 1219284 - DNA, 22 bp, Artificial Sequence
  chemically synthesized
acagagaaatcataacgggaag

SEQ ID NO: 1219285 - DNA, 22 bp, Artificial Sequence
  chemically synthesized
cagagaaatcataacgggaaga

SEQ ID NO: 1219286 - DNA, 22 bp, Artificial Sequence
  chemically synthesized
tgaatcagacaattctcttccc

SEQ ID NO: 1219287 - DNA, 22 bp, Artificial Sequence
  chemically synthesized
gtgaatcagacaattctcttcc

SEQ ID NO: 1219288 - DNA, 22 bp, Artificial Sequence
  chemically synthesized
tgtgaatcagacaattctcttc

SEQ ID NO: 1219289 - DNA, 22 bp, Artificial Sequence
  chemically synthesized
ttgtgaatcagacaattctctt

SEQ ID NO: 1219290 - DNA, 22 bp, Artificial Sequence
  chemically synthesized
aaaatatccttttgtgaatcag

SEQ ID NO: 1219291 - DNA, 22 bp, Artificial Sequence
  chemically synthesized
aaaaatatccttttgtgaatca

SEQ ID NO: 1219292 - DNA, 22 bp, Artificial Sequence
  chemically synthesized
taaaaatatccttttgtgaatc

SEQ ID NO: 1219293 - DNA, 22 bp, Artificial Sequence
  chemically synthesized
tttaaaaatatccttttgtgaa

SEQ ID NO: 1219294 - DNA, 22 bp, Artificial Sequence
  chemically synthesized
tctgattcacaaaaggatattt

SEQ ID NO: 1219295 - DNA, 22 bp, Artificial Sequence
  chemically synthesized
attcacaaaaggatatttttaa

SEQ ID NO: 1219296 - DNA, 22 bp, Artificial Sequence
  chemically synthesized
acaaaaggatatttttaaagag

SEQ ID NO: 1219297 - DNA, 22 bp, Artificial Sequence
  chemically synthesized
atagataataggtatatctctt

SEQ ID NO: 1219298 - DNA, 22 bp, Artificial Sequence
  chemically synthesized
tgctcatagataataggtatat

SEQ ID NO: 1219299 - DNA, 22 bp, Artificial Sequence
  chemically synthesized
atgctcatagataataggtata

SEQ ID NO: 1219300 - DNA, 22 bp, Artificial Sequence
  chemically synthesized
ttaaagagatatacctattatc

SEQ ID NO: 1219301 - DNA, 22 bp, Artificial Sequence
  chemically synthesized
taaagagatatacctattatct

SEQ ID NO: 1219302 - DNA, 22 bp, Artificial Sequence
  chemically synthesized
aaagagatatacctattatcta

SEQ ID NO: 1219303 - DNA, 22 bp, Artificial Sequence
  chemically synthesized
aagagatatacctattatctat

SEQ ID NO: 1219304 - DNA, 22 bp, Artificial Sequence
  chemically synthesized
tgtatgtttatgctcatagata

SEQ ID NO: 1219305 - DNA, 22 bp, Artificial Sequence
  chemically synthesized
ataaattatgtatgtttatgct

SEQ ID NO: 1219306 - DNA, 22 bp, Artificial Sequence
  chemically synthesized
aataaattatgtatgtttatgc

SEQ ID NO: 1219307 - DNA, 22 bp, Artificial Sequence
  chemically synthesized
ttatctatgagcataaacatac

SEQ ID NO: 1219308 - DNA, 22 bp, Artificial Sequence
  chemically synthesized
tctatgagcataaacatacata

SEQ ID NO: 1219309 - DNA, 22 bp, Artificial Sequence
  chemically synthesized
tgagcataaacatacataattt

SEQ ID NO: 1219310 - DNA, 22 bp, Artificial Sequence
  chemically synthesized
gggtaaacttaataaattatgt

SEQ ID NO: 1219311 - DNA, 22 bp, Artificial Sequence
  chemically synthesized
attaagtttaccctagatgtac

SEQ ID NO: 1219312 - DNA, 22 bp, Artificial Sequence
  chemically synthesized
ttaagtttaccctagatgtact

SEQ ID NO: 1219313 - DNA, 22 bp, Artificial Sequence
  chemically synthesized
agtttaccctagatgtacttat

SEQ ID NO: 1219314 - DNA, 22 bp, Artificial Sequence
  chemically synthesized
acatatgcaaaaataagtacat

SEQ ID NO: 1219315 - DNA, 22 bp, Artificial Sequence
  chemically synthesized
accctagatgtacttatttttg

SEQ ID NO: 1219316 - DNA, 22 bp, Artificial Sequence
  chemically synthesized
ccctagatgtacttatttttgc

SEQ ID NO: 1219317 - DNA, 22 bp, Artificial Sequence
  chemically synthesized
gatgctaacatatgcaaaaata

SEQ ID NO: 1219318 - DNA, 22 bp, Artificial Sequence
  chemically synthesized
agatgctaacatatgcaaaaat

SEQ ID NO: 1219319 - DNA, 22 bp, Artificial Sequence
  chemically synthesized
gatgtacttatttttgcatatg

SEQ ID NO: 1219320 - DNA, 22 bp, Artificial Sequence
  chemically synthesized
gtgtgtttagatgctaacatat

SEQ ID NO: 1219321 - DNA, 22 bp, Artificial Sequence
  chemically synthesized
tagtgtgtttagatgctaacat

SEQ ID NO: 1219322 - DNA, 22 bp, Artificial Sequence
  chemically synthesized
ctagtgtgtttagatgctaaca

SEQ ID NO: 1219323 - DNA, 22 bp, Artificial Sequence
  chemically synthesized
atttttgcatatgttagcatct

SEQ ID NO: 1219324 - DNA, 22 bp, Artificial Sequence
  chemically synthesized
tttttgcatatgttagcatcta

SEQ ID NO: 1219325 - DNA, 22 bp, Artificial Sequence
  chemically synthesized
tttctagtgtgtttagatgcta

SEQ ID NO: 1219326 - DNA, 22 bp, Artificial Sequence
  chemically synthesized
ttgcatatgttagcatctaaac

SEQ ID NO: 1219327 - DNA, 22 bp, Artificial Sequence
  chemically synthesized
tgcatatgttagcatctaaaca

SEQ ID NO: 1219328 - DNA, 22 bp, Artificial Sequence
  chemically synthesized
gcatatgttagcatctaaacac

SEQ ID NO: 1219329 - DNA, 22 bp, Artificial Sequence
  chemically synthesized
catatgttagcatctaaacaca

SEQ ID NO: 1219330 - DNA, 22 bp, Artificial Sequence
  chemically synthesized
aggagctgtttctagtgtgttt

SEQ ID NO: 1219331 - DNA, 22 bp, Artificial Sequence
  chemically synthesized
caggagctgtttctagtgtgtt

SEQ ID NO: 1219332 - DNA, 22 bp, Artificial Sequence
  chemically synthesized
gcatctaaacacactagaaaca

SEQ ID NO: 1219333 - DNA, 22 bp, Artificial Sequence
  chemically synthesized
aacacactagaaacagctcctg

SEQ ID NO: 1219334 - DNA, 22 bp, Artificial Sequence
  chemically synthesized
gcataagcgatttcaggagctg

SEQ ID NO: 1219335 - DNA, 22 bp, Artificial Sequence
  chemically synthesized
gaaacagctcctgaaatcgctt

SEQ ID NO: 1219336 - DNA, 22 bp, Artificial Sequence
  chemically synthesized
ctgaaatcgcttatgctaatgc

SEQ ID NO: 1219337 - DNA, 22 bp, Artificial Sequence
  chemically synthesized
aaatcgcttatgctaatgccta

SEQ ID NO: 1219338 - DNA, 22 bp, Artificial Sequence
  chemically synthesized
aaatgagtagcagtaggcatta

SEQ ID NO: 1219339 - DNA, 22 bp, Artificial Sequence
  chemically synthesized
aaaatgagtagcagtaggcatt

SEQ ID NO: 1219340 - DNA, 22 bp, Artificial Sequence
  chemically synthesized
taaaatgagtagcagtaggcat

SEQ ID NO: 1219341 - DNA, 22 bp, Artificial Sequence
  chemically synthesized
ttaaaatgagtagcagtaggca

SEQ ID NO: 1219342 - DNA, 22 bp, Artificial Sequence
  chemically synthesized
ccttttaaaatgagtagcagta

SEQ ID NO: 1219343 - DNA, 22 bp, Artificial Sequence
  chemically synthesized
atgctaatgcctactgctactc

SEQ ID NO: 1219344 - DNA, 22 bp, Artificial Sequence
  chemically synthesized
tgctaatgcctactgctactca

SEQ ID NO: 1219345 - DNA, 22 bp, Artificial Sequence
  chemically synthesized
atgcctactgctactcatttta

SEQ ID NO: 1219346 - DNA, 22 bp, Artificial Sequence
  chemically synthesized
agtggaattgccttttaaaatg

SEQ ID NO: 1219347 - DNA, 22 bp, Artificial Sequence
  chemically synthesized
aagtggaattgccttttaaaat

SEQ ID NO: 1219348 - DNA, 22 bp, Artificial Sequence
  chemically synthesized
taagtggaattgccttttaaaa

SEQ ID NO: 1219349 - DNA, 22 bp, Artificial Sequence
  chemically synthesized
ctgctactcattttaaaaggca

SEQ ID NO: 1219350 - DNA, 22 bp, Artificial Sequence
  chemically synthesized
gttttaagtggaattgcctttt

SEQ ID NO: 1219351 - DNA, 22 bp, Artificial Sequence
  chemically synthesized
ctactcattttaaaaggcaatt

SEQ ID NO: 1219352 - DNA, 22 bp, Artificial Sequence
  chemically synthesized
agttttaagtggaattgccttt

SEQ ID NO: 1219353 - DNA, 22 bp, Artificial Sequence
  chemically synthesized
ctcattttaaaaggcaattcca

SEQ ID NO: 1219354 - DNA, 22 bp, Artificial Sequence
  chemically synthesized
attttaaaaggcaattccactt

SEQ ID NO: 1219355 - DNA, 22 bp, Artificial Sequence
  chemically synthesized
aggtttagttttaagtggaatt

SEQ ID NO: 1219356 - DNA, 22 bp, Artificial Sequence
  chemically synthesized
taaaaggcaattccacttaaaa

SEQ ID NO: 1219357 - DNA, 22 bp, Artificial Sequence
  chemically synthesized
aaaaggcaattccacttaaaac

SEQ ID NO: 1219358 - DNA, 22 bp, Artificial Sequence
  chemically synthesized
aaaggcaattccacttaaaact

SEQ ID NO: 1219359 - DNA, 22 bp, Artificial Sequence
  chemically synthesized
aggcctgaggtttagttttaag

SEQ ID NO: 1219360 - DNA, 22 bp, Artificial Sequence
  chemically synthesized
gaggcctgaggtttagttttaa

SEQ ID NO: 1219361 - DNA, 22 bp, Artificial Sequence
  chemically synthesized
tgaggcctgaggtttagtttta

SEQ ID NO: 1219362 - DNA, 22 bp, Artificial Sequence
  chemically synthesized
gtgttttgaggcctgaggttta

SEQ ID NO: 1219363 - DNA, 22 bp, Artificial Sequence
  chemically synthesized
cacttaaaactaaacctcaggc

SEQ ID NO: 1219364 - DNA, 22 bp, Artificial Sequence
  chemically synthesized
actggtgttttgaggcctgagg

SEQ ID NO: 1219365 - DNA, 22 bp, Artificial Sequence
  chemically synthesized
aactggtgttttgaggcctgag

SEQ ID NO: 1219366 - DNA, 22 bp, Artificial Sequence
  chemically synthesized
aaaactaaacctcaggcctcaa

SEQ ID NO: 1219367 - DNA, 22 bp, Artificial Sequence
  chemically synthesized
aaactaaacctcaggcctcaaa

SEQ ID NO: 1219368 - DNA, 22 bp, Artificial Sequence
  chemically synthesized
gccttaactggtgttttgaggc

SEQ ID NO: 1219369 - DNA, 22 bp, Artificial Sequence
  chemically synthesized
ggccttaactggtgttttgagg

SEQ ID NO: 1219370 - DNA, 22 bp, Artificial Sequence
  chemically synthesized
tggccttaactggtgttttgag

SEQ ID NO: 1219371 - DNA, 22 bp, Artificial Sequence
  chemically synthesized
aacctcaggcctcaaaacacca

SEQ ID NO: 1219372 - DNA, 22 bp, Artificial Sequence
  chemically synthesized
aggcctcaaaacaccagttaag

SEQ ID NO: 1219373 - DNA, 22 bp, Artificial Sequence
  chemically synthesized
atatgctttggccttaactggt

SEQ ID NO: 1219374 - DNA, 22 bp, Artificial Sequence
  chemically synthesized
gatatgctttggccttaactgg

SEQ ID NO: 1219375 - DNA, 22 bp, Artificial Sequence
  chemically synthesized
aaaacaccagttaaggccaaag

SEQ ID NO: 1219376 - DNA, 22 bp, Artificial Sequence
  chemically synthesized
atatatagaatttgatatgctt

SEQ ID NO: 1219377 - DNA, 22 bp, Artificial Sequence
  chemically synthesized
catatatagaatttgatatgct

SEQ ID NO: 1219378 - DNA, 22 bp, Artificial Sequence
  chemically synthesized
aggccaaagcatatcaaattct

SEQ ID NO: 1219379 - DNA, 22 bp, Artificial Sequence
  chemically synthesized
taggatttcatatatagaattt

SEQ ID NO: 1219380 - DNA, 22 bp, Artificial Sequence
  chemically synthesized
gtaggatttcatatatagaatt

SEQ ID NO: 1219381 - DNA, 22 bp, Artificial Sequence
  chemically synthesized
aaaccttgtaggatttcatata

SEQ ID NO: 1219382 - DNA, 22 bp, Artificial Sequence
  chemically synthesized
tatatatgaaatcctacaaggt

SEQ ID NO: 1219383 - DNA, 22 bp, Artificial Sequence
  chemically synthesized
ggaagtcattgaaaccttgtag

SEQ ID NO: 1219384 - DNA, 22 bp, Artificial Sequence
  chemically synthesized
tatatgaaatcctacaaggttt

SEQ ID NO: 1219385 - DNA, 22 bp, Artificial Sequence
  chemically synthesized
taaaattaggaagtcattgaaa

SEQ ID NO: 1219386 - DNA, 22 bp, Artificial Sequence
  chemically synthesized
ataaaattaggaagtcattgaa

SEQ ID NO: 1219387 - DNA, 22 bp, Artificial Sequence
  chemically synthesized
tataaaattaggaagtcattga

SEQ ID NO: 1219388 - DNA, 22 bp, Artificial Sequence
  chemically synthesized
ctttataaaattaggaagtcat

SEQ ID NO: 1219389 - DNA, 22 bp, Artificial Sequence
  chemically synthesized
caaggtttcaatgacttcctaa

SEQ ID NO: 1219390 - DNA, 22 bp, Artificial Sequence
  chemically synthesized
atagaattgctttataaaatta

SEQ ID NO: 1219391 - DNA, 22 bp, Artificial Sequence
  chemically synthesized
caatgacttcctaattttataa

SEQ ID NO: 1219392 - DNA, 22 bp, Artificial Sequence
  chemically synthesized
aatgacttcctaattttataaa

SEQ ID NO: 1219393 - DNA, 22 bp, Artificial Sequence
  chemically synthesized
ttgatagaattgctttataaaa

SEQ ID NO: 1219394 - DNA, 22 bp, Artificial Sequence
  chemically synthesized
gttgatagaattgctttataaa

SEQ ID NO: 1219395 - DNA, 22 bp, Artificial Sequence
  chemically synthesized
tgttgatagaattgctttataa

SEQ ID NO: 1219396 - DNA, 22 bp, Artificial Sequence
  chemically synthesized
cctaattttataaagcaattct

SEQ ID NO: 1219397 - DNA, 22 bp, Artificial Sequence
  chemically synthesized
ctaattttataaagcaattcta

SEQ ID NO: 1219398 - DNA, 22 bp, Artificial Sequence
  chemically synthesized
attttataaagcaattctatca

SEQ ID NO: 1219399 - DNA, 22 bp, Artificial Sequence
  chemically synthesized
aacataagctttgttgatagaa

SEQ ID NO: 1219400 - DNA, 22 bp, Artificial Sequence
  chemically synthesized
aaacataagctttgttgataga

SEQ ID NO: 1219401 - DNA, 22 bp, Artificial Sequence
  chemically synthesized
tataaagcaattctatcaacaa

SEQ ID NO: 1219402 - DNA, 22 bp, Artificial Sequence
  chemically synthesized
taaacataagctttgttgatag

SEQ ID NO: 1219403 - DNA, 22 bp, Artificial Sequence
  chemically synthesized
ataaagcaattctatcaacaaa

SEQ ID NO: 1219404 - DNA, 22 bp, Artificial Sequence
  chemically synthesized
taaagcaattctatcaacaaag

SEQ ID NO: 1219405 - DNA, 22 bp, Artificial Sequence
  chemically synthesized
acaattttaaacataagctttg

SEQ ID NO: 1219406 - DNA, 22 bp, Artificial Sequence
  chemically synthesized
gacaattttaaacataagcttt

SEQ ID NO: 1219407 - DNA, 22 bp, Artificial Sequence
  chemically synthesized
tgacaattttaaacataagctt

SEQ ID NO: 1219408 - DNA, 22 bp, Artificial Sequence
  chemically synthesized
tatcaacaaagcttatgtttaa

SEQ ID NO: 1219409 - DNA, 22 bp, Artificial Sequence
  chemically synthesized
tcaacaaagcttatgtttaaaa

SEQ ID NO: 1219410 - DNA, 22 bp, Artificial Sequence
  chemically synthesized
ccaaataatgctttgacaattt

SEQ ID NO: 1219411 - DNA, 22 bp, Artificial Sequence
  chemically synthesized
atgtttaaaattgtcaaagcat

SEQ ID NO: 1219412 - DNA, 22 bp, Artificial Sequence
  chemically synthesized
tgtttaaaattgtcaaagcatt

SEQ ID NO: 1219413 - DNA, 22 bp, Artificial Sequence
  chemically synthesized
aaaattgtcaaagcattatttg

SEQ ID NO: 1219414 - DNA, 22 bp, Artificial Sequence
  chemically synthesized
agaaatacctgccaaataatgc

SEQ ID NO: 1219415 - DNA, 22 bp, Artificial Sequence
  chemically synthesized
aaattgtcaaagcattatttgg

SEQ ID NO: 1219416 - DNA, 22 bp, Artificial Sequence
  chemically synthesized
aagaaatacctgccaaataatg

SEQ ID NO: 1219417 - DNA, 22 bp, Artificial Sequence
  chemically synthesized
gtttaagaaatacctgccaaat

SEQ ID NO: 1219418 - DNA, 22 bp, Artificial Sequence
  chemically synthesized
ggtttaagaaatacctgccaaa

SEQ ID NO: 1219419 - DNA, 22 bp, Artificial Sequence
  chemically synthesized
tcaaagcattatttggcaggta

SEQ ID NO: 1219420 - DNA, 22 bp, Artificial Sequence
  chemically synthesized
tatttggtttaagaaatacctg

SEQ ID NO: 1219421 - DNA, 22 bp, Artificial Sequence
  chemically synthesized
aagctatatttggtttaagaaa

SEQ ID NO: 1219422 - DNA, 22 bp, Artificial Sequence
  chemically synthesized
tttggcaggtatttcttaaacc

SEQ ID NO: 1219423 - DNA, 22 bp, Artificial Sequence
  chemically synthesized
ggcaggtatttcttaaaccaaa

SEQ ID NO: 1219424 - DNA, 22 bp, Artificial Sequence
  chemically synthesized
gcaggtatttcttaaaccaaat

SEQ ID NO: 1219425 - DNA, 22 bp, Artificial Sequence
  chemically synthesized
ggggattgaagctatatttggt

SEQ ID NO: 1219426 - DNA, 22 bp, Artificial Sequence
  chemically synthesized
ttgggggattgaagctatattt

SEQ ID NO: 1219427 - DNA, 22 bp, Artificial Sequence
  chemically synthesized
ttattgggggattgaagctata

SEQ ID NO: 1219428 - DNA, 22 bp, Artificial Sequence
  chemically synthesized
cttaaaccaaatatagcttcaa

SEQ ID NO: 1219429 - DNA, 22 bp, Artificial Sequence
  chemically synthesized
attattgggggattgaagctat

SEQ ID NO: 1219430 - DNA, 22 bp, Artificial Sequence
  chemically synthesized
ttaaaccaaatatagcttcaat

SEQ ID NO: 1219431 - DNA, 22 bp, Artificial Sequence
  chemically synthesized
tattattgggggattgaagcta

SEQ ID NO: 1219432 - DNA, 22 bp, Artificial Sequence
  chemically synthesized
aaaccaaatatagcttcaatcc

SEQ ID NO: 1219433 - DNA, 22 bp, Artificial Sequence
  chemically synthesized
aaccaaatatagcttcaatccc

SEQ ID NO: 1219434 - DNA, 22 bp, Artificial Sequence
  chemically synthesized
gggagaattttattattggggg

SEQ ID NO: 1219435 - DNA, 22 bp, Artificial Sequence
  chemically synthesized
ggggagaattttattattgggg

SEQ ID NO: 1219436 - DNA, 22 bp, Artificial Sequence
  chemically synthesized
caatcccccaataataaaattc

SEQ ID NO: 1219437 - DNA, 22 bp, Artificial Sequence
  chemically synthesized
aatcccccaataataaaattct

SEQ ID NO: 1219438 - DNA, 22 bp, Artificial Sequence
  chemically synthesized
ggagaataatgaaacatttggg

SEQ ID NO: 1219439 - DNA, 22 bp, Artificial Sequence
  chemically synthesized
aggagaataatgaaacatttgg

SEQ ID NO: 1219440 - DNA, 22 bp, Artificial Sequence
  chemically synthesized
tgccccttaggagaataatgaa

SEQ ID NO: 1219441 - DNA, 22 bp, Artificial Sequence
  chemically synthesized
tccccaaatgtttcattattct

SEQ ID NO: 1219442 - DNA, 22 bp, Artificial Sequence
  chemically synthesized
cccaaatgtttcattattctcc

SEQ ID NO: 1219443 - DNA, 22 bp, Artificial Sequence
  chemically synthesized
gttatgccccttaggagaataa

SEQ ID NO: 1219444 - DNA, 22 bp, Artificial Sequence
  chemically synthesized
aattagttatgccccttaggag

SEQ ID NO: 1219445 - DNA, 22 bp, Artificial Sequence
  chemically synthesized
aaattagttatgccccttagga

SEQ ID NO: 1219446 - DNA, 22 bp, Artificial Sequence
  chemically synthesized
taaattagttatgccccttagg

SEQ ID NO: 1219447 - DNA, 22 bp, Artificial Sequence
  chemically synthesized
cattattctcctaaggggcata

SEQ ID NO: 1219448 - DNA, 22 bp, Artificial Sequence
  chemically synthesized
attattctcctaaggggcataa

SEQ ID NO: 1219449 - DNA, 22 bp, Artificial Sequence
  chemically synthesized
attttaaattagttatgcccct

SEQ ID NO: 1219450 - DNA, 22 bp, Artificial Sequence
  chemically synthesized
cattttaaattagttatgcccc

SEQ ID NO: 1219451 - DNA, 22 bp, Artificial Sequence
  chemically synthesized
ttctcctaaggggcataactaa

SEQ ID NO: 1219452 - DNA, 22 bp, Artificial Sequence
  chemically synthesized
tcctaaggggcataactaattt

SEQ ID NO: 1219453 - DNA, 22 bp, Artificial Sequence
  chemically synthesized
ctaaggggcataactaatttaa

SEQ ID NO: 1219454 - DNA, 22 bp, Artificial Sequence
  chemically synthesized
aggggcataactaatttaaaat

SEQ ID NO: 1219455 - DNA, 22 bp, Artificial Sequence
  chemically synthesized
caaagaaatttcattttaaatt

SEQ ID NO: 1219456 - DNA, 22 bp, Artificial Sequence
  chemically synthesized
tccaaagaaatttcattttaaa

SEQ ID NO: 1219457 - DNA, 22 bp, Artificial Sequence
  chemically synthesized
ctctccaaagaaatttcatttt

SEQ ID NO: 1219458 - DNA, 22 bp, Artificial Sequence
  chemically synthesized
gctactctccaaagaaatttca

SEQ ID NO: 1219459 - DNA, 22 bp, Artificial Sequence
  chemically synthesized
atttaaaatgaaatttctttgg

SEQ ID NO: 1219460 - DNA, 22 bp, Artificial Sequence
  chemically synthesized
aaaatgaaatttctttggagag

SEQ ID NO: 1219461 - DNA, 22 bp, Artificial Sequence
  chemically synthesized
aaatgaaatttctttggagagt

SEQ ID NO: 1219462 - DNA, 22 bp, Artificial Sequence
  chemically synthesized
tgcatgatgttggctactctcc

SEQ ID NO: 1219463 - DNA, 22 bp, Artificial Sequence
  chemically synthesized
atgcatgatgttggctactctc

SEQ ID NO: 1219464 - DNA, 22 bp, Artificial Sequence
  chemically synthesized
tagcttatgcatgatgttggct

SEQ ID NO: 1219465 - DNA, 22 bp, Artificial Sequence
  chemically synthesized
ctttggagagtagccaacatca

SEQ ID NO: 1219466 - DNA, 22 bp, Artificial Sequence
  chemically synthesized
tttggagagtagccaacatcat

SEQ ID NO: 1219467 - DNA, 22 bp, Artificial Sequence
  chemically synthesized
tgtagcttatgcatgatgttgg

SEQ ID NO: 1219468 - DNA, 22 bp, Artificial Sequence
  chemically synthesized
tggagagtagccaacatcatgc

SEQ ID NO: 1219469 - DNA, 22 bp, Artificial Sequence
  chemically synthesized
ggagagtagccaacatcatgca

SEQ ID NO: 1219470 - DNA, 22 bp, Artificial Sequence
  chemically synthesized
gagagtagccaacatcatgcat

SEQ ID NO: 1219471 - DNA, 22 bp, Artificial Sequence
  chemically synthesized
gttctgtagcttatgcatgatg

SEQ ID NO: 1219472 - DNA, 22 bp, Artificial Sequence
  chemically synthesized
accagatattggttctgtagct

SEQ ID NO: 1219473 - DNA, 22 bp, Artificial Sequence
  chemically synthesized
aaccagatattggttctgtagc

SEQ ID NO: 1219474 - DNA, 22 bp, Artificial Sequence
  chemically synthesized
tttaaccagatattggttctgt

SEQ ID NO: 1219475 - DNA, 22 bp, Artificial Sequence
  chemically synthesized
atttaaccagatattggttctg

SEQ ID NO: 1219476 - DNA, 22 bp, Artificial Sequence
  chemically synthesized
tatttaaccagatattggttct

SEQ ID NO: 1219477 - DNA, 22 bp, Artificial Sequence
  chemically synthesized
ttatttaaccagatattggttc

SEQ ID NO: 1219478 - DNA, 22 bp, Artificial Sequence
  chemically synthesized
atatttttatttaaccagatat

SEQ ID NO: 1219479 - DNA, 22 bp, Artificial Sequence
  chemically synthesized
cagaaccaatatctggttaaat

SEQ ID NO: 1219480 - DNA, 22 bp, Artificial Sequence
  chemically synthesized
tgatgttcatatttttatttaa

SEQ ID NO: 1219481 - DNA, 22 bp, Artificial Sequence
  chemically synthesized
gtgatgttcatatttttattta

SEQ ID NO: 1219482 - DNA, 22 bp, Artificial Sequence
  chemically synthesized
tgtgatgttcatatttttattt

SEQ ID NO: 1219483 - DNA, 22 bp, Artificial Sequence
  chemically synthesized
ttgtgatgttcatatttttatt

SEQ ID NO: 1219484 - DNA, 22 bp, Artificial Sequence
  chemically synthesized
cttttgtgatgttcatattttt

SEQ ID NO: 1219485 - DNA, 22 bp, Artificial Sequence
  chemically synthesized
gttaaataaaaatatgaacatc

SEQ ID NO: 1219486 - DNA, 22 bp, Artificial Sequence
  chemically synthesized
aataaaaatatgaacatcacaa

SEQ ID NO: 1219487 - DNA, 22 bp, Artificial Sequence
  chemically synthesized
tatagtaattgcttttgtgatg

SEQ ID NO: 1219488 - DNA, 22 bp, Artificial Sequence
  chemically synthesized
atgcctgtatagtaattgcttt

SEQ ID NO: 1219489 - DNA, 22 bp, Artificial Sequence
  chemically synthesized
gtgattcatgcctgtatagtaa

SEQ ID NO: 1219490 - DNA, 22 bp, Artificial Sequence
  chemically synthesized
ccagcaaaattcgtgattcatg

SEQ ID NO: 1219491 - DNA, 22 bp, Artificial Sequence
  chemically synthesized
accagcaaaattcgtgattcat

SEQ ID NO: 1219492 - DNA, 22 bp, Artificial Sequence
  chemically synthesized
ctatacaggcatgaatcacgaa

SEQ ID NO: 1219493 - DNA, 22 bp, Artificial Sequence
  chemically synthesized
tacaggcatgaatcacgaattt

SEQ ID NO: 1219494 - DNA, 22 bp, Artificial Sequence
  chemically synthesized
gatagatttaccagcaaaattc

SEQ ID NO: 1219495 - DNA, 22 bp, Artificial Sequence
  chemically synthesized
cgatagatttaccagcaaaatt

SEQ ID NO: 1219496 - DNA, 22 bp, Artificial Sequence
  chemically synthesized
ttcgatagatttaccagcaaaa

SEQ ID NO: 1219497 - DNA, 22 bp, Artificial Sequence
  chemically synthesized
tcttcgatagatttaccagcaa

SEQ ID NO: 1219498 - DNA, 22 bp, Artificial Sequence
  chemically synthesized
gaacactctcttcgatagattt

SEQ ID NO: 1219499 - DNA, 22 bp, Artificial Sequence
  chemically synthesized
agaacactctcttcgatagatt

SEQ ID NO: 1219500 - DNA, 22 bp, Artificial Sequence
  chemically synthesized
tgctggtaaatctatcgaagag

SEQ ID NO: 1219501 - DNA, 22 bp, Artificial Sequence
  chemically synthesized
gctggtaaatctatcgaagaga

SEQ ID NO: 1219502 - DNA, 22 bp, Artificial Sequence
  chemically synthesized
ctggtaaatctatcgaagagag

SEQ ID NO: 1219503 - DNA, 22 bp, Artificial Sequence
  chemically synthesized
agacttagaacactctcttcga

SEQ ID NO: 1219504 - DNA, 22 bp, Artificial Sequence
  chemically synthesized
gtaaatctatcgaagagagtgt

SEQ ID NO: 1219505 - DNA, 22 bp, Artificial Sequence
  chemically synthesized
aagtctcagacttagaacactc

SEQ ID NO: 1219506 - DNA, 22 bp, Artificial Sequence
  chemically synthesized
gaagtctcagacttagaacact

SEQ ID NO: 1219507 - DNA, 22 bp, Artificial Sequence
  chemically synthesized
ttgaagtctcagacttagaaca

SEQ ID NO: 1219508 - DNA, 22 bp, Artificial Sequence
  chemically synthesized
tcgaagagagtgttctaagtct

SEQ ID NO: 1219509 - DNA, 22 bp, Artificial Sequence
  chemically synthesized
taagtctgagacttcaagagat

SEQ ID NO: 1219510 - DNA, 22 bp, Artificial Sequence
  chemically synthesized
agtctgagacttcaagagatgg

SEQ ID NO: 1219511 - DNA, 22 bp, Artificial Sequence
  chemically synthesized
agacttcaagagatggtgttct

SEQ ID NO: 1219512 - DNA, 22 bp, Artificial Sequence
  chemically synthesized
gtcacaaaagacagaacaccat

SEQ ID NO: 1219513 - DNA, 22 bp, Artificial Sequence
  chemically synthesized
agtcacaaaagacagaacacca

SEQ ID NO: 1219514 - DNA, 22 bp, Artificial Sequence
  chemically synthesized
cttagtcacaaaagacagaaca

SEQ ID NO: 1219515 - DNA, 22 bp, Artificial Sequence
  chemically synthesized
caagagatggtgttctgtcttt

SEQ ID NO: 1219516 - DNA, 22 bp, Artificial Sequence
  chemically synthesized
aagagatggtgttctgtctttt

SEQ ID NO: 1219517 - DNA, 22 bp, Artificial Sequence
  chemically synthesized
actgcttagtcacaaaagacag

SEQ ID NO: 1219518 - DNA, 22 bp, Artificial Sequence
  chemically synthesized
ctgactgcttagtcacaaaaga

SEQ ID NO: 1219519 - DNA, 22 bp, Artificial Sequence
  chemically synthesized
actgactgcttagtcacaaaag

SEQ ID NO: 1219520 - DNA, 22 bp, Artificial Sequence
  chemically synthesized
tttactgactgcttagtcacaa

SEQ ID NO: 1219521 - DNA, 22 bp, Artificial Sequence
  chemically synthesized
atttactgactgcttagtcaca

SEQ ID NO: 1219522 - DNA, 22 bp, Artificial Sequence
  chemically synthesized
tatttactgactgcttagtcac

SEQ ID NO: 1219523 - DNA, 22 bp, Artificial Sequence
  chemically synthesized
ttatttactgactgcttagtca

SEQ ID NO: 1219524 - DNA, 22 bp, Artificial Sequence
  chemically synthesized
tgtcttttgtgactaagcagtc

SEQ ID NO: 1219525 - DNA, 22 bp, Artificial Sequence
  chemically synthesized
tcttttgtgactaagcagtcag

SEQ ID NO: 1219526 - DNA, 22 bp, Artificial Sequence
  chemically synthesized
ttgtgactaagcagtcagtaaa

SEQ ID NO: 1219527 - DNA, 22 bp, Artificial Sequence
  chemically synthesized
tgtgactaagcagtcagtaaat

SEQ ID NO: 1219528 - DNA, 22 bp, Artificial Sequence
  chemically synthesized
ataagaatttttatttactgac

SEQ ID NO: 1219529 - DNA, 22 bp, Artificial Sequence
  chemically synthesized
gtgactaagcagtcagtaaata

SEQ ID NO: 1219530 - DNA, 22 bp, Artificial Sequence
  chemically synthesized
tgactaagcagtcagtaaataa

SEQ ID NO: 1219531 - DNA, 22 bp, Artificial Sequence
  chemically synthesized
agcagtcagtaaataaaaattc

SEQ ID NO: 1219532 - DNA, 22 bp, Artificial Sequence
  chemically synthesized
aaagaaaaaaataataactcat

SEQ ID NO: 1219533 - DNA, 22 bp, Artificial Sequence
  chemically synthesized
ttatgagttattatttttttct

SEQ ID NO: 1219534 - DNA, 22 bp, Artificial Sequence
  chemically synthesized
aatgatgattcaaagaaaaaaa

SEQ ID NO: 1219535 - DNA, 22 bp, Artificial Sequence
  chemically synthesized
atgagttattatttttttcttt

SEQ ID NO: 1219536 - DNA, 22 bp, Artificial Sequence
  chemically synthesized
tgagttattatttttttctttg

SEQ ID NO: 1219537 - DNA, 22 bp, Artificial Sequence
  chemically synthesized
ttatttttttctttgaatcatc

SEQ ID NO: 1219538 - DNA, 22 bp, Artificial Sequence
  chemically synthesized
tttttttctttgaatcatcatt

SEQ ID NO: 1219539 - DNA, 22 bp, Artificial Sequence
  chemically synthesized
aggagataatctcaatgatgat

SEQ ID NO: 1219540 - DNA, 22 bp, Artificial Sequence
  chemically synthesized
caggagataatctcaatgatga

SEQ ID NO: 1219541 - DNA, 22 bp, Artificial Sequence
  chemically synthesized
ttttctttgaatcatcattgag

SEQ ID NO: 1219542 - DNA, 22 bp, Artificial Sequence
  chemically synthesized
tcaggagataatctcaatgatg

SEQ ID NO: 1219543 - DNA, 22 bp, Artificial Sequence
  chemically synthesized
tttctttgaatcatcattgaga

SEQ ID NO: 1219544 - DNA, 22 bp, Artificial Sequence
  chemically synthesized
ttcaggagataatctcaatgat

SEQ ID NO: 1219545 - DNA, 22 bp, Artificial Sequence
  chemically synthesized
ttctttgaatcatcattgagat

SEQ ID NO: 1219546 - DNA, 22 bp, Artificial Sequence
  chemically synthesized
tctttgaatcatcattgagatt

SEQ ID NO: 1219547 - DNA, 22 bp, Artificial Sequence
  chemically synthesized
ctttgaatcatcattgagatta

SEQ ID NO: 1219548 - DNA, 22 bp, Artificial Sequence
  chemically synthesized
tttgaatcatcattgagattat

SEQ ID NO: 1219549 - DNA, 22 bp, Artificial Sequence
  chemically synthesized
tgaatcatcattgagattatct

SEQ ID NO: 1219550 - DNA, 22 bp, Artificial Sequence
  chemically synthesized
gaatcatcattgagattatctc

SEQ ID NO: 1219551 - DNA, 22 bp, Artificial Sequence
  chemically synthesized
agcatttttcaggagataatct

SEQ ID NO: 1219552 - DNA, 22 bp, Artificial Sequence
  chemically synthesized
aatcatcattgagattatctcc

SEQ ID NO: 1219553 - DNA, 22 bp, Artificial Sequence
  chemically synthesized
ctcagcatttttcaggagataa

SEQ ID NO: 1219554 - DNA, 22 bp, Artificial Sequence
  chemically synthesized
gctcagcatttttcaggagata

SEQ ID NO: 1219555 - DNA, 22 bp, Artificial Sequence
  chemically synthesized
tgctcagcatttttcaggagat

SEQ ID NO: 1219556 - DNA, 22 bp, Artificial Sequence
  chemically synthesized
ttgctcagcatttttcaggaga

SEQ ID NO: 1219557 - DNA, 22 bp, Artificial Sequence
  chemically synthesized
agattatctcctgaaaaatgct

SEQ ID NO: 1219558 - DNA, 22 bp, Artificial Sequence
  chemically synthesized
tacatttttgctcagcattttt

SEQ ID NO: 1219559 - DNA, 22 bp, Artificial Sequence
  chemically synthesized
atacatttttgctcagcatttt

SEQ ID NO: 1219560 - DNA, 22 bp, Artificial Sequence
  chemically synthesized
tctcctgaaaaatgctgagcaa

SEQ ID NO: 1219561 - DNA, 22 bp, Artificial Sequence
  chemically synthesized
ctgaaaaatgctgagcaaaaat

SEQ ID NO: 1219562 - DNA, 22 bp, Artificial Sequence
  chemically synthesized
aaaaatgctgagcaaaaatgta

SEQ ID NO: 1219563 - DNA, 22 bp, Artificial Sequence
  chemically synthesized
agcaaaaatgtataaatgtgta

SEQ ID NO: 1219564 - DNA, 22 bp, Artificial Sequence
  chemically synthesized
gggaaaccaccaagtacacatt

SEQ ID NO: 1219565 - DNA, 22 bp, Artificial Sequence
  chemically synthesized
tgttagggaaaccaccaagtac

SEQ ID NO: 1219566 - DNA, 22 bp, Artificial Sequence
  chemically synthesized
ccattgtgttagggaaaccacc

SEQ ID NO: 1219567 - DNA, 22 bp, Artificial Sequence
  chemically synthesized
gccattgtgttagggaaaccac

SEQ ID NO: 1219568 - DNA, 22 bp, Artificial Sequence
  chemically synthesized
ttgccattgtgttagggaaacc

SEQ ID NO: 1219569 - DNA, 22 bp, Artificial Sequence
  chemically synthesized
ggtggtttccctaacacaatgg

SEQ ID NO: 1219570 - DNA, 22 bp, Artificial Sequence
  chemically synthesized
gtggtttccctaacacaatggc

SEQ ID NO: 1219571 - DNA, 22 bp, Artificial Sequence
  chemically synthesized
aaatatgtcaattcttgccatt

SEQ ID NO: 1219572 - DNA, 22 bp, Artificial Sequence
  chemically synthesized
aaaatatgtcaattcttgccat

SEQ ID NO: 1219573 - DNA, 22 bp, Artificial Sequence
  chemically synthesized
taaaatatgtcaattcttgcca

SEQ ID NO: 1219574 - DNA, 22 bp, Artificial Sequence
  chemically synthesized
ccctaacacaatggcaagaatt

SEQ ID NO: 1219575 - DNA, 22 bp, Artificial Sequence
  chemically synthesized
ttaaaatatgtcaattcttgcc

SEQ ID NO: 1219576 - DNA, 22 bp, Artificial Sequence
  chemically synthesized
cctaacacaatggcaagaattg

SEQ ID NO: 1219577 - DNA, 22 bp, Artificial Sequence
  chemically synthesized
acacaatggcaagaattgacat

SEQ ID NO: 1219578 - DNA, 22 bp, Artificial Sequence
  chemically synthesized
agcataagtcatatatttttaa

SEQ ID NO: 1219579 - DNA, 22 bp, Artificial Sequence
  chemically synthesized
acatattttaaaaatatatgac

SEQ ID NO: 1219580 - DNA, 22 bp, Artificial Sequence
  chemically synthesized
taaaaatatatgacttatgctg

SEQ ID NO: 1219581 - DNA, 22 bp, Artificial Sequence
  chemically synthesized
aaaaatatatgacttatgctga

SEQ ID NO: 1219582 - DNA, 22 bp, Artificial Sequence
  chemically synthesized
aaaatatatgacttatgctgaa

SEQ ID NO: 1219583 - DNA, 22 bp, Artificial Sequence
  chemically synthesized
caaataagatgaggattcagca

SEQ ID NO: 1219584 - DNA, 22 bp, Artificial Sequence
  chemically synthesized
tggctgcaaataagatgaggat

SEQ ID NO: 1219585 - DNA, 22 bp, Artificial Sequence
  chemically synthesized
atggctgcaaataagatgagga

SEQ ID NO: 1219586 - DNA, 22 bp, Artificial Sequence
  chemically synthesized
cttatggctgcaaataagatga

SEQ ID NO: 1219587 - DNA, 22 bp, Artificial Sequence
  chemically synthesized
atgctgaatcctcatcttattt

SEQ ID NO: 1219588 - DNA, 22 bp, Artificial Sequence
  chemically synthesized
acttatggctgcaaataagatg

SEQ ID NO: 1219589 - DNA, 22 bp, Artificial Sequence
  chemically synthesized
tgctgaatcctcatcttatttg

SEQ ID NO: 1219590 - DNA, 22 bp, Artificial Sequence
  chemically synthesized
aatcctcatcttatttgcagcc

SEQ ID NO: 1219591 - DNA, 22 bp, Artificial Sequence
  chemically synthesized
aagtttacttatggctgcaaat

SEQ ID NO: 1219592 - DNA, 22 bp, Artificial Sequence
  chemically synthesized
aaagtttacttatggctgcaaa

SEQ ID NO: 1219593 - DNA, 22 bp, Artificial Sequence
  chemically synthesized
ttaaagtttacttatggctgca

SEQ ID NO: 1219594 - DNA, 22 bp, Artificial Sequence
  chemically synthesized
cttaaagtttacttatggctgc

SEQ ID NO: 1219595 - DNA, 22 bp, Artificial Sequence
  chemically synthesized
atcttatttgcagccataagta

SEQ ID NO: 1219596 - DNA, 22 bp, Artificial Sequence
  chemically synthesized
atttgcagccataagtaaactt

SEQ ID NO: 1219597 - DNA, 22 bp, Artificial Sequence
  chemically synthesized
tttgcagccataagtaaacttt

SEQ ID NO: 1219598 - DNA, 22 bp, Artificial Sequence
  chemically synthesized
gcagccataagtaaactttaag

SEQ ID NO: 1219599 - DNA, 22 bp, Artificial Sequence
  chemically synthesized
cagccataagtaaactttaaga

SEQ ID NO: 1219600 - DNA, 22 bp, Artificial Sequence
  chemically synthesized
aagtataataataaaaagtttc

SEQ ID NO: 1219601 - DNA, 22 bp, Artificial Sequence
  chemically synthesized
aaagtataataataaaaagttt

SEQ ID NO: 1219602 - DNA, 22 bp, Artificial Sequence
  chemically synthesized
taagaaactttttattattata

SEQ ID NO: 1219603 - DNA, 22 bp, Artificial Sequence
  chemically synthesized
aagaaactttttattattatac

SEQ ID NO: 1219604 - DNA, 22 bp, Artificial Sequence
  chemically synthesized
agaaactttttattattatact

SEQ ID NO: 1219605 - DNA, 22 bp, Artificial Sequence
  chemically synthesized
tttattattatactttaagttt

SEQ ID NO: 1219606 - DNA, 22 bp, Artificial Sequence
  chemically synthesized
ttattattatactttaagtttt

SEQ ID NO: 1219607 - DNA, 22 bp, Artificial Sequence
  chemically synthesized
cacatgtatcccaaaacttaaa

SEQ ID NO: 1219608 - DNA, 22 bp, Artificial Sequence
  chemically synthesized
tattattatactttaagttttg

SEQ ID NO: 1219609 - DNA, 22 bp, Artificial Sequence
  chemically synthesized
attattatactttaagttttgg

SEQ ID NO: 1219610 - DNA, 22 bp, Artificial Sequence
  chemically synthesized
tgcacatgtatcccaaaactta

SEQ ID NO: 1219611 - DNA, 22 bp, Artificial Sequence
  chemically synthesized
ttattatactttaagttttggg

SEQ ID NO: 1219612 - DNA, 22 bp, Artificial Sequence
  chemically synthesized
ttatactttaagttttgggata

SEQ ID NO: 1219613 - DNA, 22 bp, Artificial Sequence
  chemically synthesized
tactttaagttttgggatacat

SEQ ID NO: 1219614 - DNA, 22 bp, Artificial Sequence
  chemically synthesized
cacgttctgcacatgtatccca

SEQ ID NO: 1219615 - DNA, 22 bp, Artificial Sequence
  chemically synthesized
taagttttgggatacatgtgca

SEQ ID NO: 1219616 - DNA, 22 bp, Artificial Sequence
  chemically synthesized
aagttttgggatacatgtgcag

SEQ ID NO: 1219617 - DNA, 22 bp, Artificial Sequence
  chemically synthesized
agttttgggatacatgtgcaga

SEQ ID NO: 1219618 - DNA, 22 bp, Artificial Sequence
  chemically synthesized
tgggatacatgtgcagaacgtg

SEQ ID NO: 1219619 - DNA, 22 bp, Artificial Sequence
  chemically synthesized
gggatacatgtgcagaacgtgc

SEQ ID NO: 1219620 - DNA, 22 bp, Artificial Sequence
  chemically synthesized
tgtaacaaacctgcacgttctg

SEQ ID NO: 1219621 - DNA, 22 bp, Artificial Sequence
  chemically synthesized
ggatacatgtgcagaacgtgca

SEQ ID NO: 1219622 - DNA, 22 bp, Artificial Sequence
  chemically synthesized
gttacataggtatacacatgcc

SEQ ID NO: 1219623 - DNA, 22 bp, Artificial Sequence
  chemically synthesized
ttacataggtatacacatgcca

SEQ ID NO: 1219624 - DNA, 22 bp, Artificial Sequence
  chemically synthesized
cataggtatacacatgccatgg

SEQ ID NO: 1219625 - DNA, 22 bp, Artificial Sequence
  chemically synthesized
gtacagcaaaccaccatggcat

SEQ ID NO: 1219626 - DNA, 22 bp, Artificial Sequence
  chemically synthesized
acatagatgacggattggtaca

SEQ ID NO: 1219627 - DNA, 22 bp, Artificial Sequence
  chemically synthesized
gctgtaccaatccgtcatctat

SEQ ID NO: 1219628 - DNA, 22 bp, Artificial Sequence
  chemically synthesized
ctgtaccaatccgtcatctatg

SEQ ID NO: 1219629 - DNA, 22 bp, Artificial Sequence
  chemically synthesized
ggggaaatacctaacatagatg

SEQ ID NO: 1219630 - DNA, 22 bp, Artificial Sequence
  chemically synthesized
taccaatccgtcatctatgtta

SEQ ID NO: 1219631 - DNA, 22 bp, Artificial Sequence
  chemically synthesized
ggggagtgatagcattagggga

SEQ ID NO: 1219632 - DNA, 22 bp, Artificial Sequence
  chemically synthesized
tgttaggtatttcccctaatgc

SEQ ID NO: 1219633 - DNA, 22 bp, Artificial Sequence
  chemically synthesized
ggtatttcccctaatgctatca

SEQ ID NO: 1219634 - DNA, 22 bp, Artificial Sequence
  chemically synthesized
cccctaatgctatcactcccct

SEQ ID NO: 1219635 - DNA, 22 bp, Artificial Sequence
  chemically synthesized
ccctaatgctatcactccccta

SEQ ID NO: 1219636 - DNA, 22 bp, Artificial Sequence
  chemically synthesized
gggtgtgtggggctaggggagt

SEQ ID NO: 1219637 - DNA, 22 bp, Artificial Sequence
  chemically synthesized
ggggtgtgtggggctaggggag

SEQ ID NO: 1219638 - DNA, 22 bp, Artificial Sequence
  chemically synthesized
tggggtgtgtggggctagggga

SEQ ID NO: 1219639 - DNA, 22 bp, Artificial Sequence
  chemically synthesized
ttggggtgtgtggggctagggg

SEQ ID NO: 1219640 - DNA, 22 bp, Artificial Sequence
  chemically synthesized
atgctatcactcccctagcccc

SEQ ID NO: 1219641 - DNA, 22 bp, Artificial Sequence
  chemically synthesized
tcactcccctagccccacacac

SEQ ID NO: 1219642 - DNA, 22 bp, Artificial Sequence
  chemically synthesized
gggccttttggggtgtgtgggg

SEQ ID NO: 1219643 - DNA, 22 bp, Artificial Sequence
  chemically synthesized
ccctagccccacacaccccaaa

SEQ ID NO: 1219644 - DNA, 22 bp, Artificial Sequence
  chemically synthesized
gccccacacaccccaaaaggcc

SEQ ID NO: 1219645 - DNA, 22 bp, Artificial Sequence
  chemically synthesized
aacaaccagaagacatggatgc

SEQ ID NO: 1219646 - DNA, 22 bp, Artificial Sequence
  chemically synthesized
cactgcatccatgtcttctggt

SEQ ID NO: 1219647 - DNA, 22 bp, Artificial Sequence
  chemically synthesized
catccatgtcttctggttgttc

SEQ ID NO: 1219648 - DNA, 22 bp, Artificial Sequence
  chemically synthesized
ataaatcggagttgaacaacca

SEQ ID NO: 1219649 - DNA, 22 bp, Artificial Sequence
  chemically synthesized
actcataaatcggagttgaaca

SEQ ID NO: 1219650 - DNA, 22 bp, Artificial Sequence
  chemically synthesized
tcactcataaatcggagttgaa

SEQ ID NO: 1219651 - DNA, 22 bp, Artificial Sequence
  chemically synthesized
ctggttgttcaactccgattta

SEQ ID NO: 1219652 - DNA, 22 bp, Artificial Sequence
  chemically synthesized
tggttgttcaactccgatttat

SEQ ID NO: 1219653 - DNA, 22 bp, Artificial Sequence
  chemically synthesized
gttgttcaactccgatttatga

SEQ ID NO: 1219654 - DNA, 22 bp, Artificial Sequence
  chemically synthesized
ggcatgttctcactcataaatc

SEQ ID NO: 1219655 - DNA, 22 bp, Artificial Sequence
  chemically synthesized
ttcaactccgatttatgagtga

SEQ ID NO: 1219656 - DNA, 22 bp, Artificial Sequence
  chemically synthesized
aactccgatttatgagtgagaa

SEQ ID NO: 1219657 - DNA, 22 bp, Artificial Sequence
  chemically synthesized
cgatttatgagtgagaacatgc

SEQ ID NO: 1219658 - DNA, 22 bp, Artificial Sequence
  chemically synthesized
atgagtgagaacatgccgagtt

SEQ ID NO: 1219659 - DNA, 22 bp, Artificial Sequence
  chemically synthesized
tgagtgagaacatgccgagttt

SEQ ID NO: 1219660 - DNA, 22 bp, Artificial Sequence
  chemically synthesized
acataggaacagaaaatcaaac

SEQ ID NO: 1219661 - DNA, 22 bp, Artificial Sequence
  chemically synthesized
agcaaactaacataggaacaga

SEQ ID NO: 1219662 - DNA, 22 bp, Artificial Sequence
  chemically synthesized
tcagcaaactaacataggaaca

SEQ ID NO: 1219663 - DNA, 22 bp, Artificial Sequence
  chemically synthesized
gattttctgttcctatgttagt

SEQ ID NO: 1219664 - DNA, 22 bp, Artificial Sequence
  chemically synthesized
attttctgttcctatgttagtt

SEQ ID NO: 1219665 - DNA, 22 bp, Artificial Sequence
  chemically synthesized
tctgttcctatgttagtttgct

SEQ ID NO: 1219666 - DNA, 22 bp, Artificial Sequence
  chemically synthesized
ctgttcctatgttagtttgctg

SEQ ID NO: 1219667 - DNA, 22 bp, Artificial Sequence
  chemically synthesized
tgttcctatgttagtttgctga

SEQ ID NO: 1219668 - DNA, 22 bp, Artificial Sequence
  chemically synthesized
gaaaacatcattctcagcaaac

SEQ ID NO: 1219669 - DNA, 22 bp, Artificial Sequence
  chemically synthesized
ttcctatgttagtttgctgaga

SEQ ID NO: 1219670 - DNA, 22 bp, Artificial Sequence
  chemically synthesized
ctatgttagtttgctgagaatg

SEQ ID NO: 1219671 - DNA, 22 bp, Artificial Sequence
  chemically synthesized
tgttagtttgctgagaatgatg

SEQ ID NO: 1219672 - DNA, 22 bp, Artificial Sequence
  chemically synthesized
gtttgctgagaatgatgttttc

SEQ ID NO: 1219673 - DNA, 22 bp, Artificial Sequence
  chemically synthesized
gctgagaatgatgttttccagc

SEQ ID NO: 1219674 - DNA, 22 bp, Artificial Sequence
  chemically synthesized
ctgagaatgatgttttccagct

SEQ ID NO: 1219675 - DNA, 22 bp, Artificial Sequence
  chemically synthesized
agaatgatgttttccagcttca

SEQ ID NO: 1219676 - DNA, 22 bp, Artificial Sequence
  chemically synthesized
cagggatgtggatgaagctgga

SEQ ID NO: 1219677 - DNA, 22 bp, Artificial Sequence
  chemically synthesized
gcagggatgtggatgaagctgg

SEQ ID NO: 1219678 - DNA, 22 bp, Artificial Sequence
  chemically synthesized
tgcagggatgtggatgaagctg

SEQ ID NO: 1219679 - DNA, 22 bp, Artificial Sequence
  chemically synthesized
atgtcctttgcagggatgtgga

SEQ ID NO: 1219680 - DNA, 22 bp, Artificial Sequence
  chemically synthesized
catgtcctttgcagggatgtgg

SEQ ID NO: 1219681 - DNA, 22 bp, Artificial Sequence
  chemically synthesized
tccagcttcatccacatccctg

SEQ ID NO: 1219682 - DNA, 22 bp, Artificial Sequence
  chemically synthesized
ccagcttcatccacatccctgc

SEQ ID NO: 1219683 - DNA, 22 bp, Artificial Sequence
  chemically synthesized
cagcttcatccacatccctgca

SEQ ID NO: 1219684 - DNA, 22 bp, Artificial Sequence
  chemically synthesized
catccacatccctgcaaaggac

SEQ ID NO: 1219685 - DNA, 22 bp, Artificial Sequence
  chemically synthesized
atccacatccctgcaaaggaca

SEQ ID NO: 1219686 - DNA, 22 bp, Artificial Sequence
  chemically synthesized
caaaggacatgaaactcatcct

SEQ ID NO: 1219687 - DNA, 22 bp, Artificial Sequence
  chemically synthesized
tgcagcaacaaaaaaggatgag

SEQ ID NO: 1219688 - DNA, 22 bp, Artificial Sequence
  chemically synthesized
atccttttttgttgctgcatag

SEQ ID NO: 1219689 - DNA, 22 bp, Artificial Sequence
  chemically synthesized
ttttgttgctgcatagtattcc

SEQ ID NO: 1219690 - DNA, 22 bp, Artificial Sequence
  chemically synthesized
tttgttgctgcatagtattcca

SEQ ID NO: 1219691 - DNA, 22 bp, Artificial Sequence
  chemically synthesized
ttgttgctgcatagtattccat

SEQ ID NO: 1219692 - DNA, 22 bp, Artificial Sequence
  chemically synthesized
tgttgctgcatagtattccatg

SEQ ID NO: 1219693 - DNA, 22 bp, Artificial Sequence
  chemically synthesized
gcacatatacaccatggaatac

SEQ ID NO: 1219694 - DNA, 22 bp, Artificial Sequence
  chemically synthesized
gttgctgcatagtattccatgg

SEQ ID NO: 1219695 - DNA, 22 bp, Artificial Sequence
  chemically synthesized
ggcacatatacaccatggaata

SEQ ID NO: 1219696 - DNA, 22 bp, Artificial Sequence
  chemically synthesized
ttgctgcatagtattccatggt

SEQ ID NO: 1219697 - DNA, 22 bp, Artificial Sequence
  chemically synthesized
ctgcatagtattccatggtgta

SEQ ID NO: 1219698 - DNA, 22 bp, Artificial Sequence
  chemically synthesized
catagtattccatggtgtatat

SEQ ID NO: 1219699 - DNA, 22 bp, Artificial Sequence
  chemically synthesized
gataaagaaaatttggcacata

SEQ ID NO: 1219700 - DNA, 22 bp, Artificial Sequence
  chemically synthesized
catggtgtatatgtgccaaatt

SEQ ID NO: 1219701 - DNA, 22 bp, Artificial Sequence
  chemically synthesized
tctttatccagtctatcattga

SEQ ID NO: 1219702 - DNA, 22 bp, Artificial Sequence
  chemically synthesized
ctttatccagtctatcattgat

SEQ ID NO: 1219703 - DNA, 22 bp, Artificial Sequence
  chemically synthesized
tttatccagtctatcattgatg

SEQ ID NO: 1219704 - DNA, 22 bp, Artificial Sequence
  chemically synthesized
tatccagtctatcattgatggg

SEQ ID NO: 1219705 - DNA, 22 bp, Artificial Sequence
  chemically synthesized
atccagtctatcattgatgggc

SEQ ID NO: 1219706 - DNA, 22 bp, Artificial Sequence
  chemically synthesized
tccagtctatcattgatgggca

SEQ ID NO: 1219707 - DNA, 22 bp, Artificial Sequence
  chemically synthesized
aaaccaacccaaatgcccatca

SEQ ID NO: 1219708 - DNA, 22 bp, Artificial Sequence
  chemically synthesized
gaaaccaacccaaatgcccatc

SEQ ID NO: 1219709 - DNA, 22 bp, Artificial Sequence
  chemically synthesized
tcattgatgggcatttgggttg

SEQ ID NO: 1219710 - DNA, 22 bp, Artificial Sequence
  chemically synthesized
atgggcatttgggttggtttca

SEQ ID NO: 1219711 - DNA, 22 bp, Artificial Sequence
  chemically synthesized
acaatagcaaagacttgaaacc

SEQ ID NO: 1219712 - DNA, 22 bp, Artificial Sequence
  chemically synthesized
ttcacaatagcaaagacttgaa

SEQ ID NO: 1219713 - DNA, 22 bp, Artificial Sequence
  chemically synthesized
gggttggtttcaagtctttgct

SEQ ID NO: 1219714 - DNA, 22 bp, Artificial Sequence
  chemically synthesized
ggttggtttcaagtctttgcta

SEQ ID NO: 1219715 - DNA, 22 bp, Artificial Sequence
  chemically synthesized
agcactattcacaatagcaaag

SEQ ID NO: 1219716 - DNA, 22 bp, Artificial Sequence
  chemically synthesized
cagcactattcacaatagcaaa

SEQ ID NO: 1219717 - DNA, 22 bp, Artificial Sequence
  chemically synthesized
gtttcaagtctttgctattgtg

SEQ ID NO: 1219718 - DNA, 22 bp, Artificial Sequence
  chemically synthesized
tttcagcactattcacaatagc

SEQ ID NO: 1219719 - DNA, 22 bp, Artificial Sequence
  chemically synthesized
atttcagcactattcacaatag

SEQ ID NO: 1219720 - DNA, 22 bp, Artificial Sequence
  chemically synthesized
caagtctttgctattgtgaata

SEQ ID NO: 1219721 - DNA, 22 bp, Artificial Sequence
  chemically synthesized
aagtctttgctattgtgaatag

SEQ ID NO: 1219722 - DNA, 22 bp, Artificial Sequence
  chemically synthesized
tgcttatttcagcactattcac

SEQ ID NO: 1219723 - DNA, 22 bp, Artificial Sequence
  chemically synthesized
tgtgcttatttcagcactattc

SEQ ID NO: 1219724 - DNA, 22 bp, Artificial Sequence
  chemically synthesized
tgctattgtgaatagtgctgaa

SEQ ID NO: 1219725 - DNA, 22 bp, Artificial Sequence
  chemically synthesized
ttctgtgcttatttcagcacta

SEQ ID NO: 1219726 - DNA, 22 bp, Artificial Sequence
  chemically synthesized
gctattgtgaatagtgctgaaa

SEQ ID NO: 1219727 - DNA, 22 bp, Artificial Sequence
  chemically synthesized
ctattgtgaatagtgctgaaat

SEQ ID NO: 1219728 - DNA, 22 bp, Artificial Sequence
  chemically synthesized
ttgtgaatagtgctgaaataag

SEQ ID NO: 1219729 - DNA, 22 bp, Artificial Sequence
  chemically synthesized
taaattattctgtgcttatttc

SEQ ID NO: 1219730 - DNA, 22 bp, Artificial Sequence
  chemically synthesized
tgaatagtgctgaaataagcac

SEQ ID NO: 1219731 - DNA, 22 bp, Artificial Sequence
  chemically synthesized
aaataagcacagaataatttat

SEQ ID NO: 1219732 - DNA, 22 bp, Artificial Sequence
  chemically synthesized
ggtatatacccaaaggattata

SEQ ID NO: 1219733 - DNA, 22 bp, Artificial Sequence
  chemically synthesized
ataatcctttgggtatataccc

SEQ ID NO: 1219734 - DNA, 22 bp, Artificial Sequence
  chemically synthesized
taatcctttgggtatataccca

SEQ ID NO: 1219735 - DNA, 22 bp, Artificial Sequence
  chemically synthesized
accaagcaatcccatcactggg

SEQ ID NO: 1219736 - DNA, 22 bp, Artificial Sequence
  chemically synthesized
gaccaagcaatcccatcactgg

SEQ ID NO: 1219737 - DNA, 22 bp, Artificial Sequence
  chemically synthesized
tgggtatatacccagtgatggg

SEQ ID NO: 1219738 - DNA, 22 bp, Artificial Sequence
  chemically synthesized
gggtatatacccagtgatggga

SEQ ID NO: 1219739 - DNA, 22 bp, Artificial Sequence
  chemically synthesized
ggtatatacccagtgatgggat

SEQ ID NO: 1219740 - DNA, 22 bp, Artificial Sequence
  chemically synthesized
gagccagaaataccatttgacc

SEQ ID NO: 1219741 - DNA, 22 bp, Artificial Sequence
  chemically synthesized
cttggtcaaatggtatttctgg

SEQ ID NO: 1219742 - DNA, 22 bp, Artificial Sequence
  chemically synthesized
aaggatctagagccagaaatac

SEQ ID NO: 1219743 - DNA, 22 bp, Artificial Sequence
  chemically synthesized
ggtcaaatggtatttctggctc

SEQ ID NO: 1219744 - DNA, 22 bp, Artificial Sequence
  chemically synthesized
ctcaaggatctagagccagaaa

SEQ ID NO: 1219745 - DNA, 22 bp, Artificial Sequence
  chemically synthesized
gtcaaatggtatttctggctct

SEQ ID NO: 1219746 - DNA, 22 bp, Artificial Sequence
  chemically synthesized
ctggctctagatccttgagcaa

SEQ ID NO: 1219747 - DNA, 22 bp, Artificial Sequence
  chemically synthesized
tggctctagatccttgagcaat

SEQ ID NO: 1219748 - DNA, 22 bp, Artificial Sequence
  chemically synthesized
gctctagatccttgagcaatca

SEQ ID NO: 1219749 - DNA, 22 bp, Artificial Sequence
  chemically synthesized
tggaagacagtgtggtgattgc

SEQ ID NO: 1219750 - DNA, 22 bp, Artificial Sequence
  chemically synthesized
tagatccttgagcaatcaccac

SEQ ID NO: 1219751 - DNA, 22 bp, Artificial Sequence
  chemically synthesized
gatccttgagcaatcaccacac

SEQ ID NO: 1219752 - DNA, 22 bp, Artificial Sequence
  chemically synthesized
aaacattgtggaagacagtgtg

SEQ ID NO: 1219753 - DNA, 22 bp, Artificial Sequence
  chemically synthesized
gagcaatcaccacactgtcttc

SEQ ID NO: 1219754 - DNA, 22 bp, Artificial Sequence
  chemically synthesized
agcaatcaccacactgtcttcc

SEQ ID NO: 1219755 - DNA, 22 bp, Artificial Sequence
  chemically synthesized
gttcaaacattgtggaagacag

SEQ ID NO: 1219756 - DNA, 22 bp, Artificial Sequence
  chemically synthesized
ggagtgtaaattagttcaaaca

SEQ ID NO: 1219757 - DNA, 22 bp, Artificial Sequence
  chemically synthesized
tcttccacaatgtttgaactaa

SEQ ID NO: 1219758 - DNA, 22 bp, Artificial Sequence
  chemically synthesized
ttgggagtgtaaattagttcaa

SEQ ID NO: 1219759 - DNA, 22 bp, Artificial Sequence
  chemically synthesized
ccacaatgtttgaactaattta

SEQ ID NO: 1219760 - DNA, 22 bp, Artificial Sequence
  chemically synthesized
cacaatgtttgaactaatttac

SEQ ID NO: 1219761 - DNA, 22 bp, Artificial Sequence
  chemically synthesized
cactgttgggagtgtaaattag

SEQ ID NO: 1219762 - DNA, 22 bp, Artificial Sequence
  chemically synthesized
acactgttgggagtgtaaatta

SEQ ID NO: 1219763 - DNA, 22 bp, Artificial Sequence
  chemically synthesized
tacactgttgggagtgtaaatt

SEQ ID NO: 1219764 - DNA, 22 bp, Artificial Sequence
  chemically synthesized
gaactaatttacactcccaaca

SEQ ID NO: 1219765 - DNA, 22 bp, Artificial Sequence
  chemically synthesized
aactaatttacactcccaacag

SEQ ID NO: 1219766 - DNA, 22 bp, Artificial Sequence
  chemically synthesized
atttacactcccaacagtgtaa

SEQ ID NO: 1219767 - DNA, 22 bp, Artificial Sequence
  chemically synthesized
acactcccaacagtgtaaaatc

SEQ ID NO: 1219768 - DNA, 22 bp, Artificial Sequence
  chemically synthesized
cactcccaacagtgtaaaatca

SEQ ID NO: 1219769 - DNA, 22 bp, Artificial Sequence
  chemically synthesized
ccaacagtgtaaaatcattcct

SEQ ID NO: 1219770 - DNA, 22 bp, Artificial Sequence
  chemically synthesized
gagagaatatggagaaatagga

SEQ ID NO: 1219771 - DNA, 22 bp, Artificial Sequence
  chemically synthesized
ctatttctccatattctctcca

SEQ ID NO: 1219772 - DNA, 22 bp, Artificial Sequence
  chemically synthesized
tttctccatattctctccagca

SEQ ID NO: 1219773 - DNA, 22 bp, Artificial Sequence
  chemically synthesized
ctccatattctctccagcatct

SEQ ID NO: 1219774 - DNA, 22 bp, Artificial Sequence
  chemically synthesized
tccatattctctccagcatctg

SEQ ID NO: 1219775 - DNA, 22 bp, Artificial Sequence
  chemically synthesized
catattctctccagcatctgtt

SEQ ID NO: 1219776 - DNA, 22 bp, Artificial Sequence
  chemically synthesized
tctccagcatctgttgtttcct

SEQ ID NO: 1219777 - DNA, 22 bp, Artificial Sequence
  chemically synthesized
tccagcatctgttgtttcctga

SEQ ID NO: 1219778 - DNA, 22 bp, Artificial Sequence
  chemically synthesized
cagcatctgttgtttcctgact

SEQ ID NO: 1219779 - DNA, 22 bp, Artificial Sequence
  chemically synthesized
gaatggtgatcatcaaaaagtc

SEQ ID NO: 1219780 - DNA, 22 bp, Artificial Sequence
  chemically synthesized
ttgtttcctgactttttgatga

SEQ ID NO: 1219781 - DNA, 22 bp, Artificial Sequence
  chemically synthesized
gttagaatggtgatcatcaaaa

SEQ ID NO: 1219782 - DNA, 22 bp, Artificial Sequence
  chemically synthesized
tttcctgactttttgatgatca

SEQ ID NO: 1219783 - DNA, 22 bp, Artificial Sequence
  chemically synthesized
cctgactttttgatgatcacca

SEQ ID NO: 1219784 - DNA, 22 bp, Artificial Sequence
  chemically synthesized
ctgactttttgatgatcaccat

SEQ ID NO: 1219785 - DNA, 22 bp, Artificial Sequence
  chemically synthesized
atgctagttagaatggtgatca

SEQ ID NO: 1219786 - DNA, 22 bp, Artificial Sequence
  chemically synthesized
actttttgatgatcaccattct

SEQ ID NO: 1219787 - DNA, 22 bp, Artificial Sequence
  chemically synthesized
tttgatgatcaccattctaact

SEQ ID NO: 1219788 - DNA, 22 bp, Artificial Sequence
  chemically synthesized
ttgatgatcaccattctaacta

SEQ ID NO: 1219789 - DNA, 22 bp, Artificial Sequence
  chemically synthesized
tgatgatcaccattctaactag

SEQ ID NO: 1219790 - DNA, 22 bp, Artificial Sequence
  chemically synthesized
gatgatcaccattctaactagc

SEQ ID NO: 1219791 - DNA, 22 bp, Artificial Sequence
  chemically synthesized
atgatcaccattctaactagca

SEQ ID NO: 1219792 - DNA, 22 bp, Artificial Sequence
  chemically synthesized
taactagcatgagatggtatct

SEQ ID NO: 1219793 - DNA, 22 bp, Artificial Sequence
  chemically synthesized
actagcatgagatggtatctca

SEQ ID NO: 1219794 - DNA, 22 bp, Artificial Sequence
  chemically synthesized
gcatgagatggtatctcattgt

SEQ ID NO: 1219795 - DNA, 22 bp, Artificial Sequence
  chemically synthesized
gagaaatgaaaatcaaaaccac

SEQ ID NO: 1219796 - DNA, 22 bp, Artificial Sequence
  chemically synthesized
gtcattagagaaatgaaaatca

SEQ ID NO: 1219797 - DNA, 22 bp, Artificial Sequence
  chemically synthesized
attgtggttttgattttcattt

SEQ ID NO: 1219798 - DNA, 22 bp, Artificial Sequence
  chemically synthesized
tggttttgattttcatttctct

SEQ ID NO: 1219799 - DNA, 22 bp, Artificial Sequence
  chemically synthesized
atcatcactggtcattagagaa

SEQ ID NO: 1219800 - DNA, 22 bp, Artificial Sequence
  chemically synthesized
tgattttcatttctctaatgac

SEQ ID NO: 1219801 - DNA, 22 bp, Artificial Sequence
  chemically synthesized
gattttcatttctctaatgacc

SEQ ID NO: 1219802 - DNA, 22 bp, Artificial Sequence
  chemically synthesized
attttcatttctctaatgacca

SEQ ID NO: 1219803 - DNA, 22 bp, Artificial Sequence
  chemically synthesized
tcatttctctaatgaccagtga

SEQ ID NO: 1219804 - DNA, 22 bp, Artificial Sequence
  chemically synthesized
catttctctaatgaccagtgat

SEQ ID NO: 1219805 - DNA, 22 bp, Artificial Sequence
  chemically synthesized
atttctctaatgaccagtgatg

SEQ ID NO: 1219806 - DNA, 22 bp, Artificial Sequence
  chemically synthesized
ctctaatgaccagtgatgatga

SEQ ID NO: 1219807 - DNA, 22 bp, Artificial Sequence
  chemically synthesized
tctaatgaccagtgatgatgaa

SEQ ID NO: 1219808 - DNA, 22 bp, Artificial Sequence
  chemically synthesized
taatgaccagtgatgatgaact

SEQ ID NO: 1219809 - DNA, 22 bp, Artificial Sequence
  chemically synthesized
atgaccagtgatgatgaacttt

SEQ ID NO: 1219810 - DNA, 22 bp, Artificial Sequence
  chemically synthesized
tgtggccaacaagtatgtgaaa

SEQ ID NO: 1219811 - DNA, 22 bp, Artificial Sequence
  chemically synthesized
atgtggccaacaagtatgtgaa

SEQ ID NO: 1219812 - DNA, 22 bp, Artificial Sequence
  chemically synthesized
ttttttcacatacttgttggcc

SEQ ID NO: 1219813 - DNA, 22 bp, Artificial Sequence
  chemically synthesized
tttttcacatacttgttggcca

SEQ ID NO: 1219814 - DNA, 22 bp, Artificial Sequence
  chemically synthesized
ttttcacatacttgttggccac

SEQ ID NO: 1219815 - DNA, 22 bp, Artificial Sequence
  chemically synthesized
tttcacatacttgttggccaca

SEQ ID NO: 1219816 - DNA, 22 bp, Artificial Sequence
  chemically synthesized
ttcacatacttgttggccacat

SEQ ID NO: 1219817 - DNA, 22 bp, Artificial Sequence
  chemically synthesized
tcacatacttgttggccacata

SEQ ID NO: 1219818 - DNA, 22 bp, Artificial Sequence
  chemically synthesized
aaagaagacatttatgtggcca

SEQ ID NO: 1219819 - DNA, 22 bp, Artificial Sequence
  chemically synthesized
cacatacttgttggccacataa

SEQ ID NO: 1219820 - DNA, 22 bp, Artificial Sequence
  chemically synthesized
acatacttgttggccacataaa

SEQ ID NO: 1219821 - DNA, 22 bp, Artificial Sequence
  chemically synthesized
tcaaagaagacatttatgtggc

SEQ ID NO: 1219822 - DNA, 22 bp, Artificial Sequence
  chemically synthesized
ctcaaagaagacatttatgtgg

SEQ ID NO: 1219823 - DNA, 22 bp, Artificial Sequence
  chemically synthesized
gttggccacataaatgtcttct

SEQ ID NO: 1219824 - DNA, 22 bp, Artificial Sequence
  chemically synthesized
ttggccacataaatgtcttctt

SEQ ID NO: 1219825 - DNA, 22 bp, Artificial Sequence
  chemically synthesized
gccacataaatgtcttctttga

SEQ ID NO: 1219826 - DNA, 22 bp, Artificial Sequence
  chemically synthesized
ctttgagaagggtctgttcata

SEQ ID NO: 1219827 - DNA, 22 bp, Artificial Sequence
  chemically synthesized
tttgagaagggtctgttcatac

SEQ ID NO: 1219828 - DNA, 22 bp, Artificial Sequence
  chemically synthesized
tgagaagggtctgttcataccc

SEQ ID NO: 1219829 - DNA, 22 bp, Artificial Sequence
  chemically synthesized
gagaagggtctgttcataccct

SEQ ID NO: 1219830 - DNA, 22 bp, Artificial Sequence
  chemically synthesized
agaagggtctgttcataccctt

SEQ ID NO: 1219831 - DNA, 22 bp, Artificial Sequence
  chemically synthesized
ttcataccctttgcctactttt

SEQ ID NO: 1219832 - DNA, 22 bp, Artificial Sequence
  chemically synthesized
ataccctttgcctactttttga

SEQ ID NO: 1219833 - DNA, 22 bp, Artificial Sequence
  chemically synthesized
caggaaaataaccccatcaaaa

SEQ ID NO: 1219834 - DNA, 22 bp, Artificial Sequence
  chemically synthesized
acaggaaaataaccccatcaaa

SEQ ID NO: 1219835 - DNA, 22 bp, Artificial Sequence
  chemically synthesized
tgcctactttttgatggggtta

SEQ ID NO: 1219836 - DNA, 22 bp, Artificial Sequence
  chemically synthesized
gcctactttttgatggggttat

SEQ ID NO: 1219837 - DNA, 22 bp, Artificial Sequence
  chemically synthesized
cctactttttgatggggttatt

SEQ ID NO: 1219838 - DNA, 22 bp, Artificial Sequence
  chemically synthesized
ctttttgatggggttattttcc

SEQ ID NO: 1219839 - DNA, 22 bp, Artificial Sequence
  chemically synthesized
tttgatggggttattttcctgt

SEQ ID NO: 1219840 - DNA, 22 bp, Artificial Sequence
  chemically synthesized
ttgatggggttattttcctgta

SEQ ID NO: 1219841 - DNA, 22 bp, Artificial Sequence
  chemically synthesized
tgatggggttattttcctgtaa

SEQ ID NO: 1219842 - DNA, 22 bp, Artificial Sequence
  chemically synthesized
caagaaacaaatttacaggaaa

SEQ ID NO: 1219843 - DNA, 22 bp, Artificial Sequence
  chemically synthesized
gatggggttattttcctgtaaa

SEQ ID NO: 1219844 - DNA, 22 bp, Artificial Sequence
  chemically synthesized
atggggttattttcctgtaaat

SEQ ID NO: 1219845 - DNA, 22 bp, Artificial Sequence
  chemically synthesized
ttttcctgtaaatttgtttctt

SEQ ID NO: 1219846 - DNA, 22 bp, Artificial Sequence
  chemically synthesized
tcctgtaaatttgtttcttgta

SEQ ID NO: 1219847 - DNA, 22 bp, Artificial Sequence
  chemically synthesized
atatccagaatctacaagaaac

SEQ ID NO: 1219848 - DNA, 22 bp, Artificial Sequence
  chemically synthesized
cctgtaaatttgtttcttgtag

SEQ ID NO: 1219849 - DNA, 22 bp, Artificial Sequence
  chemically synthesized
ctgtaaatttgtttcttgtaga

SEQ ID NO: 1219850 - DNA, 22 bp, Artificial Sequence
  chemically synthesized
taaatttgtttcttgtagattc

SEQ ID NO: 1219851 - DNA, 22 bp, Artificial Sequence
  chemically synthesized
acaaagggctaatatccagaat

SEQ ID NO: 1219852 - DNA, 22 bp, Artificial Sequence
  chemically synthesized
gtttcttgtagattctggatat

SEQ ID NO: 1219853 - DNA, 22 bp, Artificial Sequence
  chemically synthesized
tttcttgtagattctggatatt

SEQ ID NO: 1219854 - DNA, 22 bp, Artificial Sequence
  chemically synthesized
tctgacaaagggctaatatcca

SEQ ID NO: 1219855 - DNA, 22 bp, Artificial Sequence
  chemically synthesized
cttgtagattctggatattagc

SEQ ID NO: 1219856 - DNA, 22 bp, Artificial Sequence
  chemically synthesized
ttgtagattctggatattagcc

SEQ ID NO: 1219857 - DNA, 22 bp, Artificial Sequence
  chemically synthesized
gtagattctggatattagccct

SEQ ID NO: 1219858 - DNA, 22 bp, Artificial Sequence
  chemically synthesized
tctatctgacaaagggctaata

SEQ ID NO: 1219859 - DNA, 22 bp, Artificial Sequence
  chemically synthesized
tagattctggatattagccctt

SEQ ID NO: 1219860 - DNA, 22 bp, Artificial Sequence
  chemically synthesized
caatctatctatctgacaaagg

SEQ ID NO: 1219861 - DNA, 22 bp, Artificial Sequence
  chemically synthesized
tggatattagccctttgtcaga

SEQ ID NO: 1219862 - DNA, 22 bp, Artificial Sequence
  chemically synthesized
gcaatctatctatctgacaaag

SEQ ID NO: 1219863 - DNA, 22 bp, Artificial Sequence
  chemically synthesized
tgcaatctatctatctgacaaa

SEQ ID NO: 1219864 - DNA, 22 bp, Artificial Sequence
  chemically synthesized
gatattagccctttgtcagata

SEQ ID NO: 1219865 - DNA, 22 bp, Artificial Sequence
  chemically synthesized
ttgcaatctatctatctgacaa

SEQ ID NO: 1219866 - DNA, 22 bp, Artificial Sequence
  chemically synthesized
gccctttgtcagatagatagat

SEQ ID NO: 1219867 - DNA, 22 bp, Artificial Sequence
  chemically synthesized
tgtcagatagatagattgcaaa

SEQ ID NO: 1219868 - DNA, 22 bp, Artificial Sequence
  chemically synthesized
gtcagatagatagattgcaaaa

SEQ ID NO: 1219869 - DNA, 22 bp, Artificial Sequence
  chemically synthesized
tcagatagatagattgcaaaaa

SEQ ID NO: 1219870 - DNA, 22 bp, Artificial Sequence
  chemically synthesized
taggatgggagaaaatttttgc

SEQ ID NO: 1219871 - DNA, 22 bp, Artificial Sequence
  chemically synthesized
caaaaattttctcccatcctat

SEQ ID NO: 1219872 - DNA, 22 bp, Artificial Sequence
  chemically synthesized
tctcccatcctataggctgcct

SEQ ID NO: 1219873 - DNA, 22 bp, Artificial Sequence
  chemically synthesized
ctcccatcctataggctgcctg

SEQ ID NO: 1219874 - DNA, 22 bp, Artificial Sequence
  chemically synthesized
tcccatcctataggctgcctgt

SEQ ID NO: 1219875 - DNA, 22 bp, Artificial Sequence
  chemically synthesized
tcatcagagtgaacaggcagcc

SEQ ID NO: 1219876 - DNA, 22 bp, Artificial Sequence
  chemically synthesized
ccatcctataggctgcctgttc

SEQ ID NO: 1219877 - DNA, 22 bp, Artificial Sequence
  chemically synthesized
taggctgcctgttcactctgat

SEQ ID NO: 1219878 - DNA, 22 bp, Artificial Sequence
  chemically synthesized
cctgttcactctgatgatagtt

SEQ ID NO: 1219879 - DNA, 22 bp, Artificial Sequence
  chemically synthesized
cacagcaaaagaaaactatcat

SEQ ID NO: 1219880 - DNA, 22 bp, Artificial Sequence
  chemically synthesized
ttcactctgatgatagttttct

SEQ ID NO: 1219881 - DNA, 22 bp, Artificial Sequence
  chemically synthesized
ctgcacagcaaaagaaaactat

SEQ ID NO: 1219882 - DNA, 22 bp, Artificial Sequence
  chemically synthesized
actctgatgatagttttctttt

SEQ ID NO: 1219883 - DNA, 22 bp, Artificial Sequence
  chemically synthesized
tgatgatagttttcttttgctg

SEQ ID NO: 1219884 - DNA, 22 bp, Artificial Sequence
  chemically synthesized
aatagctcctgcacagcaaaag

SEQ ID NO: 1219885 - DNA, 22 bp, Artificial Sequence
  chemically synthesized
atgatagttttcttttgctgtg

SEQ ID NO: 1219886 - DNA, 22 bp, Artificial Sequence
  chemically synthesized
ctaaatagctcctgcacagcaa

SEQ ID NO: 1219887 - DNA, 22 bp, Artificial Sequence
  chemically synthesized
actaaatagctcctgcacagca

SEQ ID NO: 1219888 - DNA, 22 bp, Artificial Sequence
  chemically synthesized
tcttttgctgtgcaggagctat

SEQ ID NO: 1219889 - DNA, 22 bp, Artificial Sequence
  chemically synthesized
cttttgctgtgcaggagctatt

SEQ ID NO: 1219890 - DNA, 22 bp, Artificial Sequence
  chemically synthesized
ttttgctgtgcaggagctattt

SEQ ID NO: 1219891 - DNA, 22 bp, Artificial Sequence
  chemically synthesized
ttgctgtgcaggagctatttag

SEQ ID NO: 1219892 - DNA, 22 bp, Artificial Sequence
  chemically synthesized
tgctgtgcaggagctatttagt

SEQ ID NO: 1219893 - DNA, 22 bp, Artificial Sequence
  chemically synthesized
gctgtgcaggagctatttagta

SEQ ID NO: 1219894 - DNA, 22 bp, Artificial Sequence
  chemically synthesized
ctgtgcaggagctatttagtaa

SEQ ID NO: 1219895 - DNA, 22 bp, Artificial Sequence
  chemically synthesized
acaaatgagatcttactaaata

SEQ ID NO: 1219896 - DNA, 22 bp, Artificial Sequence
  chemically synthesized
tgcaggagctatttagtaagat

SEQ ID NO: 1219897 - DNA, 22 bp, Artificial Sequence
  chemically synthesized
tttagtaagatctcatttgtca

SEQ ID NO: 1219898 - DNA, 22 bp, Artificial Sequence
  chemically synthesized
agtaagatctcatttgtcaatt

SEQ ID NO: 1219899 - DNA, 22 bp, Artificial Sequence
  chemically synthesized
gtaagatctcatttgtcaattt

SEQ ID NO: 1219900 - DNA, 22 bp, Artificial Sequence
  chemically synthesized
atttgtcaattttggcttttct

SEQ ID NO: 1219901 - DNA, 22 bp, Artificial Sequence
  chemically synthesized
gtcaattttggcttttcttgcc

SEQ ID NO: 1219902 - DNA, 22 bp, Artificial Sequence
  chemically synthesized
tcaattttggcttttcttgcca

SEQ ID NO: 1219903 - DNA, 22 bp, Artificial Sequence
  chemically synthesized
aaacaccaaaagcaatggcaag

SEQ ID NO: 1219904 - DNA, 22 bp, Artificial Sequence
  chemically synthesized
tggcttttcttgccattgcttt

SEQ ID NO: 1219905 - DNA, 22 bp, Artificial Sequence
  chemically synthesized
ggcttttcttgccattgctttt

SEQ ID NO: 1219906 - DNA, 22 bp, Artificial Sequence
  chemically synthesized
gcttttcttgccattgcttttg

SEQ ID NO: 1219907 - DNA, 22 bp, Artificial Sequence
  chemically synthesized
atgactgaaacaccaaaagcaa

SEQ ID NO: 1219908 - DNA, 22 bp, Artificial Sequence
  chemically synthesized
catgactgaaacaccaaaagca

SEQ ID NO: 1219909 - DNA, 22 bp, Artificial Sequence
  chemically synthesized
ttcttgccattgcttttggtgt

SEQ ID NO: 1219910 - DNA, 22 bp, Artificial Sequence
  chemically synthesized
tcttgccattgcttttggtgtt

SEQ ID NO: 1219911 - DNA, 22 bp, Artificial Sequence
  chemically synthesized
cttgccattgcttttggtgttt

SEQ ID NO: 1219912 - DNA, 22 bp, Artificial Sequence
  chemically synthesized
ttgccattgcttttggtgtttc

SEQ ID NO: 1219913 - DNA, 22 bp, Artificial Sequence
  chemically synthesized
gccattgcttttggtgtttcag

SEQ ID NO: 1219914 - DNA, 22 bp, Artificial Sequence
  chemically synthesized
ccattgcttttggtgtttcagt

SEQ ID NO: 1219915 - DNA, 22 bp, Artificial Sequence
  chemically synthesized
cttttggtgtttcagtcatgaa

SEQ ID NO: 1219916 - DNA, 22 bp, Artificial Sequence
  chemically synthesized
ttggtgtttcagtcatgaagtc

SEQ ID NO: 1219917 - DNA, 22 bp, Artificial Sequence
  chemically synthesized
tggtgtttcagtcatgaagtct

SEQ ID NO: 1219918 - DNA, 22 bp, Artificial Sequence
  chemically synthesized
ggtgtttcagtcatgaagtctt

SEQ ID NO: 1219919 - DNA, 22 bp, Artificial Sequence
  chemically synthesized
gtgtttcagtcatgaagtcttt

SEQ ID NO: 1219920 - DNA, 22 bp, Artificial Sequence
  chemically synthesized
aggacataggcatgggcaaaga

SEQ ID NO: 1219921 - DNA, 22 bp, Artificial Sequence
  chemically synthesized
cagtcatgaagtctttgcccat

SEQ ID NO: 1219922 - DNA, 22 bp, Artificial Sequence
  chemically synthesized
caggacataggcatgggcaaag

SEQ ID NO: 1219923 - DNA, 22 bp, Artificial Sequence
  chemically synthesized
agtcatgaagtctttgcccatg

SEQ ID NO: 1219924 - DNA, 22 bp, Artificial Sequence
  chemically synthesized
tcaggacataggcatgggcaaa

SEQ ID NO: 1219925 - DNA, 22 bp, Artificial Sequence
  chemically synthesized
ggcaatacctttcaggacatag

SEQ ID NO: 1219926 - DNA, 22 bp, Artificial Sequence
  chemically synthesized
tgcccatgcctatgtcctgaaa

SEQ ID NO: 1219927 - DNA, 22 bp, Artificial Sequence
  chemically synthesized
gcccatgcctatgtcctgaaag

SEQ ID NO: 1219928 - DNA, 22 bp, Artificial Sequence
  chemically synthesized
cccatgcctatgtcctgaaagg

SEQ ID NO: 1219929 - DNA, 22 bp, Artificial Sequence
  chemically synthesized
gaagaaaacctaggcaatacct

SEQ ID NO: 1219930 - DNA, 22 bp, Artificial Sequence
  chemically synthesized
tgtcctgaaaggtattgcctag

SEQ ID NO: 1219931 - DNA, 22 bp, Artificial Sequence
  chemically synthesized
aaaggtattgcctaggttttct

SEQ ID NO: 1219932 - DNA, 22 bp, Artificial Sequence
  chemically synthesized
aaaccataaaaaccctagaaga

SEQ ID NO: 1219933 - DNA, 22 bp, Artificial Sequence
  chemically synthesized
cctaggttttcttctagggttt

SEQ ID NO: 1219934 - DNA, 22 bp, Artificial Sequence
  chemically synthesized
ggttttcttctagggtttttat

SEQ ID NO: 1219935 - DNA, 22 bp, Artificial Sequence
  chemically synthesized
tcttctagggtttttatggttt

SEQ ID NO: 1219936 - DNA, 22 bp, Artificial Sequence
  chemically synthesized
cttctagggtttttatggtttt

SEQ ID NO: 1219937 - DNA, 22 bp, Artificial Sequence
  chemically synthesized
aatgtaatacctaaaaccataa

SEQ ID NO: 1219938 - DNA, 22 bp, Artificial Sequence
  chemically synthesized
ttctagggtttttatggtttta

SEQ ID NO: 1219939 - DNA, 22 bp, Artificial Sequence
  chemically synthesized
aaatgtaatacctaaaaccata

SEQ ID NO: 1219940 - DNA, 22 bp, Artificial Sequence
  chemically synthesized
ctagggtttttatggttttagg

SEQ ID NO: 1219941 - DNA, 22 bp, Artificial Sequence
  chemically synthesized
tagggtttttatggttttaggt

SEQ ID NO: 1219942 - DNA, 22 bp, Artificial Sequence
  chemically synthesized
gggtttttatggttttaggtat

SEQ ID NO: 1219943 - DNA, 22 bp, Artificial Sequence
  chemically synthesized
aagacttaaatgtaatacctaa

SEQ ID NO: 1219944 - DNA, 22 bp, Artificial Sequence
  chemically synthesized
ttatggttttaggtattacatt

SEQ ID NO: 1219945 - DNA, 22 bp, Artificial Sequence
  chemically synthesized
tatggttttaggtattacattt

SEQ ID NO: 1219946 - DNA, 22 bp, Artificial Sequence
  chemically synthesized
atggttttaggtattacattta

SEQ ID NO: 1219947 - DNA, 22 bp, Artificial Sequence
  chemically synthesized
tggttttaggtattacatttaa

SEQ ID NO: 1219948 - DNA, 22 bp, Artificial Sequence
  chemically synthesized
aagatggattaaagacttaaat

SEQ ID NO: 1219949 - DNA, 22 bp, Artificial Sequence
  chemically synthesized
taggtattacatttaagtcttt

SEQ ID NO: 1219950 - DNA, 22 bp, Artificial Sequence
  chemically synthesized
aggtattacatttaagtcttta

SEQ ID NO: 1219951 - DNA, 22 bp, Artificial Sequence
  chemically synthesized
ggtattacatttaagtctttaa

SEQ ID NO: 1219952 - DNA, 22 bp, Artificial Sequence
  chemically synthesized
actcaagatggattaaagactt

SEQ ID NO: 1219953 - DNA, 22 bp, Artificial Sequence
  chemically synthesized
catttaagtctttaatccatct

SEQ ID NO: 1219954 - DNA, 22 bp, Artificial Sequence
  chemically synthesized
tacaaaaattaactcaagatgg

SEQ ID NO: 1219955 - DNA, 22 bp, Artificial Sequence
  chemically synthesized
aagtctttaatccatcttgagt

SEQ ID NO: 1219956 - DNA, 22 bp, Artificial Sequence
  chemically synthesized
atacaaaaattaactcaagatg

SEQ ID NO: 1219957 - DNA, 22 bp, Artificial Sequence
  chemically synthesized
agtctttaatccatcttgagtt

SEQ ID NO: 1219958 - DNA, 22 bp, Artificial Sequence
  chemically synthesized
ccccttatacaaaaattaactc

SEQ ID NO: 1219959 - DNA, 22 bp, Artificial Sequence
  chemically synthesized
taatccatcttgagttaatttt

SEQ ID NO: 1219960 - DNA, 22 bp, Artificial Sequence
  chemically synthesized
accccttatacaaaaattaact

SEQ ID NO: 1219961 - DNA, 22 bp, Artificial Sequence
  chemically synthesized
aatccatcttgagttaattttt

SEQ ID NO: 1219962 - DNA, 22 bp, Artificial Sequence
  chemically synthesized
atccatcttgagttaatttttg

SEQ ID NO: 1219963 - DNA, 22 bp, Artificial Sequence
  chemically synthesized
cttaccccttatacaaaaatta

SEQ ID NO: 1219964 - DNA, 22 bp, Artificial Sequence
  chemically synthesized
ccttaccccttatacaaaaatt

SEQ ID NO: 1219965 - DNA, 22 bp, Artificial Sequence
  chemically synthesized
gagttaatttttgtataagggg

SEQ ID NO: 1219966 - DNA, 22 bp, Artificial Sequence
  chemically synthesized
agttaatttttgtataaggggt

SEQ ID NO: 1219967 - DNA, 22 bp, Artificial Sequence
  chemically synthesized
gaccccttccttaccccttata

SEQ ID NO: 1219968 - DNA, 22 bp, Artificial Sequence
  chemically synthesized
atttttgtataaggggtaagga

SEQ ID NO: 1219969 - DNA, 22 bp, Artificial Sequence
  chemically synthesized
aaactggaccccttccttaccc

SEQ ID NO: 1219970 - DNA, 22 bp, Artificial Sequence
  chemically synthesized
ttgtataaggggtaaggaaggg

SEQ ID NO: 1219971 - DNA, 22 bp, Artificial Sequence
  chemically synthesized
tgtataaggggtaaggaagggg

SEQ ID NO: 1219972 - DNA, 22 bp, Artificial Sequence
  chemically synthesized
gtataaggggtaaggaaggggt

SEQ ID NO: 1219973 - DNA, 22 bp, Artificial Sequence
  chemically synthesized
tataaggggtaaggaaggggtc

SEQ ID NO: 1219974 - DNA, 22 bp, Artificial Sequence
  chemically synthesized
gccatatgcagaagactgaaac

SEQ ID NO: 1219975 - DNA, 22 bp, Artificial Sequence
  chemically synthesized
gctagccatatgcagaagactg

SEQ ID NO: 1219976 - DNA, 22 bp, Artificial Sequence
  chemically synthesized
cagtcttctgcatatggctagc

SEQ ID NO: 1219977 - DNA, 22 bp, Artificial Sequence
  chemically synthesized
agtcttctgcatatggctagcc

SEQ ID NO: 1219978 - DNA, 22 bp, Artificial Sequence
  chemically synthesized
ctgcatatggctagccagtttt

SEQ ID NO: 1219979 - DNA, 22 bp, Artificial Sequence
  chemically synthesized
tgcatatggctagccagttttc

SEQ ID NO: 1219980 - DNA, 22 bp, Artificial Sequence
  chemically synthesized
catatggctagccagttttccc

SEQ ID NO: 1219981 - DNA, 22 bp, Artificial Sequence
  chemically synthesized
ataaatgatgatgggaaaactg

SEQ ID NO: 1219982 - DNA, 22 bp, Artificial Sequence
  chemically synthesized
aataaatgatgatgggaaaact

SEQ ID NO: 1219983 - DNA, 22 bp, Artificial Sequence
  chemically synthesized
tttaataaatgatgatgggaaa

SEQ ID NO: 1219984 - DNA, 22 bp, Artificial Sequence
  chemically synthesized
cctatttaataaatgatgatgg

SEQ ID NO: 1219985 - DNA, 22 bp, Artificial Sequence
  chemically synthesized
gccagttttcccatcatcattt

SEQ ID NO: 1219986 - DNA, 22 bp, Artificial Sequence
  chemically synthesized
tcccatcatcatttattaaata

SEQ ID NO: 1219987 - DNA, 22 bp, Artificial Sequence
  chemically synthesized
cccatcatcatttattaaatag

SEQ ID NO: 1219988 - DNA, 22 bp, Artificial Sequence
  chemically synthesized
ccatcatcatttattaaatagg

SEQ ID NO: 1219989 - DNA, 22 bp, Artificial Sequence
  chemically synthesized
attaaatagggaatgctttccc

SEQ ID NO: 1219990 - DNA, 22 bp, Artificial Sequence
  chemically synthesized
ttaaatagggaatgctttcccc

SEQ ID NO: 1219991 - DNA, 22 bp, Artificial Sequence
  chemically synthesized
aatagggaatgctttccccatt

SEQ ID NO: 1219992 - DNA, 22 bp, Artificial Sequence
  chemically synthesized
ccaaaaacaagcaatggggaaa

SEQ ID NO: 1219993 - DNA, 22 bp, Artificial Sequence
  chemically synthesized
acaaacctgccaaaaacaagca

SEQ ID NO: 1219994 - DNA, 22 bp, Artificial Sequence
  chemically synthesized
gacaaacctgccaaaaacaagc

SEQ ID NO: 1219995 - DNA, 22 bp, Artificial Sequence
  chemically synthesized
tgacaaacctgccaaaaacaag

SEQ ID NO: 1219996 - DNA, 22 bp, Artificial Sequence
  chemically synthesized
tccccattgcttgtttttggca

SEQ ID NO: 1219997 - DNA, 22 bp, Artificial Sequence
  chemically synthesized
ccccattgcttgtttttggcag

SEQ ID NO: 1219998 - DNA, 22 bp, Artificial Sequence
  chemically synthesized
cccattgcttgtttttggcagg

SEQ ID NO: 1219999 - DNA, 22 bp, Artificial Sequence
  chemically synthesized
atctttgacaaacctgccaaaa

SEQ ID NO: 1220000 - DNA, 22 bp, Artificial Sequence
  chemically synthesized
cttgtttttggcaggtttgtca

SEQ ID NO: 1220001 - DNA, 22 bp, Artificial Sequence
  chemically synthesized
gtttttggcaggtttgtcaaag

SEQ ID NO: 1220002 - DNA, 22 bp, Artificial Sequence
  chemically synthesized
caaccatctgatctttgacaaa

SEQ ID NO: 1220003 - DNA, 22 bp, Artificial Sequence
  chemically synthesized
tttttggcaggtttgtcaaaga

SEQ ID NO: 1220004 - DNA, 22 bp, Artificial Sequence
  chemically synthesized
ttggcaggtttgtcaaagatca

SEQ ID NO: 1220005 - DNA, 22 bp, Artificial Sequence
  chemically synthesized
tggcaggtttgtcaaagatcag

SEQ ID NO: 1220006 - DNA, 22 bp, Artificial Sequence
  chemically synthesized
ggcaggtttgtcaaagatcaga

SEQ ID NO: 1220007 - DNA, 22 bp, Artificial Sequence
  chemically synthesized
gcaggtttgtcaaagatcagat

SEQ ID NO: 1220008 - DNA, 22 bp, Artificial Sequence
  chemically synthesized
gtcaaagatcagatggttgtag

SEQ ID NO: 1220009 - DNA, 22 bp, Artificial Sequence
  chemically synthesized
tcaaagatcagatggttgtaga

SEQ ID NO: 1220010 - DNA, 22 bp, Artificial Sequence
  chemically synthesized
agaaataacaccacacatctac

SEQ ID NO: 1220011 - DNA, 22 bp, Artificial Sequence
  chemically synthesized
tagatgtgtggtgttatttctg

SEQ ID NO: 1220012 - DNA, 22 bp, Artificial Sequence
  chemically synthesized
tttctgaggcctctgttctgtt

SEQ ID NO: 1220013 - DNA, 22 bp, Artificial Sequence
  chemically synthesized
ctgaggcctctgttctgttcca

SEQ ID NO: 1220014 - DNA, 22 bp, Artificial Sequence
  chemically synthesized
tgaggcctctgttctgttccat

SEQ ID NO: 1220015 - DNA, 22 bp, Artificial Sequence
  chemically synthesized
aggcctctgttctgttccattc

SEQ ID NO: 1220016 - DNA, 22 bp, Artificial Sequence
  chemically synthesized
tgttctgttccattcgtctatg

SEQ ID NO: 1220017 - DNA, 22 bp, Artificial Sequence
  chemically synthesized
ttctgttccattcgtctatgta

SEQ ID NO: 1220018 - DNA, 22 bp, Artificial Sequence
  chemically synthesized
gtaccagaacagatacatagac

SEQ ID NO: 1220019 - DNA, 22 bp, Artificial Sequence
  chemically synthesized
tgttccattcgtctatgtatct

SEQ ID NO: 1220020 - DNA, 22 bp, Artificial Sequence
  chemically synthesized
ttccattcgtctatgtatctgt

SEQ ID NO: 1220021 - DNA, 22 bp, Artificial Sequence
  chemically synthesized
cattcgtctatgtatctgttct

SEQ ID NO: 1220022 - DNA, 22 bp, Artificial Sequence
  chemically synthesized
gtctatgtatctgttctggtac

SEQ ID NO: 1220023 - DNA, 22 bp, Artificial Sequence
  chemically synthesized
tgtatctgttctggtaccagta

SEQ ID NO: 1220024 - DNA, 22 bp, Artificial Sequence
  chemically synthesized
ttctggtaccagtatcatgctg

SEQ ID NO: 1220025 - DNA, 22 bp, Artificial Sequence
  chemically synthesized
cagtaaccaaaacagcatgata

SEQ ID NO: 1220026 - DNA, 22 bp, Artificial Sequence
  chemically synthesized
tggtaccagtatcatgctgttt

SEQ ID NO: 1220027 - DNA, 22 bp, Artificial Sequence
  chemically synthesized
gtaccagtatcatgctgttttg

SEQ ID NO: 1220028 - DNA, 22 bp, Artificial Sequence
  chemically synthesized
caaggctacagtaaccaaaaca

SEQ ID NO: 1220029 - DNA, 22 bp, Artificial Sequence
  chemically synthesized
cactacaaggctacagtaacca

SEQ ID NO: 1220030 - DNA, 22 bp, Artificial Sequence
  chemically synthesized
aaactacactacaaggctacag

SEQ ID NO: 1220031 - DNA, 22 bp, Artificial Sequence
  chemically synthesized
gaaactacactacaaggctaca

SEQ ID NO: 1220032 - DNA, 22 bp, Artificial Sequence
  chemically synthesized
ttttggttactgtagccttgta

SEQ ID NO: 1220033 - DNA, 22 bp, Artificial Sequence
  chemically synthesized
cttgaaactacactacaaggct

SEQ ID NO: 1220034 - DNA, 22 bp, Artificial Sequence
  chemically synthesized
acttgaaactacactacaaggc

SEQ ID NO: 1220035 - DNA, 22 bp, Artificial Sequence
  chemically synthesized
tggttactgtagccttgtagtg

SEQ ID NO: 1220036 - DNA, 22 bp, Artificial Sequence
  chemically synthesized
ggttactgtagccttgtagtgt

SEQ ID NO: 1220037 - DNA, 22 bp, Artificial Sequence
  chemically synthesized
gttactgtagccttgtagtgta

SEQ ID NO: 1220038 - DNA, 22 bp, Artificial Sequence
  chemically synthesized
ccttacttgaaactacactaca

SEQ ID NO: 1220039 - DNA, 22 bp, Artificial Sequence
  chemically synthesized
ctgtagccttgtagtgtagttt

SEQ ID NO: 1220040 - DNA, 22 bp, Artificial Sequence
  chemically synthesized
tagccttgtagtgtagtttcaa

SEQ ID NO: 1220041 - DNA, 22 bp, Artificial Sequence
  chemically synthesized
gtagtgtagtttcaagtaaggt

SEQ ID NO: 1220042 - DNA, 22 bp, Artificial Sequence
  chemically synthesized
tagtgtagtttcaagtaaggta

SEQ ID NO: 1220043 - DNA, 22 bp, Artificial Sequence
  chemically synthesized
gaggcatcatgctaccttactt

SEQ ID NO: 1220044 - DNA, 22 bp, Artificial Sequence
  chemically synthesized
caagtaaggtagcatgatgcct

SEQ ID NO: 1220045 - DNA, 22 bp, Artificial Sequence
  chemically synthesized
aagtaaggtagcatgatgcctc

SEQ ID NO: 1220046 - DNA, 22 bp, Artificial Sequence
  chemically synthesized
agcaaaaataacaaagctggag

SEQ ID NO: 1220047 - DNA, 22 bp, Artificial Sequence
  chemically synthesized
ccaaaaccatcctaagcaaaaa

SEQ ID NO: 1220048 - DNA, 22 bp, Artificial Sequence
  chemically synthesized
cagctttgttatttttgcttag

SEQ ID NO: 1220049 - DNA, 22 bp, Artificial Sequence
  chemically synthesized
cattgccaaaaccatcctaagc

SEQ ID NO: 1220050 - DNA, 22 bp, Artificial Sequence
  chemically synthesized
tgttatttttgcttaggatggt

SEQ ID NO: 1220051 - DNA, 22 bp, Artificial Sequence
  chemically synthesized
gttatttttgcttaggatggtt

SEQ ID NO: 1220052 - DNA, 22 bp, Artificial Sequence
  chemically synthesized
ttatttttgcttaggatggttt

SEQ ID NO: 1220053 - DNA, 22 bp, Artificial Sequence
  chemically synthesized
tttttgcttaggatggttttgg

SEQ ID NO: 1220054 - DNA, 22 bp, Artificial Sequence
  chemically synthesized
ttgcttaggatggttttggcaa

SEQ ID NO: 1220055 - DNA, 22 bp, Artificial Sequence
  chemically synthesized
tgcttaggatggttttggcaat

SEQ ID NO: 1220056 - DNA, 22 bp, Artificial Sequence
  chemically synthesized
gcttaggatggttttggcaatg

SEQ ID NO: 1220057 - DNA, 22 bp, Artificial Sequence
  chemically synthesized
aaaaagagcctgcattgccaaa

SEQ ID NO: 1220058 - DNA, 22 bp, Artificial Sequence
  chemically synthesized
cttaggatggttttggcaatgc

SEQ ID NO: 1220059 - DNA, 22 bp, Artificial Sequence
  chemically synthesized
aggatggttttggcaatgcagg

SEQ ID NO: 1220060 - DNA, 22 bp, Artificial Sequence
  chemically synthesized
ggatggttttggcaatgcaggc

SEQ ID NO: 1220061 - DNA, 22 bp, Artificial Sequence
  chemically synthesized
atgtggaactaaaaaagagcct

SEQ ID NO: 1220062 - DNA, 22 bp, Artificial Sequence
  chemically synthesized
catgtggaactaaaaaagagcc

SEQ ID NO: 1220063 - DNA, 22 bp, Artificial Sequence
  chemically synthesized
tggcaatgcaggctctttttta

SEQ ID NO: 1220064 - DNA, 22 bp, Artificial Sequence
  chemically synthesized
ggcaatgcaggctcttttttag

SEQ ID NO: 1220065 - DNA, 22 bp, Artificial Sequence
  chemically synthesized
gcaatgcaggctcttttttagt

SEQ ID NO: 1220066 - DNA, 22 bp, Artificial Sequence
  chemically synthesized
aatttcatgtggaactaaaaaa

SEQ ID NO: 1220067 - DNA, 22 bp, Artificial Sequence
  chemically synthesized
aaatttcatgtggaactaaaaa

SEQ ID NO: 1220068 - DNA, 22 bp, Artificial Sequence
  chemically synthesized
taaatttcatgtggaactaaaa

SEQ ID NO: 1220069 - DNA, 22 bp, Artificial Sequence
  chemically synthesized
ctttaaatttcatgtggaacta

SEQ ID NO: 1220070 - DNA, 22 bp, Artificial Sequence
  chemically synthesized
ttttttagttccacatgaaatt

SEQ ID NO: 1220071 - DNA, 22 bp, Artificial Sequence
  chemically synthesized
ttttagttccacatgaaattta

SEQ ID NO: 1220072 - DNA, 22 bp, Artificial Sequence
  chemically synthesized
tttagttccacatgaaatttaa

SEQ ID NO: 1220073 - DNA, 22 bp, Artificial Sequence
  chemically synthesized
ttagttccacatgaaatttaaa

SEQ ID NO: 1220074 - DNA, 22 bp, Artificial Sequence
  chemically synthesized
gaaaaaaactactttaaatttc

SEQ ID NO: 1220075 - DNA, 22 bp, Artificial Sequence
  chemically synthesized
tagttccacatgaaatttaaag

SEQ ID NO: 1220076 - DNA, 22 bp, Artificial Sequence
  chemically synthesized
agttccacatgaaatttaaagt

SEQ ID NO: 1220077 - DNA, 22 bp, Artificial Sequence
  chemically synthesized
gttccacatgaaatttaaagta

SEQ ID NO: 1220078 - DNA, 22 bp, Artificial Sequence
  chemically synthesized
cacatgaaatttaaagtagttt

SEQ ID NO: 1220079 - DNA, 22 bp, Artificial Sequence
  chemically synthesized
acagaattagaaaaaaactact

SEQ ID NO: 1220080 - DNA, 22 bp, Artificial Sequence
  chemically synthesized
cacagaattagaaaaaaactac

SEQ ID NO: 1220081 - DNA, 22 bp, Artificial Sequence
  chemically synthesized
ttcacagaattagaaaaaaact

SEQ ID NO: 1220082 - DNA, 22 bp, Artificial Sequence
  chemically synthesized
cttcacagaattagaaaaaaac

SEQ ID NO: 1220083 - DNA, 22 bp, Artificial Sequence
  chemically synthesized
tcttcacagaattagaaaaaaa

SEQ ID NO: 1220084 - DNA, 22 bp, Artificial Sequence
  chemically synthesized
actttcttcacagaattagaaa

SEQ ID NO: 1220085 - DNA, 22 bp, Artificial Sequence
  chemically synthesized
aaagtagtttttttctaattct

SEQ ID NO: 1220086 - DNA, 22 bp, Artificial Sequence
  chemically synthesized
aagtagtttttttctaattctg

SEQ ID NO: 1220087 - DNA, 22 bp, Artificial Sequence
  chemically synthesized
caattcactttcttcacagaat

SEQ ID NO: 1220088 - DNA, 22 bp, Artificial Sequence
  chemically synthesized
ttttctaattctgtgaagaaag

SEQ ID NO: 1220089 - DNA, 22 bp, Artificial Sequence
  chemically synthesized
agctacaattcactttcttcac

SEQ ID NO: 1220090 - DNA, 22 bp, Artificial Sequence
  chemically synthesized
tttctaattctgtgaagaaagt

SEQ ID NO: 1220091 - DNA, 22 bp, Artificial Sequence
  chemically synthesized
ttctaattctgtgaagaaagtg

SEQ ID NO: 1220092 - DNA, 22 bp, Artificial Sequence
  chemically synthesized
tctaattctgtgaagaaagtga

SEQ ID NO: 1220093 - DNA, 22 bp, Artificial Sequence
  chemically synthesized
ctaattctgtgaagaaagtgaa

SEQ ID NO: 1220094 - DNA, 22 bp, Artificial Sequence
  chemically synthesized
attaagctacaattcactttct

SEQ ID NO: 1220095 - DNA, 22 bp, Artificial Sequence
  chemically synthesized
taattctgtgaagaaagtgaat

SEQ ID NO: 1220096 - DNA, 22 bp, Artificial Sequence
  chemically synthesized
attctgtgaagaaagtgaattg

SEQ ID NO: 1220097 - DNA, 22 bp, Artificial Sequence
  chemically synthesized
cctcattaagctacaattcact

SEQ ID NO: 1220098 - DNA, 22 bp, Artificial Sequence
  chemically synthesized
tgtgaagaaagtgaattgtagc

SEQ ID NO: 1220099 - DNA, 22 bp, Artificial Sequence
  chemically synthesized
tgaagaaagtgaattgtagctt

SEQ ID NO: 1220100 - DNA, 22 bp, Artificial Sequence
  chemically synthesized
aatgttacctcattaagctaca

SEQ ID NO: 1220101 - DNA, 22 bp, Artificial Sequence
  chemically synthesized
tagattcaatgttacctcatta

SEQ ID NO: 1220102 - DNA, 22 bp, Artificial Sequence
  chemically synthesized
atagattcaatgttacctcatt

SEQ ID NO: 1220103 - DNA, 22 bp, Artificial Sequence
  chemically synthesized
tagcttaatgaggtaacattga

SEQ ID NO: 1220104 - DNA, 22 bp, Artificial Sequence
  chemically synthesized
aatgaggtaacattgaatctat

SEQ ID NO: 1220105 - DNA, 22 bp, Artificial Sequence
  chemically synthesized
atgaggtaacattgaatctata

SEQ ID NO: 1220106 - DNA, 22 bp, Artificial Sequence
  chemically synthesized
cccgaagtaatttatagattca

SEQ ID NO: 1220107 - DNA, 22 bp, Artificial Sequence
  chemically synthesized
aatctataaattacttcgggca

SEQ ID NO: 1220108 - DNA, 22 bp, Artificial Sequence
  chemically synthesized
taaattacttcgggcagtatgg

SEQ ID NO: 1220109 - DNA, 22 bp, Artificial Sequence
  chemically synthesized
cttcgggcagtatggccatttt

SEQ ID NO: 1220110 - DNA, 22 bp, Artificial Sequence
  chemically synthesized
cgggcagtatggccattttcat

SEQ ID NO: 1220111 - DNA, 22 bp, Artificial Sequence
  chemically synthesized
gggcagtatggccattttcatg

SEQ ID NO: 1220112 - DNA, 22 bp, Artificial Sequence
  chemically synthesized
tggataggaagaatcaatatca

SEQ ID NO: 1220113 - DNA, 22 bp, Artificial Sequence
  chemically synthesized
atggataggaagaatcaatatc

SEQ ID NO: 1220114 - DNA, 22 bp, Artificial Sequence
  chemically synthesized
catgcttatggataggaagaat

SEQ ID NO: 1220115 - DNA, 22 bp, Artificial Sequence
  chemically synthesized
tcatgatattgattcttcctat

SEQ ID NO: 1220116 - DNA, 22 bp, Artificial Sequence
  chemically synthesized
catgatattgattcttcctatc

SEQ ID NO: 1220117 - DNA, 22 bp, Artificial Sequence
  chemically synthesized
atgatattgattcttcctatcc

SEQ ID NO: 1220118 - DNA, 22 bp, Artificial Sequence
  chemically synthesized
attcttcctatccataagcatg

SEQ ID NO: 1220119 - DNA, 22 bp, Artificial Sequence
  chemically synthesized
ttcctatccataagcatggaat

SEQ ID NO: 1220120 - DNA, 22 bp, Artificial Sequence
  chemically synthesized
cctatccataagcatggaatgt

SEQ ID NO: 1220121 - DNA, 22 bp, Artificial Sequence
  chemically synthesized
ctatccataagcatggaatgtt

SEQ ID NO: 1220122 - DNA, 22 bp, Artificial Sequence
  chemically synthesized
tccataagcatggaatgttttt

SEQ ID NO: 1220123 - DNA, 22 bp, Artificial Sequence
  chemically synthesized
aaggaagtaagagaggacgcaa

SEQ ID NO: 1220124 - DNA, 22 bp, Artificial Sequence
  chemically synthesized
tttcatttgtttgcgtcctctc

SEQ ID NO: 1220125 - DNA, 22 bp, Artificial Sequence
  chemically synthesized
ttcatttgtttgcgtcctctct

SEQ ID NO: 1220126 - DNA, 22 bp, Artificial Sequence
  chemically synthesized
ctcaaggaagtaagagaggacg

SEQ ID NO: 1220127 - DNA, 22 bp, Artificial Sequence
  chemically synthesized
tcatttgtttgcgtcctctctt

SEQ ID NO: 1220128 - DNA, 22 bp, Artificial Sequence
  chemically synthesized
catttgtttgcgtcctctctta

SEQ ID NO: 1220129 - DNA, 22 bp, Artificial Sequence
  chemically synthesized
atttgtttgcgtcctctcttac

SEQ ID NO: 1220130 - DNA, 22 bp, Artificial Sequence
  chemically synthesized
gtttgcgtcctctcttacttcc

SEQ ID NO: 1220131 - DNA, 22 bp, Artificial Sequence
  chemically synthesized
tttgcgtcctctcttacttcct

SEQ ID NO: 1220132 - DNA, 22 bp, Artificial Sequence
  chemically synthesized
caaaccactgctcaaggaagta

SEQ ID NO: 1220133 - DNA, 22 bp, Artificial Sequence
  chemically synthesized
gcgtcctctcttacttccttga

SEQ ID NO: 1220134 - DNA, 22 bp, Artificial Sequence
  chemically synthesized
cgtcctctcttacttccttgag

SEQ ID NO: 1220135 - DNA, 22 bp, Artificial Sequence
  chemically synthesized
tcttacttccttgagcagtggt

SEQ ID NO: 1220136 - DNA, 22 bp, Artificial Sequence
  chemically synthesized
ttacttccttgagcagtggttt

SEQ ID NO: 1220137 - DNA, 22 bp, Artificial Sequence
  chemically synthesized
aaggagaactacaaaccactgc

SEQ ID NO: 1220138 - DNA, 22 bp, Artificial Sequence
  chemically synthesized
caaggagaactacaaaccactg

SEQ ID NO: 1220139 - DNA, 22 bp, Artificial Sequence
  chemically synthesized
acttccttgagcagtggtttgt

SEQ ID NO: 1220140 - DNA, 22 bp, Artificial Sequence
  chemically synthesized
cttccttgagcagtggtttgta

SEQ ID NO: 1220141 - DNA, 22 bp, Artificial Sequence
  chemically synthesized
ttcaaggagaactacaaaccac

SEQ ID NO: 1220142 - DNA, 22 bp, Artificial Sequence
  chemically synthesized
ccttgagcagtggtttgtagtt

SEQ ID NO: 1220143 - DNA, 22 bp, Artificial Sequence
  chemically synthesized
cttgagcagtggtttgtagttc

SEQ ID NO: 1220144 - DNA, 22 bp, Artificial Sequence
  chemically synthesized
gagcagtggtttgtagttctcc

SEQ ID NO: 1220145 - DNA, 22 bp, Artificial Sequence
  chemically synthesized
agcagtggtttgtagttctcct

SEQ ID NO: 1220146 - DNA, 22 bp, Artificial Sequence
  chemically synthesized
gtagttctccttgaagaggtcc

SEQ ID NO: 1220147 - DNA, 22 bp, Artificial Sequence
  chemically synthesized
tagttctccttgaagaggtcct

SEQ ID NO: 1220148 - DNA, 22 bp, Artificial Sequence
  chemically synthesized
taagggatgtgaaggacctctt

SEQ ID NO: 1220149 - DNA, 22 bp, Artificial Sequence
  chemically synthesized
ataagggatgtgaaggacctct

SEQ ID NO: 1220150 - DNA, 22 bp, Artificial Sequence
  chemically synthesized
tccttgaagaggtccttcacat

SEQ ID NO: 1220151 - DNA, 22 bp, Artificial Sequence
  chemically synthesized
cttgaagaggtccttcacatcc

SEQ ID NO: 1220152 - DNA, 22 bp, Artificial Sequence
  chemically synthesized
gaagaggtccttcacatccctt

SEQ ID NO: 1220153 - DNA, 22 bp, Artificial Sequence
  chemically synthesized
aagaggtccttcacatccctta

SEQ ID NO: 1220154 - DNA, 22 bp, Artificial Sequence
  chemically synthesized
gcaatccaacttataagggatg

SEQ ID NO: 1220155 - DNA, 22 bp, Artificial Sequence
  chemically synthesized
ctagcaatccaacttataaggg

SEQ ID NO: 1220156 - DNA, 22 bp, Artificial Sequence
  chemically synthesized
cacatcccttataagttggatt

SEQ ID NO: 1220157 - DNA, 22 bp, Artificial Sequence
  chemically synthesized
acatcccttataagttggattg

SEQ ID NO: 1220158 - DNA, 22 bp, Artificial Sequence
  chemically synthesized
ataagttggattgctaggaatt

SEQ ID NO: 1220159 - DNA, 22 bp, Artificial Sequence
  chemically synthesized
caaggagaatagaattcctagc

SEQ ID NO: 1220160 - DNA, 22 bp, Artificial Sequence
  chemically synthesized
taagttggattgctaggaattc

SEQ ID NO: 1220161 - DNA, 22 bp, Artificial Sequence
  chemically synthesized
ctacaaggagaatagaattcct

SEQ ID NO: 1220162 - DNA, 22 bp, Artificial Sequence
  chemically synthesized
gattgctaggaattctattctc

SEQ ID NO: 1220163 - DNA, 22 bp, Artificial Sequence
  chemically synthesized
caattgctacaaggagaataga

SEQ ID NO: 1220164 - DNA, 22 bp, Artificial Sequence
  chemically synthesized
acaattgctacaaggagaatag

SEQ ID NO: 1220165 - DNA, 22 bp, Artificial Sequence
  chemically synthesized
ctaggaattctattctccttgt

SEQ ID NO: 1220166 - DNA, 22 bp, Artificial Sequence
  chemically synthesized
ggaattctattctccttgtagc

SEQ ID NO: 1220167 - DNA, 22 bp, Artificial Sequence
  chemically synthesized
ccatttacaattgctacaagga

SEQ ID NO: 1220168 - DNA, 22 bp, Artificial Sequence
  chemically synthesized
tattctccttgtagcaattgta

SEQ ID NO: 1220169 - DNA, 22 bp, Artificial Sequence
  chemically synthesized
ttctccttgtagcaattgtaaa

SEQ ID NO: 1220170 - DNA, 22 bp, Artificial Sequence
  chemically synthesized
tccttgtagcaattgtaaatgg

SEQ ID NO: 1220171 - DNA, 22 bp, Artificial Sequence
  chemically synthesized
cttgtagcaattgtaaatggga

SEQ ID NO: 1220172 - DNA, 22 bp, Artificial Sequence
  chemically synthesized
gtagcaattgtaaatgggagtt

SEQ ID NO: 1220173 - DNA, 22 bp, Artificial Sequence
  chemically synthesized
tagcaattgtaaatgggagttc

SEQ ID NO: 1220174 - DNA, 22 bp, Artificial Sequence
  chemically synthesized
taaatgggagttcactcatgat

SEQ ID NO: 1220175 - DNA, 22 bp, Artificial Sequence
  chemically synthesized
tacaccgataataaacagccaa

SEQ ID NO: 1220176 - DNA, 22 bp, Artificial Sequence
  chemically synthesized
actcatgatttggctgtttatt

SEQ ID NO: 1220177 - DNA, 22 bp, Artificial Sequence
  chemically synthesized
ctatacaccgataataaacagc

SEQ ID NO: 1220178 - DNA, 22 bp, Artificial Sequence
  chemically synthesized
atgatttggctgtttattatcg

SEQ ID NO: 1220179 - DNA, 22 bp, Artificial Sequence
  chemically synthesized
ggctgtttattatcggtgtata

SEQ ID NO: 1220180 - DNA, 22 bp, Artificial Sequence
  chemically synthesized
gctgtttattatcggtgtatag

SEQ ID NO: 1220181 - DNA, 22 bp, Artificial Sequence
  chemically synthesized
tttattatcggtgtataggaat

SEQ ID NO: 1220182 - DNA, 22 bp, Artificial Sequence
  chemically synthesized
attatcggtgtataggaatgct

SEQ ID NO: 1220183 - DNA, 22 bp, Artificial Sequence
  chemically synthesized
ttatcggtgtataggaatgctt

SEQ ID NO: 1220184 - DNA, 22 bp, Artificial Sequence
  chemically synthesized
tcggtgtataggaatgcttgtt

SEQ ID NO: 1220185 - DNA, 22 bp, Artificial Sequence
  chemically synthesized
aggatacaaaatcgatgtggaa

SEQ ID NO: 1220186 - DNA, 22 bp, Artificial Sequence
  chemically synthesized
gttatttttccacatcgatttt

SEQ ID NO: 1220187 - DNA, 22 bp, Artificial Sequence
  chemically synthesized
ttatttttccacatcgattttg

SEQ ID NO: 1220188 - DNA, 22 bp, Artificial Sequence
  chemically synthesized
tttttccacatcgattttgtat

SEQ ID NO: 1220189 - DNA, 22 bp, Artificial Sequence
  chemically synthesized
ttccacatcgattttgtatcct

SEQ ID NO: 1220190 - DNA, 22 bp, Artificial Sequence
  chemically synthesized
tccacatcgattttgtatcctg

SEQ ID NO: 1220191 - DNA, 22 bp, Artificial Sequence
  chemically synthesized
ccacatcgattttgtatcctga

SEQ ID NO: 1220192 - DNA, 22 bp, Artificial Sequence
  chemically synthesized
cacatcgattttgtatcctgag

SEQ ID NO: 1220193 - DNA, 22 bp, Artificial Sequence
  chemically synthesized
ataggcagtgtcaacaaagtct

SEQ ID NO: 1220194 - DNA, 22 bp, Artificial Sequence
  chemically synthesized
tgtatcctgagactttgttgac

SEQ ID NO: 1220195 - DNA, 22 bp, Artificial Sequence
  chemically synthesized
gtatcctgagactttgttgaca

SEQ ID NO: 1220196 - DNA, 22 bp, Artificial Sequence
  chemically synthesized
tatcctgagactttgttgacac

SEQ ID NO: 1220197 - DNA, 22 bp, Artificial Sequence
  chemically synthesized
agctgataggcagtgtcaacaa

SEQ ID NO: 1220198 - DNA, 22 bp, Artificial Sequence
  chemically synthesized
aagctgataggcagtgtcaaca

SEQ ID NO: 1220199 - DNA, 22 bp, Artificial Sequence
  chemically synthesized
cttaagctgataggcagtgtca

SEQ ID NO: 1220200 - DNA, 22 bp, Artificial Sequence
  chemically synthesized
agactttgttgacactgcctat

SEQ ID NO: 1220201 - DNA, 22 bp, Artificial Sequence
  chemically synthesized
tgttgacactgcctatcagctt

SEQ ID NO: 1220202 - DNA, 22 bp, Artificial Sequence
  chemically synthesized
gttgacactgcctatcagctta

SEQ ID NO: 1220203 - DNA, 22 bp, Artificial Sequence
  chemically synthesized
ttgacactgcctatcagcttaa

SEQ ID NO: 1220204 - DNA, 22 bp, Artificial Sequence
  chemically synthesized
agccgaaaatctccttaagctg

SEQ ID NO: 1220205 - DNA, 22 bp, Artificial Sequence
  chemically synthesized
acactgcctatcagcttaagga

SEQ ID NO: 1220206 - DNA, 22 bp, Artificial Sequence
  chemically synthesized
cctatcagcttaaggagatttt

SEQ ID NO: 1220207 - DNA, 22 bp, Artificial Sequence
  chemically synthesized
tcagcttaaggagattttcggc

SEQ ID NO: 1220208 - DNA, 22 bp, Artificial Sequence
  chemically synthesized
gaaaaccccatcatctcagccg

SEQ ID NO: 1220209 - DNA, 22 bp, Artificial Sequence
  chemically synthesized
aaggagattttcggctgagatg

SEQ ID NO: 1220210 - DNA, 22 bp, Artificial Sequence
  chemically synthesized
agaaaaccccatcatctcagcc

SEQ ID NO: 1220211 - DNA, 22 bp, Artificial Sequence
  chemically synthesized
aggagattttcggctgagatga

SEQ ID NO: 1220212 - DNA, 22 bp, Artificial Sequence
  chemically synthesized
tatatttagaaaaccccatcat

SEQ ID NO: 1220213 - DNA, 22 bp, Artificial Sequence
  chemically synthesized
tcggctgagatgatggggtttt

SEQ ID NO: 1220214 - DNA, 22 bp, Artificial Sequence
  chemically synthesized
cggctgagatgatggggttttc

SEQ ID NO: 1220215 - DNA, 22 bp, Artificial Sequence
  chemically synthesized
ggctgagatgatggggttttct

SEQ ID NO: 1220216 - DNA, 22 bp, Artificial Sequence
  chemically synthesized
agatgatggggttttctaaata

SEQ ID NO: 1220217 - DNA, 22 bp, Artificial Sequence
  chemically synthesized
cagatgacatgattgtatattt

SEQ ID NO: 1220218 - DNA, 22 bp, Artificial Sequence
  chemically synthesized
gcagatgacatgattgtatatt

SEQ ID NO: 1220219 - DNA, 22 bp, Artificial Sequence
  chemically synthesized
tttgcagatgacatgattgtat

SEQ ID NO: 1220220 - DNA, 22 bp, Artificial Sequence
  chemically synthesized
tgtttgcagatgacatgattgt

SEQ ID NO: 1220221 - DNA, 22 bp, Artificial Sequence
  chemically synthesized
tctgtttgcagatgacatgatt

SEQ ID NO: 1220222 - DNA, 22 bp, Artificial Sequence
  chemically synthesized
tctaaatatacaatcatgtcat

SEQ ID NO: 1220223 - DNA, 22 bp, Artificial Sequence
  chemically synthesized
ctaaatatacaatcatgtcatc

SEQ ID NO: 1220224 - DNA, 22 bp, Artificial Sequence
  chemically synthesized
taaatatacaatcatgtcatct

SEQ ID NO: 1220225 - DNA, 22 bp, Artificial Sequence
  chemically synthesized
aatatacaatcatgtcatctgc

SEQ ID NO: 1220226 - DNA, 22 bp, Artificial Sequence
  chemically synthesized
aaattctctgtttgcagatgac

SEQ ID NO: 1220227 - DNA, 22 bp, Artificial Sequence
  chemically synthesized
caaacagagaatttgaataccc

SEQ ID NO: 1220228 - DNA, 22 bp, Artificial Sequence
  chemically synthesized
gaataccctttctttctcctgc

SEQ ID NO: 1220229 - DNA, 22 bp, Artificial Sequence
  chemically synthesized
aataccctttctttctcctgcc

SEQ ID NO: 1220230 - DNA, 22 bp, Artificial Sequence
  chemically synthesized
gccagcacaatcaggcaggaga

SEQ ID NO: 1220231 - DNA, 22 bp, Artificial Sequence
  chemically synthesized
tggccagcacaatcaggcagga

SEQ ID NO: 1220232 - DNA, 22 bp, Artificial Sequence
  chemically synthesized
tctttctcctgcctgattgtgc

SEQ ID NO: 1220233 - DNA, 22 bp, Artificial Sequence
  chemically synthesized
ctttctcctgcctgattgtgct

SEQ ID NO: 1220234 - DNA, 22 bp, Artificial Sequence
  chemically synthesized
gaagttctggccagcacaatca

SEQ ID NO: 1220235 - DNA, 22 bp, Artificial Sequence
  chemically synthesized
tttctcctgcctgattgtgctg

SEQ ID NO: 1220236 - DNA, 22 bp, Artificial Sequence
  chemically synthesized
tctcctgcctgattgtgctggc

SEQ ID NO: 1220237 - DNA, 22 bp, Artificial Sequence
  chemically synthesized
ctcctgcctgattgtgctggcc

SEQ ID NO: 1220238 - DNA, 22 bp, Artificial Sequence
  chemically synthesized
tcctgcctgattgtgctggcca

SEQ ID NO: 1220239 - DNA, 22 bp, Artificial Sequence
  chemically synthesized
ctgcctgattgtgctggccaga

SEQ ID NO: 1220240 - DNA, 22 bp, Artificial Sequence
  chemically synthesized
cctgattgtgctggccagaact

SEQ ID NO: 1220241 - DNA, 22 bp, Artificial Sequence
  chemically synthesized
aacatagtattggaagttctgg

SEQ ID NO: 1220242 - DNA, 22 bp, Artificial Sequence
  chemically synthesized
attgtgctggccagaacttcca

SEQ ID NO: 1220243 - DNA, 22 bp, Artificial Sequence
  chemically synthesized
ttcaacatagtattggaagttc

SEQ ID NO: 1220244 - DNA, 22 bp, Artificial Sequence
  chemically synthesized
tgctggccagaacttccaatac

SEQ ID NO: 1220245 - DNA, 22 bp, Artificial Sequence
  chemically synthesized
ctattcaacatagtattggaag

SEQ ID NO: 1220246 - DNA, 22 bp, Artificial Sequence
  chemically synthesized
gccagaacttccaatactatgt

SEQ ID NO: 1220247 - DNA, 22 bp, Artificial Sequence
  chemically synthesized
atcactcctattcaacatagta

SEQ ID NO: 1220248 - DNA, 22 bp, Artificial Sequence
  chemically synthesized
tcatcactcctattcaacatag

SEQ ID NO: 1220249 - DNA, 22 bp, Artificial Sequence
  chemically synthesized
tctcatcactcctattcaacat

SEQ ID NO: 1220250 - DNA, 22 bp, Artificial Sequence
  chemically synthesized
ccaatactatgttgaataggag

SEQ ID NO: 1220251 - DNA, 22 bp, Artificial Sequence
  chemically synthesized
cctctctcatcactcctattca

SEQ ID NO: 1220252 - DNA, 22 bp, Artificial Sequence
  chemically synthesized
caatactatgttgaataggagt

SEQ ID NO: 1220253 - DNA, 22 bp, Artificial Sequence
  chemically synthesized
tgttgaataggagtgatgagag

SEQ ID NO: 1220254 - DNA, 22 bp, Artificial Sequence
  chemically synthesized
aataggagtgatgagagaggga

SEQ ID NO: 1220255 - DNA, 22 bp, Artificial Sequence
  chemically synthesized
gcacaagacaaaaattccctct

SEQ ID NO: 1220256 - DNA, 22 bp, Artificial Sequence
  chemically synthesized
aaaactggcacaagacaaaaat

SEQ ID NO: 1220257 - DNA, 22 bp, Artificial Sequence
  chemically synthesized
aaaaactggcacaagacaaaaa

SEQ ID NO: 1220258 - DNA, 22 bp, Artificial Sequence
  chemically synthesized
taaaaactggcacaagacaaaa

SEQ ID NO: 1220259 - DNA, 22 bp, Artificial Sequence
  chemically synthesized
cctttaaaaactggcacaagac

SEQ ID NO: 1220260 - DNA, 22 bp, Artificial Sequence
  chemically synthesized
gaagcactccctttaaaaactg

SEQ ID NO: 1220261 - DNA, 22 bp, Artificial Sequence
  chemically synthesized
ttgtcttgtgccagtttttaaa

SEQ ID NO: 1220262 - DNA, 22 bp, Artificial Sequence
  chemically synthesized
tgtcttgtgccagtttttaaag

SEQ ID NO: 1220263 - DNA, 22 bp, Artificial Sequence
  chemically synthesized
gtcttgtgccagtttttaaagg

SEQ ID NO: 1220264 - DNA, 22 bp, Artificial Sequence
  chemically synthesized
tcttgtgccagtttttaaaggg

SEQ ID NO: 1220265 - DNA, 22 bp, Artificial Sequence
  chemically synthesized
gtgccagtttttaaagggagtg

SEQ ID NO: 1220266 - DNA, 22 bp, Artificial Sequence
  chemically synthesized
tgccagtttttaaagggagtgc

SEQ ID NO: 1220267 - DNA, 22 bp, Artificial Sequence
  chemically synthesized
aatgggcaaaagctggaagcac

SEQ ID NO: 1220268 - DNA, 22 bp, Artificial Sequence
  chemically synthesized
ttaaagggagtgcttccagctt

SEQ ID NO: 1220269 - DNA, 22 bp, Artificial Sequence
  chemically synthesized
taaagggagtgcttccagcttt

SEQ ID NO: 1220270 - DNA, 22 bp, Artificial Sequence
  chemically synthesized
aaagggagtgcttccagctttt

SEQ ID NO: 1220271 - DNA, 22 bp, Artificial Sequence
  chemically synthesized
aagggagtgcttccagcttttg

SEQ ID NO: 1220272 - DNA, 22 bp, Artificial Sequence
  chemically synthesized
ccagcttttgcccattcagtat

SEQ ID NO: 1220273 - DNA, 22 bp, Artificial Sequence
  chemically synthesized
cagcttttgcccattcagtatg

SEQ ID NO: 1220274 - DNA, 22 bp, Artificial Sequence
  chemically synthesized
ttgcccattcagtatgatattg

SEQ ID NO: 1220275 - DNA, 22 bp, Artificial Sequence
  chemically synthesized
tgcccattcagtatgatattgg

SEQ ID NO: 1220276 - DNA, 22 bp, Artificial Sequence
  chemically synthesized
gcccattcagtatgatattggc

SEQ ID NO: 1220277 - DNA, 22 bp, Artificial Sequence
  chemically synthesized
cccattcagtatgatattggct

SEQ ID NO: 1220278 - DNA, 22 bp, Artificial Sequence
  chemically synthesized
tgacatacccacagccaatatc

SEQ ID NO: 1220279 - DNA, 22 bp, Artificial Sequence
  chemically synthesized
atgacatacccacagccaatat

SEQ ID NO: 1220280 - DNA, 22 bp, Artificial Sequence
  chemically synthesized
tttatgacatacccacagccaa

SEQ ID NO: 1220281 - DNA, 22 bp, Artificial Sequence
  chemically synthesized
agtatgatattggctgtgggta

SEQ ID NO: 1220282 - DNA, 22 bp, Artificial Sequence
  chemically synthesized
aaaataagagctatttatgaca

SEQ ID NO: 1220283 - DNA, 22 bp, Artificial Sequence
  chemically synthesized
gctgtgggtatgtcataaatag

SEQ ID NO: 1220284 - DNA, 22 bp, Artificial Sequence
  chemically synthesized
tgggtatgtcataaatagctct

SEQ ID NO: 1220285 - DNA, 22 bp, Artificial Sequence
  chemically synthesized
atggaatgtgtctcaaaataag

SEQ ID NO: 1220286 - DNA, 22 bp, Artificial Sequence
  chemically synthesized
ggtattgatggaatgtgtctca

SEQ ID NO: 1220287 - DNA, 22 bp, Artificial Sequence
  chemically synthesized
ttattttgagacacattccatc

SEQ ID NO: 1220288 - DNA, 22 bp, Artificial Sequence
  chemically synthesized
attttgagacacattccatcaa

SEQ ID NO: 1220289 - DNA, 22 bp, Artificial Sequence
  chemically synthesized
ttttgagacacattccatcaat

SEQ ID NO: 1220290 - DNA, 22 bp, Artificial Sequence
  chemically synthesized
aataaactaggtattgatggaa

SEQ ID NO: 1220291 - DNA, 22 bp, Artificial Sequence
  chemically synthesized
caataaactaggtattgatgga

SEQ ID NO: 1220292 - DNA, 22 bp, Artificial Sequence
  chemically synthesized
tcaataaactaggtattgatgg

SEQ ID NO: 1220293 - DNA, 22 bp, Artificial Sequence
  chemically synthesized
tgagacacattccatcaatacc

SEQ ID NO: 1220294 - DNA, 22 bp, Artificial Sequence
  chemically synthesized
gagacacattccatcaatacct

SEQ ID NO: 1220295 - DNA, 22 bp, Artificial Sequence
  chemically synthesized
agacacattccatcaataccta

SEQ ID NO: 1220296 - DNA, 22 bp, Artificial Sequence
  chemically synthesized
aaaattttcaataaactaggta

SEQ ID NO: 1220297 - DNA, 22 bp, Artificial Sequence
  chemically synthesized
catcaatacctagtttattgaa

SEQ ID NO: 1220298 - DNA, 22 bp, Artificial Sequence
  chemically synthesized
atgctaaaaattttcaataaac

SEQ ID NO: 1220299 - DNA, 22 bp, Artificial Sequence
  chemically synthesized
catgctaaaaattttcaataaa

SEQ ID NO: 1220300 - DNA, 22 bp, Artificial Sequence
  chemically synthesized
cccttcatgctaaaaattttca

SEQ ID NO: 1220301 - DNA, 22 bp, Artificial Sequence
  chemically synthesized
actacccttcatgctaaaaatt

SEQ ID NO: 1220302 - DNA, 22 bp, Artificial Sequence
  chemically synthesized
gtttattgaaaatttttagcat

SEQ ID NO: 1220303 - DNA, 22 bp, Artificial Sequence
  chemically synthesized
attgaaaatttttagcatgaag

SEQ ID NO: 1220304 - DNA, 22 bp, Artificial Sequence
  chemically synthesized
ttgaaaatttttagcatgaagg

SEQ ID NO: 1220305 - DNA, 22 bp, Artificial Sequence
  chemically synthesized
ataaaattcactacccttcatg

SEQ ID NO: 1220306 - DNA, 22 bp, Artificial Sequence
  chemically synthesized
aaaatttttagcatgaagggta

SEQ ID NO: 1220307 - DNA, 22 bp, Artificial Sequence
  chemically synthesized
gataaaattcactacccttcat

SEQ ID NO: 1220308 - DNA, 22 bp, Artificial Sequence
  chemically synthesized
tgataaaattcactacccttca

SEQ ID NO: 1220309 - DNA, 22 bp, Artificial Sequence
  chemically synthesized
ttagcatgaagggtagtgaatt

SEQ ID NO: 1220310 - DNA, 22 bp, Artificial Sequence
  chemically synthesized
tagcatgaagggtagtgaattt

SEQ ID NO: 1220311 - DNA, 22 bp, Artificial Sequence
  chemically synthesized
agcatgaagggtagtgaatttt

SEQ ID NO: 1220312 - DNA, 22 bp, Artificial Sequence
  chemically synthesized
gcatgaagggtagtgaatttta

SEQ ID NO: 1220313 - DNA, 22 bp, Artificial Sequence
  chemically synthesized
aatagatgcagaaaaggccttt

SEQ ID NO: 1220314 - DNA, 22 bp, Artificial Sequence
  chemically synthesized
tctcaatagatgcagaaaaggc

SEQ ID NO: 1220315 - DNA, 22 bp, Artificial Sequence
  chemically synthesized
tatcaaaggccttttctgcatc

SEQ ID NO: 1220316 - DNA, 22 bp, Artificial Sequence
  chemically synthesized
atcaaaggccttttctgcatct

SEQ ID NO: 1220317 - DNA, 22 bp, Artificial Sequence
  chemically synthesized
tcaaaggccttttctgcatcta

SEQ ID NO: 1220318 - DNA, 22 bp, Artificial Sequence
  chemically synthesized
ttctgcatctattgagataatc

SEQ ID NO: 1220319 - DNA, 22 bp, Artificial Sequence
  chemically synthesized
tctgcatctattgagataatca

SEQ ID NO: 1220320 - DNA, 22 bp, Artificial Sequence
  chemically synthesized
ctgcatctattgagataatcat

SEQ ID NO: 1220321 - DNA, 22 bp, Artificial Sequence
  chemically synthesized
tgcatctattgagataatcatg

SEQ ID NO: 1220322 - DNA, 22 bp, Artificial Sequence
  chemically synthesized
catctattgagataatcatgtg

SEQ ID NO: 1220323 - DNA, 22 bp, Artificial Sequence
  chemically synthesized
ttgagataatcatgtggttttt

SEQ ID NO: 1220324 - DNA, 22 bp, Artificial Sequence
  chemically synthesized
agataatcatgtggtttttgtc

SEQ ID NO: 1220325 - DNA, 22 bp, Artificial Sequence
  chemically synthesized
ttgtcattggttctgtttatgt

SEQ ID NO: 1220326 - DNA, 22 bp, Artificial Sequence
  chemically synthesized
tgtcattggttctgtttatgtg

SEQ ID NO: 1220327 - DNA, 22 bp, Artificial Sequence
  chemically synthesized
gtcattggttctgtttatgtga

SEQ ID NO: 1220328 - DNA, 22 bp, Artificial Sequence
  chemically synthesized
tcattggttctgtttatgtgat

SEQ ID NO: 1220329 - DNA, 22 bp, Artificial Sequence
  chemically synthesized
gttctgtttatgtgatggatta

SEQ ID NO: 1220330 - DNA, 22 bp, Artificial Sequence
  chemically synthesized
tgtttatgtgatggattacgtt

SEQ ID NO: 1220331 - DNA, 22 bp, Artificial Sequence
  chemically synthesized
tttatgtgatggattacgtttg

SEQ ID NO: 1220332 - DNA, 22 bp, Artificial Sequence
  chemically synthesized
atgtgatggattacgtttgttg

SEQ ID NO: 1220333 - DNA, 22 bp, Artificial Sequence
  chemically synthesized
acatacagaaaccaacaaacgt

SEQ ID NO: 1220334 - DNA, 22 bp, Artificial Sequence
  chemically synthesized
tgtgatggattacgtttgttgg

SEQ ID NO: 1220335 - DNA, 22 bp, Artificial Sequence
  chemically synthesized
aacatacagaaaccaacaaacg

SEQ ID NO: 1220336 - DNA, 22 bp, Artificial Sequence
  chemically synthesized
gtttaacatacagaaaccaaca

SEQ ID NO: 1220337 - DNA, 22 bp, Artificial Sequence
  chemically synthesized
cgtttgttggtttctgtatgtt

SEQ ID NO: 1220338 - DNA, 22 bp, Artificial Sequence
  chemically synthesized
gttggtttctgtatgttaaact

SEQ ID NO: 1220339 - DNA, 22 bp, Artificial Sequence
  chemically synthesized
ggatgcaagattagtttaacat

SEQ ID NO: 1220340 - DNA, 22 bp, Artificial Sequence
  chemically synthesized
ttggtttctgtatgttaaacta

SEQ ID NO: 1220341 - DNA, 22 bp, Artificial Sequence
  chemically synthesized
gtttctgtatgttaaactaatc

SEQ ID NO: 1220342 - DNA, 22 bp, Artificial Sequence
  chemically synthesized
atccctgggatgcaagattagt

SEQ ID NO: 1220343 - DNA, 22 bp, Artificial Sequence
  chemically synthesized
ctgtatgttaaactaatcttgc

SEQ ID NO: 1220344 - DNA, 22 bp, Artificial Sequence
  chemically synthesized
catccctgggatgcaagattag

SEQ ID NO: 1220345 - DNA, 22 bp, Artificial Sequence
  chemically synthesized
tgtatgttaaactaatcttgca

SEQ ID NO: 1220346 - DNA, 22 bp, Artificial Sequence
  chemically synthesized
tatgttaaactaatcttgcatc

SEQ ID NO: 1220347 - DNA, 22 bp, Artificial Sequence
  chemically synthesized
gcttcatccctgggatgcaaga

SEQ ID NO: 1220348 - DNA, 22 bp, Artificial Sequence
  chemically synthesized
aactaatcttgcatcccaggga

SEQ ID NO: 1220349 - DNA, 22 bp, Artificial Sequence
  chemically synthesized
atcttgcatcccagggatgaag

SEQ ID NO: 1220350 - DNA, 22 bp, Artificial Sequence
  chemically synthesized
gcatcccagggatgaagccaac

SEQ ID NO: 1220351 - DNA, 22 bp, Artificial Sequence
  chemically synthesized
catcccagggatgaagccaact

SEQ ID NO: 1220352 - DNA, 22 bp, Artificial Sequence
  chemically synthesized
tccaccatgatcaagttggctt

SEQ ID NO: 1220353 - DNA, 22 bp, Artificial Sequence
  chemically synthesized
gatcatggtggataaccttttt

SEQ ID NO: 1220354 - DNA, 22 bp, Artificial Sequence
  chemically synthesized
atcatggtggataacctttttg

SEQ ID NO: 1220355 - DNA, 22 bp, Artificial Sequence
  chemically synthesized
gcaaaccgaatccagcagcaca

SEQ ID NO: 1220356 - DNA, 22 bp, Artificial Sequence
  chemically synthesized
tttgatgtgctgctggattcgg

SEQ ID NO: 1220357 - DNA, 22 bp, Artificial Sequence
  chemically synthesized
ttgatgtgctgctggattcggt

SEQ ID NO: 1220358 - DNA, 22 bp, Artificial Sequence
  chemically synthesized
tgatgtgctgctggattcggtt

SEQ ID NO: 1220359 - DNA, 22 bp, Artificial Sequence
  chemically synthesized
gatgtgctgctggattcggttt

SEQ ID NO: 1220360 - DNA, 22 bp, Artificial Sequence
  chemically synthesized
atgtgctgctggattcggtttg

SEQ ID NO: 1220361 - DNA, 22 bp, Artificial Sequence
  chemically synthesized
aataaaatactggcaaaccgaa

SEQ ID NO: 1220362 - DNA, 22 bp, Artificial Sequence
  chemically synthesized
ctggattcggtttgccagtatt

SEQ ID NO: 1220363 - DNA, 22 bp, Artificial Sequence
  chemically synthesized
gattcggtttgccagtatttta

SEQ ID NO: 1220364 - DNA, 22 bp, Artificial Sequence
  chemically synthesized
ggtttgccagtattttattgag

SEQ ID NO: 1220365 - DNA, 22 bp, Artificial Sequence
  chemically synthesized
gccagtattttattgagccttt

SEQ ID NO: 1220366 - DNA, 22 bp, Artificial Sequence
  chemically synthesized
ccagtattttattgagcctttc

SEQ ID NO: 1220367 - DNA, 22 bp, Artificial Sequence
  chemically synthesized
atgaacatcaatgtgaaaggct

SEQ ID NO: 1220368 - DNA, 22 bp, Artificial Sequence
  chemically synthesized
tattgagcctttcacattgatg

SEQ ID NO: 1220369 - DNA, 22 bp, Artificial Sequence
  chemically synthesized
attgagcctttcacattgatgt

SEQ ID NO: 1220370 - DNA, 22 bp, Artificial Sequence
  chemically synthesized
ttgagcctttcacattgatgtt

SEQ ID NO: 1220371 - DNA, 22 bp, Artificial Sequence
  chemically synthesized
agcctttcacattgatgttcat

SEQ ID NO: 1220372 - DNA, 22 bp, Artificial Sequence
  chemically synthesized
aggtcaatatccctgatgaaca

SEQ ID NO: 1220373 - DNA, 22 bp, Artificial Sequence
  chemically synthesized
caggtcaatatccctgatgaac

SEQ ID NO: 1220374 - DNA, 22 bp, Artificial Sequence
  chemically synthesized
tcacattgatgttcatcaggga

SEQ ID NO: 1220375 - DNA, 22 bp, Artificial Sequence
  chemically synthesized
cacattgatgttcatcagggat

SEQ ID NO: 1220376 - DNA, 22 bp, Artificial Sequence
  chemically synthesized
acattgatgttcatcagggata

SEQ ID NO: 1220377 - DNA, 22 bp, Artificial Sequence
  chemically synthesized
atgttcatcagggatattgacc

SEQ ID NO: 1220378 - DNA, 22 bp, Artificial Sequence
  chemically synthesized
atcagggatattgacctgaaat

SEQ ID NO: 1220379 - DNA, 22 bp, Artificial Sequence
  chemically synthesized
gcagagacacaataaaaaaaat

SEQ ID NO: 1220380 - DNA, 22 bp, Artificial Sequence
  chemically synthesized
acctgaaattttttttattgtg

SEQ ID NO: 1220381 - DNA, 22 bp, Artificial Sequence
  chemically synthesized
aaattttttttattgtgtctct

SEQ ID NO: 1220382 - DNA, 22 bp, Artificial Sequence
  chemically synthesized
ataccaaaacctggcagagaca

SEQ ID NO: 1220383 - DNA, 22 bp, Artificial Sequence
  chemically synthesized
tttttattgtgtctctgccagg

SEQ ID NO: 1220384 - DNA, 22 bp, Artificial Sequence
  chemically synthesized
ttttattgtgtctctgccaggt

SEQ ID NO: 1220385 - DNA, 22 bp, Artificial Sequence
  chemically synthesized
tttattgtgtctctgccaggtt

SEQ ID NO: 1220386 - DNA, 22 bp, Artificial Sequence
  chemically synthesized
ttattgtgtctctgccaggttt

SEQ ID NO: 1220387 - DNA, 22 bp, Artificial Sequence
  chemically synthesized
tattgtgtctctgccaggtttt

SEQ ID NO: 1220388 - DNA, 22 bp, Artificial Sequence
  chemically synthesized
attgtgtctctgccaggttttg

SEQ ID NO: 1220389 - DNA, 22 bp, Artificial Sequence
  chemically synthesized
ttgtgtctctgccaggttttgg

SEQ ID NO: 1220390 - DNA, 22 bp, Artificial Sequence
  chemically synthesized
tgtctctgccaggttttggtat

SEQ ID NO: 1220391 - DNA, 22 bp, Artificial Sequence
  chemically synthesized
tgccaggttttggtatcaggat

SEQ ID NO: 1220392 - DNA, 22 bp, Artificial Sequence
  chemically synthesized
tgaggccaacatcatcctgata

SEQ ID NO: 1220393 - DNA, 22 bp, Artificial Sequence
  chemically synthesized
ccaggttttggtatcaggatga

SEQ ID NO: 1220394 - DNA, 22 bp, Artificial Sequence
  chemically synthesized
atgaggccaacatcatcctgat

SEQ ID NO: 1220395 - DNA, 22 bp, Artificial Sequence
  chemically synthesized
tatgaggccaacatcatcctga

SEQ ID NO: 1220396 - DNA, 22 bp, Artificial Sequence
  chemically synthesized
attttatgaggccaacatcatc

SEQ ID NO: 1220397 - DNA, 22 bp, Artificial Sequence
  chemically synthesized
tggtatcaggatgatgttggcc

SEQ ID NO: 1220398 - DNA, 22 bp, Artificial Sequence
  chemically synthesized
ggtatcaggatgatgttggcct

SEQ ID NO: 1220399 - DNA, 22 bp, Artificial Sequence
  chemically synthesized
actcattttatgaggccaacat

SEQ ID NO: 1220400 - DNA, 22 bp, Artificial Sequence
  chemically synthesized
gtatcaggatgatgttggcctc

SEQ ID NO: 1220401 - DNA, 22 bp, Artificial Sequence
  chemically synthesized
cctaactcattttatgaggcca

SEQ ID NO: 1220402 - DNA, 22 bp, Artificial Sequence
  chemically synthesized
ctccctaactcattttatgagg

SEQ ID NO: 1220403 - DNA, 22 bp, Artificial Sequence
  chemically synthesized
gcctcataaaatgagttaggga

SEQ ID NO: 1220404 - DNA, 22 bp, Artificial Sequence
  chemically synthesized
ataaaatgagttagggaggagt

SEQ ID NO: 1220405 - DNA, 22 bp, Artificial Sequence
  chemically synthesized
caaacaatagaaaaataaggac

SEQ ID NO: 1220406 - DNA, 22 bp, Artificial Sequence
  chemically synthesized
ttccaaacaatagaaaaataag

SEQ ID NO: 1220407 - DNA, 22 bp, Artificial Sequence
  chemically synthesized
gggaggagtccttatttttcta

SEQ ID NO: 1220408 - DNA, 22 bp, Artificial Sequence
  chemically synthesized
aaactattccaaacaatagaaa

SEQ ID NO: 1220409 - DNA, 22 bp, Artificial Sequence
  chemically synthesized
tgaaactattccaaacaataga

SEQ ID NO: 1220410 - DNA, 22 bp, Artificial Sequence
  chemically synthesized
ctgaaactattccaaacaatag

SEQ ID NO: 1220411 - DNA, 22 bp, Artificial Sequence
  chemically synthesized
cttctgaaactattccaaacaa

SEQ ID NO: 1220412 - DNA, 22 bp, Artificial Sequence
  chemically synthesized
atttttctattgtttggaatag

SEQ ID NO: 1220413 - DNA, 22 bp, Artificial Sequence
  chemically synthesized
tttttctattgtttggaatagt

SEQ ID NO: 1220414 - DNA, 22 bp, Artificial Sequence
  chemically synthesized
ttctattgtttggaatagtttc

SEQ ID NO: 1220415 - DNA, 22 bp, Artificial Sequence
  chemically synthesized
tctattgtttggaatagtttca

SEQ ID NO: 1220416 - DNA, 22 bp, Artificial Sequence
  chemically synthesized
ctattgtttggaatagtttcag

SEQ ID NO: 1220417 - DNA, 22 bp, Artificial Sequence
  chemically synthesized
gtaccattccttctgaaactat

SEQ ID NO: 1220418 - DNA, 22 bp, Artificial Sequence
  chemically synthesized
tattgtttggaatagtttcaga

SEQ ID NO: 1220419 - DNA, 22 bp, Artificial Sequence
  chemically synthesized
ttgtttggaatagtttcagaag

SEQ ID NO: 1220420 - DNA, 22 bp, Artificial Sequence
  chemically synthesized
tttggaatagtttcagaaggaa

SEQ ID NO: 1220421 - DNA, 22 bp, Artificial Sequence
  chemically synthesized
ggaatagtttcagaaggaatgg

SEQ ID NO: 1220422 - DNA, 22 bp, Artificial Sequence
  chemically synthesized
gaatagtttcagaaggaatggt

SEQ ID NO: 1220423 - DNA, 22 bp, Artificial Sequence
  chemically synthesized
cagaaggaatggtactagctcc

SEQ ID NO: 1220424 - DNA, 22 bp, Artificial Sequence
  chemically synthesized
agaaggaatggtactagctcct

SEQ ID NO: 1220425 - DNA, 22 bp, Artificial Sequence
  chemically synthesized
ccagaggtacaaagaggagcta

SEQ ID NO: 1220426 - DNA, 22 bp, Artificial Sequence
  chemically synthesized
taccagaggtacaaagaggagc

SEQ ID NO: 1220427 - DNA, 22 bp, Artificial Sequence
  chemically synthesized
gctcctctttgtacctctggta

SEQ ID NO: 1220428 - DNA, 22 bp, Artificial Sequence
  chemically synthesized
acagccgaattctaccagaggt

SEQ ID NO: 1220429 - DNA, 22 bp, Artificial Sequence
  chemically synthesized
ctctttgtacctctggtagaat

SEQ ID NO: 1220430 - DNA, 22 bp, Artificial Sequence
  chemically synthesized
tttgtacctctggtagaattcg

SEQ ID NO: 1220431 - DNA, 22 bp, Artificial Sequence
  chemically synthesized
tgtacctctggtagaattcggc

SEQ ID NO: 1220432 - DNA, 22 bp, Artificial Sequence
  chemically synthesized
gtacctctggtagaattcggct

SEQ ID NO: 1220433 - DNA, 22 bp, Artificial Sequence
  chemically synthesized
tacctctggtagaattcggctg

SEQ ID NO: 1220434 - DNA, 22 bp, Artificial Sequence
  chemically synthesized
tggtagaattcggctgtgaatc

SEQ ID NO: 1220435 - DNA, 22 bp, Artificial Sequence
  chemically synthesized
gtagaattcggctgtgaatctg

SEQ ID NO: 1220436 - DNA, 22 bp, Artificial Sequence
  chemically synthesized
ggctgtgaatctgtctggtcct

SEQ ID NO: 1220437 - DNA, 22 bp, Artificial Sequence
  chemically synthesized
tgaatctgtctggtcctgggct

SEQ ID NO: 1220438 - DNA, 22 bp, Artificial Sequence
  chemically synthesized
caaaccaaaaaaagcccaggac

SEQ ID NO: 1220439 - DNA, 22 bp, Artificial Sequence
  chemically synthesized
tctggtcctgggctttttttgg

SEQ ID NO: 1220440 - DNA, 22 bp, Artificial Sequence
  chemically synthesized
atagcctacaaaccaaaaaaag

SEQ ID NO: 1220441 - DNA, 22 bp, Artificial Sequence
  chemically synthesized
gtcctgggctttttttggtttg

SEQ ID NO: 1220442 - DNA, 22 bp, Artificial Sequence
  chemically synthesized
ggctttttttggtttgtaggct

SEQ ID NO: 1220443 - DNA, 22 bp, Artificial Sequence
  chemically synthesized
aggcagtaattaatagcctaca

SEQ ID NO: 1220444 - DNA, 22 bp, Artificial Sequence
  chemically synthesized
tttttggtttgtaggctattaa

SEQ ID NO: 1220445 - DNA, 22 bp, Artificial Sequence
  chemically synthesized
ttttggtttgtaggctattaat

SEQ ID NO: 1220446 - DNA, 22 bp, Artificial Sequence
  chemically synthesized
tttggtttgtaggctattaatt

SEQ ID NO: 1220447 - DNA, 22 bp, Artificial Sequence
  chemically synthesized
ttggtttgtaggctattaatta

SEQ ID NO: 1220448 - DNA, 22 bp, Artificial Sequence
  chemically synthesized
aaattgaggcagtaattaatag

SEQ ID NO: 1220449 - DNA, 22 bp, Artificial Sequence
  chemically synthesized
tggtttgtaggctattaattac

SEQ ID NO: 1220450 - DNA, 22 bp, Artificial Sequence
  chemically synthesized
ggtttgtaggctattaattact

SEQ ID NO: 1220451 - DNA, 22 bp, Artificial Sequence
  chemically synthesized
tgaaattgaggcagtaattaat

SEQ ID NO: 1220452 - DNA, 22 bp, Artificial Sequence
  chemically synthesized
gtttgtaggctattaattactg

SEQ ID NO: 1220453 - DNA, 22 bp, Artificial Sequence
  chemically synthesized
gtaggctattaattactgcctc

SEQ ID NO: 1220454 - DNA, 22 bp, Artificial Sequence
  chemically synthesized
taggctattaattactgcctca

SEQ ID NO: 1220455 - DNA, 22 bp, Artificial Sequence
  chemically synthesized
ttaattactgcctcaatttcag

SEQ ID NO: 1220456 - DNA, 22 bp, Artificial Sequence
  chemically synthesized
attactgcctcaatttcagaac

SEQ ID NO: 1220457 - DNA, 22 bp, Artificial Sequence
  chemically synthesized
ctgcctcaatttcagaacttgt

SEQ ID NO: 1220458 - DNA, 22 bp, Artificial Sequence
  chemically synthesized
aatagaacaataacaagttctg

SEQ ID NO: 1220459 - DNA, 22 bp, Artificial Sequence
  chemically synthesized
cctcaatttcagaacttgttat

SEQ ID NO: 1220460 - DNA, 22 bp, Artificial Sequence
  chemically synthesized
aatttcagaacttgttattgtt

SEQ ID NO: 1220461 - DNA, 22 bp, Artificial Sequence
  chemically synthesized
cagaacttgttattgttctatt

SEQ ID NO: 1220462 - DNA, 22 bp, Artificial Sequence
  chemically synthesized
agaacttgttattgttctattc

SEQ ID NO: 1220463 - DNA, 22 bp, Artificial Sequence
  chemically synthesized
gttattgttctattcagggatt

SEQ ID NO: 1220464 - DNA, 22 bp, Artificial Sequence
  chemically synthesized
ttattgttctattcagggattt

SEQ ID NO: 1220465 - DNA, 22 bp, Artificial Sequence
  chemically synthesized
ttgttctattcagggatttgac

SEQ ID NO: 1220466 - DNA, 22 bp, Artificial Sequence
  chemically synthesized
aaccaggaagaagtcaaatccc

SEQ ID NO: 1220467 - DNA, 22 bp, Artificial Sequence
  chemically synthesized
ttctattcagggatttgacttc

SEQ ID NO: 1220468 - DNA, 22 bp, Artificial Sequence
  chemically synthesized
tattcagggatttgacttcttc

SEQ ID NO: 1220469 - DNA, 22 bp, Artificial Sequence
  chemically synthesized
ttcagggatttgacttcttcct

SEQ ID NO: 1220470 - DNA, 22 bp, Artificial Sequence
  chemically synthesized
caagattaaaccaggaagaagt

SEQ ID NO: 1220471 - DNA, 22 bp, Artificial Sequence
  chemically synthesized
ccaagattaaaccaggaagaag

SEQ ID NO: 1220472 - DNA, 22 bp, Artificial Sequence
  chemically synthesized
agggatttgacttcttcctggt

SEQ ID NO: 1220473 - DNA, 22 bp, Artificial Sequence
  chemically synthesized
ttccaagattaaaccaggaaga

SEQ ID NO: 1220474 - DNA, 22 bp, Artificial Sequence
  chemically synthesized
gacttcttcctggtttaatctt

SEQ ID NO: 1220475 - DNA, 22 bp, Artificial Sequence
  chemically synthesized
acttcttcctggtttaatcttg

SEQ ID NO: 1220476 - DNA, 22 bp, Artificial Sequence
  chemically synthesized
cttcctggtttaatcttggaag

SEQ ID NO: 1220477 - DNA, 22 bp, Artificial Sequence
  chemically synthesized
tacatatacactcttccaagat

SEQ ID NO: 1220478 - DNA, 22 bp, Artificial Sequence
  chemically synthesized
ttcctggtttaatcttggaaga

SEQ ID NO: 1220479 - DNA, 22 bp, Artificial Sequence
  chemically synthesized
cctggtttaatcttggaagagt

SEQ ID NO: 1220480 - DNA, 22 bp, Artificial Sequence
  chemically synthesized
ctgtacatatacactcttccaa

SEQ ID NO: 1220481 - DNA, 22 bp, Artificial Sequence
  chemically synthesized
ctggtttaatcttggaagagtg

SEQ ID NO: 1220482 - DNA, 22 bp, Artificial Sequence
  chemically synthesized
gtttaatcttggaagagtgtat

SEQ ID NO: 1220483 - DNA, 22 bp, Artificial Sequence
  chemically synthesized
aatcttggaagagtgtatatgt

SEQ ID NO: 1220484 - DNA, 22 bp, Artificial Sequence
  chemically synthesized
atcttggaagagtgtatatgta

SEQ ID NO: 1220485 - DNA, 22 bp, Artificial Sequence
  chemically synthesized
ggaagagtgtatatgtacagga

SEQ ID NO: 1220486 - DNA, 22 bp, Artificial Sequence
  chemically synthesized
gaagagtgtatatgtacaggaa

SEQ ID NO: 1220487 - DNA, 22 bp, Artificial Sequence
  chemically synthesized
gaagaaatggaaaaattcctgt

SEQ ID NO: 1220488 - DNA, 22 bp, Artificial Sequence
  chemically synthesized
gaaaatctagaagaaatggaaa

SEQ ID NO: 1220489 - DNA, 22 bp, Artificial Sequence
  chemically synthesized
ttccatttcttctagattttct

SEQ ID NO: 1220490 - DNA, 22 bp, Artificial Sequence
  chemically synthesized
tccatttcttctagattttcta

SEQ ID NO: 1220491 - DNA, 22 bp, Artificial Sequence
  chemically synthesized
ccatttcttctagattttctag

SEQ ID NO: 1220492 - DNA, 22 bp, Artificial Sequence
  chemically synthesized
cacgcaaataaactagaaaatc

SEQ ID NO: 1220493 - DNA, 22 bp, Artificial Sequence
  chemically synthesized
catttcttctagattttctagt

SEQ ID NO: 1220494 - DNA, 22 bp, Artificial Sequence
  chemically synthesized
cttctagattttctagtttatt

SEQ ID NO: 1220495 - DNA, 22 bp, Artificial Sequence
  chemically synthesized
ttctagattttctagtttattt

SEQ ID NO: 1220496 - DNA, 22 bp, Artificial Sequence
  chemically synthesized
ctagattttctagtttatttgc

SEQ ID NO: 1220497 - DNA, 22 bp, Artificial Sequence
  chemically synthesized
tagattttctagtttatttgcg

SEQ ID NO: 1220498 - DNA, 22 bp, Artificial Sequence
  chemically synthesized
taaacatctccacgcaaataaa

SEQ ID NO: 1220499 - DNA, 22 bp, Artificial Sequence
  chemically synthesized
gattttctagtttatttgcgtg

SEQ ID NO: 1220500 - DNA, 22 bp, Artificial Sequence
  chemically synthesized
tctagtttatttgcgtggagat

SEQ ID NO: 1220501 - DNA, 22 bp, Artificial Sequence
  chemically synthesized
ctagtttatttgcgtggagatg

SEQ ID NO: 1220502 - DNA, 22 bp, Artificial Sequence
  chemically synthesized
tagtttatttgcgtggagatgt

SEQ ID NO: 1220503 - DNA, 22 bp, Artificial Sequence
  chemically synthesized
gtttatttgcgtggagatgttt

SEQ ID NO: 1220504 - DNA, 22 bp, Artificial Sequence
  chemically synthesized
atttgcgtggagatgtttatag

SEQ ID NO: 1220505 - DNA, 22 bp, Artificial Sequence
  chemically synthesized
tttgcgtggagatgtttatagt

SEQ ID NO: 1220506 - DNA, 22 bp, Artificial Sequence
  chemically synthesized
ccatcagagaatactataaaca

SEQ ID NO: 1220507 - DNA, 22 bp, Artificial Sequence
  chemically synthesized
gcgtggagatgtttatagtatt

SEQ ID NO: 1220508 - DNA, 22 bp, Artificial Sequence
  chemically synthesized
cgtggagatgtttatagtattc

SEQ ID NO: 1220509 - DNA, 22 bp, Artificial Sequence
  chemically synthesized
atagtattctctgatggtagtt

SEQ ID NO: 1220510 - DNA, 22 bp, Artificial Sequence
  chemically synthesized
tagtattctctgatggtagttt

SEQ ID NO: 1220511 - DNA, 22 bp, Artificial Sequence
  chemically synthesized
atcccacagaaatacaaactac

SEQ ID NO: 1220512 - DNA, 22 bp, Artificial Sequence
  chemically synthesized
tctgatggtagtttgtatttct

SEQ ID NO: 1220513 - DNA, 22 bp, Artificial Sequence
  chemically synthesized
tgatggtagtttgtatttctgt

SEQ ID NO: 1220514 - DNA, 22 bp, Artificial Sequence
  chemically synthesized
atggtagtttgtatttctgtgg

SEQ ID NO: 1220515 - DNA, 22 bp, Artificial Sequence
  chemically synthesized
gtatttctgtgggatcagtggt

SEQ ID NO: 1220516 - DNA, 22 bp, Artificial Sequence
  chemically synthesized
tatttctgtgggatcagtggtg

SEQ ID NO: 1220517 - DNA, 22 bp, Artificial Sequence
  chemically synthesized
ctgtgggatcagtggtgatatc

SEQ ID NO: 1220518 - DNA, 22 bp, Artificial Sequence
  chemically synthesized
tgtgggatcagtggtgatatcc

SEQ ID NO: 1220519 - DNA, 22 bp, Artificial Sequence
  chemically synthesized
tgggatcagtggtgatatcccc

SEQ ID NO: 1220520 - DNA, 22 bp, Artificial Sequence
  chemically synthesized
tatcattttttactgtgtctat

SEQ ID NO: 1220521 - DNA, 22 bp, Artificial Sequence
  chemically synthesized
atcattttttactgtgtctatt

SEQ ID NO: 1220522 - DNA, 22 bp, Artificial Sequence
  chemically synthesized
tcattttttactgtgtctattt

SEQ ID NO: 1220523 - DNA, 22 bp, Artificial Sequence
  chemically synthesized
tttactgtgtctatttgattct

SEQ ID NO: 1220524 - DNA, 22 bp, Artificial Sequence
  chemically synthesized
ttactgtgtctatttgattctt

SEQ ID NO: 1220525 - DNA, 22 bp, Artificial Sequence
  chemically synthesized
tactgtgtctatttgattcttc

SEQ ID NO: 1220526 - DNA, 22 bp, Artificial Sequence
  chemically synthesized
actgtgtctatttgattcttct

SEQ ID NO: 1220527 - DNA, 22 bp, Artificial Sequence
  chemically synthesized
ctgtgtctatttgattcttctc

SEQ ID NO: 1220528 - DNA, 22 bp, Artificial Sequence
  chemically synthesized
tgtctatttgattcttctctct

SEQ ID NO: 1220529 - DNA, 22 bp, Artificial Sequence
  chemically synthesized
aaaaagaagaaaagagagaaga

SEQ ID NO: 1220530 - DNA, 22 bp, Artificial Sequence
  chemically synthesized
tttgattcttctctcttttctt

SEQ ID NO: 1220531 - DNA, 22 bp, Artificial Sequence
  chemically synthesized
gattcttctctcttttcttctt

SEQ ID NO: 1220532 - DNA, 22 bp, Artificial Sequence
  chemically synthesized
gccagactaaaaaagaagaaaa

SEQ ID NO: 1220533 - DNA, 22 bp, Artificial Sequence
  chemically synthesized
attcttctctcttttcttcttt

SEQ ID NO: 1220534 - DNA, 22 bp, Artificial Sequence
  chemically synthesized
ttctctcttttcttctttttta

SEQ ID NO: 1220535 - DNA, 22 bp, Artificial Sequence
  chemically synthesized
ctctcttttcttcttttttagt

SEQ ID NO: 1220536 - DNA, 22 bp, Artificial Sequence
  chemically synthesized
tctcttttcttcttttttagtc

SEQ ID NO: 1220537 - DNA, 22 bp, Artificial Sequence
  chemically synthesized
tcttttcttcttttttagtctg

SEQ ID NO: 1220538 - DNA, 22 bp, Artificial Sequence
  chemically synthesized
ttttcttcttttttagtctggc

SEQ ID NO: 1220539 - DNA, 22 bp, Artificial Sequence
  chemically synthesized
ttcttcttttttagtctggcta

SEQ ID NO: 1220540 - DNA, 22 bp, Artificial Sequence
  chemically synthesized
tcttcttttttagtctggctag

SEQ ID NO: 1220541 - DNA, 22 bp, Artificial Sequence
  chemically synthesized
cttcttttttagtctggctagc

SEQ ID NO: 1220542 - DNA, 22 bp, Artificial Sequence
  chemically synthesized
acaaaatagatggctagccaga

SEQ ID NO: 1220543 - DNA, 22 bp, Artificial Sequence
  chemically synthesized
ttcttttttagtctggctagcc

SEQ ID NO: 1220544 - DNA, 22 bp, Artificial Sequence
  chemically synthesized
cttttttagtctggctagccat

SEQ ID NO: 1220545 - DNA, 22 bp, Artificial Sequence
  chemically synthesized
ttttttagtctggctagccatc

SEQ ID NO: 1220546 - DNA, 22 bp, Artificial Sequence
  chemically synthesized
ttttagtctggctagccatcta

SEQ ID NO: 1220547 - DNA, 22 bp, Artificial Sequence
  chemically synthesized
tttagtctggctagccatctat

SEQ ID NO: 1220548 - DNA, 22 bp, Artificial Sequence
  chemically synthesized
ttagtctggctagccatctatt

SEQ ID NO: 1220549 - DNA, 22 bp, Artificial Sequence
  chemically synthesized
tagtctggctagccatctattt

SEQ ID NO: 1220550 - DNA, 22 bp, Artificial Sequence
  chemically synthesized
aaaagattaacaaaatagatgg

SEQ ID NO: 1220551 - DNA, 22 bp, Artificial Sequence
  chemically synthesized
agtctggctagccatctatttt

SEQ ID NO: 1220552 - DNA, 22 bp, Artificial Sequence
  chemically synthesized
gaaaagattaacaaaatagatg

SEQ ID NO: 1220553 - DNA, 22 bp, Artificial Sequence
  chemically synthesized
gtctggctagccatctattttg

SEQ ID NO: 1220554 - DNA, 22 bp, Artificial Sequence
  chemically synthesized
tgaaaagattaacaaaatagat

SEQ ID NO: 1220555 - DNA, 22 bp, Artificial Sequence
  chemically synthesized
ttgaaaagattaacaaaataga

SEQ ID NO: 1220556 - DNA, 22 bp, Artificial Sequence
  chemically synthesized
tttgaaaagattaacaaaatag

SEQ ID NO: 1220557 - DNA, 22 bp, Artificial Sequence
  chemically synthesized
ttttgaaaagattaacaaaata

SEQ ID NO: 1220558 - DNA, 22 bp, Artificial Sequence
  chemically synthesized
gctagccatctattttgttaat

SEQ ID NO: 1220559 - DNA, 22 bp, Artificial Sequence
  chemically synthesized
tttttttgaaaagattaacaaa

SEQ ID NO: 1220560 - DNA, 22 bp, Artificial Sequence
  chemically synthesized
gccatctattttgttaatcttt

SEQ ID NO: 1220561 - DNA, 22 bp, Artificial Sequence
  chemically synthesized
aggagctgtttttttgaaaaga

SEQ ID NO: 1220562 - DNA, 22 bp, Artificial Sequence
  chemically synthesized
ttttgttaatcttttcaaaaaa

SEQ ID NO: 1220563 - DNA, 22 bp, Artificial Sequence
  chemically synthesized
aattcaggagctgtttttttga

SEQ ID NO: 1220564 - DNA, 22 bp, Artificial Sequence
  chemically synthesized
tgttaatcttttcaaaaaaaca

SEQ ID NO: 1220565 - DNA, 22 bp, Artificial Sequence
  chemically synthesized
gttaatcttttcaaaaaaacag

SEQ ID NO: 1220566 - DNA, 22 bp, Artificial Sequence
  chemically synthesized
ttaatcttttcaaaaaaacagc

SEQ ID NO: 1220567 - DNA, 22 bp, Artificial Sequence
  chemically synthesized
atcttttcaaaaaaacagctcc

SEQ ID NO: 1220568 - DNA, 22 bp, Artificial Sequence
  chemically synthesized
ttcaaaaaaacagctcctgaat

SEQ ID NO: 1220569 - DNA, 22 bp, Artificial Sequence
  chemically synthesized
tcaaaaaaacagctcctgaatt

SEQ ID NO: 1220570 - DNA, 22 bp, Artificial Sequence
  chemically synthesized
caaaaaaacagctcctgaattg

SEQ ID NO: 1220571 - DNA, 22 bp, Artificial Sequence
  chemically synthesized
aaaaaaacagctcctgaattga

SEQ ID NO: 1220572 - DNA, 22 bp, Artificial Sequence
  chemically synthesized
aaaaaaaaaaactcaattcagg

SEQ ID NO: 1220573 - DNA, 22 bp, Artificial Sequence
  chemically synthesized
aaaaaaaaaaaactcaattcag

SEQ ID NO: 1220574 - DNA, 22 bp, Artificial Sequence
  chemically synthesized
ctgaattgagtttttttttttt

SEQ ID NO: 1220575 - DNA, 22 bp, Artificial Sequence
  chemically synthesized
aattgagttttttttttttaag

SEQ ID NO: 1220576 - DNA, 22 bp, Artificial Sequence
  chemically synthesized
agttttttttttttaagggttt

SEQ ID NO: 1220577 - DNA, 22 bp, Artificial Sequence
  chemically synthesized
tttttttttaagggtttttcgt

SEQ ID NO: 1220578 - DNA, 22 bp, Artificial Sequence
  chemically synthesized
ttttttttaagggtttttcgtg

SEQ ID NO: 1220579 - DNA, 22 bp, Artificial Sequence
  chemically synthesized
tttttttaagggtttttcgtgt

SEQ ID NO: 1220580 - DNA, 22 bp, Artificial Sequence
  chemically synthesized
aaggagatagagacacgaaaaa

SEQ ID NO: 1220581 - DNA, 22 bp, Artificial Sequence
  chemically synthesized
ttttttaagggtttttcgtgtc

SEQ ID NO: 1220582 - DNA, 22 bp, Artificial Sequence
  chemically synthesized
tttttaagggtttttcgtgtct

SEQ ID NO: 1220583 - DNA, 22 bp, Artificial Sequence
  chemically synthesized
ttttaagggtttttcgtgtctc

SEQ ID NO: 1220584 - DNA, 22 bp, Artificial Sequence
  chemically synthesized
tttaagggtttttcgtgtctct

SEQ ID NO: 1220585 - DNA, 22 bp, Artificial Sequence
  chemically synthesized
ttaagggtttttcgtgtctcta

SEQ ID NO: 1220586 - DNA, 22 bp, Artificial Sequence
  chemically synthesized
taagggtttttcgtgtctctat

SEQ ID NO: 1220587 - DNA, 22 bp, Artificial Sequence
  chemically synthesized
aagggtttttcgtgtctctatc

SEQ ID NO: 1220588 - DNA, 22 bp, Artificial Sequence
  chemically synthesized
agggtttttcgtgtctctatct

SEQ ID NO: 1220589 - DNA, 22 bp, Artificial Sequence
  chemically synthesized
agagcagaactgaaggagatag

SEQ ID NO: 1220590 - DNA, 22 bp, Artificial Sequence
  chemically synthesized
ttcgtgtctctatctccttcag

SEQ ID NO: 1220591 - DNA, 22 bp, Artificial Sequence
  chemically synthesized
tcgtgtctctatctccttcagt

SEQ ID NO: 1220592 - DNA, 22 bp, Artificial Sequence
  chemically synthesized
cgtgtctctatctccttcagtt

SEQ ID NO: 1220593 - DNA, 22 bp, Artificial Sequence
  chemically synthesized
gtgtctctatctccttcagttc

SEQ ID NO: 1220594 - DNA, 22 bp, Artificial Sequence
  chemically synthesized
tatctccttcagttctgctctt

SEQ ID NO: 1220595 - DNA, 22 bp, Artificial Sequence
  chemically synthesized
tctccttcagttctgctcttag

SEQ ID NO: 1220596 - DNA, 22 bp, Artificial Sequence
  chemically synthesized
tcagaagacaaataactaagag

SEQ ID NO: 1220597 - DNA, 22 bp, Artificial Sequence
  chemically synthesized
cttcagttctgctcttagttat

SEQ ID NO: 1220598 - DNA, 22 bp, Artificial Sequence
  chemically synthesized
cagttctgctcttagttatttg

SEQ ID NO: 1220599 - DNA, 22 bp, Artificial Sequence
  chemically synthesized
agttctgctcttagttatttgt

SEQ ID NO: 1220600 - DNA, 22 bp, Artificial Sequence
  chemically synthesized
aaaagctatcagaagacaaata

SEQ ID NO: 1220601 - DNA, 22 bp, Artificial Sequence
  chemically synthesized
tgctcttagttatttgtcttct

SEQ ID NO: 1220602 - DNA, 22 bp, Artificial Sequence
  chemically synthesized
ctcttagttatttgtcttctga

SEQ ID NO: 1220603 - DNA, 22 bp, Artificial Sequence
  chemically synthesized
ttagttatttgtcttctgatag

SEQ ID NO: 1220604 - DNA, 22 bp, Artificial Sequence
  chemically synthesized
agttatttgtcttctgatagct

SEQ ID NO: 1220605 - DNA, 22 bp, Artificial Sequence
  chemically synthesized
gttatttgtcttctgatagctt

SEQ ID NO: 1220606 - DNA, 22 bp, Artificial Sequence
  chemically synthesized
tttgtcttctgatagcttttga

SEQ ID NO: 1220607 - DNA, 22 bp, Artificial Sequence
  chemically synthesized
gtcttctgatagcttttgaatt

SEQ ID NO: 1220608 - DNA, 22 bp, Artificial Sequence
  chemically synthesized
tcttctgatagcttttgaattt

SEQ ID NO: 1220609 - DNA, 22 bp, Artificial Sequence
  chemically synthesized
ctgatagcttttgaatttgttt

SEQ ID NO: 1220610 - DNA, 22 bp, Artificial Sequence
  chemically synthesized
tgatagcttttgaatttgtttg

SEQ ID NO: 1220611 - DNA, 22 bp, Artificial Sequence
  chemically synthesized
gagcagcaagagcaaacaaatt

SEQ ID NO: 1220612 - DNA, 22 bp, Artificial Sequence
  chemically synthesized
atagcttttgaatttgtttgct

SEQ ID NO: 1220613 - DNA, 22 bp, Artificial Sequence
  chemically synthesized
ttgaatttgtttgctcttgctg

SEQ ID NO: 1220614 - DNA, 22 bp, Artificial Sequence
  chemically synthesized
aatgaactagagcagcaagagc

SEQ ID NO: 1220615 - DNA, 22 bp, Artificial Sequence
  chemically synthesized
tgaatttgtttgctcttgctgc

SEQ ID NO: 1220616 - DNA, 22 bp, Artificial Sequence
  chemically synthesized
gaatttgtttgctcttgctgct

SEQ ID NO: 1220617 - DNA, 22 bp, Artificial Sequence
  chemically synthesized
aatttgtttgctcttgctgctc

SEQ ID NO: 1220618 - DNA, 22 bp, Artificial Sequence
  chemically synthesized
gtttgctcttgctgctctagtt

SEQ ID NO: 1220619 - DNA, 22 bp, Artificial Sequence
  chemically synthesized
tttgctcttgctgctctagttc

SEQ ID NO: 1220620 - DNA, 22 bp, Artificial Sequence
  chemically synthesized
gctcttgctgctctagttcatt

SEQ ID NO: 1220621 - DNA, 22 bp, Artificial Sequence
  chemically synthesized
acatcacaattaaatgaactag

SEQ ID NO: 1220622 - DNA, 22 bp, Artificial Sequence
  chemically synthesized
ctcttgctgctctagttcattt

SEQ ID NO: 1220623 - DNA, 22 bp, Artificial Sequence
  chemically synthesized
ttgctgctctagttcatttaat

SEQ ID NO: 1220624 - DNA, 22 bp, Artificial Sequence
  chemically synthesized
gctgctctagttcatttaattg

SEQ ID NO: 1220625 - DNA, 22 bp, Artificial Sequence
  chemically synthesized
ctgctctagttcatttaattgt

SEQ ID NO: 1220626 - DNA, 22 bp, Artificial Sequence
  chemically synthesized
ctctagttcatttaattgtgat

SEQ ID NO: 1220627 - DNA, 22 bp, Artificial Sequence
  chemically synthesized
tagttcatttaattgtgatgtt

SEQ ID NO: 1220628 - DNA, 22 bp, Artificial Sequence
  chemically synthesized
taatcgacatcctaacatcaca

SEQ ID NO: 1220629 - DNA, 22 bp, Artificial Sequence
  chemically synthesized
gttcatttaattgtgatgttag

SEQ ID NO: 1220630 - DNA, 22 bp, Artificial Sequence
  chemically synthesized
atttaattgtgatgttaggatg

SEQ ID NO: 1220631 - DNA, 22 bp, Artificial Sequence
  chemically synthesized
aattgtgatgttaggatgtcga

SEQ ID NO: 1220632 - DNA, 22 bp, Artificial Sequence
  chemically synthesized
attgtgatgttaggatgtcgat

SEQ ID NO: 1220633 - DNA, 22 bp, Artificial Sequence
  chemically synthesized
tgatgttaggatgtcgattata

SEQ ID NO: 1220634 - DNA, 22 bp, Artificial Sequence
  chemically synthesized
ggatgtcgattatagatctttc

SEQ ID NO: 1220635 - DNA, 22 bp, Artificial Sequence
  chemically synthesized
aatgcccacaggagaaagtggg

SEQ ID NO: 1220636 - DNA, 22 bp, Artificial Sequence
  chemically synthesized
tagatctttcccactttctcct

SEQ ID NO: 1220637 - DNA, 22 bp, Artificial Sequence
  chemically synthesized
tagcactaaatgcccacaggag

SEQ ID NO: 1220638 - DNA, 22 bp, Artificial Sequence
  chemically synthesized
atagcactaaatgcccacagga

SEQ ID NO: 1220639 - DNA, 22 bp, Artificial Sequence
  chemically synthesized
tcccactttctcctgtgggcat

SEQ ID NO: 1220640 - DNA, 22 bp, Artificial Sequence
  chemically synthesized
cccactttctcctgtgggcatt

SEQ ID NO: 1220641 - DNA, 22 bp, Artificial Sequence
  chemically synthesized
ccactttctcctgtgggcattt

SEQ ID NO: 1220642 - DNA, 22 bp, Artificial Sequence
  chemically synthesized
tctcctgtgggcatttagtgct

SEQ ID NO: 1220643 - DNA, 22 bp, Artificial Sequence
  chemically synthesized
ctcctgtgggcatttagtgcta

SEQ ID NO: 1220644 - DNA, 22 bp, Artificial Sequence
  chemically synthesized
tcctgtgggcatttagtgctat

SEQ ID NO: 1220645 - DNA, 22 bp, Artificial Sequence
  chemically synthesized
ctgtgggcatttagtgctataa

SEQ ID NO: 1220646 - DNA, 22 bp, Artificial Sequence
  chemically synthesized
gaagagggaaatttatagcact

SEQ ID NO: 1220647 - DNA, 22 bp, Artificial Sequence
  chemically synthesized
agaagagggaaatttatagcac

SEQ ID NO: 1220648 - DNA, 22 bp, Artificial Sequence
  chemically synthesized
tgggcatttagtgctataaatt

SEQ ID NO: 1220649 - DNA, 22 bp, Artificial Sequence
  chemically synthesized
agtgctataaatttccctcttc

SEQ ID NO: 1220650 - DNA, 22 bp, Artificial Sequence
  chemically synthesized
aagaagtgtttagaagagggaa

SEQ ID NO: 1220651 - DNA, 22 bp, Artificial Sequence
  chemically synthesized
gtgctataaatttccctcttct

SEQ ID NO: 1220652 - DNA, 22 bp, Artificial Sequence
  chemically synthesized
taaatttccctcttctaaacac

SEQ ID NO: 1220653 - DNA, 22 bp, Artificial Sequence
  chemically synthesized
tgggacacagctaaagaagtgt

SEQ ID NO: 1220654 - DNA, 22 bp, Artificial Sequence
  chemically synthesized
ccctcttctaaacacttcttta

SEQ ID NO: 1220655 - DNA, 22 bp, Artificial Sequence
  chemically synthesized
cctcttctaaacacttctttag

SEQ ID NO: 1220656 - DNA, 22 bp, Artificial Sequence
  chemically synthesized
ttctaaacacttctttagctgt

SEQ ID NO: 1220657 - DNA, 22 bp, Artificial Sequence
  chemically synthesized
ctaaacacttctttagctgtgt

SEQ ID NO: 1220658 - DNA, 22 bp, Artificial Sequence
  chemically synthesized
taaacacttctttagctgtgtc

SEQ ID NO: 1220659 - DNA, 22 bp, Artificial Sequence
  chemically synthesized
aacacttctttagctgtgtccc

SEQ ID NO: 1220660 - DNA, 22 bp, Artificial Sequence
  chemically synthesized
ctttagctgtgtcccacagatt

SEQ ID NO: 1220661 - DNA, 22 bp, Artificial Sequence
  chemically synthesized
tttagctgtgtcccacagattc

SEQ ID NO: 1220662 - DNA, 22 bp, Artificial Sequence
  chemically synthesized
tagctgtgtcccacagattctg

SEQ ID NO: 1220663 - DNA, 22 bp, Artificial Sequence
  chemically synthesized
agctgtgtcccacagattctgc

SEQ ID NO: 1220664 - DNA, 22 bp, Artificial Sequence
  chemically synthesized
gctgtgtcccacagattctgct

SEQ ID NO: 1220665 - DNA, 22 bp, Artificial Sequence
  chemically synthesized
tgtcccacagattctgctacat

SEQ ID NO: 1220666 - DNA, 22 bp, Artificial Sequence
  chemically synthesized
aaaccaatgagaacaaacacac

SEQ ID NO: 1220667 - DNA, 22 bp, Artificial Sequence
  chemically synthesized
gaaaccaatgagaacaaacaca

SEQ ID NO: 1220668 - DNA, 22 bp, Artificial Sequence
  chemically synthesized
tgaaaccaatgagaacaaacac

SEQ ID NO: 1220669 - DNA, 22 bp, Artificial Sequence
  chemically synthesized
tgctacattgtgtgtttgttct

SEQ ID NO: 1220670 - DNA, 22 bp, Artificial Sequence
  chemically synthesized
tttgaaaccaatgagaacaaac

SEQ ID NO: 1220671 - DNA, 22 bp, Artificial Sequence
  chemically synthesized
ctacattgtgtgtttgttctca

SEQ ID NO: 1220672 - DNA, 22 bp, Artificial Sequence
  chemically synthesized
cattgtgtgtttgttctcattg

SEQ ID NO: 1220673 - DNA, 22 bp, Artificial Sequence
  chemically synthesized
tgtgtttgttctcattggtttc

SEQ ID NO: 1220674 - DNA, 22 bp, Artificial Sequence
  chemically synthesized
gttctcattggtttcaaagaac

SEQ ID NO: 1220675 - DNA, 22 bp, Artificial Sequence
  chemically synthesized
ttctcattggtttcaaagaact

SEQ ID NO: 1220676 - DNA, 22 bp, Artificial Sequence
  chemically synthesized
tcattggtttcaaagaacttat

SEQ ID NO: 1220677 - DNA, 22 bp, Artificial Sequence
  chemically synthesized
aggcagaaataaataagttctt

SEQ ID NO: 1220678 - DNA, 22 bp, Artificial Sequence
  chemically synthesized
attggtttcaaagaacttattt

SEQ ID NO: 1220679 - DNA, 22 bp, Artificial Sequence
  chemically synthesized
gtttcaaagaacttatttattt

SEQ ID NO: 1220680 - DNA, 22 bp, Artificial Sequence
  chemically synthesized
caaagaacttatttatttctgc

SEQ ID NO: 1220681 - DNA, 22 bp, Artificial Sequence
  chemically synthesized
aaagaacttatttatttctgcc

SEQ ID NO: 1220682 - DNA, 22 bp, Artificial Sequence
  chemically synthesized
ggtaaataatgaaattaaggca

SEQ ID NO: 1220683 - DNA, 22 bp, Artificial Sequence
  chemically synthesized
atttatttctgccttaatttca

SEQ ID NO: 1220684 - DNA, 22 bp, Artificial Sequence
  chemically synthesized
ctgggtaaataatgaaattaag

SEQ ID NO: 1220685 - DNA, 22 bp, Artificial Sequence
  chemically synthesized
tttatttctgccttaatttcat

SEQ ID NO: 1220686 - DNA, 22 bp, Artificial Sequence
  chemically synthesized
atttctgccttaatttcattat

SEQ ID NO: 1220687 - DNA, 22 bp, Artificial Sequence
  chemically synthesized
tttctgccttaatttcattatt

SEQ ID NO: 1220688 - DNA, 22 bp, Artificial Sequence
  chemically synthesized
ctgccttaatttcattatttac

SEQ ID NO: 1220689 - DNA, 22 bp, Artificial Sequence
  chemically synthesized
ggtgactactgggtaaataatg

SEQ ID NO: 1220690 - DNA, 22 bp, Artificial Sequence
  chemically synthesized
tgccttaatttcattatttacc

SEQ ID NO: 1220691 - DNA, 22 bp, Artificial Sequence
  chemically synthesized
ccttaatttcattatttaccca

SEQ ID NO: 1220692 - DNA, 22 bp, Artificial Sequence
  chemically synthesized
ctgggtgactactgggtaaata

SEQ ID NO: 1220693 - DNA, 22 bp, Artificial Sequence
  chemically synthesized
ctcctgggtgactactgggtaa

SEQ ID NO: 1220694 - DNA, 22 bp, Artificial Sequence
  chemically synthesized
aatttcattatttacccagtag

SEQ ID NO: 1220695 - DNA, 22 bp, Artificial Sequence
  chemically synthesized
atttcattatttacccagtagt

SEQ ID NO: 1220696 - DNA, 22 bp, Artificial Sequence
  chemically synthesized
cattatttacccagtagtcacc

SEQ ID NO: 1220697 - DNA, 22 bp, Artificial Sequence
  chemically synthesized
attatttacccagtagtcaccc

SEQ ID NO: 1220698 - DNA, 22 bp, Artificial Sequence
  chemically synthesized
aacaaacctgctcctgggtgac

SEQ ID NO: 1220699 - DNA, 22 bp, Artificial Sequence
  chemically synthesized
tttacccagtagtcacccagga

SEQ ID NO: 1220700 - DNA, 22 bp, Artificial Sequence
  chemically synthesized
acccagtagtcacccaggagca

SEQ ID NO: 1220701 - DNA, 22 bp, Artificial Sequence
  chemically synthesized
cccagtagtcacccaggagcag

SEQ ID NO: 1220702 - DNA, 22 bp, Artificial Sequence
  chemically synthesized
catggaagctgaacaaacctgc

SEQ ID NO: 1220703 - DNA, 22 bp, Artificial Sequence
  chemically synthesized
aaaagtgcacaactacatggaa

SEQ ID NO: 1220704 - DNA, 22 bp, Artificial Sequence
  chemically synthesized
gttcagcttccatgtagttgtg

SEQ ID NO: 1220705 - DNA, 22 bp, Artificial Sequence
  chemically synthesized
ttcagcttccatgtagttgtgc

SEQ ID NO: 1220706 - DNA, 22 bp, Artificial Sequence
  chemically synthesized
agaaactcaaaagtgcacaact

SEQ ID NO: 1220707 - DNA, 22 bp, Artificial Sequence
  chemically synthesized
agcttccatgtagttgtgcact

SEQ ID NO: 1220708 - DNA, 22 bp, Artificial Sequence
  chemically synthesized
ccatgtagttgtgcacttttga

SEQ ID NO: 1220709 - DNA, 22 bp, Artificial Sequence
  chemically synthesized
catgtagttgtgcacttttgag

SEQ ID NO: 1220710 - DNA, 22 bp, Artificial Sequence
  chemically synthesized
gaatgcgggattaagaaactca

SEQ ID NO: 1220711 - DNA, 22 bp, Artificial Sequence
  chemically synthesized
tgcacttttgagtttcttaatc

SEQ ID NO: 1220712 - DNA, 22 bp, Artificial Sequence
  chemically synthesized
attagaatgcgggattaagaaa

SEQ ID NO: 1220713 - DNA, 22 bp, Artificial Sequence
  chemically synthesized
ttgagtttcttaatcccgcatt

SEQ ID NO: 1220714 - DNA, 22 bp, Artificial Sequence
  chemically synthesized
tgagtttcttaatcccgcattc

SEQ ID NO: 1220715 - DNA, 22 bp, Artificial Sequence
  chemically synthesized
gagtttcttaatcccgcattct

SEQ ID NO: 1220716 - DNA, 22 bp, Artificial Sequence
  chemically synthesized
agtttcttaatcccgcattcta

SEQ ID NO: 1220717 - DNA, 22 bp, Artificial Sequence
  chemically synthesized
cttaatcccgcattctaattag

SEQ ID NO: 1220718 - DNA, 22 bp, Artificial Sequence
  chemically synthesized
ttaatcccgcattctaattaga

SEQ ID NO: 1220719 - DNA, 22 bp, Artificial Sequence
  chemically synthesized
aatcccgcattctaattagatt

SEQ ID NO: 1220720 - DNA, 22 bp, Artificial Sequence
  chemically synthesized
agatcacagtgcaatctaatta

SEQ ID NO: 1220721 - DNA, 22 bp, Artificial Sequence
  chemically synthesized
atcccgcattctaattagattg

SEQ ID NO: 1220722 - DNA, 22 bp, Artificial Sequence
  chemically synthesized
tcagatcacagtgcaatctaat

SEQ ID NO: 1220723 - DNA, 22 bp, Artificial Sequence
  chemically synthesized
taattagattgcactgtgatct

SEQ ID NO: 1220724 - DNA, 22 bp, Artificial Sequence
  chemically synthesized
attagattgcactgtgatctga

SEQ ID NO: 1220725 - DNA, 22 bp, Artificial Sequence
  chemically synthesized
gattgcactgtgatctgagagg

SEQ ID NO: 1220726 - DNA, 22 bp, Artificial Sequence
  chemically synthesized
cactgtgatctgagaggctgtt

SEQ ID NO: 1220727 - DNA, 22 bp, Artificial Sequence
  chemically synthesized
tgatctgagaggctgttatgat

SEQ ID NO: 1220728 - DNA, 22 bp, Artificial Sequence
  chemically synthesized
agaggctgttatgattttcatt

SEQ ID NO: 1220729 - DNA, 22 bp, Artificial Sequence
  chemically synthesized
agcaaatgcaaaagaatgaaaa

SEQ ID NO: 1220730 - DNA, 22 bp, Artificial Sequence
  chemically synthesized
ctcagcaaatgcaaaagaatga

SEQ ID NO: 1220731 - DNA, 22 bp, Artificial Sequence
  chemically synthesized
ttatgattttcattcttttgca

SEQ ID NO: 1220732 - DNA, 22 bp, Artificial Sequence
  chemically synthesized
tgattttcattcttttgcattt

SEQ ID NO: 1220733 - DNA, 22 bp, Artificial Sequence
  chemically synthesized
tcattcttttgcatttgctgag

SEQ ID NO: 1220734 - DNA, 22 bp, Artificial Sequence
  chemically synthesized
cattcttttgcatttgctgagg

SEQ ID NO: 1220735 - DNA, 22 bp, Artificial Sequence
  chemically synthesized
attcttttgcatttgctgagga

SEQ ID NO: 1220736 - DNA, 22 bp, Artificial Sequence
  chemically synthesized
gaagtaaaatactcctcagcaa

SEQ ID NO: 1220737 - DNA, 22 bp, Artificial Sequence
  chemically synthesized
ttttgcatttgctgaggagtat

SEQ ID NO: 1220738 - DNA, 22 bp, Artificial Sequence
  chemically synthesized
ttgcatttgctgaggagtattt

SEQ ID NO: 1220739 - DNA, 22 bp, Artificial Sequence
  chemically synthesized
tgcatttgctgaggagtatttt

SEQ ID NO: 1220740 - DNA, 22 bp, Artificial Sequence
  chemically synthesized
gcatttgctgaggagtatttta

SEQ ID NO: 1220741 - DNA, 22 bp, Artificial Sequence
  chemically synthesized
catttgctgaggagtattttac

SEQ ID NO: 1220742 - DNA, 22 bp, Artificial Sequence
  chemically synthesized
acgacataattggaagtaaaat

SEQ ID NO: 1220743 - DNA, 22 bp, Artificial Sequence
  chemically synthesized
gctgaggagtattttacttcca

SEQ ID NO: 1220744 - DNA, 22 bp, Artificial Sequence
  chemically synthesized
ctgaggagtattttacttccaa

SEQ ID NO: 1220745 - DNA, 22 bp, Artificial Sequence
  chemically synthesized
aggagtattttacttccaatta

SEQ ID NO: 1220746 - DNA, 22 bp, Artificial Sequence
  chemically synthesized
aaattgacgacataattggaag

SEQ ID NO: 1220747 - DNA, 22 bp, Artificial Sequence
  chemically synthesized
taaaattgacgacataattgga

SEQ ID NO: 1220748 - DNA, 22 bp, Artificial Sequence
  chemically synthesized
ttctaaaattgacgacataatt

SEQ ID NO: 1220749 - DNA, 22 bp, Artificial Sequence
  chemically synthesized
attctaaaattgacgacataat

SEQ ID NO: 1220750 - DNA, 22 bp, Artificial Sequence
  chemically synthesized
tacttccaattatgtcgtcaat

SEQ ID NO: 1220751 - DNA, 22 bp, Artificial Sequence
  chemically synthesized
acttccaattatgtcgtcaatt

SEQ ID NO: 1220752 - DNA, 22 bp, Artificial Sequence
  chemically synthesized
cacttattctaaaattgacgac

SEQ ID NO: 1220753 - DNA, 22 bp, Artificial Sequence
  chemically synthesized
cttccaattatgtcgtcaattt

SEQ ID NO: 1220754 - DNA, 22 bp, Artificial Sequence
  chemically synthesized
ccaattatgtcgtcaattttag

SEQ ID NO: 1220755 - DNA, 22 bp, Artificial Sequence
  chemically synthesized
caattatgtcgtcaattttaga

SEQ ID NO: 1220756 - DNA, 22 bp, Artificial Sequence
  chemically synthesized
tgtcgtcaattttagaataagt

SEQ ID NO: 1220757 - DNA, 22 bp, Artificial Sequence
  chemically synthesized
agcaccacattgcacttattct

SEQ ID NO: 1220758 - DNA, 22 bp, Artificial Sequence
  chemically synthesized
tcagcaccacattgcacttatt

SEQ ID NO: 1220759 - DNA, 22 bp, Artificial Sequence
  chemically synthesized
ctcagcaccacattgcacttat

SEQ ID NO: 1220760 - DNA, 22 bp, Artificial Sequence
  chemically synthesized
ttctcagcaccacattgcactt

SEQ ID NO: 1220761 - DNA, 22 bp, Artificial Sequence
  chemically synthesized
tagaataagtgcaatgtggtgc

SEQ ID NO: 1220762 - DNA, 22 bp, Artificial Sequence
  chemically synthesized
agaataagtgcaatgtggtgct

SEQ ID NO: 1220763 - DNA, 22 bp, Artificial Sequence
  chemically synthesized
gaataagtgcaatgtggtgctg

SEQ ID NO: 1220764 - DNA, 22 bp, Artificial Sequence
  chemically synthesized
caccccaaatcaacagaatata

SEQ ID NO: 1220765 - DNA, 22 bp, Artificial Sequence
  chemically synthesized
tccaccccaaatcaacagaata

SEQ ID NO: 1220766 - DNA, 22 bp, Artificial Sequence
  chemically synthesized
agaagaatgtatattctgttga

SEQ ID NO: 1220767 - DNA, 22 bp, Artificial Sequence
  chemically synthesized
cagaactctccaccccaaatca

SEQ ID NO: 1220768 - DNA, 22 bp, Artificial Sequence
  chemically synthesized
tgttgatttggggtggagagtt

SEQ ID NO: 1220769 - DNA, 22 bp, Artificial Sequence
  chemically synthesized
ttgatttggggtggagagttct

SEQ ID NO: 1220770 - DNA, 22 bp, Artificial Sequence
  chemically synthesized
atagacatctacagaactctcc

SEQ ID NO: 1220771 - DNA, 22 bp, Artificial Sequence
  chemically synthesized
atttggggtggagagttctgta

SEQ ID NO: 1220772 - DNA, 22 bp, Artificial Sequence
  chemically synthesized
ggggtggagagttctgtagatg

SEQ ID NO: 1220773 - DNA, 22 bp, Artificial Sequence
  chemically synthesized
gggtggagagttctgtagatgt

SEQ ID NO: 1220774 - DNA, 22 bp, Artificial Sequence
  chemically synthesized
gaccaagcagacctaatagaca

SEQ ID NO: 1220775 - DNA, 22 bp, Artificial Sequence
  chemically synthesized
tggaccaagcagacctaataga

SEQ ID NO: 1220776 - DNA, 22 bp, Artificial Sequence
  chemically synthesized
tgtagatgtctattaggtctgc

SEQ ID NO: 1220777 - DNA, 22 bp, Artificial Sequence
  chemically synthesized
agctctggaccaagcagaccta

SEQ ID NO: 1220778 - DNA, 22 bp, Artificial Sequence
  chemically synthesized
tagatgtctattaggtctgctt

SEQ ID NO: 1220779 - DNA, 22 bp, Artificial Sequence
  chemically synthesized
agctcagctctggaccaagcag

SEQ ID NO: 1220780 - DNA, 22 bp, Artificial Sequence
  chemically synthesized
gagctcagctctggaccaagca

SEQ ID NO: 1220781 - DNA, 22 bp, Artificial Sequence
  chemically synthesized
ttaggtctgcttggtccagagc

SEQ ID NO: 1220782 - DNA, 22 bp, Artificial Sequence
  chemically synthesized
agtacttgagctcagctctgga

SEQ ID NO: 1220783 - DNA, 22 bp, Artificial Sequence
  chemically synthesized
ggtctgcttggtccagagctga

SEQ ID NO: 1220784 - DNA, 22 bp, Artificial Sequence
  chemically synthesized
cttggtccagagctgagctcaa

SEQ ID NO: 1220785 - DNA, 22 bp, Artificial Sequence
  chemically synthesized
ggtccagagctgagctcaagta

SEQ ID NO: 1220786 - DNA, 22 bp, Artificial Sequence
  chemically synthesized
gtccagagctgagctcaagtac

SEQ ID NO: 1220787 - DNA, 22 bp, Artificial Sequence
  chemically synthesized
aaaaggatattcagtacttgag

SEQ ID NO: 1220788 - DNA, 22 bp, Artificial Sequence
  chemically synthesized
agctcaagtactgaatatcctt

SEQ ID NO: 1220789 - DNA, 22 bp, Artificial Sequence
  chemically synthesized
aagtactgaatatcctttttaa

SEQ ID NO: 1220790 - DNA, 22 bp, Artificial Sequence
  chemically synthesized
aatatcctttttaattttctgt

SEQ ID NO: 1220791 - DNA, 22 bp, Artificial Sequence
  chemically synthesized
gacagatcaacgagacagaaaa

SEQ ID NO: 1220792 - DNA, 22 bp, Artificial Sequence
  chemically synthesized
tttaattttctgtctcgttgat

SEQ ID NO: 1220793 - DNA, 22 bp, Artificial Sequence
  chemically synthesized
ttaattttctgtctcgttgatc

SEQ ID NO: 1220794 - DNA, 22 bp, Artificial Sequence
  chemically synthesized
taattttctgtctcgttgatct

SEQ ID NO: 1220795 - DNA, 22 bp, Artificial Sequence
  chemically synthesized
tcaatattagacagatcaacga

SEQ ID NO: 1220796 - DNA, 22 bp, Artificial Sequence
  chemically synthesized
aattttctgtctcgttgatctg

SEQ ID NO: 1220797 - DNA, 22 bp, Artificial Sequence
  chemically synthesized
attttctgtctcgttgatctgt

SEQ ID NO: 1220798 - DNA, 22 bp, Artificial Sequence
  chemically synthesized
tctgtctcgttgatctgtctaa

SEQ ID NO: 1220799 - DNA, 22 bp, Artificial Sequence
  chemically synthesized
ctgtctcgttgatctgtctaat

SEQ ID NO: 1220800 - DNA, 22 bp, Artificial Sequence
  chemically synthesized
tgtctcgttgatctgtctaata

SEQ ID NO: 1220801 - DNA, 22 bp, Artificial Sequence
  chemically synthesized
tctcgttgatctgtctaatatt

SEQ ID NO: 1220802 - DNA, 22 bp, Artificial Sequence
  chemically synthesized
gttgatctgtctaatattgaca

SEQ ID NO: 1220803 - DNA, 22 bp, Artificial Sequence
  chemically synthesized
aacacaccccactgtcaatatt

SEQ ID NO: 1220804 - DNA, 22 bp, Artificial Sequence
  chemically synthesized
gaacacaccccactgtcaatat

SEQ ID NO: 1220805 - DNA, 22 bp, Artificial Sequence
  chemically synthesized
atctgtctaatattgacagtgg

SEQ ID NO: 1220806 - DNA, 22 bp, Artificial Sequence
  chemically synthesized
tctaatattgacagtggggtgt

SEQ ID NO: 1220807 - DNA, 22 bp, Artificial Sequence
  chemically synthesized
atattgacagtggggtgtgttc

SEQ ID NO: 1220808 - DNA, 22 bp, Artificial Sequence
  chemically synthesized
acagtggggtgtgttcaagtct

SEQ ID NO: 1220809 - DNA, 22 bp, Artificial Sequence
  chemically synthesized
ccacacaataatagtgggagac

SEQ ID NO: 1220810 - DNA, 22 bp, Artificial Sequence
  chemically synthesized
gactcccacacaataatagtgg

SEQ ID NO: 1220811 - DNA, 22 bp, Artificial Sequence
  chemically synthesized
aagtctcccactattattgtgt

SEQ ID NO: 1220812 - DNA, 22 bp, Artificial Sequence
  chemically synthesized
ggtattagactcccacacaata

SEQ ID NO: 1220813 - DNA, 22 bp, Artificial Sequence
  chemically synthesized
ccactattattgtgtgggagtc

SEQ ID NO: 1220814 - DNA, 22 bp, Artificial Sequence
  chemically synthesized
ttattgtgtgggagtctaatac

SEQ ID NO: 1220815 - DNA, 22 bp, Artificial Sequence
  chemically synthesized
caggcaccactgggtattagac

SEQ ID NO: 1220816 - DNA, 22 bp, Artificial Sequence
  chemically synthesized
ttgtgtgggagtctaataccca

SEQ ID NO: 1220817 - DNA, 22 bp, Artificial Sequence
  chemically synthesized
tgtgggagtctaatacccagtg

SEQ ID NO: 1220818 - DNA, 22 bp, Artificial Sequence
  chemically synthesized
gcgttccaggcaccactgggta

SEQ ID NO: 1220819 - DNA, 22 bp, Artificial Sequence
  chemically synthesized
gctggcgttccaggcaccactg

SEQ ID NO: 1220820 - DNA, 22 bp, Artificial Sequence
  chemically synthesized
tctcgctggcgttccaggcacc

SEQ ID NO: 1220821 - DNA, 22 bp, Artificial Sequence
  chemically synthesized
tgtctcgctggcgttccaggca

SEQ ID NO: 1220822 - DNA, 22 bp, Artificial Sequence
  chemically synthesized
atacccagtggtgcctggaacg

SEQ ID NO: 1220823 - DNA, 22 bp, Artificial Sequence
  chemically synthesized
gaacgccagcgagacagaaccg

SEQ ID NO: 1220824 - DNA, 22 bp, Artificial Sequence
  chemically synthesized
caggggagtgaacggttctgtc

SEQ ID NO: 1220825 - DNA, 22 bp, Artificial Sequence
  chemically synthesized
ccaggggagtgaacggttctgt

SEQ ID NO: 1220826 - DNA, 22 bp, Artificial Sequence
  chemically synthesized
tccaggggagtgaacggttctg

SEQ ID NO: 1220827 - DNA, 22 bp, Artificial Sequence
  chemically synthesized
agccccctttccaggggagtga

SEQ ID NO: 1220828 - DNA, 22 bp, Artificial Sequence
  chemically synthesized
cagccccctttccaggggagtg

SEQ ID NO: 1220829 - DNA, 22 bp, Artificial Sequence
  chemically synthesized
gtttcagccccctttccagggg

SEQ ID NO: 1220830 - DNA, 22 bp, Artificial Sequence
  chemically synthesized
cctggtttcagccccctttcca

SEQ ID NO: 1220831 - DNA, 22 bp, Artificial Sequence
  chemically synthesized
gctccctggtttcagccccctt

SEQ ID NO: 1220832 - DNA, 22 bp, Artificial Sequence
  chemically synthesized
actcccctggaaagggggctga

SEQ ID NO: 1220833 - DNA, 22 bp, Artificial Sequence
  chemically synthesized
ggctccctggtttcagccccct

SEQ ID NO: 1220834 - DNA, 22 bp, Artificial Sequence
  chemically synthesized
ccctggaaagggggctgaaacc

SEQ ID NO: 1220835 - DNA, 22 bp, Artificial Sequence
  chemically synthesized
accacttggctccctggtttca

SEQ ID NO: 1220836 - DNA, 22 bp, Artificial Sequence
  chemically synthesized
gaccacttggctccctggtttc

SEQ ID NO: 1220837 - DNA, 22 bp, Artificial Sequence
  chemically synthesized
gaaagggggctgaaaccaggga

SEQ ID NO: 1220838 - DNA, 22 bp, Artificial Sequence
  chemically synthesized
aacttgaccacttggctccctg

SEQ ID NO: 1220839 - DNA, 22 bp, Artificial Sequence
  chemically synthesized
ctgaacttgaccacttggctcc

SEQ ID NO: 1220840 - DNA, 22 bp, Artificial Sequence
  chemically synthesized
aaaccagggagccaagtggtca

SEQ ID NO: 1220841 - DNA, 22 bp, Artificial Sequence
  chemically synthesized
gatctgctgaacttgaccactt

SEQ ID NO: 1220842 - DNA, 22 bp, Artificial Sequence
  chemically synthesized
cgtgggcgttggatctgctgaa

SEQ ID NO: 1220843 - DNA, 22 bp, Artificial Sequence
  chemically synthesized
ggctccgtgggcgttggatctg

SEQ ID NO: 1220844 - DNA, 22 bp, Artificial Sequence
  chemically synthesized
ctgggctccgtgggcgttggat

SEQ ID NO: 1220845 - DNA, 22 bp, Artificial Sequence
  chemically synthesized
gctgggctccgtgggcgttgga

SEQ ID NO: 1220846 - DNA, 22 bp, Artificial Sequence
  chemically synthesized
agcttgctgggctccgtgggcg

SEQ ID NO: 1220847 - DNA, 22 bp, Artificial Sequence
  chemically synthesized
agcagatccaacgcccacggag

SEQ ID NO: 1220848 - DNA, 22 bp, Artificial Sequence
  chemically synthesized
caagccagtggatctcagcttg

SEQ ID NO: 1220849 - DNA, 22 bp, Artificial Sequence
  chemically synthesized
gcagcgagaattacaagccagt

SEQ ID NO: 1220850 - DNA, 22 bp, Artificial Sequence
  chemically synthesized
tgctggcagcgagaattacaag

SEQ ID NO: 1220851 - DNA, 22 bp, Artificial Sequence
  chemically synthesized
agatccactggcttgtaattct

SEQ ID NO: 1220852 - DNA, 22 bp, Artificial Sequence
  chemically synthesized
ctgtgctggcagcgagaattac

SEQ ID NO: 1220853 - DNA, 22 bp, Artificial Sequence
  chemically synthesized
agactgctgtgctggcagcgag

SEQ ID NO: 1220854 - DNA, 22 bp, Artificial Sequence
  chemically synthesized
cagactgctgtgctggcagcga

SEQ ID NO: 1220855 - DNA, 22 bp, Artificial Sequence
  chemically synthesized
gcttgtaattctcgctgccagc

SEQ ID NO: 1220856 - DNA, 22 bp, Artificial Sequence
  chemically synthesized
gtaattctcgctgccagcacag

SEQ ID NO: 1220857 - DNA, 22 bp, Artificial Sequence
  chemically synthesized
taattctcgctgccagcacagc

SEQ ID NO: 1220858 - DNA, 22 bp, Artificial Sequence
  chemically synthesized
aggtccacttcagactgctgtg

SEQ ID NO: 1220859 - DNA, 22 bp, Artificial Sequence
  chemically synthesized
tcgctgccagcacagcagtctg

SEQ ID NO: 1220860 - DNA, 22 bp, Artificial Sequence
  chemically synthesized
gctgccagcacagcagtctgaa

SEQ ID NO: 1220861 - DNA, 22 bp, Artificial Sequence
  chemically synthesized
gagcctcaggtccacttcagac

SEQ ID NO: 1220862 - DNA, 22 bp, Artificial Sequence
  chemically synthesized
ccagcacagcagtctgaagtgg

SEQ ID NO: 1220863 - DNA, 22 bp, Artificial Sequence
  chemically synthesized
caccaagctggagcctcaggtc

SEQ ID NO: 1220864 - DNA, 22 bp, Artificial Sequence
  chemically synthesized
cctccaccaagctggagcctca

SEQ ID NO: 1220865 - DNA, 22 bp, Artificial Sequence
  chemically synthesized
aagtggacctgaggctccagct

SEQ ID NO: 1220866 - DNA, 22 bp, Artificial Sequence
  chemically synthesized
aggctccagcttggtggaggga

SEQ ID NO: 1220867 - DNA, 22 bp, Artificial Sequence
  chemically synthesized
cagcttggtggagggaggggcg

SEQ ID NO: 1220868 - DNA, 22 bp, Artificial Sequence
  chemically synthesized
agtaatggcggacgcccctccc

SEQ ID NO: 1220869 - DNA, 22 bp, Artificial Sequence
  chemically synthesized
ggtggagggaggggcgtccgcc

SEQ ID NO: 1220870 - DNA, 22 bp, Artificial Sequence
  chemically synthesized
gtggagggaggggcgtccgcca

SEQ ID NO: 1220871 - DNA, 22 bp, Artificial Sequence
  chemically synthesized
aagcctcagtaatggcggacgc

SEQ ID NO: 1220872 - DNA, 22 bp, Artificial Sequence
  chemically synthesized
ctcaagcctcagtaatggcgga

SEQ ID NO: 1220873 - DNA, 22 bp, Artificial Sequence
  chemically synthesized
tgagggaaaaccgcctactcaa

SEQ ID NO: 1220874 - DNA, 22 bp, Artificial Sequence
  chemically synthesized
ctgaggcttgagtaggcggttt

SEQ ID NO: 1220875 - DNA, 22 bp, Artificial Sequence
  chemically synthesized
cactgtgagggaaaaccgccta

SEQ ID NO: 1220876 - DNA, 22 bp, Artificial Sequence
  chemically synthesized
acactgtgagggaaaaccgcct

SEQ ID NO: 1220877 - DNA, 22 bp, Artificial Sequence
  chemically synthesized
aggcttgagtaggcggttttcc

SEQ ID NO: 1220878 - DNA, 22 bp, Artificial Sequence
  chemically synthesized
tttacactgtgagggaaaaccg

SEQ ID NO: 1220879 - DNA, 22 bp, Artificial Sequence
  chemically synthesized
gtttacactgtgagggaaaacc

SEQ ID NO: 1220880 - DNA, 22 bp, Artificial Sequence
  chemically synthesized
tgtttacactgtgagggaaaac

SEQ ID NO: 1220881 - DNA, 22 bp, Artificial Sequence
  chemically synthesized
gagtaggcggttttccctcaca

SEQ ID NO: 1220882 - DNA, 22 bp, Artificial Sequence
  chemically synthesized
agtaggcggttttccctcacag

SEQ ID NO: 1220883 - DNA, 22 bp, Artificial Sequence
  chemically synthesized
ccagcgactttgtttacactgt

SEQ ID NO: 1220884 - DNA, 22 bp, Artificial Sequence
  chemically synthesized
cccagcgactttgtttacactg

SEQ ID NO: 1220885 - DNA, 22 bp, Artificial Sequence
  chemically synthesized
tccctcacagtgtaaacaaagt

SEQ ID NO: 1220886 - DNA, 22 bp, Artificial Sequence
  chemically synthesized
aacttcccagcgactttgttta

SEQ ID NO: 1220887 - DNA, 22 bp, Artificial Sequence
  chemically synthesized
ccctcacagtgtaaacaaagtc

SEQ ID NO: 1220888 - DNA, 22 bp, Artificial Sequence
  chemically synthesized
gaacttcccagcgactttgttt

SEQ ID NO: 1220889 - DNA, 22 bp, Artificial Sequence
  chemically synthesized
cctcacagtgtaaacaaagtcg

SEQ ID NO: 1220890 - DNA, 22 bp, Artificial Sequence
  chemically synthesized
acagtgtaaacaaagtcgctgg

SEQ ID NO: 1220891 - DNA, 22 bp, Artificial Sequence
  chemically synthesized
cccagtttgaacttcccagcga

SEQ ID NO: 1220892 - DNA, 22 bp, Artificial Sequence
  chemically synthesized
tgcccagtttgaacttcccagc

SEQ ID NO: 1220893 - DNA, 22 bp, Artificial Sequence
  chemically synthesized
cagtgggctctgcccagtttga

SEQ ID NO: 1220894 - DNA, 22 bp, Artificial Sequence
  chemically synthesized
agctacagtgggctctgcccag

SEQ ID NO: 1220895 - DNA, 22 bp, Artificial Sequence
  chemically synthesized
ggaagttcaaactgggcagagc

SEQ ID NO: 1220896 - DNA, 22 bp, Artificial Sequence
  chemically synthesized
ctgagctacagtgggctctgcc

SEQ ID NO: 1220897 - DNA, 22 bp, Artificial Sequence
  chemically synthesized
gctgagctacagtgggctctgc

SEQ ID NO: 1220898 - DNA, 22 bp, Artificial Sequence
  chemically synthesized
tgctgagctacagtgggctctg

SEQ ID NO: 1220899 - DNA, 22 bp, Artificial Sequence
  chemically synthesized
aaactgggcagagcccactgta

SEQ ID NO: 1220900 - DNA, 22 bp, Artificial Sequence
  chemically synthesized
cagtggctttgctgagctacag

SEQ ID NO: 1220901 - DNA, 22 bp, Artificial Sequence
  chemically synthesized
ggcagagcccactgtagctcag

SEQ ID NO: 1220902 - DNA, 22 bp, Artificial Sequence
  chemically synthesized
gctacagtggctttgctgagct

SEQ ID NO: 1220903 - DNA, 22 bp, Artificial Sequence
  chemically synthesized
tagctcagcaaagccactgtag

SEQ ID NO: 1220904 - DNA, 22 bp, Artificial Sequence
  chemically synthesized
gagaggcagtctggctacagtg

SEQ ID NO: 1220905 - DNA, 22 bp, Artificial Sequence
  chemically synthesized
agcaaagccactgtagccagac

SEQ ID NO: 1220906 - DNA, 22 bp, Artificial Sequence
  chemically synthesized
tagccagactgcctctctagat

SEQ ID NO: 1220907 - DNA, 22 bp, Artificial Sequence
  chemically synthesized
cccagagaggaagaatctagag

SEQ ID NO: 1220908 - DNA, 22 bp, Artificial Sequence
  chemically synthesized
cctctctagattcttcctctct

SEQ ID NO: 1220909 - DNA, 22 bp, Artificial Sequence
  chemically synthesized
agagatgccctgcccagagagg

SEQ ID NO: 1220910 - DNA, 22 bp, Artificial Sequence
  chemically synthesized
tctagattcttcctctctgggc

SEQ ID NO: 1220911 - DNA, 22 bp, Artificial Sequence
  chemically synthesized
cagagatgccctgcccagagag

SEQ ID NO: 1220912 - DNA, 22 bp, Artificial Sequence
  chemically synthesized
tcagagatgccctgcccagaga

SEQ ID NO: 1220913 - DNA, 22 bp, Artificial Sequence
  chemically synthesized
tagattcttcctctctgggcag

SEQ ID NO: 1220914 - DNA, 22 bp, Artificial Sequence
  chemically synthesized
tttcagagatgccctgcccaga

SEQ ID NO: 1220915 - DNA, 22 bp, Artificial Sequence
  chemically synthesized
gattcttcctctctgggcaggg

SEQ ID NO: 1220916 - DNA, 22 bp, Artificial Sequence
  chemically synthesized
ctttcagagatgccctgcccag

SEQ ID NO: 1220917 - DNA, 22 bp, Artificial Sequence
  chemically synthesized
tctttcagagatgccctgccca

SEQ ID NO: 1220918 - DNA, 22 bp, Artificial Sequence
  chemically synthesized
ttcctctctgggcagggcatct

SEQ ID NO: 1220919 - DNA, 22 bp, Artificial Sequence
  chemically synthesized
cctttctttcagagatgccctg

SEQ ID NO: 1220920 - DNA, 22 bp, Artificial Sequence
  chemically synthesized
cctctctgggcagggcatctct

SEQ ID NO: 1220921 - DNA, 22 bp, Artificial Sequence
  chemically synthesized
ctctctgggcagggcatctctg

SEQ ID NO: 1220922 - DNA, 22 bp, Artificial Sequence
  chemically synthesized
ctgcctttctttcagagatgcc

SEQ ID NO: 1220923 - DNA, 22 bp, Artificial Sequence
  chemically synthesized
tctgggcagggcatctctgaaa

SEQ ID NO: 1220924 - DNA, 22 bp, Artificial Sequence
  chemically synthesized
tgggcagggcatctctgaaaga

SEQ ID NO: 1220925 - DNA, 22 bp, Artificial Sequence
  chemically synthesized
gggctgctgcctttctttcaga

SEQ ID NO: 1220926 - DNA, 22 bp, Artificial Sequence
  chemically synthesized
ggcagggcatctctgaaagaaa

SEQ ID NO: 1220927 - DNA, 22 bp, Artificial Sequence
  chemically synthesized
actggggctgctgcctttcttt

SEQ ID NO: 1220928 - DNA, 22 bp, Artificial Sequence
  chemically synthesized
tgaaagaaaggcagcagcccca

SEQ ID NO: 1220929 - DNA, 22 bp, Artificial Sequence
  chemically synthesized
taagccgctgactggggctgct

SEQ ID NO: 1220930 - DNA, 22 bp, Artificial Sequence
  chemically synthesized
aaagaaaggcagcagccccagt

SEQ ID NO: 1220931 - DNA, 22 bp, Artificial Sequence
  chemically synthesized
tctgtaagccgctgactggggc

SEQ ID NO: 1220932 - DNA, 22 bp, Artificial Sequence
  chemically synthesized
atctgtaagccgctgactgggg

SEQ ID NO: 1220933 - DNA, 22 bp, Artificial Sequence
  chemically synthesized
tatctgtaagccgctgactggg

SEQ ID NO: 1220934 - DNA, 22 bp, Artificial Sequence
  chemically synthesized
agggagatgggagttttatctg

SEQ ID NO: 1220935 - DNA, 22 bp, Artificial Sequence
  chemically synthesized
tctcagggagatgggagtttta

SEQ ID NO: 1220936 - DNA, 22 bp, Artificial Sequence
  chemically synthesized
tgtctcagggagatgggagttt

SEQ ID NO: 1220937 - DNA, 22 bp, Artificial Sequence
  chemically synthesized
acagataaaactcccatctccc

SEQ ID NO: 1220938 - DNA, 22 bp, Artificial Sequence
  chemically synthesized
cagataaaactcccatctccct

SEQ ID NO: 1220939 - DNA, 22 bp, Artificial Sequence
  chemically synthesized
acgtgctctgtctcagggagat

SEQ ID NO: 1220940 - DNA, 22 bp, Artificial Sequence
  chemically synthesized
cctcacgtgctctgtctcaggg

SEQ ID NO: 1220941 - DNA, 22 bp, Artificial Sequence
  chemically synthesized
ccctcacgtgctctgtctcagg

SEQ ID NO: 1220942 - DNA, 22 bp, Artificial Sequence
  chemically synthesized
ccatctccctgagacagagcac

SEQ ID NO: 1220943 - DNA, 22 bp, Artificial Sequence
  chemically synthesized
ccccttccctcacgtgctctgt

SEQ ID NO: 1220944 - DNA, 22 bp, Artificial Sequence
  chemically synthesized
cctgagacagagcacgtgaggg

SEQ ID NO: 1220945 - DNA, 22 bp, Artificial Sequence
  chemically synthesized
agacagagcacgtgagggaagg

SEQ ID NO: 1220946 - DNA, 22 bp, Artificial Sequence
  chemically synthesized
cacccacagctgccccttccct

SEQ ID NO: 1220947 - DNA, 22 bp, Artificial Sequence
  chemically synthesized
atgctgcacccacagctgcccc

SEQ ID NO: 1220948 - DNA, 22 bp, Artificial Sequence
  chemically synthesized
ctgatgctgcacccacagctgc

SEQ ID NO: 1220949 - DNA, 22 bp, Artificial Sequence
  chemically synthesized
gtctgctgatgctgcacccaca

SEQ ID NO: 1220950 - DNA, 22 bp, Artificial Sequence
  chemically synthesized
agtctgctgatgctgcacccac

SEQ ID NO: 1220951 - DNA, 22 bp, Artificial Sequence
  chemically synthesized
tgggtgcagcatcagcagacta

SEQ ID NO: 1220952 - DNA, 22 bp, Artificial Sequence
  chemically synthesized
agagccggcaggcaagaacgtt

SEQ ID NO: 1220953 - DNA, 22 bp, Artificial Sequence
  chemically synthesized
cagagccggcaggcaagaacgt

SEQ ID NO: 1220954 - DNA, 22 bp, Artificial Sequence
  chemically synthesized
ttcagagccggcaggcaagaac

SEQ ID NO: 1220955 - DNA, 22 bp, Artificial Sequence
  chemically synthesized
tcttcagagccggcaggcaaga

SEQ ID NO: 1220956 - DNA, 22 bp, Artificial Sequence
  chemically synthesized
ctctcttcagagccggcaggca

SEQ ID NO: 1220957 - DNA, 22 bp, Artificial Sequence
  chemically synthesized
ctgctctcttcagagccggcag

SEQ ID NO: 1220958 - DNA, 22 bp, Artificial Sequence
  chemically synthesized
aacgttcttgcctgccggctct

SEQ ID NO: 1220959 - DNA, 22 bp, Artificial Sequence
  chemically synthesized
ttgcctgccggctctgaagaga

SEQ ID NO: 1220960 - DNA, 22 bp, Artificial Sequence
  chemically synthesized
ggagatctgctgctctcttcag

SEQ ID NO: 1220961 - DNA, 22 bp, Artificial Sequence
  chemically synthesized
gcctgccggctctgaagagagc

SEQ ID NO: 1220962 - DNA, 22 bp, Artificial Sequence
  chemically synthesized
cctgccggctctgaagagagca

SEQ ID NO: 1220963 - DNA, 22 bp, Artificial Sequence
  chemically synthesized
tgctgggagatctgctgctctc

SEQ ID NO: 1220964 - DNA, 22 bp, Artificial Sequence
  chemically synthesized
ccggctctgaagagagcagcag

SEQ ID NO: 1220965 - DNA, 22 bp, Artificial Sequence
  chemically synthesized
tgaagagagcagcagatctccc

SEQ ID NO: 1220966 - DNA, 22 bp, Artificial Sequence
  chemically synthesized
cagtgctgtgctgggagatctg

SEQ ID NO: 1220967 - DNA, 22 bp, Artificial Sequence
  chemically synthesized
aagagagcagcagatctcccag

SEQ ID NO: 1220968 - DNA, 22 bp, Artificial Sequence
  chemically synthesized
gcagagctccagtgctgtgctg

SEQ ID NO: 1220969 - DNA, 22 bp, Artificial Sequence
  chemically synthesized
agcagagctccagtgctgtgct

SEQ ID NO: 1220970 - DNA, 22 bp, Artificial Sequence
  chemically synthesized
tcccttagcagagctccagtgc

SEQ ID NO: 1220971 - DNA, 22 bp, Artificial Sequence
  chemically synthesized
ccagcacagcactggagctctg

SEQ ID NO: 1220972 - DNA, 22 bp, Artificial Sequence
  chemically synthesized
agaaggcaatctgtcccttagc

SEQ ID NO: 1220973 - DNA, 22 bp, Artificial Sequence
  chemically synthesized
gagaaggcaatctgtcccttag

SEQ ID NO: 1220974 - DNA, 22 bp, Artificial Sequence
  chemically synthesized
gagctctgctaagggacagatt

SEQ ID NO: 1220975 - DNA, 22 bp, Artificial Sequence
  chemically synthesized
tgctaagggacagattgccttc

SEQ ID NO: 1220976 - DNA, 22 bp, Artificial Sequence
  chemically synthesized
ctaagggacagattgccttctc

SEQ ID NO: 1220977 - DNA, 22 bp, Artificial Sequence
  chemically synthesized
agggacagattgccttctcaag

SEQ ID NO: 1220978 - DNA, 22 bp, Artificial Sequence
  chemically synthesized
ccttctcaagtggggccctgac

SEQ ID NO: 1220979 - DNA, 22 bp, Artificial Sequence
  chemically synthesized
ctcaagtggggccctgaccccc

SEQ ID NO: 1220980 - DNA, 22 bp, Artificial Sequence
  chemically synthesized
ggcaggaggcacgggggtcagg

SEQ ID NO: 1220981 - DNA, 22 bp, Artificial Sequence
  chemically synthesized
tcaagtggggccctgacccccg

SEQ ID NO: 1220982 - DNA, 22 bp, Artificial Sequence
  chemically synthesized
aagtggggccctgacccccgtg

SEQ ID NO: 1220983 - DNA, 22 bp, Artificial Sequence
  chemically synthesized
ctaggcaggaggcacgggggtc

SEQ ID NO: 1220984 - DNA, 22 bp, Artificial Sequence
  chemically synthesized
ggaggcatctcctaggcaggag

SEQ ID NO: 1220985 - DNA, 22 bp, Artificial Sequence
  chemically synthesized
acccccgtgcctcctgcctagg

SEQ ID NO: 1220986 - DNA, 22 bp, Artificial Sequence
  chemically synthesized
ctgggaggcatctcctaggcag

SEQ ID NO: 1220987 - DNA, 22 bp, Artificial Sequence
  chemically synthesized
tcgacccctgctgggaggcatc

SEQ ID NO: 1220988 - DNA, 22 bp, Artificial Sequence
  chemically synthesized
ctgcctaggagatgcctcccag

SEQ ID NO: 1220989 - DNA, 22 bp, Artificial Sequence
  chemically synthesized
cctaggagatgcctcccagcag

SEQ ID NO: 1220990 - DNA, 22 bp, Artificial Sequence
  chemically synthesized
ggagatgcctcccagcaggggt

SEQ ID NO: 1220991 - DNA, 22 bp, Artificial Sequence
  chemically synthesized
tatgatgtgtctgtcgacccct

SEQ ID NO: 1220992 - DNA, 22 bp, Artificial Sequence
  chemically synthesized
ctgtatgatgtgtctgtcgacc

SEQ ID NO: 1220993 - DNA, 22 bp, Artificial Sequence
  chemically synthesized
tcctgtatgatgtgtctgtcga

SEQ ID NO: 1220994 - DNA, 22 bp, Artificial Sequence
  chemically synthesized
ccagcaggggtcgacagacaca

SEQ ID NO: 1220995 - DNA, 22 bp, Artificial Sequence
  chemically synthesized
ccagccagagctctcctgtatg

SEQ ID NO: 1220996 - DNA, 22 bp, Artificial Sequence
  chemically synthesized
gtcccagaggggcacccaccag

SEQ ID NO: 1220997 - DNA, 22 bp, Artificial Sequence
  chemically synthesized
cgtcccagaggggcacccacca

SEQ ID NO: 1220998 - DNA, 22 bp, Artificial Sequence
  chemically synthesized
tggctggcaactggtgggtgcc

SEQ ID NO: 1220999 - DNA, 22 bp, Artificial Sequence
  chemically synthesized
gctggcaactggtgggtgcccc

SEQ ID NO: 1221000 - DNA, 22 bp, Artificial Sequence
  chemically synthesized
gcaactggtgggtgcccctctg

SEQ ID NO: 1221001 - DNA, 22 bp, Artificial Sequence
  chemically synthesized
gaagcttcgtcccagaggggca

SEQ ID NO: 1221002 - DNA, 22 bp, Artificial Sequence
  chemically synthesized
tggaagcttcgtcccagagggg

SEQ ID NO: 1221003 - DNA, 22 bp, Artificial Sequence
  chemically synthesized
gtgggtgcccctctgggacgaa

SEQ ID NO: 1221004 - DNA, 22 bp, Artificial Sequence
  chemically synthesized
catcctctggaagcttcgtccc

SEQ ID NO: 1221005 - DNA, 22 bp, Artificial Sequence
  chemically synthesized
ttccatcctctggaagcttcgt

SEQ ID NO: 1221006 - DNA, 22 bp, Artificial Sequence
  chemically synthesized
cctgttccatcctctggaagct

SEQ ID NO: 1221007 - DNA, 22 bp, Artificial Sequence
  chemically synthesized
ctgcctgttccatcctctggaa

SEQ ID NO: 1221008 - DNA, 22 bp, Artificial Sequence
  chemically synthesized
tgggacgaagcttccagaggat

SEQ ID NO: 1221009 - DNA, 22 bp, Artificial Sequence
  chemically synthesized
ggacgaagcttccagaggatgg

SEQ ID NO: 1221010 - DNA, 22 bp, Artificial Sequence
  chemically synthesized
ccagaggatggaacaggcagca

SEQ ID NO: 1221011 - DNA, 22 bp, Artificial Sequence
  chemically synthesized
cagaggatggaacaggcagcaa

SEQ ID NO: 1221012 - DNA, 22 bp, Artificial Sequence
  chemically synthesized
cagaacagcaaagattgctgcc

SEQ ID NO: 1221013 - DNA, 22 bp, Artificial Sequence
  chemically synthesized
ggtatcaccagcagagactgca

SEQ ID NO: 1221014 - DNA, 22 bp, Artificial Sequence
  chemically synthesized
tgctgttctgcagtctctgctg

SEQ ID NO: 1221015 - DNA, 22 bp, Artificial Sequence
  chemically synthesized
cctgggtatcaccagcagagac

SEQ ID NO: 1221016 - DNA, 22 bp, Artificial Sequence
  chemically synthesized
gctgttctgcagtctctgctgg

SEQ ID NO: 1221017 - DNA, 22 bp, Artificial Sequence
  chemically synthesized
gcctgggtatcaccagcagaga

SEQ ID NO: 1221018 - DNA, 22 bp, Artificial Sequence
  chemically synthesized
ctgttctgcagtctctgctggt

SEQ ID NO: 1221019 - DNA, 22 bp, Artificial Sequence
  chemically synthesized
tttgcctgggtatcaccagcag

SEQ ID NO: 1221020 - DNA, 22 bp, Artificial Sequence
  chemically synthesized
ttctgcagtctctgctggtgat

SEQ ID NO: 1221021 - DNA, 22 bp, Artificial Sequence
  chemically synthesized
tgcagtctctgctggtgatacc

SEQ ID NO: 1221022 - DNA, 22 bp, Artificial Sequence
  chemically synthesized
cagtctctgctggtgataccca

SEQ ID NO: 1221023 - DNA, 22 bp, Artificial Sequence
  chemically synthesized
gaccctatttgcctgggtatca

SEQ ID NO: 1221024 - DNA, 22 bp, Artificial Sequence
  chemically synthesized
tagaccctatttgcctgggtat

SEQ ID NO: 1221025 - DNA, 22 bp, Artificial Sequence
  chemically synthesized
tgctggtgatacccaggcaaat

SEQ ID NO: 1221026 - DNA, 22 bp, Artificial Sequence
  chemically synthesized
ctggtgatacccaggcaaatag

SEQ ID NO: 1221027 - DNA, 22 bp, Artificial Sequence
  chemically synthesized
gtgatacccaggcaaatagggt

SEQ ID NO: 1221028 - DNA, 22 bp, Artificial Sequence
  chemically synthesized
gaggtccactctagaccctatt

SEQ ID NO: 1221029 - DNA, 22 bp, Artificial Sequence
  chemically synthesized
ctggaggtccactctagaccct

SEQ ID NO: 1221030 - DNA, 22 bp, Artificial Sequence
  chemically synthesized
actggaggtccactctagaccc

SEQ ID NO: 1221031 - DNA, 22 bp, Artificial Sequence
  chemically synthesized
gagtttactggaggtccactct

SEQ ID NO: 1221032 - DNA, 22 bp, Artificial Sequence
  chemically synthesized
ctggagtttactggaggtccac

SEQ ID NO: 1221033 - DNA, 22 bp, Artificial Sequence
  chemically synthesized
gctggagtttactggaggtcca

SEQ ID NO: 1221034 - DNA, 22 bp, Artificial Sequence
  chemically synthesized
caggtttgctggagtttactgg

SEQ ID NO: 1221035 - DNA, 22 bp, Artificial Sequence
  chemically synthesized
gagtggacctccagtaaactcc

SEQ ID NO: 1221036 - DNA, 22 bp, Artificial Sequence
  chemically synthesized
ctgcaggtttgctggagtttac

SEQ ID NO: 1221037 - DNA, 22 bp, Artificial Sequence
  chemically synthesized
tgctgcaggtttgctggagttt

SEQ ID NO: 1221038 - DNA, 22 bp, Artificial Sequence
  chemically synthesized
cagtaaactccagcaaacctgc

SEQ ID NO: 1221039 - DNA, 22 bp, Artificial Sequence
  chemically synthesized
aaacaggcccctctgctgcagg

SEQ ID NO: 1221040 - DNA, 22 bp, Artificial Sequence
  chemically synthesized
caaacaggcccctctgctgcag

SEQ ID NO: 1221041 - DNA, 22 bp, Artificial Sequence
  chemically synthesized
cttcaaacaggcccctctgctg

SEQ ID NO: 1221042 - DNA, 22 bp, Artificial Sequence
  chemically synthesized
cagcaaacctgcagcagagggg

SEQ ID NO: 1221043 - DNA, 22 bp, Artificial Sequence
  chemically synthesized
ccttcaaacaggcccctctgct

SEQ ID NO: 1221044 - DNA, 22 bp, Artificial Sequence
  chemically synthesized
tccttcaaacaggcccctctgc

SEQ ID NO: 1221045 - DNA, 22 bp, Artificial Sequence
  chemically synthesized
gttttccttcaaacaggcccct

SEQ ID NO: 1221046 - DNA, 22 bp, Artificial Sequence
  chemically synthesized
agttttccttcaaacaggcccc

SEQ ID NO: 1221047 - DNA, 22 bp, Artificial Sequence
  chemically synthesized
tagttttccttcaaacaggccc

SEQ ID NO: 1221048 - DNA, 22 bp, Artificial Sequence
  chemically synthesized
ttttagttttccttcaaacagg

SEQ ID NO: 1221049 - DNA, 22 bp, Artificial Sequence
  chemically synthesized
cagcagaggggcctgtttgaag

SEQ ID NO: 1221050 - DNA, 22 bp, Artificial Sequence
  chemically synthesized
tgttttagttttccttcaaaca

SEQ ID NO: 1221051 - DNA, 22 bp, Artificial Sequence
  chemically synthesized
ctgttttagttttccttcaaac

SEQ ID NO: 1221052 - DNA, 22 bp, Artificial Sequence
  chemically synthesized
tctgttttagttttccttcaaa

SEQ ID NO: 1221053 - DNA, 22 bp, Artificial Sequence
  chemically synthesized
ctttctgttttagttttccttc

SEQ ID NO: 1221054 - DNA, 22 bp, Artificial Sequence
  chemically synthesized
ttcctttctgttttagttttcc

SEQ ID NO: 1221055 - DNA, 22 bp, Artificial Sequence
  chemically synthesized
tttgaaggaaaactaaaacaga

SEQ ID NO: 1221056 - DNA, 22 bp, Artificial Sequence
  chemically synthesized
atgctattcctttctgttttag

SEQ ID NO: 1221057 - DNA, 22 bp, Artificial Sequence
  chemically synthesized
gaaggaaaactaaaacagaaag

SEQ ID NO: 1221058 - DNA, 22 bp, Artificial Sequence
  chemically synthesized
ttgatgctattcctttctgttt

SEQ ID NO: 1221059 - DNA, 22 bp, Artificial Sequence
  chemically synthesized
aaggaaaactaaaacagaaagg

SEQ ID NO: 1221060 - DNA, 22 bp, Artificial Sequence
  chemically synthesized
gttgatgctattcctttctgtt

SEQ ID NO: 1221061 - DNA, 22 bp, Artificial Sequence
  chemically synthesized
tgttgatgctattcctttctgt

SEQ ID NO: 1221062 - DNA, 22 bp, Artificial Sequence
  chemically synthesized
ttgttgatgctattcctttctg

SEQ ID NO: 1221063 - DNA, 22 bp, Artificial Sequence
  chemically synthesized
tttgttgatgctattcctttct

SEQ ID NO: 1221064 - DNA, 22 bp, Artificial Sequence
  chemically synthesized
aaacagaaaggaatagcatcaa

SEQ ID NO: 1221065 - DNA, 22 bp, Artificial Sequence
  chemically synthesized
agtggatgtcctttttgttgat

SEQ ID NO: 1221066 - DNA, 22 bp, Artificial Sequence
  chemically synthesized
tgagtggatgtcctttttgttg

SEQ ID NO: 1221067 - DNA, 22 bp, Artificial Sequence
  chemically synthesized
ctgagtggatgtcctttttgtt

SEQ ID NO: 1221068 - DNA, 22 bp, Artificial Sequence
  chemically synthesized
agatggggtttctgagtggatg

SEQ ID NO: 1221069 - DNA, 22 bp, Artificial Sequence
  chemically synthesized
cagatggggtttctgagtggat

SEQ ID NO: 1221070 - DNA, 22 bp, Artificial Sequence
  chemically synthesized
gtgaccttcagatggggtttct

SEQ ID NO: 1221071 - DNA, 22 bp, Artificial Sequence
  chemically synthesized
acattggtgaccttcagatggg

SEQ ID NO: 1221072 - DNA, 22 bp, Artificial Sequence
  chemically synthesized
gacattggtgaccttcagatgg

SEQ ID NO: 1221073 - DNA, 22 bp, Artificial Sequence
  chemically synthesized
tgacattggtgaccttcagatg

SEQ ID NO: 1221074 - DNA, 22 bp, Artificial Sequence
  chemically synthesized
agaaaccccatctgaaggtcac

SEQ ID NO: 1221075 - DNA, 22 bp, Artificial Sequence
  chemically synthesized
atctttgacattggtgaccttc

SEQ ID NO: 1221076 - DNA, 22 bp, Artificial Sequence
  chemically synthesized
gatctttgacattggtgacctt

SEQ ID NO: 1221077 - DNA, 22 bp, Artificial Sequence
  chemically synthesized
tgatctttgacattggtgacct

SEQ ID NO: 1221078 - DNA, 22 bp, Artificial Sequence
  chemically synthesized
cctttgatctttgacattggtg

SEQ ID NO: 1221079 - DNA, 22 bp, Artificial Sequence
  chemically synthesized
tctacctttgatctttgacatt

SEQ ID NO: 1221080 - DNA, 22 bp, Artificial Sequence
  chemically synthesized
atctacctttgatctttgacat

SEQ ID NO: 1221081 - DNA, 22 bp, Artificial Sequence
  chemically synthesized
aaggtcaccaatgtcaaagatc

SEQ ID NO: 1221082 - DNA, 22 bp, Artificial Sequence
  chemically synthesized
tggatttatctacctttgatct

SEQ ID NO: 1221083 - DNA, 22 bp, Artificial Sequence
  chemically synthesized
gtggatttatctacctttgatc

SEQ ID NO: 1221084 - DNA, 22 bp, Artificial Sequence
  chemically synthesized
tgtggatttatctacctttgat

SEQ ID NO: 1221085 - DNA, 22 bp, Artificial Sequence
  chemically synthesized
atctttgtggatttatctacct

SEQ ID NO: 1221086 - DNA, 22 bp, Artificial Sequence
  chemically synthesized
ctcatctttgtggatttatcta

SEQ ID NO: 1221087 - DNA, 22 bp, Artificial Sequence
  chemically synthesized
cctcatctttgtggatttatct

SEQ ID NO: 1221088 - DNA, 22 bp, Artificial Sequence
  chemically synthesized
tcctcatctttgtggatttatc

SEQ ID NO: 1221089 - DNA, 22 bp, Artificial Sequence
  chemically synthesized
ttcctcatctttgtggatttat

SEQ ID NO: 1221090 - DNA, 22 bp, Artificial Sequence
  chemically synthesized
gtttttcctcatctttgtggat

SEQ ID NO: 1221091 - DNA, 22 bp, Artificial Sequence
  chemically synthesized
tgctggtttttcctcatctttg

SEQ ID NO: 1221092 - DNA, 22 bp, Artificial Sequence
  chemically synthesized
gtgctggtttttcctcatcttt

SEQ ID NO: 1221093 - DNA, 22 bp, Artificial Sequence
  chemically synthesized
tgtgctggtttttcctcatctt

SEQ ID NO: 1221094 - DNA, 22 bp, Artificial Sequence
  chemically synthesized
ttgtgctggtttttcctcatct

SEQ ID NO: 1221095 - DNA, 22 bp, Artificial Sequence
  chemically synthesized
tttgtgctggtttttcctcatc

SEQ ID NO: 1221096 - DNA, 22 bp, Artificial Sequence
  chemically synthesized
accctttttgtgctggtttttc

SEQ ID NO: 1221097 - DNA, 22 bp, Artificial Sequence
  chemically synthesized
caccctttttgtgctggttttt

SEQ ID NO: 1221098 - DNA, 22 bp, Artificial Sequence
  chemically synthesized
tcaccctttttgtgctggtttt

SEQ ID NO: 1221099 - DNA, 22 bp, Artificial Sequence
  chemically synthesized
gaattttcaccctttttgtgct

SEQ ID NO: 1221100 - DNA, 22 bp, Artificial Sequence
  chemically synthesized
ggaattttcaccctttttgtgc

SEQ ID NO: 1221101 - DNA, 22 bp, Artificial Sequence
  chemically synthesized
tggaattttcaccctttttgtg

SEQ ID NO: 1221102 - DNA, 22 bp, Artificial Sequence
  chemically synthesized
ggttttggaattttcacccttt

SEQ ID NO: 1221103 - DNA, 22 bp, Artificial Sequence
  chemically synthesized
tgggttttggaattttcaccct

SEQ ID NO: 1221104 - DNA, 22 bp, Artificial Sequence
  chemically synthesized
gaggagaagaggtgttctgggt

SEQ ID NO: 1221105 - DNA, 22 bp, Artificial Sequence
  chemically synthesized
ggaggagaagaggtgttctggg

SEQ ID NO: 1221106 - DNA, 22 bp, Artificial Sequence
  chemically synthesized
tggaggagaagaggtgttctgg

SEQ ID NO: 1221107 - DNA, 22 bp, Artificial Sequence
  chemically synthesized
caaaacccagaacacctcttct

SEQ ID NO: 1221108 - DNA, 22 bp, Artificial Sequence
  chemically synthesized
tgatcctttggaggagaagagg

SEQ ID NO: 1221109 - DNA, 22 bp, Artificial Sequence
  chemically synthesized
gtgaggagttgtgatcctttgg

SEQ ID NO: 1221110 - DNA, 22 bp, Artificial Sequence
  chemically synthesized
ggtgaggagttgtgatcctttg

SEQ ID NO: 1221111 - DNA, 22 bp, Artificial Sequence
  chemically synthesized
tttggtgaggagttgtgatcct

SEQ ID NO: 1221112 - DNA, 22 bp, Artificial Sequence
  chemically synthesized
ttctcctccaaaggatcacaac

SEQ ID NO: 1221113 - DNA, 22 bp, Artificial Sequence
  chemically synthesized
gtttggtgaggagttgtgatcc

SEQ ID NO: 1221114 - DNA, 22 bp, Artificial Sequence
  chemically synthesized
ctcctccaaaggatcacaactc

SEQ ID NO: 1221115 - DNA, 22 bp, Artificial Sequence
  chemically synthesized
ttgtttggtgaggagttgtgat

SEQ ID NO: 1221116 - DNA, 22 bp, Artificial Sequence
  chemically synthesized
tcctccaaaggatcacaactcc

SEQ ID NO: 1221117 - DNA, 22 bp, Artificial Sequence
  chemically synthesized
tcttgtttggtgaggagttgtg

SEQ ID NO: 1221118 - DNA, 22 bp, Artificial Sequence
  chemically synthesized
ctccaaaggatcacaactcctc

SEQ ID NO: 1221119 - DNA, 22 bp, Artificial Sequence
  chemically synthesized
ttctcttgtttggtgaggagtt

SEQ ID NO: 1221120 - DNA, 22 bp, Artificial Sequence
  chemically synthesized
caaaggatcacaactcctcacc

SEQ ID NO: 1221121 - DNA, 22 bp, Artificial Sequence
  chemically synthesized
gttctcttgtttggtgaggagt

SEQ ID NO: 1221122 - DNA, 22 bp, Artificial Sequence
  chemically synthesized
tgttctcttgtttggtgaggag

SEQ ID NO: 1221123 - DNA, 22 bp, Artificial Sequence
  chemically synthesized
catccagttttgttctcttgtt

SEQ ID NO: 1221124 - DNA, 22 bp, Artificial Sequence
  chemically synthesized
tccatccagttttgttctcttg

SEQ ID NO: 1221125 - DNA, 22 bp, Artificial Sequence
  chemically synthesized
ctcaccaaacaagagaacaaaa

SEQ ID NO: 1221126 - DNA, 22 bp, Artificial Sequence
  chemically synthesized
attctccatccagttttgttct

SEQ ID NO: 1221127 - DNA, 22 bp, Artificial Sequence
  chemically synthesized
accaaacaagagaacaaaactg

SEQ ID NO: 1221128 - DNA, 22 bp, Artificial Sequence
  chemically synthesized
gtcatactcattctccatccag

SEQ ID NO: 1221129 - DNA, 22 bp, Artificial Sequence
  chemically synthesized
tgtcaattcgtcatactcattc

SEQ ID NO: 1221130 - DNA, 22 bp, Artificial Sequence
  chemically synthesized
atgtcaattcgtcatactcatt

SEQ ID NO: 1221131 - DNA, 22 bp, Artificial Sequence
  chemically synthesized
cttatgtcaattcgtcatactc

SEQ ID NO: 1221132 - DNA, 22 bp, Artificial Sequence
  chemically synthesized
gatggagaatgagtatgacgaa

SEQ ID NO: 1221133 - DNA, 22 bp, Artificial Sequence
  chemically synthesized
aagcctacttatgtcaattcgt

SEQ ID NO: 1221134 - DNA, 22 bp, Artificial Sequence
  chemically synthesized
tgaagcctacttatgtcaattc

SEQ ID NO: 1221135 - DNA, 22 bp, Artificial Sequence
  chemically synthesized
ctgaagcctacttatgtcaatt

SEQ ID NO: 1221136 - DNA, 22 bp, Artificial Sequence
  chemically synthesized
cccaccttctgaagcctactta

SEQ ID NO: 1221137 - DNA, 22 bp, Artificial Sequence
  chemically synthesized
ttacccaccttctgaagcctac

SEQ ID NO: 1221138 - DNA, 22 bp, Artificial Sequence
  chemically synthesized
attacccaccttctgaagccta

SEQ ID NO: 1221139 - DNA, 22 bp, Artificial Sequence
  chemically synthesized
acataagtaggcttcagaaggt

SEQ ID NO: 1221140 - DNA, 22 bp, Artificial Sequence
  chemically synthesized
gaggagtttattacccaccttc

SEQ ID NO: 1221141 - DNA, 22 bp, Artificial Sequence
  chemically synthesized
ggaggagtttattacccacctt

SEQ ID NO: 1221142 - DNA, 22 bp, Artificial Sequence
  chemically synthesized
gcttggaggagtttattaccca

SEQ ID NO: 1221143 - DNA, 22 bp, Artificial Sequence
  chemically synthesized
agcttggaggagtttattaccc

SEQ ID NO: 1221144 - DNA, 22 bp, Artificial Sequence
  chemically synthesized
tagcttggaggagtttattacc

SEQ ID NO: 1221145 - DNA, 22 bp, Artificial Sequence
  chemically synthesized
cagaaggtgggtaataaactcc

SEQ ID NO: 1221146 - DNA, 22 bp, Artificial Sequence
  chemically synthesized
ctttagcttggaggagtttatt

SEQ ID NO: 1221147 - DNA, 22 bp, Artificial Sequence
  chemically synthesized
agaaggtgggtaataaactcct

SEQ ID NO: 1221148 - DNA, 22 bp, Artificial Sequence
  chemically synthesized
gaacatgctcctttagcttgga

SEQ ID NO: 1221149 - DNA, 22 bp, Artificial Sequence
  chemically synthesized
ggttagaacatgctcctttagc

SEQ ID NO: 1221150 - DNA, 22 bp, Artificial Sequence
  chemically synthesized
cattgggttagaacatgctcct

SEQ ID NO: 1221151 - DNA, 22 bp, Artificial Sequence
  chemically synthesized
ctccaagctaaaggagcatgtt

SEQ ID NO: 1221152 - DNA, 22 bp, Artificial Sequence
  chemically synthesized
ccattgggttagaacatgctcc

SEQ ID NO: 1221153 - DNA, 22 bp, Artificial Sequence
  chemically synthesized
caagctaaaggagcatgttcta

SEQ ID NO: 1221154 - DNA, 22 bp, Artificial Sequence
  chemically synthesized
cttccattgggttagaacatgc

SEQ ID NO: 1221155 - DNA, 22 bp, Artificial Sequence
  chemically synthesized
ccttccattgggttagaacatg

SEQ ID NO: 1221156 - DNA, 22 bp, Artificial Sequence
  chemically synthesized
gcttccttccattgggttagaa

SEQ ID NO: 1221157 - DNA, 22 bp, Artificial Sequence
  chemically synthesized
agcttccttccattgggttaga

SEQ ID NO: 1221158 - DNA, 22 bp, Artificial Sequence
  chemically synthesized
aaggagcatgttctaacccaat

SEQ ID NO: 1221159 - DNA, 22 bp, Artificial Sequence
  chemically synthesized
ttagcttccttccattgggtta

SEQ ID NO: 1221160 - DNA, 22 bp, Artificial Sequence
  chemically synthesized
aaggttcttagcttccttccat

SEQ ID NO: 1221161 - DNA, 22 bp, Artificial Sequence
  chemically synthesized
caaggttcttagcttccttcca

SEQ ID NO: 1221162 - DNA, 22 bp, Artificial Sequence
  chemically synthesized
tcaaggttcttagcttccttcc

SEQ ID NO: 1221163 - DNA, 22 bp, Artificial Sequence
  chemically synthesized
ttcaaggttcttagcttccttc

SEQ ID NO: 1221164 - DNA, 22 bp, Artificial Sequence
  chemically synthesized
tttcaaggttcttagcttcctt

SEQ ID NO: 1221165 - DNA, 22 bp, Artificial Sequence
  chemically synthesized
taacccaatggaaggaagctaa

SEQ ID NO: 1221166 - DNA, 22 bp, Artificial Sequence
  chemically synthesized
ttttcaaggttcttagcttcct

SEQ ID NO: 1221167 - DNA, 22 bp, Artificial Sequence
  chemically synthesized
acccaatggaaggaagctaaga

SEQ ID NO: 1221168 - DNA, 22 bp, Artificial Sequence
  chemically synthesized
accttttttcaaggttcttagc

SEQ ID NO: 1221169 - DNA, 22 bp, Artificial Sequence
  chemically synthesized
taaccttttttcaaggttctta

SEQ ID NO: 1221170 - DNA, 22 bp, Artificial Sequence
  chemically synthesized
ctctaaccttttttcaaggttc

SEQ ID NO: 1221171 - DNA, 22 bp, Artificial Sequence
  chemically synthesized
gcaactcctctaaccttttttc

SEQ ID NO: 1221172 - DNA, 22 bp, Artificial Sequence
  chemically synthesized
agaaccttgaaaaaaggttaga

SEQ ID NO: 1221173 - DNA, 22 bp, Artificial Sequence
  chemically synthesized
tagttagcaactcctctaacct

SEQ ID NO: 1221174 - DNA, 22 bp, Artificial Sequence
  chemically synthesized
ttgtagttagcaactcctctaa

SEQ ID NO: 1221175 - DNA, 22 bp, Artificial Sequence
  chemically synthesized
gaaaaaaggttagaggagttgc

SEQ ID NO: 1221176 - DNA, 22 bp, Artificial Sequence
  chemically synthesized
aaaaaaggttagaggagttgct

SEQ ID NO: 1221177 - DNA, 22 bp, Artificial Sequence
  chemically synthesized
gttattgtagttagcaactcct

SEQ ID NO: 1221178 - DNA, 22 bp, Artificial Sequence
  chemically synthesized
aactggttattgtagttagcaa

SEQ ID NO: 1221179 - DNA, 22 bp, Artificial Sequence
  chemically synthesized
cctaaactggttattgtagtta

SEQ ID NO: 1221180 - DNA, 22 bp, Artificial Sequence
  chemically synthesized
gcctaaactggttattgtagtt

SEQ ID NO: 1221181 - DNA, 22 bp, Artificial Sequence
  chemically synthesized
gaggagttgctaactacaataa

SEQ ID NO: 1221182 - DNA, 22 bp, Artificial Sequence
  chemically synthesized
tgcctaaactggttattgtagt

SEQ ID NO: 1221183 - DNA, 22 bp, Artificial Sequence
  chemically synthesized
ttttgcctaaactggttattgt

SEQ ID NO: 1221184 - DNA, 22 bp, Artificial Sequence
  chemically synthesized
ttgttttgcctaaactggttat

SEQ ID NO: 1221185 - DNA, 22 bp, Artificial Sequence
  chemically synthesized
attgttttgcctaaactggtta

SEQ ID NO: 1221186 - DNA, 22 bp, Artificial Sequence
  chemically synthesized
ctaactacaataaccagtttag

SEQ ID NO: 1221187 - DNA, 22 bp, Artificial Sequence
  chemically synthesized
actacaataaccagtttaggca

SEQ ID NO: 1221188 - DNA, 22 bp, Artificial Sequence
  chemically synthesized
caataaccagtttaggcaaaac

SEQ ID NO: 1221189 - DNA, 22 bp, Artificial Sequence
  chemically synthesized
catcaggtcatttattgttttg

SEQ ID NO: 1221190 - DNA, 22 bp, Artificial Sequence
  chemically synthesized
agttccatcaggtcatttattg

SEQ ID NO: 1221191 - DNA, 22 bp, Artificial Sequence
  chemically synthesized
cagttccatcaggtcatttatt

SEQ ID NO: 1221192 - DNA, 22 bp, Artificial Sequence
  chemically synthesized
tcagttccatcaggtcatttat

SEQ ID NO: 1221193 - DNA, 22 bp, Artificial Sequence
  chemically synthesized
ttcagttccatcaggtcattta

SEQ ID NO: 1221194 - DNA, 22 bp, Artificial Sequence
  chemically synthesized
aggcaaaacaataaatgacctg

SEQ ID NO: 1221195 - DNA, 22 bp, Artificial Sequence
  chemically synthesized
ggcaaaacaataaatgacctga

SEQ ID NO: 1221196 - DNA, 22 bp, Artificial Sequence
  chemically synthesized
tgtttttcagttccatcaggtc

SEQ ID NO: 1221197 - DNA, 22 bp, Artificial Sequence
  chemically synthesized
tgctgtgtttttcagttccatc

SEQ ID NO: 1221198 - DNA, 22 bp, Artificial Sequence
  chemically synthesized
ttgtgctgtgtttttcagttcc

SEQ ID NO: 1221199 - DNA, 22 bp, Artificial Sequence
  chemically synthesized
atgaagttgttgtgctgtgttt

SEQ ID NO: 1221200 - DNA, 22 bp, Artificial Sequence
  chemically synthesized
atggaactgaaaaacacagcac

SEQ ID NO: 1221201 - DNA, 22 bp, Artificial Sequence
  chemically synthesized
catgaagttgttgtgctgtgtt

SEQ ID NO: 1221202 - DNA, 22 bp, Artificial Sequence
  chemically synthesized
aaaaacacagcacaacaacttc

SEQ ID NO: 1221203 - DNA, 22 bp, Artificial Sequence
  chemically synthesized
tgtatgcttcatgaagttgttg

SEQ ID NO: 1221204 - DNA, 22 bp, Artificial Sequence
  chemically synthesized
gtgtatgcttcatgaagttgtt

SEQ ID NO: 1221205 - DNA, 22 bp, Artificial Sequence
  chemically synthesized
atacttgtgtatgcttcatgaa

SEQ ID NO: 1221206 - DNA, 22 bp, Artificial Sequence
  chemically synthesized
ttgatacttgtgtatgcttcat

SEQ ID NO: 1221207 - DNA, 22 bp, Artificial Sequence
  chemically synthesized
agctattgatacttgtgtatgc

SEQ ID NO: 1221208 - DNA, 22 bp, Artificial Sequence
  chemically synthesized
catgaagcatacacaagtatca

SEQ ID NO: 1221209 - DNA, 22 bp, Artificial Sequence
  chemically synthesized
atgaagcatacacaagtatcaa

SEQ ID NO: 1221210 - DNA, 22 bp, Artificial Sequence
  chemically synthesized
gatcgattgagctattgatact

SEQ ID NO: 1221211 - DNA, 22 bp, Artificial Sequence
  chemically synthesized
ctggatcgattgagctattgat

SEQ ID NO: 1221212 - DNA, 22 bp, Artificial Sequence
  chemically synthesized
tgctggatcgattgagctattg

SEQ ID NO: 1221213 - DNA, 22 bp, Artificial Sequence
  chemically synthesized
ctgctggatcgattgagctatt

SEQ ID NO: 1221214 - DNA, 22 bp, Artificial Sequence
  chemically synthesized
ttctgctggatcgattgagcta

SEQ ID NO: 1221215 - DNA, 22 bp, Artificial Sequence
  chemically synthesized
cttctgctggatcgattgagct

SEQ ID NO: 1221216 - DNA, 22 bp, Artificial Sequence
  chemically synthesized
tcttctgctggatcgattgagc

SEQ ID NO: 1221217 - DNA, 22 bp, Artificial Sequence
  chemically synthesized
ttcttctgctggatcgattgag

SEQ ID NO: 1221218 - DNA, 22 bp, Artificial Sequence
  chemically synthesized
atatcttttcttctgctggatc

SEQ ID NO: 1221219 - DNA, 22 bp, Artificial Sequence
  chemically synthesized
tgatatcttttcttctgctgga

SEQ ID NO: 1221220 - DNA, 22 bp, Artificial Sequence
  chemically synthesized
aatcgatccagcagaagaaaag

SEQ ID NO: 1221221 - DNA, 22 bp, Artificial Sequence
  chemically synthesized
aatctctgatatcttttcttct

SEQ ID NO: 1221222 - DNA, 22 bp, Artificial Sequence
  chemically synthesized
caatctctgatatcttttcttc

SEQ ID NO: 1221223 - DNA, 22 bp, Artificial Sequence
  chemically synthesized
atcttcaatctctgatatcttt

SEQ ID NO: 1221224 - DNA, 22 bp, Artificial Sequence
  chemically synthesized
agttgatcttcaatctctgata

SEQ ID NO: 1221225 - DNA, 22 bp, Artificial Sequence
  chemically synthesized
attaagttgatcttcaatctct

SEQ ID NO: 1221226 - DNA, 22 bp, Artificial Sequence
  chemically synthesized
cattaagttgatcttcaatctc

SEQ ID NO: 1221227 - DNA, 22 bp, Artificial Sequence
  chemically synthesized
tttcattaagttgatcttcaat

SEQ ID NO: 1221228 - DNA, 22 bp, Artificial Sequence
  chemically synthesized
atttcattaagttgatcttcaa

SEQ ID NO: 1221229 - DNA, 22 bp, Artificial Sequence
  chemically synthesized
tatttcattaagttgatcttca

SEQ ID NO: 1221230 - DNA, 22 bp, Artificial Sequence
  chemically synthesized
acactttatttcattaagttga

SEQ ID NO: 1221231 - DNA, 22 bp, Artificial Sequence
  chemically synthesized
cacactttatttcattaagttg

SEQ ID NO: 1221232 - DNA, 22 bp, Artificial Sequence
  chemically synthesized
tcttcacactttatttcattaa

SEQ ID NO: 1221233 - DNA, 22 bp, Artificial Sequence
  chemically synthesized
gtcttcacactttatttcatta

SEQ ID NO: 1221234 - DNA, 22 bp, Artificial Sequence
  chemically synthesized
aagatcaacttaatgaaataaa

SEQ ID NO: 1221235 - DNA, 22 bp, Artificial Sequence
  chemically synthesized
atcttgtcttcacactttattt

SEQ ID NO: 1221236 - DNA, 22 bp, Artificial Sequence
  chemically synthesized
taatcttgtcttcacactttat

SEQ ID NO: 1221237 - DNA, 22 bp, Artificial Sequence
  chemically synthesized
tctaatcttgtcttcacacttt

SEQ ID NO: 1221238 - DNA, 22 bp, Artificial Sequence
  chemically synthesized
ctctaatcttgtcttcacactt

SEQ ID NO: 1221239 - DNA, 22 bp, Artificial Sequence
  chemically synthesized
tctctaatcttgtcttcacact

SEQ ID NO: 1221240 - DNA, 22 bp, Artificial Sequence
  chemically synthesized
ttctctaatcttgtcttcacac

SEQ ID NO: 1221241 - DNA, 22 bp, Artificial Sequence
  chemically synthesized
aatgaaataaagtgtgaagaca

SEQ ID NO: 1221242 - DNA, 22 bp, Artificial Sequence
  chemically synthesized
tttctctaatcttgtcttcaca

SEQ ID NO: 1221243 - DNA, 22 bp, Artificial Sequence
  chemically synthesized
atgaaataaagtgtgaagacaa

SEQ ID NO: 1221244 - DNA, 22 bp, Artificial Sequence
  chemically synthesized
ttttctctaatcttgtcttcac

SEQ ID NO: 1221245 - DNA, 22 bp, Artificial Sequence
  chemically synthesized
ttttttctctaatcttgtcttc

SEQ ID NO: 1221246 - DNA, 22 bp, Artificial Sequence
  chemically synthesized
attcttttttctctaatcttgt

SEQ ID NO: 1221247 - DNA, 22 bp, Artificial Sequence
  chemically synthesized
cattcttttttctctaatcttg

SEQ ID NO: 1221248 - DNA, 22 bp, Artificial Sequence
  chemically synthesized
tcattcttttttctctaatctt

SEQ ID NO: 1221249 - DNA, 22 bp, Artificial Sequence
  chemically synthesized
ttcattcttttttctctaatct

SEQ ID NO: 1221250 - DNA, 22 bp, Artificial Sequence
  chemically synthesized
cttttcattcttttttctctaa

SEQ ID NO: 1221251 - DNA, 22 bp, Artificial Sequence
  chemically synthesized
attccttttcattcttttttct

SEQ ID NO: 1221252 - DNA, 22 bp, Artificial Sequence
  chemically synthesized
ttcattccttttcattcttttt

SEQ ID NO: 1221253 - DNA, 22 bp, Artificial Sequence
  chemically synthesized
gttcattccttttcattctttt

SEQ ID NO: 1221254 - DNA, 22 bp, Artificial Sequence
  chemically synthesized
tgttcattccttttcattcttt

SEQ ID NO: 1221255 - DNA, 22 bp, Artificial Sequence
  chemically synthesized
gagaaaaaagaatgaaaaggaa

SEQ ID NO: 1221256 - DNA, 22 bp, Artificial Sequence
  chemically synthesized
gtggaggctttgttcattcctt

SEQ ID NO: 1221257 - DNA, 22 bp, Artificial Sequence
  chemically synthesized
cgtggaggctttgttcattcct

SEQ ID NO: 1221258 - DNA, 22 bp, Artificial Sequence
  chemically synthesized
acatagtcccatatttcgtgga

SEQ ID NO: 1221259 - DNA, 22 bp, Artificial Sequence
  chemically synthesized
cacatagtcccatatttcgtgg

SEQ ID NO: 1221260 - DNA, 22 bp, Artificial Sequence
  chemically synthesized
tcacatagtcccatatttcgtg

SEQ ID NO: 1221261 - DNA, 22 bp, Artificial Sequence
  chemically synthesized
ttcacatagtcccatatttcgt

SEQ ID NO: 1221262 - DNA, 22 bp, Artificial Sequence
  chemically synthesized
tcttttcacatagtcccatatt

SEQ ID NO: 1221263 - DNA, 22 bp, Artificial Sequence
  chemically synthesized
gtcttttcacatagtcccatat

SEQ ID NO: 1221264 - DNA, 22 bp, Artificial Sequence
  chemically synthesized
tgtcttttcacatagtcccata

SEQ ID NO: 1221265 - DNA, 22 bp, Artificial Sequence
  chemically synthesized
cacgaaatatgggactatgtga

SEQ ID NO: 1221266 - DNA, 22 bp, Artificial Sequence
  chemically synthesized
ggttttgtcttttcacatagtc

SEQ ID NO: 1221267 - DNA, 22 bp, Artificial Sequence
  chemically synthesized
aggttttgtcttttcacatagt

SEQ ID NO: 1221268 - DNA, 22 bp, Artificial Sequence
  chemically synthesized
atcaaacttaggttttgtcttt

SEQ ID NO: 1221269 - DNA, 22 bp, Artificial Sequence
  chemically synthesized
tgtgaaaagacaaaacctaagt

SEQ ID NO: 1221270 - DNA, 22 bp, Artificial Sequence
  chemically synthesized
ccaggtatactaatcaaactta

SEQ ID NO: 1221271 - DNA, 22 bp, Artificial Sequence
  chemically synthesized
cccaggtatactaatcaaactt

SEQ ID NO: 1221272 - DNA, 22 bp, Artificial Sequence
  chemically synthesized
tcccaggtatactaatcaaact

SEQ ID NO: 1221273 - DNA, 22 bp, Artificial Sequence
  chemically synthesized
aagaatgttttcccaggtatac

SEQ ID NO: 1221274 - DNA, 22 bp, Artificial Sequence
  chemically synthesized
agtttgattagtatacctggga

SEQ ID NO: 1221275 - DNA, 22 bp, Artificial Sequence
  chemically synthesized
gattagtatacctgggaaaaca

SEQ ID NO: 1221276 - DNA, 22 bp, Artificial Sequence
  chemically synthesized
attagtatacctgggaaaacat

SEQ ID NO: 1221277 - DNA, 22 bp, Artificial Sequence
  chemically synthesized
gtatacctgggaaaacattctt

SEQ ID NO: 1221278 - DNA, 22 bp, Artificial Sequence
  chemically synthesized
gccgggataatatcctgaagaa

SEQ ID NO: 1221279 - DNA, 22 bp, Artificial Sequence
  chemically synthesized
ggaaaacattcttcaggatatt

SEQ ID NO: 1221280 - DNA, 22 bp, Artificial Sequence
  chemically synthesized
ggaaagttcgccgggataatat

SEQ ID NO: 1221281 - DNA, 22 bp, Artificial Sequence
  chemically synthesized
gggaaagttcgccgggataata

SEQ ID NO: 1221282 - DNA, 22 bp, Artificial Sequence
  chemically synthesized
gtttgggaaagttcgccgggat

SEQ ID NO: 1221283 - DNA, 22 bp, Artificial Sequence
  chemically synthesized
ttcaggatattatcccggcgaa

SEQ ID NO: 1221284 - DNA, 22 bp, Artificial Sequence
  chemically synthesized
caggatattatcccggcgaact

SEQ ID NO: 1221285 - DNA, 22 bp, Artificial Sequence
  chemically synthesized
ctagtttgggaaagttcgccgg

SEQ ID NO: 1221286 - DNA, 22 bp, Artificial Sequence
  chemically synthesized
aggatattatcccggcgaactt

SEQ ID NO: 1221287 - DNA, 22 bp, Artificial Sequence
  chemically synthesized
gctagtttgggaaagttcgccg

SEQ ID NO: 1221288 - DNA, 22 bp, Artificial Sequence
  chemically synthesized
tcttgctagtttgggaaagttc

SEQ ID NO: 1221289 - DNA, 22 bp, Artificial Sequence
  chemically synthesized
tcccggcgaactttcccaaact

SEQ ID NO: 1221290 - DNA, 22 bp, Artificial Sequence
  chemically synthesized
aatggtgggctgtcttgctagt

SEQ ID NO: 1221291 - DNA, 22 bp, Artificial Sequence
  chemically synthesized
gaatggtgggctgtcttgctag

SEQ ID NO: 1221292 - DNA, 22 bp, Artificial Sequence
  chemically synthesized
tcccaaactagcaagacagccc

SEQ ID NO: 1221293 - DNA, 22 bp, Artificial Sequence
  chemically synthesized
aatttgaatggtgggctgtctt

SEQ ID NO: 1221294 - DNA, 22 bp, Artificial Sequence
  chemically synthesized
cccaaactagcaagacagccca

SEQ ID NO: 1221295 - DNA, 22 bp, Artificial Sequence
  chemically synthesized
ccaaactagcaagacagcccac

SEQ ID NO: 1221296 - DNA, 22 bp, Artificial Sequence
  chemically synthesized
ctaaatttgaatggtgggctgt

SEQ ID NO: 1221297 - DNA, 22 bp, Artificial Sequence
  chemically synthesized
cctaaatttgaatggtgggctg

SEQ ID NO: 1221298 - DNA, 22 bp, Artificial Sequence
  chemically synthesized
tatttcctaaatttgaatggtg

SEQ ID NO: 1221299 - DNA, 22 bp, Artificial Sequence
  chemically synthesized
gcaagacagcccaccattcaaa

SEQ ID NO: 1221300 - DNA, 22 bp, Artificial Sequence
  chemically synthesized
tgtatttcctaaatttgaatgg

SEQ ID NO: 1221301 - DNA, 22 bp, Artificial Sequence
  chemically synthesized
tctgtatttcctaaatttgaat

SEQ ID NO: 1221302 - DNA, 22 bp, Artificial Sequence
  chemically synthesized
tggatgttctctgtatttccta

SEQ ID NO: 1221303 - DNA, 22 bp, Artificial Sequence
  chemically synthesized
gtggatgttctctgtatttcct

SEQ ID NO: 1221304 - DNA, 22 bp, Artificial Sequence
  chemically synthesized
tgtggatgttctctgtatttcc

SEQ ID NO: 1221305 - DNA, 22 bp, Artificial Sequence
  chemically synthesized
ttgtggatgttctctgtatttc

SEQ ID NO: 1221306 - DNA, 22 bp, Artificial Sequence
  chemically synthesized
aaatttaggaaatacagagaac

SEQ ID NO: 1221307 - DNA, 22 bp, Artificial Sequence
  chemically synthesized
aggaaatacagagaacatccac

SEQ ID NO: 1221308 - DNA, 22 bp, Artificial Sequence
  chemically synthesized
aggagtatttttgtggatgttc

SEQ ID NO: 1221309 - DNA, 22 bp, Artificial Sequence
  chemically synthesized
ggaaatacagagaacatccaca

SEQ ID NO: 1221310 - DNA, 22 bp, Artificial Sequence
  chemically synthesized
gaggagtatttttgtggatgtt

SEQ ID NO: 1221311 - DNA, 22 bp, Artificial Sequence
  chemically synthesized
tgaggagtatttttgtggatgt

SEQ ID NO: 1221312 - DNA, 22 bp, Artificial Sequence
  chemically synthesized
ttgaggagtatttttgtggatg

SEQ ID NO: 1221313 - DNA, 22 bp, Artificial Sequence
  chemically synthesized
tttgaggagtatttttgtggat

SEQ ID NO: 1221314 - DNA, 22 bp, Artificial Sequence
  chemically synthesized
tttttgaggagtatttttgtgg

SEQ ID NO: 1221315 - DNA, 22 bp, Artificial Sequence
  chemically synthesized
ctctttttgaggagtatttttg

SEQ ID NO: 1221316 - DNA, 22 bp, Artificial Sequence
  chemically synthesized
gggttgctctttttgaggagta

SEQ ID NO: 1221317 - DNA, 22 bp, Artificial Sequence
  chemically synthesized
ggggttgctctttttgaggagt

SEQ ID NO: 1221318 - DNA, 22 bp, Artificial Sequence
  chemically synthesized
tgtgtcttggggttgctctttt

SEQ ID NO: 1221319 - DNA, 22 bp, Artificial Sequence
  chemically synthesized
acaattatgtgtcttggggttg

SEQ ID NO: 1221320 - DNA, 22 bp, Artificial Sequence
  chemically synthesized
ctcaaaaagagcaaccccaaga

SEQ ID NO: 1221321 - DNA, 22 bp, Artificial Sequence
  chemically synthesized
aaaaagagcaaccccaagacac

SEQ ID NO: 1221322 - DNA, 22 bp, Artificial Sequence
  chemically synthesized
gtgaatctgacaattatgtgtc

SEQ ID NO: 1221323 - DNA, 22 bp, Artificial Sequence
  chemically synthesized
ggtgaatctgacaattatgtgt

SEQ ID NO: 1221324 - DNA, 22 bp, Artificial Sequence
  chemically synthesized
aaccttggtgaatctgacaatt

SEQ ID NO: 1221325 - DNA, 22 bp, Artificial Sequence
  chemically synthesized
caaccttggtgaatctgacaat

SEQ ID NO: 1221326 - DNA, 22 bp, Artificial Sequence
  chemically synthesized
atttcaaccttggtgaatctga

SEQ ID NO: 1221327 - DNA, 22 bp, Artificial Sequence
  chemically synthesized
catttcaaccttggtgaatctg

SEQ ID NO: 1221328 - DNA, 22 bp, Artificial Sequence
  chemically synthesized
cttcatttcaaccttggtgaat

SEQ ID NO: 1221329 - DNA, 22 bp, Artificial Sequence
  chemically synthesized
ccttcatttcaaccttggtgaa

SEQ ID NO: 1221330 - DNA, 22 bp, Artificial Sequence
  chemically synthesized
tccttcatttcaaccttggtga

SEQ ID NO: 1221331 - DNA, 22 bp, Artificial Sequence
  chemically synthesized
ttccttcatttcaaccttggtg

SEQ ID NO: 1221332 - DNA, 22 bp, Artificial Sequence
  chemically synthesized
tttccttcatttcaaccttggt

SEQ ID NO: 1221333 - DNA, 22 bp, Artificial Sequence
  chemically synthesized
tcagattcaccaaggttgaaat

SEQ ID NO: 1221334 - DNA, 22 bp, Artificial Sequence
  chemically synthesized
aacattttttccttcatttcaa

SEQ ID NO: 1221335 - DNA, 22 bp, Artificial Sequence
  chemically synthesized
accaaggttgaaatgaaggaaa

SEQ ID NO: 1221336 - DNA, 22 bp, Artificial Sequence
  chemically synthesized
tcctgaacattttttccttcat

SEQ ID NO: 1221337 - DNA, 22 bp, Artificial Sequence
  chemically synthesized
actgtcctgaacattttttcct

SEQ ID NO: 1221338 - DNA, 22 bp, Artificial Sequence
  chemically synthesized
gactgtcctgaacattttttcc

SEQ ID NO: 1221339 - DNA, 22 bp, Artificial Sequence
  chemically synthesized
tgactgtcctgaacattttttc

SEQ ID NO: 1221340 - DNA, 22 bp, Artificial Sequence
  chemically synthesized
tttgactgtcctgaacattttt

SEQ ID NO: 1221341 - DNA, 22 bp, Artificial Sequence
  chemically synthesized
aaatgaaggaaaaaatgttcag

SEQ ID NO: 1221342 - DNA, 22 bp, Artificial Sequence
  chemically synthesized
tctttgactgtcctgaacattt

SEQ ID NO: 1221343 - DNA, 22 bp, Artificial Sequence
  chemically synthesized
ctctttgactgtcctgaacatt

SEQ ID NO: 1221344 - DNA, 22 bp, Artificial Sequence
  chemically synthesized
tctctttgactgtcctgaacat

SEQ ID NO: 1221345 - DNA, 22 bp, Artificial Sequence
  chemically synthesized
tgggtaagccgacctttctctt

SEQ ID NO: 1221346 - DNA, 22 bp, Artificial Sequence
  chemically synthesized
gtgggtaagccgacctttctct

SEQ ID NO: 1221347 - DNA, 22 bp, Artificial Sequence
  chemically synthesized
aggacagtcaaagagaaaggtc

SEQ ID NO: 1221348 - DNA, 22 bp, Artificial Sequence
  chemically synthesized
tgtgggtaagccgacctttctc

SEQ ID NO: 1221349 - DNA, 22 bp, Artificial Sequence
  chemically synthesized
cctttgtgggtaagccgacctt

SEQ ID NO: 1221350 - DNA, 22 bp, Artificial Sequence
  chemically synthesized
ccctttgtgggtaagccgacct

SEQ ID NO: 1221351 - DNA, 22 bp, Artificial Sequence
  chemically synthesized
atgggcttccctttgtgggtaa

SEQ ID NO: 1221352 - DNA, 22 bp, Artificial Sequence
  chemically synthesized
gtctgatgggcttccctttgtg

SEQ ID NO: 1221353 - DNA, 22 bp, Artificial Sequence
  chemically synthesized
ttagtctgatgggcttcccttt

SEQ ID NO: 1221354 - DNA, 22 bp, Artificial Sequence
  chemically synthesized
ctgttagtctgatgggcttccc

SEQ ID NO: 1221355 - DNA, 22 bp, Artificial Sequence
  chemically synthesized
acccacaaagggaagcccatca

SEQ ID NO: 1221356 - DNA, 22 bp, Artificial Sequence
  chemically synthesized
cccacaaagggaagcccatcag

SEQ ID NO: 1221357 - DNA, 22 bp, Artificial Sequence
  chemically synthesized
cagaaagatctgctgttagtct

SEQ ID NO: 1221358 - DNA, 22 bp, Artificial Sequence
  chemically synthesized
tgcagaaagatctgctgttagt

SEQ ID NO: 1221359 - DNA, 22 bp, Artificial Sequence
  chemically synthesized
ctgcagaaagatctgctgttag

SEQ ID NO: 1221360 - DNA, 22 bp, Artificial Sequence
  chemically synthesized
tagggtttctgcagaaagatct

SEQ ID NO: 1221361 - DNA, 22 bp, Artificial Sequence
  chemically synthesized
gtagggtttctgcagaaagatc

SEQ ID NO: 1221362 - DNA, 22 bp, Artificial Sequence
  chemically synthesized
gcttgtagggtttctgcagaaa

SEQ ID NO: 1221363 - DNA, 22 bp, Artificial Sequence
  chemically synthesized
acagcagatctttctgcagaaa

SEQ ID NO: 1221364 - DNA, 22 bp, Artificial Sequence
  chemically synthesized
tggcttgtagggtttctgcaga

SEQ ID NO: 1221365 - DNA, 22 bp, Artificial Sequence
  chemically synthesized
ctggcttgtagggtttctgcag

SEQ ID NO: 1221366 - DNA, 22 bp, Artificial Sequence
  chemically synthesized
ttctggcttgtagggtttctgc

SEQ ID NO: 1221367 - DNA, 22 bp, Artificial Sequence
  chemically synthesized
tcttctggcttgtagggtttct

SEQ ID NO: 1221368 - DNA, 22 bp, Artificial Sequence
  chemically synthesized
ctctcttctggcttgtagggtt

SEQ ID NO: 1221369 - DNA, 22 bp, Artificial Sequence
  chemically synthesized
tctgcagaaaccctacaagcca

SEQ ID NO: 1221370 - DNA, 22 bp, Artificial Sequence
  chemically synthesized
ctgcagaaaccctacaagccag

SEQ ID NO: 1221371 - DNA, 22 bp, Artificial Sequence
  chemically synthesized
tgcagaaaccctacaagccaga

SEQ ID NO: 1221372 - DNA, 22 bp, Artificial Sequence
  chemically synthesized
gcccctactctcttctggcttg

SEQ ID NO: 1221373 - DNA, 22 bp, Artificial Sequence
  chemically synthesized
cagaaaccctacaagccagaag

SEQ ID NO: 1221374 - DNA, 22 bp, Artificial Sequence
  chemically synthesized
aatattggcccctactctcttc

SEQ ID NO: 1221375 - DNA, 22 bp, Artificial Sequence
  chemically synthesized
caagccagaagagagtaggggc

SEQ ID NO: 1221376 - DNA, 22 bp, Artificial Sequence
  chemically synthesized
agaatgttgaatattggcccct

SEQ ID NO: 1221377 - DNA, 22 bp, Artificial Sequence
  chemically synthesized
aagaatgttgaatattggcccc

SEQ ID NO: 1221378 - DNA, 22 bp, Artificial Sequence
  chemically synthesized
taagaatgttgaatattggccc

SEQ ID NO: 1221379 - DNA, 22 bp, Artificial Sequence
  chemically synthesized
ttttaagaatgttgaatattgg

SEQ ID NO: 1221380 - DNA, 22 bp, Artificial Sequence
  chemically synthesized
aaaattattttaagaatgttga

SEQ ID NO: 1221381 - DNA, 22 bp, Artificial Sequence
  chemically synthesized
agttaaaaattattttaagaat

SEQ ID NO: 1221382 - DNA, 22 bp, Artificial Sequence
  chemically synthesized
tgagttaaaaattattttaaga

SEQ ID NO: 1221383 - DNA, 22 bp, Artificial Sequence
  chemically synthesized
aacattcttaaaataattttta

SEQ ID NO: 1221384 - DNA, 22 bp, Artificial Sequence
  chemically synthesized
tgaaattctgagttaaaaatta

SEQ ID NO: 1221385 - DNA, 22 bp, Artificial Sequence
  chemically synthesized
gctatgaaattctgagttaaaa

SEQ ID NO: 1221386 - DNA, 22 bp, Artificial Sequence
  chemically synthesized
ttaaaataatttttaactcaga

SEQ ID NO: 1221387 - DNA, 22 bp, Artificial Sequence
  chemically synthesized
aaaataatttttaactcagaat

SEQ ID NO: 1221388 - DNA, 22 bp, Artificial Sequence
  chemically synthesized
actggctatgaaattctgagtt

SEQ ID NO: 1221389 - DNA, 22 bp, Artificial Sequence
  chemically synthesized
aaataatttttaactcagaatt

SEQ ID NO: 1221390 - DNA, 22 bp, Artificial Sequence
  chemically synthesized
gactggctatgaaattctgagt

SEQ ID NO: 1221391 - DNA, 22 bp, Artificial Sequence
  chemically synthesized
gtttgactggctatgaaattct

SEQ ID NO: 1221392 - DNA, 22 bp, Artificial Sequence
  chemically synthesized
agtttgactggctatgaaattc

SEQ ID NO: 1221393 - DNA, 22 bp, Artificial Sequence
  chemically synthesized
ttaactcagaatttcatagcca

SEQ ID NO: 1221394 - DNA, 22 bp, Artificial Sequence
  chemically synthesized
taactcagaatttcatagccag

SEQ ID NO: 1221395 - DNA, 22 bp, Artificial Sequence
  chemically synthesized
aactcagaatttcatagccagt

SEQ ID NO: 1221396 - DNA, 22 bp, Artificial Sequence
  chemically synthesized
actcagaatttcatagccagtc

SEQ ID NO: 1221397 - DNA, 22 bp, Artificial Sequence
  chemically synthesized
tgaagcttagtttgactggcta

SEQ ID NO: 1221398 - DNA, 22 bp, Artificial Sequence
  chemically synthesized
atgaagcttagtttgactggct

SEQ ID NO: 1221399 - DNA, 22 bp, Artificial Sequence
  chemically synthesized
agaatttcatagccagtcaaac

SEQ ID NO: 1221400 - DNA, 22 bp, Artificial Sequence
  chemically synthesized
gcttatgaagcttagtttgact

SEQ ID NO: 1221401 - DNA, 22 bp, Artificial Sequence
  chemically synthesized
cgcttatgaagcttagtttgac

SEQ ID NO: 1221402 - DNA, 22 bp, Artificial Sequence
  chemically synthesized
cttcgcttatgaagcttagttt

SEQ ID NO: 1221403 - DNA, 22 bp, Artificial Sequence
  chemically synthesized
catagccagtcaaactaagctt

SEQ ID NO: 1221404 - DNA, 22 bp, Artificial Sequence
  chemically synthesized
atagccagtcaaactaagcttc

SEQ ID NO: 1221405 - DNA, 22 bp, Artificial Sequence
  chemically synthesized
tccttcgcttatgaagcttagt

SEQ ID NO: 1221406 - DNA, 22 bp, Artificial Sequence
  chemically synthesized
ctccttcgcttatgaagcttag

SEQ ID NO: 1221407 - DNA, 22 bp, Artificial Sequence
  chemically synthesized
tttctccttcgcttatgaagct

SEQ ID NO: 1221408 - DNA, 22 bp, Artificial Sequence
  chemically synthesized
tatttctccttcgcttatgaag

SEQ ID NO: 1221409 - DNA, 22 bp, Artificial Sequence
  chemically synthesized
aagcattctatttctccttcgc

SEQ ID NO: 1221410 - DNA, 22 bp, Artificial Sequence
  chemically synthesized
aaagcattctatttctccttcg

SEQ ID NO: 1221411 - DNA, 22 bp, Artificial Sequence
  chemically synthesized
agcttcataagcgaaggagaaa

SEQ ID NO: 1221412 - DNA, 22 bp, Artificial Sequence
  chemically synthesized
taaagcattctatttctccttc

SEQ ID NO: 1221413 - DNA, 22 bp, Artificial Sequence
  chemically synthesized
cataagcgaaggagaaatagaa

SEQ ID NO: 1221414 - DNA, 22 bp, Artificial Sequence
  chemically synthesized
gtctttaaagcattctatttct

SEQ ID NO: 1221415 - DNA, 22 bp, Artificial Sequence
  chemically synthesized
ataagcgaaggagaaatagaat

SEQ ID NO: 1221416 - DNA, 22 bp, Artificial Sequence
  chemically synthesized
ctcgtctttaaagcattctatt

SEQ ID NO: 1221417 - DNA, 22 bp, Artificial Sequence
  chemically synthesized
gctcgtctttaaagcattctat

SEQ ID NO: 1221418 - DNA, 22 bp, Artificial Sequence
  chemically synthesized
agcatttgctcgtctttaaagc

SEQ ID NO: 1221419 - DNA, 22 bp, Artificial Sequence
  chemically synthesized
tcagcatttgctcgtctttaaa

SEQ ID NO: 1221420 - DNA, 22 bp, Artificial Sequence
  chemically synthesized
taaagacgagcaaatgctgaga

SEQ ID NO: 1221421 - DNA, 22 bp, Artificial Sequence
  chemically synthesized
aaagacgagcaaatgctgagag

SEQ ID NO: 1221422 - DNA, 22 bp, Artificial Sequence
  chemically synthesized
aagacgagcaaatgctgagaga

SEQ ID NO: 1221423 - DNA, 22 bp, Artificial Sequence
  chemically synthesized
gtggtgacaaaatctctcagca

SEQ ID NO: 1221424 - DNA, 22 bp, Artificial Sequence
  chemically synthesized
taagacaggcctggtggtgaca

SEQ ID NO: 1221425 - DNA, 22 bp, Artificial Sequence
  chemically synthesized
gtaagacaggcctggtggtgac

SEQ ID NO: 1221426 - DNA, 22 bp, Artificial Sequence
  chemically synthesized
ttgtaagacaggcctggtggtg

SEQ ID NO: 1221427 - DNA, 22 bp, Artificial Sequence
  chemically synthesized
agagattttgtcaccaccaggc

SEQ ID NO: 1221428 - DNA, 22 bp, Artificial Sequence
  chemically synthesized
tgtcaccaccaggcctgtctta

SEQ ID NO: 1221429 - DNA, 22 bp, Artificial Sequence
  chemically synthesized
aaggagctcttgtaagacaggc

SEQ ID NO: 1221430 - DNA, 22 bp, Artificial Sequence
  chemically synthesized
gtcaccaccaggcctgtcttac

SEQ ID NO: 1221431 - DNA, 22 bp, Artificial Sequence
  chemically synthesized
tcaccaccaggcctgtcttaca

SEQ ID NO: 1221432 - DNA, 22 bp, Artificial Sequence
  chemically synthesized
ctgaaggagctcttgtaagaca

SEQ ID NO: 1221433 - DNA, 22 bp, Artificial Sequence
  chemically synthesized
cctgaaggagctcttgtaagac

SEQ ID NO: 1221434 - DNA, 22 bp, Artificial Sequence
  chemically synthesized
gtgcttcctgaaggagctcttg

SEQ ID NO: 1221435 - DNA, 22 bp, Artificial Sequence
  chemically synthesized
agtgcttcctgaaggagctctt

SEQ ID NO: 1221436 - DNA, 22 bp, Artificial Sequence
  chemically synthesized
tcttacaagagctccttcagga

SEQ ID NO: 1221437 - DNA, 22 bp, Artificial Sequence
  chemically synthesized
ccatatttagtgcttcctgaag

SEQ ID NO: 1221438 - DNA, 22 bp, Artificial Sequence
  chemically synthesized
gccatatttagtgcttcctgaa

SEQ ID NO: 1221439 - DNA, 22 bp, Artificial Sequence
  chemically synthesized
acaagagctccttcaggaagca

SEQ ID NO: 1221440 - DNA, 22 bp, Artificial Sequence
  chemically synthesized
caagagctccttcaggaagcac

SEQ ID NO: 1221441 - DNA, 22 bp, Artificial Sequence
  chemically synthesized
tccttgccatatttagtgcttc

SEQ ID NO: 1221442 - DNA, 22 bp, Artificial Sequence
  chemically synthesized
gtccttgccatatttagtgctt

SEQ ID NO: 1221443 - DNA, 22 bp, Artificial Sequence
  chemically synthesized
gtttgtccttgccatatttagt

SEQ ID NO: 1221444 - DNA, 22 bp, Artificial Sequence
  chemically synthesized
cttcaggaagcactaaatatgg

SEQ ID NO: 1221445 - DNA, 22 bp, Artificial Sequence
  chemically synthesized
caggaagcactaaatatggcaa

SEQ ID NO: 1221446 - DNA, 22 bp, Artificial Sequence
  chemically synthesized
aggaagcactaaatatggcaag

SEQ ID NO: 1221447 - DNA, 22 bp, Artificial Sequence
  chemically synthesized
gtactggtttgtccttgccata

SEQ ID NO: 1221448 - DNA, 22 bp, Artificial Sequence
  chemically synthesized
cagtggctggtactggtttgtc

SEQ ID NO: 1221449 - DNA, 22 bp, Artificial Sequence
  chemically synthesized
aatatggcaaggacaaaccagt

SEQ ID NO: 1221450 - DNA, 22 bp, Artificial Sequence
  chemically synthesized
tgcagtggctggtactggtttg

SEQ ID NO: 1221451 - DNA, 22 bp, Artificial Sequence
  chemically synthesized
ctgcagtggctggtactggttt

SEQ ID NO: 1221452 - DNA, 22 bp, Artificial Sequence
  chemically synthesized
gtatgcttctgcagtggctggt

SEQ ID NO: 1221453 - DNA, 22 bp, Artificial Sequence
  chemically synthesized
ggtatgcttctgcagtggctgg

SEQ ID NO: 1221454 - DNA, 22 bp, Artificial Sequence
  chemically synthesized
caatttggtatgcttctgcagt

SEQ ID NO: 1221455 - DNA, 22 bp, Artificial Sequence
  chemically synthesized
acaatttggtatgcttctgcag

SEQ ID NO: 1221456 - DNA, 22 bp, Artificial Sequence
  chemically synthesized
cagaagcataccaaattgtaaa

SEQ ID NO: 1221457 - DNA, 22 bp, Artificial Sequence
  chemically synthesized
atggtgtcgatggtgtttacaa

SEQ ID NO: 1221458 - DNA, 22 bp, Artificial Sequence
  chemically synthesized
catggtgtcgatggtgtttaca

SEQ ID NO: 1221459 - DNA, 22 bp, Artificial Sequence
  chemically synthesized
ttcatggtgtcgatggtgttta

SEQ ID NO: 1221460 - DNA, 22 bp, Artificial Sequence
  chemically synthesized
cttcatggtgtcgatggtgttt

SEQ ID NO: 1221461 - DNA, 22 bp, Artificial Sequence
  chemically synthesized
atgcagtttcttcatggtgtcg

SEQ ID NO: 1221462 - DNA, 22 bp, Artificial Sequence
  chemically synthesized
taaacaccatcgacaccatgaa

SEQ ID NO: 1221463 - DNA, 22 bp, Artificial Sequence
  chemically synthesized
gttgatgcagtttcttcatggt

SEQ ID NO: 1221464 - DNA, 22 bp, Artificial Sequence
  chemically synthesized
ttagttgatgcagtttcttcat

SEQ ID NO: 1221465 - DNA, 22 bp, Artificial Sequence
  chemically synthesized
gttagttgatgcagtttcttca

SEQ ID NO: 1221466 - DNA, 22 bp, Artificial Sequence
  chemically synthesized
cttgttagttgatgcagtttct

SEQ ID NO: 1221467 - DNA, 22 bp, Artificial Sequence
  chemically synthesized
gcttgttagttgatgcagtttc

SEQ ID NO: 1221468 - DNA, 22 bp, Artificial Sequence
  chemically synthesized
tgcttgttagttgatgcagttt

SEQ ID NO: 1221469 - DNA, 22 bp, Artificial Sequence
  chemically synthesized
ttttgcttgttagttgatgcag

SEQ ID NO: 1221470 - DNA, 22 bp, Artificial Sequence
  chemically synthesized
gttattttgcttgttagttgat

SEQ ID NO: 1221471 - DNA, 22 bp, Artificial Sequence
  chemically synthesized
gctggttattttgcttgttagt

SEQ ID NO: 1221472 - DNA, 22 bp, Artificial Sequence
  chemically synthesized
catcaactaacaagcaaaataa

SEQ ID NO: 1221473 - DNA, 22 bp, Artificial Sequence
  chemically synthesized
tgatgctagctggttattttgc

SEQ ID NO: 1221474 - DNA, 22 bp, Artificial Sequence
  chemically synthesized
tcattatgatgctagctggtta

SEQ ID NO: 1221475 - DNA, 22 bp, Artificial Sequence
  chemically synthesized
acaagcaaaataaccagctagc

SEQ ID NO: 1221476 - DNA, 22 bp, Artificial Sequence
  chemically synthesized
atcctgtcattatgatgctagc

SEQ ID NO: 1221477 - DNA, 22 bp, Artificial Sequence
  chemically synthesized
gatcctgtcattatgatgctag

SEQ ID NO: 1221478 - DNA, 22 bp, Artificial Sequence
  chemically synthesized
tgtgtaaatttgatcctgtcat

SEQ ID NO: 1221479 - DNA, 22 bp, Artificial Sequence
  chemically synthesized
ttatgtgtaaatttgatcctgt

SEQ ID NO: 1221480 - DNA, 22 bp, Artificial Sequence
  chemically synthesized
gcatcataatgacaggatcaaa

SEQ ID NO: 1221481 - DNA, 22 bp, Artificial Sequence
  chemically synthesized
atattgttatgtgtaaatttga

SEQ ID NO: 1221482 - DNA, 22 bp, Artificial Sequence
  chemically synthesized
aggttaatattgttatgtgtaa

SEQ ID NO: 1221483 - DNA, 22 bp, Artificial Sequence
  chemically synthesized
aaggttaatattgttatgtgta

SEQ ID NO: 1221484 - DNA, 22 bp, Artificial Sequence
  chemically synthesized
catttaaggttaatattgttat

SEQ ID NO: 1221485 - DNA, 22 bp, Artificial Sequence
  chemically synthesized
acatttaaggttaatattgtta

SEQ ID NO: 1221486 - DNA, 22 bp, Artificial Sequence
  chemically synthesized
acacataacaatattaacctta

SEQ ID NO: 1221487 - DNA, 22 bp, Artificial Sequence
  chemically synthesized
cacataacaatattaaccttaa

SEQ ID NO: 1221488 - DNA, 22 bp, Artificial Sequence
  chemically synthesized
gcccatttacatttaaggttaa

SEQ ID NO: 1221489 - DNA, 22 bp, Artificial Sequence
  chemically synthesized
agcccatttacatttaaggtta

SEQ ID NO: 1221490 - DNA, 22 bp, Artificial Sequence
  chemically synthesized
gggcatttagcccatttacatt

SEQ ID NO: 1221491 - DNA, 22 bp, Artificial Sequence
  chemically synthesized
attggggcatttagcccattta

SEQ ID NO: 1221492 - DNA, 22 bp, Artificial Sequence
  chemically synthesized
aattggggcatttagcccattt

SEQ ID NO: 1221493 - DNA, 22 bp, Artificial Sequence
  chemically synthesized
accttaaatgtaaatgggctaa

SEQ ID NO: 1221494 - DNA, 22 bp, Artificial Sequence
  chemically synthesized
taattggggcatttagcccatt

SEQ ID NO: 1221495 - DNA, 22 bp, Artificial Sequence
  chemically synthesized
ttaattggggcatttagcccat

SEQ ID NO: 1221496 - DNA, 22 bp, Artificial Sequence
  chemically synthesized
aaatgtaaatgggctaaatgcc

SEQ ID NO: 1221497 - DNA, 22 bp, Artificial Sequence
  chemically synthesized
aatgtaaatgggctaaatgccc

SEQ ID NO: 1221498 - DNA, 22 bp, Artificial Sequence
  chemically synthesized
tgtcttttaattggggcattta

SEQ ID NO: 1221499 - DNA, 22 bp, Artificial Sequence
  chemically synthesized
ccagtctgtgtcttttaattgg

SEQ ID NO: 1221500 - DNA, 22 bp, Artificial Sequence
  chemically synthesized
gccagtctgtgtcttttaattg

SEQ ID NO: 1221501 - DNA, 22 bp, Artificial Sequence
  chemically synthesized
aatgccccaattaaaagacaca

SEQ ID NO: 1221502 - DNA, 22 bp, Artificial Sequence
  chemically synthesized
atccaatttgccagtctgtgtc

SEQ ID NO: 1221503 - DNA, 22 bp, Artificial Sequence
  chemically synthesized
catccaatttgccagtctgtgt

SEQ ID NO: 1221504 - DNA, 22 bp, Artificial Sequence
  chemically synthesized
ttcatccaatttgccagtctgt

SEQ ID NO: 1221505 - DNA, 22 bp, Artificial Sequence
  chemically synthesized
actcttcatccaatttgccagt

SEQ ID NO: 1221506 - DNA, 22 bp, Artificial Sequence
  chemically synthesized
gactcttcatccaatttgccag

SEQ ID NO: 1221507 - DNA, 22 bp, Artificial Sequence
  chemically synthesized
aaagacacagactggcaaattg

SEQ ID NO: 1221508 - DNA, 22 bp, Artificial Sequence
  chemically synthesized
gtcttgactcttcatccaattt

SEQ ID NO: 1221509 - DNA, 22 bp, Artificial Sequence
  chemically synthesized
ggtcttgactcttcatccaatt

SEQ ID NO: 1221510 - DNA, 22 bp, Artificial Sequence
  chemically synthesized
gcaaattggatgaagagtcaag

SEQ ID NO: 1221511 - DNA, 22 bp, Artificial Sequence
  chemically synthesized
cagcacaccatttggtcttgac

SEQ ID NO: 1221512 - DNA, 22 bp, Artificial Sequence
  chemically synthesized
gatgaagagtcaagaccaaatg

SEQ ID NO: 1221513 - DNA, 22 bp, Artificial Sequence
  chemically synthesized
actacagcacaccatttggtct

SEQ ID NO: 1221514 - DNA, 22 bp, Artificial Sequence
  chemically synthesized
ctgactacagcacaccatttgg

SEQ ID NO: 1221515 - DNA, 22 bp, Artificial Sequence
  chemically synthesized
tcctgactacagcacaccattt

SEQ ID NO: 1221516 - DNA, 22 bp, Artificial Sequence
  chemically synthesized
ctctcctgactacagcacacca

SEQ ID NO: 1221517 - DNA, 22 bp, Artificial Sequence
  chemically synthesized
cacgtgagattgctctcctgac

SEQ ID NO: 1221518 - DNA, 22 bp, Artificial Sequence
  chemically synthesized
gcacgtgagattgctctcctga

SEQ ID NO: 1221519 - DNA, 22 bp, Artificial Sequence
  chemically synthesized
tgcacgtgagattgctctcctg

SEQ ID NO: 1221520 - DNA, 22 bp, Artificial Sequence
  chemically synthesized
tagtcaggagagcaatctcacg

SEQ ID NO: 1221521 - DNA, 22 bp, Artificial Sequence
  chemically synthesized
tgtgtgtctttgcacgtgagat

SEQ ID NO: 1221522 - DNA, 22 bp, Artificial Sequence
  chemically synthesized
agcctatgtgtgtctttgcacg

SEQ ID NO: 1221523 - DNA, 22 bp, Artificial Sequence
  chemically synthesized
gagcctatgtgtgtctttgcac

SEQ ID NO: 1221524 - DNA, 22 bp, Artificial Sequence
  chemically synthesized
tgagcctatgtgtgtctttgca

SEQ ID NO: 1221525 - DNA, 22 bp, Artificial Sequence
  chemically synthesized
ttttgagcctatgtgtgtcttt

SEQ ID NO: 1221526 - DNA, 22 bp, Artificial Sequence
  chemically synthesized
attttgagcctatgtgtgtctt

SEQ ID NO: 1221527 - DNA, 22 bp, Artificial Sequence
  chemically synthesized
tattttgagcctatgtgtgtct

SEQ ID NO: 1221528 - DNA, 22 bp, Artificial Sequence
  chemically synthesized
ttattttgagcctatgtgtgtc

SEQ ID NO: 1221529 - DNA, 22 bp, Artificial Sequence
  chemically synthesized
acgtgcaaagacacacataggc

SEQ ID NO: 1221530 - DNA, 22 bp, Artificial Sequence
  chemically synthesized
tccttttattttgagcctatgt

SEQ ID NO: 1221531 - DNA, 22 bp, Artificial Sequence
  chemically synthesized
tatccttttattttgagcctat

SEQ ID NO: 1221532 - DNA, 22 bp, Artificial Sequence
  chemically synthesized
ctctatccttttattttgagcc

SEQ ID NO: 1221533 - DNA, 22 bp, Artificial Sequence
  chemically synthesized
gtaaatattcctctatcctttt

SEQ ID NO: 1221534 - DNA, 22 bp, Artificial Sequence
  chemically synthesized
ggtaaatattcctctatccttt

SEQ ID NO: 1221535 - DNA, 22 bp, Artificial Sequence
  chemically synthesized
cttggtaaatattcctctatcc

SEQ ID NO: 1221536 - DNA, 22 bp, Artificial Sequence
  chemically synthesized
gcttggtaaatattcctctatc

SEQ ID NO: 1221537 - DNA, 22 bp, Artificial Sequence
  chemically synthesized
aaaataaaaggatagaggaata

SEQ ID NO: 1221538 - DNA, 22 bp, Artificial Sequence
  chemically synthesized
catttgcttggtaaatattcct

SEQ ID NO: 1221539 - DNA, 22 bp, Artificial Sequence
  chemically synthesized
ccatttgcttggtaaatattcc

SEQ ID NO: 1221540 - DNA, 22 bp, Artificial Sequence
  chemically synthesized
tccatttgcttggtaaatattc

SEQ ID NO: 1221541 - DNA, 22 bp, Artificial Sequence
  chemically synthesized
ctttccatttgcttggtaaata

SEQ ID NO: 1221542 - DNA, 22 bp, Artificial Sequence
  chemically synthesized
gctttccatttgcttggtaaat

SEQ ID NO: 1221543 - DNA, 22 bp, Artificial Sequence
  chemically synthesized
tgctttccatttgcttggtaaa

SEQ ID NO: 1221544 - DNA, 22 bp, Artificial Sequence
  chemically synthesized
ttgctttccatttgcttggtaa

SEQ ID NO: 1221545 - DNA, 22 bp, Artificial Sequence
  chemically synthesized
tttgctttccatttgcttggta

SEQ ID NO: 1221546 - DNA, 22 bp, Artificial Sequence
  chemically synthesized
ttttgctttccatttgcttggt

SEQ ID NO: 1221547 - DNA, 22 bp, Artificial Sequence
  chemically synthesized
tttttgctttccatttgcttgg

SEQ ID NO: 1221548 - DNA, 22 bp, Artificial Sequence
  chemically synthesized
ttttttttgctttccatttgct

SEQ ID NO: 1221549 - DNA, 22 bp, Artificial Sequence
  chemically synthesized
attttttttgctttccatttgc

SEQ ID NO: 1221550 - DNA, 22 bp, Artificial Sequence
  chemically synthesized
tattttttttgctttccatttg

SEQ ID NO: 1221551 - DNA, 22 bp, Artificial Sequence
  chemically synthesized
ttattttttttgctttccattt

SEQ ID NO: 1221552 - DNA, 22 bp, Artificial Sequence
  chemically synthesized
cttttattttttttgctttcca

SEQ ID NO: 1221553 - DNA, 22 bp, Artificial Sequence
  chemically synthesized
accaagcaaatggaaagcaaaa

SEQ ID NO: 1221554 - DNA, 22 bp, Artificial Sequence
  chemically synthesized
ccaagcaaatggaaagcaaaaa

SEQ ID NO: 1221555 - DNA, 22 bp, Artificial Sequence
  chemically synthesized
caacccctgcttttattttttt

SEQ ID NO: 1221556 - DNA, 22 bp, Artificial Sequence
  chemically synthesized
tcagagaatagaattgcaaccc

SEQ ID NO: 1221557 - DNA, 22 bp, Artificial Sequence
  chemically synthesized
atcagagaatagaattgcaacc

SEQ ID NO: 1221558 - DNA, 22 bp, Artificial Sequence
  chemically synthesized
tatcagagaatagaattgcaac

SEQ ID NO: 1221559 - DNA, 22 bp, Artificial Sequence
  chemically synthesized
ttttatcagagaatagaattgc

SEQ ID NO: 1221560 - DNA, 22 bp, Artificial Sequence
  chemically synthesized
aagtctattttatcagagaata

SEQ ID NO: 1221561 - DNA, 22 bp, Artificial Sequence
  chemically synthesized
aaagtctattttatcagagaat

SEQ ID NO: 1221562 - DNA, 22 bp, Artificial Sequence
  chemically synthesized
gtttaaagtctattttatcaga

SEQ ID NO: 1221563 - DNA, 22 bp, Artificial Sequence
  chemically synthesized
caattctattctctgataaaat

SEQ ID NO: 1221564 - DNA, 22 bp, Artificial Sequence
  chemically synthesized
ttagtttaaagtctattttatc

SEQ ID NO: 1221565 - DNA, 22 bp, Artificial Sequence
  chemically synthesized
gttagtttaaagtctattttat

SEQ ID NO: 1221566 - DNA, 22 bp, Artificial Sequence
  chemically synthesized
tgttagtttaaagtctatttta

SEQ ID NO: 1221567 - DNA, 22 bp, Artificial Sequence
  chemically synthesized
tattctctgataaaatagactt

SEQ ID NO: 1221568 - DNA, 22 bp, Artificial Sequence
  chemically synthesized
ttctctgataaaatagacttta

SEQ ID NO: 1221569 - DNA, 22 bp, Artificial Sequence
  chemically synthesized
aatctttgttagtttaaagtct

SEQ ID NO: 1221570 - DNA, 22 bp, Artificial Sequence
  chemically synthesized
tctgataaaatagactttaaac

SEQ ID NO: 1221571 - DNA, 22 bp, Artificial Sequence
  chemically synthesized
aaatctttgttagtttaaagtc

SEQ ID NO: 1221572 - DNA, 22 bp, Artificial Sequence
  chemically synthesized
taaatctttgttagtttaaagt

SEQ ID NO: 1221573 - DNA, 22 bp, Artificial Sequence
  chemically synthesized
tgataaaatagactttaaacta

SEQ ID NO: 1221574 - DNA, 22 bp, Artificial Sequence
  chemically synthesized
ttaaatctttgttagtttaaag

SEQ ID NO: 1221575 - DNA, 22 bp, Artificial Sequence
  chemically synthesized
tttaaatctttgttagtttaaa

SEQ ID NO: 1221576 - DNA, 22 bp, Artificial Sequence
  chemically synthesized
ataaaatagactttaaactaac

SEQ ID NO: 1221577 - DNA, 22 bp, Artificial Sequence
  chemically synthesized
ttttaaatctttgttagtttaa

SEQ ID NO: 1221578 - DNA, 22 bp, Artificial Sequence
  chemically synthesized
tttttaaatctttgttagttta

SEQ ID NO: 1221579 - DNA, 22 bp, Artificial Sequence
  chemically synthesized
ttttttttaaatctttgttagt

SEQ ID NO: 1221580 - DNA, 22 bp, Artificial Sequence
  chemically synthesized
gttttttttaaatctttgttag

SEQ ID NO: 1221581 - DNA, 22 bp, Artificial Sequence
  chemically synthesized
tgttttttttaaatctttgtta

SEQ ID NO: 1221582 - DNA, 22 bp, Artificial Sequence
  chemically synthesized
ttgttttttttaaatctttgtt

SEQ ID NO: 1221583 - DNA, 22 bp, Artificial Sequence
  chemically synthesized
tttgttttttttaaatctttgt

SEQ ID NO: 1221584 - DNA, 22 bp, Artificial Sequence
  chemically synthesized
ttttgttttttttaaatctttg

SEQ ID NO: 1221585 - DNA, 22 bp, Artificial Sequence
  chemically synthesized
tttttgttttttttaaatcttt

SEQ ID NO: 1221586 - DNA, 22 bp, Artificial Sequence
  chemically synthesized
taaactaacaaagatttaaaaa

SEQ ID NO: 1221587 - DNA, 22 bp, Artificial Sequence
  chemically synthesized
aaactaacaaagatttaaaaaa

SEQ ID NO: 1221588 - DNA, 22 bp, Artificial Sequence
  chemically synthesized
tctttttttgttttttttaaat

SEQ ID NO: 1221589 - DNA, 22 bp, Artificial Sequence
  chemically synthesized
aactaacaaagatttaaaaaaa

SEQ ID NO: 1221590 - DNA, 22 bp, Artificial Sequence
  chemically synthesized
gtctttttttgttttttttaaa

SEQ ID NO: 1221591 - DNA, 22 bp, Artificial Sequence
  chemically synthesized
tgtctttttttgttttttttaa

SEQ ID NO: 1221592 - DNA, 22 bp, Artificial Sequence
  chemically synthesized
tttgtctttttttgtttttttt

SEQ ID NO: 1221593 - DNA, 22 bp, Artificial Sequence
  chemically synthesized
ctttgtctttttttgttttttt

SEQ ID NO: 1221594 - DNA, 22 bp, Artificial Sequence
  chemically synthesized
acaaagatttaaaaaaaacaaa

SEQ ID NO: 1221595 - DNA, 22 bp, Artificial Sequence
  chemically synthesized
aaaaaaaacaaaaaaagacaaa

SEQ ID NO: 1221596 - DNA, 22 bp, Artificial Sequence
  chemically synthesized
aaaaaaacaaaaaaagacaaag

SEQ ID NO: 1221597 - DNA, 22 bp, Artificial Sequence
  chemically synthesized
tgtaatgcccttctttgtcttt

SEQ ID NO: 1221598 - DNA, 22 bp, Artificial Sequence
  chemically synthesized
ccattatgtaatgcccttcttt

SEQ ID NO: 1221599 - DNA, 22 bp, Artificial Sequence
  chemically synthesized
accattatgtaatgcccttctt

SEQ ID NO: 1221600 - DNA, 22 bp, Artificial Sequence
  chemically synthesized
taccattatgtaatgcccttct

SEQ ID NO: 1221601 - DNA, 22 bp, Artificial Sequence
  chemically synthesized
atccctttaccattatgtaatg

SEQ ID NO: 1221602 - DNA, 22 bp, Artificial Sequence
  chemically synthesized
cattgatccctttaccattatg

SEQ ID NO: 1221603 - DNA, 22 bp, Artificial Sequence
  chemically synthesized
ttgcattgatccctttaccatt

SEQ ID NO: 1221604 - DNA, 22 bp, Artificial Sequence
  chemically synthesized
attgcattgatccctttaccat

SEQ ID NO: 1221605 - DNA, 22 bp, Artificial Sequence
  chemically synthesized
ttattgcattgatccctttacc

SEQ ID NO: 1221606 - DNA, 22 bp, Artificial Sequence
  chemically synthesized
cttattgcattgatccctttac

SEQ ID NO: 1221607 - DNA, 22 bp, Artificial Sequence
  chemically synthesized
cataatggtaaagggatcaatg

SEQ ID NO: 1221608 - DNA, 22 bp, Artificial Sequence
  chemically synthesized
ggacttcttattgcattgatcc

SEQ ID NO: 1221609 - DNA, 22 bp, Artificial Sequence
  chemically synthesized
ggatagttaggacttcttattg

SEQ ID NO: 1221610 - DNA, 22 bp, Artificial Sequence
  chemically synthesized
aggatagttaggacttcttatt

SEQ ID NO: 1221611 - DNA, 22 bp, Artificial Sequence
  chemically synthesized
ggtgcatatatatttaggatag

SEQ ID NO: 1221612 - DNA, 22 bp, Artificial Sequence
  chemically synthesized
tattgggtgcatatatatttag

SEQ ID NO: 1221613 - DNA, 22 bp, Artificial Sequence
  chemically synthesized
ctgtattgggtgcatatatatt

SEQ ID NO: 1221614 - DNA, 22 bp, Artificial Sequence
  chemically synthesized
actatcctaaatatatatgcac

SEQ ID NO: 1221615 - DNA, 22 bp, Artificial Sequence
  chemically synthesized
tcctaaatatatatgcacccaa

SEQ ID NO: 1221616 - DNA, 22 bp, Artificial Sequence
  chemically synthesized
ggtgctcctgtattgggtgcat

SEQ ID NO: 1221617 - DNA, 22 bp, Artificial Sequence
  chemically synthesized
aatatatatgcacccaatacag

SEQ ID NO: 1221618 - DNA, 22 bp, Artificial Sequence
  chemically synthesized
tgaatctgggtgctcctgtatt

SEQ ID NO: 1221619 - DNA, 22 bp, Artificial Sequence
  chemically synthesized
atgaatctgggtgctcctgtat

SEQ ID NO: 1221620 - DNA, 22 bp, Artificial Sequence
  chemically synthesized
tatgaatctgggtgctcctgta

SEQ ID NO: 1221621 - DNA, 22 bp, Artificial Sequence
  chemically synthesized
ctttatgaatctgggtgctcct

SEQ ID NO: 1221622 - DNA, 22 bp, Artificial Sequence
  chemically synthesized
gctttatgaatctgggtgctcc

SEQ ID NO: 1221623 - DNA, 22 bp, Artificial Sequence
  chemically synthesized
agaacttgctttatgaatctgg

SEQ ID NO: 1221624 - DNA, 22 bp, Artificial Sequence
  chemically synthesized
taagaacttgctttatgaatct

SEQ ID NO: 1221625 - DNA, 22 bp, Artificial Sequence
  chemically synthesized
tgtaggtctctaagaacttgct

SEQ ID NO: 1221626 - DNA, 22 bp, Artificial Sequence
  chemically synthesized
tatgtaggtctctaagaacttg

SEQ ID NO: 1221627 - DNA, 22 bp, Artificial Sequence
  chemically synthesized
tctctatgtaggtctctaagaa

SEQ ID NO: 1221628 - DNA, 22 bp, Artificial Sequence
  chemically synthesized
ataaagcaagttcttagagacc

SEQ ID NO: 1221629 - DNA, 22 bp, Artificial Sequence
  chemically synthesized
ggagtctgtctctatgtaggtc

SEQ ID NO: 1221630 - DNA, 22 bp, Artificial Sequence
  chemically synthesized
gggagtctgtctctatgtaggt

SEQ ID NO: 1221631 - DNA, 22 bp, Artificial Sequence
  chemically synthesized
tttgggagtctgtctctatgta

SEQ ID NO: 1221632 - DNA, 22 bp, Artificial Sequence
  chemically synthesized
ttagagacctacatagagacag

SEQ ID NO: 1221633 - DNA, 22 bp, Artificial Sequence
  chemically synthesized
ttgtttgggagtctgtctctat

SEQ ID NO: 1221634 - DNA, 22 bp, Artificial Sequence
  chemically synthesized
agagacctacatagagacagac

SEQ ID NO: 1221635 - DNA, 22 bp, Artificial Sequence
  chemically synthesized
gagacctacatagagacagact

SEQ ID NO: 1221636 - DNA, 22 bp, Artificial Sequence
  chemically synthesized
ttattgtttgggagtctgtctc

SEQ ID NO: 1221637 - DNA, 22 bp, Artificial Sequence
  chemically synthesized
ccactattattgtttgggagtc

SEQ ID NO: 1221638 - DNA, 22 bp, Artificial Sequence
  chemically synthesized
catagagacagactcccaaaca

SEQ ID NO: 1221639 - DNA, 22 bp, Artificial Sequence
  chemically synthesized
aagtctcccactattattgttt

SEQ ID NO: 1221640 - DNA, 22 bp, Artificial Sequence
  chemically synthesized
ccaaacaataatagtgggagac

SEQ ID NO: 1221641 - DNA, 22 bp, Artificial Sequence
  chemically synthesized
gcagtggggtgttaaagtctcc

SEQ ID NO: 1221642 - DNA, 22 bp, Artificial Sequence
  chemically synthesized
atgttggcagtggggtgttaaa

SEQ ID NO: 1221643 - DNA, 22 bp, Artificial Sequence
  chemically synthesized
atctaatgttggcagtggggtg

SEQ ID NO: 1221644 - DNA, 22 bp, Artificial Sequence
  chemically synthesized
gttgatctaatgttggcagtgg

SEQ ID NO: 1221645 - DNA, 22 bp, Artificial Sequence
  chemically synthesized
tctcgttgatctaatgttggca

SEQ ID NO: 1221646 - DNA, 22 bp, Artificial Sequence
  chemically synthesized
taacaccccactgccaacatta

SEQ ID NO: 1221647 - DNA, 22 bp, Artificial Sequence
  chemically synthesized
aacaccccactgccaacattag

SEQ ID NO: 1221648 - DNA, 22 bp, Artificial Sequence
  chemically synthesized
tgtctcgttgatctaatgttgg

SEQ ID NO: 1221649 - DNA, 22 bp, Artificial Sequence
  chemically synthesized
acaccccactgccaacattaga

SEQ ID NO: 1221650 - DNA, 22 bp, Artificial Sequence
  chemically synthesized
ctgtctcgttgatctaatgttg

SEQ ID NO: 1221651 - DNA, 22 bp, Artificial Sequence
  chemically synthesized
tctgtctcgttgatctaatgtt

SEQ ID NO: 1221652 - DNA, 22 bp, Artificial Sequence
  chemically synthesized
attttctgtctcgttgatctaa

SEQ ID NO: 1221653 - DNA, 22 bp, Artificial Sequence
  chemically synthesized
ttaattttctgtctcgttgatc

SEQ ID NO: 1221654 - DNA, 22 bp, Artificial Sequence
  chemically synthesized
gttaattttctgtctcgttgat

SEQ ID NO: 1221655 - DNA, 22 bp, Artificial Sequence
  chemically synthesized
ccaacattagatcaacgagaca

SEQ ID NO: 1221656 - DNA, 22 bp, Artificial Sequence
  chemically synthesized
aacatccttgttaattttctgt

SEQ ID NO: 1221657 - DNA, 22 bp, Artificial Sequence
  chemically synthesized
gatcaacgagacagaaaattaa

SEQ ID NO: 1221658 - DNA, 22 bp, Artificial Sequence
  chemically synthesized
aagtactgaacatccttgttaa

SEQ ID NO: 1221659 - DNA, 22 bp, Artificial Sequence
  chemically synthesized
agttcaagtactgaacatcctt

SEQ ID NO: 1221660 - DNA, 22 bp, Artificial Sequence
  chemically synthesized
acaaggatgttcagtacttgaa

SEQ ID NO: 1221661 - DNA, 22 bp, Artificial Sequence
  chemically synthesized
gtccagagctgagttcaagtac

SEQ ID NO: 1221662 - DNA, 22 bp, Artificial Sequence
  chemically synthesized
ggtccagagctgagttcaagta

SEQ ID NO: 1221663 - DNA, 22 bp, Artificial Sequence
  chemically synthesized
agtacttgaactcagctctgga

SEQ ID NO: 1221664 - DNA, 22 bp, Artificial Sequence
  chemically synthesized
tgaggtccacttggtccagagc

SEQ ID NO: 1221665 - DNA, 22 bp, Artificial Sequence
  chemically synthesized
gaactcagctctggaccaagtg

SEQ ID NO: 1221666 - DNA, 22 bp, Artificial Sequence
  chemically synthesized
aactcagctctggaccaagtgg

SEQ ID NO: 1221667 - DNA, 22 bp, Artificial Sequence
  chemically synthesized
tagatgtctgtgaggtccactt

SEQ ID NO: 1221668 - DNA, 22 bp, Artificial Sequence
  chemically synthesized
agctctggaccaagtggacctc

SEQ ID NO: 1221669 - DNA, 22 bp, Artificial Sequence
  chemically synthesized
tgtagatgtctgtgaggtccac

SEQ ID NO: 1221670 - DNA, 22 bp, Artificial Sequence
  chemically synthesized
tggaccaagtggacctcacaga

SEQ ID NO: 1221671 - DNA, 22 bp, Artificial Sequence
  chemically synthesized
gaccaagtggacctcacagaca

SEQ ID NO: 1221672 - DNA, 22 bp, Artificial Sequence
  chemically synthesized
gggtggagagttctgtagatgt

SEQ ID NO: 1221673 - DNA, 22 bp, Artificial Sequence
  chemically synthesized
ggggtggagagttctgtagatg

SEQ ID NO: 1221674 - DNA, 22 bp, Artificial Sequence
  chemically synthesized
atttggggtggagagttctgta

SEQ ID NO: 1221675 - DNA, 22 bp, Artificial Sequence
  chemically synthesized
acagacatctacagaactctcc

SEQ ID NO: 1221676 - DNA, 22 bp, Artificial Sequence
  chemically synthesized
ttgatttggggtggagagttct

SEQ ID NO: 1221677 - DNA, 22 bp, Artificial Sequence
  chemically synthesized
tgttgatttggggtggagagtt

SEQ ID NO: 1221678 - DNA, 22 bp, Artificial Sequence
  chemically synthesized
cagaactctccaccccaaatca

SEQ ID NO: 1221679 - DNA, 22 bp, Artificial Sequence
  chemically synthesized
agaagaatgtatattctgttga

SEQ ID NO: 1221680 - DNA, 22 bp, Artificial Sequence
  chemically synthesized
tccaccccaaatcaacagaata

SEQ ID NO: 1221681 - DNA, 22 bp, Artificial Sequence
  chemically synthesized
caccccaaatcaacagaatata

SEQ ID NO: 1221682 - DNA, 22 bp, Artificial Sequence
  chemically synthesized
gaataagtatgatgtggtgctg

SEQ ID NO: 1221683 - DNA, 22 bp, Artificial Sequence
  chemically synthesized
agaataagtatgatgtggtgct

SEQ ID NO: 1221684 - DNA, 22 bp, Artificial Sequence
  chemically synthesized
tagaataagtatgatgtggtgc

SEQ ID NO: 1221685 - DNA, 22 bp, Artificial Sequence
  chemically synthesized
ttctcagcaccacatcatactt

SEQ ID NO: 1221686 - DNA, 22 bp, Artificial Sequence
  chemically synthesized
ctcagcaccacatcatacttat

SEQ ID NO: 1221687 - DNA, 22 bp, Artificial Sequence
  chemically synthesized
tcagcaccacatcatacttatt

SEQ ID NO: 1221688 - DNA, 22 bp, Artificial Sequence
  chemically synthesized
agcaccacatcatacttattct

SEQ ID NO: 1221689 - DNA, 22 bp, Artificial Sequence
  chemically synthesized
tgtgatcaattttagaataagt

SEQ ID NO: 1221690 - DNA, 22 bp, Artificial Sequence
  chemically synthesized
attatgtgatcaattttagaat

SEQ ID NO: 1221691 - DNA, 22 bp, Artificial Sequence
  chemically synthesized
taattatgtgatcaattttaga

SEQ ID NO: 1221692 - DNA, 22 bp, Artificial Sequence
  chemically synthesized
ctaattatgtgatcaattttag

SEQ ID NO: 1221693 - DNA, 22 bp, Artificial Sequence
  chemically synthesized
cttctaattatgtgatcaattt

SEQ ID NO: 1221694 - DNA, 22 bp, Artificial Sequence
  chemically synthesized
acttctaattatgtgatcaatt

SEQ ID NO: 1221695 - DNA, 22 bp, Artificial Sequence
  chemically synthesized
tacttctaattatgtgatcaat

SEQ ID NO: 1221696 - DNA, 22 bp, Artificial Sequence
  chemically synthesized
attctaaaattgatcacataat

SEQ ID NO: 1221697 - DNA, 22 bp, Artificial Sequence
  chemically synthesized
ttctaaaattgatcacataatt

SEQ ID NO: 1221698 - DNA, 22 bp, Artificial Sequence
  chemically synthesized
taaaattgatcacataattaga

SEQ ID NO: 1221699 - DNA, 22 bp, Artificial Sequence
  chemically synthesized
aaattgatcacataattagaag

SEQ ID NO: 1221700 - DNA, 22 bp, Artificial Sequence
  chemically synthesized
aggagtgttttacttctaatta

SEQ ID NO: 1221701 - DNA, 22 bp, Artificial Sequence
  chemically synthesized
ctgaggagtgttttacttctaa

SEQ ID NO: 1221702 - DNA, 22 bp, Artificial Sequence
  chemically synthesized
gctgaggagtgttttacttcta

SEQ ID NO: 1221703 - DNA, 22 bp, Artificial Sequence
  chemically synthesized
atcacataattagaagtaaaac

SEQ ID NO: 1221704 - DNA, 22 bp, Artificial Sequence
  chemically synthesized
catttgctgaggagtgttttac

SEQ ID NO: 1221705 - DNA, 22 bp, Artificial Sequence
  chemically synthesized
gcatttgctgaggagtgtttta

SEQ ID NO: 1221706 - DNA, 22 bp, Artificial Sequence
  chemically synthesized
tgcatttgctgaggagtgtttt

SEQ ID NO: 1221707 - DNA, 22 bp, Artificial Sequence
  chemically synthesized
ttgcatttgctgaggagtgttt

SEQ ID NO: 1221708 - DNA, 22 bp, Artificial Sequence
  chemically synthesized
ttttgcatttgctgaggagtgt

SEQ ID NO: 1221709 - DNA, 22 bp, Artificial Sequence
  chemically synthesized
gaagtaaaacactcctcagcaa

SEQ ID NO: 1221710 - DNA, 22 bp, Artificial Sequence
  chemically synthesized
attcttttgcatttgctgagga

SEQ ID NO: 1221711 - DNA, 22 bp, Artificial Sequence
  chemically synthesized
cattcttttgcatttgctgagg

SEQ ID NO: 1221712 - DNA, 22 bp, Artificial Sequence
  chemically synthesized
tcattcttttgcatttgctgag

SEQ ID NO: 1221713 - DNA, 22 bp, Artificial Sequence
  chemically synthesized
tgattttcattcttttgcattt

SEQ ID NO: 1221714 - DNA, 22 bp, Artificial Sequence
  chemically synthesized
ttatgattttcattcttttgca

SEQ ID NO: 1221715 - DNA, 22 bp, Artificial Sequence
  chemically synthesized
ctcagcaaatgcaaaagaatga

SEQ ID NO: 1221716 - DNA, 22 bp, Artificial Sequence
  chemically synthesized
gttgttatgattttcattcttt

SEQ ID NO: 1221717 - DNA, 22 bp, Artificial Sequence
  chemically synthesized
agcaaatgcaaaagaatgaaaa

SEQ ID NO: 1221718 - DNA, 22 bp, Artificial Sequence
  chemically synthesized
agaggttggttgttatgatttt

SEQ ID NO: 1221719 - DNA, 22 bp, Artificial Sequence
  chemically synthesized
tggtctgagaggttggttgtta

SEQ ID NO: 1221720 - DNA, 22 bp, Artificial Sequence
  chemically synthesized
cactgtggtctgagaggttggt

SEQ ID NO: 1221721 - DNA, 22 bp, Artificial Sequence
  chemically synthesized
gcactgtggtctgagaggttgg

SEQ ID NO: 1221722 - DNA, 22 bp, Artificial Sequence
  chemically synthesized
tttgcactgtggtctgagaggt

SEQ ID NO: 1221723 - DNA, 22 bp, Artificial Sequence
  chemically synthesized
gtttgcactgtggtctgagagg

SEQ ID NO: 1221724 - DNA, 22 bp, Artificial Sequence
  chemically synthesized
atttgtttgcactgtggtctga

SEQ ID NO: 1221725 - DNA, 22 bp, Artificial Sequence
  chemically synthesized
taatttgtttgcactgtggtct

SEQ ID NO: 1221726 - DNA, 22 bp, Artificial Sequence
  chemically synthesized
agttctaatttgtttgcactgt

SEQ ID NO: 1221727 - DNA, 22 bp, Artificial Sequence
  chemically synthesized
tcagaccacagtgcaaacaaat

SEQ ID NO: 1221728 - DNA, 22 bp, Artificial Sequence
  chemically synthesized
atcctgagttctaatttgtttg

SEQ ID NO: 1221729 - DNA, 22 bp, Artificial Sequence
  chemically synthesized
agaccacagtgcaaacaaatta

SEQ ID NO: 1221730 - DNA, 22 bp, Artificial Sequence
  chemically synthesized
aatcctgagttctaatttgttt

SEQ ID NO: 1221731 - DNA, 22 bp, Artificial Sequence
  chemically synthesized
ttaatcctgagttctaatttgt

SEQ ID NO: 1221732 - DNA, 22 bp, Artificial Sequence
  chemically synthesized
cttaatcctgagttctaatttg

SEQ ID NO: 1221733 - DNA, 22 bp, Artificial Sequence
  chemically synthesized
agtgagtttcttaatcctgagt

SEQ ID NO: 1221734 - DNA, 22 bp, Artificial Sequence
  chemically synthesized
gagtgagtttcttaatcctgag

SEQ ID NO: 1221735 - DNA, 22 bp, Artificial Sequence
  chemically synthesized
tgagtgagtttcttaatcctga

SEQ ID NO: 1221736 - DNA, 22 bp, Artificial Sequence
  chemically synthesized
gaactcaggattaagaaactca

SEQ ID NO: 1221737 - DNA, 22 bp, Artificial Sequence
  chemically synthesized
tatggttttgagtgagtttctt

SEQ ID NO: 1221738 - DNA, 22 bp, Artificial Sequence
  chemically synthesized
aggattaagaaactcactcaaa

SEQ ID NO: 1221739 - DNA, 22 bp, Artificial Sequence
  chemically synthesized
catgtagttgtatggttttgag

SEQ ID NO: 1221740 - DNA, 22 bp, Artificial Sequence
  chemically synthesized
ccatgtagttgtatggttttga

SEQ ID NO: 1221741 - DNA, 22 bp, Artificial Sequence
  chemically synthesized
agaaactcactcaaaaccatac

SEQ ID NO: 1221742 - DNA, 22 bp, Artificial Sequence
  chemically synthesized
gtttccatgtagttgtatggtt

SEQ ID NO: 1221743 - DNA, 22 bp, Artificial Sequence
  chemically synthesized
ttagtttccatgtagttgtatg

SEQ ID NO: 1221744 - DNA, 22 bp, Artificial Sequence
  chemically synthesized
actcaaaaccatacaactacat

SEQ ID NO: 1221745 - DNA, 22 bp, Artificial Sequence
  chemically synthesized
aaaaccatacaactacatggaa

SEQ ID NO: 1221746 - DNA, 22 bp, Artificial Sequence
  chemically synthesized
agaagcagattgttagtttcca

SEQ ID NO: 1221747 - DNA, 22 bp, Artificial Sequence
  chemically synthesized
ttcagaagcagattgttagttt

SEQ ID NO: 1221748 - DNA, 22 bp, Artificial Sequence
  chemically synthesized
catggaaactaacaatctgctt

SEQ ID NO: 1221749 - DNA, 22 bp, Artificial Sequence
  chemically synthesized
cccagtagttattcagaagcag

SEQ ID NO: 1221750 - DNA, 22 bp, Artificial Sequence
  chemically synthesized
acccagtagttattcagaagca

SEQ ID NO: 1221751 - DNA, 22 bp, Artificial Sequence
  chemically synthesized
tttacccagtagttattcagaa

SEQ ID NO: 1221752 - DNA, 22 bp, Artificial Sequence
  chemically synthesized
acaatctgcttctgaataacta

SEQ ID NO: 1221753 - DNA, 22 bp, Artificial Sequence
  chemically synthesized
ttatttacccagtagttattca

SEQ ID NO: 1221754 - DNA, 22 bp, Artificial Sequence
  chemically synthesized
tgttatttacccagtagttatt

SEQ ID NO: 1221755 - DNA, 22 bp, Artificial Sequence
  chemically synthesized
cttctgaataactactgggtaa

SEQ ID NO: 1221756 - DNA, 22 bp, Artificial Sequence
  chemically synthesized
ctgaataactactgggtaaata

SEQ ID NO: 1221757 - DNA, 22 bp, Artificial Sequence
  chemically synthesized
tcagaattctgttatttaccca

SEQ ID NO: 1221758 - DNA, 22 bp, Artificial Sequence
  chemically synthesized
tgaataactactgggtaaataa

SEQ ID NO: 1221759 - DNA, 22 bp, Artificial Sequence
  chemically synthesized
tgtcagaattctgttatttacc

SEQ ID NO: 1221760 - DNA, 22 bp, Artificial Sequence
  chemically synthesized
aataactactgggtaaataaca

SEQ ID NO: 1221761 - DNA, 22 bp, Artificial Sequence
  chemically synthesized
ctgtcagaattctgttatttac

SEQ ID NO: 1221762 - DNA, 22 bp, Artificial Sequence
  chemically synthesized
tttctgtcagaattctgttatt

SEQ ID NO: 1221763 - DNA, 22 bp, Artificial Sequence
  chemically synthesized
atttctgtcagaattctgttat

SEQ ID NO: 1221764 - DNA, 22 bp, Artificial Sequence
  chemically synthesized
tatttctgtcagaattctgtta

SEQ ID NO: 1221765 - DNA, 22 bp, Artificial Sequence
  chemically synthesized
tttatttctgtcagaattctgt

SEQ ID NO: 1221766 - DNA, 22 bp, Artificial Sequence
  chemically synthesized
ctgggtaaataacagaattctg

SEQ ID NO: 1221767 - DNA, 22 bp, Artificial Sequence
  chemically synthesized
ctttatttctgtcagaattctg

SEQ ID NO: 1221768 - DNA, 22 bp, Artificial Sequence
  chemically synthesized
ggtaaataacagaattctgaca

SEQ ID NO: 1221769 - DNA, 22 bp, Artificial Sequence
  chemically synthesized
aaagaacttctttatttctgtc

SEQ ID NO: 1221770 - DNA, 22 bp, Artificial Sequence
  chemically synthesized
caaagaacttctttatttctgt

SEQ ID NO: 1221771 - DNA, 22 bp, Artificial Sequence
  chemically synthesized
gtttcaaagaacttctttattt

SEQ ID NO: 1221772 - DNA, 22 bp, Artificial Sequence
  chemically synthesized
attggtttcaaagaacttcttt

SEQ ID NO: 1221773 - DNA, 22 bp, Artificial Sequence
  chemically synthesized
tgacagaaataaagaagttctt

SEQ ID NO: 1221774 - DNA, 22 bp, Artificial Sequence
  chemically synthesized
tcattggtttcaaagaacttct

SEQ ID NO: 1221775 - DNA, 22 bp, Artificial Sequence
  chemically synthesized
acagaaataaagaagttctttg

SEQ ID NO: 1221776 - DNA, 22 bp, Artificial Sequence
  chemically synthesized
ttctcattggtttcaaagaact

SEQ ID NO: 1221777 - DNA, 22 bp, Artificial Sequence
  chemically synthesized
gttctcattggtttcaaagaac

SEQ ID NO: 1221778 - DNA, 22 bp, Artificial Sequence
  chemically synthesized
tgttctcattggtttcaaagaa

SEQ ID NO: 1221779 - DNA, 22 bp, Artificial Sequence
  chemically synthesized
tatctttgttctcattggtttc

SEQ ID NO: 1221780 - DNA, 22 bp, Artificial Sequence
  chemically synthesized
gcacattgtatctttgttctca

SEQ ID NO: 1221781 - DNA, 22 bp, Artificial Sequence
  chemically synthesized
tttgaaaccaatgagaacaaag

SEQ ID NO: 1221782 - DNA, 22 bp, Artificial Sequence
  chemically synthesized
tggcacattgtatctttgttct

SEQ ID NO: 1221783 - DNA, 22 bp, Artificial Sequence
  chemically synthesized
tgaaaccaatgagaacaaagat

SEQ ID NO: 1221784 - DNA, 22 bp, Artificial Sequence
  chemically synthesized
gaaaccaatgagaacaaagata

SEQ ID NO: 1221785 - DNA, 22 bp, Artificial Sequence
  chemically synthesized
aaaccaatgagaacaaagatac

SEQ ID NO: 1221786 - DNA, 22 bp, Artificial Sequence
  chemically synthesized
tgtcccagagattctggcacat

SEQ ID NO: 1221787 - DNA, 22 bp, Artificial Sequence
  chemically synthesized
gctgtgtcccagagattctggc

SEQ ID NO: 1221788 - DNA, 22 bp, Artificial Sequence
  chemically synthesized
agctgtgtcccagagattctgg

SEQ ID NO: 1221789 - DNA, 22 bp, Artificial Sequence
  chemically synthesized
tagctgtgtcccagagattctg

SEQ ID NO: 1221790 - DNA, 22 bp, Artificial Sequence
  chemically synthesized
ctttagctgtgtcccagagatt

SEQ ID NO: 1221791 - DNA, 22 bp, Artificial Sequence
  chemically synthesized
aacactgctttagctgtgtccc

SEQ ID NO: 1221792 - DNA, 22 bp, Artificial Sequence
  chemically synthesized
tcaacactgctttagctgtgtc

SEQ ID NO: 1221793 - DNA, 22 bp, Artificial Sequence
  chemically synthesized
cctctcaacactgctttagctg

SEQ ID NO: 1221794 - DNA, 22 bp, Artificial Sequence
  chemically synthesized
ccctctcaacactgctttagct

SEQ ID NO: 1221795 - DNA, 22 bp, Artificial Sequence
  chemically synthesized
tgggacacagctaaagcagtgt

SEQ ID NO: 1221796 - DNA, 22 bp, Artificial Sequence
  chemically synthesized
ggacacagctaaagcagtgttg

SEQ ID NO: 1221797 - DNA, 22 bp, Artificial Sequence
  chemically synthesized
taaatttccctctcaacactgc

SEQ ID NO: 1221798 - DNA, 22 bp, Artificial Sequence
  chemically synthesized
gtgctgtaaatttccctctcaa

SEQ ID NO: 1221799 - DNA, 22 bp, Artificial Sequence
  chemically synthesized
agtgctgtaaatttccctctca

SEQ ID NO: 1221800 - DNA, 22 bp, Artificial Sequence
  chemically synthesized
aagcagtgttgagagggaaatt

SEQ ID NO: 1221801 - DNA, 22 bp, Artificial Sequence
  chemically synthesized
tgggcatttagtgctgtaaatt

SEQ ID NO: 1221802 - DNA, 22 bp, Artificial Sequence
  chemically synthesized
ctgtgggcatttagtgctgtaa

SEQ ID NO: 1221803 - DNA, 22 bp, Artificial Sequence
  chemically synthesized
agagggaaatttacagcactaa

SEQ ID NO: 1221804 - DNA, 22 bp, Artificial Sequence
  chemically synthesized
tcctgtgggcatttagtgctgt

SEQ ID NO: 1221805 - DNA, 22 bp, Artificial Sequence
  chemically synthesized
ctcctgtgggcatttagtgctg

SEQ ID NO: 1221806 - DNA, 22 bp, Artificial Sequence
  chemically synthesized
tctcctgtgggcatttagtgct

SEQ ID NO: 1221807 - DNA, 22 bp, Artificial Sequence
  chemically synthesized
ccgctttctcctgtgggcattt

SEQ ID NO: 1221808 - DNA, 22 bp, Artificial Sequence
  chemically synthesized
cccgctttctcctgtgggcatt

SEQ ID NO: 1221809 - DNA, 22 bp, Artificial Sequence
  chemically synthesized
tcccgctttctcctgtgggcat

SEQ ID NO: 1221810 - DNA, 22 bp, Artificial Sequence
  chemically synthesized
acagcactaaatgcccacagga

SEQ ID NO: 1221811 - DNA, 22 bp, Artificial Sequence
  chemically synthesized
cagcactaaatgcccacaggag

SEQ ID NO: 1221812 - DNA, 22 bp, Artificial Sequence
  chemically synthesized
gatctttcccgctttctcctgt

SEQ ID NO: 1221813 - DNA, 22 bp, Artificial Sequence
  chemically synthesized
agatctttcccgctttctcctg

SEQ ID NO: 1221814 - DNA, 22 bp, Artificial Sequence
  chemically synthesized
tagatctttcccgctttctcct

SEQ ID NO: 1221815 - DNA, 22 bp, Artificial Sequence
  chemically synthesized
aatgcccacaggagaaagcggg

SEQ ID NO: 1221816 - DNA, 22 bp, Artificial Sequence
  chemically synthesized
attttagatctttcccgctttc

SEQ ID NO: 1221817 - DNA, 22 bp, Artificial Sequence
  chemically synthesized
gggtgttgattttagatctttc

SEQ ID NO: 1221818 - DNA, 22 bp, Artificial Sequence
  chemically synthesized
tgatgttagggtgttgatttta

SEQ ID NO: 1221819 - DNA, 22 bp, Artificial Sequence
  chemically synthesized
agttgtgatgttagggtgttga

SEQ ID NO: 1221820 - DNA, 22 bp, Artificial Sequence
  chemically synthesized
cagttgtgatgttagggtgttg

SEQ ID NO: 1221821 - DNA, 22 bp, Artificial Sequence
  chemically synthesized
tcagttgtgatgttagggtgtt

SEQ ID NO: 1221822 - DNA, 22 bp, Artificial Sequence
  chemically synthesized
tttcagttgtgatgttagggtg

SEQ ID NO: 1221823 - DNA, 22 bp, Artificial Sequence
  chemically synthesized
gttctttcagttgtgatgttag

SEQ ID NO: 1221824 - DNA, 22 bp, Artificial Sequence
  chemically synthesized
aaatcaacaccctaacatcaca

SEQ ID NO: 1221825 - DNA, 22 bp, Artificial Sequence
  chemically synthesized
tagttctttcagttgtgatgtt

SEQ ID NO: 1221826 - DNA, 22 bp, Artificial Sequence
  chemically synthesized
tctagttctttcagttgtgatg

SEQ ID NO: 1221827 - DNA, 22 bp, Artificial Sequence
  chemically synthesized
ctctagttctttcagttgtgat

SEQ ID NO: 1221828 - DNA, 22 bp, Artificial Sequence
  chemically synthesized
gcttctctagttctttcagttg

SEQ ID NO: 1221829 - DNA, 22 bp, Artificial Sequence
  chemically synthesized
tggcttctctagttctttcagt

SEQ ID NO: 1221830 - DNA, 22 bp, Artificial Sequence
  chemically synthesized
ctctggcttctctagttctttc

SEQ ID NO: 1221831 - DNA, 22 bp, Artificial Sequence
  chemically synthesized
acatcacaactgaaagaactag

SEQ ID NO: 1221832 - DNA, 22 bp, Artificial Sequence
  chemically synthesized
gctctggcttctctagttcttt

SEQ ID NO: 1221833 - DNA, 22 bp, Artificial Sequence
  chemically synthesized
cttgctctggcttctctagttc

SEQ ID NO: 1221834 - DNA, 22 bp, Artificial Sequence
  chemically synthesized
gcttgctctggcttctctagtt

SEQ ID NO: 1221835 - DNA, 22 bp, Artificial Sequence
  chemically synthesized
atttgcttgctctggcttctct

SEQ ID NO: 1221836 - DNA, 22 bp, Artificial Sequence
  chemically synthesized
gatttgcttgctctggcttctc

SEQ ID NO: 1221837 - DNA, 22 bp, Artificial Sequence
  chemically synthesized
tgatttgcttgctctggcttct

SEQ ID NO: 1221838 - DNA, 22 bp, Artificial Sequence
  chemically synthesized
ttgatttgcttgctctggcttc

SEQ ID NO: 1221839 - DNA, 22 bp, Artificial Sequence
  chemically synthesized
aaagaactagagaagccagagc

SEQ ID NO: 1221840 - DNA, 22 bp, Artificial Sequence
  chemically synthesized
gcttttgatttgcttgctctgg

SEQ ID NO: 1221841 - DNA, 22 bp, Artificial Sequence
  chemically synthesized
ctagcttttgatttgcttgctc

SEQ ID NO: 1221842 - DNA, 22 bp, Artificial Sequence
  chemically synthesized
tgctagcttttgatttgcttgc

SEQ ID NO: 1221843 - DNA, 22 bp, Artificial Sequence
  chemically synthesized
gagaagccagagcaagcaaatc

SEQ ID NO: 1221844 - DNA, 22 bp, Artificial Sequence
  chemically synthesized
ctgctagcttttgatttgcttg

SEQ ID NO: 1221845 - DNA, 22 bp, Artificial Sequence
  chemically synthesized
tcttctgctagcttttgatttg

SEQ ID NO: 1221846 - DNA, 22 bp, Artificial Sequence
  chemically synthesized
gtcttctgctagcttttgattt

SEQ ID NO: 1221847 - DNA, 22 bp, Artificial Sequence
  chemically synthesized
ttgtcttctgctagcttttgat

SEQ ID NO: 1221848 - DNA, 22 bp, Artificial Sequence
  chemically synthesized
cttgtcttctgctagcttttga

SEQ ID NO: 1221849 - DNA, 22 bp, Artificial Sequence
  chemically synthesized
tttcttgtcttctgctagcttt

SEQ ID NO: 1221850 - DNA, 22 bp, Artificial Sequence
  chemically synthesized
gttatttcttgtcttctgctag

SEQ ID NO: 1221851 - DNA, 22 bp, Artificial Sequence
  chemically synthesized
agttatttcttgtcttctgcta

SEQ ID NO: 1221852 - DNA, 22 bp, Artificial Sequence
  chemically synthesized
atcttagttatttcttgtcttc

SEQ ID NO: 1221853 - DNA, 22 bp, Artificial Sequence
  chemically synthesized
tgatcttagttatttcttgtct

SEQ ID NO: 1221854 - DNA, 22 bp, Artificial Sequence
  chemically synthesized
ctctgatcttagttatttcttg

SEQ ID NO: 1221855 - DNA, 22 bp, Artificial Sequence
  chemically synthesized
tgctctgatcttagttatttct

SEQ ID NO: 1221856 - DNA, 22 bp, Artificial Sequence
  chemically synthesized
gcagaagacaagaaataactaa

SEQ ID NO: 1221857 - DNA, 22 bp, Artificial Sequence
  chemically synthesized
agttctgctctgatcttagtta

SEQ ID NO: 1221858 - DNA, 22 bp, Artificial Sequence
  chemically synthesized
cagttctgctctgatcttagtt

SEQ ID NO: 1221859 - DNA, 22 bp, Artificial Sequence
  chemically synthesized
cttcagttctgctctgatctta

SEQ ID NO: 1221860 - DNA, 22 bp, Artificial Sequence
  chemically synthesized
cgtctccttcagttctgctctg

SEQ ID NO: 1221861 - DNA, 22 bp, Artificial Sequence
  chemically synthesized
ccgtctccttcagttctgctct

SEQ ID NO: 1221862 - DNA, 22 bp, Artificial Sequence
  chemically synthesized
agatcagagcagaactgaagga

SEQ ID NO: 1221863 - DNA, 22 bp, Artificial Sequence
  chemically synthesized
aatgtttccgtctccttcagtt

SEQ ID NO: 1221864 - DNA, 22 bp, Artificial Sequence
  chemically synthesized
aaatgtttccgtctccttcagt

SEQ ID NO: 1221865 - DNA, 22 bp, Artificial Sequence
  chemically synthesized
taaatgtttccgtctccttcag

SEQ ID NO: 1221866 - DNA, 22 bp, Artificial Sequence
  chemically synthesized
ttaaatgtttccgtctccttca

SEQ ID NO: 1221867 - DNA, 22 bp, Artificial Sequence
  chemically synthesized
tttaaatgtttccgtctccttc

SEQ ID NO: 1221868 - DNA, 22 bp, Artificial Sequence
  chemically synthesized
ttttaaatgtttccgtctcctt

SEQ ID NO: 1221869 - DNA, 22 bp, Artificial Sequence
  chemically synthesized
tttttaaatgtttccgtctcct

SEQ ID NO: 1221870 - DNA, 22 bp, Artificial Sequence
  chemically synthesized
ttttttaaatgtttccgtctcc

SEQ ID NO: 1221871 - DNA, 22 bp, Artificial Sequence
  chemically synthesized
tttttttaaatgtttccgtctc

SEQ ID NO: 1221872 - DNA, 22 bp, Artificial Sequence
  chemically synthesized
ttttttttaaatgtttccgtct

SEQ ID NO: 1221873 - DNA, 22 bp, Artificial Sequence
  chemically synthesized
tttttttttaaatgtttccgtc

SEQ ID NO: 1221874 - DNA, 22 bp, Artificial Sequence
  chemically synthesized
ttttttttttaaatgtttccgt

SEQ ID NO: 1221875 - DNA, 22 bp, Artificial Sequence
  chemically synthesized
tttttttttttaaatgtttccg

SEQ ID NO: 1221876 - DNA, 22 bp, Artificial Sequence
  chemically synthesized
ttttttttttttaaatgtttcc

SEQ ID NO: 1221877 - DNA, 22 bp, Artificial Sequence
  chemically synthesized
tttttttttttttaaatgtttc

SEQ ID NO: 1221878 - DNA, 22 bp, Artificial Sequence
  chemically synthesized
ttttttttttttttaaatgttt

SEQ ID NO: 1221879 - DNA, 22 bp, Artificial Sequence
  chemically synthesized
tttttttttttttttaaatgtt

SEQ ID NO: 1221880 - DNA, 22 bp, Artificial Sequence
  chemically synthesized
aaggagacggaaacatttaaaa

SEQ ID NO: 1221881 - DNA, 22 bp, Artificial Sequence
  chemically synthesized
ttttttttttttttttaaatgt

SEQ ID NO: 1221882 - DNA, 22 bp, Artificial Sequence
  chemically synthesized
tttttttttttttttttaaatg

SEQ ID NO: 1221883 - DNA, 22 bp, Artificial Sequence
  chemically synthesized
ttttttttttttttttttaaat

SEQ ID NO: 1221884 - DNA, 22 bp, Artificial Sequence
  chemically synthesized
tttttttttttttttttttaaa

SEQ ID NO: 1221885 - DNA, 22 bp, Artificial Sequence
  chemically synthesized
ttttttttttttttttttttaa

SEQ ID NO: 1221886 - DNA, 22 bp, Artificial Sequence
  chemically synthesized
ttttttttttttttttttttta

SEQ ID NO: 1221887 - DNA, 22 bp, Artificial Sequence
  chemically synthesized
tttttttttttttttttttttt

SEQ ID NO: 1221888 - DNA, 22 bp, Artificial Sequence
  chemically synthesized
tttttttttttttttttttttt

SEQ ID NO: 1221889 - DNA, 22 bp, Artificial Sequence
  chemically synthesized
tttttttttttttttttttttt

SEQ ID NO: 1221890 - DNA, 22 bp, Artificial Sequence
  chemically synthesized
atgttttttttttttttttttt

SEQ ID NO: 1221891 - DNA, 22 bp, Artificial Sequence
  chemically synthesized
ttgatgtttttttttttttttt

SEQ ID NO: 1221892 - DNA, 22 bp, Artificial Sequence
  chemically synthesized
aaaaaaaaaaaaaaaaaaaaaa

SEQ ID NO: 1221893 - DNA, 22 bp, Artificial Sequence
  chemically synthesized
gttgatgttttttttttttttt

SEQ ID NO: 1221894 - DNA, 22 bp, Artificial Sequence
  chemically synthesized
aaaaaaaaaaaaaaaaaaaaaa

SEQ ID NO: 1221895 - DNA, 22 bp, Artificial Sequence
  chemically synthesized
gatttgttgatgtttttttttt

SEQ ID NO: 1221896 - DNA, 22 bp, Artificial Sequence
  chemically synthesized
ctggatttgttgatgttttttt

SEQ ID NO: 1221897 - DNA, 22 bp, Artificial Sequence
  chemically synthesized
aaaaaaaaacacctcctggatt

SEQ ID NO: 1221898 - DNA, 22 bp, Artificial Sequence
  chemically synthesized
caaaaaaaaacacctcctggat

SEQ ID NO: 1221899 - DNA, 22 bp, Artificial Sequence
  chemically synthesized
ttcaaaaaaaaacacctcctgg

SEQ ID NO: 1221900 - DNA, 22 bp, Artificial Sequence
  chemically synthesized
atctcttcaaaaaaaaacacct

SEQ ID NO: 1221901 - DNA, 22 bp, Artificial Sequence
  chemically synthesized
ttaatctcttcaaaaaaaaaca

SEQ ID NO: 1221902 - DNA, 22 bp, Artificial Sequence
  chemically synthesized
gttaatctcttcaaaaaaaaac

SEQ ID NO: 1221903 - DNA, 22 bp, Artificial Sequence
  chemically synthesized
tgttaatctcttcaaaaaaaaa

SEQ ID NO: 1221904 - DNA, 22 bp, Artificial Sequence
  chemically synthesized
ttttgttaatctcttcaaaaaa

SEQ ID NO: 1221905 - DNA, 22 bp, Artificial Sequence
  chemically synthesized
gcagtctattttgttaatctct

SEQ ID NO: 1221906 - DNA, 22 bp, Artificial Sequence
  chemically synthesized
ttttttgaagagattaacaaaa

SEQ ID NO: 1221907 - DNA, 22 bp, Artificial Sequence
  chemically synthesized
tctagcagtctattttgttaat

SEQ ID NO: 1221908 - DNA, 22 bp, Artificial Sequence
  chemically synthesized
tttttgaagagattaacaaaat

SEQ ID NO: 1221909 - DNA, 22 bp, Artificial Sequence
  chemically synthesized
ttttgaagagattaacaaaata

SEQ ID NO: 1221910 - DNA, 22 bp, Artificial Sequence
  chemically synthesized
tttgaagagattaacaaaatag

SEQ ID NO: 1221911 - DNA, 22 bp, Artificial Sequence
  chemically synthesized
ttgaagagattaacaaaataga

SEQ ID NO: 1221912 - DNA, 22 bp, Artificial Sequence
  chemically synthesized
tgaagagattaacaaaatagac

SEQ ID NO: 1221913 - DNA, 22 bp, Artificial Sequence
  chemically synthesized
gtctatctagcagtctattttg

SEQ ID NO: 1221914 - DNA, 22 bp, Artificial Sequence
  chemically synthesized
gaagagattaacaaaatagact

SEQ ID NO: 1221915 - DNA, 22 bp, Artificial Sequence
  chemically synthesized
aagagattaacaaaatagactg

SEQ ID NO: 1221916 - DNA, 22 bp, Artificial Sequence
  chemically synthesized
ttagtctatctagcagtctatt

SEQ ID NO: 1221917 - DNA, 22 bp, Artificial Sequence
  chemically synthesized
attagtctatctagcagtctat

SEQ ID NO: 1221918 - DNA, 22 bp, Artificial Sequence
  chemically synthesized
tattagtctatctagcagtcta

SEQ ID NO: 1221919 - DNA, 22 bp, Artificial Sequence
  chemically synthesized
tttattagtctatctagcagtc

SEQ ID NO: 1221920 - DNA, 22 bp, Artificial Sequence
  chemically synthesized
ctttattagtctatctagcagt

SEQ ID NO: 1221921 - DNA, 22 bp, Artificial Sequence
  chemically synthesized
tctttattagtctatctagcag

SEQ ID NO: 1221922 - DNA, 22 bp, Artificial Sequence
  chemically synthesized
ttctttattagtctatctagca

SEQ ID NO: 1221923 - DNA, 22 bp, Artificial Sequence
  chemically synthesized
acaaaatagactgctagataga

SEQ ID NO: 1221924 - DNA, 22 bp, Artificial Sequence
  chemically synthesized
tttttctttattagtctatcta

SEQ ID NO: 1221925 - DNA, 22 bp, Artificial Sequence
  chemically synthesized
tatttttctttattagtctatc

SEQ ID NO: 1221926 - DNA, 22 bp, Artificial Sequence
  chemically synthesized
tctatttttctttattagtcta

SEQ ID NO: 1221927 - DNA, 22 bp, Artificial Sequence
  chemically synthesized
ctctatttttctttattagtct

SEQ ID NO: 1221928 - DNA, 22 bp, Artificial Sequence
  chemically synthesized
ttctctatttttctttattagt

SEQ ID NO: 1221929 - DNA, 22 bp, Artificial Sequence
  chemically synthesized
ctagatagactaataaagaaaa

SEQ ID NO: 1221930 - DNA, 22 bp, Artificial Sequence
  chemically synthesized
attcttctctatttttctttat

SEQ ID NO: 1221931 - DNA, 22 bp, Artificial Sequence
  chemically synthesized
gattcttctctatttttcttta

SEQ ID NO: 1221932 - DNA, 22 bp, Artificial Sequence
  chemically synthesized
gatagactaataaagaaaaata

SEQ ID NO: 1221933 - DNA, 22 bp, Artificial Sequence
  chemically synthesized
tttgattcttctctatttttct

SEQ ID NO: 1221934 - DNA, 22 bp, Artificial Sequence
  chemically synthesized
tgtctatttgattcttctctat

SEQ ID NO: 1221935 - DNA, 22 bp, Artificial Sequence
  chemically synthesized
ataaagaaaaatagagaagaat

SEQ ID NO: 1221936 - DNA, 22 bp, Artificial Sequence
  chemically synthesized
ttgtgtctatttgattcttctc

SEQ ID NO: 1221937 - DNA, 22 bp, Artificial Sequence
  chemically synthesized
attgtgtctatttgattcttct

SEQ ID NO: 1221938 - DNA, 22 bp, Artificial Sequence
  chemically synthesized
tattgtgtctatttgattcttc

SEQ ID NO: 1221939 - DNA, 22 bp, Artificial Sequence
  chemically synthesized
ttattgtgtctatttgattctt

SEQ ID NO: 1221940 - DNA, 22 bp, Artificial Sequence
  chemically synthesized
tttattgtgtctatttgattct

SEQ ID NO: 1221941 - DNA, 22 bp, Artificial Sequence
  chemically synthesized
tcattttttattgtgtctattt

SEQ ID NO: 1221942 - DNA, 22 bp, Artificial Sequence
  chemically synthesized
atcattttttattgtgtctatt

SEQ ID NO: 1221943 - DNA, 22 bp, Artificial Sequence
  chemically synthesized
tatcattttttattgtgtctat

SEQ ID NO: 1221944 - DNA, 22 bp, Artificial Sequence
  chemically synthesized
tgggatcagtggtgatatcccc

SEQ ID NO: 1221945 - DNA, 22 bp, Artificial Sequence
  chemically synthesized
tgtgggatcagtggtgatatcc

SEQ ID NO: 1221946 - DNA, 22 bp, Artificial Sequence
  chemically synthesized
ctgtgggatcagtggtgatatc

SEQ ID NO: 1221947 - DNA, 22 bp, Artificial Sequence
  chemically synthesized
tatttctgtgggatcagtggtg

SEQ ID NO: 1221948 - DNA, 22 bp, Artificial Sequence
  chemically synthesized
gtatttctgtgggatcagtggt

SEQ ID NO: 1221949 - DNA, 22 bp, Artificial Sequence
  chemically synthesized
atggtagtttgtatttctgtgg

SEQ ID NO: 1221950 - DNA, 22 bp, Artificial Sequence
  chemically synthesized
tgatggtagtttgtatttctgt

SEQ ID NO: 1221951 - DNA, 22 bp, Artificial Sequence
  chemically synthesized
tctgatggtagtttgtatttct

SEQ ID NO: 1221952 - DNA, 22 bp, Artificial Sequence
  chemically synthesized
atcccacagaaatacaaactac

SEQ ID NO: 1221953 - DNA, 22 bp, Artificial Sequence
  chemically synthesized
tagtattctctgatggtagttt

SEQ ID NO: 1221954 - DNA, 22 bp, Artificial Sequence
  chemically synthesized
gtagtattctctgatggtagtt

SEQ ID NO: 1221955 - DNA, 22 bp, Artificial Sequence
  chemically synthesized
cgtagaggtgtttgtagtattc

SEQ ID NO: 1221956 - DNA, 22 bp, Artificial Sequence
  chemically synthesized
gcgtagaggtgtttgtagtatt

SEQ ID NO: 1221957 - DNA, 22 bp, Artificial Sequence
  chemically synthesized
ccatcagagaatactacaaaca

SEQ ID NO: 1221958 - DNA, 22 bp, Artificial Sequence
  chemically synthesized
tttgcgtagaggtgtttgtagt

SEQ ID NO: 1221959 - DNA, 22 bp, Artificial Sequence
  chemically synthesized
atttgcgtagaggtgtttgtag

SEQ ID NO: 1221960 - DNA, 22 bp, Artificial Sequence
  chemically synthesized
tttatttgcgtagaggtgtttg

SEQ ID NO: 1221961 - DNA, 22 bp, Artificial Sequence
  chemically synthesized
ctgtttatttgcgtagaggtgt

SEQ ID NO: 1221962 - DNA, 22 bp, Artificial Sequence
  chemically synthesized
cctgtttatttgcgtagaggtg

SEQ ID NO: 1221963 - DNA, 22 bp, Artificial Sequence
  chemically synthesized
caaacacctctacgcaaataaa

SEQ ID NO: 1221964 - DNA, 22 bp, Artificial Sequence
  chemically synthesized
aacaggtttcctgtttatttgc

SEQ ID NO: 1221965 - DNA, 22 bp, Artificial Sequence
  chemically synthesized
aaacaggtttcctgtttatttg

SEQ ID NO: 1221966 - DNA, 22 bp, Artificial Sequence
  chemically synthesized
tcgcttaaacaggtttcctgtt

SEQ ID NO: 1221967 - DNA, 22 bp, Artificial Sequence
  chemically synthesized
atcgcttaaacaggtttcctgt

SEQ ID NO: 1221968 - DNA, 22 bp, Artificial Sequence
  chemically synthesized
tacgcaaataaacaggaaacct

SEQ ID NO: 1221969 - DNA, 22 bp, Artificial Sequence
  chemically synthesized
cgcaaataaacaggaaacctgt

SEQ ID NO: 1221970 - DNA, 22 bp, Artificial Sequence
  chemically synthesized
aaagagcatcttatcgcttaaa

SEQ ID NO: 1221971 - DNA, 22 bp, Artificial Sequence
  chemically synthesized
caattgaaagagcatcttatcg

SEQ ID NO: 1221972 - DNA, 22 bp, Artificial Sequence
  chemically synthesized
ccaattgaaagagcatcttatc

SEQ ID NO: 1221973 - DNA, 22 bp, Artificial Sequence
  chemically synthesized
ttccaattgaaagagcatctta

SEQ ID NO: 1221974 - DNA, 22 bp, Artificial Sequence
  chemically synthesized
tttaagcgataagatgctcttt

SEQ ID NO: 1221975 - DNA, 22 bp, Artificial Sequence
  chemically synthesized
aagcgataagatgctctttcaa

SEQ ID NO: 1221976 - DNA, 22 bp, Artificial Sequence
  chemically synthesized
agcgataagatgctctttcaat

SEQ ID NO: 1221977 - DNA, 22 bp, Artificial Sequence
  chemically synthesized
tatatagactcttccaattgaa

SEQ ID NO: 1221978 - DNA, 22 bp, Artificial Sequence
  chemically synthesized
tatatatagactcttccaattg

SEQ ID NO: 1221979 - DNA, 22 bp, Artificial Sequence
  chemically synthesized
ctatatatagactcttccaatt

SEQ ID NO: 1221980 - DNA, 22 bp, Artificial Sequence
  chemically synthesized
tctatatatagactcttccaat

SEQ ID NO: 1221981 - DNA, 22 bp, Artificial Sequence
  chemically synthesized
tttcaattggaagagtctatat

SEQ ID NO: 1221982 - DNA, 22 bp, Artificial Sequence
  chemically synthesized
tcaattggaagagtctatatat

SEQ ID NO: 1221983 - DNA, 22 bp, Artificial Sequence
  chemically synthesized
taaagcctttctatatatagac

SEQ ID NO: 1221984 - DNA, 22 bp, Artificial Sequence
  chemically synthesized
caattggaagagtctatatata

SEQ ID NO: 1221985 - DNA, 22 bp, Artificial Sequence
  chemically synthesized
aattggaagagtctatatatag

SEQ ID NO: 1221986 - DNA, 22 bp, Artificial Sequence
  chemically synthesized
gaagagtctatatatagaaagg

SEQ ID NO: 1221987 - DNA, 22 bp, Artificial Sequence
  chemically synthesized
atatctgtaaagcctttctata

SEQ ID NO: 1221988 - DNA, 22 bp, Artificial Sequence
  chemically synthesized
tatatagaaaggctttacagat

SEQ ID NO: 1221989 - DNA, 22 bp, Artificial Sequence
  chemically synthesized
ccaataaaatctcatatctgta

SEQ ID NO: 1221990 - DNA, 22 bp, Artificial Sequence
  chemically synthesized
cccaataaaatctcatatctgt

SEQ ID NO: 1221991 - DNA, 22 bp, Artificial Sequence
  chemically synthesized
tcccaataaaatctcatatctg

SEQ ID NO: 1221992 - DNA, 22 bp, Artificial Sequence
  chemically synthesized
gttttcccaataaaatctcata

SEQ ID NO: 1221993 - DNA, 22 bp, Artificial Sequence
  chemically synthesized
tacagatatgagattttattgg

SEQ ID NO: 1221994 - DNA, 22 bp, Artificial Sequence
  chemically synthesized
acagatatgagattttattggg

SEQ ID NO: 1221995 - DNA, 22 bp, Artificial Sequence
  chemically synthesized
tggtctcgttttcccaataaaa

SEQ ID NO: 1221996 - DNA, 22 bp, Artificial Sequence
  chemically synthesized
cagatatgagattttattggga

SEQ ID NO: 1221997 - DNA, 22 bp, Artificial Sequence
  chemically synthesized
atggtctcgttttcccaataaa

SEQ ID NO: 1221998 - DNA, 22 bp, Artificial Sequence
  chemically synthesized
cttatggtctcgttttcccaat

SEQ ID NO: 1221999 - DNA, 22 bp, Artificial Sequence
  chemically synthesized
tattgggaaaacgagaccataa

SEQ ID NO: 1222000 - DNA, 22 bp, Artificial Sequence
  chemically synthesized
attgggaaaacgagaccataag

SEQ ID NO: 1222001 - DNA, 22 bp, Artificial Sequence
  chemically synthesized
ttgggaaaacgagaccataagc

SEQ ID NO: 1222002 - DNA, 22 bp, Artificial Sequence
  chemically synthesized
ggaaaacgagaccataagcagt

SEQ ID NO: 1222003 - DNA, 22 bp, Artificial Sequence
  chemically synthesized
atgaagatccagccactgctta

SEQ ID NO: 1222004 - DNA, 22 bp, Artificial Sequence
  chemically synthesized
attaatgaagatccagccactg

SEQ ID NO: 1222005 - DNA, 22 bp, Artificial Sequence
  chemically synthesized
gatcttcattaatcagcctgta

SEQ ID NO: 1222006 - DNA, 22 bp, Artificial Sequence
  chemically synthesized
cattaatcagcctgtatttcat

SEQ ID NO: 1222007 - DNA, 22 bp, Artificial Sequence
  chemically synthesized
attaatcagcctgtatttcata

SEQ ID NO: 1222008 - DNA, 22 bp, Artificial Sequence
  chemically synthesized
atcagcctgtatttcatattac

SEQ ID NO: 1222009 - DNA, 22 bp, Artificial Sequence
  chemically synthesized
aaatcaacaaaatgtaatatga

SEQ ID NO: 1222010 - DNA, 22 bp, Artificial Sequence
  chemically synthesized
aaaatcaacaaaatgtaatatg

SEQ ID NO: 1222011 - DNA, 22 bp, Artificial Sequence
  chemically synthesized
tatttcatattacattttgttg

SEQ ID NO: 1222012 - DNA, 22 bp, Artificial Sequence
  chemically synthesized
aacaatttaaaatcaacaaaat

SEQ ID NO: 1222013 - DNA, 22 bp, Artificial Sequence
  chemically synthesized
caacaatttaaaatcaacaaaa

SEQ ID NO: 1222014 - DNA, 22 bp, Artificial Sequence
  chemically synthesized
catattacattttgttgatttt

SEQ ID NO: 1222015 - DNA, 22 bp, Artificial Sequence
  chemically synthesized
atattacattttgttgatttta

SEQ ID NO: 1222016 - DNA, 22 bp, Artificial Sequence
  chemically synthesized
aaacttcaacaatttaaaatca

SEQ ID NO: 1222017 - DNA, 22 bp, Artificial Sequence
  chemically synthesized
cattttgttgattttaaattgt

SEQ ID NO: 1222018 - DNA, 22 bp, Artificial Sequence
  chemically synthesized
tctcaaacttcaacaatttaaa

SEQ ID NO: 1222019 - DNA, 22 bp, Artificial Sequence
  chemically synthesized
ctgtctcaaacttcaacaattt

SEQ ID NO: 1222020 - DNA, 22 bp, Artificial Sequence
  chemically synthesized
actgtctcaaacttcaacaatt

SEQ ID NO: 1222021 - DNA, 22 bp, Artificial Sequence
  chemically synthesized
tgttgattttaaattgttgaag

SEQ ID NO: 1222022 - DNA, 22 bp, Artificial Sequence
  chemically synthesized
tactgtctcaaacttcaacaat

SEQ ID NO: 1222023 - DNA, 22 bp, Artificial Sequence
  chemically synthesized
gttgattttaaattgttgaagt

SEQ ID NO: 1222024 - DNA, 22 bp, Artificial Sequence
  chemically synthesized
ttgattttaaattgttgaagtt

SEQ ID NO: 1222025 - DNA, 22 bp, Artificial Sequence
  chemically synthesized
attttaaattgttgaagtttga

SEQ ID NO: 1222026 - DNA, 22 bp, Artificial Sequence
  chemically synthesized
taaattgttgaagtttgagaca

SEQ ID NO: 1222027 - DNA, 22 bp, Artificial Sequence
  chemically synthesized
aaattgttgaagtttgagacag

SEQ ID NO: 1222028 - DNA, 22 bp, Artificial Sequence
  chemically synthesized
aattgttgaagtttgagacagt

SEQ ID NO: 1222029 - DNA, 22 bp, Artificial Sequence
  chemically synthesized
taagatcaccattttactgtct

SEQ ID NO: 1222030 - DNA, 22 bp, Artificial Sequence
  chemically synthesized
ttgaagtttgagacagtaaaat

SEQ ID NO: 1222031 - DNA, 22 bp, Artificial Sequence
  chemically synthesized
aagtttgagacagtaaaatggt

SEQ ID NO: 1222032 - DNA, 22 bp, Artificial Sequence
  chemically synthesized
tatatcctataagatcaccatt

SEQ ID NO: 1222033 - DNA, 22 bp, Artificial Sequence
  chemically synthesized
gagacagtaaaatggtgatctt

SEQ ID NO: 1222034 - DNA, 22 bp, Artificial Sequence
  chemically synthesized
agacagtaaaatggtgatctta

SEQ ID NO: 1222035 - DNA, 22 bp, Artificial Sequence
  chemically synthesized
ataggatatacaatgtaccttt

SEQ ID NO: 1222036 - DNA, 22 bp, Artificial Sequence
  chemically synthesized
taggatatacaatgtacctttc

SEQ ID NO: 1222037 - DNA, 22 bp, Artificial Sequence
  chemically synthesized
agtgggaagtatatgtagaaag

SEQ ID NO: 1222038 - DNA, 22 bp, Artificial Sequence
  chemically synthesized
ctaagtgggaagtatatgtaga

SEQ ID NO: 1222039 - DNA, 22 bp, Artificial Sequence
  chemically synthesized
tcctaagtgggaagtatatgta

SEQ ID NO: 1222040 - DNA, 22 bp, Artificial Sequence
  chemically synthesized
catatgctctcctaagtgggaa

SEQ ID NO: 1222041 - DNA, 22 bp, Artificial Sequence
  chemically synthesized
tctacatatacttcccacttag

SEQ ID NO: 1222042 - DNA, 22 bp, Artificial Sequence
  chemically synthesized
ctacatatacttcccacttagg

SEQ ID NO: 1222043 - DNA, 22 bp, Artificial Sequence
  chemically synthesized
tacatatacttcccacttagga

SEQ ID NO: 1222044 - DNA, 22 bp, Artificial Sequence
  chemically synthesized
actccatatgctctcctaagtg

SEQ ID NO: 1222045 - DNA, 22 bp, Artificial Sequence
  chemically synthesized
catatacttcccacttaggaga

SEQ ID NO: 1222046 - DNA, 22 bp, Artificial Sequence
  chemically synthesized
gtatacctaactccatatgctc

SEQ ID NO: 1222047 - DNA, 22 bp, Artificial Sequence
  chemically synthesized
cccacttaggagagcatatgga

SEQ ID NO: 1222048 - DNA, 22 bp, Artificial Sequence
  chemically synthesized
ccacttaggagagcatatggag

SEQ ID NO: 1222049 - DNA, 22 bp, Artificial Sequence
  chemically synthesized
aggagagcatatggagttaggt

SEQ ID NO: 1222050 - DNA, 22 bp, Artificial Sequence
  chemically synthesized
ggagagcatatggagttaggta

SEQ ID NO: 1222051 - DNA, 22 bp, Artificial Sequence
  chemically synthesized
aaagagcctggtatacctaact

SEQ ID NO: 1222052 - DNA, 22 bp, Artificial Sequence
  chemically synthesized
tagctaaaagagcctggtatac

SEQ ID NO: 1222053 - DNA, 22 bp, Artificial Sequence
  chemically synthesized
atagctaaaagagcctggtata

SEQ ID NO: 1222054 - DNA, 22 bp, Artificial Sequence
  chemically synthesized
tatagctaaaagagcctggtat

SEQ ID NO: 1222055 - DNA, 22 bp, Artificial Sequence
  chemically synthesized
ggtataccaggctcttttagct

SEQ ID NO: 1222056 - DNA, 22 bp, Artificial Sequence
  chemically synthesized
ttttagctataaaatacactat

SEQ ID NO: 1222057 - DNA, 22 bp, Artificial Sequence
  chemically synthesized
ttagctataaaatacactattc

SEQ ID NO: 1222058 - DNA, 22 bp, Artificial Sequence
  chemically synthesized
tagctataaaatacactattca

SEQ ID NO: 1222059 - DNA, 22 bp, Artificial Sequence
  chemically synthesized
agctataaaatacactattcat

SEQ ID NO: 1222060 - DNA, 22 bp, Artificial Sequence
  chemically synthesized
gctataaaatacactattcatg

SEQ ID NO: 1222061 - DNA, 22 bp, Artificial Sequence
  chemically synthesized
taaaatacactattcatgtacc

SEQ ID NO: 1222062 - DNA, 22 bp, Artificial Sequence
  chemically synthesized
taatcagaaaaaggcaggtaca

SEQ ID NO: 1222063 - DNA, 22 bp, Artificial Sequence
  chemically synthesized
ttcatgtacctgcctttttctg

SEQ ID NO: 1222064 - DNA, 22 bp, Artificial Sequence
  chemically synthesized
acgagcctgtaatcagaaaaag

SEQ ID NO: 1222065 - DNA, 22 bp, Artificial Sequence
  chemically synthesized
atgtacctgcctttttctgatt

SEQ ID NO: 1222066 - DNA, 22 bp, Artificial Sequence
  chemically synthesized
cctttttctgattacaggctcg

SEQ ID NO: 1222067 - DNA, 22 bp, Artificial Sequence
  chemically synthesized
aaaagtaggttgacgagcctgt

SEQ ID NO: 1222068 - DNA, 22 bp, Artificial Sequence
  chemically synthesized
aaaaagtaggttgacgagcctg

SEQ ID NO: 1222069 - DNA, 22 bp, Artificial Sequence
  chemically synthesized
taaaaagtaggttgacgagcct

SEQ ID NO: 1222070 - DNA, 22 bp, Artificial Sequence
  chemically synthesized
tttctgattacaggctcgtcaa

SEQ ID NO: 1222071 - DNA, 22 bp, Artificial Sequence
  chemically synthesized
ttctgattacaggctcgtcaac

SEQ ID NO: 1222072 - DNA, 22 bp, Artificial Sequence
  chemically synthesized
tctgattacaggctcgtcaacc

SEQ ID NO: 1222073 - DNA, 22 bp, Artificial Sequence
  chemically synthesized
ctgattacaggctcgtcaacct

SEQ ID NO: 1222074 - DNA, 22 bp, Artificial Sequence
  chemically synthesized
tgattacaggctcgtcaaccta

SEQ ID NO: 1222075 - DNA, 22 bp, Artificial Sequence
  chemically synthesized
attacaggctcgtcaacctact

SEQ ID NO: 1222076 - DNA, 22 bp, Artificial Sequence
  chemically synthesized
caggctcgtcaacctacttttt

SEQ ID NO: 1222077 - DNA, 22 bp, Artificial Sequence
  chemically synthesized
gtcaacctactttttaaaattg

SEQ ID NO: 1222078 - DNA, 22 bp, Artificial Sequence
  chemically synthesized
aatgaataaaaacaattttaaa

SEQ ID NO: 1222079 - DNA, 22 bp, Artificial Sequence
  chemically synthesized
aaatgaataaaaacaattttaa

SEQ ID NO: 1222080 - DNA, 22 bp, Artificial Sequence
  chemically synthesized
ctttttaaaattgtttttattc

SEQ ID NO: 1222081 - DNA, 22 bp, Artificial Sequence
  chemically synthesized
tttaaaattgtttttattcatt

SEQ ID NO: 1222082 - DNA, 22 bp, Artificial Sequence
  chemically synthesized
ttaaaattgtttttattcattt

SEQ ID NO: 1222083 - DNA, 22 bp, Artificial Sequence
  chemically synthesized
taaaattgtttttattcattta

SEQ ID NO: 1222084 - DNA, 22 bp, Artificial Sequence
  chemically synthesized
aaaattgtttttattcatttaa

SEQ ID NO: 1222085 - DNA, 22 bp, Artificial Sequence
  chemically synthesized
aaattgtttttattcatttaaa

SEQ ID NO: 1222086 - DNA, 22 bp, Artificial Sequence
  chemically synthesized
tttttattcatttaaatttttt

SEQ ID NO: 1222087 - DNA, 22 bp, Artificial Sequence
  chemically synthesized
tgtatatatccacaaaaaattt

SEQ ID NO: 1222088 - DNA, 22 bp, Artificial Sequence
  chemically synthesized
ttattcatttaaattttttgtg

SEQ ID NO: 1222089 - DNA, 22 bp, Artificial Sequence
  chemically synthesized
tattcatttaaattttttgtgg

SEQ ID NO: 1222090 - DNA, 22 bp, Artificial Sequence
  chemically synthesized
attcatttaaattttttgtgga

SEQ ID NO: 1222091 - DNA, 22 bp, Artificial Sequence
  chemically synthesized
ttcatttaaattttttgtggat

SEQ ID NO: 1222092 - DNA, 22 bp, Artificial Sequence
  chemically synthesized
atttaaattttttgtggatata

SEQ ID NO: 1222093 - DNA, 22 bp, Artificial Sequence
  chemically synthesized
aaattttttgtggatatataca

SEQ ID NO: 1222094 - DNA, 22 bp, Artificial Sequence
  chemically synthesized
aattttttgtggatatatacat

SEQ ID NO: 1222095 - DNA, 22 bp, Artificial Sequence
  chemically synthesized
tttgtggatatatacataggtg

SEQ ID NO: 1222096 - DNA, 22 bp, Artificial Sequence
  chemically synthesized
ttgtggatatatacataggtgt

SEQ ID NO: 1222097 - DNA, 22 bp, Artificial Sequence
  chemically synthesized
tgtggatatatacataggtgta

SEQ ID NO: 1222098 - DNA, 22 bp, Artificial Sequence
  chemically synthesized
gtggatatatacataggtgtat

SEQ ID NO: 1222099 - DNA, 22 bp, Artificial Sequence
  chemically synthesized
tggatatatacataggtgtata

SEQ ID NO: 1222100 - DNA, 22 bp, Artificial Sequence
  chemically synthesized
aatgggcatccacatcataatc

SEQ ID NO: 1222101 - DNA, 22 bp, Artificial Sequence
  chemically synthesized
acctattttctgattatgatgt

SEQ ID NO: 1222102 - DNA, 22 bp, Artificial Sequence
  chemically synthesized
cctattttctgattatgatgtg

SEQ ID NO: 1222103 - DNA, 22 bp, Artificial Sequence
  chemically synthesized
ttttctgattatgatgtggatg

SEQ ID NO: 1222104 - DNA, 22 bp, Artificial Sequence
  chemically synthesized
tctgattatgatgtggatgccc

SEQ ID NO: 1222105 - DNA, 22 bp, Artificial Sequence
  chemically synthesized
ctgattatgatgtggatgccca

SEQ ID NO: 1222106 - DNA, 22 bp, Artificial Sequence
  chemically synthesized
tgattatgatgtggatgcccat

SEQ ID NO: 1222107 - DNA, 22 bp, Artificial Sequence
  chemically synthesized
attatgatgtggatgcccattt

SEQ ID NO: 1222108 - DNA, 22 bp, Artificial Sequence
  chemically synthesized
tgatgtggatgcccatttaggc

SEQ ID NO: 1222109 - DNA, 22 bp, Artificial Sequence
  chemically synthesized
cagaataggagtgcctaaatgg

SEQ ID NO: 1222110 - DNA, 22 bp, Artificial Sequence
  chemically synthesized
acagaataggagtgcctaaatg

SEQ ID NO: 1222111 - DNA, 22 bp, Artificial Sequence
  chemically synthesized
aacttacagaataggagtgcct

SEQ ID NO: 1222112 - DNA, 22 bp, Artificial Sequence
  chemically synthesized
gaacttacagaataggagtgcc

SEQ ID NO: 1222113 - DNA, 22 bp, Artificial Sequence
  chemically synthesized
tgaacttacagaataggagtgc

SEQ ID NO: 1222114 - DNA, 22 bp, Artificial Sequence
  chemically synthesized
ctttgaacttacagaataggag

SEQ ID NO: 1222115 - DNA, 22 bp, Artificial Sequence
  chemically synthesized
gtgctcctttgaacttacagaa

SEQ ID NO: 1222116 - DNA, 22 bp, Artificial Sequence
  chemically synthesized
aggcactcctattctgtaagtt

SEQ ID NO: 1222117 - DNA, 22 bp, Artificial Sequence
  chemically synthesized
ggcactcctattctgtaagttc

SEQ ID NO: 1222118 - DNA, 22 bp, Artificial Sequence
  chemically synthesized
tagtgctcctttgaacttacag

SEQ ID NO: 1222119 - DNA, 22 bp, Artificial Sequence
  chemically synthesized
acctctagtgctcctttgaact

SEQ ID NO: 1222120 - DNA, 22 bp, Artificial Sequence
  chemically synthesized
gacctctagtgctcctttgaac

SEQ ID NO: 1222121 - DNA, 22 bp, Artificial Sequence
  chemically synthesized
ctattctgtaagttcaaaggag

SEQ ID NO: 1222122 - DNA, 22 bp, Artificial Sequence
  chemically synthesized
tgacctctagtgctcctttgaa

SEQ ID NO: 1222123 - DNA, 22 bp, Artificial Sequence
  chemically synthesized
ttgacctctagtgctcctttga

SEQ ID NO: 1222124 - DNA, 22 bp, Artificial Sequence
  chemically synthesized
ttctgtaagttcaaaggagcac

SEQ ID NO: 1222125 - DNA, 22 bp, Artificial Sequence
  chemically synthesized
tgtaagttcaaaggagcactag

SEQ ID NO: 1222126 - DNA, 22 bp, Artificial Sequence
  chemically synthesized
taagttcaaaggagcactagag

SEQ ID NO: 1222127 - DNA, 22 bp, Artificial Sequence
  chemically synthesized
aaaggagcactagaggtcaaaa

SEQ ID NO: 1222128 - DNA, 22 bp, Artificial Sequence
  chemically synthesized
agtgacaaaatggcttttgacc

SEQ ID NO: 1222129 - DNA, 22 bp, Artificial Sequence
  chemically synthesized
ttaagtgacaaaatggcttttg

SEQ ID NO: 1222130 - DNA, 22 bp, Artificial Sequence
  chemically synthesized
attaagtgacaaaatggctttt

SEQ ID NO: 1222131 - DNA, 22 bp, Artificial Sequence
  chemically synthesized
ttattaagtgacaaaatggctt

SEQ ID NO: 1222132 - DNA, 22 bp, Artificial Sequence
  chemically synthesized
cttattaagtgacaaaatggct

SEQ ID NO: 1222133 - DNA, 22 bp, Artificial Sequence
  chemically synthesized
tcttattaagtgacaaaatggc

SEQ ID NO: 1222134 - DNA, 22 bp, Artificial Sequence
  chemically synthesized
ttcttattaagtgacaaaatgg

SEQ ID NO: 1222135 - DNA, 22 bp, Artificial Sequence
  chemically synthesized
gaggtcaaaagccattttgtca

SEQ ID NO: 1222136 - DNA, 22 bp, Artificial Sequence
  chemically synthesized
aaaatagatatttttcttatta

SEQ ID NO: 1222137 - DNA, 22 bp, Artificial Sequence
  chemically synthesized
aaaaatagatatttttcttatt

SEQ ID NO: 1222138 - DNA, 22 bp, Artificial Sequence
  chemically synthesized
tgtcacttaataagaaaaatat

SEQ ID NO: 1222139 - DNA, 22 bp, Artificial Sequence
  chemically synthesized
gtcacttaataagaaaaatatc

SEQ ID NO: 1222140 - DNA, 22 bp, Artificial Sequence
  chemically synthesized
tcacttaataagaaaaatatct

SEQ ID NO: 1222141 - DNA, 22 bp, Artificial Sequence
  chemically synthesized
aataagaaaaatatctattttt

SEQ ID NO: 1222142 - DNA, 22 bp, Artificial Sequence
  chemically synthesized
ataagaaaaatatctattttta

SEQ ID NO: 1222143 - DNA, 22 bp, Artificial Sequence
  chemically synthesized
ataaaacagtaagagaagattt

SEQ ID NO: 1222144 - DNA, 22 bp, Artificial Sequence
  chemically synthesized
cataaaacagtaagagaagatt

SEQ ID NO: 1222145 - DNA, 22 bp, Artificial Sequence
  chemically synthesized
tcataaaacagtaagagaagat

SEQ ID NO: 1222146 - DNA, 22 bp, Artificial Sequence
  chemically synthesized
tttttaaatcttctcttactgt

SEQ ID NO: 1222147 - DNA, 22 bp, Artificial Sequence
  chemically synthesized
tcctttcataaaacagtaagag

SEQ ID NO: 1222148 - DNA, 22 bp, Artificial Sequence
  chemically synthesized
ttaaatcttctcttactgtttt

SEQ ID NO: 1222149 - DNA, 22 bp, Artificial Sequence
  chemically synthesized
taaatcttctcttactgtttta

SEQ ID NO: 1222150 - DNA, 22 bp, Artificial Sequence
  chemically synthesized
aaatcttctcttactgttttat

SEQ ID NO: 1222151 - DNA, 22 bp, Artificial Sequence
  chemically synthesized
aatcttctcttactgttttatg

SEQ ID NO: 1222152 - DNA, 22 bp, Artificial Sequence
  chemically synthesized
tgtgtgtcctatcctttcataa

SEQ ID NO: 1222153 - DNA, 22 bp, Artificial Sequence
  chemically synthesized
ctcttactgttttatgaaagga

SEQ ID NO: 1222154 - DNA, 22 bp, Artificial Sequence
  chemically synthesized
gtgtgtgtcctatcctttcata

SEQ ID NO: 1222155 - DNA, 22 bp, Artificial Sequence
  chemically synthesized
tcttactgttttatgaaaggat

SEQ ID NO: 1222156 - DNA, 22 bp, Artificial Sequence
  chemically synthesized
ttgtgtgtgtcctatcctttca

SEQ ID NO: 1222157 - DNA, 22 bp, Artificial Sequence
  chemically synthesized
ttactgttttatgaaaggatag

SEQ ID NO: 1222158 - DNA, 22 bp, Artificial Sequence
  chemically synthesized
actgttttatgaaaggatagga

SEQ ID NO: 1222159 - DNA, 22 bp, Artificial Sequence
  chemically synthesized
ttcttgtgtgtgtcctatcctt

SEQ ID NO: 1222160 - DNA, 22 bp, Artificial Sequence
  chemically synthesized
ctgttttatgaaaggataggac

SEQ ID NO: 1222161 - DNA, 22 bp, Artificial Sequence
  chemically synthesized
ttttatgaaaggataggacaca

SEQ ID NO: 1222162 - DNA, 22 bp, Artificial Sequence
  chemically synthesized
gttattcttgtgtgtgtcctat

SEQ ID NO: 1222163 - DNA, 22 bp, Artificial Sequence
  chemically synthesized
tagttattcttgtgtgtgtcct

SEQ ID NO: 1222164 - DNA, 22 bp, Artificial Sequence
  chemically synthesized
tatgaaaggataggacacacac

SEQ ID NO: 1222165 - DNA, 22 bp, Artificial Sequence
  chemically synthesized
atgaaaggataggacacacaca

SEQ ID NO: 1222166 - DNA, 22 bp, Artificial Sequence
  chemically synthesized
tgaaaggataggacacacacaa

SEQ ID NO: 1222167 - DNA, 22 bp, Artificial Sequence
  chemically synthesized
gggtgtatgctctagttattct

SEQ ID NO: 1222168 - DNA, 22 bp, Artificial Sequence
  chemically synthesized
ttggggtgtatgctctagttat

SEQ ID NO: 1222169 - DNA, 22 bp, Artificial Sequence
  chemically synthesized
ccattattggggtgtatgctct

SEQ ID NO: 1222170 - DNA, 22 bp, Artificial Sequence
  chemically synthesized
gagcatacaccccaataatggg

SEQ ID NO: 1222171 - DNA, 22 bp, Artificial Sequence
  chemically synthesized
aatcacatatggtcagttccca

SEQ ID NO: 1222172 - DNA, 22 bp, Artificial Sequence
  chemically synthesized
ttgaatcacatatggtcagttc

SEQ ID NO: 1222173 - DNA, 22 bp, Artificial Sequence
  chemically synthesized
attgaatcacatatggtcagtt

SEQ ID NO: 1222174 - DNA, 22 bp, Artificial Sequence
  chemically synthesized
tattgaatcacatatggtcagt

SEQ ID NO: 1222175 - DNA, 22 bp, Artificial Sequence
  chemically synthesized
ttattgaatcacatatggtcag

SEQ ID NO: 1222176 - DNA, 22 bp, Artificial Sequence
  chemically synthesized
tttattgaatcacatatggtca

SEQ ID NO: 1222177 - DNA, 22 bp, Artificial Sequence
  chemically synthesized
ttttttattgaatcacatatgg

SEQ ID NO: 1222178 - DNA, 22 bp, Artificial Sequence
  chemically synthesized
gttttttattgaatcacatatg

SEQ ID NO: 1222179 - DNA, 22 bp, Artificial Sequence
  chemically synthesized
atatgtttgttttttattgaat

SEQ ID NO: 1222180 - DNA, 22 bp, Artificial Sequence
  chemically synthesized
accatatgtgattcaataaaaa

SEQ ID NO: 1222181 - DNA, 22 bp, Artificial Sequence
  chemically synthesized
ttaatatgtttgttttttattg

SEQ ID NO: 1222182 - DNA, 22 bp, Artificial Sequence
  chemically synthesized
aataaaaaacaaacatattaac

SEQ ID NO: 1222183 - DNA, 22 bp, Artificial Sequence
  chemically synthesized
aaagataaggctgttaatatgt

SEQ ID NO: 1222184 - DNA, 22 bp, Artificial Sequence
  chemically synthesized
gaaagataaggctgttaatatg

SEQ ID NO: 1222185 - DNA, 22 bp, Artificial Sequence
  chemically synthesized
tatgaatttgaaagataaggct

SEQ ID NO: 1222186 - DNA, 22 bp, Artificial Sequence
  chemically synthesized
tactgtatgaatttgaaagata

SEQ ID NO: 1222187 - DNA, 22 bp, Artificial Sequence
  chemically synthesized
acagccttatctttcaaattca

SEQ ID NO: 1222188 - DNA, 22 bp, Artificial Sequence
  chemically synthesized
atctttcaaattcatacagtat

SEQ ID NO: 1222189 - DNA, 22 bp, Artificial Sequence
  chemically synthesized
tctttcaaattcatacagtata

SEQ ID NO: 1222190 - DNA, 22 bp, Artificial Sequence
  chemically synthesized
aggataaagagctatactgtat

SEQ ID NO: 1222191 - DNA, 22 bp, Artificial Sequence
  chemically synthesized
tgaggataaagagctatactgt

SEQ ID NO: 1222192 - DNA, 22 bp, Artificial Sequence
  chemically synthesized
tcaaattcatacagtatagctc

SEQ ID NO: 1222193 - DNA, 22 bp, Artificial Sequence
  chemically synthesized
caaattcatacagtatagctct

SEQ ID NO: 1222194 - DNA, 22 bp, Artificial Sequence
  chemically synthesized
aaattcatacagtatagctctt

SEQ ID NO: 1222195 - DNA, 22 bp, Artificial Sequence
  chemically synthesized
aacctctgaggataaagagcta

SEQ ID NO: 1222196 - DNA, 22 bp, Artificial Sequence
  chemically synthesized
caacctctgaggataaagagct

SEQ ID NO: 1222197 - DNA, 22 bp, Artificial Sequence
  chemically synthesized
atacagtatagctctttatcct

SEQ ID NO: 1222198 - DNA, 22 bp, Artificial Sequence
  chemically synthesized
tttatcctcagaggttgaagtc

SEQ ID NO: 1222199 - DNA, 22 bp, Artificial Sequence
  chemically synthesized
tatcctcagaggttgaagtccg

SEQ ID NO: 1222200 - DNA, 22 bp, Artificial Sequence
  chemically synthesized
atcctcagaggttgaagtccgt

SEQ ID NO: 1222201 - DNA, 22 bp, Artificial Sequence
  chemically synthesized
tcctcagaggttgaagtccgta

SEQ ID NO: 1222202 - DNA, 22 bp, Artificial Sequence
  chemically synthesized
agaggttgaagtccgtattttc

SEQ ID NO: 1222203 - DNA, 22 bp, Artificial Sequence
  chemically synthesized
aagtccgtattttcattatgtc

SEQ ID NO: 1222204 - DNA, 22 bp, Artificial Sequence
  chemically synthesized
agtgaggtagaaagggcagaca

SEQ ID NO: 1222205 - DNA, 22 bp, Artificial Sequence
  chemically synthesized
gttcagtgaggtagaaagggca

SEQ ID NO: 1222206 - DNA, 22 bp, Artificial Sequence
  chemically synthesized
agttcagtgaggtagaaagggc

SEQ ID NO: 1222207 - DNA, 22 bp, Artificial Sequence
  chemically synthesized
tcattatgtctgccctttctac

SEQ ID NO: 1222208 - DNA, 22 bp, Artificial Sequence
  chemically synthesized
cattatgtctgccctttctacc

SEQ ID NO: 1222209 - DNA, 22 bp, Artificial Sequence
  chemically synthesized
ttagttcagtgaggtagaaagg

SEQ ID NO: 1222210 - DNA, 22 bp, Artificial Sequence
  chemically synthesized
attatgtctgccctttctacct

SEQ ID NO: 1222211 - DNA, 22 bp, Artificial Sequence
  chemically synthesized
tcttagttcagtgaggtagaaa

SEQ ID NO: 1222212 - DNA, 22 bp, Artificial Sequence
  chemically synthesized
ctcttagttcagtgaggtagaa

SEQ ID NO: 1222213 - DNA, 22 bp, Artificial Sequence
  chemically synthesized
tctcttagttcagtgaggtaga

SEQ ID NO: 1222214 - DNA, 22 bp, Artificial Sequence
  chemically synthesized
tgtctgccctttctacctcact

SEQ ID NO: 1222215 - DNA, 22 bp, Artificial Sequence
  chemically synthesized
ccctttctacctcactgaacta

SEQ ID NO: 1222216 - DNA, 22 bp, Artificial Sequence
  chemically synthesized
tatgttttctcttagttcagtg

SEQ ID NO: 1222217 - DNA, 22 bp, Artificial Sequence
  chemically synthesized
gtatgttttctcttagttcagt

SEQ ID NO: 1222218 - DNA, 22 bp, Artificial Sequence
  chemically synthesized
tctacctcactgaactaagaga

SEQ ID NO: 1222219 - DNA, 22 bp, Artificial Sequence
  chemically synthesized
ctacctcactgaactaagagaa

SEQ ID NO: 1222220 - DNA, 22 bp, Artificial Sequence
  chemically synthesized
tacctcactgaactaagagaaa

SEQ ID NO: 1222221 - DNA, 22 bp, Artificial Sequence
  chemically synthesized
cctcactgaactaagagaaaac

SEQ ID NO: 1222222 - DNA, 22 bp, Artificial Sequence
  chemically synthesized
actgaactaagagaaaacatac

SEQ ID NO: 1222223 - DNA, 22 bp, Artificial Sequence
  chemically synthesized
gtagtacacatttgtatgtttt

SEQ ID NO: 1222224 - DNA, 22 bp, Artificial Sequence
  chemically synthesized
aactaagagaaaacatacaaat

SEQ ID NO: 1222225 - DNA, 22 bp, Artificial Sequence
  chemically synthesized
actcgtagtacacatttgtatg

SEQ ID NO: 1222226 - DNA, 22 bp, Artificial Sequence
  chemically synthesized
ttgactcgtagtacacatttgt

SEQ ID NO: 1222227 - DNA, 22 bp, Artificial Sequence
  chemically synthesized
agagaaaacatacaaatgtgta

SEQ ID NO: 1222228 - DNA, 22 bp, Artificial Sequence
  chemically synthesized
ctattgactcgtagtacacatt

SEQ ID NO: 1222229 - DNA, 22 bp, Artificial Sequence
  chemically synthesized
actattgactcgtagtacacat

SEQ ID NO: 1222230 - DNA, 22 bp, Artificial Sequence
  chemically synthesized
tactattgactcgtagtacaca

SEQ ID NO: 1222231 - DNA, 22 bp, Artificial Sequence
  chemically synthesized
ctttactattgactcgtagtac

SEQ ID NO: 1222232 - DNA, 22 bp, Artificial Sequence
  chemically synthesized
cgagtcaatagtaaagtaatcc

SEQ ID NO: 1222233 - DNA, 22 bp, Artificial Sequence
  chemically synthesized
cagtataggggaggattacttt

SEQ ID NO: 1222234 - DNA, 22 bp, Artificial Sequence
  chemically synthesized
gcagtataggggaggattactt

SEQ ID NO: 1222235 - DNA, 22 bp, Artificial Sequence
  chemically synthesized
gtttgcagtataggggaggatt

SEQ ID NO: 1222236 - DNA, 22 bp, Artificial Sequence
  chemically synthesized
agtttgcagtataggggaggat

SEQ ID NO: 1222237 - DNA, 22 bp, Artificial Sequence
  chemically synthesized
cgtccttagtttgcagtatagg

SEQ ID NO: 1222238 - DNA, 22 bp, Artificial Sequence
  chemically synthesized
atcctacgtccttagtttgcag

SEQ ID NO: 1222239 - DNA, 22 bp, Artificial Sequence
  chemically synthesized
ttaatcctacgtccttagtttg

SEQ ID NO: 1222240 - DNA, 22 bp, Artificial Sequence
  chemically synthesized
ccctatactgcaaactaaggac

SEQ ID NO: 1222241 - DNA, 22 bp, Artificial Sequence
  chemically synthesized
tactgcaaactaaggacgtagg

SEQ ID NO: 1222242 - DNA, 22 bp, Artificial Sequence
  chemically synthesized
caaactaaggacgtaggattaa

SEQ ID NO: 1222243 - DNA, 22 bp, Artificial Sequence
  chemically synthesized
agggagaaactattaatcctac

SEQ ID NO: 1222244 - DNA, 22 bp, Artificial Sequence
  chemically synthesized
taagggagaaactattaatcct

SEQ ID NO: 1222245 - DNA, 22 bp, Artificial Sequence
  chemically synthesized
gctctaagggagaaactattaa

SEQ ID NO: 1222246 - DNA, 22 bp, Artificial Sequence
  chemically synthesized
aggacgtaggattaatagtttc

SEQ ID NO: 1222247 - DNA, 22 bp, Artificial Sequence
  chemically synthesized
agctctaagggagaaactatta

SEQ ID NO: 1222248 - DNA, 22 bp, Artificial Sequence
  chemically synthesized
tagctctaagggagaaactatt

SEQ ID NO: 1222249 - DNA, 22 bp, Artificial Sequence
  chemically synthesized
ttagctctaagggagaaactat

SEQ ID NO: 1222250 - DNA, 22 bp, Artificial Sequence
  chemically synthesized
tttttagctctaagggagaaac

SEQ ID NO: 1222251 - DNA, 22 bp, Artificial Sequence
  chemically synthesized
cccctgtttttagctctaaggg

SEQ ID NO: 1222252 - DNA, 22 bp, Artificial Sequence
  chemically synthesized
atagtttctcccttagagctaa

SEQ ID NO: 1222253 - DNA, 22 bp, Artificial Sequence
  chemically synthesized
ctacccctgtttttagctctaa

SEQ ID NO: 1222254 - DNA, 22 bp, Artificial Sequence
  chemically synthesized
ctcccttagagctaaaaacagg

SEQ ID NO: 1222255 - DNA, 22 bp, Artificial Sequence
  chemically synthesized
tcccttagagctaaaaacaggg

SEQ ID NO: 1222256 - DNA, 22 bp, Artificial Sequence
  chemically synthesized
ccttagagctaaaaacaggggt

SEQ ID NO: 1222257 - DNA, 22 bp, Artificial Sequence
  chemically synthesized
agagctaaaaacaggggtagga

SEQ ID NO: 1222258 - DNA, 22 bp, Artificial Sequence
  chemically synthesized
gagctaaaaacaggggtaggag

SEQ ID NO: 1222259 - DNA, 22 bp, Artificial Sequence
  chemically synthesized
tacacgatagtatccctcctac

SEQ ID NO: 1222260 - DNA, 22 bp, Artificial Sequence
  chemically synthesized
tatacacgatagtatccctcct

SEQ ID NO: 1222261 - DNA, 22 bp, Artificial Sequence
  chemically synthesized
aaaacaggggtaggagggatac

SEQ ID NO: 1222262 - DNA, 22 bp, Artificial Sequence
  chemically synthesized
ctatacacgatagtatccctcc

SEQ ID NO: 1222263 - DNA, 22 bp, Artificial Sequence
  chemically synthesized
cttctatacacgatagtatccc

SEQ ID NO: 1222264 - DNA, 22 bp, Artificial Sequence
  chemically synthesized
ttgcttctatacacgatagtat

SEQ ID NO: 1222265 - DNA, 22 bp, Artificial Sequence
  chemically synthesized
attgcttctatacacgatagta

SEQ ID NO: 1222266 - DNA, 22 bp, Artificial Sequence
  chemically synthesized
tattgcttctatacacgatagt

SEQ ID NO: 1222267 - DNA, 22 bp, Artificial Sequence
  chemically synthesized
ttattgcttctatacacgatag

SEQ ID NO: 1222268 - DNA, 22 bp, Artificial Sequence
  chemically synthesized
tttattgcttctatacacgata

SEQ ID NO: 1222269 - DNA, 22 bp, Artificial Sequence
  chemically synthesized
taacccctttttattgcttcta

SEQ ID NO: 1222270 - DNA, 22 bp, Artificial Sequence
  chemically synthesized
tcgtgtatagaagcaataaaaa

SEQ ID NO: 1222271 - DNA, 22 bp, Artificial Sequence
  chemically synthesized
aatactgtaacccctttttatt

SEQ ID NO: 1222272 - DNA, 22 bp, Artificial Sequence
  chemically synthesized
aacactgaatactgtaacccct

SEQ ID NO: 1222273 - DNA, 22 bp, Artificial Sequence
  chemically synthesized
gataatgcatggctgaacactg

SEQ ID NO: 1222274 - DNA, 22 bp, Artificial Sequence
  chemically synthesized
ggataatgcatggctgaacact

SEQ ID NO: 1222275 - DNA, 22 bp, Artificial Sequence
  chemically synthesized
tggataatgcatggctgaacac

SEQ ID NO: 1222276 - DNA, 22 bp, Artificial Sequence
  chemically synthesized
cagtattcagtgttcagccatg

SEQ ID NO: 1222277 - DNA, 22 bp, Artificial Sequence
  chemically synthesized
ctttggataatgcatggctgaa

SEQ ID NO: 1222278 - DNA, 22 bp, Artificial Sequence
  chemically synthesized
tcctttggataatgcatggctg

SEQ ID NO: 1222279 - DNA, 22 bp, Artificial Sequence
  chemically synthesized
ctcctttggataatgcatggct

SEQ ID NO: 1222280 - DNA, 22 bp, Artificial Sequence
  chemically synthesized
ttctcctttggataatgcatgg

SEQ ID NO: 1222281 - DNA, 22 bp, Artificial Sequence
  chemically synthesized
cttctcctttggataatgcatg

SEQ ID NO: 1222282 - DNA, 22 bp, Artificial Sequence
  chemically synthesized
agtgttcagccatgcattatcc

SEQ ID NO: 1222283 - DNA, 22 bp, Artificial Sequence
  chemically synthesized
aaatgtttcttctcctttggat

SEQ ID NO: 1222284 - DNA, 22 bp, Artificial Sequence
  chemically synthesized
agccatgcattatccaaaggag

SEQ ID NO: 1222285 - DNA, 22 bp, Artificial Sequence
  chemically synthesized
gaaatgtttcttctcctttgga

SEQ ID NO: 1222286 - DNA, 22 bp, Artificial Sequence
  chemically synthesized
acttgaaatgtttcttctcctt

SEQ ID NO: 1222287 - DNA, 22 bp, Artificial Sequence
  chemically synthesized
agttgacttgaaatgtttcttc

SEQ ID NO: 1222288 - DNA, 22 bp, Artificial Sequence
  chemically synthesized
tccaaaggagaagaaacatttc

SEQ ID NO: 1222289 - DNA, 22 bp, Artificial Sequence
  chemically synthesized
ggatcagattaagttgacttga

SEQ ID NO: 1222290 - DNA, 22 bp, Artificial Sequence
  chemically synthesized
tgaagttgggatcagattaagt

SEQ ID NO: 1222291 - DNA, 22 bp, Artificial Sequence
  chemically synthesized
gtgaagttgggatcagattaag

SEQ ID NO: 1222292 - DNA, 22 bp, Artificial Sequence
  chemically synthesized
caagtcaacttaatctgatccc

SEQ ID NO: 1222293 - DNA, 22 bp, Artificial Sequence
  chemically synthesized
gtttgtgaagttgggatcagat

SEQ ID NO: 1222294 - DNA, 22 bp, Artificial Sequence
  chemically synthesized
aagtcaacttaatctgatccca

SEQ ID NO: 1222295 - DNA, 22 bp, Artificial Sequence
  chemically synthesized
aatctgatcccaacttcacaaa

SEQ ID NO: 1222296 - DNA, 22 bp, Artificial Sequence
  chemically synthesized
atctgatcccaacttcacaaac

SEQ ID NO: 1222297 - DNA, 22 bp, Artificial Sequence
  chemically synthesized
caacaaaaatgttagtttgtga

SEQ ID NO: 1222298 - DNA, 22 bp, Artificial Sequence
  chemically synthesized
atcccaacttcacaaactaaca

SEQ ID NO: 1222299 - DNA, 22 bp, Artificial Sequence
  chemically synthesized
cacaaactaacatttttgttgt

SEQ ID NO: 1222300 - DNA, 22 bp, Artificial Sequence
  chemically synthesized
ggaaagcaaattacaacaaaaa

SEQ ID NO: 1222301 - DNA, 22 bp, Artificial Sequence
  chemically synthesized
acaaactaacatttttgttgta

SEQ ID NO: 1222302 - DNA, 22 bp, Artificial Sequence
  chemically synthesized
gggaaagcaaattacaacaaaa

SEQ ID NO: 1222303 - DNA, 22 bp, Artificial Sequence
  chemically synthesized
acatttttgttgtaatttgctt

SEQ ID NO: 1222304 - DNA, 22 bp, Artificial Sequence
  chemically synthesized
ttgttgtaatttgctttcccaa

SEQ ID NO: 1222305 - DNA, 22 bp, Artificial Sequence
  chemically synthesized
tgttgtaatttgctttcccaag

SEQ ID NO: 1222306 - DNA, 22 bp, Artificial Sequence
  chemically synthesized
gttgtaatttgctttcccaagt

SEQ ID NO: 1222307 - DNA, 22 bp, Artificial Sequence
  chemically synthesized
ataagcacatgtacttgggaaa

SEQ ID NO: 1222308 - DNA, 22 bp, Artificial Sequence
  chemically synthesized
ttgtaatttgctttcccaagta

SEQ ID NO: 1222309 - DNA, 22 bp, Artificial Sequence
  chemically synthesized
gataagcacatgtacttgggaa

SEQ ID NO: 1222310 - DNA, 22 bp, Artificial Sequence
  chemically synthesized
ttgataagcacatgtacttggg

SEQ ID NO: 1222311 - DNA, 22 bp, Artificial Sequence
  chemically synthesized
taatttgctttcccaagtacat

SEQ ID NO: 1222312 - DNA, 22 bp, Artificial Sequence
  chemically synthesized
ctcttgataagcacatgtactt

SEQ ID NO: 1222313 - DNA, 22 bp, Artificial Sequence
  chemically synthesized
gctttcccaagtacatgtgctt

SEQ ID NO: 1222314 - DNA, 22 bp, Artificial Sequence
  chemically synthesized
ctttcccaagtacatgtgctta

SEQ ID NO: 1222315 - DNA, 22 bp, Artificial Sequence
  chemically synthesized
tcccaagtacatgtgcttatca

SEQ ID NO: 1222316 - DNA, 22 bp, Artificial Sequence
  chemically synthesized
cccaagtacatgtgcttatcaa

SEQ ID NO: 1222317 - DNA, 22 bp, Artificial Sequence
  chemically synthesized
ccaagtacatgtgcttatcaag

SEQ ID NO: 1222318 - DNA, 22 bp, Artificial Sequence
  chemically synthesized
acaaatatattgctcttgataa

SEQ ID NO: 1222319 - DNA, 22 bp, Artificial Sequence
  chemically synthesized
acatacaattgacaaatatatt

SEQ ID NO: 1222320 - DNA, 22 bp, Artificial Sequence
  chemically synthesized
atcaagagcaatatatttgtca

SEQ ID NO: 1222321 - DNA, 22 bp, Artificial Sequence
  chemically synthesized
tcaagagcaatatatttgtcaa

SEQ ID NO: 1222322 - DNA, 22 bp, Artificial Sequence
  chemically synthesized
gtcaattgtatgtgaatattct

SEQ ID NO: 1222323 - DNA, 22 bp, Artificial Sequence
  chemically synthesized
tcaattgtatgtgaatattctg

SEQ ID NO: 1222324 - DNA, 22 bp, Artificial Sequence
  chemically synthesized
tatgtgaatattctgctgcttg

SEQ ID NO: 1222325 - DNA, 22 bp, Artificial Sequence
  chemically synthesized
aatgagatataacaagcagcag

SEQ ID NO: 1222326 - DNA, 22 bp, Artificial Sequence
  chemically synthesized
aaatgagatataacaagcagca

SEQ ID NO: 1222327 - DNA, 22 bp, Artificial Sequence
  chemically synthesized
agtaatcttaaatgagatataa

SEQ ID NO: 1222328 - DNA, 22 bp, Artificial Sequence
  chemically synthesized
tgctgcttgttatatctcattt

SEQ ID NO: 1222329 - DNA, 22 bp, Artificial Sequence
  chemically synthesized
ctgcttgttatatctcatttaa

SEQ ID NO: 1222330 - DNA, 22 bp, Artificial Sequence
  chemically synthesized
cttgttatatctcatttaagat

SEQ ID NO: 1222331 - DNA, 22 bp, Artificial Sequence
  chemically synthesized
gttatatctcatttaagattac

SEQ ID NO: 1222332 - DNA, 22 bp, Artificial Sequence
  chemically synthesized
ttatatctcatttaagattact

SEQ ID NO: 1222333 - DNA, 22 bp, Artificial Sequence
  chemically synthesized
tatctcatttaagattactgaa

SEQ ID NO: 1222334 - DNA, 22 bp, Artificial Sequence
  chemically synthesized
atttaagattactgaatttcca

SEQ ID NO: 1222335 - DNA, 22 bp, Artificial Sequence
  chemically synthesized
aagattactgaatttccatttt

SEQ ID NO: 1222336 - DNA, 22 bp, Artificial Sequence
  chemically synthesized
agattactgaatttccattttt

SEQ ID NO: 1222337 - DNA, 22 bp, Artificial Sequence
  chemically synthesized
aaaagtgatatataaataaaaa

SEQ ID NO: 1222338 - DNA, 22 bp, Artificial Sequence
  chemically synthesized
ctgaatttccatttttatttat

SEQ ID NO: 1222339 - DNA, 22 bp, Artificial Sequence
  chemically synthesized
aaaaagtgatatataaataaaa

SEQ ID NO: 1222340 - DNA, 22 bp, Artificial Sequence
  chemically synthesized
aatttccatttttatttatata

SEQ ID NO: 1222341 - DNA, 22 bp, Artificial Sequence
  chemically synthesized
agtttaaaaagtgatatataaa

SEQ ID NO: 1222342 - DNA, 22 bp, Artificial Sequence
  chemically synthesized
aagtttaaaaagtgatatataa

SEQ ID NO: 1222343 - DNA, 22 bp, Artificial Sequence
  chemically synthesized
taagtttaaaaagtgatatata

SEQ ID NO: 1222344 - DNA, 22 bp, Artificial Sequence
  chemically synthesized
ccatttttatttatatatcact

SEQ ID NO: 1222345 - DNA, 22 bp, Artificial Sequence
  chemically synthesized
catttttatttatatatcactt

SEQ ID NO: 1222346 - DNA, 22 bp, Artificial Sequence
  chemically synthesized
actttaagtttaaaaagtgata

SEQ ID NO: 1222347 - DNA, 22 bp, Artificial Sequence
  chemically synthesized
ttatttatatatcactttttaa

SEQ ID NO: 1222348 - DNA, 22 bp, Artificial Sequence
  chemically synthesized
tatttatatatcactttttaaa

SEQ ID NO: 1222349 - DNA, 22 bp, Artificial Sequence
  chemically synthesized
atttatatatcactttttaaac

SEQ ID NO: 1222350 - DNA, 22 bp, Artificial Sequence
  chemically synthesized
tttatatatcactttttaaact

SEQ ID NO: 1222351 - DNA, 22 bp, Artificial Sequence
  chemically synthesized
atatatcactttttaaacttaa

SEQ ID NO: 1222352 - DNA, 22 bp, Artificial Sequence
  chemically synthesized
tatatcactttttaaacttaaa

SEQ ID NO: 1222353 - DNA, 22 bp, Artificial Sequence
  chemically synthesized
gggtgggaggagttaactttaa

SEQ ID NO: 1222354 - DNA, 22 bp, Artificial Sequence
  chemically synthesized
tttaaacttaaagttaactcct

SEQ ID NO: 1222355 - DNA, 22 bp, Artificial Sequence
  chemically synthesized
ttaaacttaaagttaactcctc

SEQ ID NO: 1222356 - DNA, 22 bp, Artificial Sequence
  chemically synthesized
taaacttaaagttaactcctcc

SEQ ID NO: 1222357 - DNA, 22 bp, Artificial Sequence
  chemically synthesized
aaacttaaagttaactcctccc

SEQ ID NO: 1222358 - DNA, 22 bp, Artificial Sequence
  chemically synthesized
aacttaaagttaactcctccca

SEQ ID NO: 1222359 - DNA, 22 bp, Artificial Sequence
  chemically synthesized
aaagttaactcctcccacccca

SEQ ID NO: 1222360 - DNA, 22 bp, Artificial Sequence
  chemically synthesized
gcagatccacattggggtggga

SEQ ID NO: 1222361 - DNA, 22 bp, Artificial Sequence
  chemically synthesized
aagttaactcctcccaccccaa

SEQ ID NO: 1222362 - DNA, 22 bp, Artificial Sequence
  chemically synthesized
actcctcccaccccaatgtgga

SEQ ID NO: 1222363 - DNA, 22 bp, Artificial Sequence
  chemically synthesized
agatcatctagcagatccacat

SEQ ID NO: 1222364 - DNA, 22 bp, Artificial Sequence
  chemically synthesized
ctcccaccccaatgtggatctg

SEQ ID NO: 1222365 - DNA, 22 bp, Artificial Sequence
  chemically synthesized
ccaccccaatgtggatctgcta

SEQ ID NO: 1222366 - DNA, 22 bp, Artificial Sequence
  chemically synthesized
cctcagatcatctagcagatcc

SEQ ID NO: 1222367 - DNA, 22 bp, Artificial Sequence
  chemically synthesized
attgcctcagatcatctagcag

SEQ ID NO: 1222368 - DNA, 22 bp, Artificial Sequence
  chemically synthesized
ctagatgatctgaggcaatcag

SEQ ID NO: 1222369 - DNA, 22 bp, Artificial Sequence
  chemically synthesized
cagacgcagaagcctgattgcc

SEQ ID NO: 1222370 - DNA, 22 bp, Artificial Sequence
  chemically synthesized
gcagacgcagaagcctgattgc

SEQ ID NO: 1222371 - DNA, 22 bp, Artificial Sequence
  chemically synthesized
gatgatctgaggcaatcaggct

SEQ ID NO: 1222372 - DNA, 22 bp, Artificial Sequence
  chemically synthesized
tgcagacgcagaagcctgattg

SEQ ID NO: 1222373 - DNA, 22 bp, Artificial Sequence
  chemically synthesized
agttttgcagacgcagaagcct

SEQ ID NO: 1222374 - DNA, 22 bp, Artificial Sequence
  chemically synthesized
aggcaatcaggcttctgcgtct

SEQ ID NO: 1222375 - DNA, 22 bp, Artificial Sequence
  chemically synthesized
gtactcagttttgcagacgcag

SEQ ID NO: 1222376 - DNA, 22 bp, Artificial Sequence
  chemically synthesized
ctgcgtctgcaaaactgagtac

SEQ ID NO: 1222377 - DNA, 22 bp, Artificial Sequence
  chemically synthesized
tgcgtctgcaaaactgagtact

SEQ ID NO: 1222378 - DNA, 22 bp, Artificial Sequence
  chemically synthesized
tcaaccagaatctagtactcag

SEQ ID NO: 1222379 - DNA, 22 bp, Artificial Sequence
  chemically synthesized
cgtctgcaaaactgagtactag

SEQ ID NO: 1222380 - DNA, 22 bp, Artificial Sequence
  chemically synthesized
ttatcaaccagaatctagtact

SEQ ID NO: 1222381 - DNA, 22 bp, Artificial Sequence
  chemically synthesized
attatcaaccagaatctagtac

SEQ ID NO: 1222382 - DNA, 22 bp, Artificial Sequence
  chemically synthesized
caaaactgagtactagattctg

SEQ ID NO: 1222383 - DNA, 22 bp, Artificial Sequence
  chemically synthesized
agtactagattctggttgataa

SEQ ID NO: 1222384 - DNA, 22 bp, Artificial Sequence
  chemically synthesized
ccagtgaatttattatcaacca

SEQ ID NO: 1222385 - DNA, 22 bp, Artificial Sequence
  chemically synthesized
gccagtgaatttattatcaacc

SEQ ID NO: 1222386 - DNA, 22 bp, Artificial Sequence
  chemically synthesized
tgccagtgaatttattatcaac

SEQ ID NO: 1222387 - DNA, 22 bp, Artificial Sequence
  chemically synthesized
ttgccagtgaatttattatcaa

SEQ ID NO: 1222388 - DNA, 22 bp, Artificial Sequence
  chemically synthesized
gattctggttgataataaattc

SEQ ID NO: 1222389 - DNA, 22 bp, Artificial Sequence
  chemically synthesized
tggttgataataaattcactgg

SEQ ID NO: 1222390 - DNA, 22 bp, Artificial Sequence
  chemically synthesized
gttgataataaattcactggca

SEQ ID NO: 1222391 - DNA, 22 bp, Artificial Sequence
  chemically synthesized
ataataaattcactggcaaaag

SEQ ID NO: 1222392 - DNA, 22 bp, Artificial Sequence
  chemically synthesized
aaaaatgacccagaagacagcc

SEQ ID NO: 1222393 - DNA, 22 bp, Artificial Sequence
  chemically synthesized
actggcaaaaggctgtcttctg

SEQ ID NO: 1222394 - DNA, 22 bp, Artificial Sequence
  chemically synthesized
gcaaaaggctgtcttctgggtc

SEQ ID NO: 1222395 - DNA, 22 bp, Artificial Sequence
  chemically synthesized
tcttctgggtcatttttgagtt

SEQ ID NO: 1222396 - DNA, 22 bp, Artificial Sequence
  chemically synthesized
ctgggtcatttttgagttttct

SEQ ID NO: 1222397 - DNA, 22 bp, Artificial Sequence
  chemically synthesized
tgggtcatttttgagttttctt

SEQ ID NO: 1222398 - DNA, 22 bp, Artificial Sequence
  chemically synthesized
ggtcatttttgagttttcttga

SEQ ID NO: 1222399 - DNA, 22 bp, Artificial Sequence
  chemically synthesized
ttgagttttcttgatgggacct

SEQ ID NO: 1222400 - DNA, 22 bp, Artificial Sequence
  chemically synthesized
aatatggatggtaggtcccatc

SEQ ID NO: 1222401 - DNA, 22 bp, Artificial Sequence
  chemically synthesized
tgagttttcttgatgggaccta

SEQ ID NO: 1222402 - DNA, 22 bp, Artificial Sequence
  chemically synthesized
caatatggatggtaggtcccat

SEQ ID NO: 1222403 - DNA, 22 bp, Artificial Sequence
  chemically synthesized
gagttttcttgatgggacctac

SEQ ID NO: 1222404 - DNA, 22 bp, Artificial Sequence
  chemically synthesized
tcaatatggatggtaggtccca

SEQ ID NO: 1222405 - DNA, 22 bp, Artificial Sequence
  chemically synthesized
agttttcttgatgggacctacc

SEQ ID NO: 1222406 - DNA, 22 bp, Artificial Sequence
  chemically synthesized
tcttgatgggacctaccatcca

SEQ ID NO: 1222407 - DNA, 22 bp, Artificial Sequence
  chemically synthesized
cttgatgggacctaccatccat

SEQ ID NO: 1222408 - DNA, 22 bp, Artificial Sequence
  chemically synthesized
ttgatgggacctaccatccata

SEQ ID NO: 1222409 - DNA, 22 bp, Artificial Sequence
  chemically synthesized
gatgggacctaccatccatatt

SEQ ID NO: 1222410 - DNA, 22 bp, Artificial Sequence
  chemically synthesized
atgggacctaccatccatattg

SEQ ID NO: 1222411 - DNA, 22 bp, Artificial Sequence
  chemically synthesized
caaaacaggagatctttcaata

SEQ ID NO: 1222412 - DNA, 22 bp, Artificial Sequence
  chemically synthesized
ccatccatattgaaagatctcc

SEQ ID NO: 1222413 - DNA, 22 bp, Artificial Sequence
  chemically synthesized
atcaattccaaaacaggagatc

SEQ ID NO: 1222414 - DNA, 22 bp, Artificial Sequence
  chemically synthesized
catcaattccaaaacaggagat

SEQ ID NO: 1222415 - DNA, 22 bp, Artificial Sequence
  chemically synthesized
aaagatctcctgttttggaatt

SEQ ID NO: 1222416 - DNA, 22 bp, Artificial Sequence
  chemically synthesized
aatcgatttcatcaattccaaa

SEQ ID NO: 1222417 - DNA, 22 bp, Artificial Sequence
  chemically synthesized
ctgttttggaattgatgaaatc

SEQ ID NO: 1222418 - DNA, 22 bp, Artificial Sequence
  chemically synthesized
ggaatattaaatcgatttcatc

SEQ ID NO: 1222419 - DNA, 22 bp, Artificial Sequence
  chemically synthesized
gggaatattaaatcgatttcat

SEQ ID NO: 1222420 - DNA, 22 bp, Artificial Sequence
  chemically synthesized
ttttggaattgatgaaatcgat

SEQ ID NO: 1222421 - DNA, 22 bp, Artificial Sequence
  chemically synthesized
tgggaatattaaatcgatttca

SEQ ID NO: 1222422 - DNA, 22 bp, Artificial Sequence
  chemically synthesized
ttgggaatattaaatcgatttc

SEQ ID NO: 1222423 - DNA, 22 bp, Artificial Sequence
  chemically synthesized
tggaattgatgaaatcgattta

SEQ ID NO: 1222424 - DNA, 22 bp, Artificial Sequence
  chemically synthesized
ggaattgatgaaatcgatttaa

SEQ ID NO: 1222425 - DNA, 22 bp, Artificial Sequence
  chemically synthesized
gaattgatgaaatcgatttaat

SEQ ID NO: 1222426 - DNA, 22 bp, Artificial Sequence
  chemically synthesized
aatgcttttgggaatattaaat

SEQ ID NO: 1222427 - DNA, 22 bp, Artificial Sequence
  chemically synthesized
atgaaatcgatttaatattccc

SEQ ID NO: 1222428 - DNA, 22 bp, Artificial Sequence
  chemically synthesized
ataattaaatgcttttgggaat

SEQ ID NO: 1222429 - DNA, 22 bp, Artificial Sequence
  chemically synthesized
aatattcccaaaagcatttaat

SEQ ID NO: 1222430 - DNA, 22 bp, Artificial Sequence
  chemically synthesized
atattcccaaaagcatttaatt

SEQ ID NO: 1222431 - DNA, 22 bp, Artificial Sequence
  chemically synthesized
caatagaagctgataattaaat

SEQ ID NO: 1222432 - DNA, 22 bp, Artificial Sequence
  chemically synthesized
tacaatagaagctgataattaa

SEQ ID NO: 1222433 - DNA, 22 bp, Artificial Sequence
  chemically synthesized
ccaaaagcatttaattatcagc

SEQ ID NO: 1222434 - DNA, 22 bp, Artificial Sequence
  chemically synthesized
ttctacaatagaagctgataat

SEQ ID NO: 1222435 - DNA, 22 bp, Artificial Sequence
  chemically synthesized
aattatcagcttctattgtaga

SEQ ID NO: 1222436 - DNA, 22 bp, Artificial Sequence
  chemically synthesized
ggtagaagctgttctacaatag

SEQ ID NO: 1222437 - DNA, 22 bp, Artificial Sequence
  chemically synthesized
attatcagcttctattgtagaa

SEQ ID NO: 1222438 - DNA, 22 bp, Artificial Sequence
  chemically synthesized
gggtagaagctgttctacaata

SEQ ID NO: 1222439 - DNA, 22 bp, Artificial Sequence
  chemically synthesized
tcagcttctattgtagaacagc

SEQ ID NO: 1222440 - DNA, 22 bp, Artificial Sequence
  chemically synthesized
ctattgtagaacagcttctacc

SEQ ID NO: 1222441 - DNA, 22 bp, Artificial Sequence
  chemically synthesized
tattgtagaacagcttctaccc

SEQ ID NO: 1222442 - DNA, 22 bp, Artificial Sequence
  chemically synthesized
aagatgatatttgggtagaagc

SEQ ID NO: 1222443 - DNA, 22 bp, Artificial Sequence
  chemically synthesized
ttgtagaacagcttctacccaa

SEQ ID NO: 1222444 - DNA, 22 bp, Artificial Sequence
  chemically synthesized
tagaacagcttctacccaaata

SEQ ID NO: 1222445 - DNA, 22 bp, Artificial Sequence
  chemically synthesized
ctacccaaatatcatcttcaat

SEQ ID NO: 1222446 - DNA, 22 bp, Artificial Sequence
  chemically synthesized
tacccaaatatcatcttcaatc

SEQ ID NO: 1222447 - DNA, 22 bp, Artificial Sequence
  chemically synthesized
cccaaatatcatcttcaatccc

SEQ ID NO: 1222448 - DNA, 22 bp, Artificial Sequence
  chemically synthesized
gaaaagtgaaatcggtgggatt

SEQ ID NO: 1222449 - DNA, 22 bp, Artificial Sequence
  chemically synthesized
caatcccaccgatttcactttt

SEQ ID NO: 1222450 - DNA, 22 bp, Artificial Sequence
  chemically synthesized
aatcccaccgatttcacttttc

SEQ ID NO: 1222451 - DNA, 22 bp, Artificial Sequence
  chemically synthesized
aaatcaggagttggaaaagtga

SEQ ID NO: 1222452 - DNA, 22 bp, Artificial Sequence
  chemically synthesized
taaaatcaggagttggaaaagt

SEQ ID NO: 1222453 - DNA, 22 bp, Artificial Sequence
  chemically synthesized
cactctaaaatcaggagttgga

SEQ ID NO: 1222454 - DNA, 22 bp, Artificial Sequence
  chemically synthesized
ctacactctaaaatcaggagtt

SEQ ID NO: 1222455 - DNA, 22 bp, Artificial Sequence
  chemically synthesized
actacactctaaaatcaggagt

SEQ ID NO: 1222456 - DNA, 22 bp, Artificial Sequence
  chemically synthesized
tactacactctaaaatcaggag

SEQ ID NO: 1222457 - DNA, 22 bp, Artificial Sequence
  chemically synthesized
cacttttccaactcctgatttt

SEQ ID NO: 1222458 - DNA, 22 bp, Artificial Sequence
  chemically synthesized
acttttccaactcctgatttta

SEQ ID NO: 1222459 - DNA, 22 bp, Artificial Sequence
  chemically synthesized
ttccaactcctgattttagagt

SEQ ID NO: 1222460 - DNA, 22 bp, Artificial Sequence
  chemically synthesized
tccaactcctgattttagagtg

SEQ ID NO: 1222461 - DNA, 22 bp, Artificial Sequence
  chemically synthesized
aaggctttactacactctaaaa

SEQ ID NO: 1222462 - DNA, 22 bp, Artificial Sequence
  chemically synthesized
ccaactcctgattttagagtgt

SEQ ID NO: 1222463 - DNA, 22 bp, Artificial Sequence
  chemically synthesized
caactcctgattttagagtgta

SEQ ID NO: 1222464 - DNA, 22 bp, Artificial Sequence
  chemically synthesized
tcaaggctttactacactctaa

SEQ ID NO: 1222465 - DNA, 22 bp, Artificial Sequence
  chemically synthesized
aattctcaaggctttactacac

SEQ ID NO: 1222466 - DNA, 22 bp, Artificial Sequence
  chemically synthesized
ctgattttagagtgtagtaaag

SEQ ID NO: 1222467 - DNA, 22 bp, Artificial Sequence
  chemically synthesized
tcaattctcaaggctttactac

SEQ ID NO: 1222468 - DNA, 22 bp, Artificial Sequence
  chemically synthesized
attttagagtgtagtaaagcct

SEQ ID NO: 1222469 - DNA, 22 bp, Artificial Sequence
  chemically synthesized
ttctcaattctcaaggctttac

SEQ ID NO: 1222470 - DNA, 22 bp, Artificial Sequence
  chemically synthesized
tgttctcaattctcaaggcttt

SEQ ID NO: 1222471 - DNA, 22 bp, Artificial Sequence
  chemically synthesized
tagagtgtagtaaagccttgag

SEQ ID NO: 1222472 - DNA, 22 bp, Artificial Sequence
  chemically synthesized
agagtgtagtaaagccttgaga

SEQ ID NO: 1222473 - DNA, 22 bp, Artificial Sequence
  chemically synthesized
gagtgtagtaaagccttgagaa

SEQ ID NO: 1222474 - DNA, 22 bp, Artificial Sequence
  chemically synthesized
aaatggtagcctctgttctcaa

SEQ ID NO: 1222475 - DNA, 22 bp, Artificial Sequence
  chemically synthesized
gaaatggtagcctctgttctca

SEQ ID NO: 1222476 - DNA, 22 bp, Artificial Sequence
  chemically synthesized
tgaaatggtagcctctgttctc

SEQ ID NO: 1222477 - DNA, 22 bp, Artificial Sequence
  chemically synthesized
gagaattgagaacagaggctac

SEQ ID NO: 1222478 - DNA, 22 bp, Artificial Sequence
  chemically synthesized
agaattgagaacagaggctacc

SEQ ID NO: 1222479 - DNA, 22 bp, Artificial Sequence
  chemically synthesized
ccatgccaattttgaaatggta

SEQ ID NO: 1222480 - DNA, 22 bp, Artificial Sequence
  chemically synthesized
agaacagaggctaccatttcaa

SEQ ID NO: 1222481 - DNA, 22 bp, Artificial Sequence
  chemically synthesized
gccatgccaattttgaaatggt

SEQ ID NO: 1222482 - DNA, 22 bp, Artificial Sequence
  chemically synthesized
tgccatgccaattttgaaatgg

SEQ ID NO: 1222483 - DNA, 22 bp, Artificial Sequence
  chemically synthesized
ttgccatgccaattttgaaatg

SEQ ID NO: 1222484 - DNA, 22 bp, Artificial Sequence
  chemically synthesized
tttgccatgccaattttgaaat

SEQ ID NO: 1222485 - DNA, 22 bp, Artificial Sequence
  chemically synthesized
ccatttcaaaattggcatggca

SEQ ID NO: 1222486 - DNA, 22 bp, Artificial Sequence
  chemically synthesized
tgaagtacactttttgccatgc

SEQ ID NO: 1222487 - DNA, 22 bp, Artificial Sequence
  chemically synthesized
caaaattggcatggcaaaaagt

SEQ ID NO: 1222488 - DNA, 22 bp, Artificial Sequence
  chemically synthesized
aaaattggcatggcaaaaagtg

SEQ ID NO: 1222489 - DNA, 22 bp, Artificial Sequence
  chemically synthesized
gcctatgaagtacactttttgc

SEQ ID NO: 1222490 - DNA, 22 bp, Artificial Sequence
  chemically synthesized
tagcctatgaagtacacttttt

SEQ ID NO: 1222491 - DNA, 22 bp, Artificial Sequence
  chemically synthesized
ctagcctatgaagtacactttt

SEQ ID NO: 1222492 - DNA, 22 bp, Artificial Sequence
  chemically synthesized
ttctagcctatgaagtacactt

SEQ ID NO: 1222493 - DNA, 22 bp, Artificial Sequence
  chemically synthesized
cttctagcctatgaagtacact

SEQ ID NO: 1222494 - DNA, 22 bp, Artificial Sequence
  chemically synthesized
gcatggcaaaaagtgtacttca

SEQ ID NO: 1222495 - DNA, 22 bp, Artificial Sequence
  chemically synthesized
ttcttctagcctatgaagtaca

SEQ ID NO: 1222496 - DNA, 22 bp, Artificial Sequence
  chemically synthesized
ctcttcttctagcctatgaagt

SEQ ID NO: 1222497 - DNA, 22 bp, Artificial Sequence
  chemically synthesized
tactcttcttctagcctatgaa

SEQ ID NO: 1222498 - DNA, 22 bp, Artificial Sequence
  chemically synthesized
tgacctctactcttcttctagc

SEQ ID NO: 1222499 - DNA, 22 bp, Artificial Sequence
  chemically synthesized
cataggctagaagaagagtaga

SEQ ID NO: 1222500 - DNA, 22 bp, Artificial Sequence
  chemically synthesized
ataggctagaagaagagtagag

SEQ ID NO: 1222501 - DNA, 22 bp, Artificial Sequence
  chemically synthesized
gaagaagagtagaggtcacagt

SEQ ID NO: 1222502 - DNA, 22 bp, Artificial Sequence
  chemically synthesized
cagagataataacactgtgacc

SEQ ID NO: 1222503 - DNA, 22 bp, Artificial Sequence
  chemically synthesized
cagacgtagagattacagagat

SEQ ID NO: 1222504 - DNA, 22 bp, Artificial Sequence
  chemically synthesized
ccagacgtagagattacagaga

SEQ ID NO: 1222505 - DNA, 22 bp, Artificial Sequence
  chemically synthesized
ttatctctgtaatctctacgtc

SEQ ID NO: 1222506 - DNA, 22 bp, Artificial Sequence
  chemically synthesized
tctctgtaatctctacgtctgg

SEQ ID NO: 1222507 - DNA, 22 bp, Artificial Sequence
  chemically synthesized
catagtcataccttccagacgt

SEQ ID NO: 1222508 - DNA, 22 bp, Artificial Sequence
  chemically synthesized
tgtaatctctacgtctggaagg

SEQ ID NO: 1222509 - DNA, 22 bp, Artificial Sequence
  chemically synthesized
taatctctacgtctggaaggta

SEQ ID NO: 1222510 - DNA, 22 bp, Artificial Sequence
  chemically synthesized
gtgctacatagtcataccttcc

SEQ ID NO: 1222511 - DNA, 22 bp, Artificial Sequence
  chemically synthesized
tggtgctacatagtcatacctt

SEQ ID NO: 1222512 - DNA, 22 bp, Artificial Sequence
  chemically synthesized
tacgtctggaaggtatgactat

SEQ ID NO: 1222513 - DNA, 22 bp, Artificial Sequence
  chemically synthesized
tctctggtgctacatagtcata

SEQ ID NO: 1222514 - DNA, 22 bp, Artificial Sequence
  chemically synthesized
cgtctggaaggtatgactatgt

SEQ ID NO: 1222515 - DNA, 22 bp, Artificial Sequence
  chemically synthesized
atctctggtgctacatagtcat

SEQ ID NO: 1222516 - DNA, 22 bp, Artificial Sequence
  chemically synthesized
ttatctctggtgctacatagtc

SEQ ID NO: 1222517 - DNA, 22 bp, Artificial Sequence
  chemically synthesized
gaaggtatgactatgtagcacc

SEQ ID NO: 1222518 - DNA, 22 bp, Artificial Sequence
  chemically synthesized
actcttatctctggtgctacat

SEQ ID NO: 1222519 - DNA, 22 bp, Artificial Sequence
  chemically synthesized
gactcttatctctggtgctaca

SEQ ID NO: 1222520 - DNA, 22 bp, Artificial Sequence
  chemically synthesized
tgactcttatctctggtgctac

SEQ ID NO: 1222521 - DNA, 22 bp, Artificial Sequence
  chemically synthesized
aataactttgactcttatctct

SEQ ID NO: 1222522 - DNA, 22 bp, Artificial Sequence
  chemically synthesized
caataactttgactcttatctc

SEQ ID NO: 1222523 - DNA, 22 bp, Artificial Sequence
  chemically synthesized
tgtagcaccagagataagagtc

SEQ ID NO: 1222524 - DNA, 22 bp, Artificial Sequence
  chemically synthesized
cacttcaataactttgactctt

SEQ ID NO: 1222525 - DNA, 22 bp, Artificial Sequence
  chemically synthesized
cattacacttcaataactttga

SEQ ID NO: 1222526 - DNA, 22 bp, Artificial Sequence
  chemically synthesized
ttacattacacttcaataactt

SEQ ID NO: 1222527 - DNA, 22 bp, Artificial Sequence
  chemically synthesized
attacattacacttcaataact

SEQ ID NO: 1222528 - DNA, 22 bp, Artificial Sequence
  chemically synthesized
tattacattacacttcaataac

SEQ ID NO: 1222529 - DNA, 22 bp, Artificial Sequence
  chemically synthesized
ttattacattacacttcaataa

SEQ ID NO: 1222530 - DNA, 22 bp, Artificial Sequence
  chemically synthesized
tatttttattacattacacttc

SEQ ID NO: 1222531 - DNA, 22 bp, Artificial Sequence
  chemically synthesized
atatttttattacattacactt

SEQ ID NO: 1222532 - DNA, 22 bp, Artificial Sequence
  chemically synthesized
ttgaagtgtaatgtaataaaaa

SEQ ID NO: 1222533 - DNA, 22 bp, Artificial Sequence
  chemically synthesized
aagtgtaatgtaataaaaatat

SEQ ID NO: 1222534 - DNA, 22 bp, Artificial Sequence
  chemically synthesized
ataggcagaagtgtatttatat

SEQ ID NO: 1222535 - DNA, 22 bp, Artificial Sequence
  chemically synthesized
gttgataggcagaagtgtattt

SEQ ID NO: 1222536 - DNA, 22 bp, Artificial Sequence
  chemically synthesized
agttgataggcagaagtgtatt

SEQ ID NO: 1222537 - DNA, 22 bp, Artificial Sequence
  chemically synthesized
tagttgataggcagaagtgtat

SEQ ID NO: 1222538 - DNA, 22 bp, Artificial Sequence
  chemically synthesized
tttagttgataggcagaagtgt

SEQ ID NO: 1222539 - DNA, 22 bp, Artificial Sequence
  chemically synthesized
ctttagttgataggcagaagtg

SEQ ID NO: 1222540 - DNA, 22 bp, Artificial Sequence
  chemically synthesized
cttctttagttgataggcagaa

SEQ ID NO: 1222541 - DNA, 22 bp, Artificial Sequence
  chemically synthesized
tgcttctttagttgataggcag

SEQ ID NO: 1222542 - DNA, 22 bp, Artificial Sequence
  chemically synthesized
ctgcttctttagttgataggca

SEQ ID NO: 1222543 - DNA, 22 bp, Artificial Sequence
  chemically synthesized
tctgcttctttagttgataggc

SEQ ID NO: 1222544 - DNA, 22 bp, Artificial Sequence
  chemically synthesized
attttctgcttctttagttgat

SEQ ID NO: 1222545 - DNA, 22 bp, Artificial Sequence
  chemically synthesized
ctcattttctgcttctttagtt

SEQ ID NO: 1222546 - DNA, 22 bp, Artificial Sequence
  chemically synthesized
ctgcctatcaactaaagaagca

SEQ ID NO: 1222547 - DNA, 22 bp, Artificial Sequence
  chemically synthesized
tgcctatcaactaaagaagcag

SEQ ID NO: 1222548 - DNA, 22 bp, Artificial Sequence
  chemically synthesized
cctatcaactaaagaagcagaa

SEQ ID NO: 1222549 - DNA, 22 bp, Artificial Sequence
  chemically synthesized
gatggttactcattttctgctt

SEQ ID NO: 1222550 - DNA, 22 bp, Artificial Sequence
  chemically synthesized
tcaactaaagaagcagaaaatg

SEQ ID NO: 1222551 - DNA, 22 bp, Artificial Sequence
  chemically synthesized
ttggatggttactcattttctg

SEQ ID NO: 1222552 - DNA, 22 bp, Artificial Sequence
  chemically synthesized
tgttggatggttactcattttc

SEQ ID NO: 1222553 - DNA, 22 bp, Artificial Sequence
  chemically synthesized
aagaagcagaaaatgagtaacc

SEQ ID NO: 1222554 - DNA, 22 bp, Artificial Sequence
  chemically synthesized
gggagatcctctgttggatggt

SEQ ID NO: 1222555 - DNA, 22 bp, Artificial Sequence
  chemically synthesized
tggggagatcctctgttggatg

SEQ ID NO: 1222556 - DNA, 22 bp, Artificial Sequence
  chemically synthesized
actctggggagatcctctgttg

SEQ ID NO: 1222557 - DNA, 22 bp, Artificial Sequence
  chemically synthesized
cactctggggagatcctctgtt

SEQ ID NO: 1222558 - DNA, 22 bp, Artificial Sequence
  chemically synthesized
tcactctggggagatcctctgt

SEQ ID NO: 1222559 - DNA, 22 bp, Artificial Sequence
  chemically synthesized
ttcactctggggagatcctctg

SEQ ID NO: 1222560 - DNA, 22 bp, Artificial Sequence
  chemically synthesized
taatttttcactctggggagat

SEQ ID NO: 1222561 - DNA, 22 bp, Artificial Sequence
  chemically synthesized
ttgtaatttttcactctgggga

SEQ ID NO: 1222562 - DNA, 22 bp, Artificial Sequence
  chemically synthesized
tgttgtaatttttcactctggg

SEQ ID NO: 1222563 - DNA, 22 bp, Artificial Sequence
  chemically synthesized
ctgttgtaatttttcactctgg

SEQ ID NO: 1222564 - DNA, 22 bp, Artificial Sequence
  chemically synthesized
cttctgttgtaatttttcactc

SEQ ID NO: 1222565 - DNA, 22 bp, Artificial Sequence
  chemically synthesized
ccactacttctgttgtaatttt

SEQ ID NO: 1222566 - DNA, 22 bp, Artificial Sequence
  chemically synthesized
cccagagtgaaaaattacaaca

SEQ ID NO: 1222567 - DNA, 22 bp, Artificial Sequence
  chemically synthesized
ctgccactacttctgttgtaat

SEQ ID NO: 1222568 - DNA, 22 bp, Artificial Sequence
  chemically synthesized
ttcctgccactacttctgttgt

SEQ ID NO: 1222569 - DNA, 22 bp, Artificial Sequence
  chemically synthesized
caacagaagtagtggcaggaat

SEQ ID NO: 1222570 - DNA, 22 bp, Artificial Sequence
  chemically synthesized
aatcaggaaatctattcctgcc

SEQ ID NO: 1222571 - DNA, 22 bp, Artificial Sequence
  chemically synthesized
aaatcaggaaatctattcctgc

SEQ ID NO: 1222572 - DNA, 22 bp, Artificial Sequence
  chemically synthesized
tttaaatcaggaaatctattcc

SEQ ID NO: 1222573 - DNA, 22 bp, Artificial Sequence
  chemically synthesized
ctatttaaatcaggaaatctat

SEQ ID NO: 1222574 - DNA, 22 bp, Artificial Sequence
  chemically synthesized
actatttaaatcaggaaatcta

SEQ ID NO: 1222575 - DNA, 22 bp, Artificial Sequence
  chemically synthesized
taaaaggcaacatggtttacta

SEQ ID NO: 1222576 - DNA, 22 bp, Artificial Sequence
  chemically synthesized
cctgatttaaatagtaaaccat

SEQ ID NO: 1222577 - DNA, 22 bp, Artificial Sequence
  chemically synthesized
ctgatttaaatagtaaaccatg

SEQ ID NO: 1222578 - DNA, 22 bp, Artificial Sequence
  chemically synthesized
tataaaaggcaacatggtttac

SEQ ID NO: 1222579 - DNA, 22 bp, Artificial Sequence
  chemically synthesized
atttaaatagtaaaccatgttg

SEQ ID NO: 1222580 - DNA, 22 bp, Artificial Sequence
  chemically synthesized
aaatagtaaaccatgttgcctt

SEQ ID NO: 1222581 - DNA, 22 bp, Artificial Sequence
  chemically synthesized
aatagtaaaccatgttgccttt

SEQ ID NO: 1222582 - DNA, 22 bp, Artificial Sequence
  chemically synthesized
atatactctataaaaggcaaca

SEQ ID NO: 1222583 - DNA, 22 bp, Artificial Sequence
  chemically synthesized
attcatatactctataaaaggc

SEQ ID NO: 1222584 - DNA, 22 bp, Artificial Sequence
  chemically synthesized
cattcatatactctataaaagg

SEQ ID NO: 1222585 - DNA, 22 bp, Artificial Sequence
  chemically synthesized
ccaatttcattcatatactcta

SEQ ID NO: 1222586 - DNA, 22 bp, Artificial Sequence
  chemically synthesized
gccaatttcattcatatactct

SEQ ID NO: 1222587 - DNA, 22 bp, Artificial Sequence
  chemically synthesized
ttgccaatttcattcatatact

SEQ ID NO: 1222588 - DNA, 22 bp, Artificial Sequence
  chemically synthesized
ccttttatagagtatatgaatg

SEQ ID NO: 1222589 - DNA, 22 bp, Artificial Sequence
  chemically synthesized
ctcttgccaatttcattcatat

SEQ ID NO: 1222590 - DNA, 22 bp, Artificial Sequence
  chemically synthesized
ttatagagtatatgaatgaaat

SEQ ID NO: 1222591 - DNA, 22 bp, Artificial Sequence
  chemically synthesized
tatagagtatatgaatgaaatt

SEQ ID NO: 1222592 - DNA, 22 bp, Artificial Sequence
  chemically synthesized
gctactcttgccaatttcattc

SEQ ID NO: 1222593 - DNA, 22 bp, Artificial Sequence
  chemically synthesized
atagagtatatgaatgaaattg

SEQ ID NO: 1222594 - DNA, 22 bp, Artificial Sequence
  chemically synthesized
tagagtatatgaatgaaattgg

SEQ ID NO: 1222595 - DNA, 22 bp, Artificial Sequence
  chemically synthesized
attagctactcttgccaatttc

SEQ ID NO: 1222596 - DNA, 22 bp, Artificial Sequence
  chemically synthesized
taattaattagctactcttgcc

SEQ ID NO: 1222597 - DNA, 22 bp, Artificial Sequence
  chemically synthesized
gcaagagtagctaattaattat

SEQ ID NO: 1222598 - DNA, 22 bp, Artificial Sequence
  chemically synthesized
atagagtaatcagctataatta

SEQ ID NO: 1222599 - DNA, 22 bp, Artificial Sequence
  chemically synthesized
gatagagtaatcagctataatt

SEQ ID NO: 1222600 - DNA, 22 bp, Artificial Sequence
  chemically synthesized
attaattatagctgattactct

SEQ ID NO: 1222601 - DNA, 22 bp, Artificial Sequence
  chemically synthesized
ccaagagatttgatagagtaat

SEQ ID NO: 1222602 - DNA, 22 bp, Artificial Sequence
  chemically synthesized
attatagctgattactctatca

SEQ ID NO: 1222603 - DNA, 22 bp, Artificial Sequence
  chemically synthesized
tgctaccaagagatttgataga

SEQ ID NO: 1222604 - DNA, 22 bp, Artificial Sequence
  chemically synthesized
tagctgattactctatcaaatc

SEQ ID NO: 1222605 - DNA, 22 bp, Artificial Sequence
  chemically synthesized
atgctaccaagagatttgatag

SEQ ID NO: 1222606 - DNA, 22 bp, Artificial Sequence
  chemically synthesized
cttatgctaccaagagatttga

SEQ ID NO: 1222607 - DNA, 22 bp, Artificial Sequence
  chemically synthesized
gcttatgctaccaagagatttg

SEQ ID NO: 1222608 - DNA, 22 bp, Artificial Sequence
  chemically synthesized
tgcttatgctaccaagagattt

SEQ ID NO: 1222609 - DNA, 22 bp, Artificial Sequence
  chemically synthesized
attactctatcaaatctcttgg

SEQ ID NO: 1222610 - DNA, 22 bp, Artificial Sequence
  chemically synthesized
ctctatcaaatctcttggtagc

SEQ ID NO: 1222611 - DNA, 22 bp, Artificial Sequence
  chemically synthesized
atgttttgcttatgctaccaag

SEQ ID NO: 1222612 - DNA, 22 bp, Artificial Sequence
  chemically synthesized
tatcaaatctcttggtagcata

SEQ ID NO: 1222613 - DNA, 22 bp, Artificial Sequence
  chemically synthesized
tcaaatctcttggtagcataag

SEQ ID NO: 1222614 - DNA, 22 bp, Artificial Sequence
  chemically synthesized
taaaaagttaatgttttgctta

SEQ ID NO: 1222615 - DNA, 22 bp, Artificial Sequence
  chemically synthesized
ttggtagcataagcaaaacatt

SEQ ID NO: 1222616 - DNA, 22 bp, Artificial Sequence
  chemically synthesized
ggtagcataagcaaaacattaa

SEQ ID NO: 1222617 - DNA, 22 bp, Artificial Sequence
  chemically synthesized
gtagcataagcaaaacattaac

SEQ ID NO: 1222618 - DNA, 22 bp, Artificial Sequence
  chemically synthesized
caaataattataaaaagttaat

SEQ ID NO: 1222619 - DNA, 22 bp, Artificial Sequence
  chemically synthesized
actccaaataattataaaaagt

SEQ ID NO: 1222620 - DNA, 22 bp, Artificial Sequence
  chemically synthesized
gagtgcattgactccaaataat

SEQ ID NO: 1222621 - DNA, 22 bp, Artificial Sequence
  chemically synthesized
ggagtgcattgactccaaataa

SEQ ID NO: 1222622 - DNA, 22 bp, Artificial Sequence
  chemically synthesized
actttttataattatttggagt

SEQ ID NO: 1222623 - DNA, 22 bp, Artificial Sequence
  chemically synthesized
tttataattatttggagtcaat

SEQ ID NO: 1222624 - DNA, 22 bp, Artificial Sequence
  chemically synthesized
catttggagtgcattgactcca

SEQ ID NO: 1222625 - DNA, 22 bp, Artificial Sequence
  chemically synthesized
ttataattatttggagtcaatg

SEQ ID NO: 1222626 - DNA, 22 bp, Artificial Sequence
  chemically synthesized
tataattatttggagtcaatgc

SEQ ID NO: 1222627 - DNA, 22 bp, Artificial Sequence
  chemically synthesized
ataattatttggagtcaatgca

SEQ ID NO: 1222628 - DNA, 22 bp, Artificial Sequence
  chemically synthesized
taattatttggagtcaatgcac

SEQ ID NO: 1222629 - DNA, 22 bp, Artificial Sequence
  chemically synthesized
tttggagtcaatgcactccaaa

SEQ ID NO: 1222630 - DNA, 22 bp, Artificial Sequence
  chemically synthesized
ggagtcaatgcactccaaatgc

SEQ ID NO: 1222631 - DNA, 22 bp, Artificial Sequence
  chemically synthesized
gagtcaatgcactccaaatgca

SEQ ID NO: 1222632 - DNA, 22 bp, Artificial Sequence
  chemically synthesized
tggatggagcatactgcatttg

SEQ ID NO: 1222633 - DNA, 22 bp, Artificial Sequence
  chemically synthesized
caaatgcagtatgctccatcca

SEQ ID NO: 1222634 - DNA, 22 bp, Artificial Sequence
  chemically synthesized
aaatgtgtatgccctatggatg

SEQ ID NO: 1222635 - DNA, 22 bp, Artificial Sequence
  chemically synthesized
aaaatgtgtatgccctatggat

SEQ ID NO: 1222636 - DNA, 22 bp, Artificial Sequence
  chemically synthesized
taaaatgtgtatgccctatgga

SEQ ID NO: 1222637 - DNA, 22 bp, Artificial Sequence
  chemically synthesized
catccatagggcatacacattt

SEQ ID NO: 1222638 - DNA, 22 bp, Artificial Sequence
  chemically synthesized
ggaaaaaagcctttaaaatgtg

SEQ ID NO: 1222639 - DNA, 22 bp, Artificial Sequence
  chemically synthesized
aggaaaaaagcctttaaaatgt

SEQ ID NO: 1222640 - DNA, 22 bp, Artificial Sequence
  chemically synthesized
taggaaaaaagcctttaaaatg

SEQ ID NO: 1222641 - DNA, 22 bp, Artificial Sequence
  chemically synthesized
ttaggaaaaaagcctttaaaat

SEQ ID NO: 1222642 - DNA, 22 bp, Artificial Sequence
  chemically synthesized
cagtgaagacttttaggaaaaa

SEQ ID NO: 1222643 - DNA, 22 bp, Artificial Sequence
  chemically synthesized
taaaggcttttttcctaaaagt

SEQ ID NO: 1222644 - DNA, 22 bp, Artificial Sequence
  chemically synthesized
aaaggcttttttcctaaaagtc

SEQ ID NO: 1222645 - DNA, 22 bp, Artificial Sequence
  chemically synthesized
aaggcttttttcctaaaagtct

SEQ ID NO: 1222646 - DNA, 22 bp, Artificial Sequence
  chemically synthesized
aaattgcagtgaagacttttag

SEQ ID NO: 1222647 - DNA, 22 bp, Artificial Sequence
  chemically synthesized
ttttcctaaaagtcttcactgc

SEQ ID NO: 1222648 - DNA, 22 bp, Artificial Sequence
  chemically synthesized
tttcctaaaagtcttcactgca

SEQ ID NO: 1222649 - DNA, 22 bp, Artificial Sequence
  chemically synthesized
ttcctaaaagtcttcactgcaa

SEQ ID NO: 1222650 - DNA, 22 bp, Artificial Sequence
  chemically synthesized
tcctaaaagtcttcactgcaat

SEQ ID NO: 1222651 - DNA, 22 bp, Artificial Sequence
  chemically synthesized
cctaaaagtcttcactgcaatt

SEQ ID NO: 1222652 - DNA, 22 bp, Artificial Sequence
  chemically synthesized
ctaaaagtcttcactgcaattt

SEQ ID NO: 1222653 - DNA, 22 bp, Artificial Sequence
  chemically synthesized
aaagtcttcactgcaattttag

SEQ ID NO: 1222654 - DNA, 22 bp, Artificial Sequence
  chemically synthesized
aaaataccagtatctaaaattg

SEQ ID NO: 1222655 - DNA, 22 bp, Artificial Sequence
  chemically synthesized
tcaaaataccagtatctaaaat

SEQ ID NO: 1222656 - DNA, 22 bp, Artificial Sequence
  chemically synthesized
gttctcaaaataccagtatcta

SEQ ID NO: 1222657 - DNA, 22 bp, Artificial Sequence
  chemically synthesized
cactgcaattttagatactggt

SEQ ID NO: 1222658 - DNA, 22 bp, Artificial Sequence
  chemically synthesized
actgcaattttagatactggta

SEQ ID NO: 1222659 - DNA, 22 bp, Artificial Sequence
  chemically synthesized
tagttctcaaaataccagtatc

SEQ ID NO: 1222660 - DNA, 22 bp, Artificial Sequence
  chemically synthesized
caattttagatactggtatttt

SEQ ID NO: 1222661 - DNA, 22 bp, Artificial Sequence
  chemically synthesized
attctagttctcaaaataccag

SEQ ID NO: 1222662 - DNA, 22 bp, Artificial Sequence
  chemically synthesized
aattctagttctcaaaatacca

SEQ ID NO: 1222663 - DNA, 22 bp, Artificial Sequence
  chemically synthesized
tttaattctagttctcaaaata

SEQ ID NO: 1222664 - DNA, 22 bp, Artificial Sequence
  chemically synthesized
atttaattctagttctcaaaat

SEQ ID NO: 1222665 - DNA, 22 bp, Artificial Sequence
  chemically synthesized
tagatactggtattttgagaac

SEQ ID NO: 1222666 - DNA, 22 bp, Artificial Sequence
  chemically synthesized
agatactggtattttgagaact

SEQ ID NO: 1222667 - DNA, 22 bp, Artificial Sequence
  chemically synthesized
gatactggtattttgagaacta

SEQ ID NO: 1222668 - DNA, 22 bp, Artificial Sequence
  chemically synthesized
tcttatttaattctagttctca

SEQ ID NO: 1222669 - DNA, 22 bp, Artificial Sequence
  chemically synthesized
gtattttgagaactagaattaa

SEQ ID NO: 1222670 - DNA, 22 bp, Artificial Sequence
  chemically synthesized
tgaattgtcttatttaattcta

SEQ ID NO: 1222671 - DNA, 22 bp, Artificial Sequence
  chemically synthesized
tgagaactagaattaaataaga

SEQ ID NO: 1222672 - DNA, 22 bp, Artificial Sequence
  chemically synthesized
tattatgaattgtcttatttaa

SEQ ID NO: 1222673 - DNA, 22 bp, Artificial Sequence
  chemically synthesized
gagaactagaattaaataagac

SEQ ID NO: 1222674 - DNA, 22 bp, Artificial Sequence
  chemically synthesized
agaactagaattaaataagaca

SEQ ID NO: 1222675 - DNA, 22 bp, Artificial Sequence
  chemically synthesized
cactatattatgaattgtctta

SEQ ID NO: 1222676 - DNA, 22 bp, Artificial Sequence
  chemically synthesized
gcactatattatgaattgtctt

SEQ ID NO: 1222677 - DNA, 22 bp, Artificial Sequence
  chemically synthesized
ttgcactatattatgaattgtc

SEQ ID NO: 1222678 - DNA, 22 bp, Artificial Sequence
  chemically synthesized
gaattaaataagacaattcata

SEQ ID NO: 1222679 - DNA, 22 bp, Artificial Sequence
  chemically synthesized
cttgcactatattatgaattgt

SEQ ID NO: 1222680 - DNA, 22 bp, Artificial Sequence
  chemically synthesized
aataagacaattcataatatag

SEQ ID NO: 1222681 - DNA, 22 bp, Artificial Sequence
  chemically synthesized
agccttcttgcactatattatg

SEQ ID NO: 1222682 - DNA, 22 bp, Artificial Sequence
  chemically synthesized
aaatgttcagccttcttgcact

SEQ ID NO: 1222683 - DNA, 22 bp, Artificial Sequence
  chemically synthesized
aaaatgttcagccttcttgcac

SEQ ID NO: 1222684 - DNA, 22 bp, Artificial Sequence
  chemically synthesized
ataatatagtgcaagaaggctg

SEQ ID NO: 1222685 - DNA, 22 bp, Artificial Sequence
  chemically synthesized
tagatatatttaaaatgttcag

SEQ ID NO: 1222686 - DNA, 22 bp, Artificial Sequence
  chemically synthesized
caatactgtagatatatttaaa

SEQ ID NO: 1222687 - DNA, 22 bp, Artificial Sequence
  chemically synthesized
ccaatactgtagatatatttaa

SEQ ID NO: 1222688 - DNA, 22 bp, Artificial Sequence
  chemically synthesized
tccaatactgtagatatattta

SEQ ID NO: 1222689 - DNA, 22 bp, Artificial Sequence
  chemically synthesized
aacattttaaatatatctacag

SEQ ID NO: 1222690 - DNA, 22 bp, Artificial Sequence
  chemically synthesized
agttttccaatactgtagatat

SEQ ID NO: 1222691 - DNA, 22 bp, Artificial Sequence
  chemically synthesized
aagttttccaatactgtagata

SEQ ID NO: 1222692 - DNA, 22 bp, Artificial Sequence
  chemically synthesized
taaatatatctacagtattgga

SEQ ID NO: 1222693 - DNA, 22 bp, Artificial Sequence
  chemically synthesized
aaatatatctacagtattggaa

SEQ ID NO: 1222694 - DNA, 22 bp, Artificial Sequence
  chemically synthesized
aatatatctacagtattggaaa

SEQ ID NO: 1222695 - DNA, 22 bp, Artificial Sequence
  chemically synthesized
catatcttaagttttccaatac

SEQ ID NO: 1222696 - DNA, 22 bp, Artificial Sequence
  chemically synthesized
cagtattggaaaacttaagata

SEQ ID NO: 1222697 - DNA, 22 bp, Artificial Sequence
  chemically synthesized
cacaaaatacaaaactacatat

SEQ ID NO: 1222698 - DNA, 22 bp, Artificial Sequence
  chemically synthesized
gaaaacttaagatatgtagttt

SEQ ID NO: 1222699 - DNA, 22 bp, Artificial Sequence
  chemically synthesized
tacacaaaatacaaaactacat

SEQ ID NO: 1222700 - DNA, 22 bp, Artificial Sequence
  chemically synthesized
ctacacaaaatacaaaactaca

SEQ ID NO: 1222701 - DNA, 22 bp, Artificial Sequence
  chemically synthesized
aagatatgtagttttgtatttt

SEQ ID NO: 1222702 - DNA, 22 bp, Artificial Sequence
  chemically synthesized
tcatttctacacaaaatacaaa

SEQ ID NO: 1222703 - DNA, 22 bp, Artificial Sequence
  chemically synthesized
agatatgtagttttgtattttg

SEQ ID NO: 1222704 - DNA, 22 bp, Artificial Sequence
  chemically synthesized
gtcatttctacacaaaatacaa

SEQ ID NO: 1222705 - DNA, 22 bp, Artificial Sequence
  chemically synthesized
agacttgtcatttctacacaaa

SEQ ID NO: 1222706 - DNA, 22 bp, Artificial Sequence
  chemically synthesized
atctgagacttgtcatttctac

SEQ ID NO: 1222707 - DNA, 22 bp, Artificial Sequence
  chemically synthesized
catctgagacttgtcatttcta

SEQ ID NO: 1222708 - DNA, 22 bp, Artificial Sequence
  chemically synthesized
tgtattttgtgtagaaatgaca

SEQ ID NO: 1222709 - DNA, 22 bp, Artificial Sequence
  chemically synthesized
tcatctgagacttgtcatttct

SEQ ID NO: 1222710 - DNA, 22 bp, Artificial Sequence
  chemically synthesized
gtattttgtgtagaaatgacaa

SEQ ID NO: 1222711 - DNA, 22 bp, Artificial Sequence
  chemically synthesized
tattttgtgtagaaatgacaag

SEQ ID NO: 1222712 - DNA, 22 bp, Artificial Sequence
  chemically synthesized
atgttttcatctgagacttgtc

SEQ ID NO: 1222713 - DNA, 22 bp, Artificial Sequence
  chemically synthesized
tgtgtagaaatgacaagtctca

SEQ ID NO: 1222714 - DNA, 22 bp, Artificial Sequence
  chemically synthesized
aatgttttcatctgagacttgt

SEQ ID NO: 1222715 - DNA, 22 bp, Artificial Sequence
  chemically synthesized
gtgtagaaatgacaagtctcag

SEQ ID NO: 1222716 - DNA, 22 bp, Artificial Sequence
  chemically synthesized
tgtagaaatgacaagtctcaga

SEQ ID NO: 1222717 - DNA, 22 bp, Artificial Sequence
  chemically synthesized
gtatggtagagtttaatgtttt

SEQ ID NO: 1222718 - DNA, 22 bp, Artificial Sequence
  chemically synthesized
agtatggtagagtttaatgttt

SEQ ID NO: 1222719 - DNA, 22 bp, Artificial Sequence
  chemically synthesized
tagtatggtagagtttaatgtt

SEQ ID NO: 1222720 - DNA, 22 bp, Artificial Sequence
  chemically synthesized
ttagtatggtagagtttaatgt

SEQ ID NO: 1222721 - DNA, 22 bp, Artificial Sequence
  chemically synthesized
cttttagtatggtagagtttaa

SEQ ID NO: 1222722 - DNA, 22 bp, Artificial Sequence
  chemically synthesized
agatgaaaacattaaactctac

SEQ ID NO: 1222723 - DNA, 22 bp, Artificial Sequence
  chemically synthesized
ccactgcttttagtatggtaga

SEQ ID NO: 1222724 - DNA, 22 bp, Artificial Sequence
  chemically synthesized
gactaccactgcttttagtatg

SEQ ID NO: 1222725 - DNA, 22 bp, Artificial Sequence
  chemically synthesized
tggactaccactgcttttagta

SEQ ID NO: 1222726 - DNA, 22 bp, Artificial Sequence
  chemically synthesized
ctggactaccactgcttttagt

SEQ ID NO: 1222727 - DNA, 22 bp, Artificial Sequence
  chemically synthesized
aactctaccatactaaaagcag

SEQ ID NO: 1222728 - DNA, 22 bp, Artificial Sequence
  chemically synthesized
taccatactaaaagcagtggta

SEQ ID NO: 1222729 - DNA, 22 bp, Artificial Sequence
  chemically synthesized
ccatactaaaagcagtggtagt

SEQ ID NO: 1222730 - DNA, 22 bp, Artificial Sequence
  chemically synthesized
gtaaatttctggactaccactg

SEQ ID NO: 1222731 - DNA, 22 bp, Artificial Sequence
  chemically synthesized
aaggttggtaaatttctggact

SEQ ID NO: 1222732 - DNA, 22 bp, Artificial Sequence
  chemically synthesized
aaagcagtggtagtccagaaat

SEQ ID NO: 1222733 - DNA, 22 bp, Artificial Sequence
  chemically synthesized
gatcctgaaggttggtaaattt

SEQ ID NO: 1222734 - DNA, 22 bp, Artificial Sequence
  chemically synthesized
ctcgatcctgaaggttggtaaa

SEQ ID NO: 1222735 - DNA, 22 bp, Artificial Sequence
  chemically synthesized
accaaccttcaggatcgagtag

SEQ ID NO: 1222736 - DNA, 22 bp, Artificial Sequence
  chemically synthesized
ggcatagagaaactactcgatc

SEQ ID NO: 1222737 - DNA, 22 bp, Artificial Sequence
  chemically synthesized
ccaaccttcaggatcgagtagt

SEQ ID NO: 1222738 - DNA, 22 bp, Artificial Sequence
  chemically synthesized
caggatcgagtagtttctctat

SEQ ID NO: 1222739 - DNA, 22 bp, Artificial Sequence
  chemically synthesized
aggatcgagtagtttctctatg

SEQ ID NO: 1222740 - DNA, 22 bp, Artificial Sequence
  chemically synthesized
aacatcgccagatatcaattag

SEQ ID NO: 1222741 - DNA, 22 bp, Artificial Sequence
  chemically synthesized
ctctatgcctaattgatatctg

SEQ ID NO: 1222742 - DNA, 22 bp, Artificial Sequence
  chemically synthesized
tctatgcctaattgatatctgg

SEQ ID NO: 1222743 - DNA, 22 bp, Artificial Sequence
  chemically synthesized
tatgcctaattgatatctggcg

SEQ ID NO: 1222744 - DNA, 22 bp, Artificial Sequence
  chemically synthesized
tgcctaattgatatctggcgat

SEQ ID NO: 1222745 - DNA, 22 bp, Artificial Sequence
  chemically synthesized
gaacatgcattcaacatcgcca

SEQ ID NO: 1222746 - DNA, 22 bp, Artificial Sequence
  chemically synthesized
attgatatctggcgatgttgaa

SEQ ID NO: 1222747 - DNA, 22 bp, Artificial Sequence
  chemically synthesized
atatctggcgatgttgaatgca

SEQ ID NO: 1222748 - DNA, 22 bp, Artificial Sequence
  chemically synthesized
gcgatgttgaatgcatgttcca

SEQ ID NO: 1222749 - DNA, 22 bp, Artificial Sequence
  chemically synthesized
aatgcatgttccagtcgttgtg

SEQ ID NO: 1222750 - DNA, 22 bp, Artificial Sequence
  chemically synthesized
ccagcagtcagccacacaacga

SEQ ID NO: 1222751 - DNA, 22 bp, Artificial Sequence
  chemically synthesized
gccagcagtcagccacacaacg

SEQ ID NO: 1222752 - DNA, 22 bp, Artificial Sequence
  chemically synthesized
cagtcgttgtgtggctgactgc

SEQ ID NO: 1222753 - DNA, 22 bp, Artificial Sequence
  chemically synthesized
gaatagtgtggtttgccagcag

SEQ ID NO: 1222754 - DNA, 22 bp, Artificial Sequence
  chemically synthesized
tgtggctgactgctggcaaacc

SEQ ID NO: 1222755 - DNA, 22 bp, Artificial Sequence
  chemically synthesized
actggaatagtgtggtttgcca

SEQ ID NO: 1222756 - DNA, 22 bp, Artificial Sequence
  chemically synthesized
gactggaatagtgtggtttgcc

SEQ ID NO: 1222757 - DNA, 22 bp, Artificial Sequence
  chemically synthesized
tttgactggaatagtgtggttt

SEQ ID NO: 1222758 - DNA, 22 bp, Artificial Sequence
  chemically synthesized
actgctggcaaaccacactatt

SEQ ID NO: 1222759 - DNA, 22 bp, Artificial Sequence
  chemically synthesized
ctggcaaaccacactattccag

SEQ ID NO: 1222760 - DNA, 22 bp, Artificial Sequence
  chemically synthesized
gcaaaccacactattccagtca

SEQ ID NO: 1222761 - DNA, 22 bp, Artificial Sequence
  chemically synthesized
ggccagacctatttgactggaa

SEQ ID NO: 1222762 - DNA, 22 bp, Artificial Sequence
  chemically synthesized
aggccagacctatttgactgga

SEQ ID NO: 1222763 - DNA, 22 bp, Artificial Sequence
  chemically synthesized
taggccagacctatttgactgg

SEQ ID NO: 1222764 - DNA, 22 bp, Artificial Sequence
  chemically synthesized
ttccagtcaaataggtctggcc

SEQ ID NO: 1222765 - DNA, 22 bp, Artificial Sequence
  chemically synthesized
cagtcaaataggtctggcctaa

SEQ ID NO: 1222766 - DNA, 22 bp, Artificial Sequence
  chemically synthesized
tgtatgtgtgtatgtgtatgtg

SEQ ID NO: 1222767 - DNA, 22 bp, Artificial Sequence
  chemically synthesized
gtgtatgtgtgtatgtgtatgt

SEQ ID NO: 1222768 - DNA, 22 bp, Artificial Sequence
  chemically synthesized
tgtgtatgtgtgtatgtgtatg

SEQ ID NO: 1222769 - DNA, 22 bp, Artificial Sequence
  chemically synthesized
gcctaaaacacatacacataca

SEQ ID NO: 1222770 - DNA, 22 bp, Artificial Sequence
  chemically synthesized
tctttgtgtatgtgtgtatgtg

SEQ ID NO: 1222771 - DNA, 22 bp, Artificial Sequence
  chemically synthesized
gtctttgtgtatgtgtgtatgt

SEQ ID NO: 1222772 - DNA, 22 bp, Artificial Sequence
  chemically synthesized
aaacacatacacatacacacat

SEQ ID NO: 1222773 - DNA, 22 bp, Artificial Sequence
  chemically synthesized
tatttgtctttgtgtatgtgtg

SEQ ID NO: 1222774 - DNA, 22 bp, Artificial Sequence
  chemically synthesized
atatttgtctttgtgtatgtgt

SEQ ID NO: 1222775 - DNA, 22 bp, Artificial Sequence
  chemically synthesized
atttatatttgtctttgtgtat

SEQ ID NO: 1222776 - DNA, 22 bp, Artificial Sequence
  chemically synthesized
gattgatttatatttgtctttg

SEQ ID NO: 1222777 - DNA, 22 bp, Artificial Sequence
  chemically synthesized
tagattgatttatatttgtctt

SEQ ID NO: 1222778 - DNA, 22 bp, Artificial Sequence
  chemically synthesized
atggaacattctagattgattt

SEQ ID NO: 1222779 - DNA, 22 bp, Artificial Sequence
  chemically synthesized
agcatggaagtaaatctcatgg

SEQ ID NO: 1222780 - DNA, 22 bp, Artificial Sequence
  chemically synthesized
gaatgttccatgagatttactt

SEQ ID NO: 1222781 - DNA, 22 bp, Artificial Sequence
  chemically synthesized
catgagatttacttccatgctt

SEQ ID NO: 1222782 - DNA, 22 bp, Artificial Sequence
  chemically synthesized
tcaatgaaaattaagcatggaa

SEQ ID NO: 1222783 - DNA, 22 bp, Artificial Sequence
  chemically synthesized
gttgtcaatgaaaattaagcat

SEQ ID NO: 1222784 - DNA, 22 bp, Artificial Sequence
  chemically synthesized
acttccatgcttaattttcatt

SEQ ID NO: 1222785 - DNA, 22 bp, Artificial Sequence
  chemically synthesized
cttccatgcttaattttcattg

SEQ ID NO: 1222786 - DNA, 22 bp, Artificial Sequence
  chemically synthesized
tgggcattggttgtcaatgaaa

SEQ ID NO: 1222787 - DNA, 22 bp, Artificial Sequence
  chemically synthesized
ccatgcttaattttcattgaca

SEQ ID NO: 1222788 - DNA, 22 bp, Artificial Sequence
  chemically synthesized
catgcttaattttcattgacaa

SEQ ID NO: 1222789 - DNA, 22 bp, Artificial Sequence
  chemically synthesized
aggactatgggcattggttgtc

SEQ ID NO: 1222790 - DNA, 22 bp, Artificial Sequence
  chemically synthesized
aaggactatgggcattggttgt

SEQ ID NO: 1222791 - DNA, 22 bp, Artificial Sequence
  chemically synthesized
aattttcattgacaaccaatgc

SEQ ID NO: 1222792 - DNA, 22 bp, Artificial Sequence
  chemically synthesized
attttcattgacaaccaatgcc

SEQ ID NO: 1222793 - DNA, 22 bp, Artificial Sequence
  chemically synthesized
tcattgacaaccaatgcccata

SEQ ID NO: 1222794 - DNA, 22 bp, Artificial Sequence
  chemically synthesized
cattgacaaccaatgcccatag

SEQ ID NO: 1222795 - DNA, 22 bp, Artificial Sequence
  chemically synthesized
aagacttaaggactatgggcat

SEQ ID NO: 1222796 - DNA, 22 bp, Artificial Sequence
  chemically synthesized
attgacaaccaatgcccatagt

SEQ ID NO: 1222797 - DNA, 22 bp, Artificial Sequence
  chemically synthesized
acaaccaatgcccatagtcctt

SEQ ID NO: 1222798 - DNA, 22 bp, Artificial Sequence
  chemically synthesized
cactcaagacttaaggactatg

SEQ ID NO: 1222799 - DNA, 22 bp, Artificial Sequence
  chemically synthesized
aagggtaaatgaattacactca

SEQ ID NO: 1222800 - DNA, 22 bp, Artificial Sequence
  chemically synthesized
aaagggtaaatgaattacactc

SEQ ID NO: 1222801 - DNA, 22 bp, Artificial Sequence
  chemically synthesized
taaagggtaaatgaattacact

SEQ ID NO: 1222802 - DNA, 22 bp, Artificial Sequence
  chemically synthesized
aagtcttgagtgtaattcattt

SEQ ID NO: 1222803 - DNA, 22 bp, Artificial Sequence
  chemically synthesized
agtcttgagtgtaattcattta

SEQ ID NO: 1222804 - DNA, 22 bp, Artificial Sequence
  chemically synthesized
gagtgtaattcatttacccttt

SEQ ID NO: 1222805 - DNA, 22 bp, Artificial Sequence
  chemically synthesized
agtgtaattcatttacccttta

SEQ ID NO: 1222806 - DNA, 22 bp, Artificial Sequence
  chemically synthesized
aatagaaatattttaaagggta

SEQ ID NO: 1222807 - DNA, 22 bp, Artificial Sequence
  chemically synthesized
aaatagaaatattttaaagggt

SEQ ID NO: 1222808 - DNA, 22 bp, Artificial Sequence
  chemically synthesized
tttaaatagaaatattttaaag

SEQ ID NO: 1222809 - DNA, 22 bp, Artificial Sequence
  chemically synthesized
gtttaaatagaaatattttaaa

SEQ ID NO: 1222810 - DNA, 22 bp, Artificial Sequence
  chemically synthesized
cttgtttaaatagaaatatttt

SEQ ID NO: 1222811 - DNA, 22 bp, Artificial Sequence
  chemically synthesized
atttaccctttaaaatatttct

SEQ ID NO: 1222812 - DNA, 22 bp, Artificial Sequence
  chemically synthesized
ttacttgtttaaatagaaatat

SEQ ID NO: 1222813 - DNA, 22 bp, Artificial Sequence
  chemically synthesized
accctttaaaatatttctattt

SEQ ID NO: 1222814 - DNA, 22 bp, Artificial Sequence
  chemically synthesized
ccctttaaaatatttctattta

SEQ ID NO: 1222815 - DNA, 22 bp, Artificial Sequence
  chemically synthesized
aaattattacttgtttaaatag

SEQ ID NO: 1222816 - DNA, 22 bp, Artificial Sequence
  chemically synthesized
taaaatatttctatttaaacaa

SEQ ID NO: 1222817 - DNA, 22 bp, Artificial Sequence
  chemically synthesized
aaaatatttctatttaaacaag

SEQ ID NO: 1222818 - DNA, 22 bp, Artificial Sequence
  chemically synthesized
aaatatttctatttaaacaagt

SEQ ID NO: 1222819 - DNA, 22 bp, Artificial Sequence
  chemically synthesized
cattaaaattattacttgttta

SEQ ID NO: 1222820 - DNA, 22 bp, Artificial Sequence
  chemically synthesized
ccattaaaattattacttgttt

SEQ ID NO: 1222821 - DNA, 22 bp, Artificial Sequence
  chemically synthesized
ctatttaaacaagtaataattt

SEQ ID NO: 1222822 - DNA, 22 bp, Artificial Sequence
  chemically synthesized
tatttaaacaagtaataatttt

SEQ ID NO: 1222823 - DNA, 22 bp, Artificial Sequence
  chemically synthesized
tttaaacaagtaataattttaa

SEQ ID NO: 1222824 - DNA, 22 bp, Artificial Sequence
  chemically synthesized
aaacaagtaataattttaatgg

SEQ ID NO: 1222825 - DNA, 22 bp, Artificial Sequence
  chemically synthesized
aacaagtaataattttaatgga

SEQ ID NO: 1222826 - DNA, 22 bp, Artificial Sequence
  chemically synthesized
taatggaagatctcattgggtg

SEQ ID NO: 1222827 - DNA, 22 bp, Artificial Sequence
  chemically synthesized
aatggaagatctcattgggtgt

SEQ ID NO: 1222828 - DNA, 22 bp, Artificial Sequence
  chemically synthesized
atggaagatctcattgggtgtg

SEQ ID NO: 1222829 - DNA, 22 bp, Artificial Sequence
  chemically synthesized
caggcatgagccaccacaccca

SEQ ID NO: 1222830 - DNA, 22 bp, Artificial Sequence
  chemically synthesized
agattacaggcatgagccacca

SEQ ID NO: 1222831 - DNA, 22 bp, Artificial Sequence
  chemically synthesized
ttgagattacaggcatgagcca

SEQ ID NO: 1222832 - DNA, 22 bp, Artificial Sequence
  chemically synthesized
attgggtgtggtggctcatgcc

SEQ ID NO: 1222833 - DNA, 22 bp, Artificial Sequence
  chemically synthesized
ggtgtggtggctcatgcctgta

SEQ ID NO: 1222834 - DNA, 22 bp, Artificial Sequence
  chemically synthesized
ccaaattgttgagattacaggc

SEQ ID NO: 1222835 - DNA, 22 bp, Artificial Sequence
  chemically synthesized
cgtctcccaaattgttgagatt

SEQ ID NO: 1222836 - DNA, 22 bp, Artificial Sequence
  chemically synthesized
atgcctgtaatctcaacaattt

SEQ ID NO: 1222837 - DNA, 22 bp, Artificial Sequence
  chemically synthesized
cccacctccgtctcccaaattg

SEQ ID NO: 1222838 - DNA, 22 bp, Artificial Sequence
  chemically synthesized
taatctcaacaatttgggagac

SEQ ID NO: 1222839 - DNA, 22 bp, Artificial Sequence
  chemically synthesized
aacaatttgggagacggaggtg

SEQ ID NO: 1222840 - DNA, 22 bp, Artificial Sequence
  chemically synthesized
aaaggatctgcccacctccgtc

SEQ ID NO: 1222841 - DNA, 22 bp, Artificial Sequence
  chemically synthesized
ggctcaaaggatctgcccacct

SEQ ID NO: 1222842 - DNA, 22 bp, Artificial Sequence
  chemically synthesized
tgggctcaaaggatctgcccac

SEQ ID NO: 1222843 - DNA, 22 bp, Artificial Sequence
  chemically synthesized
gggagacggaggtgggcagatc

SEQ ID NO: 1222844 - DNA, 22 bp, Artificial Sequence
  chemically synthesized
ctgggctcaaaggatctgccca

SEQ ID NO: 1222845 - DNA, 22 bp, Artificial Sequence
  chemically synthesized
ggagacggaggtgggcagatcc

SEQ ID NO: 1222846 - DNA, 22 bp, Artificial Sequence
  chemically synthesized
aacttctgggctcaaaggatct

SEQ ID NO: 1222847 - DNA, 22 bp, Artificial Sequence
  chemically synthesized
gaacttctgggctcaaaggatc

SEQ ID NO: 1222848 - DNA, 22 bp, Artificial Sequence
  chemically synthesized
gtcttgaacttctgggctcaaa

SEQ ID NO: 1222849 - DNA, 22 bp, Artificial Sequence
  chemically synthesized
ggctggtcttgaacttctgggc

SEQ ID NO: 1222850 - DNA, 22 bp, Artificial Sequence
  chemically synthesized
tctaggctggtcttgaacttct

SEQ ID NO: 1222851 - DNA, 22 bp, Artificial Sequence
  chemically synthesized
tgagcccagaagttcaagacca

SEQ ID NO: 1222852 - DNA, 22 bp, Artificial Sequence
  chemically synthesized
gagcccagaagttcaagaccag

SEQ ID NO: 1222853 - DNA, 22 bp, Artificial Sequence
  chemically synthesized
agcccagaagttcaagaccagc

SEQ ID NO: 1222854 - DNA, 22 bp, Artificial Sequence
  chemically synthesized
accaaattgtctaggctggtct

SEQ ID NO: 1222855 - DNA, 22 bp, Artificial Sequence
  chemically synthesized
caccaaattgtctaggctggtc

SEQ ID NO: 1222856 - DNA, 22 bp, Artificial Sequence
  chemically synthesized
aagaccagcctagacaatttgg

SEQ ID NO: 1222857 - DNA, 22 bp, Artificial Sequence
  chemically synthesized
gtagaaacaaggtttcaccaaa

SEQ ID NO: 1222858 - DNA, 22 bp, Artificial Sequence
  chemically synthesized
ggtagaaacaaggtttcaccaa

SEQ ID NO: 1222859 - DNA, 22 bp, Artificial Sequence
  chemically synthesized
tggtagaaacaaggtttcacca

SEQ ID NO: 1222860 - DNA, 22 bp, Artificial Sequence
  chemically synthesized
ttggtagaaacaaggtttcacc

SEQ ID NO: 1222861 - DNA, 22 bp, Artificial Sequence
  chemically synthesized
tttggtagaaacaaggtttcac

SEQ ID NO: 1222862 - DNA, 22 bp, Artificial Sequence
  chemically synthesized
ttttggtagaaacaaggtttca

SEQ ID NO: 1222863 - DNA, 22 bp, Artificial Sequence
  chemically synthesized
tttttggtagaaacaaggtttc

SEQ ID NO: 1222864 - DNA, 22 bp, Artificial Sequence
  chemically synthesized
gacaatttggtgaaaccttgtt

SEQ ID NO: 1222865 - DNA, 22 bp, Artificial Sequence
  chemically synthesized
ttttttggtagaaacaaggttt

SEQ ID NO: 1222866 - DNA, 22 bp, Artificial Sequence
  chemically synthesized
tttttttggtagaaacaaggtt

SEQ ID NO: 1222867 - DNA, 22 bp, Artificial Sequence
  chemically synthesized
ttttttttggtagaaacaaggt

SEQ ID NO: 1222868 - DNA, 22 bp, Artificial Sequence
  chemically synthesized
tttttttttggtagaaacaagg

SEQ ID NO: 1222869 - DNA, 22 bp, Artificial Sequence
  chemically synthesized
ttttttttttggtagaaacaag

SEQ ID NO: 1222870 - DNA, 22 bp, Artificial Sequence
  chemically synthesized
tttttttttttggtagaaacaa

SEQ ID NO: 1222871 - DNA, 22 bp, Artificial Sequence
  chemically synthesized
ttttttttttttggtagaaaca

SEQ ID NO: 1222872 - DNA, 22 bp, Artificial Sequence
  chemically synthesized
tttttttttttttggtagaaac

SEQ ID NO: 1222873 - DNA, 22 bp, Artificial Sequence
  chemically synthesized
ggtgaaaccttgtttctaccaa

SEQ ID NO: 1222874 - DNA, 22 bp, Artificial Sequence
  chemically synthesized
ttttttttttttttggtagaaa

SEQ ID NO: 1222875 - DNA, 22 bp, Artificial Sequence
  chemically synthesized
gtgaaaccttgtttctaccaaa

SEQ ID NO: 1222876 - DNA, 22 bp, Artificial Sequence
  chemically synthesized
tttttttttttttttggtagaa

SEQ ID NO: 1222877 - DNA, 22 bp, Artificial Sequence
  chemically synthesized
ttttttttttttttttggtaga

SEQ ID NO: 1222878 - DNA, 22 bp, Artificial Sequence
  chemically synthesized
tttttttttttttttttggtag

SEQ ID NO: 1222879 - DNA, 22 bp, Artificial Sequence
  chemically synthesized
ttttttttttttttttttggta

SEQ ID NO: 1222880 - DNA, 22 bp, Artificial Sequence
  chemically synthesized
tttttttttttttttttttggt

SEQ ID NO: 1222881 - DNA, 22 bp, Artificial Sequence
  chemically synthesized
ttttttttttttttttttttgg

SEQ ID NO: 1222882 - DNA, 22 bp, Artificial Sequence
  chemically synthesized
tttttttttttttttttttttg

SEQ ID NO: 1222883 - DNA, 22 bp, Artificial Sequence
  chemically synthesized
tttttttttttttttttttttt

SEQ ID NO: 1222884 - DNA, 22 bp, Artificial Sequence
  chemically synthesized
tttttttttttttttttttttt

SEQ ID NO: 1222885 - DNA, 22 bp, Artificial Sequence
  chemically synthesized
tttttttttttttttttttttt

SEQ ID NO: 1222886 - DNA, 22 bp, Artificial Sequence
  chemically synthesized
gtttctaccaaaaaaaaaaaaa

SEQ ID NO: 1222887 - DNA, 22 bp, Artificial Sequence
  chemically synthesized
tttttttttttttttttttttt

SEQ ID NO: 1222888 - DNA, 22 bp, Artificial Sequence
  chemically synthesized
tttctaccaaaaaaaaaaaaaa

SEQ ID NO: 1222889 - DNA, 22 bp, Artificial Sequence
  chemically synthesized
tttttttttttttttttttttt

SEQ ID NO: 1222890 - DNA, 22 bp, Artificial Sequence
  chemically synthesized
cttttttttttttttttttttt

SEQ ID NO: 1222891 - DNA, 22 bp, Artificial Sequence
  chemically synthesized
ctaccaaaaaaaaaaaaaaaaa

SEQ ID NO: 1222892 - DNA, 22 bp, Artificial Sequence
  chemically synthesized
tctttttttttttttttttttt

SEQ ID NO: 1222893 - DNA, 22 bp, Artificial Sequence
  chemically synthesized
taccaaaaaaaaaaaaaaaaaa

SEQ ID NO: 1222894 - DNA, 22 bp, Artificial Sequence
  chemically synthesized
tttctttttttttttttttttt

SEQ ID NO: 1222895 - DNA, 22 bp, Artificial Sequence
  chemically synthesized
ccaaaaaaaaaaaaaaaaaaaa

SEQ ID NO: 1222896 - DNA, 22 bp, Artificial Sequence
  chemically synthesized
ctttcttttttttttttttttt

SEQ ID NO: 1222897 - DNA, 22 bp, Artificial Sequence
  chemically synthesized
tctttctttttttttttttttt

SEQ ID NO: 1222898 - DNA, 22 bp, Artificial Sequence
  chemically synthesized
tttctttctttttttttttttt

SEQ ID NO: 1222899 - DNA, 22 bp, Artificial Sequence
  chemically synthesized
ctttctttcttttttttttttt

SEQ ID NO: 1222900 - DNA, 22 bp, Artificial Sequence
  chemically synthesized
tctttctttctttttttttttt

SEQ ID NO: 1222901 - DNA, 22 bp, Artificial Sequence
  chemically synthesized
tttctttctttctttttttttt

SEQ ID NO: 1222902 - DNA, 22 bp, Artificial Sequence
  chemically synthesized
ctttctttctttcttttttttt

SEQ ID NO: 1222903 - DNA, 22 bp, Artificial Sequence
  chemically synthesized
tctttctttctttctttttttt

SEQ ID NO: 1222904 - DNA, 22 bp, Artificial Sequence
  chemically synthesized
tttctttctttctttctttttt

SEQ ID NO: 1222905 - DNA, 22 bp, Artificial Sequence
  chemically synthesized
ctttctttctttctttcttttt

SEQ ID NO: 1222906 - DNA, 22 bp, Artificial Sequence
  chemically synthesized
tctttctttctttctttctttt

SEQ ID NO: 1222907 - DNA, 22 bp, Artificial Sequence
  chemically synthesized
tttctttctttctttctttctt

SEQ ID NO: 1222908 - DNA, 22 bp, Artificial Sequence
  chemically synthesized
ctttctttctttctttctttct

SEQ ID NO: 1222909 - DNA, 22 bp, Artificial Sequence
  chemically synthesized
tctttctttctttctttctttc

SEQ ID NO: 1222910 - DNA, 22 bp, Artificial Sequence
  chemically synthesized
ttctttctttctttctttcttt

SEQ ID NO: 1222911 - DNA, 22 bp, Artificial Sequence
  chemically synthesized
gtttttctttctttctttcttt

SEQ ID NO: 1222912 - DNA, 22 bp, Artificial Sequence
  chemically synthesized
taggcatgtgacaccacaccca

SEQ ID NO: 1222913 - DNA, 22 bp, Artificial Sequence
  chemically synthesized
gaactgtaggcatgtgacacca

SEQ ID NO: 1222914 - DNA, 22 bp, Artificial Sequence
  chemically synthesized
gctgggtgtggtgtcacatgcc

SEQ ID NO: 1222915 - DNA, 22 bp, Artificial Sequence
  chemically synthesized
ggtgtggtgtcacatgcctaca

SEQ ID NO: 1222916 - DNA, 22 bp, Artificial Sequence
  chemically synthesized
agtagttggaactgtaggcatg

SEQ ID NO: 1222917 - DNA, 22 bp, Artificial Sequence
  chemically synthesized
tgagtagttggaactgtaggca

SEQ ID NO: 1222918 - DNA, 22 bp, Artificial Sequence
  chemically synthesized
ctgagtagttggaactgtaggc

SEQ ID NO: 1222919 - DNA, 22 bp, Artificial Sequence
  chemically synthesized
agccttctgagtagttggaact

SEQ ID NO: 1222920 - DNA, 22 bp, Artificial Sequence
  chemically synthesized
ccacctcagccttctgagtagt

SEQ ID NO: 1222921 - DNA, 22 bp, Artificial Sequence
  chemically synthesized
cagttccaactactcagaaggc

SEQ ID NO: 1222922 - DNA, 22 bp, Artificial Sequence
  chemically synthesized
caactactcagaaggctgaggt

SEQ ID NO: 1222923 - DNA, 22 bp, Artificial Sequence
  chemically synthesized
aggtgatcctcccacctcagcc

SEQ ID NO: 1222924 - DNA, 22 bp, Artificial Sequence
  chemically synthesized
ctcagaaggctgaggtgggagg

SEQ ID NO: 1222925 - DNA, 22 bp, Artificial Sequence
  chemically synthesized
ggctcaggtgatcctcccacct

SEQ ID NO: 1222926 - DNA, 22 bp, Artificial Sequence
  chemically synthesized
agaaggctgaggtgggaggatc

SEQ ID NO: 1222927 - DNA, 22 bp, Artificial Sequence
  chemically synthesized
cctgggctcaggtgatcctccc

SEQ ID NO: 1222928 - DNA, 22 bp, Artificial Sequence
  chemically synthesized
aacctccctgggctcaggtgat

SEQ ID NO: 1222929 - DNA, 22 bp, Artificial Sequence
  chemically synthesized
aggtgggaggatcacctgagcc

SEQ ID NO: 1222930 - DNA, 22 bp, Artificial Sequence
  chemically synthesized
aaccctcaacctccctgggctc

SEQ ID NO: 1222931 - DNA, 22 bp, Artificial Sequence
  chemically synthesized
actgaaccctcaacctccctgg

SEQ ID NO: 1222932 - DNA, 22 bp, Artificial Sequence
  chemically synthesized
tggttcactgaaccctcaacct

SEQ ID NO: 1222933 - DNA, 22 bp, Artificial Sequence
  chemically synthesized
agcccagggaggttgagggttc

SEQ ID NO: 1222934 - DNA, 22 bp, Artificial Sequence
  chemically synthesized
agggttcagtgaaccataatcg

SEQ ID NO: 1222935 - DNA, 22 bp, Artificial Sequence
  chemically synthesized
gagtacagtggcacgattatgg

SEQ ID NO: 1222936 - DNA, 22 bp, Artificial Sequence
  chemically synthesized
agtgaaccataatcgtgccact

SEQ ID NO: 1222937 - DNA, 22 bp, Artificial Sequence
  chemically synthesized
cccaggctagagtacagtggca

SEQ ID NO: 1222938 - DNA, 22 bp, Artificial Sequence
  chemically synthesized
ttgcccaggctagagtacagtg

SEQ ID NO: 1222939 - DNA, 22 bp, Artificial Sequence
  chemically synthesized
tgttgcccaggctagagtacag

SEQ ID NO: 1222940 - DNA, 22 bp, Artificial Sequence
  chemically synthesized
actctgttgcccaggctagagt

SEQ ID NO: 1222941 - DNA, 22 bp, Artificial Sequence
  chemically synthesized
tactctagcctgggcaacagag

SEQ ID NO: 1222942 - DNA, 22 bp, Artificial Sequence
  chemically synthesized
atacagggtctcactctgttgc

SEQ ID NO: 1222943 - DNA, 22 bp, Artificial Sequence
  chemically synthesized
gatacagggtctcactctgttg

SEQ ID NO: 1222944 - DNA, 22 bp, Artificial Sequence
  chemically synthesized
tgatacagggtctcactctgtt

SEQ ID NO: 1222945 - DNA, 22 bp, Artificial Sequence
  chemically synthesized
ttgatacagggtctcactctgt

SEQ ID NO: 1222946 - DNA, 22 bp, Artificial Sequence
  chemically synthesized
tagcctgggcaacagagtgaga

SEQ ID NO: 1222947 - DNA, 22 bp, Artificial Sequence
  chemically synthesized
tttgatacagggtctcactctg

SEQ ID NO: 1222948 - DNA, 22 bp, Artificial Sequence
  chemically synthesized
ttttgatacagggtctcactct

SEQ ID NO: 1222949 - DNA, 22 bp, Artificial Sequence
  chemically synthesized
gcctgggcaacagagtgagacc

SEQ ID NO: 1222950 - DNA, 22 bp, Artificial Sequence
  chemically synthesized
ttttttgatacagggtctcact

SEQ ID NO: 1222951 - DNA, 22 bp, Artificial Sequence
  chemically synthesized
ggcaacagagtgagaccctgta

SEQ ID NO: 1222952 - DNA, 22 bp, Artificial Sequence
  chemically synthesized
agcattcttttttgatacaggg

SEQ ID NO: 1222953 - DNA, 22 bp, Artificial Sequence
  chemically synthesized
aggtatacatcctcagcattct

SEQ ID NO: 1222954 - DNA, 22 bp, Artificial Sequence
  chemically synthesized
aaggtatacatcctcagcattc

SEQ ID NO: 1222955 - DNA, 22 bp, Artificial Sequence
  chemically synthesized
tatcaaaaaagaatgctgagga

SEQ ID NO: 1222956 - DNA, 22 bp, Artificial Sequence
  chemically synthesized
tatgtatttaaggtatacatcc

SEQ ID NO: 1222957 - DNA, 22 bp, Artificial Sequence
  chemically synthesized
aggatgtataccttaaatacat

SEQ ID NO: 1222958 - DNA, 22 bp, Artificial Sequence
  chemically synthesized
acaaataaacgttgtatgtatt

SEQ ID NO: 1222959 - DNA, 22 bp, Artificial Sequence
  chemically synthesized
tataattgacaaataaacgttg

SEQ ID NO: 1222960 - DNA, 22 bp, Artificial Sequence
  chemically synthesized
aaatacatacaacgtttatttg

SEQ ID NO: 1222961 - DNA, 22 bp, Artificial Sequence
  chemically synthesized
ctgtataattgacaaataaacg

SEQ ID NO: 1222962 - DNA, 22 bp, Artificial Sequence
  chemically synthesized
aatacatacaacgtttatttgt

SEQ ID NO: 1222963 - DNA, 22 bp, Artificial Sequence
  chemically synthesized
ttgctgtataattgacaaataa

SEQ ID NO: 1222964 - DNA, 22 bp, Artificial Sequence
  chemically synthesized
attgctgtataattgacaaata

SEQ ID NO: 1222965 - DNA, 22 bp, Artificial Sequence
  chemically synthesized
tattgctgtataattgacaaat

SEQ ID NO: 1222966 - DNA, 22 bp, Artificial Sequence
  chemically synthesized
cccacatctttattgctgtata

SEQ ID NO: 1222967 - DNA, 22 bp, Artificial Sequence
  chemically synthesized
ccccacatctttattgctgtat

SEQ ID NO: 1222968 - DNA, 22 bp, Artificial Sequence
  chemically synthesized
atttgtcaattatacagcaata

SEQ ID NO: 1222969 - DNA, 22 bp, Artificial Sequence
  chemically synthesized
tccccacatctttattgctgta

SEQ ID NO: 1222970 - DNA, 22 bp, Artificial Sequence
  chemically synthesized
tttgtcaattatacagcaataa

SEQ ID NO: 1222971 - DNA, 22 bp, Artificial Sequence
  chemically synthesized
ttccccacatctttattgctgt

SEQ ID NO: 1222972 - DNA, 22 bp, Artificial Sequence
  chemically synthesized
tttccccacatctttattgctg

SEQ ID NO: 1222973 - DNA, 22 bp, Artificial Sequence
  chemically synthesized
ttttccccacatctttattgct

SEQ ID NO: 1222974 - DNA, 22 bp, Artificial Sequence
  chemically synthesized
gtcaattatacagcaataaaga

SEQ ID NO: 1222975 - DNA, 22 bp, Artificial Sequence
  chemically synthesized
tcaattatacagcaataaagat

SEQ ID NO: 1222976 - DNA, 22 bp, Artificial Sequence
  chemically synthesized
ttttttccccacatctttattg

SEQ ID NO: 1222977 - DNA, 22 bp, Artificial Sequence
  chemically synthesized
cttttttccccacatctttatt

SEQ ID NO: 1222978 - DNA, 22 bp, Artificial Sequence
  chemically synthesized
tcttttttccccacatctttat

SEQ ID NO: 1222979 - DNA, 22 bp, Artificial Sequence
  chemically synthesized
tacagcaataaagatgtgggga

SEQ ID NO: 1222980 - DNA, 22 bp, Artificial Sequence
  chemically synthesized
aggattttcttttttccccaca

SEQ ID NO: 1222981 - DNA, 22 bp, Artificial Sequence
  chemically synthesized
caggattttcttttttccccac

SEQ ID NO: 1222982 - DNA, 22 bp, Artificial Sequence
  chemically synthesized
tcatcttcaggattttcttttt

SEQ ID NO: 1222983 - DNA, 22 bp, Artificial Sequence
  chemically synthesized
gtcatcttcaggattttctttt

SEQ ID NO: 1222984 - DNA, 22 bp, Artificial Sequence
  chemically synthesized
tttgtcatcttcaggattttct

SEQ ID NO: 1222985 - DNA, 22 bp, Artificial Sequence
  chemically synthesized
gcgtagattatttgtcatcttc

SEQ ID NO: 1222986 - DNA, 22 bp, Artificial Sequence
  chemically synthesized
gataagctagcgtagattattt

SEQ ID NO: 1222987 - DNA, 22 bp, Artificial Sequence
  chemically synthesized
ggataagctagcgtagattatt

SEQ ID NO: 1222988 - DNA, 22 bp, Artificial Sequence
  chemically synthesized
aagatgacaaataatctacgct

SEQ ID NO: 1222989 - DNA, 22 bp, Artificial Sequence
  chemically synthesized
cttggataagctagcgtagatt

SEQ ID NO: 1222990 - DNA, 22 bp, Artificial Sequence
  chemically synthesized
ttgcttggataagctagcgtag

SEQ ID NO: 1222991 - DNA, 22 bp, Artificial Sequence
  chemically synthesized
gttgcttggataagctagcgta

SEQ ID NO: 1222992 - DNA, 22 bp, Artificial Sequence
  chemically synthesized
tgttgcttggataagctagcgt

SEQ ID NO: 1222993 - DNA, 22 bp, Artificial Sequence
  chemically synthesized
ttgttgcttggataagctagcg

SEQ ID NO: 1222994 - DNA, 22 bp, Artificial Sequence
  chemically synthesized
cgctagcttatccaagcaacaa

SEQ ID NO: 1222995 - DNA, 22 bp, Artificial Sequence
  chemically synthesized
gcttatccaagcaacaaaaatt

SEQ ID NO: 1222996 - DNA, 22 bp, Artificial Sequence
  chemically synthesized
gatgagatagataaatttttgt

SEQ ID NO: 1222997 - DNA, 22 bp, Artificial Sequence
  chemically synthesized
atccaagcaacaaaaatttatc

SEQ ID NO: 1222998 - DNA, 22 bp, Artificial Sequence
  chemically synthesized
tccaagcaacaaaaatttatct

SEQ ID NO: 1222999 - DNA, 22 bp, Artificial Sequence
  chemically synthesized
aaatccacgagactggatgaga

SEQ ID NO: 1223000 - DNA, 22 bp, Artificial Sequence
  chemically synthesized
gtattgaaatccacgagactgg

SEQ ID NO: 1223001 - DNA, 22 bp, Artificial Sequence
  chemically synthesized
atctatctcatccagtctcgtg

SEQ ID NO: 1223002 - DNA, 22 bp, Artificial Sequence
  chemically synthesized
tctatctcatccagtctcgtgg

SEQ ID NO: 1223003 - DNA, 22 bp, Artificial Sequence
  chemically synthesized
tctcatccagtctcgtggattt

SEQ ID NO: 1223004 - DNA, 22 bp, Artificial Sequence
  chemically synthesized
atccagtctcgtggatttcaat

SEQ ID NO: 1223005 - DNA, 22 bp, Artificial Sequence
  chemically synthesized
ccagtaaatggctggtattgaa

SEQ ID NO: 1223006 - DNA, 22 bp, Artificial Sequence
  chemically synthesized
gtggatttcaataccagccatt

SEQ ID NO: 1223007 - DNA, 22 bp, Artificial Sequence
  chemically synthesized
ggcattaccagtaaatggctgg

SEQ ID NO: 1223008 - DNA, 22 bp, Artificial Sequence
  chemically synthesized
caataccagccatttactggta

SEQ ID NO: 1223009 - DNA, 22 bp, Artificial Sequence
  chemically synthesized
aataccagccatttactggtaa

SEQ ID NO: 1223010 - DNA, 22 bp, Artificial Sequence
  chemically synthesized
gacatataaaactgggcattac

SEQ ID NO: 1223011 - DNA, 22 bp, Artificial Sequence
  chemically synthesized
ggttagacatataaaactgggc

SEQ ID NO: 1223012 - DNA, 22 bp, Artificial Sequence
  chemically synthesized
actggtaatgcccagttttata

SEQ ID NO: 1223013 - DNA, 22 bp, Artificial Sequence
  chemically synthesized
ctggtaatgcccagttttatat

SEQ ID NO: 1223014 - DNA, 22 bp, Artificial Sequence
  chemically synthesized
gtaatgcccagttttatatgtc

SEQ ID NO: 1223015 - DNA, 22 bp, Artificial Sequence
  chemically synthesized
gggaagaggtctgggttagaca

SEQ ID NO: 1223016 - DNA, 22 bp, Artificial Sequence
  chemically synthesized
agggaagaggtctgggttagac

SEQ ID NO: 1223017 - DNA, 22 bp, Artificial Sequence
  chemically synthesized
aagtttagggaagaggtctggg

SEQ ID NO: 1223018 - DNA, 22 bp, Artificial Sequence
  chemically synthesized
tatatgtctaacccagacctct

SEQ ID NO: 1223019 - DNA, 22 bp, Artificial Sequence
  chemically synthesized
gaagtttagggaagaggtctgg

SEQ ID NO: 1223020 - DNA, 22 bp, Artificial Sequence
  chemically synthesized
atatgtctaacccagacctctt

SEQ ID NO: 1223021 - DNA, 22 bp, Artificial Sequence
  chemically synthesized
tatgtctaacccagacctcttc

SEQ ID NO: 1223022 - DNA, 22 bp, Artificial Sequence
  chemically synthesized
taatttgaagtttagggaagag

SEQ ID NO: 1223023 - DNA, 22 bp, Artificial Sequence
  chemically synthesized
acccagacctcttccctaaact

SEQ ID NO: 1223024 - DNA, 22 bp, Artificial Sequence
  chemically synthesized
gaagaatctataatttgaagtt

SEQ ID NO: 1223025 - DNA, 22 bp, Artificial Sequence
  chemically synthesized
agaagaatctataatttgaagt

SEQ ID NO: 1223026 - DNA, 22 bp, Artificial Sequence
  chemically synthesized
ttccctaaacttcaaattatag

SEQ ID NO: 1223027 - DNA, 22 bp, Artificial Sequence
  chemically synthesized
ccctaaacttcaaattatagat

SEQ ID NO: 1223028 - DNA, 22 bp, Artificial Sequence
  chemically synthesized
cctaaacttcaaattatagatt

SEQ ID NO: 1223029 - DNA, 22 bp, Artificial Sequence
  chemically synthesized
aacttcaaattatagattcttc

SEQ ID NO: 1223030 - DNA, 22 bp, Artificial Sequence
  chemically synthesized
caaattatagattcttctaaac

SEQ ID NO: 1223031 - DNA, 22 bp, Artificial Sequence
  chemically synthesized
aaattatagattcttctaaaca

SEQ ID NO: 1223032 - DNA, 22 bp, Artificial Sequence
  chemically synthesized
aatggagataatgagtgtttag

SEQ ID NO: 1223033 - DNA, 22 bp, Artificial Sequence
  chemically synthesized
tagattcttctaaacactcatt

SEQ ID NO: 1223034 - DNA, 22 bp, Artificial Sequence
  chemically synthesized
ctaaatggagataatgagtgtt

SEQ ID NO: 1223035 - DNA, 22 bp, Artificial Sequence
  chemically synthesized
tgattactaaatggagataatg

SEQ ID NO: 1223036 - DNA, 22 bp, Artificial Sequence
  chemically synthesized
ttctaaacactcattatctcca

SEQ ID NO: 1223037 - DNA, 22 bp, Artificial Sequence
  chemically synthesized
gtgattactaaatggagataat

SEQ ID NO: 1223038 - DNA, 22 bp, Artificial Sequence
  chemically synthesized
ctaaacactcattatctccatt

SEQ ID NO: 1223039 - DNA, 22 bp, Artificial Sequence
  chemically synthesized
taaacactcattatctccattt

SEQ ID NO: 1223040 - DNA, 22 bp, Artificial Sequence
  chemically synthesized
aacactcattatctccatttag

SEQ ID NO: 1223041 - DNA, 22 bp, Artificial Sequence
  chemically synthesized
aagcttgtgattactaaatgga

SEQ ID NO: 1223042 - DNA, 22 bp, Artificial Sequence
  chemically synthesized
gaagcttgtgattactaaatgg

SEQ ID NO: 1223043 - DNA, 22 bp, Artificial Sequence
  chemically synthesized
attatctccatttagtaatcac

SEQ ID NO: 1223044 - DNA, 22 bp, Artificial Sequence
  chemically synthesized
tctccatttagtaatcacaagc

SEQ ID NO: 1223045 - DNA, 22 bp, Artificial Sequence
  chemically synthesized
aggacacttgaagcttgtgatt

SEQ ID NO: 1223046 - DNA, 22 bp, Artificial Sequence
  chemically synthesized
catttagtaatcacaagcttca

SEQ ID NO: 1223047 - DNA, 22 bp, Artificial Sequence
  chemically synthesized
agttcaggacacttgaagcttg

SEQ ID NO: 1223048 - DNA, 22 bp, Artificial Sequence
  chemically synthesized
agtaatcacaagcttcaagtgt

SEQ ID NO: 1223049 - DNA, 22 bp, Artificial Sequence
  chemically synthesized
gtaatcacaagcttcaagtgtc

SEQ ID NO: 1223050 - DNA, 22 bp, Artificial Sequence
  chemically synthesized
caagtgtcctgaactgagcttc

SEQ ID NO: 1223051 - DNA, 22 bp, Artificial Sequence
  chemically synthesized
aagtgtcctgaactgagcttct

SEQ ID NO: 1223052 - DNA, 22 bp, Artificial Sequence
  chemically synthesized
aactgagcttctgatgtttatc

SEQ ID NO: 1223053 - DNA, 22 bp, Artificial Sequence
  chemically synthesized
ggggagtatgatgaggataaac

SEQ ID NO: 1223054 - DNA, 22 bp, Artificial Sequence
  chemically synthesized
gggggagtatgatgaggataaa

SEQ ID NO: 1223055 - DNA, 22 bp, Artificial Sequence
  chemically synthesized
agcttctgatgtttatcctcat

SEQ ID NO: 1223056 - DNA, 22 bp, Artificial Sequence
  chemically synthesized
ctgatgtttatcctcatcatac

SEQ ID NO: 1223057 - DNA, 22 bp, Artificial Sequence
  chemically synthesized
tgatgtttatcctcatcatact

SEQ ID NO: 1223058 - DNA, 22 bp, Artificial Sequence
  chemically synthesized
atgtttatcctcatcatactcc

SEQ ID NO: 1223059 - DNA, 22 bp, Artificial Sequence
  chemically synthesized
atcctcatcatactcccccaaa

SEQ ID NO: 1223060 - DNA, 22 bp, Artificial Sequence
  chemically synthesized
tcctcatcatactcccccaaac

SEQ ID NO: 1223061 - DNA, 22 bp, Artificial Sequence
  chemically synthesized
atcatactcccccaaacctacc

SEQ ID NO: 1223062 - DNA, 22 bp, Artificial Sequence
  chemically synthesized
ccccaaacctacctacttttct

SEQ ID NO: 1223063 - DNA, 22 bp, Artificial Sequence
  chemically synthesized
aggaagggagaacagcaagaaa

SEQ ID NO: 1223064 - DNA, 22 bp, Artificial Sequence
  chemically synthesized
ttgaggaagggagaacagcaag

SEQ ID NO: 1223065 - DNA, 22 bp, Artificial Sequence
  chemically synthesized
cctacttttcttgctgttctcc

SEQ ID NO: 1223066 - DNA, 22 bp, Artificial Sequence
  chemically synthesized
attattgaggaagggagaacag

SEQ ID NO: 1223067 - DNA, 22 bp, Artificial Sequence
  chemically synthesized
cttttcttgctgttctcccttc

SEQ ID NO: 1223068 - DNA, 22 bp, Artificial Sequence
  chemically synthesized
ttcattattgaggaagggagaa

SEQ ID NO: 1223069 - DNA, 22 bp, Artificial Sequence
  chemically synthesized
ttcttgctgttctcccttcctc

SEQ ID NO: 1223070 - DNA, 22 bp, Artificial Sequence
  chemically synthesized
tcttgctgttctcccttcctca

SEQ ID NO: 1223071 - DNA, 22 bp, Artificial Sequence
  chemically synthesized
cttgctgttctcccttcctcaa

SEQ ID NO: 1223072 - DNA, 22 bp, Artificial Sequence
  chemically synthesized
ttgctgttctcccttcctcaat

SEQ ID NO: 1223073 - DNA, 22 bp, Artificial Sequence
  chemically synthesized
gctgttctcccttcctcaataa

SEQ ID NO: 1223074 - DNA, 22 bp, Artificial Sequence
  chemically synthesized
ctgttctcccttcctcaataat

SEQ ID NO: 1223075 - DNA, 22 bp, Artificial Sequence
  chemically synthesized
aacacattgttcattattgagg

SEQ ID NO: 1223076 - DNA, 22 bp, Artificial Sequence
  chemically synthesized
aaacacattgttcattattgag

SEQ ID NO: 1223077 - DNA, 22 bp, Artificial Sequence
  chemically synthesized
taaacacattgttcattattga

SEQ ID NO: 1223078 - DNA, 22 bp, Artificial Sequence
  chemically synthesized
ttctcccttcctcaataatgaa

SEQ ID NO: 1223079 - DNA, 22 bp, Artificial Sequence
  chemically synthesized
tcccttcctcaataatgaacaa

SEQ ID NO: 1223080 - DNA, 22 bp, Artificial Sequence
  chemically synthesized
ccttcctcaataatgaacaatg

SEQ ID NO: 1223081 - DNA, 22 bp, Artificial Sequence
  chemically synthesized
caattttaaacacattgttcat

SEQ ID NO: 1223082 - DNA, 22 bp, Artificial Sequence
  chemically synthesized
cctcaataatgaacaatgtgtt

SEQ ID NO: 1223083 - DNA, 22 bp, Artificial Sequence
  chemically synthesized
ctcaataatgaacaatgtgttt

SEQ ID NO: 1223084 - DNA, 22 bp, Artificial Sequence
  chemically synthesized
aataatgaacaatgtgtttaaa

SEQ ID NO: 1223085 - DNA, 22 bp, Artificial Sequence
  chemically synthesized
agcaactgcaattttaaacaca

SEQ ID NO: 1223086 - DNA, 22 bp, Artificial Sequence
  chemically synthesized
tctgagcaactgcaattttaaa

SEQ ID NO: 1223087 - DNA, 22 bp, Artificial Sequence
  chemically synthesized
atctgagcaactgcaattttaa

SEQ ID NO: 1223088 - DNA, 22 bp, Artificial Sequence
  chemically synthesized
tatctgagcaactgcaatttta

SEQ ID NO: 1223089 - DNA, 22 bp, Artificial Sequence
  chemically synthesized
ttatctgagcaactgcaatttt

SEQ ID NO: 1223090 - DNA, 22 bp, Artificial Sequence
  chemically synthesized
caagggtttttatctgagcaac

SEQ ID NO: 1223091 - DNA, 22 bp, Artificial Sequence
  chemically synthesized
aaaattgcagttgctcagataa

SEQ ID NO: 1223092 - DNA, 22 bp, Artificial Sequence
  chemically synthesized
aaattgcagttgctcagataaa

SEQ ID NO: 1223093 - DNA, 22 bp, Artificial Sequence
  chemically synthesized
cagttgctcagataaaaaccct

SEQ ID NO: 1223094 - DNA, 22 bp, Artificial Sequence
  chemically synthesized
aggatgactccaagggttttta

SEQ ID NO: 1223095 - DNA, 22 bp, Artificial Sequence
  chemically synthesized
ctcagataaaaacccttggagt

SEQ ID NO: 1223096 - DNA, 22 bp, Artificial Sequence
  chemically synthesized
agataaaaacccttggagtcat

SEQ ID NO: 1223097 - DNA, 22 bp, Artificial Sequence
  chemically synthesized
tgtgagagtaaaatagtcatta

SEQ ID NO: 1223098 - DNA, 22 bp, Artificial Sequence
  chemically synthesized
ggagtcatccttaatgactatt

SEQ ID NO: 1223099 - DNA, 22 bp, Artificial Sequence
  chemically synthesized
gagtcatccttaatgactattt

SEQ ID NO: 1223100 - DNA, 22 bp, Artificial Sequence
  chemically synthesized
aatgttgtgtgagagtaaaata

SEQ ID NO: 1223101 - DNA, 22 bp, Artificial Sequence
  chemically synthesized
aattaaatgttgtgtgagagta

SEQ ID NO: 1223102 - DNA, 22 bp, Artificial Sequence
  chemically synthesized
aatgactattttactctcacac

SEQ ID NO: 1223103 - DNA, 22 bp, Artificial Sequence
  chemically synthesized
gaattaaatgttgtgtgagagt

SEQ ID NO: 1223104 - DNA, 22 bp, Artificial Sequence
  chemically synthesized
atgactattttactctcacaca

SEQ ID NO: 1223105 - DNA, 22 bp, Artificial Sequence
  chemically synthesized
tgaattaaatgttgtgtgagag

SEQ ID NO: 1223106 - DNA, 22 bp, Artificial Sequence
  chemically synthesized
ttttactctcacacaacattta

SEQ ID NO: 1223107 - DNA, 22 bp, Artificial Sequence
  chemically synthesized
aatacattttgaattaaatgtt

SEQ ID NO: 1223108 - DNA, 22 bp, Artificial Sequence
  chemically synthesized
tactctcacacaacatttaatt

SEQ ID NO: 1223109 - DNA, 22 bp, Artificial Sequence
  chemically synthesized
actctcacacaacatttaattc

SEQ ID NO: 1223110 - DNA, 22 bp, Artificial Sequence
  chemically synthesized
tgaatacattttgaattaaatg

SEQ ID NO: 1223111 - DNA, 22 bp, Artificial Sequence
  chemically synthesized
ctctcacacaacatttaattca

SEQ ID NO: 1223112 - DNA, 22 bp, Artificial Sequence
  chemically synthesized
tcacacaacatttaattcaaaa

SEQ ID NO: 1223113 - DNA, 22 bp, Artificial Sequence
  chemically synthesized
acacaacatttaattcaaaatg

SEQ ID NO: 1223114 - DNA, 22 bp, Artificial Sequence
  chemically synthesized
aattcaaaatgtattcagaatt

SEQ ID NO: 1223115 - DNA, 22 bp, Artificial Sequence
  chemically synthesized
attcaaaatgtattcagaattt

SEQ ID NO: 1223116 - DNA, 22 bp, Artificial Sequence
  chemically synthesized
aaaatgtattcagaatttgact

SEQ ID NO: 1223117 - DNA, 22 bp, Artificial Sequence
  chemically synthesized
agaatttgactgcttctgacta

SEQ ID NO: 1223118 - DNA, 22 bp, Artificial Sequence
  chemically synthesized
gagtgatggcagtgaggatagt

SEQ ID NO: 1223119 - DNA, 22 bp, Artificial Sequence
  chemically synthesized
gactgcttctgactatcctcac

SEQ ID NO: 1223120 - DNA, 22 bp, Artificial Sequence
  chemically synthesized
actgcttctgactatcctcact

SEQ ID NO: 1223121 - DNA, 22 bp, Artificial Sequence
  chemically synthesized
gactagagtgatggcagtgagg

SEQ ID NO: 1223122 - DNA, 22 bp, Artificial Sequence
  chemically synthesized
cttctgactatcctcactgcca

SEQ ID NO: 1223123 - DNA, 22 bp, Artificial Sequence
  chemically synthesized
ggactagagtgatggcagtgag

SEQ ID NO: 1223124 - DNA, 22 bp, Artificial Sequence
  chemically synthesized
tggactagagtgatggcagtga

SEQ ID NO: 1223125 - DNA, 22 bp, Artificial Sequence
  chemically synthesized
ctgactatcctcactgccatca

SEQ ID NO: 1223126 - DNA, 22 bp, Artificial Sequence
  chemically synthesized
tgactatcctcactgccatcac

SEQ ID NO: 1223127 - DNA, 22 bp, Artificial Sequence
  chemically synthesized
actatcctcactgccatcactc

SEQ ID NO: 1223128 - DNA, 22 bp, Artificial Sequence
  chemically synthesized
tcctcactgccatcactctagt

SEQ ID NO: 1223129 - DNA, 22 bp, Artificial Sequence
  chemically synthesized
actgccatcactctagtccaaa

SEQ ID NO: 1223130 - DNA, 22 bp, Artificial Sequence
  chemically synthesized
ccatcactctagtccaaaatcc

SEQ ID NO: 1223131 - DNA, 22 bp, Artificial Sequence
  chemically synthesized
atgcaagataaaatggattttg

SEQ ID NO: 1223132 - DNA, 22 bp, Artificial Sequence
  chemically synthesized
tagtccaaaatccattttatct

SEQ ID NO: 1223133 - DNA, 22 bp, Artificial Sequence
  chemically synthesized
gtccaaaatccattttatcttg

SEQ ID NO: 1223134 - DNA, 22 bp, Artificial Sequence
  chemically synthesized
tgataattcatgcaagataaaa

SEQ ID NO: 1223135 - DNA, 22 bp, Artificial Sequence
  chemically synthesized
ttgtgataattcatgcaagata

SEQ ID NO: 1223136 - DNA, 22 bp, Artificial Sequence
  chemically synthesized
tgaggctattgtgataattcat

SEQ ID NO: 1223137 - DNA, 22 bp, Artificial Sequence
  chemically synthesized
tatcttgcatgaattatcacaa

SEQ ID NO: 1223138 - DNA, 22 bp, Artificial Sequence
  chemically synthesized
atcttgcatgaattatcacaat

SEQ ID NO: 1223139 - DNA, 22 bp, Artificial Sequence
  chemically synthesized
tcttgcatgaattatcacaata

SEQ ID NO: 1223140 - DNA, 22 bp, Artificial Sequence
  chemically synthesized
gcatgaattatcacaatagcct

SEQ ID NO: 1223141 - DNA, 22 bp, Artificial Sequence
  chemically synthesized
catgaattatcacaatagcctc

SEQ ID NO: 1223142 - DNA, 22 bp, Artificial Sequence
  chemically synthesized
tcacaatagcctcataactctt

SEQ ID NO: 1223143 - DNA, 22 bp, Artificial Sequence
  chemically synthesized
acgcaggcaagagtgagagaag

SEQ ID NO: 1223144 - DNA, 22 bp, Artificial Sequence
  chemically synthesized
attaacgcaggcaagagtgaga

SEQ ID NO: 1223145 - DNA, 22 bp, Artificial Sequence
  chemically synthesized
ataactcttctctcactcttgc

SEQ ID NO: 1223146 - DNA, 22 bp, Artificial Sequence
  chemically synthesized
tgcactaattaacgcaggcaag

SEQ ID NO: 1223147 - DNA, 22 bp, Artificial Sequence
  chemically synthesized
ttctctcactcttgcctgcgtt

SEQ ID NO: 1223148 - DNA, 22 bp, Artificial Sequence
  chemically synthesized
ctatgcactaattaacgcaggc

SEQ ID NO: 1223149 - DNA, 22 bp, Artificial Sequence
  chemically synthesized
ctctcactcttgcctgcgttaa

SEQ ID NO: 1223150 - DNA, 22 bp, Artificial Sequence
  chemically synthesized
tctcactcttgcctgcgttaat

SEQ ID NO: 1223151 - DNA, 22 bp, Artificial Sequence
  chemically synthesized
tgctatgcactaattaacgcag

SEQ ID NO: 1223152 - DNA, 22 bp, Artificial Sequence
  chemically synthesized
tcactcttgcctgcgttaatta

SEQ ID NO: 1223153 - DNA, 22 bp, Artificial Sequence
  chemically synthesized
actcttgcctgcgttaattagt

SEQ ID NO: 1223154 - DNA, 22 bp, Artificial Sequence
  chemically synthesized
gcaactctgctatgcactaatt

SEQ ID NO: 1223155 - DNA, 22 bp, Artificial Sequence
  chemically synthesized
ttgcctgcgttaattagtgcat

SEQ ID NO: 1223156 - DNA, 22 bp, Artificial Sequence
  chemically synthesized
tggcaactctgctatgcactaa

SEQ ID NO: 1223157 - DNA, 22 bp, Artificial Sequence
  chemically synthesized
gcctgcgttaattagtgcatag

SEQ ID NO: 1223158 - DNA, 22 bp, Artificial Sequence
  chemically synthesized
cctgcgttaattagtgcatagc

SEQ ID NO: 1223159 - DNA, 22 bp, Artificial Sequence
  chemically synthesized
cgttaattagtgcatagcagag

SEQ ID NO: 1223160 - DNA, 22 bp, Artificial Sequence
  chemically synthesized
attagtgcatagcagagttgcc

SEQ ID NO: 1223161 - DNA, 22 bp, Artificial Sequence
  chemically synthesized
acagatcactctggcaactctg

SEQ ID NO: 1223162 - DNA, 22 bp, Artificial Sequence
  chemically synthesized
gtgcatagcagagttgccagag

SEQ ID NO: 1223163 - DNA, 22 bp, Artificial Sequence
  chemically synthesized
ccagagtgatctgttaacatgt

SEQ ID NO: 1223164 - DNA, 22 bp, Artificial Sequence
  chemically synthesized
agaagacggatatgatgaaaca

SEQ ID NO: 1223165 - DNA, 22 bp, Artificial Sequence
  chemically synthesized
gagaagacggatatgatgaaac

SEQ ID NO: 1223166 - DNA, 22 bp, Artificial Sequence
  chemically synthesized
ttaacatgtttcatcatatccg

SEQ ID NO: 1223167 - DNA, 22 bp, Artificial Sequence
  chemically synthesized
acatgtttcatcatatccgtct

SEQ ID NO: 1223168 - DNA, 22 bp, Artificial Sequence
  chemically synthesized
aagcagagatttgagaagacgg

SEQ ID NO: 1223169 - DNA, 22 bp, Artificial Sequence
  chemically synthesized
catcatatccgtcttctcaaat

SEQ ID NO: 1223170 - DNA, 22 bp, Artificial Sequence
  chemically synthesized
atcatatccgtcttctcaaatc

SEQ ID NO: 1223171 - DNA, 22 bp, Artificial Sequence
  chemically synthesized
ccctaaagcagagatttgagaa

SEQ ID NO: 1223172 - DNA, 22 bp, Artificial Sequence
  chemically synthesized
cccctaaagcagagatttgaga

SEQ ID NO: 1223173 - DNA, 22 bp, Artificial Sequence
  chemically synthesized
tacttcccctaaagcagagatt

SEQ ID NO: 1223174 - DNA, 22 bp, Artificial Sequence
  chemically synthesized
gtacttcccctaaagcagagat

SEQ ID NO: 1223175 - DNA, 22 bp, Artificial Sequence
  chemically synthesized
ctcaaatctctgctttagggga

SEQ ID NO: 1223176 - DNA, 22 bp, Artificial Sequence
  chemically synthesized
tcaaatctctgctttaggggaa

SEQ ID NO: 1223177 - DNA, 22 bp, Artificial Sequence
  chemically synthesized
aaatctctgctttaggggaagt

SEQ ID NO: 1223178 - DNA, 22 bp, Artificial Sequence
  chemically synthesized
tgctttaggggaagtacaaatt

SEQ ID NO: 1223179 - DNA, 22 bp, Artificial Sequence
  chemically synthesized
ctttaggggaagtacaaattac

SEQ ID NO: 1223180 - DNA, 22 bp, Artificial Sequence
  chemically synthesized
taggggaagtacaaattacgta

SEQ ID NO: 1223181 - DNA, 22 bp, Artificial Sequence
  chemically synthesized
aggggaagtacaaattacgtat

SEQ ID NO: 1223182 - DNA, 22 bp, Artificial Sequence
  chemically synthesized
ggggaagtacaaattacgtatt

SEQ ID NO: 1223183 - DNA, 22 bp, Artificial Sequence
  chemically synthesized
gtagatcacatgaaatacgtaa

SEQ ID NO: 1223184 - DNA, 22 bp, Artificial Sequence
  chemically synthesized
cgtagatcacatgaaatacgta

SEQ ID NO: 1223185 - DNA, 22 bp, Artificial Sequence
  chemically synthesized
gacttcgtagatcacatgaaat

SEQ ID NO: 1223186 - DNA, 22 bp, Artificial Sequence
  chemically synthesized
ttggacttcgtagatcacatga

SEQ ID NO: 1223187 - DNA, 22 bp, Artificial Sequence
  chemically synthesized
cgtatttcatgtgatctacgaa

SEQ ID NO: 1223188 - DNA, 22 bp, Artificial Sequence
  chemically synthesized
gaccctgttggacttcgtagat

SEQ ID NO: 1223189 - DNA, 22 bp, Artificial Sequence
  chemically synthesized
catgtgatctacgaagtccaac

SEQ ID NO: 1223190 - DNA, 22 bp, Artificial Sequence
  chemically synthesized
atgtgatctacgaagtccaaca

SEQ ID NO: 1223191 - DNA, 22 bp, Artificial Sequence
  chemically synthesized
atagggacctggaccctgttgg

SEQ ID NO: 1223192 - DNA, 22 bp, Artificial Sequence
  chemically synthesized
cgaagtccaacagggtccaggt

SEQ ID NO: 1223193 - DNA, 22 bp, Artificial Sequence
  chemically synthesized
ttaactctctgattttatttct

SEQ ID NO: 1223194 - DNA, 22 bp, Artificial Sequence
  chemically synthesized
actctctgattttatttcttgt

SEQ ID NO: 1223195 - DNA, 22 bp, Artificial Sequence
  chemically synthesized
tctgattttatttcttgtctct

SEQ ID NO: 1223196 - DNA, 22 bp, Artificial Sequence
  chemically synthesized
tgattttatttcttgtctcttt

SEQ ID NO: 1223197 - DNA, 22 bp, Artificial Sequence
  chemically synthesized
tggaatatgaggaaagagacaa

SEQ ID NO: 1223198 - DNA, 22 bp, Artificial Sequence
  chemically synthesized
atggaatatgaggaaagagaca

SEQ ID NO: 1223199 - DNA, 22 bp, Artificial Sequence
  chemically synthesized
attttatttcttgtctctttcc

SEQ ID NO: 1223200 - DNA, 22 bp, Artificial Sequence
  chemically synthesized
tttatggaatatgaggaaagag

SEQ ID NO: 1223201 - DNA, 22 bp, Artificial Sequence
  chemically synthesized
tatttcttgtctctttcctcat

SEQ ID NO: 1223202 - DNA, 22 bp, Artificial Sequence
  chemically synthesized
atttcttgtctctttcctcata

SEQ ID NO: 1223203 - DNA, 22 bp, Artificial Sequence
  chemically synthesized
tttcttgtctctttcctcatat

SEQ ID NO: 1223204 - DNA, 22 bp, Artificial Sequence
  chemically synthesized
cttgtctctttcctcatattcc

SEQ ID NO: 1223205 - DNA, 22 bp, Artificial Sequence
  chemically synthesized
ttgtctctttcctcatattcca

SEQ ID NO: 1223206 - DNA, 22 bp, Artificial Sequence
  chemically synthesized
tggatcctgtttatggaatatg

SEQ ID NO: 1223207 - DNA, 22 bp, Artificial Sequence
  chemically synthesized
gtctctttcctcatattccata

SEQ ID NO: 1223208 - DNA, 22 bp, Artificial Sequence
  chemically synthesized
tctctttcctcatattccataa

SEQ ID NO: 1223209 - DNA, 22 bp, Artificial Sequence
  chemically synthesized
tttcctcatattccataaacag

SEQ ID NO: 1223210 - DNA, 22 bp, Artificial Sequence
  chemically synthesized
tcctcatattccataaacagga

SEQ ID NO: 1223211 - DNA, 22 bp, Artificial Sequence
  chemically synthesized
cctcatattccataaacaggat

SEQ ID NO: 1223212 - DNA, 22 bp, Artificial Sequence
  chemically synthesized
ctcatattccataaacaggatc

SEQ ID NO: 1223213 - DNA, 22 bp, Artificial Sequence
  chemically synthesized
atattccataaacaggatccat

SEQ ID NO: 1223214 - DNA, 22 bp, Artificial Sequence
  chemically synthesized
cataaacaggatccatagtttc

SEQ ID NO: 1223215 - DNA, 22 bp, Artificial Sequence
  chemically synthesized
caaatccaagtgcaggaaacta

SEQ ID NO: 1223216 - DNA, 22 bp, Artificial Sequence
  chemically synthesized
gaaaagcgaattccaaatccaa

SEQ ID NO: 1223217 - DNA, 22 bp, Artificial Sequence
  chemically synthesized
cgaaaagcgaattccaaatcca

SEQ ID NO: 1223218 - DNA, 22 bp, Artificial Sequence
  chemically synthesized
cctgcacttggatttggaattc

SEQ ID NO: 1223219 - DNA, 22 bp, Artificial Sequence
  chemically synthesized
ctgcacttggatttggaattcg

SEQ ID NO: 1223220 - DNA, 22 bp, Artificial Sequence
  chemically synthesized
tgtcttcgaaaagcgaattcca

SEQ ID NO: 1223221 - DNA, 22 bp, Artificial Sequence
  chemically synthesized
atgtcttcgaaaagcgaattcc

SEQ ID NO: 1223222 - DNA, 22 bp, Artificial Sequence
  chemically synthesized
cacttggatttggaattcgctt

SEQ ID NO: 1223223 - DNA, 22 bp, Artificial Sequence
  chemically synthesized
ggatttggaattcgcttttcga

SEQ ID NO: 1223224 - DNA, 22 bp, Artificial Sequence
  chemically synthesized
gatttggaattcgcttttcgaa

SEQ ID NO: 1223225 - DNA, 22 bp, Artificial Sequence
  chemically synthesized
ggaattcgcttttcgaagacat

SEQ ID NO: 1223226 - DNA, 22 bp, Artificial Sequence
  chemically synthesized
gaattcgcttttcgaagacata

SEQ ID NO: 1223227 - DNA, 22 bp, Artificial Sequence
  chemically synthesized
gcttttcgaagacataaacatg

SEQ ID NO: 1223228 - DNA, 22 bp, Artificial Sequence
  chemically synthesized
ttcgaagacataaacatggctc

SEQ ID NO: 1223229 - DNA, 22 bp, Artificial Sequence
  chemically synthesized
tcgaagacataaacatggctca

SEQ ID NO: 1223230 - DNA, 22 bp, Artificial Sequence
  chemically synthesized
cgaagacataaacatggctcac

SEQ ID NO: 1223231 - DNA, 22 bp, Artificial Sequence
  chemically synthesized
gaagacataaacatggctcact

SEQ ID NO: 1223232 - DNA, 22 bp, Artificial Sequence
  chemically synthesized
gagtaaagacccaatggaagta

SEQ ID NO: 1223233 - DNA, 22 bp, Artificial Sequence
  chemically synthesized
cgagtaaagacccaatggaagt

SEQ ID NO: 1223234 - DNA, 22 bp, Artificial Sequence
  chemically synthesized
tcgagtaaagacccaatggaag

SEQ ID NO: 1223235 - DNA, 22 bp, Artificial Sequence
  chemically synthesized
actcctttacttccattgggtc

SEQ ID NO: 1223236 - DNA, 22 bp, Artificial Sequence
  chemically synthesized
ctttacttccattgggtcttta

SEQ ID NO: 1223237 - DNA, 22 bp, Artificial Sequence
  chemically synthesized
tacttccattgggtctttactc

SEQ ID NO: 1223238 - DNA, 22 bp, Artificial Sequence
  chemically synthesized
acttccattgggtctttactcg

SEQ ID NO: 1223239 - DNA, 22 bp, Artificial Sequence
  chemically synthesized
cttccattgggtctttactcga

SEQ ID NO: 1223240 - DNA, 22 bp, Artificial Sequence
  chemically synthesized
ccattgggtctttactcgaaaa

SEQ ID NO: 1223241 - DNA, 22 bp, Artificial Sequence
  chemically synthesized
tcagtgatgtgattttcgagta

SEQ ID NO: 1223242 - DNA, 22 bp, Artificial Sequence
  chemically synthesized
cattgggtctttactcgaaaat

SEQ ID NO: 1223243 - DNA, 22 bp, Artificial Sequence
  chemically synthesized
atcagtgatgtgattttcgagt

SEQ ID NO: 1223244 - DNA, 22 bp, Artificial Sequence
  chemically synthesized
ggtctttactcgaaaatcacat

SEQ ID NO: 1223245 - DNA, 22 bp, Artificial Sequence
  chemically synthesized
tactcgaaaatcacatcactga

SEQ ID NO: 1223246 - DNA, 22 bp, Artificial Sequence
  chemically synthesized
actcgaaaatcacatcactgat

SEQ ID NO: 1223247 - DNA, 22 bp, Artificial Sequence
  chemically synthesized
ctcgaaaatcacatcactgata

SEQ ID NO: 1223248 - DNA, 22 bp, Artificial Sequence
  chemically synthesized
ggcagggaagaacttatcagtg

SEQ ID NO: 1223249 - DNA, 22 bp, Artificial Sequence
  chemically synthesized
gaaaatcacatcactgataagt

SEQ ID NO: 1223250 - DNA, 22 bp, Artificial Sequence
  chemically synthesized
gggcagggaagaacttatcagt

SEQ ID NO: 1223251 - DNA, 22 bp, Artificial Sequence
  chemically synthesized
gatagggcttgggcagggaaga

SEQ ID NO: 1223252 - DNA, 22 bp, Artificial Sequence
  chemically synthesized
agatagggcttgggcagggaag

SEQ ID NO: 1223253 - DNA, 22 bp, Artificial Sequence
  chemically synthesized
tagatagggcttgggcagggaa

SEQ ID NO: 1223254 - DNA, 22 bp, Artificial Sequence
  chemically synthesized
ataagttcttccctgcccaagc

SEQ ID NO: 1223255 - DNA, 22 bp, Artificial Sequence
  chemically synthesized
ttccctgcccaagccctatcta

SEQ ID NO: 1223256 - DNA, 22 bp, Artificial Sequence
  chemically synthesized
ccctgcccaagccctatctaaa

SEQ ID NO: 1223257 - DNA, 22 bp, Artificial Sequence
  chemically synthesized
cctgcccaagccctatctaaaa

SEQ ID NO: 1223258 - DNA, 22 bp, Artificial Sequence
  chemically synthesized
gccagcatgcaattttagatag

SEQ ID NO: 1223259 - DNA, 22 bp, Artificial Sequence
  chemically synthesized
cccaagccctatctaaaattgc

SEQ ID NO: 1223260 - DNA, 22 bp, Artificial Sequence
  chemically synthesized
tctaaaattgcatgctggccag

SEQ ID NO: 1223261 - DNA, 22 bp, Artificial Sequence
  chemically synthesized
aaattgcatgctggccaggcac

SEQ ID NO: 1223262 - DNA, 22 bp, Artificial Sequence
  chemically synthesized
caggtgtgagccaaggtgcctg

SEQ ID NO: 1223263 - DNA, 22 bp, Artificial Sequence
  chemically synthesized
acaggtgtgagccaaggtgcct

SEQ ID NO: 1223264 - DNA, 22 bp, Artificial Sequence
  chemically synthesized
catgctggccaggcaccttggc

SEQ ID NO: 1223265 - DNA, 22 bp, Artificial Sequence
  chemically synthesized
gtttacaggtgtgagccaaggt

SEQ ID NO: 1223266 - DNA, 22 bp, Artificial Sequence
  chemically synthesized
ggtttacaggtgtgagccaagg

SEQ ID NO: 1223267 - DNA, 22 bp, Artificial Sequence
  chemically synthesized
gccaggcaccttggctcacacc

SEQ ID NO: 1223268 - DNA, 22 bp, Artificial Sequence
  chemically synthesized
ccaaagtgcttggtttacaggt

SEQ ID NO: 1223269 - DNA, 22 bp, Artificial Sequence
  chemically synthesized
ggctcacacctgtaaaccaagc

SEQ ID NO: 1223270 - DNA, 22 bp, Artificial Sequence
  chemically synthesized
gctcacacctgtaaaccaagca

SEQ ID NO: 1223271 - DNA, 22 bp, Artificial Sequence
  chemically synthesized
agcctcccaaagtgcttggttt

SEQ ID NO: 1223272 - DNA, 22 bp, Artificial Sequence
  chemically synthesized
acacctgtaaaccaagcacttt

SEQ ID NO: 1223273 - DNA, 22 bp, Artificial Sequence
  chemically synthesized
agcctcagcctcccaaagtgct

SEQ ID NO: 1223274 - DNA, 22 bp, Artificial Sequence
  chemically synthesized
cagcctcagcctcccaaagtgc

SEQ ID NO: 1223275 - DNA, 22 bp, Artificial Sequence
  chemically synthesized
taaaccaagcactttgggaggc

SEQ ID NO: 1223276 - DNA, 22 bp, Artificial Sequence
  chemically synthesized
aagcaaatccttcagcctcagc

SEQ ID NO: 1223277 - DNA, 22 bp, Artificial Sequence
  chemically synthesized
gcctcaagcaaatccttcagcc

SEQ ID NO: 1223278 - DNA, 22 bp, Artificial Sequence
  chemically synthesized
tgggaggctgaggctgaaggat

SEQ ID NO: 1223279 - DNA, 22 bp, Artificial Sequence
  chemically synthesized
gggaggctgaggctgaaggatt

SEQ ID NO: 1223280 - DNA, 22 bp, Artificial Sequence
  chemically synthesized
ggaggctgaggctgaaggattt

SEQ ID NO: 1223281 - DNA, 22 bp, Artificial Sequence
  chemically synthesized
ctggcctcaagcaaatccttca

SEQ ID NO: 1223282 - DNA, 22 bp, Artificial Sequence
  chemically synthesized
actcctggcctcaagcaaatcc

SEQ ID NO: 1223283 - DNA, 22 bp, Artificial Sequence
  chemically synthesized
taactcctggcctcaagcaaat

SEQ ID NO: 1223284 - DNA, 22 bp, Artificial Sequence
  chemically synthesized
aggctgaaggatttgcttgagg

SEQ ID NO: 1223285 - DNA, 22 bp, Artificial Sequence
  chemically synthesized
gtctctaactcctggcctcaag

SEQ ID NO: 1223286 - DNA, 22 bp, Artificial Sequence
  chemically synthesized
aaggatttgcttgaggccagga

SEQ ID NO: 1223287 - DNA, 22 bp, Artificial Sequence
  chemically synthesized
aggttggtctctaactcctggc

SEQ ID NO: 1223288 - DNA, 22 bp, Artificial Sequence
  chemically synthesized
gcttgaggccaggagttagaga

SEQ ID NO: 1223289 - DNA, 22 bp, Artificial Sequence
  chemically synthesized
cttgaggccaggagttagagac

SEQ ID NO: 1223290 - DNA, 22 bp, Artificial Sequence
  chemically synthesized
tgtggttcaggttggtctctaa

SEQ ID NO: 1223291 - DNA, 22 bp, Artificial Sequence
  chemically synthesized
gaggccaggagttagagaccaa

SEQ ID NO: 1223292 - DNA, 22 bp, Artificial Sequence
  chemically synthesized
aggccaggagttagagaccaac

SEQ ID NO: 1223293 - DNA, 22 bp, Artificial Sequence
  chemically synthesized
actatgtggttcaggttggtct

SEQ ID NO: 1223294 - DNA, 22 bp, Artificial Sequence
  chemically synthesized
gagaccaacctgaaccacatag

SEQ ID NO: 1223295 - DNA, 22 bp, Artificial Sequence
  chemically synthesized
tagagaccaggtctcactatgt

SEQ ID NO: 1223296 - DNA, 22 bp, Artificial Sequence
  chemically synthesized
aaccacatagtgagacctggtc

SEQ ID NO: 1223297 - DNA, 22 bp, Artificial Sequence
  chemically synthesized
ataagttgtagagaccaggtct

SEQ ID NO: 1223298 - DNA, 22 bp, Artificial Sequence
  chemically synthesized
aataagttgtagagaccaggtc

SEQ ID NO: 1223299 - DNA, 22 bp, Artificial Sequence
  chemically synthesized
taataagttgtagagaccaggt

SEQ ID NO: 1223300 - DNA, 22 bp, Artificial Sequence
  chemically synthesized
ttaataagttgtagagaccagg

SEQ ID NO: 1223301 - DNA, 22 bp, Artificial Sequence
  chemically synthesized
tttaataagttgtagagaccag

SEQ ID NO: 1223302 - DNA, 22 bp, Artificial Sequence
  chemically synthesized
ttttaataagttgtagagacca

SEQ ID NO: 1223303 - DNA, 22 bp, Artificial Sequence
  chemically synthesized
tttttaataagttgtagagacc

SEQ ID NO: 1223304 - DNA, 22 bp, Artificial Sequence
  chemically synthesized
ttttttaataagttgtagagac

SEQ ID NO: 1223305 - DNA, 22 bp, Artificial Sequence
  chemically synthesized
tttttttaataagttgtagaga

SEQ ID NO: 1223306 - DNA, 22 bp, Artificial Sequence
  chemically synthesized
ttttttttaataagttgtagag

SEQ ID NO: 1223307 - DNA, 22 bp, Artificial Sequence
  chemically synthesized
tttttttttaataagttgtaga

SEQ ID NO: 1223308 - DNA, 22 bp, Artificial Sequence
  chemically synthesized
ttttttttttaataagttgtag

SEQ ID NO: 1223309 - DNA, 22 bp, Artificial Sequence
  chemically synthesized
tttttttttttaataagttgta

SEQ ID NO: 1223310 - DNA, 22 bp, Artificial Sequence
  chemically synthesized
ttttttttttttaataagttgt

SEQ ID NO: 1223311 - DNA, 22 bp, Artificial Sequence
  chemically synthesized
tttttttttttttaataagttg

SEQ ID NO: 1223312 - DNA, 22 bp, Artificial Sequence
  chemically synthesized
ttttttttttttttaataagtt

SEQ ID NO: 1223313 - DNA, 22 bp, Artificial Sequence
  chemically synthesized
tttttttttttttttaataagt

SEQ ID NO: 1223314 - DNA, 22 bp, Artificial Sequence
  chemically synthesized
gtctctacaacttattaaaaaa

SEQ ID NO: 1223315 - DNA, 22 bp, Artificial Sequence
  chemically synthesized
ttttttttttttttttttaata

SEQ ID NO: 1223316 - DNA, 22 bp, Artificial Sequence
  chemically synthesized
gctatttttttttttttttttt

SEQ ID NO: 1223317 - DNA, 22 bp, Artificial Sequence
  chemically synthesized
tacaacttattaaaaaaaaaaa

SEQ ID NO: 1223318 - DNA, 22 bp, Artificial Sequence
  chemically synthesized
ggctattttttttttttttttt

SEQ ID NO: 1223319 - DNA, 22 bp, Artificial Sequence
  chemically synthesized
caacttattaaaaaaaaaaaaa

SEQ ID NO: 1223320 - DNA, 22 bp, Artificial Sequence
  chemically synthesized
attaaaaaaaaaaaaaaaaaat

SEQ ID NO: 1223321 - DNA, 22 bp, Artificial Sequence
  chemically synthesized
ttaaaaaaaaaaaaaaaaaata

SEQ ID NO: 1223322 - DNA, 22 bp, Artificial Sequence
  chemically synthesized
aaaaaaaaaaaaaaaaatagcc

SEQ ID NO: 1223323 - DNA, 22 bp, Artificial Sequence
  chemically synthesized
ggaccacaggggcatgccagca

SEQ ID NO: 1223324 - DNA, 22 bp, Artificial Sequence
  chemically synthesized
agtagctgggaccacaggggca

SEQ ID NO: 1223325 - DNA, 22 bp, Artificial Sequence
  chemically synthesized
ctgagtagctgggaccacaggg

SEQ ID NO: 1223326 - DNA, 22 bp, Artificial Sequence
  chemically synthesized
gcatgcccctgtggtcccagct

SEQ ID NO: 1223327 - DNA, 22 bp, Artificial Sequence
  chemically synthesized
agcctcctgagtagctgggacc

SEQ ID NO: 1223328 - DNA, 22 bp, Artificial Sequence
  chemically synthesized
caacctcagcctcctgagtagc

SEQ ID NO: 1223329 - DNA, 22 bp, Artificial Sequence
  chemically synthesized
tccaacctcagcctcctgagta

SEQ ID NO: 1223330 - DNA, 22 bp, Artificial Sequence
  chemically synthesized
tggtcccagctactcaggaggc

SEQ ID NO: 1223331 - DNA, 22 bp, Artificial Sequence
  chemically synthesized
aagtgattctccaacctcagcc

SEQ ID NO: 1223332 - DNA, 22 bp, Artificial Sequence
  chemically synthesized
ctcaggaggctgaggttggaga

SEQ ID NO: 1223333 - DNA, 22 bp, Artificial Sequence
  chemically synthesized
aggaggctgaggttggagaatc

SEQ ID NO: 1223334 - DNA, 22 bp, Artificial Sequence
  chemically synthesized
tagccacccaggctcaagtgat

SEQ ID NO: 1223335 - DNA, 22 bp, Artificial Sequence
  chemically synthesized
aggttggagaatcacttgagcc

SEQ ID NO: 1223336 - DNA, 22 bp, Artificial Sequence
  chemically synthesized
actatagccacccaggctcaag

SEQ ID NO: 1223337 - DNA, 22 bp, Artificial Sequence
  chemically synthesized
gagaatcacttgagcctgggtg

SEQ ID NO: 1223338 - DNA, 22 bp, Artificial Sequence
  chemically synthesized
gagcctgggtggctatagtgag

SEQ ID NO: 1223339 - DNA, 22 bp, Artificial Sequence
  chemically synthesized
agcctgggtggctatagtgagc

SEQ ID NO: 1223340 - DNA, 22 bp, Artificial Sequence
  chemically synthesized
ggtggctatagtgagccatgat

SEQ ID NO: 1223341 - DNA, 22 bp, Artificial Sequence
  chemically synthesized
gagtgcagtggtacaatcatgg

SEQ ID NO: 1223342 - DNA, 22 bp, Artificial Sequence
  chemically synthesized
tagtgagccatgattgtaccac

SEQ ID NO: 1223343 - DNA, 22 bp, Artificial Sequence
  chemically synthesized
agtcacccaggctggagtgcag

SEQ ID NO: 1223344 - DNA, 22 bp, Artificial Sequence
  chemically synthesized
ctcagtcacccaggctggagtg

SEQ ID NO: 1223345 - DNA, 22 bp, Artificial Sequence
  chemically synthesized
cctcagtcacccaggctggagt

SEQ ID NO: 1223346 - DNA, 22 bp, Artificial Sequence
  chemically synthesized
ttcctcagtcacccaggctgga

SEQ ID NO: 1223347 - DNA, 22 bp, Artificial Sequence
  chemically synthesized
taccactgcactccagcctggg

SEQ ID NO: 1223348 - DNA, 22 bp, Artificial Sequence
  chemically synthesized
gttcttcctcagtcacccaggc

SEQ ID NO: 1223349 - DNA, 22 bp, Artificial Sequence
  chemically synthesized
cactccagcctgggtgactgag

SEQ ID NO: 1223350 - DNA, 22 bp, Artificial Sequence
  chemically synthesized
ggagactggttcttcctcagtc

SEQ ID NO: 1223351 - DNA, 22 bp, Artificial Sequence
  chemically synthesized
aggagactggttcttcctcagt

SEQ ID NO: 1223352 - DNA, 22 bp, Artificial Sequence
  chemically synthesized
cagcctgggtgactgaggaaga

SEQ ID NO: 1223353 - DNA, 22 bp, Artificial Sequence
  chemically synthesized
tttaggagactggttcttcctc

SEQ ID NO: 1223354 - DNA, 22 bp, Artificial Sequence
  chemically synthesized
tctatttaggagactggttctt

SEQ ID NO: 1223355 - DNA, 22 bp, Artificial Sequence
  chemically synthesized
ggtgactgaggaagaaccagtc

SEQ ID NO: 1223356 - DNA, 22 bp, Artificial Sequence
  chemically synthesized
atctatttaggagactggttct

SEQ ID NO: 1223357 - DNA, 22 bp, Artificial Sequence
  chemically synthesized
atttatctatttaggagactgg

SEQ ID NO: 1223358 - DNA, 22 bp, Artificial Sequence
  chemically synthesized
catttatctatttaggagactg

SEQ ID NO: 1223359 - DNA, 22 bp, Artificial Sequence
  chemically synthesized
tcatttatctatttaggagact

SEQ ID NO: 1223360 - DNA, 22 bp, Artificial Sequence
  chemically synthesized
aggaagaaccagtctcctaaat

SEQ ID NO: 1223361 - DNA, 22 bp, Artificial Sequence
  chemically synthesized
tttcatttatctatttaggaga

SEQ ID NO: 1223362 - DNA, 22 bp, Artificial Sequence
  chemically synthesized
ctttcatttatctatttaggag

SEQ ID NO: 1223363 - DNA, 22 bp, Artificial Sequence
  chemically synthesized
tctttcatttatctatttagga

SEQ ID NO: 1223364 - DNA, 22 bp, Artificial Sequence
  chemically synthesized
aggcatgcagttttctttcatt

SEQ ID NO: 1223365 - DNA, 22 bp, Artificial Sequence
  chemically synthesized
ctaaatagataaatgaaagaaa

SEQ ID NO: 1223366 - DNA, 22 bp, Artificial Sequence
  chemically synthesized
gaggcatgcagttttctttcat

SEQ ID NO: 1223367 - DNA, 22 bp, Artificial Sequence
  chemically synthesized
aatagataaatgaaagaaaact

SEQ ID NO: 1223368 - DNA, 22 bp, Artificial Sequence
  chemically synthesized
atttgaggcatgcagttttctt

SEQ ID NO: 1223369 - DNA, 22 bp, Artificial Sequence
  chemically synthesized
gatttgaggcatgcagttttct

SEQ ID NO: 1223370 - DNA, 22 bp, Artificial Sequence
  chemically synthesized
catgcctcaaatcaaactcaca

SEQ ID NO: 1223371 - DNA, 22 bp, Artificial Sequence
  chemically synthesized
aaatcaaactcacatatactta

SEQ ID NO: 1223372 - DNA, 22 bp, Artificial Sequence
  chemically synthesized
acatatacttattttctttctc

SEQ ID NO: 1223373 - DNA, 22 bp, Artificial Sequence
  chemically synthesized
attttctttctccttatctgct

SEQ ID NO: 1223374 - DNA, 22 bp, Artificial Sequence
  chemically synthesized
ttttctttctccttatctgctt

SEQ ID NO: 1223375 - DNA, 22 bp, Artificial Sequence
  chemically synthesized
atgagaatagtataaagcagat

SEQ ID NO: 1223376 - DNA, 22 bp, Artificial Sequence
  chemically synthesized
tctttctccttatctgctttat

SEQ ID NO: 1223377 - DNA, 22 bp, Artificial Sequence
  chemically synthesized
ctttctccttatctgctttata

SEQ ID NO: 1223378 - DNA, 22 bp, Artificial Sequence
  chemically synthesized
tttctccttatctgctttatac

SEQ ID NO: 1223379 - DNA, 22 bp, Artificial Sequence
  chemically synthesized
tctccttatctgctttatacta

SEQ ID NO: 1223380 - DNA, 22 bp, Artificial Sequence
  chemically synthesized
ctccttatctgctttatactat

SEQ ID NO: 1223381 - DNA, 22 bp, Artificial Sequence
  chemically synthesized
tccttatctgctttatactatt

SEQ ID NO: 1223382 - DNA, 22 bp, Artificial Sequence
  chemically synthesized
cttatctgctttatactattct

SEQ ID NO: 1223383 - DNA, 22 bp, Artificial Sequence
  chemically synthesized
atctgctttatactattctcat

SEQ ID NO: 1223384 - DNA, 22 bp, Artificial Sequence
  chemically synthesized
tctgctttatactattctcatt

SEQ ID NO: 1223385 - DNA, 22 bp, Artificial Sequence
  chemically synthesized
aatagtaagtgttaatgagaat

SEQ ID NO: 1223386 - DNA, 22 bp, Artificial Sequence
  chemically synthesized
ctttatactattctcattaaca

SEQ ID NO: 1223387 - DNA, 22 bp, Artificial Sequence
  chemically synthesized
tatactattctcattaacactt

SEQ ID NO: 1223388 - DNA, 22 bp, Artificial Sequence
  chemically synthesized
atactattctcattaacactta

SEQ ID NO: 1223389 - DNA, 22 bp, Artificial Sequence
  chemically synthesized
tactattctcattaacacttac

SEQ ID NO: 1223390 - DNA, 22 bp, Artificial Sequence
  chemically synthesized
tataatacgttaaatagtaagt

SEQ ID NO: 1223391 - DNA, 22 bp, Artificial Sequence
  chemically synthesized
ttctcattaacacttactattt

SEQ ID NO: 1223392 - DNA, 22 bp, Artificial Sequence
  chemically synthesized
tcattaacacttactatttaac

SEQ ID NO: 1223393 - DNA, 22 bp, Artificial Sequence
  chemically synthesized
aattatataatacgttaaatag

SEQ ID NO: 1223394 - DNA, 22 bp, Artificial Sequence
  chemically synthesized
attaacacttactatttaacgt

SEQ ID NO: 1223395 - DNA, 22 bp, Artificial Sequence
  chemically synthesized
attaaattatataatacgttaa

SEQ ID NO: 1223396 - DNA, 22 bp, Artificial Sequence
  chemically synthesized
acacttactatttaacgtatta

SEQ ID NO: 1223397 - DNA, 22 bp, Artificial Sequence
  chemically synthesized
aattaaattatataatacgtta

SEQ ID NO: 1223398 - DNA, 22 bp, Artificial Sequence
  chemically synthesized
actatttaacgtattatataat

SEQ ID NO: 1223399 - DNA, 22 bp, Artificial Sequence
  chemically synthesized
ctatttaacgtattatataatt

SEQ ID NO: 1223400 - DNA, 22 bp, Artificial Sequence
  chemically synthesized
tttaacgtattatataatttaa

SEQ ID NO: 1223401 - DNA, 22 bp, Artificial Sequence
  chemically synthesized
aacgtattatataatttaatta

SEQ ID NO: 1223402 - DNA, 22 bp, Artificial Sequence
  chemically synthesized
acgtattatataatttaattaa

SEQ ID NO: 1223403 - DNA, 22 bp, Artificial Sequence
  chemically synthesized
tataatttaattaaatttctct

SEQ ID NO: 1223404 - DNA, 22 bp, Artificial Sequence
  chemically synthesized
gtggaagagaaagatacacaga

SEQ ID NO: 1223405 - DNA, 22 bp, Artificial Sequence
  chemically synthesized
aattaaatttctctgtgtatct

SEQ ID NO: 1223406 - DNA, 22 bp, Artificial Sequence
  chemically synthesized
attaaatttctctgtgtatctt

SEQ ID NO: 1223407 - DNA, 22 bp, Artificial Sequence
  chemically synthesized
tagtggaagagaaagatacaca

SEQ ID NO: 1223408 - DNA, 22 bp, Artificial Sequence
  chemically synthesized
aatttctctgtgtatctttctc

SEQ ID NO: 1223409 - DNA, 22 bp, Artificial Sequence
  chemically synthesized
tacattctagtggaagagaaag

SEQ ID NO: 1223410 - DNA, 22 bp, Artificial Sequence
  chemically synthesized
ctctgtgtatctttctcttcca

SEQ ID NO: 1223411 - DNA, 22 bp, Artificial Sequence
  chemically synthesized
tctgtgtatctttctcttccac

SEQ ID NO: 1223412 - DNA, 22 bp, Artificial Sequence
  chemically synthesized
tgtgtatctttctcttccacta

SEQ ID NO: 1223413 - DNA, 22 bp, Artificial Sequence
  chemically synthesized
tgtatctttctcttccactaga

SEQ ID NO: 1223414 - DNA, 22 bp, Artificial Sequence
  chemically synthesized
tctcttccactagaatgtacaa

SEQ ID NO: 1223415 - DNA, 22 bp, Artificial Sequence
  chemically synthesized
ctcttccactagaatgtacaat

SEQ ID NO: 1223416 - DNA, 22 bp, Artificial Sequence
  chemically synthesized
tcttccactagaatgtacaatc

SEQ ID NO: 1223417 - DNA, 22 bp, Artificial Sequence
  chemically synthesized
ttccactagaatgtacaatctt

SEQ ID NO: 1223418 - DNA, 22 bp, Artificial Sequence
  chemically synthesized
ccactagaatgtacaatctttt

SEQ ID NO: 1223419 - DNA, 22 bp, Artificial Sequence
  chemically synthesized
cactagaatgtacaatctttta

SEQ ID NO: 1223420 - DNA, 22 bp, Artificial Sequence
  chemically synthesized
gaatgtacaatcttttattgcc

SEQ ID NO: 1223421 - DNA, 22 bp, Artificial Sequence
  chemically synthesized
cagcagtgaacaaaataggcaa

SEQ ID NO: 1223422 - DNA, 22 bp, Artificial Sequence
  chemically synthesized
ccagcagtgaacaaaataggca

SEQ ID NO: 1223423 - DNA, 22 bp, Artificial Sequence
  chemically synthesized
ggtttccagcagtgaacaaaat

SEQ ID NO: 1223424 - DNA, 22 bp, Artificial Sequence
  chemically synthesized
ttattgcctattttgttcactg

SEQ ID NO: 1223425 - DNA, 22 bp, Artificial Sequence
  chemically synthesized
tattgcctattttgttcactgc

SEQ ID NO: 1223426 - DNA, 22 bp, Artificial Sequence
  chemically synthesized
attgcctattttgttcactgct

SEQ ID NO: 1223427 - DNA, 22 bp, Artificial Sequence
  chemically synthesized
ttgcctattttgttcactgctg

SEQ ID NO: 1223428 - DNA, 22 bp, Artificial Sequence
  chemically synthesized
cctattttgttcactgctggaa

SEQ ID NO: 1223429 - DNA, 22 bp, Artificial Sequence
  chemically synthesized
tgtcaggctaggtttccagcag

SEQ ID NO: 1223430 - DNA, 22 bp, Artificial Sequence
  chemically synthesized
gtgtcaggctaggtttccagca

SEQ ID NO: 1223431 - DNA, 22 bp, Artificial Sequence
  chemically synthesized
tgtgtcaggctaggtttccagc

SEQ ID NO: 1223432 - DNA, 22 bp, Artificial Sequence
  chemically synthesized
ttttgttcactgctggaaacct

SEQ ID NO: 1223433 - DNA, 22 bp, Artificial Sequence
  chemically synthesized
ttttgtgtcaggctaggtttcc

SEQ ID NO: 1223434 - DNA, 22 bp, Artificial Sequence
  chemically synthesized
tgttcactgctggaaacctagc

SEQ ID NO: 1223435 - DNA, 22 bp, Artificial Sequence
  chemically synthesized
attttgtgtcaggctaggtttc

SEQ ID NO: 1223436 - DNA, 22 bp, Artificial Sequence
  chemically synthesized
gttcactgctggaaacctagcc

SEQ ID NO: 1223437 - DNA, 22 bp, Artificial Sequence
  chemically synthesized
tattttgtgtcaggctaggttt

SEQ ID NO: 1223438 - DNA, 22 bp, Artificial Sequence
  chemically synthesized
ttcactgctggaaacctagcct

SEQ ID NO: 1223439 - DNA, 22 bp, Artificial Sequence
  chemically synthesized
actgctggaaacctagcctgac

SEQ ID NO: 1223440 - DNA, 22 bp, Artificial Sequence
  chemically synthesized
agcctttattttgtgtcaggct

SEQ ID NO: 1223441 - DNA, 22 bp, Artificial Sequence
  chemically synthesized
ctggaaacctagcctgacacaa

SEQ ID NO: 1223442 - DNA, 22 bp, Artificial Sequence
  chemically synthesized
ttgagcctttattttgtgtcag

SEQ ID NO: 1223443 - DNA, 22 bp, Artificial Sequence
  chemically synthesized
gttgagcctttattttgtgtca

SEQ ID NO: 1223444 - DNA, 22 bp, Artificial Sequence
  chemically synthesized
gaaacctagcctgacacaaaat

SEQ ID NO: 1223445 - DNA, 22 bp, Artificial Sequence
  chemically synthesized
gcctgacacaaaataaaggctc

SEQ ID NO: 1223446 - DNA, 22 bp, Artificial Sequence
  chemically synthesized
ataaatatttgttgagccttta

SEQ ID NO: 1223447 - DNA, 22 bp, Artificial Sequence
  chemically synthesized
acacaaaataaaggctcaacaa

SEQ ID NO: 1223448 - DNA, 22 bp, Artificial Sequence
  chemically synthesized
gtgtagttgataaatatttgtt

SEQ ID NO: 1223449 - DNA, 22 bp, Artificial Sequence
  chemically synthesized
tcgtgtagttgataaatatttg

SEQ ID NO: 1223450 - DNA, 22 bp, Artificial Sequence
  chemically synthesized
tctcgtgtagttgataaatatt

SEQ ID NO: 1223451 - DNA, 22 bp, Artificial Sequence
  chemically synthesized
aacaaatatttatcaactacac

SEQ ID NO: 1223452 - DNA, 22 bp, Artificial Sequence
  chemically synthesized
atccattctctcgtgtagttga

SEQ ID NO: 1223453 - DNA, 22 bp, Artificial Sequence
  chemically synthesized
atgtgctcatccattctctcgt

SEQ ID NO: 1223454 - DNA, 22 bp, Artificial Sequence
  chemically synthesized
catgtgctcatccattctctcg

SEQ ID NO: 1223455 - DNA, 22 bp, Artificial Sequence
  chemically synthesized
atcaactacacgagagaatgga

SEQ ID NO: 1223456 - DNA, 22 bp, Artificial Sequence
  chemically synthesized
tcaactacacgagagaatggat

SEQ ID NO: 1223457 - DNA, 22 bp, Artificial Sequence
  chemically synthesized
cacgagagaatggatgagcaca

SEQ ID NO: 1223458 - DNA, 22 bp, Artificial Sequence
  chemically synthesized
tcaagtaacatggtatgtaagt

SEQ ID NO: 1223459 - DNA, 22 bp, Artificial Sequence
  chemically synthesized
ttatcaagtaacatggtatgta

SEQ ID NO: 1223460 - DNA, 22 bp, Artificial Sequence
  chemically synthesized
tattatcaagtaacatggtatg

SEQ ID NO: 1223461 - DNA, 22 bp, Artificial Sequence
  chemically synthesized
tctattatcaagtaacatggta

SEQ ID NO: 1223462 - DNA, 22 bp, Artificial Sequence
  chemically synthesized
ctctattatcaagtaacatggt

SEQ ID NO: 1223463 - DNA, 22 bp, Artificial Sequence
  chemically synthesized
tctctattatcaagtaacatgg

SEQ ID NO: 1223464 - DNA, 22 bp, Artificial Sequence
  chemically synthesized
cattttctctattatcaagtaa

SEQ ID NO: 1223465 - DNA, 22 bp, Artificial Sequence
  chemically synthesized
gcattttctctattatcaagta

SEQ ID NO: 1223466 - DNA, 22 bp, Artificial Sequence
  chemically synthesized
acataccatgttacttgataat

SEQ ID NO: 1223467 - DNA, 22 bp, Artificial Sequence
  chemically synthesized
tgcattttctctattatcaagt

SEQ ID NO: 1223468 - DNA, 22 bp, Artificial Sequence
  chemically synthesized
cataccatgttacttgataata

SEQ ID NO: 1223469 - DNA, 22 bp, Artificial Sequence
  chemically synthesized
ctttgcattttctctattatca

SEQ ID NO: 1223470 - DNA, 22 bp, Artificial Sequence
  chemically synthesized
cactcctttgcattttctctat

SEQ ID NO: 1223471 - DNA, 22 bp, Artificial Sequence
  chemically synthesized
acactcctttgcattttctcta

SEQ ID NO: 1223472 - DNA, 22 bp, Artificial Sequence
  chemically synthesized
ttacactcctttgcattttctc

SEQ ID NO: 1223473 - DNA, 22 bp, Artificial Sequence
  chemically synthesized
cttgataatagagaaaatgcaa

SEQ ID NO: 1223474 - DNA, 22 bp, Artificial Sequence
  chemically synthesized
cctcttacactcctttgcattt

SEQ ID NO: 1223475 - DNA, 22 bp, Artificial Sequence
  chemically synthesized
gataatagagaaaatgcaaagg

SEQ ID NO: 1223476 - DNA, 22 bp, Artificial Sequence
  chemically synthesized
ataatagagaaaatgcaaagga

SEQ ID NO: 1223477 - DNA, 22 bp, Artificial Sequence
  chemically synthesized
taagacaagaactgcctcttac

SEQ ID NO: 1223478 - DNA, 22 bp, Artificial Sequence
  chemically synthesized
ataagacaagaactgcctctta

SEQ ID NO: 1223479 - DNA, 22 bp, Artificial Sequence
  chemically synthesized
aaatccttataagacaagaact

SEQ ID NO: 1223480 - DNA, 22 bp, Artificial Sequence
  chemically synthesized
aaaatccttataagacaagaac

SEQ ID NO: 1223481 - DNA, 22 bp, Artificial Sequence
  chemically synthesized
aatttaaaatccttataagaca

SEQ ID NO: 1223482 - DNA, 22 bp, Artificial Sequence
  chemically synthesized
attaaatttaaaatccttataa

SEQ ID NO: 1223483 - DNA, 22 bp, Artificial Sequence
  chemically synthesized
ctcattaaatttaaaatcctta

SEQ ID NO: 1223484 - DNA, 22 bp, Artificial Sequence
  chemically synthesized
gctcattaaatttaaaatcctt

SEQ ID NO: 1223485 - DNA, 22 bp, Artificial Sequence
  chemically synthesized
ttgctcattaaatttaaaatcc

SEQ ID NO: 1223486 - DNA, 22 bp, Artificial Sequence
  chemically synthesized
ttgtcttataaggattttaaat

SEQ ID NO: 1223487 - DNA, 22 bp, Artificial Sequence
  chemically synthesized
cttgctcattaaatttaaaatc

SEQ ID NO: 1223488 - DNA, 22 bp, Artificial Sequence
  chemically synthesized
tcttgctcattaaatttaaaat

SEQ ID NO: 1223489 - DNA, 22 bp, Artificial Sequence
  chemically synthesized
gtcttataaggattttaaattt

SEQ ID NO: 1223490 - DNA, 22 bp, Artificial Sequence
  chemically synthesized
ttcttgctcattaaatttaaaa

SEQ ID NO: 1223491 - DNA, 22 bp, Artificial Sequence
  chemically synthesized
tcttataaggattttaaattta

SEQ ID NO: 1223492 - DNA, 22 bp, Artificial Sequence
  chemically synthesized
atttttcttgctcattaaattt

SEQ ID NO: 1223493 - DNA, 22 bp, Artificial Sequence
  chemically synthesized
ataaggattttaaatttaatga

SEQ ID NO: 1223494 - DNA, 22 bp, Artificial Sequence
  chemically synthesized
catttttcttgctcattaaatt

SEQ ID NO: 1223495 - DNA, 22 bp, Artificial Sequence
  chemically synthesized
taaggattttaaatttaatgag

SEQ ID NO: 1223496 - DNA, 22 bp, Artificial Sequence
  chemically synthesized
ttcatttttcttgctcattaaa

SEQ ID NO: 1223497 - DNA, 22 bp, Artificial Sequence
  chemically synthesized
cttcatttttcttgctcattaa

SEQ ID NO: 1223498 - DNA, 22 bp, Artificial Sequence
  chemically synthesized
taaatttaatgagcaagaaaaa

SEQ ID NO: 1223499 - DNA, 22 bp, Artificial Sequence
  chemically synthesized
aaatttaatgagcaagaaaaat

SEQ ID NO: 1223500 - DNA, 22 bp, Artificial Sequence
  chemically synthesized
aatttaatgagcaagaaaaatg

SEQ ID NO: 1223501 - DNA, 22 bp, Artificial Sequence
  chemically synthesized
atatggcttcttcatttttctt

SEQ ID NO: 1223502 - DNA, 22 bp, Artificial Sequence
  chemically synthesized
attcatatggcttcttcatttt

SEQ ID NO: 1223503 - DNA, 22 bp, Artificial Sequence
  chemically synthesized
aatgagcaagaaaaatgaagaa

SEQ ID NO: 1223504 - DNA, 22 bp, Artificial Sequence
  chemically synthesized
atgagcaagaaaaatgaagaag

SEQ ID NO: 1223505 - DNA, 22 bp, Artificial Sequence
  chemically synthesized
attaattcatatggcttcttca

SEQ ID NO: 1223506 - DNA, 22 bp, Artificial Sequence
  chemically synthesized
aattaattcatatggcttcttc

SEQ ID NO: 1223507 - DNA, 22 bp, Artificial Sequence
  chemically synthesized
gagtttaattaattcatatggc

SEQ ID NO: 1223508 - DNA, 22 bp, Artificial Sequence
  chemically synthesized
agagtttaattaattcatatgg

SEQ ID NO: 1223509 - DNA, 22 bp, Artificial Sequence
  chemically synthesized
acatttagagtttaattaattc

SEQ ID NO: 1223510 - DNA, 22 bp, Artificial Sequence
  chemically synthesized
cacatttagagtttaattaatt

SEQ ID NO: 1223511 - DNA, 22 bp, Artificial Sequence
  chemically synthesized
tcacatttagagtttaattaat

SEQ ID NO: 1223512 - DNA, 22 bp, Artificial Sequence
  chemically synthesized
ttcacatttagagtttaattaa

SEQ ID NO: 1223513 - DNA, 22 bp, Artificial Sequence
  chemically synthesized
tttcacatttagagtttaatta

SEQ ID NO: 1223514 - DNA, 22 bp, Artificial Sequence
  chemically synthesized
tgttttttcacatttagagttt

SEQ ID NO: 1223515 - DNA, 22 bp, Artificial Sequence
  chemically synthesized
tctgtgttttttcacatttaga

SEQ ID NO: 1223516 - DNA, 22 bp, Artificial Sequence
  chemically synthesized
ttgtctgtgttttttcacattt

SEQ ID NO: 1223517 - DNA, 22 bp, Artificial Sequence
  chemically synthesized
attgtctgtgttttttcacatt

SEQ ID NO: 1223518 - DNA, 22 bp, Artificial Sequence
  chemically synthesized
attaaactctaaatgtgaaaaa

SEQ ID NO: 1223519 - DNA, 22 bp, Artificial Sequence
  chemically synthesized
ttattgtctgtgttttttcaca

SEQ ID NO: 1223520 - DNA, 22 bp, Artificial Sequence
  chemically synthesized
cttattgtctgtgttttttcac

SEQ ID NO: 1223521 - DNA, 22 bp, Artificial Sequence
  chemically synthesized
tcttattgtctgtgttttttca

SEQ ID NO: 1223522 - DNA, 22 bp, Artificial Sequence
  chemically synthesized
aactctaaatgtgaaaaaacac

SEQ ID NO: 1223523 - DNA, 22 bp, Artificial Sequence
  chemically synthesized
taaatgtgaaaaaacacagaca

SEQ ID NO: 1223524 - DNA, 22 bp, Artificial Sequence
  chemically synthesized
aatgtgaaaaaacacagacaat

SEQ ID NO: 1223525 - DNA, 22 bp, Artificial Sequence
  chemically synthesized
caaaacattttcttattgtctg

SEQ ID NO: 1223526 - DNA, 22 bp, Artificial Sequence
  chemically synthesized
acaaaacattttcttattgtct

SEQ ID NO: 1223527 - DNA, 22 bp, Artificial Sequence
  chemically synthesized
tacaaaacattttcttattgtc

SEQ ID NO: 1223528 - DNA, 22 bp, Artificial Sequence
  chemically synthesized
agattttacaaaacattttctt

SEQ ID NO: 1223529 - DNA, 22 bp, Artificial Sequence
  chemically synthesized
cagattttacaaaacattttct

SEQ ID NO: 1223530 - DNA, 22 bp, Artificial Sequence
  chemically synthesized
accgcttcagattttacaaaac

SEQ ID NO: 1223531 - DNA, 22 bp, Artificial Sequence
  chemically synthesized
gaccgcttcagattttacaaaa

SEQ ID NO: 1223532 - DNA, 22 bp, Artificial Sequence
  chemically synthesized
ttgaccgcttcagattttacaa

SEQ ID NO: 1223533 - DNA, 22 bp, Artificial Sequence
  chemically synthesized
cttgaccgcttcagattttaca

SEQ ID NO: 1223534 - DNA, 22 bp, Artificial Sequence
  chemically synthesized
tcttgaccgcttcagattttac

SEQ ID NO: 1223535 - DNA, 22 bp, Artificial Sequence
  chemically synthesized
agaaaactttcttgaccgcttc

SEQ ID NO: 1223536 - DNA, 22 bp, Artificial Sequence
  chemically synthesized
tgtaaaatctgaagcggtcaag

SEQ ID NO: 1223537 - DNA, 22 bp, Artificial Sequence
  chemically synthesized
gtaaaatctgaagcggtcaaga

SEQ ID NO: 1223538 - DNA, 22 bp, Artificial Sequence
  chemically synthesized
taaaatctgaagcggtcaagaa

SEQ ID NO: 1223539 - DNA, 22 bp, Artificial Sequence
  chemically synthesized
agcctcagaaaactttcttgac

SEQ ID NO: 1223540 - DNA, 22 bp, Artificial Sequence
  chemically synthesized
cagcctcagaaaactttcttga

SEQ ID NO: 1223541 - DNA, 22 bp, Artificial Sequence
  chemically synthesized
tcagcctcagaaaactttcttg

SEQ ID NO: 1223542 - DNA, 22 bp, Artificial Sequence
  chemically synthesized
tctttcagcctcagaaaacttt

SEQ ID NO: 1223543 - DNA, 22 bp, Artificial Sequence
  chemically synthesized
aagcggtcaagaaagttttctg

SEQ ID NO: 1223544 - DNA, 22 bp, Artificial Sequence
  chemically synthesized
atctgtctttcagcctcagaaa

SEQ ID NO: 1223545 - DNA, 22 bp, Artificial Sequence
  chemically synthesized
aatctgtctttcagcctcagaa

SEQ ID NO: 1223546 - DNA, 22 bp, Artificial Sequence
  chemically synthesized
tttaatctgtctttcagcctca

SEQ ID NO: 1223547 - DNA, 22 bp, Artificial Sequence
  chemically synthesized
tctgaggctgaaagacagatta

SEQ ID NO: 1223548 - DNA, 22 bp, Artificial Sequence
  chemically synthesized
ctgaggctgaaagacagattaa

SEQ ID NO: 1223549 - DNA, 22 bp, Artificial Sequence
  chemically synthesized
tgaggctgaaagacagattaaa

SEQ ID NO: 1223550 - DNA, 22 bp, Artificial Sequence
  chemically synthesized
aggctgaaagacagattaaata

SEQ ID NO: 1223551 - DNA, 22 bp, Artificial Sequence
  chemically synthesized
atgcaagtcgaaacgtctattt

SEQ ID NO: 1223552 - DNA, 22 bp, Artificial Sequence
  chemically synthesized
aaagacagattaaatagacgtt

SEQ ID NO: 1223553 - DNA, 22 bp, Artificial Sequence
  chemically synthesized
aatgcaagtcgaaacgtctatt

SEQ ID NO: 1223554 - DNA, 22 bp, Artificial Sequence
  chemically synthesized
taatgcaagtcgaaacgtctat

SEQ ID NO: 1223555 - DNA, 22 bp, Artificial Sequence
  chemically synthesized
ttaatgcaagtcgaaacgtcta

SEQ ID NO: 1223556 - DNA, 22 bp, Artificial Sequence
  chemically synthesized
tttaatgcaagtcgaaacgtct

SEQ ID NO: 1223557 - DNA, 22 bp, Artificial Sequence
  chemically synthesized
ttttaatgcaagtcgaaacgtc

SEQ ID NO: 1223558 - DNA, 22 bp, Artificial Sequence
  chemically synthesized
tttttaatgcaagtcgaaacgt

SEQ ID NO: 1223559 - DNA, 22 bp, Artificial Sequence
  chemically synthesized
aatagacgtttcgacttgcatt

SEQ ID NO: 1223560 - DNA, 22 bp, Artificial Sequence
  chemically synthesized
tcaatacattttttttaatgca

SEQ ID NO: 1223561 - DNA, 22 bp, Artificial Sequence
  chemically synthesized
ttatcaatacattttttttaat

SEQ ID NO: 1223562 - DNA, 22 bp, Artificial Sequence
  chemically synthesized
tattatcaatacatttttttta

SEQ ID NO: 1223563 - DNA, 22 bp, Artificial Sequence
  chemically synthesized
cgacttgcattaaaaaaaatgt

SEQ ID NO: 1223564 - DNA, 22 bp, Artificial Sequence
  chemically synthesized
gacttgcattaaaaaaaatgta

SEQ ID NO: 1223565 - DNA, 22 bp, Artificial Sequence
  chemically synthesized
gaattctattatcaatacattt

SEQ ID NO: 1223566 - DNA, 22 bp, Artificial Sequence
  chemically synthesized
agaattctattatcaatacatt

SEQ ID NO: 1223567 - DNA, 22 bp, Artificial Sequence
  chemically synthesized
gcattaaaaaaaatgtattgat

SEQ ID NO: 1223568 - DNA, 22 bp, Artificial Sequence
  chemically synthesized
cattaaaaaaaatgtattgata

SEQ ID NO: 1223569 - DNA, 22 bp, Artificial Sequence
  chemically synthesized
aaaaaaatgtattgataataga

SEQ ID NO: 1223570 - DNA, 22 bp, Artificial Sequence
  chemically synthesized
acacaacttagaattctattat

SEQ ID NO: 1223571 - DNA, 22 bp, Artificial Sequence
  chemically synthesized
acgctcacacaacttagaattc

SEQ ID NO: 1223572 - DNA, 22 bp, Artificial Sequence
  chemically synthesized
taacgctcacacaacttagaat

SEQ ID NO: 1223573 - DNA, 22 bp, Artificial Sequence
  chemically synthesized
tctaacgctcacacaacttaga

SEQ ID NO: 1223574 - DNA, 22 bp, Artificial Sequence
  chemically synthesized
ataatagaattctaagttgtgt

SEQ ID NO: 1223575 - DNA, 22 bp, Artificial Sequence
  chemically synthesized
attctctaacgctcacacaact

SEQ ID NO: 1223576 - DNA, 22 bp, Artificial Sequence
  chemically synthesized
aattctctaacgctcacacaac

SEQ ID NO: 1223577 - DNA, 22 bp, Artificial Sequence
  chemically synthesized
taattctctaacgctcacacaa

SEQ ID NO: 1223578 - DNA, 22 bp, Artificial Sequence
  chemically synthesized
agaactttaattctctaacgct

SEQ ID NO: 1223579 - DNA, 22 bp, Artificial Sequence
  chemically synthesized
taagttgtgtgagcgttagaga

SEQ ID NO: 1223580 - DNA, 22 bp, Artificial Sequence
  chemically synthesized
agttgtgtgagcgttagagaat

SEQ ID NO: 1223581 - DNA, 22 bp, Artificial Sequence
  chemically synthesized
cctaagaactttaattctctaa

SEQ ID NO: 1223582 - DNA, 22 bp, Artificial Sequence
  chemically synthesized
ccctaagaactttaattctcta

SEQ ID NO: 1223583 - DNA, 22 bp, Artificial Sequence
  chemically synthesized
tgtgagcgttagagaattaaag

SEQ ID NO: 1223584 - DNA, 22 bp, Artificial Sequence
  chemically synthesized
cttccctaagaactttaattct

SEQ ID NO: 1223585 - DNA, 22 bp, Artificial Sequence
  chemically synthesized
ccttccctaagaactttaattc

SEQ ID NO: 1223586 - DNA, 22 bp, Artificial Sequence
  chemically synthesized
tccttccctaagaactttaatt

SEQ ID NO: 1223587 - DNA, 22 bp, Artificial Sequence
  chemically synthesized
ttccttccctaagaactttaat

SEQ ID NO: 1223588 - DNA, 22 bp, Artificial Sequence
  chemically synthesized
tttccttccctaagaactttaa

SEQ ID NO: 1223589 - DNA, 22 bp, Artificial Sequence
  chemically synthesized
ttttccttccctaagaacttta

SEQ ID NO: 1223590 - DNA, 22 bp, Artificial Sequence
  chemically synthesized
cttttttccttccctaagaact

SEQ ID NO: 1223591 - DNA, 22 bp, Artificial Sequence
  chemically synthesized
gcttttttccttccctaagaac

SEQ ID NO: 1223592 - DNA, 22 bp, Artificial Sequence
  chemically synthesized
tgcttttttccttccctaagaa

SEQ ID NO: 1223593 - DNA, 22 bp, Artificial Sequence
  chemically synthesized
gagaattaaagttcttagggaa

SEQ ID NO: 1223594 - DNA, 22 bp, Artificial Sequence
  chemically synthesized
aagttcttagggaaggaaaaaa

SEQ ID NO: 1223595 - DNA, 22 bp, Artificial Sequence
  chemically synthesized
agcatgttttgcttttttcctt

SEQ ID NO: 1223596 - DNA, 22 bp, Artificial Sequence
  chemically synthesized
tctgagcatgttttgctttttt

SEQ ID NO: 1223597 - DNA, 22 bp, Artificial Sequence
  chemically synthesized
ttagggaaggaaaaaagcaaaa

SEQ ID NO: 1223598 - DNA, 22 bp, Artificial Sequence
  chemically synthesized
agggaaggaaaaaagcaaaaca

SEQ ID NO: 1223599 - DNA, 22 bp, Artificial Sequence
  chemically synthesized
attatctgagcatgttttgctt

SEQ ID NO: 1223600 - DNA, 22 bp, Artificial Sequence
  chemically synthesized
gggaaggaaaaaagcaaaacat

SEQ ID NO: 1223601 - DNA, 22 bp, Artificial Sequence
  chemically synthesized
gattatctgagcatgttttgct

SEQ ID NO: 1223602 - DNA, 22 bp, Artificial Sequence
  chemically synthesized
tgaggtcttgattatctgagca

SEQ ID NO: 1223603 - DNA, 22 bp, Artificial Sequence
  chemically synthesized
agataatcaagacctcacaggc

SEQ ID NO: 1223604 - DNA, 22 bp, Artificial Sequence
  chemically synthesized
caatggagccaggcctgtgagg

SEQ ID NO: 1223605 - DNA, 22 bp, Artificial Sequence
  chemically synthesized
ccaatggagccaggcctgtgag

SEQ ID NO: 1223606 - DNA, 22 bp, Artificial Sequence
  chemically synthesized
gaatcttccaatggagccaggc

SEQ ID NO: 1223607 - DNA, 22 bp, Artificial Sequence
  chemically synthesized
agaatcttccaatggagccagg

SEQ ID NO: 1223608 - DNA, 22 bp, Artificial Sequence
  chemically synthesized
atacttagaatcttccaatgga

SEQ ID NO: 1223609 - DNA, 22 bp, Artificial Sequence
  chemically synthesized
acaggcctggctccattggaag

SEQ ID NO: 1223610 - DNA, 22 bp, Artificial Sequence
  chemically synthesized
gatacttagaatcttccaatgg

SEQ ID NO: 1223611 - DNA, 22 bp, Artificial Sequence
  chemically synthesized
gctccattggaagattctaagt

SEQ ID NO: 1223612 - DNA, 22 bp, Artificial Sequence
  chemically synthesized
ccaccacttgatacttagaatc

SEQ ID NO: 1223613 - DNA, 22 bp, Artificial Sequence
  chemically synthesized
cattggaagattctaagtatca

SEQ ID NO: 1223614 - DNA, 22 bp, Artificial Sequence
  chemically synthesized
tctcccaccacttgatacttag

SEQ ID NO: 1223615 - DNA, 22 bp, Artificial Sequence
  chemically synthesized
gaagattctaagtatcaagtgg

SEQ ID NO: 1223616 - DNA, 22 bp, Artificial Sequence
  chemically synthesized
aacctatctcccaccacttgat

SEQ ID NO: 1223617 - DNA, 22 bp, Artificial Sequence
  chemically synthesized
aaacctatctcccaccacttga

SEQ ID NO: 1223618 - DNA, 22 bp, Artificial Sequence
  chemically synthesized
taaacctatctcccaccacttg

SEQ ID NO: 1223619 - DNA, 22 bp, Artificial Sequence
  chemically synthesized
ttaaacctatctcccaccactt

SEQ ID NO: 1223620 - DNA, 22 bp, Artificial Sequence
  chemically synthesized
ttttaaacctatctcccaccac

SEQ ID NO: 1223621 - DNA, 22 bp, Artificial Sequence
  chemically synthesized
cttttaaacctatctcccacca

SEQ ID NO: 1223622 - DNA, 22 bp, Artificial Sequence
  chemically synthesized
taagtatcaagtggtgggagat

SEQ ID NO: 1223623 - DNA, 22 bp, Artificial Sequence
  chemically synthesized
tcttttaaacctatctcccacc

SEQ ID NO: 1223624 - DNA, 22 bp, Artificial Sequence
  chemically synthesized
agtatcaagtggtgggagatag

SEQ ID NO: 1223625 - DNA, 22 bp, Artificial Sequence
  chemically synthesized
tttcttttaaacctatctccca

SEQ ID NO: 1223626 - DNA, 22 bp, Artificial Sequence
  chemically synthesized
ctttcttttaaacctatctccc

SEQ ID NO: 1223627 - DNA, 22 bp, Artificial Sequence
  chemically synthesized
agccagtttctttcttttaaac

SEQ ID NO: 1223628 - DNA, 22 bp, Artificial Sequence
  chemically synthesized
tgcaaactcagccagtttcttt

SEQ ID NO: 1223629 - DNA, 22 bp, Artificial Sequence
  chemically synthesized
atgcaaactcagccagtttctt

SEQ ID NO: 1223630 - DNA, 22 bp, Artificial Sequence
  chemically synthesized
aaaagaaagaaactggctgagt

SEQ ID NO: 1223631 - DNA, 22 bp, Artificial Sequence
  chemically synthesized
aaagaaagaaactggctgagtt

SEQ ID NO: 1223632 - DNA, 22 bp, Artificial Sequence
  chemically synthesized
acagccaacaccttatgcaaac

SEQ ID NO: 1223633 - DNA, 22 bp, Artificial Sequence
  chemically synthesized
gctgagtttgcataaggtgttg

SEQ ID NO: 1223634 - DNA, 22 bp, Artificial Sequence
  chemically synthesized
taatacgttaacagccaacacc

SEQ ID NO: 1223635 - DNA, 22 bp, Artificial Sequence
  chemically synthesized
agtttgcataaggtgttggctg

SEQ ID NO: 1223636 - DNA, 22 bp, Artificial Sequence
  chemically synthesized
gcataaggtgttggctgttaac

SEQ ID NO: 1223637 - DNA, 22 bp, Artificial Sequence
  chemically synthesized
cataaggtgttggctgttaacg

SEQ ID NO: 1223638 - DNA, 22 bp, Artificial Sequence
  chemically synthesized
ggataaattataatacgttaac

SEQ ID NO: 1223639 - DNA, 22 bp, Artificial Sequence
  chemically synthesized
ttgggataaattataatacgtt

SEQ ID NO: 1223640 - DNA, 22 bp, Artificial Sequence
  chemically synthesized
gctgttaacgtattataattta

SEQ ID NO: 1223641 - DNA, 22 bp, Artificial Sequence
  chemically synthesized
cagtgctgttgggataaattat

SEQ ID NO: 1223642 - DNA, 22 bp, Artificial Sequence
  chemically synthesized
ccagtgctgttgggataaatta

SEQ ID NO: 1223643 - DNA, 22 bp, Artificial Sequence
  chemically synthesized
ttaacgtattataatttatccc

SEQ ID NO: 1223644 - DNA, 22 bp, Artificial Sequence
  chemically synthesized
acgtattataatttatcccaac

SEQ ID NO: 1223645 - DNA, 22 bp, Artificial Sequence
  chemically synthesized
atgacttccagtgctgttggga

SEQ ID NO: 1223646 - DNA, 22 bp, Artificial Sequence
  chemically synthesized
actaatgacttccagtgctgtt

SEQ ID NO: 1223647 - DNA, 22 bp, Artificial Sequence
  chemically synthesized
taatttatcccaacagcactgg

SEQ ID NO: 1223648 - DNA, 22 bp, Artificial Sequence
  chemically synthesized
gactaatgacttccagtgctgt

SEQ ID NO: 1223649 - DNA, 22 bp, Artificial Sequence
  chemically synthesized
atcccaacagcactggaagtca

SEQ ID NO: 1223650 - DNA, 22 bp, Artificial Sequence
  chemically synthesized
tcccaacagcactggaagtcat

SEQ ID NO: 1223651 - DNA, 22 bp, Artificial Sequence
  chemically synthesized
gaagtcattagtcaagtggttc

SEQ ID NO: 1223652 - DNA, 22 bp, Artificial Sequence
  chemically synthesized
agaataggtgaagaaccacttg

SEQ ID NO: 1223653 - DNA, 22 bp, Artificial Sequence
  chemically synthesized
tgattcagaataggtgaagaac

SEQ ID NO: 1223654 - DNA, 22 bp, Artificial Sequence
  chemically synthesized
gtcaagtggttcttcacctatt

SEQ ID NO: 1223655 - DNA, 22 bp, Artificial Sequence
  chemically synthesized
aaaggtgtctgtgattcagaat

SEQ ID NO: 1223656 - DNA, 22 bp, Artificial Sequence
  chemically synthesized
tcaaaggtgtctgtgattcaga

SEQ ID NO: 1223657 - DNA, 22 bp, Artificial Sequence
  chemically synthesized
ttcacctattctgaatcacaga

SEQ ID NO: 1223658 - DNA, 22 bp, Artificial Sequence
  chemically synthesized
cacctattctgaatcacagaca

SEQ ID NO: 1223659 - DNA, 22 bp, Artificial Sequence
  chemically synthesized
acctattctgaatcacagacac

SEQ ID NO: 1223660 - DNA, 22 bp, Artificial Sequence
  chemically synthesized
aacagattctcaaaggtgtctg

SEQ ID NO: 1223661 - DNA, 22 bp, Artificial Sequence
  chemically synthesized
ttctgaatcacagacacctttg

SEQ ID NO: 1223662 - DNA, 22 bp, Artificial Sequence
  chemically synthesized
tcaacagattctcaaaggtgtc

SEQ ID NO: 1223663 - DNA, 22 bp, Artificial Sequence
  chemically synthesized
tgaatcacagacacctttgaga

SEQ ID NO: 1223664 - DNA, 22 bp, Artificial Sequence
  chemically synthesized
aatcacagacacctttgagaat

SEQ ID NO: 1223665 - DNA, 22 bp, Artificial Sequence
  chemically synthesized
atagctctcaacagattctcaa

SEQ ID NO: 1223666 - DNA, 22 bp, Artificial Sequence
  chemically synthesized
catagctctcaacagattctca

SEQ ID NO: 1223667 - DNA, 22 bp, Artificial Sequence
  chemically synthesized
tgagaatctgttgagagctatg

SEQ ID NO: 1223668 - DNA, 22 bp, Artificial Sequence
  chemically synthesized
gagaatctgttgagagctatga

SEQ ID NO: 1223669 - DNA, 22 bp, Artificial Sequence
  chemically synthesized
agaatctgttgagagctatgaa

SEQ ID NO: 1223670 - DNA, 22 bp, Artificial Sequence
  chemically synthesized
taggagtagaagtttcatagct

SEQ ID NO: 1223671 - DNA, 22 bp, Artificial Sequence
  chemically synthesized
gtaggagtagaagtttcatagc

SEQ ID NO: 1223672 - DNA, 22 bp, Artificial Sequence
  chemically synthesized
tgtaggagtagaagtttcatag

SEQ ID NO: 1223673 - DNA, 22 bp, Artificial Sequence
  chemically synthesized
ttgtaggagtagaagtttcata

SEQ ID NO: 1223674 - DNA, 22 bp, Artificial Sequence
  chemically synthesized
tttgtaggagtagaagtttcat

SEQ ID NO: 1223675 - DNA, 22 bp, Artificial Sequence
  chemically synthesized
ttttgtaggagtagaagtttca

SEQ ID NO: 1223676 - DNA, 22 bp, Artificial Sequence
  chemically synthesized
ttgagagctatgaaacttctac

SEQ ID NO: 1223677 - DNA, 22 bp, Artificial Sequence
  chemically synthesized
agagctatgaaacttctactcc

SEQ ID NO: 1223678 - DNA, 22 bp, Artificial Sequence
  chemically synthesized
tgaaacttctactcctacaaaa

SEQ ID NO: 1223679 - DNA, 22 bp, Artificial Sequence
  chemically synthesized
acagatatggagagtttttttg

SEQ ID NO: 1223680 - DNA, 22 bp, Artificial Sequence
  chemically synthesized
ctactcctacaaaaaaactctc

SEQ ID NO: 1223681 - DNA, 22 bp, Artificial Sequence
  chemically synthesized
ttcacagatatggagagttttt

SEQ ID NO: 1223682 - DNA, 22 bp, Artificial Sequence
  chemically synthesized
tactcctacaaaaaaactctcc

SEQ ID NO: 1223683 - DNA, 22 bp, Artificial Sequence
  chemically synthesized
tgttcacagatatggagagttt

SEQ ID NO: 1223684 - DNA, 22 bp, Artificial Sequence
  chemically synthesized
ctcctacaaaaaaactctccat

SEQ ID NO: 1223685 - DNA, 22 bp, Artificial Sequence
  chemically synthesized
ctacaaaaaaactctccatatc

SEQ ID NO: 1223686 - DNA, 22 bp, Artificial Sequence
  chemically synthesized
caaaaaaactctccatatctgt

SEQ ID NO: 1223687 - DNA, 22 bp, Artificial Sequence
  chemically synthesized
tatgtagactctgttcacagat

SEQ ID NO: 1223688 - DNA, 22 bp, Artificial Sequence
  chemically synthesized
aaactgtatgtagactctgttc

SEQ ID NO: 1223689 - DNA, 22 bp, Artificial Sequence
  chemically synthesized
tccatatctgtgaacagagtct

SEQ ID NO: 1223690 - DNA, 22 bp, Artificial Sequence
  chemically synthesized
taaaactgtatgtagactctgt

SEQ ID NO: 1223691 - DNA, 22 bp, Artificial Sequence
  chemically synthesized
catatctgtgaacagagtctac

SEQ ID NO: 1223692 - DNA, 22 bp, Artificial Sequence
  chemically synthesized
aaatattctaaaactgtatgta

SEQ ID NO: 1223693 - DNA, 22 bp, Artificial Sequence
  chemically synthesized
tgaacagagtctacatacagtt

SEQ ID NO: 1223694 - DNA, 22 bp, Artificial Sequence
  chemically synthesized
atagattcaaatattctaaaac

SEQ ID NO: 1223695 - DNA, 22 bp, Artificial Sequence
  chemically synthesized
catacagttttagaatatttga

SEQ ID NO: 1223696 - DNA, 22 bp, Artificial Sequence
  chemically synthesized
aacaggagtccattaatagatt

SEQ ID NO: 1223697 - DNA, 22 bp, Artificial Sequence
  chemically synthesized
tagaatatttgaatctattaat

SEQ ID NO: 1223698 - DNA, 22 bp, Artificial Sequence
  chemically synthesized
aaacaggagtccattaatagat

SEQ ID NO: 1223699 - DNA, 22 bp, Artificial Sequence
  chemically synthesized
agaatatttgaatctattaatg

SEQ ID NO: 1223700 - DNA, 22 bp, Artificial Sequence
  chemically synthesized
gaatatttgaatctattaatgg

SEQ ID NO: 1223701 - DNA, 22 bp, Artificial Sequence
  chemically synthesized
ttaaacaggagtccattaatag

SEQ ID NO: 1223702 - DNA, 22 bp, Artificial Sequence
  chemically synthesized
gaatctattaatggactcctgt

SEQ ID NO: 1223703 - DNA, 22 bp, Artificial Sequence
  chemically synthesized
aatctattaatggactcctgtt

SEQ ID NO: 1223704 - DNA, 22 bp, Artificial Sequence
  chemically synthesized
catagcatgagctcttaaacag

SEQ ID NO: 1223705 - DNA, 22 bp, Artificial Sequence
  chemically synthesized
ttaatggactcctgtttaagag

SEQ ID NO: 1223706 - DNA, 22 bp, Artificial Sequence
  chemically synthesized
gcatagcatgagctcttaaaca

SEQ ID NO: 1223707 - DNA, 22 bp, Artificial Sequence
  chemically synthesized
tgcatagcatgagctcttaaac

SEQ ID NO: 1223708 - DNA, 22 bp, Artificial Sequence
  chemically synthesized
ttgcatagcatgagctcttaaa

SEQ ID NO: 1223709 - DNA, 22 bp, Artificial Sequence
  chemically synthesized
atggactcctgtttaagagctc

SEQ ID NO: 1223710 - DNA, 22 bp, Artificial Sequence
  chemically synthesized
tttttgcatagcatgagctctt

SEQ ID NO: 1223711 - DNA, 22 bp, Artificial Sequence
  chemically synthesized
gtttttgcatagcatgagctct

SEQ ID NO: 1223712 - DNA, 22 bp, Artificial Sequence
  chemically synthesized
tgtttttgcatagcatgagctc

SEQ ID NO: 1223713 - DNA, 22 bp, Artificial Sequence
  chemically synthesized
ttgtttttgcatagcatgagct

SEQ ID NO: 1223714 - DNA, 22 bp, Artificial Sequence
  chemically synthesized
tttgtttttgcatagcatgagc

SEQ ID NO: 1223715 - DNA, 22 bp, Artificial Sequence
  chemically synthesized
ttttgtttttgcatagcatgag

SEQ ID NO: 1223716 - DNA, 22 bp, Artificial Sequence
  chemically synthesized
ctgtttaagagctcatgctatg

SEQ ID NO: 1223717 - DNA, 22 bp, Artificial Sequence
  chemically synthesized
tttttttgtttttgcatagcat

SEQ ID NO: 1223718 - DNA, 22 bp, Artificial Sequence
  chemically synthesized
tttaagagctcatgctatgcaa

SEQ ID NO: 1223719 - DNA, 22 bp, Artificial Sequence
  chemically synthesized
gtttttttgtttttgcatagca

SEQ ID NO: 1223720 - DNA, 22 bp, Artificial Sequence
  chemically synthesized
tgtttttttgtttttgcatagc

SEQ ID NO: 1223721 - DNA, 22 bp, Artificial Sequence
  chemically synthesized
aagagctcatgctatgcaaaaa

SEQ ID NO: 1223722 - DNA, 22 bp, Artificial Sequence
  chemically synthesized
agagctcatgctatgcaaaaac

SEQ ID NO: 1223723 - DNA, 22 bp, Artificial Sequence
  chemically synthesized
ttttgtttttttgtttttgcat

SEQ ID NO: 1223724 - DNA, 22 bp, Artificial Sequence
  chemically synthesized
gttattttgtttttttgttttt

SEQ ID NO: 1223725 - DNA, 22 bp, Artificial Sequence
  chemically synthesized
cgttattttgtttttttgtttt

SEQ ID NO: 1223726 - DNA, 22 bp, Artificial Sequence
  chemically synthesized
tcgttattttgtttttttgttt

SEQ ID NO: 1223727 - DNA, 22 bp, Artificial Sequence
  chemically synthesized
atgctatgcaaaaacaaaaaaa

SEQ ID NO: 1223728 - DNA, 22 bp, Artificial Sequence
  chemically synthesized
ttcgttattttgtttttttgtt

SEQ ID NO: 1223729 - DNA, 22 bp, Artificial Sequence
  chemically synthesized
tttcgttattttgtttttttgt

SEQ ID NO: 1223730 - DNA, 22 bp, Artificial Sequence
  chemically synthesized
ttttcgttattttgtttttttg

SEQ ID NO: 1223731 - DNA, 22 bp, Artificial Sequence
  chemically synthesized
tttttttcgttattttgttttt

SEQ ID NO: 1223732 - DNA, 22 bp, Artificial Sequence
  chemically synthesized
tgcaaaaacaaaaaaacaaaat

SEQ ID NO: 1223733 - DNA, 22 bp, Artificial Sequence
  chemically synthesized
gtttttttcgttattttgtttt

SEQ ID NO: 1223734 - DNA, 22 bp, Artificial Sequence
  chemically synthesized
tgtttttttcgttattttgttt

SEQ ID NO: 1223735 - DNA, 22 bp, Artificial Sequence
  chemically synthesized
ttgtttttttcgttattttgtt

SEQ ID NO: 1223736 - DNA, 22 bp, Artificial Sequence
  chemically synthesized
tttgtttttttcgttattttgt

SEQ ID NO: 1223737 - DNA, 22 bp, Artificial Sequence
  chemically synthesized
ttttgtttttttcgttattttg

SEQ ID NO: 1223738 - DNA, 22 bp, Artificial Sequence
  chemically synthesized
tttttgtttttttcgttatttt

SEQ ID NO: 1223739 - DNA, 22 bp, Artificial Sequence
  chemically synthesized
ttttttgtttttttcgttattt

SEQ ID NO: 1223740 - DNA, 22 bp, Artificial Sequence
  chemically synthesized
tttttttgtttttttcgttatt

SEQ ID NO: 1223741 - DNA, 22 bp, Artificial Sequence
  chemically synthesized
taactttttttttgtttttttc

SEQ ID NO: 1223742 - DNA, 22 bp, Artificial Sequence
  chemically synthesized
gtaactttttttttgttttttt

SEQ ID NO: 1223743 - DNA, 22 bp, Artificial Sequence
  chemically synthesized
tgtaactttttttttgtttttt

SEQ ID NO: 1223744 - DNA, 22 bp, Artificial Sequence
  chemically synthesized
cctttgtaactttttttttgtt

SEQ ID NO: 1223745 - DNA, 22 bp, Artificial Sequence
  chemically synthesized
aactacctttgtaacttttttt

SEQ ID NO: 1223746 - DNA, 22 bp, Artificial Sequence
  chemically synthesized
gaaaaataacagctaaactacc

SEQ ID NO: 1223747 - DNA, 22 bp, Artificial Sequence
  chemically synthesized
agaaaaataacagctaaactac

SEQ ID NO: 1223748 - DNA, 22 bp, Artificial Sequence
  chemically synthesized
tagaaaaataacagctaaacta

SEQ ID NO: 1223749 - DNA, 22 bp, Artificial Sequence
  chemically synthesized
caaaggtagtttagctgttatt

SEQ ID NO: 1223750 - DNA, 22 bp, Artificial Sequence
  chemically synthesized
cagttttagaaaaataacagct

SEQ ID NO: 1223751 - DNA, 22 bp, Artificial Sequence
  chemically synthesized
aattacagttttagaaaaataa

SEQ ID NO: 1223752 - DNA, 22 bp, Artificial Sequence
  chemically synthesized
gaattacagttttagaaaaata

SEQ ID NO: 1223753 - DNA, 22 bp, Artificial Sequence
  chemically synthesized
tgaattacagttttagaaaaat

SEQ ID NO: 1223754 - DNA, 22 bp, Artificial Sequence
  chemically synthesized
agctgttatttttctaaaactg

SEQ ID NO: 1223755 - DNA, 22 bp, Artificial Sequence
  chemically synthesized
gctgttatttttctaaaactgt

SEQ ID NO: 1223756 - DNA, 22 bp, Artificial Sequence
  chemically synthesized
gccaattttgaattacagtttt

SEQ ID NO: 1223757 - DNA, 22 bp, Artificial Sequence
  chemically synthesized
ttatttttctaaaactgtaatt

SEQ ID NO: 1223758 - DNA, 22 bp, Artificial Sequence
  chemically synthesized
tttttctaaaactgtaattcaa

SEQ ID NO: 1223759 - DNA, 22 bp, Artificial Sequence
  chemically synthesized
cgcctggccaattttgaattac

SEQ ID NO: 1223760 - DNA, 22 bp, Artificial Sequence
  chemically synthesized
ttctaaaactgtaattcaaaat

SEQ ID NO: 1223761 - DNA, 22 bp, Artificial Sequence
  chemically synthesized
tctaaaactgtaattcaaaatt

SEQ ID NO: 1223762 - DNA, 22 bp, Artificial Sequence
  chemically synthesized
ctaaaactgtaattcaaaattg

SEQ ID NO: 1223763 - DNA, 22 bp, Artificial Sequence
  chemically synthesized
taaaactgtaattcaaaattgg

SEQ ID NO: 1223764 - DNA, 22 bp, Artificial Sequence
  chemically synthesized
aaactgtaattcaaaattggcc

SEQ ID NO: 1223765 - DNA, 22 bp, Artificial Sequence
  chemically synthesized
taattcaaaattggccaggcgc

SEQ ID NO: 1223766 - DNA, 22 bp, Artificial Sequence
  chemically synthesized
aaaattggccaggcgcagtggc

SEQ ID NO: 1223767 - DNA, 22 bp, Artificial Sequence
  chemically synthesized
ggagtataggcgggagccactg

SEQ ID NO: 1223768 - DNA, 22 bp, Artificial Sequence
  chemically synthesized
gccaggcgcagtggctcccgcc

SEQ ID NO: 1223769 - DNA, 22 bp, Artificial Sequence
  chemically synthesized
ccaaagtgctgggagtataggc

SEQ ID NO: 1223770 - DNA, 22 bp, Artificial Sequence
  chemically synthesized
ggcctcccaaagtgctgggagt

SEQ ID NO: 1223771 - DNA, 22 bp, Artificial Sequence
  chemically synthesized
ccgcctatactcccagcacttt

SEQ ID NO: 1223772 - DNA, 22 bp, Artificial Sequence
  chemically synthesized
acccgtctcggcctcccaaagt

SEQ ID NO: 1223773 - DNA, 22 bp, Artificial Sequence
  chemically synthesized
tactcccagcactttgggaggc

SEQ ID NO: 1223774 - DNA, 22 bp, Artificial Sequence
  chemically synthesized
ccagcactttgggaggccgaga

SEQ ID NO: 1223775 - DNA, 22 bp, Artificial Sequence
  chemically synthesized
aggtgattgacccgtctcggcc

SEQ ID NO: 1223776 - DNA, 22 bp, Artificial Sequence
  chemically synthesized
gcctcaggtgattgacccgtct

SEQ ID NO: 1223777 - DNA, 22 bp, Artificial Sequence
  chemically synthesized
tgggaggccgagacgggtcaat

SEQ ID NO: 1223778 - DNA, 22 bp, Artificial Sequence
  chemically synthesized
gggaggccgagacgggtcaatc

SEQ ID NO: 1223779 - DNA, 22 bp, Artificial Sequence
  chemically synthesized
ggaggccgagacgggtcaatca

SEQ ID NO: 1223780 - DNA, 22 bp, Artificial Sequence
  chemically synthesized
gaaatcctggcctcaggtgatt

SEQ ID NO: 1223781 - DNA, 22 bp, Artificial Sequence
  chemically synthesized
gtctcgaaatcctggcctcagg

SEQ ID NO: 1223782 - DNA, 22 bp, Artificial Sequence
  chemically synthesized
tccaggctggtctcgaaatcct

SEQ ID NO: 1223783 - DNA, 22 bp, Artificial Sequence
  chemically synthesized
aggccaggatttcgagaccagc

SEQ ID NO: 1223784 - DNA, 22 bp, Artificial Sequence
  chemically synthesized
ccatgttgtccaggctggtctc

SEQ ID NO: 1223785 - DNA, 22 bp, Artificial Sequence
  chemically synthesized
accatgttgtccaggctggtct

SEQ ID NO: 1223786 - DNA, 22 bp, Artificial Sequence
  chemically synthesized
taccatgttgtccaggctggtc

SEQ ID NO: 1223787 - DNA, 22 bp, Artificial Sequence
  chemically synthesized
cgagaccagcctggacaacatg

SEQ ID NO: 1223788 - DNA, 22 bp, Artificial Sequence
  chemically synthesized
gagaccagcctggacaacatgg

SEQ ID NO: 1223789 - DNA, 22 bp, Artificial Sequence
  chemically synthesized
gtagtgtcggggttttaccatg

SEQ ID NO: 1223790 - DNA, 22 bp, Artificial Sequence
  chemically synthesized
agtagtgtcggggttttaccat

SEQ ID NO: 1223791 - DNA, 22 bp, Artificial Sequence
  chemically synthesized
tagtagtgtcggggttttacca

SEQ ID NO: 1223792 - DNA, 22 bp, Artificial Sequence
  chemically synthesized
ttagtagtgtcggggttttacc

SEQ ID NO: 1223793 - DNA, 22 bp, Artificial Sequence
  chemically synthesized
gacaacatggtaaaaccccgac

SEQ ID NO: 1223794 - DNA, 22 bp, Artificial Sequence
  chemically synthesized
tatttttagtagtgtcggggtt

SEQ ID NO: 1223795 - DNA, 22 bp, Artificial Sequence
  chemically synthesized
gtatttttagtagtgtcggggt

SEQ ID NO: 1223796 - DNA, 22 bp, Artificial Sequence
  chemically synthesized
tgtatttttagtagtgtcgggg

SEQ ID NO: 1223797 - DNA, 22 bp, Artificial Sequence
  chemically synthesized
ttgtatttttagtagtgtcggg

SEQ ID NO: 1223798 - DNA, 22 bp, Artificial Sequence
  chemically synthesized
atttttgtatttttagtagtgt

SEQ ID NO: 1223799 - DNA, 22 bp, Artificial Sequence
  chemically synthesized
ctaatttttgtatttttagtag

SEQ ID NO: 1223800 - DNA, 22 bp, Artificial Sequence
  chemically synthesized
ctaaaaatacaaaaattagcag

SEQ ID NO: 1223801 - DNA, 22 bp, Artificial Sequence
  chemically synthesized
aaaatacaaaaattagcagggc

SEQ ID NO: 1223802 - DNA, 22 bp, Artificial Sequence
  chemically synthesized
taggcacgagccaccatgccct

SEQ ID NO: 1223803 - DNA, 22 bp, Artificial Sequence
  chemically synthesized
ggactataggcacgagccacca

SEQ ID NO: 1223804 - DNA, 22 bp, Artificial Sequence
  chemically synthesized
gcagggcatggtggctcgtgcc

SEQ ID NO: 1223805 - DNA, 22 bp, Artificial Sequence
  chemically synthesized
agtagctgggactataggcacg

SEQ ID NO: 1223806 - DNA, 22 bp, Artificial Sequence
  chemically synthesized
ctgagtagctgggactataggc

SEQ ID NO: 1223807 - DNA, 22 bp, Artificial Sequence
  chemically synthesized
agcctcctgagtagctgggact

SEQ ID NO: 1223808 - DNA, 22 bp, Artificial Sequence
  chemically synthesized
gtgcctatagtcccagctactc

SEQ ID NO: 1223809 - DNA, 22 bp, Artificial Sequence
  chemically synthesized
cctcagcctcctgagtagctgg

SEQ ID NO: 1223810 - DNA, 22 bp, Artificial Sequence
  chemically synthesized
ctgcctcagcctcctgagtagc

SEQ ID NO: 1223811 - DNA, 22 bp, Artificial Sequence
  chemically synthesized
tactgcctcagcctcctgagta

SEQ ID NO: 1223812 - DNA, 22 bp, Artificial Sequence
  chemically synthesized
tagtcccagctactcaggaggc

SEQ ID NO: 1223813 - DNA, 22 bp, Artificial Sequence
  chemically synthesized
aagcgattctactgcctcagcc

SEQ ID NO: 1223814 - DNA, 22 bp, Artificial Sequence
  chemically synthesized
ctcaggaggctgaggcagtaga

SEQ ID NO: 1223815 - DNA, 22 bp, Artificial Sequence
  chemically synthesized
aggaggctgaggcagtagaatc

SEQ ID NO: 1223816 - DNA, 22 bp, Artificial Sequence
  chemically synthesized
ccaggttcaagcgattctactg

SEQ ID NO: 1223817 - DNA, 22 bp, Artificial Sequence
  chemically synthesized
cccaggttcaagcgattctact

SEQ ID NO: 1223818 - DNA, 22 bp, Artificial Sequence
  chemically synthesized
cacttcccaggttcaagcgatt

SEQ ID NO: 1223819 - DNA, 22 bp, Artificial Sequence
  chemically synthesized
aggcagtagaatcgcttgaacc

SEQ ID NO: 1223820 - DNA, 22 bp, Artificial Sequence
  chemically synthesized
caacctccacttcccaggttca

SEQ ID NO: 1223821 - DNA, 22 bp, Artificial Sequence
  chemically synthesized
actgcaacctccacttcccagg

SEQ ID NO: 1223822 - DNA, 22 bp, Artificial Sequence
  chemically synthesized
gctcactgcaacctccacttcc

SEQ ID NO: 1223823 - DNA, 22 bp, Artificial Sequence
  chemically synthesized
ggctcactgcaacctccacttc

SEQ ID NO: 1223824 - DNA, 22 bp, Artificial Sequence
  chemically synthesized
gaacctgggaagtggaggttgc

SEQ ID NO: 1223825 - DNA, 22 bp, Artificial Sequence
  chemically synthesized
aacctgggaagtggaggttgca

SEQ ID NO: 1223826 - DNA, 22 bp, Artificial Sequence
  chemically synthesized
ggaagtggaggttgcagtgagc

SEQ ID NO: 1223827 - DNA, 22 bp, Artificial Sequence
  chemically synthesized
gagcgcagtgggccaaccttgg

SEQ ID NO: 1223828 - DNA, 22 bp, Artificial Sequence
  chemically synthesized
cagtgagccaaggttggcccac

SEQ ID NO: 1223829 - DNA, 22 bp, Artificial Sequence
  chemically synthesized
cacaggctagagcgcagtgggc

SEQ ID NO: 1223830 - DNA, 22 bp, Artificial Sequence
  chemically synthesized
ttgcacaggctagagcgcagtg

SEQ ID NO: 1223831 - DNA, 22 bp, Artificial Sequence
  chemically synthesized
tgttgcacaggctagagcgcag

SEQ ID NO: 1223832 - DNA, 22 bp, Artificial Sequence
  chemically synthesized
gctctgttgcacaggctagagc

SEQ ID NO: 1223833 - DNA, 22 bp, Artificial Sequence
  chemically synthesized
gcccactgcgctctagcctgtg

SEQ ID NO: 1223834 - DNA, 22 bp, Artificial Sequence
  chemically synthesized
cgctctagcctgtgcaacagag

SEQ ID NO: 1223835 - DNA, 22 bp, Artificial Sequence
  chemically synthesized
agacggagtctcgctctgttgc

SEQ ID NO: 1223836 - DNA, 22 bp, Artificial Sequence
  chemically synthesized
gagacggagtctcgctctgttg

SEQ ID NO: 1223837 - DNA, 22 bp, Artificial Sequence
  chemically synthesized
tgagacggagtctcgctctgtt

SEQ ID NO: 1223838 - DNA, 22 bp, Artificial Sequence
  chemically synthesized
ttgagacggagtctcgctctgt

SEQ ID NO: 1223839 - DNA, 22 bp, Artificial Sequence
  chemically synthesized
tagcctgtgcaacagagcgaga

SEQ ID NO: 1223840 - DNA, 22 bp, Artificial Sequence
  chemically synthesized
tttgagacggagtctcgctctg

SEQ ID NO: 1223841 - DNA, 22 bp, Artificial Sequence
  chemically synthesized
ttttgagacggagtctcgctct

SEQ ID NO: 1223842 - DNA, 22 bp, Artificial Sequence
  chemically synthesized
gcctgtgcaacagagcgagact

SEQ ID NO: 1223843 - DNA, 22 bp, Artificial Sequence
  chemically synthesized
tgcaacagagcgagactccgtc

SEQ ID NO: 1223844 - DNA, 22 bp, Artificial Sequence
  chemically synthesized
tgtatttttttgagacggagtc

SEQ ID NO: 1223845 - DNA, 22 bp, Artificial Sequence
  chemically synthesized
atgtatttttttgagacggagt

SEQ ID NO: 1223846 - DNA, 22 bp, Artificial Sequence
  chemically synthesized
tttatgtatttttttgagacgg

SEQ ID NO: 1223847 - DNA, 22 bp, Artificial Sequence
  chemically synthesized
atttatgtatttttttgagacg

SEQ ID NO: 1223848 - DNA, 22 bp, Artificial Sequence
  chemically synthesized
tatttatgtatttttttgagac

SEQ ID NO: 1223849 - DNA, 22 bp, Artificial Sequence
  chemically synthesized
tacctttatttatgtatttttt

SEQ ID NO: 1223850 - DNA, 22 bp, Artificial Sequence
  chemically synthesized
cgtctcaaaaaaatacataaat

SEQ ID NO: 1223851 - DNA, 22 bp, Artificial Sequence
  chemically synthesized
aaaaaaatacataaataaaggt

SEQ ID NO: 1223852 - DNA, 22 bp, Artificial Sequence
  chemically synthesized
agaagaaaccaataaacctata

SEQ ID NO: 1223853 - DNA, 22 bp, Artificial Sequence
  chemically synthesized
gagtagaagcaattaagaagaa

SEQ ID NO: 1223854 - DNA, 22 bp, Artificial Sequence
  chemically synthesized
actagagtagaagcaattaaga

SEQ ID NO: 1223855 - DNA, 22 bp, Artificial Sequence
  chemically synthesized
attggtttcttcttaattgctt

SEQ ID NO: 1223856 - DNA, 22 bp, Artificial Sequence
  chemically synthesized
ttggtttcttcttaattgcttc

SEQ ID NO: 1223857 - DNA, 22 bp, Artificial Sequence
  chemically synthesized
gtttcttcttaattgcttctac

SEQ ID NO: 1223858 - DNA, 22 bp, Artificial Sequence
  chemically synthesized
gtgtattaactagagtagaagc

SEQ ID NO: 1223859 - DNA, 22 bp, Artificial Sequence
  chemically synthesized
cttcttaattgcttctactcta

SEQ ID NO: 1223860 - DNA, 22 bp, Artificial Sequence
  chemically synthesized
tggtgtattaactagagtagaa

SEQ ID NO: 1223861 - DNA, 22 bp, Artificial Sequence
  chemically synthesized
ttcttaattgcttctactctag

SEQ ID NO: 1223862 - DNA, 22 bp, Artificial Sequence
  chemically synthesized
cttaattgcttctactctagtt

SEQ ID NO: 1223863 - DNA, 22 bp, Artificial Sequence
  chemically synthesized
ttaattgcttctactctagtta

SEQ ID NO: 1223864 - DNA, 22 bp, Artificial Sequence
  chemically synthesized
aattgcttctactctagttaat

SEQ ID NO: 1223865 - DNA, 22 bp, Artificial Sequence
  chemically synthesized
attgcttctactctagttaata

SEQ ID NO: 1223866 - DNA, 22 bp, Artificial Sequence
  chemically synthesized
taaaaattctggtgtattaact

SEQ ID NO: 1223867 - DNA, 22 bp, Artificial Sequence
  chemically synthesized
cttctactctagttaatacacc

SEQ ID NO: 1223868 - DNA, 22 bp, Artificial Sequence
  chemically synthesized
ctactctagttaatacaccaga

SEQ ID NO: 1223869 - DNA, 22 bp, Artificial Sequence
  chemically synthesized
tactctagttaatacaccagaa

SEQ ID NO: 1223870 - DNA, 22 bp, Artificial Sequence
  chemically synthesized
ataattgtaaaaattctggtgt

SEQ ID NO: 1223871 - DNA, 22 bp, Artificial Sequence
  chemically synthesized
ctctagttaatacaccagaatt

SEQ ID NO: 1223872 - DNA, 22 bp, Artificial Sequence
  chemically synthesized
ctaataattgtaaaaattctgg

SEQ ID NO: 1223873 - DNA, 22 bp, Artificial Sequence
  chemically synthesized
tagttaatacaccagaattttt

SEQ ID NO: 1223874 - DNA, 22 bp, Artificial Sequence
  chemically synthesized
cctaataattgtaaaaattctg

SEQ ID NO: 1223875 - DNA, 22 bp, Artificial Sequence
  chemically synthesized
gttaatacaccagaatttttac

SEQ ID NO: 1223876 - DNA, 22 bp, Artificial Sequence
  chemically synthesized
gatttcctaataattgtaaaaa

SEQ ID NO: 1223877 - DNA, 22 bp, Artificial Sequence
  chemically synthesized
atacaccagaatttttacaatt

SEQ ID NO: 1223878 - DNA, 22 bp, Artificial Sequence
  chemically synthesized
ttacaattattaggaaatcgaa

SEQ ID NO: 1223879 - DNA, 22 bp, Artificial Sequence
  chemically synthesized
tacaattattaggaaatcgaat

SEQ ID NO: 1223880 - DNA, 22 bp, Artificial Sequence
  chemically synthesized
acaattattaggaaatcgaatc

SEQ ID NO: 1223881 - DNA, 22 bp, Artificial Sequence
  chemically synthesized
caattattaggaaatcgaatcc

SEQ ID NO: 1223882 - DNA, 22 bp, Artificial Sequence
  chemically synthesized
gaaaatatggagggattcgatt

SEQ ID NO: 1223883 - DNA, 22 bp, Artificial Sequence
  chemically synthesized
ttaggaaatcgaatccctccat

SEQ ID NO: 1223884 - DNA, 22 bp, Artificial Sequence
  chemically synthesized
ggaaatcgaatccctccatatt

SEQ ID NO: 1223885 - DNA, 22 bp, Artificial Sequence
  chemically synthesized
ggggtattggaaaatatggagg

SEQ ID NO: 1223886 - DNA, 22 bp, Artificial Sequence
  chemically synthesized
ttaggggtattggaaaatatgg

SEQ ID NO: 1223887 - DNA, 22 bp, Artificial Sequence
  chemically synthesized
gctgttaggggtattggaaaat

SEQ ID NO: 1223888 - DNA, 22 bp, Artificial Sequence
  chemically synthesized
ttagctgttaggggtattggaa

SEQ ID NO: 1223889 - DNA, 22 bp, Artificial Sequence
  chemically synthesized
gttagctgttaggggtattgga

SEQ ID NO: 1223890 - DNA, 22 bp, Artificial Sequence
  chemically synthesized
catattttccaatacccctaac

SEQ ID NO: 1223891 - DNA, 22 bp, Artificial Sequence
  chemically synthesized
cataagcttgttagctgttagg

SEQ ID NO: 1223892 - DNA, 22 bp, Artificial Sequence
  chemically synthesized
ccataagcttgttagctgttag

SEQ ID NO: 1223893 - DNA, 22 bp, Artificial Sequence
  chemically synthesized
tccaatacccctaacagctaac

SEQ ID NO: 1223894 - DNA, 22 bp, Artificial Sequence
  chemically synthesized
ccaatacccctaacagctaaca

SEQ ID NO: 1223895 - DNA, 22 bp, Artificial Sequence
  chemically synthesized
caatacccctaacagctaacaa

SEQ ID NO: 1223896 - DNA, 22 bp, Artificial Sequence
  chemically synthesized
gtttccataagcttgttagctg

SEQ ID NO: 1223897 - DNA, 22 bp, Artificial Sequence
  chemically synthesized
acagctaacaagcttatggaaa

SEQ ID NO: 1223898 - DNA, 22 bp, Artificial Sequence
  chemically synthesized
taaataagctagtttccataag

SEQ ID NO: 1223899 - DNA, 22 bp, Artificial Sequence
  chemically synthesized
gtaaataagctagtttccataa

SEQ ID NO: 1223900 - DNA, 22 bp, Artificial Sequence
  chemically synthesized
acaagcttatggaaactagctt

SEQ ID NO: 1223901 - DNA, 22 bp, Artificial Sequence
  chemically synthesized
tccaatttgtaaataagctagt

SEQ ID NO: 1223902 - DNA, 22 bp, Artificial Sequence
  chemically synthesized
atggaaactagcttatttacaa

SEQ ID NO: 1223903 - DNA, 22 bp, Artificial Sequence
  chemically synthesized
tggaaactagcttatttacaaa

SEQ ID NO: 1223904 - DNA, 22 bp, Artificial Sequence
  chemically synthesized
ataacaaaggcattatccaatt

SEQ ID NO: 1223905 - DNA, 22 bp, Artificial Sequence
  chemically synthesized
gcttatttacaaattggataat

SEQ ID NO: 1223906 - DNA, 22 bp, Artificial Sequence
  chemically synthesized
cataacaaaggcattatccaat

SEQ ID NO: 1223907 - DNA, 22 bp, Artificial Sequence
  chemically synthesized
tcataacaaaggcattatccaa

SEQ ID NO: 1223908 - DNA, 22 bp, Artificial Sequence
  chemically synthesized
ttcataacaaaggcattatcca

SEQ ID NO: 1223909 - DNA, 22 bp, Artificial Sequence
  chemically synthesized
atttacaaattggataatgcct

SEQ ID NO: 1223910 - DNA, 22 bp, Artificial Sequence
  chemically synthesized
tttacaaattggataatgcctt

SEQ ID NO: 1223911 - DNA, 22 bp, Artificial Sequence
  chemically synthesized
acaaattggataatgcctttgt

SEQ ID NO: 1223912 - DNA, 22 bp, Artificial Sequence
  chemically synthesized
caaattggataatgcctttgtt

SEQ ID NO: 1223913 - DNA, 22 bp, Artificial Sequence
  chemically synthesized
tatatttttcataacaaaggca

SEQ ID NO: 1223914 - DNA, 22 bp, Artificial Sequence
  chemically synthesized
atatatttttcataacaaaggc

SEQ ID NO: 1223915 - DNA, 22 bp, Artificial Sequence
  chemically synthesized
tatatatttttcataacaaagg

SEQ ID NO: 1223916 - DNA, 22 bp, Artificial Sequence
  chemically synthesized
ttatatatttttcataacaaag

SEQ ID NO: 1223917 - DNA, 22 bp, Artificial Sequence
  chemically synthesized
tttatatatttttcataacaaa

SEQ ID NO: 1223918 - DNA, 22 bp, Artificial Sequence
  chemically synthesized
ttttatatatttttcataacaa

SEQ ID NO: 1223919 - DNA, 22 bp, Artificial Sequence
  chemically synthesized
gataatgcctttgttatgaaaa

SEQ ID NO: 1223920 - DNA, 22 bp, Artificial Sequence
  chemically synthesized
aatttttttatatatttttcat

SEQ ID NO: 1223921 - DNA, 22 bp, Artificial Sequence
  chemically synthesized
aaatttttttatatatttttca

SEQ ID NO: 1223922 - DNA, 22 bp, Artificial Sequence
  chemically synthesized
taaatttttttatatatttttc

SEQ ID NO: 1223923 - DNA, 22 bp, Artificial Sequence
  chemically synthesized
ttaaatttttttatatattttt

SEQ ID NO: 1223924 - DNA, 22 bp, Artificial Sequence
  chemically synthesized
tgttatgaaaaatatataaaaa

SEQ ID NO: 1223925 - DNA, 22 bp, Artificial Sequence
  chemically synthesized
gttatgaaaaatatataaaaaa

SEQ ID NO: 1223926 - DNA, 22 bp, Artificial Sequence
  chemically synthesized
caatttttaaatttttttatat

SEQ ID NO: 1223927 - DNA, 22 bp, Artificial Sequence
  chemically synthesized
ttatgaaaaatatataaaaaaa

SEQ ID NO: 1223928 - DNA, 22 bp, Artificial Sequence
  chemically synthesized
tacaatttttaaatttttttat

SEQ ID NO: 1223929 - DNA, 22 bp, Artificial Sequence
  chemically synthesized
tgaaaaatatataaaaaaattt

SEQ ID NO: 1223930 - DNA, 22 bp, Artificial Sequence
  chemically synthesized
aatattctacaatttttaaatt

SEQ ID NO: 1223931 - DNA, 22 bp, Artificial Sequence
  chemically synthesized
aaagtcccctaaatattctaca

SEQ ID NO: 1223932 - DNA, 22 bp, Artificial Sequence
  chemically synthesized
aaaagtcccctaaatattctac

SEQ ID NO: 1223933 - DNA, 22 bp, Artificial Sequence
  chemically synthesized
aaaaattgtagaatatttaggg

SEQ ID NO: 1223934 - DNA, 22 bp, Artificial Sequence
  chemically synthesized
aaaattgtagaatatttagggg

SEQ ID NO: 1223935 - DNA, 22 bp, Artificial Sequence
  chemically synthesized
tagaatatttaggggactttta

SEQ ID NO: 1223936 - DNA, 22 bp, Artificial Sequence
  chemically synthesized
aggggacttttaagttcactat

SEQ ID NO: 1223937 - DNA, 22 bp, Artificial Sequence
  chemically synthesized
ggggacttttaagttcactatg

SEQ ID NO: 1223938 - DNA, 22 bp, Artificial Sequence
  chemically synthesized
ttaagttcactatgcgcactct

SEQ ID NO: 1223939 - DNA, 22 bp, Artificial Sequence
  chemically synthesized
taagttcactatgcgcactctg

SEQ ID NO: 1223940 - DNA, 22 bp, Artificial Sequence
  chemically synthesized
aagttcactatgcgcactctgc

SEQ ID NO: 1223941 - DNA, 22 bp, Artificial Sequence
  chemically synthesized
agttcactatgcgcactctgcc

SEQ ID NO: 1223942 - DNA, 22 bp, Artificial Sequence
  chemically synthesized
actatgcgcactctgccttatc

SEQ ID NO: 1223943 - DNA, 22 bp, Artificial Sequence
  chemically synthesized
cagaaaaaaatgaagataaggc

SEQ ID NO: 1223944 - DNA, 22 bp, Artificial Sequence
  chemically synthesized
tgcgcactctgccttatcttca

SEQ ID NO: 1223945 - DNA, 22 bp, Artificial Sequence
  chemically synthesized
cctacagaaaaaaatgaagata

SEQ ID NO: 1223946 - DNA, 22 bp, Artificial Sequence
  chemically synthesized
ccattgcctacagaaaaaaatg

SEQ ID NO: 1223947 - DNA, 22 bp, Artificial Sequence
  chemically synthesized
tgccttatcttcatttttttct

SEQ ID NO: 1223948 - DNA, 22 bp, Artificial Sequence
  chemically synthesized
ccttatcttcatttttttctgt

SEQ ID NO: 1223949 - DNA, 22 bp, Artificial Sequence
  chemically synthesized
ctcccattgcctacagaaaaaa

SEQ ID NO: 1223950 - DNA, 22 bp, Artificial Sequence
  chemically synthesized
actcccattgcctacagaaaaa

SEQ ID NO: 1223951 - DNA, 22 bp, Artificial Sequence
  chemically synthesized
tactcccattgcctacagaaaa

SEQ ID NO: 1223952 - DNA, 22 bp, Artificial Sequence
  chemically synthesized
ttactcccattgcctacagaaa

SEQ ID NO: 1223953 - DNA, 22 bp, Artificial Sequence
  chemically synthesized
atcttcatttttttctgtaggc

SEQ ID NO: 1223954 - DNA, 22 bp, Artificial Sequence
  chemically synthesized
tttactcccattgcctacagaa

SEQ ID NO: 1223955 - DNA, 22 bp, Artificial Sequence
  chemically synthesized
tcttcatttttttctgtaggca

SEQ ID NO: 1223956 - DNA, 22 bp, Artificial Sequence
  chemically synthesized
ttttactcccattgcctacaga

SEQ ID NO: 1223957 - DNA, 22 bp, Artificial Sequence
  chemically synthesized
tttttactcccattgcctacag

SEQ ID NO: 1223958 - DNA, 22 bp, Artificial Sequence
  chemically synthesized
catttttttctgtaggcaatgg

SEQ ID NO: 1223959 - DNA, 22 bp, Artificial Sequence
  chemically synthesized
atttttttctgtaggcaatggg

SEQ ID NO: 1223960 - DNA, 22 bp, Artificial Sequence
  chemically synthesized
tgtcctttttttactcccattg

SEQ ID NO: 1223961 - DNA, 22 bp, Artificial Sequence
  chemically synthesized
ttttctgtaggcaatgggagta

SEQ ID NO: 1223962 - DNA, 22 bp, Artificial Sequence
  chemically synthesized
tttctgtaggcaatgggagtaa

SEQ ID NO: 1223963 - DNA, 22 bp, Artificial Sequence
  chemically synthesized
ttctgtaggcaatgggagtaaa

SEQ ID NO: 1223964 - DNA, 22 bp, Artificial Sequence
  chemically synthesized
tctgtaggcaatgggagtaaaa

SEQ ID NO: 1223965 - DNA, 22 bp, Artificial Sequence
  chemically synthesized
ctgtaggcaatgggagtaaaaa

SEQ ID NO: 1223966 - DNA, 22 bp, Artificial Sequence
  chemically synthesized
tgtaggcaatgggagtaaaaaa

SEQ ID NO: 1223967 - DNA, 22 bp, Artificial Sequence
  chemically synthesized
ccacctatgtcctttttttact

SEQ ID NO: 1223968 - DNA, 22 bp, Artificial Sequence
  chemically synthesized
taggcaatgggagtaaaaaaag

SEQ ID NO: 1223969 - DNA, 22 bp, Artificial Sequence
  chemically synthesized
atatgttcccacctatgtcctt

SEQ ID NO: 1223970 - DNA, 22 bp, Artificial Sequence
  chemically synthesized
tcatatgttcccacctatgtcc

SEQ ID NO: 1223971 - DNA, 22 bp, Artificial Sequence
  chemically synthesized
ctcatatgttcccacctatgtc

SEQ ID NO: 1223972 - DNA, 22 bp, Artificial Sequence
  chemically synthesized
gtttctcatatgttcccaccta

SEQ ID NO: 1223973 - DNA, 22 bp, Artificial Sequence
  chemically synthesized
tgccatagatgagaaaactagt

SEQ ID NO: 1223974 - DNA, 22 bp, Artificial Sequence
  chemically synthesized
tatactatgccatagatgagaa

SEQ ID NO: 1223975 - DNA, 22 bp, Artificial Sequence
  chemically synthesized
gtatactatgccatagatgaga

SEQ ID NO: 1223976 - DNA, 22 bp, Artificial Sequence
  chemically synthesized
accttgtatactatgccataga

SEQ ID NO: 1223977 - DNA, 22 bp, Artificial Sequence
  chemically synthesized
aaccttgtatactatgccatag

SEQ ID NO: 1223978 - DNA, 22 bp, Artificial Sequence
  chemically synthesized
gttttctcatctatggcatagt

SEQ ID NO: 1223979 - DNA, 22 bp, Artificial Sequence
  chemically synthesized
aatttaaccttgtatactatgc

SEQ ID NO: 1223980 - DNA, 22 bp, Artificial Sequence
  chemically synthesized
tctcatctatggcatagtatac

SEQ ID NO: 1223981 - DNA, 22 bp, Artificial Sequence
  chemically synthesized
ctcatctatggcatagtataca

SEQ ID NO: 1223982 - DNA, 22 bp, Artificial Sequence
  chemically synthesized
tcatctatggcatagtatacaa

SEQ ID NO: 1223983 - DNA, 22 bp, Artificial Sequence
  chemically synthesized
atctatggcatagtatacaagg

SEQ ID NO: 1223984 - DNA, 22 bp, Artificial Sequence
  chemically synthesized
atcatactcaatttaaccttgt

SEQ ID NO: 1223985 - DNA, 22 bp, Artificial Sequence
  chemically synthesized
tggcatagtatacaaggttaaa

SEQ ID NO: 1223986 - DNA, 22 bp, Artificial Sequence
  chemically synthesized
tcatcatactcaatttaacctt

SEQ ID NO: 1223987 - DNA, 22 bp, Artificial Sequence
  chemically synthesized
ctcatcatactcaatttaacct

SEQ ID NO: 1223988 - DNA, 22 bp, Artificial Sequence
  chemically synthesized
tctcatcatactcaatttaacc

SEQ ID NO: 1223989 - DNA, 22 bp, Artificial Sequence
  chemically synthesized
ttctcatcatactcaatttaac

SEQ ID NO: 1223990 - DNA, 22 bp, Artificial Sequence
  chemically synthesized
tttctcatcatactcaatttaa

SEQ ID NO: 1223991 - DNA, 22 bp, Artificial Sequence
  chemically synthesized
ttttctcatcatactcaattta

SEQ ID NO: 1223992 - DNA, 22 bp, Artificial Sequence
  chemically synthesized
ttttttctcatcatactcaatt

SEQ ID NO: 1223993 - DNA, 22 bp, Artificial Sequence
  chemically synthesized
aattgagtatgatgagaaaaaa

SEQ ID NO: 1223994 - DNA, 22 bp, Artificial Sequence
  chemically synthesized
agtatgatgagaaaaaagagca

SEQ ID NO: 1223995 - DNA, 22 bp, Artificial Sequence
  chemically synthesized
cttatgcattcgtgctgtattc

SEQ ID NO: 1223996 - DNA, 22 bp, Artificial Sequence
  chemically synthesized
atgcattcgtgctgtattccct

SEQ ID NO: 1223997 - DNA, 22 bp, Artificial Sequence
  chemically synthesized
tgcattcgtgctgtattccctt

SEQ ID NO: 1223998 - DNA, 22 bp, Artificial Sequence
  chemically synthesized
gtgctgtattcccttgtcttac

SEQ ID NO: 1223999 - DNA, 22 bp, Artificial Sequence
  chemically synthesized
tattcccttgtcttaccttccc

SEQ ID NO: 1224000 - DNA, 22 bp, Artificial Sequence
  chemically synthesized
gtggccaaggaaatggggaagg

SEQ ID NO: 1224001 - DNA, 22 bp, Artificial Sequence
  chemically synthesized
ccttgtcttaccttccccattt

SEQ ID NO: 1224002 - DNA, 22 bp, Artificial Sequence
  chemically synthesized
gttagtggccaaggaaatgggg

SEQ ID NO: 1224003 - DNA, 22 bp, Artificial Sequence
  chemically synthesized
gtcttaccttccccatttcctt

SEQ ID NO: 1224004 - DNA, 22 bp, Artificial Sequence
  chemically synthesized
tcttaccttccccatttccttg

SEQ ID NO: 1224005 - DNA, 22 bp, Artificial Sequence
  chemically synthesized
gttagttagtggccaaggaaat

SEQ ID NO: 1224006 - DNA, 22 bp, Artificial Sequence
  chemically synthesized
accttccccatttccttggcca

SEQ ID NO: 1224007 - DNA, 22 bp, Artificial Sequence
  chemically synthesized
ccttccccatttccttggccac

SEQ ID NO: 1224008 - DNA, 22 bp, Artificial Sequence
  chemically synthesized
agttggttagttagtggccaag

SEQ ID NO: 1224009 - DNA, 22 bp, Artificial Sequence
  chemically synthesized
ccccatttccttggccactaac

SEQ ID NO: 1224010 - DNA, 22 bp, Artificial Sequence
  chemically synthesized
cccatttccttggccactaact

SEQ ID NO: 1224011 - DNA, 22 bp, Artificial Sequence
  chemically synthesized
ccttggccactaactaaccaac

SEQ ID NO: 1224012 - DNA, 22 bp, Artificial Sequence
  chemically synthesized
cttggccactaactaaccaact

SEQ ID NO: 1224013 - DNA, 22 bp, Artificial Sequence
  chemically synthesized
ggccactaactaaccaactgag

SEQ ID NO: 1224014 - DNA, 22 bp, Artificial Sequence
  chemically synthesized
gccactaactaaccaactgagt

SEQ ID NO: 1224015 - DNA, 22 bp, Artificial Sequence
  chemically synthesized
gataagatatccacacactcag

SEQ ID NO: 1224016 - DNA, 22 bp, Artificial Sequence
  chemically synthesized
agataagatatccacacactca

SEQ ID NO: 1224017 - DNA, 22 bp, Artificial Sequence
  chemically synthesized
actaaccaactgagtgtgtgga

SEQ ID NO: 1224018 - DNA, 22 bp, Artificial Sequence
  chemically synthesized
accaactgagtgtgtggatatc

SEQ ID NO: 1224019 - DNA, 22 bp, Artificial Sequence
  chemically synthesized
tatgacttagataagatatcca

SEQ ID NO: 1224020 - DNA, 22 bp, Artificial Sequence
  chemically synthesized
agtgtgtggatatcttatctaa

SEQ ID NO: 1224021 - DNA, 22 bp, Artificial Sequence
  chemically synthesized
aaataaattatatgacttagat

SEQ ID NO: 1224022 - DNA, 22 bp, Artificial Sequence
  chemically synthesized
atctaagtcatataatttattt

SEQ ID NO: 1224023 - DNA, 22 bp, Artificial Sequence
  chemically synthesized
tctaagtcatataatttatttg

SEQ ID NO: 1224024 - DNA, 22 bp, Artificial Sequence
  chemically synthesized
agtcatataatttatttgagct

SEQ ID NO: 1224025 - DNA, 22 bp, Artificial Sequence
  chemically synthesized
aatgagaatgccaaagctcaaa

SEQ ID NO: 1224026 - DNA, 22 bp, Artificial Sequence
  chemically synthesized
gaatgagaatgccaaagctcaa

SEQ ID NO: 1224027 - DNA, 22 bp, Artificial Sequence
  chemically synthesized
tgaatgagaatgccaaagctca

SEQ ID NO: 1224028 - DNA, 22 bp, Artificial Sequence
  chemically synthesized
ttgaatgagaatgccaaagctc

SEQ ID NO: 1224029 - DNA, 22 bp, Artificial Sequence
  chemically synthesized
tttgaatgagaatgccaaagct

SEQ ID NO: 1224030 - DNA, 22 bp, Artificial Sequence
  chemically synthesized
atttgagctttggcattctcat

SEQ ID NO: 1224031 - DNA, 22 bp, Artificial Sequence
  chemically synthesized
aatgctttttgaatgagaatgc

SEQ ID NO: 1224032 - DNA, 22 bp, Artificial Sequence
  chemically synthesized
tttgagctttggcattctcatt

SEQ ID NO: 1224033 - DNA, 22 bp, Artificial Sequence
  chemically synthesized
gagctttggcattctcattcaa

SEQ ID NO: 1224034 - DNA, 22 bp, Artificial Sequence
  chemically synthesized
gttcaatgctttttgaatgaga

SEQ ID NO: 1224035 - DNA, 22 bp, Artificial Sequence
  chemically synthesized
agctttggcattctcattcaaa

SEQ ID NO: 1224036 - DNA, 22 bp, Artificial Sequence
  chemically synthesized
ggttcaatgctttttgaatgag

SEQ ID NO: 1224037 - DNA, 22 bp, Artificial Sequence
  chemically synthesized
tggttcaatgctttttgaatga

SEQ ID NO: 1224038 - DNA, 22 bp, Artificial Sequence
  chemically synthesized
ttggttcaatgctttttgaatg

SEQ ID NO: 1224039 - DNA, 22 bp, Artificial Sequence
  chemically synthesized
tggcattctcattcaaaaagca

SEQ ID NO: 1224040 - DNA, 22 bp, Artificial Sequence
  chemically synthesized
ggcattctcattcaaaaagcat

SEQ ID NO: 1224041 - DNA, 22 bp, Artificial Sequence
  chemically synthesized
gcattctcattcaaaaagcatt

SEQ ID NO: 1224042 - DNA, 22 bp, Artificial Sequence
  chemically synthesized
aaaggccttttggttcaatgct

SEQ ID NO: 1224043 - DNA, 22 bp, Artificial Sequence
  chemically synthesized
tcattcaaaaagcattgaacca

SEQ ID NO: 1224044 - DNA, 22 bp, Artificial Sequence
  chemically synthesized
attcaaaaagcattgaaccaaa

SEQ ID NO: 1224045 - DNA, 22 bp, Artificial Sequence
  chemically synthesized
aaaaagcattgaaccaaaaggc

SEQ ID NO: 1224046 - DNA, 22 bp, Artificial Sequence
  chemically synthesized
gacgtgacctcaaaggcctttt

SEQ ID NO: 1224047 - DNA, 22 bp, Artificial Sequence
  chemically synthesized
atgctagacgtgacctcaaagg

SEQ ID NO: 1224048 - DNA, 22 bp, Artificial Sequence
  chemically synthesized
aatgctagacgtgacctcaaag

SEQ ID NO: 1224049 - DNA, 22 bp, Artificial Sequence
  chemically synthesized
aaccaaaaggcctttgaggtca

SEQ ID NO: 1224050 - DNA, 22 bp, Artificial Sequence
  chemically synthesized
taatgctagacgtgacctcaaa

SEQ ID NO: 1224051 - DNA, 22 bp, Artificial Sequence
  chemically synthesized
ttaatgctagacgtgacctcaa

SEQ ID NO: 1224052 - DNA, 22 bp, Artificial Sequence
  chemically synthesized
atttttaatgctagacgtgacc

SEQ ID NO: 1224053 - DNA, 22 bp, Artificial Sequence
  chemically synthesized
aattcatttttaatgctagacg

SEQ ID NO: 1224054 - DNA, 22 bp, Artificial Sequence
  chemically synthesized
tgaggtcacgtctagcattaaa

SEQ ID NO: 1224055 - DNA, 22 bp, Artificial Sequence
  chemically synthesized
gaggtcacgtctagcattaaaa

SEQ ID NO: 1224056 - DNA, 22 bp, Artificial Sequence
  chemically synthesized
aggtcacgtctagcattaaaaa

SEQ ID NO: 1224057 - DNA, 22 bp, Artificial Sequence
  chemically synthesized
atagtataaaagaattcaattc

SEQ ID NO: 1224058 - DNA, 22 bp, Artificial Sequence
  chemically synthesized
gcattaaaaatgaattgaattc

SEQ ID NO: 1224059 - DNA, 22 bp, Artificial Sequence
  chemically synthesized
aatagtataaaagaattcaatt

SEQ ID NO: 1224060 - DNA, 22 bp, Artificial Sequence
  chemically synthesized
taatagtataaaagaattcaat

SEQ ID NO: 1224061 - DNA, 22 bp, Artificial Sequence
  chemically synthesized
attttaatagtataaaagaatt

SEQ ID NO: 1224062 - DNA, 22 bp, Artificial Sequence
  chemically synthesized
aaaatgaattgaattcttttat

SEQ ID NO: 1224063 - DNA, 22 bp, Artificial Sequence
  chemically synthesized
attaattttaatagtataaaag

SEQ ID NO: 1224064 - DNA, 22 bp, Artificial Sequence
  chemically synthesized
aattcttttatactattaaaat

SEQ ID NO: 1224065 - DNA, 22 bp, Artificial Sequence
  chemically synthesized
aaatgttaattaattttaatag

SEQ ID NO: 1224066 - DNA, 22 bp, Artificial Sequence
  chemically synthesized
aaaatgttaattaattttaata

SEQ ID NO: 1224067 - DNA, 22 bp, Artificial Sequence
  chemically synthesized
ttttatactattaaaattaatt

SEQ ID NO: 1224068 - DNA, 22 bp, Artificial Sequence
  chemically synthesized
ttatactattaaaattaattaa

SEQ ID NO: 1224069 - DNA, 22 bp, Artificial Sequence
  chemically synthesized
tatactattaaaattaattaac

SEQ ID NO: 1224070 - DNA, 22 bp, Artificial Sequence
  chemically synthesized
atactattaaaattaattaaca

SEQ ID NO: 1224071 - DNA, 22 bp, Artificial Sequence
  chemically synthesized
tactattaaaattaattaacat

SEQ ID NO: 1224072 - DNA, 22 bp, Artificial Sequence
  chemically synthesized
ttaaaattaattaacattttaa

SEQ ID NO: 1224073 - DNA, 22 bp, Artificial Sequence
  chemically synthesized
aaagtcatagatatttaaaatg

SEQ ID NO: 1224074 - DNA, 22 bp, Artificial Sequence
  chemically synthesized
aaattaattaacattttaaata

SEQ ID NO: 1224075 - DNA, 22 bp, Artificial Sequence
  chemically synthesized
gaaagtcatagatatttaaaat

SEQ ID NO: 1224076 - DNA, 22 bp, Artificial Sequence
  chemically synthesized
attaacattttaaatatctatg

SEQ ID NO: 1224077 - DNA, 22 bp, Artificial Sequence
  chemically synthesized
tgcatttgaaagtcatagatat

SEQ ID NO: 1224078 - DNA, 22 bp, Artificial Sequence
  chemically synthesized
atgcatttgaaagtcatagata

SEQ ID NO: 1224079 - DNA, 22 bp, Artificial Sequence
  chemically synthesized
tatgcatttgaaagtcatagat

SEQ ID NO: 1224080 - DNA, 22 bp, Artificial Sequence
  chemically synthesized
acattttaaatatctatgactt

SEQ ID NO: 1224081 - DNA, 22 bp, Artificial Sequence
  chemically synthesized
ttatgcatttgaaagtcataga

SEQ ID NO: 1224082 - DNA, 22 bp, Artificial Sequence
  chemically synthesized
taaatatctatgactttcaaat

SEQ ID NO: 1224083 - DNA, 22 bp, Artificial Sequence
  chemically synthesized
caatttttatgcatttgaaagt

SEQ ID NO: 1224084 - DNA, 22 bp, Artificial Sequence
  chemically synthesized
aaatatctatgactttcaaatg

SEQ ID NO: 1224085 - DNA, 22 bp, Artificial Sequence
  chemically synthesized
acaatttttatgcatttgaaag

SEQ ID NO: 1224086 - DNA, 22 bp, Artificial Sequence
  chemically synthesized
aatatctatgactttcaaatgc

SEQ ID NO: 1224087 - DNA, 22 bp, Artificial Sequence
  chemically synthesized
tacaatttttatgcatttgaaa

SEQ ID NO: 1224088 - DNA, 22 bp, Artificial Sequence
  chemically synthesized
gttttacaatttttatgcattt

SEQ ID NO: 1224089 - DNA, 22 bp, Artificial Sequence
  chemically synthesized
tgactttcaaatgcataaaaat

SEQ ID NO: 1224090 - DNA, 22 bp, Artificial Sequence
  chemically synthesized
gttagttttacaatttttatgc

SEQ ID NO: 1224091 - DNA, 22 bp, Artificial Sequence
  chemically synthesized
tcaaatgcataaaaattgtaaa

SEQ ID NO: 1224092 - DNA, 22 bp, Artificial Sequence
  chemically synthesized
caaatgcataaaaattgtaaaa

SEQ ID NO: 1224093 - DNA, 22 bp, Artificial Sequence
  chemically synthesized
atagttggttagttttacaatt

SEQ ID NO: 1224094 - DNA, 22 bp, Artificial Sequence
  chemically synthesized
aaatgcataaaaattgtaaaac

SEQ ID NO: 1224095 - DNA, 22 bp, Artificial Sequence
  chemically synthesized
catagttggttagttttacaat

SEQ ID NO: 1224096 - DNA, 22 bp, Artificial Sequence
  chemically synthesized
cttcatagttggttagttttac

SEQ ID NO: 1224097 - DNA, 22 bp, Artificial Sequence
  chemically synthesized
ccttcatagttggttagtttta

SEQ ID NO: 1224098 - DNA, 22 bp, Artificial Sequence
  chemically synthesized
tgtgggtttccttcatagttgg

SEQ ID NO: 1224099 - DNA, 22 bp, Artificial Sequence
  chemically synthesized
taaaactaaccaactatgaagg

SEQ ID NO: 1224100 - DNA, 22 bp, Artificial Sequence
  chemically synthesized
aatgctgtgtgggtttccttca

SEQ ID NO: 1224101 - DNA, 22 bp, Artificial Sequence
  chemically synthesized
accaactatgaaggaaacccac

SEQ ID NO: 1224102 - DNA, 22 bp, Artificial Sequence
  chemically synthesized
acattaaatgctgtgtgggttt

SEQ ID NO: 1224103 - DNA, 22 bp, Artificial Sequence
  chemically synthesized
tgaaggaaacccacacagcatt

SEQ ID NO: 1224104 - DNA, 22 bp, Artificial Sequence
  chemically synthesized
tggtccaggttaacattaaatg

SEQ ID NO: 1224105 - DNA, 22 bp, Artificial Sequence
  chemically synthesized
caagtcaataaattatggtcca

SEQ ID NO: 1224106 - DNA, 22 bp, Artificial Sequence
  chemically synthesized
aatgttaacctggaccataatt

SEQ ID NO: 1224107 - DNA, 22 bp, Artificial Sequence
  chemically synthesized
atgttaacctggaccataattt

SEQ ID NO: 1224108 - DNA, 22 bp, Artificial Sequence
  chemically synthesized
gttgcaagtcaataaattatgg

SEQ ID NO: 1224109 - DNA, 22 bp, Artificial Sequence
  chemically synthesized
ggttgcaagtcaataaattatg

SEQ ID NO: 1224110 - DNA, 22 bp, Artificial Sequence
  chemically synthesized
acctggaccataatttattgac

SEQ ID NO: 1224111 - DNA, 22 bp, Artificial Sequence
  chemically synthesized
gaccataatttattgacttgca

SEQ ID NO: 1224112 - DNA, 22 bp, Artificial Sequence
  chemically synthesized
gtgatccttggttgcaagtcaa

SEQ ID NO: 1224113 - DNA, 22 bp, Artificial Sequence
  chemically synthesized
aaaatctggtgatccttggttg

SEQ ID NO: 1224114 - DNA, 22 bp, Artificial Sequence
  chemically synthesized
attgacttgcaaccaaggatca

SEQ ID NO: 1224115 - DNA, 22 bp, Artificial Sequence
  chemically synthesized
ttgacttgcaaccaaggatcac

SEQ ID NO: 1224116 - DNA, 22 bp, Artificial Sequence
  chemically synthesized
attaaaaatctggtgatccttg

SEQ ID NO: 1224117 - DNA, 22 bp, Artificial Sequence
  chemically synthesized
aattaaaaatctggtgatcctt

SEQ ID NO: 1224118 - DNA, 22 bp, Artificial Sequence
  chemically synthesized
acttgcaaccaaggatcaccag

SEQ ID NO: 1224119 - DNA, 22 bp, Artificial Sequence
  chemically synthesized
atttaattaaaaatctggtgat

SEQ ID NO: 1224120 - DNA, 22 bp, Artificial Sequence
  chemically synthesized
gcaaccaaggatcaccagattt

SEQ ID NO: 1224121 - DNA, 22 bp, Artificial Sequence
  chemically synthesized
caaccaaggatcaccagatttt

SEQ ID NO: 1224122 - DNA, 22 bp, Artificial Sequence
  chemically synthesized
atcatggtgttgatttaattaa

SEQ ID NO: 1224123 - DNA, 22 bp, Artificial Sequence
  chemically synthesized
tcctaatcatggtgttgattta

SEQ ID NO: 1224124 - DNA, 22 bp, Artificial Sequence
  chemically synthesized
cactatcctaatcatggtgttg

SEQ ID NO: 1224125 - DNA, 22 bp, Artificial Sequence
  chemically synthesized
acactatcctaatcatggtgtt

SEQ ID NO: 1224126 - DNA, 22 bp, Artificial Sequence
  chemically synthesized
ttaattaaatcaacaccatgat

SEQ ID NO: 1224127 - DNA, 22 bp, Artificial Sequence
  chemically synthesized
taattaaatcaacaccatgatt

SEQ ID NO: 1224128 - DNA, 22 bp, Artificial Sequence
  chemically synthesized
aattaaatcaacaccatgatta

SEQ ID NO: 1224129 - DNA, 22 bp, Artificial Sequence
  chemically synthesized
attaaatcaacaccatgattag

SEQ ID NO: 1224130 - DNA, 22 bp, Artificial Sequence
  chemically synthesized
aatttacactatcctaatcatg

SEQ ID NO: 1224131 - DNA, 22 bp, Artificial Sequence
  chemically synthesized
aaatttacactatcctaatcat

SEQ ID NO: 1224132 - DNA, 22 bp, Artificial Sequence
  chemically synthesized
aatcaacaccatgattaggata

SEQ ID NO: 1224133 - DNA, 22 bp, Artificial Sequence
  chemically synthesized
ggatttaaatttacactatcct

SEQ ID NO: 1224134 - DNA, 22 bp, Artificial Sequence
  chemically synthesized
ggatagtgtaaatttaaatcct

SEQ ID NO: 1224135 - DNA, 22 bp, Artificial Sequence
  chemically synthesized
acatgtggtagagctaggattt

SEQ ID NO: 1224136 - DNA, 22 bp, Artificial Sequence
  chemically synthesized
gctaacatgtggtagagctagg

SEQ ID NO: 1224137 - DNA, 22 bp, Artificial Sequence
  chemically synthesized
ggctaacatgtggtagagctag

SEQ ID NO: 1224138 - DNA, 22 bp, Artificial Sequence
  chemically synthesized
tttggctaacatgtggtagagc

SEQ ID NO: 1224139 - DNA, 22 bp, Artificial Sequence
  chemically synthesized
aaatcctagctctaccacatgt

SEQ ID NO: 1224140 - DNA, 22 bp, Artificial Sequence
  chemically synthesized
aatcctagctctaccacatgtt

SEQ ID NO: 1224141 - DNA, 22 bp, Artificial Sequence
  chemically synthesized
aaactgtttggctaacatgtgg

SEQ ID NO: 1224142 - DNA, 22 bp, Artificial Sequence
  chemically synthesized
cctaaaactgtttggctaacat

SEQ ID NO: 1224143 - DNA, 22 bp, Artificial Sequence
  chemically synthesized
acctaaaactgtttggctaaca

SEQ ID NO: 1224144 - DNA, 22 bp, Artificial Sequence
  chemically synthesized
gctctaccacatgttagccaaa

SEQ ID NO: 1224145 - DNA, 22 bp, Artificial Sequence
  chemically synthesized
taccacatgttagccaaacagt

SEQ ID NO: 1224146 - DNA, 22 bp, Artificial Sequence
  chemically synthesized
ccacatgttagccaaacagttt

SEQ ID NO: 1224147 - DNA, 22 bp, Artificial Sequence
  chemically synthesized
cgtaatttacctaaaactgttt

SEQ ID NO: 1224148 - DNA, 22 bp, Artificial Sequence
  chemically synthesized
gccaaacagttttaggtaaatt

SEQ ID NO: 1224149 - DNA, 22 bp, Artificial Sequence
  chemically synthesized
agtcatagagaggttacgtaat

SEQ ID NO: 1224150 - DNA, 22 bp, Artificial Sequence
  chemically synthesized
taggtaaattacgtaacctctc

SEQ ID NO: 1224151 - DNA, 22 bp, Artificial Sequence
  chemically synthesized
aggtaaattacgtaacctctct

SEQ ID NO: 1224152 - DNA, 22 bp, Artificial Sequence
  chemically synthesized
ggtaaattacgtaacctctcta

SEQ ID NO: 1224153 - DNA, 22 bp, Artificial Sequence
  chemically synthesized
cgtaacctctctatgactcaat

SEQ ID NO: 1224154 - DNA, 22 bp, Artificial Sequence
  chemically synthesized
acaaatagataaattgagtcat

SEQ ID NO: 1224155 - DNA, 22 bp, Artificial Sequence
  chemically synthesized
cccatctcacaaatagataaat

SEQ ID NO: 1224156 - DNA, 22 bp, Artificial Sequence
  chemically synthesized
tctatgactcaatttatctatt

SEQ ID NO: 1224157 - DNA, 22 bp, Artificial Sequence
  chemically synthesized
acccatctcacaaatagataaa

SEQ ID NO: 1224158 - DNA, 22 bp, Artificial Sequence
  chemically synthesized
tacccatctcacaaatagataa

SEQ ID NO: 1224159 - DNA, 22 bp, Artificial Sequence
  chemically synthesized
tatgactcaatttatctatttg

SEQ ID NO: 1224160 - DNA, 22 bp, Artificial Sequence
  chemically synthesized
tgactcaatttatctatttgtg

SEQ ID NO: 1224161 - DNA, 22 bp, Artificial Sequence
  chemically synthesized
tcattttacccatctcacaaat

SEQ ID NO: 1224162 - DNA, 22 bp, Artificial Sequence
  chemically synthesized
aatttatctatttgtgagatgg

SEQ ID NO: 1224163 - DNA, 22 bp, Artificial Sequence
  chemically synthesized
atctatttgtgagatgggtaaa

SEQ ID NO: 1224164 - DNA, 22 bp, Artificial Sequence
  chemically synthesized
tctatttgtgagatgggtaaaa

SEQ ID NO: 1224165 - DNA, 22 bp, Artificial Sequence
  chemically synthesized
tttgtgagatgggtaaaatgac

SEQ ID NO: 1224166 - DNA, 22 bp, Artificial Sequence
  chemically synthesized
gtgagatgggtaaaatgacagc

SEQ ID NO: 1224167 - DNA, 22 bp, Artificial Sequence
  chemically synthesized
catgacgtagatgctgtcattt

SEQ ID NO: 1224168 - DNA, 22 bp, Artificial Sequence
  chemically synthesized
tgagatgggtaaaatgacagca

SEQ ID NO: 1224169 - DNA, 22 bp, Artificial Sequence
  chemically synthesized
aatcaagttccatgacgtagat

SEQ ID NO: 1224170 - DNA, 22 bp, Artificial Sequence
  chemically synthesized
ggtaaaatattcaatcaagttc

SEQ ID NO: 1224171 - DNA, 22 bp, Artificial Sequence
  chemically synthesized
taggtaaaatattcaatcaagt

SEQ ID NO: 1224172 - DNA, 22 bp, Artificial Sequence
  chemically synthesized
cgtcatggaacttgattgaata

SEQ ID NO: 1224173 - DNA, 22 bp, Artificial Sequence
  chemically synthesized
tagacaccgttctaggtaaaat

SEQ ID NO: 1224174 - DNA, 22 bp, Artificial Sequence
  chemically synthesized
gtagacaccgttctaggtaaaa

SEQ ID NO: 1224175 - DNA, 22 bp, Artificial Sequence
  chemically synthesized
tgtagacaccgttctaggtaaa

SEQ ID NO: 1224176 - DNA, 22 bp, Artificial Sequence
  chemically synthesized
gattgaatattttacctagaac

SEQ ID NO: 1224177 - DNA, 22 bp, Artificial Sequence
  chemically synthesized
attgaatattttacctagaacg

SEQ ID NO: 1224178 - DNA, 22 bp, Artificial Sequence
  chemically synthesized
ttttgtagacaccgttctaggt

SEQ ID NO: 1224179 - DNA, 22 bp, Artificial Sequence
  chemically synthesized
ttattttgtagacaccgttcta

SEQ ID NO: 1224180 - DNA, 22 bp, Artificial Sequence
  chemically synthesized
aatattttacctagaacggtgt

SEQ ID NO: 1224181 - DNA, 22 bp, Artificial Sequence
  chemically synthesized
tacctagaacggtgtctacaaa

SEQ ID NO: 1224182 - DNA, 22 bp, Artificial Sequence
  chemically synthesized
aacaattattattttgtagaca

SEQ ID NO: 1224183 - DNA, 22 bp, Artificial Sequence
  chemically synthesized
acctagaacggtgtctacaaaa

SEQ ID NO: 1224184 - DNA, 22 bp, Artificial Sequence
  chemically synthesized
aaacaattattattttgtagac

SEQ ID NO: 1224185 - DNA, 22 bp, Artificial Sequence
  chemically synthesized
cctagaacggtgtctacaaaat

SEQ ID NO: 1224186 - DNA, 22 bp, Artificial Sequence
  chemically synthesized
taaacaattattattttgtaga

SEQ ID NO: 1224187 - DNA, 22 bp, Artificial Sequence
  chemically synthesized
ttaaacaattattattttgtag

SEQ ID NO: 1224188 - DNA, 22 bp, Artificial Sequence
  chemically synthesized
gaacggtgtctacaaaataata

SEQ ID NO: 1224189 - DNA, 22 bp, Artificial Sequence
  chemically synthesized
caaaataataattgtttaaaaa

SEQ ID NO: 1224190 - DNA, 22 bp, Artificial Sequence
  chemically synthesized
cagcaaaataatagaaacgaat

SEQ ID NO: 1224191 - DNA, 22 bp, Artificial Sequence
  chemically synthesized
tttaaaaacattcgtttctatt

SEQ ID NO: 1224192 - DNA, 22 bp, Artificial Sequence
  chemically synthesized
aaaaacattcgtttctattatt

SEQ ID NO: 1224193 - DNA, 22 bp, Artificial Sequence
  chemically synthesized
acattacagcaaaataatagaa

SEQ ID NO: 1224194 - DNA, 22 bp, Artificial Sequence
  chemically synthesized
aaaacattcgtttctattattt

SEQ ID NO: 1224195 - DNA, 22 bp, Artificial Sequence
  chemically synthesized
gtttctattattttgctgtaat

SEQ ID NO: 1224196 - DNA, 22 bp, Artificial Sequence
  chemically synthesized
ctattattttgctgtaatgtta

SEQ ID NO: 1224197 - DNA, 22 bp, Artificial Sequence
  chemically synthesized
tataaatgtaattaacattaca

SEQ ID NO: 1224198 - DNA, 22 bp, Artificial Sequence
  chemically synthesized
tattattttgctgtaatgttaa

SEQ ID NO: 1224199 - DNA, 22 bp, Artificial Sequence
  chemically synthesized
atataaatgtaattaacattac

SEQ ID NO: 1224200 - DNA, 22 bp, Artificial Sequence
  chemically synthesized
ttattttgctgtaatgttaatt

SEQ ID NO: 1224201 - DNA, 22 bp, Artificial Sequence
  chemically synthesized
ttatataaatgtaattaacatt

SEQ ID NO: 1224202 - DNA, 22 bp, Artificial Sequence
  chemically synthesized
cttatataaatgtaattaacat

SEQ ID NO: 1224203 - DNA, 22 bp, Artificial Sequence
  chemically synthesized
ttttgctgtaatgttaattaca

SEQ ID NO: 1224204 - DNA, 22 bp, Artificial Sequence
  chemically synthesized
ttcttatataaatgtaattaac

SEQ ID NO: 1224205 - DNA, 22 bp, Artificial Sequence
  chemically synthesized
tgctgtaatgttaattacattt

SEQ ID NO: 1224206 - DNA, 22 bp, Artificial Sequence
  chemically synthesized
gctgtaatgttaattacattta

SEQ ID NO: 1224207 - DNA, 22 bp, Artificial Sequence
  chemically synthesized
ctgtaatgttaattacatttat

SEQ ID NO: 1224208 - DNA, 22 bp, Artificial Sequence
  chemically synthesized
taatgttaattacatttatata

SEQ ID NO: 1224209 - DNA, 22 bp, Artificial Sequence
  chemically synthesized
aaaatacatcactcttcttata

SEQ ID NO: 1224210 - DNA, 22 bp, Artificial Sequence
  chemically synthesized
attacatttatataagaagagt

SEQ ID NO: 1224211 - DNA, 22 bp, Artificial Sequence
  chemically synthesized
catttatataagaagagtgatg

SEQ ID NO: 1224212 - DNA, 22 bp, Artificial Sequence
  chemically synthesized
taaattgaaaatacatcactct

SEQ ID NO: 1224213 - DNA, 22 bp, Artificial Sequence
  chemically synthesized
atataagaagagtgatgtattt

SEQ ID NO: 1224214 - DNA, 22 bp, Artificial Sequence
  chemically synthesized
tataagaagagtgatgtatttt

SEQ ID NO: 1224215 - DNA, 22 bp, Artificial Sequence
  chemically synthesized
agtctgtaaattgaaaatacat

SEQ ID NO: 1224216 - DNA, 22 bp, Artificial Sequence
  chemically synthesized
gagtctgtaaattgaaaataca

SEQ ID NO: 1224217 - DNA, 22 bp, Artificial Sequence
  chemically synthesized
gcttgagtctgtaaattgaaaa

SEQ ID NO: 1224218 - DNA, 22 bp, Artificial Sequence
  chemically synthesized
ggcttgagtctgtaaattgaaa

SEQ ID NO: 1224219 - DNA, 22 bp, Artificial Sequence
  chemically synthesized
tggcttgagtctgtaaattgaa

SEQ ID NO: 1224220 - DNA, 22 bp, Artificial Sequence
  chemically synthesized
ttggcttgagtctgtaaattga

SEQ ID NO: 1224221 - DNA, 22 bp, Artificial Sequence
  chemically synthesized
tcaatttacagactcaagccaa

SEQ ID NO: 1224222 - DNA, 22 bp, Artificial Sequence
  chemically synthesized
caatttacagactcaagccaaa

SEQ ID NO: 1224223 - DNA, 22 bp, Artificial Sequence
  chemically synthesized
aatttacagactcaagccaaaa

SEQ ID NO: 1224224 - DNA, 22 bp, Artificial Sequence
  chemically synthesized
taaagataggtgtttttggctt

SEQ ID NO: 1224225 - DNA, 22 bp, Artificial Sequence
  chemically synthesized
tgtaaagataggtgtttttggc

SEQ ID NO: 1224226 - DNA, 22 bp, Artificial Sequence
  chemically synthesized
acagactcaagccaaaaacacc

SEQ ID NO: 1224227 - DNA, 22 bp, Artificial Sequence
  chemically synthesized
cagactcaagccaaaaacacct

SEQ ID NO: 1224228 - DNA, 22 bp, Artificial Sequence
  chemically synthesized
tatcagttctgtaaagataggt

SEQ ID NO: 1224229 - DNA, 22 bp, Artificial Sequence
  chemically synthesized
aagccaaaaacacctatcttta

SEQ ID NO: 1224230 - DNA, 22 bp, Artificial Sequence
  chemically synthesized
atatcagttctgtaaagatagg

SEQ ID NO: 1224231 - DNA, 22 bp, Artificial Sequence
  chemically synthesized
taacatttatatcagttctgta

SEQ ID NO: 1224232 - DNA, 22 bp, Artificial Sequence
  chemically synthesized
gtaacatttatatcagttctgt

SEQ ID NO: 1224233 - DNA, 22 bp, Artificial Sequence
  chemically synthesized
tctttacagaactgatataaat

SEQ ID NO: 1224234 - DNA, 22 bp, Artificial Sequence
  chemically synthesized
tacagaactgatataaatgtta

SEQ ID NO: 1224235 - DNA, 22 bp, Artificial Sequence
  chemically synthesized
acagaactgatataaatgttac

SEQ ID NO: 1224236 - DNA, 22 bp, Artificial Sequence
  chemically synthesized
cagaactgatataaatgttaca

SEQ ID NO: 1224237 - DNA, 22 bp, Artificial Sequence
  chemically synthesized
catcagtagtatttgtaacatt

SEQ ID NO: 1224238 - DNA, 22 bp, Artificial Sequence
  chemically synthesized
gcatcagtagtatttgtaacat

SEQ ID NO: 1224239 - DNA, 22 bp, Artificial Sequence
  chemically synthesized
tttgcatcagtagtatttgtaa

SEQ ID NO: 1224240 - DNA, 22 bp, Artificial Sequence
  chemically synthesized
tgtttgcatcagtagtatttgt

SEQ ID NO: 1224241 - DNA, 22 bp, Artificial Sequence
  chemically synthesized
atataaatgttacaaatactac

SEQ ID NO: 1224242 - DNA, 22 bp, Artificial Sequence
  chemically synthesized
cattctgtttgcatcagtagta

SEQ ID NO: 1224243 - DNA, 22 bp, Artificial Sequence
  chemically synthesized
ggattacattctgtttgcatca

SEQ ID NO: 1224244 - DNA, 22 bp, Artificial Sequence
  chemically synthesized
cggattacattctgtttgcatc

SEQ ID NO: 1224245 - DNA, 22 bp, Artificial Sequence
  chemically synthesized
caaatactactgatgcaaacag

SEQ ID NO: 1224246 - DNA, 22 bp, Artificial Sequence
  chemically synthesized
ccatttcggattacattctgtt

SEQ ID NO: 1224247 - DNA, 22 bp, Artificial Sequence
  chemically synthesized
ctgatgcaaacagaatgtaatc

SEQ ID NO: 1224248 - DNA, 22 bp, Artificial Sequence
  chemically synthesized
cacctcccatttcggattacat

SEQ ID NO: 1224249 - DNA, 22 bp, Artificial Sequence
  chemically synthesized
atgcaaacagaatgtaatccga

SEQ ID NO: 1224250 - DNA, 22 bp, Artificial Sequence
  chemically synthesized
tccacctcccatttcggattac

SEQ ID NO: 1224251 - DNA, 22 bp, Artificial Sequence
  chemically synthesized
ctccacctcccatttcggatta

SEQ ID NO: 1224252 - DNA, 22 bp, Artificial Sequence
  chemically synthesized
ttctccacctcccatttcggat

SEQ ID NO: 1224253 - DNA, 22 bp, Artificial Sequence
  chemically synthesized
gcctcttctccacctcccattt

SEQ ID NO: 1224254 - DNA, 22 bp, Artificial Sequence
  chemically synthesized
tcgcctcttctccacctcccat

SEQ ID NO: 1224255 - DNA, 22 bp, Artificial Sequence
  chemically synthesized
ctctcgcctcttctccacctcc

SEQ ID NO: 1224256 - DNA, 22 bp, Artificial Sequence
  chemically synthesized
actctcgcctcttctccacctc

SEQ ID NO: 1224257 - DNA, 22 bp, Artificial Sequence
  chemically synthesized
ttactctcgcctcttctccacc

SEQ ID NO: 1224258 - DNA, 22 bp, Artificial Sequence
  chemically synthesized
accaatatgaaaaacgagaaaa

SEQ ID NO: 1224259 - DNA, 22 bp, Artificial Sequence
  chemically synthesized
gaccaatatgaaaaacgagaaa

SEQ ID NO: 1224260 - DNA, 22 bp, Artificial Sequence
  chemically synthesized
tgaccaatatgaaaaacgagaa

SEQ ID NO: 1224261 - DNA, 22 bp, Artificial Sequence
  chemically synthesized
ttgaccaatatgaaaaacgaga

SEQ ID NO: 1224262 - DNA, 22 bp, Artificial Sequence
  chemically synthesized
gaaaggaacttttgaccaatat

SEQ ID NO: 1224263 - DNA, 22 bp, Artificial Sequence
  chemically synthesized
tctcgtttttcatattggtcaa

SEQ ID NO: 1224264 - DNA, 22 bp, Artificial Sequence
  chemically synthesized
agaaaggaacttttgaccaata

SEQ ID NO: 1224265 - DNA, 22 bp, Artificial Sequence
  chemically synthesized
ctcgtttttcatattggtcaaa

SEQ ID NO: 1224266 - DNA, 22 bp, Artificial Sequence
  chemically synthesized
tcgtttttcatattggtcaaaa

SEQ ID NO: 1224267 - DNA, 22 bp, Artificial Sequence
  chemically synthesized
gtttttcatattggtcaaaagt

SEQ ID NO: 1224268 - DNA, 22 bp, Artificial Sequence
  chemically synthesized
ttcatattggtcaaaagttcct

SEQ ID NO: 1224269 - DNA, 22 bp, Artificial Sequence
  chemically synthesized
ccaagtttagaaaggaactttt

SEQ ID NO: 1224270 - DNA, 22 bp, Artificial Sequence
  chemically synthesized
tcatattggtcaaaagttcctt

SEQ ID NO: 1224271 - DNA, 22 bp, Artificial Sequence
  chemically synthesized
accaagtttagaaaggaacttt

SEQ ID NO: 1224272 - DNA, 22 bp, Artificial Sequence
  chemically synthesized
catattggtcaaaagttccttt

SEQ ID NO: 1224273 - DNA, 22 bp, Artificial Sequence
  chemically synthesized
taccaagtttagaaaggaactt

SEQ ID NO: 1224274 - DNA, 22 bp, Artificial Sequence
  chemically synthesized
atattggtcaaaagttcctttc

SEQ ID NO: 1224275 - DNA, 22 bp, Artificial Sequence
  chemically synthesized
ttaccaagtttagaaaggaact

SEQ ID NO: 1224276 - DNA, 22 bp, Artificial Sequence
  chemically synthesized
aatttttaccaagtttagaaag

SEQ ID NO: 1224277 - DNA, 22 bp, Artificial Sequence
  chemically synthesized
gtcaaaagttcctttctaaact

SEQ ID NO: 1224278 - DNA, 22 bp, Artificial Sequence
  chemically synthesized
aaatttttaccaagtttagaaa

SEQ ID NO: 1224279 - DNA, 22 bp, Artificial Sequence
  chemically synthesized
taaatttttaccaagtttagaa

SEQ ID NO: 1224280 - DNA, 22 bp, Artificial Sequence
  chemically synthesized
attttaaatttttaccaagttt

SEQ ID NO: 1224281 - DNA, 22 bp, Artificial Sequence
  chemically synthesized
ctttctaaacttggtaaaaatt

SEQ ID NO: 1224282 - DNA, 22 bp, Artificial Sequence
  chemically synthesized
tctaaacttggtaaaaatttaa

SEQ ID NO: 1224283 - DNA, 22 bp, Artificial Sequence
  chemically synthesized
ctaaacttggtaaaaatttaaa

SEQ ID NO: 1224284 - DNA, 22 bp, Artificial Sequence
  chemically synthesized
taaacttggtaaaaatttaaaa

SEQ ID NO: 1224285 - DNA, 22 bp, Artificial Sequence
  chemically synthesized
aacttggtaaaaatttaaaatg

SEQ ID NO: 1224286 - DNA, 22 bp, Artificial Sequence
  chemically synthesized
ggtaaaaatttaaaatgaggta

SEQ ID NO: 1224287 - DNA, 22 bp, Artificial Sequence
  chemically synthesized
gtaaaaatttaaaatgaggtat

SEQ ID NO: 1224288 - DNA, 22 bp, Artificial Sequence
  chemically synthesized
aatggtatgagtatacctcatt

SEQ ID NO: 1224289 - DNA, 22 bp, Artificial Sequence
  chemically synthesized
cattaaatggtatgagtatacc

SEQ ID NO: 1224290 - DNA, 22 bp, Artificial Sequence
  chemically synthesized
ttacattaaatggtatgagtat

SEQ ID NO: 1224291 - DNA, 22 bp, Artificial Sequence
  chemically synthesized
attacattaaatggtatgagta

SEQ ID NO: 1224292 - DNA, 22 bp, Artificial Sequence
  chemically synthesized
aaaatgaggtatactcatacca

SEQ ID NO: 1224293 - DNA, 22 bp, Artificial Sequence
  chemically synthesized
tattacattaaatggtatgagt

SEQ ID NO: 1224294 - DNA, 22 bp, Artificial Sequence
  chemically synthesized
aaatgaggtatactcataccat

SEQ ID NO: 1224295 - DNA, 22 bp, Artificial Sequence
  chemically synthesized
ttattacattaaatggtatgag

SEQ ID NO: 1224296 - DNA, 22 bp, Artificial Sequence
  chemically synthesized
cttttattacattaaatggtat

SEQ ID NO: 1224297 - DNA, 22 bp, Artificial Sequence
  chemically synthesized
gcttttattacattaaatggta

SEQ ID NO: 1224298 - DNA, 22 bp, Artificial Sequence
  chemically synthesized
tgcttttattacattaaatggt

SEQ ID NO: 1224299 - DNA, 22 bp, Artificial Sequence
  chemically synthesized
ttgcttttattacattaaatgg

SEQ ID NO: 1224300 - DNA, 22 bp, Artificial Sequence
  chemically synthesized
taatttttgcttttattacatt

SEQ ID NO: 1224301 - DNA, 22 bp, Artificial Sequence
  chemically synthesized
ataccatttaatgtaataaaag

SEQ ID NO: 1224302 - DNA, 22 bp, Artificial Sequence
  chemically synthesized
tagttgtaatttttgcttttat

SEQ ID NO: 1224303 - DNA, 22 bp, Artificial Sequence
  chemically synthesized
atagttgtaatttttgctttta

SEQ ID NO: 1224304 - DNA, 22 bp, Artificial Sequence
  chemically synthesized
tatagttgtaatttttgctttt

SEQ ID NO: 1224305 - DNA, 22 bp, Artificial Sequence
  chemically synthesized
aatgtaataaaagcaaaaatta

SEQ ID NO: 1224306 - DNA, 22 bp, Artificial Sequence
  chemically synthesized
atgtaataaaagcaaaaattac

SEQ ID NO: 1224307 - DNA, 22 bp, Artificial Sequence
  chemically synthesized
taatcattttatagttgtaatt

SEQ ID NO: 1224308 - DNA, 22 bp, Artificial Sequence
  chemically synthesized
ataatcattttatagttgtaat

SEQ ID NO: 1224309 - DNA, 22 bp, Artificial Sequence
  chemically synthesized
cttataatcattttatagttgt

SEQ ID NO: 1224310 - DNA, 22 bp, Artificial Sequence
  chemically synthesized
ttacttataatcattttatagt

SEQ ID NO: 1224311 - DNA, 22 bp, Artificial Sequence
  chemically synthesized
attacttataatcattttatag

SEQ ID NO: 1224312 - DNA, 22 bp, Artificial Sequence
  chemically synthesized
tattacttataatcattttata

SEQ ID NO: 1224313 - DNA, 22 bp, Artificial Sequence
  chemically synthesized
attttattacttataatcattt

SEQ ID NO: 1224314 - DNA, 22 bp, Artificial Sequence
  chemically synthesized
ctaattttattacttataatca

SEQ ID NO: 1224315 - DNA, 22 bp, Artificial Sequence
  chemically synthesized
caactataaaatgattataagt

SEQ ID NO: 1224316 - DNA, 22 bp, Artificial Sequence
  chemically synthesized
cctaattttattacttataatc

SEQ ID NO: 1224317 - DNA, 22 bp, Artificial Sequence
  chemically synthesized
taaaatgattataagtaataaa

SEQ ID NO: 1224318 - DNA, 22 bp, Artificial Sequence
  chemically synthesized
atccccaggtatttcctaattt

SEQ ID NO: 1224319 - DNA, 22 bp, Artificial Sequence
  chemically synthesized
catccccaggtatttcctaatt

SEQ ID NO: 1224320 - DNA, 22 bp, Artificial Sequence
  chemically synthesized
taagtaataaaattaggaaata

SEQ ID NO: 1224321 - DNA, 22 bp, Artificial Sequence
  chemically synthesized
tgtttcatccccaggtatttcc

SEQ ID NO: 1224322 - DNA, 22 bp, Artificial Sequence
  chemically synthesized
ggaaatacctggggatgaaaca

SEQ ID NO: 1224323 - DNA, 22 bp, Artificial Sequence
  chemically synthesized
gggatgaaacataatatggctg

SEQ ID NO: 1224324 - DNA, 22 bp, Artificial Sequence
  chemically synthesized
catagtatgaaaaccagccata

SEQ ID NO: 1224325 - DNA, 22 bp, Artificial Sequence
  chemically synthesized
ctccatagtatgaaaaccagcc

SEQ ID NO: 1224326 - DNA, 22 bp, Artificial Sequence
  chemically synthesized
actccatagtatgaaaaccagc

SEQ ID NO: 1224327 - DNA, 22 bp, Artificial Sequence
  chemically synthesized
acagtataggtatttactccat

SEQ ID NO: 1224328 - DNA, 22 bp, Artificial Sequence
  chemically synthesized
gttttcatactatggagtaaat

SEQ ID NO: 1224329 - DNA, 22 bp, Artificial Sequence
  chemically synthesized
taacagtataggtatttactcc

SEQ ID NO: 1224330 - DNA, 22 bp, Artificial Sequence
  chemically synthesized
ctaacagtataggtatttactc

SEQ ID NO: 1224331 - DNA, 22 bp, Artificial Sequence
  chemically synthesized
tcatactatggagtaaatacct

SEQ ID NO: 1224332 - DNA, 22 bp, Artificial Sequence
  chemically synthesized
catactatggagtaaataccta

SEQ ID NO: 1224333 - DNA, 22 bp, Artificial Sequence
  chemically synthesized
atactatggagtaaatacctat

SEQ ID NO: 1224334 - DNA, 22 bp, Artificial Sequence
  chemically synthesized
atttctaacagtataggtattt

SEQ ID NO: 1224335 - DNA, 22 bp, Artificial Sequence
  chemically synthesized
tggagtaaatacctatactgtt

SEQ ID NO: 1224336 - DNA, 22 bp, Artificial Sequence
  chemically synthesized
acaaactaatttctaacagtat

SEQ ID NO: 1224337 - DNA, 22 bp, Artificial Sequence
  chemically synthesized
ttgacaaactaatttctaacag

SEQ ID NO: 1224338 - DNA, 22 bp, Artificial Sequence
  chemically synthesized
gttgacaaactaatttctaaca

SEQ ID NO: 1224339 - DNA, 22 bp, Artificial Sequence
  chemically synthesized
cttgttgacaaactaatttcta

SEQ ID NO: 1224340 - DNA, 22 bp, Artificial Sequence
  chemically synthesized
tacttgttgacaaactaatttc

SEQ ID NO: 1224341 - DNA, 22 bp, Artificial Sequence
  chemically synthesized
ctacttgttgacaaactaattt

SEQ ID NO: 1224342 - DNA, 22 bp, Artificial Sequence
  chemically synthesized
tactgttagaaattagtttgtc

SEQ ID NO: 1224343 - DNA, 22 bp, Artificial Sequence
  chemically synthesized
ttagaaattagtttgtcaacaa

SEQ ID NO: 1224344 - DNA, 22 bp, Artificial Sequence
  chemically synthesized
gaaattagtttgtcaacaagta

SEQ ID NO: 1224345 - DNA, 22 bp, Artificial Sequence
  chemically synthesized
gtttgtcaacaagtagaaacat

SEQ ID NO: 1224346 - DNA, 22 bp, Artificial Sequence
  chemically synthesized
gtcaacaagtagaaacattatc

SEQ ID NO: 1224347 - DNA, 22 bp, Artificial Sequence
  chemically synthesized
tcaacaagtagaaacattatca

SEQ ID NO: 1224348 - DNA, 22 bp, Artificial Sequence
  chemically synthesized
taataatatgtgtgataatgtt

SEQ ID NO: 1224349 - DNA, 22 bp, Artificial Sequence
  chemically synthesized
gttataataatatgtgtgataa

SEQ ID NO: 1224350 - DNA, 22 bp, Artificial Sequence
  chemically synthesized
ctggttataataatatgtgtga

SEQ ID NO: 1224351 - DNA, 22 bp, Artificial Sequence
  chemically synthesized
ctgctggttataataatatgtg

SEQ ID NO: 1224352 - DNA, 22 bp, Artificial Sequence
  chemically synthesized
gttcctgctggttataataata

SEQ ID NO: 1224353 - DNA, 22 bp, Artificial Sequence
  chemically synthesized
ggttcctgctggttataataat

SEQ ID NO: 1224354 - DNA, 22 bp, Artificial Sequence
  chemically synthesized
tggttcctgctggttataataa

SEQ ID NO: 1224355 - DNA, 22 bp, Artificial Sequence
  chemically synthesized
tcacacatattattataaccag

SEQ ID NO: 1224356 - DNA, 22 bp, Artificial Sequence
  chemically synthesized
tactttggttcctgctggttat

SEQ ID NO: 1224357 - DNA, 22 bp, Artificial Sequence
  chemically synthesized
gtactttggttcctgctggtta

SEQ ID NO: 1224358 - DNA, 22 bp, Artificial Sequence
  chemically synthesized
cttgtactttggttcctgctgg

SEQ ID NO: 1224359 - DNA, 22 bp, Artificial Sequence
  chemically synthesized
ttataaccagcaggaaccaaag

SEQ ID NO: 1224360 - DNA, 22 bp, Artificial Sequence
  chemically synthesized
tcagctacttgtactttggttc

SEQ ID NO: 1224361 - DNA, 22 bp, Artificial Sequence
  chemically synthesized
taaccagcaggaaccaaagtac

SEQ ID NO: 1224362 - DNA, 22 bp, Artificial Sequence
  chemically synthesized
gatgcagtcactgtcagctact

SEQ ID NO: 1224363 - DNA, 22 bp, Artificial Sequence
  chemically synthesized
agatgcagtcactgtcagctac

SEQ ID NO: 1224364 - DNA, 22 bp, Artificial Sequence
  chemically synthesized
ttagatgcagtcactgtcagct

SEQ ID NO: 1224365 - DNA, 22 bp, Artificial Sequence
  chemically synthesized
aattcttagatgcagtcactgt

SEQ ID NO: 1224366 - DNA, 22 bp, Artificial Sequence
  chemically synthesized
caattcttagatgcagtcactg

SEQ ID NO: 1224367 - DNA, 22 bp, Artificial Sequence
  chemically synthesized
tttcaattcttagatgcagtca

SEQ ID NO: 1224368 - DNA, 22 bp, Artificial Sequence
  chemically synthesized
atttcaattcttagatgcagtc

SEQ ID NO: 1224369 - DNA, 22 bp, Artificial Sequence
  chemically synthesized
ccttatttcaattcttagatgc

SEQ ID NO: 1224370 - DNA, 22 bp, Artificial Sequence
  chemically synthesized
accttatttcaattcttagatg

SEQ ID NO: 1224371 - DNA, 22 bp, Artificial Sequence
  chemically synthesized
acagtgactgcatctaagaatt

SEQ ID NO: 1224372 - DNA, 22 bp, Artificial Sequence
  chemically synthesized
acttaccttatttcaattctta

SEQ ID NO: 1224373 - DNA, 22 bp, Artificial Sequence
  chemically synthesized
aacttaccttatttcaattctt

SEQ ID NO: 1224374 - DNA, 22 bp, Artificial Sequence
  chemically synthesized
catctaagaattgaaataaggt

SEQ ID NO: 1224375 - DNA, 22 bp, Artificial Sequence
  chemically synthesized
agaattgaaataaggtaagtta

SEQ ID NO: 1224376 - DNA, 22 bp, Artificial Sequence
  chemically synthesized
atgaccccaatcttaacttacc

SEQ ID NO: 1224377 - DNA, 22 bp, Artificial Sequence
  chemically synthesized
catgaccccaatcttaacttac

SEQ ID NO: 1224378 - DNA, 22 bp, Artificial Sequence
  chemically synthesized
aaataaggtaagttaagattgg

SEQ ID NO: 1224379 - DNA, 22 bp, Artificial Sequence
  chemically synthesized
agattggggtcatgaagacaca

SEQ ID NO: 1224380 - DNA, 22 bp, Artificial Sequence
  chemically synthesized
gggtcatgaagacacattgtgt

SEQ ID NO: 1224381 - DNA, 22 bp, Artificial Sequence
  chemically synthesized
gaatcaggagcaaagggaaaac

SEQ ID NO: 1224382 - DNA, 22 bp, Artificial Sequence
  chemically synthesized
tgtttctgttttccctttgctc

SEQ ID NO: 1224383 - DNA, 22 bp, Artificial Sequence
  chemically synthesized
ctgttttccctttgctcctgat

SEQ ID NO: 1224384 - DNA, 22 bp, Artificial Sequence
  chemically synthesized
tgttttccctttgctcctgatt

SEQ ID NO: 1224385 - DNA, 22 bp, Artificial Sequence
  chemically synthesized
ttttccctttgctcctgattct

SEQ ID NO: 1224386 - DNA, 22 bp, Artificial Sequence
  chemically synthesized
tccctttgctcctgattctagt

SEQ ID NO: 1224387 - DNA, 22 bp, Artificial Sequence
  chemically synthesized
ccctttgctcctgattctagtg

SEQ ID NO: 1224388 - DNA, 22 bp, Artificial Sequence
  chemically synthesized
gaagcaaatgaacactagaatc

SEQ ID NO: 1224389 - DNA, 22 bp, Artificial Sequence
  chemically synthesized
cctttgctcctgattctagtgt

SEQ ID NO: 1224390 - DNA, 22 bp, Artificial Sequence
  chemically synthesized
tgctcctgattctagtgttcat

SEQ ID NO: 1224391 - DNA, 22 bp, Artificial Sequence
  chemically synthesized
gctcctgattctagtgttcatt

SEQ ID NO: 1224392 - DNA, 22 bp, Artificial Sequence
  chemically synthesized
ctcctgattctagtgttcattt

SEQ ID NO: 1224393 - DNA, 22 bp, Artificial Sequence
  chemically synthesized
ctgattctagtgttcatttgct

SEQ ID NO: 1224394 - DNA, 22 bp, Artificial Sequence
  chemically synthesized
attctagtgttcatttgcttct

SEQ ID NO: 1224395 - DNA, 22 bp, Artificial Sequence
  chemically synthesized
ccacagcaaattagaagcaaat

SEQ ID NO: 1224396 - DNA, 22 bp, Artificial Sequence
  chemically synthesized
tagtgttcatttgcttctaatt

SEQ ID NO: 1224397 - DNA, 22 bp, Artificial Sequence
  chemically synthesized
gtgttcatttgcttctaatttg

SEQ ID NO: 1224398 - DNA, 22 bp, Artificial Sequence
  chemically synthesized
gtgtattaccacagcaaattag

SEQ ID NO: 1224399 - DNA, 22 bp, Artificial Sequence
  chemically synthesized
agtgtattaccacagcaaatta

SEQ ID NO: 1224400 - DNA, 22 bp, Artificial Sequence
  chemically synthesized
tagtgtattaccacagcaaatt

SEQ ID NO: 1224401 - DNA, 22 bp, Artificial Sequence
  chemically synthesized
atttgcttctaatttgctgtgg

SEQ ID NO: 1224402 - DNA, 22 bp, Artificial Sequence
  chemically synthesized
ttttagtgtattaccacagcaa

SEQ ID NO: 1224403 - DNA, 22 bp, Artificial Sequence
  chemically synthesized
attttagtgtattaccacagca

SEQ ID NO: 1224404 - DNA, 22 bp, Artificial Sequence
  chemically synthesized
gcttctaatttgctgtggtaat

SEQ ID NO: 1224405 - DNA, 22 bp, Artificial Sequence
  chemically synthesized
cttctaatttgctgtggtaata

SEQ ID NO: 1224406 - DNA, 22 bp, Artificial Sequence
  chemically synthesized
ctaatttgctgtggtaatacac

SEQ ID NO: 1224407 - DNA, 22 bp, Artificial Sequence
  chemically synthesized
taatttgctgtggtaatacact

SEQ ID NO: 1224408 - DNA, 22 bp, Artificial Sequence
  chemically synthesized
aatccttattttagtgtattac

SEQ ID NO: 1224409 - DNA, 22 bp, Artificial Sequence
  chemically synthesized
atttgctgtggtaatacactaa

SEQ ID NO: 1224410 - DNA, 22 bp, Artificial Sequence
  chemically synthesized
ctaaatccttattttagtgtat

SEQ ID NO: 1224411 - DNA, 22 bp, Artificial Sequence
  chemically synthesized
cctaaatccttattttagtgta

SEQ ID NO: 1224412 - DNA, 22 bp, Artificial Sequence
  chemically synthesized
gctgtggtaatacactaaaata

SEQ ID NO: 1224413 - DNA, 22 bp, Artificial Sequence
  chemically synthesized
ctgtggtaatacactaaaataa

SEQ ID NO: 1224414 - DNA, 22 bp, Artificial Sequence
  chemically synthesized
tcttcctaaatccttattttag

SEQ ID NO: 1224415 - DNA, 22 bp, Artificial Sequence
  chemically synthesized
tggtaatacactaaaataagga

SEQ ID NO: 1224416 - DNA, 22 bp, Artificial Sequence
  chemically synthesized
caattgtcttcctaaatcctta

SEQ ID NO: 1224417 - DNA, 22 bp, Artificial Sequence
  chemically synthesized
taaagttacaattgtcttccta

SEQ ID NO: 1224418 - DNA, 22 bp, Artificial Sequence
  chemically synthesized
aaataaggatttaggaagacaa

SEQ ID NO: 1224419 - DNA, 22 bp, Artificial Sequence
  chemically synthesized
caataactataaagttacaatt

SEQ ID NO: 1224420 - DNA, 22 bp, Artificial Sequence
  chemically synthesized
aggaagacaattgtaactttat
